United States Patent 7,300,788 (METHOD FOR GENOTYPING POLYMORPHISMS IN HUMANS) - sequence listing, part 3

SEQ ID NO: 79957 - DNA, 25 bp, Homo sapien
ggtgcattactggaggtcccagcta

SEQ ID NO: 79958 - DNA, 25 bp, Homo sapien
ggtgcattacttgaggtcccagcta

SEQ ID NO: 79959 - DNA, 25 bp, Homo sapien
ggtgcatttatctgctgagtgaaac

SEQ ID NO: 79960 - DNA, 25 bp, Homo sapien
ggtgcatttgtctgctgagtgaaac

SEQ ID NO: 79961 - DNA, 25 bp, Homo sapien
ggtgccagatacatacaaagccaga

SEQ ID NO: 79962 - DNA, 25 bp, Homo sapien
ggtgccagatacgtacaaagccaga

SEQ ID NO: 79963 - DNA, 25 bp, Homo sapien
ggtgccgttcccatcgacagcagcc

SEQ ID NO: 79964 - DNA, 25 bp, Homo sapien
ggtgccgttcctatcgacagcagcc

SEQ ID NO: 79965 - DNA, 25 bp, Homo sapien
ggtgcctcaacagcccttgtttatt

SEQ ID NO: 79966 - DNA, 25 bp, Homo sapien
ggtgcctcaacagtccttgtttatt

SEQ ID NO: 79967 - DNA, 25 bp, Homo sapien
ggtgccttggtatcctcatctgtaa

SEQ ID NO: 79968 - DNA, 25 bp, Homo sapien
ggtgccttggtatgctcatctgtaa

SEQ ID NO: 79969 - DNA, 25 bp, Homo sapien
ggtgcgtgcagtacatttttttagc

SEQ ID NO: 79970 - DNA, 25 bp, Homo sapien
ggtgcgtggagtacatttttttagc

SEQ ID NO: 79971 - DNA, 25 bp, Homo sapien
ggtgctaggcgagatcaattatttt

SEQ ID NO: 79972 - DNA, 25 bp, Homo sapien
ggtgctaggtgagatcaattatttt

SEQ ID NO: 79973 - DNA, 25 bp, Homo sapien
ggtgctccactctagtatatgttta

SEQ ID NO: 79974 - DNA, 25 bp, Homo sapien
ggtgctccatcaatggtcactgtgg

SEQ ID NO: 79975 - DNA, 25 bp, Homo sapien
ggtgctccatcagtggtcactgtgg

SEQ ID NO: 79976 - DNA, 25 bp, Homo sapien
ggtgctccgctctagtatatgttta

SEQ ID NO: 79977 - DNA, 25 bp, Homo sapien
ggtgctcttaagcaaacgaagaaca

SEQ ID NO: 79978 - DNA, 25 bp, Homo sapien
ggtgctcttaaggaaacgaagaaca

SEQ ID NO: 79979 - DNA, 25 bp, Homo sapien
ggtgctgaccaagaacaggttaaac

SEQ ID NO: 79980 - DNA, 25 bp, Homo sapien
ggtgctgaccaaggacaggttaaac

SEQ ID NO: 79981 - DNA, 25 bp, Homo sapien
ggtgctgcatttgtctataaattta

SEQ ID NO: 79982 - DNA, 25 bp, Homo sapien
ggtgctgcatttgtttataaattta

SEQ ID NO: 79983 - DNA, 25 bp, Homo sapien
ggtgctggtatattctatcatttag

SEQ ID NO: 79984 - DNA, 25 bp, Homo sapien
ggtgctggtatattctgtcatttag

SEQ ID NO: 79985 - DNA, 25 bp, Homo sapien
ggtgctgtagtggcattacccttct

SEQ ID NO: 79986 - DNA, 25 bp, Homo sapien
ggtgctgtagtggcgttacccttct

SEQ ID NO: 79987 - DNA, 25 bp, Homo sapien
ggtgctgtatgatcctgggcaagtg

SEQ ID NO: 79988 - DNA, 25 bp, Homo sapien
ggtgctgtgtgatcctgggcaagtg

SEQ ID NO: 79989 - DNA, 25 bp, Homo sapien
ggtgcttaatccgtttgggctacta

SEQ ID NO: 79990 - DNA, 25 bp, Homo sapien
ggtgcttaatctgtttgggctacta

SEQ ID NO: 79991 - DNA, 25 bp, Homo sapien
ggtgcttacaaacaattttgattat

SEQ ID NO: 79992 - DNA, 25 bp, Homo sapien
ggtgcttacaaataattttgattat

SEQ ID NO: 79993 - DNA, 25 bp, Homo sapien
ggtgcttatatacaagtaggcatgt

SEQ ID NO: 79994 - DNA, 25 bp, Homo sapien
ggtgcttatatacatgtaggcatgt

SEQ ID NO: 79995 - DNA, 25 bp, Homo sapien
ggtgcttatgcatggagagagatgg

SEQ ID NO: 79996 - DNA, 25 bp, Homo sapien
ggtgcttatgcttggagagagatgg

SEQ ID NO: 79997 - DNA, 25 bp, Homo sapien
ggtgcttcaccaagtgagtagatct

SEQ ID NO: 79998 - DNA, 25 bp, Homo sapien
ggtgcttcatacagctctagttaaa

SEQ ID NO: 79999 - DNA, 25 bp, Homo sapien
ggtgcttcatatagctctagttaaa

SEQ ID NO: 80000 - DNA, 25 bp, Homo sapien
ggtgcttcgccaagtgagtagatct

SEQ ID NO: 80001 - DNA, 25 bp, Homo sapien
ggtgcttgctgcagaaagttataag

SEQ ID NO: 80002 - DNA, 25 bp, Homo sapien
ggtgcttgctgcggaaagttataag

SEQ ID NO: 80003 - DNA, 25 bp, Homo sapien
ggtgctttaaagtgaggcttctcta

SEQ ID NO: 80004 - DNA, 25 bp, Homo sapien
ggtgctttaggcattccctggttga

SEQ ID NO: 80005 - DNA, 25 bp, Homo sapien
ggtgctttaggccttccctggttga

SEQ ID NO: 80006 - DNA, 25 bp, Homo sapien
ggtgctttcaagtgaggcttctcta

SEQ ID NO: 80007 - DNA, 25 bp, Homo sapien
ggtgcttttctccgcaggcctcatt

SEQ ID NO: 80008 - DNA, 25 bp, Homo sapien
ggtgcttttctctgcaggcctcatt

SEQ ID NO: 80009 - DNA, 25 bp, Homo sapien
ggtggaaacgttcttagggctggct

SEQ ID NO: 80010 - DNA, 25 bp, Homo sapien
ggtggaaatgttcttagggctggct

SEQ ID NO: 80011 - DNA, 25 bp, Homo sapien
ggtggaagaactgtagaggcagcaa

SEQ ID NO: 80012 - DNA, 25 bp, Homo sapien
ggtggaagaactgtagcggcagcaa

SEQ ID NO: 80013 - DNA, 25 bp, Homo sapien
ggtggaagacattgagacgccttta

SEQ ID NO: 80014 - DNA, 25 bp, Homo sapien
ggtggaaggcattgagacgccttta

SEQ ID NO: 80015 - DNA, 25 bp, Homo sapien
ggtggaattttcatactggcatgga

SEQ ID NO: 80016 - DNA, 25 bp, Homo sapien
ggtggaattttcatcctggcatgga

SEQ ID NO: 80017 - DNA, 25 bp, Homo sapien
ggtggacattaacggaatcacacac

SEQ ID NO: 80018 - DNA, 25 bp, Homo sapien
ggtggacattaatggaatcacacac

SEQ ID NO: 80019 - DNA, 25 bp, Homo sapien
ggtggaccaacgaagagggtgacct

SEQ ID NO: 80020 - DNA, 25 bp, Homo sapien
ggtggaccagcgaagagggtgacct

SEQ ID NO: 80021 - DNA, 25 bp, Homo sapien
ggtggaccccgtgtcataaatgaga

SEQ ID NO: 80022 - DNA, 25 bp, Homo sapien
ggtggaccctgtgtcataaatgaga

SEQ ID NO: 80023 - DNA, 25 bp, Homo sapien
ggtggagacaaatacaggaacccag

SEQ ID NO: 80024 - DNA, 25 bp, Homo sapien
ggtggagacaaatataggaacccag

SEQ ID NO: 80025 - DNA, 25 bp, Homo sapien
ggtggagacatatgtgtcaagagag

SEQ ID NO: 80026 - DNA, 25 bp, Homo sapien
ggtggagaccgcataatcaaggaac

SEQ ID NO: 80027 - DNA, 25 bp, Homo sapien
ggtggagaccgcgtaatcaaggaac

SEQ ID NO: 80028 - DNA, 25 bp, Homo sapien
ggtggagacgtatgtgtcaagagag

SEQ ID NO: 80029 - DNA, 25 bp, Homo sapien
ggtggagcccatccatcagtacttt

SEQ ID NO: 80030 - DNA, 25 bp, Homo sapien
ggtggagcccatctatcagtacttt

SEQ ID NO: 80031 - DNA, 25 bp, Homo sapien
ggtggagctcaccgaatgttggatt

SEQ ID NO: 80032 - DNA, 25 bp, Homo sapien
ggtggagctcagcgaatgttggatt

SEQ ID NO: 80033 - DNA, 25 bp, Homo sapien
ggtggagtgacttggacaaggtggt

SEQ ID NO: 80034 - DNA, 25 bp, Homo sapien
ggtggagtgacttggataaggtggt

SEQ ID NO: 80035 - DNA, 25 bp, Homo sapien
ggtggatgcgaacatgaaaagcaaa

SEQ ID NO: 80036 - DNA, 25 bp, Homo sapien
ggtggatgtgaacatgaaaagcaaa

SEQ ID NO: 80037 - DNA, 25 bp, Homo sapien
ggtggattagctaaatctgccaacc

SEQ ID NO: 80038 - DNA, 25 bp, Homo sapien
ggtggattccactgttccttccact

SEQ ID NO: 80039 - DNA, 25 bp, Homo sapien
ggtggattgtctgtcactgaacaca

SEQ ID NO: 80040 - DNA, 25 bp, Homo sapien
ggtggattgtttacctgtctgtttt

SEQ ID NO: 80041 - DNA, 25 bp, Homo sapien
ggtggattgtttccctgtctgtttt

SEQ ID NO: 80042 - DNA, 25 bp, Homo sapien
ggtggatttcactgttccttccact

SEQ ID NO: 80043 - DNA, 25 bp, Homo sapien
ggtggatttgctaaatctgccaacc

SEQ ID NO: 80044 - DNA, 25 bp, Homo sapien
ggtggattttctgtcactgaacaca

SEQ ID NO: 80045 - DNA, 25 bp, Homo sapien
ggtggcaactctggctcccctgaga

SEQ ID NO: 80046 - DNA, 25 bp, Homo sapien
ggtggcaattctggctcccctgaga

SEQ ID NO: 80047 - DNA, 25 bp, Homo sapien
ggtggcagagggaaaaatggctgct

SEQ ID NO: 80048 - DNA, 25 bp, Homo sapien
ggtggcagagggagaaatggctgct

SEQ ID NO: 80049 - DNA, 25 bp, Homo sapien
ggtggcaggagaaaagcaagaagac

SEQ ID NO: 80050 - DNA, 25 bp, Homo sapien
ggtggcaggagaacagcaagaagac

SEQ ID NO: 80051 - DNA, 25 bp, Homo sapien
ggtggcatctggtaagggtcatccc

SEQ ID NO: 80052 - DNA, 25 bp, Homo sapien
ggtggcatctggtgagggtcatccc

SEQ ID NO: 80053 - DNA, 25 bp, Homo sapien
ggtggcatgtccaaagactcagaaa

SEQ ID NO: 80054 - DNA, 25 bp, Homo sapien
ggtggcatgtcgaaagactcagaaa

SEQ ID NO: 80055 - DNA, 25 bp, Homo sapien
ggtggccactctaggactgcaaggt

SEQ ID NO: 80056 - DNA, 25 bp, Homo sapien
ggtggccactctatgactgcaaggt

SEQ ID NO: 80057 - DNA, 25 bp, Homo sapien
ggtggcccaaaaggcgtcatcagct

SEQ ID NO: 80058 - DNA, 25 bp, Homo sapien
ggtggcccaaaatgcgtcatcagct

SEQ ID NO: 80059 - DNA, 25 bp, Homo sapien
ggtggcccaaggaccaatcagtgtg

SEQ ID NO: 80060 - DNA, 25 bp, Homo sapien
ggtggcccaaggaccagtcagtgtg

SEQ ID NO: 80061 - DNA, 25 bp, Homo sapien
ggtggctatgtagacccggttcgca

SEQ ID NO: 80062 - DNA, 25 bp, Homo sapien
ggtggctatgtagagccggttcgca

SEQ ID NO: 80063 - DNA, 25 bp, Homo sapien
ggtggctgatgaaaaattatcttga

SEQ ID NO: 80064 - DNA, 25 bp, Homo sapien
ggtggctgatgaaacattatcttga

SEQ ID NO: 80065 - DNA, 25 bp, Homo sapien
ggtggctgtctaatgtttaggactg

SEQ ID NO: 80066 - DNA, 25 bp, Homo sapien
ggtggctgtctgatgtttaggactg

SEQ ID NO: 80067 - DNA, 25 bp, Homo sapien
ggtgggaagaggagagacccagctg

SEQ ID NO: 80068 - DNA, 25 bp, Homo sapien
ggtgggaagaggagaggcccagctg

SEQ ID NO: 80069 - DNA, 25 bp, Homo sapien
ggtgggagggtatcttgcatttgtc

SEQ ID NO: 80070 - DNA, 25 bp, Homo sapien
ggtgggagggtattttgcatttgtc

SEQ ID NO: 80071 - DNA, 25 bp, Homo sapien
ggtgggcgtctgccacacacttgca

SEQ ID NO: 80072 - DNA, 25 bp, Homo sapien
ggtgggcgtctgcctcacacttgca

SEQ ID NO: 80073 - DNA, 25 bp, Homo sapien
ggtggtacaatataacaagaaccac

SEQ ID NO: 80074 - DNA, 25 bp, Homo sapien
ggtggtacaatgtaacaagaaccac

SEQ ID NO: 80075 - DNA, 25 bp, Homo sapien
ggtggtacgctgaggacattgagtg

SEQ ID NO: 80076 - DNA, 25 bp, Homo sapien
ggtggtacgctgaggatattgagtg

SEQ ID NO: 80077 - DNA, 25 bp, Homo sapien
ggtggtatggccgtagactagagct

SEQ ID NO: 80078 - DNA, 25 bp, Homo sapien
ggtggtatggctgtagactagagct

SEQ ID NO: 80079 - DNA, 25 bp, Homo sapien
ggtggtctttaaagcgatttcctgc

SEQ ID NO: 80080 - DNA, 25 bp, Homo sapien
ggtggtctttaaagtgatttcctgc

SEQ ID NO: 80081 - DNA, 25 bp, Homo sapien
ggtggtgacaagataaaataaggaa

SEQ ID NO: 80082 - DNA, 25 bp, Homo sapien
ggtggtgacaaggtaaaataaggaa

SEQ ID NO: 80083 - DNA, 25 bp, Homo sapien
ggtggtgcattactggaggtcccag

SEQ ID NO: 80084 - DNA, 25 bp, Homo sapien
ggtggtgcattacttgaggtcccag

SEQ ID NO: 80085 - DNA, 25 bp, Homo sapien
ggtggtgccattagtcaggatgaca

SEQ ID NO: 80086 - DNA, 25 bp, Homo sapien
ggtggtgccggactccagttcttgt

SEQ ID NO: 80087 - DNA, 25 bp, Homo sapien
ggtggtgccgttagtcaggatgaca

SEQ ID NO: 80088 - DNA, 25 bp, Homo sapien
ggtggtgcgtgcagtacattttttt

SEQ ID NO: 80089 - DNA, 25 bp, Homo sapien
ggtggtgcgtggagtacattttttt

SEQ ID NO: 80090 - DNA, 25 bp, Homo sapien
ggtggtgctggactccagttcttgt

SEQ ID NO: 80091 - DNA, 25 bp, Homo sapien
ggtggtggaacccgttctcactcca

SEQ ID NO: 80092 - DNA, 25 bp, Homo sapien
ggtggtggaacctgttctcactcca

SEQ ID NO: 80093 - DNA, 25 bp, Homo sapien
ggtggtggcaacacagacttgtttg

SEQ ID NO: 80094 - DNA, 25 bp, Homo sapien
ggtggtggctacacagacttgtttg

SEQ ID NO: 80095 - DNA, 25 bp, Homo sapien
ggtggtgtgcgtccaagatggtgat

SEQ ID NO: 80096 - DNA, 25 bp, Homo sapien
ggtggtgtgtgtccaagatggtgat

SEQ ID NO: 80097 - DNA, 25 bp, Homo sapien
ggtggtgttttaaacttctaaattt

SEQ ID NO: 80098 - DNA, 25 bp, Homo sapien
ggtggtgttttaaccttctaaattt

SEQ ID NO: 80099 - DNA, 25 bp, Homo sapien
ggtggttctgaacactggagttgaa

SEQ ID NO: 80100 - DNA, 25 bp, Homo sapien
ggtggttctgaatactggagttgaa

SEQ ID NO: 80101 - DNA, 25 bp, Homo sapien
ggtgtaaaaagaaaaaagcatcatc

SEQ ID NO: 80102 - DNA, 25 bp, Homo sapien
ggtgtaaaaagataaaagcatcatc

SEQ ID NO: 80103 - DNA, 25 bp, Homo sapien
ggtgtaaacagtacctgacaaaata

SEQ ID NO: 80104 - DNA, 25 bp, Homo sapien
ggtgtaaatagtacctgacaaaata

SEQ ID NO: 80105 - DNA, 25 bp, Homo sapien
ggtgtaacaagcattgccatatgct

SEQ ID NO: 80106 - DNA, 25 bp, Homo sapien
ggtgtaaccagcattgccatatgct

SEQ ID NO: 80107 - DNA, 25 bp, Homo sapien
ggtgtaagcagaaaagaggatctac

SEQ ID NO: 80108 - DNA, 25 bp, Homo sapien
ggtgtaagcagaaatgaggatctac

SEQ ID NO: 80109 - DNA, 25 bp, Homo sapien
ggtgtacaaaacaatagaaaagtgg

SEQ ID NO: 80110 - DNA, 25 bp, Homo sapien
ggtgtacaaaagaatagaaaagtgg

SEQ ID NO: 80111 - DNA, 25 bp, Homo sapien
ggtgtacacacaggatagacagtta

SEQ ID NO: 80112 - DNA, 25 bp, Homo sapien
ggtgtacacacaggatggacagtta

SEQ ID NO: 80113 - DNA, 25 bp, Homo sapien
ggtgtactcacaatcacttaattgc

SEQ ID NO: 80114 - DNA, 25 bp, Homo sapien
ggtgtactcacattcacttaattgc

SEQ ID NO: 80115 - DNA, 25 bp, Homo sapien
ggtgtactgttaacgagcagtaatc

SEQ ID NO: 80116 - DNA, 25 bp, Homo sapien
ggtgtactgttaatgagcagtaatc

SEQ ID NO: 80117 - DNA, 25 bp, Homo sapien
ggtgtagaaaactttttacttactg

SEQ ID NO: 80118 - DNA, 25 bp, Homo sapien
ggtgtagataactttttacttactg

SEQ ID NO: 80119 - DNA, 25 bp, Homo sapien
ggtgtagtgattcaagcacacatgt

SEQ ID NO: 80120 - DNA, 25 bp, Homo sapien
ggtgtagtgattcaaggacacatgt

SEQ ID NO: 80121 - DNA, 25 bp, Homo sapien
ggtgtatcgattcctattgacttta

SEQ ID NO: 80122 - DNA, 25 bp, Homo sapien
ggtgtatcgattcttattgacttta

SEQ ID NO: 80123 - DNA, 25 bp, Homo sapien
ggtgtattagacaaacgagacttag

SEQ ID NO: 80124 - DNA, 25 bp, Homo sapien
ggtgtattagaccaacgagacttag

SEQ ID NO: 80125 - DNA, 25 bp, Homo sapien
ggtgtcacctgctctcaagtattat

SEQ ID NO: 80126 - DNA, 25 bp, Homo sapien
ggtgtcacttgctctcaagtattat

SEQ ID NO: 80127 - DNA, 25 bp, Homo sapien
ggtgtcagacatacattgcagcatg

SEQ ID NO: 80128 - DNA, 25 bp, Homo sapien
ggtgtcagacatgcattgcagcatg

SEQ ID NO: 80129 - DNA, 25 bp, Homo sapien
ggtgtcattgacatggcaagacttc

SEQ ID NO: 80130 - DNA, 25 bp, Homo sapien
ggtgtcattgacttggcaagacttc

SEQ ID NO: 80131 - DNA, 25 bp, Homo sapien
ggtgtcattgtacgatttatacctg

SEQ ID NO: 80132 - DNA, 25 bp, Homo sapien
ggtgtcattgtatgatttatacctg

SEQ ID NO: 80133 - DNA, 25 bp, Homo sapien
ggtgtcctccttccctgtcctgctt

SEQ ID NO: 80134 - DNA, 25 bp, Homo sapien
ggtgtcctctttccctgtcctgctt

SEQ ID NO: 80135 - DNA, 25 bp, Homo sapien
ggtgtcgtcctcagcacccaggcca

SEQ ID NO: 80136 - DNA, 25 bp, Homo sapien
ggtgtcgtcttcagcacccaggcca

SEQ ID NO: 80137 - DNA, 25 bp, Homo sapien
ggtgtctaggttaaacaactcaagt

SEQ ID NO: 80138 - DNA, 25 bp, Homo sapien
ggtgtctaggttaagcaactcaagt

SEQ ID NO: 80139 - DNA, 25 bp, Homo sapien
ggtgtgaacagtatgaataaaagga

SEQ ID NO: 80140 - DNA, 25 bp, Homo sapien
ggtgtgaacagtctgaataaaagga

SEQ ID NO: 80141 - DNA, 25 bp, Homo sapien
ggtgtgaccattttcctgggccagg

SEQ ID NO: 80142 - DNA, 25 bp, Homo sapien
ggtgtgaccatttttctgggccagg

SEQ ID NO: 80143 - DNA, 25 bp, Homo sapien
ggtgtgctctactcccaggagtcct

SEQ ID NO: 80144 - DNA, 25 bp, Homo sapien
ggtgtgctctactcgcaggagtcct

SEQ ID NO: 80145 - DNA, 25 bp, Homo sapien
ggtgtggagagaatttttatgggca

SEQ ID NO: 80146 - DNA, 25 bp, Homo sapien
ggtgtggagagactttttatgggca

SEQ ID NO: 80147 - DNA, 25 bp, Homo sapien
ggtgtggcccaaagtcccaatctag

SEQ ID NO: 80148 - DNA, 25 bp, Homo sapien
ggtgtggcccagagtcccaatctag

SEQ ID NO: 80149 - DNA, 25 bp, Homo sapien
ggtgtggctgaccatccaaaggaaa

SEQ ID NO: 80150 - DNA, 25 bp, Homo sapien
ggtgtggctgagcatccaaaggaaa

SEQ ID NO: 80151 - DNA, 25 bp, Homo sapien
ggtgtgggcgatctctacaagtaga

SEQ ID NO: 80152 - DNA, 25 bp, Homo sapien
ggtgtgggcgatctgtacaagtaga

SEQ ID NO: 80153 - DNA, 25 bp, Homo sapien
ggtgtgtctgtcacgaacccagtca

SEQ ID NO: 80154 - DNA, 25 bp, Homo sapien
ggtgtgtctgtcatgaacccagtca

SEQ ID NO: 80155 - DNA, 25 bp, Homo sapien
ggtgtgtgagtctgagaaagtcagt

SEQ ID NO: 80156 - DNA, 25 bp, Homo sapien
ggtgtgtgagtctgggaaagtcagt

SEQ ID NO: 80157 - DNA, 25 bp, Homo sapien
ggtgtgtgccctacgcaaatgaaaa

SEQ ID NO: 80158 - DNA, 25 bp, Homo sapien
ggtgtgtgccctatgcaaatgaaaa

SEQ ID NO: 80159 - DNA, 25 bp, Homo sapien
ggtgtgttaaaacgctgcaatgaag

SEQ ID NO: 80160 - DNA, 25 bp, Homo sapien
ggtgtgttaaaatgctgcaatgaag

SEQ ID NO: 80161 - DNA, 25 bp, Homo sapien
ggtgttcatctgaattatcccctac

SEQ ID NO: 80162 - DNA, 25 bp, Homo sapien
ggtgttcatctggattatcccctac

SEQ ID NO: 80163 - DNA, 25 bp, Homo sapien
ggtgttctataaatattcattccct

SEQ ID NO: 80164 - DNA, 25 bp, Homo sapien
ggtgttctctctctactgcactttg

SEQ ID NO: 80165 - DNA, 25 bp, Homo sapien
ggtgttctgtaaatattcattccct

SEQ ID NO: 80166 - DNA, 25 bp, Homo sapien
ggtgttctgtctctactgcactttg

SEQ ID NO: 80167 - DNA, 25 bp, Homo sapien
ggtgttgataggcaaataaataact

SEQ ID NO: 80168 - DNA, 25 bp, Homo sapien
ggtgttgataggtaaataaataact

SEQ ID NO: 80169 - DNA, 25 bp, Homo sapien
ggtgttggacttacataagagaaat

SEQ ID NO: 80170 - DNA, 25 bp, Homo sapien
ggtgttggatttacataagagaaat

SEQ ID NO: 80171 - DNA, 25 bp, Homo sapien
ggtgttggcctgtagattgggtgtg

SEQ ID NO: 80172 - DNA, 25 bp, Homo sapien
ggtgttggcctgtatattgggtgtg

SEQ ID NO: 80173 - DNA, 25 bp, Homo sapien
ggtgttgtacaaatggtagttctta

SEQ ID NO: 80174 - DNA, 25 bp, Homo sapien
ggtgttgtacacatggtagttctta

SEQ ID NO: 80175 - DNA, 25 bp, Homo sapien
ggtgttgttattgaggcctgtataa

SEQ ID NO: 80176 - DNA, 25 bp, Homo sapien
ggtgttgttattgaggtctgtataa

SEQ ID NO: 80177 - DNA, 25 bp, Homo sapien
ggtgtttattgtccatctcctctgc

SEQ ID NO: 80178 - DNA, 25 bp, Homo sapien
ggtgtttattgtccgtctcctctgc

SEQ ID NO: 80179 - DNA, 25 bp, Homo sapien
ggtgtttccatatatccaaactcat

SEQ ID NO: 80180 - DNA, 25 bp, Homo sapien
ggtgtttccatgtatccaaactcat

SEQ ID NO: 80181 - DNA, 25 bp, Homo sapien
ggtgtttctactctttagcatacag

SEQ ID NO: 80182 - DNA, 25 bp, Homo sapien
ggtgtttctactttttagcatacag

SEQ ID NO: 80183 - DNA, 25 bp, Homo sapien
ggtgtttgtggagatggatggatcc

SEQ ID NO: 80184 - DNA, 25 bp, Homo sapien
ggtgtttgtggcgatggatggatcc

SEQ ID NO: 80185 - DNA, 25 bp, Homo sapien
ggtgtttttacttacttattgaact

SEQ ID NO: 80186 - DNA, 25 bp, Homo sapien
ggtgtttttacttatttattgaact

SEQ ID NO: 80187 - DNA, 25 bp, Homo sapien
ggtgtttttgcatagcttgtcccat

SEQ ID NO: 80188 - DNA, 25 bp, Homo sapien
ggtgtttttgcgtagcttgtcccat

SEQ ID NO: 80189 - DNA, 25 bp, Homo sapien
ggtgtttttgggttagttttgcact

SEQ ID NO: 80190 - DNA, 25 bp, Homo sapien
ggtgttttttggttagttttgcact

SEQ ID NO: 80191 - DNA, 25 bp, Homo sapien
ggttaaagaaaaactgtggcaaggg

SEQ ID NO: 80192 - DNA, 25 bp, Homo sapien
ggttaaagcaaaactgtggcaaggg

SEQ ID NO: 80193 - DNA, 25 bp, Homo sapien
ggttaaatgaaaccttctagctgtt

SEQ ID NO: 80194 - DNA, 25 bp, Homo sapien
ggttaaatgaaatcttctagctgtt

SEQ ID NO: 80195 - DNA, 25 bp, Homo sapien
ggttaaatggtgactaatcgtaata

SEQ ID NO: 80196 - DNA, 25 bp, Homo sapien
ggttaaattgtgactaatcgtaata

SEQ ID NO: 80197 - DNA, 25 bp, Homo sapien
ggttaaggaaagaagctggttaata

SEQ ID NO: 80198 - DNA, 25 bp, Homo sapien
ggttaaggaaataagctggttaata

SEQ ID NO: 80199 - DNA, 25 bp, Homo sapien
ggttaaggttttatcatattgtaca

SEQ ID NO: 80200 - DNA, 25 bp, Homo sapien
ggttaaggttttgtcatattgtaca

SEQ ID NO: 80201 - DNA, 25 bp, Homo sapien
ggttaagtagcattcccagagtgac

SEQ ID NO: 80202 - DNA, 25 bp, Homo sapien
ggttaagtagcatttccagagtgac

SEQ ID NO: 80203 - DNA, 25 bp, Homo sapien
ggttaataaagcccaattgagagag

SEQ ID NO: 80204 - DNA, 25 bp, Homo sapien
ggttaataaagcccgattgagagag

SEQ ID NO: 80205 - DNA, 25 bp, Homo sapien
ggttaatcacgaagcagtggccagc

SEQ ID NO: 80206 - DNA, 25 bp, Homo sapien
ggttaatcatgaagcagtggccagc

SEQ ID NO: 80207 - DNA, 25 bp, Homo sapien
ggttaatgcaacacagactgctcaa

SEQ ID NO: 80208 - DNA, 25 bp, Homo sapien
ggttaatgcaatacagactgctcaa

SEQ ID NO: 80209 - DNA, 25 bp, Homo sapien
ggttaatggctacaaaacattttaa

SEQ ID NO: 80210 - DNA, 25 bp, Homo sapien
ggttaatggctacgaaacattttaa

SEQ ID NO: 80211 - DNA, 25 bp, Homo sapien
ggttaatttactccagttcctccaa

SEQ ID NO: 80212 - DNA, 25 bp, Homo sapien
ggttaatttactccggttcctccaa

SEQ ID NO: 80213 - DNA, 25 bp, Homo sapien
ggttacaatttgtcatcttgataag

SEQ ID NO: 80214 - DNA, 25 bp, Homo sapien
ggttacaatttgttatcttgataag

SEQ ID NO: 80215 - DNA, 25 bp, Homo sapien
ggttacagataccaggtaccaggca

SEQ ID NO: 80216 - DNA, 25 bp, Homo sapien
ggttacagatatcaggtaccaggca

SEQ ID NO: 80217 - DNA, 25 bp, Homo sapien
ggttacagattcaaagggtatgttg

SEQ ID NO: 80218 - DNA, 25 bp, Homo sapien
ggttacagattcaaggggtatgttg

SEQ ID NO: 80219 - DNA, 25 bp, Homo sapien
ggttacagcatgtatgctttcaaat

SEQ ID NO: 80220 - DNA, 25 bp, Homo sapien
ggttacagcatttatgctttcaaat

SEQ ID NO: 80221 - DNA, 25 bp, Homo sapien
ggttacagtattatagctggtacat

SEQ ID NO: 80222 - DNA, 25 bp, Homo sapien
ggttacagtattatagttggtacat

SEQ ID NO: 80223 - DNA, 25 bp, Homo sapien
ggttacatgaactgacttttgttga

SEQ ID NO: 80224 - DNA, 25 bp, Homo sapien
ggttacattaactgacttttgttga

SEQ ID NO: 80225 - DNA, 25 bp, Homo sapien
ggttacattgaccaagttagaaagc

SEQ ID NO: 80226 - DNA, 25 bp, Homo sapien
ggttacattgacccagttagaaagc

SEQ ID NO: 80227 - DNA, 25 bp, Homo sapien
ggttaccaacaagagcaaaagagaa

SEQ ID NO: 80228 - DNA, 25 bp, Homo sapien
ggttaccaacaggagcaaaagagaa

SEQ ID NO: 80229 - DNA, 25 bp, Homo sapien
ggttaccaagctaaagtttttgttc

SEQ ID NO: 80230 - DNA, 25 bp, Homo sapien
ggttaccaagctacagtttttgttc

SEQ ID NO: 80231 - DNA, 25 bp, Homo sapien
ggttacctaacaacataccattgcc

SEQ ID NO: 80232 - DNA, 25 bp, Homo sapien
ggttacctaacatcataccattgcc

SEQ ID NO: 80233 - DNA, 25 bp, Homo sapien
ggttactaagaggattgagttaata

SEQ ID NO: 80234 - DNA, 25 bp, Homo sapien
ggttactatgaggattgagttaata

SEQ ID NO: 80235 - DNA, 25 bp, Homo sapien
ggttactccaactcaccttgtccac

SEQ ID NO: 80236 - DNA, 25 bp, Homo sapien
ggttactccaactcgccttgtccac

SEQ ID NO: 80237 - DNA, 25 bp, Homo sapien
ggttactgagactatgtgagctttt

SEQ ID NO: 80238 - DNA, 25 bp, Homo sapien
ggttactgggactatgtgagctttt

SEQ ID NO: 80239 - DNA, 25 bp, Homo sapien
ggttacttcatggtctcaaatagct

SEQ ID NO: 80240 - DNA, 25 bp, Homo sapien
ggttacttcattgtctcaaatagct

SEQ ID NO: 80241 - DNA, 25 bp, Homo sapien
ggttagaaagggaataaactggaaa

SEQ ID NO: 80242 - DNA, 25 bp, Homo sapien
ggttagaaatggaataaactggaaa

SEQ ID NO: 80243 - DNA, 25 bp, Homo sapien
ggttagagcacagcatgaaggaagc

SEQ ID NO: 80244 - DNA, 25 bp, Homo sapien
ggttagagcacaggatgaaggaagc

SEQ ID NO: 80245 - DNA, 25 bp, Homo sapien
ggttaggatttcaatgtatgaattt

SEQ ID NO: 80246 - DNA, 25 bp, Homo sapien
ggttaggatttcagtgtatgaattt

SEQ ID NO: 80247 - DNA, 25 bp, Homo sapien
ggttaggccaagttgagagtccttg

SEQ ID NO: 80248 - DNA, 25 bp, Homo sapien
ggttaggccgagttgagagtccttg

SEQ ID NO: 80249 - DNA, 25 bp, Homo sapien
ggttagtgcatgagtaacaattcgg

SEQ ID NO: 80250 - DNA, 25 bp, Homo sapien
ggttagtgtatgagtaacaattcgg

SEQ ID NO: 80251 - DNA, 25 bp, Homo sapien
ggttagtgtatttcgcagtgtcaca

SEQ ID NO: 80252 - DNA, 25 bp, Homo sapien
ggttagtgtattttgcagtgtcaca

SEQ ID NO: 80253 - DNA, 25 bp, Homo sapien
ggttagttgcttagattgggtcgtg

SEQ ID NO: 80254 - DNA, 25 bp, Homo sapien
ggttagttgcttaggttgggtcgtg

SEQ ID NO: 80255 - DNA, 25 bp, Homo sapien
ggttatacaatggaaaacaacaacc

SEQ ID NO: 80256 - DNA, 25 bp, Homo sapien
ggttatacagtggaaaacaacaacc

SEQ ID NO: 80257 - DNA, 25 bp, Homo sapien
ggttatatagcagggctcacttgca

SEQ ID NO: 80258 - DNA, 25 bp, Homo sapien
ggttatattgcagggctcacttgca

SEQ ID NO: 80259 - DNA, 25 bp, Homo sapien
ggttatggagaactcagtcatgaga

SEQ ID NO: 80260 - DNA, 25 bp, Homo sapien
ggttatggagaattcagtcatgaga

SEQ ID NO: 80261 - DNA, 25 bp, Homo sapien
ggttatggcatatgtaaaacaggaa

SEQ ID NO: 80262 - DNA, 25 bp, Homo sapien
ggttatggcatatgtacaacaggaa

SEQ ID NO: 80263 - DNA, 25 bp, Homo sapien
ggttatggctagctgctgaaaccag

SEQ ID NO: 80264 - DNA, 25 bp, Homo sapien
ggttatggctagcttctgaaaccag

SEQ ID NO: 80265 - DNA, 25 bp, Homo sapien
ggttatggcttcccttacataagaa

SEQ ID NO: 80266 - DNA, 25 bp, Homo sapien
ggttatggctttccttacataagaa

SEQ ID NO: 80267 - DNA, 25 bp, Homo sapien
ggttatggcttttgacaacatcagc

SEQ ID NO: 80268 - DNA, 25 bp, Homo sapien
ggttatggcttttggcaacatcagc

SEQ ID NO: 80269 - DNA, 25 bp, Homo sapien
ggttatggtaagtcttgagagaaat

SEQ ID NO: 80270 - DNA, 25 bp, Homo sapien
ggttatggtaagttttgagagaaat

SEQ ID NO: 80271 - DNA, 25 bp, Homo sapien
ggttatgtcagtttatttggaagca

SEQ ID NO: 80272 - DNA, 25 bp, Homo sapien
ggttatgtgagtttatttggaagca

SEQ ID NO: 80273 - DNA, 25 bp, Homo sapien
ggttatgttttctttgaccttactt

SEQ ID NO: 80274 - DNA, 25 bp, Homo sapien
ggttatgttttctttgcccttactt

SEQ ID NO: 80275 - DNA, 25 bp, Homo sapien
ggttatttcccatggagcaaaattg

SEQ ID NO: 80276 - DNA, 25 bp, Homo sapien
ggttatttgaagaccaatctggcat

SEQ ID NO: 80277 - DNA, 25 bp, Homo sapien
ggttatttgaaggccaatctggcat

SEQ ID NO: 80278 - DNA, 25 bp, Homo sapien
ggttatttgattgtattgtcttaga

SEQ ID NO: 80279 - DNA, 25 bp, Homo sapien
ggttatttgattgtgttgtcttaga

SEQ ID NO: 80280 - DNA, 25 bp, Homo sapien
ggttattttcaccctcctgtcagat

SEQ ID NO: 80281 - DNA, 25 bp, Homo sapien
ggttattttcactctcctgtcagat

SEQ ID NO: 80282 - DNA, 25 bp, Homo sapien
ggttattttccatggagcaaaattg

SEQ ID NO: 80283 - DNA, 25 bp, Homo sapien
ggttattttctcatggcatgacaat

SEQ ID NO: 80284 - DNA, 25 bp, Homo sapien
ggttattttggctcatgcttctaca

SEQ ID NO: 80285 - DNA, 25 bp, Homo sapien
ggttattttggcttatgcttctaca

SEQ ID NO: 80286 - DNA, 25 bp, Homo sapien
ggttatttttgcctcagtttatatt

SEQ ID NO: 80287 - DNA, 25 bp, Homo sapien
ggttatttttgcctcattttatatt

SEQ ID NO: 80288 - DNA, 25 bp, Homo sapien
ggttattttttcatggcatgacaat

SEQ ID NO: 80289 - DNA, 25 bp, Homo sapien
ggttatttttttaaggcaagtattt

SEQ ID NO: 80290 - DNA, 25 bp, Homo sapien
ggttatttttttaatgcaagtattt

SEQ ID NO: 80291 - DNA, 25 bp, Homo sapien
ggttcaagccacgactctgctacag

SEQ ID NO: 80292 - DNA, 25 bp, Homo sapien
ggttcaaggaagacaatgacagata

SEQ ID NO: 80293 - DNA, 25 bp, Homo sapien
ggttcaaggaagccaatgacagata

SEQ ID NO: 80294 - DNA, 25 bp, Homo sapien
ggttcaagtcacgactctgctacag

SEQ ID NO: 80295 - DNA, 25 bp, Homo sapien
ggttcaatcatccgtctactattgg

SEQ ID NO: 80296 - DNA, 25 bp, Homo sapien
ggttcaatcgtccgtctactattgg

SEQ ID NO: 80297 - DNA, 25 bp, Homo sapien
ggttcacaagcatcagaggcaggat

SEQ ID NO: 80298 - DNA, 25 bp, Homo sapien
ggttcacaagcgtcagaggcaggat

SEQ ID NO: 80299 - DNA, 25 bp, Homo sapien
ggttcacaggacgtcaaggctatta

SEQ ID NO: 80300 - DNA, 25 bp, Homo sapien
ggttcacaggatgtcaaggctatta

SEQ ID NO: 80301 - DNA, 25 bp, Homo sapien
ggttcacattgctttccactcatca

SEQ ID NO: 80302 - DNA, 25 bp, Homo sapien
ggttcacattgttttccactcatca

SEQ ID NO: 80303 - DNA, 25 bp, Homo sapien
ggttcactgcatactactgatcttt

SEQ ID NO: 80304 - DNA, 25 bp, Homo sapien
ggttcactgcatactattgatcttt

SEQ ID NO: 80305 - DNA, 25 bp, Homo sapien
ggttcacttcgctactactgaagca

SEQ ID NO: 80306 - DNA, 25 bp, Homo sapien
ggttcactttgctactactgaagca

SEQ ID NO: 80307 - DNA, 25 bp, Homo sapien
ggttcagaacatcacaaggtgtatg

SEQ ID NO: 80308 - DNA, 25 bp, Homo sapien
ggttcagaatatcacaaggtgtatg

SEQ ID NO: 80309 - DNA, 25 bp, Homo sapien
ggttcagcacagaaagaaagacttc

SEQ ID NO: 80310 - DNA, 25 bp, Homo sapien
ggttcagcacagcaagaaagacttc

SEQ ID NO: 80311 - DNA, 25 bp, Homo sapien
ggttcatacaataagctcaagaaac

SEQ ID NO: 80312 - DNA, 25 bp, Homo sapien
ggttcatacaatgagctcaagaaac

SEQ ID NO: 80313 - DNA, 25 bp, Homo sapien
ggttcattcagaagaggcactgagg

SEQ ID NO: 80314 - DNA, 25 bp, Homo sapien
ggttcattcagaagagtcactgagg

SEQ ID NO: 80315 - DNA, 25 bp, Homo sapien
ggttccaaaggatggagaaaacaga

SEQ ID NO: 80316 - DNA, 25 bp, Homo sapien
ggttccaaaggatggataaaacaga

SEQ ID NO: 80317 - DNA, 25 bp, Homo sapien
ggttccaattacgcctaattatttg

SEQ ID NO: 80318 - DNA, 25 bp, Homo sapien
ggttccaattactcctaattatttg

SEQ ID NO: 80319 - DNA, 25 bp, Homo sapien
ggttccaattctgcacaaatatgag

SEQ ID NO: 80320 - DNA, 25 bp, Homo sapien
ggttccaattcttcacaaatatgag

SEQ ID NO: 80321 - DNA, 25 bp, Homo sapien
ggttccacaagaggctcagggacac

SEQ ID NO: 80322 - DNA, 25 bp, Homo sapien
ggttccacgagaggctcagggacac

SEQ ID NO: 80323 - DNA, 25 bp, Homo sapien
ggttccagaaactccacagaagtta

SEQ ID NO: 80324 - DNA, 25 bp, Homo sapien
ggttccaggaactccacagaagtta

SEQ ID NO: 80325 - DNA, 25 bp, Homo sapien
ggttccatatcaagatatttggcac

SEQ ID NO: 80326 - DNA, 25 bp, Homo sapien
ggttccatatcgagatatttggcac

SEQ ID NO: 80327 - DNA, 25 bp, Homo sapien
ggttcccgaagccgatgggctctgt

SEQ ID NO: 80328 - DNA, 25 bp, Homo sapien
ggttcccgaagctgatgggctctgt

SEQ ID NO: 80329 - DNA, 25 bp, Homo sapien
ggttcctgcctgccacatgccatac

SEQ ID NO: 80330 - DNA, 25 bp, Homo sapien
ggttcctgcctgccacgtgccatac

SEQ ID NO: 80331 - DNA, 25 bp, Homo sapien
ggttccttataaaacgacaaattca

SEQ ID NO: 80332 - DNA, 25 bp, Homo sapien
ggttccttataaaatgacaaattca

SEQ ID NO: 80333 - DNA, 25 bp, Homo sapien
ggttcgacctctacgtcagcagttc

SEQ ID NO: 80334 - DNA, 25 bp, Homo sapien
ggttcgacctctacgttagcagttc

SEQ ID NO: 80335 - DNA, 25 bp, Homo sapien
ggttctaaaactctaatctctttcc

SEQ ID NO: 80336 - DNA, 25 bp, Homo sapien
ggttctaaaactttaatctctttcc

SEQ ID NO: 80337 - DNA, 25 bp, Homo sapien
ggttctaaagtacgaaaagatgtaa

SEQ ID NO: 80338 - DNA, 25 bp, Homo sapien
ggttctaaggctcttgctggaaacc

SEQ ID NO: 80339 - DNA, 25 bp, Homo sapien
ggttctaaggctcttgttggaaacc

SEQ ID NO: 80340 - DNA, 25 bp, Homo sapien
ggttctaaggtacgaaaagatgtaa

SEQ ID NO: 80341 - DNA, 25 bp, Homo sapien
ggttctcagtcacacctggcagact

SEQ ID NO: 80342 - DNA, 25 bp, Homo sapien
ggttctcagtcccacctggcagact

SEQ ID NO: 80343 - DNA, 25 bp, Homo sapien
ggttctctgcagaacaaggcagatc

SEQ ID NO: 80344 - DNA, 25 bp, Homo sapien
ggttctctgtagaacaaggcagatc

SEQ ID NO: 80345 - DNA, 25 bp, Homo sapien
ggttctgaacactggagttgaattt

SEQ ID NO: 80346 - DNA, 25 bp, Homo sapien
ggttctgaatactggagttgaattt

SEQ ID NO: 80347 - DNA, 25 bp, Homo sapien
ggttctgcacctactgattcaaaca

SEQ ID NO: 80348 - DNA, 25 bp, Homo sapien
ggttctgcatctactgattcaaaca

SEQ ID NO: 80349 - DNA, 25 bp, Homo sapien
ggttctgcctgaaatgtgagcacat

SEQ ID NO: 80350 - DNA, 25 bp, Homo sapien
ggttctgcttgaaatgtgagcacat

SEQ ID NO: 80351 - DNA, 25 bp, Homo sapien
ggttctggaagggacccgcagcttc

SEQ ID NO: 80352 - DNA, 25 bp, Homo sapien
ggttctggaagggacctgcagcttc

SEQ ID NO: 80353 - DNA, 25 bp, Homo sapien
ggttctggtcaaagtcctattctaa

SEQ ID NO: 80354 - DNA, 25 bp, Homo sapien
ggttctggtcaaggtcctattctaa

SEQ ID NO: 80355 - DNA, 25 bp, Homo sapien
ggttctgtagactctgcgtgtgtgt

SEQ ID NO: 80356 - DNA, 25 bp, Homo sapien
ggttctgtagactgtgcgtgtgtgt

SEQ ID NO: 80357 - DNA, 25 bp, Homo sapien
ggttctgtatgaaacgcccctgctc

SEQ ID NO: 80358 - DNA, 25 bp, Homo sapien
ggttctgtatgaaatgcccctgctc

SEQ ID NO: 80359 - DNA, 25 bp, Homo sapien
ggttctgtcaaaaccctaacttacg

SEQ ID NO: 80360 - DNA, 25 bp, Homo sapien
ggttctgtcaaaagcctaacttacg

SEQ ID NO: 80361 - DNA, 25 bp, Homo sapien
ggttctgtttaaccatacctaaaaa

SEQ ID NO: 80362 - DNA, 25 bp, Homo sapien
ggttctgtttaaccgtacctaaaaa

SEQ ID NO: 80363 - DNA, 25 bp, Homo sapien
ggttcttactttattgcactgaaga

SEQ ID NO: 80364 - DNA, 25 bp, Homo sapien
ggttcttattttattgcactgaaga

SEQ ID NO: 80365 - DNA, 25 bp, Homo sapien
ggttcttcacccagacataatcccc

SEQ ID NO: 80366 - DNA, 25 bp, Homo sapien
ggttcttcataaagattgcatagga

SEQ ID NO: 80367 - DNA, 25 bp, Homo sapien
ggttcttcatagagattgcatagga

SEQ ID NO: 80368 - DNA, 25 bp, Homo sapien
ggttcttcgcccagacataatcccc

SEQ ID NO: 80369 - DNA, 25 bp, Homo sapien
ggttcttctggacactagattaatt

SEQ ID NO: 80370 - DNA, 25 bp, Homo sapien
ggttcttctgggcactagattaatt

SEQ ID NO: 80371 - DNA, 25 bp, Homo sapien
ggttcttgccctatatgtgtgactt

SEQ ID NO: 80372 - DNA, 25 bp, Homo sapien
ggttcttgccctgtatgtgtgactt

SEQ ID NO: 80373 - DNA, 25 bp, Homo sapien
ggttctttctctgggctcaagaagt

SEQ ID NO: 80374 - DNA, 25 bp, Homo sapien
ggttctttctctgtgctcaagaagt

SEQ ID NO: 80375 - DNA, 25 bp, Homo sapien
ggttgaaaacgtgttaataaagatg

SEQ ID NO: 80376 - DNA, 25 bp, Homo sapien
ggttgaaaatgcaattgacacactg

SEQ ID NO: 80377 - DNA, 25 bp, Homo sapien
ggttgaaaatgcgattgacacactg

SEQ ID NO: 80378 - DNA, 25 bp, Homo sapien
ggttgaaaatgtgttaataaagatg

SEQ ID NO: 80379 - DNA, 25 bp, Homo sapien
ggttgaaagtcattttcttcctgct

SEQ ID NO: 80380 - DNA, 25 bp, Homo sapien
ggttgaaagtcattttgttcctgct

SEQ ID NO: 80381 - DNA, 25 bp, Homo sapien
ggttgaattcccggaaatatgtaga

SEQ ID NO: 80382 - DNA, 25 bp, Homo sapien
ggttgaattcctggaaatatgtaga

SEQ ID NO: 80383 - DNA, 25 bp, Homo sapien
ggttgacacagaaatacagacccag

SEQ ID NO: 80384 - DNA, 25 bp, Homo sapien
ggttgacacagaattacagacccag

SEQ ID NO: 80385 - DNA, 25 bp, Homo sapien
ggttgacagccttaagcagcataga

SEQ ID NO: 80386 - DNA, 25 bp, Homo sapien
ggttgacagccttatgcagcataga

SEQ ID NO: 80387 - DNA, 25 bp, Homo sapien
ggttgacatccacctgatcaccacc

SEQ ID NO: 80388 - DNA, 25 bp, Homo sapien
ggttgacatcctcctgatcaccacc

SEQ ID NO: 80389 - DNA, 25 bp, Homo sapien
ggttgaccctacagaaaagaaaatt

SEQ ID NO: 80390 - DNA, 25 bp, Homo sapien
ggttgaccttacagaaaagaaaatt

SEQ ID NO: 80391 - DNA, 25 bp, Homo sapien
ggttgaccttcagacttattttctc

SEQ ID NO: 80392 - DNA, 25 bp, Homo sapien
ggttgaccttcagatttattttctc

SEQ ID NO: 80393 - DNA, 25 bp, Homo sapien
ggttgactcttccacattctatggg

SEQ ID NO: 80394 - DNA, 25 bp, Homo sapien
ggttgactcttctacattctatggg

SEQ ID NO: 80395 - DNA, 25 bp, Homo sapien
ggttgaggtataagacaacagggct

SEQ ID NO: 80396 - DNA, 25 bp, Homo sapien
ggttgaggtataaggcaacagggct

SEQ ID NO: 80397 - DNA, 25 bp, Homo sapien
ggttgaggtccttaattcagagact

SEQ ID NO: 80398 - DNA, 25 bp, Homo sapien
ggttgaggtccttagttcagagact

SEQ ID NO: 80399 - DNA, 25 bp, Homo sapien
ggttgagtcagagattgcttctaaa

SEQ ID NO: 80400 - DNA, 25 bp, Homo sapien
ggttgagtcagggattgcttctaaa

SEQ ID NO: 80401 - DNA, 25 bp, Homo sapien
ggttgagtgaaaccatgaataaaac

SEQ ID NO: 80402 - DNA, 25 bp, Homo sapien
ggttgagtgaaactatgaataaaac

SEQ ID NO: 80403 - DNA, 25 bp, Homo sapien
ggttgataaatgaacaaacacaatg

SEQ ID NO: 80404 - DNA, 25 bp, Homo sapien
ggttgataaatgagcaaacacaatg

SEQ ID NO: 80405 - DNA, 25 bp, Homo sapien
ggttgctctcacctgtggtcctagc

SEQ ID NO: 80406 - DNA, 25 bp, Homo sapien
ggttgctctcatctgtggtcctagc

SEQ ID NO: 80407 - DNA, 25 bp, Homo sapien
ggttgcttgacaacatgctttccca

SEQ ID NO: 80408 - DNA, 25 bp, Homo sapien
ggttgcttgacaacgtgctttccca

SEQ ID NO: 80409 - DNA, 25 bp, Homo sapien
ggttggaagttgctatcttattgcc

SEQ ID NO: 80410 - DNA, 25 bp, Homo sapien
ggttggaagttggtatcttattgcc

SEQ ID NO: 80411 - DNA, 25 bp, Homo sapien
ggttggagtacagcagaaccacaaa

SEQ ID NO: 80412 - DNA, 25 bp, Homo sapien
ggttggagtactgcagaaccacaaa

SEQ ID NO: 80413 - DNA, 25 bp, Homo sapien
ggttggatttctttctccatggtta

SEQ ID NO: 80414 - DNA, 25 bp, Homo sapien
ggttggatttctttttccatggtta

SEQ ID NO: 80415 - DNA, 25 bp, Homo sapien
ggttggatttgacttcttcttatga

SEQ ID NO: 80416 - DNA, 25 bp, Homo sapien
ggttggatttgatttcttcttatga

SEQ ID NO: 80417 - DNA, 25 bp, Homo sapien
ggttggggagaagacgcaatagctc

SEQ ID NO: 80418 - DNA, 25 bp, Homo sapien
ggttggggagaagatgcaatagctc

SEQ ID NO: 80419 - DNA, 25 bp, Homo sapien
ggttggggattagctctctcaggac

SEQ ID NO: 80420 - DNA, 25 bp, Homo sapien
ggttggggattatctctctcaggac

SEQ ID NO: 80421 - DNA, 25 bp, Homo sapien
ggttggttaagagaaaggtatctcc

SEQ ID NO: 80422 - DNA, 25 bp, Homo sapien
ggttggttaagagacaggtatctcc

SEQ ID NO: 80423 - DNA, 25 bp, Homo sapien
ggttggttataagcaatgcatgaag

SEQ ID NO: 80424 - DNA, 25 bp, Homo sapien
ggttggttataggcaatgcatgaag

SEQ ID NO: 80425 - DNA, 25 bp, Homo sapien
ggttggttcaaggtcacaccatgag

SEQ ID NO: 80426 - DNA, 25 bp, Homo sapien
ggttggttccaggtcacaccatgag

SEQ ID NO: 80427 - DNA, 25 bp, Homo sapien
ggttgtagacataacatgcttattt

SEQ ID NO: 80428 - DNA, 25 bp, Homo sapien
ggttgtagacataatatgcttattt

SEQ ID NO: 80429 - DNA, 25 bp, Homo sapien
ggttgtcatcttggaacacatgaac

SEQ ID NO: 80430 - DNA, 25 bp, Homo sapien
ggttgtcatcttgggacacatgaac

SEQ ID NO: 80431 - DNA, 25 bp, Homo sapien
ggttgtctcatcactgctaatgtca

SEQ ID NO: 80432 - DNA, 25 bp, Homo sapien
ggttgtctcatgactgctaatgtca

SEQ ID NO: 80433 - DNA, 25 bp, Homo sapien
ggttgtctcttcaatctgttggttg

SEQ ID NO: 80434 - DNA, 25 bp, Homo sapien
ggttgtctcttgaatctgttggttg

SEQ ID NO: 80435 - DNA, 25 bp, Homo sapien
ggttgtgcaggaggccagctgccag

SEQ ID NO: 80436 - DNA, 25 bp, Homo sapien
ggttgtgcaggaggccggctgccag

SEQ ID NO: 80437 - DNA, 25 bp, Homo sapien
ggttgttagattctaaatttactac

SEQ ID NO: 80438 - DNA, 25 bp, Homo sapien
ggttgttagattgtaaatttactac

SEQ ID NO: 80439 - DNA, 25 bp, Homo sapien
ggttgttattcatgcaattcctgac

SEQ ID NO: 80440 - DNA, 25 bp, Homo sapien
ggttgttattcatgcagttcctgac

SEQ ID NO: 80441 - DNA, 25 bp, Homo sapien
ggttgttcttatttcttgcttgtgt

SEQ ID NO: 80442 - DNA, 25 bp, Homo sapien
ggttgttcttatttgttgcttgtgt

SEQ ID NO: 80443 - DNA, 25 bp, Homo sapien
ggttgtttccaagccctttagatga

SEQ ID NO: 80444 - DNA, 25 bp, Homo sapien
ggttgtttccatgccctttagatga

SEQ ID NO: 80445 - DNA, 25 bp, Homo sapien
ggttgtttcctttctatttgagaga

SEQ ID NO: 80446 - DNA, 25 bp, Homo sapien
ggttgttttctttctatttgagaga

SEQ ID NO: 80447 - DNA, 25 bp, Homo sapien
ggtttaccttggaccctgacacagt

SEQ ID NO: 80448 - DNA, 25 bp, Homo sapien
ggtttaccttggactctgacacagt

SEQ ID NO: 80449 - DNA, 25 bp, Homo sapien
ggtttaggaaagaaccatctgagag

SEQ ID NO: 80450 - DNA, 25 bp, Homo sapien
ggtttagggaagaaccatctgagag

SEQ ID NO: 80451 - DNA, 25 bp, Homo sapien
ggtttagttgttcaacatcatctca

SEQ ID NO: 80452 - DNA, 25 bp, Homo sapien
ggtttagttgttgaacatcatctca

SEQ ID NO: 80453 - DNA, 25 bp, Homo sapien
ggtttataaaaggtcaaaaagctaa

SEQ ID NO: 80454 - DNA, 25 bp, Homo sapien
ggtttataaaaggtcacaaagctaa

SEQ ID NO: 80455 - DNA, 25 bp, Homo sapien
ggtttcaagcggtgagcctagctct

SEQ ID NO: 80456 - DNA, 25 bp, Homo sapien
ggtttcaagtggtgagcctagctct

SEQ ID NO: 80457 - DNA, 25 bp, Homo sapien
ggtttcacagatgagaaaaattaga

SEQ ID NO: 80458 - DNA, 25 bp, Homo sapien
ggtttcacagatgggaaaaattaga

SEQ ID NO: 80459 - DNA, 25 bp, Homo sapien
ggtttcacctcttcatcattcagaa

SEQ ID NO: 80460 - DNA, 25 bp, Homo sapien
ggtttcacctcttcttcattcagaa

SEQ ID NO: 80461 - DNA, 25 bp, Homo sapien
ggtttcagattaaacattttgtttt

SEQ ID NO: 80462 - DNA, 25 bp, Homo sapien
ggtttcagctcaggccatttttcta

SEQ ID NO: 80463 - DNA, 25 bp, Homo sapien
ggtttcagctcaggtcatttttcta

SEQ ID NO: 80464 - DNA, 25 bp, Homo sapien
ggtttcaggttaaacattttgtttt

SEQ ID NO: 80465 - DNA, 25 bp, Homo sapien
ggtttcagttaacggcaactttaga

SEQ ID NO: 80466 - DNA, 25 bp, Homo sapien
ggtttcagttaatggcaactttaga

SEQ ID NO: 80467 - DNA, 25 bp, Homo sapien
ggtttcatagatacatgtcaaaact

SEQ ID NO: 80468 - DNA, 25 bp, Homo sapien
ggtttcatagatatatgtcaaaact

SEQ ID NO: 80469 - DNA, 25 bp, Homo sapien
ggtttcatgagctacaaaaggttgc

SEQ ID NO: 80470 - DNA, 25 bp, Homo sapien
ggtttcatgagctacagaaggttgc

SEQ ID NO: 80471 - DNA, 25 bp, Homo sapien
ggtttcatgattaccaagtggcaga

SEQ ID NO: 80472 - DNA, 25 bp, Homo sapien
ggtttcatgattagcaagtggcaga

SEQ ID NO: 80473 - DNA, 25 bp, Homo sapien
ggtttccagagatcacatgtggaat

SEQ ID NO: 80474 - DNA, 25 bp, Homo sapien
ggtttccagcgatcacatgtggaat

SEQ ID NO: 80475 - DNA, 25 bp, Homo sapien
ggtttccagggctgtaatattatac

SEQ ID NO: 80476 - DNA, 25 bp, Homo sapien
ggtttccagggttgtaatattatac

SEQ ID NO: 80477 - DNA, 25 bp, Homo sapien
ggtttcccatgacccaaatttacca

SEQ ID NO: 80478 - DNA, 25 bp, Homo sapien
ggtttcccatgacccagatttacca

SEQ ID NO: 80479 - DNA, 25 bp, Homo sapien
ggtttcgcgagatactctctcttaa

SEQ ID NO: 80480 - DNA, 25 bp, Homo sapien
ggtttcgctagatactctctcttaa

SEQ ID NO: 80481 - DNA, 25 bp, Homo sapien
ggtttctacagagtaacaaaacaaa

SEQ ID NO: 80482 - DNA, 25 bp, Homo sapien
ggtttctacagagtgacaaaacaaa

SEQ ID NO: 80483 - DNA, 25 bp, Homo sapien
ggtttctaggctatcatgcagtgag

SEQ ID NO: 80484 - DNA, 25 bp, Homo sapien
ggtttctaggctatgatgcagtgag

SEQ ID NO: 80485 - DNA, 25 bp, Homo sapien
ggtttctattctggatgctaagaat

SEQ ID NO: 80486 - DNA, 25 bp, Homo sapien
ggtttctattctggttgctaagaat

SEQ ID NO: 80487 - DNA, 25 bp, Homo sapien
ggtttctcaggcctaatgatttact

SEQ ID NO: 80488 - DNA, 25 bp, Homo sapien
ggtttctcaggcttaatgatttact

SEQ ID NO: 80489 - DNA, 25 bp, Homo sapien
ggtttctcttctacgactaatccta

SEQ ID NO: 80490 - DNA, 25 bp, Homo sapien
ggtttctcttctatgactaatccta

SEQ ID NO: 80491 - DNA, 25 bp, Homo sapien
ggtttctgtagaagctgggctgatg

SEQ ID NO: 80492 - DNA, 25 bp, Homo sapien
ggtttctgtaggagctgggctgatg

SEQ ID NO: 80493 - DNA, 25 bp, Homo sapien
ggtttctgttcaggatttagctaac

SEQ ID NO: 80494 - DNA, 25 bp, Homo sapien
ggtttctgttcgggatttagctaac

SEQ ID NO: 80495 - DNA, 25 bp, Homo sapien
ggtttcttcttcacttacccgcaag

SEQ ID NO: 80496 - DNA, 25 bp, Homo sapien
ggtttcttcttcacttgcccgcaag

SEQ ID NO: 80497 - DNA, 25 bp, Homo sapien
ggtttgagaagaaatatgtcggctt

SEQ ID NO: 80498 - DNA, 25 bp, Homo sapien
ggtttgagaaggaatatgtcggctt

SEQ ID NO: 80499 - DNA, 25 bp, Homo sapien
ggtttgagcagcactccgccagtga

SEQ ID NO: 80500 - DNA, 25 bp, Homo sapien
ggtttgagcagcactctgccagtga

SEQ ID NO: 80501 - DNA, 25 bp, Homo sapien
ggtttgagtactacctcagccacag

SEQ ID NO: 80502 - DNA, 25 bp, Homo sapien
ggtttgagtactacttcagccacag

SEQ ID NO: 80503 - DNA, 25 bp, Homo sapien
ggtttgagtggcagcctccatcgta

SEQ ID NO: 80504 - DNA, 25 bp, Homo sapien
ggtttgagtggcaggctccatcgta

SEQ ID NO: 80505 - DNA, 25 bp, Homo sapien
ggtttgattccaaatgctctggaaa

SEQ ID NO: 80506 - DNA, 25 bp, Homo sapien
ggtttgattccaagtgctctggaaa

SEQ ID NO: 80507 - DNA, 25 bp, Homo sapien
ggtttgattttacgcaagaaaccat

SEQ ID NO: 80508 - DNA, 25 bp, Homo sapien
ggtttgattttatgcaagaaaccat

SEQ ID NO: 80509 - DNA, 25 bp, Homo sapien
ggtttgcaaaataaatttggtctca

SEQ ID NO: 80510 - DNA, 25 bp, Homo sapien
ggtttgcaaaataagtttggtctca

SEQ ID NO: 80511 - DNA, 25 bp, Homo sapien
ggtttgccatactggagcaagtagt

SEQ ID NO: 80512 - DNA, 25 bp, Homo sapien
ggtttgccatagtggagcaagtagt

SEQ ID NO: 80513 - DNA, 25 bp, Homo sapien
ggtttgccctagagtaggtatcatc

SEQ ID NO: 80514 - DNA, 25 bp, Homo sapien
ggtttgccctagcgtaggtatcatc

SEQ ID NO: 80515 - DNA, 25 bp, Homo sapien
ggtttgctcgtctctggttttgagt

SEQ ID NO: 80516 - DNA, 25 bp, Homo sapien
ggtttgctcgtctctgtttttgagt

SEQ ID NO: 80517 - DNA, 25 bp, Homo sapien
ggtttgctctaaatacacccaatat

SEQ ID NO: 80518 - DNA, 25 bp, Homo sapien
ggtttgctgtaaatacacccaatat

SEQ ID NO: 80519 - DNA, 25 bp, Homo sapien
ggtttggagtcatgcaaccaattca

SEQ ID NO: 80520 - DNA, 25 bp, Homo sapien
ggtttggagtcgtgcaaccaattca

SEQ ID NO: 80521 - DNA, 25 bp, Homo sapien
ggtttggatatgcctcacagttgca

SEQ ID NO: 80522 - DNA, 25 bp, Homo sapien
ggtttggatatgcctcgcagttgca

SEQ ID NO: 80523 - DNA, 25 bp, Homo sapien
ggtttggcatagcacattgtgccaa

SEQ ID NO: 80524 - DNA, 25 bp, Homo sapien
ggtttggcgtagcacattgtgccaa

SEQ ID NO: 80525 - DNA, 25 bp, Homo sapien
ggtttggctgccacttgcttataaa

SEQ ID NO: 80526 - DNA, 25 bp, Homo sapien
ggtttggctgccagttgcttataaa

SEQ ID NO: 80527 - DNA, 25 bp, Homo sapien
ggtttggtcacacgagttatagcta

SEQ ID NO: 80528 - DNA, 25 bp, Homo sapien
ggtttggtcacatgagttatagcta

SEQ ID NO: 80529 - DNA, 25 bp, Homo sapien
ggtttggtttacatgcagatgtttt

SEQ ID NO: 80530 - DNA, 25 bp, Homo sapien
ggtttggtttacgtgcagatgtttt

SEQ ID NO: 80531 - DNA, 25 bp, Homo sapien
ggtttggtttatggagacctggcta

SEQ ID NO: 80532 - DNA, 25 bp, Homo sapien
ggtttggtttatggagccctggcta

SEQ ID NO: 80533 - DNA, 25 bp, Homo sapien
ggtttggtttttttattgcccagac

SEQ ID NO: 80534 - DNA, 25 bp, Homo sapien
ggtttggtttttttgttgcccagac

SEQ ID NO: 80535 - DNA, 25 bp, Homo sapien
ggtttgtatctggttattaaaagtt

SEQ ID NO: 80536 - DNA, 25 bp, Homo sapien
ggtttgtatctgtttattaaaagtt

SEQ ID NO: 80537 - DNA, 25 bp, Homo sapien
ggtttgtggttaaaggtgaagatgt

SEQ ID NO: 80538 - DNA, 25 bp, Homo sapien
ggtttgtggttaaatgtgaagatgt

SEQ ID NO: 80539 - DNA, 25 bp, Homo sapien
ggtttgttaaagcacacattgctgg

SEQ ID NO: 80540 - DNA, 25 bp, Homo sapien
ggtttgttaaagcacagattgctgg

SEQ ID NO: 80541 - DNA, 25 bp, Homo sapien
ggtttgtttagaaagcagtgggttc

SEQ ID NO: 80542 - DNA, 25 bp, Homo sapien
ggtttgtttaggaagcagtgggttc

SEQ ID NO: 80543 - DNA, 25 bp, Homo sapien
ggttttaaacacgttatgtgtgcta

SEQ ID NO: 80544 - DNA, 25 bp, Homo sapien
ggttttaaacatgttatgtgtgcta

SEQ ID NO: 80545 - DNA, 25 bp, Homo sapien
ggttttaatttgcgtccctaatagc

SEQ ID NO: 80546 - DNA, 25 bp, Homo sapien
ggttttaatttgtgtccctaatagc

SEQ ID NO: 80547 - DNA, 25 bp, Homo sapien
ggttttatacattgaaggagacatg

SEQ ID NO: 80548 - DNA, 25 bp, Homo sapien
ggttttatgcattgaaggagacatg

SEQ ID NO: 80549 - DNA, 25 bp, Homo sapien
ggttttcaactgacagccttctcct

SEQ ID NO: 80550 - DNA, 25 bp, Homo sapien
ggttttcacttttaaggagtttctg

SEQ ID NO: 80551 - DNA, 25 bp, Homo sapien
ggttttcacttttaagtagtttctg

SEQ ID NO: 80552 - DNA, 25 bp, Homo sapien
ggttttcagctgacagccttctcct

SEQ ID NO: 80553 - DNA, 25 bp, Homo sapien
ggttttcccagccatttccttggtc

SEQ ID NO: 80554 - DNA, 25 bp, Homo sapien
ggttttcccagcgatttccttggtc

SEQ ID NO: 80555 - DNA, 25 bp, Homo sapien
ggttttcctcttctacctctagctc

SEQ ID NO: 80556 - DNA, 25 bp, Homo sapien
ggttttcctttatcagccttttaat

SEQ ID NO: 80557 - DNA, 25 bp, Homo sapien
ggttttcctttattagccttttaat

SEQ ID NO: 80558 - DNA, 25 bp, Homo sapien
ggttttccttttctacctctagctc

SEQ ID NO: 80559 - DNA, 25 bp, Homo sapien
ggttttctcgtccatttcttcacac

SEQ ID NO: 80560 - DNA, 25 bp, Homo sapien
ggttttcttattggttttcatagtt

SEQ ID NO: 80561 - DNA, 25 bp, Homo sapien
ggttttcttatttgttttcatagtt

SEQ ID NO: 80562 - DNA, 25 bp, Homo sapien
ggttttcttgtccatttcttcacac

SEQ ID NO: 80563 - DNA, 25 bp, Homo sapien
ggttttgactgggattatgactata

SEQ ID NO: 80564 - DNA, 25 bp, Homo sapien
ggttttgagatgaaatggttccacc

SEQ ID NO: 80565 - DNA, 25 bp, Homo sapien
ggttttgagatgaagtggttccacc

SEQ ID NO: 80566 - DNA, 25 bp, Homo sapien
ggttttgattgggattatgactata

SEQ ID NO: 80567 - DNA, 25 bp, Homo sapien
ggttttgcattgtaaattaaagtct

SEQ ID NO: 80568 - DNA, 25 bp, Homo sapien
ggttttgcattttaaattaaagtct

SEQ ID NO: 80569 - DNA, 25 bp, Homo sapien
ggttttgctcaatgtagtcactttg

SEQ ID NO: 80570 - DNA, 25 bp, Homo sapien
ggttttgctcagtgtagtcactttg

SEQ ID NO: 80571 - DNA, 25 bp, Homo sapien
ggttttgctgacactgctgcccacc

SEQ ID NO: 80572 - DNA, 25 bp, Homo sapien
ggttttgctgacgctgctgcccacc

SEQ ID NO: 80573 - DNA, 25 bp, Homo sapien
ggttttggcttctgagttcaggaag

SEQ ID NO: 80574 - DNA, 25 bp, Homo sapien
ggttttggggaaattagtttgattt

SEQ ID NO: 80575 - DNA, 25 bp, Homo sapien
ggttttggggaaattattttgattt

SEQ ID NO: 80576 - DNA, 25 bp, Homo sapien
ggttttgggttctgagttcaggaag

SEQ ID NO: 80577 - DNA, 25 bp, Homo sapien
ggttttggtagtttgttcctttcat

SEQ ID NO: 80578 - DNA, 25 bp, Homo sapien
ggttttggtcgtttgttcctttcat

SEQ ID NO: 80579 - DNA, 25 bp, Homo sapien
ggttttgtactccaacatgctctat

SEQ ID NO: 80580 - DNA, 25 bp, Homo sapien
ggttttgtactcccacatgctctat

SEQ ID NO: 80581 - DNA, 25 bp, Homo sapien
ggtttttatacaagtcttctagaac

SEQ ID NO: 80582 - DNA, 25 bp, Homo sapien
ggtttttattcaagtcttctagaac

SEQ ID NO: 80583 - DNA, 25 bp, Homo sapien
ggtttttcaagagaagatactgtgt

SEQ ID NO: 80584 - DNA, 25 bp, Homo sapien
ggtttttcaggagaagatactgtgt

SEQ ID NO: 80585 - DNA, 25 bp, Homo sapien
gtaaaaaaaagccatccgtctggca

SEQ ID NO: 80586 - DNA, 25 bp, Homo sapien
gtaaaaaaaagccatctgtctggca

SEQ ID NO: 80587 - DNA, 25 bp, Homo sapien
gtaaaaaccagttcagagaaatttg

SEQ ID NO: 80588 - DNA, 25 bp, Homo sapien
gtaaaaaccagttgagagaaatttg

SEQ ID NO: 80589 - DNA, 25 bp, Homo sapien
gtaaaaacctcagatctccttcacg

SEQ ID NO: 80590 - DNA, 25 bp, Homo sapien
gtaaaaacctcaggtctccttcacg

SEQ ID NO: 80591 - DNA, 25 bp, Homo sapien
gtaaaaagaaaaaagcatcatcatt

SEQ ID NO: 80592 - DNA, 25 bp, Homo sapien
gtaaaaagagacaggtaaatcgaat

SEQ ID NO: 80593 - DNA, 25 bp, Homo sapien
gtaaaaagagacgggtaaatcgaat

SEQ ID NO: 80594 - DNA, 25 bp, Homo sapien
gtaaaaagataaaagcatcatcatt

SEQ ID NO: 80595 - DNA, 25 bp, Homo sapien
gtaaaaagcgagttaagaaggaaaa

SEQ ID NO: 80596 - DNA, 25 bp, Homo sapien
gtaaaaagtcttcccatggcttctc

SEQ ID NO: 80597 - DNA, 25 bp, Homo sapien
gtaaaaagtcttcctatggcttctc

SEQ ID NO: 80598 - DNA, 25 bp, Homo sapien
gtaaaaagtgagttaagaaggaaaa

SEQ ID NO: 80599 - DNA, 25 bp, Homo sapien
gtaaaaatacaattaggcagaactc

SEQ ID NO: 80600 - DNA, 25 bp, Homo sapien
gtaaaaatacagttaggcagaactc

SEQ ID NO: 80601 - DNA, 25 bp, Homo sapien
gtaaaaatacgacctaaaattatct

SEQ ID NO: 80602 - DNA, 25 bp, Homo sapien
gtaaaaatatgacctaaaattatct

SEQ ID NO: 80603 - DNA, 25 bp, Homo sapien
gtaaaaatatgtccgtaagttaaat

SEQ ID NO: 80604 - DNA, 25 bp, Homo sapien
gtaaaaatatgtctgtaagttaaat

SEQ ID NO: 80605 - DNA, 25 bp, Homo sapien
gtaaaaatggctacaaccagaacga

SEQ ID NO: 80606 - DNA, 25 bp, Homo sapien
gtaaaaatggctacaatcagaacga

SEQ ID NO: 80607 - DNA, 25 bp, Homo sapien
gtaaaaattgttcaactatacagag

SEQ ID NO: 80608 - DNA, 25 bp, Homo sapien
gtaaaaattgttcagctatacagag

SEQ ID NO: 80609 - DNA, 25 bp, Homo sapien
gtaaaacagtagagtgccaagcaca

SEQ ID NO: 80610 - DNA, 25 bp, Homo sapien
gtaaaacagtagagtgtcaagcaca

SEQ ID NO: 80611 - DNA, 25 bp, Homo sapien
gtaaaacatagcatggaagacaggt

SEQ ID NO: 80612 - DNA, 25 bp, Homo sapien
gtaaaacatagtatggaagacaggt

SEQ ID NO: 80613 - DNA, 25 bp, Homo sapien
gtaaaacattagagcaataaggtga

SEQ ID NO: 80614 - DNA, 25 bp, Homo sapien
gtaaaacattagggcaataaggtga

SEQ ID NO: 80615 - DNA, 25 bp, Homo sapien
gtaaaactcccatttcgacattctg

SEQ ID NO: 80616 - DNA, 25 bp, Homo sapien
gtaaaactcccgtttcgacattctg

SEQ ID NO: 80617 - DNA, 25 bp, Homo sapien
gtaaaactctttttccagtggactc

SEQ ID NO: 80618 - DNA, 25 bp, Homo sapien
gtaaaactctttttcccgtggactc

SEQ ID NO: 80619 - DNA, 25 bp, Homo sapien
gtaaaagaacagagctccagaacag

SEQ ID NO: 80620 - DNA, 25 bp, Homo sapien
gtaaaagaagaccagtagaatcttg

SEQ ID NO: 80621 - DNA, 25 bp, Homo sapien
gtaaaagaagagagctccagaacag

SEQ ID NO: 80622 - DNA, 25 bp, Homo sapien
gtaaaagaggaccagtagaatcttg

SEQ ID NO: 80623 - DNA, 25 bp, Homo sapien
gtaaaagcacttatcatgagatcta

SEQ ID NO: 80624 - DNA, 25 bp, Homo sapien
gtaaaagcacttatgatgagatcta

SEQ ID NO: 80625 - DNA, 25 bp, Homo sapien
gtaaaagcagattttactcaggaac

SEQ ID NO: 80626 - DNA, 25 bp, Homo sapien
gtaaaagcagattttattcaggaac

SEQ ID NO: 80627 - DNA, 25 bp, Homo sapien
gtaaaaggaaatctgtgggattctg

SEQ ID NO: 80628 - DNA, 25 bp, Homo sapien
gtaaaaggagacaaaaatagagctg

SEQ ID NO: 80629 - DNA, 25 bp, Homo sapien
gtaaaaggagacaacaatagagctg

SEQ ID NO: 80630 - DNA, 25 bp, Homo sapien
gtaaaaggagatctgtgggattctg

SEQ ID NO: 80631 - DNA, 25 bp, Homo sapien
gtaaaaggctacaccaactacataa

SEQ ID NO: 80632 - DNA, 25 bp, Homo sapien
gtaaaaggctacaccacctacataa

SEQ ID NO: 80633 - DNA, 25 bp, Homo sapien
gtaaaagtcaggcaggttttcttgc

SEQ ID NO: 80634 - DNA, 25 bp, Homo sapien
gtaaaagtcagtcaggttttcttgc

SEQ ID NO: 80635 - DNA, 25 bp, Homo sapien
gtaaaatcaactgtctcaccataaa

SEQ ID NO: 80636 - DNA, 25 bp, Homo sapien
gtaaaatcgactgtctcaccataaa

SEQ ID NO: 80637 - DNA, 25 bp, Homo sapien
gtaaaattaacaatgatataaccat

SEQ ID NO: 80638 - DNA, 25 bp, Homo sapien
gtaaaattagttttattttgagagg

SEQ ID NO: 80639 - DNA, 25 bp, Homo sapien
gtaaaattatttttattttgagagg

SEQ ID NO: 80640 - DNA, 25 bp, Homo sapien
gtaaaattgacaatgatataaccat

SEQ ID NO: 80641 - DNA, 25 bp, Homo sapien
gtaaacaacccattcaagacaatca

SEQ ID NO: 80642 - DNA, 25 bp, Homo sapien
gtaaacaacccgttcaagacaatca

SEQ ID NO: 80643 - DNA, 25 bp, Homo sapien
gtaaacactctcaatttcccagatt

SEQ ID NO: 80644 - DNA, 25 bp, Homo sapien
gtaaacactctccatttcccagatt

SEQ ID NO: 80645 - DNA, 25 bp, Homo sapien
gtaaacagaaacaatacgtgcaact

SEQ ID NO: 80646 - DNA, 25 bp, Homo sapien
gtaaacagaaacaatatgtgcaact

SEQ ID NO: 80647 - DNA, 25 bp, Homo sapien
gtaaacatacaactgaggtgatgga

SEQ ID NO: 80648 - DNA, 25 bp, Homo sapien
gtaaacatacagctgaggtgatgga

SEQ ID NO: 80649 - DNA, 25 bp, Homo sapien
gtaaacatactcaagtctctatttt

SEQ ID NO: 80650 - DNA, 25 bp, Homo sapien
gtaaacatagtcaagtctctatttt

SEQ ID NO: 80651 - DNA, 25 bp, Homo sapien
gtaaacatatgccctgcagtaaaca

SEQ ID NO: 80652 - DNA, 25 bp, Homo sapien
gtaaacatatgtcctgcagtaaaca

SEQ ID NO: 80653 - DNA, 25 bp, Homo sapien
gtaaaccgtacgccttgaccagtgc

SEQ ID NO: 80654 - DNA, 25 bp, Homo sapien
gtaaaccgtgcgccttgaccagtgc

SEQ ID NO: 80655 - DNA, 25 bp, Homo sapien
gtaaagaaatcgtaagtgttcaaaa

SEQ ID NO: 80656 - DNA, 25 bp, Homo sapien
gtaaagaagtcgtaagtgttcaaaa

SEQ ID NO: 80657 - DNA, 25 bp, Homo sapien
gtaaagagaacagtatattatggac

SEQ ID NO: 80658 - DNA, 25 bp, Homo sapien
gtaaagagaacagtgtattatggac

SEQ ID NO: 80659 - DNA, 25 bp, Homo sapien
gtaaagatactaaccagccagagag

SEQ ID NO: 80660 - DNA, 25 bp, Homo sapien
gtaaagatgctaaccagccagagag

SEQ ID NO: 80661 - DNA, 25 bp, Homo sapien
gtaaagcagaagtattaatttgacc

SEQ ID NO: 80662 - DNA, 25 bp, Homo sapien
gtaaagcagaattattaatttgacc

SEQ ID NO: 80663 - DNA, 25 bp, Homo sapien
gtaaagcctcactcgcatatcttac

SEQ ID NO: 80664 - DNA, 25 bp, Homo sapien
gtaaagcctcactcgcgtatcttac

SEQ ID NO: 80665 - DNA, 25 bp, Homo sapien
gtaaagccttgaacaagaaagcaag

SEQ ID NO: 80666 - DNA, 25 bp, Homo sapien
gtaaagccttgaagaagaaagcaag

SEQ ID NO: 80667 - DNA, 25 bp, Homo sapien
gtaaaggaccacagagtaaacattt

SEQ ID NO: 80668 - DNA, 25 bp, Homo sapien
gtaaaggaccacggagtaaacattt

SEQ ID NO: 80669 - DNA, 25 bp, Homo sapien
gtaaaggggaatttgtcttgcgtct

SEQ ID NO: 80670 - DNA, 25 bp, Homo sapien
gtaaagggtaatttgtcttgcgtct

SEQ ID NO: 80671 - DNA, 25 bp, Homo sapien
gtaaagtacattcttagggcacaga

SEQ ID NO: 80672 - DNA, 25 bp, Homo sapien
gtaaagtacgttcttagggcacaga

SEQ ID NO: 80673 - DNA, 25 bp, Homo sapien
gtaaagttagaggaaatttcagctc

SEQ ID NO: 80674 - DNA, 25 bp, Homo sapien
gtaaagttagaggcaatttcagctc

SEQ ID NO: 80675 - DNA, 25 bp, Homo sapien
gtaaagttgatcattttaaacacct

SEQ ID NO: 80676 - DNA, 25 bp, Homo sapien
gtaaagttgatcgttttaaacacct

SEQ ID NO: 80677 - DNA, 25 bp, Homo sapien
gtaaagttggcttcacctttgggct

SEQ ID NO: 80678 - DNA, 25 bp, Homo sapien
gtaaagttggcttcacgtttgggct

SEQ ID NO: 80679 - DNA, 25 bp, Homo sapien
gtaaagttgttgcccctgactcaga

SEQ ID NO: 80680 - DNA, 25 bp, Homo sapien
gtaaagttgttgcctctgactcaga

SEQ ID NO: 80681 - DNA, 25 bp, Homo sapien
gtaaataaaatggaacactgttgat

SEQ ID NO: 80682 - DNA, 25 bp, Homo sapien
gtaaataaagtggaacactgttgat

SEQ ID NO: 80683 - DNA, 25 bp, Homo sapien
gtaaataactccagagcgtagcatc

SEQ ID NO: 80684 - DNA, 25 bp, Homo sapien
gtaaataactccagagtgtagcatc

SEQ ID NO: 80685 - DNA, 25 bp, Homo sapien
gtaaatacaaataccctaagccaac

SEQ ID NO: 80686 - DNA, 25 bp, Homo sapien
gtaaatacaccttaagtaaactaga

SEQ ID NO: 80687 - DNA, 25 bp, Homo sapien
gtaaataccaataccctaagccaac

SEQ ID NO: 80688 - DNA, 25 bp, Homo sapien
gtaaataccgagcgtaaaaaatgaa

SEQ ID NO: 80689 - DNA, 25 bp, Homo sapien
gtaaataccgagtgtaaaaaatgaa

SEQ ID NO: 80690 - DNA, 25 bp, Homo sapien
gtaaatacgccttaagtaaactaga

SEQ ID NO: 80691 - DNA, 25 bp, Homo sapien
gtaaatactagtagacattcataac

SEQ ID NO: 80692 - DNA, 25 bp, Homo sapien
gtaaatactagtagtcattcataac

SEQ ID NO: 80693 - DNA, 25 bp, Homo sapien
gtaaatagaaaatccgtggacatga

SEQ ID NO: 80694 - DNA, 25 bp, Homo sapien
gtaaatagagaatccgtggacatga

SEQ ID NO: 80695 - DNA, 25 bp, Homo sapien
gtaaatatacccagatacagctgca

SEQ ID NO: 80696 - DNA, 25 bp, Homo sapien
gtaaatatacccagatgcagctgca

SEQ ID NO: 80697 - DNA, 25 bp, Homo sapien
gtaaatataggattaaagtgcaagt

SEQ ID NO: 80698 - DNA, 25 bp, Homo sapien
gtaaatatctcagtgctatttttaa

SEQ ID NO: 80699 - DNA, 25 bp, Homo sapien
gtaaatatgggattaaagtgcaagt

SEQ ID NO: 80700 - DNA, 25 bp, Homo sapien
gtaaatatttcagtgctatttttaa

SEQ ID NO: 80701 - DNA, 25 bp, Homo sapien
gtaaatcactcatcaattccacaac

SEQ ID NO: 80702 - DNA, 25 bp, Homo sapien
gtaaatcactcattaattccacaac

SEQ ID NO: 80703 - DNA, 25 bp, Homo sapien
gtaaatcagttttaaccttgctagc

SEQ ID NO: 80704 - DNA, 25 bp, Homo sapien
gtaaatcagttttaacgttgctagc

SEQ ID NO: 80705 - DNA, 25 bp, Homo sapien
gtaaatcattcaaatccttactatg

SEQ ID NO: 80706 - DNA, 25 bp, Homo sapien
gtaaatcattcgaatccttactatg

SEQ ID NO: 80707 - DNA, 25 bp, Homo sapien
gtaaatcctactacggaatggagag

SEQ ID NO: 80708 - DNA, 25 bp, Homo sapien
gtaaatcctactatggaatggagag

SEQ ID NO: 80709 - DNA, 25 bp, Homo sapien
gtaaatcctcatgaccctgagttaa

SEQ ID NO: 80710 - DNA, 25 bp, Homo sapien
gtaaatcctcatgaccttgagttaa

SEQ ID NO: 80711 - DNA, 25 bp, Homo sapien
gtaaatctgagtcactgattgatgt

SEQ ID NO: 80712 - DNA, 25 bp, Homo sapien
gtaaatctgagtcagtgattgatgt

SEQ ID NO: 80713 - DNA, 25 bp, Homo sapien
gtaaatctgctggcgggattaaagt

SEQ ID NO: 80714 - DNA, 25 bp, Homo sapien
gtaaatctgctggtgggattaaagt

SEQ ID NO: 80715 - DNA, 25 bp, Homo sapien
gtaaatgagtttcagaagagttgtt

SEQ ID NO: 80716 - DNA, 25 bp, Homo sapien
gtaaatgagtttcggaagagttgtt

SEQ ID NO: 80717 - DNA, 25 bp, Homo sapien
gtaaatgctacttaactggtagtta

SEQ ID NO: 80718 - DNA, 25 bp, Homo sapien
gtaaatgcttcttaactggtagtta

SEQ ID NO: 80719 - DNA, 25 bp, Homo sapien
gtaaatggccaaacaaccatatcta

SEQ ID NO: 80720 - DNA, 25 bp, Homo sapien
gtaaatgggcctatggtattttatt

SEQ ID NO: 80721 - DNA, 25 bp, Homo sapien
gtaaatgggtctatggtattttatt

SEQ ID NO: 80722 - DNA, 25 bp, Homo sapien
gtaaatggtcaaacaaccatatcta

SEQ ID NO: 80723 - DNA, 25 bp, Homo sapien
gtaaattatgtacgcacgagataaa

SEQ ID NO: 80724 - DNA, 25 bp, Homo sapien
gtaaattatgtacgcatgagataaa

SEQ ID NO: 80725 - DNA, 25 bp, Homo sapien
gtaaattctgcctgacaaaggactc

SEQ ID NO: 80726 - DNA, 25 bp, Homo sapien
gtaaattctgcctgaccaaggactc

SEQ ID NO: 80727 - DNA, 25 bp, Homo sapien
gtaaattgcatctcgacaaaacttt

SEQ ID NO: 80728 - DNA, 25 bp, Homo sapien
gtaaattggcagtgtgtatggcaca

SEQ ID NO: 80729 - DNA, 25 bp, Homo sapien
gtaaattggtagtgtgtatggcaca

SEQ ID NO: 80730 - DNA, 25 bp, Homo sapien
gtaaattgtatctcgacaaaacttt

SEQ ID NO: 80731 - DNA, 25 bp, Homo sapien
gtaacaaaactgaagggttaggaag

SEQ ID NO: 80732 - DNA, 25 bp, Homo sapien
gtaacaaaatatgttcaagatctgt

SEQ ID NO: 80733 - DNA, 25 bp, Homo sapien
gtaacaaaattgaagggttaggaag

SEQ ID NO: 80734 - DNA, 25 bp, Homo sapien
gtaacaaacctcaaattttcaaagt

SEQ ID NO: 80735 - DNA, 25 bp, Homo sapien
gtaacaaacctcatattttcaaagt

SEQ ID NO: 80736 - DNA, 25 bp, Homo sapien
gtaacaaacgcaagcttagaaccta

SEQ ID NO: 80737 - DNA, 25 bp, Homo sapien
gtaacaaagtatgttcaagatctgt

SEQ ID NO: 80738 - DNA, 25 bp, Homo sapien
gtaacaaagtttcgctaattaagta

SEQ ID NO: 80739 - DNA, 25 bp, Homo sapien
gtaacaaagttttgctaattaagta

SEQ ID NO: 80740 - DNA, 25 bp, Homo sapien
gtaacaaatgatactttaacagcaa

SEQ ID NO: 80741 - DNA, 25 bp, Homo sapien
gtaacaaatgcaagcttagaaccta

SEQ ID NO: 80742 - DNA, 25 bp, Homo sapien
gtaacaaattatactttaacagcaa

SEQ ID NO: 80743 - DNA, 25 bp, Homo sapien
gtaacaagcctacctactgatgcta

SEQ ID NO: 80744 - DNA, 25 bp, Homo sapien
gtaacaagccttcctactgatgcta

SEQ ID NO: 80745 - DNA, 25 bp, Homo sapien
gtaacaagttacgacaaagcagcaa

SEQ ID NO: 80746 - DNA, 25 bp, Homo sapien
gtaacaagttatgacaaagcagcaa

SEQ ID NO: 80747 - DNA, 25 bp, Homo sapien
gtaacacaaagatcaatggatgttt

SEQ ID NO: 80748 - DNA, 25 bp, Homo sapien
gtaacacaaagttcaatggatgttt

SEQ ID NO: 80749 - DNA, 25 bp, Homo sapien
gtaacactgcataattgacctgatt

SEQ ID NO: 80750 - DNA, 25 bp, Homo sapien
gtaacactgcatagttgacctgatt

SEQ ID NO: 80751 - DNA, 25 bp, Homo sapien
gtaacacttatagtaaacattttct

SEQ ID NO: 80752 - DNA, 25 bp, Homo sapien
gtaacacttatattaaacattttct

SEQ ID NO: 80753 - DNA, 25 bp, Homo sapien
gtaacagcaagctctgctttccctt

SEQ ID NO: 80754 - DNA, 25 bp, Homo sapien
gtaacagcattcaccgacaggggag

SEQ ID NO: 80755 - DNA, 25 bp, Homo sapien
gtaacagcattcactgacaggggag

SEQ ID NO: 80756 - DNA, 25 bp, Homo sapien
gtaacagccagaacacagtccatat

SEQ ID NO: 80757 - DNA, 25 bp, Homo sapien
gtaacagccggaacacagtccatat

SEQ ID NO: 80758 - DNA, 25 bp, Homo sapien
gtaacagcgagctctgctttccctt

SEQ ID NO: 80759 - DNA, 25 bp, Homo sapien
gtaacagcttccttctggaccggga

SEQ ID NO: 80760 - DNA, 25 bp, Homo sapien
gtaacagcttctttctggaccggga

SEQ ID NO: 80761 - DNA, 25 bp, Homo sapien
gtaacaggactcggcaacttcttgg

SEQ ID NO: 80762 - DNA, 25 bp, Homo sapien
gtaacaggactcggtaacttcttgg

SEQ ID NO: 80763 - DNA, 25 bp, Homo sapien
gtaacaggattatctcatgattaaa

SEQ ID NO: 80764 - DNA, 25 bp, Homo sapien
gtaacaggattatctcgtgattaaa

SEQ ID NO: 80765 - DNA, 25 bp, Homo sapien
gtaacagggctcatttggttgcaaa

SEQ ID NO: 80766 - DNA, 25 bp, Homo sapien
gtaacagggttcatttggttgcaaa

SEQ ID NO: 80767 - DNA, 25 bp, Homo sapien
gtaacagtccaaaagcggtctctca

SEQ ID NO: 80768 - DNA, 25 bp, Homo sapien
gtaacagtccaaaagctgtctctca

SEQ ID NO: 80769 - DNA, 25 bp, Homo sapien
gtaacagtgtctcgttttccctttt

SEQ ID NO: 80770 - DNA, 25 bp, Homo sapien
gtaacagtgtcttgttttccctttt

SEQ ID NO: 80771 - DNA, 25 bp, Homo sapien
gtaacatctacggatctgtggaggt

SEQ ID NO: 80772 - DNA, 25 bp, Homo sapien
gtaacatctacgtatctgtggaggt

SEQ ID NO: 80773 - DNA, 25 bp, Homo sapien
gtaacatggaggaaatatctactgg

SEQ ID NO: 80774 - DNA, 25 bp, Homo sapien
gtaacatggaggaaatgtctactgg

SEQ ID NO: 80775 - DNA, 25 bp, Homo sapien
gtaacatgtaaatgggcctatggta

SEQ ID NO: 80776 - DNA, 25 bp, Homo sapien
gtaacatgtaaatgggtctatggta

SEQ ID NO: 80777 - DNA, 25 bp, Homo sapien
gtaacattgctaaaagtcctatgca

SEQ ID NO: 80778 - DNA, 25 bp, Homo sapien
gtaacattgctcaaagtcctatgca

SEQ ID NO: 80779 - DNA, 25 bp, Homo sapien
gtaaccaccagaaaaataaattgat

SEQ ID NO: 80780 - DNA, 25 bp, Homo sapien
gtaaccaccagacaaataaattgat

SEQ ID NO: 80781 - DNA, 25 bp, Homo sapien
gtaaccataataggctcattggtca

SEQ ID NO: 80782 - DNA, 25 bp, Homo sapien
gtaaccataatagtctcattggtca

SEQ ID NO: 80783 - DNA, 25 bp, Homo sapien
gtaacccggcatcatggagaaaaat

SEQ ID NO: 80784 - DNA, 25 bp, Homo sapien
gtaacccggcatcctggagaaaaat

SEQ ID NO: 80785 - DNA, 25 bp, Homo sapien
gtaaccgcatcaaaagaaaggtgag

SEQ ID NO: 80786 - DNA, 25 bp, Homo sapien
gtaaccgcatcaaaaggaaggtgag

SEQ ID NO: 80787 - DNA, 25 bp, Homo sapien
gtaacctaagagatgccggatgttc

SEQ ID NO: 80788 - DNA, 25 bp, Homo sapien
gtaacctaagagatgctggatgttc

SEQ ID NO: 80789 - DNA, 25 bp, Homo sapien
gtaacctaccactgaagccaaaatt

SEQ ID NO: 80790 - DNA, 25 bp, Homo sapien
gtaacctaccattgaagccaaaatt

SEQ ID NO: 80791 - DNA, 25 bp, Homo sapien
gtaacctcacggccacttagcaact

SEQ ID NO: 80792 - DNA, 25 bp, Homo sapien
gtaacctcagggccacttagcaact

SEQ ID NO: 80793 - DNA, 25 bp, Homo sapien
gtaacgcaagtagagtacactcaga

SEQ ID NO: 80794 - DNA, 25 bp, Homo sapien
gtaacgcaggtagagtacactcaga

SEQ ID NO: 80795 - DNA, 25 bp, Homo sapien
gtaacgccggagataaacttctttt

SEQ ID NO: 80796 - DNA, 25 bp, Homo sapien
gtaacgcctgagataaacttctttt

SEQ ID NO: 80797 - DNA, 25 bp, Homo sapien
gtaacgtctttcgatgccacattgt

SEQ ID NO: 80798 - DNA, 25 bp, Homo sapien
gtaacgtcttttgatgccacattgt

SEQ ID NO: 80799 - DNA, 25 bp, Homo sapien
gtaactcattggactctagtctcat

SEQ ID NO: 80800 - DNA, 25 bp, Homo sapien
gtaactcattggagtctagtctcat

SEQ ID NO: 80801 - DNA, 25 bp, Homo sapien
gtaactgaatcataggaacagactt

SEQ ID NO: 80802 - DNA, 25 bp, Homo sapien
gtaactgaatcatgggaacagactt

SEQ ID NO: 80803 - DNA, 25 bp, Homo sapien
gtaactgccaataggtaagttctta

SEQ ID NO: 80804 - DNA, 25 bp, Homo sapien
gtaactgccaatagttaagttctta

SEQ ID NO: 80805 - DNA, 25 bp, Homo sapien
gtaacttccttcaaagactgcagtg

SEQ ID NO: 80806 - DNA, 25 bp, Homo sapien
gtaacttccttccaagactgcagtg

SEQ ID NO: 80807 - DNA, 25 bp, Homo sapien
gtaacttctatgtgccaggtacctt

SEQ ID NO: 80808 - DNA, 25 bp, Homo sapien
gtaacttctgtgtgccaggtacctt

SEQ ID NO: 80809 - DNA, 25 bp, Homo sapien
gtaactttaattcttcctacttgac

SEQ ID NO: 80810 - DNA, 25 bp, Homo sapien
gtaactttaatttttcctacttgac

SEQ ID NO: 80811 - DNA, 25 bp, Homo sapien
gtaacttttcgggttggcatttttc

SEQ ID NO: 80812 - DNA, 25 bp, Homo sapien
gtaactttttgggttggcatttttc

SEQ ID NO: 80813 - DNA, 25 bp, Homo sapien
gtaagaaatgccacaggtaagctaa

SEQ ID NO: 80814 - DNA, 25 bp, Homo sapien
gtaagaaatgccacgggtaagctaa

SEQ ID NO: 80815 - DNA, 25 bp, Homo sapien
gtaagaataagaatggtacgtagaa

SEQ ID NO: 80816 - DNA, 25 bp, Homo sapien
gtaagaataagagtggtacgtagaa

SEQ ID NO: 80817 - DNA, 25 bp, Homo sapien
gtaagaatgtacgggcattgaagca

SEQ ID NO: 80818 - DNA, 25 bp, Homo sapien
gtaagaatgtactggcattgaagca

SEQ ID NO: 80819 - DNA, 25 bp, Homo sapien
gtaagactgtaccattcatcattac

SEQ ID NO: 80820 - DNA, 25 bp, Homo sapien
gtaagactttaccattcatcattac

SEQ ID NO: 80821 - DNA, 25 bp, Homo sapien
gtaagagagacttttctaacaatat

SEQ ID NO: 80822 - DNA, 25 bp, Homo sapien
gtaagagaggctttcatgtagtact

SEQ ID NO: 80823 - DNA, 25 bp, Homo sapien
gtaagagatacttttctaacaatat

SEQ ID NO: 80824 - DNA, 25 bp, Homo sapien
gtaagagatgctttcatgtagtact

SEQ ID NO: 80825 - DNA, 25 bp, Homo sapien
gtaagagcataagatcatttttcag

SEQ ID NO: 80826 - DNA, 25 bp, Homo sapien
gtaagagcataagatcgtttttcag

SEQ ID NO: 80827 - DNA, 25 bp, Homo sapien
gtaagagctgaaactgtaaaagtgc

SEQ ID NO: 80828 - DNA, 25 bp, Homo sapien
gtaagagctgaaattgtaaaagtgc

SEQ ID NO: 80829 - DNA, 25 bp, Homo sapien
gtaagaggtagaggttggaaggatt

SEQ ID NO: 80830 - DNA, 25 bp, Homo sapien
gtaagaggtagagtttggaaggatt

SEQ ID NO: 80831 - DNA, 25 bp, Homo sapien
gtaagagttgactcatcattggagg

SEQ ID NO: 80832 - DNA, 25 bp, Homo sapien
gtaagagttgagtcatcattggagg

SEQ ID NO: 80833 - DNA, 25 bp, Homo sapien
gtaagatcggaaaccaactcaagtt

SEQ ID NO: 80834 - DNA, 25 bp, Homo sapien
gtaagatctgaaaccaactcaagtt

SEQ ID NO: 80835 - DNA, 25 bp, Homo sapien
gtaagatgcacatattgtagcttgg

SEQ ID NO: 80836 - DNA, 25 bp, Homo sapien
gtaagatgcacatgttgtagcttgg

SEQ ID NO: 80837 - DNA, 25 bp, Homo sapien
gtaagattacacgaagagttaaaga

SEQ ID NO: 80838 - DNA, 25 bp, Homo sapien
gtaagattacatgaagagttaaaga

SEQ ID NO: 80839 - DNA, 25 bp, Homo sapien
gtaagattcagaaaaaaatgaagaa

SEQ ID NO: 80840 - DNA, 25 bp, Homo sapien
gtaagattcaggaaaaaatgaagaa

SEQ ID NO: 80841 - DNA, 25 bp, Homo sapien
gtaagattccacttacattttatat

SEQ ID NO: 80842 - DNA, 25 bp, Homo sapien
gtaagattccacttgcattttatat

SEQ ID NO: 80843 - DNA, 25 bp, Homo sapien
gtaagatttagttataatgaaagga

SEQ ID NO: 80844 - DNA, 25 bp, Homo sapien
gtaagatttagttctaatgaaagga

SEQ ID NO: 80845 - DNA, 25 bp, Homo sapien
gtaagattttcaaggcagaatgaga

SEQ ID NO: 80846 - DNA, 25 bp, Homo sapien
gtaagattttcagggcagaatgaga

SEQ ID NO: 80847 - DNA, 25 bp, Homo sapien
gtaagcacgatgaccaccttcttac

SEQ ID NO: 80848 - DNA, 25 bp, Homo sapien
gtaagcacgatgatcaccttcttac

SEQ ID NO: 80849 - DNA, 25 bp, Homo sapien
gtaagccaattcctctcttgttctc

SEQ ID NO: 80850 - DNA, 25 bp, Homo sapien
gtaagccacaaggcattgtcatctc

SEQ ID NO: 80851 - DNA, 25 bp, Homo sapien
gtaagccacgaggcattgtcatctc

SEQ ID NO: 80852 - DNA, 25 bp, Homo sapien
gtaagccagttcctctcttgttctc

SEQ ID NO: 80853 - DNA, 25 bp, Homo sapien
gtaagcccagggaaatagtaattgc

SEQ ID NO: 80854 - DNA, 25 bp, Homo sapien
gtaagcccagggaactagtaattgc

SEQ ID NO: 80855 - DNA, 25 bp, Homo sapien
gtaaggaaattagaatccctgtcct

SEQ ID NO: 80856 - DNA, 25 bp, Homo sapien
gtaaggaaattagagtccctgtcct

SEQ ID NO: 80857 - DNA, 25 bp, Homo sapien
gtaaggacacagagagaaggcatct

SEQ ID NO: 80858 - DNA, 25 bp, Homo sapien
gtaaggacacagcgagaaggcatct

SEQ ID NO: 80859 - DNA, 25 bp, Homo sapien
gtaaggacagttctaacggcttcca

SEQ ID NO: 80860 - DNA, 25 bp, Homo sapien
gtaaggacagttctaatggcttcca

SEQ ID NO: 80861 - DNA, 25 bp, Homo sapien
gtaaggaccaatgacacagagttga

SEQ ID NO: 80862 - DNA, 25 bp, Homo sapien
gtaaggaccgatgacacagagttga

SEQ ID NO: 80863 - DNA, 25 bp, Homo sapien
gtaaggagactgattggactttaga

SEQ ID NO: 80864 - DNA, 25 bp, Homo sapien
gtaaggagagaacttccgactgaaa

SEQ ID NO: 80865 - DNA, 25 bp, Homo sapien
gtaaggagagaacttctgactgaaa

SEQ ID NO: 80866 - DNA, 25 bp, Homo sapien
gtaaggagattgattggactttaga

SEQ ID NO: 80867 - DNA, 25 bp, Homo sapien
gtaaggagtagaattaacagaagac

SEQ ID NO: 80868 - DNA, 25 bp, Homo sapien
gtaaggagtagagttaacagaagac

SEQ ID NO: 80869 - DNA, 25 bp, Homo sapien
gtaaggcaaagaacacacagctaca

SEQ ID NO: 80870 - DNA, 25 bp, Homo sapien
gtaaggcaaagaacacgcagctaca

SEQ ID NO: 80871 - DNA, 25 bp, Homo sapien
gtaaggcagagcagtgagtgaatgt

SEQ ID NO: 80872 - DNA, 25 bp, Homo sapien
gtaaggcagagctgtgagtgaatgt

SEQ ID NO: 80873 - DNA, 25 bp, Homo sapien
gtaaggcccaaagtattgattgtca

SEQ ID NO: 80874 - DNA, 25 bp, Homo sapien
gtaaggcccgaagtattgattgtca

SEQ ID NO: 80875 - DNA, 25 bp, Homo sapien
gtaaggctcaccatgtcaactaaca

SEQ ID NO: 80876 - DNA, 25 bp, Homo sapien
gtaaggctcaccgtgtcaactaaca

SEQ ID NO: 80877 - DNA, 25 bp, Homo sapien
gtaagggtttcagattaaacatttt

SEQ ID NO: 80878 - DNA, 25 bp, Homo sapien
gtaagggtttcaggttaaacatttt

SEQ ID NO: 80879 - DNA, 25 bp, Homo sapien
gtaaggtcacaggataaaaggtcaa

SEQ ID NO: 80880 - DNA, 25 bp, Homo sapien
gtaaggtcacaggatacaaggtcaa

SEQ ID NO: 80881 - DNA, 25 bp, Homo sapien
gtaaggtgacatattcacagattct

SEQ ID NO: 80882 - DNA, 25 bp, Homo sapien
gtaaggtgacatattcgcagattct

SEQ ID NO: 80883 - DNA, 25 bp, Homo sapien
gtaaggttgcaacagaagattgaaa

SEQ ID NO: 80884 - DNA, 25 bp, Homo sapien
gtaaggttgcaatagaagattgaaa

SEQ ID NO: 80885 - DNA, 25 bp, Homo sapien
gtaagtagtcagaccggaaatgtac

SEQ ID NO: 80886 - DNA, 25 bp, Homo sapien
gtaagtagtcagactggaaatgtac

SEQ ID NO: 80887 - DNA, 25 bp, Homo sapien
gtaagtcatttcaaattttcactat

SEQ ID NO: 80888 - DNA, 25 bp, Homo sapien
gtaagtcattttaaattttcactat

SEQ ID NO: 80889 - DNA, 25 bp, Homo sapien
gtaagtctaataaagcgtggacatg

SEQ ID NO: 80890 - DNA, 25 bp, Homo sapien
gtaagtctagtaaagcgtggacatg

SEQ ID NO: 80891 - DNA, 25 bp, Homo sapien
gtaagtgctcaaagatatttcctgt

SEQ ID NO: 80892 - DNA, 25 bp, Homo sapien
gtaagtgctcagagatatttcctgt

SEQ ID NO: 80893 - DNA, 25 bp, Homo sapien
gtaagtggacagcctcattctcaag

SEQ ID NO: 80894 - DNA, 25 bp, Homo sapien
gtaagtggacagcctccttctcaag

SEQ ID NO: 80895 - DNA, 25 bp, Homo sapien
gtaagtggtacagctatcattagaa

SEQ ID NO: 80896 - DNA, 25 bp, Homo sapien
gtaagtggtacagttatcattagaa

SEQ ID NO: 80897 - DNA, 25 bp, Homo sapien
gtaagtgtaaacaggtcaaaaaata

SEQ ID NO: 80898 - DNA, 25 bp, Homo sapien
gtaagtgtgaacaggtcaaaaaata

SEQ ID NO: 80899 - DNA, 25 bp, Homo sapien
gtaagttgtctcattatgatttctc

SEQ ID NO: 80900 - DNA, 25 bp, Homo sapien
gtaagttgtctcgttatgatttctc

SEQ ID NO: 80901 - DNA, 25 bp, Homo sapien
gtaataatagcccttgagatcagag

SEQ ID NO: 80902 - DNA, 25 bp, Homo sapien
gtaataattgcccttgagatcagag

SEQ ID NO: 80903 - DNA, 25 bp, Homo sapien
gtaatacactgtggcaacttcagaa

SEQ ID NO: 80904 - DNA, 25 bp, Homo sapien
gtaatacactgtggcagcttcagaa

SEQ ID NO: 80905 - DNA, 25 bp, Homo sapien
gtaatacataggaaatcctggaggc

SEQ ID NO: 80906 - DNA, 25 bp, Homo sapien
gtaatacatgggaaatcctggaggc

SEQ ID NO: 80907 - DNA, 25 bp, Homo sapien
gtaatactagccacatagaataagt

SEQ ID NO: 80908 - DNA, 25 bp, Homo sapien
gtaatactagccacgtagaataagt

SEQ ID NO: 80909 - DNA, 25 bp, Homo sapien
gtaatactattcataacaaccctca

SEQ ID NO: 80910 - DNA, 25 bp, Homo sapien
gtaatactattcctaacaaccctca

SEQ ID NO: 80911 - DNA, 25 bp, Homo sapien
gtaatacttccaatatcatattcat

SEQ ID NO: 80912 - DNA, 25 bp, Homo sapien
gtaatacttccgatatcatattcat

SEQ ID NO: 80913 - DNA, 25 bp, Homo sapien
gtaatagatgctaataaacatttgg

SEQ ID NO: 80914 - DNA, 25 bp, Homo sapien
gtaatagatgctcataaacatttgg

SEQ ID NO: 80915 - DNA, 25 bp, Homo sapien
gtaatagcaaaatgtccttcacttt

SEQ ID NO: 80916 - DNA, 25 bp, Homo sapien
gtaatagcacccctagcatatcttg

SEQ ID NO: 80917 - DNA, 25 bp, Homo sapien
gtaatagcatccctagcatatcttg

SEQ ID NO: 80918 - DNA, 25 bp, Homo sapien
gtaatagcgaaatgtccttcacttt

SEQ ID NO: 80919 - DNA, 25 bp, Homo sapien
gtaatagcttcaacataaaagtcca

SEQ ID NO: 80920 - DNA, 25 bp, Homo sapien
gtaatagcttcaacgtaaaagtcca

SEQ ID NO: 80921 - DNA, 25 bp, Homo sapien
gtaataggacagaactatcattcaa

SEQ ID NO: 80922 - DNA, 25 bp, Homo sapien
gtaataggacagaagtatcattcaa

SEQ ID NO: 80923 - DNA, 25 bp, Homo sapien
gtaatagtaataataatagtagttg

SEQ ID NO: 80924 - DNA, 25 bp, Homo sapien
gtaatagtagtaataatagtagttg

SEQ ID NO: 80925 - DNA, 25 bp, Homo sapien
gtaatagtgacaagctaataaaaaa

SEQ ID NO: 80926 - DNA, 25 bp, Homo sapien
gtaatagtggcaagctaataaaaaa

SEQ ID NO: 80927 - DNA, 25 bp, Homo sapien
gtaatataacattgtttgtgacact

SEQ ID NO: 80928 - DNA, 25 bp, Homo sapien
gtaatataatattgtttgtgacact

SEQ ID NO: 80929 - DNA, 25 bp, Homo sapien
gtaatatagtaacaagttctgggaa

SEQ ID NO: 80930 - DNA, 25 bp, Homo sapien
gtaatatagtaacaggttctgggaa

SEQ ID NO: 80931 - DNA, 25 bp, Homo sapien
gtaatatgcagagtttcacaacata

SEQ ID NO: 80932 - DNA, 25 bp, Homo sapien
gtaatatgcagagttttacaacata

SEQ ID NO: 80933 - DNA, 25 bp, Homo sapien
gtaatatgcataattttggaacaga

SEQ ID NO: 80934 - DNA, 25 bp, Homo sapien
gtaatatgcgtaattttggaacaga

SEQ ID NO: 80935 - DNA, 25 bp, Homo sapien
gtaatattaagaggctttatacact

SEQ ID NO: 80936 - DNA, 25 bp, Homo sapien
gtaatattaagatgctttatacact

SEQ ID NO: 80937 - DNA, 25 bp, Homo sapien
gtaatattcaaatgcccaactgctc

SEQ ID NO: 80938 - DNA, 25 bp, Homo sapien
gtaatattcaagtgcccaactgctc

SEQ ID NO: 80939 - DNA, 25 bp, Homo sapien
gtaatattgcccttgctccaaaata

SEQ ID NO: 80940 - DNA, 25 bp, Homo sapien
gtaatattgcctttgctccaaaata

SEQ ID NO: 80941 - DNA, 25 bp, Homo sapien
gtaatcatcagatccactttttaga

SEQ ID NO: 80942 - DNA, 25 bp, Homo sapien
gtaatcatctgatccactttttaga

SEQ ID NO: 80943 - DNA, 25 bp, Homo sapien
gtaatcccaactgaggacaggagga

SEQ ID NO: 80944 - DNA, 25 bp, Homo sapien
gtaatcccacgtaagtttcgaaaaa

SEQ ID NO: 80945 - DNA, 25 bp, Homo sapien
gtaatcccagctgaggacaggagga

SEQ ID NO: 80946 - DNA, 25 bp, Homo sapien
gtaatcccgcgtaagtttcgaaaaa

SEQ ID NO: 80947 - DNA, 25 bp, Homo sapien
gtaatctcctcactatggaaacatt

SEQ ID NO: 80948 - DNA, 25 bp, Homo sapien
gtaatctcctcactgtggaaacatt

SEQ ID NO: 80949 - DNA, 25 bp, Homo sapien
gtaatgaaagctatttctgaacatg

SEQ ID NO: 80950 - DNA, 25 bp, Homo sapien
gtaatgaaagctatttttgaacatg

SEQ ID NO: 80951 - DNA, 25 bp, Homo sapien
gtaatgaacaaatgaaaaatatgtt

SEQ ID NO: 80952 - DNA, 25 bp, Homo sapien
gtaatgaacaaatggaaaatatgtt

SEQ ID NO: 80953 - DNA, 25 bp, Homo sapien
gtaatgaactatgaaaacattttta

SEQ ID NO: 80954 - DNA, 25 bp, Homo sapien
gtaatgaactatggaaacattttta

SEQ ID NO: 80955 - DNA, 25 bp, Homo sapien
gtaatgaattattgagagttgttca

SEQ ID NO: 80956 - DNA, 25 bp, Homo sapien
gtaatgaattattgagggttgttca

SEQ ID NO: 80957 - DNA, 25 bp, Homo sapien
gtaatgacacaaagatgttatctgg

SEQ ID NO: 80958 - DNA, 25 bp, Homo sapien
gtaatgacacaaatatgttatctgg

SEQ ID NO: 80959 - DNA, 25 bp, Homo sapien
gtaatgaccacaatgcagtctgtta

SEQ ID NO: 80960 - DNA, 25 bp, Homo sapien
gtaatgaccacagtgcagtctgtta

SEQ ID NO: 80961 - DNA, 25 bp, Homo sapien
gtaatgagacctctgtattataact

SEQ ID NO: 80962 - DNA, 25 bp, Homo sapien
gtaatgagacctttgtattataact

SEQ ID NO: 80963 - DNA, 25 bp, Homo sapien
gtaatgagcattatgaagtttaaca

SEQ ID NO: 80964 - DNA, 25 bp, Homo sapien
gtaatgagcattgtgaagtttaaca

SEQ ID NO: 80965 - DNA, 25 bp, Homo sapien
gtaatgcaaaggcgtaatgtggcta

SEQ ID NO: 80966 - DNA, 25 bp, Homo sapien
gtaatgcaaaggtgtaatgtggcta

SEQ ID NO: 80967 - DNA, 25 bp, Homo sapien
gtaatgctacaggcatctagtgagt

SEQ ID NO: 80968 - DNA, 25 bp, Homo sapien
gtaatgctacagggatctagtgagt

SEQ ID NO: 80969 - DNA, 25 bp, Homo sapien
gtaatgctagacacatcgccattgg

SEQ ID NO: 80970 - DNA, 25 bp, Homo sapien
gtaatgctggacacatcgccattgg

SEQ ID NO: 80971 - DNA, 25 bp, Homo sapien
gtaatggtaaaatagctcctttgca

SEQ ID NO: 80972 - DNA, 25 bp, Homo sapien
gtaatggtaaagtagctcctttgca

SEQ ID NO: 80973 - DNA, 25 bp, Homo sapien
gtaatgtcaacttacaaacctctca

SEQ ID NO: 80974 - DNA, 25 bp, Homo sapien
gtaatgtcaacttataaacctctca

SEQ ID NO: 80975 - DNA, 25 bp, Homo sapien
gtaatgtcatcacatttttctttag

SEQ ID NO: 80976 - DNA, 25 bp, Homo sapien
gtaatgtccttcatagtgaaaagat

SEQ ID NO: 80977 - DNA, 25 bp, Homo sapien
gtaatgtcctttatagtgaaaagat

SEQ ID NO: 80978 - DNA, 25 bp, Homo sapien
gtaatgtcgtcacatttttctttag

SEQ ID NO: 80979 - DNA, 25 bp, Homo sapien
gtaatgtgaacagagaagtgaccac

SEQ ID NO: 80980 - DNA, 25 bp, Homo sapien
gtaatgtgaacagataagtgaccac

SEQ ID NO: 80981 - DNA, 25 bp, Homo sapien
gtaatgtgggaagagtctcacttgt

SEQ ID NO: 80982 - DNA, 25 bp, Homo sapien
gtaatgtgggaagattctcacttgt

SEQ ID NO: 80983 - DNA, 25 bp, Homo sapien
gtaattaaagtcatgagagtggaca

SEQ ID NO: 80984 - DNA, 25 bp, Homo sapien
gtaattaaagtgatgagagtggaca

SEQ ID NO: 80985 - DNA, 25 bp, Homo sapien
gtaattaattcatgttccaaaggtg

SEQ ID NO: 80986 - DNA, 25 bp, Homo sapien
gtaattaattcatgttgcaaaggtg

SEQ ID NO: 80987 - DNA, 25 bp, Homo sapien
gtaattaccattaccgtaactgctg

SEQ ID NO: 80988 - DNA, 25 bp, Homo sapien
gtaattaccattactgtaactgctg

SEQ ID NO: 80989 - DNA, 25 bp, Homo sapien
gtaattacctatgtcttttctgcat

SEQ ID NO: 80990 - DNA, 25 bp, Homo sapien
gtaattacctatgtgttttctgcat

SEQ ID NO: 80991 - DNA, 25 bp, Homo sapien
gtaattatcagtgcctatatcctct

SEQ ID NO: 80992 - DNA, 25 bp, Homo sapien
gtaattatcggtgcctatatcctct

SEQ ID NO: 80993 - DNA, 25 bp, Homo sapien
gtaattcaatgcataacatattttc

SEQ ID NO: 80994 - DNA, 25 bp, Homo sapien
gtaattcaatgcgtaacatattttc

SEQ ID NO: 80995 - DNA, 25 bp, Homo sapien
gtaattcctgacattgagcttcact

SEQ ID NO: 80996 - DNA, 25 bp, Homo sapien
gtaattcctgacgttgagcttcact

SEQ ID NO: 80997 - DNA, 25 bp, Homo sapien
gtaattgccactttcatggactagt

SEQ ID NO: 80998 - DNA, 25 bp, Homo sapien
gtaattgccacttttatggactagt

SEQ ID NO: 80999 - DNA, 25 bp, Homo sapien
gtaattgggaaagacatattcagca

SEQ ID NO: 81000 - DNA, 25 bp, Homo sapien
gtaattgggaaagatatattcagca

SEQ ID NO: 81001 - DNA, 25 bp, Homo sapien
gtaatttacccaacatcacatagct

SEQ ID NO: 81002 - DNA, 25 bp, Homo sapien
gtaatttacccatcatcacatagct

SEQ ID NO: 81003 - DNA, 25 bp, Homo sapien
gtaatttactgaaaacggaactgaa

SEQ ID NO: 81004 - DNA, 25 bp, Homo sapien
gtaatttactgaaaactgaactgaa

SEQ ID NO: 81005 - DNA, 25 bp, Homo sapien
gtaatttagatctcagtaaaaagaa

SEQ ID NO: 81006 - DNA, 25 bp, Homo sapien
gtaatttagatctctgtaaaaagaa

SEQ ID NO: 81007 - DNA, 25 bp, Homo sapien
gtaatttgcacacgtggagggaggg

SEQ ID NO: 81008 - DNA, 25 bp, Homo sapien
gtaatttgcacatgtggagggaggg

SEQ ID NO: 81009 - DNA, 25 bp, Homo sapien
gtaattttaaacaatcaaacatgga

SEQ ID NO: 81010 - DNA, 25 bp, Homo sapien
gtaattttaaacgatcaaacatgga

SEQ ID NO: 81011 - DNA, 25 bp, Homo sapien
gtaattttcactttgaagtcttttt

SEQ ID NO: 81012 - DNA, 25 bp, Homo sapien
gtaattttcacttttaagtcttttt

SEQ ID NO: 81013 - DNA, 25 bp, Homo sapien
gtaattttcattgctctccttgagc

SEQ ID NO: 81014 - DNA, 25 bp, Homo sapien
gtaattttcgttgctctccttgagc

SEQ ID NO: 81015 - DNA, 25 bp, Homo sapien
gtacaaaaagaaccagataaatgat

SEQ ID NO: 81016 - DNA, 25 bp, Homo sapien
gtacaaaaagaatcagataaatgat

SEQ ID NO: 81017 - DNA, 25 bp, Homo sapien
gtacaaaacaatagaaaagtgggcc

SEQ ID NO: 81018 - DNA, 25 bp, Homo sapien
gtacaaaagaaaagagagatattga

SEQ ID NO: 81019 - DNA, 25 bp, Homo sapien
gtacaaaagaatagaaaagtgggcc

SEQ ID NO: 81020 - DNA, 25 bp, Homo sapien
gtacaaaaggaaagagagatattga

SEQ ID NO: 81021 - DNA, 25 bp, Homo sapien
gtacaaacaagcccggacagtgaag

SEQ ID NO: 81022 - DNA, 25 bp, Homo sapien
gtacaaacaagcctggacagtgaag

SEQ ID NO: 81023 - DNA, 25 bp, Homo sapien
gtacaaacattcccaaagctgagca

SEQ ID NO: 81024 - DNA, 25 bp, Homo sapien
gtacaaacattcccaacgctgagca

SEQ ID NO: 81025 - DNA, 25 bp, Homo sapien
gtacaagataatgccgctgtgctat

SEQ ID NO: 81026 - DNA, 25 bp, Homo sapien
gtacaagataatgctgctgtgctat

SEQ ID NO: 81027 - DNA, 25 bp, Homo sapien
gtacaagatattcagttcctcagcc

SEQ ID NO: 81028 - DNA, 25 bp, Homo sapien
gtacaagatattcggttcctcagcc

SEQ ID NO: 81029 - DNA, 25 bp, Homo sapien
gtacaagggaacacataaactgagg

SEQ ID NO: 81030 - DNA, 25 bp, Homo sapien
gtacaagggaacatataaactgagg

SEQ ID NO: 81031 - DNA, 25 bp, Homo sapien
gtacaagtcaacggaatataataca

SEQ ID NO: 81032 - DNA, 25 bp, Homo sapien
gtacaagtcaatggaatataataca

SEQ ID NO: 81033 - DNA, 25 bp, Homo sapien
gtacaagtgcaaagccatgttcaat

SEQ ID NO: 81034 - DNA, 25 bp, Homo sapien
gtacaagttcaaagccatgttcaat

SEQ ID NO: 81035 - DNA, 25 bp, Homo sapien
gtacaatgcagcatattaaaattgc

SEQ ID NO: 81036 - DNA, 25 bp, Homo sapien
gtacaatgcagcgtattaaaattgc

SEQ ID NO: 81037 - DNA, 25 bp, Homo sapien
gtacaattacacccatctgtggaaa

SEQ ID NO: 81038 - DNA, 25 bp, Homo sapien
gtacaattacacccgtctgtggaaa

SEQ ID NO: 81039 - DNA, 25 bp, Homo sapien
gtacacaagctggtttcttacttaa

SEQ ID NO: 81040 - DNA, 25 bp, Homo sapien
gtacacaagctggttttttacttaa

SEQ ID NO: 81041 - DNA, 25 bp, Homo sapien
gtacacacaggatagacagttatat

SEQ ID NO: 81042 - DNA, 25 bp, Homo sapien
gtacacacaggatggacagttatat

SEQ ID NO: 81043 - DNA, 25 bp, Homo sapien
gtacacaggtactgaaacatcacac

SEQ ID NO: 81044 - DNA, 25 bp, Homo sapien
gtacacaggtattgaaacatcacac

SEQ ID NO: 81045 - DNA, 25 bp, Homo sapien
gtacacccatcagacggagagttgg

SEQ ID NO: 81046 - DNA, 25 bp, Homo sapien
gtacacccatcagatggagagttgg

SEQ ID NO: 81047 - DNA, 25 bp, Homo sapien
gtacactcaataaaacctgttaata

SEQ ID NO: 81048 - DNA, 25 bp, Homo sapien
gtacactcaataaatcctgttaata

SEQ ID NO: 81049 - DNA, 25 bp, Homo sapien
gtacactgcagcattgttgactgta

SEQ ID NO: 81050 - DNA, 25 bp, Homo sapien
gtacactgtacattcaatgtttttt

SEQ ID NO: 81051 - DNA, 25 bp, Homo sapien
gtacactgtacattcattgtttttt

SEQ ID NO: 81052 - DNA, 25 bp, Homo sapien
gtacactgtagcattgttgactgta

SEQ ID NO: 81053 - DNA, 25 bp, Homo sapien
gtacagaaagcagagttattcatcc

SEQ ID NO: 81054 - DNA, 25 bp, Homo sapien
gtacagaaagctaattaaaagtttg

SEQ ID NO: 81055 - DNA, 25 bp, Homo sapien
gtacagaactctttaattataccag

SEQ ID NO: 81056 - DNA, 25 bp, Homo sapien
gtacagaaggcagagttattcatcc

SEQ ID NO: 81057 - DNA, 25 bp, Homo sapien
gtacagaatgctaattaaaagtttg

SEQ ID NO: 81058 - DNA, 25 bp, Homo sapien
gtacagaattctttaattataccag

SEQ ID NO: 81059 - DNA, 25 bp, Homo sapien
gtacagagaagcagaagataaaaag

SEQ ID NO: 81060 - DNA, 25 bp, Homo sapien
gtacagagaagcggaagataaaaag

SEQ ID NO: 81061 - DNA, 25 bp, Homo sapien
gtacagagaatctcatttcttgact

SEQ ID NO: 81062 - DNA, 25 bp, Homo sapien
gtacagagaatctcgtttcttgact

SEQ ID NO: 81063 - DNA, 25 bp, Homo sapien
gtacagatgataagaaacatttgag

SEQ ID NO: 81064 - DNA, 25 bp, Homo sapien
gtacagatgataaggaacatttgag

SEQ ID NO: 81065 - DNA, 25 bp, Homo sapien
gtacagccttgctgacagcttgatt

SEQ ID NO: 81066 - DNA, 25 bp, Homo sapien
gtacagccttgttgacagcttgatt

SEQ ID NO: 81067 - DNA, 25 bp, Homo sapien
gtacaggaaggttgtgcgtttaatc

SEQ ID NO: 81068 - DNA, 25 bp, Homo sapien
gtacaggaaggttgtgtgtttaatc

SEQ ID NO: 81069 - DNA, 25 bp, Homo sapien
gtacaggcaactaaagaatgatttg

SEQ ID NO: 81070 - DNA, 25 bp, Homo sapien
gtacaggcagctaaagaatgatttg

SEQ ID NO: 81071 - DNA, 25 bp, Homo sapien
gtacagggagtagagcagcttctgc

SEQ ID NO: 81072 - DNA, 25 bp, Homo sapien
gtacagggagtatagcagcttctgc

SEQ ID NO: 81073 - DNA, 25 bp, Homo sapien
gtacagtccacaaacatgagtgtct

SEQ ID NO: 81074 - DNA, 25 bp, Homo sapien
gtacagtccacaaatatgagtgtct

SEQ ID NO: 81075 - DNA, 25 bp, Homo sapien
gtacagtgcttacaggcagtttctt

SEQ ID NO: 81076 - DNA, 25 bp, Homo sapien
gtacagtgcttataggcagtttctt

SEQ ID NO: 81077 - DNA, 25 bp, Homo sapien
gtacagtgtttgtgttgtacgctgt

SEQ ID NO: 81078 - DNA, 25 bp, Homo sapien
gtacagtgtttgtgttttacgctgt

SEQ ID NO: 81079 - DNA, 25 bp, Homo sapien
gtacagttaaaacacagtatgcatg

SEQ ID NO: 81080 - DNA, 25 bp, Homo sapien
gtacagttaaaacatagtatgcatg

SEQ ID NO: 81081 - DNA, 25 bp, Homo sapien
gtacataaatgcagccagagagaat

SEQ ID NO: 81082 - DNA, 25 bp, Homo sapien
gtacataaatgcagcccgagagaat

SEQ ID NO: 81083 - DNA, 25 bp, Homo sapien
gtacataggttaatgacaagtggaa

SEQ ID NO: 81084 - DNA, 25 bp, Homo sapien
gtacatagtttaatgacaagtggaa

SEQ ID NO: 81085 - DNA, 25 bp, Homo sapien
gtacatattatgcacagttggattt

SEQ ID NO: 81086 - DNA, 25 bp, Homo sapien
gtacatattatgcccagttggattt

SEQ ID NO: 81087 - DNA, 25 bp, Homo sapien
gtacatccaactcgttgttttccat

SEQ ID NO: 81088 - DNA, 25 bp, Homo sapien
gtacatccacctcgttgttttccat

SEQ ID NO: 81089 - DNA, 25 bp, Homo sapien
gtacatcctcattcagaagcagtca

SEQ ID NO: 81090 - DNA, 25 bp, Homo sapien
gtacatcctcattgagaagcagtca

SEQ ID NO: 81091 - DNA, 25 bp, Homo sapien
gtacatctccgcataagtcatattt

SEQ ID NO: 81092 - DNA, 25 bp, Homo sapien
gtacatctccgcatgagtcatattt

SEQ ID NO: 81093 - DNA, 25 bp, Homo sapien
gtacatcttaaaaattgacattatg

SEQ ID NO: 81094 - DNA, 25 bp, Homo sapien
gtacatcttgaaaattgacattatg

SEQ ID NO: 81095 - DNA, 25 bp, Homo sapien
gtacatgctcaaacattcatccaga

SEQ ID NO: 81096 - DNA, 25 bp, Homo sapien
gtacatgctcaagcattcatccaga

SEQ ID NO: 81097 - DNA, 25 bp, Homo sapien
gtacattaattcaacaagcacatat

SEQ ID NO: 81098 - DNA, 25 bp, Homo sapien
gtacattaattcagcaagcacatat

SEQ ID NO: 81099 - DNA, 25 bp, Homo sapien
gtacattcaatgttttttggggttt

SEQ ID NO: 81100 - DNA, 25 bp, Homo sapien
gtacattcattgttttttggggttt

SEQ ID NO: 81101 - DNA, 25 bp, Homo sapien
gtacatttaaagagccatgattatt

SEQ ID NO: 81102 - DNA, 25 bp, Homo sapien
gtacatttaaagagccgtgattatt

SEQ ID NO: 81103 - DNA, 25 bp, Homo sapien
gtacatttccgggtcggctaatttc

SEQ ID NO: 81104 - DNA, 25 bp, Homo sapien
gtacatttctgggtcggctaatttc

SEQ ID NO: 81105 - DNA, 25 bp, Homo sapien
gtacatttgttacaagtaatgggct

SEQ ID NO: 81106 - DNA, 25 bp, Homo sapien
gtacatttgttgcaagtaatgggct

SEQ ID NO: 81107 - DNA, 25 bp, Homo sapien
gtacattttcaaaatgccctttgca

SEQ ID NO: 81108 - DNA, 25 bp, Homo sapien
gtacattttcaaaatgtcctttgca

SEQ ID NO: 81109 - DNA, 25 bp, Homo sapien
gtacattttcaggctccttaagtct

SEQ ID NO: 81110 - DNA, 25 bp, Homo sapien
gtacattttcaggctcgttaagtct

SEQ ID NO: 81111 - DNA, 25 bp, Homo sapien
gtacattttcatagcttatcttttc

SEQ ID NO: 81112 - DNA, 25 bp, Homo sapien
gtacattttgatagcttatcttttc

SEQ ID NO: 81113 - DNA, 25 bp, Homo sapien
gtaccaagctggtccaatcagagtt

SEQ ID NO: 81114 - DNA, 25 bp, Homo sapien
gtaccaagttggtccaatcagagtt

SEQ ID NO: 81115 - DNA, 25 bp, Homo sapien
gtaccaatagctctatataatagta

SEQ ID NO: 81116 - DNA, 25 bp, Homo sapien
gtaccaatagctgtatataatagta

SEQ ID NO: 81117 - DNA, 25 bp, Homo sapien
gtaccaatgatcctatatttgtgtg

SEQ ID NO: 81118 - DNA, 25 bp, Homo sapien
gtaccaatgattctatatttgtgtg

SEQ ID NO: 81119 - DNA, 25 bp, Homo sapien
gtaccaattataatgctgttaaaaa

SEQ ID NO: 81120 - DNA, 25 bp, Homo sapien
gtaccaattatactgctgttaaaaa

SEQ ID NO: 81121 - DNA, 25 bp, Homo sapien
gtaccacatggaaatttgtgcccct

SEQ ID NO: 81122 - DNA, 25 bp, Homo sapien
gtaccacatggaagtttgtgcccct

SEQ ID NO: 81123 - DNA, 25 bp, Homo sapien
gtaccaggctgccctgcttgtgcct

SEQ ID NO: 81124 - DNA, 25 bp, Homo sapien
gtaccaggctgccctgtttgtgcct

SEQ ID NO: 81125 - DNA, 25 bp, Homo sapien
gtaccagtcagagtcatgaggcccc

SEQ ID NO: 81126 - DNA, 25 bp, Homo sapien
gtaccagtccgagtcatgaggcccc

SEQ ID NO: 81127 - DNA, 25 bp, Homo sapien
gtaccagtgtgcaacaggactttgg

SEQ ID NO: 81128 - DNA, 25 bp, Homo sapien
gtaccagtgtgcaataggactttgg

SEQ ID NO: 81129 - DNA, 25 bp, Homo sapien
gtaccataatgagacaagagagtag

SEQ ID NO: 81130 - DNA, 25 bp, Homo sapien
gtaccataatgagacaggagagtag

SEQ ID NO: 81131 - DNA, 25 bp, Homo sapien
gtaccattgcaacttggaaggaatt

SEQ ID NO: 81132 - DNA, 25 bp, Homo sapien
gtaccattgtaacttggaaggaatt

SEQ ID NO: 81133 - DNA, 25 bp, Homo sapien
gtaccattttcacataaagcatgca

SEQ ID NO: 81134 - DNA, 25 bp, Homo sapien
gtaccattttcatataaagcatgca

SEQ ID NO: 81135 - DNA, 25 bp, Homo sapien
gtaccccagcgggttcaacaggtaa

SEQ ID NO: 81136 - DNA, 25 bp, Homo sapien
gtaccccagtgggttcaacaggtaa

SEQ ID NO: 81137 - DNA, 25 bp, Homo sapien
gtaccctcatacacagctactgggg

SEQ ID NO: 81138 - DNA, 25 bp, Homo sapien
gtaccctcatacaccgctactgggg

SEQ ID NO: 81139 - DNA, 25 bp, Homo sapien
gtaccctcttgccaaggttgatgga

SEQ ID NO: 81140 - DNA, 25 bp, Homo sapien
gtaccctcttgccaagtttgatgga

SEQ ID NO: 81141 - DNA, 25 bp, Homo sapien
gtacccttacttgaccactctgatt

SEQ ID NO: 81142 - DNA, 25 bp, Homo sapien
gtacccttactttaccactctgatt

SEQ ID NO: 81143 - DNA, 25 bp, Homo sapien
gtacctaacagcatatgtatcagca

SEQ ID NO: 81144 - DNA, 25 bp, Homo sapien
gtacctaaccgcatatgtatcagca

SEQ ID NO: 81145 - DNA, 25 bp, Homo sapien
gtacctactgcaaatggcttctcct

SEQ ID NO: 81146 - DNA, 25 bp, Homo sapien
gtacctactgcatatggcttctcct

SEQ ID NO: 81147 - DNA, 25 bp, Homo sapien
gtacctccactataccatgcctctt

SEQ ID NO: 81148 - DNA, 25 bp, Homo sapien
gtacctccactgaattaaagattta

SEQ ID NO: 81149 - DNA, 25 bp, Homo sapien
gtacctccattgaattaaagattta

SEQ ID NO: 81150 - DNA, 25 bp, Homo sapien
gtacctccgctataccatgcctctt

SEQ ID NO: 81151 - DNA, 25 bp, Homo sapien
gtacctgccacctcggcatccaata

SEQ ID NO: 81152 - DNA, 25 bp, Homo sapien
gtacctgcctcctcggcatccaata

SEQ ID NO: 81153 - DNA, 25 bp, Homo sapien
gtacctgcgctaagagaagttttat

SEQ ID NO: 81154 - DNA, 25 bp, Homo sapien
gtacctgctctaagagaagttttat

SEQ ID NO: 81155 - DNA, 25 bp, Homo sapien
gtacctgggcagatgcaaagagctg

SEQ ID NO: 81156 - DNA, 25 bp, Homo sapien
gtacctgggcaggtgcaaagagctg

SEQ ID NO: 81157 - DNA, 25 bp, Homo sapien
gtacctgtagttcctgttacttagg

SEQ ID NO: 81158 - DNA, 25 bp, Homo sapien
gtacctgtagttcttgttacttagg

SEQ ID NO: 81159 - DNA, 25 bp, Homo sapien
gtaccttagttgttacatcttcaaa

SEQ ID NO: 81160 - DNA, 25 bp, Homo sapien
gtaccttagtttttacatcttcaaa

SEQ ID NO: 81161 - DNA, 25 bp, Homo sapien
gtaccttggaggagttttcgtcatg

SEQ ID NO: 81162 - DNA, 25 bp, Homo sapien
gtaccttggtggagttttcgtcatg

SEQ ID NO: 81163 - DNA, 25 bp, Homo sapien
gtacgacaaagactactccaataag

SEQ ID NO: 81164 - DNA, 25 bp, Homo sapien
gtacgacaaaggctactccaataag

SEQ ID NO: 81165 - DNA, 25 bp, Homo sapien
gtacgataccataatggtggataca

SEQ ID NO: 81166 - DNA, 25 bp, Homo sapien
gtacgatatcataatggtggataca

SEQ ID NO: 81167 - DNA, 25 bp, Homo sapien
gtacgctgaggacattgagtgatct

SEQ ID NO: 81168 - DNA, 25 bp, Homo sapien
gtacgctgaggatattgagtgatct

SEQ ID NO: 81169 - DNA, 25 bp, Homo sapien
gtacggatgagtaaagcacatggac

SEQ ID NO: 81170 - DNA, 25 bp, Homo sapien
gtacggatgtgtaaagcacatggac

SEQ ID NO: 81171 - DNA, 25 bp, Homo sapien
gtacggtagacactgatgtgttata

SEQ ID NO: 81172 - DNA, 25 bp, Homo sapien
gtacggtagacattgatgtgttata

SEQ ID NO: 81173 - DNA, 25 bp, Homo sapien
gtacggtgttcatcaattcctatgg

SEQ ID NO: 81174 - DNA, 25 bp, Homo sapien
gtacggtgttcgtcaattcctatgg

SEQ ID NO: 81175 - DNA, 25 bp, Homo sapien
gtacgtaccaattataatgctgtta

SEQ ID NO: 81176 - DNA, 25 bp, Homo sapien
gtacgtaccaattatactgctgtta

SEQ ID NO: 81177 - DNA, 25 bp, Homo sapien
gtactaaatagcttacatttcagag

SEQ ID NO: 81178 - DNA, 25 bp, Homo sapien
gtactaaatagcttgcatttcagag

SEQ ID NO: 81179 - DNA, 25 bp, Homo sapien
gtactaacatgaaccaggaaaagct

SEQ ID NO: 81180 - DNA, 25 bp, Homo sapien
gtactaacatgaactaggaaaagct

SEQ ID NO: 81181 - DNA, 25 bp, Homo sapien
gtactaattaccaccaaagaatgtg

SEQ ID NO: 81182 - DNA, 25 bp, Homo sapien
gtactaattaccatcaaagaatgtg

SEQ ID NO: 81183 - DNA, 25 bp, Homo sapien
gtactagctctgtcataagagtcac

SEQ ID NO: 81184 - DNA, 25 bp, Homo sapien
gtactagctctgtcgtaagagtcac

SEQ ID NO: 81185 - DNA, 25 bp, Homo sapien
gtactaggtactacggaggagacaa

SEQ ID NO: 81186 - DNA, 25 bp, Homo sapien
gtactaggtactatggaggagacaa

SEQ ID NO: 81187 - DNA, 25 bp, Homo sapien
gtactatggtgtaatactagatccc

SEQ ID NO: 81188 - DNA, 25 bp, Homo sapien
gtactatggtgtgatactagatccc

SEQ ID NO: 81189 - DNA, 25 bp, Homo sapien
gtactattaattatccactttataa

SEQ ID NO: 81190 - DNA, 25 bp, Homo sapien
gtactattatttatccactttataa

SEQ ID NO: 81191 - DNA, 25 bp, Homo sapien
gtactattcccacgacaaaactggc

SEQ ID NO: 81192 - DNA, 25 bp, Homo sapien
gtactattcccaggacaaaactggc

SEQ ID NO: 81193 - DNA, 25 bp, Homo sapien
gtactatttgcttaaaaaggaatgc

SEQ ID NO: 81194 - DNA, 25 bp, Homo sapien
gtactatttgcttgaaaaggaatgc

SEQ ID NO: 81195 - DNA, 25 bp, Homo sapien
gtactcaattagacatttgtcagca

SEQ ID NO: 81196 - DNA, 25 bp, Homo sapien
gtactcaattagacttttgtcagca

SEQ ID NO: 81197 - DNA, 25 bp, Homo sapien
gtactcacaatcacttaattgccct

SEQ ID NO: 81198 - DNA, 25 bp, Homo sapien
gtactcacattcacttaattgccct

SEQ ID NO: 81199 - DNA, 25 bp, Homo sapien
gtactcatacacttgacaacatgtg

SEQ ID NO: 81200 - DNA, 25 bp, Homo sapien
gtactcatagacttgacaacatgtg

SEQ ID NO: 81201 - DNA, 25 bp, Homo sapien
gtactctcacgacacattgtatgta

SEQ ID NO: 81202 - DNA, 25 bp, Homo sapien
gtactctcacgacgcattgtatgta

SEQ ID NO: 81203 - DNA, 25 bp, Homo sapien
gtactctccacgccataatttgtaa

SEQ ID NO: 81204 - DNA, 25 bp, Homo sapien
gtactctccacggcataatttgtaa

SEQ ID NO: 81205 - DNA, 25 bp, Homo sapien
gtactctttcttgaatttaatatac

SEQ ID NO: 81206 - DNA, 25 bp, Homo sapien
gtactctttcttgattttaatatac

SEQ ID NO: 81207 - DNA, 25 bp, Homo sapien
gtactgaacgatgcaggctatcttc

SEQ ID NO: 81208 - DNA, 25 bp, Homo sapien
gtactgaaggcttgaaacttccagg

SEQ ID NO: 81209 - DNA, 25 bp, Homo sapien
gtactgaaggcttgcaacttccagg

SEQ ID NO: 81210 - DNA, 25 bp, Homo sapien
gtactgaatgatgcaggctatcttc

SEQ ID NO: 81211 - DNA, 25 bp, Homo sapien
gtactgacactggcccaggtccgat

SEQ ID NO: 81212 - DNA, 25 bp, Homo sapien
gtactgacgctggcccaggtccgat

SEQ ID NO: 81213 - DNA, 25 bp, Homo sapien
gtactgatatattggaacaattaat

SEQ ID NO: 81214 - DNA, 25 bp, Homo sapien
gtactgatatattgtaacaattaat

SEQ ID NO: 81215 - DNA, 25 bp, Homo sapien
gtactggagtagacacactaacaca

SEQ ID NO: 81216 - DNA, 25 bp, Homo sapien
gtactggagtagacaccctaacaca

SEQ ID NO: 81217 - DNA, 25 bp, Homo sapien
gtactggatctaatcttatttatgc

SEQ ID NO: 81218 - DNA, 25 bp, Homo sapien
gtactggatctcatcttatttatgc

SEQ ID NO: 81219 - DNA, 25 bp, Homo sapien
gtactggtacaatacaaacacataa

SEQ ID NO: 81220 - DNA, 25 bp, Homo sapien
gtactggtacaatacagacacataa

SEQ ID NO: 81221 - DNA, 25 bp, Homo sapien
gtactgtcaccaccagataacaaca

SEQ ID NO: 81222 - DNA, 25 bp, Homo sapien
gtactgtcaccactagataacaaca

SEQ ID NO: 81223 - DNA, 25 bp, Homo sapien
gtactgtgttcaatctttggttact

SEQ ID NO: 81224 - DNA, 25 bp, Homo sapien
gtactgtgttcagtctttggttact

SEQ ID NO: 81225 - DNA, 25 bp, Homo sapien
gtacttacagcagttacacagtagt

SEQ ID NO: 81226 - DNA, 25 bp, Homo sapien
gtacttacagcggttacacagtagt

SEQ ID NO: 81227 - DNA, 25 bp, Homo sapien
gtacttagtgagtcaaattcgacca

SEQ ID NO: 81228 - DNA, 25 bp, Homo sapien
gtacttagtgagttaaattcgacca

SEQ ID NO: 81229 - DNA, 25 bp, Homo sapien
gtacttcctagagacggccggagcc

SEQ ID NO: 81230 - DNA, 25 bp, Homo sapien
gtacttcctagagatggccggagcc

SEQ ID NO: 81231 - DNA, 25 bp, Homo sapien
gtacttcctgaacgtagccctgctg

SEQ ID NO: 81232 - DNA, 25 bp, Homo sapien
gtacttcctgaatgtagccctgctg

SEQ ID NO: 81233 - DNA, 25 bp, Homo sapien
gtacttcctgtcagtcaggcagagg

SEQ ID NO: 81234 - DNA, 25 bp, Homo sapien
gtacttcctgttagtcaggcagagg

SEQ ID NO: 81235 - DNA, 25 bp, Homo sapien
gtacttctagacagctgctttttac

SEQ ID NO: 81236 - DNA, 25 bp, Homo sapien
gtacttctagacagttgctttttac

SEQ ID NO: 81237 - DNA, 25 bp, Homo sapien
gtacttctcattaacatgcaatcat

SEQ ID NO: 81238 - DNA, 25 bp, Homo sapien
gtacttctcattaatatgcaatcat

SEQ ID NO: 81239 - DNA, 25 bp, Homo sapien
gtacttcttaaaatattactatgca

SEQ ID NO: 81240 - DNA, 25 bp, Homo sapien
gtacttcttaaagtattactatgca

SEQ ID NO: 81241 - DNA, 25 bp, Homo sapien
gtacttctttgctccacagctacta

SEQ ID NO: 81242 - DNA, 25 bp, Homo sapien
gtacttctttgctccatagctacta

SEQ ID NO: 81243 - DNA, 25 bp, Homo sapien
gtacttgaaaccaggacctggaact

SEQ ID NO: 81244 - DNA, 25 bp, Homo sapien
gtacttgaagccaggacctggaact

SEQ ID NO: 81245 - DNA, 25 bp, Homo sapien
gtacttgacagtgtcctcaataaaa

SEQ ID NO: 81246 - DNA, 25 bp, Homo sapien
gtacttgacggtgtcctcaataaaa

SEQ ID NO: 81247 - DNA, 25 bp, Homo sapien
gtacttgcatccaagaggtccagcc

SEQ ID NO: 81248 - DNA, 25 bp, Homo sapien
gtacttgcatcctagaggtccagcc

SEQ ID NO: 81249 - DNA, 25 bp, Homo sapien
gtacttgtcactcaagtaatgccta

SEQ ID NO: 81250 - DNA, 25 bp, Homo sapien
gtacttgtcacttaagtaatgccta

SEQ ID NO: 81251 - DNA, 25 bp, Homo sapien
gtactttgcattgtaggatcagagt

SEQ ID NO: 81252 - DNA, 25 bp, Homo sapien
gtactttgcattgtgggatcagagt

SEQ ID NO: 81253 - DNA, 25 bp, Homo sapien
gtactttgtatttcaatcattttga

SEQ ID NO: 81254 - DNA, 25 bp, Homo sapien
gtactttgtattttaatcattttga

SEQ ID NO: 81255 - DNA, 25 bp, Homo sapien
gtacttttcttttggtggccacaag

SEQ ID NO: 81256 - DNA, 25 bp, Homo sapien
gtactttttagcagttaagtccact

SEQ ID NO: 81257 - DNA, 25 bp, Homo sapien
gtactttttcgcagttaagtccact

SEQ ID NO: 81258 - DNA, 25 bp, Homo sapien
gtactttttgccatccactctattt

SEQ ID NO: 81259 - DNA, 25 bp, Homo sapien
gtactttttgccattcactctattt

SEQ ID NO: 81260 - DNA, 25 bp, Homo sapien
gtactttttttttggtggccacaag

SEQ ID NO: 81261 - DNA, 25 bp, Homo sapien
gtagaaaaatatacggttggaagga

SEQ ID NO: 81262 - DNA, 25 bp, Homo sapien
gtagaaaaatatatggttggaagga

SEQ ID NO: 81263 - DNA, 25 bp, Homo sapien
gtagaaaatgttacctctgatccct

SEQ ID NO: 81264 - DNA, 25 bp, Homo sapien
gtagaaaatgttacctttgatccct

SEQ ID NO: 81265 - DNA, 25 bp, Homo sapien
gtagaaatgcttggagataaaattg

SEQ ID NO: 81266 - DNA, 25 bp, Homo sapien
gtagaaatgtaccaggtaatcatca

SEQ ID NO: 81267 - DNA, 25 bp, Homo sapien
gtagaaatgtacgaggtaatcatca

SEQ ID NO: 81268 - DNA, 25 bp, Homo sapien
gtagaaattcttggagataaaattg

SEQ ID NO: 81269 - DNA, 25 bp, Homo sapien
gtagaacatacacatttctcatgct

SEQ ID NO: 81270 - DNA, 25 bp, Homo sapien
gtagaacatacccatttctcatgct

SEQ ID NO: 81271 - DNA, 25 bp, Homo sapien
gtagaacgtcacttgatccttggat

SEQ ID NO: 81272 - DNA, 25 bp, Homo sapien
gtagaacgttacttgatccttggat

SEQ ID NO: 81273 - DNA, 25 bp, Homo sapien
gtagaagacaggaatgctgctatat

SEQ ID NO: 81274 - DNA, 25 bp, Homo sapien
gtagaagacagggatgctgctatat

SEQ ID NO: 81275 - DNA, 25 bp, Homo sapien
gtagaagagccaggtaatagccatc

SEQ ID NO: 81276 - DNA, 25 bp, Homo sapien
gtagaagaggaaaatatgatctcag

SEQ ID NO: 81277 - DNA, 25 bp, Homo sapien
gtagaagaggacaatatgatctcag

SEQ ID NO: 81278 - DNA, 25 bp, Homo sapien
gtagaagatccaggtaatagccatc

SEQ ID NO: 81279 - DNA, 25 bp, Homo sapien
gtagaagctgcagaaaacacatagc

SEQ ID NO: 81280 - DNA, 25 bp, Homo sapien
gtagaagctgcagcaaacacatagc

SEQ ID NO: 81281 - DNA, 25 bp, Homo sapien
gtagaagctgtgtgctaaacctaac

SEQ ID NO: 81282 - DNA, 25 bp, Homo sapien
gtagaagctgtgtgttaaacctaac

SEQ ID NO: 81283 - DNA, 25 bp, Homo sapien
gtagaaggcgcttaccatatttcag

SEQ ID NO: 81284 - DNA, 25 bp, Homo sapien
gtagaaggtgcttaccatatttcag

SEQ ID NO: 81285 - DNA, 25 bp, Homo sapien
gtagaagtgaagcgtaaaatctaat

SEQ ID NO: 81286 - DNA, 25 bp, Homo sapien
gtagaagtgaagtgtaaaatctaat

SEQ ID NO: 81287 - DNA, 25 bp, Homo sapien
gtagaatgacaatcaccgtggtggg

SEQ ID NO: 81288 - DNA, 25 bp, Homo sapien
gtagaatgacaatcactgtggtggg

SEQ ID NO: 81289 - DNA, 25 bp, Homo sapien
gtagaatgccttcctttgtacttca

SEQ ID NO: 81290 - DNA, 25 bp, Homo sapien
gtagaatgccttcttttgtacttca

SEQ ID NO: 81291 - DNA, 25 bp, Homo sapien
gtagaatgtattttatgtcttttat

SEQ ID NO: 81292 - DNA, 25 bp, Homo sapien
gtagaatgtgttttatgtcttttat

SEQ ID NO: 81293 - DNA, 25 bp, Homo sapien
gtagaatttatagactcctcagagt

SEQ ID NO: 81294 - DNA, 25 bp, Homo sapien
gtagaatttgtagactcctcagagt

SEQ ID NO: 81295 - DNA, 25 bp, Homo sapien
gtagacaataacaaaatcaaggcaa

SEQ ID NO: 81296 - DNA, 25 bp, Homo sapien
gtagacaataacagaatcaaggcaa

SEQ ID NO: 81297 - DNA, 25 bp, Homo sapien
gtagacacaatagcctcaggccttt

SEQ ID NO: 81298 - DNA, 25 bp, Homo sapien
gtagacacgatagcctcaggccttt

SEQ ID NO: 81299 - DNA, 25 bp, Homo sapien
gtagacatgaccgtgacagttaaaa

SEQ ID NO: 81300 - DNA, 25 bp, Homo sapien
gtagacatgactgtgacagttaaaa

SEQ ID NO: 81301 - DNA, 25 bp, Homo sapien
gtagacatgattaagagcatcttga

SEQ ID NO: 81302 - DNA, 25 bp, Homo sapien
gtagacatggttaagagcatcttga

SEQ ID NO: 81303 - DNA, 25 bp, Homo sapien
gtagacatttacgtagacgtttttg

SEQ ID NO: 81304 - DNA, 25 bp, Homo sapien
gtagacatttacgtagtcgtttttg

SEQ ID NO: 81305 - DNA, 25 bp, Homo sapien
gtagaccagaagagcaaaccagcct

SEQ ID NO: 81306 - DNA, 25 bp, Homo sapien
gtagaccagaagagtaaaccagcct

SEQ ID NO: 81307 - DNA, 25 bp, Homo sapien
gtagacgagttaccctgtcttcttc

SEQ ID NO: 81308 - DNA, 25 bp, Homo sapien
gtagacgagttaccctttcttcttc

SEQ ID NO: 81309 - DNA, 25 bp, Homo sapien
gtagactcacctgacacataaagac

SEQ ID NO: 81310 - DNA, 25 bp, Homo sapien
gtagactcagaaatgtctccgcaat

SEQ ID NO: 81311 - DNA, 25 bp, Homo sapien
gtagactcagaattgtctccgcaat

SEQ ID NO: 81312 - DNA, 25 bp, Homo sapien
gtagactcatctgacacataaagac

SEQ ID NO: 81313 - DNA, 25 bp, Homo sapien
gtagactgagcatgtggaaataagg

SEQ ID NO: 81314 - DNA, 25 bp, Homo sapien
gtagactgagcgtgtggaaataagg

SEQ ID NO: 81315 - DNA, 25 bp, Homo sapien
gtagagacaaggtcttcctatgttg

SEQ ID NO: 81316 - DNA, 25 bp, Homo sapien
gtagagacagtgcaaccctgctggt

SEQ ID NO: 81317 - DNA, 25 bp, Homo sapien
gtagagacagtgcgaccctgctggt

SEQ ID NO: 81318 - DNA, 25 bp, Homo sapien
gtagagacgaggtcttcctatgttg

SEQ ID NO: 81319 - DNA, 25 bp, Homo sapien
gtagagagaaccgtgtaggagactc

SEQ ID NO: 81320 - DNA, 25 bp, Homo sapien
gtagagagaaccgtgtgggagactc

SEQ ID NO: 81321 - DNA, 25 bp, Homo sapien
gtagagagaatgaaaattaaaatat

SEQ ID NO: 81322 - DNA, 25 bp, Homo sapien
gtagagagaatggaaattaaaatat

SEQ ID NO: 81323 - DNA, 25 bp, Homo sapien
gtagagagtcatcagtaacctcaga

SEQ ID NO: 81324 - DNA, 25 bp, Homo sapien
gtagagagtcattagtaacctcaga

SEQ ID NO: 81325 - DNA, 25 bp, Homo sapien
gtagagatatttggttaattcctag

SEQ ID NO: 81326 - DNA, 25 bp, Homo sapien
gtagagatctttggttaattcctag

SEQ ID NO: 81327 - DNA, 25 bp, Homo sapien
gtagagcacagatagaggagcctga

SEQ ID NO: 81328 - DNA, 25 bp, Homo sapien
gtagagcacagttagaggagcctga

SEQ ID NO: 81329 - DNA, 25 bp, Homo sapien
gtagagcacgtagcagtatcctggg

SEQ ID NO: 81330 - DNA, 25 bp, Homo sapien
gtagagcacttagcagtatcctggg

SEQ ID NO: 81331 - DNA, 25 bp, Homo sapien
gtagagccagtaaaacattacaatc

SEQ ID NO: 81332 - DNA, 25 bp, Homo sapien
gtagagccagtgaaacattacaatc

SEQ ID NO: 81333 - DNA, 25 bp, Homo sapien
gtagaggaaataacatgcctaaaag

SEQ ID NO: 81334 - DNA, 25 bp, Homo sapien
gtagaggaaataatatgcctaaaag

SEQ ID NO: 81335 - DNA, 25 bp, Homo sapien
gtagaggagacatttcccatacctt

SEQ ID NO: 81336 - DNA, 25 bp, Homo sapien
gtagaggaggcatttcccatacctt

SEQ ID NO: 81337 - DNA, 25 bp, Homo sapien
gtagaggctagggtcctccatttaa

SEQ ID NO: 81338 - DNA, 25 bp, Homo sapien
gtagaggctagtgtcctccatttaa

SEQ ID NO: 81339 - DNA, 25 bp, Homo sapien
gtagagggactctcattctggctgc

SEQ ID NO: 81340 - DNA, 25 bp, Homo sapien
gtagagggattctcattctggctgc

SEQ ID NO: 81341 - DNA, 25 bp, Homo sapien
gtagaggtaatccttgctgctggac

SEQ ID NO: 81342 - DNA, 25 bp, Homo sapien
gtagaggtaatccttgttgctggac

SEQ ID NO: 81343 - DNA, 25 bp, Homo sapien
gtagaggttagtggaattgtttttt

SEQ ID NO: 81344 - DNA, 25 bp, Homo sapien
gtagaggttcgtggaattgtttttt

SEQ ID NO: 81345 - DNA, 25 bp, Homo sapien
gtagaggtttaaaaatatactaggg

SEQ ID NO: 81346 - DNA, 25 bp, Homo sapien
gtagaggtttagaaatatactaggg

SEQ ID NO: 81347 - DNA, 25 bp, Homo sapien
gtagaggtttgcctatgtgattaaa

SEQ ID NO: 81348 - DNA, 25 bp, Homo sapien
gtagaggtttgcttatgtgattaaa

SEQ ID NO: 81349 - DNA, 25 bp, Homo sapien
gtagagtagaatgtattttatgtct

SEQ ID NO: 81350 - DNA, 25 bp, Homo sapien
gtagagtagaatgtgttttatgtct

SEQ ID NO: 81351 - DNA, 25 bp, Homo sapien
gtagagtcagcctagtatatgagca

SEQ ID NO: 81352 - DNA, 25 bp, Homo sapien
gtagagtcagcctcgtatatgagca

SEQ ID NO: 81353 - DNA, 25 bp, Homo sapien
gtagagtccagacataaattcatgc

SEQ ID NO: 81354 - DNA, 25 bp, Homo sapien
gtagagtccagatataaattcatgc

SEQ ID NO: 81355 - DNA, 25 bp, Homo sapien
gtagagtccatcaggctcattcttt

SEQ ID NO: 81356 - DNA, 25 bp, Homo sapien
gtagagtccatccggctcattcttt

SEQ ID NO: 81357 - DNA, 25 bp, Homo sapien
gtagagttgacttttgaccttgttc

SEQ ID NO: 81358 - DNA, 25 bp, Homo sapien
gtagagttgacttttggccttgttc

SEQ ID NO: 81359 - DNA, 25 bp, Homo sapien
gtagatactcacatattgaatagat

SEQ ID NO: 81360 - DNA, 25 bp, Homo sapien
gtagatactcatatattgaatagat

SEQ ID NO: 81361 - DNA, 25 bp, Homo sapien
gtagatagagacattcagccaagga

SEQ ID NO: 81362 - DNA, 25 bp, Homo sapien
gtagatagagacgttcagccaagga

SEQ ID NO: 81363 - DNA, 25 bp, Homo sapien
gtagatagccttacgtttctttttg

SEQ ID NO: 81364 - DNA, 25 bp, Homo sapien
gtagatagccttatgtttctttttg

SEQ ID NO: 81365 - DNA, 25 bp, Homo sapien
gtagatatcagttaatcggtaatat

SEQ ID NO: 81366 - DNA, 25 bp, Homo sapien
gtagatatcagttaattggtaatat

SEQ ID NO: 81367 - DNA, 25 bp, Homo sapien
gtagatatgactcttttttggctta

SEQ ID NO: 81368 - DNA, 25 bp, Homo sapien
gtagatatggctcttttttggctta

SEQ ID NO: 81369 - DNA, 25 bp, Homo sapien
gtagatcactatactcctaaagaaa

SEQ ID NO: 81370 - DNA, 25 bp, Homo sapien
gtagatcactatactcgtaaagaaa

SEQ ID NO: 81371 - DNA, 25 bp, Homo sapien
gtagatccaaagttttcgtgcaaaa

SEQ ID NO: 81372 - DNA, 25 bp, Homo sapien
gtagatccaaagtttttgtgcaaaa

SEQ ID NO: 81373 - DNA, 25 bp, Homo sapien
gtagatcgaacagccttctgctgga

SEQ ID NO: 81374 - DNA, 25 bp, Homo sapien
gtagatcgaccagccttctgctgga

SEQ ID NO: 81375 - DNA, 25 bp, Homo sapien
gtagatgaaacctacttctagttcg

SEQ ID NO: 81376 - DNA, 25 bp, Homo sapien
gtagatgaaacctagttctagttcg

SEQ ID NO: 81377 - DNA, 25 bp, Homo sapien
gtagatgcagaaatgagagaggaac

SEQ ID NO: 81378 - DNA, 25 bp, Homo sapien
gtagatgcagaagtgagagaggaac

SEQ ID NO: 81379 - DNA, 25 bp, Homo sapien
gtagattcagcctgagcctaaaggc

SEQ ID NO: 81380 - DNA, 25 bp, Homo sapien
gtagattcagcctgggcctaaaggc

SEQ ID NO: 81381 - DNA, 25 bp, Homo sapien
gtagattcccagatccagggctgca

SEQ ID NO: 81382 - DNA, 25 bp, Homo sapien
gtagattcccaggtccagggctgca

SEQ ID NO: 81383 - DNA, 25 bp, Homo sapien
gtagattcttagctcggccataagc

SEQ ID NO: 81384 - DNA, 25 bp, Homo sapien
gtagattcttagctgggccataagc

SEQ ID NO: 81385 - DNA, 25 bp, Homo sapien
gtagattgccaggtgaacaccacag

SEQ ID NO: 81386 - DNA, 25 bp, Homo sapien
gtagattgccaggtgagcaccacag

SEQ ID NO: 81387 - DNA, 25 bp, Homo sapien
gtagattgctgaaaaatattccaca

SEQ ID NO: 81388 - DNA, 25 bp, Homo sapien
gtagattgtgagacaggttcaggaa

SEQ ID NO: 81389 - DNA, 25 bp, Homo sapien
gtagattgtgaggcaggttcaggaa

SEQ ID NO: 81390 - DNA, 25 bp, Homo sapien
gtagattgtgccaccagctgcacct

SEQ ID NO: 81391 - DNA, 25 bp, Homo sapien
gtagattgtgccgccagctgcacct

SEQ ID NO: 81392 - DNA, 25 bp, Homo sapien
gtagattgttgaaaaatattccaca

SEQ ID NO: 81393 - DNA, 25 bp, Homo sapien
gtagatttagaattaaatgatatga

SEQ ID NO: 81394 - DNA, 25 bp, Homo sapien
gtagatttgtagaaaggttgttggt

SEQ ID NO: 81395 - DNA, 25 bp, Homo sapien
gtagatttgtagaagggttgttggt

SEQ ID NO: 81396 - DNA, 25 bp, Homo sapien
gtagattttgaattaaatgatatga

SEQ ID NO: 81397 - DNA, 25 bp, Homo sapien
gtagcaagaaggttactggtgccct

SEQ ID NO: 81398 - DNA, 25 bp, Homo sapien
gtagcaaggactccataggaattat

SEQ ID NO: 81399 - DNA, 25 bp, Homo sapien
gtagcaaggactctataggaattat

SEQ ID NO: 81400 - DNA, 25 bp, Homo sapien
gtagcaaggaggttactggtgccct

SEQ ID NO: 81401 - DNA, 25 bp, Homo sapien
gtagcacaatattgattgcacaata

SEQ ID NO: 81402 - DNA, 25 bp, Homo sapien
gtagcacaatatttattgcacaata

SEQ ID NO: 81403 - DNA, 25 bp, Homo sapien
gtagcacattgtgaatcctccataa

SEQ ID NO: 81404 - DNA, 25 bp, Homo sapien
gtagcacattgtgagtcctccataa

SEQ ID NO: 81405 - DNA, 25 bp, Homo sapien
gtagcactgagttattcttgagaat

SEQ ID NO: 81406 - DNA, 25 bp, Homo sapien
gtagcactgagttatttttgagaat

SEQ ID NO: 81407 - DNA, 25 bp, Homo sapien
gtagcagaacatactccttataaat

SEQ ID NO: 81408 - DNA, 25 bp, Homo sapien
gtagcagaacatgctccttataaat

SEQ ID NO: 81409 - DNA, 25 bp, Homo sapien
gtagcagaatattttaattggatca

SEQ ID NO: 81410 - DNA, 25 bp, Homo sapien
gtagcagacacaattatatcccatt

SEQ ID NO: 81411 - DNA, 25 bp, Homo sapien
gtagcagacgcaattatatcccatt

SEQ ID NO: 81412 - DNA, 25 bp, Homo sapien
gtagcagagtattttaattggatca

SEQ ID NO: 81413 - DNA, 25 bp, Homo sapien
gtagcagcaaacctaatgctctctt

SEQ ID NO: 81414 - DNA, 25 bp, Homo sapien
gtagcagcagacctaatgctctctt

SEQ ID NO: 81415 - DNA, 25 bp, Homo sapien
gtagcaggagaaaggcacttggtta

SEQ ID NO: 81416 - DNA, 25 bp, Homo sapien
gtagcaggataaaggcacttggtta

SEQ ID NO: 81417 - DNA, 25 bp, Homo sapien
gtagcagggattaggatgtgaacgc

SEQ ID NO: 81418 - DNA, 25 bp, Homo sapien
gtagcagggattgggatgtgaacgc

SEQ ID NO: 81419 - DNA, 25 bp, Homo sapien
gtagcatacaagacagcatctctgt

SEQ ID NO: 81420 - DNA, 25 bp, Homo sapien
gtagcatacaagatagcatctctgt

SEQ ID NO: 81421 - DNA, 25 bp, Homo sapien
gtagcatacaatcagaagaggctgg

SEQ ID NO: 81422 - DNA, 25 bp, Homo sapien
gtagcatacaatcagaggaggctgg

SEQ ID NO: 81423 - DNA, 25 bp, Homo sapien
gtagcatatagaatatctgaaccga

SEQ ID NO: 81424 - DNA, 25 bp, Homo sapien
gtagcatatagaatgtctgaaccga

SEQ ID NO: 81425 - DNA, 25 bp, Homo sapien
gtagcatcaattgtttcatttcctc

SEQ ID NO: 81426 - DNA, 25 bp, Homo sapien
gtagcatcacttgtttcatttcctc

SEQ ID NO: 81427 - DNA, 25 bp, Homo sapien
gtagcatccagagcagttttcacag

SEQ ID NO: 81428 - DNA, 25 bp, Homo sapien
gtagcatccggagcagttttcacag

SEQ ID NO: 81429 - DNA, 25 bp, Homo sapien
gtagcatgcgattctaataatgaaa

SEQ ID NO: 81430 - DNA, 25 bp, Homo sapien
gtagcatgtgattctaataatgaaa

SEQ ID NO: 81431 - DNA, 25 bp, Homo sapien
gtagcattcccagagtgacagaaga

SEQ ID NO: 81432 - DNA, 25 bp, Homo sapien
gtagcatttccagagtgacagaaga

SEQ ID NO: 81433 - DNA, 25 bp, Homo sapien
gtagcattttttaaagtctgttaca

SEQ ID NO: 81434 - DNA, 25 bp, Homo sapien
gtagcatttttttaagtctgttaca

SEQ ID NO: 81435 - DNA, 25 bp, Homo sapien
gtagccaggaagtacttacaggaag

SEQ ID NO: 81436 - DNA, 25 bp, Homo sapien
gtagccaggaagtagttacaggaag

SEQ ID NO: 81437 - DNA, 25 bp, Homo sapien
gtagccagggacatttgtctttcta

SEQ ID NO: 81438 - DNA, 25 bp, Homo sapien
gtagccagggatatttgtctttcta

SEQ ID NO: 81439 - DNA, 25 bp, Homo sapien
gtagccagtgagcaccctaggagga

SEQ ID NO: 81440 - DNA, 25 bp, Homo sapien
gtagccagtgaggaccctaggagga

SEQ ID NO: 81441 - DNA, 25 bp, Homo sapien
gtagccagtgttgcgtgtcttagcg

SEQ ID NO: 81442 - DNA, 25 bp, Homo sapien
gtagccagtgtttcgtgtcttagcg

SEQ ID NO: 81443 - DNA, 25 bp, Homo sapien
gtagcccaaactcaagaatgagaat

SEQ ID NO: 81444 - DNA, 25 bp, Homo sapien
gtagcccaaactgaagaatgagaat

SEQ ID NO: 81445 - DNA, 25 bp, Homo sapien
gtagccgaagaggacaatgccacag

SEQ ID NO: 81446 - DNA, 25 bp, Homo sapien
gtagccgaagaggacagtgccacag

SEQ ID NO: 81447 - DNA, 25 bp, Homo sapien
gtagccgtttacagcccttgttgag

SEQ ID NO: 81448 - DNA, 25 bp, Homo sapien
gtagccgtttatagcccttgttgag

SEQ ID NO: 81449 - DNA, 25 bp, Homo sapien
gtagcctcaggaaaataggaagaag

SEQ ID NO: 81450 - DNA, 25 bp, Homo sapien
gtagcctcaggaaaatgggaagaag

SEQ ID NO: 81451 - DNA, 25 bp, Homo sapien
gtagcctctatcctgaccttaggca

SEQ ID NO: 81452 - DNA, 25 bp, Homo sapien
gtagcctctatgctgaccttaggca

SEQ ID NO: 81453 - DNA, 25 bp, Homo sapien
gtagcctgaattctggaatagagtt

SEQ ID NO: 81454 - DNA, 25 bp, Homo sapien
gtagcctgatttctggaatagagtt

SEQ ID NO: 81455 - DNA, 25 bp, Homo sapien
gtagcgttaatgcttgatgtatccg

SEQ ID NO: 81456 - DNA, 25 bp, Homo sapien
gtagcgttaatgcttggtgtatccg

SEQ ID NO: 81457 - DNA, 25 bp, Homo sapien
gtagctatgggggtggcttaatgac

SEQ ID NO: 81458 - DNA, 25 bp, Homo sapien
gtagctatgggggtggtttaatgac

SEQ ID NO: 81459 - DNA, 25 bp, Homo sapien
gtagctccatctttaatgatcacac

SEQ ID NO: 81460 - DNA, 25 bp, Homo sapien
gtagctccttctttaatgatcacac

SEQ ID NO: 81461 - DNA, 25 bp, Homo sapien
gtagctctgaacagagagtgacatg

SEQ ID NO: 81462 - DNA, 25 bp, Homo sapien
gtagctctgaacggagagtgacatg

SEQ ID NO: 81463 - DNA, 25 bp, Homo sapien
gtagctgataatgatgatcctaaga

SEQ ID NO: 81464 - DNA, 25 bp, Homo sapien
gtagctgataattatgatcctaaga

SEQ ID NO: 81465 - DNA, 25 bp, Homo sapien
gtagctgatgtgacgagtggctccc

SEQ ID NO: 81466 - DNA, 25 bp, Homo sapien
gtagctgatgtgatgagtggctccc

SEQ ID NO: 81467 - DNA, 25 bp, Homo sapien
gtagctgcactaaacaatggatttt

SEQ ID NO: 81468 - DNA, 25 bp, Homo sapien
gtagctgcactgaacaatggatttt

SEQ ID NO: 81469 - DNA, 25 bp, Homo sapien
gtagctgccctggcatatttaacaa

SEQ ID NO: 81470 - DNA, 25 bp, Homo sapien
gtagctgccctggcgtatttaacaa

SEQ ID NO: 81471 - DNA, 25 bp, Homo sapien
gtagctgctgactttaaattgaagc

SEQ ID NO: 81472 - DNA, 25 bp, Homo sapien
gtagctgctgattttaaattgaagc

SEQ ID NO: 81473 - DNA, 25 bp, Homo sapien
gtagctggaatacattggtccaacc

SEQ ID NO: 81474 - DNA, 25 bp, Homo sapien
gtagctggaatccattggtccaacc

SEQ ID NO: 81475 - DNA, 25 bp, Homo sapien
gtagctgtgggatctaacaatgaac

SEQ ID NO: 81476 - DNA, 25 bp, Homo sapien
gtagctgtgggttctaacaatgaac

SEQ ID NO: 81477 - DNA, 25 bp, Homo sapien
gtagcttaaagaatataaaatcatg

SEQ ID NO: 81478 - DNA, 25 bp, Homo sapien
gtagcttaaagactataaaatcatg

SEQ ID NO: 81479 - DNA, 25 bp, Homo sapien
gtagcttaactgtacgccaggagaa

SEQ ID NO: 81480 - DNA, 25 bp, Homo sapien
gtagcttaactgtatgccaggagaa

SEQ ID NO: 81481 - DNA, 25 bp, Homo sapien
gtagcttctctaaccattttgcatc

SEQ ID NO: 81482 - DNA, 25 bp, Homo sapien
gtagcttctgtaaccattttgcatc

SEQ ID NO: 81483 - DNA, 25 bp, Homo sapien
gtagcttttaggtatacggcacagg

SEQ ID NO: 81484 - DNA, 25 bp, Homo sapien
gtagcttttaggtatatggcacagg

SEQ ID NO: 81485 - DNA, 25 bp, Homo sapien
gtaggaaaaattgccatatattctc

SEQ ID NO: 81486 - DNA, 25 bp, Homo sapien
gtaggaaaaattgctatatattctc

SEQ ID NO: 81487 - DNA, 25 bp, Homo sapien
gtaggaaaggttacagaggctaatg

SEQ ID NO: 81488 - DNA, 25 bp, Homo sapien
gtaggaaagttgccatgactccaca

SEQ ID NO: 81489 - DNA, 25 bp, Homo sapien
gtaggaaagttgccgtgactccaca

SEQ ID NO: 81490 - DNA, 25 bp, Homo sapien
gtaggaaataagagagatagctgtt

SEQ ID NO: 81491 - DNA, 25 bp, Homo sapien
gtaggaaatagcacggtgagtaaga

SEQ ID NO: 81492 - DNA, 25 bp, Homo sapien
gtaggaaatagcatggtgagtaaga

SEQ ID NO: 81493 - DNA, 25 bp, Homo sapien
gtaggaaatgagagagatagctgtt

SEQ ID NO: 81494 - DNA, 25 bp, Homo sapien
gtaggaaatgttacagaggctaatg

SEQ ID NO: 81495 - DNA, 25 bp, Homo sapien
gtaggaagactctacaaggacatgg

SEQ ID NO: 81496 - DNA, 25 bp, Homo sapien
gtaggaagactctataaggacatgg

SEQ ID NO: 81497 - DNA, 25 bp, Homo sapien
gtaggaagcggaagtattttaggaa

SEQ ID NO: 81498 - DNA, 25 bp, Homo sapien
gtaggaagtggaagtattttaggaa

SEQ ID NO: 81499 - DNA, 25 bp, Homo sapien
gtaggaataaaaccaaaaaagatca

SEQ ID NO: 81500 - DNA, 25 bp, Homo sapien
gtaggaataaagccaaaaaagatca

SEQ ID NO: 81501 - DNA, 25 bp, Homo sapien
gtaggaataattagcacaataggca

SEQ ID NO: 81502 - DNA, 25 bp, Homo sapien
gtaggaataattagcagaataggca

SEQ ID NO: 81503 - DNA, 25 bp, Homo sapien
gtaggaggagataggaacaattttc

SEQ ID NO: 81504 - DNA, 25 bp, Homo sapien
gtaggaggagataggaccaattttc

SEQ ID NO: 81505 - DNA, 25 bp, Homo sapien
gtaggatatgacacagaaatggtaa

SEQ ID NO: 81506 - DNA, 25 bp, Homo sapien
gtaggatatgacacagcaatggtaa

SEQ ID NO: 81507 - DNA, 25 bp, Homo sapien
gtaggcagacacattaggtggaaaa

SEQ ID NO: 81508 - DNA, 25 bp, Homo sapien
gtaggcagacatattaggtggaaaa

SEQ ID NO: 81509 - DNA, 25 bp, Homo sapien
gtaggcatgatcttgtggtctgaac

SEQ ID NO: 81510 - DNA, 25 bp, Homo sapien
gtaggcatgatgttgtggtctgaac

SEQ ID NO: 81511 - DNA, 25 bp, Homo sapien
gtaggcatttttatacttttgaaaa

SEQ ID NO: 81512 - DNA, 25 bp, Homo sapien
gtaggcatttttgtacttttgaaaa

SEQ ID NO: 81513 - DNA, 25 bp, Homo sapien
gtaggcctataacaagattcaatta

SEQ ID NO: 81514 - DNA, 25 bp, Homo sapien
gtaggcctgctactagttccaattc

SEQ ID NO: 81515 - DNA, 25 bp, Homo sapien
gtaggcctgctattagttccaattc

SEQ ID NO: 81516 - DNA, 25 bp, Homo sapien
gtaggcctggtaacgttcaccacaa

SEQ ID NO: 81517 - DNA, 25 bp, Homo sapien
gtaggcctggtaatgttcaccacaa

SEQ ID NO: 81518 - DNA, 25 bp, Homo sapien
gtaggcctgtaacaagattcaatta

SEQ ID NO: 81519 - DNA, 25 bp, Homo sapien
gtaggctccatgaaagggcatccag

SEQ ID NO: 81520 - DNA, 25 bp, Homo sapien
gtaggctccttgaaagggcatccag

SEQ ID NO: 81521 - DNA, 25 bp, Homo sapien
gtaggctttaaaaagattcaaccaa

SEQ ID NO: 81522 - DNA, 25 bp, Homo sapien
gtaggctttaaacagattcaaccaa

SEQ ID NO: 81523 - DNA, 25 bp, Homo sapien
gtaggctttatccaggagatgtaag

SEQ ID NO: 81524 - DNA, 25 bp, Homo sapien
gtaggctttatccatgagatgtaag

SEQ ID NO: 81525 - DNA, 25 bp, Homo sapien
gtagggaagcaaataccttcaaggt

SEQ ID NO: 81526 - DNA, 25 bp, Homo sapien
gtagggaagcaaatcccttcaaggt

SEQ ID NO: 81527 - DNA, 25 bp, Homo sapien
gtagggaggcacacccattccacat

SEQ ID NO: 81528 - DNA, 25 bp, Homo sapien
gtagggaggcacactcattccacat

SEQ ID NO: 81529 - DNA, 25 bp, Homo sapien
gtagggccttgtacgcctgagctct

SEQ ID NO: 81530 - DNA, 25 bp, Homo sapien
gtagggccttgtatgcctgagctct

SEQ ID NO: 81531 - DNA, 25 bp, Homo sapien
gtagggctacatccagacctggctg

SEQ ID NO: 81532 - DNA, 25 bp, Homo sapien
gtagggctacattcagacctggctg

SEQ ID NO: 81533 - DNA, 25 bp, Homo sapien
gtaggggagatttctccacctttag

SEQ ID NO: 81534 - DNA, 25 bp, Homo sapien
gtaggggagatttctctacctttag

SEQ ID NO: 81535 - DNA, 25 bp, Homo sapien
gtagggttgctttgaagtattcttt

SEQ ID NO: 81536 - DNA, 25 bp, Homo sapien
gtagggttgctttgcagtattcttt

SEQ ID NO: 81537 - DNA, 25 bp, Homo sapien
gtaggtactattaattatccacttt

SEQ ID NO: 81538 - DNA, 25 bp, Homo sapien
gtaggtactattatttatccacttt

SEQ ID NO: 81539 - DNA, 25 bp, Homo sapien
gtaggtagttaagagaaagtcaggc

SEQ ID NO: 81540 - DNA, 25 bp, Homo sapien
gtaggtagttaagggaaagtcaggc

SEQ ID NO: 81541 - DNA, 25 bp, Homo sapien
gtaggtatcaacatattttatcttg

SEQ ID NO: 81542 - DNA, 25 bp, Homo sapien
gtaggtatcaacgtattttatcttg

SEQ ID NO: 81543 - DNA, 25 bp, Homo sapien
gtaggtcacaaggagtacacacatt

SEQ ID NO: 81544 - DNA, 25 bp, Homo sapien
gtaggtcacaaggattacacacatt

SEQ ID NO: 81545 - DNA, 25 bp, Homo sapien
gtaggtcaccgggtgcagaaccagt

SEQ ID NO: 81546 - DNA, 25 bp, Homo sapien
gtaggtcactgggtgcagaaccagt

SEQ ID NO: 81547 - DNA, 25 bp, Homo sapien
gtaggtgagtcatgtacagtataaa

SEQ ID NO: 81548 - DNA, 25 bp, Homo sapien
gtaggtgagtcatgtatagtataaa

SEQ ID NO: 81549 - DNA, 25 bp, Homo sapien
gtaggtgcactgatacagaagcaag

SEQ ID NO: 81550 - DNA, 25 bp, Homo sapien
gtaggtgcattgatacagaagcaag

SEQ ID NO: 81551 - DNA, 25 bp, Homo sapien
gtaggtggaccaacgaagagggtga

SEQ ID NO: 81552 - DNA, 25 bp, Homo sapien
gtaggtggaccagcgaagagggtga

SEQ ID NO: 81553 - DNA, 25 bp, Homo sapien
gtaggtgtactggaatgctcccata

SEQ ID NO: 81554 - DNA, 25 bp, Homo sapien
gtaggtgtgctggaatgctcccata

SEQ ID NO: 81555 - DNA, 25 bp, Homo sapien
gtaggttatacaatggaaaacaaca

SEQ ID NO: 81556 - DNA, 25 bp, Homo sapien
gtaggttatacagtggaaaacaaca

SEQ ID NO: 81557 - DNA, 25 bp, Homo sapien
gtaggttgcattcggttaattatat

SEQ ID NO: 81558 - DNA, 25 bp, Homo sapien
gtaggttgcatttggttaattatat

SEQ ID NO: 81559 - DNA, 25 bp, Homo sapien
gtaggttgtctcttcaatctgttgg

SEQ ID NO: 81560 - DNA, 25 bp, Homo sapien
gtaggttgtctcttgaatctgttgg

SEQ ID NO: 81561 - DNA, 25 bp, Homo sapien
gtagtaaaaggaaatctgtgggatt

SEQ ID NO: 81562 - DNA, 25 bp, Homo sapien
gtagtaaaaggagatctgtgggatt

SEQ ID NO: 81563 - DNA, 25 bp, Homo sapien
gtagtaataccaacgatggggagtg

SEQ ID NO: 81564 - DNA, 25 bp, Homo sapien
gtagtaataccaatgatggggagtg

SEQ ID NO: 81565 - DNA, 25 bp, Homo sapien
gtagtagtggcactctctaaccatt

SEQ ID NO: 81566 - DNA, 25 bp, Homo sapien
gtagtagtggcactttctaaccatt

SEQ ID NO: 81567 - DNA, 25 bp, Homo sapien
gtagtcaacagtttatgtgcaactc

SEQ ID NO: 81568 - DNA, 25 bp, Homo sapien
gtagtcaacagtttgtgtgcaactc

SEQ ID NO: 81569 - DNA, 25 bp, Homo sapien
gtagtcactgagccgcagcaggcgc

SEQ ID NO: 81570 - DNA, 25 bp, Homo sapien
gtagtcactgagctgcagcaggcgc

SEQ ID NO: 81571 - DNA, 25 bp, Homo sapien
gtagtcagttacaaatcaaacattt

SEQ ID NO: 81572 - DNA, 25 bp, Homo sapien
gtagtcagttacaattcaaacattt

SEQ ID NO: 81573 - DNA, 25 bp, Homo sapien
gtagtctctaccctgaccatgtgcc

SEQ ID NO: 81574 - DNA, 25 bp, Homo sapien
gtagtctctaccttgaccatgtgcc

SEQ ID NO: 81575 - DNA, 25 bp, Homo sapien
gtagtctttatatcaccaaagcacc

SEQ ID NO: 81576 - DNA, 25 bp, Homo sapien
gtagtctttatatcgccaaagcacc

SEQ ID NO: 81577 - DNA, 25 bp, Homo sapien
gtagtgacaaagcgaaagaaaaggg

SEQ ID NO: 81578 - DNA, 25 bp, Homo sapien
gtagtgacaaagtgaaagaaaaggg

SEQ ID NO: 81579 - DNA, 25 bp, Homo sapien
gtagtgactttactcggatagagtg

SEQ ID NO: 81580 - DNA, 25 bp, Homo sapien
gtagtgactttacttggatagagtg

SEQ ID NO: 81581 - DNA, 25 bp, Homo sapien
gtagtgattcaagcacacatgtggc

SEQ ID NO: 81582 - DNA, 25 bp, Homo sapien
gtagtgattcaaggacacatgtggc

SEQ ID NO: 81583 - DNA, 25 bp, Homo sapien
gtagtgatttttgcctcctacttag

SEQ ID NO: 81584 - DNA, 25 bp, Homo sapien
gtagtgatttttgcttcctacttag

SEQ ID NO: 81585 - DNA, 25 bp, Homo sapien
gtagtgcagctacggaaggcaatca

SEQ ID NO: 81586 - DNA, 25 bp, Homo sapien
gtagtgcagctatggaaggcaatca

SEQ ID NO: 81587 - DNA, 25 bp, Homo sapien
gtagtgcccattggaggttggcatg

SEQ ID NO: 81588 - DNA, 25 bp, Homo sapien
gtagtgccctttggaggttggcatg

SEQ ID NO: 81589 - DNA, 25 bp, Homo sapien
gtagtggacatacctggtttttctg

SEQ ID NO: 81590 - DNA, 25 bp, Homo sapien
gtagtggatatacctggtttttctg

SEQ ID NO: 81591 - DNA, 25 bp, Homo sapien
gtagtggatgtgcttcttttggcaa

SEQ ID NO: 81592 - DNA, 25 bp, Homo sapien
gtagtggatgtgtttcttttggcaa

SEQ ID NO: 81593 - DNA, 25 bp, Homo sapien
gtagtggcattacccttctttttgg

SEQ ID NO: 81594 - DNA, 25 bp, Homo sapien
gtagtggcgttacccttctttttgg

SEQ ID NO: 81595 - DNA, 25 bp, Homo sapien
gtagtggctgagccttggtaatcaa

SEQ ID NO: 81596 - DNA, 25 bp, Homo sapien
gtagtggctgagtcttggtaatcaa

SEQ ID NO: 81597 - DNA, 25 bp, Homo sapien
gtagtgggaattatgatagagatta

SEQ ID NO: 81598 - DNA, 25 bp, Homo sapien
gtagtgggaattgtgatagagatta

SEQ ID NO: 81599 - DNA, 25 bp, Homo sapien
gtagtggtaattcagtgaggtttta

SEQ ID NO: 81600 - DNA, 25 bp, Homo sapien
gtagtggtatctcgttgttgtaatt

SEQ ID NO: 81601 - DNA, 25 bp, Homo sapien
gtagtggtatcttgttgttgtaatt

SEQ ID NO: 81602 - DNA, 25 bp, Homo sapien
gtagtggtatttcagtgaggtttta

SEQ ID NO: 81603 - DNA, 25 bp, Homo sapien
gtagtggtgctgagaggttcctcag

SEQ ID NO: 81604 - DNA, 25 bp, Homo sapien
gtagtggtgcttagaggttcctcag

SEQ ID NO: 81605 - DNA, 25 bp, Homo sapien
gtagtgttactccaaattgctggct

SEQ ID NO: 81606 - DNA, 25 bp, Homo sapien
gtagtgttactctaaattgctggct

SEQ ID NO: 81607 - DNA, 25 bp, Homo sapien
gtagtgtttgccttcgttacataga

SEQ ID NO: 81608 - DNA, 25 bp, Homo sapien
gtagtgtttgctttcgttacataga

SEQ ID NO: 81609 - DNA, 25 bp, Homo sapien
gtagtgttttcccattcgtattgct

SEQ ID NO: 81610 - DNA, 25 bp, Homo sapien
gtagtgttttcccatttgtattgct

SEQ ID NO: 81611 - DNA, 25 bp, Homo sapien
gtagttgagagacgagctatgggca

SEQ ID NO: 81612 - DNA, 25 bp, Homo sapien
gtagttgagagatgagctatgggca

SEQ ID NO: 81613 - DNA, 25 bp, Homo sapien
gtagttggcttactcaaagcagaga

SEQ ID NO: 81614 - DNA, 25 bp, Homo sapien
gtagttggcttattcaaagcagaga

SEQ ID NO: 81615 - DNA, 25 bp, Homo sapien
gtagttgggtaaagaaactgccaag

SEQ ID NO: 81616 - DNA, 25 bp, Homo sapien
gtagttgggtaaggaaactgccaag

SEQ ID NO: 81617 - DNA, 25 bp, Homo sapien
gtagttgttctcagatgtggggatc

SEQ ID NO: 81618 - DNA, 25 bp, Homo sapien
gtagttgttttcagatgtggggatc

SEQ ID NO: 81619 - DNA, 25 bp, Homo sapien
gtagtttaacatgcacgtattttgc

SEQ ID NO: 81620 - DNA, 25 bp, Homo sapien
gtagtttaacattcacgtattttgc

SEQ ID NO: 81621 - DNA, 25 bp, Homo sapien
gtagtttcacaaaaagtagatttga

SEQ ID NO: 81622 - DNA, 25 bp, Homo sapien
gtagtttcacaacaagtagatttga

SEQ ID NO: 81623 - DNA, 25 bp, Homo sapien
gtagtttctatatagaaaaagaagt

SEQ ID NO: 81624 - DNA, 25 bp, Homo sapien
gtagtttctatatagagaaagaagt

SEQ ID NO: 81625 - DNA, 25 bp, Homo sapien
gtagtttgtacacgtagctattttc

SEQ ID NO: 81626 - DNA, 25 bp, Homo sapien
gtagtttgtacacttagctattttc

SEQ ID NO: 81627 - DNA, 25 bp, Homo sapien
gtagttttaataagtcttaactttt

SEQ ID NO: 81628 - DNA, 25 bp, Homo sapien
gtagttttagtaagtcttaactttt

SEQ ID NO: 81629 - DNA, 25 bp, Homo sapien
gtagttttccactgaacgatctttt

SEQ ID NO: 81630 - DNA, 25 bp, Homo sapien
gtagttttccactgaatgatctttt

SEQ ID NO: 81631 - DNA, 25 bp, Homo sapien
gtataaaaacttacagagctagcat

SEQ ID NO: 81632 - DNA, 25 bp, Homo sapien
gtataaaaacttatagagctagcat

SEQ ID NO: 81633 - DNA, 25 bp, Homo sapien
gtataaaacacctagagaatagttt

SEQ ID NO: 81634 - DNA, 25 bp, Homo sapien
gtataaaacgcctagagaatagttt

SEQ ID NO: 81635 - DNA, 25 bp, Homo sapien
gtataaactccacatgttgttttct

SEQ ID NO: 81636 - DNA, 25 bp, Homo sapien
gtataaactccacgtgttgttttct

SEQ ID NO: 81637 - DNA, 25 bp, Homo sapien
gtataaagaatctccgtgacattgg

SEQ ID NO: 81638 - DNA, 25 bp, Homo sapien
gtataaagaatctctgtgacattgg

SEQ ID NO: 81639 - DNA, 25 bp, Homo sapien
gtataaaggcaggcgagacaggaag

SEQ ID NO: 81640 - DNA, 25 bp, Homo sapien
gtataaagtcaggcgagacaggaag

SEQ ID NO: 81641 - DNA, 25 bp, Homo sapien
gtataactcaaatctttgatcttca

SEQ ID NO: 81642 - DNA, 25 bp, Homo sapien
gtataactcaagtctttgatcttca

SEQ ID NO: 81643 - DNA, 25 bp, Homo sapien
gtataactgcaagtattctgagttt

SEQ ID NO: 81644 - DNA, 25 bp, Homo sapien
gtataactgcacgtattctgagttt

SEQ ID NO: 81645 - DNA, 25 bp, Homo sapien
gtataagagtgaactagaaataaac

SEQ ID NO: 81646 - DNA, 25 bp, Homo sapien
gtataagagtgaattagaaataaac

SEQ ID NO: 81647 - DNA, 25 bp, Homo sapien
gtataagattgccagatatggaaca

SEQ ID NO: 81648 - DNA, 25 bp, Homo sapien
gtataagattgccggatatggaaca

SEQ ID NO: 81649 - DNA, 25 bp, Homo sapien
gtataaggtccaaaatcacactttt

SEQ ID NO: 81650 - DNA, 25 bp, Homo sapien
gtataaggtcccaaatcacactttt

SEQ ID NO: 81651 - DNA, 25 bp, Homo sapien
gtataatctatccataagtgtgtgt

SEQ ID NO: 81652 - DNA, 25 bp, Homo sapien
gtataatctctccataagtgtgtgt

SEQ ID NO: 81653 - DNA, 25 bp, Homo sapien
gtataattaaccagaagtccagtag

SEQ ID NO: 81654 - DNA, 25 bp, Homo sapien
gtataattaactagaagtccagtag

SEQ ID NO: 81655 - DNA, 25 bp, Homo sapien
gtataattcttaaaggccctagtat

SEQ ID NO: 81656 - DNA, 25 bp, Homo sapien
gtataattcttaaaggtcctagtat

SEQ ID NO: 81657 - DNA, 25 bp, Homo sapien
gtatacatagagccttgtaaacctt

SEQ ID NO: 81658 - DNA, 25 bp, Homo sapien
gtatacatagagtcttgtaaacctt

SEQ ID NO: 81659 - DNA, 25 bp, Homo sapien
gtatacctatgcctatcatatttcg

SEQ ID NO: 81660 - DNA, 25 bp, Homo sapien
gtatacctatgcttatcatatttcg

SEQ ID NO: 81661 - DNA, 25 bp, Homo sapien
gtatacttactgacctgctgccatt

SEQ ID NO: 81662 - DNA, 25 bp, Homo sapien
gtatacttattgacctgctgccatt

SEQ ID NO: 81663 - DNA, 25 bp, Homo sapien
gtatactttacttgcctttattttc

SEQ ID NO: 81664 - DNA, 25 bp, Homo sapien
gtatactttccttgcctttattttc

SEQ ID NO: 81665 - DNA, 25 bp, Homo sapien
gtatagaagaaaaaacgcaggcttc

SEQ ID NO: 81666 - DNA, 25 bp, Homo sapien
gtatagaaggaaaaacgcaggcttc

SEQ ID NO: 81667 - DNA, 25 bp, Homo sapien
gtatagaagtatctgaattttattc

SEQ ID NO: 81668 - DNA, 25 bp, Homo sapien
gtatagaagtatttgaattttattc

SEQ ID NO: 81669 - DNA, 25 bp, Homo sapien
gtatagaatgagaagggaaggggtt

SEQ ID NO: 81670 - DNA, 25 bp, Homo sapien
gtatagaatgagaggggaaggggtt

SEQ ID NO: 81671 - DNA, 25 bp, Homo sapien
gtatagacaaccatccaatttcatt

SEQ ID NO: 81672 - DNA, 25 bp, Homo sapien
gtatagacagccatccaatttcatt

SEQ ID NO: 81673 - DNA, 25 bp, Homo sapien
gtatagagcaaggcatggctaaaat

SEQ ID NO: 81674 - DNA, 25 bp, Homo sapien
gtatagagcaaggcgtggctaaaat

SEQ ID NO: 81675 - DNA, 25 bp, Homo sapien
gtatagatccacgtctctgttctcc

SEQ ID NO: 81676 - DNA, 25 bp, Homo sapien
gtatagatccatgtctctgttctcc

SEQ ID NO: 81677 - DNA, 25 bp, Homo sapien
gtatagatgtaaagatgtatgtgta

SEQ ID NO: 81678 - DNA, 25 bp, Homo sapien
gtatagatgtaaaggtgtatgtgta

SEQ ID NO: 81679 - DNA, 25 bp, Homo sapien
gtatagcagtgcagttaatttgtgt

SEQ ID NO: 81680 - DNA, 25 bp, Homo sapien
gtatagcagtgctgttaatttgtgt

SEQ ID NO: 81681 - DNA, 25 bp, Homo sapien
gtatagctcaatacatcagtgcaag

SEQ ID NO: 81682 - DNA, 25 bp, Homo sapien
gtatagctcaatacgtcagtgcaag

SEQ ID NO: 81683 - DNA, 25 bp, Homo sapien
gtatagctttgccaccagtatctaa

SEQ ID NO: 81684 - DNA, 25 bp, Homo sapien
gtatagctttgtcaccagtatctaa

SEQ ID NO: 81685 - DNA, 25 bp, Homo sapien
gtataggagagccactatgtaggtg

SEQ ID NO: 81686 - DNA, 25 bp, Homo sapien
gtataggagagccattatgtaggtg

SEQ ID NO: 81687 - DNA, 25 bp, Homo sapien
gtatagggtaccagtcagagtcatg

SEQ ID NO: 81688 - DNA, 25 bp, Homo sapien
gtatagggtaccagtccgagtcatg

SEQ ID NO: 81689 - DNA, 25 bp, Homo sapien
gtataggtcatagtcatttgcttca

SEQ ID NO: 81690 - DNA, 25 bp, Homo sapien
gtataggtcatagtgatttgcttca

SEQ ID NO: 81691 - DNA, 25 bp, Homo sapien
gtatagtaatctgttacgctctgta

SEQ ID NO: 81692 - DNA, 25 bp, Homo sapien
gtatagtaatcttttacgctctgta

SEQ ID NO: 81693 - DNA, 25 bp, Homo sapien
gtatagtttctaagcctttaagaag

SEQ ID NO: 81694 - DNA, 25 bp, Homo sapien
gtatagttttacctcttatatttca

SEQ ID NO: 81695 - DNA, 25 bp, Homo sapien
gtatagttttacctgttatatttca

SEQ ID NO: 81696 - DNA, 25 bp, Homo sapien
gtatagtttttaagcctttaagaag

SEQ ID NO: 81697 - DNA, 25 bp, Homo sapien
gtatatagcttatctaggaatactg

SEQ ID NO: 81698 - DNA, 25 bp, Homo sapien
gtatatagcttatttaggaatactg

SEQ ID NO: 81699 - DNA, 25 bp, Homo sapien
gtatatcagagcatcaagaacactg

SEQ ID NO: 81700 - DNA, 25 bp, Homo sapien
gtatatcagagcgtcaagaacactg

SEQ ID NO: 81701 - DNA, 25 bp, Homo sapien
gtatatctgttcatattctgtctgc

SEQ ID NO: 81702 - DNA, 25 bp, Homo sapien
gtatatctgttcgtattctgtctgc

SEQ ID NO: 81703 - DNA, 25 bp, Homo sapien
gtatatcttccacatgatagttatg

SEQ ID NO: 81704 - DNA, 25 bp, Homo sapien
gtatatcttccacgtgatagttatg

SEQ ID NO: 81705 - DNA, 25 bp, Homo sapien
gtatatgacaaccgcgacagcaact

SEQ ID NO: 81706 - DNA, 25 bp, Homo sapien
gtatatgacaactgcgacagcaact

SEQ ID NO: 81707 - DNA, 25 bp, Homo sapien
gtatatgatggagtaggtagatgaa

SEQ ID NO: 81708 - DNA, 25 bp, Homo sapien
gtatatgatggtgtaggtagatgaa

SEQ ID NO: 81709 - DNA, 25 bp, Homo sapien
gtatatggtggtaagagagctgaca

SEQ ID NO: 81710 - DNA, 25 bp, Homo sapien
gtatatggtggtatgagagctgaca

SEQ ID NO: 81711 - DNA, 25 bp, Homo sapien
gtatatgtatacgttaatctggaag

SEQ ID NO: 81712 - DNA, 25 bp, Homo sapien
gtatatgtatatgttaatctggaag

SEQ ID NO: 81713 - DNA, 25 bp, Homo sapien
gtatatgtctacgcattcttgtaaa

SEQ ID NO: 81714 - DNA, 25 bp, Homo sapien
gtatatgtctatgcattcttgtaaa

SEQ ID NO: 81715 - DNA, 25 bp, Homo sapien
gtatatgtttgcaatgagcatgctt

SEQ ID NO: 81716 - DNA, 25 bp, Homo sapien
gtatatgtttggaatgagcatgctt

SEQ ID NO: 81717 - DNA, 25 bp, Homo sapien
gtatatgttttattcacgttctcgg

SEQ ID NO: 81718 - DNA, 25 bp, Homo sapien
gtatatgttttattcatgttctcgg

SEQ ID NO: 81719 - DNA, 25 bp, Homo sapien
gtatattatccatcattatggcaaa

SEQ ID NO: 81720 - DNA, 25 bp, Homo sapien
gtatattatccatctttatggcaaa

SEQ ID NO: 81721 - DNA, 25 bp, Homo sapien
gtatattatctcaaatggcacaagg

SEQ ID NO: 81722 - DNA, 25 bp, Homo sapien
gtatattatctcacatggcacaagg

SEQ ID NO: 81723 - DNA, 25 bp, Homo sapien
gtatattatgagaattagtggtcac

SEQ ID NO: 81724 - DNA, 25 bp, Homo sapien
gtatattatgagagttagtggtcac

SEQ ID NO: 81725 - DNA, 25 bp, Homo sapien
gtatattccggtaacaaagagctaa

SEQ ID NO: 81726 - DNA, 25 bp, Homo sapien
gtatattcctatccttctgtggaca

SEQ ID NO: 81727 - DNA, 25 bp, Homo sapien
gtatattcctatccttttgtggaca

SEQ ID NO: 81728 - DNA, 25 bp, Homo sapien
gtatattctatcatttagagaggtc

SEQ ID NO: 81729 - DNA, 25 bp, Homo sapien
gtatattctggtaacaaagagctaa

SEQ ID NO: 81730 - DNA, 25 bp, Homo sapien
gtatattctgtcatttagagaggtc

SEQ ID NO: 81731 - DNA, 25 bp, Homo sapien
gtatattttctcatgatgaattctt

SEQ ID NO: 81732 - DNA, 25 bp, Homo sapien
gtatattttctcttgatgaattctt

SEQ ID NO: 81733 - DNA, 25 bp, Homo sapien
gtatcaaaacatgttcaactggaac

SEQ ID NO: 81734 - DNA, 25 bp, Homo sapien
gtatcaaagaccatttgactctatt

SEQ ID NO: 81735 - DNA, 25 bp, Homo sapien
gtatcaaagaccattttactctatt

SEQ ID NO: 81736 - DNA, 25 bp, Homo sapien
gtatcaaagcatgttcaactggaac

SEQ ID NO: 81737 - DNA, 25 bp, Homo sapien
gtatcaacacggataagcaaagaaa

SEQ ID NO: 81738 - DNA, 25 bp, Homo sapien
gtatcaacacgggtaagcaaagaaa

SEQ ID NO: 81739 - DNA, 25 bp, Homo sapien
gtatcaagtttgacttcgcaacagt

SEQ ID NO: 81740 - DNA, 25 bp, Homo sapien
gtatcaagtttgactttgcaacagt

SEQ ID NO: 81741 - DNA, 25 bp, Homo sapien
gtatcacgatttatcttcctttttc

SEQ ID NO: 81742 - DNA, 25 bp, Homo sapien
gtatcacgatttctcttcctttttc

SEQ ID NO: 81743 - DNA, 25 bp, Homo sapien
gtatcagacgcatttatttcgcata

SEQ ID NO: 81744 - DNA, 25 bp, Homo sapien
gtatcagatgcatttatttcgcata

SEQ ID NO: 81745 - DNA, 25 bp, Homo sapien
gtatcatccgaatgtcccaggtgaa

SEQ ID NO: 81746 - DNA, 25 bp, Homo sapien
gtatcatctgaatgtcccaggtgaa

SEQ ID NO: 81747 - DNA, 25 bp, Homo sapien
gtatcattgttgcatttgattgtcc

SEQ ID NO: 81748 - DNA, 25 bp, Homo sapien
gtatcatttatcatgagaagtgctg

SEQ ID NO: 81749 - DNA, 25 bp, Homo sapien
gtatcatttatcctgagaagtgctg

SEQ ID NO: 81750 - DNA, 25 bp, Homo sapien
gtatcatttttgcatttgattgtcc

SEQ ID NO: 81751 - DNA, 25 bp, Homo sapien
gtatccaccagtagtcacttccctc

SEQ ID NO: 81752 - DNA, 25 bp, Homo sapien
gtatccaccggtagtcacttccctc

SEQ ID NO: 81753 - DNA, 25 bp, Homo sapien
gtatccagccacagacagctcccga

SEQ ID NO: 81754 - DNA, 25 bp, Homo sapien
gtatccagccacagacggctcccga

SEQ ID NO: 81755 - DNA, 25 bp, Homo sapien
gtatccagtataagctaaacattat

SEQ ID NO: 81756 - DNA, 25 bp, Homo sapien
gtatccagtatatgctaaacattat

SEQ ID NO: 81757 - DNA, 25 bp, Homo sapien
gtatcccgtgccttctggaggtaat

SEQ ID NO: 81758 - DNA, 25 bp, Homo sapien
gtatcccgtgctttctggaggtaat

SEQ ID NO: 81759 - DNA, 25 bp, Homo sapien
gtatccctaggtgcgctttctcgac

SEQ ID NO: 81760 - DNA, 25 bp, Homo sapien
gtatccctaggtgctctttctcgac

SEQ ID NO: 81761 - DNA, 25 bp, Homo sapien
gtatcctaaaataagccaacacata

SEQ ID NO: 81762 - DNA, 25 bp, Homo sapien
gtatcctaagataagccaacacata

SEQ ID NO: 81763 - DNA, 25 bp, Homo sapien
gtatctaaacttcaaagtaccatat

SEQ ID NO: 81764 - DNA, 25 bp, Homo sapien
gtatctaaccttcaaagtaccatat

SEQ ID NO: 81765 - DNA, 25 bp, Homo sapien
gtatctatttcaactaagcaatggt

SEQ ID NO: 81766 - DNA, 25 bp, Homo sapien
gtatctatttccactaagcaatggt

SEQ ID NO: 81767 - DNA, 25 bp, Homo sapien
gtatctcactcttgaaaatgggcca

SEQ ID NO: 81768 - DNA, 25 bp, Homo sapien
gtatctcattcttgaaaatgggcca

SEQ ID NO: 81769 - DNA, 25 bp, Homo sapien
gtatctccacgaggttggtcattgg

SEQ ID NO: 81770 - DNA, 25 bp, Homo sapien
gtatctccatgaggttggtcattgg

SEQ ID NO: 81771 - DNA, 25 bp, Homo sapien
gtatctcctccatcttgccatcata

SEQ ID NO: 81772 - DNA, 25 bp, Homo sapien
gtatctcctccattttgccatcata

SEQ ID NO: 81773 - DNA, 25 bp, Homo sapien
gtatctgaactaattggtgatattc

SEQ ID NO: 81774 - DNA, 25 bp, Homo sapien
gtatctgaattaattggtgatattc

SEQ ID NO: 81775 - DNA, 25 bp, Homo sapien
gtatctgccactgattgctgttaaa

SEQ ID NO: 81776 - DNA, 25 bp, Homo sapien
gtatctgccgctgattgctgttaaa

SEQ ID NO: 81777 - DNA, 25 bp, Homo sapien
gtatctggaaacattttttggttgt

SEQ ID NO: 81778 - DNA, 25 bp, Homo sapien
gtatctggaaacgttttttggttgt

SEQ ID NO: 81779 - DNA, 25 bp, Homo sapien
gtatctggtaaagtgacaaaaatgt

SEQ ID NO: 81780 - DNA, 25 bp, Homo sapien
gtatctggtgaagtgacaaaaatgt

SEQ ID NO: 81781 - DNA, 25 bp, Homo sapien
gtatctgtaatcccttgtatcacat

SEQ ID NO: 81782 - DNA, 25 bp, Homo sapien
gtatctgtaatcctttgtatcacat

SEQ ID NO: 81783 - DNA, 25 bp, Homo sapien
gtatctgtggtttaagcttttcact

SEQ ID NO: 81784 - DNA, 25 bp, Homo sapien
gtatctgtggtttacgcttttcact

SEQ ID NO: 81785 - DNA, 25 bp, Homo sapien
gtatctgtgtattgcactaaatgga

SEQ ID NO: 81786 - DNA, 25 bp, Homo sapien
gtatctgtgtattgtactaaatgga

SEQ ID NO: 81787 - DNA, 25 bp, Homo sapien
gtatcttaagtaagtgaagcaggca

SEQ ID NO: 81788 - DNA, 25 bp, Homo sapien
gtatcttaagtgagtgaagcaggca

SEQ ID NO: 81789 - DNA, 25 bp, Homo sapien
gtatcttcctctgtcttactagatg

SEQ ID NO: 81790 - DNA, 25 bp, Homo sapien
gtatcttcgtctgtcttactagatg

SEQ ID NO: 81791 - DNA, 25 bp, Homo sapien
gtatcttctcaatttcaagccacct

SEQ ID NO: 81792 - DNA, 25 bp, Homo sapien
gtatcttctcaatttccagccacct

SEQ ID NO: 81793 - DNA, 25 bp, Homo sapien
gtatcttgctgaaaattgacacaga

SEQ ID NO: 81794 - DNA, 25 bp, Homo sapien
gtatcttgctgaagattgacacaga

SEQ ID NO: 81795 - DNA, 25 bp, Homo sapien
gtatcttgtaaattgagacagctct

SEQ ID NO: 81796 - DNA, 25 bp, Homo sapien
gtatcttgtaagttgagacagctct

SEQ ID NO: 81797 - DNA, 25 bp, Homo sapien
gtatctttagtagaagtgctgccac

SEQ ID NO: 81798 - DNA, 25 bp, Homo sapien
gtatctttagtaggagtgctgccac

SEQ ID NO: 81799 - DNA, 25 bp, Homo sapien
gtatctttctgggcactattatata

SEQ ID NO: 81800 - DNA, 25 bp, Homo sapien
gtatctttctgggcgctattatata

SEQ ID NO: 81801 - DNA, 25 bp, Homo sapien
gtatctttcttgctttgtagacaat

SEQ ID NO: 81802 - DNA, 25 bp, Homo sapien
gtatcttttgctagagaatgaaatc

SEQ ID NO: 81803 - DNA, 25 bp, Homo sapien
gtatcttttgctatagaatgaaatc

SEQ ID NO: 81804 - DNA, 25 bp, Homo sapien
gtatcttttttgctttgtagacaat

SEQ ID NO: 81805 - DNA, 25 bp, Homo sapien
gtatgaaacgcccctgctctgtgca

SEQ ID NO: 81806 - DNA, 25 bp, Homo sapien
gtatgaaatagaactccaaggcatc

SEQ ID NO: 81807 - DNA, 25 bp, Homo sapien
gtatgaaatagcactccaaggcatc

SEQ ID NO: 81808 - DNA, 25 bp, Homo sapien
gtatgaaatgcccctgctctgtgca

SEQ ID NO: 81809 - DNA, 25 bp, Homo sapien
gtatgaacaaaaaacgtatctcatt

SEQ ID NO: 81810 - DNA, 25 bp, Homo sapien
gtatgaacaaaaaatgtatctcatt

SEQ ID NO: 81811 - DNA, 25 bp, Homo sapien
gtatgaacttcatggtcttcagaat

SEQ ID NO: 81812 - DNA, 25 bp, Homo sapien
gtatgaacttcattgtcttcagaat

SEQ ID NO: 81813 - DNA, 25 bp, Homo sapien
gtatgaagcttcccaaagttttaag

SEQ ID NO: 81814 - DNA, 25 bp, Homo sapien
gtatgaagcttctcaaagttttaag

SEQ ID NO: 81815 - DNA, 25 bp, Homo sapien
gtatgaattagaaagtataagtgaa

SEQ ID NO: 81816 - DNA, 25 bp, Homo sapien
gtatgaattagaaagtgtaagtgaa

SEQ ID NO: 81817 - DNA, 25 bp, Homo sapien
gtatgaggctactgtttccatccac

SEQ ID NO: 81818 - DNA, 25 bp, Homo sapien
gtatgaggctactttttccatccac

SEQ ID NO: 81819 - DNA, 25 bp, Homo sapien
gtatgaggtcgcagccttctctgtc

SEQ ID NO: 81820 - DNA, 25 bp, Homo sapien
gtatgaggtcgcaggcttctctgtc

SEQ ID NO: 81821 - DNA, 25 bp, Homo sapien
gtatgagtatggaatcaagaaatgg

SEQ ID NO: 81822 - DNA, 25 bp, Homo sapien
gtatgagtatggtatcaagaaatgg

SEQ ID NO: 81823 - DNA, 25 bp, Homo sapien
gtatgagttagcagtcccagaatgt

SEQ ID NO: 81824 - DNA, 25 bp, Homo sapien
gtatgagttagcagtctcagaatgt

SEQ ID NO: 81825 - DNA, 25 bp, Homo sapien
gtatgagttcaggcaaatcatctaa

SEQ ID NO: 81826 - DNA, 25 bp, Homo sapien
gtatgagttcaggcaagtcatctaa

SEQ ID NO: 81827 - DNA, 25 bp, Homo sapien
gtatgcaaaaaagcctaaaacaaaa

SEQ ID NO: 81828 - DNA, 25 bp, Homo sapien
gtatgcaaaaaaggctaaaacaaaa

SEQ ID NO: 81829 - DNA, 25 bp, Homo sapien
gtatgcaatcaaacaaccagatcat

SEQ ID NO: 81830 - DNA, 25 bp, Homo sapien
gtatgcaattaaacaaccagatcat

SEQ ID NO: 81831 - DNA, 25 bp, Homo sapien
gtatgcaattccaacggctcagagc

SEQ ID NO: 81832 - DNA, 25 bp, Homo sapien
gtatgcaattccaagggctcagagc

SEQ ID NO: 81833 - DNA, 25 bp, Homo sapien
gtatgcacaaagggcaataaagcaa

SEQ ID NO: 81834 - DNA, 25 bp, Homo sapien
gtatgcacgaagggcaataaagcaa

SEQ ID NO: 81835 - DNA, 25 bp, Homo sapien
gtatgcagagaaaggaaatgtctgt

SEQ ID NO: 81836 - DNA, 25 bp, Homo sapien
gtatgcagcgaaaggaaatgtctgt

SEQ ID NO: 81837 - DNA, 25 bp, Homo sapien
gtatgcaggcttcaggcacagtttg

SEQ ID NO: 81838 - DNA, 25 bp, Homo sapien
gtatgcaggtttcaggcacagtttg

SEQ ID NO: 81839 - DNA, 25 bp, Homo sapien
gtatgcccatcaattcaagcattta

SEQ ID NO: 81840 - DNA, 25 bp, Homo sapien
gtatgcccatcagttcaagcattta

SEQ ID NO: 81841 - DNA, 25 bp, Homo sapien
gtatgctgtgcagcagttatccctt

SEQ ID NO: 81842 - DNA, 25 bp, Homo sapien
gtatgctgtgcagcggttatccctt

SEQ ID NO: 81843 - DNA, 25 bp, Homo sapien
gtatgctttggagtggcgaggttaa

SEQ ID NO: 81844 - DNA, 25 bp, Homo sapien
gtatgctttggagtggtgaggttaa

SEQ ID NO: 81845 - DNA, 25 bp, Homo sapien
gtatggaaaatacgtataaggtccc

SEQ ID NO: 81846 - DNA, 25 bp, Homo sapien
gtatggaaaatatgtataaggtccc

SEQ ID NO: 81847 - DNA, 25 bp, Homo sapien
gtatggaagaggtacaaaaaaacag

SEQ ID NO: 81848 - DNA, 25 bp, Homo sapien
gtatggaagaggtagaaaaaaacag

SEQ ID NO: 81849 - DNA, 25 bp, Homo sapien
gtatggacactaaccaactctacaa

SEQ ID NO: 81850 - DNA, 25 bp, Homo sapien
gtatggacactacccaactctacaa

SEQ ID NO: 81851 - DNA, 25 bp, Homo sapien
gtatggagcatggaaaaatgggcac

SEQ ID NO: 81852 - DNA, 25 bp, Homo sapien
gtatggagcctggaaaaatgggcac

SEQ ID NO: 81853 - DNA, 25 bp, Homo sapien
gtatggatatttggcatgatatatt

SEQ ID NO: 81854 - DNA, 25 bp, Homo sapien
gtatggatattttgcatgatatatt

SEQ ID NO: 81855 - DNA, 25 bp, Homo sapien
gtatggatggcatcatttggttaaa

SEQ ID NO: 81856 - DNA, 25 bp, Homo sapien
gtatggatggcatcgtttggttaaa

SEQ ID NO: 81857 - DNA, 25 bp, Homo sapien
gtatggccagagaactgaaaatggc

SEQ ID NO: 81858 - DNA, 25 bp, Homo sapien
gtatggccagagaattgaaaatggc

SEQ ID NO: 81859 - DNA, 25 bp, Homo sapien
gtatgggcagcctataaaagctggt

SEQ ID NO: 81860 - DNA, 25 bp, Homo sapien
gtatgggcagcgtataaaagctggt

SEQ ID NO: 81861 - DNA, 25 bp, Homo sapien
gtatgggccctttcgtcacctggac

SEQ ID NO: 81862 - DNA, 25 bp, Homo sapien
gtatgggcccttttgtcacctggac

SEQ ID NO: 81863 - DNA, 25 bp, Homo sapien
gtatggtattgatacttgcagatgt

SEQ ID NO: 81864 - DNA, 25 bp, Homo sapien
gtatggtattgatgcttgcagatgt

SEQ ID NO: 81865 - DNA, 25 bp, Homo sapien
gtatggtctcacttacaatggaata

SEQ ID NO: 81866 - DNA, 25 bp, Homo sapien
gtatggtctcacttgcaatggaata

SEQ ID NO: 81867 - DNA, 25 bp, Homo sapien
gtatggttgagattgtctcatagag

SEQ ID NO: 81868 - DNA, 25 bp, Homo sapien
gtatggttgagattttctcatagag

SEQ ID NO: 81869 - DNA, 25 bp, Homo sapien
gtatgtattataagacctacagttg

SEQ ID NO: 81870 - DNA, 25 bp, Homo sapien
gtatgtattcagatgagtttcaaga

SEQ ID NO: 81871 - DNA, 25 bp, Homo sapien
gtatgtattctgcaaatatttcaaa

SEQ ID NO: 81872 - DNA, 25 bp, Homo sapien
gtatgtattctgtaaatatttcaaa

SEQ ID NO: 81873 - DNA, 25 bp, Homo sapien
gtatgtattgagatgagtttcaaga

SEQ ID NO: 81874 - DNA, 25 bp, Homo sapien
gtatgtattgtaagacctacagttg

SEQ ID NO: 81875 - DNA, 25 bp, Homo sapien
gtatgtcaagtacagggctgcaaaa

SEQ ID NO: 81876 - DNA, 25 bp, Homo sapien
gtatgtcaagtacggggctgcaaaa

SEQ ID NO: 81877 - DNA, 25 bp, Homo sapien
gtatgtcacctctccttgaatgtag

SEQ ID NO: 81878 - DNA, 25 bp, Homo sapien
gtatgtcacctcttcttgaatgtag

SEQ ID NO: 81879 - DNA, 25 bp, Homo sapien
gtatgtccattctcagggctcaaat

SEQ ID NO: 81880 - DNA, 25 bp, Homo sapien
gtatgtccattctcagtgctcaaat

SEQ ID NO: 81881 - DNA, 25 bp, Homo sapien
gtatgtgtaataattcatgtataca

SEQ ID NO: 81882 - DNA, 25 bp, Homo sapien
gtatgtgtagtaattcatgtataca

SEQ ID NO: 81883 - DNA, 25 bp, Homo sapien
gtatgttaattacggacgcaaacaa

SEQ ID NO: 81884 - DNA, 25 bp, Homo sapien
gtatgttaattacggatgcaaacaa

SEQ ID NO: 81885 - DNA, 25 bp, Homo sapien
gtatgttacgggcttcatcagagaa

SEQ ID NO: 81886 - DNA, 25 bp, Homo sapien
gtatgttagaaccaaagtgctaagt

SEQ ID NO: 81887 - DNA, 25 bp, Homo sapien
gtatgttagaaccgaagtgctaagt

SEQ ID NO: 81888 - DNA, 25 bp, Homo sapien
gtatgttatgggcttcatcagagaa

SEQ ID NO: 81889 - DNA, 25 bp, Homo sapien
gtatgttgttctagcaccatgcatg

SEQ ID NO: 81890 - DNA, 25 bp, Homo sapien
gtatgttgttctggcaccatgcatg

SEQ ID NO: 81891 - DNA, 25 bp, Homo sapien
gtatgtttaaggaagagaaagatag

SEQ ID NO: 81892 - DNA, 25 bp, Homo sapien
gtatgtttagggaagagaaagatag

SEQ ID NO: 81893 - DNA, 25 bp, Homo sapien
gtatgtttgcagtgacaaaagttga

SEQ ID NO: 81894 - DNA, 25 bp, Homo sapien
gtatgtttgtagtgacaaaagttga

SEQ ID NO: 81895 - DNA, 25 bp, Homo sapien
gtatgttttatacgtatcctagtag

SEQ ID NO: 81896 - DNA, 25 bp, Homo sapien
gtatgttttatatgtatcctagtag

SEQ ID NO: 81897 - DNA, 25 bp, Homo sapien
gtattaaaacacctcacgcctcagg

SEQ ID NO: 81898 - DNA, 25 bp, Homo sapien
gtattaaaacacttcacgcctcagg

SEQ ID NO: 81899 - DNA, 25 bp, Homo sapien
gtattaaaatcacaagaaaagcaaa

SEQ ID NO: 81900 - DNA, 25 bp, Homo sapien
gtattaaagagtcttgtcaatgcct

SEQ ID NO: 81901 - DNA, 25 bp, Homo sapien
gtattaaagggtcttgtcaatgcct

SEQ ID NO: 81902 - DNA, 25 bp, Homo sapien
gtattaaagtcacaagaaaagcaaa

SEQ ID NO: 81903 - DNA, 25 bp, Homo sapien
gtattaacaatttttccataagctc

SEQ ID NO: 81904 - DNA, 25 bp, Homo sapien
gtattaacagtttttccataagctc

SEQ ID NO: 81905 - DNA, 25 bp, Homo sapien
gtattaagcgtccagtcagataatc

SEQ ID NO: 81906 - DNA, 25 bp, Homo sapien
gtattaaggatcatttttgagtatt

SEQ ID NO: 81907 - DNA, 25 bp, Homo sapien
gtattaaggatcgtttttgagtatt

SEQ ID NO: 81908 - DNA, 25 bp, Homo sapien
gtattaagtactttttagcagttaa

SEQ ID NO: 81909 - DNA, 25 bp, Homo sapien
gtattaagtactttttcgcagttaa

SEQ ID NO: 81910 - DNA, 25 bp, Homo sapien
gtattaagtgtccagtcagataatc

SEQ ID NO: 81911 - DNA, 25 bp, Homo sapien
gtattacaagtcatgccacagaaat

SEQ ID NO: 81912 - DNA, 25 bp, Homo sapien
gtattacaagtcgtgccacagaaat

SEQ ID NO: 81913 - DNA, 25 bp, Homo sapien
gtattacctcacttgccgcttattt

SEQ ID NO: 81914 - DNA, 25 bp, Homo sapien
gtattacctcagttgccgcttattt

SEQ ID NO: 81915 - DNA, 25 bp, Homo sapien
gtattactcacaatttttgccatgg

SEQ ID NO: 81916 - DNA, 25 bp, Homo sapien
gtattactcacagtttttgccatgg

SEQ ID NO: 81917 - DNA, 25 bp, Homo sapien
gtattactcttgcagttgtttactt

SEQ ID NO: 81918 - DNA, 25 bp, Homo sapien
gtattactcttgtagttgtttactt

SEQ ID NO: 81919 - DNA, 25 bp, Homo sapien
gtattagacagaccatcaaggcaga

SEQ ID NO: 81920 - DNA, 25 bp, Homo sapien
gtattagatagaccatcaaggcaga

SEQ ID NO: 81921 - DNA, 25 bp, Homo sapien
gtattagattgactaaaagcatggt

SEQ ID NO: 81922 - DNA, 25 bp, Homo sapien
gtattagattgattaaaagcatggt

SEQ ID NO: 81923 - DNA, 25 bp, Homo sapien
gtattaggtacaaaaccataatgac

SEQ ID NO: 81924 - DNA, 25 bp, Homo sapien
gtattaggtacaaatccataatgac

SEQ ID NO: 81925 - DNA, 25 bp, Homo sapien
gtattagtctccaaagattagaaaa

SEQ ID NO: 81926 - DNA, 25 bp, Homo sapien
gtattagtctccgaagattagaaaa

SEQ ID NO: 81927 - DNA, 25 bp, Homo sapien
gtattataatgtgcaaccagattaa

SEQ ID NO: 81928 - DNA, 25 bp, Homo sapien
gtattataatgtgcgaccagattaa

SEQ ID NO: 81929 - DNA, 25 bp, Homo sapien
gtattatagctggtacataaagaac

SEQ ID NO: 81930 - DNA, 25 bp, Homo sapien
gtattatagttggtacataaagaac

SEQ ID NO: 81931 - DNA, 25 bp, Homo sapien
gtattatgatctttacactaaagga

SEQ ID NO: 81932 - DNA, 25 bp, Homo sapien
gtattatgctctttacactaaagga

SEQ ID NO: 81933 - DNA, 25 bp, Homo sapien
gtattattagggatttaggtcagtc

SEQ ID NO: 81934 - DNA, 25 bp, Homo sapien
gtattattagggttttaggtcagtc

SEQ ID NO: 81935 - DNA, 25 bp, Homo sapien
gtattattgctcctcacaagcttaa

SEQ ID NO: 81936 - DNA, 25 bp, Homo sapien
gtattattgctcctcataagcttaa

SEQ ID NO: 81937 - DNA, 25 bp, Homo sapien
gtattcacacacttcttttggatga

SEQ ID NO: 81938 - DNA, 25 bp, Homo sapien
gtattcacatacttcttttggatga

SEQ ID NO: 81939 - DNA, 25 bp, Homo sapien
gtattcaccggtgtgaccctagtac

SEQ ID NO: 81940 - DNA, 25 bp, Homo sapien
gtattcactggtgtgaccctagtac

SEQ ID NO: 81941 - DNA, 25 bp, Homo sapien
gtattcagatttccccagttgctca

SEQ ID NO: 81942 - DNA, 25 bp, Homo sapien
gtattcagattttcccagttgctca

SEQ ID NO: 81943 - DNA, 25 bp, Homo sapien
gtattcagtagactcacctgacaca

SEQ ID NO: 81944 - DNA, 25 bp, Homo sapien
gtattcagtagactcatctgacaca

SEQ ID NO: 81945 - DNA, 25 bp, Homo sapien
gtattcatccaagtccttgagtgga

SEQ ID NO: 81946 - DNA, 25 bp, Homo sapien
gtattcatccaagtgcttgagtgga

SEQ ID NO: 81947 - DNA, 25 bp, Homo sapien
gtattcattggttttcattgttagt

SEQ ID NO: 81948 - DNA, 25 bp, Homo sapien
gtattcatttgttttcattgttagt

SEQ ID NO: 81949 - DNA, 25 bp, Homo sapien
gtattcctctttaatttatctgact

SEQ ID NO: 81950 - DNA, 25 bp, Homo sapien
gtattcctctttgatttatctgact

SEQ ID NO: 81951 - DNA, 25 bp, Homo sapien
gtattctactcagaatcttacccta

SEQ ID NO: 81952 - DNA, 25 bp, Homo sapien
gtattctactcagactcttacccta

SEQ ID NO: 81953 - DNA, 25 bp, Homo sapien
gtattctcattgtgaattctgggac

SEQ ID NO: 81954 - DNA, 25 bp, Homo sapien
gtattctcattgttaattctgggac

SEQ ID NO: 81955 - DNA, 25 bp, Homo sapien
gtattctctgaagtatgaatgtcta

SEQ ID NO: 81956 - DNA, 25 bp, Homo sapien
gtattctctgaggtatgaatgtcta

SEQ ID NO: 81957 - DNA, 25 bp, Homo sapien
gtattctgaaatcctcaaaactttc

SEQ ID NO: 81958 - DNA, 25 bp, Homo sapien
gtattctgcaaatatttcaaaatct

SEQ ID NO: 81959 - DNA, 25 bp, Homo sapien
gtattctggaatcctcaaaactttc

SEQ ID NO: 81960 - DNA, 25 bp, Homo sapien
gtattctgtaaatatttcaaaatct

SEQ ID NO: 81961 - DNA, 25 bp, Homo sapien
gtattcttacagcagcgctccacta

SEQ ID NO: 81962 - DNA, 25 bp, Homo sapien
gtattcttacagctgcgctccacta

SEQ ID NO: 81963 - DNA, 25 bp, Homo sapien
gtattcttagtgtcctcatctttga

SEQ ID NO: 81964 - DNA, 25 bp, Homo sapien
gtattcttagtgtcttcatctttga

SEQ ID NO: 81965 - DNA, 25 bp, Homo sapien
gtattctttcaaaactccattgact

SEQ ID NO: 81966 - DNA, 25 bp, Homo sapien
gtattctttcaaatctccattgact

SEQ ID NO: 81967 - DNA, 25 bp, Homo sapien
gtattcttttcaatatgtcagtctt

SEQ ID NO: 81968 - DNA, 25 bp, Homo sapien
gtattcttttcagtatgtcagtctt

SEQ ID NO: 81969 - DNA, 25 bp, Homo sapien
gtattgaacacaattgaatcttatt

SEQ ID NO: 81970 - DNA, 25 bp, Homo sapien
gtattgaacacaattggatcttatt

SEQ ID NO: 81971 - DNA, 25 bp, Homo sapien
gtattgagcattacaataagtgctg

SEQ ID NO: 81972 - DNA, 25 bp, Homo sapien
gtattgagcattataataagtgctg

SEQ ID NO: 81973 - DNA, 25 bp, Homo sapien
gtattgagccaagcagcttaaaaca

SEQ ID NO: 81974 - DNA, 25 bp, Homo sapien
gtattgagccaagctgcttaaaaca

SEQ ID NO: 81975 - DNA, 25 bp, Homo sapien
gtattgaggcttctcaggcaatggg

SEQ ID NO: 81976 - DNA, 25 bp, Homo sapien
gtattgaggtttctcaggcaatggg

SEQ ID NO: 81977 - DNA, 25 bp, Homo sapien
gtattgattaactagtatggaaaca

SEQ ID NO: 81978 - DNA, 25 bp, Homo sapien
gtattgattgactagtatggaaaca

SEQ ID NO: 81979 - DNA, 25 bp, Homo sapien
gtattgcagccaggaaatgaataaa

SEQ ID NO: 81980 - DNA, 25 bp, Homo sapien
gtattgcagtcaggaaatgaataaa

SEQ ID NO: 81981 - DNA, 25 bp, Homo sapien
gtattgctaaactacgcaggccctc

SEQ ID NO: 81982 - DNA, 25 bp, Homo sapien
gtattgctaaactatgcaggccctc

SEQ ID NO: 81983 - DNA, 25 bp, Homo sapien
gtattgctaagtagtactccatttt

SEQ ID NO: 81984 - DNA, 25 bp, Homo sapien
gtattgctaagtagtattccatttt

SEQ ID NO: 81985 - DNA, 25 bp, Homo sapien
gtattgctatcaacaacgtattatg

SEQ ID NO: 81986 - DNA, 25 bp, Homo sapien
gtattgctatcagcaacgtattatg

SEQ ID NO: 81987 - DNA, 25 bp, Homo sapien
gtattgctgtttctcaatgattctc

SEQ ID NO: 81988 - DNA, 25 bp, Homo sapien
gtattgctgtttctcattgattctc

SEQ ID NO: 81989 - DNA, 25 bp, Homo sapien
gtattggagttatagcatgagagga

SEQ ID NO: 81990 - DNA, 25 bp, Homo sapien
gtattggagttctagcatgagagga

SEQ ID NO: 81991 - DNA, 25 bp, Homo sapien
gtattggcagggaccaaaataacat

SEQ ID NO: 81992 - DNA, 25 bp, Homo sapien
gtattggcagggacgaaaataacat

SEQ ID NO: 81993 - DNA, 25 bp, Homo sapien
gtattggctgggaccggtcatgtgt

SEQ ID NO: 81994 - DNA, 25 bp, Homo sapien
gtattggctgggactggtcatgtgt

SEQ ID NO: 81995 - DNA, 25 bp, Homo sapien
gtattgtcaaaggtaaaatattctg

SEQ ID NO: 81996 - DNA, 25 bp, Homo sapien
gtattgtcaaaggtgaaatattctg

SEQ ID NO: 81997 - DNA, 25 bp, Homo sapien
gtattgtcaatagcagtgagattgg

SEQ ID NO: 81998 - DNA, 25 bp, Homo sapien
gtattgtcaggacttggattctagc

SEQ ID NO: 81999 - DNA, 25 bp, Homo sapien
gtattgtcaggatttggattctagc

SEQ ID NO: 82000 - DNA, 25 bp, Homo sapien
gtattgtcagtagcagtgagattgg

SEQ ID NO: 82001 - DNA, 25 bp, Homo sapien
gtattgtggaatgagaaaggacttg

SEQ ID NO: 82002 - DNA, 25 bp, Homo sapien
gtattgtggaatgagagaggacttg

SEQ ID NO: 82003 - DNA, 25 bp, Homo sapien
gtattgttattatccttccaaaaat

SEQ ID NO: 82004 - DNA, 25 bp, Homo sapien
gtattgttattatcgttccaaaaat

SEQ ID NO: 82005 - DNA, 25 bp, Homo sapien
gtattgttcttagaatgtatgtctt

SEQ ID NO: 82006 - DNA, 25 bp, Homo sapien
gtattgtttttagaatgtatgtctt

SEQ ID NO: 82007 - DNA, 25 bp, Homo sapien
gtatttaaacagcaatccaaaggac

SEQ ID NO: 82008 - DNA, 25 bp, Homo sapien
gtatttaaccaatatttagaggggc

SEQ ID NO: 82009 - DNA, 25 bp, Homo sapien
gtatttaaccagcaatccaaaggac

SEQ ID NO: 82010 - DNA, 25 bp, Homo sapien
gtatttaaccattatttagaggggc

SEQ ID NO: 82011 - DNA, 25 bp, Homo sapien
gtatttacaaagctccctgttttat

SEQ ID NO: 82012 - DNA, 25 bp, Homo sapien
gtatttacatagctccctgttttat

SEQ ID NO: 82013 - DNA, 25 bp, Homo sapien
gtatttatagtcctgcaattatcag

SEQ ID NO: 82014 - DNA, 25 bp, Homo sapien
gtatttatagtcttgcaattatcag

SEQ ID NO: 82015 - DNA, 25 bp, Homo sapien
gtatttcatgacgtcttgaggcagg

SEQ ID NO: 82016 - DNA, 25 bp, Homo sapien
gtatttcatgatgtcttgaggcagg

SEQ ID NO: 82017 - DNA, 25 bp, Homo sapien
gtatttcatgctgccggccactgaa

SEQ ID NO: 82018 - DNA, 25 bp, Homo sapien
gtatttcatgctgctggccactgaa

SEQ ID NO: 82019 - DNA, 25 bp, Homo sapien
gtatttccagtgcagtgttctatct

SEQ ID NO: 82020 - DNA, 25 bp, Homo sapien
gtatttccggtgcagtgttctatct

SEQ ID NO: 82021 - DNA, 25 bp, Homo sapien
gtatttctatagagaggatccagct

SEQ ID NO: 82022 - DNA, 25 bp, Homo sapien
gtatttctctctcacgttatatgtg

SEQ ID NO: 82023 - DNA, 25 bp, Homo sapien
gtatttctctctcatgttatatgtg

SEQ ID NO: 82024 - DNA, 25 bp, Homo sapien
gtatttctgatgttttaaaatgtct

SEQ ID NO: 82025 - DNA, 25 bp, Homo sapien
gtatttctgcacgaaggatttaaaa

SEQ ID NO: 82026 - DNA, 25 bp, Homo sapien
gtatttctgctgttttaaaatgtct

SEQ ID NO: 82027 - DNA, 25 bp, Homo sapien
gtatttctggacgaaggatttaaaa

SEQ ID NO: 82028 - DNA, 25 bp, Homo sapien
gtatttcttcttctcatttctcgcc

SEQ ID NO: 82029 - DNA, 25 bp, Homo sapien
gtatttcttcttctgatttctcgcc

SEQ ID NO: 82030 - DNA, 25 bp, Homo sapien
gtatttcttgagccgagactttttg

SEQ ID NO: 82031 - DNA, 25 bp, Homo sapien
gtatttcttgagctgagactttttg

SEQ ID NO: 82032 - DNA, 25 bp, Homo sapien
gtatttctttagagaggatccagct

SEQ ID NO: 82033 - DNA, 25 bp, Homo sapien
gtatttgactgcctaacttttcagg

SEQ ID NO: 82034 - DNA, 25 bp, Homo sapien
gtatttgactgcttaacttttcagg

SEQ ID NO: 82035 - DNA, 25 bp, Homo sapien
gtatttgcatacctatagctctttc

SEQ ID NO: 82036 - DNA, 25 bp, Homo sapien
gtatttgcatacttatagctctttc

SEQ ID NO: 82037 - DNA, 25 bp, Homo sapien
gtatttgcattgcatcttctttgat

SEQ ID NO: 82038 - DNA, 25 bp, Homo sapien
gtatttgcattgcgtcttctttgat

SEQ ID NO: 82039 - DNA, 25 bp, Homo sapien
gtatttgctcggtgaagtgaaatgt

SEQ ID NO: 82040 - DNA, 25 bp, Homo sapien
gtatttgcttggtgaagtgaaatgt

SEQ ID NO: 82041 - DNA, 25 bp, Homo sapien
gtatttgtccctcggaacagagcac

SEQ ID NO: 82042 - DNA, 25 bp, Homo sapien
gtatttgtcccttggaacagagcac

SEQ ID NO: 82043 - DNA, 25 bp, Homo sapien
gtatttgtgctaacgatctctgtct

SEQ ID NO: 82044 - DNA, 25 bp, Homo sapien
gtatttgtgctaatgatctctgtct

SEQ ID NO: 82045 - DNA, 25 bp, Homo sapien
gtattttaaattggccattccacct

SEQ ID NO: 82046 - DNA, 25 bp, Homo sapien
gtattttaaattggtcattccacct

SEQ ID NO: 82047 - DNA, 25 bp, Homo sapien
gtattttaacgtaaaacatgcagga

SEQ ID NO: 82048 - DNA, 25 bp, Homo sapien
gtattttaatgtaaaacatgcagga

SEQ ID NO: 82049 - DNA, 25 bp, Homo sapien
gtattttacacacatagcctgttac

SEQ ID NO: 82050 - DNA, 25 bp, Homo sapien
gtattttacacatatagcctgttac

SEQ ID NO: 82051 - DNA, 25 bp, Homo sapien
gtattttactttactcaccattgta

SEQ ID NO: 82052 - DNA, 25 bp, Homo sapien
gtattttactttattcaccattgta

SEQ ID NO: 82053 - DNA, 25 bp, Homo sapien
gtattttcaaataatgccaggaaat

SEQ ID NO: 82054 - DNA, 25 bp, Homo sapien
gtattttcaaataatgtcaggaaat

SEQ ID NO: 82055 - DNA, 25 bp, Homo sapien
gtattttccaaacttattgtactac

SEQ ID NO: 82056 - DNA, 25 bp, Homo sapien
gtattttccaaatttattgtactac

SEQ ID NO: 82057 - DNA, 25 bp, Homo sapien
gtattttctacctaattggcacatt

SEQ ID NO: 82058 - DNA, 25 bp, Homo sapien
gtattttctccctaattggcacatt

SEQ ID NO: 82059 - DNA, 25 bp, Homo sapien
gtattttctgtaatgactttcagag

SEQ ID NO: 82060 - DNA, 25 bp, Homo sapien
gtattttctgtaatgattttcagag

SEQ ID NO: 82061 - DNA, 25 bp, Homo sapien
gtcaaaaaatttcatgctaagccag

SEQ ID NO: 82062 - DNA, 25 bp, Homo sapien
gtcaaaaaatttcatgttaagccag

SEQ ID NO: 82063 - DNA, 25 bp, Homo sapien
gtcaaaagatggcaactcagcattg

SEQ ID NO: 82064 - DNA, 25 bp, Homo sapien
gtcaaaagatgggaactcagcattg

SEQ ID NO: 82065 - DNA, 25 bp, Homo sapien
gtcaaaagccattgcaaaatttgaa

SEQ ID NO: 82066 - DNA, 25 bp, Homo sapien
gtcaaaagccattgtaaaatttgaa

SEQ ID NO: 82067 - DNA, 25 bp, Homo sapien
gtcaaaaggccctaagaggaaagtg

SEQ ID NO: 82068 - DNA, 25 bp, Homo sapien
gtcaaaaggtcctaagaggaaagtg

SEQ ID NO: 82069 - DNA, 25 bp, Homo sapien
gtcaaaatcacacttaaactgaact

SEQ ID NO: 82070 - DNA, 25 bp, Homo sapien
gtcaaaatcgcacttaaactgaact

SEQ ID NO: 82071 - DNA, 25 bp, Homo sapien
gtcaaaatgtgaacagaccagtcaa

SEQ ID NO: 82072 - DNA, 25 bp, Homo sapien
gtcaaaatgtgaatagaccagtcaa

SEQ ID NO: 82073 - DNA, 25 bp, Homo sapien
gtcaaactccttccttttggtgatg

SEQ ID NO: 82074 - DNA, 25 bp, Homo sapien
gtcaaactctttccttttggtgatg

SEQ ID NO: 82075 - DNA, 25 bp, Homo sapien
gtcaaactgccacctcagggcaaat

SEQ ID NO: 82076 - DNA, 25 bp, Homo sapien
gtcaaactgccgcctcagggcaaat

SEQ ID NO: 82077 - DNA, 25 bp, Homo sapien
gtcaaacttctgagctgagagagca

SEQ ID NO: 82078 - DNA, 25 bp, Homo sapien
gtcaaacttttgagctgagagagca

SEQ ID NO: 82079 - DNA, 25 bp, Homo sapien
gtcaaagaactacataagcttctga

SEQ ID NO: 82080 - DNA, 25 bp, Homo sapien
gtcaaagaactacgtaagcttctga

SEQ ID NO: 82081 - DNA, 25 bp, Homo sapien
gtcaaagaggtcactttactttcct

SEQ ID NO: 82082 - DNA, 25 bp, Homo sapien
gtcaaagaggtcgctttactttcct

SEQ ID NO: 82083 - DNA, 25 bp, Homo sapien
gtcaaagcaccgtaacttggggtat

SEQ ID NO: 82084 - DNA, 25 bp, Homo sapien
gtcaaagcaccgtatcttggggtat

SEQ ID NO: 82085 - DNA, 25 bp, Homo sapien
gtcaaagcataaagaaaaagtagca

SEQ ID NO: 82086 - DNA, 25 bp, Homo sapien
gtcaaagcataaagaacaagtagca

SEQ ID NO: 82087 - DNA, 25 bp, Homo sapien
gtcaaagctgaaagcctgtttgaac

SEQ ID NO: 82088 - DNA, 25 bp, Homo sapien
gtcaaagctgaatgcctgtttgaac

SEQ ID NO: 82089 - DNA, 25 bp, Homo sapien
gtcaaaggaaagagtgcaatcagag

SEQ ID NO: 82090 - DNA, 25 bp, Homo sapien
gtcaaaggaaagggtgcaatcagag

SEQ ID NO: 82091 - DNA, 25 bp, Homo sapien
gtcaaaggtagtatgagctctgctc

SEQ ID NO: 82092 - DNA, 25 bp, Homo sapien
gtcaaaggtggtatgagctctgctc

SEQ ID NO: 82093 - DNA, 25 bp, Homo sapien
gtcaaagtagaatgagagatggcat

SEQ ID NO: 82094 - DNA, 25 bp, Homo sapien
gtcaaagtagaattagagatggcat

SEQ ID NO: 82095 - DNA, 25 bp, Homo sapien
gtcaaagtaggatgagatttataca

SEQ ID NO: 82096 - DNA, 25 bp, Homo sapien
gtcaaagtgggatgagatttataca

SEQ ID NO: 82097 - DNA, 25 bp, Homo sapien
gtcaaatacctcaaatgtctatcag

SEQ ID NO: 82098 - DNA, 25 bp, Homo sapien
gtcaaataccttaaatgtctatcag

SEQ ID NO: 82099 - DNA, 25 bp, Homo sapien
gtcaaataggctgcaccgtactttg

SEQ ID NO: 82100 - DNA, 25 bp, Homo sapien
gtcaaataggctgcactgtactttg

SEQ ID NO: 82101 - DNA, 25 bp, Homo sapien
gtcaaatccaactggaacccaggtg

SEQ ID NO: 82102 - DNA, 25 bp, Homo sapien
gtcaaatccaattggaacccaggtg

SEQ ID NO: 82103 - DNA, 25 bp, Homo sapien
gtcaaatgctttagggctgtcccag

SEQ ID NO: 82104 - DNA, 25 bp, Homo sapien
gtcaaatgttttagggctgtcccag

SEQ ID NO: 82105 - DNA, 25 bp, Homo sapien
gtcaaattgtacaataattcccagt

SEQ ID NO: 82106 - DNA, 25 bp, Homo sapien
gtcaaattgtacagtaattcccagt

SEQ ID NO: 82107 - DNA, 25 bp, Homo sapien
gtcaacagttcaggcaactttactt

SEQ ID NO: 82108 - DNA, 25 bp, Homo sapien
gtcaacagttcaggcagctttactt

SEQ ID NO: 82109 - DNA, 25 bp, Homo sapien
gtcaacagtttatgtgcaactcaac

SEQ ID NO: 82110 - DNA, 25 bp, Homo sapien
gtcaacagtttgtgtgcaactcaac

SEQ ID NO: 82111 - DNA, 25 bp, Homo sapien
gtcaacatgctccgaatttatgagt

SEQ ID NO: 82112 - DNA, 25 bp, Homo sapien
gtcaacatgctctgaatttatgagt

SEQ ID NO: 82113 - DNA, 25 bp, Homo sapien
gtcaacattatgatcaaaggtgaaa

SEQ ID NO: 82114 - DNA, 25 bp, Homo sapien
gtcaacattatgctcaaaggtgaaa

SEQ ID NO: 82115 - DNA, 25 bp, Homo sapien
gtcaacccccagttccaccattcgt

SEQ ID NO: 82116 - DNA, 25 bp, Homo sapien
gtcaacccctagttccaccattcgt

SEQ ID NO: 82117 - DNA, 25 bp, Homo sapien
gtcaacctgggatactcgagtttgg

SEQ ID NO: 82118 - DNA, 25 bp, Homo sapien
gtcaacctgggatacttgagtttgg

SEQ ID NO: 82119 - DNA, 25 bp, Homo sapien
gtcaactatttaagaaggctacttt

SEQ ID NO: 82120 - DNA, 25 bp, Homo sapien
gtcaactatttaagcaggctacttt

SEQ ID NO: 82121 - DNA, 25 bp, Homo sapien
gtcaactgtgtcaccctttaccaag

SEQ ID NO: 82122 - DNA, 25 bp, Homo sapien
gtcaactgtgtcgccctttaccaag

SEQ ID NO: 82123 - DNA, 25 bp, Homo sapien
gtcaagaaatgacaattgactttga

SEQ ID NO: 82124 - DNA, 25 bp, Homo sapien
gtcaagaaatgataattgactttga

SEQ ID NO: 82125 - DNA, 25 bp, Homo sapien
gtcaagaccggagtttcagtgtagt

SEQ ID NO: 82126 - DNA, 25 bp, Homo sapien
gtcaagacctgagtttcagtgtagt

SEQ ID NO: 82127 - DNA, 25 bp, Homo sapien
gtcaagagacacttacaagatgacc

SEQ ID NO: 82128 - DNA, 25 bp, Homo sapien
gtcaagagatacttacaagatgacc

SEQ ID NO: 82129 - DNA, 25 bp, Homo sapien
gtcaagcacttccccttggtgtcaa

SEQ ID NO: 82130 - DNA, 25 bp, Homo sapien
gtcaagcactttcccttggtgtcaa

SEQ ID NO: 82131 - DNA, 25 bp, Homo sapien
gtcaagctgtgcaaagtcaattcaa

SEQ ID NO: 82132 - DNA, 25 bp, Homo sapien
gtcaagctgtgcagagtcaattcaa

SEQ ID NO: 82133 - DNA, 25 bp, Homo sapien
gtcaaggaagaatcagcattctgtc

SEQ ID NO: 82134 - DNA, 25 bp, Homo sapien
gtcaaggaggaatcagcattctgtc

SEQ ID NO: 82135 - DNA, 25 bp, Homo sapien
gtcaagtacagggctgcaaaaaacc

SEQ ID NO: 82136 - DNA, 25 bp, Homo sapien
gtcaagtaccttctcaataacacat

SEQ ID NO: 82137 - DNA, 25 bp, Homo sapien
gtcaagtaccttgtcaataacacat

SEQ ID NO: 82138 - DNA, 25 bp, Homo sapien
gtcaagtacggggctgcaaaaaacc

SEQ ID NO: 82139 - DNA, 25 bp, Homo sapien
gtcaagtatataatgacaaaaacta

SEQ ID NO: 82140 - DNA, 25 bp, Homo sapien
gtcaagtatgtaatgacaaaaacta

SEQ ID NO: 82141 - DNA, 25 bp, Homo sapien
gtcaagtgtgagactcaaagttaga

SEQ ID NO: 82142 - DNA, 25 bp, Homo sapien
gtcaagtgtgagcctcaaagttaga

SEQ ID NO: 82143 - DNA, 25 bp, Homo sapien
gtcaagttggtaactgatatatgtg

SEQ ID NO: 82144 - DNA, 25 bp, Homo sapien
gtcaagttggtaattgatatatgtg

SEQ ID NO: 82145 - DNA, 25 bp, Homo sapien
gtcaagtttcttattccatgtttaa

SEQ ID NO: 82146 - DNA, 25 bp, Homo sapien
gtcaagttttttattccatgtttaa

SEQ ID NO: 82147 - DNA, 25 bp, Homo sapien
gtcaatactgaaccactgctcctgg

SEQ ID NO: 82148 - DNA, 25 bp, Homo sapien
gtcaatactgaatcactgctcctgg

SEQ ID NO: 82149 - DNA, 25 bp, Homo sapien
gtcaatagcaaatgtttcaattgcc

SEQ ID NO: 82150 - DNA, 25 bp, Homo sapien
gtcaatagcaagtgtttcaattgcc

SEQ ID NO: 82151 - DNA, 25 bp, Homo sapien
gtcaataggagcgactcacgcgctg

SEQ ID NO: 82152 - DNA, 25 bp, Homo sapien
gtcaataggagcgtctcacgcgctg

SEQ ID NO: 82153 - DNA, 25 bp, Homo sapien
gtcaatatgatccctgtaaagcata

SEQ ID NO: 82154 - DNA, 25 bp, Homo sapien
gtcaatatgatcgctgtaaagcata

SEQ ID NO: 82155 - DNA, 25 bp, Homo sapien
gtcaatcaaaccttcttcctttata

SEQ ID NO: 82156 - DNA, 25 bp, Homo sapien
gtcaatcaaacctttttcctttata

SEQ ID NO: 82157 - DNA, 25 bp, Homo sapien
gtcaatccaccagaatttagggctt

SEQ ID NO: 82158 - DNA, 25 bp, Homo sapien
gtcaatccaccggaatttagggctt

SEQ ID NO: 82159 - DNA, 25 bp, Homo sapien
gtcaatccataatctgataggtgtg

SEQ ID NO: 82160 - DNA, 25 bp, Homo sapien
gtcaatccgtaatctgataggtgtg

SEQ ID NO: 82161 - DNA, 25 bp, Homo sapien
gtcaatctttgcactcagggttgaa

SEQ ID NO: 82162 - DNA, 25 bp, Homo sapien
gtcaatctttgcgctcagggttgaa

SEQ ID NO: 82163 - DNA, 25 bp, Homo sapien
gtcaatggtaagatgttggactaag

SEQ ID NO: 82164 - DNA, 25 bp, Homo sapien
gtcaatggtaagattttggactaag

SEQ ID NO: 82165 - DNA, 25 bp, Homo sapien
gtcaattctgttgtacttacatgga

SEQ ID NO: 82166 - DNA, 25 bp, Homo sapien
gtcaattctgttgttcttacatgga

SEQ ID NO: 82167 - DNA, 25 bp, Homo sapien
gtcaattgaatgaaggctttgtgga

SEQ ID NO: 82168 - DNA, 25 bp, Homo sapien
gtcaattgaatgatggctttgtgga

SEQ ID NO: 82169 - DNA, 25 bp, Homo sapien
gtcacaaatcaattaaccattaatg

SEQ ID NO: 82170 - DNA, 25 bp, Homo sapien
gtcacaaatcaatttaccattaatg

SEQ ID NO: 82171 - DNA, 25 bp, Homo sapien
gtcacaagacctatcgcaagccctc

SEQ ID NO: 82172 - DNA, 25 bp, Homo sapien
gtcacaagacctattgcaagccctc

SEQ ID NO: 82173 - DNA, 25 bp, Homo sapien
gtcacaagttgaaattgaataacca

SEQ ID NO: 82174 - DNA, 25 bp, Homo sapien
gtcacaagttgaagttgaataacca

SEQ ID NO: 82175 - DNA, 25 bp, Homo sapien
gtcacaattctgctaacagtactac

SEQ ID NO: 82176 - DNA, 25 bp, Homo sapien
gtcacaattttgctaacagtactac

SEQ ID NO: 82177 - DNA, 25 bp, Homo sapien
gtcacacaaatgtactacattgatt

SEQ ID NO: 82178 - DNA, 25 bp, Homo sapien
gtcacacaaatgtactccattgatt

SEQ ID NO: 82179 - DNA, 25 bp, Homo sapien
gtcacacgttgtggacagcaaagcc

SEQ ID NO: 82180 - DNA, 25 bp, Homo sapien
gtcacacgttgtgggcagcaaagcc

SEQ ID NO: 82181 - DNA, 25 bp, Homo sapien
gtcacactacaagctgcaaaagtta

SEQ ID NO: 82182 - DNA, 25 bp, Homo sapien
gtcacacttcaagctgcaaaagtta

SEQ ID NO: 82183 - DNA, 25 bp, Homo sapien
gtcacacttgtcacgtcacaatgtt

SEQ ID NO: 82184 - DNA, 25 bp, Homo sapien
gtcacacttgtcatgtcacaatgtt

SEQ ID NO: 82185 - DNA, 25 bp, Homo sapien
gtcacagcttgtccacatgatctcc

SEQ ID NO: 82186 - DNA, 25 bp, Homo sapien
gtcacagcttgtccgcatgatctcc

SEQ ID NO: 82187 - DNA, 25 bp, Homo sapien
gtcacaggaagaaaaccagacttag

SEQ ID NO: 82188 - DNA, 25 bp, Homo sapien
gtcacaggaagaaaactagacttag

SEQ ID NO: 82189 - DNA, 25 bp, Homo sapien
gtcacaggaaggcatactacagtgg

SEQ ID NO: 82190 - DNA, 25 bp, Homo sapien
gtcacaggacaaaacttgaaatgag

SEQ ID NO: 82191 - DNA, 25 bp, Homo sapien
gtcacaggacaaaccttgaaatgag

SEQ ID NO: 82192 - DNA, 25 bp, Homo sapien
gtcacaggagggcatactacagtgg

SEQ ID NO: 82193 - DNA, 25 bp, Homo sapien
gtcacaggtccctctgacaaactgg

SEQ ID NO: 82194 - DNA, 25 bp, Homo sapien
gtcacaggtccctttgacaaactgg

SEQ ID NO: 82195 - DNA, 25 bp, Homo sapien
gtcacagtattaagatgtgcattct

SEQ ID NO: 82196 - DNA, 25 bp, Homo sapien
gtcacagtgttaagatgtgcattct

SEQ ID NO: 82197 - DNA, 25 bp, Homo sapien
gtcacagtttgcttcaaggtctaca

SEQ ID NO: 82198 - DNA, 25 bp, Homo sapien
gtcacagtttgctttaaggtctaca

SEQ ID NO: 82199 - DNA, 25 bp, Homo sapien
gtcacatatttccattttgtactgg

SEQ ID NO: 82200 - DNA, 25 bp, Homo sapien
gtcacatattttcattttgtactgg

SEQ ID NO: 82201 - DNA, 25 bp, Homo sapien
gtcacatctctctgttcattcccag

SEQ ID NO: 82202 - DNA, 25 bp, Homo sapien
gtcacatctctctgtttattcccag

SEQ ID NO: 82203 - DNA, 25 bp, Homo sapien
gtcacatgaactaaaaagcattaca

SEQ ID NO: 82204 - DNA, 25 bp, Homo sapien
gtcacatgaactgaaaagcattaca

SEQ ID NO: 82205 - DNA, 25 bp, Homo sapien
gtcacatgaccatcccagttttctc

SEQ ID NO: 82206 - DNA, 25 bp, Homo sapien
gtcacatgaccgtcccagttttctc

SEQ ID NO: 82207 - DNA, 25 bp, Homo sapien
gtcacatgatcaatcctggtcttta

SEQ ID NO: 82208 - DNA, 25 bp, Homo sapien
gtcacatgatcagtcctggtcttta

SEQ ID NO: 82209 - DNA, 25 bp, Homo sapien
gtcacatgcacatatggattttgct

SEQ ID NO: 82210 - DNA, 25 bp, Homo sapien
gtcacatgtacatatggattttgct

SEQ ID NO: 82211 - DNA, 25 bp, Homo sapien
gtcaccaatggttgccagcatacac

SEQ ID NO: 82212 - DNA, 25 bp, Homo sapien
gtcaccaatggttgtcagcatacac

SEQ ID NO: 82213 - DNA, 25 bp, Homo sapien
gtcaccaccatttcaagagggaggc

SEQ ID NO: 82214 - DNA, 25 bp, Homo sapien
gtcaccaccgtttcaagagggaggc

SEQ ID NO: 82215 - DNA, 25 bp, Homo sapien
gtcaccatgcttggctaacttttgt

SEQ ID NO: 82216 - DNA, 25 bp, Homo sapien
gtcaccatgcttgggtaacttttgt

SEQ ID NO: 82217 - DNA, 25 bp, Homo sapien
gtcaccattttaaaaccataagagg

SEQ ID NO: 82218 - DNA, 25 bp, Homo sapien
gtcaccattttacaaccataagagg

SEQ ID NO: 82219 - DNA, 25 bp, Homo sapien
gtcacctagtcagaagttcatatca

SEQ ID NO: 82220 - DNA, 25 bp, Homo sapien
gtcacctattcagaagttcatatca

SEQ ID NO: 82221 - DNA, 25 bp, Homo sapien
gtcacctctccttgaatgtagagct

SEQ ID NO: 82222 - DNA, 25 bp, Homo sapien
gtcacctcttcttgaatgtagagct

SEQ ID NO: 82223 - DNA, 25 bp, Homo sapien
gtcacctgaatgagactatgagcac

SEQ ID NO: 82224 - DNA, 25 bp, Homo sapien
gtcacctgagtgagactatgagcac

SEQ ID NO: 82225 - DNA, 25 bp, Homo sapien
gtcacctttcctacctggcaacata

SEQ ID NO: 82226 - DNA, 25 bp, Homo sapien
gtcacctttcctgcctggcaacata

SEQ ID NO: 82227 - DNA, 25 bp, Homo sapien
gtcacggaagagaaaaattcaggaa

SEQ ID NO: 82228 - DNA, 25 bp, Homo sapien
gtcacggaagagaagaattcaggaa

SEQ ID NO: 82229 - DNA, 25 bp, Homo sapien
gtcacgtgataccaacaaggtgcat

SEQ ID NO: 82230 - DNA, 25 bp, Homo sapien
gtcacgtgatatcaacaaggtgcat

SEQ ID NO: 82231 - DNA, 25 bp, Homo sapien
gtcacgtggtcaaacccagagaaga

SEQ ID NO: 82232 - DNA, 25 bp, Homo sapien
gtcacgtggtcaaatccagagaaga

SEQ ID NO: 82233 - DNA, 25 bp, Homo sapien
gtcactagaaggatgctcaccaaat

SEQ ID NO: 82234 - DNA, 25 bp, Homo sapien
gtcactagaagtatgctcaccaaat

SEQ ID NO: 82235 - DNA, 25 bp, Homo sapien
gtcactagcacatcctgaatgacaa

SEQ ID NO: 82236 - DNA, 25 bp, Homo sapien
gtcactagcacatcttgaatgacaa

SEQ ID NO: 82237 - DNA, 25 bp, Homo sapien
gtcactataagaagttgcttttata

SEQ ID NO: 82238 - DNA, 25 bp, Homo sapien
gtcactataagaggttgcttttata

SEQ ID NO: 82239 - DNA, 25 bp, Homo sapien
gtcactcacggtctaaagaattctg

SEQ ID NO: 82240 - DNA, 25 bp, Homo sapien
gtcactcatggtctaaagaattctg

SEQ ID NO: 82241 - DNA, 25 bp, Homo sapien
gtcactcattcagggttagaatcat

SEQ ID NO: 82242 - DNA, 25 bp, Homo sapien
gtcactcattccgggttagaatcat

SEQ ID NO: 82243 - DNA, 25 bp, Homo sapien
gtcactccaagggctgaggtggtaa

SEQ ID NO: 82244 - DNA, 25 bp, Homo sapien
gtcactccgagggctgaggtggtaa

SEQ ID NO: 82245 - DNA, 25 bp, Homo sapien
gtcactgcacacatgttctccaaga

SEQ ID NO: 82246 - DNA, 25 bp, Homo sapien
gtcactgcacacgtgttctccaaga

SEQ ID NO: 82247 - DNA, 25 bp, Homo sapien
gtcactgcagccagatccctaaccc

SEQ ID NO: 82248 - DNA, 25 bp, Homo sapien
gtcactgcagccggatccctaaccc

SEQ ID NO: 82249 - DNA, 25 bp, Homo sapien
gtcactgccctaattttccacatca

SEQ ID NO: 82250 - DNA, 25 bp, Homo sapien
gtcactgccttaattttccacatca

SEQ ID NO: 82251 - DNA, 25 bp, Homo sapien
gtcactggaaataccctcacaatca

SEQ ID NO: 82252 - DNA, 25 bp, Homo sapien
gtcactggaaattccctcacaatca

SEQ ID NO: 82253 - DNA, 25 bp, Homo sapien
gtcactggacaatttacataagggt

SEQ ID NO: 82254 - DNA, 25 bp, Homo sapien
gtcactggacaatttagataagggt

SEQ ID NO: 82255 - DNA, 25 bp, Homo sapien
gtcactgtagaactctaacatggga

SEQ ID NO: 82256 - DNA, 25 bp, Homo sapien
gtcactgtagaagtctaacatggga

SEQ ID NO: 82257 - DNA, 25 bp, Homo sapien
gtcacttaatgacaatgatacattc

SEQ ID NO: 82258 - DNA, 25 bp, Homo sapien
gtcacttaatgacgatgatacattc

SEQ ID NO: 82259 - DNA, 25 bp, Homo sapien
gtcacttgattagatgccctctgtt

SEQ ID NO: 82260 - DNA, 25 bp, Homo sapien
gtcacttgattcgatgccctctgtt

SEQ ID NO: 82261 - DNA, 25 bp, Homo sapien
gtcactttacaatggagaaacctga

SEQ ID NO: 82262 - DNA, 25 bp, Homo sapien
gtcactttgcaatggagaaacctga

SEQ ID NO: 82263 - DNA, 25 bp, Homo sapien
gtcagaaaacgaagtcattactgga

SEQ ID NO: 82264 - DNA, 25 bp, Homo sapien
gtcagaaaatgaagtcattactgga

SEQ ID NO: 82265 - DNA, 25 bp, Homo sapien
gtcagaaacatttggatggaatgag

SEQ ID NO: 82266 - DNA, 25 bp, Homo sapien
gtcagaaacctaatttttgtgctgg

SEQ ID NO: 82267 - DNA, 25 bp, Homo sapien
gtcagaaacctagtttttgtgctgg

SEQ ID NO: 82268 - DNA, 25 bp, Homo sapien
gtcagaaatatttggatggaatgag

SEQ ID NO: 82269 - DNA, 25 bp, Homo sapien
gtcagaaatcagtaacaaagcctat

SEQ ID NO: 82270 - DNA, 25 bp, Homo sapien
gtcagaaatcagtaaccaagcctat

SEQ ID NO: 82271 - DNA, 25 bp, Homo sapien
gtcagaagtggttgcacatggttct

SEQ ID NO: 82272 - DNA, 25 bp, Homo sapien
gtcagaagtggttgtacatggttct

SEQ ID NO: 82273 - DNA, 25 bp, Homo sapien
gtcagaatgtttgctgccctccaaa

SEQ ID NO: 82274 - DNA, 25 bp, Homo sapien
gtcagaatgtttgttgccctccaaa

SEQ ID NO: 82275 - DNA, 25 bp, Homo sapien
gtcagaattccatgtgggcctgtgg

SEQ ID NO: 82276 - DNA, 25 bp, Homo sapien
gtcagaattccctgtgggcctgtgg

SEQ ID NO: 82277 - DNA, 25 bp, Homo sapien
gtcagaccaagaatttaaaaataga

SEQ ID NO: 82278 - DNA, 25 bp, Homo sapien
gtcagaccaaggatttaaaaataga

SEQ ID NO: 82279 - DNA, 25 bp, Homo sapien
gtcagacgccaagtagaaaacctgg

SEQ ID NO: 82280 - DNA, 25 bp, Homo sapien
gtcagacgtcaagtagaaaacctgg

SEQ ID NO: 82281 - DNA, 25 bp, Homo sapien
gtcagactatgaagccagcagcagg

SEQ ID NO: 82282 - DNA, 25 bp, Homo sapien
gtcagactatgaggccagcagcagg

SEQ ID NO: 82283 - DNA, 25 bp, Homo sapien
gtcagagaaccaccagctccaactt

SEQ ID NO: 82284 - DNA, 25 bp, Homo sapien
gtcagagaagcaccagctccaactt

SEQ ID NO: 82285 - DNA, 25 bp, Homo sapien
gtcagagatagcagtaccttgcatc

SEQ ID NO: 82286 - DNA, 25 bp, Homo sapien
gtcagagatagtagtaccttgcatc

SEQ ID NO: 82287 - DNA, 25 bp, Homo sapien
gtcagagatcttgtatatttggaca

SEQ ID NO: 82288 - DNA, 25 bp, Homo sapien
gtcagagatcttgtgtatttggaca

SEQ ID NO: 82289 - DNA, 25 bp, Homo sapien
gtcagagcatttgatactgagttgg

SEQ ID NO: 82290 - DNA, 25 bp, Homo sapien
gtcagagcatttgatattgagttgg

SEQ ID NO: 82291 - DNA, 25 bp, Homo sapien
gtcagaggaccttaagaaagaggga

SEQ ID NO: 82292 - DNA, 25 bp, Homo sapien
gtcagaggatcttaagaaagaggga

SEQ ID NO: 82293 - DNA, 25 bp, Homo sapien
gtcagagtcttgttctgttgcccag

SEQ ID NO: 82294 - DNA, 25 bp, Homo sapien
gtcagagtctttttctgttgcccag

SEQ ID NO: 82295 - DNA, 25 bp, Homo sapien
gtcagagtggagccgataatcggaa

SEQ ID NO: 82296 - DNA, 25 bp, Homo sapien
gtcagagtggagctgataatcggaa

SEQ ID NO: 82297 - DNA, 25 bp, Homo sapien
gtcagagtttgccgcccaaaaaagt

SEQ ID NO: 82298 - DNA, 25 bp, Homo sapien
gtcagagtttgctgcccaaaaaagt

SEQ ID NO: 82299 - DNA, 25 bp, Homo sapien
gtcagatagtccagcgttaaatgcc

SEQ ID NO: 82300 - DNA, 25 bp, Homo sapien
gtcagatagtccagggttaaatgcc

SEQ ID NO: 82301 - DNA, 25 bp, Homo sapien
gtcagatttatgcctgtagaaaaaa

SEQ ID NO: 82302 - DNA, 25 bp, Homo sapien
gtcagatttatgcttgtagaaaaaa

SEQ ID NO: 82303 - DNA, 25 bp, Homo sapien
gtcagcaagagaacacatatacgat

SEQ ID NO: 82304 - DNA, 25 bp, Homo sapien
gtcagcaagagaccacatatacgat

SEQ ID NO: 82305 - DNA, 25 bp, Homo sapien
gtcagcacagaaaaaactaccattt

SEQ ID NO: 82306 - DNA, 25 bp, Homo sapien
gtcagcacagaaaaaattaccattt

SEQ ID NO: 82307 - DNA, 25 bp, Homo sapien
gtcagcaccatccgtgatgccatgt

SEQ ID NO: 82308 - DNA, 25 bp, Homo sapien
gtcagcaccatctgtgatgccatgt

SEQ ID NO: 82309 - DNA, 25 bp, Homo sapien
gtcagcaccgcacactgcatcattg

SEQ ID NO: 82310 - DNA, 25 bp, Homo sapien
gtcagcacggcacactgcatcattg

SEQ ID NO: 82311 - DNA, 25 bp, Homo sapien
gtcagcagagccagctcatcaactg

SEQ ID NO: 82312 - DNA, 25 bp, Homo sapien
gtcagcagggccagctcatcaactg

SEQ ID NO: 82313 - DNA, 25 bp, Homo sapien
gtcagcatacccaacctgaaagaat

SEQ ID NO: 82314 - DNA, 25 bp, Homo sapien
gtcagcatacccatcctgaaagaat

SEQ ID NO: 82315 - DNA, 25 bp, Homo sapien
gtcagcatcaatcacacctgtcctc

SEQ ID NO: 82316 - DNA, 25 bp, Homo sapien
gtcagcatcaatcatacctgtcctc

SEQ ID NO: 82317 - DNA, 25 bp, Homo sapien
gtcagccacaaattagtcattaata

SEQ ID NO: 82318 - DNA, 25 bp, Homo sapien
gtcagccacaatttagtcattaata

SEQ ID NO: 82319 - DNA, 25 bp, Homo sapien
gtcagccccacagaggagaagggga

SEQ ID NO: 82320 - DNA, 25 bp, Homo sapien
gtcagccctacagaggagaagggga

SEQ ID NO: 82321 - DNA, 25 bp, Homo sapien
gtcagcctactattgccaggtagct

SEQ ID NO: 82322 - DNA, 25 bp, Homo sapien
gtcagcctactgttgccaggtagct

SEQ ID NO: 82323 - DNA, 25 bp, Homo sapien
gtcagcctttacataacagtagtca

SEQ ID NO: 82324 - DNA, 25 bp, Homo sapien
gtcagcctttacataatagtagtca

SEQ ID NO: 82325 - DNA, 25 bp, Homo sapien
gtcagctcagaatggaaaacgcatt

SEQ ID NO: 82326 - DNA, 25 bp, Homo sapien
gtcagctcagagtggaaaacgcatt

SEQ ID NO: 82327 - DNA, 25 bp, Homo sapien
gtcagctgtagacctctctgaatag

SEQ ID NO: 82328 - DNA, 25 bp, Homo sapien
gtcagctgtagatctctctgaatag

SEQ ID NO: 82329 - DNA, 25 bp, Homo sapien
gtcagctgtcacttcggaaaccatc

SEQ ID NO: 82330 - DNA, 25 bp, Homo sapien
gtcagctgtcatttcggaaaccatc

SEQ ID NO: 82331 - DNA, 25 bp, Homo sapien
gtcagctttctctcccattctggca

SEQ ID NO: 82332 - DNA, 25 bp, Homo sapien
gtcagctttgtctcccattctggca

SEQ ID NO: 82333 - DNA, 25 bp, Homo sapien
gtcaggaaaagcctatttattctga

SEQ ID NO: 82334 - DNA, 25 bp, Homo sapien
gtcaggaaaggcctatttattctga

SEQ ID NO: 82335 - DNA, 25 bp, Homo sapien
gtcaggaacccatcagcagaaaaga

SEQ ID NO: 82336 - DNA, 25 bp, Homo sapien
gtcaggaacctggacagtgatagga

SEQ ID NO: 82337 - DNA, 25 bp, Homo sapien
gtcaggaacctgggcagtgatagga

SEQ ID NO: 82338 - DNA, 25 bp, Homo sapien
gtcaggaacggatggtacttccaac

SEQ ID NO: 82339 - DNA, 25 bp, Homo sapien
gtcaggaactcatcagcagaaaaga

SEQ ID NO: 82340 - DNA, 25 bp, Homo sapien
gtcaggaagttgagttttgaatatg

SEQ ID NO: 82341 - DNA, 25 bp, Homo sapien
gtcaggaagttgcgttttgaatatg

SEQ ID NO: 82342 - DNA, 25 bp, Homo sapien
gtcaggaatggatggtacttccaac

SEQ ID NO: 82343 - DNA, 25 bp, Homo sapien
gtcaggagttccgagagacacccag

SEQ ID NO: 82344 - DNA, 25 bp, Homo sapien
gtcaggagttcggagagacacccag

SEQ ID NO: 82345 - DNA, 25 bp, Homo sapien
gtcaggcaactatactattatgcca

SEQ ID NO: 82346 - DNA, 25 bp, Homo sapien
gtcaggcaactatattattatgcca

SEQ ID NO: 82347 - DNA, 25 bp, Homo sapien
gtcaggcactaatgctcagtattga

SEQ ID NO: 82348 - DNA, 25 bp, Homo sapien
gtcaggcagtaatgctcagtattga

SEQ ID NO: 82349 - DNA, 25 bp, Homo sapien
gtcaggcatacctagcgtcagattc

SEQ ID NO: 82350 - DNA, 25 bp, Homo sapien
gtcaggcatacctagcttcagattc

SEQ ID NO: 82351 - DNA, 25 bp, Homo sapien
gtcaggcatttcacagctttgtgtc

SEQ ID NO: 82352 - DNA, 25 bp, Homo sapien
gtcaggcatttcgcagctttgtgtc

SEQ ID NO: 82353 - DNA, 25 bp, Homo sapien
gtcagggactcatatctcattctct

SEQ ID NO: 82354 - DNA, 25 bp, Homo sapien
gtcagggattcatatctcattctct

SEQ ID NO: 82355 - DNA, 25 bp, Homo sapien
gtcagggctccaacttcatatttcc

SEQ ID NO: 82356 - DNA, 25 bp, Homo sapien
gtcagggctccgacttcatatttcc

SEQ ID NO: 82357 - DNA, 25 bp, Homo sapien
gtcagggctctgctgtaaatcctaa

SEQ ID NO: 82358 - DNA, 25 bp, Homo sapien
gtcagggctttgctgtaaatcctaa

SEQ ID NO: 82359 - DNA, 25 bp, Homo sapien
gtcaggtcagccgaaggatgaagga

SEQ ID NO: 82360 - DNA, 25 bp, Homo sapien
gtcaggtcagctgaaggatgaagga

SEQ ID NO: 82361 - DNA, 25 bp, Homo sapien
gtcaggtgaaacttaaaagatgagt

SEQ ID NO: 82362 - DNA, 25 bp, Homo sapien
gtcaggtgacacttaaaagatgagt

SEQ ID NO: 82363 - DNA, 25 bp, Homo sapien
gtcaggtgagtgaaatgataggctg

SEQ ID NO: 82364 - DNA, 25 bp, Homo sapien
gtcaggtgagtggaatgataggctg

SEQ ID NO: 82365 - DNA, 25 bp, Homo sapien
gtcagtaaactcaccaatgtcttct

SEQ ID NO: 82366 - DNA, 25 bp, Homo sapien
gtcagtaagctcaccaatgtcttct

SEQ ID NO: 82367 - DNA, 25 bp, Homo sapien
gtcagtaccagtttatgacaaaatc

SEQ ID NO: 82368 - DNA, 25 bp, Homo sapien
gtcagtacctgtttatgacaaaatc

SEQ ID NO: 82369 - DNA, 25 bp, Homo sapien
gtcagtagcacataagatcccatcc

SEQ ID NO: 82370 - DNA, 25 bp, Homo sapien
gtcagtagcacgtaagatcccatcc

SEQ ID NO: 82371 - DNA, 25 bp, Homo sapien
gtcagtcaaaagatggcaactcagc

SEQ ID NO: 82372 - DNA, 25 bp, Homo sapien
gtcagtcaaaagatgggaactcagc

SEQ ID NO: 82373 - DNA, 25 bp, Homo sapien
gtcagtcaaaaggccctaagaggaa

SEQ ID NO: 82374 - DNA, 25 bp, Homo sapien
gtcagtcaaaaggtcctaagaggaa

SEQ ID NO: 82375 - DNA, 25 bp, Homo sapien
gtcagtctcatactttcaggttgtt

SEQ ID NO: 82376 - DNA, 25 bp, Homo sapien
gtcagtctcatcctttcaggttgtt

SEQ ID NO: 82377 - DNA, 25 bp, Homo sapien
gtcagtctccctgatgattctatca

SEQ ID NO: 82378 - DNA, 25 bp, Homo sapien
gtcagtctcgtttggacatggtaat

SEQ ID NO: 82379 - DNA, 25 bp, Homo sapien
gtcagtctctctgatgattctatca

SEQ ID NO: 82380 - DNA, 25 bp, Homo sapien
gtcagtcttcctccctggtgagact

SEQ ID NO: 82381 - DNA, 25 bp, Homo sapien
gtcagtcttgctccctggtgagact

SEQ ID NO: 82382 - DNA, 25 bp, Homo sapien
gtcagtcttgtttggacatggtaat

SEQ ID NO: 82383 - DNA, 25 bp, Homo sapien
gtcagtgaaagaccagaggattaaa

SEQ ID NO: 82384 - DNA, 25 bp, Homo sapien
gtcagtgaaagaccggaggattaaa

SEQ ID NO: 82385 - DNA, 25 bp, Homo sapien
gtcagtgaccatatgttgcctgttt

SEQ ID NO: 82386 - DNA, 25 bp, Homo sapien
gtcagtgaccatattttgcctgttt

SEQ ID NO: 82387 - DNA, 25 bp, Homo sapien
gtcagtgagatgcgaactaaaaggg

SEQ ID NO: 82388 - DNA, 25 bp, Homo sapien
gtcagtgagatgcggactaaaaggg

SEQ ID NO: 82389 - DNA, 25 bp, Homo sapien
gtcagtgagtcatccaatgccctat

SEQ ID NO: 82390 - DNA, 25 bp, Homo sapien
gtcagtgagtcatgcaatgccctat

SEQ ID NO: 82391 - DNA, 25 bp, Homo sapien
gtcagtggctgaagtgtggttttaa

SEQ ID NO: 82392 - DNA, 25 bp, Homo sapien
gtcagtggctgaggtgtggttttaa

SEQ ID NO: 82393 - DNA, 25 bp, Homo sapien
gtcagtggttctcgcactcccaaag

SEQ ID NO: 82394 - DNA, 25 bp, Homo sapien
gtcagtggttcttgcactcccaaag

SEQ ID NO: 82395 - DNA, 25 bp, Homo sapien
gtcagtgtatccattttatgtcatt

SEQ ID NO: 82396 - DNA, 25 bp, Homo sapien
gtcagtgtatctattttatgtcatt

SEQ ID NO: 82397 - DNA, 25 bp, Homo sapien
gtcagtgttgtgaaaggaaatacct

SEQ ID NO: 82398 - DNA, 25 bp, Homo sapien
gtcagtgttttgaaaggaaatacct

SEQ ID NO: 82399 - DNA, 25 bp, Homo sapien
gtcagttacaaatcaaacatttaaa

SEQ ID NO: 82400 - DNA, 25 bp, Homo sapien
gtcagttacaattcaaacatttaaa

SEQ ID NO: 82401 - DNA, 25 bp, Homo sapien
gtcagttacgacttatggataaaca

SEQ ID NO: 82402 - DNA, 25 bp, Homo sapien
gtcagttaggacttatggataaaca

SEQ ID NO: 82403 - DNA, 25 bp, Homo sapien
gtcagttctcccaacccaggaaaaa

SEQ ID NO: 82404 - DNA, 25 bp, Homo sapien
gtcagttctcccaacctaggaaaaa

SEQ ID NO: 82405 - DNA, 25 bp, Homo sapien
gtcagttgcatcacaccctaagaaa

SEQ ID NO: 82406 - DNA, 25 bp, Homo sapien
gtcagttgcgtcacaccctaagaaa

SEQ ID NO: 82407 - DNA, 25 bp, Homo sapien
gtcagttgttacatatttgtgtata

SEQ ID NO: 82408 - DNA, 25 bp, Homo sapien
gtcagttgttatatatttgtgtata

SEQ ID NO: 82409 - DNA, 25 bp, Homo sapien
gtcagttgttgcgataagatctaga

SEQ ID NO: 82410 - DNA, 25 bp, Homo sapien
gtcagttgttgggataagatctaga

SEQ ID NO: 82411 - DNA, 25 bp, Homo sapien
gtcagtttatggcatactggagtat

SEQ ID NO: 82412 - DNA, 25 bp, Homo sapien
gtcagtttatgtcatactggagtat

SEQ ID NO: 82413 - DNA, 25 bp, Homo sapien
gtcagtttccttatcacccacccca

SEQ ID NO: 82414 - DNA, 25 bp, Homo sapien
gtcagtttctttatcacccacccca

SEQ ID NO: 82415 - DNA, 25 bp, Homo sapien
gtcataatgtggtcctgatacactg

SEQ ID NO: 82416 - DNA, 25 bp, Homo sapien
gtcataatttggtcctgatacactg

SEQ ID NO: 82417 - DNA, 25 bp, Homo sapien
gtcataccctgtgctctgaacattg

SEQ ID NO: 82418 - DNA, 25 bp, Homo sapien
gtcataccctgtgttctgaacattg

SEQ ID NO: 82419 - DNA, 25 bp, Homo sapien
gtcatagaacgcagctgaagaaact

SEQ ID NO: 82420 - DNA, 25 bp, Homo sapien
gtcatagaatgcagctgaagaaact

SEQ ID NO: 82421 - DNA, 25 bp, Homo sapien
gtcatagagaagaaagatttggagg

SEQ ID NO: 82422 - DNA, 25 bp, Homo sapien
gtcatagaggacacttatgggatga

SEQ ID NO: 82423 - DNA, 25 bp, Homo sapien
gtcatagaggcaaatgagatgccaa

SEQ ID NO: 82424 - DNA, 25 bp, Homo sapien
gtcatagaggtggacaatcataaaa

SEQ ID NO: 82425 - DNA, 25 bp, Homo sapien
gtcatagaggtggagaatcataaaa

SEQ ID NO: 82426 - DNA, 25 bp, Homo sapien
gtcatagagtacacttatgggatga

SEQ ID NO: 82427 - DNA, 25 bp, Homo sapien
gtcatagagtcaaatgagatgccaa

SEQ ID NO: 82428 - DNA, 25 bp, Homo sapien
gtcatagataagaaagatttggagg

SEQ ID NO: 82429 - DNA, 25 bp, Homo sapien
gtcatagatattcacattatctgta

SEQ ID NO: 82430 - DNA, 25 bp, Homo sapien
gtcatagatattcgcattatctgta

SEQ ID NO: 82431 - DNA, 25 bp, Homo sapien
gtcatagatctaaataaatggagag

SEQ ID NO: 82432 - DNA, 25 bp, Homo sapien
gtcatagatttaaataaatggagag

SEQ ID NO: 82433 - DNA, 25 bp, Homo sapien
gtcatagctttcacgacaataaaat

SEQ ID NO: 82434 - DNA, 25 bp, Homo sapien
gtcatagctttcatgacaataaaat

SEQ ID NO: 82435 - DNA, 25 bp, Homo sapien
gtcatagtctgtttcctgcttctat

SEQ ID NO: 82436 - DNA, 25 bp, Homo sapien
gtcatagtctgttttctgcttctat

SEQ ID NO: 82437 - DNA, 25 bp, Homo sapien
gtcatataccaatgtcattctttat

SEQ ID NO: 82438 - DNA, 25 bp, Homo sapien
gtcatataccagtgtcattctttat

SEQ ID NO: 82439 - DNA, 25 bp, Homo sapien
gtcatattccaactttgtgtttcta

SEQ ID NO: 82440 - DNA, 25 bp, Homo sapien
gtcatattccaattttgtgtttcta

SEQ ID NO: 82441 - DNA, 25 bp, Homo sapien
gtcatcacacactagtcattctatt

SEQ ID NO: 82442 - DNA, 25 bp, Homo sapien
gtcatcacatactagtcattctatt

SEQ ID NO: 82443 - DNA, 25 bp, Homo sapien
gtcatcagtcacttggaggacaaat

SEQ ID NO: 82444 - DNA, 25 bp, Homo sapien
gtcatcagttacttggaggacaaat

SEQ ID NO: 82445 - DNA, 25 bp, Homo sapien
gtcatccaaccctgtaagccagcag

SEQ ID NO: 82446 - DNA, 25 bp, Homo sapien
gtcatccaaccctttaagccagcag

SEQ ID NO: 82447 - DNA, 25 bp, Homo sapien
gtcatccaatcataacaggactttc

SEQ ID NO: 82448 - DNA, 25 bp, Homo sapien
gtcatccagtcataacaggactttc

SEQ ID NO: 82449 - DNA, 25 bp, Homo sapien
gtcatcccactgtcatcttgacagc

SEQ ID NO: 82450 - DNA, 25 bp, Homo sapien
gtcatcccagtgtcatcttgacagc

SEQ ID NO: 82451 - DNA, 25 bp, Homo sapien
gtcatcctgggaatcaaaatcagac

SEQ ID NO: 82452 - DNA, 25 bp, Homo sapien
gtcatcctgggagtcaaaatcagac

SEQ ID NO: 82453 - DNA, 25 bp, Homo sapien
gtcatctgccgtcactcagacatca

SEQ ID NO: 82454 - DNA, 25 bp, Homo sapien
gtcatctgccttttctctcctggga

SEQ ID NO: 82455 - DNA, 25 bp, Homo sapien
gtcatctgcgttttctctcctggga

SEQ ID NO: 82456 - DNA, 25 bp, Homo sapien
gtcatctgctgtcactcagacatca

SEQ ID NO: 82457 - DNA, 25 bp, Homo sapien
gtcatctggtaaccgtgtgtttaat

SEQ ID NO: 82458 - DNA, 25 bp, Homo sapien
gtcatctggtaactgtgtgtttaat

SEQ ID NO: 82459 - DNA, 25 bp, Homo sapien
gtcatctgtcttatatggcatgctt

SEQ ID NO: 82460 - DNA, 25 bp, Homo sapien
gtcatctgtcttatgtggcatgctt

SEQ ID NO: 82461 - DNA, 25 bp, Homo sapien
gtcatgaaacagcccaaggcaggca

SEQ ID NO: 82462 - DNA, 25 bp, Homo sapien
gtcatgaaagagcccaaggcaggca

SEQ ID NO: 82463 - DNA, 25 bp, Homo sapien
gtcatgaactcagcattggaagttt

SEQ ID NO: 82464 - DNA, 25 bp, Homo sapien
gtcatgaactcagcgttggaagttt

SEQ ID NO: 82465 - DNA, 25 bp, Homo sapien
gtcatgactatcagtaatttacacc

SEQ ID NO: 82466 - DNA, 25 bp, Homo sapien
gtcatgactatcggtaatttacacc

SEQ ID NO: 82467 - DNA, 25 bp, Homo sapien
gtcatgagaaaccctgatagaagga

SEQ ID NO: 82468 - DNA, 25 bp, Homo sapien
gtcatgagaaaccttgatagaagga

SEQ ID NO: 82469 - DNA, 25 bp, Homo sapien
gtcatgatgaggagtacaagagtta

SEQ ID NO: 82470 - DNA, 25 bp, Homo sapien
gtcatgatgaggagtagaagagtta

SEQ ID NO: 82471 - DNA, 25 bp, Homo sapien
gtcatgcaagtgaataatgtggttg

SEQ ID NO: 82472 - DNA, 25 bp, Homo sapien
gtcatgcaggtgaataatgtggttg

SEQ ID NO: 82473 - DNA, 25 bp, Homo sapien
gtcatgccttagaacatgcccatga

SEQ ID NO: 82474 - DNA, 25 bp, Homo sapien
gtcatgccttagaatatgcccatga

SEQ ID NO: 82475 - DNA, 25 bp, Homo sapien
gtcatgctttcagttactttggata

SEQ ID NO: 82476 - DNA, 25 bp, Homo sapien
gtcatgctttcagttattttggata

SEQ ID NO: 82477 - DNA, 25 bp, Homo sapien
gtcatggaaaatatgccgtgactag

SEQ ID NO: 82478 - DNA, 25 bp, Homo sapien
gtcatggaaaatatgctgtgactag

SEQ ID NO: 82479 - DNA, 25 bp, Homo sapien
gtcatggaagtagagagtagaatag

SEQ ID NO: 82480 - DNA, 25 bp, Homo sapien
gtcatggatgcgtgtacagggttgg

SEQ ID NO: 82481 - DNA, 25 bp, Homo sapien
gtcatggatgcttgtacagggttgg

SEQ ID NO: 82482 - DNA, 25 bp, Homo sapien
gtcatggatgtagagagtagaatag

SEQ ID NO: 82483 - DNA, 25 bp, Homo sapien
gtcatggctagcagcatttcccttt

SEQ ID NO: 82484 - DNA, 25 bp, Homo sapien
gtcatggctagcggcatttcccttt

SEQ ID NO: 82485 - DNA, 25 bp, Homo sapien
gtcatgggtcaacgtccttctccac

SEQ ID NO: 82486 - DNA, 25 bp, Homo sapien
gtcatgggtcaatgtccttctccac

SEQ ID NO: 82487 - DNA, 25 bp, Homo sapien
gtcatggtgttttagtctttgagaa

SEQ ID NO: 82488 - DNA, 25 bp, Homo sapien
gtcatggttttttagtctttgagaa

SEQ ID NO: 82489 - DNA, 25 bp, Homo sapien
gtcatgtacagtataaaggattata

SEQ ID NO: 82490 - DNA, 25 bp, Homo sapien
gtcatgtatagtataaaggattata

SEQ ID NO: 82491 - DNA, 25 bp, Homo sapien
gtcatgtctgtgtccagatgtccac

SEQ ID NO: 82492 - DNA, 25 bp, Homo sapien
gtcatgtctttgtccagatgtccac

SEQ ID NO: 82493 - DNA, 25 bp, Homo sapien
gtcatgtgaaatccatagaaccaga

SEQ ID NO: 82494 - DNA, 25 bp, Homo sapien
gtcatgtgaaatcgatagaaccaga

SEQ ID NO: 82495 - DNA, 25 bp, Homo sapien
gtcatgtggcgttactgactggagt

SEQ ID NO: 82496 - DNA, 25 bp, Homo sapien
gtcatgtggtgttactgactggagt

SEQ ID NO: 82497 - DNA, 25 bp, Homo sapien
gtcattaaaacgtgattaagtcctg

SEQ ID NO: 82498 - DNA, 25 bp, Homo sapien
gtcattaaaacgtggttaagtcctg

SEQ ID NO: 82499 - DNA, 25 bp, Homo sapien
gtcattactttcaaccccatctgtt

SEQ ID NO: 82500 - DNA, 25 bp, Homo sapien
gtcattactttcgaccccatctgtt

SEQ ID NO: 82501 - DNA, 25 bp, Homo sapien
gtcattatttgaccgtacatgtgtg

SEQ ID NO: 82502 - DNA, 25 bp, Homo sapien
gtcattatttgactgtacatgtgtg

SEQ ID NO: 82503 - DNA, 25 bp, Homo sapien
gtcattcagatctccacgtcctact

SEQ ID NO: 82504 - DNA, 25 bp, Homo sapien
gtcattcagatctccatgtcctact

SEQ ID NO: 82505 - DNA, 25 bp, Homo sapien
gtcattcaggttaaagagaaaccat

SEQ ID NO: 82506 - DNA, 25 bp, Homo sapien
gtcattcagtttaaagagaaaccat

SEQ ID NO: 82507 - DNA, 25 bp, Homo sapien
gtcattcatgggatgcattttctaa

SEQ ID NO: 82508 - DNA, 25 bp, Homo sapien
gtcattcatgggatgcgttttctaa

SEQ ID NO: 82509 - DNA, 25 bp, Homo sapien
gtcattcctacaagccagtataata

SEQ ID NO: 82510 - DNA, 25 bp, Homo sapien
gtcattcctacaggccagtataata

SEQ ID NO: 82511 - DNA, 25 bp, Homo sapien
gtcattctcgtacgcctctctagaa

SEQ ID NO: 82512 - DNA, 25 bp, Homo sapien
gtcattctcgtgcgcctctctagaa

SEQ ID NO: 82513 - DNA, 25 bp, Homo sapien
gtcattgacatggcaagacttcaca

SEQ ID NO: 82514 - DNA, 25 bp, Homo sapien
gtcattgacttggcaagacttcaca

SEQ ID NO: 82515 - DNA, 25 bp, Homo sapien
gtcattgcccaacgtcacactaggc

SEQ ID NO: 82516 - DNA, 25 bp, Homo sapien
gtcattgcccaatgtcacactaggc

SEQ ID NO: 82517 - DNA, 25 bp, Homo sapien
gtcattgctgtcactgacttccatt

SEQ ID NO: 82518 - DNA, 25 bp, Homo sapien
gtcattgctgtcattgacttccatt

SEQ ID NO: 82519 - DNA, 25 bp, Homo sapien
gtcattggctggaaagagacaagga

SEQ ID NO: 82520 - DNA, 25 bp, Homo sapien
gtcattggctggagagagacaagga

SEQ ID NO: 82521 - DNA, 25 bp, Homo sapien
gtcattgtacgatttatacctgaaa

SEQ ID NO: 82522 - DNA, 25 bp, Homo sapien
gtcattgtatgatttatacctgaaa

SEQ ID NO: 82523 - DNA, 25 bp, Homo sapien
gtcattgtggtcaaaaaccacgagc

SEQ ID NO: 82524 - DNA, 25 bp, Homo sapien
gtcattgtggtcagaaaccacgagc

SEQ ID NO: 82525 - DNA, 25 bp, Homo sapien
gtcattgttgcctgcccaaaatagt

SEQ ID NO: 82526 - DNA, 25 bp, Homo sapien
gtcattgttgcctgtccaaaatagt

SEQ ID NO: 82527 - DNA, 25 bp, Homo sapien
gtcatttaactaccaggactaatta

SEQ ID NO: 82528 - DNA, 25 bp, Homo sapien
gtcatttaacttccaggactaatta

SEQ ID NO: 82529 - DNA, 25 bp, Homo sapien
gtcatttccatgttttctatttaac

SEQ ID NO: 82530 - DNA, 25 bp, Homo sapien
gtcatttccattttttctatttaac

SEQ ID NO: 82531 - DNA, 25 bp, Homo sapien
gtcatttggttcacttcgctactac

SEQ ID NO: 82532 - DNA, 25 bp, Homo sapien
gtcatttggttcactttgctactac

SEQ ID NO: 82533 - DNA, 25 bp, Homo sapien
gtcattttgaaaaacgacacagcac

SEQ ID NO: 82534 - DNA, 25 bp, Homo sapien
gtcattttgaaaagcgacacagcac

SEQ ID NO: 82535 - DNA, 25 bp, Homo sapien
gtcatttttcatgacgaactttgag

SEQ ID NO: 82536 - DNA, 25 bp, Homo sapien
gtcatttttcatgatgaactttgag

SEQ ID NO: 82537 - DNA, 25 bp, Homo sapien
gtccaacagcacatagttaatatga

SEQ ID NO: 82538 - DNA, 25 bp, Homo sapien
gtccaacagcacgtagttaatatga

SEQ ID NO: 82539 - DNA, 25 bp, Homo sapien
gtccaagagaacttaacggttttcc

SEQ ID NO: 82540 - DNA, 25 bp, Homo sapien
gtccaagagaacttaatggttttcc

SEQ ID NO: 82541 - DNA, 25 bp, Homo sapien
gtccaagcgacatcaggtgttttag

SEQ ID NO: 82542 - DNA, 25 bp, Homo sapien
gtccaagcgacattaggtgttttag

SEQ ID NO: 82543 - DNA, 25 bp, Homo sapien
gtccaaggacttgggttcagatgag

SEQ ID NO: 82544 - DNA, 25 bp, Homo sapien
gtccaaggattgccatttattcaac

SEQ ID NO: 82545 - DNA, 25 bp, Homo sapien
gtccaagggttgccatttattcaac

SEQ ID NO: 82546 - DNA, 25 bp, Homo sapien
gtccaaggtcttgggttcagatgag

SEQ ID NO: 82547 - DNA, 25 bp, Homo sapien
gtccaagttaaatacatgttactgt

SEQ ID NO: 82548 - DNA, 25 bp, Homo sapien
gtccaagttgaatacatgttactgt

SEQ ID NO: 82549 - DNA, 25 bp, Homo sapien
gtccaataaaaccacaacaaacagc

SEQ ID NO: 82550 - DNA, 25 bp, Homo sapien
gtccaataaaaccacagcaaacagc

SEQ ID NO: 82551 - DNA, 25 bp, Homo sapien
gtccaatacggtatccaccagccat

SEQ ID NO: 82552 - DNA, 25 bp, Homo sapien
gtccaatacggtgtccaccagccat

SEQ ID NO: 82553 - DNA, 25 bp, Homo sapien
gtccaatgttactttgctaattttc

SEQ ID NO: 82554 - DNA, 25 bp, Homo sapien
gtccaatgttagtttgctaattttc

SEQ ID NO: 82555 - DNA, 25 bp, Homo sapien
gtccacaaacacctttttgtagggt

SEQ ID NO: 82556 - DNA, 25 bp, Homo sapien
gtccacaaacatgagtgtctatttc

SEQ ID NO: 82557 - DNA, 25 bp, Homo sapien
gtccacaaatatgagtgtctatttc

SEQ ID NO: 82558 - DNA, 25 bp, Homo sapien
gtccacaatcacctttttgtagggt

SEQ ID NO: 82559 - DNA, 25 bp, Homo sapien
gtccacatcaaagacgccatcttct

SEQ ID NO: 82560 - DNA, 25 bp, Homo sapien
gtccacatcaaggacgccatcttct

SEQ ID NO: 82561 - DNA, 25 bp, Homo sapien
gtccacatcctgatccccggacctg

SEQ ID NO: 82562 - DNA, 25 bp, Homo sapien
gtccacattctgatccccggacctg

SEQ ID NO: 82563 - DNA, 25 bp, Homo sapien
gtccacctcatatcagatgaacata

SEQ ID NO: 82564 - DNA, 25 bp, Homo sapien
gtccacctcatgtcagatgaacata

SEQ ID NO: 82565 - DNA, 25 bp, Homo sapien
gtccactccatagaagaacaaggca

SEQ ID NO: 82566 - DNA, 25 bp, Homo sapien
gtccactccgtagaagaacaaggca

SEQ ID NO: 82567 - DNA, 25 bp, Homo sapien
gtccactgccgatctaaactatttc

SEQ ID NO: 82568 - DNA, 25 bp, Homo sapien
gtccactgccgatttaaactatttc

SEQ ID NO: 82569 - DNA, 25 bp, Homo sapien
gtccactttgtgcgccagaattgag

SEQ ID NO: 82570 - DNA, 25 bp, Homo sapien
gtccactttgtgtgccagaattgag

SEQ ID NO: 82571 - DNA, 25 bp, Homo sapien
gtccagaaataaaatccgaggccca

SEQ ID NO: 82572 - DNA, 25 bp, Homo sapien
gtccagaaataacatccgaggccca

SEQ ID NO: 82573 - DNA, 25 bp, Homo sapien
gtccagagatactatgtgcaaaata

SEQ ID NO: 82574 - DNA, 25 bp, Homo sapien
gtccagagatactgtgtgcaaaata

SEQ ID NO: 82575 - DNA, 25 bp, Homo sapien
gtccagcactctctaacagaccctg

SEQ ID NO: 82576 - DNA, 25 bp, Homo sapien
gtccagcagctatcttgggccataa

SEQ ID NO: 82577 - DNA, 25 bp, Homo sapien
gtccagcagttatcttgggccataa

SEQ ID NO: 82578 - DNA, 25 bp, Homo sapien
gtccagcattaaacagctctgaggc

SEQ ID NO: 82579 - DNA, 25 bp, Homo sapien
gtccagcattaaccagctctgaggc

SEQ ID NO: 82580 - DNA, 25 bp, Homo sapien
gtccagcattctctaacagaccctg

SEQ ID NO: 82581 - DNA, 25 bp, Homo sapien
gtccaggagtgccctgtatataagt

SEQ ID NO: 82582 - DNA, 25 bp, Homo sapien
gtccaggagtgctctgtatataagt

SEQ ID NO: 82583 - DNA, 25 bp, Homo sapien
gtccagggtaagccacaaggcattg

SEQ ID NO: 82584 - DNA, 25 bp, Homo sapien
gtccagggtaagccacgaggcattg

SEQ ID NO: 82585 - DNA, 25 bp, Homo sapien
gtccaggtcccattttctctacagg

SEQ ID NO: 82586 - DNA, 25 bp, Homo sapien
gtccaggtccccttttctctacagg

SEQ ID NO: 82587 - DNA, 25 bp, Homo sapien
gtccagtatcttcttttttgatcct

SEQ ID NO: 82588 - DNA, 25 bp, Homo sapien
gtccagtatgttcttttttgatcct

SEQ ID NO: 82589 - DNA, 25 bp, Homo sapien
gtccataaatcgaaccctgtgttct

SEQ ID NO: 82590 - DNA, 25 bp, Homo sapien
gtccataaatcgaaccttgtgttct

SEQ ID NO: 82591 - DNA, 25 bp, Homo sapien
gtccataacatgaattaatactgcc

SEQ ID NO: 82592 - DNA, 25 bp, Homo sapien
gtccataagtagatcagagttttag

SEQ ID NO: 82593 - DNA, 25 bp, Homo sapien
gtccataatatactcaacaagtggc

SEQ ID NO: 82594 - DNA, 25 bp, Homo sapien
gtccataatatattcaacaagtggc

SEQ ID NO: 82595 - DNA, 25 bp, Homo sapien
gtccataatatgaattaatactgcc

SEQ ID NO: 82596 - DNA, 25 bp, Homo sapien
gtccataattagatcagagttttag

SEQ ID NO: 82597 - DNA, 25 bp, Homo sapien
gtccatagaaagacgatagagataa

SEQ ID NO: 82598 - DNA, 25 bp, Homo sapien
gtccatagaaagatgatagagataa

SEQ ID NO: 82599 - DNA, 25 bp, Homo sapien
gtccatcttttcgaggccattcatg

SEQ ID NO: 82600 - DNA, 25 bp, Homo sapien
gtccatctttttgaggccattcatg

SEQ ID NO: 82601 - DNA, 25 bp, Homo sapien
gtccatgactttcccttgcttggat

SEQ ID NO: 82602 - DNA, 25 bp, Homo sapien
gtccatgattttcccttgcttggat

SEQ ID NO: 82603 - DNA, 25 bp, Homo sapien
gtccatgtgacatttgtgggtcagc

SEQ ID NO: 82604 - DNA, 25 bp, Homo sapien
gtccatgtgacttttgtgggtcagc

SEQ ID NO: 82605 - DNA, 25 bp, Homo sapien
gtccattctcagggctcaaatgcct

SEQ ID NO: 82606 - DNA, 25 bp, Homo sapien
gtccattctcagtgctcaaatgcct

SEQ ID NO: 82607 - DNA, 25 bp, Homo sapien
gtccatttactatgttgttggctgt

SEQ ID NO: 82608 - DNA, 25 bp, Homo sapien
gtccatttagtatgttgttggctgt

SEQ ID NO: 82609 - DNA, 25 bp, Homo sapien
gtccatttctcaggtgaggaaaatg

SEQ ID NO: 82610 - DNA, 25 bp, Homo sapien
gtccatttctcgggtgaggaaaatg

SEQ ID NO: 82611 - DNA, 25 bp, Homo sapien
gtccatttcttcaccatggggtaac

SEQ ID NO: 82612 - DNA, 25 bp, Homo sapien
gtccatttcttcactatggggtaac

SEQ ID NO: 82613 - DNA, 25 bp, Homo sapien
gtcccaaaagaaatgttgcctgttg

SEQ ID NO: 82614 - DNA, 25 bp, Homo sapien
gtcccaaaataaatgttgcctgttg

SEQ ID NO: 82615 - DNA, 25 bp, Homo sapien
gtcccaaatctgctataaagcaaag

SEQ ID NO: 82616 - DNA, 25 bp, Homo sapien
gtcccaaatctgctgtaaagcaaag

SEQ ID NO: 82617 - DNA, 25 bp, Homo sapien
gtcccaacaagataagagagaaaaa

SEQ ID NO: 82618 - DNA, 25 bp, Homo sapien
gtcccaacaaggtaagagagaaaaa

SEQ ID NO: 82619 - DNA, 25 bp, Homo sapien
gtcccaagaagccaagaaatgttac

SEQ ID NO: 82620 - DNA, 25 bp, Homo sapien
gtcccaagaagccgagaaatgttac

SEQ ID NO: 82621 - DNA, 25 bp, Homo sapien
gtcccaatggaaggcggacagcggc

SEQ ID NO: 82622 - DNA, 25 bp, Homo sapien
gtcccaatggaaggtggacagcggc

SEQ ID NO: 82623 - DNA, 25 bp, Homo sapien
gtcccagcatataacaattacttgc

SEQ ID NO: 82624 - DNA, 25 bp, Homo sapien
gtcccagcgtataacaattacttgc

SEQ ID NO: 82625 - DNA, 25 bp, Homo sapien
gtcccaggaaggagatatgtgagag

SEQ ID NO: 82626 - DNA, 25 bp, Homo sapien
gtcccaggaaggaggtatgtgagag

SEQ ID NO: 82627 - DNA, 25 bp, Homo sapien
gtcccatcaacacttcatgaaagac

SEQ ID NO: 82628 - DNA, 25 bp, Homo sapien
gtcccatcaccacttcatgaaagac

SEQ ID NO: 82629 - DNA, 25 bp, Homo sapien
gtcccatgatgaaaccctagcttga

SEQ ID NO: 82630 - DNA, 25 bp, Homo sapien
gtcccatgcatgcacctgattagtg

SEQ ID NO: 82631 - DNA, 25 bp, Homo sapien
gtcccatgcatgcatctgattagtg

SEQ ID NO: 82632 - DNA, 25 bp, Homo sapien
gtcccatgttgaaaccctagcttga

SEQ ID NO: 82633 - DNA, 25 bp, Homo sapien
gtccccctccaccgcaaatgtgtat

SEQ ID NO: 82634 - DNA, 25 bp, Homo sapien
gtccccctccactgcaaatgtgtat

SEQ ID NO: 82635 - DNA, 25 bp, Homo sapien
gtcccctaaaaggaccagcatgttc

SEQ ID NO: 82636 - DNA, 25 bp, Homo sapien
gtcccctaaaaggatcagcatgttc

SEQ ID NO: 82637 - DNA, 25 bp, Homo sapien
gtcccctcacgggtgcaagctgaaa

SEQ ID NO: 82638 - DNA, 25 bp, Homo sapien
gtcccctcatgggtgcaagctgaaa

SEQ ID NO: 82639 - DNA, 25 bp, Homo sapien
gtcccctgaaattcgtatgttgaaa

SEQ ID NO: 82640 - DNA, 25 bp, Homo sapien
gtcccctgaaatttgtatgttgaaa

SEQ ID NO: 82641 - DNA, 25 bp, Homo sapien
gtccccttgccagcgaaaacttggg

SEQ ID NO: 82642 - DNA, 25 bp, Homo sapien
gtccccttgccagtgaaaacttggg

SEQ ID NO: 82643 - DNA, 25 bp, Homo sapien
gtcccgaaatggcgactcatgccct

SEQ ID NO: 82644 - DNA, 25 bp, Homo sapien
gtcccgaaatggtgactcatgccct

SEQ ID NO: 82645 - DNA, 25 bp, Homo sapien
gtcccgatcagctagttttcaggtg

SEQ ID NO: 82646 - DNA, 25 bp, Homo sapien
gtcccgattagctagttttcaggtg

SEQ ID NO: 82647 - DNA, 25 bp, Homo sapien
gtcccgtgaaaaagtagaatttata

SEQ ID NO: 82648 - DNA, 25 bp, Homo sapien
gtcccgtgaaaaattagaatttata

SEQ ID NO: 82649 - DNA, 25 bp, Homo sapien
gtccctggagggtcgtgaatagcag

SEQ ID NO: 82650 - DNA, 25 bp, Homo sapien
gtccctggagggttgtgaatagcag

SEQ ID NO: 82651 - DNA, 25 bp, Homo sapien
gtccctttatgcttctatataggcc

SEQ ID NO: 82652 - DNA, 25 bp, Homo sapien
gtccctttgtgcttctatataggcc

SEQ ID NO: 82653 - DNA, 25 bp, Homo sapien
gtccgagtctatagtctcatactta

SEQ ID NO: 82654 - DNA, 25 bp, Homo sapien
gtccgagtgtatagtctcatactta

SEQ ID NO: 82655 - DNA, 25 bp, Homo sapien
gtccggaatggcggaagtaaatcga

SEQ ID NO: 82656 - DNA, 25 bp, Homo sapien
gtccggaatggtggaagtaaatcga

SEQ ID NO: 82657 - DNA, 25 bp, Homo sapien
gtccggcataggactgtgacaatta

SEQ ID NO: 82658 - DNA, 25 bp, Homo sapien
gtccggcataggattgtgacaatta

SEQ ID NO: 82659 - DNA, 25 bp, Homo sapien
gtccgtaagtaaccctaaagaaaat

SEQ ID NO: 82660 - DNA, 25 bp, Homo sapien
gtccgtaagtaaccttaaagaaaat

SEQ ID NO: 82661 - DNA, 25 bp, Homo sapien
gtcctaaagttaatcaatgtcttta

SEQ ID NO: 82662 - DNA, 25 bp, Homo sapien
gtcctaaagttaatcagtgtcttta

SEQ ID NO: 82663 - DNA, 25 bp, Homo sapien
gtcctacatttccaacaagatataa

SEQ ID NO: 82664 - DNA, 25 bp, Homo sapien
gtcctacatttcgaacaagatataa

SEQ ID NO: 82665 - DNA, 25 bp, Homo sapien
gtcctactgtgaagattttgccttt

SEQ ID NO: 82666 - DNA, 25 bp, Homo sapien
gtcctactgtgacgattttgccttt

SEQ ID NO: 82667 - DNA, 25 bp, Homo sapien
gtcctagagagaagaaagacacatt

SEQ ID NO: 82668 - DNA, 25 bp, Homo sapien
gtcctagagggaagaaagacacatt

SEQ ID NO: 82669 - DNA, 25 bp, Homo sapien
gtcctaggtgttcaaattcattcat

SEQ ID NO: 82670 - DNA, 25 bp, Homo sapien
gtcctaggtgttcacattcattcat

SEQ ID NO: 82671 - DNA, 25 bp, Homo sapien
gtcctagtagaaggcgcttaccata

SEQ ID NO: 82672 - DNA, 25 bp, Homo sapien
gtcctagtagaaggtgcttaccata

SEQ ID NO: 82673 - DNA, 25 bp, Homo sapien
gtcctagtcaagatggccacacctc

SEQ ID NO: 82674 - DNA, 25 bp, Homo sapien
gtcctagtcgagatggccacacctc

SEQ ID NO: 82675 - DNA, 25 bp, Homo sapien
gtcctatataacatcttccaatata

SEQ ID NO: 82676 - DNA, 25 bp, Homo sapien
gtcctatataacgtcttccaatata

SEQ ID NO: 82677 - DNA, 25 bp, Homo sapien
gtcctatcctcacacttcctgtaca

SEQ ID NO: 82678 - DNA, 25 bp, Homo sapien
gtcctatcctcatacttcctgtaca

SEQ ID NO: 82679 - DNA, 25 bp, Homo sapien
gtcctattaaaacaattttggcaac

SEQ ID NO: 82680 - DNA, 25 bp, Homo sapien
gtcctattaaaagaattttggcaac

SEQ ID NO: 82681 - DNA, 25 bp, Homo sapien
gtcctattattgaattatcccccaa

SEQ ID NO: 82682 - DNA, 25 bp, Homo sapien
gtcctattcttgaattatcccccaa

SEQ ID NO: 82683 - DNA, 25 bp, Homo sapien
gtcctcaagatttcaaaagctaaaa

SEQ ID NO: 82684 - DNA, 25 bp, Homo sapien
gtcctcaaggtttcaaaagctaaaa

SEQ ID NO: 82685 - DNA, 25 bp, Homo sapien
gtcctcacaaagatatgtgttcaag

SEQ ID NO: 82686 - DNA, 25 bp, Homo sapien
gtcctcacgaagatatgtgttcaag

SEQ ID NO: 82687 - DNA, 25 bp, Homo sapien
gtcctcagatatccgtcctctttag

SEQ ID NO: 82688 - DNA, 25 bp, Homo sapien
gtcctcagatatctgtcctctttag

SEQ ID NO: 82689 - DNA, 25 bp, Homo sapien
gtcctcagcaaccacagggaggatc

SEQ ID NO: 82690 - DNA, 25 bp, Homo sapien
gtcctcagcaactacagggaggatc

SEQ ID NO: 82691 - DNA, 25 bp, Homo sapien
gtcctcatcactagaaacaaaaagg

SEQ ID NO: 82692 - DNA, 25 bp, Homo sapien
gtcctcatcactggaaacaaaaagg

SEQ ID NO: 82693 - DNA, 25 bp, Homo sapien
gtcctcatgagatcaaagtataaaa

SEQ ID NO: 82694 - DNA, 25 bp, Homo sapien
gtcctcatgagttcaaagtataaaa

SEQ ID NO: 82695 - DNA, 25 bp, Homo sapien
gtcctcgcaacttctgagtcactcc

SEQ ID NO: 82696 - DNA, 25 bp, Homo sapien
gtcctcgccacttctgagtcactcc

SEQ ID NO: 82697 - DNA, 25 bp, Homo sapien
gtcctcgtgtcaaaaacagcacacc

SEQ ID NO: 82698 - DNA, 25 bp, Homo sapien
gtcctcgtgtcaaaaatagcacacc

SEQ ID NO: 82699 - DNA, 25 bp, Homo sapien
gtcctctcacaatgaacgaggacat

SEQ ID NO: 82700 - DNA, 25 bp, Homo sapien
gtcctctcacaatgaatgaggacat

SEQ ID NO: 82701 - DNA, 25 bp, Homo sapien
gtcctctccactatgtttctaaaac

SEQ ID NO: 82702 - DNA, 25 bp, Homo sapien
gtcctctccactgtgtttctaaaac

SEQ ID NO: 82703 - DNA, 25 bp, Homo sapien
gtcctctgccaaagttctaagtttt

SEQ ID NO: 82704 - DNA, 25 bp, Homo sapien
gtcctctgccaaagttgtaagtttt

SEQ ID NO: 82705 - DNA, 25 bp, Homo sapien
gtcctctttttcccatacttcatcc

SEQ ID NO: 82706 - DNA, 25 bp, Homo sapien
gtcctctttttcccgtacttcatcc

SEQ ID NO: 82707 - DNA, 25 bp, Homo sapien
gtcctgaacagagagacagtcgtct

SEQ ID NO: 82708 - DNA, 25 bp, Homo sapien
gtcctgaacagagatacagtcgtct

SEQ ID NO: 82709 - DNA, 25 bp, Homo sapien
gtcctgaatacactcacttatgcat

SEQ ID NO: 82710 - DNA, 25 bp, Homo sapien
gtcctgaatactctcacttatgcat

SEQ ID NO: 82711 - DNA, 25 bp, Homo sapien
gtcctgagaatttgcaggtctaaca

SEQ ID NO: 82712 - DNA, 25 bp, Homo sapien
gtcctgagaatttgtaggtctaaca

SEQ ID NO: 82713 - DNA, 25 bp, Homo sapien
gtcctgccttattggagattctaga

SEQ ID NO: 82714 - DNA, 25 bp, Homo sapien
gtcctgccttatttgagattctaga

SEQ ID NO: 82715 - DNA, 25 bp, Homo sapien
gtcctgctataagaagatggaagat

SEQ ID NO: 82716 - DNA, 25 bp, Homo sapien
gtcctgctataataagatggaagat

SEQ ID NO: 82717 - DNA, 25 bp, Homo sapien
gtcctggagatcagcgtggatgaga

SEQ ID NO: 82718 - DNA, 25 bp, Homo sapien
gtcctggagatcagtgtggatgaga

SEQ ID NO: 82719 - DNA, 25 bp, Homo sapien
gtcctgggcattttctcgttggtag

SEQ ID NO: 82720 - DNA, 25 bp, Homo sapien
gtcctgggcattttttcgttggtag

SEQ ID NO: 82721 - DNA, 25 bp, Homo sapien
gtcctggggatacagaaatggagaa

SEQ ID NO: 82722 - DNA, 25 bp, Homo sapien
gtcctggggatagagaaatggagaa

SEQ ID NO: 82723 - DNA, 25 bp, Homo sapien
gtcctggtgacaatctgagtaggtt

SEQ ID NO: 82724 - DNA, 25 bp, Homo sapien
gtcctggtgacaatttgagtaggtt

SEQ ID NO: 82725 - DNA, 25 bp, Homo sapien
gtcctggttcatctttgagtaattt

SEQ ID NO: 82726 - DNA, 25 bp, Homo sapien
gtcctggtttatctttgagtaattt

SEQ ID NO: 82727 - DNA, 25 bp, Homo sapien
gtcctgtgaggcactgccaagtcgc

SEQ ID NO: 82728 - DNA, 25 bp, Homo sapien
gtcctgtgaggcattgccaagtcgc

SEQ ID NO: 82729 - DNA, 25 bp, Homo sapien
gtcctgtgtatggtgggctccaccc

SEQ ID NO: 82730 - DNA, 25 bp, Homo sapien
gtcctgtgtgtggtgggctccaccc

SEQ ID NO: 82731 - DNA, 25 bp, Homo sapien
gtcctgttgagcatagcagagatga

SEQ ID NO: 82732 - DNA, 25 bp, Homo sapien
gtcctgttgagcgtagcagagatga

SEQ ID NO: 82733 - DNA, 25 bp, Homo sapien
gtcctgttgtaactttagtgaaaat

SEQ ID NO: 82734 - DNA, 25 bp, Homo sapien
gtcctgttttaactttagtgaaaat

SEQ ID NO: 82735 - DNA, 25 bp, Homo sapien
gtccttacagagtttgtggtctagt

SEQ ID NO: 82736 - DNA, 25 bp, Homo sapien
gtccttacggagtttgtggtctagt

SEQ ID NO: 82737 - DNA, 25 bp, Homo sapien
gtccttccacggatacctgaagcat

SEQ ID NO: 82738 - DNA, 25 bp, Homo sapien
gtccttccatggatacctgaagcat

SEQ ID NO: 82739 - DNA, 25 bp, Homo sapien
gtccttcccgaaagcagccctctgt

SEQ ID NO: 82740 - DNA, 25 bp, Homo sapien
gtccttcccggtgtctcaggcttct

SEQ ID NO: 82741 - DNA, 25 bp, Homo sapien
gtccttcctgaaagcagccctctgt

SEQ ID NO: 82742 - DNA, 25 bp, Homo sapien
gtccttcctggtgtctcaggcttct

SEQ ID NO: 82743 - DNA, 25 bp, Homo sapien
gtccttgaaacatttatcttctgct

SEQ ID NO: 82744 - DNA, 25 bp, Homo sapien
gtccttgaaacctttatcttctgct

SEQ ID NO: 82745 - DNA, 25 bp, Homo sapien
gtccttgaagataggataatggatg

SEQ ID NO: 82746 - DNA, 25 bp, Homo sapien
gtccttgaagatgggataatggatg

SEQ ID NO: 82747 - DNA, 25 bp, Homo sapien
gtccttgatttgggcagagatttct

SEQ ID NO: 82748 - DNA, 25 bp, Homo sapien
gtccttgatttggggagagatttct

SEQ ID NO: 82749 - DNA, 25 bp, Homo sapien
gtccttgcagacctcctggaatggt

SEQ ID NO: 82750 - DNA, 25 bp, Homo sapien
gtccttgcagagctcctggaatggt

SEQ ID NO: 82751 - DNA, 25 bp, Homo sapien
gtccttgggaaacttgctgtgtgac

SEQ ID NO: 82752 - DNA, 25 bp, Homo sapien
gtccttgggcaacttgctgtgtgac

SEQ ID NO: 82753 - DNA, 25 bp, Homo sapien
gtccttgtcaacaaaatggatgtta

SEQ ID NO: 82754 - DNA, 25 bp, Homo sapien
gtccttgtcgacaaaatggatgtta

SEQ ID NO: 82755 - DNA, 25 bp, Homo sapien
gtcctttattccatattaaaacatt

SEQ ID NO: 82756 - DNA, 25 bp, Homo sapien
gtcctttattccgtattaaaacatt

SEQ ID NO: 82757 - DNA, 25 bp, Homo sapien
gtcctttatttcggcagatgttacc

SEQ ID NO: 82758 - DNA, 25 bp, Homo sapien
gtcctttattttggcagatgttacc

SEQ ID NO: 82759 - DNA, 25 bp, Homo sapien
gtcctttccaatagagtgagcagtt

SEQ ID NO: 82760 - DNA, 25 bp, Homo sapien
gtcctttccaatggagtgagcagtt

SEQ ID NO: 82761 - DNA, 25 bp, Homo sapien
gtcctttctattgataactatcctc

SEQ ID NO: 82762 - DNA, 25 bp, Homo sapien
gtcctttctattgatatctatcctc

SEQ ID NO: 82763 - DNA, 25 bp, Homo sapien
gtcctttgacctaggattatcttct

SEQ ID NO: 82764 - DNA, 25 bp, Homo sapien
gtcctttgatctaggattatcttct

SEQ ID NO: 82765 - DNA, 25 bp, Homo sapien
gtcctttgattcatggaggtacttg

SEQ ID NO: 82766 - DNA, 25 bp, Homo sapien
gtcctttgctcatcttaaaatctgg

SEQ ID NO: 82767 - DNA, 25 bp, Homo sapien
gtcctttgctcattttaaaatctgg

SEQ ID NO: 82768 - DNA, 25 bp, Homo sapien
gtcctttgtttcatggaggtacttg

SEQ ID NO: 82769 - DNA, 25 bp, Homo sapien
gtccttttaaaatctgatctgcaaa

SEQ ID NO: 82770 - DNA, 25 bp, Homo sapien
gtccttttaaagtctgatctgcaaa

SEQ ID NO: 82771 - DNA, 25 bp, Homo sapien
gtccttttgacatacttttattatc

SEQ ID NO: 82772 - DNA, 25 bp, Homo sapien
gtccttttgatcacatttcctgggg

SEQ ID NO: 82773 - DNA, 25 bp, Homo sapien
gtccttttggtcacatttcctgggg

SEQ ID NO: 82774 - DNA, 25 bp, Homo sapien
gtcctttttacatacttttattatc

SEQ ID NO: 82775 - DNA, 25 bp, Homo sapien
gtcgaactgttacctttccagaaaa

SEQ ID NO: 82776 - DNA, 25 bp, Homo sapien
gtcgaactgtttcctttccagaaaa

SEQ ID NO: 82777 - DNA, 25 bp, Homo sapien
gtcgattttagcacttctaaaatca

SEQ ID NO: 82778 - DNA, 25 bp, Homo sapien
gtcgattttagcacttttaaaatca

SEQ ID NO: 82779 - DNA, 25 bp, Homo sapien
gtcgcagtgaaccaaaatagggcca

SEQ ID NO: 82780 - DNA, 25 bp, Homo sapien
gtcgcagtgaaccgaaatagggcca

SEQ ID NO: 82781 - DNA, 25 bp, Homo sapien
gtcgcatgacatattcaaagtgcta

SEQ ID NO: 82782 - DNA, 25 bp, Homo sapien
gtcgcatgacatattcgaagtgcta

SEQ ID NO: 82783 - DNA, 25 bp, Homo sapien
gtcgccaaaaactacgtactcttgg

SEQ ID NO: 82784 - DNA, 25 bp, Homo sapien
gtcgccaaaaactatgtactcttgg

SEQ ID NO: 82785 - DNA, 25 bp, Homo sapien
gtcgccctttaccaagcaagccaac

SEQ ID NO: 82786 - DNA, 25 bp, Homo sapien
gtcgccctttaccgagcaagccaac

SEQ ID NO: 82787 - DNA, 25 bp, Homo sapien
gtcgctatgaattttccgtctttaa

SEQ ID NO: 82788 - DNA, 25 bp, Homo sapien
gtcgctatgaattttctgtctttaa

SEQ ID NO: 82789 - DNA, 25 bp, Homo sapien
gtcgctgagtcacaggggcaggcgt

SEQ ID NO: 82790 - DNA, 25 bp, Homo sapien
gtcgctgagtcacgggggcaggcgt

SEQ ID NO: 82791 - DNA, 25 bp, Homo sapien
gtcgctggacaacgaaacactgcag

SEQ ID NO: 82792 - DNA, 25 bp, Homo sapien
gtcgctggacaatgaaacactgcag

SEQ ID NO: 82793 - DNA, 25 bp, Homo sapien
gtcgcttaattcaggaggcagaggt

SEQ ID NO: 82794 - DNA, 25 bp, Homo sapien
gtcgcttaattcgggaggcagaggt

SEQ ID NO: 82795 - DNA, 25 bp, Homo sapien
gtcggattgtgttttggtgattgta

SEQ ID NO: 82796 - DNA, 25 bp, Homo sapien
gtcggattgtgttttgttgattgta

SEQ ID NO: 82797 - DNA, 25 bp, Homo sapien
gtcggcattaagcactgaagagaaa

SEQ ID NO: 82798 - DNA, 25 bp, Homo sapien
gtcggcattaagcgctgaagagaaa

SEQ ID NO: 82799 - DNA, 25 bp, Homo sapien
gtcgggagcttctcccacaaagact

SEQ ID NO: 82800 - DNA, 25 bp, Homo sapien
gtcgggagcttctcccgcaaagact

SEQ ID NO: 82801 - DNA, 25 bp, Homo sapien
gtcgtagcatacaagacagcatctc

SEQ ID NO: 82802 - DNA, 25 bp, Homo sapien
gtcgtagcatacaagatagcatctc

SEQ ID NO: 82803 - DNA, 25 bp, Homo sapien
gtcgtaggcctggtaacgttcacca

SEQ ID NO: 82804 - DNA, 25 bp, Homo sapien
gtcgtaggcctggtaatgttcacca

SEQ ID NO: 82805 - DNA, 25 bp, Homo sapien
gtcgtatgttctatgaagagccaca

SEQ ID NO: 82806 - DNA, 25 bp, Homo sapien
gtcgtatgttctgtgaagagccaca

SEQ ID NO: 82807 - DNA, 25 bp, Homo sapien
gtcgtctataatgtcttgcagcagt

SEQ ID NO: 82808 - DNA, 25 bp, Homo sapien
gtcgtctataatttcttgcagcagt

SEQ ID NO: 82809 - DNA, 25 bp, Homo sapien
gtcgtgatggagccgctgcacccca

SEQ ID NO: 82810 - DNA, 25 bp, Homo sapien
gtcgtgattcccagcaataaaaagg

SEQ ID NO: 82811 - DNA, 25 bp, Homo sapien
gtcgtgattccgagcaataaaaagg

SEQ ID NO: 82812 - DNA, 25 bp, Homo sapien
gtcgtgattgagccgctgcacccca

SEQ ID NO: 82813 - DNA, 25 bp, Homo sapien
gtcgtgtttctctaatgagatgatg

SEQ ID NO: 82814 - DNA, 25 bp, Homo sapien
gtcgtgtttgtctaatgagatgatg

SEQ ID NO: 82815 - DNA, 25 bp, Homo sapien
gtcgtttgcttaacatacaccctgg

SEQ ID NO: 82816 - DNA, 25 bp, Homo sapien
gtcgtttgcttaacgtacaccctgg

SEQ ID NO: 82817 - DNA, 25 bp, Homo sapien
gtctaaaacaatgactcactcatga

SEQ ID NO: 82818 - DNA, 25 bp, Homo sapien
gtctaaaacaatgacttactcatga

SEQ ID NO: 82819 - DNA, 25 bp, Homo sapien
gtctaaaacataagtgctattttaa

SEQ ID NO: 82820 - DNA, 25 bp, Homo sapien
gtctaaaacgtaagtgctattttaa

SEQ ID NO: 82821 - DNA, 25 bp, Homo sapien
gtctaaagaatcgatctgatttcca

SEQ ID NO: 82822 - DNA, 25 bp, Homo sapien
gtctaaagaatctatctgatttcca

SEQ ID NO: 82823 - DNA, 25 bp, Homo sapien
gtctaacacatgttttatgagcata

SEQ ID NO: 82824 - DNA, 25 bp, Homo sapien
gtctaacacatgttttgtgagcata

SEQ ID NO: 82825 - DNA, 25 bp, Homo sapien
gtctaagatgaaacttccaccctac

SEQ ID NO: 82826 - DNA, 25 bp, Homo sapien
gtctaagatgaaactttcaccctac

SEQ ID NO: 82827 - DNA, 25 bp, Homo sapien
gtctaaggcttgtagacaggataac

SEQ ID NO: 82828 - DNA, 25 bp, Homo sapien
gtctaaggcttgtagataggataac

SEQ ID NO: 82829 - DNA, 25 bp, Homo sapien
gtctaaggtccagaaggtagtgatc

SEQ ID NO: 82830 - DNA, 25 bp, Homo sapien
gtctaaggtccggaaggtagtgatc

SEQ ID NO: 82831 - DNA, 25 bp, Homo sapien
gtctaatactttcaggaagaaacaa

SEQ ID NO: 82832 - DNA, 25 bp, Homo sapien
gtctaatactttgaggaagaaacaa

SEQ ID NO: 82833 - DNA, 25 bp, Homo sapien
gtctaatagtgcaattctttccctt

SEQ ID NO: 82834 - DNA, 25 bp, Homo sapien
gtctaatattgcaattctttccctt

SEQ ID NO: 82835 - DNA, 25 bp, Homo sapien
gtctaatgaattccctttcttcttg

SEQ ID NO: 82836 - DNA, 25 bp, Homo sapien
gtctaatgaattctctttcttcttg

SEQ ID NO: 82837 - DNA, 25 bp, Homo sapien
gtctacaaacactgaatgagcacct

SEQ ID NO: 82838 - DNA, 25 bp, Homo sapien
gtctacaagcactgaatgagcacct

SEQ ID NO: 82839 - DNA, 25 bp, Homo sapien
gtctacatcaacaatcatttgctta

SEQ ID NO: 82840 - DNA, 25 bp, Homo sapien
gtctacattaacaatcatttgctta

SEQ ID NO: 82841 - DNA, 25 bp, Homo sapien
gtctacctagaggtaacatcagatc

SEQ ID NO: 82842 - DNA, 25 bp, Homo sapien
gtctacctagaggtaatatcagatc

SEQ ID NO: 82843 - DNA, 25 bp, Homo sapien
gtctactaaaaattcagtgaatatg

SEQ ID NO: 82844 - DNA, 25 bp, Homo sapien
gtctactaagaattcagtgaatatg

SEQ ID NO: 82845 - DNA, 25 bp, Homo sapien
gtctactacatcactgcagctgcaa

SEQ ID NO: 82846 - DNA, 25 bp, Homo sapien
gtctactacatcgctgcagctgcaa

SEQ ID NO: 82847 - DNA, 25 bp, Homo sapien
gtctactatgtaacagataattaca

SEQ ID NO: 82848 - DNA, 25 bp, Homo sapien
gtctactatgtatcagataattaca

SEQ ID NO: 82849 - DNA, 25 bp, Homo sapien
gtctactgaatctaaaggaatgctc

SEQ ID NO: 82850 - DNA, 25 bp, Homo sapien
gtctactgagtctaaaggaatgctc

SEQ ID NO: 82851 - DNA, 25 bp, Homo sapien
gtctactggcggtatcctttcctgt

SEQ ID NO: 82852 - DNA, 25 bp, Homo sapien
gtctactggtggtatcctttcctgt

SEQ ID NO: 82853 - DNA, 25 bp, Homo sapien
gtctacttatgctaggtgtcgggaa

SEQ ID NO: 82854 - DNA, 25 bp, Homo sapien
gtctacttttgctaggtgtcgggaa

SEQ ID NO: 82855 - DNA, 25 bp, Homo sapien
gtctagaactttcattcagtgatat

SEQ ID NO: 82856 - DNA, 25 bp, Homo sapien
gtctagaactttcattgagtgatat

SEQ ID NO: 82857 - DNA, 25 bp, Homo sapien
gtctagatgaatactcaccctgtat

SEQ ID NO: 82858 - DNA, 25 bp, Homo sapien
gtctagatgaatattcaccctgtat

SEQ ID NO: 82859 - DNA, 25 bp, Homo sapien
gtctagattggaacccctgcacatg

SEQ ID NO: 82860 - DNA, 25 bp, Homo sapien
gtctagattgggacccctgcacatg

SEQ ID NO: 82861 - DNA, 25 bp, Homo sapien
gtctagcaccttttttgaattatga

SEQ ID NO: 82862 - DNA, 25 bp, Homo sapien
gtctagcatcttttttgaattatga

SEQ ID NO: 82863 - DNA, 25 bp, Homo sapien
gtctagctctctaaaaaaaaagatt

SEQ ID NO: 82864 - DNA, 25 bp, Homo sapien
gtctagctctctcaaaaaaaagatt

SEQ ID NO: 82865 - DNA, 25 bp, Homo sapien
gtctagggtatacacagtagcattg

SEQ ID NO: 82866 - DNA, 25 bp, Homo sapien
gtctagggtatatacagtagcattg

SEQ ID NO: 82867 - DNA, 25 bp, Homo sapien
gtctaggtgttcaaaccaactccta

SEQ ID NO: 82868 - DNA, 25 bp, Homo sapien
gtctaggtgttcgaaccaactccta

SEQ ID NO: 82869 - DNA, 25 bp, Homo sapien
gtctagtgaatgagctgagaggtga

SEQ ID NO: 82870 - DNA, 25 bp, Homo sapien
gtctagtgaatgggctgagaggtga

SEQ ID NO: 82871 - DNA, 25 bp, Homo sapien
gtctagtttatcacttggacaactt

SEQ ID NO: 82872 - DNA, 25 bp, Homo sapien
gtctagtttctcacttggacaactt

SEQ ID NO: 82873 - DNA, 25 bp, Homo sapien
gtctataatgtcttgcagcagtgtt

SEQ ID NO: 82874 - DNA, 25 bp, Homo sapien
gtctataatttcttgcagcagtgtt

SEQ ID NO: 82875 - DNA, 25 bp, Homo sapien
gtctatacagcaggataagcaataa

SEQ ID NO: 82876 - DNA, 25 bp, Homo sapien
gtctatacagcaggttaagcaataa

SEQ ID NO: 82877 - DNA, 25 bp, Homo sapien
gtctatatccgataggctacagttc

SEQ ID NO: 82878 - DNA, 25 bp, Homo sapien
gtctatatctgataggctacagttc

SEQ ID NO: 82879 - DNA, 25 bp, Homo sapien
gtctatattttagtgcactggttcc

SEQ ID NO: 82880 - DNA, 25 bp, Homo sapien
gtctatattttagtgcgctggttcc

SEQ ID NO: 82881 - DNA, 25 bp, Homo sapien
gtctatcaagctatttactgagtgc

SEQ ID NO: 82882 - DNA, 25 bp, Homo sapien
gtctatcaggctatttactgagtgc

SEQ ID NO: 82883 - DNA, 25 bp, Homo sapien
gtctatgacgatttgcttggtttgt

SEQ ID NO: 82884 - DNA, 25 bp, Homo sapien
gtctatgatgatttgcttggtttgt

SEQ ID NO: 82885 - DNA, 25 bp, Homo sapien
gtctatgctcaacaaatggaagaac

SEQ ID NO: 82886 - DNA, 25 bp, Homo sapien
gtctatgctcaataaatggaagaac

SEQ ID NO: 82887 - DNA, 25 bp, Homo sapien
gtctatgttacatatattcatagac

SEQ ID NO: 82888 - DNA, 25 bp, Homo sapien
gtctatgttacatgtattcatagac

SEQ ID NO: 82889 - DNA, 25 bp, Homo sapien
gtctattcgtaatttctgacactca

SEQ ID NO: 82890 - DNA, 25 bp, Homo sapien
gtctattcgtagtttctgacactca

SEQ ID NO: 82891 - DNA, 25 bp, Homo sapien
gtctattggaagaagatgccttgta

SEQ ID NO: 82892 - DNA, 25 bp, Homo sapien
gtctattggcagaagatgccttgta

SEQ ID NO: 82893 - DNA, 25 bp, Homo sapien
gtctatttcagccttacagtgggag

SEQ ID NO: 82894 - DNA, 25 bp, Homo sapien
gtctatttcagccttagagtgggag

SEQ ID NO: 82895 - DNA, 25 bp, Homo sapien
gtctcaaaattaatgttccagtccc

SEQ ID NO: 82896 - DNA, 25 bp, Homo sapien
gtctcaaaatttatgttccagtccc

SEQ ID NO: 82897 - DNA, 25 bp, Homo sapien
gtctcaaagccataattgatattta

SEQ ID NO: 82898 - DNA, 25 bp, Homo sapien
gtctcaaagccgtaattgatattta

SEQ ID NO: 82899 - DNA, 25 bp, Homo sapien
gtctcaaatccatttccttgaccca

SEQ ID NO: 82900 - DNA, 25 bp, Homo sapien
gtctcaaatccttttccttgaccca

SEQ ID NO: 82901 - DNA, 25 bp, Homo sapien
gtctcaacatcattcgctatgctga

SEQ ID NO: 82902 - DNA, 25 bp, Homo sapien
gtctcaacatcattggctatgctga

SEQ ID NO: 82903 - DNA, 25 bp, Homo sapien
gtctcaagaaataagctgcaaatat

SEQ ID NO: 82904 - DNA, 25 bp, Homo sapien
gtctcaagaaatatgctgcaaatat

SEQ ID NO: 82905 - DNA, 25 bp, Homo sapien
gtctcacacagaaatattaactttc

SEQ ID NO: 82906 - DNA, 25 bp, Homo sapien
gtctcacacggaaatattaactttc

SEQ ID NO: 82907 - DNA, 25 bp, Homo sapien
gtctcacactttctttcagggtata

SEQ ID NO: 82908 - DNA, 25 bp, Homo sapien
gtctcacataaaccaaaacttacac

SEQ ID NO: 82909 - DNA, 25 bp, Homo sapien
gtctcacataatccaaaacttacac

SEQ ID NO: 82910 - DNA, 25 bp, Homo sapien
gtctcacattttctttcagggtata

SEQ ID NO: 82911 - DNA, 25 bp, Homo sapien
gtctcacttacaatggaatatcatc

SEQ ID NO: 82912 - DNA, 25 bp, Homo sapien
gtctcacttgcaatggaatatcatc

SEQ ID NO: 82913 - DNA, 25 bp, Homo sapien
gtctcagaatatactgatgaatgca

SEQ ID NO: 82914 - DNA, 25 bp, Homo sapien
gtctcagaatatattgatgaatgca

SEQ ID NO: 82915 - DNA, 25 bp, Homo sapien
gtctcagatgcctattgtattaccg

SEQ ID NO: 82916 - DNA, 25 bp, Homo sapien
gtctcagatgcctattttattaccg

SEQ ID NO: 82917 - DNA, 25 bp, Homo sapien
gtctcagctacatactgtttcattc

SEQ ID NO: 82918 - DNA, 25 bp, Homo sapien
gtctcagctaccaacactgtgttct

SEQ ID NO: 82919 - DNA, 25 bp, Homo sapien
gtctcagctaccaagactgtgttct

SEQ ID NO: 82920 - DNA, 25 bp, Homo sapien
gtctcagctacgtactgtttcattc

SEQ ID NO: 82921 - DNA, 25 bp, Homo sapien
gtctcagcttgccgcaatcttggtc

SEQ ID NO: 82922 - DNA, 25 bp, Homo sapien
gtctcagcttgctgcaatcttggtc

SEQ ID NO: 82923 - DNA, 25 bp, Homo sapien
gtctcaggataacagatgccctgtc

SEQ ID NO: 82924 - DNA, 25 bp, Homo sapien
gtctcagggtaacagatgccctgtc

SEQ ID NO: 82925 - DNA, 25 bp, Homo sapien
gtctcagtcgaatggccaaatcatt

SEQ ID NO: 82926 - DNA, 25 bp, Homo sapien
gtctcagtcttcatctactttctca

SEQ ID NO: 82927 - DNA, 25 bp, Homo sapien
gtctcagtcttcgtctactttctca

SEQ ID NO: 82928 - DNA, 25 bp, Homo sapien
gtctcagttgaatggccaaatcatt

SEQ ID NO: 82929 - DNA, 25 bp, Homo sapien
gtctcatcacaaattctgttttaga

SEQ ID NO: 82930 - DNA, 25 bp, Homo sapien
gtctcatcacaatttctgttttaga

SEQ ID NO: 82931 - DNA, 25 bp, Homo sapien
gtctcatccatatcattgtcactga

SEQ ID NO: 82932 - DNA, 25 bp, Homo sapien
gtctcatccatattattgtcactga

SEQ ID NO: 82933 - DNA, 25 bp, Homo sapien
gtctcatgaacccagccattcgtca

SEQ ID NO: 82934 - DNA, 25 bp, Homo sapien
gtctcatgaccccagccattcgtca

SEQ ID NO: 82935 - DNA, 25 bp, Homo sapien
gtctcatgagttttgcatgttgcgt

SEQ ID NO: 82936 - DNA, 25 bp, Homo sapien
gtctcatgagttttgcgtgttgcgt

SEQ ID NO: 82937 - DNA, 25 bp, Homo sapien
gtctcatgctgcagtcgcattttca

SEQ ID NO: 82938 - DNA, 25 bp, Homo sapien
gtctcatgctgcagtctcattttca

SEQ ID NO: 82939 - DNA, 25 bp, Homo sapien
gtctccaacaggatgggcttaactt

SEQ ID NO: 82940 - DNA, 25 bp, Homo sapien
gtctccaaccatttttccttctttg

SEQ ID NO: 82941 - DNA, 25 bp, Homo sapien
gtctccaaccattttttcttctttg

SEQ ID NO: 82942 - DNA, 25 bp, Homo sapien
gtctccaacctttttcacaccaagg

SEQ ID NO: 82943 - DNA, 25 bp, Homo sapien
gtctccaacctttttcgcaccaagg

SEQ ID NO: 82944 - DNA, 25 bp, Homo sapien
gtctccaaggcatatcattgacctt

SEQ ID NO: 82945 - DNA, 25 bp, Homo sapien
gtctccaaggcatgtcattgacctt

SEQ ID NO: 82946 - DNA, 25 bp, Homo sapien
gtctccaataggatgggcttaactt

SEQ ID NO: 82947 - DNA, 25 bp, Homo sapien
gtctccacaccacagctgtagccta

SEQ ID NO: 82948 - DNA, 25 bp, Homo sapien
gtctccacacctcagctgtagccta

SEQ ID NO: 82949 - DNA, 25 bp, Homo sapien
gtctccatgtttctttttgttacaa

SEQ ID NO: 82950 - DNA, 25 bp, Homo sapien
gtctccatttgtgcacgactgttct

SEQ ID NO: 82951 - DNA, 25 bp, Homo sapien
gtctccatttgtgtacgactgttct

SEQ ID NO: 82952 - DNA, 25 bp, Homo sapien
gtctccatttttctttttgttacaa

SEQ ID NO: 82953 - DNA, 25 bp, Homo sapien
gtctcccaaatttataaagacaatg

SEQ ID NO: 82954 - DNA, 25 bp, Homo sapien
gtctcccagatttataaagacaatg

SEQ ID NO: 82955 - DNA, 25 bp, Homo sapien
gtctccctaggaagtgtaaaagcca

SEQ ID NO: 82956 - DNA, 25 bp, Homo sapien
gtctccctaggatgtgtaaaagcca

SEQ ID NO: 82957 - DNA, 25 bp, Homo sapien
gtctccctcaggcatgtgacttttc

SEQ ID NO: 82958 - DNA, 25 bp, Homo sapien
gtctccctcagggatgtgacttttc

SEQ ID NO: 82959 - DNA, 25 bp, Homo sapien
gtctcctggctctcagttcagagat

SEQ ID NO: 82960 - DNA, 25 bp, Homo sapien
gtctcctggctctcggttcagagat

SEQ ID NO: 82961 - DNA, 25 bp, Homo sapien
gtctcctgtttctgattgtagctgg

SEQ ID NO: 82962 - DNA, 25 bp, Homo sapien
gtctcctgtttttgattgtagctgg

SEQ ID NO: 82963 - DNA, 25 bp, Homo sapien
gtctccttgcgtaattgagagtgat

SEQ ID NO: 82964 - DNA, 25 bp, Homo sapien
gtctccttgtgtaattgagagtgat

SEQ ID NO: 82965 - DNA, 25 bp, Homo sapien
gtctcctttttgttccattggtctg

SEQ ID NO: 82966 - DNA, 25 bp, Homo sapien
gtctcctttttgttccgttggtctg

SEQ ID NO: 82967 - DNA, 25 bp, Homo sapien
gtctcgcaaggatgttcaaatgcca

SEQ ID NO: 82968 - DNA, 25 bp, Homo sapien
gtctcgcaaggattttcaaatgcca

SEQ ID NO: 82969 - DNA, 25 bp, Homo sapien
gtctcgggtgaaggacaattatttt

SEQ ID NO: 82970 - DNA, 25 bp, Homo sapien
gtctcgggtgaaggacgattatttt

SEQ ID NO: 82971 - DNA, 25 bp, Homo sapien
gtctctaccctgaccatgtgccttg

SEQ ID NO: 82972 - DNA, 25 bp, Homo sapien
gtctctaccttgaccatgtgccttg

SEQ ID NO: 82973 - DNA, 25 bp, Homo sapien
gtctctactatgtacatggagcgtg

SEQ ID NO: 82974 - DNA, 25 bp, Homo sapien
gtctctactctgtacatggagcgtg

SEQ ID NO: 82975 - DNA, 25 bp, Homo sapien
gtctctcaactgtacgtcagaagtc

SEQ ID NO: 82976 - DNA, 25 bp, Homo sapien
gtctctcaactgtatgtcagaagtc

SEQ ID NO: 82977 - DNA, 25 bp, Homo sapien
gtctctcaatttataaggtcgttta

SEQ ID NO: 82978 - DNA, 25 bp, Homo sapien
gtctctcaatttatgaggtcgttta

SEQ ID NO: 82979 - DNA, 25 bp, Homo sapien
gtctctcacacatataattttttaa

SEQ ID NO: 82980 - DNA, 25 bp, Homo sapien
gtctctcacacgtataattttttaa

SEQ ID NO: 82981 - DNA, 25 bp, Homo sapien
gtctctcatctattcatgaatttcc

SEQ ID NO: 82982 - DNA, 25 bp, Homo sapien
gtctctcatctatttatgaatttcc

SEQ ID NO: 82983 - DNA, 25 bp, Homo sapien
gtctctctaccttttcaccaaaatc

SEQ ID NO: 82984 - DNA, 25 bp, Homo sapien
gtctctctatcttttcaccaaaatc

SEQ ID NO: 82985 - DNA, 25 bp, Homo sapien
gtctctctctgtatgtttgaatata

SEQ ID NO: 82986 - DNA, 25 bp, Homo sapien
gtctctctctgtgtgtttgaatata

SEQ ID NO: 82987 - DNA, 25 bp, Homo sapien
gtctctctctgttccttctattagt

SEQ ID NO: 82988 - DNA, 25 bp, Homo sapien
gtctctctgtgttccttctattagt

SEQ ID NO: 82989 - DNA, 25 bp, Homo sapien
gtctctgaacataccgtacttgtcc

SEQ ID NO: 82990 - DNA, 25 bp, Homo sapien
gtctctgaacatactgtacttgtcc

SEQ ID NO: 82991 - DNA, 25 bp, Homo sapien
gtctctgaggagctaccatttgagc

SEQ ID NO: 82992 - DNA, 25 bp, Homo sapien
gtctctgaggagttaccatttgagc

SEQ ID NO: 82993 - DNA, 25 bp, Homo sapien
gtctctgcatggtcattatcctttt

SEQ ID NO: 82994 - DNA, 25 bp, Homo sapien
gtctctgcatggtcgttatcctttt

SEQ ID NO: 82995 - DNA, 25 bp, Homo sapien
gtctctgccatcatgacagaaagcc

SEQ ID NO: 82996 - DNA, 25 bp, Homo sapien
gtctctgccttcatgacagaaagcc

SEQ ID NO: 82997 - DNA, 25 bp, Homo sapien
gtctctggagtcccagcgcggcagg

SEQ ID NO: 82998 - DNA, 25 bp, Homo sapien
gtctctggagtcccagtgcggcagg

SEQ ID NO: 82999 - DNA, 25 bp, Homo sapien
gtctcttcacaaacgtggggtagag

SEQ ID NO: 83000 - DNA, 25 bp, Homo sapien
gtctcttcacaaatgtggggtagag

SEQ ID NO: 83001 - DNA, 25 bp, Homo sapien
gtctcttgctccctactgccttgtg

SEQ ID NO: 83002 - DNA, 25 bp, Homo sapien
gtctcttgctccctcctgccttgtg

SEQ ID NO: 83003 - DNA, 25 bp, Homo sapien
gtctctttcatcagttggaggtatt

SEQ ID NO: 83004 - DNA, 25 bp, Homo sapien
gtctctttcgtcaattggaggtatt

SEQ ID NO: 83005 - DNA, 25 bp, Homo sapien
gtctctttcgtcagttggaggtatt

SEQ ID NO: 83006 - DNA, 25 bp, Homo sapien
gtctctttctgaaacatgtatctgg

SEQ ID NO: 83007 - DNA, 25 bp, Homo sapien
gtctctttctggaacatgtatctgg

SEQ ID NO: 83008 - DNA, 25 bp, Homo sapien
gtctcttttaccacatgaaatgaca

SEQ ID NO: 83009 - DNA, 25 bp, Homo sapien
gtctcttttaccgcatgaaatgaca

SEQ ID NO: 83010 - DNA, 25 bp, Homo sapien
gtctctttttacaaactgtgcttat

SEQ ID NO: 83011 - DNA, 25 bp, Homo sapien
gtctctttttacgaactgtgcttat

SEQ ID NO: 83012 - DNA, 25 bp, Homo sapien
gtctctttttccatgaaatgcctgt

SEQ ID NO: 83013 - DNA, 25 bp, Homo sapien
gtctctttttccgtgaaatgcctgt

SEQ ID NO: 83014 - DNA, 25 bp, Homo sapien
gtctgaaaagaaactaagcacgtgc

SEQ ID NO: 83015 - DNA, 25 bp, Homo sapien
gtctgaaaagatactaagcacgtgc

SEQ ID NO: 83016 - DNA, 25 bp, Homo sapien
gtctgaaatcaaggtgtaaagaggg

SEQ ID NO: 83017 - DNA, 25 bp, Homo sapien
gtctgaaatcaatgtgtaaagaggg

SEQ ID NO: 83018 - DNA, 25 bp, Homo sapien
gtctgaaattaacgggacatggagg

SEQ ID NO: 83019 - DNA, 25 bp, Homo sapien
gtctgaaattaatgggacatggagg

SEQ ID NO: 83020 - DNA, 25 bp, Homo sapien
gtctgaactgtaaaagaaattgtgc

SEQ ID NO: 83021 - DNA, 25 bp, Homo sapien
gtctgaactgtaaggtatgcaaaat

SEQ ID NO: 83022 - DNA, 25 bp, Homo sapien
gtctgaactgtgaaagaaattgtgc

SEQ ID NO: 83023 - DNA, 25 bp, Homo sapien
gtctgaactgtgaggtatgcaaaat

SEQ ID NO: 83024 - DNA, 25 bp, Homo sapien
gtctgaatcgattggcagtaaatgg

SEQ ID NO: 83025 - DNA, 25 bp, Homo sapien
gtctgaattaattaagccttgagac

SEQ ID NO: 83026 - DNA, 25 bp, Homo sapien
gtctgaattaattaggccttgagac

SEQ ID NO: 83027 - DNA, 25 bp, Homo sapien
gtctgaattgattggcagtaaatgg

SEQ ID NO: 83028 - DNA, 25 bp, Homo sapien
gtctgaatttgatgacagacttaat

SEQ ID NO: 83029 - DNA, 25 bp, Homo sapien
gtctgaatttggtgacagacttaat

SEQ ID NO: 83030 - DNA, 25 bp, Homo sapien
gtctgacagcttccgtggtccctta

SEQ ID NO: 83031 - DNA, 25 bp, Homo sapien
gtctgacaggttccgtggtccctta

SEQ ID NO: 83032 - DNA, 25 bp, Homo sapien
gtctgactcaaaagcgcactgtcac

SEQ ID NO: 83033 - DNA, 25 bp, Homo sapien
gtctgactcaaaggcgcactgtcac

SEQ ID NO: 83034 - DNA, 25 bp, Homo sapien
gtctgactggaatccccatgggcct

SEQ ID NO: 83035 - DNA, 25 bp, Homo sapien
gtctgactgtaatccccatgggcct

SEQ ID NO: 83036 - DNA, 25 bp, Homo sapien
gtctgagactcagaacctcaacagt

SEQ ID NO: 83037 - DNA, 25 bp, Homo sapien
gtctgagagaaaataaagagttata

SEQ ID NO: 83038 - DNA, 25 bp, Homo sapien
gtctgagagaaaataacgagttata

SEQ ID NO: 83039 - DNA, 25 bp, Homo sapien
gtctgagattcagaacctcaacagt

SEQ ID NO: 83040 - DNA, 25 bp, Homo sapien
gtctgagccagaaaattccttcagt

SEQ ID NO: 83041 - DNA, 25 bp, Homo sapien
gtctgagccagaaatttccttcagt

SEQ ID NO: 83042 - DNA, 25 bp, Homo sapien
gtctgagctataaccacattcacgt

SEQ ID NO: 83043 - DNA, 25 bp, Homo sapien
gtctgagctataacgacattcacgt

SEQ ID NO: 83044 - DNA, 25 bp, Homo sapien
gtctgagctatgagaaatcccggtc

SEQ ID NO: 83045 - DNA, 25 bp, Homo sapien
gtctgagctcaaacatcccaaggtc

SEQ ID NO: 83046 - DNA, 25 bp, Homo sapien
gtctgagctcaaagatcccaaggtc

SEQ ID NO: 83047 - DNA, 25 bp, Homo sapien
gtctgagctgtgagaaatcccggtc

SEQ ID NO: 83048 - DNA, 25 bp, Homo sapien
gtctgataaaaagtttgttggatta

SEQ ID NO: 83049 - DNA, 25 bp, Homo sapien
gtctgataaaacgtttgttggatta

SEQ ID NO: 83050 - DNA, 25 bp, Homo sapien
gtctgatgaatgtactttagaattc

SEQ ID NO: 83051 - DNA, 25 bp, Homo sapien
gtctgatgaatgtcctttagaattc

SEQ ID NO: 83052 - DNA, 25 bp, Homo sapien
gtctgattatcctgagcaggttcct

SEQ ID NO: 83053 - DNA, 25 bp, Homo sapien
gtctgattctcacaaatggcctagc

SEQ ID NO: 83054 - DNA, 25 bp, Homo sapien
gtctgattctcataaatggcctagc

SEQ ID NO: 83055 - DNA, 25 bp, Homo sapien
gtctgattgtcctgagcaggttcct

SEQ ID NO: 83056 - DNA, 25 bp, Homo sapien
gtctgcaaacctcattcttcctgga

SEQ ID NO: 83057 - DNA, 25 bp, Homo sapien
gtctgcaaacctcattgttcctgga

SEQ ID NO: 83058 - DNA, 25 bp, Homo sapien
gtctgcaagagtgctcttgtttcac

SEQ ID NO: 83059 - DNA, 25 bp, Homo sapien
gtctgcaagagtggtcttgtttcac

SEQ ID NO: 83060 - DNA, 25 bp, Homo sapien
gtctgcaatttgactgtaagctctt

SEQ ID NO: 83061 - DNA, 25 bp, Homo sapien
gtctgcaatttgattgtaagctctt

SEQ ID NO: 83062 - DNA, 25 bp, Homo sapien
gtctgcacagcttaagggtcagcgt

SEQ ID NO: 83063 - DNA, 25 bp, Homo sapien
gtctgcacagcttaggggtcagcgt

SEQ ID NO: 83064 - DNA, 25 bp, Homo sapien
gtctgcaggattcagcaccaagagc

SEQ ID NO: 83065 - DNA, 25 bp, Homo sapien
gtctgcaggattcatcaccaagagc

SEQ ID NO: 83066 - DNA, 25 bp, Homo sapien
gtctgcatcataaacccaaattcct

SEQ ID NO: 83067 - DNA, 25 bp, Homo sapien
gtctgcatcatgaacccaaattcct

SEQ ID NO: 83068 - DNA, 25 bp, Homo sapien
gtctgcatggctggattcacagacc

SEQ ID NO: 83069 - DNA, 25 bp, Homo sapien
gtctgcatggcttgattcacagacc

SEQ ID NO: 83070 - DNA, 25 bp, Homo sapien
gtctgcattcgttaaaggaaaacta

SEQ ID NO: 83071 - DNA, 25 bp, Homo sapien
gtctgcatttcaagcagcaaaatgg

SEQ ID NO: 83072 - DNA, 25 bp, Homo sapien
gtctgcatttcaagtagcaaaatgg

SEQ ID NO: 83073 - DNA, 25 bp, Homo sapien
gtctgcatttgttaaaggaaaacta

SEQ ID NO: 83074 - DNA, 25 bp, Homo sapien
gtctgcccattccagaacattcatc

SEQ ID NO: 83075 - DNA, 25 bp, Homo sapien
gtctgcccattcccgaacattcatc

SEQ ID NO: 83076 - DNA, 25 bp, Homo sapien
gtctgcccctccataaattgcctta

SEQ ID NO: 83077 - DNA, 25 bp, Homo sapien
gtctgcccctctataaattgcctta

SEQ ID NO: 83078 - DNA, 25 bp, Homo sapien
gtctgctaacaaaatgtcggtgacc

SEQ ID NO: 83079 - DNA, 25 bp, Homo sapien
gtctgctaccaaaatgtcggtgacc

SEQ ID NO: 83080 - DNA, 25 bp, Homo sapien
gtctgctcttaaagctttctgcctt

SEQ ID NO: 83081 - DNA, 25 bp, Homo sapien
gtctgctcttaaggctttctgcctt

SEQ ID NO: 83082 - DNA, 25 bp, Homo sapien
gtctgctgagctcatgttgtcacaa

SEQ ID NO: 83083 - DNA, 25 bp, Homo sapien
gtctgctgagctcttgttgtcacaa

SEQ ID NO: 83084 - DNA, 25 bp, Homo sapien
gtctgcttgaaaacccatcaaaggc

SEQ ID NO: 83085 - DNA, 25 bp, Homo sapien
gtctgcttggaaacccatcaaaggc

SEQ ID NO: 83086 - DNA, 25 bp, Homo sapien
gtctggaaatctatcctatggtcta

SEQ ID NO: 83087 - DNA, 25 bp, Homo sapien
gtctggaaatctatgctatggtcta

SEQ ID NO: 83088 - DNA, 25 bp, Homo sapien
gtctggaagttttccctacctaaca

SEQ ID NO: 83089 - DNA, 25 bp, Homo sapien
gtctggaagttttctctacctaaca

SEQ ID NO: 83090 - DNA, 25 bp, Homo sapien
gtctggacccagatttcgtgccaag

SEQ ID NO: 83091 - DNA, 25 bp, Homo sapien
gtctggacccagattttgtgccaag

SEQ ID NO: 83092 - DNA, 25 bp, Homo sapien
gtctggactttacacaataagacct

SEQ ID NO: 83093 - DNA, 25 bp, Homo sapien
gtctggactttacacagtaagacct

SEQ ID NO: 83094 - DNA, 25 bp, Homo sapien
gtctggagcatccatgtggctgaat

SEQ ID NO: 83095 - DNA, 25 bp, Homo sapien
gtctggagcgtccatgtggctgaat

SEQ ID NO: 83096 - DNA, 25 bp, Homo sapien
gtctggataaggtaactgccataac

SEQ ID NO: 83097 - DNA, 25 bp, Homo sapien
gtctggataaggtcactgccataac

SEQ ID NO: 83098 - DNA, 25 bp, Homo sapien
gtctggcacagaacaagcactcgga

SEQ ID NO: 83099 - DNA, 25 bp, Homo sapien
gtctggcacagcacaagcactcgga

SEQ ID NO: 83100 - DNA, 25 bp, Homo sapien
gtctggcagcatatggtgtggctgt

SEQ ID NO: 83101 - DNA, 25 bp, Homo sapien
gtctggcagtatatggtgtggctgt

SEQ ID NO: 83102 - DNA, 25 bp, Homo sapien
gtctggcttctttttcgtagtataa

SEQ ID NO: 83103 - DNA, 25 bp, Homo sapien
gtctggcttctttttcttagtataa

SEQ ID NO: 83104 - DNA, 25 bp, Homo sapien
gtctgggcgtggagaaaagatgttc

SEQ ID NO: 83105 - DNA, 25 bp, Homo sapien
gtctgggcgtggagaagagatgttc

SEQ ID NO: 83106 - DNA, 25 bp, Homo sapien
gtctggggataaagaataagccaag

SEQ ID NO: 83107 - DNA, 25 bp, Homo sapien
gtctggggatacagaataagccaag

SEQ ID NO: 83108 - DNA, 25 bp, Homo sapien
gtctgggtattttgttcttttagca

SEQ ID NO: 83109 - DNA, 25 bp, Homo sapien
gtctgggtatttttttcttttagca

SEQ ID NO: 83110 - DNA, 25 bp, Homo sapien
gtctgggtcggcccaaagcaaacat

SEQ ID NO: 83111 - DNA, 25 bp, Homo sapien
gtctgggtctgcccaaagcaaacat

SEQ ID NO: 83112 - DNA, 25 bp, Homo sapien
gtctggtaaacctacaaaaacttgc

SEQ ID NO: 83113 - DNA, 25 bp, Homo sapien
gtctggtaaacctataaaaacttgc

SEQ ID NO: 83114 - DNA, 25 bp, Homo sapien
gtctggtaaatgctgaccatttgtt

SEQ ID NO: 83115 - DNA, 25 bp, Homo sapien
gtctggtaaatgttgaccatttgtt

SEQ ID NO: 83116 - DNA, 25 bp, Homo sapien
gtctggtaacagcttccttctggac

SEQ ID NO: 83117 - DNA, 25 bp, Homo sapien
gtctggtaacagcttctttctggac

SEQ ID NO: 83118 - DNA, 25 bp, Homo sapien
gtctggtagatgaatagaatgcagt

SEQ ID NO: 83119 - DNA, 25 bp, Homo sapien
gtctggtaggtgaatagaatgcagt

SEQ ID NO: 83120 - DNA, 25 bp, Homo sapien
gtctggtcaaactccttccttttgg

SEQ ID NO: 83121 - DNA, 25 bp, Homo sapien
gtctggtcaaactctttccttttgg

SEQ ID NO: 83122 - DNA, 25 bp, Homo sapien
gtctggtccgctacagtgagaataa

SEQ ID NO: 83123 - DNA, 25 bp, Homo sapien
gtctggtcctctacagtgagaataa

SEQ ID NO: 83124 - DNA, 25 bp, Homo sapien
gtctggtctaaactgcaagtgactt

SEQ ID NO: 83125 - DNA, 25 bp, Homo sapien
gtctggtctaaacttcaagtgactt

SEQ ID NO: 83126 - DNA, 25 bp, Homo sapien
gtctggtgagctagtttgtataaag

SEQ ID NO: 83127 - DNA, 25 bp, Homo sapien
gtctggtgagcttgtttgtataaag

SEQ ID NO: 83128 - DNA, 25 bp, Homo sapien
gtctggtggacccactgtaatcaca

SEQ ID NO: 83129 - DNA, 25 bp, Homo sapien
gtctggtggacccattgtaatcaca

SEQ ID NO: 83130 - DNA, 25 bp, Homo sapien
gtctggtgtgctcacttggccagaa

SEQ ID NO: 83131 - DNA, 25 bp, Homo sapien
gtctggtgtgctcatttggccagaa

SEQ ID NO: 83132 - DNA, 25 bp, Homo sapien
gtctggttcctagtctgctagttga

SEQ ID NO: 83133 - DNA, 25 bp, Homo sapien
gtctggttcctagtgtgctagttga

SEQ ID NO: 83134 - DNA, 25 bp, Homo sapien
gtctggtttctatcacttagcacca

SEQ ID NO: 83135 - DNA, 25 bp, Homo sapien
gtctggtttctgtcacttagcacca

SEQ ID NO: 83136 - DNA, 25 bp, Homo sapien
gtctggttttgacaatcatagtatc

SEQ ID NO: 83137 - DNA, 25 bp, Homo sapien
gtctggttttggcaatcatagtatc

SEQ ID NO: 83138 - DNA, 25 bp, Homo sapien
gtctgtaccagaaaattcctccaac

SEQ ID NO: 83139 - DNA, 25 bp, Homo sapien
gtctgtacctgaaaattcctccaac

SEQ ID NO: 83140 - DNA, 25 bp, Homo sapien
gtctgtagcagaatattttaattgg

SEQ ID NO: 83141 - DNA, 25 bp, Homo sapien
gtctgtagcagagtattttaattgg

SEQ ID NO: 83142 - DNA, 25 bp, Homo sapien
gtctgtagccaaagacccgcgagct

SEQ ID NO: 83143 - DNA, 25 bp, Homo sapien
gtctgtagccaaaggcccgcgagct

SEQ ID NO: 83144 - DNA, 25 bp, Homo sapien
gtctgtatcaaccaagacatttttt

SEQ ID NO: 83145 - DNA, 25 bp, Homo sapien
gtctgtatccaccaagacatttttt

SEQ ID NO: 83146 - DNA, 25 bp, Homo sapien
gtctgtatgacctctaattcttatc

SEQ ID NO: 83147 - DNA, 25 bp, Homo sapien
gtctgtatggcctctaattcttatc

SEQ ID NO: 83148 - DNA, 25 bp, Homo sapien
gtctgtcacgaacccagtcagcctt

SEQ ID NO: 83149 - DNA, 25 bp, Homo sapien
gtctgtcatgaacccagtcagcctt

SEQ ID NO: 83150 - DNA, 25 bp, Homo sapien
gtctgtcatgcaccgagttgatggt

SEQ ID NO: 83151 - DNA, 25 bp, Homo sapien
gtctgtcatgcacctagttgatggt

SEQ ID NO: 83152 - DNA, 25 bp, Homo sapien
gtctgtccaacacgctatgaaggac

SEQ ID NO: 83153 - DNA, 25 bp, Homo sapien
gtctgtccaacgcgctatgaaggac

SEQ ID NO: 83154 - DNA, 25 bp, Homo sapien
gtctgtctgtagcagaatattttaa

SEQ ID NO: 83155 - DNA, 25 bp, Homo sapien
gtctgtctgtagcagagtattttaa

SEQ ID NO: 83156 - DNA, 25 bp, Homo sapien
gtctgtgacctctgtgctttgtttt

SEQ ID NO: 83157 - DNA, 25 bp, Homo sapien
gtctgtgatctctgtgctttgtttt

SEQ ID NO: 83158 - DNA, 25 bp, Homo sapien
gtctgtgatgatttccatgtctaca

SEQ ID NO: 83159 - DNA, 25 bp, Homo sapien
gtctgtgatgatttccgtgtctaca

SEQ ID NO: 83160 - DNA, 25 bp, Homo sapien
gtctgtgctttcataggccactcta

SEQ ID NO: 83161 - DNA, 25 bp, Homo sapien
gtctgtgctttgataggccactcta

SEQ ID NO: 83162 - DNA, 25 bp, Homo sapien
gtctgtggggtgtcctttttctaga

SEQ ID NO: 83163 - DNA, 25 bp, Homo sapien
gtctgtggggtgtcttttttctaga

SEQ ID NO: 83164 - DNA, 25 bp, Homo sapien
gtctgtgtgtatgctttgaactgca

SEQ ID NO: 83165 - DNA, 25 bp, Homo sapien
gtctgtgtgtattctttgaactgca

SEQ ID NO: 83166 - DNA, 25 bp, Homo sapien
gtctgttaaaaaatgcctccttttc

SEQ ID NO: 83167 - DNA, 25 bp, Homo sapien
gtctgttaaaaagtgcctccttttc

SEQ ID NO: 83168 - DNA, 25 bp, Homo sapien
gtctgttaaccaatctctgactatt

SEQ ID NO: 83169 - DNA, 25 bp, Homo sapien
gtctgttaaccaatttctgactatt

SEQ ID NO: 83170 - DNA, 25 bp, Homo sapien
gtctgttagtttaaccatgtatctg

SEQ ID NO: 83171 - DNA, 25 bp, Homo sapien
gtctgttagtttaaccgtgtatctg

SEQ ID NO: 83172 - DNA, 25 bp, Homo sapien
gtctgttcatatgcctattatttca

SEQ ID NO: 83173 - DNA, 25 bp, Homo sapien
gtctgttcatatgtctattatttca

SEQ ID NO: 83174 - DNA, 25 bp, Homo sapien
gtctgttctaccaaggactcggttt

SEQ ID NO: 83175 - DNA, 25 bp, Homo sapien
gtctgttctaccagggactcggttt

SEQ ID NO: 83176 - DNA, 25 bp, Homo sapien
gtctgttctttctctattgtttgga

SEQ ID NO: 83177 - DNA, 25 bp, Homo sapien
gtctgttctttctttattgtttgga

SEQ ID NO: 83178 - DNA, 25 bp, Homo sapien
gtcttaagtgagatgacgtaaatag

SEQ ID NO: 83179 - DNA, 25 bp, Homo sapien
gtcttaagtgagatgatgtaaatag

SEQ ID NO: 83180 - DNA, 25 bp, Homo sapien
gtcttacatgccttcttaaaacaca

SEQ ID NO: 83181 - DNA, 25 bp, Homo sapien
gtcttacatgctttcttaaaacaca

SEQ ID NO: 83182 - DNA, 25 bp, Homo sapien
gtcttagagatagtatcccaggtga

SEQ ID NO: 83183 - DNA, 25 bp, Homo sapien
gtcttagagatggtatcccaggtga

SEQ ID NO: 83184 - DNA, 25 bp, Homo sapien
gtcttagggaaataaatcattgaag

SEQ ID NO: 83185 - DNA, 25 bp, Homo sapien
gtcttaggtaaataaatcattgaag

SEQ ID NO: 83186 - DNA, 25 bp, Homo sapien
gtcttagtatttatctggttccctc

SEQ ID NO: 83187 - DNA, 25 bp, Homo sapien
gtcttagtatttctctggttccctc

SEQ ID NO: 83188 - DNA, 25 bp, Homo sapien
gtcttagtcaacacttaatattatg

SEQ ID NO: 83189 - DNA, 25 bp, Homo sapien
gtcttagtgaacacttaatattatg

SEQ ID NO: 83190 - DNA, 25 bp, Homo sapien
gtcttataattcagctctaacactg

SEQ ID NO: 83191 - DNA, 25 bp, Homo sapien
gtcttataattcggctctaacactg

SEQ ID NO: 83192 - DNA, 25 bp, Homo sapien
gtcttatctaaaggaaagtactgtg

SEQ ID NO: 83193 - DNA, 25 bp, Homo sapien
gtcttatctaaagggaagtactgtg

SEQ ID NO: 83194 - DNA, 25 bp, Homo sapien
gtcttcaagacacagtcatcatcaa

SEQ ID NO: 83195 - DNA, 25 bp, Homo sapien
gtcttcaagacacggtcatcatcaa

SEQ ID NO: 83196 - DNA, 25 bp, Homo sapien
gtcttcacagctaattgactagtga

SEQ ID NO: 83197 - DNA, 25 bp, Homo sapien
gtcttcacagctaatttactagtga

SEQ ID NO: 83198 - DNA, 25 bp, Homo sapien
gtcttcacatttttcacatttgatt

SEQ ID NO: 83199 - DNA, 25 bp, Homo sapien
gtcttcacatttttcagatttgatt

SEQ ID NO: 83200 - DNA, 25 bp, Homo sapien
gtcttcagaaacacagcgagtggcc

SEQ ID NO: 83201 - DNA, 25 bp, Homo sapien
gtcttcagaaacacagtgagtggcc

SEQ ID NO: 83202 - DNA, 25 bp, Homo sapien
gtcttcagattaacttgaaaaccac

SEQ ID NO: 83203 - DNA, 25 bp, Homo sapien
gtcttcagattaagttgaaaaccac

SEQ ID NO: 83204 - DNA, 25 bp, Homo sapien
gtcttcatcacctacagctccgtgg

SEQ ID NO: 83205 - DNA, 25 bp, Homo sapien
gtcttcatcacctatagctccgtgg

SEQ ID NO: 83206 - DNA, 25 bp, Homo sapien
gtcttcatccataaggcatgaggcc

SEQ ID NO: 83207 - DNA, 25 bp, Homo sapien
gtcttcatccataatgcatgaggcc

SEQ ID NO: 83208 - DNA, 25 bp, Homo sapien
gtcttcatgtcacctagtcagaagt

SEQ ID NO: 83209 - DNA, 25 bp, Homo sapien
gtcttcatgtcacctattcagaagt

SEQ ID NO: 83210 - DNA, 25 bp, Homo sapien
gtcttcatgtgatgaccgggaaatt

SEQ ID NO: 83211 - DNA, 25 bp, Homo sapien
gtcttcatgtgatgactgggaaatt

SEQ ID NO: 83212 - DNA, 25 bp, Homo sapien
gtcttccaaatcttgagtgacttct

SEQ ID NO: 83213 - DNA, 25 bp, Homo sapien
gtcttccaattgcagcaattcggtt

SEQ ID NO: 83214 - DNA, 25 bp, Homo sapien
gtcttccaattgctgcaattcggtt

SEQ ID NO: 83215 - DNA, 25 bp, Homo sapien
gtcttccacatcttgagtgacttct

SEQ ID NO: 83216 - DNA, 25 bp, Homo sapien
gtcttccacattccgttgatggttg

SEQ ID NO: 83217 - DNA, 25 bp, Homo sapien
gtcttccacattctgttgatggttg

SEQ ID NO: 83218 - DNA, 25 bp, Homo sapien
gtcttccagactgtgacgaactggg

SEQ ID NO: 83219 - DNA, 25 bp, Homo sapien
gtcttccagactgtgatgaactggg

SEQ ID NO: 83220 - DNA, 25 bp, Homo sapien
gtcttcctatacctaccactacttg

SEQ ID NO: 83221 - DNA, 25 bp, Homo sapien
gtcttcctatacttaccactacttg

SEQ ID NO: 83222 - DNA, 25 bp, Homo sapien
gtcttctctaatgctcatatagtgc

SEQ ID NO: 83223 - DNA, 25 bp, Homo sapien
gtcttctctaatgttcatatagtgc

SEQ ID NO: 83224 - DNA, 25 bp, Homo sapien
gtcttctctccagcagaaatgatca

SEQ ID NO: 83225 - DNA, 25 bp, Homo sapien
gtcttctctccggcagaaatgatca

SEQ ID NO: 83226 - DNA, 25 bp, Homo sapien
gtcttctctgtacttacatgaattt

SEQ ID NO: 83227 - DNA, 25 bp, Homo sapien
gtcttctctgtacttatatgaattt

SEQ ID NO: 83228 - DNA, 25 bp, Homo sapien
gtcttctctttcaatgtcagaagcc

SEQ ID NO: 83229 - DNA, 25 bp, Homo sapien
gtcttctctttctatgtcagaagcc

SEQ ID NO: 83230 - DNA, 25 bp, Homo sapien
gtcttcttaaaaaatccagcattgc

SEQ ID NO: 83231 - DNA, 25 bp, Homo sapien
gtcttcttgaaaaatccagcattgc

SEQ ID NO: 83232 - DNA, 25 bp, Homo sapien
gtcttcttgctttgggaaatattaa

SEQ ID NO: 83233 - DNA, 25 bp, Homo sapien
gtcttcttgttttgggaaatattaa

SEQ ID NO: 83234 - DNA, 25 bp, Homo sapien
gtcttgaagtcagttggaatgaagt

SEQ ID NO: 83235 - DNA, 25 bp, Homo sapien
gtcttgaatctcatgtaggaagaaa

SEQ ID NO: 83236 - DNA, 25 bp, Homo sapien
gtcttgaatctcgtgtaggaagaaa

SEQ ID NO: 83237 - DNA, 25 bp, Homo sapien
gtcttgaattcagttggaatgaagt

SEQ ID NO: 83238 - DNA, 25 bp, Homo sapien
gtcttgagagtacatggcatttcaa

SEQ ID NO: 83239 - DNA, 25 bp, Homo sapien
gtcttgagagtacgtggcatttcaa

SEQ ID NO: 83240 - DNA, 25 bp, Homo sapien
gtcttgatatttataaagcagaaaa

SEQ ID NO: 83241 - DNA, 25 bp, Homo sapien
gtcttgatatttataaggcagaaaa

SEQ ID NO: 83242 - DNA, 25 bp, Homo sapien
gtcttgcactctcaaaatgagtgta

SEQ ID NO: 83243 - DNA, 25 bp, Homo sapien
gtcttgcactctcgaaatgagtgta

SEQ ID NO: 83244 - DNA, 25 bp, Homo sapien
gtcttgcagatatgattatagagaa

SEQ ID NO: 83245 - DNA, 25 bp, Homo sapien
gtcttgcagatatggttatagagaa

SEQ ID NO: 83246 - DNA, 25 bp, Homo sapien
gtcttgcagtattgcttaaccctga

SEQ ID NO: 83247 - DNA, 25 bp, Homo sapien
gtcttgcagtattgtttaaccctga

SEQ ID NO: 83248 - DNA, 25 bp, Homo sapien
gtcttgctatcgagtcctcggaccc

SEQ ID NO: 83249 - DNA, 25 bp, Homo sapien
gtcttgctgccttcagtcttgctca

SEQ ID NO: 83250 - DNA, 25 bp, Homo sapien
gtcttgctggcttcagtcttgctca

SEQ ID NO: 83251 - DNA, 25 bp, Homo sapien
gtcttgctgtcgagtcctcggaccc

SEQ ID NO: 83252 - DNA, 25 bp, Homo sapien
gtcttggctgtgctatgaaacctgg

SEQ ID NO: 83253 - DNA, 25 bp, Homo sapien
gtcttggctgtgctctgaaacctgg

SEQ ID NO: 83254 - DNA, 25 bp, Homo sapien
gtcttgtacatcacattgccagatg

SEQ ID NO: 83255 - DNA, 25 bp, Homo sapien
gtcttgtacatctcattgccagatg

SEQ ID NO: 83256 - DNA, 25 bp, Homo sapien
gtcttgttctttctcccagtctgag

SEQ ID NO: 83257 - DNA, 25 bp, Homo sapien
gtcttgttctttttcccagtctgag

SEQ ID NO: 83258 - DNA, 25 bp, Homo sapien
gtctttaactcaagtatagtaatag

SEQ ID NO: 83259 - DNA, 25 bp, Homo sapien
gtctttaactcaggtatagtaatag

SEQ ID NO: 83260 - DNA, 25 bp, Homo sapien
gtctttaataatggctacttgatcc

SEQ ID NO: 83261 - DNA, 25 bp, Homo sapien
gtctttaataattgctacttgatcc

SEQ ID NO: 83262 - DNA, 25 bp, Homo sapien
gtctttaccaactcagtcaatgtca

SEQ ID NO: 83263 - DNA, 25 bp, Homo sapien
gtctttaccaattcagtcaatgtca

SEQ ID NO: 83264 - DNA, 25 bp, Homo sapien
gtctttaccagtgaagtgggtgtaa

SEQ ID NO: 83265 - DNA, 25 bp, Homo sapien
gtctttaccagtgaggtgggtgtaa

SEQ ID NO: 83266 - DNA, 25 bp, Homo sapien
gtctttagctttcaaagtagatctt

SEQ ID NO: 83267 - DNA, 25 bp, Homo sapien
gtctttagctttgaaagtagatctt

SEQ ID NO: 83268 - DNA, 25 bp, Homo sapien
gtctttatatcaccaaagcaccaat

SEQ ID NO: 83269 - DNA, 25 bp, Homo sapien
gtctttatatcgccaaagcaccaat

SEQ ID NO: 83270 - DNA, 25 bp, Homo sapien
gtctttatcgtttgttagagttata

SEQ ID NO: 83271 - DNA, 25 bp, Homo sapien
gtctttatcttttgttagagttata

SEQ ID NO: 83272 - DNA, 25 bp, Homo sapien
gtctttatgactctcacgtacacac

SEQ ID NO: 83273 - DNA, 25 bp, Homo sapien
gtctttatgactctcatgtacacac

SEQ ID NO: 83274 - DNA, 25 bp, Homo sapien
gtctttcacaattgcctagaaacca

SEQ ID NO: 83275 - DNA, 25 bp, Homo sapien
gtctttcataattgcctagaaacca

SEQ ID NO: 83276 - DNA, 25 bp, Homo sapien
gtctttccagaaggcttcccaaggg

SEQ ID NO: 83277 - DNA, 25 bp, Homo sapien
gtctttccagaagtcttcccaaggg

SEQ ID NO: 83278 - DNA, 25 bp, Homo sapien
gtctttccttgagtgactgacctct

SEQ ID NO: 83279 - DNA, 25 bp, Homo sapien
gtctttccttgagtgattgacctct

SEQ ID NO: 83280 - DNA, 25 bp, Homo sapien
gtctttccttggctaacttcttcga

SEQ ID NO: 83281 - DNA, 25 bp, Homo sapien
gtctttccttggttaacttcttcga

SEQ ID NO: 83282 - DNA, 25 bp, Homo sapien
gtctttcgcctggaattagcagaga

SEQ ID NO: 83283 - DNA, 25 bp, Homo sapien
gtctttcgcctgggattagcagaga

SEQ ID NO: 83284 - DNA, 25 bp, Homo sapien
gtctttctcattacagggttagcta

SEQ ID NO: 83285 - DNA, 25 bp, Homo sapien
gtctttctcattagagggttagcta

SEQ ID NO: 83286 - DNA, 25 bp, Homo sapien
gtctttctctttatgaatagcagct

SEQ ID NO: 83287 - DNA, 25 bp, Homo sapien
gtctttctctttatgagtagcagct

SEQ ID NO: 83288 - DNA, 25 bp, Homo sapien
gtctttcttactaccattcctctct

SEQ ID NO: 83289 - DNA, 25 bp, Homo sapien
gtctttcttactatcattcctctct

SEQ ID NO: 83290 - DNA, 25 bp, Homo sapien
gtctttgaaacaacagagataccag

SEQ ID NO: 83291 - DNA, 25 bp, Homo sapien
gtctttgaaacaatagagataccag

SEQ ID NO: 83292 - DNA, 25 bp, Homo sapien
gtctttgaccacagcctggcacagg

SEQ ID NO: 83293 - DNA, 25 bp, Homo sapien
gtctttgaccacaggctggcacagg

SEQ ID NO: 83294 - DNA, 25 bp, Homo sapien
gtctttgcacccaaaactccaaact

SEQ ID NO: 83295 - DNA, 25 bp, Homo sapien
gtctttgcacccacaactccaaact

SEQ ID NO: 83296 - DNA, 25 bp, Homo sapien
gtctttgtccttacagagtttgtgg

SEQ ID NO: 83297 - DNA, 25 bp, Homo sapien
gtctttgtccttacggagtttgtgg

SEQ ID NO: 83298 - DNA, 25 bp, Homo sapien
gtcttttagccatgaaagagaatat

SEQ ID NO: 83299 - DNA, 25 bp, Homo sapien
gtcttttagccatgtaagagaatat

SEQ ID NO: 83300 - DNA, 25 bp, Homo sapien
gtcttttagcccatcttaaaattgg

SEQ ID NO: 83301 - DNA, 25 bp, Homo sapien
gtcttttaggttgtttgactgaagc

SEQ ID NO: 83302 - DNA, 25 bp, Homo sapien
gtcttttagtccatcttaaaattgg

SEQ ID NO: 83303 - DNA, 25 bp, Homo sapien
gtcttttagtttgtttgactgaagc

SEQ ID NO: 83304 - DNA, 25 bp, Homo sapien
gtcttttcaatagctaatttttact

SEQ ID NO: 83305 - DNA, 25 bp, Homo sapien
gtcttttcaatagctattttttact

SEQ ID NO: 83306 - DNA, 25 bp, Homo sapien
gtcttttcactactacacagtgcat

SEQ ID NO: 83307 - DNA, 25 bp, Homo sapien
gtcttttcactactccacagtgcat

SEQ ID NO: 83308 - DNA, 25 bp, Homo sapien
gtcttttctctgcaccatccagcgc

SEQ ID NO: 83309 - DNA, 25 bp, Homo sapien
gtcttttctctgcgccatccagcgc

SEQ ID NO: 83310 - DNA, 25 bp, Homo sapien
gtctttttcacagaacagttgctta

SEQ ID NO: 83311 - DNA, 25 bp, Homo sapien
gtctttttcacagcacagttgctta

SEQ ID NO: 83312 - DNA, 25 bp, Homo sapien
gtctttttcggctgaatggcttcag

SEQ ID NO: 83313 - DNA, 25 bp, Homo sapien
gtcttttttggctgaatggcttcag

SEQ ID NO: 83314 - DNA, 25 bp, Homo sapien
gtgaaaaaaacagcttataggctgt

SEQ ID NO: 83315 - DNA, 25 bp, Homo sapien
gtgaaaaaacattaagttaccagct

SEQ ID NO: 83316 - DNA, 25 bp, Homo sapien
gtgaaaaaagaagaatttgggatct

SEQ ID NO: 83317 - DNA, 25 bp, Homo sapien
gtgaaaaaagaagtatttgggatct

SEQ ID NO: 83318 - DNA, 25 bp, Homo sapien
gtgaaaaaagcagcttataggctgt

SEQ ID NO: 83319 - DNA, 25 bp, Homo sapien
gtgaaaaaatattaagttaccagct

SEQ ID NO: 83320 - DNA, 25 bp, Homo sapien
gtgaaaaacaaacatcatgctcaaa

SEQ ID NO: 83321 - DNA, 25 bp, Homo sapien
gtgaaaaacaaacgtcatgctcaaa

SEQ ID NO: 83322 - DNA, 25 bp, Homo sapien
gtgaaaaacacaatggttgcatgag

SEQ ID NO: 83323 - DNA, 25 bp, Homo sapien
gtgaaaaacacagtggttgcatgag

SEQ ID NO: 83324 - DNA, 25 bp, Homo sapien
gtgaaaaataaatgatccctaagga

SEQ ID NO: 83325 - DNA, 25 bp, Homo sapien
gtgaaaaataaatgattcctaagga

SEQ ID NO: 83326 - DNA, 25 bp, Homo sapien
gtgaaaagactacagtggcttagcc

SEQ ID NO: 83327 - DNA, 25 bp, Homo sapien
gtgaaaagactagagtggcttagcc

SEQ ID NO: 83328 - DNA, 25 bp, Homo sapien
gtgaaaaggtgggaagacttgcaaa

SEQ ID NO: 83329 - DNA, 25 bp, Homo sapien
gtgaaaagttgggaagacttgcaaa

SEQ ID NO: 83330 - DNA, 25 bp, Homo sapien
gtgaaaagttgtgtaatcattgtgt

SEQ ID NO: 83331 - DNA, 25 bp, Homo sapien
gtgaaaagttgtgtcatcattgtgt

SEQ ID NO: 83332 - DNA, 25 bp, Homo sapien
gtgaaaataacttaggaccaaagct

SEQ ID NO: 83333 - DNA, 25 bp, Homo sapien
gtgaaaataacttagggccaaagct

SEQ ID NO: 83334 - DNA, 25 bp, Homo sapien
gtgaaaatgatatgtagaatcaaaa

SEQ ID NO: 83335 - DNA, 25 bp, Homo sapien
gtgaaaattatatgtagaatcaaaa

SEQ ID NO: 83336 - DNA, 25 bp, Homo sapien
gtgaaacagcgttcggtggccactg

SEQ ID NO: 83337 - DNA, 25 bp, Homo sapien
gtgaaacagcgtttggtggccactg

SEQ ID NO: 83338 - DNA, 25 bp, Homo sapien
gtgaaacatattaccatcatattga

SEQ ID NO: 83339 - DNA, 25 bp, Homo sapien
gtgaaacatattatcatcatattga

SEQ ID NO: 83340 - DNA, 25 bp, Homo sapien
gtgaaagacgggagttcaggcaggt

SEQ ID NO: 83341 - DNA, 25 bp, Homo sapien
gtgaaagatgggagttcaggcaggt

SEQ ID NO: 83342 - DNA, 25 bp, Homo sapien
gtgaaagccatgtgctcttcctggt

SEQ ID NO: 83343 - DNA, 25 bp, Homo sapien
gtgaaagccgtgtgctcttcctggt

SEQ ID NO: 83344 - DNA, 25 bp, Homo sapien
gtgaaaggtagcatcatcaaaacag

SEQ ID NO: 83345 - DNA, 25 bp, Homo sapien
gtgaaaggtagcgtcatcaaaacag

SEQ ID NO: 83346 - DNA, 25 bp, Homo sapien
gtgaaagtatagtcgtcctttaaat

SEQ ID NO: 83347 - DNA, 25 bp, Homo sapien
gtgaaagtatagttgtcctttaaat

SEQ ID NO: 83348 - DNA, 25 bp, Homo sapien
gtgaaagtctttcgattgtttccat

SEQ ID NO: 83349 - DNA, 25 bp, Homo sapien
gtgaaagtcttttgattgtttccat

SEQ ID NO: 83350 - DNA, 25 bp, Homo sapien
gtgaaatactcccagaatgttctgt

SEQ ID NO: 83351 - DNA, 25 bp, Homo sapien
gtgaaatactcccagactgttctgt

SEQ ID NO: 83352 - DNA, 25 bp, Homo sapien
gtgaaatataattgctaaatatggt

SEQ ID NO: 83353 - DNA, 25 bp, Homo sapien
gtgaaatataattgttaaatatggt

SEQ ID NO: 83354 - DNA, 25 bp, Homo sapien
gtgaaatatggcagtttgcatgatg

SEQ ID NO: 83355 - DNA, 25 bp, Homo sapien
gtgaaatatggcggtttgcatgatg

SEQ ID NO: 83356 - DNA, 25 bp, Homo sapien
gtgaaatcacctttaactgtgtcat

SEQ ID NO: 83357 - DNA, 25 bp, Homo sapien
gtgaaatcagctttaactgtgtcat

SEQ ID NO: 83358 - DNA, 25 bp, Homo sapien
gtgaaatccatagaaccagaatacc

SEQ ID NO: 83359 - DNA, 25 bp, Homo sapien
gtgaaatcctgagttgactaagagc

SEQ ID NO: 83360 - DNA, 25 bp, Homo sapien
gtgaaatcctgatttgactaagagc

SEQ ID NO: 83361 - DNA, 25 bp, Homo sapien
gtgaaatcgatagaaccagaatacc

SEQ ID NO: 83362 - DNA, 25 bp, Homo sapien
gtgaaatctcaacctaggagcaggt

SEQ ID NO: 83363 - DNA, 25 bp, Homo sapien
gtgaaatctcaacgtaggagcaggt

SEQ ID NO: 83364 - DNA, 25 bp, Homo sapien
gtgaaatctgaatccagattctgaa

SEQ ID NO: 83365 - DNA, 25 bp, Homo sapien
gtgaaatctgaatccatattctgaa

SEQ ID NO: 83366 - DNA, 25 bp, Homo sapien
gtgaaatgactatgggttctgtcat

SEQ ID NO: 83367 - DNA, 25 bp, Homo sapien
gtgaaatgactctgggttctgtcat

SEQ ID NO: 83368 - DNA, 25 bp, Homo sapien
gtgaaatgatgggtagagtctaaaa

SEQ ID NO: 83369 - DNA, 25 bp, Homo sapien
gtgaaatgatggttagagtctaaaa

SEQ ID NO: 83370 - DNA, 25 bp, Homo sapien
gtgaaatttgaccactaatgcaata

SEQ ID NO: 83371 - DNA, 25 bp, Homo sapien
gtgaaatttgatcactaatgcaata

SEQ ID NO: 83372 - DNA, 25 bp, Homo sapien
gtgaacaaataagagaagcaggatt

SEQ ID NO: 83373 - DNA, 25 bp, Homo sapien
gtgaacaaatacttttcatagtcat

SEQ ID NO: 83374 - DNA, 25 bp, Homo sapien
gtgaacaactacttttcatagtcat

SEQ ID NO: 83375 - DNA, 25 bp, Homo sapien
gtgaacaagcgagattttaatagct

SEQ ID NO: 83376 - DNA, 25 bp, Homo sapien
gtgaacaagtaagagaagcaggatt

SEQ ID NO: 83377 - DNA, 25 bp, Homo sapien
gtgaacaagtgagattttaatagct

SEQ ID NO: 83378 - DNA, 25 bp, Homo sapien
gtgaacagagaagtgaccacagaat

SEQ ID NO: 83379 - DNA, 25 bp, Homo sapien
gtgaacagataagtgaccacagaat

SEQ ID NO: 83380 - DNA, 25 bp, Homo sapien
gtgaacagatggataaggtctctgt

SEQ ID NO: 83381 - DNA, 25 bp, Homo sapien
gtgaacagcatcagcaacgagttgg

SEQ ID NO: 83382 - DNA, 25 bp, Homo sapien
gtgaacagcatcggcaacgagttgg

SEQ ID NO: 83383 - DNA, 25 bp, Homo sapien
gtgaacaggtggataaggtctctgt

SEQ ID NO: 83384 - DNA, 25 bp, Homo sapien
gtgaacagtatgaataaaaggagat

SEQ ID NO: 83385 - DNA, 25 bp, Homo sapien
gtgaacagtctgaataaaaggagat

SEQ ID NO: 83386 - DNA, 25 bp, Homo sapien
gtgaacatcatcaaacagatttttt

SEQ ID NO: 83387 - DNA, 25 bp, Homo sapien
gtgaacatcattaaacagatttttt

SEQ ID NO: 83388 - DNA, 25 bp, Homo sapien
gtgaaccaggccacgtcttaaaaat

SEQ ID NO: 83389 - DNA, 25 bp, Homo sapien
gtgaaccaggccaggtcttaaaaat

SEQ ID NO: 83390 - DNA, 25 bp, Homo sapien
gtgaacccgaacttcaaagtgtttt

SEQ ID NO: 83391 - DNA, 25 bp, Homo sapien
gtgaacccggacttcaaagtgtttt

SEQ ID NO: 83392 - DNA, 25 bp, Homo sapien
gtgaaccctcaaacacaaaacacaa

SEQ ID NO: 83393 - DNA, 25 bp, Homo sapien
gtgaaccctcaagcacaaaacacaa

SEQ ID NO: 83394 - DNA, 25 bp, Homo sapien
gtgaaccctggcattttcatgattt

SEQ ID NO: 83395 - DNA, 25 bp, Homo sapien
gtgaaccctggcgttttcatgattt

SEQ ID NO: 83396 - DNA, 25 bp, Homo sapien
gtgaacctcgcatattcttacttta

SEQ ID NO: 83397 - DNA, 25 bp, Homo sapien
gtgaaccttgcatattcttacttta

SEQ ID NO: 83398 - DNA, 25 bp, Homo sapien
gtgaacgagccaccttttccatgaa

SEQ ID NO: 83399 - DNA, 25 bp, Homo sapien
gtgaacgagccactttttccatgaa

SEQ ID NO: 83400 - DNA, 25 bp, Homo sapien
gtgaactagggcttgaaatagatct

SEQ ID NO: 83401 - DNA, 25 bp, Homo sapien
gtgaactagggcttgagatagatct

SEQ ID NO: 83402 - DNA, 25 bp, Homo sapien
gtgaactataggtgtgctagaatgt

SEQ ID NO: 83403 - DNA, 25 bp, Homo sapien
gtgaactataggtgtgttagaatgt

SEQ ID NO: 83404 - DNA, 25 bp, Homo sapien
gtgaactgaagaaaccttgggccat

SEQ ID NO: 83405 - DNA, 25 bp, Homo sapien
gtgaactgaagaacccttgggccat

SEQ ID NO: 83406 - DNA, 25 bp, Homo sapien
gtgaactggtggacctacaagtaag

SEQ ID NO: 83407 - DNA, 25 bp, Homo sapien
gtgaactggtggccctacaagtaag

SEQ ID NO: 83408 - DNA, 25 bp, Homo sapien
gtgaacttaggaaactgaatctatc

SEQ ID NO: 83409 - DNA, 25 bp, Homo sapien
gtgaacttaggaaacttaatctatc

SEQ ID NO: 83410 - DNA, 25 bp, Homo sapien
gtgaacttagttcggagctaccttg

SEQ ID NO: 83411 - DNA, 25 bp, Homo sapien
gtgaacttagtttggagctaccttg

SEQ ID NO: 83412 - DNA, 25 bp, Homo sapien
gtgaacttggcatcagaaacaagat

SEQ ID NO: 83413 - DNA, 25 bp, Homo sapien
gtgaactttgcatcagaaacaagat

SEQ ID NO: 83414 - DNA, 25 bp, Homo sapien
gtgaagaagctcagacaatctgtgc

SEQ ID NO: 83415 - DNA, 25 bp, Homo sapien
gtgaagaagctctgacaatctgtgc

SEQ ID NO: 83416 - DNA, 25 bp, Homo sapien
gtgaagaagctggaacctttgtgca

SEQ ID NO: 83417 - DNA, 25 bp, Homo sapien
gtgaagaagttggaacctttgtgca

SEQ ID NO: 83418 - DNA, 25 bp, Homo sapien
gtgaagacagtaacacagcaggatc

SEQ ID NO: 83419 - DNA, 25 bp, Homo sapien
gtgaagacagttacacagcaggatc

SEQ ID NO: 83420 - DNA, 25 bp, Homo sapien
gtgaagactacagtttacacacaca

SEQ ID NO: 83421 - DNA, 25 bp, Homo sapien
gtgaagactacggtttacacacaca

SEQ ID NO: 83422 - DNA, 25 bp, Homo sapien
gtgaagagtgacagcaaaaatcata

SEQ ID NO: 83423 - DNA, 25 bp, Homo sapien
gtgaagagtgacatcaaaaatcata

SEQ ID NO: 83424 - DNA, 25 bp, Homo sapien
gtgaagatacattacctacacagga

SEQ ID NO: 83425 - DNA, 25 bp, Homo sapien
gtgaagatagattacctacacagga

SEQ ID NO: 83426 - DNA, 25 bp, Homo sapien
gtgaagattcataaaaaaaaaaaag

SEQ ID NO: 83427 - DNA, 25 bp, Homo sapien
gtgaagattcataaaagaaaaaaag

SEQ ID NO: 83428 - DNA, 25 bp, Homo sapien
gtgaaggaatgagggaacaatgaat

SEQ ID NO: 83429 - DNA, 25 bp, Homo sapien
gtgaaggaatgcgggaacaatgaat

SEQ ID NO: 83430 - DNA, 25 bp, Homo sapien
gtgaaggccagactgaagaggtcac

SEQ ID NO: 83431 - DNA, 25 bp, Homo sapien
gtgaaggccagacttaagaggtcac

SEQ ID NO: 83432 - DNA, 25 bp, Homo sapien
gtgaagtatatcaagcagaaggaac

SEQ ID NO: 83433 - DNA, 25 bp, Homo sapien
gtgaagtatatcgagcagaaggaac

SEQ ID NO: 83434 - DNA, 25 bp, Homo sapien
gtgaagttcgaaggatcactcgtgc

SEQ ID NO: 83435 - DNA, 25 bp, Homo sapien
gtgaagttgattccagatgttcagc

SEQ ID NO: 83436 - DNA, 25 bp, Homo sapien
gtgaagttgatttcagatgttcagc

SEQ ID NO: 83437 - DNA, 25 bp, Homo sapien
gtgaagttgctgtcaggtaacttgc

SEQ ID NO: 83438 - DNA, 25 bp, Homo sapien
gtgaagttggtgtcaggtaacttgc

SEQ ID NO: 83439 - DNA, 25 bp, Homo sapien
gtgaagtttgaaggatcactcgtgc

SEQ ID NO: 83440 - DNA, 25 bp, Homo sapien
gtgaataaaaaagataatgcaggta

SEQ ID NO: 83441 - DNA, 25 bp, Homo sapien
gtgaataaaaaaggtaatgcaggta

SEQ ID NO: 83442 - DNA, 25 bp, Homo sapien
gtgaataggaagggctctctgtgat

SEQ ID NO: 83443 - DNA, 25 bp, Homo sapien
gtgaataggaaggtctctctgtgat

SEQ ID NO: 83444 - DNA, 25 bp, Homo sapien
gtgaatagggacactctccagagag

SEQ ID NO: 83445 - DNA, 25 bp, Homo sapien
gtgaatagggatactctccagagag

SEQ ID NO: 83446 - DNA, 25 bp, Homo sapien
gtgaatatgtgacctggagtctgca

SEQ ID NO: 83447 - DNA, 25 bp, Homo sapien
gtgaatatgtgacttggagtctgca

SEQ ID NO: 83448 - DNA, 25 bp, Homo sapien
gtgaatatttaaagagttcttgtag

SEQ ID NO: 83449 - DNA, 25 bp, Homo sapien
gtgaatatttaaagggttcttgtag

SEQ ID NO: 83450 - DNA, 25 bp, Homo sapien
gtgaatcttagtaaataaaggtcaa

SEQ ID NO: 83451 - DNA, 25 bp, Homo sapien
gtgaatcttagtaagtaaaggtcaa

SEQ ID NO: 83452 - DNA, 25 bp, Homo sapien
gtgaatcttatgactcttaacctct

SEQ ID NO: 83453 - DNA, 25 bp, Homo sapien
gtgaatcttatgagtcttaacctct

SEQ ID NO: 83454 - DNA, 25 bp, Homo sapien
gtgaatgaagaaacatttaagatta

SEQ ID NO: 83455 - DNA, 25 bp, Homo sapien
gtgaatgaagagacatttaagatta

SEQ ID NO: 83456 - DNA, 25 bp, Homo sapien
gtgaatgacgctaaagggtaatttc

SEQ ID NO: 83457 - DNA, 25 bp, Homo sapien
gtgaatgagaaagaatttttttgcc

SEQ ID NO: 83458 - DNA, 25 bp, Homo sapien
gtgaatgagaaataatttttttgcc

SEQ ID NO: 83459 - DNA, 25 bp, Homo sapien
gtgaatgagaacttccaaattaacc

SEQ ID NO: 83460 - DNA, 25 bp, Homo sapien
gtgaatgagaagggtaagagactta

SEQ ID NO: 83461 - DNA, 25 bp, Homo sapien
gtgaatgagaagggtaggagactta

SEQ ID NO: 83462 - DNA, 25 bp, Homo sapien
gtgaatgagaatttccaaattaacc

SEQ ID NO: 83463 - DNA, 25 bp, Homo sapien
gtgaatgatgctaaagggtaatttc

SEQ ID NO: 83464 - DNA, 25 bp, Homo sapien
gtgaatgctttatagttagttgaga

SEQ ID NO: 83465 - DNA, 25 bp, Homo sapien
gtgaatgctttctagttagttgaga

SEQ ID NO: 83466 - DNA, 25 bp, Homo sapien
gtgaatggagtccacggatgttgct

SEQ ID NO: 83467 - DNA, 25 bp, Homo sapien
gtgaatggagtccgcggatgttgct

SEQ ID NO: 83468 - DNA, 25 bp, Homo sapien
gtgaatgtggtagcttctggaaact

SEQ ID NO: 83469 - DNA, 25 bp, Homo sapien
gtgaatgtgtccaaggacttgggtt

SEQ ID NO: 83470 - DNA, 25 bp, Homo sapien
gtgaatgtgtccaaggtcttgggtt

SEQ ID NO: 83471 - DNA, 25 bp, Homo sapien
gtgaatgtgttagcttctggaaact

SEQ ID NO: 83472 - DNA, 25 bp, Homo sapien
gtgaatgtttccctcgagcccttgg

SEQ ID NO: 83473 - DNA, 25 bp, Homo sapien
gtgaatgtttccctcgggcccttgg

SEQ ID NO: 83474 - DNA, 25 bp, Homo sapien
gtgaattaaacagagaagactagaa

SEQ ID NO: 83475 - DNA, 25 bp, Homo sapien
gtgaattaaacggagaagactagaa

SEQ ID NO: 83476 - DNA, 25 bp, Homo sapien
gtgaattagaagttttagagcatgt

SEQ ID NO: 83477 - DNA, 25 bp, Homo sapien
gtgaattagcagttttagagcatgt

SEQ ID NO: 83478 - DNA, 25 bp, Homo sapien
gtgaattatctaatggcgaataaag

SEQ ID NO: 83479 - DNA, 25 bp, Homo sapien
gtgaattatctaatggtgaataaag

SEQ ID NO: 83480 - DNA, 25 bp, Homo sapien
gtgaattattacaggaaaaaaatag

SEQ ID NO: 83481 - DNA, 25 bp, Homo sapien
gtgaattattacgggaaaaaaatag

SEQ ID NO: 83482 - DNA, 25 bp, Homo sapien
gtgaattcatccaccaagtagtggc

SEQ ID NO: 83483 - DNA, 25 bp, Homo sapien
gtgaattcatccaccaggtagtggc

SEQ ID NO: 83484 - DNA, 25 bp, Homo sapien
gtgaattccacagtggccatgctgc

SEQ ID NO: 83485 - DNA, 25 bp, Homo sapien
gtgaattccacggtggccatgctgc

SEQ ID NO: 83486 - DNA, 25 bp, Homo sapien
gtgaattctacaaacccttgttgtg

SEQ ID NO: 83487 - DNA, 25 bp, Homo sapien
gtgaattctacagacccttgttgtg

SEQ ID NO: 83488 - DNA, 25 bp, Homo sapien
gtgaattgcagtatttaacaagaat

SEQ ID NO: 83489 - DNA, 25 bp, Homo sapien
gtgaattgcggtatttaacaagaat

SEQ ID NO: 83490 - DNA, 25 bp, Homo sapien
gtgaatttgacagaggacttggaca

SEQ ID NO: 83491 - DNA, 25 bp, Homo sapien
gtgaatttgacagaggtcttggaca

SEQ ID NO: 83492 - DNA, 25 bp, Homo sapien
gtgacaaaagaaattcatagtgact

SEQ ID NO: 83493 - DNA, 25 bp, Homo sapien
gtgacaaaagaatttcatagtgact

SEQ ID NO: 83494 - DNA, 25 bp, Homo sapien
gtgacaaagcgaaagaaaagggtag

SEQ ID NO: 83495 - DNA, 25 bp, Homo sapien
gtgacaaagtgaaagaaaagggtag

SEQ ID NO: 83496 - DNA, 25 bp, Homo sapien
gtgacaagaaggaacaagatggttt

SEQ ID NO: 83497 - DNA, 25 bp, Homo sapien
gtgacaagagggaacaagatggttt

SEQ ID NO: 83498 - DNA, 25 bp, Homo sapien
gtgacaatatgaagatttttaaggc

SEQ ID NO: 83499 - DNA, 25 bp, Homo sapien
gtgacaatatgaggatttttaaggc

SEQ ID NO: 83500 - DNA, 25 bp, Homo sapien
gtgacaatctaacgccactggtaag

SEQ ID NO: 83501 - DNA, 25 bp, Homo sapien
gtgacaatctaatgccactggtaag

SEQ ID NO: 83502 - DNA, 25 bp, Homo sapien
gtgacaatttatcatatccatcata

SEQ ID NO: 83503 - DNA, 25 bp, Homo sapien
gtgacaatttattatatccatcata

SEQ ID NO: 83504 - DNA, 25 bp, Homo sapien
gtgacacatcctgaataaggctata

SEQ ID NO: 83505 - DNA, 25 bp, Homo sapien
gtgacacatcctgagtaaggctata

SEQ ID NO: 83506 - DNA, 25 bp, Homo sapien
gtgacaccatgcttctgagaagaca

SEQ ID NO: 83507 - DNA, 25 bp, Homo sapien
gtgacaccatgcttttgagaagaca

SEQ ID NO: 83508 - DNA, 25 bp, Homo sapien
gtgacactcggtaaagcacagtaag

SEQ ID NO: 83509 - DNA, 25 bp, Homo sapien
gtgacactcggtgaagcacagtaag

SEQ ID NO: 83510 - DNA, 25 bp, Homo sapien
gtgacactcgtgcctggcatgctcc

SEQ ID NO: 83511 - DNA, 25 bp, Homo sapien
gtgacactgatcaccaaatcttgac

SEQ ID NO: 83512 - DNA, 25 bp, Homo sapien
gtgacactgattaccaaatcttgac

SEQ ID NO: 83513 - DNA, 25 bp, Homo sapien
gtgacacttgtgcctggcatgctcc

SEQ ID NO: 83514 - DNA, 25 bp, Homo sapien
gtgacagaaaaacgccaggacccaa

SEQ ID NO: 83515 - DNA, 25 bp, Homo sapien
gtgacagaaaaatgccaggacccaa

SEQ ID NO: 83516 - DNA, 25 bp, Homo sapien
gtgacagaagggatgtatatgtaat

SEQ ID NO: 83517 - DNA, 25 bp, Homo sapien
gtgacagaagggttgtatatgtaat

SEQ ID NO: 83518 - DNA, 25 bp, Homo sapien
gtgacagcctattcagaattaggat

SEQ ID NO: 83519 - DNA, 25 bp, Homo sapien
gtgacagcctattcaggattaggat

SEQ ID NO: 83520 - DNA, 25 bp, Homo sapien
gtgacaggtaaaagaacagagctcc

SEQ ID NO: 83521 - DNA, 25 bp, Homo sapien
gtgacaggtaaaagaagagagctcc

SEQ ID NO: 83522 - DNA, 25 bp, Homo sapien
gtgacagttggcacagtggaaacaa

SEQ ID NO: 83523 - DNA, 25 bp, Homo sapien
gtgacagttggctcagtggaaacaa

SEQ ID NO: 83524 - DNA, 25 bp, Homo sapien
gtgacataaaacggaaatataagtc

SEQ ID NO: 83525 - DNA, 25 bp, Homo sapien
gtgacataaaatggaaatataagtc

SEQ ID NO: 83526 - DNA, 25 bp, Homo sapien
gtgacatattcacagattcttggga

SEQ ID NO: 83527 - DNA, 25 bp, Homo sapien
gtgacatattcgcagattcttggga

SEQ ID NO: 83528 - DNA, 25 bp, Homo sapien
gtgacatgcatatattgcatagtgg

SEQ ID NO: 83529 - DNA, 25 bp, Homo sapien
gtgacatgtatatattgcatagtgg

SEQ ID NO: 83530 - DNA, 25 bp, Homo sapien
gtgacattttacggactgctaagca

SEQ ID NO: 83531 - DNA, 25 bp, Homo sapien
gtgacattttatggactgctaagca

SEQ ID NO: 83532 - DNA, 25 bp, Homo sapien
gtgaccaacgctagacaaacatagc

SEQ ID NO: 83533 - DNA, 25 bp, Homo sapien
gtgaccaacgctggacaaacatagc

SEQ ID NO: 83534 - DNA, 25 bp, Homo sapien
gtgaccattcgacacaggtgtggat

SEQ ID NO: 83535 - DNA, 25 bp, Homo sapien
gtgaccattcgacataggtgtggat

SEQ ID NO: 83536 - DNA, 25 bp, Homo sapien
gtgacctatagcatgtccttgagga

SEQ ID NO: 83537 - DNA, 25 bp, Homo sapien
gtgacctatggcatgtccttgagga

SEQ ID NO: 83538 - DNA, 25 bp, Homo sapien
gtgacctcaaaatcaacccacaagt

SEQ ID NO: 83539 - DNA, 25 bp, Homo sapien
gtgacctcagaatcaacccacaagt

SEQ ID NO: 83540 - DNA, 25 bp, Homo sapien
gtgacctctgtaataacttgcctgg

SEQ ID NO: 83541 - DNA, 25 bp, Homo sapien
gtgacctctgtaataagttgcctgg

SEQ ID NO: 83542 - DNA, 25 bp, Homo sapien
gtgaccttgcctcgtcagtgttctg

SEQ ID NO: 83543 - DNA, 25 bp, Homo sapien
gtgaccttgccttgtcagtgttctg

SEQ ID NO: 83544 - DNA, 25 bp, Homo sapien
gtgacgtgtttctcctggtaacaaa

SEQ ID NO: 83545 - DNA, 25 bp, Homo sapien
gtgacgtgtttttcctggtaacaaa

SEQ ID NO: 83546 - DNA, 25 bp, Homo sapien
gtgactaagatgatacccaagttgc

SEQ ID NO: 83547 - DNA, 25 bp, Homo sapien
gtgactaagatggtacccaagttgc

SEQ ID NO: 83548 - DNA, 25 bp, Homo sapien
gtgactccaagctagttccctcatc

SEQ ID NO: 83549 - DNA, 25 bp, Homo sapien
gtgactccgagctagttccctcatc

SEQ ID NO: 83550 - DNA, 25 bp, Homo sapien
gtgactctaccatgaccctagaata

SEQ ID NO: 83551 - DNA, 25 bp, Homo sapien
gtgactctaccgtgaccctagaata

SEQ ID NO: 83552 - DNA, 25 bp, Homo sapien
gtgactcttctaaactaaattaaca

SEQ ID NO: 83553 - DNA, 25 bp, Homo sapien
gtgactcttctatactaaattaaca

SEQ ID NO: 83554 - DNA, 25 bp, Homo sapien
gtgactgaacggtactgtgaaacac

SEQ ID NO: 83555 - DNA, 25 bp, Homo sapien
gtgactgaatggtactgtgaaacac

SEQ ID NO: 83556 - DNA, 25 bp, Homo sapien
gtgactgacttcgtttgcagcagag

SEQ ID NO: 83557 - DNA, 25 bp, Homo sapien
gtgactgactttgtttgcagcagag

SEQ ID NO: 83558 - DNA, 25 bp, Homo sapien
gtgactgagtctcgctccaaggcta

SEQ ID NO: 83559 - DNA, 25 bp, Homo sapien
gtgactgagtcttgctccaaggcta

SEQ ID NO: 83560 - DNA, 25 bp, Homo sapien
gtgactgataactacccactctcag

SEQ ID NO: 83561 - DNA, 25 bp, Homo sapien
gtgactgataattacccactctcag

SEQ ID NO: 83562 - DNA, 25 bp, Homo sapien
gtgactgtccttcccgaaagcagcc

SEQ ID NO: 83563 - DNA, 25 bp, Homo sapien
gtgactgtccttcctgaaagcagcc

SEQ ID NO: 83564 - DNA, 25 bp, Homo sapien
gtgactgttccataagttatgtatt

SEQ ID NO: 83565 - DNA, 25 bp, Homo sapien
gtgactgttccgtaagttatgtatt

SEQ ID NO: 83566 - DNA, 25 bp, Homo sapien
gtgacttagaaaccagtttagagaa

SEQ ID NO: 83567 - DNA, 25 bp, Homo sapien
gtgacttagaaaccggtttagagaa

SEQ ID NO: 83568 - DNA, 25 bp, Homo sapien
gtgacttatcttaaacagcatctac

SEQ ID NO: 83569 - DNA, 25 bp, Homo sapien
gtgacttatcttagacagcatctac

SEQ ID NO: 83570 - DNA, 25 bp, Homo sapien
gtgacttcagccaaatcacttgtat

SEQ ID NO: 83571 - DNA, 25 bp, Homo sapien
gtgacttcctaacaataaaccacat

SEQ ID NO: 83572 - DNA, 25 bp, Homo sapien
gtgacttcctaacactaaaccacat

SEQ ID NO: 83573 - DNA, 25 bp, Homo sapien
gtgacttcggccaaatcacttgtat

SEQ ID NO: 83574 - DNA, 25 bp, Homo sapien
gtgacttctgtattcccttgcagat

SEQ ID NO: 83575 - DNA, 25 bp, Homo sapien
gtgacttctgtattcctttgcagat

SEQ ID NO: 83576 - DNA, 25 bp, Homo sapien
gtgacttgtctgcttagcaagaatc

SEQ ID NO: 83577 - DNA, 25 bp, Homo sapien
gtgacttgtttgcttagcaagaatc

SEQ ID NO: 83578 - DNA, 25 bp, Homo sapien
gtgactttcgctgattcaagttaga

SEQ ID NO: 83579 - DNA, 25 bp, Homo sapien
gtgactttgggcaagtttactccga

SEQ ID NO: 83580 - DNA, 25 bp, Homo sapien
gtgactttgggcaggtttactccga

SEQ ID NO: 83581 - DNA, 25 bp, Homo sapien
gtgacttttcggagaagattaggga

SEQ ID NO: 83582 - DNA, 25 bp, Homo sapien
gtgacttttgcaatgtgttgattct

SEQ ID NO: 83583 - DNA, 25 bp, Homo sapien
gtgacttttgccatgtgttgattct

SEQ ID NO: 83584 - DNA, 25 bp, Homo sapien
gtgacttttgctgattcaagttaga

SEQ ID NO: 83585 - DNA, 25 bp, Homo sapien
gtgacttttggcaggtcacatgtgc

SEQ ID NO: 83586 - DNA, 25 bp, Homo sapien
gtgacttttggccggtcacatgtgc

SEQ ID NO: 83587 - DNA, 25 bp, Homo sapien
gtgactttttggagaagattaggga

SEQ ID NO: 83588 - DNA, 25 bp, Homo sapien
gtgagaaagtcaggcttcagctcag

SEQ ID NO: 83589 - DNA, 25 bp, Homo sapien
gtgagaaagtcatgcttcagctcag

SEQ ID NO: 83590 - DNA, 25 bp, Homo sapien
gtgagaaatctacgctgccgcttac

SEQ ID NO: 83591 - DNA, 25 bp, Homo sapien
gtgagaaatctactctgccgcttac

SEQ ID NO: 83592 - DNA, 25 bp, Homo sapien
gtgagaaatgatattcaccgccgac

SEQ ID NO: 83593 - DNA, 25 bp, Homo sapien
gtgagaaatgatattcgccgccgac

SEQ ID NO: 83594 - DNA, 25 bp, Homo sapien
gtgagaactccaagtagaagcaggc

SEQ ID NO: 83595 - DNA, 25 bp, Homo sapien
gtgagaactccaggtagaagcaggc

SEQ ID NO: 83596 - DNA, 25 bp, Homo sapien
gtgagaagaagcctgaagggtgagc

SEQ ID NO: 83597 - DNA, 25 bp, Homo sapien
gtgagaagaaggctgaagggtgagc

SEQ ID NO: 83598 - DNA, 25 bp, Homo sapien
gtgagaagcatgagaaaagctagga

SEQ ID NO: 83599 - DNA, 25 bp, Homo sapien
gtgagaagcatgggaaaagctagga

SEQ ID NO: 83600 - DNA, 25 bp, Homo sapien
gtgagaagtaagaaaatgacagagt

SEQ ID NO: 83601 - DNA, 25 bp, Homo sapien
gtgagaagtaagaagatgacagagt

SEQ ID NO: 83602 - DNA, 25 bp, Homo sapien
gtgagaatctttaatcacatccaaa

SEQ ID NO: 83603 - DNA, 25 bp, Homo sapien
gtgagaatttttaatcacatccaaa

SEQ ID NO: 83604 - DNA, 25 bp, Homo sapien
gtgagactggttactcctccgtgca

SEQ ID NO: 83605 - DNA, 25 bp, Homo sapien
gtgagactggttattcctccgtgca

SEQ ID NO: 83606 - DNA, 25 bp, Homo sapien
gtgagagcccggagaagtatctcct

SEQ ID NO: 83607 - DNA, 25 bp, Homo sapien
gtgagagcctggagaagtatctcct

SEQ ID NO: 83608 - DNA, 25 bp, Homo sapien
gtgagaggaaacctggcatgagctg

SEQ ID NO: 83609 - DNA, 25 bp, Homo sapien
gtgagaggaaagctggcatgagctg

SEQ ID NO: 83610 - DNA, 25 bp, Homo sapien
gtgagaggtaaaaacgagccactct

SEQ ID NO: 83611 - DNA, 25 bp, Homo sapien
gtgagaggtaaaaatgagccactct

SEQ ID NO: 83612 - DNA, 25 bp, Homo sapien
gtgagataagccacgagtgcagtgc

SEQ ID NO: 83613 - DNA, 25 bp, Homo sapien
gtgagataagccatgagtgcagtgc

SEQ ID NO: 83614 - DNA, 25 bp, Homo sapien
gtgagatattgatgtattagtagac

SEQ ID NO: 83615 - DNA, 25 bp, Homo sapien
gtgagatattggtgtattagtagac

SEQ ID NO: 83616 - DNA, 25 bp, Homo sapien
gtgagatccacaagataattctgtg

SEQ ID NO: 83617 - DNA, 25 bp, Homo sapien
gtgagatccacaagatgattctgtg

SEQ ID NO: 83618 - DNA, 25 bp, Homo sapien
gtgagatgacgtaaatagtttatta

SEQ ID NO: 83619 - DNA, 25 bp, Homo sapien
gtgagatgatgtaaatagtttatta

SEQ ID NO: 83620 - DNA, 25 bp, Homo sapien
gtgagatgctatcgatgttgctagt

SEQ ID NO: 83621 - DNA, 25 bp, Homo sapien
gtgagatgctattgatgttgctagt

SEQ ID NO: 83622 - DNA, 25 bp, Homo sapien
gtgagatggatatacctaacagttg

SEQ ID NO: 83623 - DNA, 25 bp, Homo sapien
gtgagatggatatgcctaacagttg

SEQ ID NO: 83624 - DNA, 25 bp, Homo sapien
gtgagattctcaggctcatcaggaa

SEQ ID NO: 83625 - DNA, 25 bp, Homo sapien
gtgagattctcatgctcatcaggaa

SEQ ID NO: 83626 - DNA, 25 bp, Homo sapien
gtgagcaaaggatcgagtggaagga

SEQ ID NO: 83627 - DNA, 25 bp, Homo sapien
gtgagcaaaggatggagtggaagga

SEQ ID NO: 83628 - DNA, 25 bp, Homo sapien
gtgagcaatttctggcaggcatcca

SEQ ID NO: 83629 - DNA, 25 bp, Homo sapien
gtgagcaatttcttgcaggcatcca

SEQ ID NO: 83630 - DNA, 25 bp, Homo sapien
gtgagcaggcaccagctgtgaccac

SEQ ID NO: 83631 - DNA, 25 bp, Homo sapien
gtgagcaggcaccggctgtgaccac

SEQ ID NO: 83632 - DNA, 25 bp, Homo sapien
gtgagcatggtcatggatcctaagg

SEQ ID NO: 83633 - DNA, 25 bp, Homo sapien
gtgagcatggttatggatcctaagg

SEQ ID NO: 83634 - DNA, 25 bp, Homo sapien
gtgagcatggttctatgaaggattt

SEQ ID NO: 83635 - DNA, 25 bp, Homo sapien
gtgagcatggttttatgaaggattt

SEQ ID NO: 83636 - DNA, 25 bp, Homo sapien
gtgagccagaagatttttaatggga

SEQ ID NO: 83637 - DNA, 25 bp, Homo sapien
gtgagccagaaggtttttaatggga

SEQ ID NO: 83638 - DNA, 25 bp, Homo sapien
gtgagccatcttttcgcccctgcta

SEQ ID NO: 83639 - DNA, 25 bp, Homo sapien
gtgagccatctttttgcccctgcta

SEQ ID NO: 83640 - DNA, 25 bp, Homo sapien
gtgagccctaaatgacatcatgtgt

SEQ ID NO: 83641 - DNA, 25 bp, Homo sapien
gtgagccctaaatgtcatcatgtgt

SEQ ID NO: 83642 - DNA, 25 bp, Homo sapien
gtgagcctgctcaaacatccagtac

SEQ ID NO: 83643 - DNA, 25 bp, Homo sapien
gtgagcctgttcaaacatccagtac

SEQ ID NO: 83644 - DNA, 25 bp, Homo sapien
gtgagcgggacactgagttcttccc

SEQ ID NO: 83645 - DNA, 25 bp, Homo sapien
gtgagcgggacagtgagttcttccc

SEQ ID NO: 83646 - DNA, 25 bp, Homo sapien
gtgagctacgactctggaaaatctc

SEQ ID NO: 83647 - DNA, 25 bp, Homo sapien
gtgagctatgactctggaaaatctc

SEQ ID NO: 83648 - DNA, 25 bp, Homo sapien
gtgagctatgtatcttctgctaatt

SEQ ID NO: 83649 - DNA, 25 bp, Homo sapien
gtgagctatgtattttctgctaatt

SEQ ID NO: 83650 - DNA, 25 bp, Homo sapien
gtgagctattgttggactcattaag

SEQ ID NO: 83651 - DNA, 25 bp, Homo sapien
gtgagctattgttgtactcattaag

SEQ ID NO: 83652 - DNA, 25 bp, Homo sapien
gtgagcttcttcaacttgggccccc

SEQ ID NO: 83653 - DNA, 25 bp, Homo sapien
gtgagcttcttcatcttgggccccc

SEQ ID NO: 83654 - DNA, 25 bp, Homo sapien
gtgaggaacggtagttgattaaatg

SEQ ID NO: 83655 - DNA, 25 bp, Homo sapien
gtgaggaagcactaacacttgttcc

SEQ ID NO: 83656 - DNA, 25 bp, Homo sapien
gtgaggaagcagtaacacttgttcc

SEQ ID NO: 83657 - DNA, 25 bp, Homo sapien
gtgaggaatggtagttgattaaatg

SEQ ID NO: 83658 - DNA, 25 bp, Homo sapien
gtgaggatacacttacaacgaactg

SEQ ID NO: 83659 - DNA, 25 bp, Homo sapien
gtgaggatacactttcaacgaactg

SEQ ID NO: 83660 - DNA, 25 bp, Homo sapien
gtgaggatcattaactgtccagaaa

SEQ ID NO: 83661 - DNA, 25 bp, Homo sapien
gtgaggatcattcactgtccagaaa

SEQ ID NO: 83662 - DNA, 25 bp, Homo sapien
gtgaggatgcaaaaatagaaaatgt

SEQ ID NO: 83663 - DNA, 25 bp, Homo sapien
gtgaggatggaaaaatagaaaatgt

SEQ ID NO: 83664 - DNA, 25 bp, Homo sapien
gtgaggattggaatagaatatgggc

SEQ ID NO: 83665 - DNA, 25 bp, Homo sapien
gtgaggattggcatagaatatgggc

SEQ ID NO: 83666 - DNA, 25 bp, Homo sapien
gtgaggctaaaataaacagtcttca

SEQ ID NO: 83667 - DNA, 25 bp, Homo sapien
gtgaggctaaaataaatagtcttca

SEQ ID NO: 83668 - DNA, 25 bp, Homo sapien
gtgaggctccgccccatcaggtaca

SEQ ID NO: 83669 - DNA, 25 bp, Homo sapien
gtgaggctccgccctatcaggtaca

SEQ ID NO: 83670 - DNA, 25 bp, Homo sapien
gtgaggctgaacaactaacttgcca

SEQ ID NO: 83671 - DNA, 25 bp, Homo sapien
gtgaggctgaataactaacttgcca

SEQ ID NO: 83672 - DNA, 25 bp, Homo sapien
gtgaggcttagagaactaaagtaac

SEQ ID NO: 83673 - DNA, 25 bp, Homo sapien
gtgaggcttagagagctaaagtaac

SEQ ID NO: 83674 - DNA, 25 bp, Homo sapien
gtgagggacctaggctgtgctcctt

SEQ ID NO: 83675 - DNA, 25 bp, Homo sapien
gtgagggacctagtctgtgctcctt

SEQ ID NO: 83676 - DNA, 25 bp, Homo sapien
gtgagggatcgtacggtatgaaacc

SEQ ID NO: 83677 - DNA, 25 bp, Homo sapien
gtgagggatcgtatggtatgaaacc

SEQ ID NO: 83678 - DNA, 25 bp, Homo sapien
gtgagggcaagaacagaaaccatag

SEQ ID NO: 83679 - DNA, 25 bp, Homo sapien
gtgagggccgatctgaaccatggca

SEQ ID NO: 83680 - DNA, 25 bp, Homo sapien
gtgagggccgatgtgaaccatggca

SEQ ID NO: 83681 - DNA, 25 bp, Homo sapien
gtgagggcgagaacagaaaccatag

SEQ ID NO: 83682 - DNA, 25 bp, Homo sapien
gtgagggtacaaaattatgatgcta

SEQ ID NO: 83683 - DNA, 25 bp, Homo sapien
gtgagggtataaaattatgatgcta

SEQ ID NO: 83684 - DNA, 25 bp, Homo sapien
gtgaggtagctgacatcatggtgtc

SEQ ID NO: 83685 - DNA, 25 bp, Homo sapien
gtgaggtagctgccatcatggtgtc

SEQ ID NO: 83686 - DNA, 25 bp, Homo sapien
gtgaggtaggcctctttgtgtaata

SEQ ID NO: 83687 - DNA, 25 bp, Homo sapien
gtgaggtaggcctttttgtgtaata

SEQ ID NO: 83688 - DNA, 25 bp, Homo sapien
gtgaggtgtggagagaatttttatg

SEQ ID NO: 83689 - DNA, 25 bp, Homo sapien
gtgaggtgtggagagactttttatg

SEQ ID NO: 83690 - DNA, 25 bp, Homo sapien
gtgaggttgaagtccccacacagag

SEQ ID NO: 83691 - DNA, 25 bp, Homo sapien
gtgaggtttaagtccccacacagag

SEQ ID NO: 83692 - DNA, 25 bp, Homo sapien
gtgagtaaactctatctagctcatt

SEQ ID NO: 83693 - DNA, 25 bp, Homo sapien
gtgagtaaagtacattcttagggca

SEQ ID NO: 83694 - DNA, 25 bp, Homo sapien
gtgagtaaagtacgttcttagggca

SEQ ID NO: 83695 - DNA, 25 bp, Homo sapien
gtgagtaaattctatctagctcatt

SEQ ID NO: 83696 - DNA, 25 bp, Homo sapien
gtgagtacaaaatagtctctgaaac

SEQ ID NO: 83697 - DNA, 25 bp, Homo sapien
gtgagtacaaactagtctctgaaac

SEQ ID NO: 83698 - DNA, 25 bp, Homo sapien
gtgagtagaacgtcacttgatcctt

SEQ ID NO: 83699 - DNA, 25 bp, Homo sapien
gtgagtagaacgttacttgatcctt

SEQ ID NO: 83700 - DNA, 25 bp, Homo sapien
gtgagtagaggtacaacatagcaaa

SEQ ID NO: 83701 - DNA, 25 bp, Homo sapien
gtgagtagaggtataacatagcaaa

SEQ ID NO: 83702 - DNA, 25 bp, Homo sapien
gtgagtagttacagcagtgaaacag

SEQ ID NO: 83703 - DNA, 25 bp, Homo sapien
gtgagtagttatagcagtgaaacag

SEQ ID NO: 83704 - DNA, 25 bp, Homo sapien
gtgagtcaagttatcggttgacatc

SEQ ID NO: 83705 - DNA, 25 bp, Homo sapien
gtgagtcaagttattggttgacatc

SEQ ID NO: 83706 - DNA, 25 bp, Homo sapien
gtgagtcatccaatgccctataact

SEQ ID NO: 83707 - DNA, 25 bp, Homo sapien
gtgagtcatgcaatgccctataact

SEQ ID NO: 83708 - DNA, 25 bp, Homo sapien
gtgagtcatgtacagtataaaggat

SEQ ID NO: 83709 - DNA, 25 bp, Homo sapien
gtgagtcatgtatagtataaaggat

SEQ ID NO: 83710 - DNA, 25 bp, Homo sapien
gtgagtccttggccgccggacaggg

SEQ ID NO: 83711 - DNA, 25 bp, Homo sapien
gtgagtccttggctgccggacaggg

SEQ ID NO: 83712 - DNA, 25 bp, Homo sapien
gtgagtcgtgatggagccgctgcac

SEQ ID NO: 83713 - DNA, 25 bp, Homo sapien
gtgagtcgtgattgagccgctgcac

SEQ ID NO: 83714 - DNA, 25 bp, Homo sapien
gtgagtctgagaaagtcagttcctt

SEQ ID NO: 83715 - DNA, 25 bp, Homo sapien
gtgagtctgggaaagtcagttcctt

SEQ ID NO: 83716 - DNA, 25 bp, Homo sapien
gtgagtgacactgtccagcacacct

SEQ ID NO: 83717 - DNA, 25 bp, Homo sapien
gtgagtgagctataataggccttaa

SEQ ID NO: 83718 - DNA, 25 bp, Homo sapien
gtgagtgagctatactaggccttaa

SEQ ID NO: 83719 - DNA, 25 bp, Homo sapien
gtgagtgatactgtccagcacacct

SEQ ID NO: 83720 - DNA, 25 bp, Homo sapien
gtgagtgttgctccagctctctgtt

SEQ ID NO: 83721 - DNA, 25 bp, Homo sapien
gtgagtgtttctccagctctctgtt

SEQ ID NO: 83722 - DNA, 25 bp, Homo sapien
gtgagttagaagaaactttatcaca

SEQ ID NO: 83723 - DNA, 25 bp, Homo sapien
gtgagttagaagaacctttatcaca

SEQ ID NO: 83724 - DNA, 25 bp, Homo sapien
gtgagttctgaattggaagagcatc

SEQ ID NO: 83725 - DNA, 25 bp, Homo sapien
gtgagttctgaatttgaagagcatc

SEQ ID NO: 83726 - DNA, 25 bp, Homo sapien
gtgagtttccatttaatagttttca

SEQ ID NO: 83727 - DNA, 25 bp, Homo sapien
gtgagttttcatttaatagttttca

SEQ ID NO: 83728 - DNA, 25 bp, Homo sapien
gtgataaaacccaacaaatcatcga

SEQ ID NO: 83729 - DNA, 25 bp, Homo sapien
gtgataaaacccagcaaatcatcga

SEQ ID NO: 83730 - DNA, 25 bp, Homo sapien
gtgataaccaaataaaatttgagga

SEQ ID NO: 83731 - DNA, 25 bp, Homo sapien
gtgataaccaaatacaatttgagga

SEQ ID NO: 83732 - DNA, 25 bp, Homo sapien
gtgatacatagaatacaatgaaaat

SEQ ID NO: 83733 - DNA, 25 bp, Homo sapien
gtgatacatagactacaatgaaaat

SEQ ID NO: 83734 - DNA, 25 bp, Homo sapien
gtgataccacacgggactcattatt

SEQ ID NO: 83735 - DNA, 25 bp, Homo sapien
gtgataccgcacgggactcattatt

SEQ ID NO: 83736 - DNA, 25 bp, Homo sapien
gtgatactgagataaggataaacat

SEQ ID NO: 83737 - DNA, 25 bp, Homo sapien
gtgatactgagatagggataaacat

SEQ ID NO: 83738 - DNA, 25 bp, Homo sapien
gtgatagagtagtgaagaatttaag

SEQ ID NO: 83739 - DNA, 25 bp, Homo sapien
gtgatagattagtgaagaatttaag

SEQ ID NO: 83740 - DNA, 25 bp, Homo sapien
gtgataggaagaccgcactttgcaa

SEQ ID NO: 83741 - DNA, 25 bp, Homo sapien
gtgataggaagactgcactttgcaa

SEQ ID NO: 83742 - DNA, 25 bp, Homo sapien
gtgatataacacaatttgttcaaca

SEQ ID NO: 83743 - DNA, 25 bp, Homo sapien
gtgatatacagtagtagaaaacagc

SEQ ID NO: 83744 - DNA, 25 bp, Homo sapien
gtgatataccacaatttgttcaaca

SEQ ID NO: 83745 - DNA, 25 bp, Homo sapien
gtgatatagagtagtagaaaacagc

SEQ ID NO: 83746 - DNA, 25 bp, Homo sapien
gtgatatcttacgaggttttgctag

SEQ ID NO: 83747 - DNA, 25 bp, Homo sapien
gtgatatcttatgaggttttgctag

SEQ ID NO: 83748 - DNA, 25 bp, Homo sapien
gtgatcaaacataaaatgcactata

SEQ ID NO: 83749 - DNA, 25 bp, Homo sapien
gtgatcaaacatcaaatgcactata

SEQ ID NO: 83750 - DNA, 25 bp, Homo sapien
gtgatcaaataatcctcacgtatag

SEQ ID NO: 83751 - DNA, 25 bp, Homo sapien
gtgatcaaatagtcctcacgtatag

SEQ ID NO: 83752 - DNA, 25 bp, Homo sapien
gtgatcaagcatcatagtcctcggt

SEQ ID NO: 83753 - DNA, 25 bp, Homo sapien
gtgatcaagtatcatagtcctcggt

SEQ ID NO: 83754 - DNA, 25 bp, Homo sapien
gtgatccaagctgtagtccacagat

SEQ ID NO: 83755 - DNA, 25 bp, Homo sapien
gtgatccaagctgtcgtccacagat

SEQ ID NO: 83756 - DNA, 25 bp, Homo sapien
gtgatccctgcagtattgtttctac

SEQ ID NO: 83757 - DNA, 25 bp, Homo sapien
gtgatccctgcggtattgtttctac

SEQ ID NO: 83758 - DNA, 25 bp, Homo sapien
gtgatccgcctgcctggactatcac

SEQ ID NO: 83759 - DNA, 25 bp, Homo sapien
gtgatccgcgtgcctggactatcac

SEQ ID NO: 83760 - DNA, 25 bp, Homo sapien
gtgatcctgcggaagagctcccaat

SEQ ID NO: 83761 - DNA, 25 bp, Homo sapien
gtgatcctgcggatgagctcccaat

SEQ ID NO: 83762 - DNA, 25 bp, Homo sapien
gtgatctaacatttgaaagtgattt

SEQ ID NO: 83763 - DNA, 25 bp, Homo sapien
gtgatctaacatttgatagtgattt

SEQ ID NO: 83764 - DNA, 25 bp, Homo sapien
gtgatctactagacagtgcttaagc

SEQ ID NO: 83765 - DNA, 25 bp, Homo sapien
gtgatctactagacggtgcttaagc

SEQ ID NO: 83766 - DNA, 25 bp, Homo sapien
gtgatctctaccactattttggagt

SEQ ID NO: 83767 - DNA, 25 bp, Homo sapien
gtgatctctactactattttggagt

SEQ ID NO: 83768 - DNA, 25 bp, Homo sapien
gtgatgaactcctgaggcagaagta

SEQ ID NO: 83769 - DNA, 25 bp, Homo sapien
gtgatgaactcctgcggcagaagta

SEQ ID NO: 83770 - DNA, 25 bp, Homo sapien
gtgatgaccgggaaatttaagagca

SEQ ID NO: 83771 - DNA, 25 bp, Homo sapien
gtgatgactgggaaatttaagagca

SEQ ID NO: 83772 - DNA, 25 bp, Homo sapien
gtgatgaggacctagatttgacccc

SEQ ID NO: 83773 - DNA, 25 bp, Homo sapien
gtgatgaggacttagatttgacccc

SEQ ID NO: 83774 - DNA, 25 bp, Homo sapien
gtgatgatgttccactaaggatggg

SEQ ID NO: 83775 - DNA, 25 bp, Homo sapien
gtgatgatgttccagtaaggatggg

SEQ ID NO: 83776 - DNA, 25 bp, Homo sapien
gtgatgatttccatgtctacaatgc

SEQ ID NO: 83777 - DNA, 25 bp, Homo sapien
gtgatgatttccgtgtctacaatgc

SEQ ID NO: 83778 - DNA, 25 bp, Homo sapien
gtgatgcaaaagagcataagagctg

SEQ ID NO: 83779 - DNA, 25 bp, Homo sapien
gtgatgcaaaatagcataagagctg

SEQ ID NO: 83780 - DNA, 25 bp, Homo sapien
gtgatgcaatcattgaccttgaaaa

SEQ ID NO: 83781 - DNA, 25 bp, Homo sapien
gtgatgcaatcgttgaccttgaaaa

SEQ ID NO: 83782 - DNA, 25 bp, Homo sapien
gtgatgcagttcagtggaatgttag

SEQ ID NO: 83783 - DNA, 25 bp, Homo sapien
gtgatgcagttcagtgtaatgttag

SEQ ID NO: 83784 - DNA, 25 bp, Homo sapien
gtgatgccaccattgacttcagttg

SEQ ID NO: 83785 - DNA, 25 bp, Homo sapien
gtgatgccaccgttgacttcagttg

SEQ ID NO: 83786 - DNA, 25 bp, Homo sapien
gtgatgctcacacctataagcccag

SEQ ID NO: 83787 - DNA, 25 bp, Homo sapien
gtgatgctcacacttataagcccag

SEQ ID NO: 83788 - DNA, 25 bp, Homo sapien
gtgatgctcttcaaattcagaactc

SEQ ID NO: 83789 - DNA, 25 bp, Homo sapien
gtgatgctcttccaattcagaactc

SEQ ID NO: 83790 - DNA, 25 bp, Homo sapien
gtgatgctgaggatcgaaaacagaa

SEQ ID NO: 83791 - DNA, 25 bp, Homo sapien
gtgatgctgaggattgaaaacagaa

SEQ ID NO: 83792 - DNA, 25 bp, Homo sapien
gtgatggcaaaattctccttcagtg

SEQ ID NO: 83793 - DNA, 25 bp, Homo sapien
gtgatggccaaattctccttcagtg

SEQ ID NO: 83794 - DNA, 25 bp, Homo sapien
gtgatggggttgccagacacctagt

SEQ ID NO: 83795 - DNA, 25 bp, Homo sapien
gtgatggggttgcctgacacctagt

SEQ ID NO: 83796 - DNA, 25 bp, Homo sapien
gtgatgggtaaacctaacaagaatc

SEQ ID NO: 83797 - DNA, 25 bp, Homo sapien
gtgatgggtaaacttaacaagaatc

SEQ ID NO: 83798 - DNA, 25 bp, Homo sapien
gtgatgggttacgttaattgttttg

SEQ ID NO: 83799 - DNA, 25 bp, Homo sapien
gtgatgggttatgttaattgttttg

SEQ ID NO: 83800 - DNA, 25 bp, Homo sapien
gtgatggtgacgtgtcattgtgggt

SEQ ID NO: 83801 - DNA, 25 bp, Homo sapien
gtgatggtgacgtgtccttgtgggt

SEQ ID NO: 83802 - DNA, 25 bp, Homo sapien
gtgatgtaaaattaacaatgatata

SEQ ID NO: 83803 - DNA, 25 bp, Homo sapien
gtgatgtaaaattgacaatgatata

SEQ ID NO: 83804 - DNA, 25 bp, Homo sapien
gtgatgttatgaactgcctttctaa

SEQ ID NO: 83805 - DNA, 25 bp, Homo sapien
gtgatgttatgaattgcctttctaa

SEQ ID NO: 83806 - DNA, 25 bp, Homo sapien
gtgatgttccaatgaaaacagacat

SEQ ID NO: 83807 - DNA, 25 bp, Homo sapien
gtgatgttccagtgaaaacagacat

SEQ ID NO: 83808 - DNA, 25 bp, Homo sapien
gtgatgtttaagaataattttcaat

SEQ ID NO: 83809 - DNA, 25 bp, Homo sapien
gtgatgtttaagagtaattttcaat

SEQ ID NO: 83810 - DNA, 25 bp, Homo sapien
gtgattaagaaacacttctgccacc

SEQ ID NO: 83811 - DNA, 25 bp, Homo sapien
gtgattaagaaacatttctgccacc

SEQ ID NO: 83812 - DNA, 25 bp, Homo sapien
gtgattacaattcaacacgagattt

SEQ ID NO: 83813 - DNA, 25 bp, Homo sapien
gtgattacaattcgacacgagattt

SEQ ID NO: 83814 - DNA, 25 bp, Homo sapien
gtgattagctgtaattagctgaaat

SEQ ID NO: 83815 - DNA, 25 bp, Homo sapien
gtgattagttgtaattagctgaaat

SEQ ID NO: 83816 - DNA, 25 bp, Homo sapien
gtgattatagggaacaattaagaag

SEQ ID NO: 83817 - DNA, 25 bp, Homo sapien
gtgattatagggagcaattaagaag

SEQ ID NO: 83818 - DNA, 25 bp, Homo sapien
gtgattatgtcatgaaatctttgtt

SEQ ID NO: 83819 - DNA, 25 bp, Homo sapien
gtgattatgtcatgcaatctttgtt

SEQ ID NO: 83820 - DNA, 25 bp, Homo sapien
gtgattattggtagtaagccagaca

SEQ ID NO: 83821 - DNA, 25 bp, Homo sapien
gtgattattggttgtaagccagaca

SEQ ID NO: 83822 - DNA, 25 bp, Homo sapien
gtgattatttaagcctcagttccta

SEQ ID NO: 83823 - DNA, 25 bp, Homo sapien
gtgattatttaagccttagttccta

SEQ ID NO: 83824 - DNA, 25 bp, Homo sapien
gtgattcaaatataatctcctgaaa

SEQ ID NO: 83825 - DNA, 25 bp, Homo sapien
gtgattcagatataatctcctgaaa

SEQ ID NO: 83826 - DNA, 25 bp, Homo sapien
gtgattcccagcaataaaaaggcct

SEQ ID NO: 83827 - DNA, 25 bp, Homo sapien
gtgattccgagcaataaaaaggcct

SEQ ID NO: 83828 - DNA, 25 bp, Homo sapien
gtgattctaaatgacaggagcagca

SEQ ID NO: 83829 - DNA, 25 bp, Homo sapien
gtgattctaaattacaggagcagca

SEQ ID NO: 83830 - DNA, 25 bp, Homo sapien
gtgattctccttcacttttgctgta

SEQ ID NO: 83831 - DNA, 25 bp, Homo sapien
gtgattctctttcacttttgctgta

SEQ ID NO: 83832 - DNA, 25 bp, Homo sapien
gtgattctggatacattttgaaaat

SEQ ID NO: 83833 - DNA, 25 bp, Homo sapien
gtgattctggatacgttttgaaaat

SEQ ID NO: 83834 - DNA, 25 bp, Homo sapien
gtgattgaaggagaatgagaacgag

SEQ ID NO: 83835 - DNA, 25 bp, Homo sapien
gtgattgaaggagcatgagaacgag

SEQ ID NO: 83836 - DNA, 25 bp, Homo sapien
gtgattgacaaataaacttaatcat

SEQ ID NO: 83837 - DNA, 25 bp, Homo sapien
gtgattgacaagtaaacttaatcat

SEQ ID NO: 83838 - DNA, 25 bp, Homo sapien
gtgattgacacttccttacaactga

SEQ ID NO: 83839 - DNA, 25 bp, Homo sapien
gtgattgacgcttccttacaactga

SEQ ID NO: 83840 - DNA, 25 bp, Homo sapien
gtgattgactggtcatgtctgacgt

SEQ ID NO: 83841 - DNA, 25 bp, Homo sapien
gtgattgagagaaggctggatacac

SEQ ID NO: 83842 - DNA, 25 bp, Homo sapien
gtgattgagagaatgctggatacac

SEQ ID NO: 83843 - DNA, 25 bp, Homo sapien
gtgattgattggtcatgtctgacgt

SEQ ID NO: 83844 - DNA, 25 bp, Homo sapien
gtgattggagtcacaatgcatagct

SEQ ID NO: 83845 - DNA, 25 bp, Homo sapien
gtgattggagtcaccatgcatagct

SEQ ID NO: 83846 - DNA, 25 bp, Homo sapien
gtgattggcatcctgaattttgtac

SEQ ID NO: 83847 - DNA, 25 bp, Homo sapien
gtgattggtatcctgaattttgtac

SEQ ID NO: 83848 - DNA, 25 bp, Homo sapien
gtgattgtccaggcgaacttgtggg

SEQ ID NO: 83849 - DNA, 25 bp, Homo sapien
gtgattgtccaggtgaacttgtggg

SEQ ID NO: 83850 - DNA, 25 bp, Homo sapien
gtgattgttacagcgggtggtgtgt

SEQ ID NO: 83851 - DNA, 25 bp, Homo sapien
gtgattgttactgcgggtggtgtgt

SEQ ID NO: 83852 - DNA, 25 bp, Homo sapien
gtgattgttttatacgactttgagt

SEQ ID NO: 83853 - DNA, 25 bp, Homo sapien
gtgattgttttatatgactttgagt

SEQ ID NO: 83854 - DNA, 25 bp, Homo sapien
gtgattgtttttgaactgggtggtg

SEQ ID NO: 83855 - DNA, 25 bp, Homo sapien
gtgattgtttttgacctgggtggtg

SEQ ID NO: 83856 - DNA, 25 bp, Homo sapien
gtgatttccttttgagttcttggca

SEQ ID NO: 83857 - DNA, 25 bp, Homo sapien
gtgatttccttttgtgttcttggca

SEQ ID NO: 83858 - DNA, 25 bp, Homo sapien
gtgatttgagttccgtgtatgttgt

SEQ ID NO: 83859 - DNA, 25 bp, Homo sapien
gtgatttgagttccttgtatgttgt

SEQ ID NO: 83860 - DNA, 25 bp, Homo sapien
gtgatttggcaacagaaatatgcaa

SEQ ID NO: 83861 - DNA, 25 bp, Homo sapien
gtgatttggcaatagaaatatgcaa

SEQ ID NO: 83862 - DNA, 25 bp, Homo sapien
gtgatttgttccatatagcagagca

SEQ ID NO: 83863 - DNA, 25 bp, Homo sapien
gtgatttgttccgtatagcagagca

SEQ ID NO: 83864 - DNA, 25 bp, Homo sapien
gtgattttaatcgtatgtccatgaa

SEQ ID NO: 83865 - DNA, 25 bp, Homo sapien
gtgattttaatggtatgtccatgaa

SEQ ID NO: 83866 - DNA, 25 bp, Homo sapien
gtgatttttgcctcctacttagcta

SEQ ID NO: 83867 - DNA, 25 bp, Homo sapien
gtgatttttgcttcctacttagcta

SEQ ID NO: 83868 - DNA, 25 bp, Homo sapien
gtgcaaacaaaggaacagagacagt

SEQ ID NO: 83869 - DNA, 25 bp, Homo sapien
gtgcaaacaaaggaaccgagacagt

SEQ ID NO: 83870 - DNA, 25 bp, Homo sapien
gtgcaaaggacgatatttgggagtg

SEQ ID NO: 83871 - DNA, 25 bp, Homo sapien
gtgcaaaggacgatgtttgggagtg

SEQ ID NO: 83872 - DNA, 25 bp, Homo sapien
gtgcaacactgggttttgctttaaa

SEQ ID NO: 83873 - DNA, 25 bp, Homo sapien
gtgcaacatcggtgcagtttggcaa

SEQ ID NO: 83874 - DNA, 25 bp, Homo sapien
gtgcaacattgggttttgctttaaa

SEQ ID NO: 83875 - DNA, 25 bp, Homo sapien
gtgcaacattggtgcagtttggcaa

SEQ ID NO: 83876 - DNA, 25 bp, Homo sapien
gtgcaaccatggaatacttgagtgg

SEQ ID NO: 83877 - DNA, 25 bp, Homo sapien
gtgcaaccatggagtacttgagtgg

SEQ ID NO: 83878 - DNA, 25 bp, Homo sapien
gtgcaactatatctgcagaggaaaa

SEQ ID NO: 83879 - DNA, 25 bp, Homo sapien
gtgcaactcagtactttaacaagac

SEQ ID NO: 83880 - DNA, 25 bp, Homo sapien
gtgcaactcagtgctttaacaagac

SEQ ID NO: 83881 - DNA, 25 bp, Homo sapien
gtgcaactcgtgacttcatcatggc

SEQ ID NO: 83882 - DNA, 25 bp, Homo sapien
gtgcaactcttgacttcatcatggc

SEQ ID NO: 83883 - DNA, 25 bp, Homo sapien
gtgcaactgtatctgcagaggaaaa

SEQ ID NO: 83884 - DNA, 25 bp, Homo sapien
gtgcaagctcaataagaacagggac

SEQ ID NO: 83885 - DNA, 25 bp, Homo sapien
gtgcaagctcaatgagaacagggac

SEQ ID NO: 83886 - DNA, 25 bp, Homo sapien
gtgcaaggatcaaaggctcacattg

SEQ ID NO: 83887 - DNA, 25 bp, Homo sapien
gtgcaaggatcgtctttatttactt

SEQ ID NO: 83888 - DNA, 25 bp, Homo sapien
gtgcaaggatcttctttatttactt

SEQ ID NO: 83889 - DNA, 25 bp, Homo sapien
gtgcaagggtcaaaggctcacattg

SEQ ID NO: 83890 - DNA, 25 bp, Homo sapien
gtgcaatgcatgctctttaaataga

SEQ ID NO: 83891 - DNA, 25 bp, Homo sapien
gtgcaatgcatgctttttaaataga

SEQ ID NO: 83892 - DNA, 25 bp, Homo sapien
gtgcacaacgggacatagaccctca

SEQ ID NO: 83893 - DNA, 25 bp, Homo sapien
gtgcacaataaataattgaattatc

SEQ ID NO: 83894 - DNA, 25 bp, Homo sapien
gtgcacaataagtaattgaattatc

SEQ ID NO: 83895 - DNA, 25 bp, Homo sapien
gtgcacaatgggacatagaccctca

SEQ ID NO: 83896 - DNA, 25 bp, Homo sapien
gtgcacagtatgttcaaaggccctg

SEQ ID NO: 83897 - DNA, 25 bp, Homo sapien
gtgcacagtgtgttcaaaggccctg

SEQ ID NO: 83898 - DNA, 25 bp, Homo sapien
gtgcacataatgggtcctgagtatt

SEQ ID NO: 83899 - DNA, 25 bp, Homo sapien
gtgcacatagtgggtcctgagtatt

SEQ ID NO: 83900 - DNA, 25 bp, Homo sapien
gtgcacatttgcccgcaccttccat

SEQ ID NO: 83901 - DNA, 25 bp, Homo sapien
gtgcacatttgcctgcaccttccat

SEQ ID NO: 83902 - DNA, 25 bp, Homo sapien
gtgcaccaaagtatcatcctagttt

SEQ ID NO: 83903 - DNA, 25 bp, Homo sapien
gtgcaccaaagtgtcatcctagttt

SEQ ID NO: 83904 - DNA, 25 bp, Homo sapien
gtgcactaactgaacacttgcagca

SEQ ID NO: 83905 - DNA, 25 bp, Homo sapien
gtgcactaactgagcacttgcagca

SEQ ID NO: 83906 - DNA, 25 bp, Homo sapien
gtgcagagagaatggtgtcatggct

SEQ ID NO: 83907 - DNA, 25 bp, Homo sapien
gtgcagagagaatggtttcatggct

SEQ ID NO: 83908 - DNA, 25 bp, Homo sapien
gtgcagaggcctcccaagacagtct

SEQ ID NO: 83909 - DNA, 25 bp, Homo sapien
gtgcagaggcctcccaggacagtct

SEQ ID NO: 83910 - DNA, 25 bp, Homo sapien
gtgcagatactgggttttccgtcca

SEQ ID NO: 83911 - DNA, 25 bp, Homo sapien
gtgcagatactgtgttttccgtcca

SEQ ID NO: 83912 - DNA, 25 bp, Homo sapien
gtgcagcagtaaaatgatcaaacaa

SEQ ID NO: 83913 - DNA, 25 bp, Homo sapien
gtgcagcagtaaaatgttcaaacaa

SEQ ID NO: 83914 - DNA, 25 bp, Homo sapien
gtgcaggaggccagctgccagtgcc

SEQ ID NO: 83915 - DNA, 25 bp, Homo sapien
gtgcaggaggccggctgccagtgcc

SEQ ID NO: 83916 - DNA, 25 bp, Homo sapien
gtgcagtccacaaacacctttttgt

SEQ ID NO: 83917 - DNA, 25 bp, Homo sapien
gtgcagtccacaatcacctttttgt

SEQ ID NO: 83918 - DNA, 25 bp, Homo sapien
gtgcagtcctctctcattgtccttg

SEQ ID NO: 83919 - DNA, 25 bp, Homo sapien
gtgcagtcctctgtcattgtccttg

SEQ ID NO: 83920 - DNA, 25 bp, Homo sapien
gtgcagtgccacatttcacaggtca

SEQ ID NO: 83921 - DNA, 25 bp, Homo sapien
gtgcagtgccacgtttcacaggtca

SEQ ID NO: 83922 - DNA, 25 bp, Homo sapien
gtgcagtgtttctgaggcccctttg

SEQ ID NO: 83923 - DNA, 25 bp, Homo sapien
gtgcagtgtttctggggcccctttg

SEQ ID NO: 83924 - DNA, 25 bp, Homo sapien
gtgcataatgtgatagacaagaaac

SEQ ID NO: 83925 - DNA, 25 bp, Homo sapien
gtgcataatgtgatagccaagaaac

SEQ ID NO: 83926 - DNA, 25 bp, Homo sapien
gtgcatacatgaattttgtttatcg

SEQ ID NO: 83927 - DNA, 25 bp, Homo sapien
gtgcatacatgagttttgtttatcg

SEQ ID NO: 83928 - DNA, 25 bp, Homo sapien
gtgcatagtgtatcggtattgtgtt

SEQ ID NO: 83929 - DNA, 25 bp, Homo sapien
gtgcatagtgtattggtattgtgtt

SEQ ID NO: 83930 - DNA, 25 bp, Homo sapien
gtgcatcagaacagctggatccaag

SEQ ID NO: 83931 - DNA, 25 bp, Homo sapien
gtgcatcagaacaggtggatccaag

SEQ ID NO: 83932 - DNA, 25 bp, Homo sapien
gtgcatcagtagtaagaactgtgag

SEQ ID NO: 83933 - DNA, 25 bp, Homo sapien
gtgcatcattagtaagaactgtgag

SEQ ID NO: 83934 - DNA, 25 bp, Homo sapien
gtgcatcttacttcatgagaaatgc

SEQ ID NO: 83935 - DNA, 25 bp, Homo sapien
gtgcatcttactttatgagaaatgc

SEQ ID NO: 83936 - DNA, 25 bp, Homo sapien
gtgcattccattaaattcctcagag

SEQ ID NO: 83937 - DNA, 25 bp, Homo sapien
gtgcattccatttaattcctcagag

SEQ ID NO: 83938 - DNA, 25 bp, Homo sapien
gtgcattctatgtatggcccaagac

SEQ ID NO: 83939 - DNA, 25 bp, Homo sapien
gtgcattctgtgtatggcccaagac

SEQ ID NO: 83940 - DNA, 25 bp, Homo sapien
gtgcatttatctgctgagtgaaact

SEQ ID NO: 83941 - DNA, 25 bp, Homo sapien
gtgcatttcctttatgaccagtgat

SEQ ID NO: 83942 - DNA, 25 bp, Homo sapien
gtgcatttcttttatgaccagtgat

SEQ ID NO: 83943 - DNA, 25 bp, Homo sapien
gtgcatttgcttagatgtttgatag

SEQ ID NO: 83944 - DNA, 25 bp, Homo sapien
gtgcatttgtctgctgagtgaaact

SEQ ID NO: 83945 - DNA, 25 bp, Homo sapien
gtgcatttgtttagatgtttgatag

SEQ ID NO: 83946 - DNA, 25 bp, Homo sapien
gtgcattttccttacgttgctaata

SEQ ID NO: 83947 - DNA, 25 bp, Homo sapien
gtgcattttccttatgttgctaata

SEQ ID NO: 83948 - DNA, 25 bp, Homo sapien
gtgccaaagtatgaagatagaaagc

SEQ ID NO: 83949 - DNA, 25 bp, Homo sapien
gtgccaaagtatgaaggtagaaagc

SEQ ID NO: 83950 - DNA, 25 bp, Homo sapien
gtgccaataggcagccgatatggga

SEQ ID NO: 83951 - DNA, 25 bp, Homo sapien
gtgccaatgggcagccgatatggga

SEQ ID NO: 83952 - DNA, 25 bp, Homo sapien
gtgccacattggatttaaaattgtt

SEQ ID NO: 83953 - DNA, 25 bp, Homo sapien
gtgccacattggttttaaaattgtt

SEQ ID NO: 83954 - DNA, 25 bp, Homo sapien
gtgccagcaaaagagaaggcaatgt

SEQ ID NO: 83955 - DNA, 25 bp, Homo sapien
gtgccagccaccatgccaaacactt

SEQ ID NO: 83956 - DNA, 25 bp, Homo sapien
gtgccagccaccgtgccaaacactt

SEQ ID NO: 83957 - DNA, 25 bp, Homo sapien
gtgccagcgaaagagaaggcaatgt

SEQ ID NO: 83958 - DNA, 25 bp, Homo sapien
gtgccagctctgtgacagtgcttga

SEQ ID NO: 83959 - DNA, 25 bp, Homo sapien
gtgccagctttgtgacagtgcttga

SEQ ID NO: 83960 - DNA, 25 bp, Homo sapien
gtgccatatccaatcgtgttctatc

SEQ ID NO: 83961 - DNA, 25 bp, Homo sapien
gtgccatatccagtcgtgttctatc

SEQ ID NO: 83962 - DNA, 25 bp, Homo sapien
gtgccatgaaaaattctgagaagcc

SEQ ID NO: 83963 - DNA, 25 bp, Homo sapien
gtgccatgaaaagttctgagaagcc

SEQ ID NO: 83964 - DNA, 25 bp, Homo sapien
gtgccattcaccgaatataaagcag

SEQ ID NO: 83965 - DNA, 25 bp, Homo sapien
gtgccattcactgaatataaagcag

SEQ ID NO: 83966 - DNA, 25 bp, Homo sapien
gtgccattgactatgttggttaata

SEQ ID NO: 83967 - DNA, 25 bp, Homo sapien
gtgccattgtctatgttggttaata

SEQ ID NO: 83968 - DNA, 25 bp, Homo sapien
gtgcccaaaatgcagtcagtaggag

SEQ ID NO: 83969 - DNA, 25 bp, Homo sapien
gtgcccaaaatggagtcagtaggag

SEQ ID NO: 83970 - DNA, 25 bp, Homo sapien
gtgcccagagtttaccttggctttg

SEQ ID NO: 83971 - DNA, 25 bp, Homo sapien
gtgcccagagtttatcttggctttg

SEQ ID NO: 83972 - DNA, 25 bp, Homo sapien
gtgcccagatccgagccagagaaaa

SEQ ID NO: 83973 - DNA, 25 bp, Homo sapien
gtgcccaggtccgagccagagaaaa

SEQ ID NO: 83974 - DNA, 25 bp, Homo sapien
gtgcccatagacggccataatccca

SEQ ID NO: 83975 - DNA, 25 bp, Homo sapien
gtgcccatcaaactaccaattacat

SEQ ID NO: 83976 - DNA, 25 bp, Homo sapien
gtgcccatcgaactaccaattacat

SEQ ID NO: 83977 - DNA, 25 bp, Homo sapien
gtgcccatggacggccataatccca

SEQ ID NO: 83978 - DNA, 25 bp, Homo sapien
gtgccccactgaatcttgtgtacct

SEQ ID NO: 83979 - DNA, 25 bp, Homo sapien
gtgccccactgaattttgtgtacct

SEQ ID NO: 83980 - DNA, 25 bp, Homo sapien
gtgcccgtattgttatcgaaaagac

SEQ ID NO: 83981 - DNA, 25 bp, Homo sapien
gtgcccgtattgttatggaaaagac

SEQ ID NO: 83982 - DNA, 25 bp, Homo sapien
gtgccctaactcaggcagatagcaa

SEQ ID NO: 83983 - DNA, 25 bp, Homo sapien
gtgccctacgcaaatgaaaaggata

SEQ ID NO: 83984 - DNA, 25 bp, Homo sapien
gtgccctagctcaggcagatagcaa

SEQ ID NO: 83985 - DNA, 25 bp, Homo sapien
gtgccctatgcaaatgaaaaggata

SEQ ID NO: 83986 - DNA, 25 bp, Homo sapien
gtgccctctatacaagcaactatgc

SEQ ID NO: 83987 - DNA, 25 bp, Homo sapien
gtgccctctatacatgcaactatgc

SEQ ID NO: 83988 - DNA, 25 bp, Homo sapien
gtgccctgtgagctggtctgggcat

SEQ ID NO: 83989 - DNA, 25 bp, Homo sapien
gtgccctgtgatctggtctgggcat

SEQ ID NO: 83990 - DNA, 25 bp, Homo sapien
gtgcccttctcacctgaatctgaca

SEQ ID NO: 83991 - DNA, 25 bp, Homo sapien
gtgcccttctcatctgaatctgaca

SEQ ID NO: 83992 - DNA, 25 bp, Homo sapien
gtgcccttctgcgttttgctttgtg

SEQ ID NO: 83993 - DNA, 25 bp, Homo sapien
gtgcccttctgtgttttgctttgtg

SEQ ID NO: 83994 - DNA, 25 bp, Homo sapien
gtgccggcccataatattaaataac

SEQ ID NO: 83995 - DNA, 25 bp, Homo sapien
gtgccggcccatcatattaaataac

SEQ ID NO: 83996 - DNA, 25 bp, Homo sapien
gtgccgtgcctatttgtctatacca

SEQ ID NO: 83997 - DNA, 25 bp, Homo sapien
gtgccgtgcctgtttgtctatacca

SEQ ID NO: 83998 - DNA, 25 bp, Homo sapien
gtgcctaaccgggtgccttcagtgt

SEQ ID NO: 83999 - DNA, 25 bp, Homo sapien
gtgcctaactgggtgccttcagtgt

SEQ ID NO: 84000 - DNA, 25 bp, Homo sapien
gtgcctacacacgccttttgagaaa

SEQ ID NO: 84001 - DNA, 25 bp, Homo sapien
gtgcctacacatgccttttgagaaa

SEQ ID NO: 84002 - DNA, 25 bp, Homo sapien
gtgcctacatactcgatatgttaga

SEQ ID NO: 84003 - DNA, 25 bp, Homo sapien
gtgcctacatactctatatgttaga

SEQ ID NO: 84004 - DNA, 25 bp, Homo sapien
gtgcctcaacagcccttgtttattc

SEQ ID NO: 84005 - DNA, 25 bp, Homo sapien
gtgcctcaacagtccttgtttattc

SEQ ID NO: 84006 - DNA, 25 bp, Homo sapien
gtgcctcaagtacccaaaacagacc

SEQ ID NO: 84007 - DNA, 25 bp, Homo sapien
gtgcctcaagtacctaaaacagacc

SEQ ID NO: 84008 - DNA, 25 bp, Homo sapien
gtgcctccatattttagcagagaca

SEQ ID NO: 84009 - DNA, 25 bp, Homo sapien
gtgcctccgtattttagcagagaca

SEQ ID NO: 84010 - DNA, 25 bp, Homo sapien
gtgcctgattcccagactacaatat

SEQ ID NO: 84011 - DNA, 25 bp, Homo sapien
gtgcctgattcccagagtacaatat

SEQ ID NO: 84012 - DNA, 25 bp, Homo sapien
gtgcctgtaccaagctggtccaatc

SEQ ID NO: 84013 - DNA, 25 bp, Homo sapien
gtgcctgtaccaagttggtccaatc

SEQ ID NO: 84014 - DNA, 25 bp, Homo sapien
gtgccttaatctctgtatctcctga

SEQ ID NO: 84015 - DNA, 25 bp, Homo sapien
gtgccttaatctttgtatctcctga

SEQ ID NO: 84016 - DNA, 25 bp, Homo sapien
gtgccttgaggaacggtgcactgtg

SEQ ID NO: 84017 - DNA, 25 bp, Homo sapien
gtgccttgaggaatggtgcactgtg

SEQ ID NO: 84018 - DNA, 25 bp, Homo sapien
gtgccttgctagtctcaccctgggc

SEQ ID NO: 84019 - DNA, 25 bp, Homo sapien
gtgccttgctagtgtcaccctgggc

SEQ ID NO: 84020 - DNA, 25 bp, Homo sapien
gtgccttggtatcctcatctgtaat

SEQ ID NO: 84021 - DNA, 25 bp, Homo sapien
gtgccttggtatgctcatctgtaat

SEQ ID NO: 84022 - DNA, 25 bp, Homo sapien
gtgcctttcagattgcaaaacccgc

SEQ ID NO: 84023 - DNA, 25 bp, Homo sapien
gtgcctttctgattgcaaaacccgc

SEQ ID NO: 84024 - DNA, 25 bp, Homo sapien
gtgcgaacaaaacaaattaggaaaa

SEQ ID NO: 84025 - DNA, 25 bp, Homo sapien
gtgcgaacaaaccaaattaggaaaa

SEQ ID NO: 84026 - DNA, 25 bp, Homo sapien
gtgcgctttttccaagtgtgctgta

SEQ ID NO: 84027 - DNA, 25 bp, Homo sapien
gtgcgctttttgcaagtgtgctgta

SEQ ID NO: 84028 - DNA, 25 bp, Homo sapien
gtgcggccaagatgaattttgagga

SEQ ID NO: 84029 - DNA, 25 bp, Homo sapien
gtgcggccaagatgcattttgagga

SEQ ID NO: 84030 - DNA, 25 bp, Homo sapien
gtgcgtatgccttaacttttcagaa

SEQ ID NO: 84031 - DNA, 25 bp, Homo sapien
gtgcgtatgccttagcttttcagaa

SEQ ID NO: 84032 - DNA, 25 bp, Homo sapien
gtgctaaagttaaagcaatatgcaa

SEQ ID NO: 84033 - DNA, 25 bp, Homo sapien
gtgctaaagttaaggcaatatgcaa

SEQ ID NO: 84034 - DNA, 25 bp, Homo sapien
gtgctaagcagtgaagtcctcatgg

SEQ ID NO: 84035 - DNA, 25 bp, Homo sapien
gtgctaagtagtgaagtcctcatgg

SEQ ID NO: 84036 - DNA, 25 bp, Homo sapien
gtgctaatacatggtatcattctaa

SEQ ID NO: 84037 - DNA, 25 bp, Homo sapien
gtgctaatcgtgtcattacagaaat

SEQ ID NO: 84038 - DNA, 25 bp, Homo sapien
gtgctaatgcatggtatcattctaa

SEQ ID NO: 84039 - DNA, 25 bp, Homo sapien
gtgctaattgtgtcattacagaaat

SEQ ID NO: 84040 - DNA, 25 bp, Homo sapien
gtgctacatataagtcaatctgaaa

SEQ ID NO: 84041 - DNA, 25 bp, Homo sapien
gtgctacatataggtcaatctgaaa

SEQ ID NO: 84042 - DNA, 25 bp, Homo sapien
gtgctaccatgcctgaataattttt

SEQ ID NO: 84043 - DNA, 25 bp, Homo sapien
gtgctaccatgcctgagtaattttt

SEQ ID NO: 84044 - DNA, 25 bp, Homo sapien
gtgctacgaggaggccatgagaaga

SEQ ID NO: 84045 - DNA, 25 bp, Homo sapien
gtgctacgaggaggccgtgagaaga

SEQ ID NO: 84046 - DNA, 25 bp, Homo sapien
gtgctactgtagagattcatcggct

SEQ ID NO: 84047 - DNA, 25 bp, Homo sapien
gtgctactgtagagtttcatcggct

SEQ ID NO: 84048 - DNA, 25 bp, Homo sapien
gtgctactttctcaccttgtgtttc

SEQ ID NO: 84049 - DNA, 25 bp, Homo sapien
gtgctactttcttaccttgtgtttc

SEQ ID NO: 84050 - DNA, 25 bp, Homo sapien
gtgctaggcgagatcaatattttga

SEQ ID NO: 84051 - DNA, 25 bp, Homo sapien
gtgctaggcgagatcaattattttg

SEQ ID NO: 84052 - DNA, 25 bp, Homo sapien
gtgctaggtgagatcaatattttga

SEQ ID NO: 84053 - DNA, 25 bp, Homo sapien
gtgctaggtgagatcaattattttg

SEQ ID NO: 84054 - DNA, 25 bp, Homo sapien
gtgctagtcctcacaggcacataga

SEQ ID NO: 84055 - DNA, 25 bp, Homo sapien
gtgctagtcctcacagtcacataga

SEQ ID NO: 84056 - DNA, 25 bp, Homo sapien
gtgctagtttctcatactacttgtc

SEQ ID NO: 84057 - DNA, 25 bp, Homo sapien
gtgctagtttcttatactacttgtc

SEQ ID NO: 84058 - DNA, 25 bp, Homo sapien
gtgctatagtgtacgtctacatact

SEQ ID NO: 84059 - DNA, 25 bp, Homo sapien
gtgctatagtgtaggtctacatact

SEQ ID NO: 84060 - DNA, 25 bp, Homo sapien
gtgctatatgcaagaatggcaatta

SEQ ID NO: 84061 - DNA, 25 bp, Homo sapien
gtgctatatgcaggaatggcaatta

SEQ ID NO: 84062 - DNA, 25 bp, Homo sapien
gtgctatgaagtatttcctaggtac

SEQ ID NO: 84063 - DNA, 25 bp, Homo sapien
gtgctatgctgaggaaaaagtgcac

SEQ ID NO: 84064 - DNA, 25 bp, Homo sapien
gtgctatgctgagggaaaagtgcac

SEQ ID NO: 84065 - DNA, 25 bp, Homo sapien
gtgctatggaacactgcaacatatt

SEQ ID NO: 84066 - DNA, 25 bp, Homo sapien
gtgctatggaacactggaacatatt

SEQ ID NO: 84067 - DNA, 25 bp, Homo sapien
gtgctatggagtatttcctaggtac

SEQ ID NO: 84068 - DNA, 25 bp, Homo sapien
gtgctattagattacaacacgtggg

SEQ ID NO: 84069 - DNA, 25 bp, Homo sapien
gtgctattagattccaacacgtggg

SEQ ID NO: 84070 - DNA, 25 bp, Homo sapien
gtgctcaaacatattcataaagcag

SEQ ID NO: 84071 - DNA, 25 bp, Homo sapien
gtgctcaaacatgttcataaagcag

SEQ ID NO: 84072 - DNA, 25 bp, Homo sapien
gtgctcaagcatttaaagaaaaaca

SEQ ID NO: 84073 - DNA, 25 bp, Homo sapien
gtgctcaaggatttaaagaaaaaca

SEQ ID NO: 84074 - DNA, 25 bp, Homo sapien
gtgctcaataaatgcctactgagaa

SEQ ID NO: 84075 - DNA, 25 bp, Homo sapien
gtgctcaataaatgtctactgagaa

SEQ ID NO: 84076 - DNA, 25 bp, Homo sapien
gtgctcagctgaacagcagtgagtg

SEQ ID NO: 84077 - DNA, 25 bp, Homo sapien
gtgctcagctgaccagcagtgagtg

SEQ ID NO: 84078 - DNA, 25 bp, Homo sapien
gtgctcagtaactgcgtgtgactaa

SEQ ID NO: 84079 - DNA, 25 bp, Homo sapien
gtgctcagtaactgtgtgtgactaa

SEQ ID NO: 84080 - DNA, 25 bp, Homo sapien
gtgctccatcaatggtcactgtggg

SEQ ID NO: 84081 - DNA, 25 bp, Homo sapien
gtgctccatcagtggtcactgtggg

SEQ ID NO: 84082 - DNA, 25 bp, Homo sapien
gtgctcgattcctctacgtaaatct

SEQ ID NO: 84083 - DNA, 25 bp, Homo sapien
gtgctcgattcctctatgtaaatct

SEQ ID NO: 84084 - DNA, 25 bp, Homo sapien
gtgctcgtggagacgctggtggttt

SEQ ID NO: 84085 - DNA, 25 bp, Homo sapien
gtgctcgtggagatgctggtggttt

SEQ ID NO: 84086 - DNA, 25 bp, Homo sapien
gtgctctactcccaggagtccttac

SEQ ID NO: 84087 - DNA, 25 bp, Homo sapien
gtgctctactcgcaggagtccttac

SEQ ID NO: 84088 - DNA, 25 bp, Homo sapien
gtgctctcaatttcaatacatcttt

SEQ ID NO: 84089 - DNA, 25 bp, Homo sapien
gtgctctcgatttcaatacatcttt

SEQ ID NO: 84090 - DNA, 25 bp, Homo sapien
gtgctctggtttaattatatcgcac

SEQ ID NO: 84091 - DNA, 25 bp, Homo sapien
gtgctctggtttaattgtatcgcac

SEQ ID NO: 84092 - DNA, 25 bp, Homo sapien
gtgctgaaaagatgggacaaatgtc

SEQ ID NO: 84093 - DNA, 25 bp, Homo sapien
gtgctgaaagagacagtgctatctg

SEQ ID NO: 84094 - DNA, 25 bp, Homo sapien
gtgctgaaagagacggtgctatctg

SEQ ID NO: 84095 - DNA, 25 bp, Homo sapien
gtgctgaacagccacagaaataact

SEQ ID NO: 84096 - DNA, 25 bp, Homo sapien
gtgctgaacagccgcagaaataact

SEQ ID NO: 84097 - DNA, 25 bp, Homo sapien
gtgctgaagagatgggacaaatgtc

SEQ ID NO: 84098 - DNA, 25 bp, Homo sapien
gtgctgaccaagaacaggttaaacc

SEQ ID NO: 84099 - DNA, 25 bp, Homo sapien
gtgctgaccaaggacaggttaaacc

SEQ ID NO: 84100 - DNA, 25 bp, Homo sapien
gtgctgagctgtcccgcgtgtggtg

SEQ ID NO: 84101 - DNA, 25 bp, Homo sapien
gtgctgagctgtcctgcgtgtggtg

SEQ ID NO: 84102 - DNA, 25 bp, Homo sapien
gtgctgatcgttgtagtgtgaggaa

SEQ ID NO: 84103 - DNA, 25 bp, Homo sapien
gtgctgatctgatacagaaaacttt

SEQ ID NO: 84104 - DNA, 25 bp, Homo sapien
gtgctgatctgatagagaaaacttt

SEQ ID NO: 84105 - DNA, 25 bp, Homo sapien
gtgctgattgttgtagtgtgaggaa

SEQ ID NO: 84106 - DNA, 25 bp, Homo sapien
gtgctgcagcggtgtgtgtgtctgc

SEQ ID NO: 84107 - DNA, 25 bp, Homo sapien
gtgctgcagtggtgtgtgtgtctgc

SEQ ID NO: 84108 - DNA, 25 bp, Homo sapien
gtgctgcatttgtctataaatttag

SEQ ID NO: 84109 - DNA, 25 bp, Homo sapien
gtgctgcatttgtttataaatttag

SEQ ID NO: 84110 - DNA, 25 bp, Homo sapien
gtgctgcattttgtcaaacattcat

SEQ ID NO: 84111 - DNA, 25 bp, Homo sapien
gtgctgcattttgtgaaacattcat

SEQ ID NO: 84112 - DNA, 25 bp, Homo sapien
gtgctgccattcagactgttgtttt

SEQ ID NO: 84113 - DNA, 25 bp, Homo sapien
gtgctgccattcggactgttgtttt

SEQ ID NO: 84114 - DNA, 25 bp, Homo sapien
gtgctgctacaagccaagaacacct

SEQ ID NO: 84115 - DNA, 25 bp, Homo sapien
gtgctgctacaagccaggaacacct

SEQ ID NO: 84116 - DNA, 25 bp, Homo sapien
gtgctgggtggtatgaaactgacaa

SEQ ID NO: 84117 - DNA, 25 bp, Homo sapien
gtgctgggttgtatgaaactgacaa

SEQ ID NO: 84118 - DNA, 25 bp, Homo sapien
gtgctggtgctttaaagtgaggctt

SEQ ID NO: 84119 - DNA, 25 bp, Homo sapien
gtgctggtgctttcaagtgaggctt

SEQ ID NO: 84120 - DNA, 25 bp, Homo sapien
gtgctggttctgcctgaaatgtgag

SEQ ID NO: 84121 - DNA, 25 bp, Homo sapien
gtgctggttctgcttgaaatgtgag

SEQ ID NO: 84122 - DNA, 25 bp, Homo sapien
gtgctgtaatgaaaagaaagagact

SEQ ID NO: 84123 - DNA, 25 bp, Homo sapien
gtgctgtaggtatatctgtacttta

SEQ ID NO: 84124 - DNA, 25 bp, Homo sapien
gtgctgtatgtatatctgtacttta

SEQ ID NO: 84125 - DNA, 25 bp, Homo sapien
gtgctgtattgaaaagaaagagact

SEQ ID NO: 84126 - DNA, 25 bp, Homo sapien
gtgctgtgattgactggtcatgtct

SEQ ID NO: 84127 - DNA, 25 bp, Homo sapien
gtgctgtgattgattggtcatgtct

SEQ ID NO: 84128 - DNA, 25 bp, Homo sapien
gtgctgtgcttcttgttgggcttaa

SEQ ID NO: 84129 - DNA, 25 bp, Homo sapien
gtgctgtgcttctttttgggcttaa

SEQ ID NO: 84130 - DNA, 25 bp, Homo sapien
gtgctgttattttagcataagctca

SEQ ID NO: 84131 - DNA, 25 bp, Homo sapien
gtgctgttattttagcgtaagctca

SEQ ID NO: 84132 - DNA, 25 bp, Homo sapien
gtgctgttcagtgatggctgagtgc

SEQ ID NO: 84133 - DNA, 25 bp, Homo sapien
gtgctgttcagtgatgtctgagtgc

SEQ ID NO: 84134 - DNA, 25 bp, Homo sapien
gtgctgttcatgactcaatttcggt

SEQ ID NO: 84135 - DNA, 25 bp, Homo sapien
gtgctgttcgtgactcaatttcggt

SEQ ID NO: 84136 - DNA, 25 bp, Homo sapien
gtgcttaaatgatgcgggctcatga

SEQ ID NO: 84137 - DNA, 25 bp, Homo sapien
gtgcttaaatggtgcgggctcatga

SEQ ID NO: 84138 - DNA, 25 bp, Homo sapien
gtgcttacaaacaattttgattatg

SEQ ID NO: 84139 - DNA, 25 bp, Homo sapien
gtgcttacaaataattttgattatg

SEQ ID NO: 84140 - DNA, 25 bp, Homo sapien
gtgcttatactatgactgaatgtag

SEQ ID NO: 84141 - DNA, 25 bp, Homo sapien
gtgcttatactgtgactgaatgtag

SEQ ID NO: 84142 - DNA, 25 bp, Homo sapien
gtgcttatatacaagtaggcatgtc

SEQ ID NO: 84143 - DNA, 25 bp, Homo sapien
gtgcttatatacatgtaggcatgtc

SEQ ID NO: 84144 - DNA, 25 bp, Homo sapien
gtgcttatttgaatgttctctccct

SEQ ID NO: 84145 - DNA, 25 bp, Homo sapien
gtgcttatttgagtgttctctccct

SEQ ID NO: 84146 - DNA, 25 bp, Homo sapien
gtgcttcaccacatcttgacaacat

SEQ ID NO: 84147 - DNA, 25 bp, Homo sapien
gtgcttcaccatatcttgacaacat

SEQ ID NO: 84148 - DNA, 25 bp, Homo sapien
gtgcttccgaaaggattcttacttg

SEQ ID NO: 84149 - DNA, 25 bp, Homo sapien
gtgcttccgcaaggattcttacttg

SEQ ID NO: 84150 - DNA, 25 bp, Homo sapien
gtgcttctcataactactgggttat

SEQ ID NO: 84151 - DNA, 25 bp, Homo sapien
gtgcttctcctaactactgggttat

SEQ ID NO: 84152 - DNA, 25 bp, Homo sapien
gtgcttcttcatagcatggtaagaa

SEQ ID NO: 84153 - DNA, 25 bp, Homo sapien
gtgcttcttcatatcatggtaagaa

SEQ ID NO: 84154 - DNA, 25 bp, Homo sapien
gtgcttcttgttgggcttaatgttt

SEQ ID NO: 84155 - DNA, 25 bp, Homo sapien
gtgcttctttggtattatcagagct

SEQ ID NO: 84156 - DNA, 25 bp, Homo sapien
gtgcttctttggtgttatcagagct

SEQ ID NO: 84157 - DNA, 25 bp, Homo sapien
gtgcttctttttgggcttaatgttt

SEQ ID NO: 84158 - DNA, 25 bp, Homo sapien
gtgcttgcagagaggaaagataagt

SEQ ID NO: 84159 - DNA, 25 bp, Homo sapien
gtgcttgcatagaggaaagataagt

SEQ ID NO: 84160 - DNA, 25 bp, Homo sapien
gtgcttgctacaattcaacaccatt

SEQ ID NO: 84161 - DNA, 25 bp, Homo sapien
gtgcttgctacagttcaacaccatt

SEQ ID NO: 84162 - DNA, 25 bp, Homo sapien
gtgcttgctgcagaaagttataagg

SEQ ID NO: 84163 - DNA, 25 bp, Homo sapien
gtgcttgctgcggaaagttataagg

SEQ ID NO: 84164 - DNA, 25 bp, Homo sapien
gtgcttgctgttacgtccaaggcat

SEQ ID NO: 84165 - DNA, 25 bp, Homo sapien
gtgcttgctgttatgtccaaggcat

SEQ ID NO: 84166 - DNA, 25 bp, Homo sapien
gtgctttctatgtacctgctgagga

SEQ ID NO: 84167 - DNA, 25 bp, Homo sapien
gtgctttctcacagtaaatcaagtc

SEQ ID NO: 84168 - DNA, 25 bp, Homo sapien
gtgctttctcacggtaaatcaagtc

SEQ ID NO: 84169 - DNA, 25 bp, Homo sapien
gtgctttctgtgtacctgctgagga

SEQ ID NO: 84170 - DNA, 25 bp, Homo sapien
gtgctttgatgaataataaacccct

SEQ ID NO: 84171 - DNA, 25 bp, Homo sapien
gtgctttggtgaataataaacccct

SEQ ID NO: 84172 - DNA, 25 bp, Homo sapien
gtgctttgtctcctatagtagatta

SEQ ID NO: 84173 - DNA, 25 bp, Homo sapien
gtgctttgtcttctatagtagatta

SEQ ID NO: 84174 - DNA, 25 bp, Homo sapien
gtgctttgtggctacaaactgaaga

SEQ ID NO: 84175 - DNA, 25 bp, Homo sapien
gtgctttgtggctgcaaactgaaga

SEQ ID NO: 84176 - DNA, 25 bp, Homo sapien
gtgctttgtttcatgtgctgtgcat

SEQ ID NO: 84177 - DNA, 25 bp, Homo sapien
gtgctttgtttcgtgtgctgtgcat

SEQ ID NO: 84178 - DNA, 25 bp, Homo sapien
gtgcttttctccgcaggcctcattt

SEQ ID NO: 84179 - DNA, 25 bp, Homo sapien
gtgcttttctctgcaggcctcattt

SEQ ID NO: 84180 - DNA, 25 bp, Homo sapien
gtgctttttaaactttggaaaatat

SEQ ID NO: 84181 - DNA, 25 bp, Homo sapien
gtgctttttaaagtttggaaaatat

SEQ ID NO: 84182 - DNA, 25 bp, Homo sapien
gtggaaaacagagattgtatcttat

SEQ ID NO: 84183 - DNA, 25 bp, Homo sapien
gtggaaaacagggattgtatcttat

SEQ ID NO: 84184 - DNA, 25 bp, Homo sapien
gtggaaaatctgtacaatgtgttac

SEQ ID NO: 84185 - DNA, 25 bp, Homo sapien
gtggaaaatctgtacagtgtgttac

SEQ ID NO: 84186 - DNA, 25 bp, Homo sapien
gtggaaaatgtcaaatccaaaggaa

SEQ ID NO: 84187 - DNA, 25 bp, Homo sapien
gtggaaaatgtcacatccaaaggaa

SEQ ID NO: 84188 - DNA, 25 bp, Homo sapien
gtggaaatacaaaagagcctaaata

SEQ ID NO: 84189 - DNA, 25 bp, Homo sapien
gtggaaatacaatagagcctaaata

SEQ ID NO: 84190 - DNA, 25 bp, Homo sapien
gtggaacacgatccaactccaatga

SEQ ID NO: 84191 - DNA, 25 bp, Homo sapien
gtggaacagggaaagatattttcaa

SEQ ID NO: 84192 - DNA, 25 bp, Homo sapien
gtggaacagtgaaagatattttcaa

SEQ ID NO: 84193 - DNA, 25 bp, Homo sapien
gtggaacatgatccaactccaatga

SEQ ID NO: 84194 - DNA, 25 bp, Homo sapien
gtggaactgtgtcctgctatgcctg

SEQ ID NO: 84195 - DNA, 25 bp, Homo sapien
gtggaactgtgtcttgctatgcctg

SEQ ID NO: 84196 - DNA, 25 bp, Homo sapien
gtggaagaatgaaagaacgactgca

SEQ ID NO: 84197 - DNA, 25 bp, Homo sapien
gtggaagaatgagagaacgactgca

SEQ ID NO: 84198 - DNA, 25 bp, Homo sapien
gtggaagacactgaaatgaattttt

SEQ ID NO: 84199 - DNA, 25 bp, Homo sapien
gtggaagacgctgaaatgaattttt

SEQ ID NO: 84200 - DNA, 25 bp, Homo sapien
gtggaagaggaaacgatgctgaaga

SEQ ID NO: 84201 - DNA, 25 bp, Homo sapien
gtggaagaggaaatgatgctgaaga

SEQ ID NO: 84202 - DNA, 25 bp, Homo sapien
gtggaatcctccaaaaatgaacaca

SEQ ID NO: 84203 - DNA, 25 bp, Homo sapien
gtggaatcctccagaaatgaacaca

SEQ ID NO: 84204 - DNA, 25 bp, Homo sapien
gtggaatgagaaaggacttgtttgt

SEQ ID NO: 84205 - DNA, 25 bp, Homo sapien
gtggaatgagagaggacttgtttgt

SEQ ID NO: 84206 - DNA, 25 bp, Homo sapien
gtggaatgattgagtaaaagtgatt

SEQ ID NO: 84207 - DNA, 25 bp, Homo sapien
gtggaatgattgcgtaaaagtgatt

SEQ ID NO: 84208 - DNA, 25 bp, Homo sapien
gtggaatgcatgataagctgggttc

SEQ ID NO: 84209 - DNA, 25 bp, Homo sapien
gtggaatgcatgataatctgggttc

SEQ ID NO: 84210 - DNA, 25 bp, Homo sapien
gtggaattacattacgcaaatgaaa

SEQ ID NO: 84211 - DNA, 25 bp, Homo sapien
gtggaattacattaggcaaatgaaa

SEQ ID NO: 84212 - DNA, 25 bp, Homo sapien
gtggaattggaaatggaatagaata

SEQ ID NO: 84213 - DNA, 25 bp, Homo sapien
gtggaattggaaatgggatagaata

SEQ ID NO: 84214 - DNA, 25 bp, Homo sapien
gtggacaagaatacaatacagtact

SEQ ID NO: 84215 - DNA, 25 bp, Homo sapien
gtggacaagaatacgatacagtact

SEQ ID NO: 84216 - DNA, 25 bp, Homo sapien
gtggacagcctcattctcaagacaa

SEQ ID NO: 84217 - DNA, 25 bp, Homo sapien
gtggacagcctccttctcaagacaa

SEQ ID NO: 84218 - DNA, 25 bp, Homo sapien
gtggacagctcatcaataacacatt

SEQ ID NO: 84219 - DNA, 25 bp, Homo sapien
gtggacagctcgtcaataacacatt

SEQ ID NO: 84220 - DNA, 25 bp, Homo sapien
gtggacaggagactttccatacaag

SEQ ID NO: 84221 - DNA, 25 bp, Homo sapien
gtggacaggagagtttccatacaag

SEQ ID NO: 84222 - DNA, 25 bp, Homo sapien
gtggacattaacggaatcacacact

SEQ ID NO: 84223 - DNA, 25 bp, Homo sapien
gtggacattaatggaatcacacact

SEQ ID NO: 84224 - DNA, 25 bp, Homo sapien
gtggaccaacgaagagggtgacctg

SEQ ID NO: 84225 - DNA, 25 bp, Homo sapien
gtggaccacaaaaataaaaaaccac

SEQ ID NO: 84226 - DNA, 25 bp, Homo sapien
gtggaccagaaaaataaaaaaccac

SEQ ID NO: 84227 - DNA, 25 bp, Homo sapien
gtggaccagaaagacgcatggagag

SEQ ID NO: 84228 - DNA, 25 bp, Homo sapien
gtggaccagaaagatgcatggagag

SEQ ID NO: 84229 - DNA, 25 bp, Homo sapien
gtggaccagcgaagagggtgacctg

SEQ ID NO: 84230 - DNA, 25 bp, Homo sapien
gtggacccactgtaatcacaaggtt

SEQ ID NO: 84231 - DNA, 25 bp, Homo sapien
gtggacccattgtaatcacaaggtt

SEQ ID NO: 84232 - DNA, 25 bp, Homo sapien
gtggaccccgtgtcataaatgagaa

SEQ ID NO: 84233 - DNA, 25 bp, Homo sapien
gtggaccctgtgtcataaatgagaa

SEQ ID NO: 84234 - DNA, 25 bp, Homo sapien
gtggactgacgctgatttccaagat

SEQ ID NO: 84235 - DNA, 25 bp, Homo sapien
gtggactgatgctgatttccaagat

SEQ ID NO: 84236 - DNA, 25 bp, Homo sapien
gtggactttttaccttaatgtatga

SEQ ID NO: 84237 - DNA, 25 bp, Homo sapien
gtggactttttagcttaatgtatga

SEQ ID NO: 84238 - DNA, 25 bp, Homo sapien
gtggagaaaagatgttcctgaaact

SEQ ID NO: 84239 - DNA, 25 bp, Homo sapien
gtggagaaattgaagatccctgatt

SEQ ID NO: 84240 - DNA, 25 bp, Homo sapien
gtggagaaatttaagatccctgatt

SEQ ID NO: 84241 - DNA, 25 bp, Homo sapien
gtggagaagagatgttcctgaaact

SEQ ID NO: 84242 - DNA, 25 bp, Homo sapien
gtggagacaaatacaggaacccagt

SEQ ID NO: 84243 - DNA, 25 bp, Homo sapien
gtggagacaaatataggaacccagt

SEQ ID NO: 84244 - DNA, 25 bp, Homo sapien
gtggagacatatgtgtcaagagagt

SEQ ID NO: 84245 - DNA, 25 bp, Homo sapien
gtggagacatgacagagatctggtg

SEQ ID NO: 84246 - DNA, 25 bp, Homo sapien
gtggagacatgatagagatctggtg

SEQ ID NO: 84247 - DNA, 25 bp, Homo sapien
gtggagaccgcataatcaaggaact

SEQ ID NO: 84248 - DNA, 25 bp, Homo sapien
gtggagaccgcgtaatcaaggaact

SEQ ID NO: 84249 - DNA, 25 bp, Homo sapien
gtggagacgtatgtgtcaagagagt

SEQ ID NO: 84250 - DNA, 25 bp, Homo sapien
gtggagagaatttttatgggcagag

SEQ ID NO: 84251 - DNA, 25 bp, Homo sapien
gtggagagactttttatgggcagag

SEQ ID NO: 84252 - DNA, 25 bp, Homo sapien
gtggagaggtgacgaggaatactct

SEQ ID NO: 84253 - DNA, 25 bp, Homo sapien
gtggagaggtgatgaggaatactct

SEQ ID NO: 84254 - DNA, 25 bp, Homo sapien
gtggagcagttgtcggtatggttat

SEQ ID NO: 84255 - DNA, 25 bp, Homo sapien
gtggagcagttgttggtatggttat

SEQ ID NO: 84256 - DNA, 25 bp, Homo sapien
gtggagcccatccatcagtactttc

SEQ ID NO: 84257 - DNA, 25 bp, Homo sapien
gtggagcccatctatcagtactttc

SEQ ID NO: 84258 - DNA, 25 bp, Homo sapien
gtggagccctgtcatccttaaagat

SEQ ID NO: 84259 - DNA, 25 bp, Homo sapien
gtggagccctgtcgtccttaaagat

SEQ ID NO: 84260 - DNA, 25 bp, Homo sapien
gtggagctgagtaataccctcatta

SEQ ID NO: 84261 - DNA, 25 bp, Homo sapien
gtggagctgggtaataccctcatta

SEQ ID NO: 84262 - DNA, 25 bp, Homo sapien
gtggaggcgacacagcccaagaggc

SEQ ID NO: 84263 - DNA, 25 bp, Homo sapien
gtggaggcggcacagcccaagaggc

SEQ ID NO: 84264 - DNA, 25 bp, Homo sapien
gtggaggctcctttacaatgtggcc

SEQ ID NO: 84265 - DNA, 25 bp, Homo sapien
gtggaggctcctttaccatgtggcc

SEQ ID NO: 84266 - DNA, 25 bp, Homo sapien
gtggagggtatctaatagaagcatc

SEQ ID NO: 84267 - DNA, 25 bp, Homo sapien
gtggagggtatctgatagaagcatc

SEQ ID NO: 84268 - DNA, 25 bp, Homo sapien
gtggaggtcagacgccaagtagaaa

SEQ ID NO: 84269 - DNA, 25 bp, Homo sapien
gtggaggtcagacgtcaagtagaaa

SEQ ID NO: 84270 - DNA, 25 bp, Homo sapien
gtggaggtttgccactaggatttcc

SEQ ID NO: 84271 - DNA, 25 bp, Homo sapien
gtggaggtttgtcactaggatttcc

SEQ ID NO: 84272 - DNA, 25 bp, Homo sapien
gtggagtcccagaagcatgatgcag

SEQ ID NO: 84273 - DNA, 25 bp, Homo sapien
gtggagtctcagaagcatgatgcag

SEQ ID NO: 84274 - DNA, 25 bp, Homo sapien
gtggagttgaagaaagggagtttcc

SEQ ID NO: 84275 - DNA, 25 bp, Homo sapien
gtggagttgaagatagggagtttcc

SEQ ID NO: 84276 - DNA, 25 bp, Homo sapien
gtggataagttttcaatttggtgtt

SEQ ID NO: 84277 - DNA, 25 bp, Homo sapien
gtggataatttttcaatttggtgtt

SEQ ID NO: 84278 - DNA, 25 bp, Homo sapien
gtggatacattggaacccttgcgca

SEQ ID NO: 84279 - DNA, 25 bp, Homo sapien
gtggatacattggaactcttgcgca

SEQ ID NO: 84280 - DNA, 25 bp, Homo sapien
gtggatccaatggtcaccctttagg

SEQ ID NO: 84281 - DNA, 25 bp, Homo sapien
gtggatccaatggtgaccctttagg

SEQ ID NO: 84282 - DNA, 25 bp, Homo sapien
gtggatctgtacatttccttagggc

SEQ ID NO: 84283 - DNA, 25 bp, Homo sapien
gtggatctgtacgtttccttagggc

SEQ ID NO: 84284 - DNA, 25 bp, Homo sapien
gtggatgcatcaacctatcgtcagt

SEQ ID NO: 84285 - DNA, 25 bp, Homo sapien
gtggatgcatcaagctatcgtcagt

SEQ ID NO: 84286 - DNA, 25 bp, Homo sapien
gtggatgcttaccaaatgctgacac

SEQ ID NO: 84287 - DNA, 25 bp, Homo sapien
gtggatgcttactaaatgctgacac

SEQ ID NO: 84288 - DNA, 25 bp, Homo sapien
gtggatggacagaaggatgctgcct

SEQ ID NO: 84289 - DNA, 25 bp, Homo sapien
gtggatggatagaaggatgctgcct

SEQ ID NO: 84290 - DNA, 25 bp, Homo sapien
gtggatgtagaacctgtggatgcag

SEQ ID NO: 84291 - DNA, 25 bp, Homo sapien
gtggatgtagaagctgtggatgcag

SEQ ID NO: 84292 - DNA, 25 bp, Homo sapien
gtggatgtgcttcttttggcaaggg

SEQ ID NO: 84293 - DNA, 25 bp, Homo sapien
gtggatgtgtttcttttggcaaggg

SEQ ID NO: 84294 - DNA, 25 bp, Homo sapien
gtggatgttcaacgttgcaatactg

SEQ ID NO: 84295 - DNA, 25 bp, Homo sapien
gtggatgttcaatgttgcaatactg

SEQ ID NO: 84296 - DNA, 25 bp, Homo sapien
gtggattaagagttgtacggcttgg

SEQ ID NO: 84297 - DNA, 25 bp, Homo sapien
gtggattaagagttgtgcggcttgg

SEQ ID NO: 84298 - DNA, 25 bp, Homo sapien
gtggattcaggtgtgaaccagtgca

SEQ ID NO: 84299 - DNA, 25 bp, Homo sapien
gtggattcaggtgtgacccagtgca

SEQ ID NO: 84300 - DNA, 25 bp, Homo sapien
gtggattgaccacctaatctcatca

SEQ ID NO: 84301 - DNA, 25 bp, Homo sapien
gtggattgaccacgtaatctcatca

SEQ ID NO: 84302 - DNA, 25 bp, Homo sapien
gtggattgtttacctgtctgttttg

SEQ ID NO: 84303 - DNA, 25 bp, Homo sapien
gtggattgtttccctgtctgttttg

SEQ ID NO: 84304 - DNA, 25 bp, Homo sapien
gtggcaaaagctcaactctactaaa

SEQ ID NO: 84305 - DNA, 25 bp, Homo sapien
gtggcaaaagctcacctctactaaa

SEQ ID NO: 84306 - DNA, 25 bp, Homo sapien
gtggcaagctcaaatttaaactcta

SEQ ID NO: 84307 - DNA, 25 bp, Homo sapien
gtggcaagctctaatttaaactcta

SEQ ID NO: 84308 - DNA, 25 bp, Homo sapien
gtggcaaggatgggactctgctctg

SEQ ID NO: 84309 - DNA, 25 bp, Homo sapien
gtggcaaggattggactctgctctg

SEQ ID NO: 84310 - DNA, 25 bp, Homo sapien
gtggcaatacagaagtagcccaagg

SEQ ID NO: 84311 - DNA, 25 bp, Homo sapien
gtggcaatatagaagtagcccaagg

SEQ ID NO: 84312 - DNA, 25 bp, Homo sapien
gtggcacatgacacagtgagacacc

SEQ ID NO: 84313 - DNA, 25 bp, Homo sapien
gtggcacattacacagtgagacacc

SEQ ID NO: 84314 - DNA, 25 bp, Homo sapien
gtggcacctcttcaccttccacaaa

SEQ ID NO: 84315 - DNA, 25 bp, Homo sapien
gtggcacctcttgaccttccacaaa

SEQ ID NO: 84316 - DNA, 25 bp, Homo sapien
gtggcactatcatctactacccatt

SEQ ID NO: 84317 - DNA, 25 bp, Homo sapien
gtggcactatcatttactacccatt

SEQ ID NO: 84318 - DNA, 25 bp, Homo sapien
gtggcactcattaatagagtctgca

SEQ ID NO: 84319 - DNA, 25 bp, Homo sapien
gtggcactcatttatagagtctgca

SEQ ID NO: 84320 - DNA, 25 bp, Homo sapien
gtggcactcctcattgacattatta

SEQ ID NO: 84321 - DNA, 25 bp, Homo sapien
gtggcactcctcattggcattatta

SEQ ID NO: 84322 - DNA, 25 bp, Homo sapien
gtggcactctctaaccattagggac

SEQ ID NO: 84323 - DNA, 25 bp, Homo sapien
gtggcacttacttcagtgtctgagc

SEQ ID NO: 84324 - DNA, 25 bp, Homo sapien
gtggcacttactttagtgtctgagc

SEQ ID NO: 84325 - DNA, 25 bp, Homo sapien
gtggcacttcagcgactattcaata

SEQ ID NO: 84326 - DNA, 25 bp, Homo sapien
gtggcactttagcgactattcaata

SEQ ID NO: 84327 - DNA, 25 bp, Homo sapien
gtggcactttctaaccattagggac

SEQ ID NO: 84328 - DNA, 25 bp, Homo sapien
gtggcagaaactcaataaatacttg

SEQ ID NO: 84329 - DNA, 25 bp, Homo sapien
gtggcagaaactcaatgaatacttg

SEQ ID NO: 84330 - DNA, 25 bp, Homo sapien
gtggcagagggaaaaatggctgcta

SEQ ID NO: 84331 - DNA, 25 bp, Homo sapien
gtggcagagggagaaatggctgcta

SEQ ID NO: 84332 - DNA, 25 bp, Homo sapien
gtggcagatgtgaagtggcccttgg

SEQ ID NO: 84333 - DNA, 25 bp, Homo sapien
gtggcagatttgaagtggcccttgg

SEQ ID NO: 84334 - DNA, 25 bp, Homo sapien
gtggcaggacaatataagcaggcaa

SEQ ID NO: 84335 - DNA, 25 bp, Homo sapien
gtggcaggacaatatatgcaggcaa

SEQ ID NO: 84336 - DNA, 25 bp, Homo sapien
gtggcaggagaaaagcaagaagaca

SEQ ID NO: 84337 - DNA, 25 bp, Homo sapien
gtggcaggagaacagcaagaagaca

SEQ ID NO: 84338 - DNA, 25 bp, Homo sapien
gtggcagtgacatattcggtgttca

SEQ ID NO: 84339 - DNA, 25 bp, Homo sapien
gtggcagtgacatatttggtgttca

SEQ ID NO: 84340 - DNA, 25 bp, Homo sapien
gtggcagtgacatgttgaagaaact

SEQ ID NO: 84341 - DNA, 25 bp, Homo sapien
gtggcagtgacttgttgaagaaact

SEQ ID NO: 84342 - DNA, 25 bp, Homo sapien
gtggcagtgtaaacccatgtagact

SEQ ID NO: 84343 - DNA, 25 bp, Homo sapien
gtggcagtgtaaacccctgtagact

SEQ ID NO: 84344 - DNA, 25 bp, Homo sapien
gtggcatagttcacgtgtaattaca

SEQ ID NO: 84345 - DNA, 25 bp, Homo sapien
gtggcatagttcacttgtaattaca

SEQ ID NO: 84346 - DNA, 25 bp, Homo sapien
gtggcatcctgacagctttccccct

SEQ ID NO: 84347 - DNA, 25 bp, Homo sapien
gtggcatctggtaagggtcatccca

SEQ ID NO: 84348 - DNA, 25 bp, Homo sapien
gtggcatctggtgagggtcatccca

SEQ ID NO: 84349 - DNA, 25 bp, Homo sapien
gtggcatcttgacagctttccccct

SEQ ID NO: 84350 - DNA, 25 bp, Homo sapien
gtggcatgcgttatatttctaccag

SEQ ID NO: 84351 - DNA, 25 bp, Homo sapien
gtggcatggttgtgcttgaatgata

SEQ ID NO: 84352 - DNA, 25 bp, Homo sapien
gtggcatggttgtggttgaatgata

SEQ ID NO: 84353 - DNA, 25 bp, Homo sapien
gtggcatgtatcgtggcaatcttta

SEQ ID NO: 84354 - DNA, 25 bp, Homo sapien
gtggcatgtcgaaaactgagaaagg

SEQ ID NO: 84355 - DNA, 25 bp, Homo sapien
gtggcatgtcgaaagctgagaaagg

SEQ ID NO: 84356 - DNA, 25 bp, Homo sapien
gtggcatgtctcgtggcaatcttta

SEQ ID NO: 84357 - DNA, 25 bp, Homo sapien
gtggcatgtgttatatttctaccag

SEQ ID NO: 84358 - DNA, 25 bp, Homo sapien
gtggccaacttgtcccagttttcct

SEQ ID NO: 84359 - DNA, 25 bp, Homo sapien
gtggccaatttgtcccagttttcct

SEQ ID NO: 84360 - DNA, 25 bp, Homo sapien
gtggccaccatcatccatacagaga

SEQ ID NO: 84361 - DNA, 25 bp, Homo sapien
gtggccaccatcattcatacagaga

SEQ ID NO: 84362 - DNA, 25 bp, Homo sapien
gtggccactctaggactgcaaggta

SEQ ID NO: 84363 - DNA, 25 bp, Homo sapien
gtggccactctatgactgcaaggta

SEQ ID NO: 84364 - DNA, 25 bp, Homo sapien
gtggcccaaaaggcgtcatcagctg

SEQ ID NO: 84365 - DNA, 25 bp, Homo sapien
gtggcccaaaatgcgtcatcagctg

SEQ ID NO: 84366 - DNA, 25 bp, Homo sapien
gtggcccaaagtcccaatctaggtg

SEQ ID NO: 84367 - DNA, 25 bp, Homo sapien
gtggcccagagtcccaatctaggtg

SEQ ID NO: 84368 - DNA, 25 bp, Homo sapien
gtggcccaggcgctgaatgggcttt

SEQ ID NO: 84369 - DNA, 25 bp, Homo sapien
gtggcccaggcgctgagtgggcttt

SEQ ID NO: 84370 - DNA, 25 bp, Homo sapien
gtggccccaatgcaagggtgcttta

SEQ ID NO: 84371 - DNA, 25 bp, Homo sapien
gtggccccagtgcaagggtgcttta

SEQ ID NO: 84372 - DNA, 25 bp, Homo sapien
gtggccctcatctcatagctccact

SEQ ID NO: 84373 - DNA, 25 bp, Homo sapien
gtggccctcatctcttagctccact

SEQ ID NO: 84374 - DNA, 25 bp, Homo sapien
gtggccgacctattcctggctacta

SEQ ID NO: 84375 - DNA, 25 bp, Homo sapien
gtggccgacgtattcctggctacta

SEQ ID NO: 84376 - DNA, 25 bp, Homo sapien
gtggccggtttctgtaatccgggaa

SEQ ID NO: 84377 - DNA, 25 bp, Homo sapien
gtggccggtttttgtaatccgggaa

SEQ ID NO: 84378 - DNA, 25 bp, Homo sapien
gtggcctcaccctggacgctgggcc

SEQ ID NO: 84379 - DNA, 25 bp, Homo sapien
gtggcctcatcctggacgctgggcc

SEQ ID NO: 84380 - DNA, 25 bp, Homo sapien
gtggcctccatctcgattgccatct

SEQ ID NO: 84381 - DNA, 25 bp, Homo sapien
gtggcctccatcttgattgccatct

SEQ ID NO: 84382 - DNA, 25 bp, Homo sapien
gtggctagagttactggaaaacaaa

SEQ ID NO: 84383 - DNA, 25 bp, Homo sapien
gtggctagtgttactggaaaacaaa

SEQ ID NO: 84384 - DNA, 25 bp, Homo sapien
gtggctatcggccaggaatctgaca

SEQ ID NO: 84385 - DNA, 25 bp, Homo sapien
gtggctatgtagacccggttcgcag

SEQ ID NO: 84386 - DNA, 25 bp, Homo sapien
gtggctatgtagagccggttcgcag

SEQ ID NO: 84387 - DNA, 25 bp, Homo sapien
gtggctattggccaggaatctgaca

SEQ ID NO: 84388 - DNA, 25 bp, Homo sapien
gtggctatttactgaacaggaatga

SEQ ID NO: 84389 - DNA, 25 bp, Homo sapien
gtggctatttattgaacaggaatga

SEQ ID NO: 84390 - DNA, 25 bp, Homo sapien
gtggctcatctatagtgctgctttt

SEQ ID NO: 84391 - DNA, 25 bp, Homo sapien
gtggctcatctgtagtgctgctttt

SEQ ID NO: 84392 - DNA, 25 bp, Homo sapien
gtggctccatccgccatatttaaag

SEQ ID NO: 84393 - DNA, 25 bp, Homo sapien
gtggctccatcctccatatttaaag

SEQ ID NO: 84394 - DNA, 25 bp, Homo sapien
gtggctcctaccaattgaggtcatt

SEQ ID NO: 84395 - DNA, 25 bp, Homo sapien
gtggctcctgccaattgaggtcatt

SEQ ID NO: 84396 - DNA, 25 bp, Homo sapien
gtggctctcctacctccttttcctt

SEQ ID NO: 84397 - DNA, 25 bp, Homo sapien
gtggctctcttacctccttttcctt

SEQ ID NO: 84398 - DNA, 25 bp, Homo sapien
gtggctgaactgatatacagtttgt

SEQ ID NO: 84399 - DNA, 25 bp, Homo sapien
gtggctgaactgatatccagtttgt

SEQ ID NO: 84400 - DNA, 25 bp, Homo sapien
gtggctgaagtgtggttttaatcta

SEQ ID NO: 84401 - DNA, 25 bp, Homo sapien
gtggctgaccatccaaaggaaagcc

SEQ ID NO: 84402 - DNA, 25 bp, Homo sapien
gtggctgagcatccaaaggaaagcc

SEQ ID NO: 84403 - DNA, 25 bp, Homo sapien
gtggctgagccttggtaatcaagtc

SEQ ID NO: 84404 - DNA, 25 bp, Homo sapien
gtggctgaggtgtggttttaatcta

SEQ ID NO: 84405 - DNA, 25 bp, Homo sapien
gtggctgagtcttggtaatcaagtc

SEQ ID NO: 84406 - DNA, 25 bp, Homo sapien
gtggctgatcacactcaatttgtcc

SEQ ID NO: 84407 - DNA, 25 bp, Homo sapien
gtggctgatcatactcaatttgtcc

SEQ ID NO: 84408 - DNA, 25 bp, Homo sapien
gtggctgatgaaaaattatcttgat

SEQ ID NO: 84409 - DNA, 25 bp, Homo sapien
gtggctgatgaaacattatcttgat

SEQ ID NO: 84410 - DNA, 25 bp, Homo sapien
gtggctgcaataagctattaaagat

SEQ ID NO: 84411 - DNA, 25 bp, Homo sapien
gtggctgcaatatgctattaaagat

SEQ ID NO: 84412 - DNA, 25 bp, Homo sapien
gtggctgcagcaccgccactcagga

SEQ ID NO: 84413 - DNA, 25 bp, Homo sapien
gtggctgcggcaccgccactcagga

SEQ ID NO: 84414 - DNA, 25 bp, Homo sapien
gtggctgctgcaatattaagttcct

SEQ ID NO: 84415 - DNA, 25 bp, Homo sapien
gtggctgctgcagtattaagttcct

SEQ ID NO: 84416 - DNA, 25 bp, Homo sapien
gtggctggcctcacttaggattgca

SEQ ID NO: 84417 - DNA, 25 bp, Homo sapien
gtggctggcctcagttaggattgca

SEQ ID NO: 84418 - DNA, 25 bp, Homo sapien
gtggcttaactgagtatcctaaggt

SEQ ID NO: 84419 - DNA, 25 bp, Homo sapien
gtggcttaactgattatcctaaggt

SEQ ID NO: 84420 - DNA, 25 bp, Homo sapien
gtggcttaggttctagtggtacatg

SEQ ID NO: 84421 - DNA, 25 bp, Homo sapien
gtggcttaggttctggtggtacatg

SEQ ID NO: 84422 - DNA, 25 bp, Homo sapien
gtggcttatttcaccactgtactga

SEQ ID NO: 84423 - DNA, 25 bp, Homo sapien
gtggcttatttcatcactgtactga

SEQ ID NO: 84424 - DNA, 25 bp, Homo sapien
gtggcttcaaacgtaaatgtccctg

SEQ ID NO: 84425 - DNA, 25 bp, Homo sapien
gtggcttcaaatgtaaatgtccctg

SEQ ID NO: 84426 - DNA, 25 bp, Homo sapien
gtggcttcatataaacaagtgaggc

SEQ ID NO: 84427 - DNA, 25 bp, Homo sapien
gtggcttcatatcaacaagtgaggc

SEQ ID NO: 84428 - DNA, 25 bp, Homo sapien
gtggcttctccaggctcaaaaaaac

SEQ ID NO: 84429 - DNA, 25 bp, Homo sapien
gtggcttctccgggctcaaaaaaac

SEQ ID NO: 84430 - DNA, 25 bp, Homo sapien
gtggcttgaattagatggtgatatc

SEQ ID NO: 84431 - DNA, 25 bp, Homo sapien
gtggcttgaattggatggtgatatc

SEQ ID NO: 84432 - DNA, 25 bp, Homo sapien
gtgggaaaaataacagaaccaataa

SEQ ID NO: 84433 - DNA, 25 bp, Homo sapien
gtgggaaaaataacggaaccaataa

SEQ ID NO: 84434 - DNA, 25 bp, Homo sapien
gtgggaaaggtggattgtctgtcac

SEQ ID NO: 84435 - DNA, 25 bp, Homo sapien
gtgggaaaggtggattttctgtcac

SEQ ID NO: 84436 - DNA, 25 bp, Homo sapien
gtgggaaataaatacccagcataag

SEQ ID NO: 84437 - DNA, 25 bp, Homo sapien
gtgggaaataaataccgagcataag

SEQ ID NO: 84438 - DNA, 25 bp, Homo sapien
gtgggaaatggagaagtgttaatct

SEQ ID NO: 84439 - DNA, 25 bp, Homo sapien
gtgggaaatggagtagtgttaatct

SEQ ID NO: 84440 - DNA, 25 bp, Homo sapien
gtgggaagacccatcgcatcatcat

SEQ ID NO: 84441 - DNA, 25 bp, Homo sapien
gtgggaagacccatggcatcatcat

SEQ ID NO: 84442 - DNA, 25 bp, Homo sapien
gtgggaagactcatgtgagttcaga

SEQ ID NO: 84443 - DNA, 25 bp, Homo sapien
gtgggaagactcatttgagttcaga

SEQ ID NO: 84444 - DNA, 25 bp, Homo sapien
gtgggaagagtctcacttgttaatt

SEQ ID NO: 84445 - DNA, 25 bp, Homo sapien
gtgggaagattctcacttgttaatt

SEQ ID NO: 84446 - DNA, 25 bp, Homo sapien
gtgggaataacaatgcccatcatcc

SEQ ID NO: 84447 - DNA, 25 bp, Homo sapien
gtgggaatagcaatgcccatcatcc

SEQ ID NO: 84448 - DNA, 25 bp, Homo sapien
gtgggaattatgatagagattaagc

SEQ ID NO: 84449 - DNA, 25 bp, Homo sapien
gtgggaattgtgatagagattaagc

SEQ ID NO: 84450 - DNA, 25 bp, Homo sapien
gtgggacaggtgtaacaagcattgc

SEQ ID NO: 84451 - DNA, 25 bp, Homo sapien
gtgggacaggtgtaaccagcattgc

SEQ ID NO: 84452 - DNA, 25 bp, Homo sapien
gtgggaccaagtagatctagctttg

SEQ ID NO: 84453 - DNA, 25 bp, Homo sapien
gtgggaccaagtaggtctagctttg

SEQ ID NO: 84454 - DNA, 25 bp, Homo sapien
gtgggaccagagcattcaggacttt

SEQ ID NO: 84455 - DNA, 25 bp, Homo sapien
gtgggaccggagcattcaggacttt

SEQ ID NO: 84456 - DNA, 25 bp, Homo sapien
gtgggagacaggagaagaagctctg

SEQ ID NO: 84457 - DNA, 25 bp, Homo sapien
gtgggagataggagaagaagctctg

SEQ ID NO: 84458 - DNA, 25 bp, Homo sapien
gtgggagggtatcttgcatttgtct

SEQ ID NO: 84459 - DNA, 25 bp, Homo sapien
gtgggagggtattttgcatttgtct

SEQ ID NO: 84460 - DNA, 25 bp, Homo sapien
gtgggatatttttcctcttcactct

SEQ ID NO: 84461 - DNA, 25 bp, Homo sapien
gtgggatattttttctcttcactct

SEQ ID NO: 84462 - DNA, 25 bp, Homo sapien
gtgggattaggttctcctgatcatc

SEQ ID NO: 84463 - DNA, 25 bp, Homo sapien
gtgggattatgttctcctgatcatc

SEQ ID NO: 84464 - DNA, 25 bp, Homo sapien
gtgggattgaacagaaagaagctca

SEQ ID NO: 84465 - DNA, 25 bp, Homo sapien
gtgggattggacagaaagaagctca

SEQ ID NO: 84466 - DNA, 25 bp, Homo sapien
gtgggatttaaatcaaaccagtagg

SEQ ID NO: 84467 - DNA, 25 bp, Homo sapien
gtgggatttaactgaagttgacaca

SEQ ID NO: 84468 - DNA, 25 bp, Homo sapien
gtgggatttaattgaagttgacaca

SEQ ID NO: 84469 - DNA, 25 bp, Homo sapien
gtgggatttcttttaaacattggtt

SEQ ID NO: 84470 - DNA, 25 bp, Homo sapien
gtgggatttcttttaagcattggtt

SEQ ID NO: 84471 - DNA, 25 bp, Homo sapien
gtgggattttaatcaaaccagtagg

SEQ ID NO: 84472 - DNA, 25 bp, Homo sapien
gtgggcaaaaacctaccaacacagc

SEQ ID NO: 84473 - DNA, 25 bp, Homo sapien
gtgggcaaaaagctaccaacacagc

SEQ ID NO: 84474 - DNA, 25 bp, Homo sapien
gtgggcaagcccgcctagatactga

SEQ ID NO: 84475 - DNA, 25 bp, Homo sapien
gtgggcaaggccgcctagatactga

SEQ ID NO: 84476 - DNA, 25 bp, Homo sapien
gtgggcagtagtcatattaaaagtg

SEQ ID NO: 84477 - DNA, 25 bp, Homo sapien
gtgggcagtagtcgtattaaaagtg

SEQ ID NO: 84478 - DNA, 25 bp, Homo sapien
gtgggcatagctaccgtgaagggca

SEQ ID NO: 84479 - DNA, 25 bp, Homo sapien
gtgggcatagctactgtgaagggca

SEQ ID NO: 84480 - DNA, 25 bp, Homo sapien
gtgggcccttaatacttatggaatg

SEQ ID NO: 84481 - DNA, 25 bp, Homo sapien
gtgggcccttactacttatggaatg

SEQ ID NO: 84482 - DNA, 25 bp, Homo sapien
gtgggcctatgatcaagcctggcca

SEQ ID NO: 84483 - DNA, 25 bp, Homo sapien
gtgggcctatggtcaagcctggcca

SEQ ID NO: 84484 - DNA, 25 bp, Homo sapien
gtgggccttccataaaagtttgttg

SEQ ID NO: 84485 - DNA, 25 bp, Homo sapien
gtgggccttccatagaagtttgttg

SEQ ID NO: 84486 - DNA, 25 bp, Homo sapien
gtgggcctttcatatattgtctata

SEQ ID NO: 84487 - DNA, 25 bp, Homo sapien
gtgggcctttcgtatattgtctata

SEQ ID NO: 84488 - DNA, 25 bp, Homo sapien
gtgggcgatctctacaagtagaagc

SEQ ID NO: 84489 - DNA, 25 bp, Homo sapien
gtgggcgatctgtacaagtagaagc

SEQ ID NO: 84490 - DNA, 25 bp, Homo sapien
gtgggcgtctgccacacacttgcac

SEQ ID NO: 84491 - DNA, 25 bp, Homo sapien
gtgggcgtctgcctcacacttgcac

SEQ ID NO: 84492 - DNA, 25 bp, Homo sapien
gtgggctacaggatttctgtgtcaa

SEQ ID NO: 84493 - DNA, 25 bp, Homo sapien
gtgggctacagtatttctgtgtcaa

SEQ ID NO: 84494 - DNA, 25 bp, Homo sapien
gtgggctgccgacatgggtagtggc

SEQ ID NO: 84495 - DNA, 25 bp, Homo sapien
gtgggctgccgacatgtgtagtggc

SEQ ID NO: 84496 - DNA, 25 bp, Homo sapien
gtggggatcctggcttcagtacgtt

SEQ ID NO: 84497 - DNA, 25 bp, Homo sapien
gtggggatcctgggttcagtacgtt

SEQ ID NO: 84498 - DNA, 25 bp, Homo sapien
gtggggccaagaatttctagttcta

SEQ ID NO: 84499 - DNA, 25 bp, Homo sapien
gtggggccaagactttctagttcta

SEQ ID NO: 84500 - DNA, 25 bp, Homo sapien
gtggggcttctcacatgcagtccag

SEQ ID NO: 84501 - DNA, 25 bp, Homo sapien
gtggggcttttcacatgcagtccag

SEQ ID NO: 84502 - DNA, 25 bp, Homo sapien
gtgggggtgtcataatgtggtcctg

SEQ ID NO: 84503 - DNA, 25 bp, Homo sapien
gtgggggtgtcataatttggtcctg

SEQ ID NO: 84504 - DNA, 25 bp, Homo sapien
gtggggtcaattccagtatcaactg

SEQ ID NO: 84505 - DNA, 25 bp, Homo sapien
gtggggtcatttccagtatcaactg

SEQ ID NO: 84506 - DNA, 25 bp, Homo sapien
gtggggtggaagacactgaaatgaa

SEQ ID NO: 84507 - DNA, 25 bp, Homo sapien
gtggggtggaagacgctgaaatgaa

SEQ ID NO: 84508 - DNA, 25 bp, Homo sapien
gtgggtaacagtacctgctatactg

SEQ ID NO: 84509 - DNA, 25 bp, Homo sapien
gtgggtaatagtacctgctatactg

SEQ ID NO: 84510 - DNA, 25 bp, Homo sapien
gtgggtctctcactcactgccttga

SEQ ID NO: 84511 - DNA, 25 bp, Homo sapien
gtgggtctctcattcactgccttga

SEQ ID NO: 84512 - DNA, 25 bp, Homo sapien
gtgggtctggagcatccatgtggct

SEQ ID NO: 84513 - DNA, 25 bp, Homo sapien
gtgggtctggagcgtccatgtggct

SEQ ID NO: 84514 - DNA, 25 bp, Homo sapien
gtgggtctgtgtctacacataaagg

SEQ ID NO: 84515 - DNA, 25 bp, Homo sapien
gtgggtctgtgtctccacataaagg

SEQ ID NO: 84516 - DNA, 25 bp, Homo sapien
gtgggtgaaaaggacgctatgtgct

SEQ ID NO: 84517 - DNA, 25 bp, Homo sapien
gtgggtgaaaaggatgctatgtgct

SEQ ID NO: 84518 - DNA, 25 bp, Homo sapien
gtgggtgtctacttatgctaggtgt

SEQ ID NO: 84519 - DNA, 25 bp, Homo sapien
gtgggtgtctacttttgctaggtgt

SEQ ID NO: 84520 - DNA, 25 bp, Homo sapien
gtggtaaaaaccagttcagagaaat

SEQ ID NO: 84521 - DNA, 25 bp, Homo sapien
gtggtaaaaaccagttgagagaaat

SEQ ID NO: 84522 - DNA, 25 bp, Homo sapien
gtggtaaaacgagattatgtacagg

SEQ ID NO: 84523 - DNA, 25 bp, Homo sapien
gtggtaaaatgagattatgtacagg

SEQ ID NO: 84524 - DNA, 25 bp, Homo sapien
gtggtaacaacaatagagaccttaa

SEQ ID NO: 84525 - DNA, 25 bp, Homo sapien
gtggtaacagcaatagagaccttaa

SEQ ID NO: 84526 - DNA, 25 bp, Homo sapien
gtggtaataggaggtgcatctgagt

SEQ ID NO: 84527 - DNA, 25 bp, Homo sapien
gtggtaataggcggtgcatctgagt

SEQ ID NO: 84528 - DNA, 25 bp, Homo sapien
gtggtaatatgcataattttggaac

SEQ ID NO: 84529 - DNA, 25 bp, Homo sapien
gtggtaatatgcgtaattttggaac

SEQ ID NO: 84530 - DNA, 25 bp, Homo sapien
gtggtacaacgtgaagtcagtctgg

SEQ ID NO: 84531 - DNA, 25 bp, Homo sapien
gtggtacaatgtgaagtcagtctgg

SEQ ID NO: 84532 - DNA, 25 bp, Homo sapien
gtggtacagctatcattagaaacca

SEQ ID NO: 84533 - DNA, 25 bp, Homo sapien
gtggtacagttatcattagaaacca

SEQ ID NO: 84534 - DNA, 25 bp, Homo sapien
gtggtacatttgttacaagtaatgg

SEQ ID NO: 84535 - DNA, 25 bp, Homo sapien
gtggtacatttgttgcaagtaatgg

SEQ ID NO: 84536 - DNA, 25 bp, Homo sapien
gtggtactaccaaggctttgactgg

SEQ ID NO: 84537 - DNA, 25 bp, Homo sapien
gtggtactatcaaggctttgactgg

SEQ ID NO: 84538 - DNA, 25 bp, Homo sapien
gtggtactttgtatttcaatcattt

SEQ ID NO: 84539 - DNA, 25 bp, Homo sapien
gtggtactttgtattttaatcattt

SEQ ID NO: 84540 - DNA, 25 bp, Homo sapien
gtggtatctcgttgttgtaatttgc

SEQ ID NO: 84541 - DNA, 25 bp, Homo sapien
gtggtatcttgttgttgtaatttgc

SEQ ID NO: 84542 - DNA, 25 bp, Homo sapien
gtggtatgtttgcagtgacaaaagt

SEQ ID NO: 84543 - DNA, 25 bp, Homo sapien
gtggtatgtttgtagtgacaaaagt

SEQ ID NO: 84544 - DNA, 25 bp, Homo sapien
gtggtcaaaagcagaatttaaaaga

SEQ ID NO: 84545 - DNA, 25 bp, Homo sapien
gtggtcaaaagtagaatttaaaaga

SEQ ID NO: 84546 - DNA, 25 bp, Homo sapien
gtggtcaccaggaataagttgtgta

SEQ ID NO: 84547 - DNA, 25 bp, Homo sapien
gtggtcaccaggagtaagttgtgta

SEQ ID NO: 84548 - DNA, 25 bp, Homo sapien
gtggtcagatttatgcctgtagaaa

SEQ ID NO: 84549 - DNA, 25 bp, Homo sapien
gtggtcagatttatgcttgtagaaa

SEQ ID NO: 84550 - DNA, 25 bp, Homo sapien
gtggtcatctcttggttccatataa

SEQ ID NO: 84551 - DNA, 25 bp, Homo sapien
gtggtcatgtatttatggatttgtt

SEQ ID NO: 84552 - DNA, 25 bp, Homo sapien
gtggtcatgtatttgtggatttgtt

SEQ ID NO: 84553 - DNA, 25 bp, Homo sapien
gtggtcatttcttggttccatataa

SEQ ID NO: 84554 - DNA, 25 bp, Homo sapien
gtggtccacgtgctacaactgagag

SEQ ID NO: 84555 - DNA, 25 bp, Homo sapien
gtggtccatgtgctacaactgagag

SEQ ID NO: 84556 - DNA, 25 bp, Homo sapien
gtggtccggaatggcggaagtaaat

SEQ ID NO: 84557 - DNA, 25 bp, Homo sapien
gtggtccggaatggtggaagtaaat

SEQ ID NO: 84558 - DNA, 25 bp, Homo sapien
gtggtctccatacatcatcttcact

SEQ ID NO: 84559 - DNA, 25 bp, Homo sapien
gtggtctccatacctcatcttcact

SEQ ID NO: 84560 - DNA, 25 bp, Homo sapien
gtggtctgacagcttccgtggtccc

SEQ ID NO: 84561 - DNA, 25 bp, Homo sapien
gtggtctgacaggttccgtggtccc

SEQ ID NO: 84562 - DNA, 25 bp, Homo sapien
gtggtctggggataaagaataagcc

SEQ ID NO: 84563 - DNA, 25 bp, Homo sapien
gtggtctggggatacagaataagcc

SEQ ID NO: 84564 - DNA, 25 bp, Homo sapien
gtggtcttcagtaagttgtatgttg

SEQ ID NO: 84565 - DNA, 25 bp, Homo sapien
gtggtctttaaagcgatttcctgcc

SEQ ID NO: 84566 - DNA, 25 bp, Homo sapien
gtggtctttaaagtgatttcctgcc

SEQ ID NO: 84567 - DNA, 25 bp, Homo sapien
gtggtctttagtaagttgtatgttg

SEQ ID NO: 84568 - DNA, 25 bp, Homo sapien
gtggtgacaagataaaataaggaag

SEQ ID NO: 84569 - DNA, 25 bp, Homo sapien
gtggtgacaaggtaaaataaggaag

SEQ ID NO: 84570 - DNA, 25 bp, Homo sapien
gtggtgaccctgaccctaagaacca

SEQ ID NO: 84571 - DNA, 25 bp, Homo sapien
gtggtgactctgaccctaagaacca

SEQ ID NO: 84572 - DNA, 25 bp, Homo sapien
gtggtgcattactggaggtcccagc

SEQ ID NO: 84573 - DNA, 25 bp, Homo sapien
gtggtgcattacttgaggtcccagc

SEQ ID NO: 84574 - DNA, 25 bp, Homo sapien
gtggtgccattagtcaggatgacag

SEQ ID NO: 84575 - DNA, 25 bp, Homo sapien
gtggtgccgttagtcaggatgacag

SEQ ID NO: 84576 - DNA, 25 bp, Homo sapien
gtggtgctcaccttccagcaccagc

SEQ ID NO: 84577 - DNA, 25 bp, Homo sapien
gtggtgctcactttccagcaccagc

SEQ ID NO: 84578 - DNA, 25 bp, Homo sapien
gtggtgctcccagaggctcgggctc

SEQ ID NO: 84579 - DNA, 25 bp, Homo sapien
gtggtgcttccagaggctcgggctc

SEQ ID NO: 84580 - DNA, 25 bp, Homo sapien
gtggtggaacccgttctcactccag

SEQ ID NO: 84581 - DNA, 25 bp, Homo sapien
gtggtggaacctgttctcactccag

SEQ ID NO: 84582 - DNA, 25 bp, Homo sapien
gtggtggaactgaaccatctttgta

SEQ ID NO: 84583 - DNA, 25 bp, Homo sapien
gtggtggaattgaaccatctttgta

SEQ ID NO: 84584 - DNA, 25 bp, Homo sapien
gtggtggcaacacagacttgtttgg

SEQ ID NO: 84585 - DNA, 25 bp, Homo sapien
gtggtggctacacagacttgtttgg

SEQ ID NO: 84586 - DNA, 25 bp, Homo sapien
gtggtgtcattgtacgatttatacc

SEQ ID NO: 84587 - DNA, 25 bp, Homo sapien
gtggtgtcattgtatgatttatacc

SEQ ID NO: 84588 - DNA, 25 bp, Homo sapien
gtggtgtcgtcctcagcacccaggc

SEQ ID NO: 84589 - DNA, 25 bp, Homo sapien
gtggtgtcgtcttcagcacccaggc

SEQ ID NO: 84590 - DNA, 25 bp, Homo sapien
gtggtgtgaacagtatgaataaaag

SEQ ID NO: 84591 - DNA, 25 bp, Homo sapien
gtggtgtgaacagtctgaataaaag

SEQ ID NO: 84592 - DNA, 25 bp, Homo sapien
gtggtgtgcgtccaagatggtgatg

SEQ ID NO: 84593 - DNA, 25 bp, Homo sapien
gtggtgtgtgtccaagatggtgatg

SEQ ID NO: 84594 - DNA, 25 bp, Homo sapien
gtggtgttcagtctcacccattaga

SEQ ID NO: 84595 - DNA, 25 bp, Homo sapien
gtggtgttcagtttcacccattaga

SEQ ID NO: 84596 - DNA, 25 bp, Homo sapien
gtggtgtttctttgagacagagtct

SEQ ID NO: 84597 - DNA, 25 bp, Homo sapien
gtggtgttttaaacttctaaatttg

SEQ ID NO: 84598 - DNA, 25 bp, Homo sapien
gtggtgttttaaccttctaaatttg

SEQ ID NO: 84599 - DNA, 25 bp, Homo sapien
gtggtgtttttttgagacagagtct

SEQ ID NO: 84600 - DNA, 25 bp, Homo sapien
gtggttatgatcagcatgtacccgc

SEQ ID NO: 84601 - DNA, 25 bp, Homo sapien
gtggttatgatccgcatgtacccgc

SEQ ID NO: 84602 - DNA, 25 bp, Homo sapien
gtggttatggagaactcagtcatga

SEQ ID NO: 84603 - DNA, 25 bp, Homo sapien
gtggttatggagaattcagtcatga

SEQ ID NO: 84604 - DNA, 25 bp, Homo sapien
gtggttatttaagtcacccgtgaaa

SEQ ID NO: 84605 - DNA, 25 bp, Homo sapien
gtggttatttaggtcacccgtgaaa

SEQ ID NO: 84606 - DNA, 25 bp, Homo sapien
gtggttatttgattgtattgtctta

SEQ ID NO: 84607 - DNA, 25 bp, Homo sapien
gtggttatttgattgtgttgtctta

SEQ ID NO: 84608 - DNA, 25 bp, Homo sapien
gtggttcagctgatccacagtatct

SEQ ID NO: 84609 - DNA, 25 bp, Homo sapien
gtggttcagctgatccgcagtatct

SEQ ID NO: 84610 - DNA, 25 bp, Homo sapien
gtggttctcgcactcccaaagccag

SEQ ID NO: 84611 - DNA, 25 bp, Homo sapien
gtggttctgaacactggagttgaat

SEQ ID NO: 84612 - DNA, 25 bp, Homo sapien
gtggttctgaatactggagttgaat

SEQ ID NO: 84613 - DNA, 25 bp, Homo sapien
gtggttcttcataaagattgcatag

SEQ ID NO: 84614 - DNA, 25 bp, Homo sapien
gtggttcttcatagagattgcatag

SEQ ID NO: 84615 - DNA, 25 bp, Homo sapien
gtggttcttgcactcccaaagccag

SEQ ID NO: 84616 - DNA, 25 bp, Homo sapien
gtggttgaaaacgtgttaataaaga

SEQ ID NO: 84617 - DNA, 25 bp, Homo sapien
gtggttgaaaatgtgttaataaaga

SEQ ID NO: 84618 - DNA, 25 bp, Homo sapien
gtggttggttaagagaaaggtatct

SEQ ID NO: 84619 - DNA, 25 bp, Homo sapien
gtggttggttaagagacaggtatct

SEQ ID NO: 84620 - DNA, 25 bp, Homo sapien
gtggttggttcaaggtcacaccatg

SEQ ID NO: 84621 - DNA, 25 bp, Homo sapien
gtggttggttccaggtcacaccatg

SEQ ID NO: 84622 - DNA, 25 bp, Homo sapien
gtggttgtccgagtgcccaaaggac

SEQ ID NO: 84623 - DNA, 25 bp, Homo sapien
gtggttgtctgagtgcccaaaggac

SEQ ID NO: 84624 - DNA, 25 bp, Homo sapien
gtggttgtgaccatgcccgagactg

SEQ ID NO: 84625 - DNA, 25 bp, Homo sapien
gtggttgtgtccatgcccgagactg

SEQ ID NO: 84626 - DNA, 25 bp, Homo sapien
gtggtttacattggtagcttaatca

SEQ ID NO: 84627 - DNA, 25 bp, Homo sapien
gtggtttacatttgtagcttaatca

SEQ ID NO: 84628 - DNA, 25 bp, Homo sapien
gtggtttccagtttagcagtgggcc

SEQ ID NO: 84629 - DNA, 25 bp, Homo sapien
gtggtttctagtttagcagtgggcc

SEQ ID NO: 84630 - DNA, 25 bp, Homo sapien
gtggtttgagtactacctcagccac

SEQ ID NO: 84631 - DNA, 25 bp, Homo sapien
gtggtttgagtactacttcagccac

SEQ ID NO: 84632 - DNA, 25 bp, Homo sapien
gtggtttgctttatggatgagctta

SEQ ID NO: 84633 - DNA, 25 bp, Homo sapien
gtggtttgctttgtggatgagctta

SEQ ID NO: 84634 - DNA, 25 bp, Homo sapien
gtggttttaaacacgttatgtgtgc

SEQ ID NO: 84635 - DNA, 25 bp, Homo sapien
gtggttttaaacatgttatgtgtgc

SEQ ID NO: 84636 - DNA, 25 bp, Homo sapien
gtgtaaaaagaaaaaagcatcatca

SEQ ID NO: 84637 - DNA, 25 bp, Homo sapien
gtgtaaaaagataaaagcatcatca

SEQ ID NO: 84638 - DNA, 25 bp, Homo sapien
gtgtaaaagacagtattttcaacaa

SEQ ID NO: 84639 - DNA, 25 bp, Homo sapien
gtgtaaaagacattattttcaacaa

SEQ ID NO: 84640 - DNA, 25 bp, Homo sapien
gtgtaaaagatgctagaggagcata

SEQ ID NO: 84641 - DNA, 25 bp, Homo sapien
gtgtaaaagatgttagaggagcata

SEQ ID NO: 84642 - DNA, 25 bp, Homo sapien
gtgtaaaataccaggctgctctccc

SEQ ID NO: 84643 - DNA, 25 bp, Homo sapien
gtgtaaaatgccaggctgctctccc

SEQ ID NO: 84644 - DNA, 25 bp, Homo sapien
gtgtaaacataactgccattttttg

SEQ ID NO: 84645 - DNA, 25 bp, Homo sapien
gtgtaaacataattgccattttttg

SEQ ID NO: 84646 - DNA, 25 bp, Homo sapien
gtgtaaacatcaaagatcttataag

SEQ ID NO: 84647 - DNA, 25 bp, Homo sapien
gtgtaaacgtcaaagatcttataag

SEQ ID NO: 84648 - DNA, 25 bp, Homo sapien
gtgtaaacttagccggaaagcccac

SEQ ID NO: 84649 - DNA, 25 bp, Homo sapien
gtgtaaacttagctggaaagcccac

SEQ ID NO: 84650 - DNA, 25 bp, Homo sapien
gtgtaaatcattcaaatccttacta

SEQ ID NO: 84651 - DNA, 25 bp, Homo sapien
gtgtaaatcattcgaatccttacta

SEQ ID NO: 84652 - DNA, 25 bp, Homo sapien
gtgtaacttttcgggttggcatttt

SEQ ID NO: 84653 - DNA, 25 bp, Homo sapien
gtgtaactttttgggttggcatttt

SEQ ID NO: 84654 - DNA, 25 bp, Homo sapien
gtgtaagacgagtacctcttcagag

SEQ ID NO: 84655 - DNA, 25 bp, Homo sapien
gtgtaagactagtacctcttcagag

SEQ ID NO: 84656 - DNA, 25 bp, Homo sapien
gtgtaagcagattatcatcatcaga

SEQ ID NO: 84657 - DNA, 25 bp, Homo sapien
gtgtaagcagattgtcatcatcaga

SEQ ID NO: 84658 - DNA, 25 bp, Homo sapien
gtgtaagccaacgattttataccca

SEQ ID NO: 84659 - DNA, 25 bp, Homo sapien
gtgtaagccaatgattttataccca

SEQ ID NO: 84660 - DNA, 25 bp, Homo sapien
gtgtaaggaccaatgacacagagtt

SEQ ID NO: 84661 - DNA, 25 bp, Homo sapien
gtgtaaggaccgatgacacagagtt

SEQ ID NO: 84662 - DNA, 25 bp, Homo sapien
gtgtaatagcacccctagcatatct

SEQ ID NO: 84663 - DNA, 25 bp, Homo sapien
gtgtaatagcatccctagcatatct

SEQ ID NO: 84664 - DNA, 25 bp, Homo sapien
gtgtaatgaaaacaattctggtact

SEQ ID NO: 84665 - DNA, 25 bp, Homo sapien
gtgtaatgaaaataattctggtact

SEQ ID NO: 84666 - DNA, 25 bp, Homo sapien
gtgtaatgtctcatggcttttaact

SEQ ID NO: 84667 - DNA, 25 bp, Homo sapien
gtgtaatgtcttatggcttttaact

SEQ ID NO: 84668 - DNA, 25 bp, Homo sapien
gtgtaatgtgaacagagaagtgacc

SEQ ID NO: 84669 - DNA, 25 bp, Homo sapien
gtgtaatgtgaacagataagtgacc

SEQ ID NO: 84670 - DNA, 25 bp, Homo sapien
gtgtaatgtgggaagagtctcactt

SEQ ID NO: 84671 - DNA, 25 bp, Homo sapien
gtgtaatgtgggaagattctcactt

SEQ ID NO: 84672 - DNA, 25 bp, Homo sapien
gtgtaattcgcctgcctagctagga

SEQ ID NO: 84673 - DNA, 25 bp, Homo sapien
gtgtaatttgcctgcctagctagga

SEQ ID NO: 84674 - DNA, 25 bp, Homo sapien
gtgtacaacatttccctttctaata

SEQ ID NO: 84675 - DNA, 25 bp, Homo sapien
gtgtacaatatttccctttctaata

SEQ ID NO: 84676 - DNA, 25 bp, Homo sapien
gtgtacagaatattttaccacctag

SEQ ID NO: 84677 - DNA, 25 bp, Homo sapien
gtgtacagattattttaccacctag

SEQ ID NO: 84678 - DNA, 25 bp, Homo sapien
gtgtacattttcatagcttatcttt

SEQ ID NO: 84679 - DNA, 25 bp, Homo sapien
gtgtacattttgatagcttatcttt

SEQ ID NO: 84680 - DNA, 25 bp, Homo sapien
gtgtaccaatagctctatataatag

SEQ ID NO: 84681 - DNA, 25 bp, Homo sapien
gtgtaccaatagctgtatataatag

SEQ ID NO: 84682 - DNA, 25 bp, Homo sapien
gtgtaccagctagaagtaactacaa

SEQ ID NO: 84683 - DNA, 25 bp, Homo sapien
gtgtaccagctggaagtaactacaa

SEQ ID NO: 84684 - DNA, 25 bp, Homo sapien
gtgtacggcaagcatttgttagaag

SEQ ID NO: 84685 - DNA, 25 bp, Homo sapien
gtgtacggcgagcatttgttagaag

SEQ ID NO: 84686 - DNA, 25 bp, Homo sapien
gtgtacgtgactatatcttgtatag

SEQ ID NO: 84687 - DNA, 25 bp, Homo sapien
gtgtacgtgactgtatcttgtatag

SEQ ID NO: 84688 - DNA, 25 bp, Homo sapien
gtgtactaccaccaacaattcgtca

SEQ ID NO: 84689 - DNA, 25 bp, Homo sapien
gtgtactactaccaacaattcgtca

SEQ ID NO: 84690 - DNA, 25 bp, Homo sapien
gtgtactcacaatcacttaattgcc

SEQ ID NO: 84691 - DNA, 25 bp, Homo sapien
gtgtactcacattcacttaattgcc

SEQ ID NO: 84692 - DNA, 25 bp, Homo sapien
gtgtactcatacacttgacaacatg

SEQ ID NO: 84693 - DNA, 25 bp, Homo sapien
gtgtactcatagacttgacaacatg

SEQ ID NO: 84694 - DNA, 25 bp, Homo sapien
gtgtactgttaacgagcagtaatct

SEQ ID NO: 84695 - DNA, 25 bp, Homo sapien
gtgtactgttaatgagcagtaatct

SEQ ID NO: 84696 - DNA, 25 bp, Homo sapien
gtgtagaactgataatatggacttt

SEQ ID NO: 84697 - DNA, 25 bp, Homo sapien
gtgtagaattgataatatggacttt

SEQ ID NO: 84698 - DNA, 25 bp, Homo sapien
gtgtagaatttatagactcctcaga

SEQ ID NO: 84699 - DNA, 25 bp, Homo sapien
gtgtagaatttgtagactcctcaga

SEQ ID NO: 84700 - DNA, 25 bp, Homo sapien
gtgtagattcagcctgagcctaaag

SEQ ID NO: 84701 - DNA, 25 bp, Homo sapien
gtgtagattcagcctgggcctaaag

SEQ ID NO: 84702 - DNA, 25 bp, Homo sapien
gtgtagcattttttaaagtctgtta

SEQ ID NO: 84703 - DNA, 25 bp, Homo sapien
gtgtagcatttttttaagtctgtta

SEQ ID NO: 84704 - DNA, 25 bp, Homo sapien
gtgtagcgcttcccgctttgttctc

SEQ ID NO: 84705 - DNA, 25 bp, Homo sapien
gtgtagcgcttcctgctttgttctc

SEQ ID NO: 84706 - DNA, 25 bp, Homo sapien
gtgtagcttaaagaatataaaatca

SEQ ID NO: 84707 - DNA, 25 bp, Homo sapien
gtgtagcttaaagactataaaatca

SEQ ID NO: 84708 - DNA, 25 bp, Homo sapien
gtgtaggctaagcctctgtttggta

SEQ ID NO: 84709 - DNA, 25 bp, Homo sapien
gtgtaggctaagcttctgtttggta

SEQ ID NO: 84710 - DNA, 25 bp, Homo sapien
gtgtagggttgctttgaagtattct

SEQ ID NO: 84711 - DNA, 25 bp, Homo sapien
gtgtagggttgctttgcagtattct

SEQ ID NO: 84712 - DNA, 25 bp, Homo sapien
gtgtagttggcttactcaaagcaga

SEQ ID NO: 84713 - DNA, 25 bp, Homo sapien
gtgtagttggcttattcaaagcaga

SEQ ID NO: 84714 - DNA, 25 bp, Homo sapien
gtgtatacatccacactcgttttct

SEQ ID NO: 84715 - DNA, 25 bp, Homo sapien
gtgtatacatccgcactcgttttct

SEQ ID NO: 84716 - DNA, 25 bp, Homo sapien
gtgtatagcagtgcagttaatttgt

SEQ ID NO: 84717 - DNA, 25 bp, Homo sapien
gtgtatagcagtgctgttaatttgt

SEQ ID NO: 84718 - DNA, 25 bp, Homo sapien
gtgtatagccagcaggatgaattta

SEQ ID NO: 84719 - DNA, 25 bp, Homo sapien
gtgtatagccagtaggatgaattta

SEQ ID NO: 84720 - DNA, 25 bp, Homo sapien
gtgtatatgtctacgcattcttgta

SEQ ID NO: 84721 - DNA, 25 bp, Homo sapien
gtgtatatgtctatgcattcttgta

SEQ ID NO: 84722 - DNA, 25 bp, Homo sapien
gtgtatattatccatcattatggca

SEQ ID NO: 84723 - DNA, 25 bp, Homo sapien
gtgtatattatccatctttatggca

SEQ ID NO: 84724 - DNA, 25 bp, Homo sapien
gtgtatccaccagtagtcacttccc

SEQ ID NO: 84725 - DNA, 25 bp, Homo sapien
gtgtatccaccggtagtcacttccc

SEQ ID NO: 84726 - DNA, 25 bp, Homo sapien
gtgtatcgattcctattgactttat

SEQ ID NO: 84727 - DNA, 25 bp, Homo sapien
gtgtatcgattcttattgactttat

SEQ ID NO: 84728 - DNA, 25 bp, Homo sapien
gtgtatctgtgtattgcactaaatg

SEQ ID NO: 84729 - DNA, 25 bp, Homo sapien
gtgtatctgtgtattgtactaaatg

SEQ ID NO: 84730 - DNA, 25 bp, Homo sapien
gtgtatgaaattctgaaggaagggc

SEQ ID NO: 84731 - DNA, 25 bp, Homo sapien
gtgtatgaagttctgaaggaagggc

SEQ ID NO: 84732 - DNA, 25 bp, Homo sapien
gtgtatgtgcaacctaaaaatctga

SEQ ID NO: 84733 - DNA, 25 bp, Homo sapien
gtgtatgtgtaacctaaaaatctga

SEQ ID NO: 84734 - DNA, 25 bp, Homo sapien
gtgtattaatggcactaatttttgt

SEQ ID NO: 84735 - DNA, 25 bp, Homo sapien
gtgtattaatggtactaatttttgt

SEQ ID NO: 84736 - DNA, 25 bp, Homo sapien
gtgtattattgcataaggtagtgta

SEQ ID NO: 84737 - DNA, 25 bp, Homo sapien
gtgtattattgcgtaaggtagtgta

SEQ ID NO: 84738 - DNA, 25 bp, Homo sapien
gtgtattcatccaagtccttgagtg

SEQ ID NO: 84739 - DNA, 25 bp, Homo sapien
gtgtattcatccaagtgcttgagtg

SEQ ID NO: 84740 - DNA, 25 bp, Homo sapien
gtgtatttaaacgtttccattatta

SEQ ID NO: 84741 - DNA, 25 bp, Homo sapien
gtgtatttaaatgtttccattatta

SEQ ID NO: 84742 - DNA, 25 bp, Homo sapien
gtgtcaaaaaccgatgatgacatta

SEQ ID NO: 84743 - DNA, 25 bp, Homo sapien
gtgtcaaaacccgatgatgacatta

SEQ ID NO: 84744 - DNA, 25 bp, Homo sapien
gtgtcaaaatcacacttaaactgaa

SEQ ID NO: 84745 - DNA, 25 bp, Homo sapien
gtgtcaaaatcgcacttaaactgaa

SEQ ID NO: 84746 - DNA, 25 bp, Homo sapien
gtgtcaacactgtactatgcgtctg

SEQ ID NO: 84747 - DNA, 25 bp, Homo sapien
gtgtcaacactgtactgtgcgtctg

SEQ ID NO: 84748 - DNA, 25 bp, Homo sapien
gtgtcaacagaatgcacggtcccaa

SEQ ID NO: 84749 - DNA, 25 bp, Homo sapien
gtgtcaacagaatgcatggtcccaa

SEQ ID NO: 84750 - DNA, 25 bp, Homo sapien
gtgtcaatattagttcaccaactgc

SEQ ID NO: 84751 - DNA, 25 bp, Homo sapien
gtgtcaatatttgttcaccaactgc

SEQ ID NO: 84752 - DNA, 25 bp, Homo sapien
gtgtcaatccaccagaatttagggc

SEQ ID NO: 84753 - DNA, 25 bp, Homo sapien
gtgtcaatccaccggaatttagggc

SEQ ID NO: 84754 - DNA, 25 bp, Homo sapien
gtgtcacacaaattcatctttgcct

SEQ ID NO: 84755 - DNA, 25 bp, Homo sapien
gtgtcacacaagttcatctttgcct

SEQ ID NO: 84756 - DNA, 25 bp, Homo sapien
gtgtcaccatcaatgcagtcgaggt

SEQ ID NO: 84757 - DNA, 25 bp, Homo sapien
gtgtcaccatcagtgcagtcgaggt

SEQ ID NO: 84758 - DNA, 25 bp, Homo sapien
gtgtcaccatgcttggctaactttt

SEQ ID NO: 84759 - DNA, 25 bp, Homo sapien
gtgtcaccatgcttgggtaactttt

SEQ ID NO: 84760 - DNA, 25 bp, Homo sapien
gtgtcactgcagccagatccctaac

SEQ ID NO: 84761 - DNA, 25 bp, Homo sapien
gtgtcactgcagccggatccctaac

SEQ ID NO: 84762 - DNA, 25 bp, Homo sapien
gtgtcagacatacattgcagcatga

SEQ ID NO: 84763 - DNA, 25 bp, Homo sapien
gtgtcagacatgcattgcagcatga

SEQ ID NO: 84764 - DNA, 25 bp, Homo sapien
gtgtcagcatgtgaccttatttgga

SEQ ID NO: 84765 - DNA, 25 bp, Homo sapien
gtgtcagcctactattgccaggtag

SEQ ID NO: 84766 - DNA, 25 bp, Homo sapien
gtgtcagcctactgttgccaggtag

SEQ ID NO: 84767 - DNA, 25 bp, Homo sapien
gtgtcagcgtgtgaccttatttgga

SEQ ID NO: 84768 - DNA, 25 bp, Homo sapien
gtgtcaggtgagtgaaatgataggc

SEQ ID NO: 84769 - DNA, 25 bp, Homo sapien
gtgtcaggtgagtggaatgataggc

SEQ ID NO: 84770 - DNA, 25 bp, Homo sapien
gtgtcagtctctctgaacttcaatt

SEQ ID NO: 84771 - DNA, 25 bp, Homo sapien
gtgtcagtttctctgaacttcaatt

SEQ ID NO: 84772 - DNA, 25 bp, Homo sapien
gtgtcatataccaatgtcattcttt

SEQ ID NO: 84773 - DNA, 25 bp, Homo sapien
gtgtcatataccagtgtcattcttt

SEQ ID NO: 84774 - DNA, 25 bp, Homo sapien
gtgtcatgtctgtgtccagatgtcc

SEQ ID NO: 84775 - DNA, 25 bp, Homo sapien
gtgtcatgtctttgtccagatgtcc

SEQ ID NO: 84776 - DNA, 25 bp, Homo sapien
gtgtcattgacatggcaagacttca

SEQ ID NO: 84777 - DNA, 25 bp, Homo sapien
gtgtcattgacttggcaagacttca

SEQ ID NO: 84778 - DNA, 25 bp, Homo sapien
gtgtcattgcaacagtaaattcaaa

SEQ ID NO: 84779 - DNA, 25 bp, Homo sapien
gtgtcattgcaatagtaaattcaaa

SEQ ID NO: 84780 - DNA, 25 bp, Homo sapien
gtgtcattgtacgatttatacctga

SEQ ID NO: 84781 - DNA, 25 bp, Homo sapien
gtgtcattgtatgatttatacctga

SEQ ID NO: 84782 - DNA, 25 bp, Homo sapien
gtgtccaacctctttgctcattaaa

SEQ ID NO: 84783 - DNA, 25 bp, Homo sapien
gtgtccaatctctttgctcattaaa

SEQ ID NO: 84784 - DNA, 25 bp, Homo sapien
gtgtccagcaatggataaggatgtg

SEQ ID NO: 84785 - DNA, 25 bp, Homo sapien
gtgtccaggaatggataaggatgtg

SEQ ID NO: 84786 - DNA, 25 bp, Homo sapien
gtgtccaggagctggctgagtaggg

SEQ ID NO: 84787 - DNA, 25 bp, Homo sapien
gtgtccaggcgctggctgagtaggg

SEQ ID NO: 84788 - DNA, 25 bp, Homo sapien
gtgtccatttactatgttgttggct

SEQ ID NO: 84789 - DNA, 25 bp, Homo sapien
gtgtccatttagtatgttgttggct

SEQ ID NO: 84790 - DNA, 25 bp, Homo sapien
gtgtcctactgtgaagattttgcct

SEQ ID NO: 84791 - DNA, 25 bp, Homo sapien
gtgtcctactgtgacgattttgcct

SEQ ID NO: 84792 - DNA, 25 bp, Homo sapien
gtgtcctctgaattatattggtcta

SEQ ID NO: 84793 - DNA, 25 bp, Homo sapien
gtgtcctctgaattatgttggtcta

SEQ ID NO: 84794 - DNA, 25 bp, Homo sapien
gtgtcctgaaaactcactctcaata

SEQ ID NO: 84795 - DNA, 25 bp, Homo sapien
gtgtcctgaagaaatgacgaccagt

SEQ ID NO: 84796 - DNA, 25 bp, Homo sapien
gtgtcctgacaactcactctcaata

SEQ ID NO: 84797 - DNA, 25 bp, Homo sapien
gtgtcctgcagaaatgacgaccagt

SEQ ID NO: 84798 - DNA, 25 bp, Homo sapien
gtgtcctggagatcagcgtggatga

SEQ ID NO: 84799 - DNA, 25 bp, Homo sapien
gtgtcctggagatcagtgtggatga

SEQ ID NO: 84800 - DNA, 25 bp, Homo sapien
gtgtccttgggaaacttgctgtgtg

SEQ ID NO: 84801 - DNA, 25 bp, Homo sapien
gtgtccttgggcaacttgctgtgtg

SEQ ID NO: 84802 - DNA, 25 bp, Homo sapien
gtgtcgccaaaaactacgtactctt

SEQ ID NO: 84803 - DNA, 25 bp, Homo sapien
gtgtcgccaaaaactatgtactctt

SEQ ID NO: 84804 - DNA, 25 bp, Homo sapien
gtgtcgtcctcagcacccaggccaa

SEQ ID NO: 84805 - DNA, 25 bp, Homo sapien
gtgtcgtcttcagcacccaggccaa

SEQ ID NO: 84806 - DNA, 25 bp, Homo sapien
gtgtctactatgtaacagataatta

SEQ ID NO: 84807 - DNA, 25 bp, Homo sapien
gtgtctactatgtatcagataatta

SEQ ID NO: 84808 - DNA, 25 bp, Homo sapien
gtgtctaggttaaacaactcaagta

SEQ ID NO: 84809 - DNA, 25 bp, Homo sapien
gtgtctaggttaagcaactcaagta

SEQ ID NO: 84810 - DNA, 25 bp, Homo sapien
gtgtctccacaccacagctgtagcc

SEQ ID NO: 84811 - DNA, 25 bp, Homo sapien
gtgtctccacacctcagctgtagcc

SEQ ID NO: 84812 - DNA, 25 bp, Homo sapien
gtgtctccctcaggcatgtgacttt

SEQ ID NO: 84813 - DNA, 25 bp, Homo sapien
gtgtctccctcagggatgtgacttt

SEQ ID NO: 84814 - DNA, 25 bp, Homo sapien
gtgtctctgaggagctaccatttga

SEQ ID NO: 84815 - DNA, 25 bp, Homo sapien
gtgtctctgaggagttaccatttga

SEQ ID NO: 84816 - DNA, 25 bp, Homo sapien
gtgtctgaaattaacgggacatgga

SEQ ID NO: 84817 - DNA, 25 bp, Homo sapien
gtgtctgaaattaatgggacatgga

SEQ ID NO: 84818 - DNA, 25 bp, Homo sapien
gtgtctgaaggctgcacataggttg

SEQ ID NO: 84819 - DNA, 25 bp, Homo sapien
gtgtctgagctatgagaaatcccgg

SEQ ID NO: 84820 - DNA, 25 bp, Homo sapien
gtgtctgagctgtgagaaatcccgg

SEQ ID NO: 84821 - DNA, 25 bp, Homo sapien
gtgtctgagggctgcacataggttg

SEQ ID NO: 84822 - DNA, 25 bp, Homo sapien
gtgtctggcacagaacaagcactcg

SEQ ID NO: 84823 - DNA, 25 bp, Homo sapien
gtgtctggcacagcacaagcactcg

SEQ ID NO: 84824 - DNA, 25 bp, Homo sapien
gtgtctggtccgctacagtgagaat

SEQ ID NO: 84825 - DNA, 25 bp, Homo sapien
gtgtctggtcctctacagtgagaat

SEQ ID NO: 84826 - DNA, 25 bp, Homo sapien
gtgtctggtttctatcacttagcac

SEQ ID NO: 84827 - DNA, 25 bp, Homo sapien
gtgtctggtttctgtcacttagcac

SEQ ID NO: 84828 - DNA, 25 bp, Homo sapien
gtgtcttaattatcgtagctatata

SEQ ID NO: 84829 - DNA, 25 bp, Homo sapien
gtgtcttaattattgtagctatata

SEQ ID NO: 84830 - DNA, 25 bp, Homo sapien
gtgtcttataattcagctctaacac

SEQ ID NO: 84831 - DNA, 25 bp, Homo sapien
gtgtcttataattcggctctaacac

SEQ ID NO: 84832 - DNA, 25 bp, Homo sapien
gtgtctttcgtccagccaggcttat

SEQ ID NO: 84833 - DNA, 25 bp, Homo sapien
gtgtctttcgtctagccaggcttat

SEQ ID NO: 84834 - DNA, 25 bp, Homo sapien
gtgtcttttgctggttaatgagatg

SEQ ID NO: 84835 - DNA, 25 bp, Homo sapien
gtgtcttttgcttgttaatgagatg

SEQ ID NO: 84836 - DNA, 25 bp, Homo sapien
gtgtgaaagtagagtaataatgatc

SEQ ID NO: 84837 - DNA, 25 bp, Homo sapien
gtgtgaaatataattgctaaatatg

SEQ ID NO: 84838 - DNA, 25 bp, Homo sapien
gtgtgaaatataattgttaaatatg

SEQ ID NO: 84839 - DNA, 25 bp, Homo sapien
gtgtgaaatatggcagtttgcatga

SEQ ID NO: 84840 - DNA, 25 bp, Homo sapien
gtgtgaaatatggcggtttgcatga

SEQ ID NO: 84841 - DNA, 25 bp, Homo sapien
gtgtgaaatgacccaaaagataaga

SEQ ID NO: 84842 - DNA, 25 bp, Homo sapien
gtgtgaaatgaccgaaaagataaga

SEQ ID NO: 84843 - DNA, 25 bp, Homo sapien
gtgtgaaattagagtaataatgatc

SEQ ID NO: 84844 - DNA, 25 bp, Homo sapien
gtgtgaatgaagaaacatttaagat

SEQ ID NO: 84845 - DNA, 25 bp, Homo sapien
gtgtgaatgaagagacatttaagat

SEQ ID NO: 84846 - DNA, 25 bp, Homo sapien
gtgtgacacttcataagcatcaaag

SEQ ID NO: 84847 - DNA, 25 bp, Homo sapien
gtgtgacagttcataagcatcaaag

SEQ ID NO: 84848 - DNA, 25 bp, Homo sapien
gtgtgaccattttcctgggccaggg

SEQ ID NO: 84849 - DNA, 25 bp, Homo sapien
gtgtgaccatttttctgggccaggg

SEQ ID NO: 84850 - DNA, 25 bp, Homo sapien
gtgtgactcatttgcatatcggaga

SEQ ID NO: 84851 - DNA, 25 bp, Homo sapien
gtgtgactcgtttgcatatcggaga

SEQ ID NO: 84852 - DNA, 25 bp, Homo sapien
gtgtgactgaacggtactgtgaaac

SEQ ID NO: 84853 - DNA, 25 bp, Homo sapien
gtgtgactgaatggtactgtgaaac

SEQ ID NO: 84854 - DNA, 25 bp, Homo sapien
gtgtgagccctaaatgacatcatgt

SEQ ID NO: 84855 - DNA, 25 bp, Homo sapien
gtgtgagccctaaatgtcatcatgt

SEQ ID NO: 84856 - DNA, 25 bp, Homo sapien
gtgtgaggtagctgacatcatggtg

SEQ ID NO: 84857 - DNA, 25 bp, Homo sapien
gtgtgaggtagctgccatcatggtg

SEQ ID NO: 84858 - DNA, 25 bp, Homo sapien
gtgtgagtctgagaaagtcagttcc

SEQ ID NO: 84859 - DNA, 25 bp, Homo sapien
gtgtgagtctgggaaagtcagttcc

SEQ ID NO: 84860 - DNA, 25 bp, Homo sapien
gtgtgatactgagataaggataaac

SEQ ID NO: 84861 - DNA, 25 bp, Homo sapien
gtgtgatactgagatagggataaac

SEQ ID NO: 84862 - DNA, 25 bp, Homo sapien
gtgtgatatgtttgttatgtatatg

SEQ ID NO: 84863 - DNA, 25 bp, Homo sapien
gtgtgatatttttgttatgtatatg

SEQ ID NO: 84864 - DNA, 25 bp, Homo sapien
gtgtgatgttccaatgaaaacagac

SEQ ID NO: 84865 - DNA, 25 bp, Homo sapien
gtgtgatgttccagtgaaaacagac

SEQ ID NO: 84866 - DNA, 25 bp, Homo sapien
gtgtgattaaagtgggctcacctgg

SEQ ID NO: 84867 - DNA, 25 bp, Homo sapien
gtgtgattctggatacattttgaaa

SEQ ID NO: 84868 - DNA, 25 bp, Homo sapien
gtgtgattctggatacgttttgaaa

SEQ ID NO: 84869 - DNA, 25 bp, Homo sapien
gtgtgattgaagtgggctcacctgg

SEQ ID NO: 84870 - DNA, 25 bp, Homo sapien
gtgtgattgttttatacgactttga

SEQ ID NO: 84871 - DNA, 25 bp, Homo sapien
gtgtgattgttttatatgactttga

SEQ ID NO: 84872 - DNA, 25 bp, Homo sapien
gtgtgcaacaggactttggcttatg

SEQ ID NO: 84873 - DNA, 25 bp, Homo sapien
gtgtgcaataggactttggcttatg

SEQ ID NO: 84874 - DNA, 25 bp, Homo sapien
gtgtgcataatctcttccagatcct

SEQ ID NO: 84875 - DNA, 25 bp, Homo sapien
gtgtgcatattctcttccagatcct

SEQ ID NO: 84876 - DNA, 25 bp, Homo sapien
gtgtgcatgacagatcattctctaa

SEQ ID NO: 84877 - DNA, 25 bp, Homo sapien
gtgtgcatgacagatcgttctctaa

SEQ ID NO: 84878 - DNA, 25 bp, Homo sapien
gtgtgcatgtatcatctgtttacat

SEQ ID NO: 84879 - DNA, 25 bp, Homo sapien
gtgtgcatgtatgatctgtttacat

SEQ ID NO: 84880 - DNA, 25 bp, Homo sapien
gtgtgcccactttcctttgtttaac

SEQ ID NO: 84881 - DNA, 25 bp, Homo sapien
gtgtgcccgctttcctttgtttaac

SEQ ID NO: 84882 - DNA, 25 bp, Homo sapien
gtgtgcctgcaattggagggatgtg

SEQ ID NO: 84883 - DNA, 25 bp, Homo sapien
gtgtgcctgtaattggagggatgtg

SEQ ID NO: 84884 - DNA, 25 bp, Homo sapien
gtgtgcgaacaaaacaaattaggaa

SEQ ID NO: 84885 - DNA, 25 bp, Homo sapien
gtgtgcgaacaaaccaaattaggaa

SEQ ID NO: 84886 - DNA, 25 bp, Homo sapien
gtgtgcgttaacacgtaatttagta

SEQ ID NO: 84887 - DNA, 25 bp, Homo sapien
gtgtgcgttaacatgtaatttagta

SEQ ID NO: 84888 - DNA, 25 bp, Homo sapien
gtgtgctccagtaaatttcctgcat

SEQ ID NO: 84889 - DNA, 25 bp, Homo sapien
gtgtgctccctgactggcaatcctt

SEQ ID NO: 84890 - DNA, 25 bp, Homo sapien
gtgtgctccggtaaatttcctgcat

SEQ ID NO: 84891 - DNA, 25 bp, Homo sapien
gtgtgctctactcccaggagtcctt

SEQ ID NO: 84892 - DNA, 25 bp, Homo sapien
gtgtgctctactcgcaggagtcctt

SEQ ID NO: 84893 - DNA, 25 bp, Homo sapien
gtgtgctctctgactggcaatcctt

SEQ ID NO: 84894 - DNA, 25 bp, Homo sapien
gtgtgctgatctgatacagaaaact

SEQ ID NO: 84895 - DNA, 25 bp, Homo sapien
gtgtgctgatctgatagagaaaact

SEQ ID NO: 84896 - DNA, 25 bp, Homo sapien
gtgtgcttaaatgatgcgggctcat

SEQ ID NO: 84897 - DNA, 25 bp, Homo sapien
gtgtgcttaaatggtgcgggctcat

SEQ ID NO: 84898 - DNA, 25 bp, Homo sapien
gtgtgctttctcacagtaaatcaag

SEQ ID NO: 84899 - DNA, 25 bp, Homo sapien
gtgtgctttctcacggtaaatcaag

SEQ ID NO: 84900 - DNA, 25 bp, Homo sapien
gtgtggacagctcatcaataacaca

SEQ ID NO: 84901 - DNA, 25 bp, Homo sapien
gtgtggacagctcgtcaataacaca

SEQ ID NO: 84902 - DNA, 25 bp, Homo sapien
gtgtggagagaatttttatgggcag

SEQ ID NO: 84903 - DNA, 25 bp, Homo sapien
gtgtggagagactttttatgggcag

SEQ ID NO: 84904 - DNA, 25 bp, Homo sapien
gtgtggaggcacgcatatgcggtag

SEQ ID NO: 84905 - DNA, 25 bp, Homo sapien
gtgtggaggcacgcatgtgcggtag

SEQ ID NO: 84906 - DNA, 25 bp, Homo sapien
gtgtggagggtgtaaacagtacctg

SEQ ID NO: 84907 - DNA, 25 bp, Homo sapien
gtgtggagggtgtaaatagtacctg

SEQ ID NO: 84908 - DNA, 25 bp, Homo sapien
gtgtggatcatgcgtgtcatattga

SEQ ID NO: 84909 - DNA, 25 bp, Homo sapien
gtgtggatcatgcttgtcatattga

SEQ ID NO: 84910 - DNA, 25 bp, Homo sapien
gtgtggatccaatggtcacccttta

SEQ ID NO: 84911 - DNA, 25 bp, Homo sapien
gtgtggatccaatggtgacccttta

SEQ ID NO: 84912 - DNA, 25 bp, Homo sapien
gtgtggctgctgcaatattaagttc

SEQ ID NO: 84913 - DNA, 25 bp, Homo sapien
gtgtggctgctgcagtattaagttc

SEQ ID NO: 84914 - DNA, 25 bp, Homo sapien
gtgtggcttaggttctagtggtaca

SEQ ID NO: 84915 - DNA, 25 bp, Homo sapien
gtgtggcttaggttctggtggtaca

SEQ ID NO: 84916 - DNA, 25 bp, Homo sapien
gtgtggcttcaaacgtaaatgtccc

SEQ ID NO: 84917 - DNA, 25 bp, Homo sapien
gtgtggcttcaaatgtaaatgtccc

SEQ ID NO: 84918 - DNA, 25 bp, Homo sapien
gtgtgggcactaatccctttagatc

SEQ ID NO: 84919 - DNA, 25 bp, Homo sapien
gtgtgggcactactccctttagatc

SEQ ID NO: 84920 - DNA, 25 bp, Homo sapien
gtgtgggttttctgggagttcaaag

SEQ ID NO: 84921 - DNA, 25 bp, Homo sapien
gtgtgggttttttgggagttcaaag

SEQ ID NO: 84922 - DNA, 25 bp, Homo sapien
gtgtggtacaacgtgaagtcagtct

SEQ ID NO: 84923 - DNA, 25 bp, Homo sapien
gtgtggtacaatgtgaagtcagtct

SEQ ID NO: 84924 - DNA, 25 bp, Homo sapien
gtgtggtacatttgttacaagtaat

SEQ ID NO: 84925 - DNA, 25 bp, Homo sapien
gtgtggtacatttgttgcaagtaat

SEQ ID NO: 84926 - DNA, 25 bp, Homo sapien
gtgtggtttacattggtagcttaat

SEQ ID NO: 84927 - DNA, 25 bp, Homo sapien
gtgtggtttacatttgtagcttaat

SEQ ID NO: 84928 - DNA, 25 bp, Homo sapien
gtgtgtaaaagatgctagaggagca

SEQ ID NO: 84929 - DNA, 25 bp, Homo sapien
gtgtgtaaaagatgttagaggagca

SEQ ID NO: 84930 - DNA, 25 bp, Homo sapien
gtgtgtaaacactctcaatttccca

SEQ ID NO: 84931 - DNA, 25 bp, Homo sapien
gtgtgtaaacactctccatttccca

SEQ ID NO: 84932 - DNA, 25 bp, Homo sapien
gtgtgtaacttttcgggttggcatt

SEQ ID NO: 84933 - DNA, 25 bp, Homo sapien
gtgtgtaactttttgggttggcatt

SEQ ID NO: 84934 - DNA, 25 bp, Homo sapien
gtgtgtacaaattgtgggaagaatt

SEQ ID NO: 84935 - DNA, 25 bp, Homo sapien
gtgtgtacatattgtgggaagaatt

SEQ ID NO: 84936 - DNA, 25 bp, Homo sapien
gtgtgtacggcaagcatttgttaga

SEQ ID NO: 84937 - DNA, 25 bp, Homo sapien
gtgtgtacggcgagcatttgttaga

SEQ ID NO: 84938 - DNA, 25 bp, Homo sapien
gtgtgtacgtgactatatcttgtat

SEQ ID NO: 84939 - DNA, 25 bp, Homo sapien
gtgtgtacgtgactgtatcttgtat

SEQ ID NO: 84940 - DNA, 25 bp, Homo sapien
gtgtgtagtggtatctcgttgttgt

SEQ ID NO: 84941 - DNA, 25 bp, Homo sapien
gtgtgtagtggtatcttgttgttgt

SEQ ID NO: 84942 - DNA, 25 bp, Homo sapien
gtgtgtatgctttgaactgcaattc

SEQ ID NO: 84943 - DNA, 25 bp, Homo sapien
gtgtgtattctttgaactgcaattc

SEQ ID NO: 84944 - DNA, 25 bp, Homo sapien
gtgtgtcatccaatcataacaggac

SEQ ID NO: 84945 - DNA, 25 bp, Homo sapien
gtgtgtcatccagtcataacaggac

SEQ ID NO: 84946 - DNA, 25 bp, Homo sapien
gtgtgtctcagtcgaatggccaaat

SEQ ID NO: 84947 - DNA, 25 bp, Homo sapien
gtgtgtctcagttgaatggccaaat

SEQ ID NO: 84948 - DNA, 25 bp, Homo sapien
gtgtgtctgaaattaacgggacatg

SEQ ID NO: 84949 - DNA, 25 bp, Homo sapien
gtgtgtctgaaattaatgggacatg

SEQ ID NO: 84950 - DNA, 25 bp, Homo sapien
gtgtgtctgtcacgaacccagtcag

SEQ ID NO: 84951 - DNA, 25 bp, Homo sapien
gtgtgtctgtcatgaacccagtcag

SEQ ID NO: 84952 - DNA, 25 bp, Homo sapien
gtgtgtcttctctggaaatgtgtct

SEQ ID NO: 84953 - DNA, 25 bp, Homo sapien
gtgtgtcttctttggaaatgtgtct

SEQ ID NO: 84954 - DNA, 25 bp, Homo sapien
gtgtgtgaggtagctgacatcatgg

SEQ ID NO: 84955 - DNA, 25 bp, Homo sapien
gtgtgtgaggtagctgccatcatgg

SEQ ID NO: 84956 - DNA, 25 bp, Homo sapien
gtgtgtgccatgaaaaattctgaga

SEQ ID NO: 84957 - DNA, 25 bp, Homo sapien
gtgtgtgccatgaaaagttctgaga

SEQ ID NO: 84958 - DNA, 25 bp, Homo sapien
gtgtgtgccctacgcaaatgaaaag

SEQ ID NO: 84959 - DNA, 25 bp, Homo sapien
gtgtgtgccctatgcaaatgaaaag

SEQ ID NO: 84960 - DNA, 25 bp, Homo sapien
gtgtgtgcctccatattttagcaga

SEQ ID NO: 84961 - DNA, 25 bp, Homo sapien
gtgtgtgcctccgtattttagcaga

SEQ ID NO: 84962 - DNA, 25 bp, Homo sapien
gtgtgtgctgaaaagatgggacaaa

SEQ ID NO: 84963 - DNA, 25 bp, Homo sapien
gtgtgtgctgaagagatgggacaaa

SEQ ID NO: 84964 - DNA, 25 bp, Homo sapien
gtgtgttaaaacgctgcaatgaaga

SEQ ID NO: 84965 - DNA, 25 bp, Homo sapien
gtgtgttaaaatgctgcaatgaaga

SEQ ID NO: 84966 - DNA, 25 bp, Homo sapien
gtgtgttatttccatcatttttctc

SEQ ID NO: 84967 - DNA, 25 bp, Homo sapien
gtgtgttatttcgatcatttttctc

SEQ ID NO: 84968 - DNA, 25 bp, Homo sapien
gtgtgtttataccatcttttcctgg

SEQ ID NO: 84969 - DNA, 25 bp, Homo sapien
gtgtgtttatacgatcttttcctgg

SEQ ID NO: 84970 - DNA, 25 bp, Homo sapien
gtgtgtttcctggaaatgccaggga

SEQ ID NO: 84971 - DNA, 25 bp, Homo sapien
gtgtgtttgtacatgtatcttgttg

SEQ ID NO: 84972 - DNA, 25 bp, Homo sapien
gtgtgtttgtacgtgtatcttgttg

SEQ ID NO: 84973 - DNA, 25 bp, Homo sapien
gtgtgttttctggaaatgccaggga

SEQ ID NO: 84974 - DNA, 25 bp, Homo sapien
gtgttaaaacgctgcaatgaagaat

SEQ ID NO: 84975 - DNA, 25 bp, Homo sapien
gtgttaaaatgctgcaatgaagaat

SEQ ID NO: 84976 - DNA, 25 bp, Homo sapien
gtgttaatcatttacacaagcatgg

SEQ ID NO: 84977 - DNA, 25 bp, Homo sapien
gtgttaatcgtttacacaagcatgg

SEQ ID NO: 84978 - DNA, 25 bp, Homo sapien
gtgttaccataaaggacaactgatt

SEQ ID NO: 84979 - DNA, 25 bp, Homo sapien
gtgttaccatcctgccattcagagg

SEQ ID NO: 84980 - DNA, 25 bp, Homo sapien
gtgttaccatcctgccgttcagagg

SEQ ID NO: 84981 - DNA, 25 bp, Homo sapien
gtgttaccgtaaaggacaactgatt

SEQ ID NO: 84982 - DNA, 25 bp, Homo sapien
gtgttactattcggccttttacaga

SEQ ID NO: 84983 - DNA, 25 bp, Homo sapien
gtgttactatttggccttttacaga

SEQ ID NO: 84984 - DNA, 25 bp, Homo sapien
gtgttactccaaattgctggcttca

SEQ ID NO: 84985 - DNA, 25 bp, Homo sapien
gtgttactctaaattgctggcttca

SEQ ID NO: 84986 - DNA, 25 bp, Homo sapien
gtgttagagtccagagatcatgggc

SEQ ID NO: 84987 - DNA, 25 bp, Homo sapien
gtgttagagtcgagagatcatgggc

SEQ ID NO: 84988 - DNA, 25 bp, Homo sapien
gtgttagctcctataggatttaggt

SEQ ID NO: 84989 - DNA, 25 bp, Homo sapien
gtgttagcttctataggatttaggt

SEQ ID NO: 84990 - DNA, 25 bp, Homo sapien
gtgttaggcaaggcaacctcaatta

SEQ ID NO: 84991 - DNA, 25 bp, Homo sapien
gtgttaggcgaggcaacctcaatta

SEQ ID NO: 84992 - DNA, 25 bp, Homo sapien
gtgttatctgaacaagcaaaaccta

SEQ ID NO: 84993 - DNA, 25 bp, Homo sapien
gtgttatctgagcaagcaaaaccta

SEQ ID NO: 84994 - DNA, 25 bp, Homo sapien
gtgttcaccattatagcttgattat

SEQ ID NO: 84995 - DNA, 25 bp, Homo sapien
gtgttcaccattataggttgattat

SEQ ID NO: 84996 - DNA, 25 bp, Homo sapien
gtgttcactgtgaacacgtttcttg

SEQ ID NO: 84997 - DNA, 25 bp, Homo sapien
gtgttcactgtgaacatgtttcttg

SEQ ID NO: 84998 - DNA, 25 bp, Homo sapien
gtgttcagccaggaactaagaaaga

SEQ ID NO: 84999 - DNA, 25 bp, Homo sapien
gtgttcagccaggatctaagaaaga

SEQ ID NO: 85000 - DNA, 25 bp, Homo sapien
gtgttcagtctcacccattagagct

SEQ ID NO: 85001 - DNA, 25 bp, Homo sapien
gtgttcagtttcacccattagagct

SEQ ID NO: 85002 - DNA, 25 bp, Homo sapien
gtgttcatatcataaacattatcca

SEQ ID NO: 85003 - DNA, 25 bp, Homo sapien
gtgttcatatcgtaaacattatcca

SEQ ID NO: 85004 - DNA, 25 bp, Homo sapien
gtgttcatctgaattatcccctact

SEQ ID NO: 85005 - DNA, 25 bp, Homo sapien
gtgttcatctggattatcccctact

SEQ ID NO: 85006 - DNA, 25 bp, Homo sapien
gtgttccattgacagcagtgattga

SEQ ID NO: 85007 - DNA, 25 bp, Homo sapien
gtgttccattgacagcggtgattga

SEQ ID NO: 85008 - DNA, 25 bp, Homo sapien
gtgttcctttagggcaagcaccatc

SEQ ID NO: 85009 - DNA, 25 bp, Homo sapien
gtgttcctttagggcaggcaccatc

SEQ ID NO: 85010 - DNA, 25 bp, Homo sapien
gtgttctcaacatatttaaaaaact

SEQ ID NO: 85011 - DNA, 25 bp, Homo sapien
gtgttctccagaggacactgctctg

SEQ ID NO: 85012 - DNA, 25 bp, Homo sapien
gtgttctccagaggccactgctctg

SEQ ID NO: 85013 - DNA, 25 bp, Homo sapien
gtgttctctacatatttaaaaaact

SEQ ID NO: 85014 - DNA, 25 bp, Homo sapien
gtgttctttactgttgattttttat

SEQ ID NO: 85015 - DNA, 25 bp, Homo sapien
gtgttctttgctgttgattttttat

SEQ ID NO: 85016 - DNA, 25 bp, Homo sapien
gtgttgatctgagaacataactctt

SEQ ID NO: 85017 - DNA, 25 bp, Homo sapien
gtgttgatctgataacataactctt

SEQ ID NO: 85018 - DNA, 25 bp, Homo sapien
gtgttgccactgagtttctatttca

SEQ ID NO: 85019 - DNA, 25 bp, Homo sapien
gtgttgccattgagtttctatttca

SEQ ID NO: 85020 - DNA, 25 bp, Homo sapien
gtgttgctcaaagttgaagagatca

SEQ ID NO: 85021 - DNA, 25 bp, Homo sapien
gtgttgctcattttacatataaagg

SEQ ID NO: 85022 - DNA, 25 bp, Homo sapien
gtgttgctcattttacgtataaagg

SEQ ID NO: 85023 - DNA, 25 bp, Homo sapien
gtgttgctcgaagttgaagagatca

SEQ ID NO: 85024 - DNA, 25 bp, Homo sapien
gtgttggacttacataagagaaata

SEQ ID NO: 85025 - DNA, 25 bp, Homo sapien
gtgttggagaactctttggccttgg

SEQ ID NO: 85026 - DNA, 25 bp, Homo sapien
gtgttggagaactgtttggccttgg

SEQ ID NO: 85027 - DNA, 25 bp, Homo sapien
gtgttggatttacataagagaaata

SEQ ID NO: 85028 - DNA, 25 bp, Homo sapien
gtgttggcaagtcgatatagcccta

SEQ ID NO: 85029 - DNA, 25 bp, Homo sapien
gtgttggcaagtggatatagcccta

SEQ ID NO: 85030 - DNA, 25 bp, Homo sapien
gtgttggcctgtagattgggtgtgc

SEQ ID NO: 85031 - DNA, 25 bp, Homo sapien
gtgttggcctgtatattgggtgtgc

SEQ ID NO: 85032 - DNA, 25 bp, Homo sapien
gtgttggggtctagcatgtattgtg

SEQ ID NO: 85033 - DNA, 25 bp, Homo sapien
gtgttgggttctagcatgtattgtg

SEQ ID NO: 85034 - DNA, 25 bp, Homo sapien
gtgttggtgatcatacaaagctggt

SEQ ID NO: 85035 - DNA, 25 bp, Homo sapien
gtgttggtgattatacaaagctggt

SEQ ID NO: 85036 - DNA, 25 bp, Homo sapien
gtgttggtggatccaagtctattcc

SEQ ID NO: 85037 - DNA, 25 bp, Homo sapien
gtgttggttccacaagaggctcagg

SEQ ID NO: 85038 - DNA, 25 bp, Homo sapien
gtgttggttccacgagaggctcagg

SEQ ID NO: 85039 - DNA, 25 bp, Homo sapien
gtgttggttgatccaagtctattcc

SEQ ID NO: 85040 - DNA, 25 bp, Homo sapien
gtgttgtgactatagttaaatgaaa

SEQ ID NO: 85041 - DNA, 25 bp, Homo sapien
gtgttgtgatcaaataatcctcacg

SEQ ID NO: 85042 - DNA, 25 bp, Homo sapien
gtgttgtgatcaaatagtcctcacg

SEQ ID NO: 85043 - DNA, 25 bp, Homo sapien
gtgttgtgattatagttaaatgaaa

SEQ ID NO: 85044 - DNA, 25 bp, Homo sapien
gtgtttagaaggagccttttctttc

SEQ ID NO: 85045 - DNA, 25 bp, Homo sapien
gtgtttaggagatcactataggcaa

SEQ ID NO: 85046 - DNA, 25 bp, Homo sapien
gtgtttaggagatgactataggcaa

SEQ ID NO: 85047 - DNA, 25 bp, Homo sapien
gtgtttaggctgtagctggcccctt

SEQ ID NO: 85048 - DNA, 25 bp, Homo sapien
gtgtttaggttgtagctggcccctt

SEQ ID NO: 85049 - DNA, 25 bp, Homo sapien
gtgtttagtaggagccttttctttc

SEQ ID NO: 85050 - DNA, 25 bp, Homo sapien
gtgtttatactatcaccatcatcag

SEQ ID NO: 85051 - DNA, 25 bp, Homo sapien
gtgtttatactattaccatcatcag

SEQ ID NO: 85052 - DNA, 25 bp, Homo sapien
gtgtttataggccttcagtgtcagc

SEQ ID NO: 85053 - DNA, 25 bp, Homo sapien
gtgtttatagggcttcagtgtcagc

SEQ ID NO: 85054 - DNA, 25 bp, Homo sapien
gtgtttcaaattcccagaagacctt

SEQ ID NO: 85055 - DNA, 25 bp, Homo sapien
gtgtttcaaatttccagaagacctt

SEQ ID NO: 85056 - DNA, 25 bp, Homo sapien
gtgtttcaatgaacttgacctttag

SEQ ID NO: 85057 - DNA, 25 bp, Homo sapien
gtgtttcaatgaagttgacctttag

SEQ ID NO: 85058 - DNA, 25 bp, Homo sapien
gtgtttcatctagtgtggaaattaa

SEQ ID NO: 85059 - DNA, 25 bp, Homo sapien
gtgtttcatgcgtcttcctcctcct

SEQ ID NO: 85060 - DNA, 25 bp, Homo sapien
gtgtttcatgcgttttcctcctcct

SEQ ID NO: 85061 - DNA, 25 bp, Homo sapien
gtgtttcatttagtgtggaaattaa

SEQ ID NO: 85062 - DNA, 25 bp, Homo sapien
gtgtttccactaactccatgcaaaa

SEQ ID NO: 85063 - DNA, 25 bp, Homo sapien
gtgtttccgctaactccatgcaaaa

SEQ ID NO: 85064 - DNA, 25 bp, Homo sapien
gtgtttcctcggatacagaaataag

SEQ ID NO: 85065 - DNA, 25 bp, Homo sapien
gtgtttccttacctattgcccatta

SEQ ID NO: 85066 - DNA, 25 bp, Homo sapien
gtgtttccttacctgttgcccatta

SEQ ID NO: 85067 - DNA, 25 bp, Homo sapien
gtgtttccttggatacagaaataag

SEQ ID NO: 85068 - DNA, 25 bp, Homo sapien
gtgtttctctctatatatatgcaca

SEQ ID NO: 85069 - DNA, 25 bp, Homo sapien
gtgtttctctctctatatatgcaca

SEQ ID NO: 85070 - DNA, 25 bp, Homo sapien
gtgtttctgaggcccctttgacatc

SEQ ID NO: 85071 - DNA, 25 bp, Homo sapien
gtgtttctggggcccctttgacatc

SEQ ID NO: 85072 - DNA, 25 bp, Homo sapien
gtgtttgaagggtcagtcacgtctc

SEQ ID NO: 85073 - DNA, 25 bp, Homo sapien
gtgtttgaaggttcagtcacgtctc

SEQ ID NO: 85074 - DNA, 25 bp, Homo sapien
gtgtttgaggttactgcacttgcat

SEQ ID NO: 85075 - DNA, 25 bp, Homo sapien
gtgtttgaggttattgcacttgcat

SEQ ID NO: 85076 - DNA, 25 bp, Homo sapien
gtgtttggcttcaataattccattt

SEQ ID NO: 85077 - DNA, 25 bp, Homo sapien
gtgtttggctttaataattccattt

SEQ ID NO: 85078 - DNA, 25 bp, Homo sapien
gtgtttgtgagaatcctcttttaca

SEQ ID NO: 85079 - DNA, 25 bp, Homo sapien
gtgtttgtgagagtcctcttttaca

SEQ ID NO: 85080 - DNA, 25 bp, Homo sapien
gtgttttaaacttctaaatttgtgg

SEQ ID NO: 85081 - DNA, 25 bp, Homo sapien
gtgttttaacacggatattttgcac

SEQ ID NO: 85082 - DNA, 25 bp, Homo sapien
gtgttttaacatggatattttgcac

SEQ ID NO: 85083 - DNA, 25 bp, Homo sapien
gtgttttaaccttctaaatttgtgg

SEQ ID NO: 85084 - DNA, 25 bp, Homo sapien
gtgttttaagagcggtagtggcatg

SEQ ID NO: 85085 - DNA, 25 bp, Homo sapien
gtgttttaagagcggtcgtggcatg

SEQ ID NO: 85086 - DNA, 25 bp, Homo sapien
gtgttttcaagaaagtaatttacca

SEQ ID NO: 85087 - DNA, 25 bp, Homo sapien
gtgttttcaagacagtaatttacca

SEQ ID NO: 85088 - DNA, 25 bp, Homo sapien
gtgttttcccattcgtattgcttat

SEQ ID NO: 85089 - DNA, 25 bp, Homo sapien
gtgttttcccatttgtattgcttat

SEQ ID NO: 85090 - DNA, 25 bp, Homo sapien
gtgttttccgctaggttgctttggg

SEQ ID NO: 85091 - DNA, 25 bp, Homo sapien
gtgttttcctctaggttgctttggg

SEQ ID NO: 85092 - DNA, 25 bp, Homo sapien
gtgttttctacaactcccgagtcca

SEQ ID NO: 85093 - DNA, 25 bp, Homo sapien
gtgttttctacacctcccgagtcca

SEQ ID NO: 85094 - DNA, 25 bp, Homo sapien
gtgttttctcaacgattcaacctaa

SEQ ID NO: 85095 - DNA, 25 bp, Homo sapien
gtgttttctcaatgattcaacctaa

SEQ ID NO: 85096 - DNA, 25 bp, Homo sapien
gtgttttgcccagagttaggacaat

SEQ ID NO: 85097 - DNA, 25 bp, Homo sapien
gtgttttgcgcagagttaggacaat

SEQ ID NO: 85098 - DNA, 25 bp, Homo sapien
gtgttttggtgattgtatgtgtcaa

SEQ ID NO: 85099 - DNA, 25 bp, Homo sapien
gtgttttgttgattgtatgtgtcaa

SEQ ID NO: 85100 - DNA, 25 bp, Homo sapien
gtgtttttacttacttattgaactt

SEQ ID NO: 85101 - DNA, 25 bp, Homo sapien
gtgtttttacttatttattgaactt

SEQ ID NO: 85102 - DNA, 25 bp, Homo sapien
gtgtttttagttagctctccataga

SEQ ID NO: 85103 - DNA, 25 bp, Homo sapien
gtgtttttccttgacacgctaccgc

SEQ ID NO: 85104 - DNA, 25 bp, Homo sapien
gtgtttttccttgacatgctaccgc

SEQ ID NO: 85105 - DNA, 25 bp, Homo sapien
gtgtttttggttagctctccataga

SEQ ID NO: 85106 - DNA, 25 bp, Homo sapien
gttaaaaaatgcctccttttctgag

SEQ ID NO: 85107 - DNA, 25 bp, Homo sapien
gttaaaaagtgcctccttttctgag

SEQ ID NO: 85108 - DNA, 25 bp, Homo sapien
gttaaaacacagtatgcatgaagac

SEQ ID NO: 85109 - DNA, 25 bp, Homo sapien
gttaaaacatagtatgcatgaagac

SEQ ID NO: 85110 - DNA, 25 bp, Homo sapien
gttaaaagtcaaccgtttactggca

SEQ ID NO: 85111 - DNA, 25 bp, Homo sapien
gttaaaagtcagccgtttactggca

SEQ ID NO: 85112 - DNA, 25 bp, Homo sapien
gttaaaagttgcgatgatacaaaat

SEQ ID NO: 85113 - DNA, 25 bp, Homo sapien
gttaaaagttgtgatgatacaaaat

SEQ ID NO: 85114 - DNA, 25 bp, Homo sapien
gttaaaataaggcaagtgttcaaaa

SEQ ID NO: 85115 - DNA, 25 bp, Homo sapien
gttaaaataaggtaagtgttcaaaa

SEQ ID NO: 85116 - DNA, 25 bp, Homo sapien
gttaaaatgggtagactcttcattc

SEQ ID NO: 85117 - DNA, 25 bp, Homo sapien
gttaaaatgtgtagactcttcattc

SEQ ID NO: 85118 - DNA, 25 bp, Homo sapien
gttaaacatcctatgaagcacagga

SEQ ID NO: 85119 - DNA, 25 bp, Homo sapien
gttaaacatgctatgaagcacagga

SEQ ID NO: 85120 - DNA, 25 bp, Homo sapien
gttaaacccttcaagtcgttccatt

SEQ ID NO: 85121 - DNA, 25 bp, Homo sapien
gttaaacccttcacgtcgttccatt

SEQ ID NO: 85122 - DNA, 25 bp, Homo sapien
gttaaagaaagaaagatggcttggt

SEQ ID NO: 85123 - DNA, 25 bp, Homo sapien
gttaaagagagaaagatggcttggt

SEQ ID NO: 85124 - DNA, 25 bp, Homo sapien
gttaaagttctacacctcattataa

SEQ ID NO: 85125 - DNA, 25 bp, Homo sapien
gttaaagttctatacctcattataa

SEQ ID NO: 85126 - DNA, 25 bp, Homo sapien
gttaaatacctaagcatctcaaaaa

SEQ ID NO: 85127 - DNA, 25 bp, Homo sapien
gttaaatacctaggcatctcaaaaa

SEQ ID NO: 85128 - DNA, 25 bp, Homo sapien
gttaaatactgactcacaggagagg

SEQ ID NO: 85129 - DNA, 25 bp, Homo sapien
gttaaatactgagtcacaggagagg

SEQ ID NO: 85130 - DNA, 25 bp, Homo sapien
gttaaatagcagataagacacaatt

SEQ ID NO: 85131 - DNA, 25 bp, Homo sapien
gttaaatagcagataatacacaatt

SEQ ID NO: 85132 - DNA, 25 bp, Homo sapien
gttaaatataacgttgaatttcagt

SEQ ID NO: 85133 - DNA, 25 bp, Homo sapien
gttaaatataatgttgaatttcagt

SEQ ID NO: 85134 - DNA, 25 bp, Homo sapien
gttaaatatcctgataagttcacag

SEQ ID NO: 85135 - DNA, 25 bp, Homo sapien
gttaaatatcctgttaagttcacag

SEQ ID NO: 85136 - DNA, 25 bp, Homo sapien
gttaaatgaaaccttctagctgttt

SEQ ID NO: 85137 - DNA, 25 bp, Homo sapien
gttaaatgaaatcttctagctgttt

SEQ ID NO: 85138 - DNA, 25 bp, Homo sapien
gttaaatgtcaggcccattatttat

SEQ ID NO: 85139 - DNA, 25 bp, Homo sapien
gttaaatgtcaggtccattatttat

SEQ ID NO: 85140 - DNA, 25 bp, Homo sapien
gttaaatgtccagtaccaggtttgc

SEQ ID NO: 85141 - DNA, 25 bp, Homo sapien
gttaaatgtccggtaccaggtttgc

SEQ ID NO: 85142 - DNA, 25 bp, Homo sapien
gttaaatgtgctacagattcttcat

SEQ ID NO: 85143 - DNA, 25 bp, Homo sapien
gttaaatgtgctccagattcttcat

SEQ ID NO: 85144 - DNA, 25 bp, Homo sapien
gttaaattataggtcaagaatgaat

SEQ ID NO: 85145 - DNA, 25 bp, Homo sapien
gttaaattctttctgttcctcaaga

SEQ ID NO: 85146 - DNA, 25 bp, Homo sapien
gttaaattctttttgttcctcaaga

SEQ ID NO: 85147 - DNA, 25 bp, Homo sapien
gttaaattgtaggtcaagaatgaat

SEQ ID NO: 85148 - DNA, 25 bp, Homo sapien
gttaacaacaatactggaagctgca

SEQ ID NO: 85149 - DNA, 25 bp, Homo sapien
gttaacaacaatcctggaagctgca

SEQ ID NO: 85150 - DNA, 25 bp, Homo sapien
gttaacagacattcacaaagcatag

SEQ ID NO: 85151 - DNA, 25 bp, Homo sapien
gttaacagcaaagaacaatgtctcc

SEQ ID NO: 85152 - DNA, 25 bp, Homo sapien
gttaacagcaaagagcaatgtctcc

SEQ ID NO: 85153 - DNA, 25 bp, Homo sapien
gttaacaggcattcacaaagcatag

SEQ ID NO: 85154 - DNA, 25 bp, Homo sapien
gttaactaactacatgctaagagtt

SEQ ID NO: 85155 - DNA, 25 bp, Homo sapien
gttaactaattacatgctaagagtt

SEQ ID NO: 85156 - DNA, 25 bp, Homo sapien
gttaacttagcctcttcctctatgg

SEQ ID NO: 85157 - DNA, 25 bp, Homo sapien
gttaacttagcttcttcctctatgg

SEQ ID NO: 85158 - DNA, 25 bp, Homo sapien
gttaacttatgcaagtaacaatcca

SEQ ID NO: 85159 - DNA, 25 bp, Homo sapien
gttaacttatgcgagtaacaatcca

SEQ ID NO: 85160 - DNA, 25 bp, Homo sapien
gttaactttttccttgcatactatt

SEQ ID NO: 85161 - DNA, 25 bp, Homo sapien
gttaacttttttcttgcatactatt

SEQ ID NO: 85162 - DNA, 25 bp, Homo sapien
gttaagaacgagtaataagaccttg

SEQ ID NO: 85163 - DNA, 25 bp, Homo sapien
gttaagaatgagtaataagaccttg

SEQ ID NO: 85164 - DNA, 25 bp, Homo sapien
gttaagaccatcatcatctctcaac

SEQ ID NO: 85165 - DNA, 25 bp, Homo sapien
gttaagaccatcgtcatctctcaac

SEQ ID NO: 85166 - DNA, 25 bp, Homo sapien
gttaagcaaacacaaataggtttct

SEQ ID NO: 85167 - DNA, 25 bp, Homo sapien
gttaagcaaacacagataggtttct

SEQ ID NO: 85168 - DNA, 25 bp, Homo sapien
gttaagcatggtctcactaagaacc

SEQ ID NO: 85169 - DNA, 25 bp, Homo sapien
gttaagcatggtctcattaagaacc

SEQ ID NO: 85170 - DNA, 25 bp, Homo sapien
gttaagccagaggcccagtgaagtt

SEQ ID NO: 85171 - DNA, 25 bp, Homo sapien
gttaagccagaggctcagtgaagtt

SEQ ID NO: 85172 - DNA, 25 bp, Homo sapien
gttaagctgatgataaaagaagttt

SEQ ID NO: 85173 - DNA, 25 bp, Homo sapien
gttaagctgatggtaaaagaagttt

SEQ ID NO: 85174 - DNA, 25 bp, Homo sapien
gttaagtggcaatgttccatgcaat

SEQ ID NO: 85175 - DNA, 25 bp, Homo sapien
gttaagtggtaatgttccatgcaat

SEQ ID NO: 85176 - DNA, 25 bp, Homo sapien
gttaataaaagtctcatcctcccac

SEQ ID NO: 85177 - DNA, 25 bp, Homo sapien
gttaataaagatggtgctaccttca

SEQ ID NO: 85178 - DNA, 25 bp, Homo sapien
gttaataaagattgtgctaccttca

SEQ ID NO: 85179 - DNA, 25 bp, Homo sapien
gttaataaaggtctcatcctcccac

SEQ ID NO: 85180 - DNA, 25 bp, Homo sapien
gttaatacggacatgttctgaaatt

SEQ ID NO: 85181 - DNA, 25 bp, Homo sapien
gttaatacggatatgttctgaaatt

SEQ ID NO: 85182 - DNA, 25 bp, Homo sapien
gttaatcaatgtctttactttcttc

SEQ ID NO: 85183 - DNA, 25 bp, Homo sapien
gttaatcacgaagcagtggccagca

SEQ ID NO: 85184 - DNA, 25 bp, Homo sapien
gttaatcagtgtctttactttcttc

SEQ ID NO: 85185 - DNA, 25 bp, Homo sapien
gttaatcatgaagcagtggccagca

SEQ ID NO: 85186 - DNA, 25 bp, Homo sapien
gttaatctccagatcctgttaagcc

SEQ ID NO: 85187 - DNA, 25 bp, Homo sapien
gttaatctccagattctgttaagcc

SEQ ID NO: 85188 - DNA, 25 bp, Homo sapien
gttaatgagtggccagtgttattaa

SEQ ID NO: 85189 - DNA, 25 bp, Homo sapien
gttaatgagtggccggtgttattaa

SEQ ID NO: 85190 - DNA, 25 bp, Homo sapien
gttaatgcaaaagaatatcgagggt

SEQ ID NO: 85191 - DNA, 25 bp, Homo sapien
gttaatgcaaaagagtatcgagggt

SEQ ID NO: 85192 - DNA, 25 bp, Homo sapien
gttaatgcttgatgtatccgaacca

SEQ ID NO: 85193 - DNA, 25 bp, Homo sapien
gttaatgcttggtgtatccgaacca

SEQ ID NO: 85194 - DNA, 25 bp, Homo sapien
gttaatggctacaaaacattttaaa

SEQ ID NO: 85195 - DNA, 25 bp, Homo sapien
gttaatggctacgaaacattttaaa

SEQ ID NO: 85196 - DNA, 25 bp, Homo sapien
gttaatgtaaatgtattttgggaaa

SEQ ID NO: 85197 - DNA, 25 bp, Homo sapien
gttaatgtgaatgtattttgggaaa

SEQ ID NO: 85198 - DNA, 25 bp, Homo sapien
gttaatgtggccgtctccaatcaca

SEQ ID NO: 85199 - DNA, 25 bp, Homo sapien
gttaatgtggctgtctccaatcaca

SEQ ID NO: 85200 - DNA, 25 bp, Homo sapien
gttaatgttgttggttctatttatg

SEQ ID NO: 85201 - DNA, 25 bp, Homo sapien
gttaatgttgtttgttctatttatg

SEQ ID NO: 85202 - DNA, 25 bp, Homo sapien
gttaattacacttctataaaactgt

SEQ ID NO: 85203 - DNA, 25 bp, Homo sapien
gttaattacgcttctataaaactgt

SEQ ID NO: 85204 - DNA, 25 bp, Homo sapien
gttaattacggacgcaaacaaggcc

SEQ ID NO: 85205 - DNA, 25 bp, Homo sapien
gttaattacggatgcaaacaaggcc

SEQ ID NO: 85206 - DNA, 25 bp, Homo sapien
gttaattattagactgcggcaaagc

SEQ ID NO: 85207 - DNA, 25 bp, Homo sapien
gttaattattagactgtggcaaagc

SEQ ID NO: 85208 - DNA, 25 bp, Homo sapien
gttaattccatgattttgacaagtg

SEQ ID NO: 85209 - DNA, 25 bp, Homo sapien
gttaattccatggttttgacaagtg

SEQ ID NO: 85210 - DNA, 25 bp, Homo sapien
gttaattggtgacaggccaaatacg

SEQ ID NO: 85211 - DNA, 25 bp, Homo sapien
gttaattggtgagaggccaaatacg

SEQ ID NO: 85212 - DNA, 25 bp, Homo sapien
gttaatttgatggcttgagcaggga

SEQ ID NO: 85213 - DNA, 25 bp, Homo sapien
gttaatttggtggcttgagcaggga

SEQ ID NO: 85214 - DNA, 25 bp, Homo sapien
gttacaaagttagccagatctcaat

SEQ ID NO: 85215 - DNA, 25 bp, Homo sapien
gttacaaagttagtcagatctcaat

SEQ ID NO: 85216 - DNA, 25 bp, Homo sapien
gttacaattattaattcacaaaagg

SEQ ID NO: 85217 - DNA, 25 bp, Homo sapien
gttacaattgttaattcacaaaagg

SEQ ID NO: 85218 - DNA, 25 bp, Homo sapien
gttacaatttgtcatcttgataaga

SEQ ID NO: 85219 - DNA, 25 bp, Homo sapien
gttacaatttgttatcttgataaga

SEQ ID NO: 85220 - DNA, 25 bp, Homo sapien
gttacacccaacgtgcaggtggtca

SEQ ID NO: 85221 - DNA, 25 bp, Homo sapien
gttacacccaatgtgcaggtggtca

SEQ ID NO: 85222 - DNA, 25 bp, Homo sapien
gttacagattcaaagggtatgttgt

SEQ ID NO: 85223 - DNA, 25 bp, Homo sapien
gttacagattcaaggggtatgttgt

SEQ ID NO: 85224 - DNA, 25 bp, Homo sapien
gttacagccaatatgaacacacagg

SEQ ID NO: 85225 - DNA, 25 bp, Homo sapien
gttacagccattggagcaaatgaaa

SEQ ID NO: 85226 - DNA, 25 bp, Homo sapien
gttacagccatttgagcaaatgaaa

SEQ ID NO: 85227 - DNA, 25 bp, Homo sapien
gttacagccgatatgaacacacagg

SEQ ID NO: 85228 - DNA, 25 bp, Homo sapien
gttacagtgcaagaaacggcagtca

SEQ ID NO: 85229 - DNA, 25 bp, Homo sapien
gttacagtgcaagaaatggcagtca

SEQ ID NO: 85230 - DNA, 25 bp, Homo sapien
gttacatacaccatgagaatgagaa

SEQ ID NO: 85231 - DNA, 25 bp, Homo sapien
gttacatagaccatgagaatgagaa

SEQ ID NO: 85232 - DNA, 25 bp, Homo sapien
gttacattaacggctcaaagtttga

SEQ ID NO: 85233 - DNA, 25 bp, Homo sapien
gttacattgaccaagttagaaagct

SEQ ID NO: 85234 - DNA, 25 bp, Homo sapien
gttacattgacccagttagaaagct

SEQ ID NO: 85235 - DNA, 25 bp, Homo sapien
gttacattgacggctcaaagtttga

SEQ ID NO: 85236 - DNA, 25 bp, Homo sapien
gttacattttaagagtgacaagcag

SEQ ID NO: 85237 - DNA, 25 bp, Homo sapien
gttacattttacgagtgacaagcag

SEQ ID NO: 85238 - DNA, 25 bp, Homo sapien
gttaccaagctaaagtttttgttca

SEQ ID NO: 85239 - DNA, 25 bp, Homo sapien
gttaccaagctacagtttttgttca

SEQ ID NO: 85240 - DNA, 25 bp, Homo sapien
gttaccaatctgatgaggaaagcat

SEQ ID NO: 85241 - DNA, 25 bp, Homo sapien
gttaccaatcttatgaggaaagcat

SEQ ID NO: 85242 - DNA, 25 bp, Homo sapien
gttaccaatgttccactggttgacc

SEQ ID NO: 85243 - DNA, 25 bp, Homo sapien
gttaccaatgtttcactggttgacc

SEQ ID NO: 85244 - DNA, 25 bp, Homo sapien
gttaccacacaccacacgggagaga

SEQ ID NO: 85245 - DNA, 25 bp, Homo sapien
gttaccacacaccacatgggagaga

SEQ ID NO: 85246 - DNA, 25 bp, Homo sapien
gttaccagatcttcgcatgtttttc

SEQ ID NO: 85247 - DNA, 25 bp, Homo sapien
gttaccagatctttgcatgtttttc

SEQ ID NO: 85248 - DNA, 25 bp, Homo sapien
gttaccatcagatcatcttaatcct

SEQ ID NO: 85249 - DNA, 25 bp, Homo sapien
gttaccatcagatcgtcttaatcct

SEQ ID NO: 85250 - DNA, 25 bp, Homo sapien
gttaccatcctgccattcagaggag

SEQ ID NO: 85251 - DNA, 25 bp, Homo sapien
gttaccatcctgccgttcagaggag

SEQ ID NO: 85252 - DNA, 25 bp, Homo sapien
gttacctctcagacatcaggcagat

SEQ ID NO: 85253 - DNA, 25 bp, Homo sapien
gttacctctcagatatcaggcagat

SEQ ID NO: 85254 - DNA, 25 bp, Homo sapien
gttaccttcaaaccaaaagcttaat

SEQ ID NO: 85255 - DNA, 25 bp, Homo sapien
gttaccttcaaaccgaaagcttaat

SEQ ID NO: 85256 - DNA, 25 bp, Homo sapien
gttaccttcttcatctatgcacact

SEQ ID NO: 85257 - DNA, 25 bp, Homo sapien
gttaccttcttcttctatgcacact

SEQ ID NO: 85258 - DNA, 25 bp, Homo sapien
gttacgactcagccacattgcatac

SEQ ID NO: 85259 - DNA, 25 bp, Homo sapien
gttacgactcagccacgttgcatac

SEQ ID NO: 85260 - DNA, 25 bp, Homo sapien
gttacgtacctatgcttcttttaag

SEQ ID NO: 85261 - DNA, 25 bp, Homo sapien
gttacgtacctgtgcttcttttaag

SEQ ID NO: 85262 - DNA, 25 bp, Homo sapien
gttactacattgagatacaccagtc

SEQ ID NO: 85263 - DNA, 25 bp, Homo sapien
gttactacattgcgatacaccagtc

SEQ ID NO: 85264 - DNA, 25 bp, Homo sapien
gttactataattggtgattcctatc

SEQ ID NO: 85265 - DNA, 25 bp, Homo sapien
gttactataattggtggttcctatc

SEQ ID NO: 85266 - DNA, 25 bp, Homo sapien
gttactatacattcatcctcttgcc

SEQ ID NO: 85267 - DNA, 25 bp, Homo sapien
gttactatacattcattctcttgcc

SEQ ID NO: 85268 - DNA, 25 bp, Homo sapien
gttactgacatgatgccccttcacc

SEQ ID NO: 85269 - DNA, 25 bp, Homo sapien
gttactgacattatgccccttcacc

SEQ ID NO: 85270 - DNA, 25 bp, Homo sapien
gttactggttgcgtgttaactggta

SEQ ID NO: 85271 - DNA, 25 bp, Homo sapien
gttactggttgtgtgttaactggta

SEQ ID NO: 85272 - DNA, 25 bp, Homo sapien
gttactgtccccgtaaaggtaatga

SEQ ID NO: 85273 - DNA, 25 bp, Homo sapien
gttactgtccctgtaaaggtaatga

SEQ ID NO: 85274 - DNA, 25 bp, Homo sapien
gttactgtttataagacgcctacaa

SEQ ID NO: 85275 - DNA, 25 bp, Homo sapien
gttactgtttataagatgcctacaa

SEQ ID NO: 85276 - DNA, 25 bp, Homo sapien
gttacttaacagaacaacatggatt

SEQ ID NO: 85277 - DNA, 25 bp, Homo sapien
gttacttaacagagcaacatggatt

SEQ ID NO: 85278 - DNA, 25 bp, Homo sapien
gttacttgaaagagtttcagaaaag

SEQ ID NO: 85279 - DNA, 25 bp, Homo sapien
gttacttggaagagtttcagaaaag

SEQ ID NO: 85280 - DNA, 25 bp, Homo sapien
gttacttgtatcacataagaaagca

SEQ ID NO: 85281 - DNA, 25 bp, Homo sapien
gttacttgtatcacgtaagaaagca

SEQ ID NO: 85282 - DNA, 25 bp, Homo sapien
gttactttcggacagtctatgccaa

SEQ ID NO: 85283 - DNA, 25 bp, Homo sapien
gttactttgggacagtctatgccaa

SEQ ID NO: 85284 - DNA, 25 bp, Homo sapien
gttagaaagagcaactgaatatgtt

SEQ ID NO: 85285 - DNA, 25 bp, Homo sapien
gttagaaagagcaattgaatatgtt

SEQ ID NO: 85286 - DNA, 25 bp, Homo sapien
gttagaaagggaataaactggaaaa

SEQ ID NO: 85287 - DNA, 25 bp, Homo sapien
gttagaaatggaataaactggaaaa

SEQ ID NO: 85288 - DNA, 25 bp, Homo sapien
gttagaaccaaagtgctaagttaat

SEQ ID NO: 85289 - DNA, 25 bp, Homo sapien
gttagaaccgaagtgctaagttaat

SEQ ID NO: 85290 - DNA, 25 bp, Homo sapien
gttagaactagagacaaacatacaa

SEQ ID NO: 85291 - DNA, 25 bp, Homo sapien
gttagaactggagacaaacatacaa

SEQ ID NO: 85292 - DNA, 25 bp, Homo sapien
gttagaagataactagcagtgttcc

SEQ ID NO: 85293 - DNA, 25 bp, Homo sapien
gttagaagataactggcagtgttcc

SEQ ID NO: 85294 - DNA, 25 bp, Homo sapien
gttagagaggtccggcatgtgagga

SEQ ID NO: 85295 - DNA, 25 bp, Homo sapien
gttagagaggtctggcatgtgagga

SEQ ID NO: 85296 - DNA, 25 bp, Homo sapien
gttagagcaataaacattcttcaaa

SEQ ID NO: 85297 - DNA, 25 bp, Homo sapien
gttagagcaataaagattcttcaaa

SEQ ID NO: 85298 - DNA, 25 bp, Homo sapien
gttagagcacagcatgaaggaagca

SEQ ID NO: 85299 - DNA, 25 bp, Homo sapien
gttagagcacaggatgaaggaagca

SEQ ID NO: 85300 - DNA, 25 bp, Homo sapien
gttagagtccagagatcatgggcct

SEQ ID NO: 85301 - DNA, 25 bp, Homo sapien
gttagagtcgagagatcatgggcct

SEQ ID NO: 85302 - DNA, 25 bp, Homo sapien
gttagatgaactttaagtctagctg

SEQ ID NO: 85303 - DNA, 25 bp, Homo sapien
gttagatgaactttaattctagctg

SEQ ID NO: 85304 - DNA, 25 bp, Homo sapien
gttagattatgtggtcagtgatcca

SEQ ID NO: 85305 - DNA, 25 bp, Homo sapien
gttagattatgtggtcggtgatcca

SEQ ID NO: 85306 - DNA, 25 bp, Homo sapien
gttagattctaaatttactacttca

SEQ ID NO: 85307 - DNA, 25 bp, Homo sapien
gttagattgtaaatttactacttca

SEQ ID NO: 85308 - DNA, 25 bp, Homo sapien
gttagcaatgttctaacagttcaaa

SEQ ID NO: 85309 - DNA, 25 bp, Homo sapien
gttagcaatgttctaatagttcaaa

SEQ ID NO: 85310 - DNA, 25 bp, Homo sapien
gttagcaccaatcttgtacatattt

SEQ ID NO: 85311 - DNA, 25 bp, Homo sapien
gttagcaccgatcttgtacatattt

SEQ ID NO: 85312 - DNA, 25 bp, Homo sapien
gttagcataatggacttgtgaccag

SEQ ID NO: 85313 - DNA, 25 bp, Homo sapien
gttagcataatggccttgtgaccag

SEQ ID NO: 85314 - DNA, 25 bp, Homo sapien
gttagcatacgctttttaaactggg

SEQ ID NO: 85315 - DNA, 25 bp, Homo sapien
gttagcatatgctttttaaactggg

SEQ ID NO: 85316 - DNA, 25 bp, Homo sapien
gttagccgaatgccctcaagagctt

SEQ ID NO: 85317 - DNA, 25 bp, Homo sapien
gttagccgaatgtcctcaagagctt

SEQ ID NO: 85318 - DNA, 25 bp, Homo sapien
gttagctcattacagatttcacatc

SEQ ID NO: 85319 - DNA, 25 bp, Homo sapien
gttagctcgttacagatttcacatc

SEQ ID NO: 85320 - DNA, 25 bp, Homo sapien
gttagctgcacagccagaatataaa

SEQ ID NO: 85321 - DNA, 25 bp, Homo sapien
gttagctgcacggccagaatataaa

SEQ ID NO: 85322 - DNA, 25 bp, Homo sapien
gttagctgttcctttgcttggctac

SEQ ID NO: 85323 - DNA, 25 bp, Homo sapien
gttagctgttcctttgtttggctac

SEQ ID NO: 85324 - DNA, 25 bp, Homo sapien
gttagcttaccactctgatactttt

SEQ ID NO: 85325 - DNA, 25 bp, Homo sapien
gttagcttaccgctctgatactttt

SEQ ID NO: 85326 - DNA, 25 bp, Homo sapien
gttagcttatgtccttggaaatgga

SEQ ID NO: 85327 - DNA, 25 bp, Homo sapien
gttagcttatgtctttggaaatgga

SEQ ID NO: 85328 - DNA, 25 bp, Homo sapien
gttaggaaagctgcaaaggcaaatt

SEQ ID NO: 85329 - DNA, 25 bp, Homo sapien
gttaggaaagctgcaatggcaaatt

SEQ ID NO: 85330 - DNA, 25 bp, Homo sapien
gttaggagaacaggcaaaatctatg

SEQ ID NO: 85331 - DNA, 25 bp, Homo sapien
gttaggagaccaggcaaaatctatg

SEQ ID NO: 85332 - DNA, 25 bp, Homo sapien
gttaggatacagtatcatggctagt

SEQ ID NO: 85333 - DNA, 25 bp, Homo sapien
gttaggatacagtatcgtggctagt

SEQ ID NO: 85334 - DNA, 25 bp, Homo sapien
gttaggatctaacctcttcctacaa

SEQ ID NO: 85335 - DNA, 25 bp, Homo sapien
gttaggatctagcctcttcctacaa

SEQ ID NO: 85336 - DNA, 25 bp, Homo sapien
gttaggatttcaatgtatgaatttt

SEQ ID NO: 85337 - DNA, 25 bp, Homo sapien
gttaggatttcagtgtatgaatttt

SEQ ID NO: 85338 - DNA, 25 bp, Homo sapien
gttaggccaagttgagagtccttgg

SEQ ID NO: 85339 - DNA, 25 bp, Homo sapien
gttaggccgagttgagagtccttgg

SEQ ID NO: 85340 - DNA, 25 bp, Homo sapien
gttagggacgaattcagattactga

SEQ ID NO: 85341 - DNA, 25 bp, Homo sapien
gttagggatgaattcagattactga

SEQ ID NO: 85342 - DNA, 25 bp, Homo sapien
gttagggcatgctgatgagctgaga

SEQ ID NO: 85343 - DNA, 25 bp, Homo sapien
gttagggcatgctgttgagctgaga

SEQ ID NO: 85344 - DNA, 25 bp, Homo sapien
gttaggtattcactgcagtctcctc

SEQ ID NO: 85345 - DNA, 25 bp, Homo sapien
gttaggtattcattgcagtctcctc

SEQ ID NO: 85346 - DNA, 25 bp, Homo sapien
gttaggtgaacaaatacttttcata

SEQ ID NO: 85347 - DNA, 25 bp, Homo sapien
gttaggtgaacaactacttttcata

SEQ ID NO: 85348 - DNA, 25 bp, Homo sapien
gttaggtttgctctattctttatta

SEQ ID NO: 85349 - DNA, 25 bp, Homo sapien
gttaggtttgctttattctttatta

SEQ ID NO: 85350 - DNA, 25 bp, Homo sapien
gttagtatttgtaagtggtgtaaga

SEQ ID NO: 85351 - DNA, 25 bp, Homo sapien
gttagtatttgtgagtggtgtaaga

SEQ ID NO: 85352 - DNA, 25 bp, Homo sapien
gttagtgcagatctgtggtactgct

SEQ ID NO: 85353 - DNA, 25 bp, Homo sapien
gttagtgcattctatgtatggccca

SEQ ID NO: 85354 - DNA, 25 bp, Homo sapien
gttagtgcattctgtgtatggccca

SEQ ID NO: 85355 - DNA, 25 bp, Homo sapien
gttagtgcggatctgtggtactgct

SEQ ID NO: 85356 - DNA, 25 bp, Homo sapien
gttagtgtatttcgcagtgtcacag

SEQ ID NO: 85357 - DNA, 25 bp, Homo sapien
gttagtgtattttgcagtgtcacag

SEQ ID NO: 85358 - DNA, 25 bp, Homo sapien
gttagttataccgatcttcattttg

SEQ ID NO: 85359 - DNA, 25 bp, Homo sapien
gttagttatactgatcttcattttg

SEQ ID NO: 85360 - DNA, 25 bp, Homo sapien
gttagttgcttagattgggtcgtgt

SEQ ID NO: 85361 - DNA, 25 bp, Homo sapien
gttagttgcttaggttgggtcgtgt

SEQ ID NO: 85362 - DNA, 25 bp, Homo sapien
gttagttgtctgtaatgatttagtt

SEQ ID NO: 85363 - DNA, 25 bp, Homo sapien
gttagttgtctgtaattatttagtt

SEQ ID NO: 85364 - DNA, 25 bp, Homo sapien
gttagtttaaccatgtatctgactg

SEQ ID NO: 85365 - DNA, 25 bp, Homo sapien
gttagtttaaccgtgtatctgactg

SEQ ID NO: 85366 - DNA, 25 bp, Homo sapien
gttagtttcaaaaatcttaatgtag

SEQ ID NO: 85367 - DNA, 25 bp, Homo sapien
gttagtttcaaaagtcttaatgtag

SEQ ID NO: 85368 - DNA, 25 bp, Homo sapien
gttataaaacagagggaccgaaaga

SEQ ID NO: 85369 - DNA, 25 bp, Homo sapien
gttataaaacagagggtccgaaaga

SEQ ID NO: 85370 - DNA, 25 bp, Homo sapien
gttataaccatgccaagtggagctc

SEQ ID NO: 85371 - DNA, 25 bp, Homo sapien
gttataaccgctgcaccttacaaac

SEQ ID NO: 85372 - DNA, 25 bp, Homo sapien
gttataaccgtgccaagtggagctc

SEQ ID NO: 85373 - DNA, 25 bp, Homo sapien
gttataacctctgcaccttacaaac

SEQ ID NO: 85374 - DNA, 25 bp, Homo sapien
gttatacccttacgcaatttaatag

SEQ ID NO: 85375 - DNA, 25 bp, Homo sapien
gttatacccttaggcaatttaatag

SEQ ID NO: 85376 - DNA, 25 bp, Homo sapien
gttatacttcacaactactagggtg

SEQ ID NO: 85377 - DNA, 25 bp, Homo sapien
gttatacttcacaactgctagggtg

SEQ ID NO: 85378 - DNA, 25 bp, Homo sapien
gttatagcagcaatagaaaatggac

SEQ ID NO: 85379 - DNA, 25 bp, Homo sapien
gttatagcagcagtagaaaatggac

SEQ ID NO: 85380 - DNA, 25 bp, Homo sapien
gttatatagagcaatcatgaatcat

SEQ ID NO: 85381 - DNA, 25 bp, Homo sapien
gttatatagcgcaatcatgaatcat

SEQ ID NO: 85382 - DNA, 25 bp, Homo sapien
gttatatgacgatttgcagactggc

SEQ ID NO: 85383 - DNA, 25 bp, Homo sapien
gttatatgatgatttgcagactggc

SEQ ID NO: 85384 - DNA, 25 bp, Homo sapien
gttatattttgttcacatttttaac

SEQ ID NO: 85385 - DNA, 25 bp, Homo sapien
gttatattttgttcacgtttttaac

SEQ ID NO: 85386 - DNA, 25 bp, Homo sapien
gttatcaagaaagaggaattttgct

SEQ ID NO: 85387 - DNA, 25 bp, Homo sapien
gttatcaagaatgaggaattttgct

SEQ ID NO: 85388 - DNA, 25 bp, Homo sapien
gttatctatggccaactcatgcaca

SEQ ID NO: 85389 - DNA, 25 bp, Homo sapien
gttatctatggccagctcatgcaca

SEQ ID NO: 85390 - DNA, 25 bp, Homo sapien
gttatctgaacaagcaaaacctaag

SEQ ID NO: 85391 - DNA, 25 bp, Homo sapien
gttatctgagcaagcaaaacctaag

SEQ ID NO: 85392 - DNA, 25 bp, Homo sapien
gttatctgaggatgaaaaaatgacc

SEQ ID NO: 85393 - DNA, 25 bp, Homo sapien
gttatctgaggttgaaaaaatgacc

SEQ ID NO: 85394 - DNA, 25 bp, Homo sapien
gttatctttacagaacttcagtatt

SEQ ID NO: 85395 - DNA, 25 bp, Homo sapien
gttatctttacagagcttcagtatt

SEQ ID NO: 85396 - DNA, 25 bp, Homo sapien
gttatctttacgcaacagcatcatt

SEQ ID NO: 85397 - DNA, 25 bp, Homo sapien
gttatctttactcaacagcatcatt

SEQ ID NO: 85398 - DNA, 25 bp, Homo sapien
gttatgaactgcctttctaaaattt

SEQ ID NO: 85399 - DNA, 25 bp, Homo sapien
gttatgaattgcctttctaaaattt

SEQ ID NO: 85400 - DNA, 25 bp, Homo sapien
gttatgaatttgtccactttcactg

SEQ ID NO: 85401 - DNA, 25 bp, Homo sapien
gttatgaatttgttcactttcactg

SEQ ID NO: 85402 - DNA, 25 bp, Homo sapien
gttatgacaggacacaaaggaggtg

SEQ ID NO: 85403 - DNA, 25 bp, Homo sapien
gttatgacagggcacaaaggaggtg

SEQ ID NO: 85404 - DNA, 25 bp, Homo sapien
gttatgatcagcatgtacccgccaa

SEQ ID NO: 85405 - DNA, 25 bp, Homo sapien
gttatgatccgcatgtacccgccaa

SEQ ID NO: 85406 - DNA, 25 bp, Homo sapien
gttatgcccactcttctgcccagag

SEQ ID NO: 85407 - DNA, 25 bp, Homo sapien
gttatgcccacttttctgcccagag

SEQ ID NO: 85408 - DNA, 25 bp, Homo sapien
gttatgcctgtcattgaaccaggag

SEQ ID NO: 85409 - DNA, 25 bp, Homo sapien
gttatgcctgtcgttgaaccaggag

SEQ ID NO: 85410 - DNA, 25 bp, Homo sapien
gttatggaactcataatttttaaaa

SEQ ID NO: 85411 - DNA, 25 bp, Homo sapien
gttatggaagtcataatttttaaaa

SEQ ID NO: 85412 - DNA, 25 bp, Homo sapien
gttatggagaactcagtcatgagaa

SEQ ID NO: 85413 - DNA, 25 bp, Homo sapien
gttatggagaattcagtcatgagaa

SEQ ID NO: 85414 - DNA, 25 bp, Homo sapien
gttatggcaggatttacaggtaaag

SEQ ID NO: 85415 - DNA, 25 bp, Homo sapien
gttatggcaggatttagaggtaaag

SEQ ID NO: 85416 - DNA, 25 bp, Homo sapien
gttatggctagctgctgaaaccagt

SEQ ID NO: 85417 - DNA, 25 bp, Homo sapien
gttatggctagcttctgaaaccagt

SEQ ID NO: 85418 - DNA, 25 bp, Homo sapien
gttatggcttttgacaacatcagcc

SEQ ID NO: 85419 - DNA, 25 bp, Homo sapien
gttatggcttttggcaacatcagcc

SEQ ID NO: 85420 - DNA, 25 bp, Homo sapien
gttatggtaagtcttgagagaaatg

SEQ ID NO: 85421 - DNA, 25 bp, Homo sapien
gttatggtaagttttgagagaaatg

SEQ ID NO: 85422 - DNA, 25 bp, Homo sapien
gttatgtagtggtaattcagtgagg

SEQ ID NO: 85423 - DNA, 25 bp, Homo sapien
gttatgtagtggtatttcagtgagg

SEQ ID NO: 85424 - DNA, 25 bp, Homo sapien
gttatgtcttcaagctcacccatct

SEQ ID NO: 85425 - DNA, 25 bp, Homo sapien
gttatgtcttcaggctcacccatct

SEQ ID NO: 85426 - DNA, 25 bp, Homo sapien
gttatgttgtttactgatatcctgc

SEQ ID NO: 85427 - DNA, 25 bp, Homo sapien
gttatgttgtttattgatatcctgc

SEQ ID NO: 85428 - DNA, 25 bp, Homo sapien
gttatgtttctcggaagcagtttaa

SEQ ID NO: 85429 - DNA, 25 bp, Homo sapien
gttatgtttcttggaagcagtttaa

SEQ ID NO: 85430 - DNA, 25 bp, Homo sapien
gttattaattctagtcattatccat

SEQ ID NO: 85431 - DNA, 25 bp, Homo sapien
gttattaattctagtcgttatccat

SEQ ID NO: 85432 - DNA, 25 bp, Homo sapien
gttattacagagctgtgaacttctt

SEQ ID NO: 85433 - DNA, 25 bp, Homo sapien
gttattacggagctgtgaacttctt

SEQ ID NO: 85434 - DNA, 25 bp, Homo sapien
gttattacttttcctgtacatctct

SEQ ID NO: 85435 - DNA, 25 bp, Homo sapien
gttattacttttcttgtacatctct

SEQ ID NO: 85436 - DNA, 25 bp, Homo sapien
gttattatccttccaaaaatagaca

SEQ ID NO: 85437 - DNA, 25 bp, Homo sapien
gttattatcgttccaaaaatagaca

SEQ ID NO: 85438 - DNA, 25 bp, Homo sapien
gttattcatgcaattcctgacaatg

SEQ ID NO: 85439 - DNA, 25 bp, Homo sapien
gttattcatgcagttcctgacaatg

SEQ ID NO: 85440 - DNA, 25 bp, Homo sapien
gttattccccatattgcgatggtag

SEQ ID NO: 85441 - DNA, 25 bp, Homo sapien
gttattccccatattgtgatggtag

SEQ ID NO: 85442 - DNA, 25 bp, Homo sapien
gttattcttagagattatgtcagga

SEQ ID NO: 85443 - DNA, 25 bp, Homo sapien
gttattcttagcgattatgtcagga

SEQ ID NO: 85444 - DNA, 25 bp, Homo sapien
gttattggccaaggacgtcgtagtt

SEQ ID NO: 85445 - DNA, 25 bp, Homo sapien
gttattggccaaggacttcgtagtt

SEQ ID NO: 85446 - DNA, 25 bp, Homo sapien
gttattgggatgaccccttgaataa

SEQ ID NO: 85447 - DNA, 25 bp, Homo sapien
gttattgggatgcccccttgaataa

SEQ ID NO: 85448 - DNA, 25 bp, Homo sapien
gttatttaagtcacccgtgaaattc

SEQ ID NO: 85449 - DNA, 25 bp, Homo sapien
gttatttacattacacattgcggtg

SEQ ID NO: 85450 - DNA, 25 bp, Homo sapien
gttatttacattacacgttgcggtg

SEQ ID NO: 85451 - DNA, 25 bp, Homo sapien
gttatttaggtcacccgtgaaattc

SEQ ID NO: 85452 - DNA, 25 bp, Homo sapien
gttatttaggtcatatttatttcaa

SEQ ID NO: 85453 - DNA, 25 bp, Homo sapien
gttatttaggtcgtatttatttcaa

SEQ ID NO: 85454 - DNA, 25 bp, Homo sapien
gttatttccatcatttttctccttt

SEQ ID NO: 85455 - DNA, 25 bp, Homo sapien
gttatttcgatcatttttctccttt

SEQ ID NO: 85456 - DNA, 25 bp, Homo sapien
gttatttgaagaccaatctggcata

SEQ ID NO: 85457 - DNA, 25 bp, Homo sapien
gttatttgaaggccaatctggcata

SEQ ID NO: 85458 - DNA, 25 bp, Homo sapien
gttatttgacaaaatttctcatgta

SEQ ID NO: 85459 - DNA, 25 bp, Homo sapien
gttatttgacataatttctcatgta

SEQ ID NO: 85460 - DNA, 25 bp, Homo sapien
gttattttagcataagctcatttgt

SEQ ID NO: 85461 - DNA, 25 bp, Homo sapien
gttattttagcgtaagctcatttgt

SEQ ID NO: 85462 - DNA, 25 bp, Homo sapien
gttattttcaccctcctgtcagatt

SEQ ID NO: 85463 - DNA, 25 bp, Homo sapien
gttattttcactctcctgtcagatt

SEQ ID NO: 85464 - DNA, 25 bp, Homo sapien
gttattttctcatggcatgacaatg

SEQ ID NO: 85465 - DNA, 25 bp, Homo sapien
gttattttcttccgacctcatatct

SEQ ID NO: 85466 - DNA, 25 bp, Homo sapien
gttattttcttctgacctcatatct

SEQ ID NO: 85467 - DNA, 25 bp, Homo sapien
gttattttggctcatgcttctacaa

SEQ ID NO: 85468 - DNA, 25 bp, Homo sapien
gttattttggcttatgcttctacaa

SEQ ID NO: 85469 - DNA, 25 bp, Homo sapien
gttattttttcatggcatgacaatg

SEQ ID NO: 85470 - DNA, 25 bp, Homo sapien
gttatttttttaaggcaagtatttt

SEQ ID NO: 85471 - DNA, 25 bp, Homo sapien
gttatttttttaatgcaagtatttt

SEQ ID NO: 85472 - DNA, 25 bp, Homo sapien
gttcaaaaccagcataagcaacaga

SEQ ID NO: 85473 - DNA, 25 bp, Homo sapien
gttcaaaaccagcataggcaacaga

SEQ ID NO: 85474 - DNA, 25 bp, Homo sapien
gttcaaaacttttcacttagttaat

SEQ ID NO: 85475 - DNA, 25 bp, Homo sapien
gttcaaaagacatgtacgagaataa

SEQ ID NO: 85476 - DNA, 25 bp, Homo sapien
gttcaaaagacatgtatgagaataa

SEQ ID NO: 85477 - DNA, 25 bp, Homo sapien
gttcaaaatagcctgtctctggaac

SEQ ID NO: 85478 - DNA, 25 bp, Homo sapien
gttcaaaataggctgtctctggaac

SEQ ID NO: 85479 - DNA, 25 bp, Homo sapien
gttcaaaatttttcacttagttaat

SEQ ID NO: 85480 - DNA, 25 bp, Homo sapien
gttcaaagcagcgctattcatatta

SEQ ID NO: 85481 - DNA, 25 bp, Homo sapien
gttcaaagcagtgctattcatatta

SEQ ID NO: 85482 - DNA, 25 bp, Homo sapien
gttcaaataaaaagtgatgtagata

SEQ ID NO: 85483 - DNA, 25 bp, Homo sapien
gttcaaatacaaagtgatgtagata

SEQ ID NO: 85484 - DNA, 25 bp, Homo sapien
gttcaaatatcacaggcagaagaat

SEQ ID NO: 85485 - DNA, 25 bp, Homo sapien
gttcaaatatcacatgcagaagaat

SEQ ID NO: 85486 - DNA, 25 bp, Homo sapien
gttcaaatcccagtggcatctacta

SEQ ID NO: 85487 - DNA, 25 bp, Homo sapien
gttcaaatcccggtggcatctacta

SEQ ID NO: 85488 - DNA, 25 bp, Homo sapien
gttcaacaatttttaaatcagggtt

SEQ ID NO: 85489 - DNA, 25 bp, Homo sapien
gttcaacaattttttaatcagggtt

SEQ ID NO: 85490 - DNA, 25 bp, Homo sapien
gttcaagaatggatatataactttg

SEQ ID NO: 85491 - DNA, 25 bp, Homo sapien
gttcaagaatggatatgtaactttg

SEQ ID NO: 85492 - DNA, 25 bp, Homo sapien
gttcaagattaggcatctgcatttg

SEQ ID NO: 85493 - DNA, 25 bp, Homo sapien
gttcaagattaggcttctgcatttg

SEQ ID NO: 85494 - DNA, 25 bp, Homo sapien
gttcaaggaagacaatgacagataa

SEQ ID NO: 85495 - DNA, 25 bp, Homo sapien
gttcaaggaagccaatgacagataa

SEQ ID NO: 85496 - DNA, 25 bp, Homo sapien
gttcaagggagactaaactggatga

SEQ ID NO: 85497 - DNA, 25 bp, Homo sapien
gttcaagggaggctaaactggatga

SEQ ID NO: 85498 - DNA, 25 bp, Homo sapien
gttcaagtgcagtaaataatgaatg

SEQ ID NO: 85499 - DNA, 25 bp, Homo sapien
gttcaagtgtagtaaataatgaatg

SEQ ID NO: 85500 - DNA, 25 bp, Homo sapien
gttcaatacaaacttattgagcaat

SEQ ID NO: 85501 - DNA, 25 bp, Homo sapien
gttcaatacaaatttattgagcaat

SEQ ID NO: 85502 - DNA, 25 bp, Homo sapien
gttcaatacaggactgaaggacaaa

SEQ ID NO: 85503 - DNA, 25 bp, Homo sapien
gttcaatacagggctgaaggacaaa

SEQ ID NO: 85504 - DNA, 25 bp, Homo sapien
gttcaatcatccgtctactattgga

SEQ ID NO: 85505 - DNA, 25 bp, Homo sapien
gttcaatcccaatagtttcttgatc

SEQ ID NO: 85506 - DNA, 25 bp, Homo sapien
gttcaatcccagtagtttcttgatc

SEQ ID NO: 85507 - DNA, 25 bp, Homo sapien
gttcaatcgtccgtctactattgga

SEQ ID NO: 85508 - DNA, 25 bp, Homo sapien
gttcaattttttaaagacatgttca

SEQ ID NO: 85509 - DNA, 25 bp, Homo sapien
gttcaattttttaaggacatgttca

SEQ ID NO: 85510 - DNA, 25 bp, Homo sapien
gttcacacacttgagaccaaccctt

SEQ ID NO: 85511 - DNA, 25 bp, Homo sapien
gttcacacatttgagaccaaccctt

SEQ ID NO: 85512 - DNA, 25 bp, Homo sapien
gttcacactagacgtgcctccaccc

SEQ ID NO: 85513 - DNA, 25 bp, Homo sapien
gttcacactagatgtgcctccaccc

SEQ ID NO: 85514 - DNA, 25 bp, Homo sapien
gttcacactccactgtatccctgcc

SEQ ID NO: 85515 - DNA, 25 bp, Homo sapien
gttcacacttcactgtatccctgcc

SEQ ID NO: 85516 - DNA, 25 bp, Homo sapien
gttcacatctgctctctgaatcagt

SEQ ID NO: 85517 - DNA, 25 bp, Homo sapien
gttcacatgaccatgaagtgggttc

SEQ ID NO: 85518 - DNA, 25 bp, Homo sapien
gttcacatgaccatgaggtgggttc

SEQ ID NO: 85519 - DNA, 25 bp, Homo sapien
gttcacatttgctctctgaatcagt

SEQ ID NO: 85520 - DNA, 25 bp, Homo sapien
gttcaccataacagtgttgggcttc

SEQ ID NO: 85521 - DNA, 25 bp, Homo sapien
gttcaccataacattgttgggcttc

SEQ ID NO: 85522 - DNA, 25 bp, Homo sapien
gttcaccattatagcttgattattt

SEQ ID NO: 85523 - DNA, 25 bp, Homo sapien
gttcaccattataggttgattattt

SEQ ID NO: 85524 - DNA, 25 bp, Homo sapien
gttcacctccctttgtatctcactc

SEQ ID NO: 85525 - DNA, 25 bp, Homo sapien
gttcacctccctttgtctctcactc

SEQ ID NO: 85526 - DNA, 25 bp, Homo sapien
gttcacgcctcactgccccacttct

SEQ ID NO: 85527 - DNA, 25 bp, Homo sapien
gttcacgcctcattgccccacttct

SEQ ID NO: 85528 - DNA, 25 bp, Homo sapien
gttcactcactccgaaacatgctgg

SEQ ID NO: 85529 - DNA, 25 bp, Homo sapien
gttcactcactctgaaacatgctgg

SEQ ID NO: 85530 - DNA, 25 bp, Homo sapien
gttcactggatgaattttgggtttt

SEQ ID NO: 85531 - DNA, 25 bp, Homo sapien
gttcactggttgaattttgggtttt

SEQ ID NO: 85532 - DNA, 25 bp, Homo sapien
gttcactgtgaacacgtttcttgtg

SEQ ID NO: 85533 - DNA, 25 bp, Homo sapien
gttcactgtgaacatgtttcttgtg

SEQ ID NO: 85534 - DNA, 25 bp, Homo sapien
gttcacttcgctactactgaagcat

SEQ ID NO: 85535 - DNA, 25 bp, Homo sapien
gttcactttcatatcaaatatatca

SEQ ID NO: 85536 - DNA, 25 bp, Homo sapien
gttcactttcatgtcaaatatatca

SEQ ID NO: 85537 - DNA, 25 bp, Homo sapien
gttcactttgctactactgaagcat

SEQ ID NO: 85538 - DNA, 25 bp, Homo sapien
gttcagaaaaaaacctgaggagaga

SEQ ID NO: 85539 - DNA, 25 bp, Homo sapien
gttcagaaaaaaatctgaggagaga

SEQ ID NO: 85540 - DNA, 25 bp, Homo sapien
gttcagaacatcacaaggtgtatgg

SEQ ID NO: 85541 - DNA, 25 bp, Homo sapien
gttcagaatatcacaaggtgtatgg

SEQ ID NO: 85542 - DNA, 25 bp, Homo sapien
gttcagaatatgctccttatccaag

SEQ ID NO: 85543 - DNA, 25 bp, Homo sapien
gttcagaatatgttccttatccaag

SEQ ID NO: 85544 - DNA, 25 bp, Homo sapien
gttcagacgtctgaaactggtgttc

SEQ ID NO: 85545 - DNA, 25 bp, Homo sapien
gttcagacgtctgatactggtgttc

SEQ ID NO: 85546 - DNA, 25 bp, Homo sapien
gttcagaggttgccatctagccttc

SEQ ID NO: 85547 - DNA, 25 bp, Homo sapien
gttcagaggttgccgtctagccttc

SEQ ID NO: 85548 - DNA, 25 bp, Homo sapien
gttcagagtcgctctttgaccatct

SEQ ID NO: 85549 - DNA, 25 bp, Homo sapien
gttcagagttgctctttgaccatct

SEQ ID NO: 85550 - DNA, 25 bp, Homo sapien
gttcagatagctcttggtctccaat

SEQ ID NO: 85551 - DNA, 25 bp, Homo sapien
gttcagatagctgttggtctccaat

SEQ ID NO: 85552 - DNA, 25 bp, Homo sapien
gttcagatggtcaacaacttcatat

SEQ ID NO: 85553 - DNA, 25 bp, Homo sapien
gttcagatggtcagcaacttcatat

SEQ ID NO: 85554 - DNA, 25 bp, Homo sapien
gttcagattcgctccttgttcttca

SEQ ID NO: 85555 - DNA, 25 bp, Homo sapien
gttcagatttgctccttgttcttca

SEQ ID NO: 85556 - DNA, 25 bp, Homo sapien
gttcagcaatttcctagctgaatag

SEQ ID NO: 85557 - DNA, 25 bp, Homo sapien
gttcagcaccatagctaagataatg

SEQ ID NO: 85558 - DNA, 25 bp, Homo sapien
gttcagcactttcctagctgaatag

SEQ ID NO: 85559 - DNA, 25 bp, Homo sapien
gttcagcagatatttgactctggat

SEQ ID NO: 85560 - DNA, 25 bp, Homo sapien
gttcagcaggtatttgactctggat

SEQ ID NO: 85561 - DNA, 25 bp, Homo sapien
gttcagcatcatagctaagataatg

SEQ ID NO: 85562 - DNA, 25 bp, Homo sapien
gttcagccaggaactaagaaagaag

SEQ ID NO: 85563 - DNA, 25 bp, Homo sapien
gttcagccaggatctaagaaagaag

SEQ ID NO: 85564 - DNA, 25 bp, Homo sapien
gttcagcttaccaggactttaaact

SEQ ID NO: 85565 - DNA, 25 bp, Homo sapien
gttcagcttaccaggattttaaact

SEQ ID NO: 85566 - DNA, 25 bp, Homo sapien
gttcagctttcctcctgcttgggta

SEQ ID NO: 85567 - DNA, 25 bp, Homo sapien
gttcagctttccttctgcttgggta

SEQ ID NO: 85568 - DNA, 25 bp, Homo sapien
gttcaggcaactttacttagcttgt

SEQ ID NO: 85569 - DNA, 25 bp, Homo sapien
gttcaggcagctttacttagcttgt

SEQ ID NO: 85570 - DNA, 25 bp, Homo sapien
gttcagggaggattaaaaagcactg

SEQ ID NO: 85571 - DNA, 25 bp, Homo sapien
gttcagggaggattaacaagcactg

SEQ ID NO: 85572 - DNA, 25 bp, Homo sapien
gttcaggttccagcccatgctgagg

SEQ ID NO: 85573 - DNA, 25 bp, Homo sapien
gttcaggttccagcccgtgctgagg

SEQ ID NO: 85574 - DNA, 25 bp, Homo sapien
gttcagtcgtctaataattttattc

SEQ ID NO: 85575 - DNA, 25 bp, Homo sapien
gttcagtctcagctacatactgttt

SEQ ID NO: 85576 - DNA, 25 bp, Homo sapien
gttcagtctcagctacgtactgttt

SEQ ID NO: 85577 - DNA, 25 bp, Homo sapien
gttcagtcttctaataattttattc

SEQ ID NO: 85578 - DNA, 25 bp, Homo sapien
gttcagtgatggctgagtgctggcc

SEQ ID NO: 85579 - DNA, 25 bp, Homo sapien
gttcagtgatgtctgagtgctggcc

SEQ ID NO: 85580 - DNA, 25 bp, Homo sapien
gttcagtgccttgaaataaaactaa

SEQ ID NO: 85581 - DNA, 25 bp, Homo sapien
gttcagtggaatgttagagagcaac

SEQ ID NO: 85582 - DNA, 25 bp, Homo sapien
gttcagtgtaatgttagagagcaac

SEQ ID NO: 85583 - DNA, 25 bp, Homo sapien
gttcagtgtcttgaaataaaactaa

SEQ ID NO: 85584 - DNA, 25 bp, Homo sapien
gttcagtgttttatccccagatcct

SEQ ID NO: 85585 - DNA, 25 bp, Homo sapien
gttcagtgttttgtccccagatcct

SEQ ID NO: 85586 - DNA, 25 bp, Homo sapien
gttcagttgatataatacaattctc

SEQ ID NO: 85587 - DNA, 25 bp, Homo sapien
gttcagttgcgtttctgtgatttgc

SEQ ID NO: 85588 - DNA, 25 bp, Homo sapien
gttcagttgcgtttttgtgatttgc

SEQ ID NO: 85589 - DNA, 25 bp, Homo sapien
gttcagttggtataatacaattctc

SEQ ID NO: 85590 - DNA, 25 bp, Homo sapien
gttcataatttccggtatggtttaa

SEQ ID NO: 85591 - DNA, 25 bp, Homo sapien
gttcataatttcctgtatggtttaa

SEQ ID NO: 85592 - DNA, 25 bp, Homo sapien
gttcatacaataagctcaagaaaca

SEQ ID NO: 85593 - DNA, 25 bp, Homo sapien
gttcatacaatgagctcaagaaaca

SEQ ID NO: 85594 - DNA, 25 bp, Homo sapien
gttcataggtagtaacaaagaatga

SEQ ID NO: 85595 - DNA, 25 bp, Homo sapien
gttcatagtagacactaagaaaatg

SEQ ID NO: 85596 - DNA, 25 bp, Homo sapien
gttcatagtagacagtaagaaaatg

SEQ ID NO: 85597 - DNA, 25 bp, Homo sapien
gttcatagttagtaacaaagaatga

SEQ ID NO: 85598 - DNA, 25 bp, Homo sapien
gttcatatcataaacattatccacc

SEQ ID NO: 85599 - DNA, 25 bp, Homo sapien
gttcatatcgtaaacattatccacc

SEQ ID NO: 85600 - DNA, 25 bp, Homo sapien
gttcatatgcctattatttcactcc

SEQ ID NO: 85601 - DNA, 25 bp, Homo sapien
gttcatatgtctattatttcactcc

SEQ ID NO: 85602 - DNA, 25 bp, Homo sapien
gttcatcaattgaattttacagctc

SEQ ID NO: 85603 - DNA, 25 bp, Homo sapien
gttcatcactcccgattgctctcag

SEQ ID NO: 85604 - DNA, 25 bp, Homo sapien
gttcatcactcctgattgctctcag

SEQ ID NO: 85605 - DNA, 25 bp, Homo sapien
gttcatcatttgaattttacagctc

SEQ ID NO: 85606 - DNA, 25 bp, Homo sapien
gttcatctattcagtacttcagata

SEQ ID NO: 85607 - DNA, 25 bp, Homo sapien
gttcatctctctatccatcactata

SEQ ID NO: 85608 - DNA, 25 bp, Homo sapien
gttcatctctctctccatcactata

SEQ ID NO: 85609 - DNA, 25 bp, Homo sapien
gttcatctgaattatcccctactgg

SEQ ID NO: 85610 - DNA, 25 bp, Homo sapien
gttcatctggattatcccctactgg

SEQ ID NO: 85611 - DNA, 25 bp, Homo sapien
gttcatctgttcagtacttcagata

SEQ ID NO: 85612 - DNA, 25 bp, Homo sapien
gttcatcttgtcacctttttattta

SEQ ID NO: 85613 - DNA, 25 bp, Homo sapien
gttcatcttgtcacttttttattta

SEQ ID NO: 85614 - DNA, 25 bp, Homo sapien
gttcatgacagtggctagaggtgat

SEQ ID NO: 85615 - DNA, 25 bp, Homo sapien
gttcatgaccgtggctagaggtgat

SEQ ID NO: 85616 - DNA, 25 bp, Homo sapien
gttcatgctgcaattttctttattc

SEQ ID NO: 85617 - DNA, 25 bp, Homo sapien
gttcatgctgcgattttctttattc

SEQ ID NO: 85618 - DNA, 25 bp, Homo sapien
gttcatgtgttaaaagaagcaatat

SEQ ID NO: 85619 - DNA, 25 bp, Homo sapien
gttcatgtgttagaagaagcaatat

SEQ ID NO: 85620 - DNA, 25 bp, Homo sapien
gttcatgttctcagaacgttaccac

SEQ ID NO: 85621 - DNA, 25 bp, Homo sapien
gttcatgttctcagaatgttaccac

SEQ ID NO: 85622 - DNA, 25 bp, Homo sapien
gttcattaaccaaaagagttgttgt

SEQ ID NO: 85623 - DNA, 25 bp, Homo sapien
gttcattaaccaaaagggttgttgt

SEQ ID NO: 85624 - DNA, 25 bp, Homo sapien
gttcattcaataatgcctgtttttg

SEQ ID NO: 85625 - DNA, 25 bp, Homo sapien
gttcattcaatattgcctgtttttg

SEQ ID NO: 85626 - DNA, 25 bp, Homo sapien
gttcattctccagtttacatctcca

SEQ ID NO: 85627 - DNA, 25 bp, Homo sapien
gttcattctccattttacatctcca

SEQ ID NO: 85628 - DNA, 25 bp, Homo sapien
gttcattcttaccctcagtgcacag

SEQ ID NO: 85629 - DNA, 25 bp, Homo sapien
gttcattcttactctcagtgcacag

SEQ ID NO: 85630 - DNA, 25 bp, Homo sapien
gttcattgtgccattgactatgttg

SEQ ID NO: 85631 - DNA, 25 bp, Homo sapien
gttcattgtgccattgtctatgttg

SEQ ID NO: 85632 - DNA, 25 bp, Homo sapien
gttcattttatgtgagcaaatggga

SEQ ID NO: 85633 - DNA, 25 bp, Homo sapien
gttcatttttagcattacccactag

SEQ ID NO: 85634 - DNA, 25 bp, Homo sapien
gttcatttttagcattccccactag

SEQ ID NO: 85635 - DNA, 25 bp, Homo sapien
gttcattttttgtgagcaaatggga

SEQ ID NO: 85636 - DNA, 25 bp, Homo sapien
gttcatttttttccctcaaagctgc

SEQ ID NO: 85637 - DNA, 25 bp, Homo sapien
gttcattttttttcctcaaagctgc

SEQ ID NO: 85638 - DNA, 25 bp, Homo sapien
gttccaaaaaggttagaagagatca

SEQ ID NO: 85639 - DNA, 25 bp, Homo sapien
gttccaaaaaggtttgaagagatca

SEQ ID NO: 85640 - DNA, 25 bp, Homo sapien
gttccaaacaccttccactggggtc

SEQ ID NO: 85641 - DNA, 25 bp, Homo sapien
gttccaaacaccttccgctggggtc

SEQ ID NO: 85642 - DNA, 25 bp, Homo sapien
gttccaaacagaagattatttgctg

SEQ ID NO: 85643 - DNA, 25 bp, Homo sapien
gttccaaacagaatattatttgctg

SEQ ID NO: 85644 - DNA, 25 bp, Homo sapien
gttccaaaccaaagcaaggattaaa

SEQ ID NO: 85645 - DNA, 25 bp, Homo sapien
gttccaaaccaaggcaaggattaaa

SEQ ID NO: 85646 - DNA, 25 bp, Homo sapien
gttccaacaaacccattcataggta

SEQ ID NO: 85647 - DNA, 25 bp, Homo sapien
gttccaacaaacccgttcataggta

SEQ ID NO: 85648 - DNA, 25 bp, Homo sapien
gttccaacagaacttcgtttacaaa

SEQ ID NO: 85649 - DNA, 25 bp, Homo sapien
gttccaacagaatttcgtttacaaa

SEQ ID NO: 85650 - DNA, 25 bp, Homo sapien
gttccaataaaacgttactaaaaca

SEQ ID NO: 85651 - DNA, 25 bp, Homo sapien
gttccaatagaacgttactaaaaca

SEQ ID NO: 85652 - DNA, 25 bp, Homo sapien
gttccaatgacatcaacttttatta

SEQ ID NO: 85653 - DNA, 25 bp, Homo sapien
gttccaatgacatctacttttatta

SEQ ID NO: 85654 - DNA, 25 bp, Homo sapien
gttccaattacgcctaattatttgt

SEQ ID NO: 85655 - DNA, 25 bp, Homo sapien
gttccaattactcctaattatttgt

SEQ ID NO: 85656 - DNA, 25 bp, Homo sapien
gttccacaaaagctaggagtaataa

SEQ ID NO: 85657 - DNA, 25 bp, Homo sapien
gttccacaaaagctgggagtaataa

SEQ ID NO: 85658 - DNA, 25 bp, Homo sapien
gttccacatcttcttgcctgggctc

SEQ ID NO: 85659 - DNA, 25 bp, Homo sapien
gttccacatcttcttgtctgggctc

SEQ ID NO: 85660 - DNA, 25 bp, Homo sapien
gttccaccaaatcaagaggtaaacc

SEQ ID NO: 85661 - DNA, 25 bp, Homo sapien
gttccaccaaatcgagaggtaaacc

SEQ ID NO: 85662 - DNA, 25 bp, Homo sapien
gttccagaaatgtgggttcaagttc

SEQ ID NO: 85663 - DNA, 25 bp, Homo sapien
gttccagaagaaattacttgaaagt

SEQ ID NO: 85664 - DNA, 25 bp, Homo sapien
gttccagaagaagttacttgaaagt

SEQ ID NO: 85665 - DNA, 25 bp, Homo sapien
gttccagagatgtgggttcaagttc

SEQ ID NO: 85666 - DNA, 25 bp, Homo sapien
gttccagcagccctactagtcagga

SEQ ID NO: 85667 - DNA, 25 bp, Homo sapien
gttccagcagccctgctagtcagga

SEQ ID NO: 85668 - DNA, 25 bp, Homo sapien
gttccatggttttacgcaaatgtct

SEQ ID NO: 85669 - DNA, 25 bp, Homo sapien
gttccatggttttatgcaaatgtct

SEQ ID NO: 85670 - DNA, 25 bp, Homo sapien
gttccattcctgttacacttgggag

SEQ ID NO: 85671 - DNA, 25 bp, Homo sapien
gttccattctgcacttggtggccac

SEQ ID NO: 85672 - DNA, 25 bp, Homo sapien
gttccattctgcatttggtggccac

SEQ ID NO: 85673 - DNA, 25 bp, Homo sapien
gttccattcttgttacacttgggag

SEQ ID NO: 85674 - DNA, 25 bp, Homo sapien
gttccattgctttttcttagagaag

SEQ ID NO: 85675 - DNA, 25 bp, Homo sapien
gttccattgttttttcttagagaag

SEQ ID NO: 85676 - DNA, 25 bp, Homo sapien
gttccatttcccttctctactttgc

SEQ ID NO: 85677 - DNA, 25 bp, Homo sapien
gttccatttcctttctctactttgc

SEQ ID NO: 85678 - DNA, 25 bp, Homo sapien
gttcccgaagccgatgggctctgtc

SEQ ID NO: 85679 - DNA, 25 bp, Homo sapien
gttcccgaagctgatgggctctgtc

SEQ ID NO: 85680 - DNA, 25 bp, Homo sapien
gttcccttcaatggattccaggctg

SEQ ID NO: 85681 - DNA, 25 bp, Homo sapien
gttcccttcaatgtattccaggctg

SEQ ID NO: 85682 - DNA, 25 bp, Homo sapien
gttccgccaatagaagacatccata

SEQ ID NO: 85683 - DNA, 25 bp, Homo sapien
gttccgccaatagaaggcatccata

SEQ ID NO: 85684 - DNA, 25 bp, Homo sapien
gttcctaagattcaacttcctctgt

SEQ ID NO: 85685 - DNA, 25 bp, Homo sapien
gttcctaagattcatcttcctctgt

SEQ ID NO: 85686 - DNA, 25 bp, Homo sapien
gttcctagtctgctagttgatatct

SEQ ID NO: 85687 - DNA, 25 bp, Homo sapien
gttcctagtgtgctagttgatatct

SEQ ID NO: 85688 - DNA, 25 bp, Homo sapien
gttcctataattggatagataagac

SEQ ID NO: 85689 - DNA, 25 bp, Homo sapien
gttcctataattggatggataagac

SEQ ID NO: 85690 - DNA, 25 bp, Homo sapien
gttcctatctgcacttcatttaaat

SEQ ID NO: 85691 - DNA, 25 bp, Homo sapien
gttcctatctgcactttatttaaat

SEQ ID NO: 85692 - DNA, 25 bp, Homo sapien
gttcctatgaaacagagaatttcaa

SEQ ID NO: 85693 - DNA, 25 bp, Homo sapien
gttcctatgaagcagagaatttcaa

SEQ ID NO: 85694 - DNA, 25 bp, Homo sapien
gttcctatgaagccatgttggaacc

SEQ ID NO: 85695 - DNA, 25 bp, Homo sapien
gttcctattaagccatgttggaacc

SEQ ID NO: 85696 - DNA, 25 bp, Homo sapien
gttcctcaatcttggtgctattgtc

SEQ ID NO: 85697 - DNA, 25 bp, Homo sapien
gttcctcagtcttggtgctattgtc

SEQ ID NO: 85698 - DNA, 25 bp, Homo sapien
gttcctcatgcactctgttgttagt

SEQ ID NO: 85699 - DNA, 25 bp, Homo sapien
gttcctcatgcattctgttgttagt

SEQ ID NO: 85700 - DNA, 25 bp, Homo sapien
gttcctccaacattaaagggcctag

SEQ ID NO: 85701 - DNA, 25 bp, Homo sapien
gttcctccaacattgaagggcctag

SEQ ID NO: 85702 - DNA, 25 bp, Homo sapien
gttcctccacgcgtaaatacaaaaa

SEQ ID NO: 85703 - DNA, 25 bp, Homo sapien
gttcctccatgcgtaaatacaaaaa

SEQ ID NO: 85704 - DNA, 25 bp, Homo sapien
gttcctctaatggctcatggggaaa

SEQ ID NO: 85705 - DNA, 25 bp, Homo sapien
gttcctctaatggctcgtggggaaa

SEQ ID NO: 85706 - DNA, 25 bp, Homo sapien
gttcctctgacaaacgtctctcagc

SEQ ID NO: 85707 - DNA, 25 bp, Homo sapien
gttcctctgacaaatgtctctcagc

SEQ ID NO: 85708 - DNA, 25 bp, Homo sapien
gttcctcttggtcctccagacacgc

SEQ ID NO: 85709 - DNA, 25 bp, Homo sapien
gttcctcttggttctccagacacgc

SEQ ID NO: 85710 - DNA, 25 bp, Homo sapien
gttcctgacaggttactggccacga

SEQ ID NO: 85711 - DNA, 25 bp, Homo sapien
gttcctgataggttactggccacga

SEQ ID NO: 85712 - DNA, 25 bp, Homo sapien
gttcctgcaattctaacatttgatc

SEQ ID NO: 85713 - DNA, 25 bp, Homo sapien
gttcctgcagttctaacatttgatc

SEQ ID NO: 85714 - DNA, 25 bp, Homo sapien
gttcctgcttcatgccactagctcg

SEQ ID NO: 85715 - DNA, 25 bp, Homo sapien
gttcctgcttcgtgccactagctcg

SEQ ID NO: 85716 - DNA, 25 bp, Homo sapien
gttcctgtgggagagcatcctagcc

SEQ ID NO: 85717 - DNA, 25 bp, Homo sapien
gttcctgtgggagagcgtcctagcc

SEQ ID NO: 85718 - DNA, 25 bp, Homo sapien
gttccttaatagttttttacatgcc

SEQ ID NO: 85719 - DNA, 25 bp, Homo sapien
gttccttaatatttttttacatgcc

SEQ ID NO: 85720 - DNA, 25 bp, Homo sapien
gttccttataaaacgacaaattcag

SEQ ID NO: 85721 - DNA, 25 bp, Homo sapien
gttccttataaaatgacaaattcag

SEQ ID NO: 85722 - DNA, 25 bp, Homo sapien
gttccttgacctagaaccaaagcta

SEQ ID NO: 85723 - DNA, 25 bp, Homo sapien
gttccttgacctagaatcaaagcta

SEQ ID NO: 85724 - DNA, 25 bp, Homo sapien
gttcctttaaagctcacgtctgtag

SEQ ID NO: 85725 - DNA, 25 bp, Homo sapien
gttcctttaaagctcatgtctgtag

SEQ ID NO: 85726 - DNA, 25 bp, Homo sapien
gttcctttgaaatacaagaagtttg

SEQ ID NO: 85727 - DNA, 25 bp, Homo sapien
gttcctttgaaatataagaagtttg

SEQ ID NO: 85728 - DNA, 25 bp, Homo sapien
gttcgagacttacatgctcatgact

SEQ ID NO: 85729 - DNA, 25 bp, Homo sapien
gttcgagatttacatgctcatgact

SEQ ID NO: 85730 - DNA, 25 bp, Homo sapien
gttcgagcagatacttataggaaag

SEQ ID NO: 85731 - DNA, 25 bp, Homo sapien
gttcgagcagatacttctaggaaag

SEQ ID NO: 85732 - DNA, 25 bp, Homo sapien
gttcgctgaattattcttgtttgtc

SEQ ID NO: 85733 - DNA, 25 bp, Homo sapien
gttcgctgagttattcttgtttgtc

SEQ ID NO: 85734 - DNA, 25 bp, Homo sapien
gttcgctgttattaatgtactccgt

SEQ ID NO: 85735 - DNA, 25 bp, Homo sapien
gttcgctgttattagtgtactccgt

SEQ ID NO: 85736 - DNA, 25 bp, Homo sapien
gttcggcttatctaatacgttgggt

SEQ ID NO: 85737 - DNA, 25 bp, Homo sapien
gttcggcttatctaatgcgttgggt

SEQ ID NO: 85738 - DNA, 25 bp, Homo sapien
gttcgtaatgctagacacatcgcca

SEQ ID NO: 85739 - DNA, 25 bp, Homo sapien
gttcgtaatgctggacacatcgcca

SEQ ID NO: 85740 - DNA, 25 bp, Homo sapien
gttctaaaactctaatctctttccc

SEQ ID NO: 85741 - DNA, 25 bp, Homo sapien
gttctaaaactttaatctctttccc

SEQ ID NO: 85742 - DNA, 25 bp, Homo sapien
gttctaagagaaaaatgattgtgct

SEQ ID NO: 85743 - DNA, 25 bp, Homo sapien
gttctaagagaaacatgattgtgct

SEQ ID NO: 85744 - DNA, 25 bp, Homo sapien
gttctaatgattggatataggttga

SEQ ID NO: 85745 - DNA, 25 bp, Homo sapien
gttctaatgattggatgtaggttga

SEQ ID NO: 85746 - DNA, 25 bp, Homo sapien
gttctacatgtgcatgttggatgtg

SEQ ID NO: 85747 - DNA, 25 bp, Homo sapien
gttctacatgtgtatgttggatgtg

SEQ ID NO: 85748 - DNA, 25 bp, Homo sapien
gttctaccaaggactcggtttccat

SEQ ID NO: 85749 - DNA, 25 bp, Homo sapien
gttctaccagggactcggtttccat

SEQ ID NO: 85750 - DNA, 25 bp, Homo sapien
gttctactagttcatcttctataag

SEQ ID NO: 85751 - DNA, 25 bp, Homo sapien
gttctactagttcgtcttctataag

SEQ ID NO: 85752 - DNA, 25 bp, Homo sapien
gttctactctgtctgcagatttaaa

SEQ ID NO: 85753 - DNA, 25 bp, Homo sapien
gttctactctgtcttcagatttaaa

SEQ ID NO: 85754 - DNA, 25 bp, Homo sapien
gttctaggatacaacaagaaggatc

SEQ ID NO: 85755 - DNA, 25 bp, Homo sapien
gttctaggataccacaagaaggatc

SEQ ID NO: 85756 - DNA, 25 bp, Homo sapien
gttctaggcagactcagaactactt

SEQ ID NO: 85757 - DNA, 25 bp, Homo sapien
gttctaggcagagtcagaactactt

SEQ ID NO: 85758 - DNA, 25 bp, Homo sapien
gttctaggcgcacttccttggactc

SEQ ID NO: 85759 - DNA, 25 bp, Homo sapien
gttctaggcgcatttccttggactc

SEQ ID NO: 85760 - DNA, 25 bp, Homo sapien
gttctataattctagcgcagagact

SEQ ID NO: 85761 - DNA, 25 bp, Homo sapien
gttctataattctagctcagagact

SEQ ID NO: 85762 - DNA, 25 bp, Homo sapien
gttctatcacccgtatctgctaaga

SEQ ID NO: 85763 - DNA, 25 bp, Homo sapien
gttctatcacttcctgaaataaaaa

SEQ ID NO: 85764 - DNA, 25 bp, Homo sapien
gttctatcatccgtatctgctaaga

SEQ ID NO: 85765 - DNA, 25 bp, Homo sapien
gttctatcgcttcctgaaataaaaa

SEQ ID NO: 85766 - DNA, 25 bp, Homo sapien
gttctattttgatacagtttgttag

SEQ ID NO: 85767 - DNA, 25 bp, Homo sapien
gttctattttgatatagtttgttag

SEQ ID NO: 85768 - DNA, 25 bp, Homo sapien
gttctcaacttttaactccaccctt

SEQ ID NO: 85769 - DNA, 25 bp, Homo sapien
gttctcaacttttcactccaccctt

SEQ ID NO: 85770 - DNA, 25 bp, Homo sapien
gttctcactctggcaaaatgggatg

SEQ ID NO: 85771 - DNA, 25 bp, Homo sapien
gttctcactctggcaagatgggatg

SEQ ID NO: 85772 - DNA, 25 bp, Homo sapien
gttctcactcttaatagaaactgct

SEQ ID NO: 85773 - DNA, 25 bp, Homo sapien
gttctcactcttagtagaaactgct

SEQ ID NO: 85774 - DNA, 25 bp, Homo sapien
gttctcagtcgtgtttctctaatga

SEQ ID NO: 85775 - DNA, 25 bp, Homo sapien
gttctcagtcgtgtttgtctaatga

SEQ ID NO: 85776 - DNA, 25 bp, Homo sapien
gttctcagtttgggagagaatatga

SEQ ID NO: 85777 - DNA, 25 bp, Homo sapien
gttctcagttttggagagaatatga

SEQ ID NO: 85778 - DNA, 25 bp, Homo sapien
gttctcatttgccttacgggtgtct

SEQ ID NO: 85779 - DNA, 25 bp, Homo sapien
gttctcatttgctttacgggtgtct

SEQ ID NO: 85780 - DNA, 25 bp, Homo sapien
gttctccagaggacactgctctgta

SEQ ID NO: 85781 - DNA, 25 bp, Homo sapien
gttctccagaggccactgctctgta

SEQ ID NO: 85782 - DNA, 25 bp, Homo sapien
gttctccatctcatcccttggtctt

SEQ ID NO: 85783 - DNA, 25 bp, Homo sapien
gttctccatctcgtcccttggtctt

SEQ ID NO: 85784 - DNA, 25 bp, Homo sapien
gttctcccaacccaggaaaaaggaa

SEQ ID NO: 85785 - DNA, 25 bp, Homo sapien
gttctcccaacctaggaaaaaggaa

SEQ ID NO: 85786 - DNA, 25 bp, Homo sapien
gttctcccattatccacgtttatcc

SEQ ID NO: 85787 - DNA, 25 bp, Homo sapien
gttctcccattatccatgtttatcc

SEQ ID NO: 85788 - DNA, 25 bp, Homo sapien
gttctccttatctaccctttaatat

SEQ ID NO: 85789 - DNA, 25 bp, Homo sapien
gttctccttatctaccttttaatat

SEQ ID NO: 85790 - DNA, 25 bp, Homo sapien
gttctcgccacatcagtgtttttct

SEQ ID NO: 85791 - DNA, 25 bp, Homo sapien
gttctcgccgcatcagtgtttttct

SEQ ID NO: 85792 - DNA, 25 bp, Homo sapien
gttctctaataatacacagagtgga

SEQ ID NO: 85793 - DNA, 25 bp, Homo sapien
gttctctaataatatacagagtgga

SEQ ID NO: 85794 - DNA, 25 bp, Homo sapien
gttctctctgggaaggattgtggta

SEQ ID NO: 85795 - DNA, 25 bp, Homo sapien
gttctctctgggtaggattgtggta

SEQ ID NO: 85796 - DNA, 25 bp, Homo sapien
gttctctgagacacatatctctgtc

SEQ ID NO: 85797 - DNA, 25 bp, Homo sapien
gttctctgagacacatttctctgtc

SEQ ID NO: 85798 - DNA, 25 bp, Homo sapien
gttctctgtacccctgaaaataagt

SEQ ID NO: 85799 - DNA, 25 bp, Homo sapien
gttctctgtactcctgaaaataagt

SEQ ID NO: 85800 - DNA, 25 bp, Homo sapien
gttctcttggcaagttcatagtcat

SEQ ID NO: 85801 - DNA, 25 bp, Homo sapien
gttctcttggccagttcatagtcat

SEQ ID NO: 85802 - DNA, 25 bp, Homo sapien
gttctctttccatctgggtctaggt

SEQ ID NO: 85803 - DNA, 25 bp, Homo sapien
gttctctttccgtctgggtctaggt

SEQ ID NO: 85804 - DNA, 25 bp, Homo sapien
gttctgaactcaaagatgacatctg

SEQ ID NO: 85805 - DNA, 25 bp, Homo sapien
gttctgaactcagagatgacatctg

SEQ ID NO: 85806 - DNA, 25 bp, Homo sapien
gttctgaattcaaaggtcagaaacc

SEQ ID NO: 85807 - DNA, 25 bp, Homo sapien
gttctgaattcgaaggtcagaaacc

SEQ ID NO: 85808 - DNA, 25 bp, Homo sapien
gttctgactatatgagtactaatag

SEQ ID NO: 85809 - DNA, 25 bp, Homo sapien
gttctgactatatgggtactaatag

SEQ ID NO: 85810 - DNA, 25 bp, Homo sapien
gttctgagcaacccaaagctggatg

SEQ ID NO: 85811 - DNA, 25 bp, Homo sapien
gttctgagcaacccgaagctggatg

SEQ ID NO: 85812 - DNA, 25 bp, Homo sapien
gttctgaggatagtggcctttgtag

SEQ ID NO: 85813 - DNA, 25 bp, Homo sapien
gttctgagggtagtggcctttgtag

SEQ ID NO: 85814 - DNA, 25 bp, Homo sapien
gttctgagttgaaattcagttagat

SEQ ID NO: 85815 - DNA, 25 bp, Homo sapien
gttctgagttgaatttcagttagat

SEQ ID NO: 85816 - DNA, 25 bp, Homo sapien
gttctgatgaggacatcaagctgct

SEQ ID NO: 85817 - DNA, 25 bp, Homo sapien
gttctgatgagggcatcaagctgct

SEQ ID NO: 85818 - DNA, 25 bp, Homo sapien
gttctgatgctatactattgtttta

SEQ ID NO: 85819 - DNA, 25 bp, Homo sapien
gttctgatggtatactattgtttta

SEQ ID NO: 85820 - DNA, 25 bp, Homo sapien
gttctgcacctactgattcaaacaa

SEQ ID NO: 85821 - DNA, 25 bp, Homo sapien
gttctgcatctactgattcaaacaa

SEQ ID NO: 85822 - DNA, 25 bp, Homo sapien
gttctgccatatagccacctgtgtt

SEQ ID NO: 85823 - DNA, 25 bp, Homo sapien
gttctgccatatagtcacctgtgtt

SEQ ID NO: 85824 - DNA, 25 bp, Homo sapien
gttctgccttcttcctttgttggca

SEQ ID NO: 85825 - DNA, 25 bp, Homo sapien
gttctgccttcttcgtttgttggca

SEQ ID NO: 85826 - DNA, 25 bp, Homo sapien
gttctgctcttaatttttacatatt

SEQ ID NO: 85827 - DNA, 25 bp, Homo sapien
gttctgctcttattttttacatatt

SEQ ID NO: 85828 - DNA, 25 bp, Homo sapien
gttctggtcaaagtcctattctaag

SEQ ID NO: 85829 - DNA, 25 bp, Homo sapien
gttctggtcaaggtcctattctaag

SEQ ID NO: 85830 - DNA, 25 bp, Homo sapien
gttctgtagactctgcgtgtgtgta

SEQ ID NO: 85831 - DNA, 25 bp, Homo sapien
gttctgtagactgtgcgtgtgtgta

SEQ ID NO: 85832 - DNA, 25 bp, Homo sapien
gttctgtcaaaaccctaacttacgg

SEQ ID NO: 85833 - DNA, 25 bp, Homo sapien
gttctgtcaaaagcctaacttacgg

SEQ ID NO: 85834 - DNA, 25 bp, Homo sapien
gttctgttgtttaaagaagcaaata

SEQ ID NO: 85835 - DNA, 25 bp, Homo sapien
gttctgttgtttaaagtagcaaata

SEQ ID NO: 85836 - DNA, 25 bp, Homo sapien
gttctgtttaaccatacctaaaaat

SEQ ID NO: 85837 - DNA, 25 bp, Homo sapien
gttctgtttaaccgtacctaaaaat

SEQ ID NO: 85838 - DNA, 25 bp, Homo sapien
gttctgtttaatgagagtgatgcag

SEQ ID NO: 85839 - DNA, 25 bp, Homo sapien
gttctgtttaatgatagtgatgcag

SEQ ID NO: 85840 - DNA, 25 bp, Homo sapien
gttcttaatgtactccaatgaaaga

SEQ ID NO: 85841 - DNA, 25 bp, Homo sapien
gttcttaatgtgctccaatgaaaga

SEQ ID NO: 85842 - DNA, 25 bp, Homo sapien
gttcttactcctagatatttgatct

SEQ ID NO: 85843 - DNA, 25 bp, Homo sapien
gttcttactgatcatttataaaagg

SEQ ID NO: 85844 - DNA, 25 bp, Homo sapien
gttcttactgatcgtttataaaagg

SEQ ID NO: 85845 - DNA, 25 bp, Homo sapien
gttcttactgctagatatttgatct

SEQ ID NO: 85846 - DNA, 25 bp, Homo sapien
gttcttagaataaatgacaataaag

SEQ ID NO: 85847 - DNA, 25 bp, Homo sapien
gttcttagacaaggtgtgaagaggc

SEQ ID NO: 85848 - DNA, 25 bp, Homo sapien
gttcttagacaatgtgtgaagaggc

SEQ ID NO: 85849 - DNA, 25 bp, Homo sapien
gttcttagagtaaatgacaataaag

SEQ ID NO: 85850 - DNA, 25 bp, Homo sapien
gttcttatcgcaccttattgacaat

SEQ ID NO: 85851 - DNA, 25 bp, Homo sapien
gttcttattgcaccttattgacaat

SEQ ID NO: 85852 - DNA, 25 bp, Homo sapien
gttcttcaacgtcctactctgtaag

SEQ ID NO: 85853 - DNA, 25 bp, Homo sapien
gttcttcaatgtcctactctgtaag

SEQ ID NO: 85854 - DNA, 25 bp, Homo sapien
gttcttcaggcataataggtgcagt

SEQ ID NO: 85855 - DNA, 25 bp, Homo sapien
gttcttcaggcctaataggtgcagt

SEQ ID NO: 85856 - DNA, 25 bp, Homo sapien
gttcttccatttctgttatgaaaga

SEQ ID NO: 85857 - DNA, 25 bp, Homo sapien
gttcttccgtttctgttatgaaaga

SEQ ID NO: 85858 - DNA, 25 bp, Homo sapien
gttcttcttgttcattcacatattc

SEQ ID NO: 85859 - DNA, 25 bp, Homo sapien
gttcttcttgttgattcacatattc

SEQ ID NO: 85860 - DNA, 25 bp, Homo sapien
gttcttgaccttggctatctctgtc

SEQ ID NO: 85861 - DNA, 25 bp, Homo sapien
gttcttgaccttggctgtctctgtc

SEQ ID NO: 85862 - DNA, 25 bp, Homo sapien
gttcttgagggtggaaagagagaac

SEQ ID NO: 85863 - DNA, 25 bp, Homo sapien
gttcttgagggtggaaggagagaac

SEQ ID NO: 85864 - DNA, 25 bp, Homo sapien
gttcttgttggctacaccctctggc

SEQ ID NO: 85865 - DNA, 25 bp, Homo sapien
gttcttgttggctccaccctctggc

SEQ ID NO: 85866 - DNA, 25 bp, Homo sapien
gttctttacagagcctcattatatt

SEQ ID NO: 85867 - DNA, 25 bp, Homo sapien
gttctttacagagtctcattatatt

SEQ ID NO: 85868 - DNA, 25 bp, Homo sapien
gttctttccacatattcgatttgct

SEQ ID NO: 85869 - DNA, 25 bp, Homo sapien
gttctttccacatatttgatttgct

SEQ ID NO: 85870 - DNA, 25 bp, Homo sapien
gttctttctctattgtttggatatt

SEQ ID NO: 85871 - DNA, 25 bp, Homo sapien
gttctttctctgggctcaagaagtt

SEQ ID NO: 85872 - DNA, 25 bp, Homo sapien
gttctttctctgtgctcaagaagtt

SEQ ID NO: 85873 - DNA, 25 bp, Homo sapien
gttctttctttattgtttggatatt

SEQ ID NO: 85874 - DNA, 25 bp, Homo sapien
gttctttgtagtctcataacaccct

SEQ ID NO: 85875 - DNA, 25 bp, Homo sapien
gttctttgtagtttcataacaccct

SEQ ID NO: 85876 - DNA, 25 bp, Homo sapien
gttctttgtcctatacctgtgaaga

SEQ ID NO: 85877 - DNA, 25 bp, Homo sapien
gttctttgtcctatacgtgtgaaga

SEQ ID NO: 85878 - DNA, 25 bp, Homo sapien
gttcttttacttttttaaatcttct

SEQ ID NO: 85879 - DNA, 25 bp, Homo sapien
gttcttttagcatatgtgaaaaaca

SEQ ID NO: 85880 - DNA, 25 bp, Homo sapien
gttcttttagcatgtgtgaaaaaca

SEQ ID NO: 85881 - DNA, 25 bp, Homo sapien
gttcttttataaatccattcactac

SEQ ID NO: 85882 - DNA, 25 bp, Homo sapien
gttcttttataaatccgttcactac

SEQ ID NO: 85883 - DNA, 25 bp, Homo sapien
gttcttttcattcaccaagccaact

SEQ ID NO: 85884 - DNA, 25 bp, Homo sapien
gttcttttcattcaccgagccaact

SEQ ID NO: 85885 - DNA, 25 bp, Homo sapien
gttcttttccctgcctgacatactt

SEQ ID NO: 85886 - DNA, 25 bp, Homo sapien
gttcttttcccttcctgacatactt

SEQ ID NO: 85887 - DNA, 25 bp, Homo sapien
gttctttttcttttttaaatcttct

SEQ ID NO: 85888 - DNA, 25 bp, Homo sapien
gttctttttttcggttatctgtgat

SEQ ID NO: 85889 - DNA, 25 bp, Homo sapien
gttcttttttttggttatctgtgat

SEQ ID NO: 85890 - DNA, 25 bp, Homo sapien
gttgaaaaatgactcaacaatggcc

SEQ ID NO: 85891 - DNA, 25 bp, Homo sapien
gttgaaaaatgagtcaacaatggcc

SEQ ID NO: 85892 - DNA, 25 bp, Homo sapien
gttgaaaacgtgttaataaagatgg

SEQ ID NO: 85893 - DNA, 25 bp, Homo sapien
gttgaaaatatgatcaatccaagat

SEQ ID NO: 85894 - DNA, 25 bp, Homo sapien
gttgaaaatatggtcaatccaagat

SEQ ID NO: 85895 - DNA, 25 bp, Homo sapien
gttgaaaatgcaattgacacactga

SEQ ID NO: 85896 - DNA, 25 bp, Homo sapien
gttgaaaatgcgattgacacactga

SEQ ID NO: 85897 - DNA, 25 bp, Homo sapien
gttgaaaatgtgttaataaagatgg

SEQ ID NO: 85898 - DNA, 25 bp, Homo sapien
gttgaaactgcaatgagcgttgatt

SEQ ID NO: 85899 - DNA, 25 bp, Homo sapien
gttgaaactgcagtgagcgttgatt

SEQ ID NO: 85900 - DNA, 25 bp, Homo sapien
gttgaaagaatgcttgtctccaatt

SEQ ID NO: 85901 - DNA, 25 bp, Homo sapien
gttgaaagagccagctccacaacca

SEQ ID NO: 85902 - DNA, 25 bp, Homo sapien
gttgaaagagccagcttcacaacca

SEQ ID NO: 85903 - DNA, 25 bp, Homo sapien
gttgaaagagtgcttgtctccaatt

SEQ ID NO: 85904 - DNA, 25 bp, Homo sapien
gttgaaagtggaaccgttagtccat

SEQ ID NO: 85905 - DNA, 25 bp, Homo sapien
gttgaaagtggatccgttagtccat

SEQ ID NO: 85906 - DNA, 25 bp, Homo sapien
gttgaaatcgtcctcaatgaaaaac

SEQ ID NO: 85907 - DNA, 25 bp, Homo sapien
gttgaaatcgtcctcagtgaaaaac

SEQ ID NO: 85908 - DNA, 25 bp, Homo sapien
gttgaaatgacaaccaaggctttag

SEQ ID NO: 85909 - DNA, 25 bp, Homo sapien
gttgaaatgacgaccaaggctttag

SEQ ID NO: 85910 - DNA, 25 bp, Homo sapien
gttgaaatttggccttcaatattag

SEQ ID NO: 85911 - DNA, 25 bp, Homo sapien
gttgaaatttggtcttcaatattag

SEQ ID NO: 85912 - DNA, 25 bp, Homo sapien
gttgaacacagactcagctcaacat

SEQ ID NO: 85913 - DNA, 25 bp, Homo sapien
gttgaacacagattcagctcaacat

SEQ ID NO: 85914 - DNA, 25 bp, Homo sapien
gttgaaccacttttgcatcactggg

SEQ ID NO: 85915 - DNA, 25 bp, Homo sapien
gttgaaccagtctccgggacatgga

SEQ ID NO: 85916 - DNA, 25 bp, Homo sapien
gttgaaccagtcttcgggacatgga

SEQ ID NO: 85917 - DNA, 25 bp, Homo sapien
gttgaaccatttttgcatcactggg

SEQ ID NO: 85918 - DNA, 25 bp, Homo sapien
gttgaacctgtcaaattgagttctc

SEQ ID NO: 85919 - DNA, 25 bp, Homo sapien
gttgaacctgttaaattgagttctc

SEQ ID NO: 85920 - DNA, 25 bp, Homo sapien
gttgaactcagtatgtttaatttca

SEQ ID NO: 85921 - DNA, 25 bp, Homo sapien
gttgaactcggtatgtttaatttca

SEQ ID NO: 85922 - DNA, 25 bp, Homo sapien
gttgaactgatgatgtggtttcttt

SEQ ID NO: 85923 - DNA, 25 bp, Homo sapien
gttgaactgatgctgtggtttcttt

SEQ ID NO: 85924 - DNA, 25 bp, Homo sapien
gttgaacttttgcgttccttcttgg

SEQ ID NO: 85925 - DNA, 25 bp, Homo sapien
gttgaacttttgtgttccttcttgg

SEQ ID NO: 85926 - DNA, 25 bp, Homo sapien
gttgaagaaagggagtttcccaccc

SEQ ID NO: 85927 - DNA, 25 bp, Homo sapien
gttgaagatagggagtttcccaccc

SEQ ID NO: 85928 - DNA, 25 bp, Homo sapien
gttgaagatcaaatagttgcaggtg

SEQ ID NO: 85929 - DNA, 25 bp, Homo sapien
gttgaagatcaaatggttgcaggtg

SEQ ID NO: 85930 - DNA, 25 bp, Homo sapien
gttgaagggagatcaacatgaaatg

SEQ ID NO: 85931 - DNA, 25 bp, Homo sapien
gttgaagggagatcaatatgaaatg

SEQ ID NO: 85932 - DNA, 25 bp, Homo sapien
gttgaataaaacaccaagtggagaa

SEQ ID NO: 85933 - DNA, 25 bp, Homo sapien
gttgaataaaacgccaagtggagaa

SEQ ID NO: 85934 - DNA, 25 bp, Homo sapien
gttgaatacttgaagggaacaatca

SEQ ID NO: 85935 - DNA, 25 bp, Homo sapien
gttgaatagttgaagggaacaatca

SEQ ID NO: 85936 - DNA, 25 bp, Homo sapien
gttgaatccctacatgataagaaac

SEQ ID NO: 85937 - DNA, 25 bp, Homo sapien
gttgaatccctacgtgataagaaac

SEQ ID NO: 85938 - DNA, 25 bp, Homo sapien
gttgaatctcagctctgccacatac

SEQ ID NO: 85939 - DNA, 25 bp, Homo sapien
gttgaatctcagctttgccacatac

SEQ ID NO: 85940 - DNA, 25 bp, Homo sapien
gttgaatctcctcttccttttctta

SEQ ID NO: 85941 - DNA, 25 bp, Homo sapien
gttgaatctcctcttctttttctta

SEQ ID NO: 85942 - DNA, 25 bp, Homo sapien
gttgaatctcttcagtagctcattt

SEQ ID NO: 85943 - DNA, 25 bp, Homo sapien
gttgaatctcttcattagctcattt

SEQ ID NO: 85944 - DNA, 25 bp, Homo sapien
gttgaatttccaacatctcactttt

SEQ ID NO: 85945 - DNA, 25 bp, Homo sapien
gttgaatttgcaacatctcactttt

SEQ ID NO: 85946 - DNA, 25 bp, Homo sapien
gttgacaacgatgctgaacaatagg

SEQ ID NO: 85947 - DNA, 25 bp, Homo sapien
gttgacaaggatgctgaacaatagg

SEQ ID NO: 85948 - DNA, 25 bp, Homo sapien
gttgacacagaaatacagacccagt

SEQ ID NO: 85949 - DNA, 25 bp, Homo sapien
gttgacacagaattacagacccagt

SEQ ID NO: 85950 - DNA, 25 bp, Homo sapien
gttgacacccgatcactcaatatca

SEQ ID NO: 85951 - DNA, 25 bp, Homo sapien
gttgacaccggatcactcaatatca

SEQ ID NO: 85952 - DNA, 25 bp, Homo sapien
gttgacagccttaagcagcatagag

SEQ ID NO: 85953 - DNA, 25 bp, Homo sapien
gttgacagccttatgcagcatagag

SEQ ID NO: 85954 - DNA, 25 bp, Homo sapien
gttgaccattaggcttcatcctggt

SEQ ID NO: 85955 - DNA, 25 bp, Homo sapien
gttgaccattaggctttatcctggt

SEQ ID NO: 85956 - DNA, 25 bp, Homo sapien
gttgaccttcagacttattttctca

SEQ ID NO: 85957 - DNA, 25 bp, Homo sapien
gttgaccttcagatttattttctca

SEQ ID NO: 85958 - DNA, 25 bp, Homo sapien
gttgactactttgacgtttctcaaa

SEQ ID NO: 85959 - DNA, 25 bp, Homo sapien
gttgactactttgaggtttctcaaa

SEQ ID NO: 85960 - DNA, 25 bp, Homo sapien
gttgactttaagatcgcataatgca

SEQ ID NO: 85961 - DNA, 25 bp, Homo sapien
gttgactttaagattgcataatgca

SEQ ID NO: 85962 - DNA, 25 bp, Homo sapien
gttgacttttgaccttgttccttgc

SEQ ID NO: 85963 - DNA, 25 bp, Homo sapien
gttgacttttggccttgttccttgc

SEQ ID NO: 85964 - DNA, 25 bp, Homo sapien
gttgagactagctgatacagttaag

SEQ ID NO: 85965 - DNA, 25 bp, Homo sapien
gttgagactagctggtacagttaag

SEQ ID NO: 85966 - DNA, 25 bp, Homo sapien
gttgagactccaagaactgtcatct

SEQ ID NO: 85967 - DNA, 25 bp, Homo sapien
gttgagactccatgaactgtcatct

SEQ ID NO: 85968 - DNA, 25 bp, Homo sapien
gttgagagacgagctatgggcaaga

SEQ ID NO: 85969 - DNA, 25 bp, Homo sapien
gttgagagatgagctatgggcaaga

SEQ ID NO: 85970 - DNA, 25 bp, Homo sapien
gttgaggaaactcaaagaaatacaa

SEQ ID NO: 85971 - DNA, 25 bp, Homo sapien
gttgaggaaactcagagaaatacaa

SEQ ID NO: 85972 - DNA, 25 bp, Homo sapien
gttgaggtataagacaacagggctt

SEQ ID NO: 85973 - DNA, 25 bp, Homo sapien
gttgaggtataaggcaacagggctt

SEQ ID NO: 85974 - DNA, 25 bp, Homo sapien
gttgaggtccttaattcagagactc

SEQ ID NO: 85975 - DNA, 25 bp, Homo sapien
gttgaggtccttagttcagagactc

SEQ ID NO: 85976 - DNA, 25 bp, Homo sapien
gttgagtaaataagtatcttgttga

SEQ ID NO: 85977 - DNA, 25 bp, Homo sapien
gttgagtaaatatgtatcttgttga

SEQ ID NO: 85978 - DNA, 25 bp, Homo sapien
gttgagtcaaaggccatagtgatga

SEQ ID NO: 85979 - DNA, 25 bp, Homo sapien
gttgagtccaaggccatagtgatga

SEQ ID NO: 85980 - DNA, 25 bp, Homo sapien
gttgagtgaaaccatgaataaaaca

SEQ ID NO: 85981 - DNA, 25 bp, Homo sapien
gttgagtgaaactatgaataaaaca

SEQ ID NO: 85982 - DNA, 25 bp, Homo sapien
gttgataaatgaacaaacacaatgt

SEQ ID NO: 85983 - DNA, 25 bp, Homo sapien
gttgataaatgagcaaacacaatgt

SEQ ID NO: 85984 - DNA, 25 bp, Homo sapien
gttgatacttttatgtaattctctg

SEQ ID NO: 85985 - DNA, 25 bp, Homo sapien
gttgatacttttatttaattctctg

SEQ ID NO: 85986 - DNA, 25 bp, Homo sapien
gttgataggcaaataaataacttat

SEQ ID NO: 85987 - DNA, 25 bp, Homo sapien
gttgataggtaaataaataacttat

SEQ ID NO: 85988 - DNA, 25 bp, Homo sapien
gttgatataagacggtcaactaaaa

SEQ ID NO: 85989 - DNA, 25 bp, Homo sapien
gttgatataagatggtcaactaaaa

SEQ ID NO: 85990 - DNA, 25 bp, Homo sapien
gttgatattgggtaagtttctgggc

SEQ ID NO: 85991 - DNA, 25 bp, Homo sapien
gttgatattgggtgagtttctgggc

SEQ ID NO: 85992 - DNA, 25 bp, Homo sapien
gttgatcaatgacactaatctacac

SEQ ID NO: 85993 - DNA, 25 bp, Homo sapien
gttgatcacgtggtctgccagggct

SEQ ID NO: 85994 - DNA, 25 bp, Homo sapien
gttgatcacgtggtttgccagggct

SEQ ID NO: 85995 - DNA, 25 bp, Homo sapien
gttgatcagtgacactaatctacac

SEQ ID NO: 85996 - DNA, 25 bp, Homo sapien
gttgatgagaatacagagcaactgg

SEQ ID NO: 85997 - DNA, 25 bp, Homo sapien
gttgatgagaatacggagcaactgg

SEQ ID NO: 85998 - DNA, 25 bp, Homo sapien
gttgatgccaatcgatactctgaca

SEQ ID NO: 85999 - DNA, 25 bp, Homo sapien
gttgatgccaattgatactctgaca

SEQ ID NO: 86000 - DNA, 25 bp, Homo sapien
gttgatgctcatgataatataaata

SEQ ID NO: 86001 - DNA, 25 bp, Homo sapien
gttgatgctgatgataatataaata

SEQ ID NO: 86002 - DNA, 25 bp, Homo sapien
gttgatggcttgaccgtggactttc

SEQ ID NO: 86003 - DNA, 25 bp, Homo sapien
gttgatggcttgatcgtggactttc

SEQ ID NO: 86004 - DNA, 25 bp, Homo sapien
gttgatgtcacctaatgtaaaaaaa

SEQ ID NO: 86005 - DNA, 25 bp, Homo sapien
gttgatgtcacctagtgtaaaaaaa

SEQ ID NO: 86006 - DNA, 25 bp, Homo sapien
gttgatgtgtctacctgcactcact

SEQ ID NO: 86007 - DNA, 25 bp, Homo sapien
gttgatgtgtctatctgcactcact

SEQ ID NO: 86008 - DNA, 25 bp, Homo sapien
gttgatgtttcacaagactgctctt

SEQ ID NO: 86009 - DNA, 25 bp, Homo sapien
gttgatgtttcacacgactgctctt

SEQ ID NO: 86010 - DNA, 25 bp, Homo sapien
gttgattcactaaacaaatgcctca

SEQ ID NO: 86011 - DNA, 25 bp, Homo sapien
gttgattcactgaacaaatgcctca

SEQ ID NO: 86012 - DNA, 25 bp, Homo sapien
gttgattcttcttctacggttccac

SEQ ID NO: 86013 - DNA, 25 bp, Homo sapien
gttgattcttcttctatggttccac

SEQ ID NO: 86014 - DNA, 25 bp, Homo sapien
gttgattgccagcaggtcagaaccc

SEQ ID NO: 86015 - DNA, 25 bp, Homo sapien
gttgattgccagcgggtcagaaccc

SEQ ID NO: 86016 - DNA, 25 bp, Homo sapien
gttgattgtctgcctgctttttgtt

SEQ ID NO: 86017 - DNA, 25 bp, Homo sapien
gttgattgtctgcttgctttttgtt

SEQ ID NO: 86018 - DNA, 25 bp, Homo sapien
gttgatttacctttaacaaacttta

SEQ ID NO: 86019 - DNA, 25 bp, Homo sapien
gttgatttatctttaacaaacttta

SEQ ID NO: 86020 - DNA, 25 bp, Homo sapien
gttgatttcaaccggactaagccaa

SEQ ID NO: 86021 - DNA, 25 bp, Homo sapien
gttgatttcaactggactaagccaa

SEQ ID NO: 86022 - DNA, 25 bp, Homo sapien
gttgattttatatatgccttcaagc

SEQ ID NO: 86023 - DNA, 25 bp, Homo sapien
gttgattttatatatggcttcaagc

SEQ ID NO: 86024 - DNA, 25 bp, Homo sapien
gttgcaaaaatacatgagattatat

SEQ ID NO: 86025 - DNA, 25 bp, Homo sapien
gttgcaaaaattcatgagattatat

SEQ ID NO: 86026 - DNA, 25 bp, Homo sapien
gttgcaagacttttctgtgtacatt

SEQ ID NO: 86027 - DNA, 25 bp, Homo sapien
gttgcaagccttttctgtgtacatt

SEQ ID NO: 86028 - DNA, 25 bp, Homo sapien
gttgcaataagataaccaatttata

SEQ ID NO: 86029 - DNA, 25 bp, Homo sapien
gttgcaatcagataaccaatttata

SEQ ID NO: 86030 - DNA, 25 bp, Homo sapien
gttgcacacaaaggcccaggaatca

SEQ ID NO: 86031 - DNA, 25 bp, Homo sapien
gttgcacacaaagtcccaggaatca

SEQ ID NO: 86032 - DNA, 25 bp, Homo sapien
gttgcacactagctacagcagagac

SEQ ID NO: 86033 - DNA, 25 bp, Homo sapien
gttgcacactaggtacagcagagac

SEQ ID NO: 86034 - DNA, 25 bp, Homo sapien
gttgcagaggcaccaatggttgcag

SEQ ID NO: 86035 - DNA, 25 bp, Homo sapien
gttgcagaggcagcaatggttgcag

SEQ ID NO: 86036 - DNA, 25 bp, Homo sapien
gttgcagcttctaggagctcagcag

SEQ ID NO: 86037 - DNA, 25 bp, Homo sapien
gttgcagcttctgggagctcagcag

SEQ ID NO: 86038 - DNA, 25 bp, Homo sapien
gttgcataataacccacgaagacaa

SEQ ID NO: 86039 - DNA, 25 bp, Homo sapien
gttgcataataagccacgaagacaa

SEQ ID NO: 86040 - DNA, 25 bp, Homo sapien
gttgcataatttgataactaattct

SEQ ID NO: 86041 - DNA, 25 bp, Homo sapien
gttgcataatttgctaactaattct

SEQ ID NO: 86042 - DNA, 25 bp, Homo sapien
gttgcatgtcccctcacgggtgcaa

SEQ ID NO: 86043 - DNA, 25 bp, Homo sapien
gttgcatgtcccctcatgggtgcaa

SEQ ID NO: 86044 - DNA, 25 bp, Homo sapien
gttgcatgtttcaaatgtatgaatc

SEQ ID NO: 86045 - DNA, 25 bp, Homo sapien
gttgcatgtttcaaatttatgaatc

SEQ ID NO: 86046 - DNA, 25 bp, Homo sapien
gttgcatttatctatcaattattat

SEQ ID NO: 86047 - DNA, 25 bp, Homo sapien
gttgcatttatctgtcaattattat

SEQ ID NO: 86048 - DNA, 25 bp, Homo sapien
gttgccaagcgccacccttccattg

SEQ ID NO: 86049 - DNA, 25 bp, Homo sapien
gttgccaagtgccacccttccattg

SEQ ID NO: 86050 - DNA, 25 bp, Homo sapien
gttgccaataggaaagtggaattcc

SEQ ID NO: 86051 - DNA, 25 bp, Homo sapien
gttgccaataggagagtggaattcc

SEQ ID NO: 86052 - DNA, 25 bp, Homo sapien
gttgccatatccatttctgtgatgc

SEQ ID NO: 86053 - DNA, 25 bp, Homo sapien
gttgccatatctatttctgtgatgc

SEQ ID NO: 86054 - DNA, 25 bp, Homo sapien
gttgcccaaaatttgcatgtgcagt

SEQ ID NO: 86055 - DNA, 25 bp, Homo sapien
gttgcccagaatttgcatgtgcagt

SEQ ID NO: 86056 - DNA, 25 bp, Homo sapien
gttgcctaatcgatcgaaagagggc

SEQ ID NO: 86057 - DNA, 25 bp, Homo sapien
gttgcctaatcgatggaaagagggc

SEQ ID NO: 86058 - DNA, 25 bp, Homo sapien
gttgcctagactataaactttagtt

SEQ ID NO: 86059 - DNA, 25 bp, Homo sapien
gttgcctagactgtaaactttagtt

SEQ ID NO: 86060 - DNA, 25 bp, Homo sapien
gttgcctagagcccgatgctatcca

SEQ ID NO: 86061 - DNA, 25 bp, Homo sapien
gttgcctagagctcgatgctatcca

SEQ ID NO: 86062 - DNA, 25 bp, Homo sapien
gttgcctccataagttaagatttta

SEQ ID NO: 86063 - DNA, 25 bp, Homo sapien
gttgcctccgtaagttaagatttta

SEQ ID NO: 86064 - DNA, 25 bp, Homo sapien
gttgcctgaggagacaaaaagaaag

SEQ ID NO: 86065 - DNA, 25 bp, Homo sapien
gttgcctgaggagataaaaagaaag

SEQ ID NO: 86066 - DNA, 25 bp, Homo sapien
gttgcctgcccaaaatagtacttag

SEQ ID NO: 86067 - DNA, 25 bp, Homo sapien
gttgcctgtccaaaatagtacttag

SEQ ID NO: 86068 - DNA, 25 bp, Homo sapien
gttgccttcttattggtaaggagtg

SEQ ID NO: 86069 - DNA, 25 bp, Homo sapien
gttgccttcttgttggtaaggagtg

SEQ ID NO: 86070 - DNA, 25 bp, Homo sapien
gttgcgatgaggagatagggagaga

SEQ ID NO: 86071 - DNA, 25 bp, Homo sapien
gttgcgatgaggagctagggagaga

SEQ ID NO: 86072 - DNA, 25 bp, Homo sapien
gttgcggcgtatcggagacgagttt

SEQ ID NO: 86073 - DNA, 25 bp, Homo sapien
gttgcggcgtattggagacgagttt

SEQ ID NO: 86074 - DNA, 25 bp, Homo sapien
gttgctaacaccactggctcatctc

SEQ ID NO: 86075 - DNA, 25 bp, Homo sapien
gttgctaacaccgctggctcatctc

SEQ ID NO: 86076 - DNA, 25 bp, Homo sapien
gttgctactttggtgacatttgtta

SEQ ID NO: 86077 - DNA, 25 bp, Homo sapien
gttgctactttggtgatatttgtta

SEQ ID NO: 86078 - DNA, 25 bp, Homo sapien
gttgctagaagtattatatcttttg

SEQ ID NO: 86079 - DNA, 25 bp, Homo sapien
gttgctagcagtattatatcttttg

SEQ ID NO: 86080 - DNA, 25 bp, Homo sapien
gttgctaggcacctgtatctctttg

SEQ ID NO: 86081 - DNA, 25 bp, Homo sapien
gttgctaggcatctgtatctctttg

SEQ ID NO: 86082 - DNA, 25 bp, Homo sapien
gttgctatattatttttcttctgat

SEQ ID NO: 86083 - DNA, 25 bp, Homo sapien
gttgctatattctttttcttctgat

SEQ ID NO: 86084 - DNA, 25 bp, Homo sapien
gttgctattgaaacctccaattcta

SEQ ID NO: 86085 - DNA, 25 bp, Homo sapien
gttgctattgatacctccaattcta

SEQ ID NO: 86086 - DNA, 25 bp, Homo sapien
gttgctcattttacatataaaggaa

SEQ ID NO: 86087 - DNA, 25 bp, Homo sapien
gttgctcattttacgtataaaggaa

SEQ ID NO: 86088 - DNA, 25 bp, Homo sapien
gttgctctcctccctctttgtaggc

SEQ ID NO: 86089 - DNA, 25 bp, Homo sapien
gttgctctgctccctctttgtaggc

SEQ ID NO: 86090 - DNA, 25 bp, Homo sapien
gttgctcttccactgatctctcaag

SEQ ID NO: 86091 - DNA, 25 bp, Homo sapien
gttgctcttcctctgatctctcaag

SEQ ID NO: 86092 - DNA, 25 bp, Homo sapien
gttgctgggtatcgagaaccaaact

SEQ ID NO: 86093 - DNA, 25 bp, Homo sapien
gttgctgggtattacgaaagcttca

SEQ ID NO: 86094 - DNA, 25 bp, Homo sapien
gttgctgggtattatgaaagcttca

SEQ ID NO: 86095 - DNA, 25 bp, Homo sapien
gttgctgggtattgagaaccaaact

SEQ ID NO: 86096 - DNA, 25 bp, Homo sapien
gttgcttaaataccacttccagaaa

SEQ ID NO: 86097 - DNA, 25 bp, Homo sapien
gttgcttaaattccacttccagaaa

SEQ ID NO: 86098 - DNA, 25 bp, Homo sapien
gttgcttacaacagtaaaagtcctg

SEQ ID NO: 86099 - DNA, 25 bp, Homo sapien
gttgcttacaatagtaaaagtcctg

SEQ ID NO: 86100 - DNA, 25 bp, Homo sapien
gttgcttagacaatgcctagtccag

SEQ ID NO: 86101 - DNA, 25 bp, Homo sapien
gttgcttagaccatgcctagtccag

SEQ ID NO: 86102 - DNA, 25 bp, Homo sapien
gttgcttagattgggtcgtgttttc

SEQ ID NO: 86103 - DNA, 25 bp, Homo sapien
gttgcttaggttgggtcgtgttttc

SEQ ID NO: 86104 - DNA, 25 bp, Homo sapien
gttgcttcgagtttgactttgaaat

SEQ ID NO: 86105 - DNA, 25 bp, Homo sapien
gttgcttcgagttttactttgaaat

SEQ ID NO: 86106 - DNA, 25 bp, Homo sapien
gttgctttatctccaatgtcacttt

SEQ ID NO: 86107 - DNA, 25 bp, Homo sapien
gttgctttatctcccatgtcacttt

SEQ ID NO: 86108 - DNA, 25 bp, Homo sapien
gttggaaggaagccaatcacagggt

SEQ ID NO: 86109 - DNA, 25 bp, Homo sapien
gttggaaggaagccgatcacagggt

SEQ ID NO: 86110 - DNA, 25 bp, Homo sapien
gttggaagttgctatcttattgcca

SEQ ID NO: 86111 - DNA, 25 bp, Homo sapien
gttggaagttggtatcttattgcca

SEQ ID NO: 86112 - DNA, 25 bp, Homo sapien
gttggaatgaaaccatactctgttt

SEQ ID NO: 86113 - DNA, 25 bp, Homo sapien
gttggaatgaaactatactctgttt

SEQ ID NO: 86114 - DNA, 25 bp, Homo sapien
gttggaccagcacagggcttctttg

SEQ ID NO: 86115 - DNA, 25 bp, Homo sapien
gttggaccagcgcagggcttctttg

SEQ ID NO: 86116 - DNA, 25 bp, Homo sapien
gttggagaactctttggccttggtc

SEQ ID NO: 86117 - DNA, 25 bp, Homo sapien
gttggagaactgtttggccttggtc

SEQ ID NO: 86118 - DNA, 25 bp, Homo sapien
gttggagaataacgaaagagaagta

SEQ ID NO: 86119 - DNA, 25 bp, Homo sapien
gttggagaataatgaaagagaagta

SEQ ID NO: 86120 - DNA, 25 bp, Homo sapien
gttggagccacaatagaactgcgtt

SEQ ID NO: 86121 - DNA, 25 bp, Homo sapien
gttggagcctcaatagaactgcgtt

SEQ ID NO: 86122 - DNA, 25 bp, Homo sapien
gttggagcttcctcatctcccattt

SEQ ID NO: 86123 - DNA, 25 bp, Homo sapien
gttggagcttcctcgtctcccattt

SEQ ID NO: 86124 - DNA, 25 bp, Homo sapien
gttggagggggatgtgcggctgagt

SEQ ID NO: 86125 - DNA, 25 bp, Homo sapien
gttggagggggatgtgtggctgagt

SEQ ID NO: 86126 - DNA, 25 bp, Homo sapien
gttggagttctaacctctggtacct

SEQ ID NO: 86127 - DNA, 25 bp, Homo sapien
gttggagttctaacctgtggtacct

SEQ ID NO: 86128 - DNA, 25 bp, Homo sapien
gttggattcagacacgcatgctgga

SEQ ID NO: 86129 - DNA, 25 bp, Homo sapien
gttggattgactcaaactcttttaa

SEQ ID NO: 86130 - DNA, 25 bp, Homo sapien
gttggattgacttaaactcttttaa

SEQ ID NO: 86131 - DNA, 25 bp, Homo sapien
gttggatttagacacgcatgctgga

SEQ ID NO: 86132 - DNA, 25 bp, Homo sapien
gttggatttctttctccatggttaa

SEQ ID NO: 86133 - DNA, 25 bp, Homo sapien
gttggatttctttttccatggttaa

SEQ ID NO: 86134 - DNA, 25 bp, Homo sapien
gttggatttgacttcttcttatgag

SEQ ID NO: 86135 - DNA, 25 bp, Homo sapien
gttggatttgatttcttcttatgag

SEQ ID NO: 86136 - DNA, 25 bp, Homo sapien
gttggattttgcttccattaatgtt

SEQ ID NO: 86137 - DNA, 25 bp, Homo sapien
gttggattttgtttccattaatgtt

SEQ ID NO: 86138 - DNA, 25 bp, Homo sapien
gttggcaaaggcacggggaaataag

SEQ ID NO: 86139 - DNA, 25 bp, Homo sapien
gttggcaacggcacggggaaataag

SEQ ID NO: 86140 - DNA, 25 bp, Homo sapien
gttggcactatgtgttaattgctta

SEQ ID NO: 86141 - DNA, 25 bp, Homo sapien
gttggcactatgtgtttattgctta

SEQ ID NO: 86142 - DNA, 25 bp, Homo sapien
gttggccaagtccgagctgtgtcct

SEQ ID NO: 86143 - DNA, 25 bp, Homo sapien
gttggccaagtctgagctgtgtcct

SEQ ID NO: 86144 - DNA, 25 bp, Homo sapien
gttggccgtagcgttaagtgtcaga

SEQ ID NO: 86145 - DNA, 25 bp, Homo sapien
gttggccgtagctttaagtgtcaga

SEQ ID NO: 86146 - DNA, 25 bp, Homo sapien
gttggcctgtagattgggtgtgcag

SEQ ID NO: 86147 - DNA, 25 bp, Homo sapien
gttggcctgtatattgggtgtgcag

SEQ ID NO: 86148 - DNA, 25 bp, Homo sapien
gttggcttcacctttgggctggctt

SEQ ID NO: 86149 - DNA, 25 bp, Homo sapien
gttggcttcacgtttgggctggctt

SEQ ID NO: 86150 - DNA, 25 bp, Homo sapien
gttgggaacacatgatgagctctga

SEQ ID NO: 86151 - DNA, 25 bp, Homo sapien
gttgggaacacgtgatgagctctga

SEQ ID NO: 86152 - DNA, 25 bp, Homo sapien
gttgggaatctttccaacaaaaagg

SEQ ID NO: 86153 - DNA, 25 bp, Homo sapien
gttgggaatctttctaacaaaaagg

SEQ ID NO: 86154 - DNA, 25 bp, Homo sapien
gttgggactgcaataaaacatgact

SEQ ID NO: 86155 - DNA, 25 bp, Homo sapien
gttgggactgccataaaacatgact

SEQ ID NO: 86156 - DNA, 25 bp, Homo sapien
gttgggagactaggtgctggatgtg

SEQ ID NO: 86157 - DNA, 25 bp, Homo sapien
gttgggagactaggtgttggatgtg

SEQ ID NO: 86158 - DNA, 25 bp, Homo sapien
gttgggagaggtaaagtgatctctc

SEQ ID NO: 86159 - DNA, 25 bp, Homo sapien
gttgggagaggtgaagtgatctctc

SEQ ID NO: 86160 - DNA, 25 bp, Homo sapien
gttgggatatgtagcctgtgggatc

SEQ ID NO: 86161 - DNA, 25 bp, Homo sapien
gttgggatatgtagtctgtgggatc

SEQ ID NO: 86162 - DNA, 25 bp, Homo sapien
gttgggatcatatagtgtgtaacct

SEQ ID NO: 86163 - DNA, 25 bp, Homo sapien
gttgggatcatatagtttgtaacct

SEQ ID NO: 86164 - DNA, 25 bp, Homo sapien
gttgggcacatggcatcagcataaa

SEQ ID NO: 86165 - DNA, 25 bp, Homo sapien
gttgggcacgtggcatcagcataaa

SEQ ID NO: 86166 - DNA, 25 bp, Homo sapien
gttgggccagtttccgattcctttt

SEQ ID NO: 86167 - DNA, 25 bp, Homo sapien
gttgggccagtttctgattcctttt

SEQ ID NO: 86168 - DNA, 25 bp, Homo sapien
gttggggagaagacgcaatagctct

SEQ ID NO: 86169 - DNA, 25 bp, Homo sapien
gttggggagaagatgcaatagctct

SEQ ID NO: 86170 - DNA, 25 bp, Homo sapien
gttggggagggcagccctgtgcatt

SEQ ID NO: 86171 - DNA, 25 bp, Homo sapien
gttggggagggcagccttgtgcatt

SEQ ID NO: 86172 - DNA, 25 bp, Homo sapien
gttggggcatgcatcctctgaagcc

SEQ ID NO: 86173 - DNA, 25 bp, Homo sapien
gttggggcttgcatcctctgaagcc

SEQ ID NO: 86174 - DNA, 25 bp, Homo sapien
gttgggttaggagaacaggcaaaat

SEQ ID NO: 86175 - DNA, 25 bp, Homo sapien
gttgggttaggagaccaggcaaaat

SEQ ID NO: 86176 - DNA, 25 bp, Homo sapien
gttggtaactgatatatgtgaatct

SEQ ID NO: 86177 - DNA, 25 bp, Homo sapien
gttggtaattgatatatgtgaatct

SEQ ID NO: 86178 - DNA, 25 bp, Homo sapien
gttggtagtagactggaattccttt

SEQ ID NO: 86179 - DNA, 25 bp, Homo sapien
gttggtagtagcctggaattccttt

SEQ ID NO: 86180 - DNA, 25 bp, Homo sapien
gttggtattcaccggtgtgacccta

SEQ ID NO: 86181 - DNA, 25 bp, Homo sapien
gttggtattcactggtgtgacccta

SEQ ID NO: 86182 - DNA, 25 bp, Homo sapien
gttggtcacgcccaagacaaaactc

SEQ ID NO: 86183 - DNA, 25 bp, Homo sapien
gttggtcatgcccaagacaaaactc

SEQ ID NO: 86184 - DNA, 25 bp, Homo sapien
gttggtccttaaaagtgggctttag

SEQ ID NO: 86185 - DNA, 25 bp, Homo sapien
gttggtccttagaagtgggctttag

SEQ ID NO: 86186 - DNA, 25 bp, Homo sapien
gttggtgatcatacaaagctggtat

SEQ ID NO: 86187 - DNA, 25 bp, Homo sapien
gttggtgattatacaaagctggtat

SEQ ID NO: 86188 - DNA, 25 bp, Homo sapien
gttggttaagagaaaggtatctcca

SEQ ID NO: 86189 - DNA, 25 bp, Homo sapien
gttggttaagagacaggtatctcca

SEQ ID NO: 86190 - DNA, 25 bp, Homo sapien
gttggttcaaggtcacaccatgagc

SEQ ID NO: 86191 - DNA, 25 bp, Homo sapien
gttggttccacaagaggctcaggga

SEQ ID NO: 86192 - DNA, 25 bp, Homo sapien
gttggttccacgagaggctcaggga

SEQ ID NO: 86193 - DNA, 25 bp, Homo sapien
gttggttccaggtcacaccatgagc

SEQ ID NO: 86194 - DNA, 25 bp, Homo sapien
gttggttgctcctaatttgagtgga

SEQ ID NO: 86195 - DNA, 25 bp, Homo sapien
gttggttgctcctgatttgagtgga

SEQ ID NO: 86196 - DNA, 25 bp, Homo sapien
gttggttggagtacagcagaaccac

SEQ ID NO: 86197 - DNA, 25 bp, Homo sapien
gttggttggagtactgcagaaccac

SEQ ID NO: 86198 - DNA, 25 bp, Homo sapien
gttgtaaaggtgtgggcaatgttct

SEQ ID NO: 86199 - DNA, 25 bp, Homo sapien
gttgtaaatgtgtgggcaatgttct

SEQ ID NO: 86200 - DNA, 25 bp, Homo sapien
gttgtaacaaaactcatacaagctc

SEQ ID NO: 86201 - DNA, 25 bp, Homo sapien
gttgtaacaaaattcatacaagctc

SEQ ID NO: 86202 - DNA, 25 bp, Homo sapien
gttgtaacaaatgacataaaggaga

SEQ ID NO: 86203 - DNA, 25 bp, Homo sapien
gttgtaacgaatgacataaaggaga

SEQ ID NO: 86204 - DNA, 25 bp, Homo sapien
gttgtaatatcccatgcgtacttgc

SEQ ID NO: 86205 - DNA, 25 bp, Homo sapien
gttgtaatatcccatgtgtacttgc

SEQ ID NO: 86206 - DNA, 25 bp, Homo sapien
gttgtaatattcaaatgcccaactg

SEQ ID NO: 86207 - DNA, 25 bp, Homo sapien
gttgtaatattcaagtgcccaactg

SEQ ID NO: 86208 - DNA, 25 bp, Homo sapien
gttgtaattcgtatcactgcatttt

SEQ ID NO: 86209 - DNA, 25 bp, Homo sapien
gttgtaatttgtatcactgcatttt

SEQ ID NO: 86210 - DNA, 25 bp, Homo sapien
gttgtacaaatggtagttcttattt

SEQ ID NO: 86211 - DNA, 25 bp, Homo sapien
gttgtacacatggtagttcttattt

SEQ ID NO: 86212 - DNA, 25 bp, Homo sapien
gttgtacagtgcaacagtttcatag

SEQ ID NO: 86213 - DNA, 25 bp, Homo sapien
gttgtacagtgcagcagtttcatag

SEQ ID NO: 86214 - DNA, 25 bp, Homo sapien
gttgtagatagccttacgtttcttt

SEQ ID NO: 86215 - DNA, 25 bp, Homo sapien
gttgtagatagccttatgtttcttt

SEQ ID NO: 86216 - DNA, 25 bp, Homo sapien
gttgtagccacattacacctttgca

SEQ ID NO: 86217 - DNA, 25 bp, Homo sapien
gttgtagccacattacgcctttgca

SEQ ID NO: 86218 - DNA, 25 bp, Homo sapien
gttgtaggctcatatgtaaaagttg

SEQ ID NO: 86219 - DNA, 25 bp, Homo sapien
gttgtaggctcatgtgtaaaagttg

SEQ ID NO: 86220 - DNA, 25 bp, Homo sapien
gttgtaggtcaccgggtgcagaacc

SEQ ID NO: 86221 - DNA, 25 bp, Homo sapien
gttgtaggtcactgggtgcagaacc

SEQ ID NO: 86222 - DNA, 25 bp, Homo sapien
gttgtagtacgatattcccaaatgt

SEQ ID NO: 86223 - DNA, 25 bp, Homo sapien
gttgtagtatgatattcccaaatgt

SEQ ID NO: 86224 - DNA, 25 bp, Homo sapien
gttgtagtcactgagccgcagcagg

SEQ ID NO: 86225 - DNA, 25 bp, Homo sapien
gttgtagtcactgagctgcagcagg

SEQ ID NO: 86226 - DNA, 25 bp, Homo sapien
gttgtagttcttctgtagattgtct

SEQ ID NO: 86227 - DNA, 25 bp, Homo sapien
gttgtagtttttctgtagattgtct

SEQ ID NO: 86228 - DNA, 25 bp, Homo sapien
gttgtatacgttaatgattgtctgc

SEQ ID NO: 86229 - DNA, 25 bp, Homo sapien
gttgtatatgttaatgattgtctgc

SEQ ID NO: 86230 - DNA, 25 bp, Homo sapien
gttgtatcatttctatttttgagat

SEQ ID NO: 86231 - DNA, 25 bp, Homo sapien
gttgtatcgtttctatttttgagat

SEQ ID NO: 86232 - DNA, 25 bp, Homo sapien
gttgtatgactaaagaagatgagta

SEQ ID NO: 86233 - DNA, 25 bp, Homo sapien
gttgtatgagtaaagaagatgagta

SEQ ID NO: 86234 - DNA, 25 bp, Homo sapien
gttgtatttctgatgttttaaaatg

SEQ ID NO: 86235 - DNA, 25 bp, Homo sapien
gttgtatttctgctgttttaaaatg

SEQ ID NO: 86236 - DNA, 25 bp, Homo sapien
gttgtcaccaccatttcaagaggga

SEQ ID NO: 86237 - DNA, 25 bp, Homo sapien
gttgtcaccaccgtttcaagaggga

SEQ ID NO: 86238 - DNA, 25 bp, Homo sapien
gttgtcacccaatggcagttgaaat

SEQ ID NO: 86239 - DNA, 25 bp, Homo sapien
gttgtcacccagtggcagttgaaat

SEQ ID NO: 86240 - DNA, 25 bp, Homo sapien
gttgtcagggctctgctgtaaatcc

SEQ ID NO: 86241 - DNA, 25 bp, Homo sapien
gttgtcagggctttgctgtaaatcc

SEQ ID NO: 86242 - DNA, 25 bp, Homo sapien
gttgtcagtctcgtttggacatggt

SEQ ID NO: 86243 - DNA, 25 bp, Homo sapien
gttgtcagtcttgtttggacatggt

SEQ ID NO: 86244 - DNA, 25 bp, Homo sapien
gttgtcatagaggcaaatgagatgc

SEQ ID NO: 86245 - DNA, 25 bp, Homo sapien
gttgtcatagagtcaaatgagatgc

SEQ ID NO: 86246 - DNA, 25 bp, Homo sapien
gttgtcatattatctctaggcagta

SEQ ID NO: 86247 - DNA, 25 bp, Homo sapien
gttgtcatattatttctaggcagta

SEQ ID NO: 86248 - DNA, 25 bp, Homo sapien
gttgtcatcttggaacacatgaaca

SEQ ID NO: 86249 - DNA, 25 bp, Homo sapien
gttgtcatcttgggacacatgaaca

SEQ ID NO: 86250 - DNA, 25 bp, Homo sapien
gttgtccaaaacaaacaaatattgc

SEQ ID NO: 86251 - DNA, 25 bp, Homo sapien
gttgtccaaaacaaccaaatattgc

SEQ ID NO: 86252 - DNA, 25 bp, Homo sapien
gttgtcccatgatgaaaccctagct

SEQ ID NO: 86253 - DNA, 25 bp, Homo sapien
gttgtcccatgttgaaaccctagct

SEQ ID NO: 86254 - DNA, 25 bp, Homo sapien
gttgtctcattatgatttctcacca

SEQ ID NO: 86255 - DNA, 25 bp, Homo sapien
gttgtctcgttatgatttctcacca

SEQ ID NO: 86256 - DNA, 25 bp, Homo sapien
gttgtctgatttttgtgctgtaaag

SEQ ID NO: 86257 - DNA, 25 bp, Homo sapien
gttgtctgatttttgttctgtaaag

SEQ ID NO: 86258 - DNA, 25 bp, Homo sapien
gttgtctgtaatgatttagttttaa

SEQ ID NO: 86259 - DNA, 25 bp, Homo sapien
gttgtctgtaattatttagttttaa

SEQ ID NO: 86260 - DNA, 25 bp, Homo sapien
gttgtgatcaaataatcctcacgta

SEQ ID NO: 86261 - DNA, 25 bp, Homo sapien
gttgtgatcaaatagtcctcacgta

SEQ ID NO: 86262 - DNA, 25 bp, Homo sapien
gttgtgattcacagatttaatccca

SEQ ID NO: 86263 - DNA, 25 bp, Homo sapien
gttgtgattcacatatttaatccca

SEQ ID NO: 86264 - DNA, 25 bp, Homo sapien
gttgtgattgtacgagtcaatacta

SEQ ID NO: 86265 - DNA, 25 bp, Homo sapien
gttgtgattgtgcgagtcaatacta

SEQ ID NO: 86266 - DNA, 25 bp, Homo sapien
gttgtgcaactcgtgacttcatcat

SEQ ID NO: 86267 - DNA, 25 bp, Homo sapien
gttgtgcaactcttgacttcatcat

SEQ ID NO: 86268 - DNA, 25 bp, Homo sapien
gttgtgcacatgcccatctgtggca

SEQ ID NO: 86269 - DNA, 25 bp, Homo sapien
gttgtgcacatgctcatctgtggca

SEQ ID NO: 86270 - DNA, 25 bp, Homo sapien
gttgtgccaactccgcaagaattga

SEQ ID NO: 86271 - DNA, 25 bp, Homo sapien
gttgtgccaactcctcaagaattga

SEQ ID NO: 86272 - DNA, 25 bp, Homo sapien
gttgtgccattcaccgaatataaag

SEQ ID NO: 86273 - DNA, 25 bp, Homo sapien
gttgtgccattcactgaatataaag

SEQ ID NO: 86274 - DNA, 25 bp, Homo sapien
gttgtggcaaggatgggactctgct

SEQ ID NO: 86275 - DNA, 25 bp, Homo sapien
gttgtggcaaggattggactctgct

SEQ ID NO: 86276 - DNA, 25 bp, Homo sapien
gttgtggcttatttcaccactgtac

SEQ ID NO: 86277 - DNA, 25 bp, Homo sapien
gttgtggcttatttcatcactgtac

SEQ ID NO: 86278 - DNA, 25 bp, Homo sapien
gttgtgtatgcaatcaaacaaccag

SEQ ID NO: 86279 - DNA, 25 bp, Homo sapien
gttgtgtatgcaattaaacaaccag

SEQ ID NO: 86280 - DNA, 25 bp, Homo sapien
gttgtgtcacctatcagcgggctat

SEQ ID NO: 86281 - DNA, 25 bp, Homo sapien
gttgtgtcatctatcagcgggctat

SEQ ID NO: 86282 - DNA, 25 bp, Homo sapien
gttgttagattctaaatttactact

SEQ ID NO: 86283 - DNA, 25 bp, Homo sapien
gttgttagattgtaaatttactact

SEQ ID NO: 86284 - DNA, 25 bp, Homo sapien
gttgttcctgtcatgaatggagtct

SEQ ID NO: 86285 - DNA, 25 bp, Homo sapien
gttgttcctgtcgtgaatggagtct

SEQ ID NO: 86286 - DNA, 25 bp, Homo sapien
gttgttctagcaccatgcatggact

SEQ ID NO: 86287 - DNA, 25 bp, Homo sapien
gttgttctcaaatggaataaatata

SEQ ID NO: 86288 - DNA, 25 bp, Homo sapien
gttgttctcgaatggaataaatata

SEQ ID NO: 86289 - DNA, 25 bp, Homo sapien
gttgttctggcaccatgcatggact

SEQ ID NO: 86290 - DNA, 25 bp, Homo sapien
gttgttgacacggggaaaatttcag

SEQ ID NO: 86291 - DNA, 25 bp, Homo sapien
gttgttgatacggggaaaatttcag

SEQ ID NO: 86292 - DNA, 25 bp, Homo sapien
gttgttgcaaaaatacatgagatta

SEQ ID NO: 86293 - DNA, 25 bp, Homo sapien
gttgttgcaaaaattcatgagatta

SEQ ID NO: 86294 - DNA, 25 bp, Homo sapien
gttgttgcatttatctatcaattat

SEQ ID NO: 86295 - DNA, 25 bp, Homo sapien
gttgttgcatttatctgtcaattat

SEQ ID NO: 86296 - DNA, 25 bp, Homo sapien
gttgttgcccctgactcagattatg

SEQ ID NO: 86297 - DNA, 25 bp, Homo sapien
gttgttgcctctgactcagattatg

SEQ ID NO: 86298 - DNA, 25 bp, Homo sapien
gttgttggactgtacttcctcactc

SEQ ID NO: 86299 - DNA, 25 bp, Homo sapien
gttgttggactgtatttcctcactc

SEQ ID NO: 86300 - DNA, 25 bp, Homo sapien
gttgttgtaaaggtgtgggcaatgt

SEQ ID NO: 86301 - DNA, 25 bp, Homo sapien
gttgttgtaaatgtgtgggcaatgt

SEQ ID NO: 86302 - DNA, 25 bp, Homo sapien
gttgttgttccaaagttacaattaa

SEQ ID NO: 86303 - DNA, 25 bp, Homo sapien
gttgttgtttcaaagttacaattaa

SEQ ID NO: 86304 - DNA, 25 bp, Homo sapien
gttgtttaaagaagcaaataccaag

SEQ ID NO: 86305 - DNA, 25 bp, Homo sapien
gttgtttaaagtagcaaataccaag

SEQ ID NO: 86306 - DNA, 25 bp, Homo sapien
gttgtttactgatatcctgcctccg

SEQ ID NO: 86307 - DNA, 25 bp, Homo sapien
gttgtttattgatatcctgcctccg

SEQ ID NO: 86308 - DNA, 25 bp, Homo sapien
gttgtttcacttatagaacacagac

SEQ ID NO: 86309 - DNA, 25 bp, Homo sapien
gttgtttcgcttatagaacacagac

SEQ ID NO: 86310 - DNA, 25 bp, Homo sapien
gttgtttctcctttgtatcacagca

SEQ ID NO: 86311 - DNA, 25 bp, Homo sapien
gttgtttctcctttttatcacagca

SEQ ID NO: 86312 - DNA, 25 bp, Homo sapien
gttgtttctgtctttttgtaatcta

SEQ ID NO: 86313 - DNA, 25 bp, Homo sapien
gttgtttctgtttttttgtaatcta

SEQ ID NO: 86314 - DNA, 25 bp, Homo sapien
gttgttttacaccactgagttccgg

SEQ ID NO: 86315 - DNA, 25 bp, Homo sapien
gttgttttataccactgagttccgg

SEQ ID NO: 86316 - DNA, 25 bp, Homo sapien
gttgttttctcacgactcattgttc

SEQ ID NO: 86317 - DNA, 25 bp, Homo sapien
gttgttttctcatgactcattgttc

SEQ ID NO: 86318 - DNA, 25 bp, Homo sapien
gttgttttctgtctatcctgctagg

SEQ ID NO: 86319 - DNA, 25 bp, Homo sapien
gttgttttctgtttatcctgctagg

SEQ ID NO: 86320 - DNA, 25 bp, Homo sapien
gttgttttgatacttaagtgtgata

SEQ ID NO: 86321 - DNA, 25 bp, Homo sapien
gttgttttgcctctgccgtctcttg

SEQ ID NO: 86322 - DNA, 25 bp, Homo sapien
gttgttttgcctctgctgtctcttg

SEQ ID NO: 86323 - DNA, 25 bp, Homo sapien
gttgttttggtacttaagtgtgata

SEQ ID NO: 86324 - DNA, 25 bp, Homo sapien
gttgtttttgatattaaaagcacaa

SEQ ID NO: 86325 - DNA, 25 bp, Homo sapien
gttgtttttgatgttaaaagcacaa

SEQ ID NO: 86326 - DNA, 25 bp, Homo sapien
gtttaaaaacaaagccttgaagtgc

SEQ ID NO: 86327 - DNA, 25 bp, Homo sapien
gtttaaaagccaaatatccaggttc

SEQ ID NO: 86328 - DNA, 25 bp, Homo sapien
gtttaaaagccagatatccaggttc

SEQ ID NO: 86329 - DNA, 25 bp, Homo sapien
gtttaaaatcaaagccttgaagtgc

SEQ ID NO: 86330 - DNA, 25 bp, Homo sapien
gtttaaagccactagtattagtaca

SEQ ID NO: 86331 - DNA, 25 bp, Homo sapien
gtttaaagccattagtattagtaca

SEQ ID NO: 86332 - DNA, 25 bp, Homo sapien
gtttaaatacgagtctgtgaaattc

SEQ ID NO: 86333 - DNA, 25 bp, Homo sapien
gtttaaatacgagtttgtgaaattc

SEQ ID NO: 86334 - DNA, 25 bp, Homo sapien
gtttaacatgcacgtattttgctgc

SEQ ID NO: 86335 - DNA, 25 bp, Homo sapien
gtttaacattcacgtattttgctgc

SEQ ID NO: 86336 - DNA, 25 bp, Homo sapien
gtttaaccatgtatctgactggcca

SEQ ID NO: 86337 - DNA, 25 bp, Homo sapien
gtttaaccgtgtatctgactggcca

SEQ ID NO: 86338 - DNA, 25 bp, Homo sapien
gtttaagaacaaatgcataaggaag

SEQ ID NO: 86339 - DNA, 25 bp, Homo sapien
gtttaagaataattttcaattacat

SEQ ID NO: 86340 - DNA, 25 bp, Homo sapien
gtttaagacatactagagctttgta

SEQ ID NO: 86341 - DNA, 25 bp, Homo sapien
gtttaagacgtactagagctttgta

SEQ ID NO: 86342 - DNA, 25 bp, Homo sapien
gtttaagagtaattttcaattacat

SEQ ID NO: 86343 - DNA, 25 bp, Homo sapien
gtttaagatcaaatgcataaggaag

SEQ ID NO: 86344 - DNA, 25 bp, Homo sapien
gtttaagccatgctggagtggtgct

SEQ ID NO: 86345 - DNA, 25 bp, Homo sapien
gtttaagccatgctggcgtggtgct

SEQ ID NO: 86346 - DNA, 25 bp, Homo sapien
gtttaagggtcactttgtaaattat

SEQ ID NO: 86347 - DNA, 25 bp, Homo sapien
gtttaagggtcattttgtaaattat

SEQ ID NO: 86348 - DNA, 25 bp, Homo sapien
gtttaatatatgactgctgactttg

SEQ ID NO: 86349 - DNA, 25 bp, Homo sapien
gtttaatatatgagtgctgactttg

SEQ ID NO: 86350 - DNA, 25 bp, Homo sapien
gtttaatcaaaccaacaagcattta

SEQ ID NO: 86351 - DNA, 25 bp, Homo sapien
gtttaatcaaatcaacaagcattta

SEQ ID NO: 86352 - DNA, 25 bp, Homo sapien
gtttaatcctgggttagcaaaaatg

SEQ ID NO: 86353 - DNA, 25 bp, Homo sapien
gtttaatcctggtttagcaaaaatg

SEQ ID NO: 86354 - DNA, 25 bp, Homo sapien
gtttaatgaagtatggttgcagaaa

SEQ ID NO: 86355 - DNA, 25 bp, Homo sapien
gtttaatgacgtatggttgcagaaa

SEQ ID NO: 86356 - DNA, 25 bp, Homo sapien
gtttacaaacattttctcacgatct

SEQ ID NO: 86357 - DNA, 25 bp, Homo sapien
gtttacaaatattttctcacgatct

SEQ ID NO: 86358 - DNA, 25 bp, Homo sapien
gtttacagaacgcatagaacagttg

SEQ ID NO: 86359 - DNA, 25 bp, Homo sapien
gtttacagaacgcatataacagttg

SEQ ID NO: 86360 - DNA, 25 bp, Homo sapien
gtttacagcctgatatactgaatat

SEQ ID NO: 86361 - DNA, 25 bp, Homo sapien
gtttacagcctggtatactgaatat

SEQ ID NO: 86362 - DNA, 25 bp, Homo sapien
gtttacagttggctaaatatggcat

SEQ ID NO: 86363 - DNA, 25 bp, Homo sapien
gtttacagttggttaaatatggcat

SEQ ID NO: 86364 - DNA, 25 bp, Homo sapien
gtttacattggtagcttaatcaagg

SEQ ID NO: 86365 - DNA, 25 bp, Homo sapien
gtttacatttgtagcttaatcaagg

SEQ ID NO: 86366 - DNA, 25 bp, Homo sapien
gtttaccaatcaacgtgtacactta

SEQ ID NO: 86367 - DNA, 25 bp, Homo sapien
gtttaccaatcaatgtgtacactta

SEQ ID NO: 86368 - DNA, 25 bp, Homo sapien
gtttactaaaggcataaactatcta

SEQ ID NO: 86369 - DNA, 25 bp, Homo sapien
gtttactaaaggcatagactatcta

SEQ ID NO: 86370 - DNA, 25 bp, Homo sapien
gtttactccactaacaatcttgctc

SEQ ID NO: 86371 - DNA, 25 bp, Homo sapien
gtttactccactaacagtcttgctc

SEQ ID NO: 86372 - DNA, 25 bp, Homo sapien
gtttagaattttgcataggcatcta

SEQ ID NO: 86373 - DNA, 25 bp, Homo sapien
gtttagaattttgcattggcatcta

SEQ ID NO: 86374 - DNA, 25 bp, Homo sapien
gtttagagacagctgattttcatat

SEQ ID NO: 86375 - DNA, 25 bp, Homo sapien
gtttagagaggaaaataggcagcat

SEQ ID NO: 86376 - DNA, 25 bp, Homo sapien
gtttagagaggaaaatgggcagcat

SEQ ID NO: 86377 - DNA, 25 bp, Homo sapien
gtttagagatagctgattttcatat

SEQ ID NO: 86378 - DNA, 25 bp, Homo sapien
gtttagatgaaaagaatcactccta

SEQ ID NO: 86379 - DNA, 25 bp, Homo sapien
gtttagatgaaaggaatcactccta

SEQ ID NO: 86380 - DNA, 25 bp, Homo sapien
gtttagcaatatttatgactgcctg

SEQ ID NO: 86381 - DNA, 25 bp, Homo sapien
gtttagcaatatttctgactgcctg

SEQ ID NO: 86382 - DNA, 25 bp, Homo sapien
gtttagctcccattttgaagagaga

SEQ ID NO: 86383 - DNA, 25 bp, Homo sapien
gtttagctcccatttttaagagaga

SEQ ID NO: 86384 - DNA, 25 bp, Homo sapien
gtttagctgaggatcattctgcttt

SEQ ID NO: 86385 - DNA, 25 bp, Homo sapien
gtttagctgaggctcattctgcttt

SEQ ID NO: 86386 - DNA, 25 bp, Homo sapien
gtttaggatctctacagaaagtggt

SEQ ID NO: 86387 - DNA, 25 bp, Homo sapien
gtttaggatctctatagaaagtggt

SEQ ID NO: 86388 - DNA, 25 bp, Homo sapien
gtttagggaaaccacatttacccac

SEQ ID NO: 86389 - DNA, 25 bp, Homo sapien
gtttagggaaatcacatttacccac

SEQ ID NO: 86390 - DNA, 25 bp, Homo sapien
gtttagggacgctcagcaggccagg

SEQ ID NO: 86391 - DNA, 25 bp, Homo sapien
gtttagggatgctcagcaggccagg

SEQ ID NO: 86392 - DNA, 25 bp, Homo sapien
gtttagtaatgatgccttgcagtcc

SEQ ID NO: 86393 - DNA, 25 bp, Homo sapien
gtttagtattgatgccttgcagtcc

SEQ ID NO: 86394 - DNA, 25 bp, Homo sapien
gtttagtgtcggtaagatctatatt

SEQ ID NO: 86395 - DNA, 25 bp, Homo sapien
gtttagtgttggtaagatctatatt

SEQ ID NO: 86396 - DNA, 25 bp, Homo sapien
gtttagttgttcaacatcatctcag

SEQ ID NO: 86397 - DNA, 25 bp, Homo sapien
gtttagttgttgaacatcatctcag

SEQ ID NO: 86398 - DNA, 25 bp, Homo sapien
gtttagtttgcaccattgttcctgt

SEQ ID NO: 86399 - DNA, 25 bp, Homo sapien
gtttagtttgcaccgttgttcctgt

SEQ ID NO: 86400 - DNA, 25 bp, Homo sapien
gtttataatacatttcatctttcat

SEQ ID NO: 86401 - DNA, 25 bp, Homo sapien
gtttataatacatttcgtctttcat

SEQ ID NO: 86402 - DNA, 25 bp, Homo sapien
gtttataccatcttttcctggaaag

SEQ ID NO: 86403 - DNA, 25 bp, Homo sapien
gtttatacgatcttttcctggaaag

SEQ ID NO: 86404 - DNA, 25 bp, Homo sapien
gtttatactatcaccatcatcagta

SEQ ID NO: 86405 - DNA, 25 bp, Homo sapien
gtttatactattaccatcatcagta

SEQ ID NO: 86406 - DNA, 25 bp, Homo sapien
gtttatagaagaactttccatctat

SEQ ID NO: 86407 - DNA, 25 bp, Homo sapien
gtttatagaaggactttccatctat

SEQ ID NO: 86408 - DNA, 25 bp, Homo sapien
gtttatagcaaatatacggctttag

SEQ ID NO: 86409 - DNA, 25 bp, Homo sapien
gtttatagcaaatatagggctttag

SEQ ID NO: 86410 - DNA, 25 bp, Homo sapien
gtttatagcagcattttaaaaagta

SEQ ID NO: 86411 - DNA, 25 bp, Homo sapien
gtttatagcagcgttttaaaaagta

SEQ ID NO: 86412 - DNA, 25 bp, Homo sapien
gtttataggccttcagtgtcagcaa

SEQ ID NO: 86413 - DNA, 25 bp, Homo sapien
gtttatagggcttcagtgtcagcaa

SEQ ID NO: 86414 - DNA, 25 bp, Homo sapien
gtttatatacaggcttatggtttat

SEQ ID NO: 86415 - DNA, 25 bp, Homo sapien
gtttatatataggcttatggtttat

SEQ ID NO: 86416 - DNA, 25 bp, Homo sapien
gtttatcagcaatattggcctatag

SEQ ID NO: 86417 - DNA, 25 bp, Homo sapien
gtttatcagcatttacaagctcagt

SEQ ID NO: 86418 - DNA, 25 bp, Homo sapien
gtttatcagcatttacgagctcagt

SEQ ID NO: 86419 - DNA, 25 bp, Homo sapien
gtttatcaggaatattggcctatag

SEQ ID NO: 86420 - DNA, 25 bp, Homo sapien
gtttatccaagtccaagaagtagta

SEQ ID NO: 86421 - DNA, 25 bp, Homo sapien
gtttatccaggtccaagaagtagta

SEQ ID NO: 86422 - DNA, 25 bp, Homo sapien
gtttatcccagcttaacattttaac

SEQ ID NO: 86423 - DNA, 25 bp, Homo sapien
gtttatcccagcttaatattttaac

SEQ ID NO: 86424 - DNA, 25 bp, Homo sapien
gtttatcgtggtataacaggcactg

SEQ ID NO: 86425 - DNA, 25 bp, Homo sapien
gtttatcgtggtgtaacaggcactg

SEQ ID NO: 86426 - DNA, 25 bp, Homo sapien
gtttatggcaataataggtagaacg

SEQ ID NO: 86427 - DNA, 25 bp, Homo sapien
gtttatgggaataataggtagaacg

SEQ ID NO: 86428 - DNA, 25 bp, Homo sapien
gtttatgtgcgaggtatttaggttt

SEQ ID NO: 86429 - DNA, 25 bp, Homo sapien
gtttatgtgtgaggtatttaggttt

SEQ ID NO: 86430 - DNA, 25 bp, Homo sapien
gtttatgttcctattgcctgtctcc

SEQ ID NO: 86431 - DNA, 25 bp, Homo sapien
gtttatgtttctattgcctgtctcc

SEQ ID NO: 86432 - DNA, 25 bp, Homo sapien
gtttattagaggtctagcagaaagt

SEQ ID NO: 86433 - DNA, 25 bp, Homo sapien
gtttattagaggtttagcagaaagt

SEQ ID NO: 86434 - DNA, 25 bp, Homo sapien
gtttattccagcccatgatgttgga

SEQ ID NO: 86435 - DNA, 25 bp, Homo sapien
gtttattccagcccgtgatgttgga

SEQ ID NO: 86436 - DNA, 25 bp, Homo sapien
gtttattcccaattgcactggacaa

SEQ ID NO: 86437 - DNA, 25 bp, Homo sapien
gtttattcctaattgcactggacaa

SEQ ID NO: 86438 - DNA, 25 bp, Homo sapien
gtttattcttctctggttgatgaga

SEQ ID NO: 86439 - DNA, 25 bp, Homo sapien
gtttattcttctttggttgatgaga

SEQ ID NO: 86440 - DNA, 25 bp, Homo sapien
gtttcaaagtacatgtaacatttat

SEQ ID NO: 86441 - DNA, 25 bp, Homo sapien
gtttcaaagtatatgtaacatttat

SEQ ID NO: 86442 - DNA, 25 bp, Homo sapien
gtttcaaatatttaaaaaaatctca

SEQ ID NO: 86443 - DNA, 25 bp, Homo sapien
gtttcaaatattttaaaaaatctca

SEQ ID NO: 86444 - DNA, 25 bp, Homo sapien
gtttcaactacagggaaacctattc

SEQ ID NO: 86445 - DNA, 25 bp, Homo sapien
gtttcaactacatggaaacctattc

SEQ ID NO: 86446 - DNA, 25 bp, Homo sapien
gtttcaagaacattgaatgcttaaa

SEQ ID NO: 86447 - DNA, 25 bp, Homo sapien
gtttcaagaccattgaatgcttaaa

SEQ ID NO: 86448 - DNA, 25 bp, Homo sapien
gtttcaagactaggaccaagaaatg

SEQ ID NO: 86449 - DNA, 25 bp, Homo sapien
gtttcaagattaggaccaagaaatg

SEQ ID NO: 86450 - DNA, 25 bp, Homo sapien
gtttcaagcggtgagcctagctcta

SEQ ID NO: 86451 - DNA, 25 bp, Homo sapien
gtttcaaggttaataccctgatagt

SEQ ID NO: 86452 - DNA, 25 bp, Homo sapien
gtttcaaggttagtaccctgatagt

SEQ ID NO: 86453 - DNA, 25 bp, Homo sapien
gtttcaagtggtgagcctagctcta

SEQ ID NO: 86454 - DNA, 25 bp, Homo sapien
gtttcaatgaacttgacctttagtg

SEQ ID NO: 86455 - DNA, 25 bp, Homo sapien
gtttcaatgaagttgacctttagtg

SEQ ID NO: 86456 - DNA, 25 bp, Homo sapien
gtttcacaaaaagtagatttgaaga

SEQ ID NO: 86457 - DNA, 25 bp, Homo sapien
gtttcacaacaagtagatttgaaga

SEQ ID NO: 86458 - DNA, 25 bp, Homo sapien
gtttcacagatgagaaaaattagat

SEQ ID NO: 86459 - DNA, 25 bp, Homo sapien
gtttcacagatgggaaaaattagat

SEQ ID NO: 86460 - DNA, 25 bp, Homo sapien
gtttcaccaaatcctaacagcagaa

SEQ ID NO: 86461 - DNA, 25 bp, Homo sapien
gtttcaccaaatcctagcagcagaa

SEQ ID NO: 86462 - DNA, 25 bp, Homo sapien
gtttcactaatatctgattttccct

SEQ ID NO: 86463 - DNA, 25 bp, Homo sapien
gtttcactaatatttgattttccct

SEQ ID NO: 86464 - DNA, 25 bp, Homo sapien
gtttcacttcgacctggaggccagt

SEQ ID NO: 86465 - DNA, 25 bp, Homo sapien
gtttcacttcgacttggaggccagt

SEQ ID NO: 86466 - DNA, 25 bp, Homo sapien
gtttcagaaaaccggcattctggct

SEQ ID NO: 86467 - DNA, 25 bp, Homo sapien
gtttcagaaaactggcattctggct

SEQ ID NO: 86468 - DNA, 25 bp, Homo sapien
gtttcagaaagaataggttcccaca

SEQ ID NO: 86469 - DNA, 25 bp, Homo sapien
gtttcagagagaataggttcccaca

SEQ ID NO: 86470 - DNA, 25 bp, Homo sapien
gtttcagcctcaaatttaacttctg

SEQ ID NO: 86471 - DNA, 25 bp, Homo sapien
gtttcagcctctaatttaacttctg

SEQ ID NO: 86472 - DNA, 25 bp, Homo sapien
gtttcaggaatgaagctgagtccca

SEQ ID NO: 86473 - DNA, 25 bp, Homo sapien
gtttcaggaatgaggctgagtccca

SEQ ID NO: 86474 - DNA, 25 bp, Homo sapien
gtttcaggcatagaataagaggctt

SEQ ID NO: 86475 - DNA, 25 bp, Homo sapien
gtttcaggcatagactaagaggctt

SEQ ID NO: 86476 - DNA, 25 bp, Homo sapien
gtttcaggctacataattctttgtt

SEQ ID NO: 86477 - DNA, 25 bp, Homo sapien
gtttcaggctacctaattctttgtt

SEQ ID NO: 86478 - DNA, 25 bp, Homo sapien
gtttcagggatccacgtagaagttg

SEQ ID NO: 86479 - DNA, 25 bp, Homo sapien
gtttcagggatccatgtagaagttg

SEQ ID NO: 86480 - DNA, 25 bp, Homo sapien
gtttcagtgagtacacagtcaacac

SEQ ID NO: 86481 - DNA, 25 bp, Homo sapien
gtttcagtgcgtacacagtcaacac

SEQ ID NO: 86482 - DNA, 25 bp, Homo sapien
gtttcagtggactatataatgtagt

SEQ ID NO: 86483 - DNA, 25 bp, Homo sapien
gtttcagtggactgtataatgtagt

SEQ ID NO: 86484 - DNA, 25 bp, Homo sapien
gtttcagttagcattttcagcttcc

SEQ ID NO: 86485 - DNA, 25 bp, Homo sapien
gtttcagttagtattttcagcttcc

SEQ ID NO: 86486 - DNA, 25 bp, Homo sapien
gtttcagttccgactctaacttgtg

SEQ ID NO: 86487 - DNA, 25 bp, Homo sapien
gtttcagttccgcctctaacttgtg

SEQ ID NO: 86488 - DNA, 25 bp, Homo sapien
gtttcagtttcaattcagtttcttt

SEQ ID NO: 86489 - DNA, 25 bp, Homo sapien
gtttcagtttcagttcagtttcttt

SEQ ID NO: 86490 - DNA, 25 bp, Homo sapien
gtttcatagatacatgtcaaaactt

SEQ ID NO: 86491 - DNA, 25 bp, Homo sapien
gtttcatagatatatgtcaaaactt

SEQ ID NO: 86492 - DNA, 25 bp, Homo sapien
gtttcatatacctccaattgtaaac

SEQ ID NO: 86493 - DNA, 25 bp, Homo sapien
gtttcatatacctccagttgtaaac

SEQ ID NO: 86494 - DNA, 25 bp, Homo sapien
gtttcatctgcagcaagcatctgtt

SEQ ID NO: 86495 - DNA, 25 bp, Homo sapien
gtttcatctgcagcgagcatctgtt

SEQ ID NO: 86496 - DNA, 25 bp, Homo sapien
gtttcatgattaccaagtggcagag

SEQ ID NO: 86497 - DNA, 25 bp, Homo sapien
gtttcatgattagcaagtggcagag

SEQ ID NO: 86498 - DNA, 25 bp, Homo sapien
gtttcatgcgtcttcctcctcctat

SEQ ID NO: 86499 - DNA, 25 bp, Homo sapien
gtttcatgcgttttcctcctcctat

SEQ ID NO: 86500 - DNA, 25 bp, Homo sapien
gtttcatgtgaaatcttttggagat

SEQ ID NO: 86501 - DNA, 25 bp, Homo sapien
gtttcatgtgaattcttttggagat

SEQ ID NO: 86502 - DNA, 25 bp, Homo sapien
gtttcattgagcaaatcatcaaact

SEQ ID NO: 86503 - DNA, 25 bp, Homo sapien
gtttcattgagcaagtcatcaaact

SEQ ID NO: 86504 - DNA, 25 bp, Homo sapien
gtttccaaatggaccaaggaaaaca

SEQ ID NO: 86505 - DNA, 25 bp, Homo sapien
gtttccaaatggaccagggaaaaca

SEQ ID NO: 86506 - DNA, 25 bp, Homo sapien
gtttccagagatcacatgtggaatc

SEQ ID NO: 86507 - DNA, 25 bp, Homo sapien
gtttccagcgatcacatgtggaatc

SEQ ID NO: 86508 - DNA, 25 bp, Homo sapien
gtttccaggcttacagaggaggcac

SEQ ID NO: 86509 - DNA, 25 bp, Homo sapien
gtttccaggtttacagaggaggcac

SEQ ID NO: 86510 - DNA, 25 bp, Homo sapien
gtttccatctgtcccacgcaaattc

SEQ ID NO: 86511 - DNA, 25 bp, Homo sapien
gtttccatctgtcccatgcaaattc

SEQ ID NO: 86512 - DNA, 25 bp, Homo sapien
gtttccatgcaccaataaaattcct

SEQ ID NO: 86513 - DNA, 25 bp, Homo sapien
gtttccatgtaccaataaaattcct

SEQ ID NO: 86514 - DNA, 25 bp, Homo sapien
gtttccatttatatgaaattcaata

SEQ ID NO: 86515 - DNA, 25 bp, Homo sapien
gtttccatttatgtgaaattcaata

SEQ ID NO: 86516 - DNA, 25 bp, Homo sapien
gtttcccacgaaacaatgacttctc

SEQ ID NO: 86517 - DNA, 25 bp, Homo sapien
gtttcccacgaaacgatgacttctc

SEQ ID NO: 86518 - DNA, 25 bp, Homo sapien
gtttccctatactctaagaatattc

SEQ ID NO: 86519 - DNA, 25 bp, Homo sapien
gtttccctggttttctactatgatt

SEQ ID NO: 86520 - DNA, 25 bp, Homo sapien
gtttccctgtactctaagaatattc

SEQ ID NO: 86521 - DNA, 25 bp, Homo sapien
gtttccctgtttttctactatgatt

SEQ ID NO: 86522 - DNA, 25 bp, Homo sapien
gtttccgacattccgtattagacat

SEQ ID NO: 86523 - DNA, 25 bp, Homo sapien
gtttccgacattctgtattagacat

SEQ ID NO: 86524 - DNA, 25 bp, Homo sapien
gtttcctaaggctgccataaaaaat

SEQ ID NO: 86525 - DNA, 25 bp, Homo sapien
gtttcctaaggctgccgtaaaaaat

SEQ ID NO: 86526 - DNA, 25 bp, Homo sapien
gtttcctaattacttcaccaaaatc

SEQ ID NO: 86527 - DNA, 25 bp, Homo sapien
gtttcctaattatttcaccaaaatc

SEQ ID NO: 86528 - DNA, 25 bp, Homo sapien
gtttcctcacacggcaccatggctg

SEQ ID NO: 86529 - DNA, 25 bp, Homo sapien
gtttcctcacagggcaccatggctg

SEQ ID NO: 86530 - DNA, 25 bp, Homo sapien
gtttcctctctgaaaacgtccatgg

SEQ ID NO: 86531 - DNA, 25 bp, Homo sapien
gtttcctctctgaaaatgtccatgg

SEQ ID NO: 86532 - DNA, 25 bp, Homo sapien
gtttcctgagacaactcctggtgat

SEQ ID NO: 86533 - DNA, 25 bp, Homo sapien
gtttcctgagaccactcctggtgat

SEQ ID NO: 86534 - DNA, 25 bp, Homo sapien
gtttccttacctattgcccattagg

SEQ ID NO: 86535 - DNA, 25 bp, Homo sapien
gtttccttacctgttgcccattagg

SEQ ID NO: 86536 - DNA, 25 bp, Homo sapien
gtttccttcaagtcttggagcatgc

SEQ ID NO: 86537 - DNA, 25 bp, Homo sapien
gtttccttcaagtctttgagcatgc

SEQ ID NO: 86538 - DNA, 25 bp, Homo sapien
gtttccttcctgtacagactggacc

SEQ ID NO: 86539 - DNA, 25 bp, Homo sapien
gtttccttcctgtacatactggacc

SEQ ID NO: 86540 - DNA, 25 bp, Homo sapien
gtttccttgctcatctcagatctgc

SEQ ID NO: 86541 - DNA, 25 bp, Homo sapien
gtttccttgctcgtctcagatctgc

SEQ ID NO: 86542 - DNA, 25 bp, Homo sapien
gtttcgtgatccgcctgcctggact

SEQ ID NO: 86543 - DNA, 25 bp, Homo sapien
gtttcgtgatccgcgtgcctggact

SEQ ID NO: 86544 - DNA, 25 bp, Homo sapien
gtttctaaaaattcattacttgcat

SEQ ID NO: 86545 - DNA, 25 bp, Homo sapien
gtttctaagaattcattacttgcat

SEQ ID NO: 86546 - DNA, 25 bp, Homo sapien
gtttctacagagtaacaaaacaaaa

SEQ ID NO: 86547 - DNA, 25 bp, Homo sapien
gtttctacagagtgacaaaacaaaa

SEQ ID NO: 86548 - DNA, 25 bp, Homo sapien
gtttctacatagcgtttgaaaacaa

SEQ ID NO: 86549 - DNA, 25 bp, Homo sapien
gtttctacatagtgtttgaaaacaa

SEQ ID NO: 86550 - DNA, 25 bp, Homo sapien
gtttctactgctcctgttttttttt

SEQ ID NO: 86551 - DNA, 25 bp, Homo sapien
gtttctactgcttctgttttttttt

SEQ ID NO: 86552 - DNA, 25 bp, Homo sapien
gtttctaggctatcatgcagtgagg

SEQ ID NO: 86553 - DNA, 25 bp, Homo sapien
gtttctaggctatgatgcagtgagg

SEQ ID NO: 86554 - DNA, 25 bp, Homo sapien
gtttctagtagactcgagctgctgt

SEQ ID NO: 86555 - DNA, 25 bp, Homo sapien
gtttctagtagacttgagctgctgt

SEQ ID NO: 86556 - DNA, 25 bp, Homo sapien
gtttctagtagtataaagttcccag

SEQ ID NO: 86557 - DNA, 25 bp, Homo sapien
gtttctagtagtatgaagttcccag

SEQ ID NO: 86558 - DNA, 25 bp, Homo sapien
gtttctcagctctgtttgcccgctg

SEQ ID NO: 86559 - DNA, 25 bp, Homo sapien
gtttctcaggcctaatgatttactg

SEQ ID NO: 86560 - DNA, 25 bp, Homo sapien
gtttctcaggcttaatgatttactg

SEQ ID NO: 86561 - DNA, 25 bp, Homo sapien
gtttctcagttctgtttgcccgctg

SEQ ID NO: 86562 - DNA, 25 bp, Homo sapien
gtttctcccagctccaatgttttca

SEQ ID NO: 86563 - DNA, 25 bp, Homo sapien
gtttctcccagctccagtgttttca

SEQ ID NO: 86564 - DNA, 25 bp, Homo sapien
gtttctcctttgtatcacagcatca

SEQ ID NO: 86565 - DNA, 25 bp, Homo sapien
gtttctcctttttatcacagcatca

SEQ ID NO: 86566 - DNA, 25 bp, Homo sapien
gtttctcttctacgactaatcctac

SEQ ID NO: 86567 - DNA, 25 bp, Homo sapien
gtttctcttctatgactaatcctac

SEQ ID NO: 86568 - DNA, 25 bp, Homo sapien
gtttctgataaaacgaggagactgc

SEQ ID NO: 86569 - DNA, 25 bp, Homo sapien
gtttctgataaaaggaggagactgc

SEQ ID NO: 86570 - DNA, 25 bp, Homo sapien
gtttctggtatagggaagagtttgg

SEQ ID NO: 86571 - DNA, 25 bp, Homo sapien
gtttctggtattcaacaaaatatcc

SEQ ID NO: 86572 - DNA, 25 bp, Homo sapien
gtttctggtcttcaacaaaatatcc

SEQ ID NO: 86573 - DNA, 25 bp, Homo sapien
gtttctggtgtagggaagagtttgg

SEQ ID NO: 86574 - DNA, 25 bp, Homo sapien
gtttctgtaaaactgcactgatagg

SEQ ID NO: 86575 - DNA, 25 bp, Homo sapien
gtttctgtaaaattgcactgatagg

SEQ ID NO: 86576 - DNA, 25 bp, Homo sapien
gtttctgtcttggccccagattttg

SEQ ID NO: 86577 - DNA, 25 bp, Homo sapien
gtttctgtcttggctccagattttg

SEQ ID NO: 86578 - DNA, 25 bp, Homo sapien
gtttctgtctttttgtaatctacca

SEQ ID NO: 86579 - DNA, 25 bp, Homo sapien
gtttctgtttttttgtaatctacca

SEQ ID NO: 86580 - DNA, 25 bp, Homo sapien
gtttcttaaaatctcattgaatctt

SEQ ID NO: 86581 - DNA, 25 bp, Homo sapien
gtttcttaaaatttcattgaatctt

SEQ ID NO: 86582 - DNA, 25 bp, Homo sapien
gtttcttcatgcatatccacatcag

SEQ ID NO: 86583 - DNA, 25 bp, Homo sapien
gtttcttcatgcatgtccacatcag

SEQ ID NO: 86584 - DNA, 25 bp, Homo sapien
gtttcttccaacaagttacttctag

SEQ ID NO: 86585 - DNA, 25 bp, Homo sapien
gtttcttccaaccagttacttctag

SEQ ID NO: 86586 - DNA, 25 bp, Homo sapien
gtttctttagtacgctccctgtctc

SEQ ID NO: 86587 - DNA, 25 bp, Homo sapien
gtttctttagtacgttccctgtctc

SEQ ID NO: 86588 - DNA, 25 bp, Homo sapien
gtttctttgtcacacgaagagagct

SEQ ID NO: 86589 - DNA, 25 bp, Homo sapien
gtttctttgtcacatgaagagagct

SEQ ID NO: 86590 - DNA, 25 bp, Homo sapien
gtttcttttcaggcagcgaaaaagt

SEQ ID NO: 86591 - DNA, 25 bp, Homo sapien
gtttcttttcaggcagtgaaaaagt

SEQ ID NO: 86592 - DNA, 25 bp, Homo sapien
gtttgaaaacgattgtcaaagaaag

SEQ ID NO: 86593 - DNA, 25 bp, Homo sapien
gtttgaaaacgattgttaaagaaag

SEQ ID NO: 86594 - DNA, 25 bp, Homo sapien
gtttgaaagctgtagaaaagtttac

SEQ ID NO: 86595 - DNA, 25 bp, Homo sapien
gtttgaaagctgtataaaagtttac

SEQ ID NO: 86596 - DNA, 25 bp, Homo sapien
gtttgaaatcgggaatacaatgata

SEQ ID NO: 86597 - DNA, 25 bp, Homo sapien
gtttgaaatcggggatacaatgata

SEQ ID NO: 86598 - DNA, 25 bp, Homo sapien
gtttgaagcccaccacggcattact

SEQ ID NO: 86599 - DNA, 25 bp, Homo sapien
gtttgaagggtcagtcacgtctcac

SEQ ID NO: 86600 - DNA, 25 bp, Homo sapien
gtttgaaggttcagtcacgtctcac

SEQ ID NO: 86601 - DNA, 25 bp, Homo sapien
gtttgaagtccaccacggcattact

SEQ ID NO: 86602 - DNA, 25 bp, Homo sapien
gtttgaagtgaagcgatactgacca

SEQ ID NO: 86603 - DNA, 25 bp, Homo sapien
gtttgaagtgaagctatactgacca

SEQ ID NO: 86604 - DNA, 25 bp, Homo sapien
gtttgaatatatgttgaggtgttaa

SEQ ID NO: 86605 - DNA, 25 bp, Homo sapien
gtttgaatatatgttggggtgttaa

SEQ ID NO: 86606 - DNA, 25 bp, Homo sapien
gtttgaatgtggatcaaaataaggt

SEQ ID NO: 86607 - DNA, 25 bp, Homo sapien
gtttgaatgtgggtcaaaataaggt

SEQ ID NO: 86608 - DNA, 25 bp, Homo sapien
gtttgacacacaataggcacttaat

SEQ ID NO: 86609 - DNA, 25 bp, Homo sapien
gtttgacagacaatcattcagacca

SEQ ID NO: 86610 - DNA, 25 bp, Homo sapien
gtttgacagacagtcattcagacca

SEQ ID NO: 86611 - DNA, 25 bp, Homo sapien
gtttgacatacaataggcacttaat

SEQ ID NO: 86612 - DNA, 25 bp, Homo sapien
gtttgaccataatgtgccctggtat

SEQ ID NO: 86613 - DNA, 25 bp, Homo sapien
gtttgaccgtaatgtgccctggtat

SEQ ID NO: 86614 - DNA, 25 bp, Homo sapien
gtttgactagttctcattcaatatt

SEQ ID NO: 86615 - DNA, 25 bp, Homo sapien
gtttgactgcacatcacaccagaag

SEQ ID NO: 86616 - DNA, 25 bp, Homo sapien
gtttgactgcacattacaccagaag

SEQ ID NO: 86617 - DNA, 25 bp, Homo sapien
gtttgactggttctcattcaatatt

SEQ ID NO: 86618 - DNA, 25 bp, Homo sapien
gtttgagattttatatcatacatag

SEQ ID NO: 86619 - DNA, 25 bp, Homo sapien
gtttgagattttgtatcatacatag

SEQ ID NO: 86620 - DNA, 25 bp, Homo sapien
gtttgagctctttcgcatttatttt

SEQ ID NO: 86621 - DNA, 25 bp, Homo sapien
gtttgagctcttttgcatttatttt

SEQ ID NO: 86622 - DNA, 25 bp, Homo sapien
gtttgaggttactgcacttgcattt

SEQ ID NO: 86623 - DNA, 25 bp, Homo sapien
gtttgaggttattgcacttgcattt

SEQ ID NO: 86624 - DNA, 25 bp, Homo sapien
gtttgagtggcagcctccatcgtac

SEQ ID NO: 86625 - DNA, 25 bp, Homo sapien
gtttgagtggcaggctccatcgtac

SEQ ID NO: 86626 - DNA, 25 bp, Homo sapien
gtttgataagcatatcagacatagt

SEQ ID NO: 86627 - DNA, 25 bp, Homo sapien
gtttgataagcgtatcagacatagt

SEQ ID NO: 86628 - DNA, 25 bp, Homo sapien
gtttgattccaaatgctctggaaag

SEQ ID NO: 86629 - DNA, 25 bp, Homo sapien
gtttgattccaagtgctctggaaag

SEQ ID NO: 86630 - DNA, 25 bp, Homo sapien
gtttgattttacgcaagaaaccata

SEQ ID NO: 86631 - DNA, 25 bp, Homo sapien
gtttgattttatgcaagaaaccata

SEQ ID NO: 86632 - DNA, 25 bp, Homo sapien
gtttgcaacataaccacagctgaat

SEQ ID NO: 86633 - DNA, 25 bp, Homo sapien
gtttgcaacataatcacagctgaat

SEQ ID NO: 86634 - DNA, 25 bp, Homo sapien
gtttgcacacttaaatggctactct

SEQ ID NO: 86635 - DNA, 25 bp, Homo sapien
gtttgcacagttcgaggctcaaaaa

SEQ ID NO: 86636 - DNA, 25 bp, Homo sapien
gtttgcacagtttgaggctcaaaaa

SEQ ID NO: 86637 - DNA, 25 bp, Homo sapien
gtttgcacgaacagcatggatttcc

SEQ ID NO: 86638 - DNA, 25 bp, Homo sapien
gtttgcacgaacaggatggatttcc

SEQ ID NO: 86639 - DNA, 25 bp, Homo sapien
gtttgcactcttaaatggctactct

SEQ ID NO: 86640 - DNA, 25 bp, Homo sapien
gtttgcagaaaaagttctgaagtct

SEQ ID NO: 86641 - DNA, 25 bp, Homo sapien
gtttgcagaaagagttctgaagtct

SEQ ID NO: 86642 - DNA, 25 bp, Homo sapien
gtttgcagcaacatggataaaccta

SEQ ID NO: 86643 - DNA, 25 bp, Homo sapien
gtttgcagcaacgtggataaaccta

SEQ ID NO: 86644 - DNA, 25 bp, Homo sapien
gtttgcaggcagagaaaaggagtgt

SEQ ID NO: 86645 - DNA, 25 bp, Homo sapien
gtttgcaggtagagaaaaggagtgt

SEQ ID NO: 86646 - DNA, 25 bp, Homo sapien
gtttgcataagtctgtccattcagt

SEQ ID NO: 86647 - DNA, 25 bp, Homo sapien
gtttgcatgagtctgtccattcagt

SEQ ID NO: 86648 - DNA, 25 bp, Homo sapien
gtttgcccaactttaagaattcagg

SEQ ID NO: 86649 - DNA, 25 bp, Homo sapien
gtttgcccaccactttgccagcgta

SEQ ID NO: 86650 - DNA, 25 bp, Homo sapien
gtttgcccagcactttgccagcgta

SEQ ID NO: 86651 - DNA, 25 bp, Homo sapien
gtttgcccatgatgtggtggtggag

SEQ ID NO: 86652 - DNA, 25 bp, Homo sapien
gtttgcccatggtgtggtggtggag

SEQ ID NO: 86653 - DNA, 25 bp, Homo sapien
gtttgcccgactttaagaattcagg

SEQ ID NO: 86654 - DNA, 25 bp, Homo sapien
gtttgcctctaacatacgtgcatcc

SEQ ID NO: 86655 - DNA, 25 bp, Homo sapien
gtttgcctctaacgtacgtgcatcc

SEQ ID NO: 86656 - DNA, 25 bp, Homo sapien
gtttgcgtagtcaacactttagtaa

SEQ ID NO: 86657 - DNA, 25 bp, Homo sapien
gtttgcgtagtcaacattttagtaa

SEQ ID NO: 86658 - DNA, 25 bp, Homo sapien
gtttgctaacaatgatgaaacaaat

SEQ ID NO: 86659 - DNA, 25 bp, Homo sapien
gtttgctagcaatgatgaaacaaat

SEQ ID NO: 86660 - DNA, 25 bp, Homo sapien
gtttgctcaaagattgtagtttact

SEQ ID NO: 86661 - DNA, 25 bp, Homo sapien
gtttgctcagagattgtagtttact

SEQ ID NO: 86662 - DNA, 25 bp, Homo sapien
gtttgctcagtcttatttcatgcct

SEQ ID NO: 86663 - DNA, 25 bp, Homo sapien
gtttgctcggtcttatttcatgcct

SEQ ID NO: 86664 - DNA, 25 bp, Homo sapien
gtttgctctataactggatcattca

SEQ ID NO: 86665 - DNA, 25 bp, Homo sapien
gtttgctctcactcttaatacaatc

SEQ ID NO: 86666 - DNA, 25 bp, Homo sapien
gtttgctctcactcttcatacaatc

SEQ ID NO: 86667 - DNA, 25 bp, Homo sapien
gtttgctctttaactggatcattca

SEQ ID NO: 86668 - DNA, 25 bp, Homo sapien
gtttgcttaacatacaccctggaaa

SEQ ID NO: 86669 - DNA, 25 bp, Homo sapien
gtttgcttaacgtacaccctggaaa

SEQ ID NO: 86670 - DNA, 25 bp, Homo sapien
gtttgcttacctctcctttacatca

SEQ ID NO: 86671 - DNA, 25 bp, Homo sapien
gtttgcttacctctgctttacatca

SEQ ID NO: 86672 - DNA, 25 bp, Homo sapien
gtttgcttcaaggtctacaaccaag

SEQ ID NO: 86673 - DNA, 25 bp, Homo sapien
gtttgctttaaggtctacaaccaag

SEQ ID NO: 86674 - DNA, 25 bp, Homo sapien
gtttgctttatggatgagcttagca

SEQ ID NO: 86675 - DNA, 25 bp, Homo sapien
gtttgctttgctctctctgccttta

SEQ ID NO: 86676 - DNA, 25 bp, Homo sapien
gtttgctttgctgtctctgccttta

SEQ ID NO: 86677 - DNA, 25 bp, Homo sapien
gtttgctttggctgtcttctgtttg

SEQ ID NO: 86678 - DNA, 25 bp, Homo sapien
gtttgctttgtggatgagcttagca

SEQ ID NO: 86679 - DNA, 25 bp, Homo sapien
gtttgcttttgctgtcttctgtttg

SEQ ID NO: 86680 - DNA, 25 bp, Homo sapien
gtttggaagtcacagaatgtcattt

SEQ ID NO: 86681 - DNA, 25 bp, Homo sapien
gtttggaagtcacataatgtcattt

SEQ ID NO: 86682 - DNA, 25 bp, Homo sapien
gtttggacacaacagaagaaataat

SEQ ID NO: 86683 - DNA, 25 bp, Homo sapien
gtttggacacaatagaagaaataat

SEQ ID NO: 86684 - DNA, 25 bp, Homo sapien
gtttggattaaagacaattcatgcc

SEQ ID NO: 86685 - DNA, 25 bp, Homo sapien
gtttggattaaaggcaattcatgcc

SEQ ID NO: 86686 - DNA, 25 bp, Homo sapien
gtttggcagtctcgttctctataaa

SEQ ID NO: 86687 - DNA, 25 bp, Homo sapien
gtttggcagtcttgttctctataaa

SEQ ID NO: 86688 - DNA, 25 bp, Homo sapien
gtttggccgtccatggtggcagtca

SEQ ID NO: 86689 - DNA, 25 bp, Homo sapien
gtttggccgtccgtggtggcagtca

SEQ ID NO: 86690 - DNA, 25 bp, Homo sapien
gtttggctgccacttgcttataaat

SEQ ID NO: 86691 - DNA, 25 bp, Homo sapien
gtttggctgccagttgcttataaat

SEQ ID NO: 86692 - DNA, 25 bp, Homo sapien
gtttgggaacaagctgactcttggt

SEQ ID NO: 86693 - DNA, 25 bp, Homo sapien
gtttgggaacaagctggctcttggt

SEQ ID NO: 86694 - DNA, 25 bp, Homo sapien
gtttgggatacactgtgcttcctag

SEQ ID NO: 86695 - DNA, 25 bp, Homo sapien
gtttgggatacgctgtgcttcctag

SEQ ID NO: 86696 - DNA, 25 bp, Homo sapien
gtttgggcttcgaacgtaactgaca

SEQ ID NO: 86697 - DNA, 25 bp, Homo sapien
gtttgggcttcgaatgtaactgaca

SEQ ID NO: 86698 - DNA, 25 bp, Homo sapien
gtttggggcatcgtgaatctcccta

SEQ ID NO: 86699 - DNA, 25 bp, Homo sapien
gtttggggcatcgtgactctcccta

SEQ ID NO: 86700 - DNA, 25 bp, Homo sapien
gtttgggtcattctgtcaggtaaaa

SEQ ID NO: 86701 - DNA, 25 bp, Homo sapien
gtttgggtcgttctgtcaggtaaaa

SEQ ID NO: 86702 - DNA, 25 bp, Homo sapien
gtttgggtggttcaaccaaggtcaa

SEQ ID NO: 86703 - DNA, 25 bp, Homo sapien
gtttgggttgttcaaccaaggtcaa

SEQ ID NO: 86704 - DNA, 25 bp, Homo sapien
gtttggtcacacgagttatagctat

SEQ ID NO: 86705 - DNA, 25 bp, Homo sapien
gtttggtcacatgagttatagctat

SEQ ID NO: 86706 - DNA, 25 bp, Homo sapien
gtttggtgcacccatatttgttctt

SEQ ID NO: 86707 - DNA, 25 bp, Homo sapien
gtttggtgcactcatatttgttctt

SEQ ID NO: 86708 - DNA, 25 bp, Homo sapien
gtttggtgtatctctccgttgtgaa

SEQ ID NO: 86709 - DNA, 25 bp, Homo sapien
gtttggtgtatttctccgttgtgaa

SEQ ID NO: 86710 - DNA, 25 bp, Homo sapien
gtttggtttacatgcagatgttttc

SEQ ID NO: 86711 - DNA, 25 bp, Homo sapien
gtttggtttacgtgcagatgttttc

SEQ ID NO: 86712 - DNA, 25 bp, Homo sapien
gtttggtttttttattgcccagacc

SEQ ID NO: 86713 - DNA, 25 bp, Homo sapien
gtttggtttttttgttgcccagacc

SEQ ID NO: 86714 - DNA, 25 bp, Homo sapien
gtttgtagaaacacctagatttgca

SEQ ID NO: 86715 - DNA, 25 bp, Homo sapien
gtttgtagaaatacctagatttgca

SEQ ID NO: 86716 - DNA, 25 bp, Homo sapien
gtttgtagttgagagacgagctatg

SEQ ID NO: 86717 - DNA, 25 bp, Homo sapien
gtttgtagttgagagatgagctatg

SEQ ID NO: 86718 - DNA, 25 bp, Homo sapien
gtttgtatatctgttcatattctgt

SEQ ID NO: 86719 - DNA, 25 bp, Homo sapien
gtttgtatatctgttcgtattctgt

SEQ ID NO: 86720 - DNA, 25 bp, Homo sapien
gtttgtatcagaagcgttttgtgta

SEQ ID NO: 86721 - DNA, 25 bp, Homo sapien
gtttgtatcagaagtgttttgtgta

SEQ ID NO: 86722 - DNA, 25 bp, Homo sapien
gtttgtatctggttattaaaagtta

SEQ ID NO: 86723 - DNA, 25 bp, Homo sapien
gtttgtatctgtttattaaaagtta

SEQ ID NO: 86724 - DNA, 25 bp, Homo sapien
gtttgtccccctccaccgcaaatgt

SEQ ID NO: 86725 - DNA, 25 bp, Homo sapien
gtttgtccccctccactgcaaatgt

SEQ ID NO: 86726 - DNA, 25 bp, Homo sapien
gtttgtctggtaaatgctgaccatt

SEQ ID NO: 86727 - DNA, 25 bp, Homo sapien
gtttgtctggtaaatgttgaccatt

SEQ ID NO: 86728 - DNA, 25 bp, Homo sapien
gtttgtctggtgatcattatttgcc

SEQ ID NO: 86729 - DNA, 25 bp, Homo sapien
gtttgtctggtgatgattatttgcc

SEQ ID NO: 86730 - DNA, 25 bp, Homo sapien
gtttgtgacagcaagctctaatcac

SEQ ID NO: 86731 - DNA, 25 bp, Homo sapien
gtttgtgacagcaatctctaatcac

SEQ ID NO: 86732 - DNA, 25 bp, Homo sapien
gtttgtgcaaatcctaggtgctcaa

SEQ ID NO: 86733 - DNA, 25 bp, Homo sapien
gtttgtgcaaatcttaggtgctcaa

SEQ ID NO: 86734 - DNA, 25 bp, Homo sapien
gtttgtgcccacagtaactccctgc

SEQ ID NO: 86735 - DNA, 25 bp, Homo sapien
gtttgtgcccaccgtaactccctgc

SEQ ID NO: 86736 - DNA, 25 bp, Homo sapien
gtttgtggagatggatggatccttc

SEQ ID NO: 86737 - DNA, 25 bp, Homo sapien
gtttgtggccaaccaaaatctccat

SEQ ID NO: 86738 - DNA, 25 bp, Homo sapien
gtttgtggccaaccgaaatctccat

SEQ ID NO: 86739 - DNA, 25 bp, Homo sapien
gtttgtggcgatggatggatccttc

SEQ ID NO: 86740 - DNA, 25 bp, Homo sapien
gtttgtggttaaaggtgaagatgtg

SEQ ID NO: 86741 - DNA, 25 bp, Homo sapien
gtttgtggttaaatgtgaagatgtg

SEQ ID NO: 86742 - DNA, 25 bp, Homo sapien
gtttgtgttgtacgctgttattgtg

SEQ ID NO: 86743 - DNA, 25 bp, Homo sapien
gtttgtgtttaggctgtagctggcc

SEQ ID NO: 86744 - DNA, 25 bp, Homo sapien
gtttgtgtttaggttgtagctggcc

SEQ ID NO: 86745 - DNA, 25 bp, Homo sapien
gtttgtgttttacgctgttattgtg

SEQ ID NO: 86746 - DNA, 25 bp, Homo sapien
gtttgttcacactccactgtatccc

SEQ ID NO: 86747 - DNA, 25 bp, Homo sapien
gtttgttcacacttcactgtatccc

SEQ ID NO: 86748 - DNA, 25 bp, Homo sapien
gtttgttccaatttcatttagttct

SEQ ID NO: 86749 - DNA, 25 bp, Homo sapien
gtttgttcctcacctaacattccag

SEQ ID NO: 86750 - DNA, 25 bp, Homo sapien
gtttgttcgtcacctaacattccag

SEQ ID NO: 86751 - DNA, 25 bp, Homo sapien
gtttgttctaatttcatttagttct

SEQ ID NO: 86752 - DNA, 25 bp, Homo sapien
gtttgttggatcagcggccaagcag

SEQ ID NO: 86753 - DNA, 25 bp, Homo sapien
gtttgttggatcagtggccaagcag

SEQ ID NO: 86754 - DNA, 25 bp, Homo sapien
gtttgtttaaataagttagcagagg

SEQ ID NO: 86755 - DNA, 25 bp, Homo sapien
gtttgtttcaataagttagcagagg

SEQ ID NO: 86756 - DNA, 25 bp, Homo sapien
gtttgtttcctgagacaactcctgg

SEQ ID NO: 86757 - DNA, 25 bp, Homo sapien
gtttgtttcctgagaccactcctgg

SEQ ID NO: 86758 - DNA, 25 bp, Homo sapien
gtttgtttgaaatgccagatatagc

SEQ ID NO: 86759 - DNA, 25 bp, Homo sapien
gtttgtttgaaatgtcagatatagc

SEQ ID NO: 86760 - DNA, 25 bp, Homo sapien
gtttgtttgttccaatttcatttag

SEQ ID NO: 86761 - DNA, 25 bp, Homo sapien
gtttgtttgttctaatttcatttag

SEQ ID NO: 86762 - DNA, 25 bp, Homo sapien
gttttaaaactgacatgcaatacaa

SEQ ID NO: 86763 - DNA, 25 bp, Homo sapien
gttttaaaattgacatgcaatacaa

SEQ ID NO: 86764 - DNA, 25 bp, Homo sapien
gttttaaagatgaaagtgaattgag

SEQ ID NO: 86765 - DNA, 25 bp, Homo sapien
gttttaaagatgagagtgaattgag

SEQ ID NO: 86766 - DNA, 25 bp, Homo sapien
gttttaaatatgttatgatgatgtt

SEQ ID NO: 86767 - DNA, 25 bp, Homo sapien
gttttaaatatgttgtgatgatgtt

SEQ ID NO: 86768 - DNA, 25 bp, Homo sapien
gttttaacacggatattttgcacta

SEQ ID NO: 86769 - DNA, 25 bp, Homo sapien
gttttaacatggatattttgcacta

SEQ ID NO: 86770 - DNA, 25 bp, Homo sapien
gttttaaccattgaccttcatctct

SEQ ID NO: 86771 - DNA, 25 bp, Homo sapien
gttttaacgattgaccttcatctct

SEQ ID NO: 86772 - DNA, 25 bp, Homo sapien
gttttaactacatgggattttggga

SEQ ID NO: 86773 - DNA, 25 bp, Homo sapien
gttttaactacgtgggattttggga

SEQ ID NO: 86774 - DNA, 25 bp, Homo sapien
gttttaagtgaacaagcgagatttt

SEQ ID NO: 86775 - DNA, 25 bp, Homo sapien
gttttaagtgaacaagtgagatttt

SEQ ID NO: 86776 - DNA, 25 bp, Homo sapien
gttttaatgtttaatgagcttagcc

SEQ ID NO: 86777 - DNA, 25 bp, Homo sapien
gttttaatgttttgggataaatatg

SEQ ID NO: 86778 - DNA, 25 bp, Homo sapien
gttttaatgttttgtgataaatatg

SEQ ID NO: 86779 - DNA, 25 bp, Homo sapien
gttttaatttgcgtccctaatagct

SEQ ID NO: 86780 - DNA, 25 bp, Homo sapien
gttttaatttgtgtccctaatagct

SEQ ID NO: 86781 - DNA, 25 bp, Homo sapien
gttttaatttttaatgagcttagcc

SEQ ID NO: 86782 - DNA, 25 bp, Homo sapien
gttttacctcttatatttcattctt

SEQ ID NO: 86783 - DNA, 25 bp, Homo sapien
gttttacctgttatatttcattctt

SEQ ID NO: 86784 - DNA, 25 bp, Homo sapien
gttttactcctcgcttaacatcttt

SEQ ID NO: 86785 - DNA, 25 bp, Homo sapien
gttttactccttgcttaacatcttt

SEQ ID NO: 86786 - DNA, 25 bp, Homo sapien
gttttactgtctaatgcccagaggt

SEQ ID NO: 86787 - DNA, 25 bp, Homo sapien
gttttactgtctactgcccagaggt

SEQ ID NO: 86788 - DNA, 25 bp, Homo sapien
gttttagaaccctcaagaaataaaa

SEQ ID NO: 86789 - DNA, 25 bp, Homo sapien
gttttagaagcctcaagaaataaaa

SEQ ID NO: 86790 - DNA, 25 bp, Homo sapien
gttttagatgcaaatgacagcttgt

SEQ ID NO: 86791 - DNA, 25 bp, Homo sapien
gttttagatgcaaatggcagcttgt

SEQ ID NO: 86792 - DNA, 25 bp, Homo sapien
gttttagcatataccatcaggcaaa

SEQ ID NO: 86793 - DNA, 25 bp, Homo sapien
gttttagcatatatcatcaggcaaa

SEQ ID NO: 86794 - DNA, 25 bp, Homo sapien
gttttaggcgataacatttcataga

SEQ ID NO: 86795 - DNA, 25 bp, Homo sapien
gttttaggtgataacatttcataga

SEQ ID NO: 86796 - DNA, 25 bp, Homo sapien
gttttagtttccattctattcaatg

SEQ ID NO: 86797 - DNA, 25 bp, Homo sapien
gttttagtttccgttctattcaatg

SEQ ID NO: 86798 - DNA, 25 bp, Homo sapien
gttttatacgtatcctagtagagag

SEQ ID NO: 86799 - DNA, 25 bp, Homo sapien
gttttatatgtatcctagtagagag

SEQ ID NO: 86800 - DNA, 25 bp, Homo sapien
gttttatcccaagccattgtgctgg

SEQ ID NO: 86801 - DNA, 25 bp, Homo sapien
gttttatcccaggccattgtgctgg

SEQ ID NO: 86802 - DNA, 25 bp, Homo sapien
gttttatgcaccgaacttactgcac

SEQ ID NO: 86803 - DNA, 25 bp, Homo sapien
gttttatgcacggaacttactgcac

SEQ ID NO: 86804 - DNA, 25 bp, Homo sapien
gttttatggctgcagtatttaaaca

SEQ ID NO: 86805 - DNA, 25 bp, Homo sapien
gttttatggtaccagagaatttgtg

SEQ ID NO: 86806 - DNA, 25 bp, Homo sapien
gttttatggtatcagagaatttgtg

SEQ ID NO: 86807 - DNA, 25 bp, Homo sapien
gttttatggttgcagtatttaaaca

SEQ ID NO: 86808 - DNA, 25 bp, Homo sapien
gttttattcgctgcttcatctcccc

SEQ ID NO: 86809 - DNA, 25 bp, Homo sapien
gttttattcgctgtttcatctcccc

SEQ ID NO: 86810 - DNA, 25 bp, Homo sapien
gttttattgacatatactccttctc

SEQ ID NO: 86811 - DNA, 25 bp, Homo sapien
gttttattgacatctactccttctc

SEQ ID NO: 86812 - DNA, 25 bp, Homo sapien
gttttattggaacacactatgtaat

SEQ ID NO: 86813 - DNA, 25 bp, Homo sapien
gttttattggaagacactatgtaat

SEQ ID NO: 86814 - DNA, 25 bp, Homo sapien
gttttatttaatgcttggtattatg

SEQ ID NO: 86815 - DNA, 25 bp, Homo sapien
gttttatttaatgtttggtattatg

SEQ ID NO: 86816 - DNA, 25 bp, Homo sapien
gttttatttgtaacttttatgagtt

SEQ ID NO: 86817 - DNA, 25 bp, Homo sapien
gttttatttgtaatttttatgagtt

SEQ ID NO: 86818 - DNA, 25 bp, Homo sapien
gttttatttgtacactgggcctttg

SEQ ID NO: 86819 - DNA, 25 bp, Homo sapien
gttttatttgtagactgggcctttg

SEQ ID NO: 86820 - DNA, 25 bp, Homo sapien
gttttattttgacgaatctccaaag

SEQ ID NO: 86821 - DNA, 25 bp, Homo sapien
gttttattttgatgaatctccaaag

SEQ ID NO: 86822 - DNA, 25 bp, Homo sapien
gttttcaacgaggtttgattagttg

SEQ ID NO: 86823 - DNA, 25 bp, Homo sapien
gttttcaactcccatacagaaaaaa

SEQ ID NO: 86824 - DNA, 25 bp, Homo sapien
gttttcaactcccatatagaaaaaa

SEQ ID NO: 86825 - DNA, 25 bp, Homo sapien
gttttcaatgaggtttgattagttg

SEQ ID NO: 86826 - DNA, 25 bp, Homo sapien
gttttcacagccttagaaatgagat

SEQ ID NO: 86827 - DNA, 25 bp, Homo sapien
gttttcacagctttagaaatgagat

SEQ ID NO: 86828 - DNA, 25 bp, Homo sapien
gttttcacttcctattggagtcttt

SEQ ID NO: 86829 - DNA, 25 bp, Homo sapien
gttttcacttcctgttggagtcttt

SEQ ID NO: 86830 - DNA, 25 bp, Homo sapien
gttttcaggattccctggtattttt

SEQ ID NO: 86831 - DNA, 25 bp, Homo sapien
gttttcaggattccttggtattttt

SEQ ID NO: 86832 - DNA, 25 bp, Homo sapien
gttttccaatagaaatcattcactg

SEQ ID NO: 86833 - DNA, 25 bp, Homo sapien
gttttccacaacggtatttggctac

SEQ ID NO: 86834 - DNA, 25 bp, Homo sapien
gttttccacaatggtatttggctac

SEQ ID NO: 86835 - DNA, 25 bp, Homo sapien
gttttccacagcggctatgctgttt

SEQ ID NO: 86836 - DNA, 25 bp, Homo sapien
gttttccacagtggctatgctgttt

SEQ ID NO: 86837 - DNA, 25 bp, Homo sapien
gttttccactgaacgatctttttat

SEQ ID NO: 86838 - DNA, 25 bp, Homo sapien
gttttccactgaatgatctttttat

SEQ ID NO: 86839 - DNA, 25 bp, Homo sapien
gttttccagtagaaatcattcactg

SEQ ID NO: 86840 - DNA, 25 bp, Homo sapien
gttttcccagccatttccttggtct

SEQ ID NO: 86841 - DNA, 25 bp, Homo sapien
gttttcccagcgatttccttggtct

SEQ ID NO: 86842 - DNA, 25 bp, Homo sapien
gttttcctcttctacctctagctcc

SEQ ID NO: 86843 - DNA, 25 bp, Homo sapien
gttttcctggcagctgtccattccg

SEQ ID NO: 86844 - DNA, 25 bp, Homo sapien
gttttcctggcagttgtccattccg

SEQ ID NO: 86845 - DNA, 25 bp, Homo sapien
gttttcctttatcagccttttaatg

SEQ ID NO: 86846 - DNA, 25 bp, Homo sapien
gttttcctttattagccttttaatg

SEQ ID NO: 86847 - DNA, 25 bp, Homo sapien
gttttccttttctacctctagctcc

SEQ ID NO: 86848 - DNA, 25 bp, Homo sapien
gttttcggcttcatagacatcttgg

SEQ ID NO: 86849 - DNA, 25 bp, Homo sapien
gttttcggcttcattgacatcttgg

SEQ ID NO: 86850 - DNA, 25 bp, Homo sapien
gttttcgtgcaccgctgacatgcac

SEQ ID NO: 86851 - DNA, 25 bp, Homo sapien
gttttcgtgcactgctgacatgcac

SEQ ID NO: 86852 - DNA, 25 bp, Homo sapien
gttttctacattatcctccttagtg

SEQ ID NO: 86853 - DNA, 25 bp, Homo sapien
gttttctacattgtcctccttagtg

SEQ ID NO: 86854 - DNA, 25 bp, Homo sapien
gttttctcacgactcattgttcttc

SEQ ID NO: 86855 - DNA, 25 bp, Homo sapien
gttttctcagctagatttcaactag

SEQ ID NO: 86856 - DNA, 25 bp, Homo sapien
gttttctcagctaggtttcaactag

SEQ ID NO: 86857 - DNA, 25 bp, Homo sapien
gttttctcatgactcattgttcttc

SEQ ID NO: 86858 - DNA, 25 bp, Homo sapien
gttttctgaaaaagtttgtgtagaa

SEQ ID NO: 86859 - DNA, 25 bp, Homo sapien
gttttctgaaaaggtttgtgtagaa

SEQ ID NO: 86860 - DNA, 25 bp, Homo sapien
gttttctgccagtgagtaaattaag

SEQ ID NO: 86861 - DNA, 25 bp, Homo sapien
gttttctgctagtgagtaaattaag

SEQ ID NO: 86862 - DNA, 25 bp, Homo sapien
gttttctgtagcacaatgcatcttc

SEQ ID NO: 86863 - DNA, 25 bp, Homo sapien
gttttctgtagcataatgcatcttc

SEQ ID NO: 86864 - DNA, 25 bp, Homo sapien
gttttctgtctatcctgctaggctt

SEQ ID NO: 86865 - DNA, 25 bp, Homo sapien
gttttctgtttatcctgctaggctt

SEQ ID NO: 86866 - DNA, 25 bp, Homo sapien
gttttcttattgacgctcaaaaatt

SEQ ID NO: 86867 - DNA, 25 bp, Homo sapien
gttttcttattgaggctcaaaaatt

SEQ ID NO: 86868 - DNA, 25 bp, Homo sapien
gttttcttattggttttcatagtta

SEQ ID NO: 86869 - DNA, 25 bp, Homo sapien
gttttcttatttgttttcatagtta

SEQ ID NO: 86870 - DNA, 25 bp, Homo sapien
gttttcttcaggacaagcaagacag

SEQ ID NO: 86871 - DNA, 25 bp, Homo sapien
gttttcttcaggacgagcaagacag

SEQ ID NO: 86872 - DNA, 25 bp, Homo sapien
gttttcttcaggtgtaagtagtttg

SEQ ID NO: 86873 - DNA, 25 bp, Homo sapien
gttttcttgcatacattctctctgt

SEQ ID NO: 86874 - DNA, 25 bp, Homo sapien
gttttcttgcatacgttctctctgt

SEQ ID NO: 86875 - DNA, 25 bp, Homo sapien
gttttcttggtcagggttgttgtct

SEQ ID NO: 86876 - DNA, 25 bp, Homo sapien
gttttcttggtccgggttgttgtct

SEQ ID NO: 86877 - DNA, 25 bp, Homo sapien
gttttcttgtcctgcgacagtgttc

SEQ ID NO: 86878 - DNA, 25 bp, Homo sapien
gttttcttgtcctgtgacagtgttc

SEQ ID NO: 86879 - DNA, 25 bp, Homo sapien
gttttctttaggtgtaagtagtttg

SEQ ID NO: 86880 - DNA, 25 bp, Homo sapien
gttttgaaagtgttcgtgttttttc

SEQ ID NO: 86881 - DNA, 25 bp, Homo sapien
gttttgaaagtgtttgtgttttttc

SEQ ID NO: 86882 - DNA, 25 bp, Homo sapien
gttttgaacagcagctgtggaactc

SEQ ID NO: 86883 - DNA, 25 bp, Homo sapien
gttttgaacagcagttgtggaactc

SEQ ID NO: 86884 - DNA, 25 bp, Homo sapien
gttttgaacttggagacttagatta

SEQ ID NO: 86885 - DNA, 25 bp, Homo sapien
gttttgaacttggggacttagatta

SEQ ID NO: 86886 - DNA, 25 bp, Homo sapien
gttttgaattaatacgaaagaggca

SEQ ID NO: 86887 - DNA, 25 bp, Homo sapien
gttttgaattaatatgaaagaggca

SEQ ID NO: 86888 - DNA, 25 bp, Homo sapien
gttttgactagccatgactgactta

SEQ ID NO: 86889 - DNA, 25 bp, Homo sapien
gttttgactgaagagaatgttggaa

SEQ ID NO: 86890 - DNA, 25 bp, Homo sapien
gttttgactgaagagattgttggaa

SEQ ID NO: 86891 - DNA, 25 bp, Homo sapien
gttttgactggccatgactgactta

SEQ ID NO: 86892 - DNA, 25 bp, Homo sapien
gttttgagcatcaaggaatacattt

SEQ ID NO: 86893 - DNA, 25 bp, Homo sapien
gttttgagcatcagggaatacattt

SEQ ID NO: 86894 - DNA, 25 bp, Homo sapien
gttttgagttaggcgagaacagtgg

SEQ ID NO: 86895 - DNA, 25 bp, Homo sapien
gttttgagttaggtgagaacagtgg

SEQ ID NO: 86896 - DNA, 25 bp, Homo sapien
gttttgatatctatcaatggagaag

SEQ ID NO: 86897 - DNA, 25 bp, Homo sapien
gttttgatatctctcaatggagaag

SEQ ID NO: 86898 - DNA, 25 bp, Homo sapien
gttttgatccagaatctctaaccat

SEQ ID NO: 86899 - DNA, 25 bp, Homo sapien
gttttgatgcagaatctctaaccat

SEQ ID NO: 86900 - DNA, 25 bp, Homo sapien
gttttgcaatttcctgttcaattta

SEQ ID NO: 86901 - DNA, 25 bp, Homo sapien
gttttgcattttcctgttcaattta

SEQ ID NO: 86902 - DNA, 25 bp, Homo sapien
gttttgcctatcacgaggccctggt

SEQ ID NO: 86903 - DNA, 25 bp, Homo sapien
gttttgcctatcatgaggccctggt

SEQ ID NO: 86904 - DNA, 25 bp, Homo sapien
gttttgctattacggtaatgctagc

SEQ ID NO: 86905 - DNA, 25 bp, Homo sapien
gttttgctattagggtaatgctagc

SEQ ID NO: 86906 - DNA, 25 bp, Homo sapien
gttttgctgtcacactacaagctgc

SEQ ID NO: 86907 - DNA, 25 bp, Homo sapien
gttttgctgtcacacttcaagctgc

SEQ ID NO: 86908 - DNA, 25 bp, Homo sapien
gttttgcttgatattcatgaacatt

SEQ ID NO: 86909 - DNA, 25 bp, Homo sapien
gttttgcttgatattcgtgaacatt

SEQ ID NO: 86910 - DNA, 25 bp, Homo sapien
gttttggaccatcaatgctttccta

SEQ ID NO: 86911 - DNA, 25 bp, Homo sapien
gttttggaccatcagtgctttccta

SEQ ID NO: 86912 - DNA, 25 bp, Homo sapien
gttttggacttgcacgagacctgta

SEQ ID NO: 86913 - DNA, 25 bp, Homo sapien
gttttggacttgcacgggacctgta

SEQ ID NO: 86914 - DNA, 25 bp, Homo sapien
gttttggatactttttccagttgat

SEQ ID NO: 86915 - DNA, 25 bp, Homo sapien
gttttggatacttttttcagttgat

SEQ ID NO: 86916 - DNA, 25 bp, Homo sapien
gttttggttaacgtactcttatatt

SEQ ID NO: 86917 - DNA, 25 bp, Homo sapien
gttttggttaatgtactcttatatt

SEQ ID NO: 86918 - DNA, 25 bp, Homo sapien
gttttgtaaaaataggtcattctta

SEQ ID NO: 86919 - DNA, 25 bp, Homo sapien
gttttgtaaaagtaggtcattctta

SEQ ID NO: 86920 - DNA, 25 bp, Homo sapien
gttttgtactccaacatgctctata

SEQ ID NO: 86921 - DNA, 25 bp, Homo sapien
gttttgtactcccacatgctctata

SEQ ID NO: 86922 - DNA, 25 bp, Homo sapien
gttttgtccttgaagacctcctgga

SEQ ID NO: 86923 - DNA, 25 bp, Homo sapien
gttttgtccttgcagacctcctgga

SEQ ID NO: 86924 - DNA, 25 bp, Homo sapien
gttttgtcggttcaaactagatgac

SEQ ID NO: 86925 - DNA, 25 bp, Homo sapien
gttttgtctacactgacaatctgtt

SEQ ID NO: 86926 - DNA, 25 bp, Homo sapien
gttttgtctacattgacaatctgtt

SEQ ID NO: 86927 - DNA, 25 bp, Homo sapien
gttttgtctgttcaaactagatgac

SEQ ID NO: 86928 - DNA, 25 bp, Homo sapien
gttttgtcttttacatttttcactt

SEQ ID NO: 86929 - DNA, 25 bp, Homo sapien
gttttgtcttttacgtttttcactt

SEQ ID NO: 86930 - DNA, 25 bp, Homo sapien
gttttgtgttgaatgtgttcaagaa

SEQ ID NO: 86931 - DNA, 25 bp, Homo sapien
gttttgtgttgagtgtgttcaagaa

SEQ ID NO: 86932 - DNA, 25 bp, Homo sapien
gtttttaaaacctgatggacctttg

SEQ ID NO: 86933 - DNA, 25 bp, Homo sapien
gtttttaaaacttgatggacctttg

SEQ ID NO: 86934 - DNA, 25 bp, Homo sapien
gtttttaatctgtgaacgtgtaagt

SEQ ID NO: 86935 - DNA, 25 bp, Homo sapien
gtttttaatttgtgaacgtgtaagt

SEQ ID NO: 86936 - DNA, 25 bp, Homo sapien
gtttttacactaattcacaaatatt

SEQ ID NO: 86937 - DNA, 25 bp, Homo sapien
gtttttacatgaatgaaggcccatt

SEQ ID NO: 86938 - DNA, 25 bp, Homo sapien
gtttttacgctaattcacaaatatt

SEQ ID NO: 86939 - DNA, 25 bp, Homo sapien
gtttttacgtgaatgaaggcccatt

SEQ ID NO: 86940 - DNA, 25 bp, Homo sapien
gtttttagactccacagcttcgctc

SEQ ID NO: 86941 - DNA, 25 bp, Homo sapien
gtttttagactccgcagcttcgctc

SEQ ID NO: 86942 - DNA, 25 bp, Homo sapien
gtttttagcaacacggctagtaaat

SEQ ID NO: 86943 - DNA, 25 bp, Homo sapien
gtttttagcaacatggctagtaaat

SEQ ID NO: 86944 - DNA, 25 bp, Homo sapien
gtttttatagaggcggagtttcgct

SEQ ID NO: 86945 - DNA, 25 bp, Homo sapien
gtttttatcaggaaagaagatcttt

SEQ ID NO: 86946 - DNA, 25 bp, Homo sapien
gtttttatcaggccttcctccttta

SEQ ID NO: 86947 - DNA, 25 bp, Homo sapien
gtttttatcgggaaagaagatcttt

SEQ ID NO: 86948 - DNA, 25 bp, Homo sapien
gtttttattaggccttcctccttta

SEQ ID NO: 86949 - DNA, 25 bp, Homo sapien
gtttttattgaggcggagtttcgct

SEQ ID NO: 86950 - DNA, 25 bp, Homo sapien
gtttttcacagcaccttgatgaagg

SEQ ID NO: 86951 - DNA, 25 bp, Homo sapien
gtttttcacggcaccttgatgaagg

SEQ ID NO: 86952 - DNA, 25 bp, Homo sapien
gtttttcacgtgccactgtttccaa

SEQ ID NO: 86953 - DNA, 25 bp, Homo sapien
gtttttcacgtgtcactgtttccaa

SEQ ID NO: 86954 - DNA, 25 bp, Homo sapien
gtttttcacttacagtacggtagtc

SEQ ID NO: 86955 - DNA, 25 bp, Homo sapien
gtttttcactttcagtacggtagtc

SEQ ID NO: 86956 - DNA, 25 bp, Homo sapien
gtttttctcctgaatgaaaccacca

SEQ ID NO: 86957 - DNA, 25 bp, Homo sapien
gtttttctcctgagtgaaaccacca

SEQ ID NO: 86958 - DNA, 25 bp, Homo sapien
gtttttctgtacatcaggaagtata

SEQ ID NO: 86959 - DNA, 25 bp, Homo sapien
gtttttctgtacatcatgaagtata

SEQ ID NO: 86960 - DNA, 25 bp, Homo sapien
gtttttctgtcaagcagatggtgag

SEQ ID NO: 86961 - DNA, 25 bp, Homo sapien
gtttttctgtcaagtagatggtgag

SEQ ID NO: 86962 - DNA, 25 bp, Homo sapien
gtttttgacatctgaaaagccctgc

SEQ ID NO: 86963 - DNA, 25 bp, Homo sapien
gtttttgacgtctgaaaagccctgc

SEQ ID NO: 86964 - DNA, 25 bp, Homo sapien
gtttttgagtgactttcgttttctt

SEQ ID NO: 86965 - DNA, 25 bp, Homo sapien
gtttttgagtgacttttgttttctt

SEQ ID NO: 86966 - DNA, 25 bp, Homo sapien
gtttttgatattaaaagcacaaatg

SEQ ID NO: 86967 - DNA, 25 bp, Homo sapien
gtttttgatgttaaaagcacaaatg

SEQ ID NO: 86968 - DNA, 25 bp, Homo sapien
gtttttgcatagcttgtcccatttg

SEQ ID NO: 86969 - DNA, 25 bp, Homo sapien
gtttttgcatatggcttccaaaagt

SEQ ID NO: 86970 - DNA, 25 bp, Homo sapien
gtttttgcgtagcttgtcccatttg

SEQ ID NO: 86971 - DNA, 25 bp, Homo sapien
gtttttgcgtatggcttccaaaagt

SEQ ID NO: 86972 - DNA, 25 bp, Homo sapien
gtttttggcccaaggatggaggatg

SEQ ID NO: 86973 - DNA, 25 bp, Homo sapien
gtttttggcccgaggatggaggatg

SEQ ID NO: 86974 - DNA, 25 bp, Homo sapien
gtttttggttatgtcacagccagtg

SEQ ID NO: 86975 - DNA, 25 bp, Homo sapien
gtttttggttatgtcatagccagtg

SEQ ID NO: 86976 - DNA, 25 bp, Homo sapien
gtttttgtagagacaaggtcttcct

SEQ ID NO: 86977 - DNA, 25 bp, Homo sapien
gtttttgtagagacgaggtcttcct

SEQ ID NO: 86978 - DNA, 25 bp, Homo sapien
gtttttgtgtaagataaatttccat

SEQ ID NO: 86979 - DNA, 25 bp, Homo sapien
gtttttgtgtaagttaaatttccat

SEQ ID NO: 86980 - DNA, 25 bp, Homo sapien
gtttttgtttagtaatgatgccttg

SEQ ID NO: 86981 - DNA, 25 bp, Homo sapien
gtttttgtttagtattgatgccttg

SEQ ID NO: 86982 - DNA, 25 bp, Homo sapien
gttttttatttccctcctatgttga

SEQ ID NO: 86983 - DNA, 25 bp, Homo sapien
gttttttattttcctcctatgttga

SEQ ID NO: 86984 - DNA, 25 bp, Homo sapien
gttttttcattttctacagctttcc

SEQ ID NO: 86985 - DNA, 25 bp, Homo sapien
gttttttcgttttctacagctttcc

SEQ ID NO: 86986 - DNA, 25 bp, Homo sapien
gttttttcttctcccgaatgcattt

SEQ ID NO: 86987 - DNA, 25 bp, Homo sapien
gttttttcttctcctgaatgcattt

SEQ ID NO: 86988 - DNA, 25 bp, Homo sapien
gttttttgactaccgtccagagttt

SEQ ID NO: 86989 - DNA, 25 bp, Homo sapien
gttttttgactactgtccagagttt

SEQ ID NO: 86990 - DNA, 25 bp, Homo sapien
gttttttggatgcgaatggaatggg

SEQ ID NO: 86991 - DNA, 25 bp, Homo sapien
gttttttggatgtgaatggaatggg

SEQ ID NO: 86992 - DNA, 25 bp, Homo sapien
gtttttttaaagagtaatgttctca

SEQ ID NO: 86993 - DNA, 25 bp, Homo sapien
gtttttttaaagagtagtgttctca

SEQ ID NO: 86994 - DNA, 25 bp, Homo sapien
gtttttttattgcccagaccatttc

SEQ ID NO: 86995 - DNA, 25 bp, Homo sapien
gtttttttccctacagaatgattga

SEQ ID NO: 86996 - DNA, 25 bp, Homo sapien
gtttttttcccttcagaatgattga

SEQ ID NO: 86997 - DNA, 25 bp, Homo sapien
gtttttttctgcagtgattcagcaa

SEQ ID NO: 86998 - DNA, 25 bp, Homo sapien
gtttttttctgcggtgattcagcaa

SEQ ID NO: 86999 - DNA, 25 bp, Homo sapien
gtttttttgtctcatggttacatta

SEQ ID NO: 87000 - DNA, 25 bp, Homo sapien
gtttttttgtctcgtggttacatta

SEQ ID NO: 87001 - DNA, 25 bp, Homo sapien
gtttttttgttgcccagaccatttc

SEQ ID NO: 87002 - DNA, 25 bp, Homo sapien
gttttttttgcggcacacagaagaa

SEQ ID NO: 87003 - DNA, 25 bp, Homo sapien
gttttttttgctgcacacagaagaa

SEQ ID NO: 87004 - DNA, 25 bp, Homo sapien
taaaaaaaaaactaaagcttgatct

SEQ ID NO: 87005 - DNA, 25 bp, Homo sapien
taaaaaaaaaactatagcttgatct

SEQ ID NO: 87006 - DNA, 25 bp, Homo sapien
taaaaaaaaagaatgtctcataggt

SEQ ID NO: 87007 - DNA, 25 bp, Homo sapien
taaaaaaaaatatgtaccacatcat

SEQ ID NO: 87008 - DNA, 25 bp, Homo sapien
taaaaaaaataggcaacgcagattc

SEQ ID NO: 87009 - DNA, 25 bp, Homo sapien
taaaaaaaataggcaatgcagattc

SEQ ID NO: 87010 - DNA, 25 bp, Homo sapien
taaaaaaaatgaatgtctcataggt

SEQ ID NO: 87011 - DNA, 25 bp, Homo sapien
taaaaaaacatatgtaccacatcat

SEQ ID NO: 87012 - DNA, 25 bp, Homo sapien
taaaaaaatactcattggaaacaga

SEQ ID NO: 87013 - DNA, 25 bp, Homo sapien
taaaaaaatactcgttggaaacaga

SEQ ID NO: 87014 - DNA, 25 bp, Homo sapien
taaaaaaatttaccaacttctaggc

SEQ ID NO: 87015 - DNA, 25 bp, Homo sapien
taaaaaaatttaccgacttctaggc

SEQ ID NO: 87016 - DNA, 25 bp, Homo sapien
taaaaaactgctgtgccttttgtat

SEQ ID NO: 87017 - DNA, 25 bp, Homo sapien
taaaaaactgctttgccttttgtat

SEQ ID NO: 87018 - DNA, 25 bp, Homo sapien
taaaaaagagattgacagtctaagc

SEQ ID NO: 87019 - DNA, 25 bp, Homo sapien
taaaaaagagattggcagtctaagc

SEQ ID NO: 87020 - DNA, 25 bp, Homo sapien
taaaaaagtctactaaaaattcagt

SEQ ID NO: 87021 - DNA, 25 bp, Homo sapien
taaaaaagtctactaagaattcagt

SEQ ID NO: 87022 - DNA, 25 bp, Homo sapien
taaaaaagttgagtacaaaaggatt

SEQ ID NO: 87023 - DNA, 25 bp, Homo sapien
taaaaaagttgagtccaaaaggatt

SEQ ID NO: 87024 - DNA, 25 bp, Homo sapien
taaaaaatacatctacaccaaaaaa

SEQ ID NO: 87025 - DNA, 25 bp, Homo sapien
taaaaaatacatctacgccaaaaaa

SEQ ID NO: 87026 - DNA, 25 bp, Homo sapien
taaaaaatatctccgaaacttcact

SEQ ID NO: 87027 - DNA, 25 bp, Homo sapien
taaaaaatatctctgaaacttcact

SEQ ID NO: 87028 - DNA, 25 bp, Homo sapien
taaaaaatgaatgacaaaataagga

SEQ ID NO: 87029 - DNA, 25 bp, Homo sapien
taaaaaatgaatgagaaaataagga

SEQ ID NO: 87030 - DNA, 25 bp, Homo sapien
taaaaaattacacgatttgtgcagg

SEQ ID NO: 87031 - DNA, 25 bp, Homo sapien
taaaaaattacatgatttgtgcagg

SEQ ID NO: 87032 - DNA, 25 bp, Homo sapien
taaaaaattgtgaaatttgggcaag

SEQ ID NO: 87033 - DNA, 25 bp, Homo sapien
taaaaaattgtggaatttgggcaag

SEQ ID NO: 87034 - DNA, 25 bp, Homo sapien
taaaaacaaaaaccacgtgaccctt

SEQ ID NO: 87035 - DNA, 25 bp, Homo sapien
taaaaacaaaaactacgtgaccctt

SEQ ID NO: 87036 - DNA, 25 bp, Homo sapien
taaaaacaaatgtacgtatgaggca

SEQ ID NO: 87037 - DNA, 25 bp, Homo sapien
taaaaacaaatgtatgtatgaggca

SEQ ID NO: 87038 - DNA, 25 bp, Homo sapien
taaaaacagaggtatcagactatat

SEQ ID NO: 87039 - DNA, 25 bp, Homo sapien
taaaaacagaggtatcggactatat

SEQ ID NO: 87040 - DNA, 25 bp, Homo sapien
taaaaacagtcatagaatggataac

SEQ ID NO: 87041 - DNA, 25 bp, Homo sapien
taaaaacagtcgtagaatggataac

SEQ ID NO: 87042 - DNA, 25 bp, Homo sapien
taaaaaccagttcagagaaatttgt

SEQ ID NO: 87043 - DNA, 25 bp, Homo sapien
taaaaaccagttgagagaaatttgt

SEQ ID NO: 87044 - DNA, 25 bp, Homo sapien
taaaaacctcacacatctcagtgcc

SEQ ID NO: 87045 - DNA, 25 bp, Homo sapien
taaaaacctcagatctccttcacgc

SEQ ID NO: 87046 - DNA, 25 bp, Homo sapien
taaaaacctcaggtctccttcacgc

SEQ ID NO: 87047 - DNA, 25 bp, Homo sapien
taaaaacctcatacatctcagtgcc

SEQ ID NO: 87048 - DNA, 25 bp, Homo sapien
taaaaactagacgaaactttctttt

SEQ ID NO: 87049 - DNA, 25 bp, Homo sapien
taaaaactagacgagactttctttt

SEQ ID NO: 87050 - DNA, 25 bp, Homo sapien
taaaaactcaaacgagtagtaacaa

SEQ ID NO: 87051 - DNA, 25 bp, Homo sapien
taaaaactcaagcgagtagtaacaa

SEQ ID NO: 87052 - DNA, 25 bp, Homo sapien
taaaaactcacaaagaacaagaggg

SEQ ID NO: 87053 - DNA, 25 bp, Homo sapien
taaaaactcccaaagaacaagaggg

SEQ ID NO: 87054 - DNA, 25 bp, Homo sapien
taaaaactggacggaaaccgtctcc

SEQ ID NO: 87055 - DNA, 25 bp, Homo sapien
taaaaactggacggaagccgtctcc

SEQ ID NO: 87056 - DNA, 25 bp, Homo sapien
taaaaagaacattcataataaggct

SEQ ID NO: 87057 - DNA, 25 bp, Homo sapien
taaaaagaattaaactgatggtaag

SEQ ID NO: 87058 - DNA, 25 bp, Homo sapien
taaaaagaattaaattgatggtaag

SEQ ID NO: 87059 - DNA, 25 bp, Homo sapien
taaaaagagacaggtaaatcgaatt

SEQ ID NO: 87060 - DNA, 25 bp, Homo sapien
taaaaagagacgggtaaatcgaatt

SEQ ID NO: 87061 - DNA, 25 bp, Homo sapien
taaaaagagcattcataataaggct

SEQ ID NO: 87062 - DNA, 25 bp, Homo sapien
taaaaagctatattcctacatttca

SEQ ID NO: 87063 - DNA, 25 bp, Homo sapien
taaaaagctatatttctacatttca

SEQ ID NO: 87064 - DNA, 25 bp, Homo sapien
taaaaagggaagtcattatccactc

SEQ ID NO: 87065 - DNA, 25 bp, Homo sapien
taaaaagggaagttattatccactc

SEQ ID NO: 87066 - DNA, 25 bp, Homo sapien
taaaaagtcttcccatggcttctct

SEQ ID NO: 87067 - DNA, 25 bp, Homo sapien
taaaaagtcttcctatggcttctct

SEQ ID NO: 87068 - DNA, 25 bp, Homo sapien
taaaaagtggatcataactggatgt

SEQ ID NO: 87069 - DNA, 25 bp, Homo sapien
taaaaagtggatcgtaactggatgt

SEQ ID NO: 87070 - DNA, 25 bp, Homo sapien
taaaaataagaggtacagtctctgt

SEQ ID NO: 87071 - DNA, 25 bp, Homo sapien
taaaaataagagttacagtctctgt

SEQ ID NO: 87072 - DNA, 25 bp, Homo sapien
taaaaataataaagttcaaaagcca

SEQ ID NO: 87073 - DNA, 25 bp, Homo sapien
taaaaataataaggttcaaaagcca

SEQ ID NO: 87074 - DNA, 25 bp, Homo sapien
taaaaatacccaaattgttcaaacc

SEQ ID NO: 87075 - DNA, 25 bp, Homo sapien
taaaaatacccagattgttcaaacc

SEQ ID NO: 87076 - DNA, 25 bp, Homo sapien
taaaaatacctgcgcaaatcgctat

SEQ ID NO: 87077 - DNA, 25 bp, Homo sapien
taaaaatacctgctcaaatcgctat

SEQ ID NO: 87078 - DNA, 25 bp, Homo sapien
taaaaatacgaccactttggtaggt

SEQ ID NO: 87079 - DNA, 25 bp, Homo sapien
taaaaatagaaggaaaagtcaggga

SEQ ID NO: 87080 - DNA, 25 bp, Homo sapien
taaaaatagaaggaaatgtcaggga

SEQ ID NO: 87081 - DNA, 25 bp, Homo sapien
taaaaatatgaccactttggtaggt

SEQ ID NO: 87082 - DNA, 25 bp, Homo sapien
taaaaatatgtccgtaagttaaatt

SEQ ID NO: 87083 - DNA, 25 bp, Homo sapien
taaaaatatgtctgtaagttaaatt

SEQ ID NO: 87084 - DNA, 25 bp, Homo sapien
taaaaatcagtcgtacttagttggc

SEQ ID NO: 87085 - DNA, 25 bp, Homo sapien
taaaaatcagtcttacttagttggc

SEQ ID NO: 87086 - DNA, 25 bp, Homo sapien
taaaaatcatgatcactaagtggtt

SEQ ID NO: 87087 - DNA, 25 bp, Homo sapien
taaaaatccatcaacttataattta

SEQ ID NO: 87088 - DNA, 25 bp, Homo sapien
taaaaatccatcagcttataattta

SEQ ID NO: 87089 - DNA, 25 bp, Homo sapien
taaaaatcctgatcactaagtggtt

SEQ ID NO: 87090 - DNA, 25 bp, Homo sapien
taaaaatcctttaaatcagttacca

SEQ ID NO: 87091 - DNA, 25 bp, Homo sapien
taaaaatcttttaaatcagttacca

SEQ ID NO: 87092 - DNA, 25 bp, Homo sapien
taaaaatgatgggtgtccaaaaagt

SEQ ID NO: 87093 - DNA, 25 bp, Homo sapien
taaaaatgatgggtgttcaaaaagt

SEQ ID NO: 87094 - DNA, 25 bp, Homo sapien
taaaaatgattagcagagtctattg

SEQ ID NO: 87095 - DNA, 25 bp, Homo sapien
taaaaatgattatcagagtctattg

SEQ ID NO: 87096 - DNA, 25 bp, Homo sapien
taaaaatgtcaacaatattatctct

SEQ ID NO: 87097 - DNA, 25 bp, Homo sapien
taaaaatgtcaagaatattatctct

SEQ ID NO: 87098 - DNA, 25 bp, Homo sapien
taaaaatgttcacgaattaagtgag

SEQ ID NO: 87099 - DNA, 25 bp, Homo sapien
taaaaatgttcgcgaattaagtgag

SEQ ID NO: 87100 - DNA, 25 bp, Homo sapien
taaaaattagtagcgtttctacatg

SEQ ID NO: 87101 - DNA, 25 bp, Homo sapien
taaaaattagtagtgtttctacatg

SEQ ID NO: 87102 - DNA, 25 bp, Homo sapien
taaaaattcacaaggaaatgtaaag

SEQ ID NO: 87103 - DNA, 25 bp, Homo sapien
taaaaattcacacggaaatgtaaag

SEQ ID NO: 87104 - DNA, 25 bp, Homo sapien
taaaaatttaaaaaccatagcgaca

SEQ ID NO: 87105 - DNA, 25 bp, Homo sapien
taaaaatttaaaaagcatagcgaca

SEQ ID NO: 87106 - DNA, 25 bp, Homo sapien
taaaaatttgaaaactcctcatttg

SEQ ID NO: 87107 - DNA, 25 bp, Homo sapien
taaaaatttgaaagctcctcatttg

SEQ ID NO: 87108 - DNA, 25 bp, Homo sapien
taaaacaaaaagatgcatagatgca

SEQ ID NO: 87109 - DNA, 25 bp, Homo sapien
taaaacaaaagtccagtcaagtcac

SEQ ID NO: 87110 - DNA, 25 bp, Homo sapien
taaaacaaaagtccggtcaagtcac

SEQ ID NO: 87111 - DNA, 25 bp, Homo sapien
taaaacaaagagatgcatagatgca

SEQ ID NO: 87112 - DNA, 25 bp, Homo sapien
taaaacaacgttaggctccacccct

SEQ ID NO: 87113 - DNA, 25 bp, Homo sapien
taaaacaactttaggctccacccct

SEQ ID NO: 87114 - DNA, 25 bp, Homo sapien
taaaacaatctgatttccttaccaa

SEQ ID NO: 87115 - DNA, 25 bp, Homo sapien
taaaacaatctgctttccttaccaa

SEQ ID NO: 87116 - DNA, 25 bp, Homo sapien
taaaacacaatcgaagctatcaata

SEQ ID NO: 87117 - DNA, 25 bp, Homo sapien
taaaacacagatgctgagccccacc

SEQ ID NO: 87118 - DNA, 25 bp, Homo sapien
taaaacacagatggtgagccccacc

SEQ ID NO: 87119 - DNA, 25 bp, Homo sapien
taaaacacagtcgaagctatcaata

SEQ ID NO: 87120 - DNA, 25 bp, Homo sapien
taaaacacctcacgcctcaggttgc

SEQ ID NO: 87121 - DNA, 25 bp, Homo sapien
taaaacacttcacgcctcaggttgc

SEQ ID NO: 87122 - DNA, 25 bp, Homo sapien
taaaacagaaactgttggagagcat

SEQ ID NO: 87123 - DNA, 25 bp, Homo sapien
taaaacagaagatatggaggtgaag

SEQ ID NO: 87124 - DNA, 25 bp, Homo sapien
taaaacagaaggtatggaggtgaag

SEQ ID NO: 87125 - DNA, 25 bp, Homo sapien
taaaacagagggaccgaaagactct

SEQ ID NO: 87126 - DNA, 25 bp, Homo sapien
taaaacagagggtccgaaagactct

SEQ ID NO: 87127 - DNA, 25 bp, Homo sapien
taaaacaggaactgttggagagcat

SEQ ID NO: 87128 - DNA, 25 bp, Homo sapien
taaaacatgcaactcaatgatattc

SEQ ID NO: 87129 - DNA, 25 bp, Homo sapien
taaaacatgcaattcaatgatattc

SEQ ID NO: 87130 - DNA, 25 bp, Homo sapien
taaaaccacaaaacgaggagaaacc

SEQ ID NO: 87131 - DNA, 25 bp, Homo sapien
taaaaccacaaaatgaggagaaacc

SEQ ID NO: 87132 - DNA, 25 bp, Homo sapien
taaaacccacgaattgggcagtttg

SEQ ID NO: 87133 - DNA, 25 bp, Homo sapien
taaaacccacgatttgggcagtttg

SEQ ID NO: 87134 - DNA, 25 bp, Homo sapien
taaaacctcggtggtgaagatttag

SEQ ID NO: 87135 - DNA, 25 bp, Homo sapien
taaaaccttcaatgaagaaaatgtg

SEQ ID NO: 87136 - DNA, 25 bp, Homo sapien
taaaaccttcattgaagaaaatgtg

SEQ ID NO: 87137 - DNA, 25 bp, Homo sapien
taaaaccttggtggtgaagatttag

SEQ ID NO: 87138 - DNA, 25 bp, Homo sapien
taaaacgaaagtgagatgtgaaatc

SEQ ID NO: 87139 - DNA, 25 bp, Homo sapien
taaaacgaaagtgtgatgtgaaatc

SEQ ID NO: 87140 - DNA, 25 bp, Homo sapien
taaaacgaggtaagagtttaagctt

SEQ ID NO: 87141 - DNA, 25 bp, Homo sapien
taaaacgagttaagagtttaagctt

SEQ ID NO: 87142 - DNA, 25 bp, Homo sapien
taaaacgggtagcagctctaaggtg

SEQ ID NO: 87143 - DNA, 25 bp, Homo sapien
taaaacggttagcagctctaaggtg

SEQ ID NO: 87144 - DNA, 25 bp, Homo sapien
taaaactcagatctaacaaagtaac

SEQ ID NO: 87145 - DNA, 25 bp, Homo sapien
taaaactcatatctaacaaagtaac

SEQ ID NO: 87146 - DNA, 25 bp, Homo sapien
taaaactccatttgaaaaaaacaat

SEQ ID NO: 87147 - DNA, 25 bp, Homo sapien
taaaactccatttgaagaaaacaat

SEQ ID NO: 87148 - DNA, 25 bp, Homo sapien
taaaactgactcaacgttcccaact

SEQ ID NO: 87149 - DNA, 25 bp, Homo sapien
taaaactgactcaatgttcccaact

SEQ ID NO: 87150 - DNA, 25 bp, Homo sapien
taaaactgattgcccttattcaatc

SEQ ID NO: 87151 - DNA, 25 bp, Homo sapien
taaaactgatttcccttattcaatc

SEQ ID NO: 87152 - DNA, 25 bp, Homo sapien
taaaacttctagagacatcacgaat

SEQ ID NO: 87153 - DNA, 25 bp, Homo sapien
taaaacttctagagacttcacgaat

SEQ ID NO: 87154 - DNA, 25 bp, Homo sapien
taaaacttcttgcgccaaactggca

SEQ ID NO: 87155 - DNA, 25 bp, Homo sapien
taaaacttcttgctccaaactggca

SEQ ID NO: 87156 - DNA, 25 bp, Homo sapien
taaaagaacagctcagccaactata

SEQ ID NO: 87157 - DNA, 25 bp, Homo sapien
taaaagaaccgctcagccaactata

SEQ ID NO: 87158 - DNA, 25 bp, Homo sapien
taaaagacagtattttcaacaagcc

SEQ ID NO: 87159 - DNA, 25 bp, Homo sapien
taaaagacatagatcacctagaaca

SEQ ID NO: 87160 - DNA, 25 bp, Homo sapien
taaaagacattattttcaacaagcc

SEQ ID NO: 87161 - DNA, 25 bp, Homo sapien
taaaagacattgtagcatcagagat

SEQ ID NO: 87162 - DNA, 25 bp, Homo sapien
taaaagacattgtagcgtcagagat

SEQ ID NO: 87163 - DNA, 25 bp, Homo sapien
taaaagacgtagatcacctagaaca

SEQ ID NO: 87164 - DNA, 25 bp, Homo sapien
taaaagagaacaagacccaatacta

SEQ ID NO: 87165 - DNA, 25 bp, Homo sapien
taaaagagaacaaggcccaatacta

SEQ ID NO: 87166 - DNA, 25 bp, Homo sapien
taaaagagatttcagtaggtgcatt

SEQ ID NO: 87167 - DNA, 25 bp, Homo sapien
taaaagagatttcattaggtgcatt

SEQ ID NO: 87168 - DNA, 25 bp, Homo sapien
taaaagagtcaagttgcttctggaa

SEQ ID NO: 87169 - DNA, 25 bp, Homo sapien
taaaagagtcatgttgcttctggaa

SEQ ID NO: 87170 - DNA, 25 bp, Homo sapien
taaaagataaacagctgaagaatct

SEQ ID NO: 87171 - DNA, 25 bp, Homo sapien
taaaagataaacagttgaagaatct

SEQ ID NO: 87172 - DNA, 25 bp, Homo sapien
taaaagataggaagagacactacac

SEQ ID NO: 87173 - DNA, 25 bp, Homo sapien
taaaagatatgaagagacactacac

SEQ ID NO: 87174 - DNA, 25 bp, Homo sapien
taaaagatcaatgaagaaagtttcc

SEQ ID NO: 87175 - DNA, 25 bp, Homo sapien
taaaagatcaatgaaggaagtttcc

SEQ ID NO: 87176 - DNA, 25 bp, Homo sapien
taaaagatgctagaggagcatagag

SEQ ID NO: 87177 - DNA, 25 bp, Homo sapien
taaaagatgttagaggagcatagag

SEQ ID NO: 87178 - DNA, 25 bp, Homo sapien
taaaagatgtttcctgttgatagta

SEQ ID NO: 87179 - DNA, 25 bp, Homo sapien
taaaagatgttttctgttgatagta

SEQ ID NO: 87180 - DNA, 25 bp, Homo sapien
taaaagcaataaactcatttgcaac

SEQ ID NO: 87181 - DNA, 25 bp, Homo sapien
taaaagcaataagctcatttgcaac

SEQ ID NO: 87182 - DNA, 25 bp, Homo sapien
taaaagcactaatactgtaaaactt

SEQ ID NO: 87183 - DNA, 25 bp, Homo sapien
taaaagcactactactgtaaaactt

SEQ ID NO: 87184 - DNA, 25 bp, Homo sapien
taaaagcacttatcatgagatctat

SEQ ID NO: 87185 - DNA, 25 bp, Homo sapien
taaaagcacttatgatgagatctat

SEQ ID NO: 87186 - DNA, 25 bp, Homo sapien
taaaagccaaatatccaggttcctc

SEQ ID NO: 87187 - DNA, 25 bp, Homo sapien
taaaagccagatatccaggttcctc

SEQ ID NO: 87188 - DNA, 25 bp, Homo sapien
taaaagctacctataaagttcaata

SEQ ID NO: 87189 - DNA, 25 bp, Homo sapien
taaaagctacctctaaagttcaata

SEQ ID NO: 87190 - DNA, 25 bp, Homo sapien
taaaagctgaagtagtaattcaaca

SEQ ID NO: 87191 - DNA, 25 bp, Homo sapien
taaaagctgaagttgtaattcaaca

SEQ ID NO: 87192 - DNA, 25 bp, Homo sapien
taaaagctgagagtgaatgaataaa

SEQ ID NO: 87193 - DNA, 25 bp, Homo sapien
taaaagctgagagttaatgaataaa

SEQ ID NO: 87194 - DNA, 25 bp, Homo sapien
taaaaggaaaaggcttaaatgccct

SEQ ID NO: 87195 - DNA, 25 bp, Homo sapien
taaaaggaaaagtcttaaatgccct

SEQ ID NO: 87196 - DNA, 25 bp, Homo sapien
taaaaggaaatctgtgggattctgc

SEQ ID NO: 87197 - DNA, 25 bp, Homo sapien
taaaaggaactgacatttactgagt

SEQ ID NO: 87198 - DNA, 25 bp, Homo sapien
taaaaggaactggcatttactgagt

SEQ ID NO: 87199 - DNA, 25 bp, Homo sapien
taaaaggagaatcaaacattttgaa

SEQ ID NO: 87200 - DNA, 25 bp, Homo sapien
taaaaggagatctgtgggattctgc

SEQ ID NO: 87201 - DNA, 25 bp, Homo sapien
taaaaggataatcaaacattttgaa

SEQ ID NO: 87202 - DNA, 25 bp, Homo sapien
taaaaggtaggcatgagagccaatt

SEQ ID NO: 87203 - DNA, 25 bp, Homo sapien
taaaaggtgggcatgagagccaatt

SEQ ID NO: 87204 - DNA, 25 bp, Homo sapien
taaaagtaccggcaaaaaccataat

SEQ ID NO: 87205 - DNA, 25 bp, Homo sapien
taaaagtactggcaaaaaccataat

SEQ ID NO: 87206 - DNA, 25 bp, Homo sapien
taaaagtcaaaaatttaccatcctg

SEQ ID NO: 87207 - DNA, 25 bp, Homo sapien
taaaagtcaaaagtttaccatcctg

SEQ ID NO: 87208 - DNA, 25 bp, Homo sapien
taaaagtcaaccgtttactggcaag

SEQ ID NO: 87209 - DNA, 25 bp, Homo sapien
taaaagtcagccgtttactggcaag

SEQ ID NO: 87210 - DNA, 25 bp, Homo sapien
taaaagtcataccttgattttcaat

SEQ ID NO: 87211 - DNA, 25 bp, Homo sapien
taaaagtcatactttgattttcaat

SEQ ID NO: 87212 - DNA, 25 bp, Homo sapien
taaaagtcttacatgccttcttaaa

SEQ ID NO: 87213 - DNA, 25 bp, Homo sapien
taaaagtcttacatgctttcttaaa

SEQ ID NO: 87214 - DNA, 25 bp, Homo sapien
taaaagtggctgctgattggagtga

SEQ ID NO: 87215 - DNA, 25 bp, Homo sapien
taaaagtggttgctgattggagtga

SEQ ID NO: 87216 - DNA, 25 bp, Homo sapien
taaaagtgtttgaagggtcagtcac

SEQ ID NO: 87217 - DNA, 25 bp, Homo sapien
taaaagtgtttgaaggttcagtcac

SEQ ID NO: 87218 - DNA, 25 bp, Homo sapien
taaaagttaccaaaaatgttatggc

SEQ ID NO: 87219 - DNA, 25 bp, Homo sapien
taaaagttaccacaaatgttatggc

SEQ ID NO: 87220 - DNA, 25 bp, Homo sapien
taaaagttattccaaaattgtataa

SEQ ID NO: 87221 - DNA, 25 bp, Homo sapien
taaaagttattccgaaattgtataa

SEQ ID NO: 87222 - DNA, 25 bp, Homo sapien
taaaagttgccaaccaacaccacca

SEQ ID NO: 87223 - DNA, 25 bp, Homo sapien
taaaagttgccatccaacaccacca

SEQ ID NO: 87224 - DNA, 25 bp, Homo sapien
taaaagttgtctcattctctcctta

SEQ ID NO: 87225 - DNA, 25 bp, Homo sapien
taaaagttgtctcgttctctcctta

SEQ ID NO: 87226 - DNA, 25 bp, Homo sapien
taaaataaacagtcttcattcacaa

SEQ ID NO: 87227 - DNA, 25 bp, Homo sapien
taaaataaatagtcttcattcacaa

SEQ ID NO: 87228 - DNA, 25 bp, Homo sapien
taaaataacatcgcaggaaactact

SEQ ID NO: 87229 - DNA, 25 bp, Homo sapien
taaaataacatcgcgggaaactact

SEQ ID NO: 87230 - DNA, 25 bp, Homo sapien
taaaataatgtaaaacatctccata

SEQ ID NO: 87231 - DNA, 25 bp, Homo sapien
taaaataatgtaaaacgtctccata

SEQ ID NO: 87232 - DNA, 25 bp, Homo sapien
taaaataattgttctcatagagttc

SEQ ID NO: 87233 - DNA, 25 bp, Homo sapien
taaaataattgttgtcatagagttc

SEQ ID NO: 87234 - DNA, 25 bp, Homo sapien
taaaatagaaagcgtaggttgattg

SEQ ID NO: 87235 - DNA, 25 bp, Homo sapien
taaaatagaaagggtaggttgattg

SEQ ID NO: 87236 - DNA, 25 bp, Homo sapien
taaaatagaagcgtaagggagacat

SEQ ID NO: 87237 - DNA, 25 bp, Homo sapien
taaaatagaagtgtaagggagacat

SEQ ID NO: 87238 - DNA, 25 bp, Homo sapien
taaaatagcagtcaaaaaaatcaag

SEQ ID NO: 87239 - DNA, 25 bp, Homo sapien
taaaatagcagtccaaaaaatcaag

SEQ ID NO: 87240 - DNA, 25 bp, Homo sapien
taaaataggataagtgtctcgatga

SEQ ID NO: 87241 - DNA, 25 bp, Homo sapien
taaaataggttaagtgtctcgatga

SEQ ID NO: 87242 - DNA, 25 bp, Homo sapien
taaaatataagagtgcagttgtcat

SEQ ID NO: 87243 - DNA, 25 bp, Homo sapien
taaaatatacctgattacatttttg

SEQ ID NO: 87244 - DNA, 25 bp, Homo sapien
taaaatatacctgtttacatttttg

SEQ ID NO: 87245 - DNA, 25 bp, Homo sapien
taaaatatggttaacgataatggtc

SEQ ID NO: 87246 - DNA, 25 bp, Homo sapien
taaaatatggttaatgataatggtc

SEQ ID NO: 87247 - DNA, 25 bp, Homo sapien
taaaatattagagtgcagttgtcat

SEQ ID NO: 87248 - DNA, 25 bp, Homo sapien
taaaatatttgaaaggaaagccaga

SEQ ID NO: 87249 - DNA, 25 bp, Homo sapien
taaaatatttgaatggaaagccaga

SEQ ID NO: 87250 - DNA, 25 bp, Homo sapien
taaaatcaatacacagtggatcaga

SEQ ID NO: 87251 - DNA, 25 bp, Homo sapien
taaaatcacccgtcaaatctttact

SEQ ID NO: 87252 - DNA, 25 bp, Homo sapien
taaaatcacccgtcgaatctttact

SEQ ID NO: 87253 - DNA, 25 bp, Homo sapien
taaaatcagccttttttcatttctg

SEQ ID NO: 87254 - DNA, 25 bp, Homo sapien
taaaatcaggcttttttcatttctg

SEQ ID NO: 87255 - DNA, 25 bp, Homo sapien
taaaatcaggtggtggaagtgagac

SEQ ID NO: 87256 - DNA, 25 bp, Homo sapien
taaaatcagtacacagtggatcaga

SEQ ID NO: 87257 - DNA, 25 bp, Homo sapien
taaaatcagttggtggaagtgagac

SEQ ID NO: 87258 - DNA, 25 bp, Homo sapien
taaaatccatgacaacacctgggat

SEQ ID NO: 87259 - DNA, 25 bp, Homo sapien
taaaatccatggcaacacctgggat

SEQ ID NO: 87260 - DNA, 25 bp, Homo sapien
taaaatctagcatcgctttatgata

SEQ ID NO: 87261 - DNA, 25 bp, Homo sapien
taaaatctagcatggctttatgata

SEQ ID NO: 87262 - DNA, 25 bp, Homo sapien
taaaatctccttgctgaatcctcga

SEQ ID NO: 87263 - DNA, 25 bp, Homo sapien
taaaatctccttgttgaatcctcga

SEQ ID NO: 87264 - DNA, 25 bp, Homo sapien
taaaatctggcatttcgcccattat

SEQ ID NO: 87265 - DNA, 25 bp, Homo sapien
taaaatctggcatttctcccattat

SEQ ID NO: 87266 - DNA, 25 bp, Homo sapien
taaaatgaataatgaacggcagact

SEQ ID NO: 87267 - DNA, 25 bp, Homo sapien
taaaatgaataatgaatggcagact

SEQ ID NO: 87268 - DNA, 25 bp, Homo sapien
taaaatgacactcgggtgattacaa

SEQ ID NO: 87269 - DNA, 25 bp, Homo sapien
taaaatgacactctggtgattacaa

SEQ ID NO: 87270 - DNA, 25 bp, Homo sapien
taaaatgacgacatattcaatgctg

SEQ ID NO: 87271 - DNA, 25 bp, Homo sapien
taaaatgagttgggaagaagttctc

SEQ ID NO: 87272 - DNA, 25 bp, Homo sapien
taaaatgagttgggtagaagttctc

SEQ ID NO: 87273 - DNA, 25 bp, Homo sapien
taaaatgatgacatattcaatgctg

SEQ ID NO: 87274 - DNA, 25 bp, Homo sapien
taaaatgcaaataccccaaagcaca

SEQ ID NO: 87275 - DNA, 25 bp, Homo sapien
taaaatgcaaatatcccaaagcaca

SEQ ID NO: 87276 - DNA, 25 bp, Homo sapien
taaaatgcagctactgagagagatg

SEQ ID NO: 87277 - DNA, 25 bp, Homo sapien
taaaatgcagctattgagagagatg

SEQ ID NO: 87278 - DNA, 25 bp, Homo sapien
taaaatggaaaaacctggacaaata

SEQ ID NO: 87279 - DNA, 25 bp, Homo sapien
taaaatggagaaacctggacaaata

SEQ ID NO: 87280 - DNA, 25 bp, Homo sapien
taaaatggagaccgcctgaacttgg

SEQ ID NO: 87281 - DNA, 25 bp, Homo sapien
taaaatggagactgcctgaacttgg

SEQ ID NO: 87282 - DNA, 25 bp, Homo sapien
taaaatggaggcacaatggtgagaa

SEQ ID NO: 87283 - DNA, 25 bp, Homo sapien
taaaatggaggcacgatggtgagaa

SEQ ID NO: 87284 - DNA, 25 bp, Homo sapien
taaaatgtagtagaaacatagtcac

SEQ ID NO: 87285 - DNA, 25 bp, Homo sapien
taaaatgtagtggaaacatagtcac

SEQ ID NO: 87286 - DNA, 25 bp, Homo sapien
taaaatgtccacatcctgatccccg

SEQ ID NO: 87287 - DNA, 25 bp, Homo sapien
taaaatgtccacattctgatccccg

SEQ ID NO: 87288 - DNA, 25 bp, Homo sapien
taaaatgtccggccgacgtttctgg

SEQ ID NO: 87289 - DNA, 25 bp, Homo sapien
taaaatgtccggccgatgtttctgg

SEQ ID NO: 87290 - DNA, 25 bp, Homo sapien
taaaatgtcttccatttgcatttta

SEQ ID NO: 87291 - DNA, 25 bp, Homo sapien
taaaatgtcttccgtttgcatttta

SEQ ID NO: 87292 - DNA, 25 bp, Homo sapien
taaaatgtgcctacgtccttccaac

SEQ ID NO: 87293 - DNA, 25 bp, Homo sapien
taaaatgtgcctatgtccttccaac

SEQ ID NO: 87294 - DNA, 25 bp, Homo sapien
taaaatgtggctagagttactggaa

SEQ ID NO: 87295 - DNA, 25 bp, Homo sapien
taaaatgtggctagtgttactggaa

SEQ ID NO: 87296 - DNA, 25 bp, Homo sapien
taaaatgtgtcatagagctgaatgc

SEQ ID NO: 87297 - DNA, 25 bp, Homo sapien
taaaatgtgtcgtagagctgaatgc

SEQ ID NO: 87298 - DNA, 25 bp, Homo sapien
taaaatgttagcctatcaatatttc

SEQ ID NO: 87299 - DNA, 25 bp, Homo sapien
taaaatgttagcgtatcaatatttc

SEQ ID NO: 87300 - DNA, 25 bp, Homo sapien
taaaattacctgcaatttgtgagca

SEQ ID NO: 87301 - DNA, 25 bp, Homo sapien
taaaattacgaaatatctcttttga

SEQ ID NO: 87302 - DNA, 25 bp, Homo sapien
taaaattagaaccacattgtttgct

SEQ ID NO: 87303 - DNA, 25 bp, Homo sapien
taaaattagaactacattgtttgct

SEQ ID NO: 87304 - DNA, 25 bp, Homo sapien
taaaattatactaatatccctgaaa

SEQ ID NO: 87305 - DNA, 25 bp, Homo sapien
taaaattatcctaatatccctgaaa

SEQ ID NO: 87306 - DNA, 25 bp, Homo sapien
taaaattatctgcaatttgtgagca

SEQ ID NO: 87307 - DNA, 25 bp, Homo sapien
taaaattatgaaatatctcttttga

SEQ ID NO: 87308 - DNA, 25 bp, Homo sapien
taaaattatggaaaaccagacacga

SEQ ID NO: 87309 - DNA, 25 bp, Homo sapien
taaaattatggagaaccagacacga

SEQ ID NO: 87310 - DNA, 25 bp, Homo sapien
taaaattcaaaaatcagtcgggtgc

SEQ ID NO: 87311 - DNA, 25 bp, Homo sapien
taaaattcaaaaattagtcgggtgc

SEQ ID NO: 87312 - DNA, 25 bp, Homo sapien
taaaattctaaaggactaacttttc

SEQ ID NO: 87313 - DNA, 25 bp, Homo sapien
taaaattctaagggactaacttttc

SEQ ID NO: 87314 - DNA, 25 bp, Homo sapien
taaaattctgctgctaaaacagtta

SEQ ID NO: 87315 - DNA, 25 bp, Homo sapien
taaaattctgcttctaaaacagtta

SEQ ID NO: 87316 - DNA, 25 bp, Homo sapien
taaaattgagaccgagaggaagtag

SEQ ID NO: 87317 - DNA, 25 bp, Homo sapien
taaaattgagactgagaggaagtag

SEQ ID NO: 87318 - DNA, 25 bp, Homo sapien
taaaattgcatttattgtgtgcaac

SEQ ID NO: 87319 - DNA, 25 bp, Homo sapien
taaaattgtatttattgtgtgcaac

SEQ ID NO: 87320 - DNA, 25 bp, Homo sapien
taaaattgtcataattaatagaaac

SEQ ID NO: 87321 - DNA, 25 bp, Homo sapien
taaaattgtcatcattaatagaaac

SEQ ID NO: 87322 - DNA, 25 bp, Homo sapien
taaaatttaataaggcaaatgtttg

SEQ ID NO: 87323 - DNA, 25 bp, Homo sapien
taaaatttagcccacattgccaagt

SEQ ID NO: 87324 - DNA, 25 bp, Homo sapien
taaaatttagccgagaacttctaga

SEQ ID NO: 87325 - DNA, 25 bp, Homo sapien
taaaatttagctcacattgccaagt

SEQ ID NO: 87326 - DNA, 25 bp, Homo sapien
taaaatttagctgagaacttctaga

SEQ ID NO: 87327 - DNA, 25 bp, Homo sapien
taaaatttagtaaggcaaatgtttg

SEQ ID NO: 87328 - DNA, 25 bp, Homo sapien
taaaattttatggatacgaattcag

SEQ ID NO: 87329 - DNA, 25 bp, Homo sapien
taaaattttgtggatacgaattcag

SEQ ID NO: 87330 - DNA, 25 bp, Homo sapien
taaacaaaaatctgagccttgcata

SEQ ID NO: 87331 - DNA, 25 bp, Homo sapien
taaacaaaaatctgagtcttgcata

SEQ ID NO: 87332 - DNA, 25 bp, Homo sapien
taaacaaacagtatgtcaggtgata

SEQ ID NO: 87333 - DNA, 25 bp, Homo sapien
taaacaaagggagcatgacatggaa

SEQ ID NO: 87334 - DNA, 25 bp, Homo sapien
taaacaaagtgagcatgacatggaa

SEQ ID NO: 87335 - DNA, 25 bp, Homo sapien
taaacaaatacgaaatcttaacaaa

SEQ ID NO: 87336 - DNA, 25 bp, Homo sapien
taaacaaatactaaatcttaacaaa

SEQ ID NO: 87337 - DNA, 25 bp, Homo sapien
taaacaaatagtatgtcaggtgata

SEQ ID NO: 87338 - DNA, 25 bp, Homo sapien
taaacaaggattcctaaatctcaaa

SEQ ID NO: 87339 - DNA, 25 bp, Homo sapien
taaacaaggattcttaaatctcaaa

SEQ ID NO: 87340 - DNA, 25 bp, Homo sapien
taaacaataagactttacttagtgc

SEQ ID NO: 87341 - DNA, 25 bp, Homo sapien
taaacaataagcctttacttagtgc

SEQ ID NO: 87342 - DNA, 25 bp, Homo sapien
taaacaatagacctctttggggagc

SEQ ID NO: 87343 - DNA, 25 bp, Homo sapien
taaacaatagacctttttggggagc

SEQ ID NO: 87344 - DNA, 25 bp, Homo sapien
taaacacactcaatgagaaaaggac

SEQ ID NO: 87345 - DNA, 25 bp, Homo sapien
taaacacactcagtgagaaaaggac

SEQ ID NO: 87346 - DNA, 25 bp, Homo sapien
taaacacactctaccatcttagata

SEQ ID NO: 87347 - DNA, 25 bp, Homo sapien
taaacacattctaccatcttagata

SEQ ID NO: 87348 - DNA, 25 bp, Homo sapien
taaacactcttcatgtaatttgtgt

SEQ ID NO: 87349 - DNA, 25 bp, Homo sapien
taaacactcttcgtgtaatttgtgt

SEQ ID NO: 87350 - DNA, 25 bp, Homo sapien
taaacagaggaaactctaatattct

SEQ ID NO: 87351 - DNA, 25 bp, Homo sapien
taaacagaggaagctctaatattct

SEQ ID NO: 87352 - DNA, 25 bp, Homo sapien
taaacagatcccgaataaagggtat

SEQ ID NO: 87353 - DNA, 25 bp, Homo sapien
taaacagatcctgaataaagggtat

SEQ ID NO: 87354 - DNA, 25 bp, Homo sapien
taaacaggcaagacagggagattag

SEQ ID NO: 87355 - DNA, 25 bp, Homo sapien
taaacaggcaaggcagggagattag

SEQ ID NO: 87356 - DNA, 25 bp, Homo sapien
taaacaggctgcgaatctgtgtctt

SEQ ID NO: 87357 - DNA, 25 bp, Homo sapien
taaacaggctgtgaatctgtgtctt

SEQ ID NO: 87358 - DNA, 25 bp, Homo sapien
taaacagtatgtgaatttctccttt

SEQ ID NO: 87359 - DNA, 25 bp, Homo sapien
taaacagtatgtgagtttctccttt

SEQ ID NO: 87360 - DNA, 25 bp, Homo sapien
taaacagtcccatgagtaagaacag

SEQ ID NO: 87361 - DNA, 25 bp, Homo sapien
taaacagtcccgtgagtaagaacag

SEQ ID NO: 87362 - DNA, 25 bp, Homo sapien
taaacagtgaccggaagagcttgta

SEQ ID NO: 87363 - DNA, 25 bp, Homo sapien
taaacagtgactggaagagcttgta

SEQ ID NO: 87364 - DNA, 25 bp, Homo sapien
taaacataaaacgatacacaaacca

SEQ ID NO: 87365 - DNA, 25 bp, Homo sapien
taaacataaaatgatacacaaacca

SEQ ID NO: 87366 - DNA, 25 bp, Homo sapien
taaacataaaggacaagttaggcat

SEQ ID NO: 87367 - DNA, 25 bp, Homo sapien
taaacataaaggataagttaggcat

SEQ ID NO: 87368 - DNA, 25 bp, Homo sapien
taaacataactgccattttttgcta

SEQ ID NO: 87369 - DNA, 25 bp, Homo sapien
taaacataatgggtaaatggtatgg

SEQ ID NO: 87370 - DNA, 25 bp, Homo sapien
taaacataatgggtcaatggtatgg

SEQ ID NO: 87371 - DNA, 25 bp, Homo sapien
taaacataattgccattttttgcta

SEQ ID NO: 87372 - DNA, 25 bp, Homo sapien
taaacatcatcaatataatttgcta

SEQ ID NO: 87373 - DNA, 25 bp, Homo sapien
taaacatcatcgatataatttgcta

SEQ ID NO: 87374 - DNA, 25 bp, Homo sapien
taaacatgcatatacccatcacctc

SEQ ID NO: 87375 - DNA, 25 bp, Homo sapien
taaacatgcatatacctatcacctc

SEQ ID NO: 87376 - DNA, 25 bp, Homo sapien
taaacatggtagattggagtaagtt

SEQ ID NO: 87377 - DNA, 25 bp, Homo sapien
taaacatggtaggttggagtaagtt

SEQ ID NO: 87378 - DNA, 25 bp, Homo sapien
taaacattacgatgcagtttttcaa

SEQ ID NO: 87379 - DNA, 25 bp, Homo sapien
taaacattatgatgcagtttttcaa

SEQ ID NO: 87380 - DNA, 25 bp, Homo sapien
taaacattcaaaaccaagatgctgg

SEQ ID NO: 87381 - DNA, 25 bp, Homo sapien
taaacattcaaagccaagatgctgg

SEQ ID NO: 87382 - DNA, 25 bp, Homo sapien
taaacattgtctctgctgggtgtga

SEQ ID NO: 87383 - DNA, 25 bp, Homo sapien
taaacattgtctttgctgggtgtga

SEQ ID NO: 87384 - DNA, 25 bp, Homo sapien
taaacatttctgccattacattagt

SEQ ID NO: 87385 - DNA, 25 bp, Homo sapien
taaacatttctgtcattacattagt

SEQ ID NO: 87386 - DNA, 25 bp, Homo sapien
taaacatttgtgggagatattgaat

SEQ ID NO: 87387 - DNA, 25 bp, Homo sapien
taaacatttgttggagatattgaat

SEQ ID NO: 87388 - DNA, 25 bp, Homo sapien
taaacattttctaccacgctccctt

SEQ ID NO: 87389 - DNA, 25 bp, Homo sapien
taaacattttctaccatgctccctt

SEQ ID NO: 87390 - DNA, 25 bp, Homo sapien
taaaccaaagaagcatctacagagc

SEQ ID NO: 87391 - DNA, 25 bp, Homo sapien
taaaccaacaatcctgcttctttct

SEQ ID NO: 87392 - DNA, 25 bp, Homo sapien
taaaccaacaattctgcttctttct

SEQ ID NO: 87393 - DNA, 25 bp, Homo sapien
taaaccaacgaagcatctacagagc

SEQ ID NO: 87394 - DNA, 25 bp, Homo sapien
taaaccaatcttattgttgtgaaat

SEQ ID NO: 87395 - DNA, 25 bp, Homo sapien
taaaccaatcttgttgttgtgaaat

SEQ ID NO: 87396 - DNA, 25 bp, Homo sapien
taaaccacttatccgagtctgctca

SEQ ID NO: 87397 - DNA, 25 bp, Homo sapien
taaaccacttatctgagtctgctca

SEQ ID NO: 87398 - DNA, 25 bp, Homo sapien
taaaccagacaaccaacgccaattt

SEQ ID NO: 87399 - DNA, 25 bp, Homo sapien
taaaccagacaaccaatgccaattt

SEQ ID NO: 87400 - DNA, 25 bp, Homo sapien
taaaccattatcaactcttgcttca

SEQ ID NO: 87401 - DNA, 25 bp, Homo sapien
taaaccattatcatctcttgcttca

SEQ ID NO: 87402 - DNA, 25 bp, Homo sapien
taaacccaatagaagcctgaagtca

SEQ ID NO: 87403 - DNA, 25 bp, Homo sapien
taaacccaatcaaatcagaaagaat

SEQ ID NO: 87404 - DNA, 25 bp, Homo sapien
taaacccaatccaatcagaaagaat

SEQ ID NO: 87405 - DNA, 25 bp, Homo sapien
taaacccagatgacatcttagctgg

SEQ ID NO: 87406 - DNA, 25 bp, Homo sapien
taaacccagatgatatcttagctgg

SEQ ID NO: 87407 - DNA, 25 bp, Homo sapien
taaacccattagaagcctgaagtca

SEQ ID NO: 87408 - DNA, 25 bp, Homo sapien
taaacccttcaagtcgttccattga

SEQ ID NO: 87409 - DNA, 25 bp, Homo sapien
taaacccttcacgtcgttccattga

SEQ ID NO: 87410 - DNA, 25 bp, Homo sapien
taaacctacaaaaacttgcaaatca

SEQ ID NO: 87411 - DNA, 25 bp, Homo sapien
taaacctataaaaacttgcaaatca

SEQ ID NO: 87412 - DNA, 25 bp, Homo sapien
taaacctatgctcaattccaagcct

SEQ ID NO: 87413 - DNA, 25 bp, Homo sapien
taaacctatgctcagttccaagcct

SEQ ID NO: 87414 - DNA, 25 bp, Homo sapien
taaacctgaagaatattatgtgaag

SEQ ID NO: 87415 - DNA, 25 bp, Homo sapien
taaacctgaagagtattatgtgaag

SEQ ID NO: 87416 - DNA, 25 bp, Homo sapien
taaacctgtacagcatcatactgtg

SEQ ID NO: 87417 - DNA, 25 bp, Homo sapien
taaacctgtacagtatcatactgtg

SEQ ID NO: 87418 - DNA, 25 bp, Homo sapien
taaacgcctagatacaataagtttc

SEQ ID NO: 87419 - DNA, 25 bp, Homo sapien
taaacgcctaggtacaataagtttc

SEQ ID NO: 87420 - DNA, 25 bp, Homo sapien
taaacgtggccccaatgcaagggtg

SEQ ID NO: 87421 - DNA, 25 bp, Homo sapien
taaacgtggccccagtgcaagggtg

SEQ ID NO: 87422 - DNA, 25 bp, Homo sapien
taaacgttgatgagaatgtggagca

SEQ ID NO: 87423 - DNA, 25 bp, Homo sapien
taaacgttggtgagaatgtggagca

SEQ ID NO: 87424 - DNA, 25 bp, Homo sapien
taaactaacctttaaaagcacaggg

SEQ ID NO: 87425 - DNA, 25 bp, Homo sapien
taaactaagagacgatacaatttta

SEQ ID NO: 87426 - DNA, 25 bp, Homo sapien
taaactaagagaggatacaatttta

SEQ ID NO: 87427 - DNA, 25 bp, Homo sapien
taaactaatctttaaaagcacaggg

SEQ ID NO: 87428 - DNA, 25 bp, Homo sapien
taaactcacatatacggaaatgtat

SEQ ID NO: 87429 - DNA, 25 bp, Homo sapien
taaactcacgtatacggaaatgtat

SEQ ID NO: 87430 - DNA, 25 bp, Homo sapien
taaactcagaaaagaatcaaagata

SEQ ID NO: 87431 - DNA, 25 bp, Homo sapien
taaactcagaagagaatcaaagata

SEQ ID NO: 87432 - DNA, 25 bp, Homo sapien
taaactcagatctacctcacattta

SEQ ID NO: 87433 - DNA, 25 bp, Homo sapien
taaactcagatctatctcacattta

SEQ ID NO: 87434 - DNA, 25 bp, Homo sapien
taaactcatcatcgcatttgcttta

SEQ ID NO: 87435 - DNA, 25 bp, Homo sapien
taaactcatcattgcatttgcttta

SEQ ID NO: 87436 - DNA, 25 bp, Homo sapien
taaactcattacgtttaacatgcaa

SEQ ID NO: 87437 - DNA, 25 bp, Homo sapien
taaactcattatgtttaacatgcaa

SEQ ID NO: 87438 - DNA, 25 bp, Homo sapien
taaactccactatccttcagacctt

SEQ ID NO: 87439 - DNA, 25 bp, Homo sapien
taaactccactctccttcagacctt

SEQ ID NO: 87440 - DNA, 25 bp, Homo sapien
taaactctgaagtccacatttttct

SEQ ID NO: 87441 - DNA, 25 bp, Homo sapien
taaactctgaagtccatatttttct

SEQ ID NO: 87442 - DNA, 25 bp, Homo sapien
taaactctgttaatatgtttacaaa

SEQ ID NO: 87443 - DNA, 25 bp, Homo sapien
taaactcttttaatatgtttacaaa

SEQ ID NO: 87444 - DNA, 25 bp, Homo sapien
taaactgaaaacattctgcacagca

SEQ ID NO: 87445 - DNA, 25 bp, Homo sapien
taaactgaaaatattctgcacagca

SEQ ID NO: 87446 - DNA, 25 bp, Homo sapien
taaactgaaatatctgcgcatgcaa

SEQ ID NO: 87447 - DNA, 25 bp, Homo sapien
taaactgaaatatctgtgcatgcaa

SEQ ID NO: 87448 - DNA, 25 bp, Homo sapien
taaactgaggatcattcacctgaag

SEQ ID NO: 87449 - DNA, 25 bp, Homo sapien
taaactgaggattattcacctgaag

SEQ ID NO: 87450 - DNA, 25 bp, Homo sapien
taaactgcaattcctccagaatctg

SEQ ID NO: 87451 - DNA, 25 bp, Homo sapien
taaactgcacttcctccagaatctg

SEQ ID NO: 87452 - DNA, 25 bp, Homo sapien
taaactggactatacgaatgcattt

SEQ ID NO: 87453 - DNA, 25 bp, Homo sapien
taaactggactatatgaatgcattt

SEQ ID NO: 87454 - DNA, 25 bp, Homo sapien
taaactgggcatcttgagttttagc

SEQ ID NO: 87455 - DNA, 25 bp, Homo sapien
taaactgggcattttgagttttagc

SEQ ID NO: 87456 - DNA, 25 bp, Homo sapien
taaactggtaaccgtaagtaaatgt

SEQ ID NO: 87457 - DNA, 25 bp, Homo sapien
taaactggtaactgtaagtaaatgt

SEQ ID NO: 87458 - DNA, 25 bp, Homo sapien
taaactggtacatctattccagaat

SEQ ID NO: 87459 - DNA, 25 bp, Homo sapien
taaactggtgcatctattccagaat

SEQ ID NO: 87460 - DNA, 25 bp, Homo sapien
taaacttacaaatgctaccagtgtg

SEQ ID NO: 87461 - DNA, 25 bp, Homo sapien
taaacttacaaatgttaccagtgtg

SEQ ID NO: 87462 - DNA, 25 bp, Homo sapien
taaacttacctgataggattccaaa

SEQ ID NO: 87463 - DNA, 25 bp, Homo sapien
taaacttatctgataggattccaaa

SEQ ID NO: 87464 - DNA, 25 bp, Homo sapien
taaacttcactgctttcaaagtggt

SEQ ID NO: 87465 - DNA, 25 bp, Homo sapien
taaacttcagtgctttcaaagtggt

SEQ ID NO: 87466 - DNA, 25 bp, Homo sapien
taaacttgctctcactttatggact

SEQ ID NO: 87467 - DNA, 25 bp, Homo sapien
taaacttgctctcagtttatggact

SEQ ID NO: 87468 - DNA, 25 bp, Homo sapien
taaacttgtactaacgttatgacat

SEQ ID NO: 87469 - DNA, 25 bp, Homo sapien
taaacttgtactaatgttatgacat

SEQ ID NO: 87470 - DNA, 25 bp, Homo sapien
taaactttattctccaaacaaatct

SEQ ID NO: 87471 - DNA, 25 bp, Homo sapien
taaactttattctccatacaaatct

SEQ ID NO: 87472 - DNA, 25 bp, Homo sapien
taaactttatttctcagcacataat

SEQ ID NO: 87473 - DNA, 25 bp, Homo sapien
taaactttatttgtcagcacataat

SEQ ID NO: 87474 - DNA, 25 bp, Homo sapien
taaactttggtcagttatgtcctat

SEQ ID NO: 87475 - DNA, 25 bp, Homo sapien
taaacttttgtcagttatgtcctat

SEQ ID NO: 87476 - DNA, 25 bp, Homo sapien
taaagaaaaaaggacagtgagtagt

SEQ ID NO: 87477 - DNA, 25 bp, Homo sapien
taaagaaaaaagggcagtgagtagt

SEQ ID NO: 87478 - DNA, 25 bp, Homo sapien
taaagaaaagataccacgctgcaaa

SEQ ID NO: 87479 - DNA, 25 bp, Homo sapien
taaagaaaagataccatgctgcaaa

SEQ ID NO: 87480 - DNA, 25 bp, Homo sapien
taaagaaattgaaaataaacactct

SEQ ID NO: 87481 - DNA, 25 bp, Homo sapien
taaagaaattggaaataaacactct

SEQ ID NO: 87482 - DNA, 25 bp, Homo sapien
taaagaacttaccaacttaactgat

SEQ ID NO: 87483 - DNA, 25 bp, Homo sapien
taaagaacttatcaacttaactgat

SEQ ID NO: 87484 - DNA, 25 bp, Homo sapien
taaagaagaacaaagtgtggcatgt

SEQ ID NO: 87485 - DNA, 25 bp, Homo sapien
taaagaagaccaaagtgtggcatgt

SEQ ID NO: 87486 - DNA, 25 bp, Homo sapien
taaagaagagaagaaagtaccagga

SEQ ID NO: 87487 - DNA, 25 bp, Homo sapien
taaagaagagaagaaattaccagga

SEQ ID NO: 87488 - DNA, 25 bp, Homo sapien
taaagaagagtcaggtaaatataaa

SEQ ID NO: 87489 - DNA, 25 bp, Homo sapien
taaagaagagtcgggtaaatataaa

SEQ ID NO: 87490 - DNA, 25 bp, Homo sapien
taaagaagataatagagaagctcca

SEQ ID NO: 87491 - DNA, 25 bp, Homo sapien
taaagaaggtaatagagaagctcca

SEQ ID NO: 87492 - DNA, 25 bp, Homo sapien
taaagaatacgagtaaacataaaat

SEQ ID NO: 87493 - DNA, 25 bp, Homo sapien
taaagaatatgagtaaacataaaat

SEQ ID NO: 87494 - DNA, 25 bp, Homo sapien
taaagaatcagagttttttcagaat

SEQ ID NO: 87495 - DNA, 25 bp, Homo sapien
taaagaatcgatctgatttccacag

SEQ ID NO: 87496 - DNA, 25 bp, Homo sapien
taaagaatcggagttttttcagaat

SEQ ID NO: 87497 - DNA, 25 bp, Homo sapien
taaagaatctatctgatttccacag

SEQ ID NO: 87498 - DNA, 25 bp, Homo sapien
taaagaatctccgtgacattggcta

SEQ ID NO: 87499 - DNA, 25 bp, Homo sapien
taaagaatctctgtgacattggcta

SEQ ID NO: 87500 - DNA, 25 bp, Homo sapien
taaagaattacacaaacaaactgat

SEQ ID NO: 87501 - DNA, 25 bp, Homo sapien
taaagaattacgcaaacaaactgat

SEQ ID NO: 87502 - DNA, 25 bp, Homo sapien
taaagaattgacgaaggaaaattac

SEQ ID NO: 87503 - DNA, 25 bp, Homo sapien
taaagaattgatgaaggaaaattac

SEQ ID NO: 87504 - DNA, 25 bp, Homo sapien
taaagacaaatgagaacagatctac

SEQ ID NO: 87505 - DNA, 25 bp, Homo sapien
taaagacaaatgataacagatctac

SEQ ID NO: 87506 - DNA, 25 bp, Homo sapien
taaagacagcagttggttagatcag

SEQ ID NO: 87507 - DNA, 25 bp, Homo sapien
taaagacaggagttggttagatcag

SEQ ID NO: 87508 - DNA, 25 bp, Homo sapien
taaagaccacctacaaaatgtagat

SEQ ID NO: 87509 - DNA, 25 bp, Homo sapien
taaagaccacctacaagatgtagat

SEQ ID NO: 87510 - DNA, 25 bp, Homo sapien
taaagactgagcatagggttcccag

SEQ ID NO: 87511 - DNA, 25 bp, Homo sapien
taaagactgagcgtagggttcccag

SEQ ID NO: 87512 - DNA, 25 bp, Homo sapien
taaagactttccatctcaattgtac

SEQ ID NO: 87513 - DNA, 25 bp, Homo sapien
taaagactttccatctgaattgtac

SEQ ID NO: 87514 - DNA, 25 bp, Homo sapien
taaagagaacagtatattatggacc

SEQ ID NO: 87515 - DNA, 25 bp, Homo sapien
taaagagaacagtgtattatggacc

SEQ ID NO: 87516 - DNA, 25 bp, Homo sapien
taaagagacacgtaggctaagaaaa

SEQ ID NO: 87517 - DNA, 25 bp, Homo sapien
taaagagacgcgtaggctaagaaaa

SEQ ID NO: 87518 - DNA, 25 bp, Homo sapien
taaagagtaatgttctcatctttcc

SEQ ID NO: 87519 - DNA, 25 bp, Homo sapien
taaagagtagtgttctcatctttcc

SEQ ID NO: 87520 - DNA, 25 bp, Homo sapien
taaagagttatgatctctcaagtca

SEQ ID NO: 87521 - DNA, 25 bp, Homo sapien
taaagagttatgttctctcaagtca

SEQ ID NO: 87522 - DNA, 25 bp, Homo sapien
taaagagttcacaggtaaatgaaag

SEQ ID NO: 87523 - DNA, 25 bp, Homo sapien
taaagagttcacaggtgaatgaaag

SEQ ID NO: 87524 - DNA, 25 bp, Homo sapien
taaagatcagtaacgtaggataaac

SEQ ID NO: 87525 - DNA, 25 bp, Homo sapien
taaagatcagtaatgtaggataaac

SEQ ID NO: 87526 - DNA, 25 bp, Homo sapien
taaagatgaaagtgaattgagactg

SEQ ID NO: 87527 - DNA, 25 bp, Homo sapien
taaagatgagagtgaattgagactg

SEQ ID NO: 87528 - DNA, 25 bp, Homo sapien
taaagatgagtaaaacaaactgtag

SEQ ID NO: 87529 - DNA, 25 bp, Homo sapien
taaagatgagtaaatcaaactgtag

SEQ ID NO: 87530 - DNA, 25 bp, Homo sapien
taaagatggaaacgatgctgaggac

SEQ ID NO: 87531 - DNA, 25 bp, Homo sapien
taaagatggtaacgatgctgaggac

SEQ ID NO: 87532 - DNA, 25 bp, Homo sapien
taaagatgtaaaacagggaagcctt

SEQ ID NO: 87533 - DNA, 25 bp, Homo sapien
taaagatgtcaaacagggaagcctt

SEQ ID NO: 87534 - DNA, 25 bp, Homo sapien
taaagattaaagaggtgaggatggc

SEQ ID NO: 87535 - DNA, 25 bp, Homo sapien
taaagattaaagagttgaggatggc

SEQ ID NO: 87536 - DNA, 25 bp, Homo sapien
taaagatttgaagtagatgagcaag

SEQ ID NO: 87537 - DNA, 25 bp, Homo sapien
taaagatttgaagtaggtgagcaag

SEQ ID NO: 87538 - DNA, 25 bp, Homo sapien
taaagcaaaaagtagaggaaatggg

SEQ ID NO: 87539 - DNA, 25 bp, Homo sapien
taaagcaaagagtagaggaaatggg

SEQ ID NO: 87540 - DNA, 25 bp, Homo sapien
taaagcacattatcacagatgtaca

SEQ ID NO: 87541 - DNA, 25 bp, Homo sapien
taaagcacatttcacggaccgtgca

SEQ ID NO: 87542 - DNA, 25 bp, Homo sapien
taaagcacatttcatggaccgtgca

SEQ ID NO: 87543 - DNA, 25 bp, Homo sapien
taaagcacgttatcacagatgtaca

SEQ ID NO: 87544 - DNA, 25 bp, Homo sapien
taaagcactaacaataggccaggca

SEQ ID NO: 87545 - DNA, 25 bp, Homo sapien
taaagcactaacgataggccaggca

SEQ ID NO: 87546 - DNA, 25 bp, Homo sapien
taaagcactaagagataacaatctt

SEQ ID NO: 87547 - DNA, 25 bp, Homo sapien
taaagcactgagagataacaatctt

SEQ ID NO: 87548 - DNA, 25 bp, Homo sapien
taaagcagataaagattgaatcaca

SEQ ID NO: 87549 - DNA, 25 bp, Homo sapien
taaagcagatacagattgaatcaca

SEQ ID NO: 87550 - DNA, 25 bp, Homo sapien
taaagcagtgtttcataaacttatt

SEQ ID NO: 87551 - DNA, 25 bp, Homo sapien
taaagcagtgtttcatgaacttatt

SEQ ID NO: 87552 - DNA, 25 bp, Homo sapien
taaagcatgctactactaatcaatt

SEQ ID NO: 87553 - DNA, 25 bp, Homo sapien
taaagcatgctactgctaatcaatt

SEQ ID NO: 87554 - DNA, 25 bp, Homo sapien
taaagccaaatattactcctacata

SEQ ID NO: 87555 - DNA, 25 bp, Homo sapien
taaagccaaatattgctcctacata

SEQ ID NO: 87556 - DNA, 25 bp, Homo sapien
taaagccactagtattagtacaata

SEQ ID NO: 87557 - DNA, 25 bp, Homo sapien
taaagccagacctcatgaaaaggat

SEQ ID NO: 87558 - DNA, 25 bp, Homo sapien
taaagccagccctcatgaaaaggat

SEQ ID NO: 87559 - DNA, 25 bp, Homo sapien
taaagccattagtattagtacaata

SEQ ID NO: 87560 - DNA, 25 bp, Homo sapien
taaagcccaattgagagagaaaagc

SEQ ID NO: 87561 - DNA, 25 bp, Homo sapien
taaagcccgattgagagagaaaagc

SEQ ID NO: 87562 - DNA, 25 bp, Homo sapien
taaagcctgtgcattataagcagga

SEQ ID NO: 87563 - DNA, 25 bp, Homo sapien
taaagcctgtgcgttataagcagga

SEQ ID NO: 87564 - DNA, 25 bp, Homo sapien
taaagccttgaacaagaaagcaagt

SEQ ID NO: 87565 - DNA, 25 bp, Homo sapien
taaagccttgaagaagaaagcaagt

SEQ ID NO: 87566 - DNA, 25 bp, Homo sapien
taaagcctttcaatgttacactatg

SEQ ID NO: 87567 - DNA, 25 bp, Homo sapien
taaagcctttcattgttacactatg

SEQ ID NO: 87568 - DNA, 25 bp, Homo sapien
taaagctaaaatatgtctcattcca

SEQ ID NO: 87569 - DNA, 25 bp, Homo sapien
taaagctaaaatgtgtctcattcca

SEQ ID NO: 87570 - DNA, 25 bp, Homo sapien
taaagctagcattaattttccatcc

SEQ ID NO: 87571 - DNA, 25 bp, Homo sapien
taaagctaggattaattttccatcc

SEQ ID NO: 87572 - DNA, 25 bp, Homo sapien
taaagctcaagcgctcttcaatcag

SEQ ID NO: 87573 - DNA, 25 bp, Homo sapien
taaagctcaagggctcttcaatcag

SEQ ID NO: 87574 - DNA, 25 bp, Homo sapien
taaagctcacgtctgtagaagcgca

SEQ ID NO: 87575 - DNA, 25 bp, Homo sapien
taaagctcagagacgttaagcaatt

SEQ ID NO: 87576 - DNA, 25 bp, Homo sapien
taaagctcagagatgttaagcaatt

SEQ ID NO: 87577 - DNA, 25 bp, Homo sapien
taaagctcatgtctgtagaagcgca

SEQ ID NO: 87578 - DNA, 25 bp, Homo sapien
taaagctccttggtctctggagaac

SEQ ID NO: 87579 - DNA, 25 bp, Homo sapien
taaagctctttggtctctggagaac

SEQ ID NO: 87580 - DNA, 25 bp, Homo sapien
taaagctgaagctatttgccagaag

SEQ ID NO: 87581 - DNA, 25 bp, Homo sapien
taaagctgaggctatttgccagaag

SEQ ID NO: 87582 - DNA, 25 bp, Homo sapien
taaagctgtttgtaggcatcgtacg

SEQ ID NO: 87583 - DNA, 25 bp, Homo sapien
taaagctgtttgtcggcatcgtacg

SEQ ID NO: 87584 - DNA, 25 bp, Homo sapien
taaagcttaatagccaatgtgacag

SEQ ID NO: 87585 - DNA, 25 bp, Homo sapien
taaagcttaatagccagtgtgacag

SEQ ID NO: 87586 - DNA, 25 bp, Homo sapien
taaaggaagttggtaagagatggat

SEQ ID NO: 87587 - DNA, 25 bp, Homo sapien
taaaggaatcaaacaaatccaattg

SEQ ID NO: 87588 - DNA, 25 bp, Homo sapien
taaaggaatcaaactaatccaattg

SEQ ID NO: 87589 - DNA, 25 bp, Homo sapien
taaaggaatttggtaagagatggat

SEQ ID NO: 87590 - DNA, 25 bp, Homo sapien
taaaggaccacagagtaaacatttt

SEQ ID NO: 87591 - DNA, 25 bp, Homo sapien
taaaggaccacggagtaaacatttt

SEQ ID NO: 87592 - DNA, 25 bp, Homo sapien
taaaggagacacaggtgatccagca

SEQ ID NO: 87593 - DNA, 25 bp, Homo sapien
taaaggagacacgggtgatccagca

SEQ ID NO: 87594 - DNA, 25 bp, Homo sapien
taaaggagtcaaaacattgatctca

SEQ ID NO: 87595 - DNA, 25 bp, Homo sapien
taaaggagttaaaacattgatctca

SEQ ID NO: 87596 - DNA, 25 bp, Homo sapien
taaaggcactgtctgacaaaacttt

SEQ ID NO: 87597 - DNA, 25 bp, Homo sapien
taaaggcactgtttgacaaaacttt

SEQ ID NO: 87598 - DNA, 25 bp, Homo sapien
taaaggcatcagtgctattgtagag

SEQ ID NO: 87599 - DNA, 25 bp, Homo sapien
taaaggcatcagtgctgttgtagag

SEQ ID NO: 87600 - DNA, 25 bp, Homo sapien
taaaggcattctcaggtagcagcat

SEQ ID NO: 87601 - DNA, 25 bp, Homo sapien
taaaggcattctcgggtagcagcat

SEQ ID NO: 87602 - DNA, 25 bp, Homo sapien
taaaggcctccaaatcttcaactgg

SEQ ID NO: 87603 - DNA, 25 bp, Homo sapien
taaaggcctccacatcttcaactgg

SEQ ID NO: 87604 - DNA, 25 bp, Homo sapien
taaaggccttcgatgcgttgaggat

SEQ ID NO: 87605 - DNA, 25 bp, Homo sapien
taaaggccttcgctgcgttgaggat

SEQ ID NO: 87606 - DNA, 25 bp, Homo sapien
taaaggcttgaccctgggaagcagc

SEQ ID NO: 87607 - DNA, 25 bp, Homo sapien
taaaggcttgatcctgggaagcagc

SEQ ID NO: 87608 - DNA, 25 bp, Homo sapien
taaagggacatcgaaatctcgacat

SEQ ID NO: 87609 - DNA, 25 bp, Homo sapien
taaagggacatcggaatctcgacat

SEQ ID NO: 87610 - DNA, 25 bp, Homo sapien
taaagggatttttgaactgcatatt

SEQ ID NO: 87611 - DNA, 25 bp, Homo sapien
taaagggatttttgaattgcatatt

SEQ ID NO: 87612 - DNA, 25 bp, Homo sapien
taaaggggatgcagataaaagttgc

SEQ ID NO: 87613 - DNA, 25 bp, Homo sapien
taaaggggatgcaggtaaaagttgc

SEQ ID NO: 87614 - DNA, 25 bp, Homo sapien
taaagggtaagatcggaaaccaact

SEQ ID NO: 87615 - DNA, 25 bp, Homo sapien
taaagggtaagatctgaaaccaact

SEQ ID NO: 87616 - DNA, 25 bp, Homo sapien
taaagggttctagtccaattcacta

SEQ ID NO: 87617 - DNA, 25 bp, Homo sapien
taaagggttctggtccaattcacta

SEQ ID NO: 87618 - DNA, 25 bp, Homo sapien
taaaggtcagggaacggggtcacaa

SEQ ID NO: 87619 - DNA, 25 bp, Homo sapien
taaaggtcagggaatggggtcacaa

SEQ ID NO: 87620 - DNA, 25 bp, Homo sapien
taaaggttatttgaagaccaatctg

SEQ ID NO: 87621 - DNA, 25 bp, Homo sapien
taaaggttatttgaaggccaatctg

SEQ ID NO: 87622 - DNA, 25 bp, Homo sapien
taaaggttggggcatgcatcctctg

SEQ ID NO: 87623 - DNA, 25 bp, Homo sapien
taaaggttggggcttgcatcctctg

SEQ ID NO: 87624 - DNA, 25 bp, Homo sapien
taaagtaaccaccagaaaaataaat

SEQ ID NO: 87625 - DNA, 25 bp, Homo sapien
taaagtaaccaccagacaaataaat

SEQ ID NO: 87626 - DNA, 25 bp, Homo sapien
taaagtacattcttagggcacagaa

SEQ ID NO: 87627 - DNA, 25 bp, Homo sapien
taaagtacgttcttagggcacagaa

SEQ ID NO: 87628 - DNA, 25 bp, Homo sapien
taaagtactattccggtattctagc

SEQ ID NO: 87629 - DNA, 25 bp, Homo sapien
taaagtactattcctgtattctagc

SEQ ID NO: 87630 - DNA, 25 bp, Homo sapien
taaagtatatttagctcatttccaa

SEQ ID NO: 87631 - DNA, 25 bp, Homo sapien
taaagtatatttagttcatttccaa

SEQ ID NO: 87632 - DNA, 25 bp, Homo sapien
taaagtatgttgttctagcaccatg

SEQ ID NO: 87633 - DNA, 25 bp, Homo sapien
taaagtatgttgttctggcaccatg

SEQ ID NO: 87634 - DNA, 25 bp, Homo sapien
taaagtattagtctccaaagattag

SEQ ID NO: 87635 - DNA, 25 bp, Homo sapien
taaagtattagtctccgaagattag

SEQ ID NO: 87636 - DNA, 25 bp, Homo sapien
taaagtcacacactcttggattgac

SEQ ID NO: 87637 - DNA, 25 bp, Homo sapien
taaagtcactgggaacagcccttag

SEQ ID NO: 87638 - DNA, 25 bp, Homo sapien
taaagtcagacactcttggattgac

SEQ ID NO: 87639 - DNA, 25 bp, Homo sapien
taaagtcagcttgtgaggtaaaaag

SEQ ID NO: 87640 - DNA, 25 bp, Homo sapien
taaagtcagtttgtgaggtaaaaag

SEQ ID NO: 87641 - DNA, 25 bp, Homo sapien
taaagtcattgggaacagcccttag

SEQ ID NO: 87642 - DNA, 25 bp, Homo sapien
taaagtctacaggcctttaagcctc

SEQ ID NO: 87643 - DNA, 25 bp, Homo sapien
taaagtctacaggcgtttaagcctc

SEQ ID NO: 87644 - DNA, 25 bp, Homo sapien
taaagtctgcataaatgtgggatgc

SEQ ID NO: 87645 - DNA, 25 bp, Homo sapien
taaagtctgcataactgtgggatgc

SEQ ID NO: 87646 - DNA, 25 bp, Homo sapien
taaagtctgtacccagctacctcag

SEQ ID NO: 87647 - DNA, 25 bp, Homo sapien
taaagtctgtactcagctacctcag

SEQ ID NO: 87648 - DNA, 25 bp, Homo sapien
taaagtcttgctaagtgtattttct

SEQ ID NO: 87649 - DNA, 25 bp, Homo sapien
taaagtcttgctaattgtattttct

SEQ ID NO: 87650 - DNA, 25 bp, Homo sapien
taaagtgaaatgatgggtagagtct

SEQ ID NO: 87651 - DNA, 25 bp, Homo sapien
taaagtgaaatgatggttagagtct

SEQ ID NO: 87652 - DNA, 25 bp, Homo sapien
taaagtgacttgtctgcttagcaag

SEQ ID NO: 87653 - DNA, 25 bp, Homo sapien
taaagtgacttgtttgcttagcaag

SEQ ID NO: 87654 - DNA, 25 bp, Homo sapien
taaagtgcatcagtataaaacaaat

SEQ ID NO: 87655 - DNA, 25 bp, Homo sapien
taaagtgcatcattataaaacaaat

SEQ ID NO: 87656 - DNA, 25 bp, Homo sapien
taaagtgcccattaaactgtagtgg

SEQ ID NO: 87657 - DNA, 25 bp, Homo sapien
taaagtgcccattgaactgtagtgg

SEQ ID NO: 87658 - DNA, 25 bp, Homo sapien
taaagtgcctggtgaagctacagtg

SEQ ID NO: 87659 - DNA, 25 bp, Homo sapien
taaagtgcctggtggagctacagtg

SEQ ID NO: 87660 - DNA, 25 bp, Homo sapien
taaagtggcaatgcaccatgcacaa

SEQ ID NO: 87661 - DNA, 25 bp, Homo sapien
taaagtggccatgcaccatgcacaa

SEQ ID NO: 87662 - DNA, 25 bp, Homo sapien
taaagtgtgaattccgatttgagga

SEQ ID NO: 87663 - DNA, 25 bp, Homo sapien
taaagtgtgaattctgatttgagga

SEQ ID NO: 87664 - DNA, 25 bp, Homo sapien
taaagttaatcaatgtctttacttt

SEQ ID NO: 87665 - DNA, 25 bp, Homo sapien
taaagttaatcagtgtctttacttt

SEQ ID NO: 87666 - DNA, 25 bp, Homo sapien
taaagttagaggaaatttcagctcc

SEQ ID NO: 87667 - DNA, 25 bp, Homo sapien
taaagttagaggcaatttcagctcc

SEQ ID NO: 87668 - DNA, 25 bp, Homo sapien
taaagttcaatttaagattccattc

SEQ ID NO: 87669 - DNA, 25 bp, Homo sapien
taaagttcagaaagtttgcagcctg

SEQ ID NO: 87670 - DNA, 25 bp, Homo sapien
taaagttcagatagatcttaccaaa

SEQ ID NO: 87671 - DNA, 25 bp, Homo sapien
taaagttcagattgatcttaccaaa

SEQ ID NO: 87672 - DNA, 25 bp, Homo sapien
taaagttcataaagtttgcagcctg

SEQ ID NO: 87673 - DNA, 25 bp, Homo sapien
taaagttcatgtgttaaaagaagca

SEQ ID NO: 87674 - DNA, 25 bp, Homo sapien
taaagttcatgtgttagaagaagca

SEQ ID NO: 87675 - DNA, 25 bp, Homo sapien
taaagttctatttaagattccattc

SEQ ID NO: 87676 - DNA, 25 bp, Homo sapien
taaagttgatcattttaaacacctt

SEQ ID NO: 87677 - DNA, 25 bp, Homo sapien
taaagttgatcgttttaaacacctt

SEQ ID NO: 87678 - DNA, 25 bp, Homo sapien
taaagttgtatttctgatgttttaa

SEQ ID NO: 87679 - DNA, 25 bp, Homo sapien
taaagttgtatttctgctgttttaa

SEQ ID NO: 87680 - DNA, 25 bp, Homo sapien
taaagttgttgcccctgactcagat

SEQ ID NO: 87681 - DNA, 25 bp, Homo sapien
taaagttgttgcctctgactcagat

SEQ ID NO: 87682 - DNA, 25 bp, Homo sapien
taaagttttgtcggttcaaactaga

SEQ ID NO: 87683 - DNA, 25 bp, Homo sapien
taaagttttgtctgttcaaactaga

SEQ ID NO: 87684 - DNA, 25 bp, Homo sapien
taaataaaacgactgttgaaagaag

SEQ ID NO: 87685 - DNA, 25 bp, Homo sapien
taaataaaacgggtagcagctctaa

SEQ ID NO: 87686 - DNA, 25 bp, Homo sapien
taaataaaacggttagcagctctaa

SEQ ID NO: 87687 - DNA, 25 bp, Homo sapien
taaataaaatgactgttgaaagaag

SEQ ID NO: 87688 - DNA, 25 bp, Homo sapien
taaataaacatggtagattggagta

SEQ ID NO: 87689 - DNA, 25 bp, Homo sapien
taaataaacatggtaggttggagta

SEQ ID NO: 87690 - DNA, 25 bp, Homo sapien
taaataaacgcctatgtactgtggt

SEQ ID NO: 87691 - DNA, 25 bp, Homo sapien
taaataaacgcttggagtgcggagc

SEQ ID NO: 87692 - DNA, 25 bp, Homo sapien
taaataaactaccaaggaccaatac

SEQ ID NO: 87693 - DNA, 25 bp, Homo sapien
taaataaactaccagggaccaatac

SEQ ID NO: 87694 - DNA, 25 bp, Homo sapien
taaataaagaaacaacgtaaaacaa

SEQ ID NO: 87695 - DNA, 25 bp, Homo sapien
taaataaagaaccaacgtaaaacaa

SEQ ID NO: 87696 - DNA, 25 bp, Homo sapien
taaataaagagccgctatgttctaa

SEQ ID NO: 87697 - DNA, 25 bp, Homo sapien
taaataaagagtcgctatgttctaa

SEQ ID NO: 87698 - DNA, 25 bp, Homo sapien
taaataaatgcctatgtactgtggt

SEQ ID NO: 87699 - DNA, 25 bp, Homo sapien
taaataaatgcttggagtgcggagc

SEQ ID NO: 87700 - DNA, 25 bp, Homo sapien
taaataacacgacagaagacaagta

SEQ ID NO: 87701 - DNA, 25 bp, Homo sapien
taaataacacgacagaggacaagta

SEQ ID NO: 87702 - DNA, 25 bp, Homo sapien
taaataagagcctgaaagaatattt

SEQ ID NO: 87703 - DNA, 25 bp, Homo sapien
taaataagagcctgaatgaatattt

SEQ ID NO: 87704 - DNA, 25 bp, Homo sapien
taaatacaacgaacaaatccaaaac

SEQ ID NO: 87705 - DNA, 25 bp, Homo sapien
taaatacaatgaacaaatccaaaac

SEQ ID NO: 87706 - DNA, 25 bp, Homo sapien
taaatacagcaaagtggttcccagg

SEQ ID NO: 87707 - DNA, 25 bp, Homo sapien
taaatacagcagagtggttcccagg

SEQ ID NO: 87708 - DNA, 25 bp, Homo sapien
taaatacattgcctaagacttagtg

SEQ ID NO: 87709 - DNA, 25 bp, Homo sapien
taaatacattgcgtaagacttagtg

SEQ ID NO: 87710 - DNA, 25 bp, Homo sapien
taaataccaagaaacacaattgctg

SEQ ID NO: 87711 - DNA, 25 bp, Homo sapien
taaataccaaggaacacaattgctg

SEQ ID NO: 87712 - DNA, 25 bp, Homo sapien
taaatacccagcataaggcattgtg

SEQ ID NO: 87713 - DNA, 25 bp, Homo sapien
taaataccgagcataaggcattgtg

SEQ ID NO: 87714 - DNA, 25 bp, Homo sapien
taaatacgagtctgtgaaattcaag

SEQ ID NO: 87715 - DNA, 25 bp, Homo sapien
taaatacgagtttgtgaaattcaag

SEQ ID NO: 87716 - DNA, 25 bp, Homo sapien
taaatacgtatgaacgatacagttt

SEQ ID NO: 87717 - DNA, 25 bp, Homo sapien
taaatacgtatgaatgatacagttt

SEQ ID NO: 87718 - DNA, 25 bp, Homo sapien
taaatactagtagacattcataacc

SEQ ID NO: 87719 - DNA, 25 bp, Homo sapien
taaatactagtagtcattcataacc

SEQ ID NO: 87720 - DNA, 25 bp, Homo sapien
taaatagaaaatccgtggacatgag

SEQ ID NO: 87721 - DNA, 25 bp, Homo sapien
taaatagaacaaacagggacaggtt

SEQ ID NO: 87722 - DNA, 25 bp, Homo sapien
taaatagaacaagcagggacaggtt

SEQ ID NO: 87723 - DNA, 25 bp, Homo sapien
taaatagacactaaaaaaaaatttg

SEQ ID NO: 87724 - DNA, 25 bp, Homo sapien
taaatagacactgaaaaaaaatttg

SEQ ID NO: 87725 - DNA, 25 bp, Homo sapien
taaatagactcacacggcaaaagga

SEQ ID NO: 87726 - DNA, 25 bp, Homo sapien
taaatagactcacatggcaaaagga

SEQ ID NO: 87727 - DNA, 25 bp, Homo sapien
taaatagagaatccgtggacatgag

SEQ ID NO: 87728 - DNA, 25 bp, Homo sapien
taaatagagacgttgcaggagaccc

SEQ ID NO: 87729 - DNA, 25 bp, Homo sapien
taaatagaggcgttgcaggagaccc

SEQ ID NO: 87730 - DNA, 25 bp, Homo sapien
taaatagcacacgtatgaagtgtgt

SEQ ID NO: 87731 - DNA, 25 bp, Homo sapien
taaatagcacatgtatgaagtgtgt

SEQ ID NO: 87732 - DNA, 25 bp, Homo sapien
taaataggtctgtatgtaaccacct

SEQ ID NO: 87733 - DNA, 25 bp, Homo sapien
taaataggtctgtgtgtaaccacct

SEQ ID NO: 87734 - DNA, 25 bp, Homo sapien
taaatataacgttgaatttcagtta

SEQ ID NO: 87735 - DNA, 25 bp, Homo sapien
taaatataatgttgaatttcagtta

SEQ ID NO: 87736 - DNA, 25 bp, Homo sapien
taaatatactgacttctctaatgtt

SEQ ID NO: 87737 - DNA, 25 bp, Homo sapien
taaatatattgacttctctaatgtt

SEQ ID NO: 87738 - DNA, 25 bp, Homo sapien
taaatatcactggttctccccttta

SEQ ID NO: 87739 - DNA, 25 bp, Homo sapien
taaatatcacttttactgcatccaa

SEQ ID NO: 87740 - DNA, 25 bp, Homo sapien
taaatatcattggttctccccttta

SEQ ID NO: 87741 - DNA, 25 bp, Homo sapien
taaatatcctgataagttcacagta

SEQ ID NO: 87742 - DNA, 25 bp, Homo sapien
taaatatcctgttaagttcacagta

SEQ ID NO: 87743 - DNA, 25 bp, Homo sapien
taaatatcgcttttactgcatccaa

SEQ ID NO: 87744 - DNA, 25 bp, Homo sapien
taaatatgattgtcacctcctgaat

SEQ ID NO: 87745 - DNA, 25 bp, Homo sapien
taaatatgattgtcgcctcctgaat

SEQ ID NO: 87746 - DNA, 25 bp, Homo sapien
taaatatggatcgttaatacctcaa

SEQ ID NO: 87747 - DNA, 25 bp, Homo sapien
taaatatggatctttaatacctcaa

SEQ ID NO: 87748 - DNA, 25 bp, Homo sapien
taaatatgtcatggagaagtaatat

SEQ ID NO: 87749 - DNA, 25 bp, Homo sapien
taaatatgtgatggagaagtaatat

SEQ ID NO: 87750 - DNA, 25 bp, Homo sapien
taaatatgtgcaccttattgtatgt

SEQ ID NO: 87751 - DNA, 25 bp, Homo sapien
taaatatgtgcgccttattgtatgt

SEQ ID NO: 87752 - DNA, 25 bp, Homo sapien
taaatatgttccggaccccaagaaa

SEQ ID NO: 87753 - DNA, 25 bp, Homo sapien
taaatatgttctggaccccaagaaa

SEQ ID NO: 87754 - DNA, 25 bp, Homo sapien
taaatattgacagaaattcaaaaaa

SEQ ID NO: 87755 - DNA, 25 bp, Homo sapien
taaatattgacagcaattcaaaaaa

SEQ ID NO: 87756 - DNA, 25 bp, Homo sapien
taaatattgcaaactgattttgggc

SEQ ID NO: 87757 - DNA, 25 bp, Homo sapien
taaatattgcaaactggttttgggc

SEQ ID NO: 87758 - DNA, 25 bp, Homo sapien
taaatatttatcaatgtgcaaaaca

SEQ ID NO: 87759 - DNA, 25 bp, Homo sapien
taaatatttatcgatgtgcaaaaca

SEQ ID NO: 87760 - DNA, 25 bp, Homo sapien
taaatatttcacgtaaaccatagac

SEQ ID NO: 87761 - DNA, 25 bp, Homo sapien
taaatatttcatgtaaaccatagac

SEQ ID NO: 87762 - DNA, 25 bp, Homo sapien
taaatcacctctgaattacttgtaa

SEQ ID NO: 87763 - DNA, 25 bp, Homo sapien
taaatcacctctgagttacttgtaa

SEQ ID NO: 87764 - DNA, 25 bp, Homo sapien
taaatcactcatcaattccacaact

SEQ ID NO: 87765 - DNA, 25 bp, Homo sapien
taaatcactcattaattccacaact

SEQ ID NO: 87766 - DNA, 25 bp, Homo sapien
taaatcactcttagtacgcagagtg

SEQ ID NO: 87767 - DNA, 25 bp, Homo sapien
taaatcactgttagtacgcagagtg

SEQ ID NO: 87768 - DNA, 25 bp, Homo sapien
taaatcagtatacaatgggaaatca

SEQ ID NO: 87769 - DNA, 25 bp, Homo sapien
taaatcagtatacagtgggaaatca

SEQ ID NO: 87770 - DNA, 25 bp, Homo sapien
taaatcataccaccttaagtttttc

SEQ ID NO: 87771 - DNA, 25 bp, Homo sapien
taaatcataccatcttaagtttttc

SEQ ID NO: 87772 - DNA, 25 bp, Homo sapien
taaatcatcaagagtaaaatgggag

SEQ ID NO: 87773 - DNA, 25 bp, Homo sapien
taaatcatcgagagtaaaatgggag

SEQ ID NO: 87774 - DNA, 25 bp, Homo sapien
taaatcccactaggttctgatgaat

SEQ ID NO: 87775 - DNA, 25 bp, Homo sapien
taaatcccacttggttctgatgaat

SEQ ID NO: 87776 - DNA, 25 bp, Homo sapien
taaatccgtcttgactcagcttcat

SEQ ID NO: 87777 - DNA, 25 bp, Homo sapien
taaatccgtcttgactgagcttcat

SEQ ID NO: 87778 - DNA, 25 bp, Homo sapien
taaatcctactacggaatggagagc

SEQ ID NO: 87779 - DNA, 25 bp, Homo sapien
taaatcctactatggaatggagagc

SEQ ID NO: 87780 - DNA, 25 bp, Homo sapien
taaatcctagaaataaaggaagcag

SEQ ID NO: 87781 - DNA, 25 bp, Homo sapien
taaatcctagatataaaggaagcag

SEQ ID NO: 87782 - DNA, 25 bp, Homo sapien
taaatcctctcttaaccatcatgag

SEQ ID NO: 87783 - DNA, 25 bp, Homo sapien
taaatcctctcttagccatcatgag

SEQ ID NO: 87784 - DNA, 25 bp, Homo sapien
taaatcctgaatctctatgctggga

SEQ ID NO: 87785 - DNA, 25 bp, Homo sapien
taaatcctgtatctctatgctggga

SEQ ID NO: 87786 - DNA, 25 bp, Homo sapien
taaatcctttttatccagttgttct

SEQ ID NO: 87787 - DNA, 25 bp, Homo sapien
taaatcctttttatccggttgttct

SEQ ID NO: 87788 - DNA, 25 bp, Homo sapien
taaatctaagctaatgctatctcgc

SEQ ID NO: 87789 - DNA, 25 bp, Homo sapien
taaatctaagctagtgctatctcgc

SEQ ID NO: 87790 - DNA, 25 bp, Homo sapien
taaatctccagcttgccagcttact

SEQ ID NO: 87791 - DNA, 25 bp, Homo sapien
taaatctccagtttgccagcttact

SEQ ID NO: 87792 - DNA, 25 bp, Homo sapien
taaatctccgcactgaataggactc

SEQ ID NO: 87793 - DNA, 25 bp, Homo sapien
taaatctccgcattgaataggactc

SEQ ID NO: 87794 - DNA, 25 bp, Homo sapien
taaatctgaacttacgactacatgg

SEQ ID NO: 87795 - DNA, 25 bp, Homo sapien
taaatctgaacttatgactacatgg

SEQ ID NO: 87796 - DNA, 25 bp, Homo sapien
taaatctgagtcactgattgatgta

SEQ ID NO: 87797 - DNA, 25 bp, Homo sapien
taaatctgagtcagtgattgatgta

SEQ ID NO: 87798 - DNA, 25 bp, Homo sapien
taaatctgcccagttgctcagccag

SEQ ID NO: 87799 - DNA, 25 bp, Homo sapien
taaatctgcccagttgttcagccag

SEQ ID NO: 87800 - DNA, 25 bp, Homo sapien
taaatctgctggcgggattaaagta

SEQ ID NO: 87801 - DNA, 25 bp, Homo sapien
taaatctgctggtgggattaaagta

SEQ ID NO: 87802 - DNA, 25 bp, Homo sapien
taaatcttcagacacaaaagtgcaa

SEQ ID NO: 87803 - DNA, 25 bp, Homo sapien
taaatcttcagacacagaagtgcaa

SEQ ID NO: 87804 - DNA, 25 bp, Homo sapien
taaatcttttttcggacaaagggta

SEQ ID NO: 87805 - DNA, 25 bp, Homo sapien
taaatctttttttggacaaagggta

SEQ ID NO: 87806 - DNA, 25 bp, Homo sapien
taaatgaaaccttctagctgtttct

SEQ ID NO: 87807 - DNA, 25 bp, Homo sapien
taaatgaaatcttctagctgtttct

SEQ ID NO: 87808 - DNA, 25 bp, Homo sapien
taaatgaccagcaataaagtccacc

SEQ ID NO: 87809 - DNA, 25 bp, Homo sapien
taaatgaccggcaataaagtccacc

SEQ ID NO: 87810 - DNA, 25 bp, Homo sapien
taaatgaggatctgattccaaaaca

SEQ ID NO: 87811 - DNA, 25 bp, Homo sapien
taaatgagtatctgattccaaaaca

SEQ ID NO: 87812 - DNA, 25 bp, Homo sapien
taaatgagtttcagaagagttgtta

SEQ ID NO: 87813 - DNA, 25 bp, Homo sapien
taaatgagtttcggaagagttgtta

SEQ ID NO: 87814 - DNA, 25 bp, Homo sapien
taaatgatatataggatttgcttca

SEQ ID NO: 87815 - DNA, 25 bp, Homo sapien
taaatgatcaataacagtgtcaatt

SEQ ID NO: 87816 - DNA, 25 bp, Homo sapien
taaatgatccctaaggagaacagat

SEQ ID NO: 87817 - DNA, 25 bp, Homo sapien
taaatgatgtataggatttgcttca

SEQ ID NO: 87818 - DNA, 25 bp, Homo sapien
taaatgattaataacagtgtcaatt

SEQ ID NO: 87819 - DNA, 25 bp, Homo sapien
taaatgattcctaaggagaacagat

SEQ ID NO: 87820 - DNA, 25 bp, Homo sapien
taaatgcaacaaacattcacataga

SEQ ID NO: 87821 - DNA, 25 bp, Homo sapien
taaatgcaacaaacgttcacataga

SEQ ID NO: 87822 - DNA, 25 bp, Homo sapien
taaatgcaattccagctgaaatggg

SEQ ID NO: 87823 - DNA, 25 bp, Homo sapien
taaatgcaattctagctgaaatggg

SEQ ID NO: 87824 - DNA, 25 bp, Homo sapien
taaatgcagcgagaagaatgagtag

SEQ ID NO: 87825 - DNA, 25 bp, Homo sapien
taaatgcagtgagaagaatgagtag

SEQ ID NO: 87826 - DNA, 25 bp, Homo sapien
taaatgcagttgtaacaaatgacat

SEQ ID NO: 87827 - DNA, 25 bp, Homo sapien
taaatgcagttgtaacgaatgacat

SEQ ID NO: 87828 - DNA, 25 bp, Homo sapien
taaatgccacaacaagaatgattag

SEQ ID NO: 87829 - DNA, 25 bp, Homo sapien
taaatgccacaataagaatgattag

SEQ ID NO: 87830 - DNA, 25 bp, Homo sapien
taaatgcccacagaagacagcagga

SEQ ID NO: 87831 - DNA, 25 bp, Homo sapien
taaatgcccacggaagacagcagga

SEQ ID NO: 87832 - DNA, 25 bp, Homo sapien
taaatgcctcctaaggatttagctg

SEQ ID NO: 87833 - DNA, 25 bp, Homo sapien
taaatgcctcctaatgatttagctg

SEQ ID NO: 87834 - DNA, 25 bp, Homo sapien
taaatgccttgcctttcaatctttc

SEQ ID NO: 87835 - DNA, 25 bp, Homo sapien
taaatgccttgcttttcaatctttc

SEQ ID NO: 87836 - DNA, 25 bp, Homo sapien
taaatgctaaaatgatgtgtaaaat

SEQ ID NO: 87837 - DNA, 25 bp, Homo sapien
taaatgctaaagtgatgtgtaaaat

SEQ ID NO: 87838 - DNA, 25 bp, Homo sapien
taaatgctacttaactggtagttac

SEQ ID NO: 87839 - DNA, 25 bp, Homo sapien
taaatgctagtggcgttcagtggtt

SEQ ID NO: 87840 - DNA, 25 bp, Homo sapien
taaatgctagtggctttcagtggtt

SEQ ID NO: 87841 - DNA, 25 bp, Homo sapien
taaatgcttcttaactggtagttac

SEQ ID NO: 87842 - DNA, 25 bp, Homo sapien
taaatggacgcatgcagttgaaacc

SEQ ID NO: 87843 - DNA, 25 bp, Homo sapien
taaatggatgcatgcagttgaaacc

SEQ ID NO: 87844 - DNA, 25 bp, Homo sapien
taaatggcaaatactgcgtttcatc

SEQ ID NO: 87845 - DNA, 25 bp, Homo sapien
taaatggcaaatactgtgtttcatc

SEQ ID NO: 87846 - DNA, 25 bp, Homo sapien
taaatgggcctatggtattttattt

SEQ ID NO: 87847 - DNA, 25 bp, Homo sapien
taaatgggtctatggtattttattt

SEQ ID NO: 87848 - DNA, 25 bp, Homo sapien
taaatggtgtcacctgctctcaagt

SEQ ID NO: 87849 - DNA, 25 bp, Homo sapien
taaatggtgtcacttgctctcaagt

SEQ ID NO: 87850 - DNA, 25 bp, Homo sapien
taaatggtgttggacttacataaga

SEQ ID NO: 87851 - DNA, 25 bp, Homo sapien
taaatggtgttggatttacataaga

SEQ ID NO: 87852 - DNA, 25 bp, Homo sapien
taaatggttagaaagggaataaact

SEQ ID NO: 87853 - DNA, 25 bp, Homo sapien
taaatggttagaaatggaataaact

SEQ ID NO: 87854 - DNA, 25 bp, Homo sapien
taaatgtcaggcccattatttattg

SEQ ID NO: 87855 - DNA, 25 bp, Homo sapien
taaatgtcaggtccattatttattg

SEQ ID NO: 87856 - DNA, 25 bp, Homo sapien
taaatgtcagttactatcattaaca

SEQ ID NO: 87857 - DNA, 25 bp, Homo sapien
taaatgtcagttattatcattaaca

SEQ ID NO: 87858 - DNA, 25 bp, Homo sapien
taaatgtccagtaccaggtttgctt

SEQ ID NO: 87859 - DNA, 25 bp, Homo sapien
taaatgtccggtaccaggtttgctt

SEQ ID NO: 87860 - DNA, 25 bp, Homo sapien
taaatgtcctcatgagatcaaagta

SEQ ID NO: 87861 - DNA, 25 bp, Homo sapien
taaatgtcctcatgagttcaaagta

SEQ ID NO: 87862 - DNA, 25 bp, Homo sapien
taaatgtgcaaaagagacaggtgca

SEQ ID NO: 87863 - DNA, 25 bp, Homo sapien
taaatgtgcgaaagagacaggtgca

SEQ ID NO: 87864 - DNA, 25 bp, Homo sapien
taaatgtgctacttggaatttgcta

SEQ ID NO: 87865 - DNA, 25 bp, Homo sapien
taaatgtgttacttggaatttgcta

SEQ ID NO: 87866 - DNA, 25 bp, Homo sapien
taaatgtgttatctgaacaagcaaa

SEQ ID NO: 87867 - DNA, 25 bp, Homo sapien
taaatgtgttatctgagcaagcaaa

SEQ ID NO: 87868 - DNA, 25 bp, Homo sapien
taaatgttgaatccagaagtagcag

SEQ ID NO: 87869 - DNA, 25 bp, Homo sapien
taaatgttgaattcagaagtagcag

SEQ ID NO: 87870 - DNA, 25 bp, Homo sapien
taaattaaagacaacacggtaccag

SEQ ID NO: 87871 - DNA, 25 bp, Homo sapien
taaattaaagataacacggtaccag

SEQ ID NO: 87872 - DNA, 25 bp, Homo sapien
taaattagtaaatagaaaatccgtg

SEQ ID NO: 87873 - DNA, 25 bp, Homo sapien
taaattagtaaatagagaatccgtg

SEQ ID NO: 87874 - DNA, 25 bp, Homo sapien
taaattatagtggaccatcaactta

SEQ ID NO: 87875 - DNA, 25 bp, Homo sapien
taaattatagtggaccgtcaactta

SEQ ID NO: 87876 - DNA, 25 bp, Homo sapien
taaattatctgtttatatcatccag

SEQ ID NO: 87877 - DNA, 25 bp, Homo sapien
taaattattctgcatcttgcattcc

SEQ ID NO: 87878 - DNA, 25 bp, Homo sapien
taaattattctgtatcttgcattcc

SEQ ID NO: 87879 - DNA, 25 bp, Homo sapien
taaattattgttttcattagcttta

SEQ ID NO: 87880 - DNA, 25 bp, Homo sapien
taaattatttgtttatatcatccag

SEQ ID NO: 87881 - DNA, 25 bp, Homo sapien
taaattatttttttcattagcttta

SEQ ID NO: 87882 - DNA, 25 bp, Homo sapien
taaattcaaaaagaagcagtagatg

SEQ ID NO: 87883 - DNA, 25 bp, Homo sapien
taaattcaaaaagaagtagtagatg

SEQ ID NO: 87884 - DNA, 25 bp, Homo sapien
taaattcaaaactgtgcaaaatcta

SEQ ID NO: 87885 - DNA, 25 bp, Homo sapien
taaattcaaaagtgtgcaaaatcta

SEQ ID NO: 87886 - DNA, 25 bp, Homo sapien
taaattcacctgttcttagaagggt

SEQ ID NO: 87887 - DNA, 25 bp, Homo sapien
taaattcacggctatggtaaaaggg

SEQ ID NO: 87888 - DNA, 25 bp, Homo sapien
taaattcacttgttcttagaagggt

SEQ ID NO: 87889 - DNA, 25 bp, Homo sapien
taaattcagtcagagcggaaaaaac

SEQ ID NO: 87890 - DNA, 25 bp, Homo sapien
taaattcagtcggagcggaaaaaac

SEQ ID NO: 87891 - DNA, 25 bp, Homo sapien
taaattcatggctatggtaaaaggg

SEQ ID NO: 87892 - DNA, 25 bp, Homo sapien
taaattcctgcataacaagtaccaa

SEQ ID NO: 87893 - DNA, 25 bp, Homo sapien
taaattcctgccagctgtgagcctg

SEQ ID NO: 87894 - DNA, 25 bp, Homo sapien
taaattcctgcgagctgtgagcctg

SEQ ID NO: 87895 - DNA, 25 bp, Homo sapien
taaattcctgcgtaacaagtaccaa

SEQ ID NO: 87896 - DNA, 25 bp, Homo sapien
taaattctgacaggccttgtgttgt

SEQ ID NO: 87897 - DNA, 25 bp, Homo sapien
taaattctgacaggtcttgtgttgt

SEQ ID NO: 87898 - DNA, 25 bp, Homo sapien
taaattgatatgcagatgaattatc

SEQ ID NO: 87899 - DNA, 25 bp, Homo sapien
taaattgatatgcggatgaattatc

SEQ ID NO: 87900 - DNA, 25 bp, Homo sapien
taaattgcatgttcttggaggaggg

SEQ ID NO: 87901 - DNA, 25 bp, Homo sapien
taaattgcttgttcttggaggaggg

SEQ ID NO: 87902 - DNA, 25 bp, Homo sapien
taaattggcagtgtgtatggcacat

SEQ ID NO: 87903 - DNA, 25 bp, Homo sapien
taaattggccattccaccttaccta

SEQ ID NO: 87904 - DNA, 25 bp, Homo sapien
taaattggtagtgtgtatggcacat

SEQ ID NO: 87905 - DNA, 25 bp, Homo sapien
taaattggtcattccaccttaccta

SEQ ID NO: 87906 - DNA, 25 bp, Homo sapien
taaattgtcgtaatctgagtgagtg

SEQ ID NO: 87907 - DNA, 25 bp, Homo sapien
taaattgttgtaatctgagtgagtg

SEQ ID NO: 87908 - DNA, 25 bp, Homo sapien
taaattgttgtgagaccaccaaatt

SEQ ID NO: 87909 - DNA, 25 bp, Homo sapien
taaattgtttgccaagcgagacaga

SEQ ID NO: 87910 - DNA, 25 bp, Homo sapien
taaattgtttgccaagtgagacaga

SEQ ID NO: 87911 - DNA, 25 bp, Homo sapien
taaattgttttgagaccaccaaatt

SEQ ID NO: 87912 - DNA, 25 bp, Homo sapien
taaatttaccctgcatcattttgca

SEQ ID NO: 87913 - DNA, 25 bp, Homo sapien
taaatttaccctgcgtcattttgca

SEQ ID NO: 87914 - DNA, 25 bp, Homo sapien
taaatttactagatccatctaattc

SEQ ID NO: 87915 - DNA, 25 bp, Homo sapien
taaatttactagattcatctaattc

SEQ ID NO: 87916 - DNA, 25 bp, Homo sapien
taaatttcaggccttgtggcactct

SEQ ID NO: 87917 - DNA, 25 bp, Homo sapien
taaatttcctatcatttacacctac

SEQ ID NO: 87918 - DNA, 25 bp, Homo sapien
taaatttcctggagccacctctggg

SEQ ID NO: 87919 - DNA, 25 bp, Homo sapien
taaatttcctggaggcacctctggg

SEQ ID NO: 87920 - DNA, 25 bp, Homo sapien
taaatttcgggccttgtggcactct

SEQ ID NO: 87921 - DNA, 25 bp, Homo sapien
taaatttctcagcccagaactgaca

SEQ ID NO: 87922 - DNA, 25 bp, Homo sapien
taaatttctcagtccagaactgaca

SEQ ID NO: 87923 - DNA, 25 bp, Homo sapien
taaatttcttatcatttacacctac

SEQ ID NO: 87924 - DNA, 25 bp, Homo sapien
taaatttgattgttcctggactcaa

SEQ ID NO: 87925 - DNA, 25 bp, Homo sapien
taaatttgccatcaggtagttcatt

SEQ ID NO: 87926 - DNA, 25 bp, Homo sapien
taaatttgccattaggtagttcatt

SEQ ID NO: 87927 - DNA, 25 bp, Homo sapien
taaatttgcttcgcgtttggagagt

SEQ ID NO: 87928 - DNA, 25 bp, Homo sapien
taaatttgctttgcgtttggagagt

SEQ ID NO: 87929 - DNA, 25 bp, Homo sapien
taaatttggcggacataggcaaaat

SEQ ID NO: 87930 - DNA, 25 bp, Homo sapien
taaatttggtggacataggcaaaat

SEQ ID NO: 87931 - DNA, 25 bp, Homo sapien
taaatttgttctcaccacaggcatc

SEQ ID NO: 87932 - DNA, 25 bp, Homo sapien
taaatttgttctgaccacaggcatc

SEQ ID NO: 87933 - DNA, 25 bp, Homo sapien
taaatttgtttgttcctggactcaa

SEQ ID NO: 87934 - DNA, 25 bp, Homo sapien
taaattttgtatatggtaaaccttt

SEQ ID NO: 87935 - DNA, 25 bp, Homo sapien
taaattttgtatgtggtaaaccttt

SEQ ID NO: 87936 - DNA, 25 bp, Homo sapien
taacaaaaattgtaaaatgcaaggg

SEQ ID NO: 87937 - DNA, 25 bp, Homo sapien
taacaaaaattgtagaatgcaaggg

SEQ ID NO: 87938 - DNA, 25 bp, Homo sapien
taacaaaacaaacatatcttctacc

SEQ ID NO: 87939 - DNA, 25 bp, Homo sapien
taacaaaacaaatgtaggattagaa

SEQ ID NO: 87940 - DNA, 25 bp, Homo sapien
taacaaaacacacatgactttagga

SEQ ID NO: 87941 - DNA, 25 bp, Homo sapien
taacaaaactcatacaagctctgtc

SEQ ID NO: 87942 - DNA, 25 bp, Homo sapien
taacaaaactgaagggttaggaagc

SEQ ID NO: 87943 - DNA, 25 bp, Homo sapien
taacaaaagaaacatatcttctacc

SEQ ID NO: 87944 - DNA, 25 bp, Homo sapien
taacaaaataaatgtaggattagaa

SEQ ID NO: 87945 - DNA, 25 bp, Homo sapien
taacaaaatacacatgactttagga

SEQ ID NO: 87946 - DNA, 25 bp, Homo sapien
taacaaaatcaaaacgttgaaattt

SEQ ID NO: 87947 - DNA, 25 bp, Homo sapien
taacaaaatcaagacgttgaaattt

SEQ ID NO: 87948 - DNA, 25 bp, Homo sapien
taacaaaattcatacaagctctgtc

SEQ ID NO: 87949 - DNA, 25 bp, Homo sapien
taacaaaattgaagggttaggaagc

SEQ ID NO: 87950 - DNA, 25 bp, Homo sapien
taacaaacagcctaaactctttcac

SEQ ID NO: 87951 - DNA, 25 bp, Homo sapien
taacaaacagcgtaaactctttcac

SEQ ID NO: 87952 - DNA, 25 bp, Homo sapien
taacaaacatgaataaaacctagta

SEQ ID NO: 87953 - DNA, 25 bp, Homo sapien
taacaaacatgaatgaaacctagta

SEQ ID NO: 87954 - DNA, 25 bp, Homo sapien
taacaaacctcaaattttcaaagtt

SEQ ID NO: 87955 - DNA, 25 bp, Homo sapien
taacaaacctcatattttcaaagtt

SEQ ID NO: 87956 - DNA, 25 bp, Homo sapien
taacaaatgaccggggaccaaccac

SEQ ID NO: 87957 - DNA, 25 bp, Homo sapien
taacaaatgaccggtgaccaaccac

SEQ ID NO: 87958 - DNA, 25 bp, Homo sapien
taacaaatgatactttaacagcaac

SEQ ID NO: 87959 - DNA, 25 bp, Homo sapien
taacaaattatactttaacagcaac

SEQ ID NO: 87960 - DNA, 25 bp, Homo sapien
taacaaattccatgattgtcagtta

SEQ ID NO: 87961 - DNA, 25 bp, Homo sapien
taacaaattccgtgattgtcagtta

SEQ ID NO: 87962 - DNA, 25 bp, Homo sapien
taacaagagttaagtgtctctgacc

SEQ ID NO: 87963 - DNA, 25 bp, Homo sapien
taacaagagttatgtgtctctgacc

SEQ ID NO: 87964 - DNA, 25 bp, Homo sapien
taacaagcctgcacatatacctctt

SEQ ID NO: 87965 - DNA, 25 bp, Homo sapien
taacaagcctgcacgtatacctctt

SEQ ID NO: 87966 - DNA, 25 bp, Homo sapien
taacaagggtcataaaaaagattca

SEQ ID NO: 87967 - DNA, 25 bp, Homo sapien
taacaagggtcataaacaagattca

SEQ ID NO: 87968 - DNA, 25 bp, Homo sapien
taacaaggtcttcaacattttaacc

SEQ ID NO: 87969 - DNA, 25 bp, Homo sapien
taacaaggtcttcagcattttaacc

SEQ ID NO: 87970 - DNA, 25 bp, Homo sapien
taacaataaatgtgctacttggaat

SEQ ID NO: 87971 - DNA, 25 bp, Homo sapien
taacaataaatgtgttacttggaat

SEQ ID NO: 87972 - DNA, 25 bp, Homo sapien
taacaatacatacgaaatttttgga

SEQ ID NO: 87973 - DNA, 25 bp, Homo sapien
taacaatacatatgaaatttttgga

SEQ ID NO: 87974 - DNA, 25 bp, Homo sapien
taacaatacctaacagcttatctgt

SEQ ID NO: 87975 - DNA, 25 bp, Homo sapien
taacaatacctaatagcttatctgt

SEQ ID NO: 87976 - DNA, 25 bp, Homo sapien
taacaattcagttagaacagagtgc

SEQ ID NO: 87977 - DNA, 25 bp, Homo sapien
taacaattcagttagaccagagtgc

SEQ ID NO: 87978 - DNA, 25 bp, Homo sapien
taacaatttcaattatgcaagtgct

SEQ ID NO: 87979 - DNA, 25 bp, Homo sapien
taacaatttcacttatgcaagtgct

SEQ ID NO: 87980 - DNA, 25 bp, Homo sapien
taacacaaagcaagatgtgataagt

SEQ ID NO: 87981 - DNA, 25 bp, Homo sapien
taacacaaagcaggatgtgataagt

SEQ ID NO: 87982 - DNA, 25 bp, Homo sapien
taacacaaatagacctcaggaggaa

SEQ ID NO: 87983 - DNA, 25 bp, Homo sapien
taacacaaatagccctcaggaggaa

SEQ ID NO: 87984 - DNA, 25 bp, Homo sapien
taacacaactatgtaatataatcac

SEQ ID NO: 87985 - DNA, 25 bp, Homo sapien
taacacaactgtagggtctgaagac

SEQ ID NO: 87986 - DNA, 25 bp, Homo sapien
taacacaactgtggggtctgaagac

SEQ ID NO: 87987 - DNA, 25 bp, Homo sapien
taacacaattatgtaatataatcac

SEQ ID NO: 87988 - DNA, 25 bp, Homo sapien
taacacaccacataccaggatgttt

SEQ ID NO: 87989 - DNA, 25 bp, Homo sapien
taacacaccacataccgggatgttt

SEQ ID NO: 87990 - DNA, 25 bp, Homo sapien
taacacaggtcattaaaggtctgca

SEQ ID NO: 87991 - DNA, 25 bp, Homo sapien
taacacaggtcgttaaaggtctgca

SEQ ID NO: 87992 - DNA, 25 bp, Homo sapien
taacacatagaatagttttctcaga

SEQ ID NO: 87993 - DNA, 25 bp, Homo sapien
taacacatagaatatttttctcaga

SEQ ID NO: 87994 - DNA, 25 bp, Homo sapien
taacacatgttttatgagcatatgc

SEQ ID NO: 87995 - DNA, 25 bp, Homo sapien
taacacatgttttgtgagcatatgc

SEQ ID NO: 87996 - DNA, 25 bp, Homo sapien
taacacgacagaagacaagtatgaa

SEQ ID NO: 87997 - DNA, 25 bp, Homo sapien
taacacgacagaggacaagtatgaa

SEQ ID NO: 87998 - DNA, 25 bp, Homo sapien
taacacgctaacaacgtaaacggct

SEQ ID NO: 87999 - DNA, 25 bp, Homo sapien
taacacgctaacaatgtaaacggct

SEQ ID NO: 88000 - DNA, 25 bp, Homo sapien
taacactagtatttaagacactatt

SEQ ID NO: 88001 - DNA, 25 bp, Homo sapien
taacactagtatttcagacactatt

SEQ ID NO: 88002 - DNA, 25 bp, Homo sapien
taacactcaccatagctcagaatgt

SEQ ID NO: 88003 - DNA, 25 bp, Homo sapien
taacactcatcatagctcagaatgt

SEQ ID NO: 88004 - DNA, 25 bp, Homo sapien
taacactcatttttaaaaaagcaca

SEQ ID NO: 88005 - DNA, 25 bp, Homo sapien
taacactcattttttaaaaagcaca

SEQ ID NO: 88006 - DNA, 25 bp, Homo sapien
taacactcctaacacggcaagaaag

SEQ ID NO: 88007 - DNA, 25 bp, Homo sapien
taacactcctaacatggcaagaaag

SEQ ID NO: 88008 - DNA, 25 bp, Homo sapien
taacactcttgtgcagtaagcgttc

SEQ ID NO: 88009 - DNA, 25 bp, Homo sapien
taacactcttgttcagtaagcgttc

SEQ ID NO: 88010 - DNA, 25 bp, Homo sapien
taacactgcataattgacctgattc

SEQ ID NO: 88011 - DNA, 25 bp, Homo sapien
taacactgcatagttgacctgattc

SEQ ID NO: 88012 - DNA, 25 bp, Homo sapien
taacactgtggcaaaataggtggtg

SEQ ID NO: 88013 - DNA, 25 bp, Homo sapien
taacactgtggcgaaataggtggtg

SEQ ID NO: 88014 - DNA, 25 bp, Homo sapien
taacacttaccatttatcatttttg

SEQ ID NO: 88015 - DNA, 25 bp, Homo sapien
taacacttaccgtttatcatttttg

SEQ ID NO: 88016 - DNA, 25 bp, Homo sapien
taacagacactgaggattgttccct

SEQ ID NO: 88017 - DNA, 25 bp, Homo sapien
taacagacactgagtattgttccct

SEQ ID NO: 88018 - DNA, 25 bp, Homo sapien
taacagagtcctaactgagctggtt

SEQ ID NO: 88019 - DNA, 25 bp, Homo sapien
taacagagttctaactgagctggtt

SEQ ID NO: 88020 - DNA, 25 bp, Homo sapien
taacagatcgaatgggagttcttac

SEQ ID NO: 88021 - DNA, 25 bp, Homo sapien
taacagattgaatgggagttcttac

SEQ ID NO: 88022 - DNA, 25 bp, Homo sapien
taacagattgagacagaaagagaga

SEQ ID NO: 88023 - DNA, 25 bp, Homo sapien
taacagattgagacagtaagagaga

SEQ ID NO: 88024 - DNA, 25 bp, Homo sapien
taacagcaaagaacaatgtctccaa

SEQ ID NO: 88025 - DNA, 25 bp, Homo sapien
taacagcaaagagcaatgtctccaa

SEQ ID NO: 88026 - DNA, 25 bp, Homo sapien
taacagcagagaagatatttttgtt

SEQ ID NO: 88027 - DNA, 25 bp, Homo sapien
taacagcagaggagatatttttgtt

SEQ ID NO: 88028 - DNA, 25 bp, Homo sapien
taacaggcagtagcagtcctgaaga

SEQ ID NO: 88029 - DNA, 25 bp, Homo sapien
taacaggcagtagcggtcctgaaga

SEQ ID NO: 88030 - DNA, 25 bp, Homo sapien
taacaggctaatgcttacttgtggt

SEQ ID NO: 88031 - DNA, 25 bp, Homo sapien
taacaggctaattcttacttgtggt

SEQ ID NO: 88032 - DNA, 25 bp, Homo sapien
taacagggctcatttggttgcaaag

SEQ ID NO: 88033 - DNA, 25 bp, Homo sapien
taacagggtggccgagaggaagaaa

SEQ ID NO: 88034 - DNA, 25 bp, Homo sapien
taacagggtggcggagaggaagaaa

SEQ ID NO: 88035 - DNA, 25 bp, Homo sapien
taacagggttcatttggttgcaaag

SEQ ID NO: 88036 - DNA, 25 bp, Homo sapien
taacaggttttggtagtttgttcct

SEQ ID NO: 88037 - DNA, 25 bp, Homo sapien
taacaggttttggtcgtttgttcct

SEQ ID NO: 88038 - DNA, 25 bp, Homo sapien
taacagtattaacaatttttccata

SEQ ID NO: 88039 - DNA, 25 bp, Homo sapien
taacagtattaacagtttttccata

SEQ ID NO: 88040 - DNA, 25 bp, Homo sapien
taacagtgtttcaataaacatagga

SEQ ID NO: 88041 - DNA, 25 bp, Homo sapien
taacagtgtttcgataaacatagga

SEQ ID NO: 88042 - DNA, 25 bp, Homo sapien
taacataatcaatttagatgcagac

SEQ ID NO: 88043 - DNA, 25 bp, Homo sapien
taacataatcagtttagatgcagac

SEQ ID NO: 88044 - DNA, 25 bp, Homo sapien
taacatatttgaagaagaagccctt

SEQ ID NO: 88045 - DNA, 25 bp, Homo sapien
taacatatttgaggaagaagccctt

SEQ ID NO: 88046 - DNA, 25 bp, Homo sapien
taacatcaaacactaggagaatcac

SEQ ID NO: 88047 - DNA, 25 bp, Homo sapien
taacatcaaacgctaggagaatcac

SEQ ID NO: 88048 - DNA, 25 bp, Homo sapien
taacatcaattgactttccactgta

SEQ ID NO: 88049 - DNA, 25 bp, Homo sapien
taacatcacagagaattttaaaaca

SEQ ID NO: 88050 - DNA, 25 bp, Homo sapien
taacatcacagataattttaaaaca

SEQ ID NO: 88051 - DNA, 25 bp, Homo sapien
taacatcagttgactttccactgta

SEQ ID NO: 88052 - DNA, 25 bp, Homo sapien
taacatcccttgctttcagttgtcc

SEQ ID NO: 88053 - DNA, 25 bp, Homo sapien
taacatccctttctttcagttgtcc

SEQ ID NO: 88054 - DNA, 25 bp, Homo sapien
taacatctactcaaccttctaatca

SEQ ID NO: 88055 - DNA, 25 bp, Homo sapien
taacatctactcaatcttctaatca

SEQ ID NO: 88056 - DNA, 25 bp, Homo sapien
taacatgcagattcgttttcaccct

SEQ ID NO: 88057 - DNA, 25 bp, Homo sapien
taacatgcagatttgttttcaccct

SEQ ID NO: 88058 - DNA, 25 bp, Homo sapien
taacatgccgtccatagcagaattg

SEQ ID NO: 88059 - DNA, 25 bp, Homo sapien
taacatgctgtccatagcagaattg

SEQ ID NO: 88060 - DNA, 25 bp, Homo sapien
taacatggccataattctctcccca

SEQ ID NO: 88061 - DNA, 25 bp, Homo sapien
taacatggctataattctctcccca

SEQ ID NO: 88062 - DNA, 25 bp, Homo sapien
taacatgttacatacaccatgagaa

SEQ ID NO: 88063 - DNA, 25 bp, Homo sapien
taacatgttacatagaccatgagaa

SEQ ID NO: 88064 - DNA, 25 bp, Homo sapien
taacatgttatacacccttttcatg

SEQ ID NO: 88065 - DNA, 25 bp, Homo sapien
taacatgttatatacccttttcatg

SEQ ID NO: 88066 - DNA, 25 bp, Homo sapien
taacattcactgactctacactata

SEQ ID NO: 88067 - DNA, 25 bp, Homo sapien
taacattcactggctctacactata

SEQ ID NO: 88068 - DNA, 25 bp, Homo sapien
taacattccaaacatgaatcagttc

SEQ ID NO: 88069 - DNA, 25 bp, Homo sapien
taacattccaccatagttcagacta

SEQ ID NO: 88070 - DNA, 25 bp, Homo sapien
taacattccaccgtagttcagacta

SEQ ID NO: 88071 - DNA, 25 bp, Homo sapien
taacattccttattatacaagagag

SEQ ID NO: 88072 - DNA, 25 bp, Homo sapien
taacattccttattctacaagagag

SEQ ID NO: 88073 - DNA, 25 bp, Homo sapien
taacattctaaacatgaatcagttc

SEQ ID NO: 88074 - DNA, 25 bp, Homo sapien
taacatttatttagccgtcactata

SEQ ID NO: 88075 - DNA, 25 bp, Homo sapien
taacatttatttagccttcactata

SEQ ID NO: 88076 - DNA, 25 bp, Homo sapien
taacatttcagaagatctcgtttaa

SEQ ID NO: 88077 - DNA, 25 bp, Homo sapien
taacatttcagaaggtctcgtttaa

SEQ ID NO: 88078 - DNA, 25 bp, Homo sapien
taaccaaaaacaggtatgaacacgt

SEQ ID NO: 88079 - DNA, 25 bp, Homo sapien
taaccaaaaccaggtatgaacacgt

SEQ ID NO: 88080 - DNA, 25 bp, Homo sapien
taaccaaatacatctccagacactg

SEQ ID NO: 88081 - DNA, 25 bp, Homo sapien
taaccaaatacgtctccagacactg

SEQ ID NO: 88082 - DNA, 25 bp, Homo sapien
taaccaaatccaacagttcattaaa

SEQ ID NO: 88083 - DNA, 25 bp, Homo sapien
taaccaaatccaagagttcattaaa

SEQ ID NO: 88084 - DNA, 25 bp, Homo sapien
taaccaagctgaccatcaaggatct

SEQ ID NO: 88085 - DNA, 25 bp, Homo sapien
taaccaagctgaccatgaaggatct

SEQ ID NO: 88086 - DNA, 25 bp, Homo sapien
taaccaatgtatttccagtgcagtg

SEQ ID NO: 88087 - DNA, 25 bp, Homo sapien
taaccaatgtatttccggtgcagtg

SEQ ID NO: 88088 - DNA, 25 bp, Homo sapien
taaccacatctcctagaattgacac

SEQ ID NO: 88089 - DNA, 25 bp, Homo sapien
taaccacatctgctagaattgacac

SEQ ID NO: 88090 - DNA, 25 bp, Homo sapien
taaccaccagaaaaataaattgatg

SEQ ID NO: 88091 - DNA, 25 bp, Homo sapien
taaccaccagacaaataaattgatg

SEQ ID NO: 88092 - DNA, 25 bp, Homo sapien
taaccaccatcatgcaaacatgcaa

SEQ ID NO: 88093 - DNA, 25 bp, Homo sapien
taaccaccatcgtgcaaacatgcaa

SEQ ID NO: 88094 - DNA, 25 bp, Homo sapien
taaccagtcgtcaactctacaccta

SEQ ID NO: 88095 - DNA, 25 bp, Homo sapien
taaccagtgacccttctaagcattc

SEQ ID NO: 88096 - DNA, 25 bp, Homo sapien
taaccagtggcccttctaagcattc

SEQ ID NO: 88097 - DNA, 25 bp, Homo sapien
taaccagttgtcaactctacaccta

SEQ ID NO: 88098 - DNA, 25 bp, Homo sapien
taaccataataggctcattggtcaa

SEQ ID NO: 88099 - DNA, 25 bp, Homo sapien
taaccataatagtctcattggtcaa

SEQ ID NO: 88100 - DNA, 25 bp, Homo sapien
taaccatgatgcagatcccctgaat

SEQ ID NO: 88101 - DNA, 25 bp, Homo sapien
taaccatgatgctgatcccctgaat

SEQ ID NO: 88102 - DNA, 25 bp, Homo sapien
taaccatggatttcattcccactgc

SEQ ID NO: 88103 - DNA, 25 bp, Homo sapien
taaccatggattttattcccactgc

SEQ ID NO: 88104 - DNA, 25 bp, Homo sapien
taaccatggctgcttttaaggcatt

SEQ ID NO: 88105 - DNA, 25 bp, Homo sapien
taaccatggctgtttttaaggcatt

SEQ ID NO: 88106 - DNA, 25 bp, Homo sapien
taaccattcacagagaaagcagcaa

SEQ ID NO: 88107 - DNA, 25 bp, Homo sapien
taaccattcgcagagaaagcagcaa

SEQ ID NO: 88108 - DNA, 25 bp, Homo sapien
taaccattgaccatattggacatga

SEQ ID NO: 88109 - DNA, 25 bp, Homo sapien
taaccattgaccgtattggacatga

SEQ ID NO: 88110 - DNA, 25 bp, Homo sapien
taacccacacagagaactgagacat

SEQ ID NO: 88111 - DNA, 25 bp, Homo sapien
taacccacacagcgaactgagacat

SEQ ID NO: 88112 - DNA, 25 bp, Homo sapien
taacccagtggctgcacgttgtagt

SEQ ID NO: 88113 - DNA, 25 bp, Homo sapien
taacccagtggctgtacgttgtagt

SEQ ID NO: 88114 - DNA, 25 bp, Homo sapien
taacccattctcaggctgttatgaa

SEQ ID NO: 88115 - DNA, 25 bp, Homo sapien
taacccattctcatgctgttatgaa

SEQ ID NO: 88116 - DNA, 25 bp, Homo sapien
taacccccttggtaaagctacctga

SEQ ID NO: 88117 - DNA, 25 bp, Homo sapien
taacccccttggtagagctacctga

SEQ ID NO: 88118 - DNA, 25 bp, Homo sapien
taacccggcatcatggagaaaaata

SEQ ID NO: 88119 - DNA, 25 bp, Homo sapien
taacccggcatcctggagaaaaata

SEQ ID NO: 88120 - DNA, 25 bp, Homo sapien
taaccctggagtcgagtttcacaaa

SEQ ID NO: 88121 - DNA, 25 bp, Homo sapien
taaccctggagttgagtttcacaaa

SEQ ID NO: 88122 - DNA, 25 bp, Homo sapien
taacccttacttgaatctgttccca

SEQ ID NO: 88123 - DNA, 25 bp, Homo sapien
taacccttatttgaatctgttccca

SEQ ID NO: 88124 - DNA, 25 bp, Homo sapien
taaccctttggacgcaaatgtacct

SEQ ID NO: 88125 - DNA, 25 bp, Homo sapien
taaccctttggatgcaaatgtacct

SEQ ID NO: 88126 - DNA, 25 bp, Homo sapien
taaccgccagccaggtttgagcacc

SEQ ID NO: 88127 - DNA, 25 bp, Homo sapien
taaccgccagccatgtttgagcacc

SEQ ID NO: 88128 - DNA, 25 bp, Homo sapien
taacctaaaaatacttctcccatgg

SEQ ID NO: 88129 - DNA, 25 bp, Homo sapien
taacctaaaaatgcttctcccatgg

SEQ ID NO: 88130 - DNA, 25 bp, Homo sapien
taacctaaaatagagttccccacag

SEQ ID NO: 88131 - DNA, 25 bp, Homo sapien
taacctaaaatggagttccccacag

SEQ ID NO: 88132 - DNA, 25 bp, Homo sapien
taacctagtgacgaattagtaatat

SEQ ID NO: 88133 - DNA, 25 bp, Homo sapien
taacctagtgatgaattagtaatat

SEQ ID NO: 88134 - DNA, 25 bp, Homo sapien
taacctatcaaaaaattgtgtctta

SEQ ID NO: 88135 - DNA, 25 bp, Homo sapien
taacctatcaaagaattgtgtctta

SEQ ID NO: 88136 - DNA, 25 bp, Homo sapien
taacctcaattctgcttcttattaa

SEQ ID NO: 88137 - DNA, 25 bp, Homo sapien
taacctcagactacatattacagaa

SEQ ID NO: 88138 - DNA, 25 bp, Homo sapien
taacctcagactagatattacagaa

SEQ ID NO: 88139 - DNA, 25 bp, Homo sapien
taacctcaggcaagactgatgaggg

SEQ ID NO: 88140 - DNA, 25 bp, Homo sapien
taacctcaggcaagtctgatgaggg

SEQ ID NO: 88141 - DNA, 25 bp, Homo sapien
taacctcagttctgcttcttattaa

SEQ ID NO: 88142 - DNA, 25 bp, Homo sapien
taacctctaaggcatttcagaagct

SEQ ID NO: 88143 - DNA, 25 bp, Homo sapien
taacctctaccatgcttacagaata

SEQ ID NO: 88144 - DNA, 25 bp, Homo sapien
taacctctaccatgtttacagaata

SEQ ID NO: 88145 - DNA, 25 bp, Homo sapien
taacctctgaggcatttcagaagct

SEQ ID NO: 88146 - DNA, 25 bp, Homo sapien
taaccttctcggtcttgtaaaatat

SEQ ID NO: 88147 - DNA, 25 bp, Homo sapien
taaccttcttggtcttgtaaaatat

SEQ ID NO: 88148 - DNA, 25 bp, Homo sapien
taaccttgagatcaaaaacataaaa

SEQ ID NO: 88149 - DNA, 25 bp, Homo sapien
taaccttgagatcagaaacataaaa

SEQ ID NO: 88150 - DNA, 25 bp, Homo sapien
taacctttctctcaggctgctctct

SEQ ID NO: 88151 - DNA, 25 bp, Homo sapien
taacctttctctccggctgctctct

SEQ ID NO: 88152 - DNA, 25 bp, Homo sapien
taacgataattcatctggtagattg

SEQ ID NO: 88153 - DNA, 25 bp, Homo sapien
taacgataattcgtctggtagattg

SEQ ID NO: 88154 - DNA, 25 bp, Homo sapien
taacgcagggatgcagcatccaata

SEQ ID NO: 88155 - DNA, 25 bp, Homo sapien
taacgcagggatgcggcatccaata

SEQ ID NO: 88156 - DNA, 25 bp, Homo sapien
taacgtggtgtatctgttcttactt

SEQ ID NO: 88157 - DNA, 25 bp, Homo sapien
taacgtggtgtgtctgttcttactt

SEQ ID NO: 88158 - DNA, 25 bp, Homo sapien
taacgtttgcatggaacagtctcaa

SEQ ID NO: 88159 - DNA, 25 bp, Homo sapien
taacgtttgcatgggacagtctcaa

SEQ ID NO: 88160 - DNA, 25 bp, Homo sapien
taactaaacagctccatagtgggga

SEQ ID NO: 88161 - DNA, 25 bp, Homo sapien
taactaaacggctccatagtgggga

SEQ ID NO: 88162 - DNA, 25 bp, Homo sapien
taactaaagcctttcaatgttacac

SEQ ID NO: 88163 - DNA, 25 bp, Homo sapien
taactaaagcctttcattgttacac

SEQ ID NO: 88164 - DNA, 25 bp, Homo sapien
taactaaatagcctttcatctttcc

SEQ ID NO: 88165 - DNA, 25 bp, Homo sapien
taactaaatagcttttcatctttcc

SEQ ID NO: 88166 - DNA, 25 bp, Homo sapien
taactaacacaccggaacgcaaaaa

SEQ ID NO: 88167 - DNA, 25 bp, Homo sapien
taactaacataccggaacgcaaaaa

SEQ ID NO: 88168 - DNA, 25 bp, Homo sapien
taactaatacttgtacacacaaaag

SEQ ID NO: 88169 - DNA, 25 bp, Homo sapien
taactaatatttgtacacacaaaag

SEQ ID NO: 88170 - DNA, 25 bp, Homo sapien
taactaattgctataacgaatctaa

SEQ ID NO: 88171 - DNA, 25 bp, Homo sapien
taactaattgctataatgaatctaa

SEQ ID NO: 88172 - DNA, 25 bp, Homo sapien
taactacaaatataatgcttattgc

SEQ ID NO: 88173 - DNA, 25 bp, Homo sapien
taactacaagtataatgcttattgc

SEQ ID NO: 88174 - DNA, 25 bp, Homo sapien
taactacataatttcagcagtatgc

SEQ ID NO: 88175 - DNA, 25 bp, Homo sapien
taactacatcatttcagcagtatgc

SEQ ID NO: 88176 - DNA, 25 bp, Homo sapien
taactacatcgtctgaaaggaagta

SEQ ID NO: 88177 - DNA, 25 bp, Homo sapien
taactacatcttatttttattcctt

SEQ ID NO: 88178 - DNA, 25 bp, Homo sapien
taactacatgcacatactggttatt

SEQ ID NO: 88179 - DNA, 25 bp, Homo sapien
taactacattcacatactggttatt

SEQ ID NO: 88180 - DNA, 25 bp, Homo sapien
taactacattgtctgaaaggaagta

SEQ ID NO: 88181 - DNA, 25 bp, Homo sapien
taactacattttatttttattcctt

SEQ ID NO: 88182 - DNA, 25 bp, Homo sapien
taactactaatagcccactctggat

SEQ ID NO: 88183 - DNA, 25 bp, Homo sapien
taactactgatagcccactctggat

SEQ ID NO: 88184 - DNA, 25 bp, Homo sapien
taactagccagcggacaaatggcag

SEQ ID NO: 88185 - DNA, 25 bp, Homo sapien
taactagccagcggccaaatggcag

SEQ ID NO: 88186 - DNA, 25 bp, Homo sapien
taactagccatcctgtattttatcc

SEQ ID NO: 88187 - DNA, 25 bp, Homo sapien
taactagccatcttgtattttatcc

SEQ ID NO: 88188 - DNA, 25 bp, Homo sapien
taactaggggtcatgtcttgaagct

SEQ ID NO: 88189 - DNA, 25 bp, Homo sapien
taactaggggtcgtgtcttgaagct

SEQ ID NO: 88190 - DNA, 25 bp, Homo sapien
taactataaattattgatgagtaaa

SEQ ID NO: 88191 - DNA, 25 bp, Homo sapien
taactataaattattggtgagtaaa

SEQ ID NO: 88192 - DNA, 25 bp, Homo sapien
taactataatcatggcagatgaaat

SEQ ID NO: 88193 - DNA, 25 bp, Homo sapien
taactataatcatggcggatgaaat

SEQ ID NO: 88194 - DNA, 25 bp, Homo sapien
taactattgctcagttattctcatt

SEQ ID NO: 88195 - DNA, 25 bp, Homo sapien
taactattgctcatttattctcatt

SEQ ID NO: 88196 - DNA, 25 bp, Homo sapien
taactatttctatttagccaaccat

SEQ ID NO: 88197 - DNA, 25 bp, Homo sapien
taactatttctgtttagccaaccat

SEQ ID NO: 88198 - DNA, 25 bp, Homo sapien
taactcaaggataattaaagcatga

SEQ ID NO: 88199 - DNA, 25 bp, Homo sapien
taactcaaggataattgaagcatga

SEQ ID NO: 88200 - DNA, 25 bp, Homo sapien
taactcataaaaattacaaataaaa

SEQ ID NO: 88201 - DNA, 25 bp, Homo sapien
taactcataaaagttacaaataaaa

SEQ ID NO: 88202 - DNA, 25 bp, Homo sapien
taactcattggactctagtctcata

SEQ ID NO: 88203 - DNA, 25 bp, Homo sapien
taactcattggagtctagtctcata

SEQ ID NO: 88204 - DNA, 25 bp, Homo sapien
taactccaaagctcatttgattgtg

SEQ ID NO: 88205 - DNA, 25 bp, Homo sapien
taactccaatgctcatttgattgtg

SEQ ID NO: 88206 - DNA, 25 bp, Homo sapien
taactccaattactttatgggtagt

SEQ ID NO: 88207 - DNA, 25 bp, Homo sapien
taactccaattattttatgggtagt

SEQ ID NO: 88208 - DNA, 25 bp, Homo sapien
taactccacatagaaagtatcagaa

SEQ ID NO: 88209 - DNA, 25 bp, Homo sapien
taactccacgtagaaagtatcagaa

SEQ ID NO: 88210 - DNA, 25 bp, Homo sapien
taactccagagcgtagcatcaaagc

SEQ ID NO: 88211 - DNA, 25 bp, Homo sapien
taactccagagtgtagcatcaaagc

SEQ ID NO: 88212 - DNA, 25 bp, Homo sapien
taactcccatttttggagcccttga

SEQ ID NO: 88213 - DNA, 25 bp, Homo sapien
taactcccttttttggagcccttga

SEQ ID NO: 88214 - DNA, 25 bp, Homo sapien
taactcctggctactactgtgtatc

SEQ ID NO: 88215 - DNA, 25 bp, Homo sapien
taactcctggctgctactgtgtatc

SEQ ID NO: 88216 - DNA, 25 bp, Homo sapien
taactctccaaacggacccaggttg

SEQ ID NO: 88217 - DNA, 25 bp, Homo sapien
taactctccaaatggacccaggttg

SEQ ID NO: 88218 - DNA, 25 bp, Homo sapien
taactctcctgtgttcatctgtgct

SEQ ID NO: 88219 - DNA, 25 bp, Homo sapien
taactctctaaagtctctggagaac

SEQ ID NO: 88220 - DNA, 25 bp, Homo sapien
taactctctataactccttcaagtg

SEQ ID NO: 88221 - DNA, 25 bp, Homo sapien
taactctctgaagtctctggagaac

SEQ ID NO: 88222 - DNA, 25 bp, Homo sapien
taactctctgtaactccttcaagtg

SEQ ID NO: 88223 - DNA, 25 bp, Homo sapien
taactctcttgtgttcatctgtgct

SEQ ID NO: 88224 - DNA, 25 bp, Homo sapien
taactctgaaagacctcatatttct

SEQ ID NO: 88225 - DNA, 25 bp, Homo sapien
taactctgaaagaccttatatttct

SEQ ID NO: 88226 - DNA, 25 bp, Homo sapien
taactctgagtgtgaacgaaaagta

SEQ ID NO: 88227 - DNA, 25 bp, Homo sapien
taactctgagtttgaacgaaaagta

SEQ ID NO: 88228 - DNA, 25 bp, Homo sapien
taactctgcaattaagtggagcatc

SEQ ID NO: 88229 - DNA, 25 bp, Homo sapien
taactctggatgactgatatgggtt

SEQ ID NO: 88230 - DNA, 25 bp, Homo sapien
taactctggatgtctgatatgggtt

SEQ ID NO: 88231 - DNA, 25 bp, Homo sapien
taactctgtaattaagtggagcatc

SEQ ID NO: 88232 - DNA, 25 bp, Homo sapien
taactgaatcataggaacagacttg

SEQ ID NO: 88233 - DNA, 25 bp, Homo sapien
taactgaatcatgggaacagacttg

SEQ ID NO: 88234 - DNA, 25 bp, Homo sapien
taactgaccaaaggcaaactttaga

SEQ ID NO: 88235 - DNA, 25 bp, Homo sapien
taactgaccaaaggcagactttaga

SEQ ID NO: 88236 - DNA, 25 bp, Homo sapien
taactgactacaattaggggtttct

SEQ ID NO: 88237 - DNA, 25 bp, Homo sapien
taactgactaccattaggggtttct

SEQ ID NO: 88238 - DNA, 25 bp, Homo sapien
taactgagaaagttcacataactgc

SEQ ID NO: 88239 - DNA, 25 bp, Homo sapien
taactgagaaagttcatataactgc

SEQ ID NO: 88240 - DNA, 25 bp, Homo sapien
taactgagaaccacaaactgagtgg

SEQ ID NO: 88241 - DNA, 25 bp, Homo sapien
taactgagaaccataaactgagtgg

SEQ ID NO: 88242 - DNA, 25 bp, Homo sapien
taactgagagatcattaagcatcac

SEQ ID NO: 88243 - DNA, 25 bp, Homo sapien
taactgagagattattaagcatcac

SEQ ID NO: 88244 - DNA, 25 bp, Homo sapien
taactgattccttggctcaccattg

SEQ ID NO: 88245 - DNA, 25 bp, Homo sapien
taactgattgcttggctcaccattg

SEQ ID NO: 88246 - DNA, 25 bp, Homo sapien
taactgcagcacagcgaagacacgg

SEQ ID NO: 88247 - DNA, 25 bp, Homo sapien
taactgcagcacagtgaagacacgg

SEQ ID NO: 88248 - DNA, 25 bp, Homo sapien
taactgccaataggtaagttcttac

SEQ ID NO: 88249 - DNA, 25 bp, Homo sapien
taactgccaatagttaagttcttac

SEQ ID NO: 88250 - DNA, 25 bp, Homo sapien
taactgctgggaatttgagaagtct

SEQ ID NO: 88251 - DNA, 25 bp, Homo sapien
taactgctgggcatttgagaagtct

SEQ ID NO: 88252 - DNA, 25 bp, Homo sapien
taactggagcccaatagcttcattg

SEQ ID NO: 88253 - DNA, 25 bp, Homo sapien
taactggagcctaatagcttcattg

SEQ ID NO: 88254 - DNA, 25 bp, Homo sapien
taactggcactatttctgagaaatt

SEQ ID NO: 88255 - DNA, 25 bp, Homo sapien
taactggcactgtttctgagaaatt

SEQ ID NO: 88256 - DNA, 25 bp, Homo sapien
taactggtcaacatatccatcactc

SEQ ID NO: 88257 - DNA, 25 bp, Homo sapien
taactggtcaacgtatccatcactc

SEQ ID NO: 88258 - DNA, 25 bp, Homo sapien
taactgtacctgagcagtgctgaaa

SEQ ID NO: 88259 - DNA, 25 bp, Homo sapien
taactgtacctgggcagtgctgaaa

SEQ ID NO: 88260 - DNA, 25 bp, Homo sapien
taactgtacgccaggagaaaaaaaa

SEQ ID NO: 88261 - DNA, 25 bp, Homo sapien
taactgtatgccaggagaaaaaaaa

SEQ ID NO: 88262 - DNA, 25 bp, Homo sapien
taactgtctaaaacataagtgctat

SEQ ID NO: 88263 - DNA, 25 bp, Homo sapien
taactgtctaaaacgtaagtgctat

SEQ ID NO: 88264 - DNA, 25 bp, Homo sapien
taactgtgataggttccgaagttgg

SEQ ID NO: 88265 - DNA, 25 bp, Homo sapien
taactgtggccaagattcaagaagg

SEQ ID NO: 88266 - DNA, 25 bp, Homo sapien
taactgtggtaggttccgaagttgg

SEQ ID NO: 88267 - DNA, 25 bp, Homo sapien
taactgtgtccaagattcaagaagg

SEQ ID NO: 88268 - DNA, 25 bp, Homo sapien
taactgttcacacacttgagaccaa

SEQ ID NO: 88269 - DNA, 25 bp, Homo sapien
taactgttcacacatttgagaccaa

SEQ ID NO: 88270 - DNA, 25 bp, Homo sapien
taactgttgagactaaggtttagaa

SEQ ID NO: 88271 - DNA, 25 bp, Homo sapien
taactgttgggactaaggtttagaa

SEQ ID NO: 88272 - DNA, 25 bp, Homo sapien
taactgttgtcccatgatgaaaccc

SEQ ID NO: 88273 - DNA, 25 bp, Homo sapien
taactgttgtcccatgttgaaaccc

SEQ ID NO: 88274 - DNA, 25 bp, Homo sapien
taacttaaggttctcaatcggtgta

SEQ ID NO: 88275 - DNA, 25 bp, Homo sapien
taacttaaggttttcaatcggtgta

SEQ ID NO: 88276 - DNA, 25 bp, Homo sapien
taacttaccgctaatctcaatgtct

SEQ ID NO: 88277 - DNA, 25 bp, Homo sapien
taacttacgaattatatattgcaag

SEQ ID NO: 88278 - DNA, 25 bp, Homo sapien
taacttacgaattgtatattgcaag

SEQ ID NO: 88279 - DNA, 25 bp, Homo sapien
taacttactgctaatctcaatgtct

SEQ ID NO: 88280 - DNA, 25 bp, Homo sapien
taacttagcctcttcctctatggag

SEQ ID NO: 88281 - DNA, 25 bp, Homo sapien
taacttagcttcttcctctatggag

SEQ ID NO: 88282 - DNA, 25 bp, Homo sapien
taacttagtgaaagttaagataaca

SEQ ID NO: 88283 - DNA, 25 bp, Homo sapien
taacttagtgaaatttaagataaca

SEQ ID NO: 88284 - DNA, 25 bp, Homo sapien
taacttccagggcttgcatttttta

SEQ ID NO: 88285 - DNA, 25 bp, Homo sapien
taacttccagggtttgcatttttta

SEQ ID NO: 88286 - DNA, 25 bp, Homo sapien
taacttccctgtatttcttggtttc

SEQ ID NO: 88287 - DNA, 25 bp, Homo sapien
taacttccctgtatttgttggtttc

SEQ ID NO: 88288 - DNA, 25 bp, Homo sapien
taacttcctataagctgaaagtatt

SEQ ID NO: 88289 - DNA, 25 bp, Homo sapien
taacttcctgtaagctgaaagtatt

SEQ ID NO: 88290 - DNA, 25 bp, Homo sapien
taacttccttcaaagactgcagtgt

SEQ ID NO: 88291 - DNA, 25 bp, Homo sapien
taacttccttccaagactgcagtgt

SEQ ID NO: 88292 - DNA, 25 bp, Homo sapien
taacttctatatctaaaaatgctga

SEQ ID NO: 88293 - DNA, 25 bp, Homo sapien
taacttctgaatcacttctttctgt

SEQ ID NO: 88294 - DNA, 25 bp, Homo sapien
taacttctgaatcgcttctttctgt

SEQ ID NO: 88295 - DNA, 25 bp, Homo sapien
taacttctgtatctaaaaatgctga

SEQ ID NO: 88296 - DNA, 25 bp, Homo sapien
taacttgaacacgactcattttgtg

SEQ ID NO: 88297 - DNA, 25 bp, Homo sapien
taacttgaacatgactcattttgtg

SEQ ID NO: 88298 - DNA, 25 bp, Homo sapien
taacttggcacctatttatatatta

SEQ ID NO: 88299 - DNA, 25 bp, Homo sapien
taacttggcacgtatttatatatta

SEQ ID NO: 88300 - DNA, 25 bp, Homo sapien
taactttaattcttcctacttgact

SEQ ID NO: 88301 - DNA, 25 bp, Homo sapien
taactttaatttttcctacttgact

SEQ ID NO: 88302 - DNA, 25 bp, Homo sapien
taactttacaactgaagggagggat

SEQ ID NO: 88303 - DNA, 25 bp, Homo sapien
taactttacaattgaagggagggat

SEQ ID NO: 88304 - DNA, 25 bp, Homo sapien
taactttattgtatacaaactcata

SEQ ID NO: 88305 - DNA, 25 bp, Homo sapien
taactttattgtgtacaaactcata

SEQ ID NO: 88306 - DNA, 25 bp, Homo sapien
taactttcaactagtatccagtatg

SEQ ID NO: 88307 - DNA, 25 bp, Homo sapien
taactttcatctagtatccagtatg

SEQ ID NO: 88308 - DNA, 25 bp, Homo sapien
taactttcctcatgaactggcattc

SEQ ID NO: 88309 - DNA, 25 bp, Homo sapien
taactttcctcatgaattggcattc

SEQ ID NO: 88310 - DNA, 25 bp, Homo sapien
taactttctgaaatcagattgtgtc

SEQ ID NO: 88311 - DNA, 25 bp, Homo sapien
taactttctgatatcagattgtgtc

SEQ ID NO: 88312 - DNA, 25 bp, Homo sapien
taactttcttaaattgtatgaaggc

SEQ ID NO: 88313 - DNA, 25 bp, Homo sapien
taactttcttaagttgtatgaaggc

SEQ ID NO: 88314 - DNA, 25 bp, Homo sapien
taactttgcacctagaagaattaga

SEQ ID NO: 88315 - DNA, 25 bp, Homo sapien
taactttgcacctagaggaattaga

SEQ ID NO: 88316 - DNA, 25 bp, Homo sapien
taacttttcgggttggcatttttca

SEQ ID NO: 88317 - DNA, 25 bp, Homo sapien
taactttttaaaaaatcaagcagaa

SEQ ID NO: 88318 - DNA, 25 bp, Homo sapien
taactttttaaaatatcaagcagaa

SEQ ID NO: 88319 - DNA, 25 bp, Homo sapien
taactttttgggttggcatttttca

SEQ ID NO: 88320 - DNA, 25 bp, Homo sapien
taagaaaaatccgtagactgtgaga

SEQ ID NO: 88321 - DNA, 25 bp, Homo sapien
taagaaaaatctgtagactgtgaga

SEQ ID NO: 88322 - DNA, 25 bp, Homo sapien
taagaaaaatgctctagtctcattc

SEQ ID NO: 88323 - DNA, 25 bp, Homo sapien
taagaaaaatgctgtagtctcattc

SEQ ID NO: 88324 - DNA, 25 bp, Homo sapien
taagaaaagcaacataagcaacaaa

SEQ ID NO: 88325 - DNA, 25 bp, Homo sapien
taagaaaagcaacgtaagcaacaaa

SEQ ID NO: 88326 - DNA, 25 bp, Homo sapien
taagaaaccacagatggaaaagtat

SEQ ID NO: 88327 - DNA, 25 bp, Homo sapien
taagaaaccataaactggaaggtaa

SEQ ID NO: 88328 - DNA, 25 bp, Homo sapien
taagaaaccataatctggaaggtaa

SEQ ID NO: 88329 - DNA, 25 bp, Homo sapien
taagaaacgacagatggaaaagtat

SEQ ID NO: 88330 - DNA, 25 bp, Homo sapien
taagaaagaactttgagatggtgaa

SEQ ID NO: 88331 - DNA, 25 bp, Homo sapien
taagaaagaccatatgcaagctaaa

SEQ ID NO: 88332 - DNA, 25 bp, Homo sapien
taagaaagaccgtatgcaagctaaa

SEQ ID NO: 88333 - DNA, 25 bp, Homo sapien
taagaaagcctgctcttgaatcatg

SEQ ID NO: 88334 - DNA, 25 bp, Homo sapien
taagaaagcctgttcttgaatcatg

SEQ ID NO: 88335 - DNA, 25 bp, Homo sapien
taagaaagcgatctcaggaagcaca

SEQ ID NO: 88336 - DNA, 25 bp, Homo sapien
taagaaaggactttgagatggtgaa

SEQ ID NO: 88337 - DNA, 25 bp, Homo sapien
taagaaagtacaaatgtcttcctgt

SEQ ID NO: 88338 - DNA, 25 bp, Homo sapien
taagaaagtacaattgtcttcctgt

SEQ ID NO: 88339 - DNA, 25 bp, Homo sapien
taagaaagtcctatctgctttaatc

SEQ ID NO: 88340 - DNA, 25 bp, Homo sapien
taagaaagtcctatcttctttaatc

SEQ ID NO: 88341 - DNA, 25 bp, Homo sapien
taagaaagtgatctcaggaagcaca

SEQ ID NO: 88342 - DNA, 25 bp, Homo sapien
taagaaatataccaaaggccaccca

SEQ ID NO: 88343 - DNA, 25 bp, Homo sapien
taagaaatataccgaaggccaccca

SEQ ID NO: 88344 - DNA, 25 bp, Homo sapien
taagaaatatctcatgcgtagtatg

SEQ ID NO: 88345 - DNA, 25 bp, Homo sapien
taagaaatatctcatgtgtagtatg

SEQ ID NO: 88346 - DNA, 25 bp, Homo sapien
taagaaatgccacaggtaagctaag

SEQ ID NO: 88347 - DNA, 25 bp, Homo sapien
taagaaatgccacgggtaagctaag

SEQ ID NO: 88348 - DNA, 25 bp, Homo sapien
taagaacaccaacctccaagttttt

SEQ ID NO: 88349 - DNA, 25 bp, Homo sapien
taagaacacgaacctccaagttttt

SEQ ID NO: 88350 - DNA, 25 bp, Homo sapien
taagaacatggaagaaatctattat

SEQ ID NO: 88351 - DNA, 25 bp, Homo sapien
taagaacatggaagaagtctattat

SEQ ID NO: 88352 - DNA, 25 bp, Homo sapien
taagaacctaaccgtagaagatcag

SEQ ID NO: 88353 - DNA, 25 bp, Homo sapien
taagaacctaatcgtagaagatcag

SEQ ID NO: 88354 - DNA, 25 bp, Homo sapien
taagaactgtggaaaaattatttca

SEQ ID NO: 88355 - DNA, 25 bp, Homo sapien
taagaactgtgggaaaattatttca

SEQ ID NO: 88356 - DNA, 25 bp, Homo sapien
taagaagagaaaatccatagacacc

SEQ ID NO: 88357 - DNA, 25 bp, Homo sapien
taagaagagaagatccatagacacc

SEQ ID NO: 88358 - DNA, 25 bp, Homo sapien
taagaagccataataactgaaggcc

SEQ ID NO: 88359 - DNA, 25 bp, Homo sapien
taagaagccatagtaactgaaggcc

SEQ ID NO: 88360 - DNA, 25 bp, Homo sapien
taagaaggacagtacttgtgctgaa

SEQ ID NO: 88361 - DNA, 25 bp, Homo sapien
taagaaggacagtatttgtgctgaa

SEQ ID NO: 88362 - DNA, 25 bp, Homo sapien
taagaaggacctaagagctccctaa

SEQ ID NO: 88363 - DNA, 25 bp, Homo sapien
taagaaggacctatgagctccctaa

SEQ ID NO: 88364 - DNA, 25 bp, Homo sapien
taagaagtctcccatcaaagaaaat

SEQ ID NO: 88365 - DNA, 25 bp, Homo sapien
taagaagtctcccgtcaaagaaaat

SEQ ID NO: 88366 - DNA, 25 bp, Homo sapien
taagaagtcttagaagcgttgtttt

SEQ ID NO: 88367 - DNA, 25 bp, Homo sapien
taagaagtcttagaagggttgtttt

SEQ ID NO: 88368 - DNA, 25 bp, Homo sapien
taagaagtgagaagttctgcctgtg

SEQ ID NO: 88369 - DNA, 25 bp, Homo sapien
taagaagtgagaagttttgcctgtg

SEQ ID NO: 88370 - DNA, 25 bp, Homo sapien
taagaagtttcaaaacagggccact

SEQ ID NO: 88371 - DNA, 25 bp, Homo sapien
taagaagtttcaaaacggggccact

SEQ ID NO: 88372 - DNA, 25 bp, Homo sapien
taagaataagaatggtacgtagaac

SEQ ID NO: 88373 - DNA, 25 bp, Homo sapien
taagaataagagtggtacgtagaac

SEQ ID NO: 88374 - DNA, 25 bp, Homo sapien
taagaataatacataccacatgctt

SEQ ID NO: 88375 - DNA, 25 bp, Homo sapien
taagaataatacgtaccacatgctt

SEQ ID NO: 88376 - DNA, 25 bp, Homo sapien
taagaatcaaacgaatggttatttt

SEQ ID NO: 88377 - DNA, 25 bp, Homo sapien
taagaatcaaatgaatggttatttt

SEQ ID NO: 88378 - DNA, 25 bp, Homo sapien
taagaatcatccaaccataattgtc

SEQ ID NO: 88379 - DNA, 25 bp, Homo sapien
taagaatcatccaaccgtaattgtc

SEQ ID NO: 88380 - DNA, 25 bp, Homo sapien
taagaatgaatatagtccatcggga

SEQ ID NO: 88381 - DNA, 25 bp, Homo sapien
taagaatgcatatagtccatcggga

SEQ ID NO: 88382 - DNA, 25 bp, Homo sapien
taagaatgtacgggcattgaagcac

SEQ ID NO: 88383 - DNA, 25 bp, Homo sapien
taagaatgtactggcattgaagcac

SEQ ID NO: 88384 - DNA, 25 bp, Homo sapien
taagacaaattaaacctctgacttc

SEQ ID NO: 88385 - DNA, 25 bp, Homo sapien
taagacaaattaaatctctgacttc

SEQ ID NO: 88386 - DNA, 25 bp, Homo sapien
taagacagcaaacatgatctattcc

SEQ ID NO: 88387 - DNA, 25 bp, Homo sapien
taagacagcaaacatgttctattcc

SEQ ID NO: 88388 - DNA, 25 bp, Homo sapien
taagacagtcaaattgggagcaggc

SEQ ID NO: 88389 - DNA, 25 bp, Homo sapien
taagacagtcaagttgggagcaggc

SEQ ID NO: 88390 - DNA, 25 bp, Homo sapien
taagaccaacattccttgttaagtg

SEQ ID NO: 88391 - DNA, 25 bp, Homo sapien
taagaccaacattctttgttaagtg

SEQ ID NO: 88392 - DNA, 25 bp, Homo sapien
taagacccaggaaaaatcgatgttg

SEQ ID NO: 88393 - DNA, 25 bp, Homo sapien
taagacccgggaaaaatcgatgttg

SEQ ID NO: 88394 - DNA, 25 bp, Homo sapien
taagacttcagaaagaaacaaaccc

SEQ ID NO: 88395 - DNA, 25 bp, Homo sapien
taagacttcggaaagaaacaaaccc

SEQ ID NO: 88396 - DNA, 25 bp, Homo sapien
taagagaaactataaaagcagtgtg

SEQ ID NO: 88397 - DNA, 25 bp, Homo sapien
taagagaaactctaaaagcagtgtg

SEQ ID NO: 88398 - DNA, 25 bp, Homo sapien
taagagaacgctaaacatgggatca

SEQ ID NO: 88399 - DNA, 25 bp, Homo sapien
taagagaacgctaagcatgggatca

SEQ ID NO: 88400 - DNA, 25 bp, Homo sapien
taagagaagtgaaccgatgttctgt

SEQ ID NO: 88401 - DNA, 25 bp, Homo sapien
taagagaagtgaactgatgttctgt

SEQ ID NO: 88402 - DNA, 25 bp, Homo sapien
taagagaattttctcgggtgataga

SEQ ID NO: 88403 - DNA, 25 bp, Homo sapien
taagagaattttcttgggtgataga

SEQ ID NO: 88404 - DNA, 25 bp, Homo sapien
taagagacgaagaccatccctcctc

SEQ ID NO: 88405 - DNA, 25 bp, Homo sapien
taagagactaagaccatccctcctc

SEQ ID NO: 88406 - DNA, 25 bp, Homo sapien
taagagcaagataccttttagtcta

SEQ ID NO: 88407 - DNA, 25 bp, Homo sapien
taagagcaagatatcttttagtcta

SEQ ID NO: 88408 - DNA, 25 bp, Homo sapien
taagagcacagtatttcgtagccca

SEQ ID NO: 88409 - DNA, 25 bp, Homo sapien
taagagcatagtatttcgtagccca

SEQ ID NO: 88410 - DNA, 25 bp, Homo sapien
taagagccgacactgcagactgtaa

SEQ ID NO: 88411 - DNA, 25 bp, Homo sapien
taagagccgacactgcggactgtaa

SEQ ID NO: 88412 - DNA, 25 bp, Homo sapien
taagagcctgaaagaatattttatg

SEQ ID NO: 88413 - DNA, 25 bp, Homo sapien
taagagcctgaatgaatattttatg

SEQ ID NO: 88414 - DNA, 25 bp, Homo sapien
taagagctgaaactgtaaaagtgca

SEQ ID NO: 88415 - DNA, 25 bp, Homo sapien
taagagctgaaattgtaaaagtgca

SEQ ID NO: 88416 - DNA, 25 bp, Homo sapien
taagaggaaggatcaactgtgaatg

SEQ ID NO: 88417 - DNA, 25 bp, Homo sapien
taagaggaaggatcgactgtgaatg

SEQ ID NO: 88418 - DNA, 25 bp, Homo sapien
taagaggtagaggttggaaggattg

SEQ ID NO: 88419 - DNA, 25 bp, Homo sapien
taagaggtagagtttggaaggattg

SEQ ID NO: 88420 - DNA, 25 bp, Homo sapien
taagagtattgactccttcatgcac

SEQ ID NO: 88421 - DNA, 25 bp, Homo sapien
taagagtattgtctccttcatgcac

SEQ ID NO: 88422 - DNA, 25 bp, Homo sapien
taagatagggcacgaccgaacttgg

SEQ ID NO: 88423 - DNA, 25 bp, Homo sapien
taagatagggcatgaccgaacttgg

SEQ ID NO: 88424 - DNA, 25 bp, Homo sapien
taagatagtaacttggtcagctaga

SEQ ID NO: 88425 - DNA, 25 bp, Homo sapien
taagatagttacttggtcagctaga

SEQ ID NO: 88426 - DNA, 25 bp, Homo sapien
taagatattaggctgccatatgatc

SEQ ID NO: 88427 - DNA, 25 bp, Homo sapien
taagatattaggcttccatatgatc

SEQ ID NO: 88428 - DNA, 25 bp, Homo sapien
taagatattcaactctcaacattag

SEQ ID NO: 88429 - DNA, 25 bp, Homo sapien
taagatattcagctctcaacattag

SEQ ID NO: 88430 - DNA, 25 bp, Homo sapien
taagatattgctaaagagaagtagc

SEQ ID NO: 88431 - DNA, 25 bp, Homo sapien
taagatattgctaaggagaagtagc

SEQ ID NO: 88432 - DNA, 25 bp, Homo sapien
taagatccacggccgctttagtgaa

SEQ ID NO: 88433 - DNA, 25 bp, Homo sapien
taagatccatggccgctttagtgaa

SEQ ID NO: 88434 - DNA, 25 bp, Homo sapien
taagatgaaacttccaccctacaga

SEQ ID NO: 88435 - DNA, 25 bp, Homo sapien
taagatgaaactttcaccctacaga

SEQ ID NO: 88436 - DNA, 25 bp, Homo sapien
taagatgagccaggtttctttctgt

SEQ ID NO: 88437 - DNA, 25 bp, Homo sapien
taagatgaggcaggtttctttctgt

SEQ ID NO: 88438 - DNA, 25 bp, Homo sapien
taagatgcacatattgtagcttggg

SEQ ID NO: 88439 - DNA, 25 bp, Homo sapien
taagatgcacatgttgtagcttggg

SEQ ID NO: 88440 - DNA, 25 bp, Homo sapien
taagatggaaattttgctgtgagaa

SEQ ID NO: 88441 - DNA, 25 bp, Homo sapien
taagatggaaattttggtgtgagaa

SEQ ID NO: 88442 - DNA, 25 bp, Homo sapien
taagattaaagactaggagtggcca

SEQ ID NO: 88443 - DNA, 25 bp, Homo sapien
taagattaaagattaggagtggcca

SEQ ID NO: 88444 - DNA, 25 bp, Homo sapien
taagattcaacttcctctgtttaaa

SEQ ID NO: 88445 - DNA, 25 bp, Homo sapien
taagattcatcttcctctgtttaaa

SEQ ID NO: 88446 - DNA, 25 bp, Homo sapien
taagattccacttacattttatatc

SEQ ID NO: 88447 - DNA, 25 bp, Homo sapien
taagattccacttgcattttatatc

SEQ ID NO: 88448 - DNA, 25 bp, Homo sapien
taagattgagagattaccctgggtg

SEQ ID NO: 88449 - DNA, 25 bp, Homo sapien
taagattgatcgaggaatatgttat

SEQ ID NO: 88450 - DNA, 25 bp, Homo sapien
taagattgatcgaggattatgttat

SEQ ID NO: 88451 - DNA, 25 bp, Homo sapien
taagattgggagattaccctgggtg

SEQ ID NO: 88452 - DNA, 25 bp, Homo sapien
taagatttagttataatgaaaggaa

SEQ ID NO: 88453 - DNA, 25 bp, Homo sapien
taagatttagttctaatgaaaggaa

SEQ ID NO: 88454 - DNA, 25 bp, Homo sapien
taagatttcacaaatgctacctgtg

SEQ ID NO: 88455 - DNA, 25 bp, Homo sapien
taagatttcacaaatgttacctgtg

SEQ ID NO: 88456 - DNA, 25 bp, Homo sapien
taagatttgaaagtccagattactc

SEQ ID NO: 88457 - DNA, 25 bp, Homo sapien
taagatttggaagtccagattactc

SEQ ID NO: 88458 - DNA, 25 bp, Homo sapien
taagattttgcttctcatctcaaac

SEQ ID NO: 88459 - DNA, 25 bp, Homo sapien
taagatttttcttctcatctcaaac

SEQ ID NO: 88460 - DNA, 25 bp, Homo sapien
taagcaaaaacaactgtccctaagt

SEQ ID NO: 88461 - DNA, 25 bp, Homo sapien
taagcaaaagcaactgtccctaagt

SEQ ID NO: 88462 - DNA, 25 bp, Homo sapien
taagcaaacacaaataggtttcttt

SEQ ID NO: 88463 - DNA, 25 bp, Homo sapien
taagcaaacacagataggtttcttt

SEQ ID NO: 88464 - DNA, 25 bp, Homo sapien
taagcaaagtatccagctaattttg

SEQ ID NO: 88465 - DNA, 25 bp, Homo sapien
taagcaaagtattcagctaattttg

SEQ ID NO: 88466 - DNA, 25 bp, Homo sapien
taagcaaatgaacatctttaccttt

SEQ ID NO: 88467 - DNA, 25 bp, Homo sapien
taagcaaatgaatatctttaccttt

SEQ ID NO: 88468 - DNA, 25 bp, Homo sapien
taagcaagcacccgttttcacttct

SEQ ID NO: 88469 - DNA, 25 bp, Homo sapien
taagcaagccaagacagttatctaa

SEQ ID NO: 88470 - DNA, 25 bp, Homo sapien
taagcaagccaagagagttatctaa

SEQ ID NO: 88471 - DNA, 25 bp, Homo sapien
taagcaagcgcccgttttcacttct

SEQ ID NO: 88472 - DNA, 25 bp, Homo sapien
taagcaattgattcgaaaacctgtg

SEQ ID NO: 88473 - DNA, 25 bp, Homo sapien
taagcaattgatttgaaaacctgtg

SEQ ID NO: 88474 - DNA, 25 bp, Homo sapien
taagcacagactgtgacgactacaa

SEQ ID NO: 88475 - DNA, 25 bp, Homo sapien
taagcacagactgtgatgactacaa

SEQ ID NO: 88476 - DNA, 25 bp, Homo sapien
taagcacctaaaacatcaatttctc

SEQ ID NO: 88477 - DNA, 25 bp, Homo sapien
taagcacctaatacatcaatttctc

SEQ ID NO: 88478 - DNA, 25 bp, Homo sapien
taagcacgatgaccaccttcttaca

SEQ ID NO: 88479 - DNA, 25 bp, Homo sapien
taagcacgatgatcaccttcttaca

SEQ ID NO: 88480 - DNA, 25 bp, Homo sapien
taagcactgcaaatcgcatcagact

SEQ ID NO: 88481 - DNA, 25 bp, Homo sapien
taagcactgcaaatggcatcagact

SEQ ID NO: 88482 - DNA, 25 bp, Homo sapien
taagcagaaaaagtgaccagagatc

SEQ ID NO: 88483 - DNA, 25 bp, Homo sapien
taagcagaaccagaaagtaaaacag

SEQ ID NO: 88484 - DNA, 25 bp, Homo sapien
taagcagaaccggaaagtaaaacag

SEQ ID NO: 88485 - DNA, 25 bp, Homo sapien
taagcagagaaagtgaccagagatc

SEQ ID NO: 88486 - DNA, 25 bp, Homo sapien
taagcagatgtttaaaaaagtgacc

SEQ ID NO: 88487 - DNA, 25 bp, Homo sapien
taagcagatgtttaaacaagtgacc

SEQ ID NO: 88488 - DNA, 25 bp, Homo sapien
taagcagccactggacaggactaag

SEQ ID NO: 88489 - DNA, 25 bp, Homo sapien
taagcagccactgggcaggactaag

SEQ ID NO: 88490 - DNA, 25 bp, Homo sapien
taagcagtaaagatggaatcaggaa

SEQ ID NO: 88491 - DNA, 25 bp, Homo sapien
taagcagtaagtcattcatttggac

SEQ ID NO: 88492 - DNA, 25 bp, Homo sapien
taagcagtaagtcatttatttggac

SEQ ID NO: 88493 - DNA, 25 bp, Homo sapien
taagcagtacagatggaatcaggaa

SEQ ID NO: 88494 - DNA, 25 bp, Homo sapien
taagcagtgctaacaggaaagttta

SEQ ID NO: 88495 - DNA, 25 bp, Homo sapien
taagcagtgctaacagtaaagttta

SEQ ID NO: 88496 - DNA, 25 bp, Homo sapien
taagcataacgataaatgaaggtac

SEQ ID NO: 88497 - DNA, 25 bp, Homo sapien
taagcataacgcaaatcgatgcaga

SEQ ID NO: 88498 - DNA, 25 bp, Homo sapien
taagcataatgataaatgaaggtac

SEQ ID NO: 88499 - DNA, 25 bp, Homo sapien
taagcataatgcaaatcgatgcaga

SEQ ID NO: 88500 - DNA, 25 bp, Homo sapien
taagcatatggcatctcctcagctt

SEQ ID NO: 88501 - DNA, 25 bp, Homo sapien
taagcatatggcatttcctcagctt

SEQ ID NO: 88502 - DNA, 25 bp, Homo sapien
taagcatcctgcaacgcacagtccc

SEQ ID NO: 88503 - DNA, 25 bp, Homo sapien
taagcatcctgcaatgcacagtccc

SEQ ID NO: 88504 - DNA, 25 bp, Homo sapien
taagcatgaaaatgatttagtagca

SEQ ID NO: 88505 - DNA, 25 bp, Homo sapien
taagcatgaaactgatttagtagca

SEQ ID NO: 88506 - DNA, 25 bp, Homo sapien
taagcatggtctcactaagaaccag

SEQ ID NO: 88507 - DNA, 25 bp, Homo sapien
taagcatggtctcattaagaaccag

SEQ ID NO: 88508 - DNA, 25 bp, Homo sapien
taagcatgttttgacctgattttct

SEQ ID NO: 88509 - DNA, 25 bp, Homo sapien
taagcatgtttttacctgattttct

SEQ ID NO: 88510 - DNA, 25 bp, Homo sapien
taagcattgtgccgcaacagctgtt

SEQ ID NO: 88511 - DNA, 25 bp, Homo sapien
taagcattgtgctgcaacagctgtt

SEQ ID NO: 88512 - DNA, 25 bp, Homo sapien
taagcatttaaataaagtgcagata

SEQ ID NO: 88513 - DNA, 25 bp, Homo sapien
taagcatttaaatgaagtgcagata

SEQ ID NO: 88514 - DNA, 25 bp, Homo sapien
taagccaaactacaatatctgccac

SEQ ID NO: 88515 - DNA, 25 bp, Homo sapien
taagccaaactgcaatatctgccac

SEQ ID NO: 88516 - DNA, 25 bp, Homo sapien
taagccaaattttgaacataaagct

SEQ ID NO: 88517 - DNA, 25 bp, Homo sapien
taagccaaattttgcacataaagct

SEQ ID NO: 88518 - DNA, 25 bp, Homo sapien
taagccacaaggcattgtcatctca

SEQ ID NO: 88519 - DNA, 25 bp, Homo sapien
taagccaccgagttggtggtgattt

SEQ ID NO: 88520 - DNA, 25 bp, Homo sapien
taagccaccgagtttgtggtgattt

SEQ ID NO: 88521 - DNA, 25 bp, Homo sapien
taagccacgaggcattgtcatctca

SEQ ID NO: 88522 - DNA, 25 bp, Homo sapien
taagccagaggcccagtgaagttat

SEQ ID NO: 88523 - DNA, 25 bp, Homo sapien
taagccagaggctcagtgaagttat

SEQ ID NO: 88524 - DNA, 25 bp, Homo sapien
taagccagatgtttctgaacgacac

SEQ ID NO: 88525 - DNA, 25 bp, Homo sapien
taagccagatgtttttgaacgacac

SEQ ID NO: 88526 - DNA, 25 bp, Homo sapien
taagccaggcatttgcagagaaaga

SEQ ID NO: 88527 - DNA, 25 bp, Homo sapien
taagccaggcatttgcggagaaaga

SEQ ID NO: 88528 - DNA, 25 bp, Homo sapien
taagccatgctggagtggtgctcac

SEQ ID NO: 88529 - DNA, 25 bp, Homo sapien
taagccatgctggcgtggtgctcac

SEQ ID NO: 88530 - DNA, 25 bp, Homo sapien
taagcctgcaaaaataagatttaac

SEQ ID NO: 88531 - DNA, 25 bp, Homo sapien
taagcctgcgaaaataagatttaac

SEQ ID NO: 88532 - DNA, 25 bp, Homo sapien
taagcctttggttaagctcctgtgt

SEQ ID NO: 88533 - DNA, 25 bp, Homo sapien
taagcctttggttaagttcctgtgt

SEQ ID NO: 88534 - DNA, 25 bp, Homo sapien
taagcggcctctctcaacttcatac

SEQ ID NO: 88535 - DNA, 25 bp, Homo sapien
taagcggcctctctcaccttcatac

SEQ ID NO: 88536 - DNA, 25 bp, Homo sapien
taagctaaaacatactaacacatga

SEQ ID NO: 88537 - DNA, 25 bp, Homo sapien
taagctaaaacttactaacacatga

SEQ ID NO: 88538 - DNA, 25 bp, Homo sapien
taagctaacaagaatcaacatttac

SEQ ID NO: 88539 - DNA, 25 bp, Homo sapien
taagctaactttgtcatgggatgtc

SEQ ID NO: 88540 - DNA, 25 bp, Homo sapien
taagctaagaaacaatgggataatt

SEQ ID NO: 88541 - DNA, 25 bp, Homo sapien
taagctaagcaacaatgggataatt

SEQ ID NO: 88542 - DNA, 25 bp, Homo sapien
taagctaataagaatcaacatttac

SEQ ID NO: 88543 - DNA, 25 bp, Homo sapien
taagctaattttgtcatgggatgtc

SEQ ID NO: 88544 - DNA, 25 bp, Homo sapien
taagctagttctctccagtacaggg

SEQ ID NO: 88545 - DNA, 25 bp, Homo sapien
taagctagttctttccagtacaggg

SEQ ID NO: 88546 - DNA, 25 bp, Homo sapien
taagctcattcaaactgttggctga

SEQ ID NO: 88547 - DNA, 25 bp, Homo sapien
taagctcattcaaattgttggctga

SEQ ID NO: 88548 - DNA, 25 bp, Homo sapien
taagctctacaaaggcaggtggctc

SEQ ID NO: 88549 - DNA, 25 bp, Homo sapien
taagctctataaaggcaggtggctc

SEQ ID NO: 88550 - DNA, 25 bp, Homo sapien
taagctctcttcatgcattctcttt

SEQ ID NO: 88551 - DNA, 25 bp, Homo sapien
taagctctcttcatgcgttctcttt

SEQ ID NO: 88552 - DNA, 25 bp, Homo sapien
taagctgcatccgagagattctggt

SEQ ID NO: 88553 - DNA, 25 bp, Homo sapien
taagctgcatctgagagattctggt

SEQ ID NO: 88554 - DNA, 25 bp, Homo sapien
taagctggctaagctggtgagtgac

SEQ ID NO: 88555 - DNA, 25 bp, Homo sapien
taagctggctaatctggtgagtgac

SEQ ID NO: 88556 - DNA, 25 bp, Homo sapien
taagctgtagaacgaacattactca

SEQ ID NO: 88557 - DNA, 25 bp, Homo sapien
taagctgtggaacgaacattactca

SEQ ID NO: 88558 - DNA, 25 bp, Homo sapien
taagcttaagaaagcgatctcagga

SEQ ID NO: 88559 - DNA, 25 bp, Homo sapien
taagcttaagaaagtgatctcagga

SEQ ID NO: 88560 - DNA, 25 bp, Homo sapien
taagcttattaaactccatgacaca

SEQ ID NO: 88561 - DNA, 25 bp, Homo sapien
taagcttattaaattccatgacaca

SEQ ID NO: 88562 - DNA, 25 bp, Homo sapien
taagcttggacagctgagttctaaa

SEQ ID NO: 88563 - DNA, 25 bp, Homo sapien
taagcttggccagctgagttctaaa

SEQ ID NO: 88564 - DNA, 25 bp, Homo sapien
taagcttttcatcaatataatatac

SEQ ID NO: 88565 - DNA, 25 bp, Homo sapien
taagcttttcatcagtataatatac

SEQ ID NO: 88566 - DNA, 25 bp, Homo sapien
taaggaaaccaatcgtgtgatttca

SEQ ID NO: 88567 - DNA, 25 bp, Homo sapien
taaggaaaccaattgtgtgatttca

SEQ ID NO: 88568 - DNA, 25 bp, Homo sapien
taaggaaagaagctggttaataaaa

SEQ ID NO: 88569 - DNA, 25 bp, Homo sapien
taaggaaataagctggttaataaaa

SEQ ID NO: 88570 - DNA, 25 bp, Homo sapien
taaggaagaaagtttggtttggtga

SEQ ID NO: 88571 - DNA, 25 bp, Homo sapien
taaggaagacaaaaccaacaacaaa

SEQ ID NO: 88572 - DNA, 25 bp, Homo sapien
taaggaagacaaaagcaacaacaaa

SEQ ID NO: 88573 - DNA, 25 bp, Homo sapien
taaggaagcaagtttggtttggtga

SEQ ID NO: 88574 - DNA, 25 bp, Homo sapien
taaggaagtcatagaggacacttat

SEQ ID NO: 88575 - DNA, 25 bp, Homo sapien
taaggaagtcatagagtacacttat

SEQ ID NO: 88576 - DNA, 25 bp, Homo sapien
taaggaatctattattatcttcatg

SEQ ID NO: 88577 - DNA, 25 bp, Homo sapien
taaggaatctatttttatcttcatg

SEQ ID NO: 88578 - DNA, 25 bp, Homo sapien
taaggacaagaatcgtcaagattga

SEQ ID NO: 88579 - DNA, 25 bp, Homo sapien
taaggacaagaattgtcaagattga

SEQ ID NO: 88580 - DNA, 25 bp, Homo sapien
taaggacaatattagacatctgctt

SEQ ID NO: 88581 - DNA, 25 bp, Homo sapien
taaggacaatattggacatctgctt

SEQ ID NO: 88582 - DNA, 25 bp, Homo sapien
taaggacacatataggctgaaagta

SEQ ID NO: 88583 - DNA, 25 bp, Homo sapien
taaggacacgtataggctgaaagta

SEQ ID NO: 88584 - DNA, 25 bp, Homo sapien
taaggacagaaagtatttgttgttg

SEQ ID NO: 88585 - DNA, 25 bp, Homo sapien
taaggacagaaggtatttgttgttg

SEQ ID NO: 88586 - DNA, 25 bp, Homo sapien
taaggacatgtaaaggaagttggaa

SEQ ID NO: 88587 - DNA, 25 bp, Homo sapien
taaggacatgtgaaggaagttggaa

SEQ ID NO: 88588 - DNA, 25 bp, Homo sapien
taaggactaagacaatgttgtgtac

SEQ ID NO: 88589 - DNA, 25 bp, Homo sapien
taaggactgagacaatgttgtgtac

SEQ ID NO: 88590 - DNA, 25 bp, Homo sapien
taaggagacagacttgccctactct

SEQ ID NO: 88591 - DNA, 25 bp, Homo sapien
taaggagacagatttgccctactct

SEQ ID NO: 88592 - DNA, 25 bp, Homo sapien
taaggagacaggaaacaatacagtc

SEQ ID NO: 88593 - DNA, 25 bp, Homo sapien
taaggagacaggagacaatacagtc

SEQ ID NO: 88594 - DNA, 25 bp, Homo sapien
taaggagataaggactggggtgtgg

SEQ ID NO: 88595 - DNA, 25 bp, Homo sapien
taaggagataatgactggggtgtgg

SEQ ID NO: 88596 - DNA, 25 bp, Homo sapien
taaggagcttcctccttcactgggc

SEQ ID NO: 88597 - DNA, 25 bp, Homo sapien
taaggagcttcctctttcactgggc

SEQ ID NO: 88598 - DNA, 25 bp, Homo sapien
taaggagtagaattaacagaagaca

SEQ ID NO: 88599 - DNA, 25 bp, Homo sapien
taaggagtagagttaacagaagaca

SEQ ID NO: 88600 - DNA, 25 bp, Homo sapien
taaggagtatacattgcacttgatg

SEQ ID NO: 88601 - DNA, 25 bp, Homo sapien
taaggagtatacattggacttgatg

SEQ ID NO: 88602 - DNA, 25 bp, Homo sapien
taaggagtgttgaacctgcattcca

SEQ ID NO: 88603 - DNA, 25 bp, Homo sapien
taaggagtgttgagcctgcattcca

SEQ ID NO: 88604 - DNA, 25 bp, Homo sapien
taaggatcatttttgagtattacgg

SEQ ID NO: 88605 - DNA, 25 bp, Homo sapien
taaggatcgtttttgagtattacgg

SEQ ID NO: 88606 - DNA, 25 bp, Homo sapien
taaggatttttactctagtctctag

SEQ ID NO: 88607 - DNA, 25 bp, Homo sapien
taaggatttttactttagtctctag

SEQ ID NO: 88608 - DNA, 25 bp, Homo sapien
taaggcaaggtttacggccctgagg

SEQ ID NO: 88609 - DNA, 25 bp, Homo sapien
taaggcaaggtttatggccctgagg

SEQ ID NO: 88610 - DNA, 25 bp, Homo sapien
taaggcacatctatgtttaatcttt

SEQ ID NO: 88611 - DNA, 25 bp, Homo sapien
taaggcacctctatgtttaatcttt

SEQ ID NO: 88612 - DNA, 25 bp, Homo sapien
taaggcatcataacttattaacagt

SEQ ID NO: 88613 - DNA, 25 bp, Homo sapien
taaggcatcataagttattaacagt

SEQ ID NO: 88614 - DNA, 25 bp, Homo sapien
taaggcattcttaaatcacaaacaa

SEQ ID NO: 88615 - DNA, 25 bp, Homo sapien
taaggcattcttacatcacaaacaa

SEQ ID NO: 88616 - DNA, 25 bp, Homo sapien
taaggcattgttctacctttcagtg

SEQ ID NO: 88617 - DNA, 25 bp, Homo sapien
taaggcattgttttacctttcagtg

SEQ ID NO: 88618 - DNA, 25 bp, Homo sapien
taaggcccattggcaagggaagaat

SEQ ID NO: 88619 - DNA, 25 bp, Homo sapien
taaggcccattggtaagggaagaat

SEQ ID NO: 88620 - DNA, 25 bp, Homo sapien
taaggccgactctcatgatctcatt

SEQ ID NO: 88621 - DNA, 25 bp, Homo sapien
taaggccgcctctcatgatctcatt

SEQ ID NO: 88622 - DNA, 25 bp, Homo sapien
taaggcctctgaacctatgaatttt

SEQ ID NO: 88623 - DNA, 25 bp, Homo sapien
taaggcctctgaacctgtgaatttt

SEQ ID NO: 88624 - DNA, 25 bp, Homo sapien
taaggcgaaataccacctggtccct

SEQ ID NO: 88625 - DNA, 25 bp, Homo sapien
taaggcgaaataccgcctggtccct

SEQ ID NO: 88626 - DNA, 25 bp, Homo sapien
taaggctaatacctataataacatt

SEQ ID NO: 88627 - DNA, 25 bp, Homo sapien
taaggctaatacgtataataacatt

SEQ ID NO: 88628 - DNA, 25 bp, Homo sapien
taaggctagtgaaaataataggtct

SEQ ID NO: 88629 - DNA, 25 bp, Homo sapien
taaggctagtgaaaatgataggtct

SEQ ID NO: 88630 - DNA, 25 bp, Homo sapien
taaggctcaccatgtcaactaacac

SEQ ID NO: 88631 - DNA, 25 bp, Homo sapien
taaggctcaccgtgtcaactaacac

SEQ ID NO: 88632 - DNA, 25 bp, Homo sapien
taaggctcggcatcctttaacctgt

SEQ ID NO: 88633 - DNA, 25 bp, Homo sapien
taaggctcggcgtcctttaacctgt

SEQ ID NO: 88634 - DNA, 25 bp, Homo sapien
taaggctcttgctggaaaccataat

SEQ ID NO: 88635 - DNA, 25 bp, Homo sapien
taaggctcttgttggaaaccataat

SEQ ID NO: 88636 - DNA, 25 bp, Homo sapien
taaggcttcaacatatgaaattggg

SEQ ID NO: 88637 - DNA, 25 bp, Homo sapien
taaggcttctgagtaccttagcctt

SEQ ID NO: 88638 - DNA, 25 bp, Homo sapien
taaggcttctgagtgccttagcctt

SEQ ID NO: 88639 - DNA, 25 bp, Homo sapien
taaggcttgaacatatgaaattggg

SEQ ID NO: 88640 - DNA, 25 bp, Homo sapien
taagggaaacataacttgcaactaa

SEQ ID NO: 88641 - DNA, 25 bp, Homo sapien
taagggaacattgtttgtaggctgg

SEQ ID NO: 88642 - DNA, 25 bp, Homo sapien
taagggaaccataacttgcaactaa

SEQ ID NO: 88643 - DNA, 25 bp, Homo sapien
taagggaatattgtttgtaggctgg

SEQ ID NO: 88644 - DNA, 25 bp, Homo sapien
taagggaatgcttgctcatatggaa

SEQ ID NO: 88645 - DNA, 25 bp, Homo sapien
taagggaatgcttgttcatatggaa

SEQ ID NO: 88646 - DNA, 25 bp, Homo sapien
taaggggaagaaatagcattattgg

SEQ ID NO: 88647 - DNA, 25 bp, Homo sapien
taaggggaagaagtagcattattgg

SEQ ID NO: 88648 - DNA, 25 bp, Homo sapien
taaggggaataacggcctggctttg

SEQ ID NO: 88649 - DNA, 25 bp, Homo sapien
taaggggaataagggcctggctttg

SEQ ID NO: 88650 - DNA, 25 bp, Homo sapien
taaggggacatgatggattatgaga

SEQ ID NO: 88651 - DNA, 25 bp, Homo sapien
taaggggagatgatggattatgaga

SEQ ID NO: 88652 - DNA, 25 bp, Homo sapien
taagggtatgcttaaattattgcta

SEQ ID NO: 88653 - DNA, 25 bp, Homo sapien
taagggtatgcttcaattattgcta

SEQ ID NO: 88654 - DNA, 25 bp, Homo sapien
taagggtcactttgtaaattatcct

SEQ ID NO: 88655 - DNA, 25 bp, Homo sapien
taagggtcattttgtaaattatcct

SEQ ID NO: 88656 - DNA, 25 bp, Homo sapien
taagggtctaaggtccagaaggtag

SEQ ID NO: 88657 - DNA, 25 bp, Homo sapien
taagggtctaaggtccggaaggtag

SEQ ID NO: 88658 - DNA, 25 bp, Homo sapien
taagggtctataaaagtagaaaaga

SEQ ID NO: 88659 - DNA, 25 bp, Homo sapien
taagggtctgtaaaagtagaaaaga

SEQ ID NO: 88660 - DNA, 25 bp, Homo sapien
taagggtgcatttatctgctgagtg

SEQ ID NO: 88661 - DNA, 25 bp, Homo sapien
taagggtgcatttgtctgctgagtg

SEQ ID NO: 88662 - DNA, 25 bp, Homo sapien
taagggtttcagattaaacattttg

SEQ ID NO: 88663 - DNA, 25 bp, Homo sapien
taagggtttcaggttaaacattttg

SEQ ID NO: 88664 - DNA, 25 bp, Homo sapien
taaggtacagtaacaacatgcctcc

SEQ ID NO: 88665 - DNA, 25 bp, Homo sapien
taaggtacggtaacaacatgcctcc

SEQ ID NO: 88666 - DNA, 25 bp, Homo sapien
taaggtagccagtgagcaccctagg

SEQ ID NO: 88667 - DNA, 25 bp, Homo sapien
taaggtagccagtgaggaccctagg

SEQ ID NO: 88668 - DNA, 25 bp, Homo sapien
taaggtcacaggaaaagatgtcaag

SEQ ID NO: 88669 - DNA, 25 bp, Homo sapien
taaggtcaccggaaaagatgtcaag

SEQ ID NO: 88670 - DNA, 25 bp, Homo sapien
taaggtccagaaggtagtgatccac

SEQ ID NO: 88671 - DNA, 25 bp, Homo sapien
taaggtccgaagagaagttgttctc

SEQ ID NO: 88672 - DNA, 25 bp, Homo sapien
taaggtccggaaggtagtgatccac

SEQ ID NO: 88673 - DNA, 25 bp, Homo sapien
taaggtccggagagaagttgttctc

SEQ ID NO: 88674 - DNA, 25 bp, Homo sapien
taaggtgattgggacgagcttttca

SEQ ID NO: 88675 - DNA, 25 bp, Homo sapien
taaggtgattgggatgagcttttca

SEQ ID NO: 88676 - DNA, 25 bp, Homo sapien
taaggtggttgtccgagtgcccaaa

SEQ ID NO: 88677 - DNA, 25 bp, Homo sapien
taaggtggttgtctgagtgcccaaa

SEQ ID NO: 88678 - DNA, 25 bp, Homo sapien
taaggtttccgactcagatcctggc

SEQ ID NO: 88679 - DNA, 25 bp, Homo sapien
taaggtttctgactcagatcctggc

SEQ ID NO: 88680 - DNA, 25 bp, Homo sapien
taaggttttatcatattgtacatgt

SEQ ID NO: 88681 - DNA, 25 bp, Homo sapien
taaggttttgtcatattgtacatgt

SEQ ID NO: 88682 - DNA, 25 bp, Homo sapien
taagtaaaaaataatctgggcatcc

SEQ ID NO: 88683 - DNA, 25 bp, Homo sapien
taagtaaaatataatctgggcatcc

SEQ ID NO: 88684 - DNA, 25 bp, Homo sapien
taagtaaactctggccccagaacaa

SEQ ID NO: 88685 - DNA, 25 bp, Homo sapien
taagtaaactctgggcccagaacaa

SEQ ID NO: 88686 - DNA, 25 bp, Homo sapien
taagtaagaatgaatatagtccatc

SEQ ID NO: 88687 - DNA, 25 bp, Homo sapien
taagtaagaatgcatatagtccatc

SEQ ID NO: 88688 - DNA, 25 bp, Homo sapien
taagtaataaaaccaagacttgaac

SEQ ID NO: 88689 - DNA, 25 bp, Homo sapien
taagtaataaaaccgagacttgaac

SEQ ID NO: 88690 - DNA, 25 bp, Homo sapien
taagtaataagagtcacaaccacta

SEQ ID NO: 88691 - DNA, 25 bp, Homo sapien
taagtaataagagtgacaaccacta

SEQ ID NO: 88692 - DNA, 25 bp, Homo sapien
taagtaattcaatggaaacatacct

SEQ ID NO: 88693 - DNA, 25 bp, Homo sapien
taagtaattcagtggaaacatacct

SEQ ID NO: 88694 - DNA, 25 bp, Homo sapien
taagtacaggcaactaaagaatgat

SEQ ID NO: 88695 - DNA, 25 bp, Homo sapien
taagtacaggcagctaaagaatgat

SEQ ID NO: 88696 - DNA, 25 bp, Homo sapien
taagtactgggatagactgataata

SEQ ID NO: 88697 - DNA, 25 bp, Homo sapien
taagtactggggtagactgataata

SEQ ID NO: 88698 - DNA, 25 bp, Homo sapien
taagtactttttagcagttaagtcc

SEQ ID NO: 88699 - DNA, 25 bp, Homo sapien
taagtactttttcgcagttaagtcc

SEQ ID NO: 88700 - DNA, 25 bp, Homo sapien
taagtagacaataacaaaatcaagg

SEQ ID NO: 88701 - DNA, 25 bp, Homo sapien
taagtagacaataacagaatcaagg

SEQ ID NO: 88702 - DNA, 25 bp, Homo sapien
taagtagtactccattttatgaata

SEQ ID NO: 88703 - DNA, 25 bp, Homo sapien
taagtagtattccattttatgaata

SEQ ID NO: 88704 - DNA, 25 bp, Homo sapien
taagtagtcagaccggaaatgtact

SEQ ID NO: 88705 - DNA, 25 bp, Homo sapien
taagtagtcagactggaaatgtact

SEQ ID NO: 88706 - DNA, 25 bp, Homo sapien
taagtatggtaccaagaagaaatat

SEQ ID NO: 88707 - DNA, 25 bp, Homo sapien
taagtatggtacccagaagaaatat

SEQ ID NO: 88708 - DNA, 25 bp, Homo sapien
taagtattgaggcttctcaggcaat

SEQ ID NO: 88709 - DNA, 25 bp, Homo sapien
taagtattgaggtttctcaggcaat

SEQ ID NO: 88710 - DNA, 25 bp, Homo sapien
taagtattgtattagtttcctcttg

SEQ ID NO: 88711 - DNA, 25 bp, Homo sapien
taagtattgtattcgtttcctcttg

SEQ ID NO: 88712 - DNA, 25 bp, Homo sapien
taagtcaagtatataatgacaaaaa

SEQ ID NO: 88713 - DNA, 25 bp, Homo sapien
taagtcaagtatgtaatgacaaaaa

SEQ ID NO: 88714 - DNA, 25 bp, Homo sapien
taagtcagaccaaggctggcccatg

SEQ ID NO: 88715 - DNA, 25 bp, Homo sapien
taagtcagaccgaggctggcccatg

SEQ ID NO: 88716 - DNA, 25 bp, Homo sapien
taagtcagagtttcagctgtaagac

SEQ ID NO: 88717 - DNA, 25 bp, Homo sapien
taagtcagtgtttcagctgtaagac

SEQ ID NO: 88718 - DNA, 25 bp, Homo sapien
taagtccaaattccccatcagttca

SEQ ID NO: 88719 - DNA, 25 bp, Homo sapien
taagtccaacagggaaaaactctga

SEQ ID NO: 88720 - DNA, 25 bp, Homo sapien
taagtccaacagggaacaactctga

SEQ ID NO: 88721 - DNA, 25 bp, Homo sapien
taagtccaatgttactttgctaatt

SEQ ID NO: 88722 - DNA, 25 bp, Homo sapien
taagtccaatgttagtttgctaatt

SEQ ID NO: 88723 - DNA, 25 bp, Homo sapien
taagtccagattccccatcagttca

SEQ ID NO: 88724 - DNA, 25 bp, Homo sapien
taagtctaataaagcgtggacatgt

SEQ ID NO: 88725 - DNA, 25 bp, Homo sapien
taagtctagtaaagcgtggacatgt

SEQ ID NO: 88726 - DNA, 25 bp, Homo sapien
taagtctctccctatgtgtcagcct

SEQ ID NO: 88727 - DNA, 25 bp, Homo sapien
taagtctctccctgtgtgtcagcct

SEQ ID NO: 88728 - DNA, 25 bp, Homo sapien
taagtctttaccaactcagtcaatg

SEQ ID NO: 88729 - DNA, 25 bp, Homo sapien
taagtctttaccaattcagtcaatg

SEQ ID NO: 88730 - DNA, 25 bp, Homo sapien
taagtctttcttactaccattcctc

SEQ ID NO: 88731 - DNA, 25 bp, Homo sapien
taagtctttcttactatcattcctc

SEQ ID NO: 88732 - DNA, 25 bp, Homo sapien
taagtgaacaagcgagattttaata

SEQ ID NO: 88733 - DNA, 25 bp, Homo sapien
taagtgaacaagtgagattttaata

SEQ ID NO: 88734 - DNA, 25 bp, Homo sapien
taagtgaactgaaagctcagtccaa

SEQ ID NO: 88735 - DNA, 25 bp, Homo sapien
taagtgaactgaatgctcagtccaa

SEQ ID NO: 88736 - DNA, 25 bp, Homo sapien
taagtgaattagaagttttagagca

SEQ ID NO: 88737 - DNA, 25 bp, Homo sapien
taagtgaattagcagttttagagca

SEQ ID NO: 88738 - DNA, 25 bp, Homo sapien
taagtgacctacactggagtcctga

SEQ ID NO: 88739 - DNA, 25 bp, Homo sapien
taagtgacctacattggagtcctga

SEQ ID NO: 88740 - DNA, 25 bp, Homo sapien
taagtgagagcccggagaagtatct

SEQ ID NO: 88741 - DNA, 25 bp, Homo sapien
taagtgagagcctggagaagtatct

SEQ ID NO: 88742 - DNA, 25 bp, Homo sapien
taagtgagatgacgtaaatagttta

SEQ ID NO: 88743 - DNA, 25 bp, Homo sapien
taagtgagatgatgtaaatagttta

SEQ ID NO: 88744 - DNA, 25 bp, Homo sapien
taagtgagtaaactctatctagctc

SEQ ID NO: 88745 - DNA, 25 bp, Homo sapien
taagtgagtaaattctatctagctc

SEQ ID NO: 88746 - DNA, 25 bp, Homo sapien
taagtgatgaggacctagatttgac

SEQ ID NO: 88747 - DNA, 25 bp, Homo sapien
taagtgatgaggacttagatttgac

SEQ ID NO: 88748 - DNA, 25 bp, Homo sapien
taagtgcacacaagacattcaaata

SEQ ID NO: 88749 - DNA, 25 bp, Homo sapien
taagtgcacacgagacattcaaata

SEQ ID NO: 88750 - DNA, 25 bp, Homo sapien
taagtgcactaactgaacacttgca

SEQ ID NO: 88751 - DNA, 25 bp, Homo sapien
taagtgcactaactgagcacttgca

SEQ ID NO: 88752 - DNA, 25 bp, Homo sapien
taagtgccaggacatggagaaacaa

SEQ ID NO: 88753 - DNA, 25 bp, Homo sapien
taagtgccaggacctggagaaacaa

SEQ ID NO: 88754 - DNA, 25 bp, Homo sapien
taagtgctgtaatgaaaagaaagag

SEQ ID NO: 88755 - DNA, 25 bp, Homo sapien
taagtgctgtattgaaaagaaagag

SEQ ID NO: 88756 - DNA, 25 bp, Homo sapien
taagtggaaaccacaagcctcccac

SEQ ID NO: 88757 - DNA, 25 bp, Homo sapien
taagtggaatccacaagcctcccac

SEQ ID NO: 88758 - DNA, 25 bp, Homo sapien
taagtggattgactgtggtcagagc

SEQ ID NO: 88759 - DNA, 25 bp, Homo sapien
taagtggattgactgttgtcagagc

SEQ ID NO: 88760 - DNA, 25 bp, Homo sapien
taagtggtacagctatcattagaaa

SEQ ID NO: 88761 - DNA, 25 bp, Homo sapien
taagtggtacagttatcattagaaa

SEQ ID NO: 88762 - DNA, 25 bp, Homo sapien
taagtggtacatcagtgacctctgg

SEQ ID NO: 88763 - DNA, 25 bp, Homo sapien
taagtggtatatcagtgacctctgg

SEQ ID NO: 88764 - DNA, 25 bp, Homo sapien
taagtgtaaacttagccggaaagcc

SEQ ID NO: 88765 - DNA, 25 bp, Homo sapien
taagtgtaaacttagctggaaagcc

SEQ ID NO: 88766 - DNA, 25 bp, Homo sapien
taagtgtaagccaacgattttatac

SEQ ID NO: 88767 - DNA, 25 bp, Homo sapien
taagtgtaagccaatgattttatac

SEQ ID NO: 88768 - DNA, 25 bp, Homo sapien
taagtgtacaagtcaacggaatata

SEQ ID NO: 88769 - DNA, 25 bp, Homo sapien
taagtgtacaagtcaatggaatata

SEQ ID NO: 88770 - DNA, 25 bp, Homo sapien
taagtgtccaacatgcattctctca

SEQ ID NO: 88771 - DNA, 25 bp, Homo sapien
taagtgtccaacgtgcattctctca

SEQ ID NO: 88772 - DNA, 25 bp, Homo sapien
taagtgtccaggagctggctgagta

SEQ ID NO: 88773 - DNA, 25 bp, Homo sapien
taagtgtccaggcgctggctgagta

SEQ ID NO: 88774 - DNA, 25 bp, Homo sapien
taagtgtttcatctagtgtggaaat

SEQ ID NO: 88775 - DNA, 25 bp, Homo sapien
taagtgtttcatttagtgtggaaat

SEQ ID NO: 88776 - DNA, 25 bp, Homo sapien
taagttacatatacatggcgattaa

SEQ ID NO: 88777 - DNA, 25 bp, Homo sapien
taagttacgtatacatggcgattaa

SEQ ID NO: 88778 - DNA, 25 bp, Homo sapien
taagttagctacccaatgacaaggt

SEQ ID NO: 88779 - DNA, 25 bp, Homo sapien
taagttagctactcaatgacaaggt

SEQ ID NO: 88780 - DNA, 25 bp, Homo sapien
taagttataatatccctaagctgaa

SEQ ID NO: 88781 - DNA, 25 bp, Homo sapien
taagttataatttccctaagctgaa

SEQ ID NO: 88782 - DNA, 25 bp, Homo sapien
taagttattgcacatgagataaaga

SEQ ID NO: 88783 - DNA, 25 bp, Homo sapien
taagttattgcacgtgagataaaga

SEQ ID NO: 88784 - DNA, 25 bp, Homo sapien
taagttcaaatcccagtggcatcta

SEQ ID NO: 88785 - DNA, 25 bp, Homo sapien
taagttcaaatcccggtggcatcta

SEQ ID NO: 88786 - DNA, 25 bp, Homo sapien
taagttcaaggttaatttgatatgt

SEQ ID NO: 88787 - DNA, 25 bp, Homo sapien
taagttcaaggttattttgatatgt

SEQ ID NO: 88788 - DNA, 25 bp, Homo sapien
taagttcatcaaaatagccagggaa

SEQ ID NO: 88789 - DNA, 25 bp, Homo sapien
taagttcatcaaagtagccagggaa

SEQ ID NO: 88790 - DNA, 25 bp, Homo sapien
taagttctgccatcctgaggctaat

SEQ ID NO: 88791 - DNA, 25 bp, Homo sapien
taagttctgccatcttgaggctaat

SEQ ID NO: 88792 - DNA, 25 bp, Homo sapien
taagttgaaccacttttgcatcact

SEQ ID NO: 88793 - DNA, 25 bp, Homo sapien
taagttgaaccatttttgcatcact

SEQ ID NO: 88794 - DNA, 25 bp, Homo sapien
taagttgcacttgaattttgaaata

SEQ ID NO: 88795 - DNA, 25 bp, Homo sapien
taagttgcatttgaattttgaaata

SEQ ID NO: 88796 - DNA, 25 bp, Homo sapien
taagttgttctctaacattccaagg

SEQ ID NO: 88797 - DNA, 25 bp, Homo sapien
taagttgttgtctaacattccaagg

SEQ ID NO: 88798 - DNA, 25 bp, Homo sapien
taagtttcctgtaacgccagccagg

SEQ ID NO: 88799 - DNA, 25 bp, Homo sapien
taagtttcctgtaatgccagccagg

SEQ ID NO: 88800 - DNA, 25 bp, Homo sapien
taagtttctcattcctctggctctg

SEQ ID NO: 88801 - DNA, 25 bp, Homo sapien
taagtttctcatttctctggctctg

SEQ ID NO: 88802 - DNA, 25 bp, Homo sapien
taagtttgaaaaatgtcttaacagc

SEQ ID NO: 88803 - DNA, 25 bp, Homo sapien
taagtttgagaaatgtcttaacagc

SEQ ID NO: 88804 - DNA, 25 bp, Homo sapien
taagttttgaacagaatctaagtgt

SEQ ID NO: 88805 - DNA, 25 bp, Homo sapien
taagttttgaatagaatctaagtgt

SEQ ID NO: 88806 - DNA, 25 bp, Homo sapien
taagttttgctggttttcctagtca

SEQ ID NO: 88807 - DNA, 25 bp, Homo sapien
taagttttgttggttttcctagtca

SEQ ID NO: 88808 - DNA, 25 bp, Homo sapien
taataaaacaaaaagatgcatagat

SEQ ID NO: 88809 - DNA, 25 bp, Homo sapien
taataaaacaaagagatgcatagat

SEQ ID NO: 88810 - DNA, 25 bp, Homo sapien
taataaaacaattgcactttgcctc

SEQ ID NO: 88811 - DNA, 25 bp, Homo sapien
taataaaacgattgcactttgcctc

SEQ ID NO: 88812 - DNA, 25 bp, Homo sapien
taataaacaggctgcgaatctgtgt

SEQ ID NO: 88813 - DNA, 25 bp, Homo sapien
taataaacaggctgtgaatctgtgt

SEQ ID NO: 88814 - DNA, 25 bp, Homo sapien
taataaagaagataatagagaagct

SEQ ID NO: 88815 - DNA, 25 bp, Homo sapien
taataaagaaggtaatagagaagct

SEQ ID NO: 88816 - DNA, 25 bp, Homo sapien
taataaagactaaataagtagtgtc

SEQ ID NO: 88817 - DNA, 25 bp, Homo sapien
taataaagactaagtaagtagtgtc

SEQ ID NO: 88818 - DNA, 25 bp, Homo sapien
taataaagaggaatagctacagtgg

SEQ ID NO: 88819 - DNA, 25 bp, Homo sapien
taataaagaggagtagctacagtgg

SEQ ID NO: 88820 - DNA, 25 bp, Homo sapien
taataaagcccaattgagagagaaa

SEQ ID NO: 88821 - DNA, 25 bp, Homo sapien
taataaagcccgattgagagagaaa

SEQ ID NO: 88822 - DNA, 25 bp, Homo sapien
taataaataaaacgactgttgaaag

SEQ ID NO: 88823 - DNA, 25 bp, Homo sapien
taataaataaaatgactgttgaaag

SEQ ID NO: 88824 - DNA, 25 bp, Homo sapien
taataaatatgtcatggagaagtaa

SEQ ID NO: 88825 - DNA, 25 bp, Homo sapien
taataaatatgtgatggagaagtaa

SEQ ID NO: 88826 - DNA, 25 bp, Homo sapien
taataaatcttgacgaaaactttct

SEQ ID NO: 88827 - DNA, 25 bp, Homo sapien
taataaatcttgatgaaaactttct

SEQ ID NO: 88828 - DNA, 25 bp, Homo sapien
taataaatgcggacagactaggtat

SEQ ID NO: 88829 - DNA, 25 bp, Homo sapien
taataaatgtggacagactaggtat

SEQ ID NO: 88830 - DNA, 25 bp, Homo sapien
taataaatttcctatcatttacacc

SEQ ID NO: 88831 - DNA, 25 bp, Homo sapien
taataaatttcttatcatttacacc

SEQ ID NO: 88832 - DNA, 25 bp, Homo sapien
taataaatttggcggacataggcaa

SEQ ID NO: 88833 - DNA, 25 bp, Homo sapien
taataaatttggtggacataggcaa

SEQ ID NO: 88834 - DNA, 25 bp, Homo sapien
taataacatgacaccagttttcaga

SEQ ID NO: 88835 - DNA, 25 bp, Homo sapien
taataacatgacactagttttcaga

SEQ ID NO: 88836 - DNA, 25 bp, Homo sapien
taataaccataacatctacgaacag

SEQ ID NO: 88837 - DNA, 25 bp, Homo sapien
taataaccataacgtctacgaacag

SEQ ID NO: 88838 - DNA, 25 bp, Homo sapien
taataacgtggtgtatctgttctta

SEQ ID NO: 88839 - DNA, 25 bp, Homo sapien
taataacgtggtgtgtctgttctta

SEQ ID NO: 88840 - DNA, 25 bp, Homo sapien
taataactaacacaccggaacgcaa

SEQ ID NO: 88841 - DNA, 25 bp, Homo sapien
taataactaacataccggaacgcaa

SEQ ID NO: 88842 - DNA, 25 bp, Homo sapien
taataacttggcacctatttatata

SEQ ID NO: 88843 - DNA, 25 bp, Homo sapien
taataacttggcacgtatttatata

SEQ ID NO: 88844 - DNA, 25 bp, Homo sapien
taataagaagtctcccatcaaagaa

SEQ ID NO: 88845 - DNA, 25 bp, Homo sapien
taataagaagtctcccgtcaaagaa

SEQ ID NO: 88846 - DNA, 25 bp, Homo sapien
taataagacactcaccgtaaagatc

SEQ ID NO: 88847 - DNA, 25 bp, Homo sapien
taataagacactcatcgtaaagatc

SEQ ID NO: 88848 - DNA, 25 bp, Homo sapien
taataagcagtaaagatggaatcag

SEQ ID NO: 88849 - DNA, 25 bp, Homo sapien
taataagcagtacagatggaatcag

SEQ ID NO: 88850 - DNA, 25 bp, Homo sapien
taataatacacagagtggaaaaaac

SEQ ID NO: 88851 - DNA, 25 bp, Homo sapien
taataataccgtgttagatgcaaat

SEQ ID NO: 88852 - DNA, 25 bp, Homo sapien
taataataccgttttagatgcaaat

SEQ ID NO: 88853 - DNA, 25 bp, Homo sapien
taataatacctacacccaaagattg

SEQ ID NO: 88854 - DNA, 25 bp, Homo sapien
taataatacctatacccaaagattg

SEQ ID NO: 88855 - DNA, 25 bp, Homo sapien
taataatatacagagtggaaaaaac

SEQ ID NO: 88856 - DNA, 25 bp, Homo sapien
taataatcaatactttggctgcttg

SEQ ID NO: 88857 - DNA, 25 bp, Homo sapien
taataatcaatcctttggctgcttg

SEQ ID NO: 88858 - DNA, 25 bp, Homo sapien
taataatcagctgatagcacaggat

SEQ ID NO: 88859 - DNA, 25 bp, Homo sapien
taataatcagcttatagcacaggat

SEQ ID NO: 88860 - DNA, 25 bp, Homo sapien
taataatgacattaatccattcatg

SEQ ID NO: 88861 - DNA, 25 bp, Homo sapien
taataatgacattagtccattcatg

SEQ ID NO: 88862 - DNA, 25 bp, Homo sapien
taataatgagtatgccctaaaattg

SEQ ID NO: 88863 - DNA, 25 bp, Homo sapien
taataatgagtatgccttaaaattg

SEQ ID NO: 88864 - DNA, 25 bp, Homo sapien
taataatgcgtatgaagcgatttct

SEQ ID NO: 88865 - DNA, 25 bp, Homo sapien
taataatgtatcaccctgaattgct

SEQ ID NO: 88866 - DNA, 25 bp, Homo sapien
taataatgtatcactctgaattgct

SEQ ID NO: 88867 - DNA, 25 bp, Homo sapien
taataatgtgtatgaagcgatttct

SEQ ID NO: 88868 - DNA, 25 bp, Homo sapien
taatacaaatctagcttccgaaagc

SEQ ID NO: 88869 - DNA, 25 bp, Homo sapien
taatacaaatctagtttccgaaagc

SEQ ID NO: 88870 - DNA, 25 bp, Homo sapien
taatacactacaattgagcacattt

SEQ ID NO: 88871 - DNA, 25 bp, Homo sapien
taatacactacagttgagcacattt

SEQ ID NO: 88872 - DNA, 25 bp, Homo sapien
taatacagcagatactatgatatcc

SEQ ID NO: 88873 - DNA, 25 bp, Homo sapien
taatacagcagatactctgatatcc

SEQ ID NO: 88874 - DNA, 25 bp, Homo sapien
taatacagccacctgctaaaggagg

SEQ ID NO: 88875 - DNA, 25 bp, Homo sapien
taatacagccatctgctaaaggagg

SEQ ID NO: 88876 - DNA, 25 bp, Homo sapien
taatacatttcatctttcataatct

SEQ ID NO: 88877 - DNA, 25 bp, Homo sapien
taatacatttcctgttgtggaagca

SEQ ID NO: 88878 - DNA, 25 bp, Homo sapien
taatacatttccttttgtggaagca

SEQ ID NO: 88879 - DNA, 25 bp, Homo sapien
taatacatttcgtctttcataatct

SEQ ID NO: 88880 - DNA, 25 bp, Homo sapien
taataccaaccatactcaaactact

SEQ ID NO: 88881 - DNA, 25 bp, Homo sapien
taataccaaccgtactcaaactact

SEQ ID NO: 88882 - DNA, 25 bp, Homo sapien
taataccaacgatggggagtggctg

SEQ ID NO: 88883 - DNA, 25 bp, Homo sapien
taataccaatgatggggagtggctg

SEQ ID NO: 88884 - DNA, 25 bp, Homo sapien
taataccgctgaaccaactcattca

SEQ ID NO: 88885 - DNA, 25 bp, Homo sapien
taataccgctgaatcaactcattca

SEQ ID NO: 88886 - DNA, 25 bp, Homo sapien
taataccgtgttagatgcaaatggc

SEQ ID NO: 88887 - DNA, 25 bp, Homo sapien
taataccgttttagatgcaaatggc

SEQ ID NO: 88888 - DNA, 25 bp, Homo sapien
taatacctaatataatgtctgatac

SEQ ID NO: 88889 - DNA, 25 bp, Homo sapien
taatacctaatgtaatgtctgatac

SEQ ID NO: 88890 - DNA, 25 bp, Homo sapien
taatacctacacccaaagattgtgg

SEQ ID NO: 88891 - DNA, 25 bp, Homo sapien
taatacctatacccaaagattgtgg

SEQ ID NO: 88892 - DNA, 25 bp, Homo sapien
taatacctgatgacctaatcttttt

SEQ ID NO: 88893 - DNA, 25 bp, Homo sapien
taatacctgatgacgtaatcttttt

SEQ ID NO: 88894 - DNA, 25 bp, Homo sapien
taatacgatgaaaaccaaggattca

SEQ ID NO: 88895 - DNA, 25 bp, Homo sapien
taatacgatgaaaagcaaggattca

SEQ ID NO: 88896 - DNA, 25 bp, Homo sapien
taatacggacatgttctgaaattct

SEQ ID NO: 88897 - DNA, 25 bp, Homo sapien
taatacggatatgttctgaaattct

SEQ ID NO: 88898 - DNA, 25 bp, Homo sapien
taatactatgtggcaacaaatggtg

SEQ ID NO: 88899 - DNA, 25 bp, Homo sapien
taatactatgtggcaataaatggtg

SEQ ID NO: 88900 - DNA, 25 bp, Homo sapien
taatactattcataacaaccctcaa

SEQ ID NO: 88901 - DNA, 25 bp, Homo sapien
taatactattcctaacaaccctcaa

SEQ ID NO: 88902 - DNA, 25 bp, Homo sapien
taatactggaaagttcctaaaacac

SEQ ID NO: 88903 - DNA, 25 bp, Homo sapien
taatactgggaagttcctaaaacac

SEQ ID NO: 88904 - DNA, 25 bp, Homo sapien
taatactttcaggaagaaacaacaa

SEQ ID NO: 88905 - DNA, 25 bp, Homo sapien
taatactttcaggcccaacaatact

SEQ ID NO: 88906 - DNA, 25 bp, Homo sapien
taatactttcaggtccaacaatact

SEQ ID NO: 88907 - DNA, 25 bp, Homo sapien
taatactttgaggaagaaacaacaa

SEQ ID NO: 88908 - DNA, 25 bp, Homo sapien
taatagaaacttacacccattgatt

SEQ ID NO: 88909 - DNA, 25 bp, Homo sapien
taatagaaacttacgcccattgatt

SEQ ID NO: 88910 - DNA, 25 bp, Homo sapien
taatagaattcaggaactcagttga

SEQ ID NO: 88911 - DNA, 25 bp, Homo sapien
taatagaattcaggtactcagttga

SEQ ID NO: 88912 - DNA, 25 bp, Homo sapien
taatagagcctacataaattagagt

SEQ ID NO: 88913 - DNA, 25 bp, Homo sapien
taatagagcctacctaaattagagt

SEQ ID NO: 88914 - DNA, 25 bp, Homo sapien
taatagagttcaaaaaaatcaagat

SEQ ID NO: 88915 - DNA, 25 bp, Homo sapien
taatagagttcaaagaaatcaagat

SEQ ID NO: 88916 - DNA, 25 bp, Homo sapien
taatagcacaaacatcaaatcagag

SEQ ID NO: 88917 - DNA, 25 bp, Homo sapien
taatagcacccctagcatatcttga

SEQ ID NO: 88918 - DNA, 25 bp, Homo sapien
taatagcacgaacatcaaatcagag

SEQ ID NO: 88919 - DNA, 25 bp, Homo sapien
taatagcatccctagcatatcttga

SEQ ID NO: 88920 - DNA, 25 bp, Homo sapien
taatagccatggcatattgtagtcc

SEQ ID NO: 88921 - DNA, 25 bp, Homo sapien
taatagccatggcgtattgtagtcc

SEQ ID NO: 88922 - DNA, 25 bp, Homo sapien
taatagccgtataaaggagttgggc

SEQ ID NO: 88923 - DNA, 25 bp, Homo sapien
taatagccgtatgaaggagttgggc

SEQ ID NO: 88924 - DNA, 25 bp, Homo sapien
taatagcttcaacataaaagtccag

SEQ ID NO: 88925 - DNA, 25 bp, Homo sapien
taatagcttcaacgtaaaagtccag

SEQ ID NO: 88926 - DNA, 25 bp, Homo sapien
taataggacagaactatcattcaat

SEQ ID NO: 88927 - DNA, 25 bp, Homo sapien
taataggacagaagtatcattcaat

SEQ ID NO: 88928 - DNA, 25 bp, Homo sapien
taataggcaatccttttgtgtgtgt

SEQ ID NO: 88929 - DNA, 25 bp, Homo sapien
taataggcaattcttttgtgtgtgt

SEQ ID NO: 88930 - DNA, 25 bp, Homo sapien
taataggctctgatatagctctcac

SEQ ID NO: 88931 - DNA, 25 bp, Homo sapien
taataggctctgatgtagctctcac

SEQ ID NO: 88932 - DNA, 25 bp, Homo sapien
taataggtgcgttgaagggatcagc

SEQ ID NO: 88933 - DNA, 25 bp, Homo sapien
taataggtgtgttgaagggatcagc

SEQ ID NO: 88934 - DNA, 25 bp, Homo sapien
taatagtaaagtcggagttctttgg

SEQ ID NO: 88935 - DNA, 25 bp, Homo sapien
taatagtaaagttggagttctttgg

SEQ ID NO: 88936 - DNA, 25 bp, Homo sapien
taatagtagcggcctacaaatctgt

SEQ ID NO: 88937 - DNA, 25 bp, Homo sapien
taatagtaggaataaaaccaaaaaa

SEQ ID NO: 88938 - DNA, 25 bp, Homo sapien
taatagtaggaataaagccaaaaaa

SEQ ID NO: 88939 - DNA, 25 bp, Homo sapien
taatagtagtggcctacaaatctgt

SEQ ID NO: 88940 - DNA, 25 bp, Homo sapien
taatagtgaaaatatgacttgatgt

SEQ ID NO: 88941 - DNA, 25 bp, Homo sapien
taatagtgacaagctaataaaaaac

SEQ ID NO: 88942 - DNA, 25 bp, Homo sapien
taatagtggaaatatgacttgatgt

SEQ ID NO: 88943 - DNA, 25 bp, Homo sapien
taatagtggcaagctaataaaaaac

SEQ ID NO: 88944 - DNA, 25 bp, Homo sapien
taatagttctctgtacccctgaaaa

SEQ ID NO: 88945 - DNA, 25 bp, Homo sapien
taatagttctctgtactcctgaaaa

SEQ ID NO: 88946 - DNA, 25 bp, Homo sapien
taatagttgtggacaagttttattc

SEQ ID NO: 88947 - DNA, 25 bp, Homo sapien
taatagttgtggagaagttttattc

SEQ ID NO: 88948 - DNA, 25 bp, Homo sapien
taatataacattgtttgtgacactc

SEQ ID NO: 88949 - DNA, 25 bp, Homo sapien
taatataatattgtttgtgacactc

SEQ ID NO: 88950 - DNA, 25 bp, Homo sapien
taatatacggttagtgtgtgagtag

SEQ ID NO: 88951 - DNA, 25 bp, Homo sapien
taatatactgttagtgtgtgagtag

SEQ ID NO: 88952 - DNA, 25 bp, Homo sapien
taatatagattccaaatttctcctc

SEQ ID NO: 88953 - DNA, 25 bp, Homo sapien
taatatagattctaaatttctcctc

SEQ ID NO: 88954 - DNA, 25 bp, Homo sapien
taatatagtaacaagttctgggaat

SEQ ID NO: 88955 - DNA, 25 bp, Homo sapien
taatatagtaacaggttctgggaat

SEQ ID NO: 88956 - DNA, 25 bp, Homo sapien
taatatattcagcattattcaagca

SEQ ID NO: 88957 - DNA, 25 bp, Homo sapien
taatatattcagcattgttcaagca

SEQ ID NO: 88958 - DNA, 25 bp, Homo sapien
taatatattccaatgcaatcctagc

SEQ ID NO: 88959 - DNA, 25 bp, Homo sapien
taatatattccagtgcaatcctagc

SEQ ID NO: 88960 - DNA, 25 bp, Homo sapien
taatatcagttataaggactagatt

SEQ ID NO: 88961 - DNA, 25 bp, Homo sapien
taatatcagttttaaggactagatt

SEQ ID NO: 88962 - DNA, 25 bp, Homo sapien
taatatcatcctcattattatcatt

SEQ ID NO: 88963 - DNA, 25 bp, Homo sapien
taatatcatcctcgttattatcatt

SEQ ID NO: 88964 - DNA, 25 bp, Homo sapien
taatatccagaaagggtaaaagttg

SEQ ID NO: 88965 - DNA, 25 bp, Homo sapien
taatatccataagcaaaatcaaaaa

SEQ ID NO: 88966 - DNA, 25 bp, Homo sapien
taatatcccatgcgtacttgcctaa

SEQ ID NO: 88967 - DNA, 25 bp, Homo sapien
taatatcccatgtgtacttgcctaa

SEQ ID NO: 88968 - DNA, 25 bp, Homo sapien
taatatcccttcaccatcattgttc

SEQ ID NO: 88969 - DNA, 25 bp, Homo sapien
taatatcccttcgccatcattgttc

SEQ ID NO: 88970 - DNA, 25 bp, Homo sapien
taatatccgtaagcaaaatcaaaaa

SEQ ID NO: 88971 - DNA, 25 bp, Homo sapien
taatatcctgaaagggtaaaagttg

SEQ ID NO: 88972 - DNA, 25 bp, Homo sapien
taatatcgccggctgtttacataca

SEQ ID NO: 88973 - DNA, 25 bp, Homo sapien
taatatcgctggctgtttacataca

SEQ ID NO: 88974 - DNA, 25 bp, Homo sapien
taatatgacagacggtaagaaaata

SEQ ID NO: 88975 - DNA, 25 bp, Homo sapien
taatatgacagagggtaagaaaata

SEQ ID NO: 88976 - DNA, 25 bp, Homo sapien
taatatgatctaacgggacttaatt

SEQ ID NO: 88977 - DNA, 25 bp, Homo sapien
taatatgatctaatgggacttaatt

SEQ ID NO: 88978 - DNA, 25 bp, Homo sapien
taatatgcaactctctaatggctaa

SEQ ID NO: 88979 - DNA, 25 bp, Homo sapien
taatatgcaactctttaatggctaa

SEQ ID NO: 88980 - DNA, 25 bp, Homo sapien
taatatgcattctttactaagcggt

SEQ ID NO: 88981 - DNA, 25 bp, Homo sapien
taatatgcattctttagtaagcggt

SEQ ID NO: 88982 - DNA, 25 bp, Homo sapien
taatatgctatcgtgaacatctggt

SEQ ID NO: 88983 - DNA, 25 bp, Homo sapien
taatatgctgtcgtgaacatctggt

SEQ ID NO: 88984 - DNA, 25 bp, Homo sapien
taatatgtggtctgtaatgactgac

SEQ ID NO: 88985 - DNA, 25 bp, Homo sapien
taatatgtggtctgtagtgactgac

SEQ ID NO: 88986 - DNA, 25 bp, Homo sapien
taatattaagaggctttatacactt

SEQ ID NO: 88987 - DNA, 25 bp, Homo sapien
taatattaagatgctttatacactt

SEQ ID NO: 88988 - DNA, 25 bp, Homo sapien
taatattacataacatgaggtcaaa

SEQ ID NO: 88989 - DNA, 25 bp, Homo sapien
taatattacgcaccatttgtgagca

SEQ ID NO: 88990 - DNA, 25 bp, Homo sapien
taatattacgtaacatgaggtcaaa

SEQ ID NO: 88991 - DNA, 25 bp, Homo sapien
taatattatgcaccatttgtgagca

SEQ ID NO: 88992 - DNA, 25 bp, Homo sapien
taatattctatccgaaagaccttgg

SEQ ID NO: 88993 - DNA, 25 bp, Homo sapien
taatattctatctgaaagaccttgg

SEQ ID NO: 88994 - DNA, 25 bp, Homo sapien
taatattctgcctattgctctccat

SEQ ID NO: 88995 - DNA, 25 bp, Homo sapien
taatattctgcgtattgctctccat

SEQ ID NO: 88996 - DNA, 25 bp, Homo sapien
taatattgaggcctttttatctgag

SEQ ID NO: 88997 - DNA, 25 bp, Homo sapien
taatattgagggctttttatctgag

SEQ ID NO: 88998 - DNA, 25 bp, Homo sapien
taatatttccaacgtgactctacca

SEQ ID NO: 88999 - DNA, 25 bp, Homo sapien
taatatttccaatgtgactctacca

SEQ ID NO: 89000 - DNA, 25 bp, Homo sapien
taatatttcctgacatgtgaacatt

SEQ ID NO: 89001 - DNA, 25 bp, Homo sapien
taatattttctgacatgtgaacatt

SEQ ID NO: 89002 - DNA, 25 bp, Homo sapien
taatcaaaccaacaagcatttattg

SEQ ID NO: 89003 - DNA, 25 bp, Homo sapien
taatcaaactgacagaaactaaagc

SEQ ID NO: 89004 - DNA, 25 bp, Homo sapien
taatcaaatcaacaagcatttattg

SEQ ID NO: 89005 - DNA, 25 bp, Homo sapien
taatcaaattgacagaaactaaagc

SEQ ID NO: 89006 - DNA, 25 bp, Homo sapien
taatcaaccagacatcacaaaccag

SEQ ID NO: 89007 - DNA, 25 bp, Homo sapien
taatcaaccagacatcgcaaaccag

SEQ ID NO: 89008 - DNA, 25 bp, Homo sapien
taatcaatcccagacgtttaaccct

SEQ ID NO: 89009 - DNA, 25 bp, Homo sapien
taatcaatcccagatgtttaaccct

SEQ ID NO: 89010 - DNA, 25 bp, Homo sapien
taatcaattaggactacagtttctt

SEQ ID NO: 89011 - DNA, 25 bp, Homo sapien
taatcaattaggactatagtttctt

SEQ ID NO: 89012 - DNA, 25 bp, Homo sapien
taatcacaaataacaaaaactgaat

SEQ ID NO: 89013 - DNA, 25 bp, Homo sapien
taatcacaaataacaacaactgaat

SEQ ID NO: 89014 - DNA, 25 bp, Homo sapien
taatcacaataatggcagcatttgc

SEQ ID NO: 89015 - DNA, 25 bp, Homo sapien
taatcacagggtccctataagagaa

SEQ ID NO: 89016 - DNA, 25 bp, Homo sapien
taatcacagggttcctataagagaa

SEQ ID NO: 89017 - DNA, 25 bp, Homo sapien
taatcacagtaatggcagcatttgc

SEQ ID NO: 89018 - DNA, 25 bp, Homo sapien
taatcactattggaaagggcctccg

SEQ ID NO: 89019 - DNA, 25 bp, Homo sapien
taatcactattggcaagggcctccg

SEQ ID NO: 89020 - DNA, 25 bp, Homo sapien
taatcactggggcacgaagactcca

SEQ ID NO: 89021 - DNA, 25 bp, Homo sapien
taatcactggggcatgaagactcca

SEQ ID NO: 89022 - DNA, 25 bp, Homo sapien
taatcagcaaagatcaatcaaggca

SEQ ID NO: 89023 - DNA, 25 bp, Homo sapien
taatcagcacctactgtcaatgtag

SEQ ID NO: 89024 - DNA, 25 bp, Homo sapien
taatcagcacctgctgtcaatgtag

SEQ ID NO: 89025 - DNA, 25 bp, Homo sapien
taatcagcagagatcaatcaaggca

SEQ ID NO: 89026 - DNA, 25 bp, Homo sapien
taatcagctgatagcacaggataat

SEQ ID NO: 89027 - DNA, 25 bp, Homo sapien
taatcagcttatagcacaggataat

SEQ ID NO: 89028 - DNA, 25 bp, Homo sapien
taatcagtgtctaatctgatgttaa

SEQ ID NO: 89029 - DNA, 25 bp, Homo sapien
taatcagtgtctagtctgatgttaa

SEQ ID NO: 89030 - DNA, 25 bp, Homo sapien
taatcagttcctgaaaatttgtgtg

SEQ ID NO: 89031 - DNA, 25 bp, Homo sapien
taatcagtttctgaaaatttgtgtg

SEQ ID NO: 89032 - DNA, 25 bp, Homo sapien
taatcatatttacagatacatcgaa

SEQ ID NO: 89033 - DNA, 25 bp, Homo sapien
taatcatatttacggatacatcgaa

SEQ ID NO: 89034 - DNA, 25 bp, Homo sapien
taatcatcaattaaatgaatcgcta

SEQ ID NO: 89035 - DNA, 25 bp, Homo sapien
taatcatcaattgaatgaatcgcta

SEQ ID NO: 89036 - DNA, 25 bp, Homo sapien
taatcatcagatccactttttagaa

SEQ ID NO: 89037 - DNA, 25 bp, Homo sapien
taatcatctgatccactttttagaa

SEQ ID NO: 89038 - DNA, 25 bp, Homo sapien
taatcatgagaataattgtaaagtc

SEQ ID NO: 89039 - DNA, 25 bp, Homo sapien
taatcatgggaataattgtaaagtc

SEQ ID NO: 89040 - DNA, 25 bp, Homo sapien
taatcattgccaggatttgatttta

SEQ ID NO: 89041 - DNA, 25 bp, Homo sapien
taatcattgtcaggatttgatttta

SEQ ID NO: 89042 - DNA, 25 bp, Homo sapien
taatccacacctagaagaggaaaag

SEQ ID NO: 89043 - DNA, 25 bp, Homo sapien
taatccacacctagcagaggaaaag

SEQ ID NO: 89044 - DNA, 25 bp, Homo sapien
taatccactgaaaatacaaaccaag

SEQ ID NO: 89045 - DNA, 25 bp, Homo sapien
taatccactgagaatacaaaccaag

SEQ ID NO: 89046 - DNA, 25 bp, Homo sapien
taatccaggatattctccttatatg

SEQ ID NO: 89047 - DNA, 25 bp, Homo sapien
taatccaggttattctccttatatg

SEQ ID NO: 89048 - DNA, 25 bp, Homo sapien
taatccatattcatacctatagccc

SEQ ID NO: 89049 - DNA, 25 bp, Homo sapien
taatccatattcatacttatagccc

SEQ ID NO: 89050 - DNA, 25 bp, Homo sapien
taatccatcggcctcctgtcagtga

SEQ ID NO: 89051 - DNA, 25 bp, Homo sapien
taatccatctgcctcctgtcagtga

SEQ ID NO: 89052 - DNA, 25 bp, Homo sapien
taatccattgaccgatggcccagaa

SEQ ID NO: 89053 - DNA, 25 bp, Homo sapien
taatccattgactgatggcccagaa

SEQ ID NO: 89054 - DNA, 25 bp, Homo sapien
taatcccaatatccttaatttcaac

SEQ ID NO: 89055 - DNA, 25 bp, Homo sapien
taatcccaatatcgttaatttcaac

SEQ ID NO: 89056 - DNA, 25 bp, Homo sapien
taatcccattcataagggcagagtc

SEQ ID NO: 89057 - DNA, 25 bp, Homo sapien
taatcccattcttaagggcagagtc

SEQ ID NO: 89058 - DNA, 25 bp, Homo sapien
taatcccgactctactcttttcctc

SEQ ID NO: 89059 - DNA, 25 bp, Homo sapien
taatcccgactgtactcttttcctc

SEQ ID NO: 89060 - DNA, 25 bp, Homo sapien
taatccggctgtggaagtgtgagat

SEQ ID NO: 89061 - DNA, 25 bp, Homo sapien
taatccggctgtgggagtgtgagat

SEQ ID NO: 89062 - DNA, 25 bp, Homo sapien
taatcctacatttattttgttatat

SEQ ID NO: 89063 - DNA, 25 bp, Homo sapien
taatcctacatttgttttgttatat

SEQ ID NO: 89064 - DNA, 25 bp, Homo sapien
taatcctcataaatccctaagcact

SEQ ID NO: 89065 - DNA, 25 bp, Homo sapien
taatcctcgtaaatccctaagcact

SEQ ID NO: 89066 - DNA, 25 bp, Homo sapien
taatcctgggttagcaaaaatgggg

SEQ ID NO: 89067 - DNA, 25 bp, Homo sapien
taatcctggtttagcaaaaatgggg

SEQ ID NO: 89068 - DNA, 25 bp, Homo sapien
taatccttcctcaactagttctgga

SEQ ID NO: 89069 - DNA, 25 bp, Homo sapien
taatccttgctgctggacccaaaaa

SEQ ID NO: 89070 - DNA, 25 bp, Homo sapien
taatccttgttgctggacccaaaaa

SEQ ID NO: 89071 - DNA, 25 bp, Homo sapien
taatcctttctcaactagttctgga

SEQ ID NO: 89072 - DNA, 25 bp, Homo sapien
taatcgatcgaaagagggcatcgga

SEQ ID NO: 89073 - DNA, 25 bp, Homo sapien
taatcgatggaaagagggcatcgga

SEQ ID NO: 89074 - DNA, 25 bp, Homo sapien
taatcgggacaattgtgaaagtctt

SEQ ID NO: 89075 - DNA, 25 bp, Homo sapien
taatcgggacagttgtgaaagtctt

SEQ ID NO: 89076 - DNA, 25 bp, Homo sapien
taatctacataacactggaagtcct

SEQ ID NO: 89077 - DNA, 25 bp, Homo sapien
taatctacgtaacactggaagtcct

SEQ ID NO: 89078 - DNA, 25 bp, Homo sapien
taatctatgaataagaaagacccaa

SEQ ID NO: 89079 - DNA, 25 bp, Homo sapien
taatctatgaatgagaaagacccaa

SEQ ID NO: 89080 - DNA, 25 bp, Homo sapien
taatctccagatcctgttaagccac

SEQ ID NO: 89081 - DNA, 25 bp, Homo sapien
taatctccagattctgttaagccac

SEQ ID NO: 89082 - DNA, 25 bp, Homo sapien
taatctcctcactatggaaacattg

SEQ ID NO: 89083 - DNA, 25 bp, Homo sapien
taatctcctcactgtggaaacattg

SEQ ID NO: 89084 - DNA, 25 bp, Homo sapien
taatctctgaccccatagcatcctt

SEQ ID NO: 89085 - DNA, 25 bp, Homo sapien
taatctctgaccccgtagcatcctt

SEQ ID NO: 89086 - DNA, 25 bp, Homo sapien
taatctctttgtacatcaccttcag

SEQ ID NO: 89087 - DNA, 25 bp, Homo sapien
taatctctttgtacgtcaccttcag

SEQ ID NO: 89088 - DNA, 25 bp, Homo sapien
taatctgaaaaatctttttatcatc

SEQ ID NO: 89089 - DNA, 25 bp, Homo sapien
taatctgaatgacagttgccctaaa

SEQ ID NO: 89090 - DNA, 25 bp, Homo sapien
taatctgaatgagagttgccctaaa

SEQ ID NO: 89091 - DNA, 25 bp, Homo sapien
taatctgagaaatctttttatcatc

SEQ ID NO: 89092 - DNA, 25 bp, Homo sapien
taatctgagattcacgcaaagacaa

SEQ ID NO: 89093 - DNA, 25 bp, Homo sapien
taatctgaggttcacgcaaagacaa

SEQ ID NO: 89094 - DNA, 25 bp, Homo sapien
taatctgatatttcagttgcaggct

SEQ ID NO: 89095 - DNA, 25 bp, Homo sapien
taatctgatatttcggttgcaggct

SEQ ID NO: 89096 - DNA, 25 bp, Homo sapien
taatctgcactgaagtatttcaaat

SEQ ID NO: 89097 - DNA, 25 bp, Homo sapien
taatctgcagacgtggactgagggt

SEQ ID NO: 89098 - DNA, 25 bp, Homo sapien
taatctgcagatgtggactgagggt

SEQ ID NO: 89099 - DNA, 25 bp, Homo sapien
taatctgcattgaagtatttcaaat

SEQ ID NO: 89100 - DNA, 25 bp, Homo sapien
taatctgccacataattaaaagtag

SEQ ID NO: 89101 - DNA, 25 bp, Homo sapien
taatctgccacgtaattaaaagtag

SEQ ID NO: 89102 - DNA, 25 bp, Homo sapien
taatctgcctactatcagcactccc

SEQ ID NO: 89103 - DNA, 25 bp, Homo sapien
taatctgcttactatcagcactccc

SEQ ID NO: 89104 - DNA, 25 bp, Homo sapien
taatctgtgaaaagtgtgttcagct

SEQ ID NO: 89105 - DNA, 25 bp, Homo sapien
taatctgtgaagagtgtgttcagct

SEQ ID NO: 89106 - DNA, 25 bp, Homo sapien
taatcttacaaaaacagaacctctg

SEQ ID NO: 89107 - DNA, 25 bp, Homo sapien
taatcttacaacaacagaacctctg

SEQ ID NO: 89108 - DNA, 25 bp, Homo sapien
taatcttagcaaagacagaacaagg

SEQ ID NO: 89109 - DNA, 25 bp, Homo sapien
taatcttagcaaaggcagaacaagg

SEQ ID NO: 89110 - DNA, 25 bp, Homo sapien
taatcttatgagaccactattactc

SEQ ID NO: 89111 - DNA, 25 bp, Homo sapien
taatcttatgaggccactattactc

SEQ ID NO: 89112 - DNA, 25 bp, Homo sapien
taatcttcattgtgaaaacctggtt

SEQ ID NO: 89113 - DNA, 25 bp, Homo sapien
taatcttccaagacagttacagatt

SEQ ID NO: 89114 - DNA, 25 bp, Homo sapien
taatcttccaagaccgttacagatt

SEQ ID NO: 89115 - DNA, 25 bp, Homo sapien
taatcttcgttgtgaaaacctggtt

SEQ ID NO: 89116 - DNA, 25 bp, Homo sapien
taatcttggagtgctatgtcttgtt

SEQ ID NO: 89117 - DNA, 25 bp, Homo sapien
taatcttggagtgttatgtcttgtt

SEQ ID NO: 89118 - DNA, 25 bp, Homo sapien
taatctttcagaaacaatttgaacc

SEQ ID NO: 89119 - DNA, 25 bp, Homo sapien
taatctttcagaaacagtttgaacc

SEQ ID NO: 89120 - DNA, 25 bp, Homo sapien
taatgaaaacaattctggtactggt

SEQ ID NO: 89121 - DNA, 25 bp, Homo sapien
taatgaaaataattctggtactggt

SEQ ID NO: 89122 - DNA, 25 bp, Homo sapien
taatgaaaatctcagtaagaaaaaa

SEQ ID NO: 89123 - DNA, 25 bp, Homo sapien
taatgaaaatctcggtaagaaaaaa

SEQ ID NO: 89124 - DNA, 25 bp, Homo sapien
taatgaaatacataactgcctggtt

SEQ ID NO: 89125 - DNA, 25 bp, Homo sapien
taatgaaatacgtaactgcctggtt

SEQ ID NO: 89126 - DNA, 25 bp, Homo sapien
taatgaacaaatgaaaaatatgttt

SEQ ID NO: 89127 - DNA, 25 bp, Homo sapien
taatgaacaaatggaaaatatgttt

SEQ ID NO: 89128 - DNA, 25 bp, Homo sapien
taatgaacaggtaaaaaaaaatgcg

SEQ ID NO: 89129 - DNA, 25 bp, Homo sapien
taatgaacaggttaaaaaaaatgcg

SEQ ID NO: 89130 - DNA, 25 bp, Homo sapien
taatgaactatgaaaacatttttaa

SEQ ID NO: 89131 - DNA, 25 bp, Homo sapien
taatgaactatggaaacatttttaa

SEQ ID NO: 89132 - DNA, 25 bp, Homo sapien
taatgaagcattcctggccatttta

SEQ ID NO: 89133 - DNA, 25 bp, Homo sapien
taatgaagtattcctggccatttta

SEQ ID NO: 89134 - DNA, 25 bp, Homo sapien
taatgaatcagttgaattcagagac

SEQ ID NO: 89135 - DNA, 25 bp, Homo sapien
taatgaatcggttgaattcagagac

SEQ ID NO: 89136 - DNA, 25 bp, Homo sapien
taatgaatgtccaaagtattcaatg

SEQ ID NO: 89137 - DNA, 25 bp, Homo sapien
taatgaatgtccgaagtattcaatg

SEQ ID NO: 89138 - DNA, 25 bp, Homo sapien
taatgacacaaagatgttatctggc

SEQ ID NO: 89139 - DNA, 25 bp, Homo sapien
taatgacacaaatatgttatctggc

SEQ ID NO: 89140 - DNA, 25 bp, Homo sapien
taatgacattaatccattcatgaag

SEQ ID NO: 89141 - DNA, 25 bp, Homo sapien
taatgacattagtccattcatgaag

SEQ ID NO: 89142 - DNA, 25 bp, Homo sapien
taatgaccacaatgcagtctgttac

SEQ ID NO: 89143 - DNA, 25 bp, Homo sapien
taatgaccacagtgcagtctgttac

SEQ ID NO: 89144 - DNA, 25 bp, Homo sapien
taatgactttatagaggcaaaagag

SEQ ID NO: 89145 - DNA, 25 bp, Homo sapien
taatgactttatggaggcaaaagag

SEQ ID NO: 89146 - DNA, 25 bp, Homo sapien
taatgagacctctgtattataactt

SEQ ID NO: 89147 - DNA, 25 bp, Homo sapien
taatgagacctttgtattataactt

SEQ ID NO: 89148 - DNA, 25 bp, Homo sapien
taatgagataaacaatgtctcttac

SEQ ID NO: 89149 - DNA, 25 bp, Homo sapien
taatgagataaacgatgtctcttac

SEQ ID NO: 89150 - DNA, 25 bp, Homo sapien
taatgagcattatgaagtttaacat

SEQ ID NO: 89151 - DNA, 25 bp, Homo sapien
taatgagcattgtgaagtttaacat

SEQ ID NO: 89152 - DNA, 25 bp, Homo sapien
taatgagcccgtcaaaagcattctt

SEQ ID NO: 89153 - DNA, 25 bp, Homo sapien
taatgagcccgtcaaaggcattctt

SEQ ID NO: 89154 - DNA, 25 bp, Homo sapien
taatgagtctaagctgaatctagtt

SEQ ID NO: 89155 - DNA, 25 bp, Homo sapien
taatgagtctaaggtgaatctagtt

SEQ ID NO: 89156 - DNA, 25 bp, Homo sapien
taatgagtgacatgcctttgatagt

SEQ ID NO: 89157 - DNA, 25 bp, Homo sapien
taatgagtggcatgcctttgatagt

SEQ ID NO: 89158 - DNA, 25 bp, Homo sapien
taatgagtggccagtgttattaact

SEQ ID NO: 89159 - DNA, 25 bp, Homo sapien
taatgagtggccggtgttattaact

SEQ ID NO: 89160 - DNA, 25 bp, Homo sapien
taatgataactcccatttttggagc

SEQ ID NO: 89161 - DNA, 25 bp, Homo sapien
taatgataactcccttttttggagc

SEQ ID NO: 89162 - DNA, 25 bp, Homo sapien
taatgatccatatactgtcacggca

SEQ ID NO: 89163 - DNA, 25 bp, Homo sapien
taatgatccatgtactgtcacggca

SEQ ID NO: 89164 - DNA, 25 bp, Homo sapien
taatgatcccaaattcacacaggta

SEQ ID NO: 89165 - DNA, 25 bp, Homo sapien
taatgatcccaagttcacacaggta

SEQ ID NO: 89166 - DNA, 25 bp, Homo sapien
taatgatgacagaattaagttgttg

SEQ ID NO: 89167 - DNA, 25 bp, Homo sapien
taatgatgatagaattaagttgttg

SEQ ID NO: 89168 - DNA, 25 bp, Homo sapien
taatgatgatcctggaaagaaaaaa

SEQ ID NO: 89169 - DNA, 25 bp, Homo sapien
taatgatgatcctggagagaaaaaa

SEQ ID NO: 89170 - DNA, 25 bp, Homo sapien
taatgatgtatggccgtgcaatgtg

SEQ ID NO: 89171 - DNA, 25 bp, Homo sapien
taatgatgtatggctgtgcaatgtg

SEQ ID NO: 89172 - DNA, 25 bp, Homo sapien
taatgattcagcatagttcactact

SEQ ID NO: 89173 - DNA, 25 bp, Homo sapien
taatgattcagcgtagttcactact

SEQ ID NO: 89174 - DNA, 25 bp, Homo sapien
taatgattggatataggttgagggg

SEQ ID NO: 89175 - DNA, 25 bp, Homo sapien
taatgattggatgtaggttgagggg

SEQ ID NO: 89176 - DNA, 25 bp, Homo sapien
taatgcaaaagaatatcgagggtac

SEQ ID NO: 89177 - DNA, 25 bp, Homo sapien
taatgcaaaagagtatcgagggtac

SEQ ID NO: 89178 - DNA, 25 bp, Homo sapien
taatgcaaaggcgtaatgtggctac

SEQ ID NO: 89179 - DNA, 25 bp, Homo sapien
taatgcaaaggtgtaatgtggctac

SEQ ID NO: 89180 - DNA, 25 bp, Homo sapien
taatgcaacacagactgctcaaggt

SEQ ID NO: 89181 - DNA, 25 bp, Homo sapien
taatgcaacactgagttttcctcaa

SEQ ID NO: 89182 - DNA, 25 bp, Homo sapien
taatgcaacactgtgttttcctcaa

SEQ ID NO: 89183 - DNA, 25 bp, Homo sapien
taatgcaatacagactgctcaaggt

SEQ ID NO: 89184 - DNA, 25 bp, Homo sapien
taatgcacaagcaaggaaagagatt

SEQ ID NO: 89185 - DNA, 25 bp, Homo sapien
taatgcacaagtaaggaaagagatt

SEQ ID NO: 89186 - DNA, 25 bp, Homo sapien
taatgcacactccataatctcaaac

SEQ ID NO: 89187 - DNA, 25 bp, Homo sapien
taatgcacattcataattgcaaaat

SEQ ID NO: 89188 - DNA, 25 bp, Homo sapien
taatgcacattcatcattgcaaaat

SEQ ID NO: 89189 - DNA, 25 bp, Homo sapien
taatgcacattccataatctcaaac

SEQ ID NO: 89190 - DNA, 25 bp, Homo sapien
taatgcacccatgcttctaaaggac

SEQ ID NO: 89191 - DNA, 25 bp, Homo sapien
taatgcacgcatgcttctaaaggac

SEQ ID NO: 89192 - DNA, 25 bp, Homo sapien
taatgcacttgttatagaataataa

SEQ ID NO: 89193 - DNA, 25 bp, Homo sapien
taatgcacttgttatataataataa

SEQ ID NO: 89194 - DNA, 25 bp, Homo sapien
taatgccaacgttctgttagcaagg

SEQ ID NO: 89195 - DNA, 25 bp, Homo sapien
taatgccaaggttctgttagcaagg

SEQ ID NO: 89196 - DNA, 25 bp, Homo sapien
taatgcccattcctggttcatgaga

SEQ ID NO: 89197 - DNA, 25 bp, Homo sapien
taatgcccattcttggttcatgaga

SEQ ID NO: 89198 - DNA, 25 bp, Homo sapien
taatgccccagtttggcttcctggg

SEQ ID NO: 89199 - DNA, 25 bp, Homo sapien
taatgccccggtttggcttcctggg

SEQ ID NO: 89200 - DNA, 25 bp, Homo sapien
taatgccttcttcggttgacaagtt

SEQ ID NO: 89201 - DNA, 25 bp, Homo sapien
taatgccttctttggttgacaagtt

SEQ ID NO: 89202 - DNA, 25 bp, Homo sapien
taatgccttttgagtaaacaaaatt

SEQ ID NO: 89203 - DNA, 25 bp, Homo sapien
taatgccttttgattaaacaaaatt

SEQ ID NO: 89204 - DNA, 25 bp, Homo sapien
taatgctacagatcccttagaacag

SEQ ID NO: 89205 - DNA, 25 bp, Homo sapien
taatgctacaggcatctagtgagta

SEQ ID NO: 89206 - DNA, 25 bp, Homo sapien
taatgctacagggatctagtgagta

SEQ ID NO: 89207 - DNA, 25 bp, Homo sapien
taatgctagagatcccttagaacag

SEQ ID NO: 89208 - DNA, 25 bp, Homo sapien
taatgctagaggatccagctgggcc

SEQ ID NO: 89209 - DNA, 25 bp, Homo sapien
taatgctagaggctccagctgggcc

SEQ ID NO: 89210 - DNA, 25 bp, Homo sapien
taatgctgccatcaagaatttaaaa

SEQ ID NO: 89211 - DNA, 25 bp, Homo sapien
taatgctgccatcatgaatttaaaa

SEQ ID NO: 89212 - DNA, 25 bp, Homo sapien
taatgcttcctatctctcacacagc

SEQ ID NO: 89213 - DNA, 25 bp, Homo sapien
taatgcttcctatgtctcacacagc

SEQ ID NO: 89214 - DNA, 25 bp, Homo sapien
taatgcttgatgtatccgaaccaga

SEQ ID NO: 89215 - DNA, 25 bp, Homo sapien
taatgcttggtgtatccgaaccaga

SEQ ID NO: 89216 - DNA, 25 bp, Homo sapien
taatggataaaataaggcagatgat

SEQ ID NO: 89217 - DNA, 25 bp, Homo sapien
taatggatacaataaggcagatgat

SEQ ID NO: 89218 - DNA, 25 bp, Homo sapien
taatggataccggaagctttaaaac

SEQ ID NO: 89219 - DNA, 25 bp, Homo sapien
taatggatgacaaatgctgagcaga

SEQ ID NO: 89220 - DNA, 25 bp, Homo sapien
taatggatggcaaatgctgagcaga

SEQ ID NO: 89221 - DNA, 25 bp, Homo sapien
taatggattccggaagctttaaaac

SEQ ID NO: 89222 - DNA, 25 bp, Homo sapien
taatggcattcgcaacctaagccca

SEQ ID NO: 89223 - DNA, 25 bp, Homo sapien
taatggcattcgcaacttaagccca

SEQ ID NO: 89224 - DNA, 25 bp, Homo sapien
taatggcttggatcttttgaatatt

SEQ ID NO: 89225 - DNA, 25 bp, Homo sapien
taatggcttggctcttttgaatatt

SEQ ID NO: 89226 - DNA, 25 bp, Homo sapien
taatgggactcagcaattagtgaaa

SEQ ID NO: 89227 - DNA, 25 bp, Homo sapien
taatgggactcagtaattagtgaaa

SEQ ID NO: 89228 - DNA, 25 bp, Homo sapien
taatgggtaaggatgagaaagctgt

SEQ ID NO: 89229 - DNA, 25 bp, Homo sapien
taatgggtaaggctgagaaagctgt

SEQ ID NO: 89230 - DNA, 25 bp, Homo sapien
taatggtacacatagtagattcata

SEQ ID NO: 89231 - DNA, 25 bp, Homo sapien
taatggtacacatagtggattcata

SEQ ID NO: 89232 - DNA, 25 bp, Homo sapien
taatggtagctgtagtttattgagt

SEQ ID NO: 89233 - DNA, 25 bp, Homo sapien
taatggtagctgtggtttattgagt

SEQ ID NO: 89234 - DNA, 25 bp, Homo sapien
taatggtccatggcctggtggttgc

SEQ ID NO: 89235 - DNA, 25 bp, Homo sapien
taatggtccgtggcctggtggttgc

SEQ ID NO: 89236 - DNA, 25 bp, Homo sapien
taatggtgtgttaaaacgctgcaat

SEQ ID NO: 89237 - DNA, 25 bp, Homo sapien
taatggtgtgttaaaatgctgcaat

SEQ ID NO: 89238 - DNA, 25 bp, Homo sapien
taatgtaaaacatctccataatttt

SEQ ID NO: 89239 - DNA, 25 bp, Homo sapien
taatgtaaaacgtctccataatttt

SEQ ID NO: 89240 - DNA, 25 bp, Homo sapien
taatgtaaactaccaaatcaacaga

SEQ ID NO: 89241 - DNA, 25 bp, Homo sapien
taatgtaagctctacaaaggcaggt

SEQ ID NO: 89242 - DNA, 25 bp, Homo sapien
taatgtaagctctataaaggcaggt

SEQ ID NO: 89243 - DNA, 25 bp, Homo sapien
taatgtaatcccacgtaagtttcga

SEQ ID NO: 89244 - DNA, 25 bp, Homo sapien
taatgtaatcccgcgtaagtttcga

SEQ ID NO: 89245 - DNA, 25 bp, Homo sapien
taatgtaatctaccaaatcaacaga

SEQ ID NO: 89246 - DNA, 25 bp, Homo sapien
taatgtaccattccattttacctgt

SEQ ID NO: 89247 - DNA, 25 bp, Homo sapien
taatgtactattccattttacctgt

SEQ ID NO: 89248 - DNA, 25 bp, Homo sapien
taatgtagaaaagccatattttatg

SEQ ID NO: 89249 - DNA, 25 bp, Homo sapien
taatgtagaaaggccatattttatg

SEQ ID NO: 89250 - DNA, 25 bp, Homo sapien
taatgtagctccatctttaatgatc

SEQ ID NO: 89251 - DNA, 25 bp, Homo sapien
taatgtagctccttctttaatgatc

SEQ ID NO: 89252 - DNA, 25 bp, Homo sapien
taatgtcaacttacaaacctctcat

SEQ ID NO: 89253 - DNA, 25 bp, Homo sapien
taatgtcaacttataaacctctcat

SEQ ID NO: 89254 - DNA, 25 bp, Homo sapien
taatgtctctctctgttccttctat

SEQ ID NO: 89255 - DNA, 25 bp, Homo sapien
taatgtctctctgtgttccttctat

SEQ ID NO: 89256 - DNA, 25 bp, Homo sapien
taatgtgcatttcctttatgaccag

SEQ ID NO: 89257 - DNA, 25 bp, Homo sapien
taatgtgcatttcttttatgaccag

SEQ ID NO: 89258 - DNA, 25 bp, Homo sapien
taatgtggccgtctccaatcacaaa

SEQ ID NO: 89259 - DNA, 25 bp, Homo sapien
taatgtggctgtctccaatcacaaa

SEQ ID NO: 89260 - DNA, 25 bp, Homo sapien
taatgttacggaagcacagggaaat

SEQ ID NO: 89261 - DNA, 25 bp, Homo sapien
taatgttatggaagcacagggaaat

SEQ ID NO: 89262 - DNA, 25 bp, Homo sapien
taatgttcagacatccagttataga

SEQ ID NO: 89263 - DNA, 25 bp, Homo sapien
taatgttcagatatccagttataga

SEQ ID NO: 89264 - DNA, 25 bp, Homo sapien
taatgttgaaaaagatgaacctctc

SEQ ID NO: 89265 - DNA, 25 bp, Homo sapien
taatgttgcataataacccacgaag

SEQ ID NO: 89266 - DNA, 25 bp, Homo sapien
taatgttgcataataagccacgaag

SEQ ID NO: 89267 - DNA, 25 bp, Homo sapien
taatgttgcctacacaactgtatgg

SEQ ID NO: 89268 - DNA, 25 bp, Homo sapien
taatgttgcctacagaactgtatgg

SEQ ID NO: 89269 - DNA, 25 bp, Homo sapien
taatgttggaaaagatgaacctctc

SEQ ID NO: 89270 - DNA, 25 bp, Homo sapien
taatgtttattatataccagatgtg

SEQ ID NO: 89271 - DNA, 25 bp, Homo sapien
taatgtttattgtataccagatgtg

SEQ ID NO: 89272 - DNA, 25 bp, Homo sapien
taatgtttcttcctgaatatttttg

SEQ ID NO: 89273 - DNA, 25 bp, Homo sapien
taatgtttcttgctgaatatttttg

SEQ ID NO: 89274 - DNA, 25 bp, Homo sapien
taattaaaaattcacaaggaaatgt

SEQ ID NO: 89275 - DNA, 25 bp, Homo sapien
taattaaaaattcacacggaaatgt

SEQ ID NO: 89276 - DNA, 25 bp, Homo sapien
taattaaaaggagaatcaaacattt

SEQ ID NO: 89277 - DNA, 25 bp, Homo sapien
taattaaaaggataatcaaacattt

SEQ ID NO: 89278 - DNA, 25 bp, Homo sapien
taattaaccagaagtccagtagagt

SEQ ID NO: 89279 - DNA, 25 bp, Homo sapien
taattaaccagatactgagccttca

SEQ ID NO: 89280 - DNA, 25 bp, Homo sapien
taattaaccagatattgagccttca

SEQ ID NO: 89281 - DNA, 25 bp, Homo sapien
taattaactagaagtccagtagagt

SEQ ID NO: 89282 - DNA, 25 bp, Homo sapien
taattacaccctgttgcctccgaag

SEQ ID NO: 89283 - DNA, 25 bp, Homo sapien
taattacatcctgttgcctccgaag

SEQ ID NO: 89284 - DNA, 25 bp, Homo sapien
taattactaaaaactgtggcactgc

SEQ ID NO: 89285 - DNA, 25 bp, Homo sapien
taattactgaaaactgtggcactgc

SEQ ID NO: 89286 - DNA, 25 bp, Homo sapien
taattagatcaggaacctaatctaa

SEQ ID NO: 89287 - DNA, 25 bp, Homo sapien
taattagatcaggaccctaatctaa

SEQ ID NO: 89288 - DNA, 25 bp, Homo sapien
taattagcacaataggcagcaaatc

SEQ ID NO: 89289 - DNA, 25 bp, Homo sapien
taattagcagaataggcagcaaatc

SEQ ID NO: 89290 - DNA, 25 bp, Homo sapien
taattaggaaaccatatttgtagag

SEQ ID NO: 89291 - DNA, 25 bp, Homo sapien
taattaggagaccatatttgtagag

SEQ ID NO: 89292 - DNA, 25 bp, Homo sapien
taattagttgaaactctcttgaata

SEQ ID NO: 89293 - DNA, 25 bp, Homo sapien
taattagttgaacctctcttgaata

SEQ ID NO: 89294 - DNA, 25 bp, Homo sapien
taattatacgaagtcctttgaaatg

SEQ ID NO: 89295 - DNA, 25 bp, Homo sapien
taattatatgaagtcctttgaaatg

SEQ ID NO: 89296 - DNA, 25 bp, Homo sapien
taattatcacataaatcttttggta

SEQ ID NO: 89297 - DNA, 25 bp, Homo sapien
taattatcagtgcctatatcctctc

SEQ ID NO: 89298 - DNA, 25 bp, Homo sapien
taattatcctcaacattactgccat

SEQ ID NO: 89299 - DNA, 25 bp, Homo sapien
taattatcctcaacgttactgccat

SEQ ID NO: 89300 - DNA, 25 bp, Homo sapien
taattatcggtgcctatatcctctc

SEQ ID NO: 89301 - DNA, 25 bp, Homo sapien
taattatctcataaatcttttggta

SEQ ID NO: 89302 - DNA, 25 bp, Homo sapien
taattattaagccatgttagcaatg

SEQ ID NO: 89303 - DNA, 25 bp, Homo sapien
taattattaagtcatgttagcaatg

SEQ ID NO: 89304 - DNA, 25 bp, Homo sapien
taattattagactgcggcaaagcca

SEQ ID NO: 89305 - DNA, 25 bp, Homo sapien
taattattagactgtggcaaagcca

SEQ ID NO: 89306 - DNA, 25 bp, Homo sapien
taattcaaagcacggatttcaagca

SEQ ID NO: 89307 - DNA, 25 bp, Homo sapien
taattcaaagcatggatttcaagca

SEQ ID NO: 89308 - DNA, 25 bp, Homo sapien
taattcaactaatccctaacctttc

SEQ ID NO: 89309 - DNA, 25 bp, Homo sapien
taattcaactagtccctaacctttc

SEQ ID NO: 89310 - DNA, 25 bp, Homo sapien
taattcaagtttccatttgtattct

SEQ ID NO: 89311 - DNA, 25 bp, Homo sapien
taattcaagtttccgtttgtattct

SEQ ID NO: 89312 - DNA, 25 bp, Homo sapien
taattcaatcagatatccttagaac

SEQ ID NO: 89313 - DNA, 25 bp, Homo sapien
taattcaatcaggtatccttagaac

SEQ ID NO: 89314 - DNA, 25 bp, Homo sapien
taattcaatgaaagaaagaataatc

SEQ ID NO: 89315 - DNA, 25 bp, Homo sapien
taattcaatgagagaaagaataatc

SEQ ID NO: 89316 - DNA, 25 bp, Homo sapien
taattcaatgcataacatattttca

SEQ ID NO: 89317 - DNA, 25 bp, Homo sapien
taattcaatgcgtaacatattttca

SEQ ID NO: 89318 - DNA, 25 bp, Homo sapien
taattcacaatgtcatagaatgcta

SEQ ID NO: 89319 - DNA, 25 bp, Homo sapien
taattcacaatgtcgtagaatgcta

SEQ ID NO: 89320 - DNA, 25 bp, Homo sapien
taattcacagtcgaaataggatcct

SEQ ID NO: 89321 - DNA, 25 bp, Homo sapien
taattcacagttgaaataggatcct

SEQ ID NO: 89322 - DNA, 25 bp, Homo sapien
taattcaccaggtgttattctttca

SEQ ID NO: 89323 - DNA, 25 bp, Homo sapien
taattcaccgggtgttattctttca

SEQ ID NO: 89324 - DNA, 25 bp, Homo sapien
taattcagacgatcttaataggtgt

SEQ ID NO: 89325 - DNA, 25 bp, Homo sapien
taattcagatgatcttaataggtgt

SEQ ID NO: 89326 - DNA, 25 bp, Homo sapien
taattcatcattaccaaattccagg

SEQ ID NO: 89327 - DNA, 25 bp, Homo sapien
taattcatcattgccaaattccagg

SEQ ID NO: 89328 - DNA, 25 bp, Homo sapien
taattcatgttccaaaggtgactta

SEQ ID NO: 89329 - DNA, 25 bp, Homo sapien
taattcatgttgcaaaggtgactta

SEQ ID NO: 89330 - DNA, 25 bp, Homo sapien
taattcccaagatgtttcagaaagg

SEQ ID NO: 89331 - DNA, 25 bp, Homo sapien
taattcccacgggtaaacacttatg

SEQ ID NO: 89332 - DNA, 25 bp, Homo sapien
taattcccaggatgtttcagaaagg

SEQ ID NO: 89333 - DNA, 25 bp, Homo sapien
taattcccatgggtaaacacttatg

SEQ ID NO: 89334 - DNA, 25 bp, Homo sapien
taattccgcttggccaatttaaaga

SEQ ID NO: 89335 - DNA, 25 bp, Homo sapien
taattccgcttggctaatttaaaga

SEQ ID NO: 89336 - DNA, 25 bp, Homo sapien
taattccttagcgcagaacagtgta

SEQ ID NO: 89337 - DNA, 25 bp, Homo sapien
taattccttagcgcagcacagtgta

SEQ ID NO: 89338 - DNA, 25 bp, Homo sapien
taattctaagatacagggttcaaag

SEQ ID NO: 89339 - DNA, 25 bp, Homo sapien
taattctaagatatagggttcaaag

SEQ ID NO: 89340 - DNA, 25 bp, Homo sapien
taattctaattctcacagctaaaca

SEQ ID NO: 89341 - DNA, 25 bp, Homo sapien
taattctaattttcacagctaaaca

SEQ ID NO: 89342 - DNA, 25 bp, Homo sapien
taattctacaccaattcttccaaaa

SEQ ID NO: 89343 - DNA, 25 bp, Homo sapien
taattctacacctattcttccaaaa

SEQ ID NO: 89344 - DNA, 25 bp, Homo sapien
taattctcgtcaggccagtcacttc

SEQ ID NO: 89345 - DNA, 25 bp, Homo sapien
taattctcgtcgggccagtcacttc

SEQ ID NO: 89346 - DNA, 25 bp, Homo sapien
taattctggaattatttttgctcaa

SEQ ID NO: 89347 - DNA, 25 bp, Homo sapien
taattctggatgatcccacaatcat

SEQ ID NO: 89348 - DNA, 25 bp, Homo sapien
taattctggatgctcccacaatcat

SEQ ID NO: 89349 - DNA, 25 bp, Homo sapien
taattctggcattatttttgctcaa

SEQ ID NO: 89350 - DNA, 25 bp, Homo sapien
taattcttaaaggccctagtatttt

SEQ ID NO: 89351 - DNA, 25 bp, Homo sapien
taattcttaaaggtcctagtatttt

SEQ ID NO: 89352 - DNA, 25 bp, Homo sapien
taattcttcctcactatcttcacag

SEQ ID NO: 89353 - DNA, 25 bp, Homo sapien
taattcttcctcgctatcttcacag

SEQ ID NO: 89354 - DNA, 25 bp, Homo sapien
taattgaacaaactctcttgattag

SEQ ID NO: 89355 - DNA, 25 bp, Homo sapien
taattgaacaaattctcttgattag

SEQ ID NO: 89356 - DNA, 25 bp, Homo sapien
taattgagaggccctctgaatactc

SEQ ID NO: 89357 - DNA, 25 bp, Homo sapien
taattgagaggctctctgaatactc

SEQ ID NO: 89358 - DNA, 25 bp, Homo sapien
taattgagattaatggaattgtctc

SEQ ID NO: 89359 - DNA, 25 bp, Homo sapien
taattgagattaattgaattgtctc

SEQ ID NO: 89360 - DNA, 25 bp, Homo sapien
taattgccactttcatggactagtg

SEQ ID NO: 89361 - DNA, 25 bp, Homo sapien
taattgccacttttatggactagtg

SEQ ID NO: 89362 - DNA, 25 bp, Homo sapien
taattgcctaactgggtatgatgct

SEQ ID NO: 89363 - DNA, 25 bp, Homo sapien
taattgcctaattgggtatgatgct

SEQ ID NO: 89364 - DNA, 25 bp, Homo sapien
taattgctataacgaatctaaagta

SEQ ID NO: 89365 - DNA, 25 bp, Homo sapien
taattgctataatgaatctaaagta

SEQ ID NO: 89366 - DNA, 25 bp, Homo sapien
taattggatactctgtgggtggttt

SEQ ID NO: 89367 - DNA, 25 bp, Homo sapien
taattggatactttgtgggtggttt

SEQ ID NO: 89368 - DNA, 25 bp, Homo sapien
taattggatagataagacaggatgt

SEQ ID NO: 89369 - DNA, 25 bp, Homo sapien
taattggatggataagacaggatgt

SEQ ID NO: 89370 - DNA, 25 bp, Homo sapien
taattggcataccttttattttgtt

SEQ ID NO: 89371 - DNA, 25 bp, Homo sapien
taattggcatactttttattttgtt

SEQ ID NO: 89372 - DNA, 25 bp, Homo sapien
taattgtaaatataggattaaagtg

SEQ ID NO: 89373 - DNA, 25 bp, Homo sapien
taattgtaaatatgggattaaagtg

SEQ ID NO: 89374 - DNA, 25 bp, Homo sapien
taattgtactgaggaatcattgcag

SEQ ID NO: 89375 - DNA, 25 bp, Homo sapien
taattgtagtgaggaatcattgcag

SEQ ID NO: 89376 - DNA, 25 bp, Homo sapien
taattgtccacttggagtgtttgcc

SEQ ID NO: 89377 - DNA, 25 bp, Homo sapien
taattgtctacttggagtgtttgcc

SEQ ID NO: 89378 - DNA, 25 bp, Homo sapien
taattgttcattcacttgctcaaca

SEQ ID NO: 89379 - DNA, 25 bp, Homo sapien
taattgttcattcagttgctcaaca

SEQ ID NO: 89380 - DNA, 25 bp, Homo sapien
taattgttctcatagagttcctaat

SEQ ID NO: 89381 - DNA, 25 bp, Homo sapien
taattgttgtcatagagttcctaat

SEQ ID NO: 89382 - DNA, 25 bp, Homo sapien
taatttaaatcatatagcatgccat

SEQ ID NO: 89383 - DNA, 25 bp, Homo sapien
taatttaaatcgtatagcatgccat

SEQ ID NO: 89384 - DNA, 25 bp, Homo sapien
taatttaaatgaggatctgattcca

SEQ ID NO: 89385 - DNA, 25 bp, Homo sapien
taatttaaatgagtatctgattcca

SEQ ID NO: 89386 - DNA, 25 bp, Homo sapien
taatttactccagttcctccaaatg

SEQ ID NO: 89387 - DNA, 25 bp, Homo sapien
taatttactccggttcctccaaatg

SEQ ID NO: 89388 - DNA, 25 bp, Homo sapien
taatttacttgtagcacagacatgc

SEQ ID NO: 89389 - DNA, 25 bp, Homo sapien
taatttacttgtggcacagacatgc

SEQ ID NO: 89390 - DNA, 25 bp, Homo sapien
taatttagataactgaccaaaggca

SEQ ID NO: 89391 - DNA, 25 bp, Homo sapien
taatttagatatctgaccaaaggca

SEQ ID NO: 89392 - DNA, 25 bp, Homo sapien
taatttagatctcagtaaaaagaaa

SEQ ID NO: 89393 - DNA, 25 bp, Homo sapien
taatttagatctctgtaaaaagaaa

SEQ ID NO: 89394 - DNA, 25 bp, Homo sapien
taatttcagcagaaaaatctaactc

SEQ ID NO: 89395 - DNA, 25 bp, Homo sapien
taatttcagtagaaaaatctaactc

SEQ ID NO: 89396 - DNA, 25 bp, Homo sapien
taatttcagtcacatcccaattaat

SEQ ID NO: 89397 - DNA, 25 bp, Homo sapien
taatttcagtcacgtcccaattaat

SEQ ID NO: 89398 - DNA, 25 bp, Homo sapien
taatttcattgaaagtctcctccaa

SEQ ID NO: 89399 - DNA, 25 bp, Homo sapien
taatttcattggaagtctcctccaa

SEQ ID NO: 89400 - DNA, 25 bp, Homo sapien
taatttccggtatggtttaagccct

SEQ ID NO: 89401 - DNA, 25 bp, Homo sapien
taatttcctgtatggtttaagccct

SEQ ID NO: 89402 - DNA, 25 bp, Homo sapien
taatttctacctactcctgttacaa

SEQ ID NO: 89403 - DNA, 25 bp, Homo sapien
taatttctacctcctcctgttacaa

SEQ ID NO: 89404 - DNA, 25 bp, Homo sapien
taatttctatccatctttgcttcaa

SEQ ID NO: 89405 - DNA, 25 bp, Homo sapien
taatttctatccgtctttgcttcaa

SEQ ID NO: 89406 - DNA, 25 bp, Homo sapien
taatttcttttccctgatgacatat

SEQ ID NO: 89407 - DNA, 25 bp, Homo sapien
taatttcttttccgtgatgacatat

SEQ ID NO: 89408 - DNA, 25 bp, Homo sapien
taatttgaaccacacacagtctaag

SEQ ID NO: 89409 - DNA, 25 bp, Homo sapien
taatttgaaccacgcacagtctaag

SEQ ID NO: 89410 - DNA, 25 bp, Homo sapien
taatttgcacacgtggagggaggga

SEQ ID NO: 89411 - DNA, 25 bp, Homo sapien
taatttgcacatgtggagggaggga

SEQ ID NO: 89412 - DNA, 25 bp, Homo sapien
taatttgcagatacaaagctggttt

SEQ ID NO: 89413 - DNA, 25 bp, Homo sapien
taatttgcagatacaaggctggttt

SEQ ID NO: 89414 - DNA, 25 bp, Homo sapien
taatttggaaactttaattgatgta

SEQ ID NO: 89415 - DNA, 25 bp, Homo sapien
taatttggaaactttagttgatgta

SEQ ID NO: 89416 - DNA, 25 bp, Homo sapien
taatttgtaagtcctgcaagatcat

SEQ ID NO: 89417 - DNA, 25 bp, Homo sapien
taatttgtaagtcgtgcaagatcat

SEQ ID NO: 89418 - DNA, 25 bp, Homo sapien
taatttgtgtttccctaattgctag

SEQ ID NO: 89419 - DNA, 25 bp, Homo sapien
taatttgtgtttctctaattgctag

SEQ ID NO: 89420 - DNA, 25 bp, Homo sapien
taatttgttttagcacctgatttag

SEQ ID NO: 89421 - DNA, 25 bp, Homo sapien
taatttgttttagtacctgatttag

SEQ ID NO: 89422 - DNA, 25 bp, Homo sapien
taattttaaacaatcaaacatggac

SEQ ID NO: 89423 - DNA, 25 bp, Homo sapien
taattttaaacgatcaaacatggac

SEQ ID NO: 89424 - DNA, 25 bp, Homo sapien
taattttccacttgtgcaaatcata

SEQ ID NO: 89425 - DNA, 25 bp, Homo sapien
taattttctacttgtgcaaatcata

SEQ ID NO: 89426 - DNA, 25 bp, Homo sapien
taattttctgcattcctcaacatag

SEQ ID NO: 89427 - DNA, 25 bp, Homo sapien
taattttctgcattgctcaacatag

SEQ ID NO: 89428 - DNA, 25 bp, Homo sapien
taattttctgcgcttagaatgctcc

SEQ ID NO: 89429 - DNA, 25 bp, Homo sapien
taattttctgctcttagaatgctcc

SEQ ID NO: 89430 - DNA, 25 bp, Homo sapien
taattttgcaccggagaaaatgggg

SEQ ID NO: 89431 - DNA, 25 bp, Homo sapien
taattttgcacgggagaaaatgggg

SEQ ID NO: 89432 - DNA, 25 bp, Homo sapien
taattttggctgcactttgaaggta

SEQ ID NO: 89433 - DNA, 25 bp, Homo sapien
taattttggctgcgctttgaaggta

SEQ ID NO: 89434 - DNA, 25 bp, Homo sapien
taattttggtttgaaaagccagggc

SEQ ID NO: 89435 - DNA, 25 bp, Homo sapien
taattttgtagaaaggagtgatgtg

SEQ ID NO: 89436 - DNA, 25 bp, Homo sapien
taattttgtagaaaggtgtgatgtg

SEQ ID NO: 89437 - DNA, 25 bp, Homo sapien
taattttgttttgaaaagccagggc

SEQ ID NO: 89438 - DNA, 25 bp, Homo sapien
taattttttaacaagtgccgtgatt

SEQ ID NO: 89439 - DNA, 25 bp, Homo sapien
taattttttaataagtgccgtgatt

SEQ ID NO: 89440 - DNA, 25 bp, Homo sapien
tacaaaaagaaaaaattagtatggc

SEQ ID NO: 89441 - DNA, 25 bp, Homo sapien
tacaaaaagccatgttaaaaaatac

SEQ ID NO: 89442 - DNA, 25 bp, Homo sapien
tacaaaaaggaaaaattagtatggc

SEQ ID NO: 89443 - DNA, 25 bp, Homo sapien
tacaaaaaggcatgttaaaaaatac

SEQ ID NO: 89444 - DNA, 25 bp, Homo sapien
tacaaaaatagttcatcatatgaca

SEQ ID NO: 89445 - DNA, 25 bp, Homo sapien
tacaaaaatggttcatcatatgaca

SEQ ID NO: 89446 - DNA, 25 bp, Homo sapien
tacaaaacagtttgcagattcctga

SEQ ID NO: 89447 - DNA, 25 bp, Homo sapien
tacaaaacagtttgcatattcctga

SEQ ID NO: 89448 - DNA, 25 bp, Homo sapien
tacaaaagagctattacgttgtgaa

SEQ ID NO: 89449 - DNA, 25 bp, Homo sapien
tacaaaagagctattaggttgtgaa

SEQ ID NO: 89450 - DNA, 25 bp, Homo sapien
tacaaaatccacttgcaacaaaaac

SEQ ID NO: 89451 - DNA, 25 bp, Homo sapien
tacaaaatccacttgcgacaaaaac

SEQ ID NO: 89452 - DNA, 25 bp, Homo sapien
tacaaaatccatcttttcagtcagt

SEQ ID NO: 89453 - DNA, 25 bp, Homo sapien
tacaaaatgcatcttttcagtcagt

SEQ ID NO: 89454 - DNA, 25 bp, Homo sapien
tacaaaatgcctagcaaaatgtacg

SEQ ID NO: 89455 - DNA, 25 bp, Homo sapien
tacaaaatgcctaggaaaatgtacg

SEQ ID NO: 89456 - DNA, 25 bp, Homo sapien
tacaaaattcacatggtagagctta

SEQ ID NO: 89457 - DNA, 25 bp, Homo sapien
tacaaaattgacgaattccttcaca

SEQ ID NO: 89458 - DNA, 25 bp, Homo sapien
tacaaaattgatgaattccttcaca

SEQ ID NO: 89459 - DNA, 25 bp, Homo sapien
tacaaaatttacatggtagagctta

SEQ ID NO: 89460 - DNA, 25 bp, Homo sapien
tacaaacaagcccggacagtgaaga

SEQ ID NO: 89461 - DNA, 25 bp, Homo sapien
tacaaacaagcctggacagtgaaga

SEQ ID NO: 89462 - DNA, 25 bp, Homo sapien
tacaaacgttgttaactcatttcac

SEQ ID NO: 89463 - DNA, 25 bp, Homo sapien
tacaaacgttgttagctcatttcac

SEQ ID NO: 89464 - DNA, 25 bp, Homo sapien
tacaaactagaagatgataaatttg

SEQ ID NO: 89465 - DNA, 25 bp, Homo sapien
tacaaactataagatgataaatttg

SEQ ID NO: 89466 - DNA, 25 bp, Homo sapien
tacaaactcaaaaaaagtctgaaga

SEQ ID NO: 89467 - DNA, 25 bp, Homo sapien
tacaaactcaaaacaagtctgaaga

SEQ ID NO: 89468 - DNA, 25 bp, Homo sapien
tacaaactgcatctcaatttcccct

SEQ ID NO: 89469 - DNA, 25 bp, Homo sapien
tacaaactggtccccgataaaaact

SEQ ID NO: 89470 - DNA, 25 bp, Homo sapien
tacaaactggtccctgataaaaact

SEQ ID NO: 89471 - DNA, 25 bp, Homo sapien
tacaaactgtatctcaatttcccct

SEQ ID NO: 89472 - DNA, 25 bp, Homo sapien
tacaaagggagaccgcgtttagttt

SEQ ID NO: 89473 - DNA, 25 bp, Homo sapien
tacaaagggagacctcgtttagttt

SEQ ID NO: 89474 - DNA, 25 bp, Homo sapien
tacaaataagaaagaactttgagat

SEQ ID NO: 89475 - DNA, 25 bp, Homo sapien
tacaaataagaaaggactttgagat

SEQ ID NO: 89476 - DNA, 25 bp, Homo sapien
tacaaatacagaacaatctcaactc

SEQ ID NO: 89477 - DNA, 25 bp, Homo sapien
tacaaatacagatcaatctcaactc

SEQ ID NO: 89478 - DNA, 25 bp, Homo sapien
tacaaatcaaagtggaatccacaag

SEQ ID NO: 89479 - DNA, 25 bp, Homo sapien
tacaaatcaaagtggagtccacaag

SEQ ID NO: 89480 - DNA, 25 bp, Homo sapien
tacaaatcaggtaaggaatacaggt

SEQ ID NO: 89481 - DNA, 25 bp, Homo sapien
tacaaatcaggtaatgaatacaggt

SEQ ID NO: 89482 - DNA, 25 bp, Homo sapien
tacaaatgcctccgcataccagaca

SEQ ID NO: 89483 - DNA, 25 bp, Homo sapien
tacaaatgcctctgcataccagaca

SEQ ID NO: 89484 - DNA, 25 bp, Homo sapien
tacaaatgctggtttattattttgg

SEQ ID NO: 89485 - DNA, 25 bp, Homo sapien
tacaaatggatgtcttttacagcaa

SEQ ID NO: 89486 - DNA, 25 bp, Homo sapien
tacaaatgggtgtcttttacagcaa

SEQ ID NO: 89487 - DNA, 25 bp, Homo sapien
tacaaatgttggtttattattttgg

SEQ ID NO: 89488 - DNA, 25 bp, Homo sapien
tacaaattctatgttgccatactcc

SEQ ID NO: 89489 - DNA, 25 bp, Homo sapien
tacaaattctatgttgtcatactcc

SEQ ID NO: 89490 - DNA, 25 bp, Homo sapien
tacaaattgtggttcttgaattgtc

SEQ ID NO: 89491 - DNA, 25 bp, Homo sapien
tacaaattgtggttgttgaattgtc

SEQ ID NO: 89492 - DNA, 25 bp, Homo sapien
tacaacaaaaagaaatggcagtacc

SEQ ID NO: 89493 - DNA, 25 bp, Homo sapien
tacaacaaaaagagatggcagtacc

SEQ ID NO: 89494 - DNA, 25 bp, Homo sapien
tacaacaacttaaagagattgacag

SEQ ID NO: 89495 - DNA, 25 bp, Homo sapien
tacaacaagcaatctatcctacaat

SEQ ID NO: 89496 - DNA, 25 bp, Homo sapien
tacaacaagcagtctatcctacaat

SEQ ID NO: 89497 - DNA, 25 bp, Homo sapien
tacaacaatttaaagagattgacag

SEQ ID NO: 89498 - DNA, 25 bp, Homo sapien
tacaacacatatgaatacacaacag

SEQ ID NO: 89499 - DNA, 25 bp, Homo sapien
tacaacacatatgactacacaacag

SEQ ID NO: 89500 - DNA, 25 bp, Homo sapien
tacaacacctctgtctgtgtgctct

SEQ ID NO: 89501 - DNA, 25 bp, Homo sapien
tacaacacctctgtttgtgtgctct

SEQ ID NO: 89502 - DNA, 25 bp, Homo sapien
tacaacagacccgataatcctcaga

SEQ ID NO: 89503 - DNA, 25 bp, Homo sapien
tacaacagaccctataatcctcaga

SEQ ID NO: 89504 - DNA, 25 bp, Homo sapien
tacaacagctgcaatggataacagc

SEQ ID NO: 89505 - DNA, 25 bp, Homo sapien
tacaacagctgcaatgtataacagc

SEQ ID NO: 89506 - DNA, 25 bp, Homo sapien
tacaacataggacaagagtagagaa

SEQ ID NO: 89507 - DNA, 25 bp, Homo sapien
tacaacatagggcaagagtagagaa

SEQ ID NO: 89508 - DNA, 25 bp, Homo sapien
tacaacatgataaaagcttgcttat

SEQ ID NO: 89509 - DNA, 25 bp, Homo sapien
tacaacatgataaaaggttgcttat

SEQ ID NO: 89510 - DNA, 25 bp, Homo sapien
tacaacatgatgatatggaacacac

SEQ ID NO: 89511 - DNA, 25 bp, Homo sapien
tacaacatgatgttatggaacacac

SEQ ID NO: 89512 - DNA, 25 bp, Homo sapien
tacaaccacagcagtcctaaaacag

SEQ ID NO: 89513 - DNA, 25 bp, Homo sapien
tacaaccagagcagtcctaaaacag

SEQ ID NO: 89514 - DNA, 25 bp, Homo sapien
tacaacctcattagcacgtcactaa

SEQ ID NO: 89515 - DNA, 25 bp, Homo sapien
tacaacctcattagcatgtcactaa

SEQ ID NO: 89516 - DNA, 25 bp, Homo sapien
tacaacgggaaggataacagtcata

SEQ ID NO: 89517 - DNA, 25 bp, Homo sapien
tacaacgggaatgataacagtcata

SEQ ID NO: 89518 - DNA, 25 bp, Homo sapien
tacaacgtggatcaatcttggaaac

SEQ ID NO: 89519 - DNA, 25 bp, Homo sapien
tacaacgtggatgaatcttggaaac

SEQ ID NO: 89520 - DNA, 25 bp, Homo sapien
tacaactaccaagcgaggcagagat

SEQ ID NO: 89521 - DNA, 25 bp, Homo sapien
tacaactaccaagtgaggcagagat

SEQ ID NO: 89522 - DNA, 25 bp, Homo sapien
tacaactatatacgtttatggcctt

SEQ ID NO: 89523 - DNA, 25 bp, Homo sapien
tacaactatatatgtttatggcctt

SEQ ID NO: 89524 - DNA, 25 bp, Homo sapien
tacaacttcatttctccctgcagac

SEQ ID NO: 89525 - DNA, 25 bp, Homo sapien
tacaactttatttctccctgcagac

SEQ ID NO: 89526 - DNA, 25 bp, Homo sapien
tacaactttgagacctgggccactc

SEQ ID NO: 89527 - DNA, 25 bp, Homo sapien
tacaactttgagacttgggccactc

SEQ ID NO: 89528 - DNA, 25 bp, Homo sapien
tacaagaaattatgaagctatttca

SEQ ID NO: 89529 - DNA, 25 bp, Homo sapien
tacaagaaattttgaagctatttca

SEQ ID NO: 89530 - DNA, 25 bp, Homo sapien
tacaagaacatgcggttccacagca

SEQ ID NO: 89531 - DNA, 25 bp, Homo sapien
tacaagaacatgtggttccacagca

SEQ ID NO: 89532 - DNA, 25 bp, Homo sapien
tacaagaactactgtattttctgcg

SEQ ID NO: 89533 - DNA, 25 bp, Homo sapien
tacaagaactattgtattttctgcg

SEQ ID NO: 89534 - DNA, 25 bp, Homo sapien
tacaagaggaccttttgcttaattt

SEQ ID NO: 89535 - DNA, 25 bp, Homo sapien
tacaagagggccttttgcttaattt

SEQ ID NO: 89536 - DNA, 25 bp, Homo sapien
tacaagagtacttaacacatgcatg

SEQ ID NO: 89537 - DNA, 25 bp, Homo sapien
tacaagagtacttgacacatgcatg

SEQ ID NO: 89538 - DNA, 25 bp, Homo sapien
tacaagataatgccgctgtgctatg

SEQ ID NO: 89539 - DNA, 25 bp, Homo sapien
tacaagataatgctgctgtgctatg

SEQ ID NO: 89540 - DNA, 25 bp, Homo sapien
tacaagatattcagttcctcagcca

SEQ ID NO: 89541 - DNA, 25 bp, Homo sapien
tacaagatattcggttcctcagcca

SEQ ID NO: 89542 - DNA, 25 bp, Homo sapien
tacaagatgcctatgtacgtggtat

SEQ ID NO: 89543 - DNA, 25 bp, Homo sapien
tacaagatgcctatgtgcgtggtat

SEQ ID NO: 89544 - DNA, 25 bp, Homo sapien
tacaagatttgaaaagaaattgtgg

SEQ ID NO: 89545 - DNA, 25 bp, Homo sapien
tacaagatttgaaaggaaattgtgg

SEQ ID NO: 89546 - DNA, 25 bp, Homo sapien
tacaagcacgaagcacaaagttcat

SEQ ID NO: 89547 - DNA, 25 bp, Homo sapien
tacaagcacgtttcaaaaaccacca

SEQ ID NO: 89548 - DNA, 25 bp, Homo sapien
tacaagcatgaagcacaaagttcat

SEQ ID NO: 89549 - DNA, 25 bp, Homo sapien
tacaagcatgtttcaaaaaccacca

SEQ ID NO: 89550 - DNA, 25 bp, Homo sapien
tacaagccgctgtgccgcccagccc

SEQ ID NO: 89551 - DNA, 25 bp, Homo sapien
tacaagcctctgtgccgcccagccc

SEQ ID NO: 89552 - DNA, 25 bp, Homo sapien
tacaagctgtaacacagtagacatt

SEQ ID NO: 89553 - DNA, 25 bp, Homo sapien
tacaagctgtaacatagtagacatt

SEQ ID NO: 89554 - DNA, 25 bp, Homo sapien
tacaagctgtaggcggatctaccat

SEQ ID NO: 89555 - DNA, 25 bp, Homo sapien
tacaagctgtaggtggatctaccat

SEQ ID NO: 89556 - DNA, 25 bp, Homo sapien
tacaaggaaagaagagctatcctag

SEQ ID NO: 89557 - DNA, 25 bp, Homo sapien
tacaaggaacgaagagctatcctag

SEQ ID NO: 89558 - DNA, 25 bp, Homo sapien
tacaaggataagaaaacaaaaagta

SEQ ID NO: 89559 - DNA, 25 bp, Homo sapien
tacaaggataaggaaacaaaaagta

SEQ ID NO: 89560 - DNA, 25 bp, Homo sapien
tacaagggaacacataaactgagga

SEQ ID NO: 89561 - DNA, 25 bp, Homo sapien
tacaagggaacatataaactgagga

SEQ ID NO: 89562 - DNA, 25 bp, Homo sapien
tacaaggtgctacgagaacatgtat

SEQ ID NO: 89563 - DNA, 25 bp, Homo sapien
tacaaggtgctatgagaacatgtat

SEQ ID NO: 89564 - DNA, 25 bp, Homo sapien
tacaagtcaatcttcctgatgaaca

SEQ ID NO: 89565 - DNA, 25 bp, Homo sapien
tacaagtcacctatgaaactgttct

SEQ ID NO: 89566 - DNA, 25 bp, Homo sapien
tacaagtcagtcttcctgatgaaca

SEQ ID NO: 89567 - DNA, 25 bp, Homo sapien
tacaagtcatctatgaaactgttct

SEQ ID NO: 89568 - DNA, 25 bp, Homo sapien
tacaagtcatgccacagaaataaaa

SEQ ID NO: 89569 - DNA, 25 bp, Homo sapien
tacaagtcgtgccacagaaataaaa

SEQ ID NO: 89570 - DNA, 25 bp, Homo sapien
tacaagtgtgttctttcagctcaca

SEQ ID NO: 89571 - DNA, 25 bp, Homo sapien
tacaagtgtgttttttcagctcaca

SEQ ID NO: 89572 - DNA, 25 bp, Homo sapien
tacaagttcttggccttctgtgtgc

SEQ ID NO: 89573 - DNA, 25 bp, Homo sapien
tacaagttcttggcgttctgtgtgc

SEQ ID NO: 89574 - DNA, 25 bp, Homo sapien
tacaataatctgaactgtaagtggc

SEQ ID NO: 89575 - DNA, 25 bp, Homo sapien
tacaataatttgaactgtaagtggc

SEQ ID NO: 89576 - DNA, 25 bp, Homo sapien
tacaatacaaacacataaatcaatg

SEQ ID NO: 89577 - DNA, 25 bp, Homo sapien
tacaatacagacacataaatcaatg

SEQ ID NO: 89578 - DNA, 25 bp, Homo sapien
tacaatagagaccatcaacaaagga

SEQ ID NO: 89579 - DNA, 25 bp, Homo sapien
tacaatagagactatcaacaaagga

SEQ ID NO: 89580 - DNA, 25 bp, Homo sapien
tacaataggtaggtgtactggaatg

SEQ ID NO: 89581 - DNA, 25 bp, Homo sapien
tacaataggtaggtgtgctggaatg

SEQ ID NO: 89582 - DNA, 25 bp, Homo sapien
tacaatatcagcccattaagcatca

SEQ ID NO: 89583 - DNA, 25 bp, Homo sapien
tacaatatcagctcattaagcatca

SEQ ID NO: 89584 - DNA, 25 bp, Homo sapien
tacaatatctgccctgcaatgttgc

SEQ ID NO: 89585 - DNA, 25 bp, Homo sapien
tacaatatctgccttgcaatgttgc

SEQ ID NO: 89586 - DNA, 25 bp, Homo sapien
tacaatcagcctctctctttttatt

SEQ ID NO: 89587 - DNA, 25 bp, Homo sapien
tacaatcagcctttctctttttatt

SEQ ID NO: 89588 - DNA, 25 bp, Homo sapien
tacaatcattgacaggcattttggc

SEQ ID NO: 89589 - DNA, 25 bp, Homo sapien
tacaatcattgacaggtattttggc

SEQ ID NO: 89590 - DNA, 25 bp, Homo sapien
tacaatgagttcatgcatcaactat

SEQ ID NO: 89591 - DNA, 25 bp, Homo sapien
tacaatgagttcgtgcatcaactat

SEQ ID NO: 89592 - DNA, 25 bp, Homo sapien
tacaatgcaaggccatgcatggaaa

SEQ ID NO: 89593 - DNA, 25 bp, Homo sapien
tacaatgcaaggtcatgcatggaaa

SEQ ID NO: 89594 - DNA, 25 bp, Homo sapien
tacaatgcagcatattaaaattgcc

SEQ ID NO: 89595 - DNA, 25 bp, Homo sapien
tacaatgcagcgtattaaaattgcc

SEQ ID NO: 89596 - DNA, 25 bp, Homo sapien
tacaatggattgatatgattattgg

SEQ ID NO: 89597 - DNA, 25 bp, Homo sapien
tacaatggattgatgtgattattgg

SEQ ID NO: 89598 - DNA, 25 bp, Homo sapien
tacaatgggagtagtgatcaggaca

SEQ ID NO: 89599 - DNA, 25 bp, Homo sapien
tacaatgggagtggtgatcaggaca

SEQ ID NO: 89600 - DNA, 25 bp, Homo sapien
tacaatgtaattcttccggtgaatt

SEQ ID NO: 89601 - DNA, 25 bp, Homo sapien
tacaatgtaattcttctggtgaatt

SEQ ID NO: 89602 - DNA, 25 bp, Homo sapien
tacaatgtctacagatgccagaact

SEQ ID NO: 89603 - DNA, 25 bp, Homo sapien
tacaatgtctacggatgccagaact

SEQ ID NO: 89604 - DNA, 25 bp, Homo sapien
tacaatgtttcaatcgctaaaacca

SEQ ID NO: 89605 - DNA, 25 bp, Homo sapien
tacaatgtttcaattgctaaaacca

SEQ ID NO: 89606 - DNA, 25 bp, Homo sapien
tacaattcaacacgagatttgggca

SEQ ID NO: 89607 - DNA, 25 bp, Homo sapien
tacaattcgacacgagatttgggca

SEQ ID NO: 89608 - DNA, 25 bp, Homo sapien
tacaatttcaacggcagcttcctcc

SEQ ID NO: 89609 - DNA, 25 bp, Homo sapien
tacaatttcaagggcagcttcctcc

SEQ ID NO: 89610 - DNA, 25 bp, Homo sapien
tacacaaaaagggataaagaataat

SEQ ID NO: 89611 - DNA, 25 bp, Homo sapien
tacacaaaataaataactgaagaaa

SEQ ID NO: 89612 - DNA, 25 bp, Homo sapien
tacacaaaataaatcactgaagaaa

SEQ ID NO: 89613 - DNA, 25 bp, Homo sapien
tacacaaaatgggataaagaataat

SEQ ID NO: 89614 - DNA, 25 bp, Homo sapien
tacacaaacactcactgacccgacg

SEQ ID NO: 89615 - DNA, 25 bp, Homo sapien
tacacaaacgctcactgacccgacg

SEQ ID NO: 89616 - DNA, 25 bp, Homo sapien
tacacaaggctctcgacttacctga

SEQ ID NO: 89617 - DNA, 25 bp, Homo sapien
tacacaaggctcttgacttacctga

SEQ ID NO: 89618 - DNA, 25 bp, Homo sapien
tacacaatcatcagataaaaattgt

SEQ ID NO: 89619 - DNA, 25 bp, Homo sapien
tacacaatcgtcagataaaaattgt

SEQ ID NO: 89620 - DNA, 25 bp, Homo sapien
tacacacaggatagacagttatatc

SEQ ID NO: 89621 - DNA, 25 bp, Homo sapien
tacacacaggatggacagttatatc

SEQ ID NO: 89622 - DNA, 25 bp, Homo sapien
tacacaccttaaaacctgctgatga

SEQ ID NO: 89623 - DNA, 25 bp, Homo sapien
tacacaccttaacacctgctgatga

SEQ ID NO: 89624 - DNA, 25 bp, Homo sapien
tacacacgaaaggaaaaatgtaaat

SEQ ID NO: 89625 - DNA, 25 bp, Homo sapien
tacacacgaaaggataaatgtaaat

SEQ ID NO: 89626 - DNA, 25 bp, Homo sapien
tacacactatcttcctcattttcct

SEQ ID NO: 89627 - DNA, 25 bp, Homo sapien
tacacactatctttctcattttcct

SEQ ID NO: 89628 - DNA, 25 bp, Homo sapien
tacacactgcacaccatcttcctga

SEQ ID NO: 89629 - DNA, 25 bp, Homo sapien
tacacactgcacgccatcttcctga

SEQ ID NO: 89630 - DNA, 25 bp, Homo sapien
tacacagaggatcatgtcatctaca

SEQ ID NO: 89631 - DNA, 25 bp, Homo sapien
tacacagaggatcgtgtcatctaca

SEQ ID NO: 89632 - DNA, 25 bp, Homo sapien
tacacagccattaaacatgaacctg

SEQ ID NO: 89633 - DNA, 25 bp, Homo sapien
tacacagccattagacatgaacctg

SEQ ID NO: 89634 - DNA, 25 bp, Homo sapien
tacacataactcatagggttttcat

SEQ ID NO: 89635 - DNA, 25 bp, Homo sapien
tacacataactcgtagggttttcat

SEQ ID NO: 89636 - DNA, 25 bp, Homo sapien
tacacatacacacaagagacatgcc

SEQ ID NO: 89637 - DNA, 25 bp, Homo sapien
tacacatacacccaagagacatgcc

SEQ ID NO: 89638 - DNA, 25 bp, Homo sapien
tacacatccgggcagcttcaagatt

SEQ ID NO: 89639 - DNA, 25 bp, Homo sapien
tacacatctgggcagcttcaagatt

SEQ ID NO: 89640 - DNA, 25 bp, Homo sapien
tacacatgaccgctatactattttt

SEQ ID NO: 89641 - DNA, 25 bp, Homo sapien
tacacatgcccgctatactattttt

SEQ ID NO: 89642 - DNA, 25 bp, Homo sapien
tacacatgtgaacctgggtagtccc

SEQ ID NO: 89643 - DNA, 25 bp, Homo sapien
tacacatgtgaatctgggtagtccc

SEQ ID NO: 89644 - DNA, 25 bp, Homo sapien
tacacattcatctcttcttatggga

SEQ ID NO: 89645 - DNA, 25 bp, Homo sapien
tacacattcatctgttcttatggga

SEQ ID NO: 89646 - DNA, 25 bp, Homo sapien
tacacattttactcattctttactg

SEQ ID NO: 89647 - DNA, 25 bp, Homo sapien
tacacattttactcgttctttactg

SEQ ID NO: 89648 - DNA, 25 bp, Homo sapien
tacaccaagaacacgcttccttgta

SEQ ID NO: 89649 - DNA, 25 bp, Homo sapien
tacaccaagaacatgcttccttgta

SEQ ID NO: 89650 - DNA, 25 bp, Homo sapien
tacaccacaccccttgctgaatgag

SEQ ID NO: 89651 - DNA, 25 bp, Homo sapien
tacaccacaccctttgctgaatgag

SEQ ID NO: 89652 - DNA, 25 bp, Homo sapien
tacaccagaatattatttagcaata

SEQ ID NO: 89653 - DNA, 25 bp, Homo sapien
tacaccagaatgttatttagcaata

SEQ ID NO: 89654 - DNA, 25 bp, Homo sapien
tacacccaacgtgcaggtggtcatt

SEQ ID NO: 89655 - DNA, 25 bp, Homo sapien
tacacccaatgtgcaggtggtcatt

SEQ ID NO: 89656 - DNA, 25 bp, Homo sapien
tacaccctacgcacatgaagaccta

SEQ ID NO: 89657 - DNA, 25 bp, Homo sapien
tacaccctatgcacatgaagaccta

SEQ ID NO: 89658 - DNA, 25 bp, Homo sapien
tacaccctccaaacgtaaccctcta

SEQ ID NO: 89659 - DNA, 25 bp, Homo sapien
tacaccctccaaatgtaaccctcta

SEQ ID NO: 89660 - DNA, 25 bp, Homo sapien
tacacccttgaacctggtttcttcg

SEQ ID NO: 89661 - DNA, 25 bp, Homo sapien
tacacccttgagcctggtttcttcg

SEQ ID NO: 89662 - DNA, 25 bp, Homo sapien
tacaccgttgtcagaattaaatttc

SEQ ID NO: 89663 - DNA, 25 bp, Homo sapien
tacaccgttgtcggaattaaatttc

SEQ ID NO: 89664 - DNA, 25 bp, Homo sapien
tacacctattttacaggtggctgaa

SEQ ID NO: 89665 - DNA, 25 bp, Homo sapien
tacacctattttagaggtggctgaa

SEQ ID NO: 89666 - DNA, 25 bp, Homo sapien
tacacctcataaaaacttcagtgga

SEQ ID NO: 89667 - DNA, 25 bp, Homo sapien
tacacctcgtaaaaacttcagtgga

SEQ ID NO: 89668 - DNA, 25 bp, Homo sapien
tacacgtaaatctcaatctggaagg

SEQ ID NO: 89669 - DNA, 25 bp, Homo sapien
tacacgtaaatcttaatctggaagg

SEQ ID NO: 89670 - DNA, 25 bp, Homo sapien
tacacgttcttcctcttggacccca

SEQ ID NO: 89671 - DNA, 25 bp, Homo sapien
tacacgttcttcctgttggacccca

SEQ ID NO: 89672 - DNA, 25 bp, Homo sapien
tacactacaattgagcacatttgtc

SEQ ID NO: 89673 - DNA, 25 bp, Homo sapien
tacactacagttgagcacatttgtc

SEQ ID NO: 89674 - DNA, 25 bp, Homo sapien
tacactatactgtctcccgtgaggt

SEQ ID NO: 89675 - DNA, 25 bp, Homo sapien
tacactatccatagagaagtttgtt

SEQ ID NO: 89676 - DNA, 25 bp, Homo sapien
tacactatccatagggaagtttgtt

SEQ ID NO: 89677 - DNA, 25 bp, Homo sapien
tacactatgctgtctcccgtgaggt

SEQ ID NO: 89678 - DNA, 25 bp, Homo sapien
tacactcaataaaacctgttaataa

SEQ ID NO: 89679 - DNA, 25 bp, Homo sapien
tacactcaataaatcctgttaataa

SEQ ID NO: 89680 - DNA, 25 bp, Homo sapien
tacactcacttccagctctaggcaa

SEQ ID NO: 89681 - DNA, 25 bp, Homo sapien
tacactcacttgcagctctaggcaa

SEQ ID NO: 89682 - DNA, 25 bp, Homo sapien
tacactcagctcaagtcttcactga

SEQ ID NO: 89683 - DNA, 25 bp, Homo sapien
tacactcagctcaagttttcactga

SEQ ID NO: 89684 - DNA, 25 bp, Homo sapien
tacactctcagcaattccacttaag

SEQ ID NO: 89685 - DNA, 25 bp, Homo sapien
tacactctcagcacttccacttaag

SEQ ID NO: 89686 - DNA, 25 bp, Homo sapien
tacactctctcacatattcacacgt

SEQ ID NO: 89687 - DNA, 25 bp, Homo sapien
tacactctttcacatattcacacgt

SEQ ID NO: 89688 - DNA, 25 bp, Homo sapien
tacactgactctctcagttcctaca

SEQ ID NO: 89689 - DNA, 25 bp, Homo sapien
tacactgagtctctcagttcctaca

SEQ ID NO: 89690 - DNA, 25 bp, Homo sapien
tacactgcacactcgtgaaacagtt

SEQ ID NO: 89691 - DNA, 25 bp, Homo sapien
tacactgcacacttgtgaaacagtt

SEQ ID NO: 89692 - DNA, 25 bp, Homo sapien
tacactggagaccgaaaccatgatg

SEQ ID NO: 89693 - DNA, 25 bp, Homo sapien
tacactggagactgaaaccatgatg

SEQ ID NO: 89694 - DNA, 25 bp, Homo sapien
tacactggattaaaacaaattgtga

SEQ ID NO: 89695 - DNA, 25 bp, Homo sapien
tacactggattacaacaaattgtga

SEQ ID NO: 89696 - DNA, 25 bp, Homo sapien
tacactggcacaacatacattgcaa

SEQ ID NO: 89697 - DNA, 25 bp, Homo sapien
tacactggcacaccatacattgcaa

SEQ ID NO: 89698 - DNA, 25 bp, Homo sapien
tacactgtaataacgtcactaaagc

SEQ ID NO: 89699 - DNA, 25 bp, Homo sapien
tacactgtaataaggtcactaaagc

SEQ ID NO: 89700 - DNA, 25 bp, Homo sapien
tacactgtatcagctcatcatctgc

SEQ ID NO: 89701 - DNA, 25 bp, Homo sapien
tacactgtatcagctcgtcatctgc

SEQ ID NO: 89702 - DNA, 25 bp, Homo sapien
tacactgtcatcacatgtgatttct

SEQ ID NO: 89703 - DNA, 25 bp, Homo sapien
tacactgtcgtcacatgtgatttct

SEQ ID NO: 89704 - DNA, 25 bp, Homo sapien
tacactgtggcaacttcagaaatca

SEQ ID NO: 89705 - DNA, 25 bp, Homo sapien
tacactgtggcagcttcagaaatca

SEQ ID NO: 89706 - DNA, 25 bp, Homo sapien
tacactttaatgccctcaaatatgg

SEQ ID NO: 89707 - DNA, 25 bp, Homo sapien
tacactttacccataatttccaggt

SEQ ID NO: 89708 - DNA, 25 bp, Homo sapien
tacactttacccgtaatttccaggt

SEQ ID NO: 89709 - DNA, 25 bp, Homo sapien
tacactttcattactgagatctctg

SEQ ID NO: 89710 - DNA, 25 bp, Homo sapien
tacactttctttactgagatctctg

SEQ ID NO: 89711 - DNA, 25 bp, Homo sapien
tacacttttatgccctcaaatatgg

SEQ ID NO: 89712 - DNA, 25 bp, Homo sapien
tacacttttttggttcaagttgatt

SEQ ID NO: 89713 - DNA, 25 bp, Homo sapien
tacacttttttgtttcaagttgatt

SEQ ID NO: 89714 - DNA, 25 bp, Homo sapien
tacagaaaaatcgagcagaaagcac

SEQ ID NO: 89715 - DNA, 25 bp, Homo sapien
tacagaaaaatcgagcggaaagcac

SEQ ID NO: 89716 - DNA, 25 bp, Homo sapien
tacagaaaacagtaagaaatcaatg

SEQ ID NO: 89717 - DNA, 25 bp, Homo sapien
tacagaaaagaaatgcttgtgttac

SEQ ID NO: 89718 - DNA, 25 bp, Homo sapien
tacagaaaagaactgcttgtgttac

SEQ ID NO: 89719 - DNA, 25 bp, Homo sapien
tacagaaaatagtaagaaatcaatg

SEQ ID NO: 89720 - DNA, 25 bp, Homo sapien
tacagaaacacaaaatgagggtgac

SEQ ID NO: 89721 - DNA, 25 bp, Homo sapien
tacagaaacacaaattgagggtgac

SEQ ID NO: 89722 - DNA, 25 bp, Homo sapien
tacagaaaccaatccaaaaaggata

SEQ ID NO: 89723 - DNA, 25 bp, Homo sapien
tacagaaagagctttcaataaaatc

SEQ ID NO: 89724 - DNA, 25 bp, Homo sapien
tacagaaagagttttcaataaaatc

SEQ ID NO: 89725 - DNA, 25 bp, Homo sapien
tacagaaatcaatccaaaaaggata

SEQ ID NO: 89726 - DNA, 25 bp, Homo sapien
tacagaactatagggtgcctttcat

SEQ ID NO: 89727 - DNA, 25 bp, Homo sapien
tacagaactatagtgtgcctttcat

SEQ ID NO: 89728 - DNA, 25 bp, Homo sapien
tacagaagaaggcatccttgaagtc

SEQ ID NO: 89729 - DNA, 25 bp, Homo sapien
tacagaagaaggcgtccttgaagtc

SEQ ID NO: 89730 - DNA, 25 bp, Homo sapien
tacagaagcggaagcctgagcaaag

SEQ ID NO: 89731 - DNA, 25 bp, Homo sapien
tacagaaggtggagacatatgtgtc

SEQ ID NO: 89732 - DNA, 25 bp, Homo sapien
tacagaaggtggagacgtatgtgtc

SEQ ID NO: 89733 - DNA, 25 bp, Homo sapien
tacagaagtggaagcctgagcaaag

SEQ ID NO: 89734 - DNA, 25 bp, Homo sapien
tacagaagtttgatttttaaaatgc

SEQ ID NO: 89735 - DNA, 25 bp, Homo sapien
tacagaagtttgttttttaaaatgc

SEQ ID NO: 89736 - DNA, 25 bp, Homo sapien
tacagaatagatgtattagcaggca

SEQ ID NO: 89737 - DNA, 25 bp, Homo sapien
tacagaatagatgtgttagcaggca

SEQ ID NO: 89738 - DNA, 25 bp, Homo sapien
tacagacagtcttcatgcaaagaaa

SEQ ID NO: 89739 - DNA, 25 bp, Homo sapien
tacagacatagaagaaacaccctat

SEQ ID NO: 89740 - DNA, 25 bp, Homo sapien
tacagacatggaagaaacaccctat

SEQ ID NO: 89741 - DNA, 25 bp, Homo sapien
tacagacattcttcatgcaaagaaa

SEQ ID NO: 89742 - DNA, 25 bp, Homo sapien
tacagaccactatctacacggaagc

SEQ ID NO: 89743 - DNA, 25 bp, Homo sapien
tacagaccactctctacacggaagc

SEQ ID NO: 89744 - DNA, 25 bp, Homo sapien
tacagacctagtcccgattcttgct

SEQ ID NO: 89745 - DNA, 25 bp, Homo sapien
tacagacctagtcctgattcttgct

SEQ ID NO: 89746 - DNA, 25 bp, Homo sapien
tacagactctatgaaaaaaaaatat

SEQ ID NO: 89747 - DNA, 25 bp, Homo sapien
tacagactctatgagaaaaaaatat

SEQ ID NO: 89748 - DNA, 25 bp, Homo sapien
tacagagaagcagaagataaaaagc

SEQ ID NO: 89749 - DNA, 25 bp, Homo sapien
tacagagaagcggaagataaaaagc

SEQ ID NO: 89750 - DNA, 25 bp, Homo sapien
tacagagaatctcatttcttgacta

SEQ ID NO: 89751 - DNA, 25 bp, Homo sapien
tacagagaatctcgtttcttgacta

SEQ ID NO: 89752 - DNA, 25 bp, Homo sapien
tacagagaattggaatcagaagaag

SEQ ID NO: 89753 - DNA, 25 bp, Homo sapien
tacagagaattggagtcagaagaag

SEQ ID NO: 89754 - DNA, 25 bp, Homo sapien
tacagagactacgtggacagcaaat

SEQ ID NO: 89755 - DNA, 25 bp, Homo sapien
tacagagactacgtgggcagcaaat

SEQ ID NO: 89756 - DNA, 25 bp, Homo sapien
tacagaggatcacattctagttttg

SEQ ID NO: 89757 - DNA, 25 bp, Homo sapien
tacagaggatcagattctagttttg

SEQ ID NO: 89758 - DNA, 25 bp, Homo sapien
tacagaggttcaatcctagggctca

SEQ ID NO: 89759 - DNA, 25 bp, Homo sapien
tacagaggttcagtcctagggctca

SEQ ID NO: 89760 - DNA, 25 bp, Homo sapien
tacagagttcacagtattcatattt

SEQ ID NO: 89761 - DNA, 25 bp, Homo sapien
tacagagttcacggtattcatattt

SEQ ID NO: 89762 - DNA, 25 bp, Homo sapien
tacagataaatgatcaataacagtg

SEQ ID NO: 89763 - DNA, 25 bp, Homo sapien
tacagataaatgattaataacagtg

SEQ ID NO: 89764 - DNA, 25 bp, Homo sapien
tacagatgattttgcttgtccttag

SEQ ID NO: 89765 - DNA, 25 bp, Homo sapien
tacagatgattttggttgtccttag

SEQ ID NO: 89766 - DNA, 25 bp, Homo sapien
tacagatggcaattttcacaaagaa

SEQ ID NO: 89767 - DNA, 25 bp, Homo sapien
tacagatggcagttttcacaaagaa

SEQ ID NO: 89768 - DNA, 25 bp, Homo sapien
tacagatgtgtgactcatttgcata

SEQ ID NO: 89769 - DNA, 25 bp, Homo sapien
tacagatgtgtgactcgtttgcata

SEQ ID NO: 89770 - DNA, 25 bp, Homo sapien
tacagcaacataactcctgagtgtt

SEQ ID NO: 89771 - DNA, 25 bp, Homo sapien
tacagcaacatgactcctgagtgtt

SEQ ID NO: 89772 - DNA, 25 bp, Homo sapien
tacagcaacattgccttccagtgtg

SEQ ID NO: 89773 - DNA, 25 bp, Homo sapien
tacagcaacattgtcttccagtgtg

SEQ ID NO: 89774 - DNA, 25 bp, Homo sapien
tacagcaagcgacaagtcaaagaag

SEQ ID NO: 89775 - DNA, 25 bp, Homo sapien
tacagcaagtgacaagtcaaagaag

SEQ ID NO: 89776 - DNA, 25 bp, Homo sapien
tacagcacaaatcacccaaacaaat

SEQ ID NO: 89777 - DNA, 25 bp, Homo sapien
tacagcacaaatcagccaaacaaat

SEQ ID NO: 89778 - DNA, 25 bp, Homo sapien
tacagcacattcccaatggtgtcct

SEQ ID NO: 89779 - DNA, 25 bp, Homo sapien
tacagcacattcccgatggtgtcct

SEQ ID NO: 89780 - DNA, 25 bp, Homo sapien
tacagcatgtatgctttcaaataga

SEQ ID NO: 89781 - DNA, 25 bp, Homo sapien
tacagcatttatgctttcaaataga

SEQ ID NO: 89782 - DNA, 25 bp, Homo sapien
tacagccacgtagggcctcaatgca

SEQ ID NO: 89783 - DNA, 25 bp, Homo sapien
tacagccatgtagggcctcaatgca

SEQ ID NO: 89784 - DNA, 25 bp, Homo sapien
tacagccccttagatttcgttgcac

SEQ ID NO: 89785 - DNA, 25 bp, Homo sapien
tacagccccttaggtttcgttgcac

SEQ ID NO: 89786 - DNA, 25 bp, Homo sapien
tacagcctgatatactgaatatttt

SEQ ID NO: 89787 - DNA, 25 bp, Homo sapien
tacagcctggtatactgaatatttt

SEQ ID NO: 89788 - DNA, 25 bp, Homo sapien
tacagctaatatccagaaagggtaa

SEQ ID NO: 89789 - DNA, 25 bp, Homo sapien
tacagctaatatcctgaaagggtaa

SEQ ID NO: 89790 - DNA, 25 bp, Homo sapien
tacagctcatggtcctgtgcaaatt

SEQ ID NO: 89791 - DNA, 25 bp, Homo sapien
tacagctcatggtcttgtgcaaatt

SEQ ID NO: 89792 - DNA, 25 bp, Homo sapien
tacagctccaaaggtagaatcatca

SEQ ID NO: 89793 - DNA, 25 bp, Homo sapien
tacagctccgaaggtagaatcatca

SEQ ID NO: 89794 - DNA, 25 bp, Homo sapien
tacagctcttggaaaaaaggtctgt

SEQ ID NO: 89795 - DNA, 25 bp, Homo sapien
tacagctcttggacaaaaggtctgt

SEQ ID NO: 89796 - DNA, 25 bp, Homo sapien
tacagctggaattcttgctatgcta

SEQ ID NO: 89797 - DNA, 25 bp, Homo sapien
tacagctgggattcttgctatgcta

SEQ ID NO: 89798 - DNA, 25 bp, Homo sapien
tacagctttgatcaaaacactcaaa

SEQ ID NO: 89799 - DNA, 25 bp, Homo sapien
tacagctttgatcgaaacactcaaa

SEQ ID NO: 89800 - DNA, 25 bp, Homo sapien
tacaggagagtttgggtcagcctat

SEQ ID NO: 89801 - DNA, 25 bp, Homo sapien
tacaggagcgtttgggtcagcctat

SEQ ID NO: 89802 - DNA, 25 bp, Homo sapien
tacaggatatgaacggagtattcaa

SEQ ID NO: 89803 - DNA, 25 bp, Homo sapien
tacaggatatgaactgagtattcaa

SEQ ID NO: 89804 - DNA, 25 bp, Homo sapien
tacaggcaactaaagaatgatttgc

SEQ ID NO: 89805 - DNA, 25 bp, Homo sapien
tacaggcagctaaagaatgatttgc

SEQ ID NO: 89806 - DNA, 25 bp, Homo sapien
tacaggcgcgcatcaccatgcatag

SEQ ID NO: 89807 - DNA, 25 bp, Homo sapien
tacaggcgcgcatcactatgcatag

SEQ ID NO: 89808 - DNA, 25 bp, Homo sapien
tacaggcttatttttagagacaggt

SEQ ID NO: 89809 - DNA, 25 bp, Homo sapien
tacaggcttgtttttagagacaggt

SEQ ID NO: 89810 - DNA, 25 bp, Homo sapien
tacagggaaacaaaccaaaacagca

SEQ ID NO: 89811 - DNA, 25 bp, Homo sapien
tacagggaagcaaaccaaaacagca

SEQ ID NO: 89812 - DNA, 25 bp, Homo sapien
tacagggacaagaaatggaaccagc

SEQ ID NO: 89813 - DNA, 25 bp, Homo sapien
tacagggacgagaaatggaaccagc

SEQ ID NO: 89814 - DNA, 25 bp, Homo sapien
tacagggagtagagcagcttctgca

SEQ ID NO: 89815 - DNA, 25 bp, Homo sapien
tacagggagtatagcagcttctgca

SEQ ID NO: 89816 - DNA, 25 bp, Homo sapien
tacagggctataagagaataaattc

SEQ ID NO: 89817 - DNA, 25 bp, Homo sapien
tacagggctataagagcataaattc

SEQ ID NO: 89818 - DNA, 25 bp, Homo sapien
tacagggggtaaggatgtctcatat

SEQ ID NO: 89819 - DNA, 25 bp, Homo sapien
tacagggggtaaggttgtctcatat

SEQ ID NO: 89820 - DNA, 25 bp, Homo sapien
tacagggtcagagtagataattgct

SEQ ID NO: 89821 - DNA, 25 bp, Homo sapien
tacagggtgagagtagataattgct

SEQ ID NO: 89822 - DNA, 25 bp, Homo sapien
tacaggtaaaaactgaaatggaaga

SEQ ID NO: 89823 - DNA, 25 bp, Homo sapien
tacaggtacttgtttttctgtgggc

SEQ ID NO: 89824 - DNA, 25 bp, Homo sapien
tacaggtagaaactgaaatggaaga

SEQ ID NO: 89825 - DNA, 25 bp, Homo sapien
tacaggtatttgtttttctgtgggc

SEQ ID NO: 89826 - DNA, 25 bp, Homo sapien
tacaggttatttcccatggagcaaa

SEQ ID NO: 89827 - DNA, 25 bp, Homo sapien
tacaggttattttccatggagcaaa

SEQ ID NO: 89828 - DNA, 25 bp, Homo sapien
tacaggttcacataggtcagctcca

SEQ ID NO: 89829 - DNA, 25 bp, Homo sapien
tacaggttcacgtaggtcagctcca

SEQ ID NO: 89830 - DNA, 25 bp, Homo sapien
tacagtaaacagggccattgatagt

SEQ ID NO: 89831 - DNA, 25 bp, Homo sapien
tacagtaaatagggccattgatagt

SEQ ID NO: 89832 - DNA, 25 bp, Homo sapien
tacagtaaatgcagcgagaagaatg

SEQ ID NO: 89833 - DNA, 25 bp, Homo sapien
tacagtaaatgcagtgagaagaatg

SEQ ID NO: 89834 - DNA, 25 bp, Homo sapien
tacagtaattatttataggaatcca

SEQ ID NO: 89835 - DNA, 25 bp, Homo sapien
tacagtaattatttgtaggaatcca

SEQ ID NO: 89836 - DNA, 25 bp, Homo sapien
tacagtagacaaacatacccaatca

SEQ ID NO: 89837 - DNA, 25 bp, Homo sapien
tacagtagataaacatacccaatca

SEQ ID NO: 89838 - DNA, 25 bp, Homo sapien
tacagtattatagctggtacataaa

SEQ ID NO: 89839 - DNA, 25 bp, Homo sapien
tacagtattatagttggtacataaa

SEQ ID NO: 89840 - DNA, 25 bp, Homo sapien
tacagtcagggactcatatctcatt

SEQ ID NO: 89841 - DNA, 25 bp, Homo sapien
tacagtcagggattcatatctcatt

SEQ ID NO: 89842 - DNA, 25 bp, Homo sapien
tacagtctgcagagaaaaatgctga

SEQ ID NO: 89843 - DNA, 25 bp, Homo sapien
tacagtcttcagagaaaaatgctga

SEQ ID NO: 89844 - DNA, 25 bp, Homo sapien
tacagtgcaagaaacggcagtcatc

SEQ ID NO: 89845 - DNA, 25 bp, Homo sapien
tacagtgcaagaaatggcagtcatc

SEQ ID NO: 89846 - DNA, 25 bp, Homo sapien
tacagtgcaagctaaaaacatactc

SEQ ID NO: 89847 - DNA, 25 bp, Homo sapien
tacagtgcgagctaaaaacatactc

SEQ ID NO: 89848 - DNA, 25 bp, Homo sapien
tacagtgctataagacagtggaaag

SEQ ID NO: 89849 - DNA, 25 bp, Homo sapien
tacagtgctataaggcagtggaaag

SEQ ID NO: 89850 - DNA, 25 bp, Homo sapien
tacagtgcttacaggcagtttcttt

SEQ ID NO: 89851 - DNA, 25 bp, Homo sapien
tacagtgcttataggcagtttcttt

SEQ ID NO: 89852 - DNA, 25 bp, Homo sapien
tacagtgtctacacatttgatgata

SEQ ID NO: 89853 - DNA, 25 bp, Homo sapien
tacagtgtctacatatttgatgata

SEQ ID NO: 89854 - DNA, 25 bp, Homo sapien
tacagttaacaacatacttactgat

SEQ ID NO: 89855 - DNA, 25 bp, Homo sapien
tacagttaacatcatacttactgat

SEQ ID NO: 89856 - DNA, 25 bp, Homo sapien
tacagttggctaaatatggcatttg

SEQ ID NO: 89857 - DNA, 25 bp, Homo sapien
tacagttggttaaatatggcatttg

SEQ ID NO: 89858 - DNA, 25 bp, Homo sapien
tacagtttagctgaggatcattctg

SEQ ID NO: 89859 - DNA, 25 bp, Homo sapien
tacagtttagctgaggctcattctg

SEQ ID NO: 89860 - DNA, 25 bp, Homo sapien
tacagtttagtcagagtcaagagca

SEQ ID NO: 89861 - DNA, 25 bp, Homo sapien
tacagtttagttagagtcaagagca

SEQ ID NO: 89862 - DNA, 25 bp, Homo sapien
tacataaaaacagagaaacaacatg

SEQ ID NO: 89863 - DNA, 25 bp, Homo sapien
tacataaaaacagggaaacaacatg

SEQ ID NO: 89864 - DNA, 25 bp, Homo sapien
tacataaacttacaaaaagatgata

SEQ ID NO: 89865 - DNA, 25 bp, Homo sapien
tacataaacttacgaaaagatgata

SEQ ID NO: 89866 - DNA, 25 bp, Homo sapien
tacataacaaaatcaaaacgttgaa

SEQ ID NO: 89867 - DNA, 25 bp, Homo sapien
tacataacaaaatcaagacgttgaa

SEQ ID NO: 89868 - DNA, 25 bp, Homo sapien
tacataagtgaattagaagttttag

SEQ ID NO: 89869 - DNA, 25 bp, Homo sapien
tacataagtgaattagcagttttag

SEQ ID NO: 89870 - DNA, 25 bp, Homo sapien
tacataatctgcctactatcagcac

SEQ ID NO: 89871 - DNA, 25 bp, Homo sapien
tacataatctgcttactatcagcac

SEQ ID NO: 89872 - DNA, 25 bp, Homo sapien
tacataattaaaggattcaaaggag

SEQ ID NO: 89873 - DNA, 25 bp, Homo sapien
tacataattcaaggattcaaaggag

SEQ ID NO: 89874 - DNA, 25 bp, Homo sapien
tacatacaaaaggttaatgtcaaag

SEQ ID NO: 89875 - DNA, 25 bp, Homo sapien
tacatacaatagagaccatcaacaa

SEQ ID NO: 89876 - DNA, 25 bp, Homo sapien
tacatacaatagagactatcaacaa

SEQ ID NO: 89877 - DNA, 25 bp, Homo sapien
tacatacagaaggttaatgtcaaag

SEQ ID NO: 89878 - DNA, 25 bp, Homo sapien
tacatacagcctacattttaactaa

SEQ ID NO: 89879 - DNA, 25 bp, Homo sapien
tacatacagcctaccttttaactaa

SEQ ID NO: 89880 - DNA, 25 bp, Homo sapien
tacatactaatgctatgcttctatt

SEQ ID NO: 89881 - DNA, 25 bp, Homo sapien
tacatactaatgctgtgcttctatt

SEQ ID NO: 89882 - DNA, 25 bp, Homo sapien
tacatacttatgcatagtctctttg

SEQ ID NO: 89883 - DNA, 25 bp, Homo sapien
tacatacttatgcatattctctttg

SEQ ID NO: 89884 - DNA, 25 bp, Homo sapien
tacatagagccttgtaaaccttggt

SEQ ID NO: 89885 - DNA, 25 bp, Homo sapien
tacatagagtcttgtaaaccttggt

SEQ ID NO: 89886 - DNA, 25 bp, Homo sapien
tacatagtgaggaacggtagttgat

SEQ ID NO: 89887 - DNA, 25 bp, Homo sapien
tacatagtgaggaatggtagttgat

SEQ ID NO: 89888 - DNA, 25 bp, Homo sapien
tacatataaatccataaacaatata

SEQ ID NO: 89889 - DNA, 25 bp, Homo sapien
tacatatacatccataaacaatata

SEQ ID NO: 89890 - DNA, 25 bp, Homo sapien
tacatatagtatgaagaagaaaaca

SEQ ID NO: 89891 - DNA, 25 bp, Homo sapien
tacatatagtattaagaagaaaaca

SEQ ID NO: 89892 - DNA, 25 bp, Homo sapien
tacatatattttctgacttaatttt

SEQ ID NO: 89893 - DNA, 25 bp, Homo sapien
tacatatattttctgatttaatttt

SEQ ID NO: 89894 - DNA, 25 bp, Homo sapien
tacatatcatctaattctgtttgtg

SEQ ID NO: 89895 - DNA, 25 bp, Homo sapien
tacatatcgtctaattctgtttgtg

SEQ ID NO: 89896 - DNA, 25 bp, Homo sapien
tacatatctaataaacattgataca

SEQ ID NO: 89897 - DNA, 25 bp, Homo sapien
tacatatctaataagcattgataca

SEQ ID NO: 89898 - DNA, 25 bp, Homo sapien
tacatattatgcacagttggattta

SEQ ID NO: 89899 - DNA, 25 bp, Homo sapien
tacatattatgcccagttggattta

SEQ ID NO: 89900 - DNA, 25 bp, Homo sapien
tacatcacacccgaacaggcaaaag

SEQ ID NO: 89901 - DNA, 25 bp, Homo sapien
tacatcacagccgaacaggcaaaag

SEQ ID NO: 89902 - DNA, 25 bp, Homo sapien
tacatcagtgctgttcatgactcaa

SEQ ID NO: 89903 - DNA, 25 bp, Homo sapien
tacatcagtgctgttcgtgactcaa

SEQ ID NO: 89904 - DNA, 25 bp, Homo sapien
tacatcatttaggcgtctaaaggtg

SEQ ID NO: 89905 - DNA, 25 bp, Homo sapien
tacatcatttaggtgtctaaaggtg

SEQ ID NO: 89906 - DNA, 25 bp, Homo sapien
tacatcattttcttcctagtaacta

SEQ ID NO: 89907 - DNA, 25 bp, Homo sapien
tacatcatttttttcctagtaacta

SEQ ID NO: 89908 - DNA, 25 bp, Homo sapien
tacatccaactcgttgttttccatg

SEQ ID NO: 89909 - DNA, 25 bp, Homo sapien
tacatccacctcgttgttttccatg

SEQ ID NO: 89910 - DNA, 25 bp, Homo sapien
tacatccaggcactatcgtagatcc

SEQ ID NO: 89911 - DNA, 25 bp, Homo sapien
tacatccaggcactattgtagatcc

SEQ ID NO: 89912 - DNA, 25 bp, Homo sapien
tacatcctcattcagaagcagtcat

SEQ ID NO: 89913 - DNA, 25 bp, Homo sapien
tacatcctcattgagaagcagtcat

SEQ ID NO: 89914 - DNA, 25 bp, Homo sapien
tacatcctctgcacgttcattagtg

SEQ ID NO: 89915 - DNA, 25 bp, Homo sapien
tacatcctctgcactttcattagtg

SEQ ID NO: 89916 - DNA, 25 bp, Homo sapien
tacatcgagtgaagtcagtgttgaa

SEQ ID NO: 89917 - DNA, 25 bp, Homo sapien
tacatcgagtgaggtcagtgttgaa

SEQ ID NO: 89918 - DNA, 25 bp, Homo sapien
tacatctacaccaaaaaagaaaata

SEQ ID NO: 89919 - DNA, 25 bp, Homo sapien
tacatctacgccaaaaaagaaaata

SEQ ID NO: 89920 - DNA, 25 bp, Homo sapien
tacatctactggccgtaagtcgggc

SEQ ID NO: 89921 - DNA, 25 bp, Homo sapien
tacatctactggctgtaagtcgggc

SEQ ID NO: 89922 - DNA, 25 bp, Homo sapien
tacatctccgcataagtcatatttt

SEQ ID NO: 89923 - DNA, 25 bp, Homo sapien
tacatctccgcatgagtcatatttt

SEQ ID NO: 89924 - DNA, 25 bp, Homo sapien
tacatcttaaaaattgacattatgc

SEQ ID NO: 89925 - DNA, 25 bp, Homo sapien
tacatcttcatagagataaaagttg

SEQ ID NO: 89926 - DNA, 25 bp, Homo sapien
tacatcttcatggagataaaagttg

SEQ ID NO: 89927 - DNA, 25 bp, Homo sapien
tacatcttgaaaattgacattatgc

SEQ ID NO: 89928 - DNA, 25 bp, Homo sapien
tacatgataacgcgatttcaaaaag

SEQ ID NO: 89929 - DNA, 25 bp, Homo sapien
tacatgatatcgcgatttcaaaaag

SEQ ID NO: 89930 - DNA, 25 bp, Homo sapien
tacatgattcagcataatctgtttt

SEQ ID NO: 89931 - DNA, 25 bp, Homo sapien
tacatgattcagcgtaatctgtttt

SEQ ID NO: 89932 - DNA, 25 bp, Homo sapien
tacatgcacatccacaatccatgtt

SEQ ID NO: 89933 - DNA, 25 bp, Homo sapien
tacatgcacgtccacaatccatgtt

SEQ ID NO: 89934 - DNA, 25 bp, Homo sapien
tacatgcatgtccgtcagagaggat

SEQ ID NO: 89935 - DNA, 25 bp, Homo sapien
tacatgcatgtctgtcagagaggat

SEQ ID NO: 89936 - DNA, 25 bp, Homo sapien
tacatgccaatcaagaagaaaggag

SEQ ID NO: 89937 - DNA, 25 bp, Homo sapien
tacatgccaatcaagaggaaaggag

SEQ ID NO: 89938 - DNA, 25 bp, Homo sapien
tacatgctaaaatgtgaatgatccc

SEQ ID NO: 89939 - DNA, 25 bp, Homo sapien
tacatgctataatgtgaatgatccc

SEQ ID NO: 89940 - DNA, 25 bp, Homo sapien
tacatgctcaaacattcatccagaa

SEQ ID NO: 89941 - DNA, 25 bp, Homo sapien
tacatgctcaagcattcatccagaa

SEQ ID NO: 89942 - DNA, 25 bp, Homo sapien
tacatggaacatcagatgaaacaat

SEQ ID NO: 89943 - DNA, 25 bp, Homo sapien
tacatggaacatcggatgaaacaat

SEQ ID NO: 89944 - DNA, 25 bp, Homo sapien
tacatggcttaaatatctctagcta

SEQ ID NO: 89945 - DNA, 25 bp, Homo sapien
tacatggcttaaatgtctctagcta

SEQ ID NO: 89946 - DNA, 25 bp, Homo sapien
tacatgggcaactccggcgtctcag

SEQ ID NO: 89947 - DNA, 25 bp, Homo sapien
tacatgggcaactctggcgtctcag

SEQ ID NO: 89948 - DNA, 25 bp, Homo sapien
tacatggggcctacgcctcagctct

SEQ ID NO: 89949 - DNA, 25 bp, Homo sapien
tacatggggcctatgcctcagctct

SEQ ID NO: 89950 - DNA, 25 bp, Homo sapien
tacatggtatagcgccaacattcga

SEQ ID NO: 89951 - DNA, 25 bp, Homo sapien
tacatggtatagtgccaacattcga

SEQ ID NO: 89952 - DNA, 25 bp, Homo sapien
tacatgtctcaaataataccatata

SEQ ID NO: 89953 - DNA, 25 bp, Homo sapien
tacatgtctcagataataccatata

SEQ ID NO: 89954 - DNA, 25 bp, Homo sapien
tacatgtgatcataagaagcaacaa

SEQ ID NO: 89955 - DNA, 25 bp, Homo sapien
tacatgtgatcgtaagaagcaacaa

SEQ ID NO: 89956 - DNA, 25 bp, Homo sapien
tacatgttaattacacttctataaa

SEQ ID NO: 89957 - DNA, 25 bp, Homo sapien
tacatgttaattacgcttctataaa

SEQ ID NO: 89958 - DNA, 25 bp, Homo sapien
tacatgttccattgctttttcttag

SEQ ID NO: 89959 - DNA, 25 bp, Homo sapien
tacatgttccattgttttttcttag

SEQ ID NO: 89960 - DNA, 25 bp, Homo sapien
tacatgttgagattagaaaggtgag

SEQ ID NO: 89961 - DNA, 25 bp, Homo sapien
tacatgttgagattggaaaggtgag

SEQ ID NO: 89962 - DNA, 25 bp, Homo sapien
tacatgttgatccataaaaaatcta

SEQ ID NO: 89963 - DNA, 25 bp, Homo sapien
tacatgttgatccgtaaaaaatcta

SEQ ID NO: 89964 - DNA, 25 bp, Homo sapien
tacattaaaagaccattcatatgca

SEQ ID NO: 89965 - DNA, 25 bp, Homo sapien
tacattaaaagatcattcatatgca

SEQ ID NO: 89966 - DNA, 25 bp, Homo sapien
tacattaagtaattcaatggaaaca

SEQ ID NO: 89967 - DNA, 25 bp, Homo sapien
tacattaagtaattcagtggaaaca

SEQ ID NO: 89968 - DNA, 25 bp, Homo sapien
tacattaattcaacaagcacatatt

SEQ ID NO: 89969 - DNA, 25 bp, Homo sapien
tacattaattcagcaagcacatatt

SEQ ID NO: 89970 - DNA, 25 bp, Homo sapien
tacattagaattagtctacaccaga

SEQ ID NO: 89971 - DNA, 25 bp, Homo sapien
tacattagaattggtctacaccaga

SEQ ID NO: 89972 - DNA, 25 bp, Homo sapien
tacattcaatgaatattttctccaa

SEQ ID NO: 89973 - DNA, 25 bp, Homo sapien
tacattcaatgcactgtattggatt

SEQ ID NO: 89974 - DNA, 25 bp, Homo sapien
tacattcaatgcgctgtattggatt

SEQ ID NO: 89975 - DNA, 25 bp, Homo sapien
tacattcagtgaatattttctccaa

SEQ ID NO: 89976 - DNA, 25 bp, Homo sapien
tacattcatccagataaaaactacc

SEQ ID NO: 89977 - DNA, 25 bp, Homo sapien
tacattcatccagctaaaaactacc

SEQ ID NO: 89978 - DNA, 25 bp, Homo sapien
tacattcatcctcttgcccatcagt

SEQ ID NO: 89979 - DNA, 25 bp, Homo sapien
tacattcattctcttgcccatcagt

SEQ ID NO: 89980 - DNA, 25 bp, Homo sapien
tacattccactccaaatattaatgt

SEQ ID NO: 89981 - DNA, 25 bp, Homo sapien
tacattccactgcaaatattaatgt

SEQ ID NO: 89982 - DNA, 25 bp, Homo sapien
tacattccacttccgacggactaca

SEQ ID NO: 89983 - DNA, 25 bp, Homo sapien
tacattccacttccgatggactaca

SEQ ID NO: 89984 - DNA, 25 bp, Homo sapien
tacattcctccagatccctgataca

SEQ ID NO: 89985 - DNA, 25 bp, Homo sapien
tacattcctccagatctctgataca

SEQ ID NO: 89986 - DNA, 25 bp, Homo sapien
tacattctaggaaccaataatcagc

SEQ ID NO: 89987 - DNA, 25 bp, Homo sapien
tacattctaggaaccagtaatcagc

SEQ ID NO: 89988 - DNA, 25 bp, Homo sapien
tacattctggcagctaagtacctat

SEQ ID NO: 89989 - DNA, 25 bp, Homo sapien
tacattctggcagctaggtacctat

SEQ ID NO: 89990 - DNA, 25 bp, Homo sapien
tacattctttcaattctgtccacct

SEQ ID NO: 89991 - DNA, 25 bp, Homo sapien
tacattctttcagttctgtccacct

SEQ ID NO: 89992 - DNA, 25 bp, Homo sapien
tacattgaaatctataacccatttt

SEQ ID NO: 89993 - DNA, 25 bp, Homo sapien
tacattgaaatctgtaacccatttt

SEQ ID NO: 89994 - DNA, 25 bp, Homo sapien
tacattgattgaaaggctattccat

SEQ ID NO: 89995 - DNA, 25 bp, Homo sapien
tacattgattgaagggctattccat

SEQ ID NO: 89996 - DNA, 25 bp, Homo sapien
tacattggaacccttgcgcaccgtt

SEQ ID NO: 89997 - DNA, 25 bp, Homo sapien
tacattggaactcttgcgcaccgtt

SEQ ID NO: 89998 - DNA, 25 bp, Homo sapien
tacattggactacttctatcatgga

SEQ ID NO: 89999 - DNA, 25 bp, Homo sapien
tacattggactgcttctatcatgga

SEQ ID NO: 90000 - DNA, 25 bp, Homo sapien
tacattgtgcccacgcagattaagg

SEQ ID NO: 90001 - DNA, 25 bp, Homo sapien
tacattgtgtccacgcagattaagg

SEQ ID NO: 90002 - DNA, 25 bp, Homo sapien
tacattgttcaaagatatacgcatg

SEQ ID NO: 90003 - DNA, 25 bp, Homo sapien
tacattgttcaaagatgtacgcatg

SEQ ID NO: 90004 - DNA, 25 bp, Homo sapien
tacatttatcaatcacctgcaatgc

SEQ ID NO: 90005 - DNA, 25 bp, Homo sapien
tacatttatcaattacctgcaatgc

SEQ ID NO: 90006 - DNA, 25 bp, Homo sapien
tacatttatcggtttgtgtatgtta

SEQ ID NO: 90007 - DNA, 25 bp, Homo sapien
tacatttattggtttgtgtatgtta

SEQ ID NO: 90008 - DNA, 25 bp, Homo sapien
tacatttcatctttcataatctcca

SEQ ID NO: 90009 - DNA, 25 bp, Homo sapien
tacatttccaacaagatataatcct

SEQ ID NO: 90010 - DNA, 25 bp, Homo sapien
tacatttcgaacaagatataatcct

SEQ ID NO: 90011 - DNA, 25 bp, Homo sapien
tacatttcgtaacgctatttctgcc

SEQ ID NO: 90012 - DNA, 25 bp, Homo sapien
tacatttcgtaatgctatttctgcc

SEQ ID NO: 90013 - DNA, 25 bp, Homo sapien
tacatttcgtctttcataatctcca

SEQ ID NO: 90014 - DNA, 25 bp, Homo sapien
tacatttgaattttataccacacac

SEQ ID NO: 90015 - DNA, 25 bp, Homo sapien
tacatttgctcagcatcttgcctgt

SEQ ID NO: 90016 - DNA, 25 bp, Homo sapien
tacatttgctcggcatcttgcctgt

SEQ ID NO: 90017 - DNA, 25 bp, Homo sapien
tacatttggattttataccacacac

SEQ ID NO: 90018 - DNA, 25 bp, Homo sapien
tacattttaagagtgacaagcaggt

SEQ ID NO: 90019 - DNA, 25 bp, Homo sapien
tacattttacgagtgacaagcaggt

SEQ ID NO: 90020 - DNA, 25 bp, Homo sapien
tacattttcatagcttatcttttct

SEQ ID NO: 90021 - DNA, 25 bp, Homo sapien
tacattttctattccttttggagtt

SEQ ID NO: 90022 - DNA, 25 bp, Homo sapien
tacattttctatttcttttggagtt

SEQ ID NO: 90023 - DNA, 25 bp, Homo sapien
tacattttgatagcttatcttttct

SEQ ID NO: 90024 - DNA, 25 bp, Homo sapien
tacattttgtgaaatagtcacctgg

SEQ ID NO: 90025 - DNA, 25 bp, Homo sapien
tacattttgtgcaatagtcacctgg

SEQ ID NO: 90026 - DNA, 25 bp, Homo sapien
tacatttttagtggtaggtgaagta

SEQ ID NO: 90027 - DNA, 25 bp, Homo sapien
tacatttttagtggtatgtgaagta

SEQ ID NO: 90028 - DNA, 25 bp, Homo sapien
taccaaaaaaggcccttagagactc

SEQ ID NO: 90029 - DNA, 25 bp, Homo sapien
taccaaaaaaggcctttagagactc

SEQ ID NO: 90030 - DNA, 25 bp, Homo sapien
taccaaaacccaaaagagacataac

SEQ ID NO: 90031 - DNA, 25 bp, Homo sapien
taccaaaacccgaaagagacataac

SEQ ID NO: 90032 - DNA, 25 bp, Homo sapien
taccaaaatcttcacttatttatca

SEQ ID NO: 90033 - DNA, 25 bp, Homo sapien
taccaaaatcttcagttatttatca

SEQ ID NO: 90034 - DNA, 25 bp, Homo sapien
taccaaagacaaagttaacagacgg

SEQ ID NO: 90035 - DNA, 25 bp, Homo sapien
taccaaagataaagttaacagacgg

SEQ ID NO: 90036 - DNA, 25 bp, Homo sapien
taccaaagtggctaataattgagaa

SEQ ID NO: 90037 - DNA, 25 bp, Homo sapien
taccaaagtggctagtaattgagaa

SEQ ID NO: 90038 - DNA, 25 bp, Homo sapien
taccaaataccacatatacataaca

SEQ ID NO: 90039 - DNA, 25 bp, Homo sapien
taccaaatacttccagatccttatg

SEQ ID NO: 90040 - DNA, 25 bp, Homo sapien
taccaaatacttccaggtccttatg

SEQ ID NO: 90041 - DNA, 25 bp, Homo sapien
taccaaatatcacatatacataaca

SEQ ID NO: 90042 - DNA, 25 bp, Homo sapien
taccaacaattcatcaacgagcatt

SEQ ID NO: 90043 - DNA, 25 bp, Homo sapien
taccaacaattcgtcaacgagcatt

SEQ ID NO: 90044 - DNA, 25 bp, Homo sapien
taccaacattaaaatgcagccaatt

SEQ ID NO: 90045 - DNA, 25 bp, Homo sapien
taccaacattaagatgcagccaatt

SEQ ID NO: 90046 - DNA, 25 bp, Homo sapien
taccaaccatactcaaactactctg

SEQ ID NO: 90047 - DNA, 25 bp, Homo sapien
taccaaccgtactcaaactactctg

SEQ ID NO: 90048 - DNA, 25 bp, Homo sapien
taccaactaaaccacttatccactt

SEQ ID NO: 90049 - DNA, 25 bp, Homo sapien
taccaactaaaccgcttatccactt

SEQ ID NO: 90050 - DNA, 25 bp, Homo sapien
taccaagatctgtgaccaaaccagg

SEQ ID NO: 90051 - DNA, 25 bp, Homo sapien
taccaagatctgtgactaaaccagg

SEQ ID NO: 90052 - DNA, 25 bp, Homo sapien
taccaaggaagactcagtgttgtct

SEQ ID NO: 90053 - DNA, 25 bp, Homo sapien
taccaaggaagtctcagtgttgtct

SEQ ID NO: 90054 - DNA, 25 bp, Homo sapien
taccaaggagcacaactgttgaatc

SEQ ID NO: 90055 - DNA, 25 bp, Homo sapien
taccaaggagcataactgttgaatc

SEQ ID NO: 90056 - DNA, 25 bp, Homo sapien
taccaaggagtgtgctagctagatt

SEQ ID NO: 90057 - DNA, 25 bp, Homo sapien
taccaaggagtgtgcttgctagatt

SEQ ID NO: 90058 - DNA, 25 bp, Homo sapien
taccaagtacaataatgtcggagtc

SEQ ID NO: 90059 - DNA, 25 bp, Homo sapien
taccaagtacaattatgtcggagtc

SEQ ID NO: 90060 - DNA, 25 bp, Homo sapien
taccaagtggaaccattatatcagt

SEQ ID NO: 90061 - DNA, 25 bp, Homo sapien
taccaagtggaactattatatcagt

SEQ ID NO: 90062 - DNA, 25 bp, Homo sapien
taccaatagctctatataatagtag

SEQ ID NO: 90063 - DNA, 25 bp, Homo sapien
taccaatagctgtatataatagtag

SEQ ID NO: 90064 - DNA, 25 bp, Homo sapien
taccaatgggccgaatggggcaggc

SEQ ID NO: 90065 - DNA, 25 bp, Homo sapien
taccaatgggctgaatggggcaggc

SEQ ID NO: 90066 - DNA, 25 bp, Homo sapien
taccaattatgaaaacctgtgatta

SEQ ID NO: 90067 - DNA, 25 bp, Homo sapien
taccaattatgaaagcctgtgatta

SEQ ID NO: 90068 - DNA, 25 bp, Homo sapien
taccaattctgctgaacgggataat

SEQ ID NO: 90069 - DNA, 25 bp, Homo sapien
taccaattctgttgaacgggataat

SEQ ID NO: 90070 - DNA, 25 bp, Homo sapien
taccaatttaaattccaaaaagcag

SEQ ID NO: 90071 - DNA, 25 bp, Homo sapien
taccaatttaaattcccaaaagcag

SEQ ID NO: 90072 - DNA, 25 bp, Homo sapien
taccaatttttttatgtgtcagcca

SEQ ID NO: 90073 - DNA, 25 bp, Homo sapien
taccaatttttttgtgtgtcagcca

SEQ ID NO: 90074 - DNA, 25 bp, Homo sapien
taccacaaatttatagtttggttgc

SEQ ID NO: 90075 - DNA, 25 bp, Homo sapien
taccacaaatttgtagtttggttgc

SEQ ID NO: 90076 - DNA, 25 bp, Homo sapien
taccacaacgattaagtaatgacaa

SEQ ID NO: 90077 - DNA, 25 bp, Homo sapien
taccacaaggattaagtaatgacaa

SEQ ID NO: 90078 - DNA, 25 bp, Homo sapien
taccacataaaccaggggggaatgc

SEQ ID NO: 90079 - DNA, 25 bp, Homo sapien
taccacataaactaggggggaatgc

SEQ ID NO: 90080 - DNA, 25 bp, Homo sapien
taccacataggcatgactggcacat

SEQ ID NO: 90081 - DNA, 25 bp, Homo sapien
taccacataggcgtgactggcacat

SEQ ID NO: 90082 - DNA, 25 bp, Homo sapien
taccacatggaaatttgtgcccctt

SEQ ID NO: 90083 - DNA, 25 bp, Homo sapien
taccacatggaagtttgtgcccctt

SEQ ID NO: 90084 - DNA, 25 bp, Homo sapien
taccacctcaaaggcctatttcagg

SEQ ID NO: 90085 - DNA, 25 bp, Homo sapien
taccacctcaaatgcctatttcagg

SEQ ID NO: 90086 - DNA, 25 bp, Homo sapien
taccactgatgtcaagattaaaaaa

SEQ ID NO: 90087 - DNA, 25 bp, Homo sapien
taccactgatgtcatgattaaaaaa

SEQ ID NO: 90088 - DNA, 25 bp, Homo sapien
taccacttcaatgcatactgtagaa

SEQ ID NO: 90089 - DNA, 25 bp, Homo sapien
taccacttcgatgcatactgtagaa

SEQ ID NO: 90090 - DNA, 25 bp, Homo sapien
taccactttatcaccgctcctcctt

SEQ ID NO: 90091 - DNA, 25 bp, Homo sapien
taccactttatcactgctcctcctt

SEQ ID NO: 90092 - DNA, 25 bp, Homo sapien
taccagaaagtgcaaaggaaaaagt

SEQ ID NO: 90093 - DNA, 25 bp, Homo sapien
taccagaaagtgcgaaggaaaaagt

SEQ ID NO: 90094 - DNA, 25 bp, Homo sapien
taccagaagttatgtaccaaatcaa

SEQ ID NO: 90095 - DNA, 25 bp, Homo sapien
taccagaatgaacttacgccaataa

SEQ ID NO: 90096 - DNA, 25 bp, Homo sapien
taccagaatgaacttatgccaataa

SEQ ID NO: 90097 - DNA, 25 bp, Homo sapien
taccagaatttatgtaccaaatcaa

SEQ ID NO: 90098 - DNA, 25 bp, Homo sapien
taccagatctccttgccctagccta

SEQ ID NO: 90099 - DNA, 25 bp, Homo sapien
taccagatctccttgcgctagccta

SEQ ID NO: 90100 - DNA, 25 bp, Homo sapien
taccagatttgtgactgtgaattat

SEQ ID NO: 90101 - DNA, 25 bp, Homo sapien
taccagatttgtgattgtgaattat

SEQ ID NO: 90102 - DNA, 25 bp, Homo sapien
taccagcacccattattcttcctta

SEQ ID NO: 90103 - DNA, 25 bp, Homo sapien
taccagcaccctttattcttcctta

SEQ ID NO: 90104 - DNA, 25 bp, Homo sapien
taccagcactagcggatgtgaaaaa

SEQ ID NO: 90105 - DNA, 25 bp, Homo sapien
taccagcatcaacagtagaaagatc

SEQ ID NO: 90106 - DNA, 25 bp, Homo sapien
taccagcatcaatagtagaaagatc

SEQ ID NO: 90107 - DNA, 25 bp, Homo sapien
taccagcattaccgagccactagtg

SEQ ID NO: 90108 - DNA, 25 bp, Homo sapien
taccagcattactgagccactagtg

SEQ ID NO: 90109 - DNA, 25 bp, Homo sapien
taccagcattagcggatgtgaaaaa

SEQ ID NO: 90110 - DNA, 25 bp, Homo sapien
taccagctagaagtaactacaagta

SEQ ID NO: 90111 - DNA, 25 bp, Homo sapien
taccagctcatcttcccaggcacag

SEQ ID NO: 90112 - DNA, 25 bp, Homo sapien
taccagctggaagtaactacaagta

SEQ ID NO: 90113 - DNA, 25 bp, Homo sapien
taccagcttatcttcccaggcacag

SEQ ID NO: 90114 - DNA, 25 bp, Homo sapien
taccaggactttaaactctttctta

SEQ ID NO: 90115 - DNA, 25 bp, Homo sapien
taccaggattttaaactctttctta

SEQ ID NO: 90116 - DNA, 25 bp, Homo sapien
taccagggcaataacgctcctgttt

SEQ ID NO: 90117 - DNA, 25 bp, Homo sapien
taccagggcaataatgctcctgttt

SEQ ID NO: 90118 - DNA, 25 bp, Homo sapien
taccaggtcatataactcactgtga

SEQ ID NO: 90119 - DNA, 25 bp, Homo sapien
taccaggtcatgtaactcactgtga

SEQ ID NO: 90120 - DNA, 25 bp, Homo sapien
taccagtagcaagtcagtttctgaa

SEQ ID NO: 90121 - DNA, 25 bp, Homo sapien
taccagtatcaagtcagtttctgaa

SEQ ID NO: 90122 - DNA, 25 bp, Homo sapien
taccagtatttctgcacgaaggatt

SEQ ID NO: 90123 - DNA, 25 bp, Homo sapien
taccagtatttctggacgaaggatt

SEQ ID NO: 90124 - DNA, 25 bp, Homo sapien
taccagtcagctacaattcagagtt

SEQ ID NO: 90125 - DNA, 25 bp, Homo sapien
taccagtcagctgcaattcagagtt

SEQ ID NO: 90126 - DNA, 25 bp, Homo sapien
taccagtgatatacgagggctgaaa

SEQ ID NO: 90127 - DNA, 25 bp, Homo sapien
taccagtgatatatgagggctgaaa

SEQ ID NO: 90128 - DNA, 25 bp, Homo sapien
taccagtgcatcgctaaggcttcta

SEQ ID NO: 90129 - DNA, 25 bp, Homo sapien
taccagtgcattgctaaggcttcta

SEQ ID NO: 90130 - DNA, 25 bp, Homo sapien
taccagtgtgagtttacgaggtatt

SEQ ID NO: 90131 - DNA, 25 bp, Homo sapien
taccagtgtgagtttatgaggtatt

SEQ ID NO: 90132 - DNA, 25 bp, Homo sapien
taccagtgtgcaacaggactttggc

SEQ ID NO: 90133 - DNA, 25 bp, Homo sapien
taccagtgtgcaataggactttggc

SEQ ID NO: 90134 - DNA, 25 bp, Homo sapien
taccagttctattacaacaatgtgt

SEQ ID NO: 90135 - DNA, 25 bp, Homo sapien
taccagttctattataacaatgtgt

SEQ ID NO: 90136 - DNA, 25 bp, Homo sapien
taccatacaatcagtagattttaaa

SEQ ID NO: 90137 - DNA, 25 bp, Homo sapien
taccatacaatcggtagattttaaa

SEQ ID NO: 90138 - DNA, 25 bp, Homo sapien
taccatacacatacagaaaagtgca

SEQ ID NO: 90139 - DNA, 25 bp, Homo sapien
taccatacacatacggaaaagtgca

SEQ ID NO: 90140 - DNA, 25 bp, Homo sapien
taccatcaaaatctcggccagcttt

SEQ ID NO: 90141 - DNA, 25 bp, Homo sapien
taccatcaaaatcttggccagcttt

SEQ ID NO: 90142 - DNA, 25 bp, Homo sapien
taccatcagatcatcttaatcctat

SEQ ID NO: 90143 - DNA, 25 bp, Homo sapien
taccatcagatcgtcttaatcctat

SEQ ID NO: 90144 - DNA, 25 bp, Homo sapien
taccatcctgccattcagaggaggg

SEQ ID NO: 90145 - DNA, 25 bp, Homo sapien
taccatcctgccgttcagaggaggg

SEQ ID NO: 90146 - DNA, 25 bp, Homo sapien
taccatctctgctttactgtgaaaa

SEQ ID NO: 90147 - DNA, 25 bp, Homo sapien
taccatctctgctttattgtgaaaa

SEQ ID NO: 90148 - DNA, 25 bp, Homo sapien
taccatctgacatggcatttgcaca

SEQ ID NO: 90149 - DNA, 25 bp, Homo sapien
taccatctgacatggcgtttgcaca

SEQ ID NO: 90150 - DNA, 25 bp, Homo sapien
taccatgaaaagagggcctggattt

SEQ ID NO: 90151 - DNA, 25 bp, Homo sapien
taccatgagaagagggcctggattt

SEQ ID NO: 90152 - DNA, 25 bp, Homo sapien
taccatgcctgaataattttttgta

SEQ ID NO: 90153 - DNA, 25 bp, Homo sapien
taccatgcctgagtaattttttgta

SEQ ID NO: 90154 - DNA, 25 bp, Homo sapien
taccattaccgtaactgctgtcagc

SEQ ID NO: 90155 - DNA, 25 bp, Homo sapien
taccattactgtaactgctgtcagc

SEQ ID NO: 90156 - DNA, 25 bp, Homo sapien
taccattcacttcctgccatcatta

SEQ ID NO: 90157 - DNA, 25 bp, Homo sapien
taccattcactttctgccatcatta

SEQ ID NO: 90158 - DNA, 25 bp, Homo sapien
taccattgcaacttggaaggaattc

SEQ ID NO: 90159 - DNA, 25 bp, Homo sapien
taccattgcttgcatgtcaaattgg

SEQ ID NO: 90160 - DNA, 25 bp, Homo sapien
taccattgtaacttggaaggaattc

SEQ ID NO: 90161 - DNA, 25 bp, Homo sapien
taccattgtttgcatgtcaaattgg

SEQ ID NO: 90162 - DNA, 25 bp, Homo sapien
taccatttctccatttcattctagt

SEQ ID NO: 90163 - DNA, 25 bp, Homo sapien
taccatttctccattttattctagt

SEQ ID NO: 90164 - DNA, 25 bp, Homo sapien
taccattttcacataaagcatgcac

SEQ ID NO: 90165 - DNA, 25 bp, Homo sapien
taccattttcatataaagcatgcac

SEQ ID NO: 90166 - DNA, 25 bp, Homo sapien
tacccaaatattcatttcatggaca

SEQ ID NO: 90167 - DNA, 25 bp, Homo sapien
tacccaaatattgatttcatggaca

SEQ ID NO: 90168 - DNA, 25 bp, Homo sapien
tacccaagacggttattccagattt

SEQ ID NO: 90169 - DNA, 25 bp, Homo sapien
tacccaagatggttattccagattt

SEQ ID NO: 90170 - DNA, 25 bp, Homo sapien
tacccaagctgcaagacataatcct

SEQ ID NO: 90171 - DNA, 25 bp, Homo sapien
tacccaagctgcaagatataatcct

SEQ ID NO: 90172 - DNA, 25 bp, Homo sapien
tacccagaaacaggtggcatctttg

SEQ ID NO: 90173 - DNA, 25 bp, Homo sapien
tacccagaaacagttggcatctttg

SEQ ID NO: 90174 - DNA, 25 bp, Homo sapien
tacccagatacagctgcagaacaga

SEQ ID NO: 90175 - DNA, 25 bp, Homo sapien
tacccagatgcagctgcagaacaga

SEQ ID NO: 90176 - DNA, 25 bp, Homo sapien
tacccagtcattagggaaaagcact

SEQ ID NO: 90177 - DNA, 25 bp, Homo sapien
tacccagtcgttagggaaaagcact

SEQ ID NO: 90178 - DNA, 25 bp, Homo sapien
tacccataatatcattttttgcagt

SEQ ID NO: 90179 - DNA, 25 bp, Homo sapien
tacccataatattattttttgcagt

SEQ ID NO: 90180 - DNA, 25 bp, Homo sapien
tacccatcagcagtgagttccaaag

SEQ ID NO: 90181 - DNA, 25 bp, Homo sapien
tacccatcagctgtgagttccaaag

SEQ ID NO: 90182 - DNA, 25 bp, Homo sapien
tacccatgacttaatcatccagggt

SEQ ID NO: 90183 - DNA, 25 bp, Homo sapien
tacccatgacttattcatccagggt

SEQ ID NO: 90184 - DNA, 25 bp, Homo sapien
tacccattgaacagcaactctccat

SEQ ID NO: 90185 - DNA, 25 bp, Homo sapien
tacccattgaacagtaactctccat

SEQ ID NO: 90186 - DNA, 25 bp, Homo sapien
taccccagcgggttcaacaggtaac

SEQ ID NO: 90187 - DNA, 25 bp, Homo sapien
taccccagtgggttcaacaggtaac

SEQ ID NO: 90188 - DNA, 25 bp, Homo sapien
taccccctgtggacctcatttttct

SEQ ID NO: 90189 - DNA, 25 bp, Homo sapien
taccccctgtggacttcatttttct

SEQ ID NO: 90190 - DNA, 25 bp, Homo sapien
tacccctgatagactgcaatataag

SEQ ID NO: 90191 - DNA, 25 bp, Homo sapien
tacccctgataggctgcaatataag

SEQ ID NO: 90192 - DNA, 25 bp, Homo sapien
taccccttcaagtagcactggtgca

SEQ ID NO: 90193 - DNA, 25 bp, Homo sapien
taccccttcaagtcgcactggtgca

SEQ ID NO: 90194 - DNA, 25 bp, Homo sapien
tacccgtatttaaacagcaatccaa

SEQ ID NO: 90195 - DNA, 25 bp, Homo sapien
tacccgtatttaaccagcaatccaa

SEQ ID NO: 90196 - DNA, 25 bp, Homo sapien
taccctataaagcaaccatgcagta

SEQ ID NO: 90197 - DNA, 25 bp, Homo sapien
taccctataaagtaaccatgcagta

SEQ ID NO: 90198 - DNA, 25 bp, Homo sapien
taccctctgtcaataacttactaat

SEQ ID NO: 90199 - DNA, 25 bp, Homo sapien
taccctctgtcagtaacttactaat

SEQ ID NO: 90200 - DNA, 25 bp, Homo sapien
taccctgcttgccagatagcatcta

SEQ ID NO: 90201 - DNA, 25 bp, Homo sapien
taccctgcttgccatatagcatcta

SEQ ID NO: 90202 - DNA, 25 bp, Homo sapien
taccctggagaactttatagtccag

SEQ ID NO: 90203 - DNA, 25 bp, Homo sapien
taccctggagaattttatagtccag

SEQ ID NO: 90204 - DNA, 25 bp, Homo sapien
taccctgtgctctgaacattgctta

SEQ ID NO: 90205 - DNA, 25 bp, Homo sapien
taccctgtgttctgaacattgctta

SEQ ID NO: 90206 - DNA, 25 bp, Homo sapien
tacccttacgcaatttaatagggcc

SEQ ID NO: 90207 - DNA, 25 bp, Homo sapien
tacccttacttgaccactctgatta

SEQ ID NO: 90208 - DNA, 25 bp, Homo sapien
tacccttactttaccactctgatta

SEQ ID NO: 90209 - DNA, 25 bp, Homo sapien
tacccttaggcaatttaatagggcc

SEQ ID NO: 90210 - DNA, 25 bp, Homo sapien
taccctttcccattctactcaaagc

SEQ ID NO: 90211 - DNA, 25 bp, Homo sapien
taccctttcccattttactcaaagc

SEQ ID NO: 90212 - DNA, 25 bp, Homo sapien
taccctttgaatatcgtgtacttta

SEQ ID NO: 90213 - DNA, 25 bp, Homo sapien
taccctttgaatatggtgtacttta

SEQ ID NO: 90214 - DNA, 25 bp, Homo sapien
taccgacgtgcatcaaccagcctta

SEQ ID NO: 90215 - DNA, 25 bp, Homo sapien
taccgacgtgcgtcaaccagcctta

SEQ ID NO: 90216 - DNA, 25 bp, Homo sapien
taccgcggtcgtttttagatccgtc

SEQ ID NO: 90217 - DNA, 25 bp, Homo sapien
taccgcggtggtttttagatccgtc

SEQ ID NO: 90218 - DNA, 25 bp, Homo sapien
taccggaccgtcctagctccagagc

SEQ ID NO: 90219 - DNA, 25 bp, Homo sapien
taccggaccgtcctagttccagagc

SEQ ID NO: 90220 - DNA, 25 bp, Homo sapien
taccgtggctttggtacatgctcct

SEQ ID NO: 90221 - DNA, 25 bp, Homo sapien
taccgtggcttttgtacatgctcct

SEQ ID NO: 90222 - DNA, 25 bp, Homo sapien
taccgttgaattgctttatttaaac

SEQ ID NO: 90223 - DNA, 25 bp, Homo sapien
taccgttggattgctttatttaaac

SEQ ID NO: 90224 - DNA, 25 bp, Homo sapien
taccgtttcattgcctccgatttat

SEQ ID NO: 90225 - DNA, 25 bp, Homo sapien
taccgtttcatttcctccgatttat

SEQ ID NO: 90226 - DNA, 25 bp, Homo sapien
tacctaaacattcattgccaagagt

SEQ ID NO: 90227 - DNA, 25 bp, Homo sapien
tacctaaacgttcattgccaagagt

SEQ ID NO: 90228 - DNA, 25 bp, Homo sapien
tacctaacaacataccattgccctg

SEQ ID NO: 90229 - DNA, 25 bp, Homo sapien
tacctaacagcatatgtatcagcat

SEQ ID NO: 90230 - DNA, 25 bp, Homo sapien
tacctaacagggtggccgagaggaa

SEQ ID NO: 90231 - DNA, 25 bp, Homo sapien
tacctaacagggtggcggagaggaa

SEQ ID NO: 90232 - DNA, 25 bp, Homo sapien
tacctaacatcataccattgccctg

SEQ ID NO: 90233 - DNA, 25 bp, Homo sapien
tacctaaccgcatatgtatcagcat

SEQ ID NO: 90234 - DNA, 25 bp, Homo sapien
tacctaagggtaatcttctacaacg

SEQ ID NO: 90235 - DNA, 25 bp, Homo sapien
tacctaagtgtaatcttctacaacg

SEQ ID NO: 90236 - DNA, 25 bp, Homo sapien
tacctaatataatgtctgatactct

SEQ ID NO: 90237 - DNA, 25 bp, Homo sapien
tacctaatgtaatgtctgatactct

SEQ ID NO: 90238 - DNA, 25 bp, Homo sapien
tacctaattatcacataaatctttt

SEQ ID NO: 90239 - DNA, 25 bp, Homo sapien
tacctaattatctcataaatctttt

SEQ ID NO: 90240 - DNA, 25 bp, Homo sapien
tacctacaaatgcctccgcatacca

SEQ ID NO: 90241 - DNA, 25 bp, Homo sapien
tacctacaaatgcctctgcatacca

SEQ ID NO: 90242 - DNA, 25 bp, Homo sapien
tacctaccctctgtcaataacttac

SEQ ID NO: 90243 - DNA, 25 bp, Homo sapien
tacctaccctctgtcagtaacttac

SEQ ID NO: 90244 - DNA, 25 bp, Homo sapien
tacctactgacctggcgtctcaccg

SEQ ID NO: 90245 - DNA, 25 bp, Homo sapien
tacctactgcaaatggcttctcctc

SEQ ID NO: 90246 - DNA, 25 bp, Homo sapien
tacctactgcatatggcttctcctc

SEQ ID NO: 90247 - DNA, 25 bp, Homo sapien
tacctactgccctggcgtctcaccg

SEQ ID NO: 90248 - DNA, 25 bp, Homo sapien
tacctagaatagtgcatacgttatg

SEQ ID NO: 90249 - DNA, 25 bp, Homo sapien
tacctagaatagttcatacgttatg

SEQ ID NO: 90250 - DNA, 25 bp, Homo sapien
tacctagagaacaccaaagattctg

SEQ ID NO: 90251 - DNA, 25 bp, Homo sapien
tacctagagaacactaaagattctg

SEQ ID NO: 90252 - DNA, 25 bp, Homo sapien
tacctagattttttggtttacaaag

SEQ ID NO: 90253 - DNA, 25 bp, Homo sapien
tacctagatttttttgtttacaaag

SEQ ID NO: 90254 - DNA, 25 bp, Homo sapien
tacctagctgcccatgtctgagcct

SEQ ID NO: 90255 - DNA, 25 bp, Homo sapien
tacctagctgcccttgtctgagcct

SEQ ID NO: 90256 - DNA, 25 bp, Homo sapien
tacctaggcttttcctgaacaatag

SEQ ID NO: 90257 - DNA, 25 bp, Homo sapien
tacctaggcttttcttgaacaatag

SEQ ID NO: 90258 - DNA, 25 bp, Homo sapien
tacctatccttttaattgcttatag

SEQ ID NO: 90259 - DNA, 25 bp, Homo sapien
tacctatccttttatttgcttatag

SEQ ID NO: 90260 - DNA, 25 bp, Homo sapien
tacctatcgataaatatgtgtgtgg

SEQ ID NO: 90261 - DNA, 25 bp, Homo sapien
tacctatcgataagtatgtgtgtgg

SEQ ID NO: 90262 - DNA, 25 bp, Homo sapien
tacctattattgataaactctctca

SEQ ID NO: 90263 - DNA, 25 bp, Homo sapien
tacctattgcacacagtagctttga

SEQ ID NO: 90264 - DNA, 25 bp, Homo sapien
tacctattgcacgcagtagctttga

SEQ ID NO: 90265 - DNA, 25 bp, Homo sapien
tacctattttgcctgatgagattta

SEQ ID NO: 90266 - DNA, 25 bp, Homo sapien
tacctattttgcttgatgagattta

SEQ ID NO: 90267 - DNA, 25 bp, Homo sapien
tacctatttttgataaactctctca

SEQ ID NO: 90268 - DNA, 25 bp, Homo sapien
tacctcatttggctataaagttgta

SEQ ID NO: 90269 - DNA, 25 bp, Homo sapien
tacctcatttgtctataaagttgta

SEQ ID NO: 90270 - DNA, 25 bp, Homo sapien
tacctccaattgtaaacacctaaat

SEQ ID NO: 90271 - DNA, 25 bp, Homo sapien
tacctccagttgtaaacacctaaat

SEQ ID NO: 90272 - DNA, 25 bp, Homo sapien
tacctccatataatacattcaggtc

SEQ ID NO: 90273 - DNA, 25 bp, Homo sapien
tacctccatgtaatacattcaggtc

SEQ ID NO: 90274 - DNA, 25 bp, Homo sapien
tacctctcagacatcaggcagatga

SEQ ID NO: 90275 - DNA, 25 bp, Homo sapien
tacctctcagatatcaggcagatga

SEQ ID NO: 90276 - DNA, 25 bp, Homo sapien
tacctctcttaatgaagaaaatgag

SEQ ID NO: 90277 - DNA, 25 bp, Homo sapien
tacctctcttaatggagaaaatgag

SEQ ID NO: 90278 - DNA, 25 bp, Homo sapien
tacctctgggccgtcacccagcaag

SEQ ID NO: 90279 - DNA, 25 bp, Homo sapien
tacctctgggctgtcacccagcaag

SEQ ID NO: 90280 - DNA, 25 bp, Homo sapien
tacctgaagtgaaagattaatgtcc

SEQ ID NO: 90281 - DNA, 25 bp, Homo sapien
tacctgaagtgaaatattaatgtcc

SEQ ID NO: 90282 - DNA, 25 bp, Homo sapien
tacctgaatacatacaccctaataa

SEQ ID NO: 90283 - DNA, 25 bp, Homo sapien
tacctgaatacatataccctaataa

SEQ ID NO: 90284 - DNA, 25 bp, Homo sapien
tacctgacaaaagagattctaaagc

SEQ ID NO: 90285 - DNA, 25 bp, Homo sapien
tacctgacgaaagagattctaaagc

SEQ ID NO: 90286 - DNA, 25 bp, Homo sapien
tacctgagccaactccccagcctct

SEQ ID NO: 90287 - DNA, 25 bp, Homo sapien
tacctgagccatctccccagcctct

SEQ ID NO: 90288 - DNA, 25 bp, Homo sapien
tacctgatgacctaatctttttatt

SEQ ID NO: 90289 - DNA, 25 bp, Homo sapien
tacctgatgacgtaatctttttatt

SEQ ID NO: 90290 - DNA, 25 bp, Homo sapien
tacctgattagccacaataacacat

SEQ ID NO: 90291 - DNA, 25 bp, Homo sapien
tacctgattagccagaataacacat

SEQ ID NO: 90292 - DNA, 25 bp, Homo sapien
tacctgcaaaagtaaaaaacaccag

SEQ ID NO: 90293 - DNA, 25 bp, Homo sapien
tacctgcaaaagtcaaaaacaccag

SEQ ID NO: 90294 - DNA, 25 bp, Homo sapien
tacctgcacgtgactttgaggccct

SEQ ID NO: 90295 - DNA, 25 bp, Homo sapien
tacctgcaggaagaatgacctccca

SEQ ID NO: 90296 - DNA, 25 bp, Homo sapien
tacctgcaggaagagtgacctccca

SEQ ID NO: 90297 - DNA, 25 bp, Homo sapien
tacctgcatgtgactttgaggccct

SEQ ID NO: 90298 - DNA, 25 bp, Homo sapien
tacctgccacctcggcatccaatat

SEQ ID NO: 90299 - DNA, 25 bp, Homo sapien
tacctgcctcctcggcatccaatat

SEQ ID NO: 90300 - DNA, 25 bp, Homo sapien
tacctgctaacgcaatctagctaat

SEQ ID NO: 90301 - DNA, 25 bp, Homo sapien
tacctgctaacggaatctagctaat

SEQ ID NO: 90302 - DNA, 25 bp, Homo sapien
tacctgctatttgctgtttgtcttt

SEQ ID NO: 90303 - DNA, 25 bp, Homo sapien
tacctgctattttctgtttgtcttt

SEQ ID NO: 90304 - DNA, 25 bp, Homo sapien
tacctggcatcgaatctataaacta

SEQ ID NO: 90305 - DNA, 25 bp, Homo sapien
tacctggcatctaatctataaacta

SEQ ID NO: 90306 - DNA, 25 bp, Homo sapien
tacctggctcaatacattactggaa

SEQ ID NO: 90307 - DNA, 25 bp, Homo sapien
tacctggctcaatccattactggaa

SEQ ID NO: 90308 - DNA, 25 bp, Homo sapien
tacctgggcatcactgcgaattatt

SEQ ID NO: 90309 - DNA, 25 bp, Homo sapien
tacctgggcatcactgtgaattatt

SEQ ID NO: 90310 - DNA, 25 bp, Homo sapien
tacctggggatgtaaagactatggt

SEQ ID NO: 90311 - DNA, 25 bp, Homo sapien
tacctgggtatgtaaagactatggt

SEQ ID NO: 90312 - DNA, 25 bp, Homo sapien
tacctggtggcaaattgattacatt

SEQ ID NO: 90313 - DNA, 25 bp, Homo sapien
tacctggtggcagattgattacatt

SEQ ID NO: 90314 - DNA, 25 bp, Homo sapien
tacctgtagttcctgttacttagga

SEQ ID NO: 90315 - DNA, 25 bp, Homo sapien
tacctgtagttcttgttacttagga

SEQ ID NO: 90316 - DNA, 25 bp, Homo sapien
tacctgtcagcaccgcacactgcat

SEQ ID NO: 90317 - DNA, 25 bp, Homo sapien
tacctgtcagcacggcacactgcat

SEQ ID NO: 90318 - DNA, 25 bp, Homo sapien
tacctgtcatcctagagaaaaaaca

SEQ ID NO: 90319 - DNA, 25 bp, Homo sapien
tacctgtcatcttagagaaaaaaca

SEQ ID NO: 90320 - DNA, 25 bp, Homo sapien
tacctgtctggcagcatatggtgtg

SEQ ID NO: 90321 - DNA, 25 bp, Homo sapien
tacctgtctggcagtatatggtgtg

SEQ ID NO: 90322 - DNA, 25 bp, Homo sapien
tacctgtctgggatttcttgacaat

SEQ ID NO: 90323 - DNA, 25 bp, Homo sapien
tacctgtcttggatttcttgacaat

SEQ ID NO: 90324 - DNA, 25 bp, Homo sapien
tacctgttgaacgaaacattttcat

SEQ ID NO: 90325 - DNA, 25 bp, Homo sapien
tacctgttgaatgaaacattttcat

SEQ ID NO: 90326 - DNA, 25 bp, Homo sapien
taccttaaattcctgccagctgtga

SEQ ID NO: 90327 - DNA, 25 bp, Homo sapien
taccttaaattcctgcgagctgtga

SEQ ID NO: 90328 - DNA, 25 bp, Homo sapien
taccttacccagtccgccaattcaa

SEQ ID NO: 90329 - DNA, 25 bp, Homo sapien
taccttacccagtctgccaattcaa

SEQ ID NO: 90330 - DNA, 25 bp, Homo sapien
taccttacttatgctaccttacttc

SEQ ID NO: 90331 - DNA, 25 bp, Homo sapien
taccttacttatgctatcttacttc

SEQ ID NO: 90332 - DNA, 25 bp, Homo sapien
taccttcaaaccaaaagcttaatct

SEQ ID NO: 90333 - DNA, 25 bp, Homo sapien
taccttcaaaccgaaagcttaatct

SEQ ID NO: 90334 - DNA, 25 bp, Homo sapien
taccttcatactttttggtttcctg

SEQ ID NO: 90335 - DNA, 25 bp, Homo sapien
taccttcatacttttttgtttcctg

SEQ ID NO: 90336 - DNA, 25 bp, Homo sapien
taccttcatttaaataaatatctgc

SEQ ID NO: 90337 - DNA, 25 bp, Homo sapien
taccttcatttaaatagatatctgc

SEQ ID NO: 90338 - DNA, 25 bp, Homo sapien
taccttcttcagcagccgcctctgc

SEQ ID NO: 90339 - DNA, 25 bp, Homo sapien
taccttcttcagcagctgcctctgc

SEQ ID NO: 90340 - DNA, 25 bp, Homo sapien
taccttgcaaattacaaaactcttg

SEQ ID NO: 90341 - DNA, 25 bp, Homo sapien
taccttgcaaattagaaaactcttg

SEQ ID NO: 90342 - DNA, 25 bp, Homo sapien
taccttgcagtgaaatataacagta

SEQ ID NO: 90343 - DNA, 25 bp, Homo sapien
taccttgcagtgaattataacagta

SEQ ID NO: 90344 - DNA, 25 bp, Homo sapien
taccttggaggagttttcgtcatgt

SEQ ID NO: 90345 - DNA, 25 bp, Homo sapien
taccttggctcttgacactagagtt

SEQ ID NO: 90346 - DNA, 25 bp, Homo sapien
taccttggctcttggcactagagtt

SEQ ID NO: 90347 - DNA, 25 bp, Homo sapien
taccttggtggagttttcgtcatgt

SEQ ID NO: 90348 - DNA, 25 bp, Homo sapien
taccttgtgattccacgagtcaaca

SEQ ID NO: 90349 - DNA, 25 bp, Homo sapien
taccttgtgattccgcgagtcaaca

SEQ ID NO: 90350 - DNA, 25 bp, Homo sapien
tacctttaatgcaactccatcaaaa

SEQ ID NO: 90351 - DNA, 25 bp, Homo sapien
tacctttaatgcacctccatcaaaa

SEQ ID NO: 90352 - DNA, 25 bp, Homo sapien
tacctttcatcttacccgcacatgg

SEQ ID NO: 90353 - DNA, 25 bp, Homo sapien
tacctttcatcttacctgcacatgg

SEQ ID NO: 90354 - DNA, 25 bp, Homo sapien
tacctttctcttacaaggacactgt

SEQ ID NO: 90355 - DNA, 25 bp, Homo sapien
tacctttctcttataaggacactgt

SEQ ID NO: 90356 - DNA, 25 bp, Homo sapien
taccttttaatctgcactgaagtat

SEQ ID NO: 90357 - DNA, 25 bp, Homo sapien
taccttttaatctgcattgaagtat

SEQ ID NO: 90358 - DNA, 25 bp, Homo sapien
taccttttagcatgaaagaaaagtt

SEQ ID NO: 90359 - DNA, 25 bp, Homo sapien
taccttttagcgtgaaagaaaagtt

SEQ ID NO: 90360 - DNA, 25 bp, Homo sapien
taccttttgaaacgtaaacaaaaga

SEQ ID NO: 90361 - DNA, 25 bp, Homo sapien
taccttttgaaatgtaaacaaaaga

SEQ ID NO: 90362 - DNA, 25 bp, Homo sapien
taccttttgatagaagacacgttta

SEQ ID NO: 90363 - DNA, 25 bp, Homo sapien
tacctttttatagaagacacgttta

SEQ ID NO: 90364 - DNA, 25 bp, Homo sapien
tacctttttatgagaagagataata

SEQ ID NO: 90365 - DNA, 25 bp, Homo sapien
tacctttttatgaggagagataata

SEQ ID NO: 90366 - DNA, 25 bp, Homo sapien
tacctttttttcccttaaacattgg

SEQ ID NO: 90367 - DNA, 25 bp, Homo sapien
taccttttttttccttaaacattgg

SEQ ID NO: 90368 - DNA, 25 bp, Homo sapien
tacgaaatccaaacgcagggagagt

SEQ ID NO: 90369 - DNA, 25 bp, Homo sapien
tacgaaatccaaatgcagggagagt

SEQ ID NO: 90370 - DNA, 25 bp, Homo sapien
tacgaacgtttcgtctttggtggct

SEQ ID NO: 90371 - DNA, 25 bp, Homo sapien
tacgaacgttttgtctttggtggct

SEQ ID NO: 90372 - DNA, 25 bp, Homo sapien
tacgaagcaaaaaccttctctcatt

SEQ ID NO: 90373 - DNA, 25 bp, Homo sapien
tacgaagcaaaaacgttctctcatt

SEQ ID NO: 90374 - DNA, 25 bp, Homo sapien
tacgaattatatattgcaagttatg

SEQ ID NO: 90375 - DNA, 25 bp, Homo sapien
tacgaattgtatattgcaagttatg

SEQ ID NO: 90376 - DNA, 25 bp, Homo sapien
tacgacaacggctgaggaatgttgc

SEQ ID NO: 90377 - DNA, 25 bp, Homo sapien
tacgacaatggctgaggaatgttgc

SEQ ID NO: 90378 - DNA, 25 bp, Homo sapien
tacgacacaacaacttgagaaatct

SEQ ID NO: 90379 - DNA, 25 bp, Homo sapien
tacgacacagcaacttgagaaatct

SEQ ID NO: 90380 - DNA, 25 bp, Homo sapien
tacgactcagccacattgcatactc

SEQ ID NO: 90381 - DNA, 25 bp, Homo sapien
tacgactcagccacgttgcatactc

SEQ ID NO: 90382 - DNA, 25 bp, Homo sapien
tacgagctattcttcgtacatatgg

SEQ ID NO: 90383 - DNA, 25 bp, Homo sapien
tacgagctattctttgtacatatgg

SEQ ID NO: 90384 - DNA, 25 bp, Homo sapien
tacgaggaggccatgagaagaggct

SEQ ID NO: 90385 - DNA, 25 bp, Homo sapien
tacgaggaggccgtgagaagaggct

SEQ ID NO: 90386 - DNA, 25 bp, Homo sapien
tacgaggcatgatccccaaattgaa

SEQ ID NO: 90387 - DNA, 25 bp, Homo sapien
tacgaggcatgattcccaaattgaa

SEQ ID NO: 90388 - DNA, 25 bp, Homo sapien
tacgatgaaaaccaaggattcaaat

SEQ ID NO: 90389 - DNA, 25 bp, Homo sapien
tacgatgaaaacgatatgataaaaa

SEQ ID NO: 90390 - DNA, 25 bp, Homo sapien
tacgatgaaaactatatgataaaaa

SEQ ID NO: 90391 - DNA, 25 bp, Homo sapien
tacgatgaaaagcaaggattcaaat

SEQ ID NO: 90392 - DNA, 25 bp, Homo sapien
tacgcactgtttcgtgtaaggcttt

SEQ ID NO: 90393 - DNA, 25 bp, Homo sapien
tacgcactgttttgtgtaaggcttt

SEQ ID NO: 90394 - DNA, 25 bp, Homo sapien
tacgcagcgatgttggctcccttat

SEQ ID NO: 90395 - DNA, 25 bp, Homo sapien
tacgcagctatgttggctcccttat

SEQ ID NO: 90396 - DNA, 25 bp, Homo sapien
tacgcatctcgcctcaagttgtgag

SEQ ID NO: 90397 - DNA, 25 bp, Homo sapien
tacgcatcttgcctcaagttgtgag

SEQ ID NO: 90398 - DNA, 25 bp, Homo sapien
tacgcatttgaccagcatccagatc

SEQ ID NO: 90399 - DNA, 25 bp, Homo sapien
tacgcatttgaccagcttccagatc

SEQ ID NO: 90400 - DNA, 25 bp, Homo sapien
tacgccagtgttctaaagtttttga

SEQ ID NO: 90401 - DNA, 25 bp, Homo sapien
tacgccagtgttctgaagtttttga

SEQ ID NO: 90402 - DNA, 25 bp, Homo sapien
tacgccatgtaccgtaggatgctta

SEQ ID NO: 90403 - DNA, 25 bp, Homo sapien
tacgccatgtaccttaggatgctta

SEQ ID NO: 90404 - DNA, 25 bp, Homo sapien
tacgctaagtcaacttgtgcaattt

SEQ ID NO: 90405 - DNA, 25 bp, Homo sapien
tacgctaagtcatcttgtgcaattt

SEQ ID NO: 90406 - DNA, 25 bp, Homo sapien
tacgctactgatagaatgtaaatta

SEQ ID NO: 90407 - DNA, 25 bp, Homo sapien
tacgctactgatggaatgtaaatta

SEQ ID NO: 90408 - DNA, 25 bp, Homo sapien
tacgctctctgccatcccaaatatg

SEQ ID NO: 90409 - DNA, 25 bp, Homo sapien
tacgctctgtgccatcccaaatatg

SEQ ID NO: 90410 - DNA, 25 bp, Homo sapien
tacgctgaggacattgagtgatcta

SEQ ID NO: 90411 - DNA, 25 bp, Homo sapien
tacgctgaggatattgagtgatcta

SEQ ID NO: 90412 - DNA, 25 bp, Homo sapien
tacgcttgagaaactgaaagggcat

SEQ ID NO: 90413 - DNA, 25 bp, Homo sapien
tacgcttgagaaactggaagggcat

SEQ ID NO: 90414 - DNA, 25 bp, Homo sapien
tacgcttggccacattacttatgta

SEQ ID NO: 90415 - DNA, 25 bp, Homo sapien
tacgcttggccacattgcttatgta

SEQ ID NO: 90416 - DNA, 25 bp, Homo sapien
tacggaagaggaaaaaattaactgt

SEQ ID NO: 90417 - DNA, 25 bp, Homo sapien
tacggaagaggaaaaatttaactgt

SEQ ID NO: 90418 - DNA, 25 bp, Homo sapien
tacggactactcaataatttatcca

SEQ ID NO: 90419 - DNA, 25 bp, Homo sapien
tacggactactcagtaatttatcca

SEQ ID NO: 90420 - DNA, 25 bp, Homo sapien
tacggatgagtaaagcacatggaca

SEQ ID NO: 90421 - DNA, 25 bp, Homo sapien
tacggatgtgtaaagcacatggaca

SEQ ID NO: 90422 - DNA, 25 bp, Homo sapien
tacggcattttcttttttttgccaa

SEQ ID NO: 90423 - DNA, 25 bp, Homo sapien
tacggcatttttttttttttgccaa

SEQ ID NO: 90424 - DNA, 25 bp, Homo sapien
tacgggctcttttccgttctatata

SEQ ID NO: 90425 - DNA, 25 bp, Homo sapien
tacgggctctttttcgttctatata

SEQ ID NO: 90426 - DNA, 25 bp, Homo sapien
tacggtagacactgatgtgttatat

SEQ ID NO: 90427 - DNA, 25 bp, Homo sapien
tacggtagacattgatgtgttatat

SEQ ID NO: 90428 - DNA, 25 bp, Homo sapien
tacggtaggtcattaagcagccaat

SEQ ID NO: 90429 - DNA, 25 bp, Homo sapien
tacggtaggtcgttaagcagccaat

SEQ ID NO: 90430 - DNA, 25 bp, Homo sapien
tacggtatagtgtaccgtggactca

SEQ ID NO: 90431 - DNA, 25 bp, Homo sapien
tacggtatagtttaccgtggactca

SEQ ID NO: 90432 - DNA, 25 bp, Homo sapien
tacggttcaacaagcttcccctaac

SEQ ID NO: 90433 - DNA, 25 bp, Homo sapien
tacggttcagcaagcttcccctaac

SEQ ID NO: 90434 - DNA, 25 bp, Homo sapien
tacgtaacaaaatatgttcaagatc

SEQ ID NO: 90435 - DNA, 25 bp, Homo sapien
tacgtaacaaagtatgttcaagatc

SEQ ID NO: 90436 - DNA, 25 bp, Homo sapien
tacgtataaggtccaaaatcacact

SEQ ID NO: 90437 - DNA, 25 bp, Homo sapien
tacgtataaggtcccaaatcacact

SEQ ID NO: 90438 - DNA, 25 bp, Homo sapien
tacgtctcaaagcagttcctcagaa

SEQ ID NO: 90439 - DNA, 25 bp, Homo sapien
tacgtctcaaagcggttcctcagaa

SEQ ID NO: 90440 - DNA, 25 bp, Homo sapien
tacgtgaggtaggcctctttgtgta

SEQ ID NO: 90441 - DNA, 25 bp, Homo sapien
tacgtgaggtaggcctttttgtgta

SEQ ID NO: 90442 - DNA, 25 bp, Homo sapien
tacgtgcacaacgggacatagaccc

SEQ ID NO: 90443 - DNA, 25 bp, Homo sapien
tacgtgcacaatgggacatagaccc

SEQ ID NO: 90444 - DNA, 25 bp, Homo sapien
tacgtggcgatcccaattcagaatg

SEQ ID NO: 90445 - DNA, 25 bp, Homo sapien
tacgtggcggtcccaattcagaatg

SEQ ID NO: 90446 - DNA, 25 bp, Homo sapien
tacgtgttcagctaattgcaaaaac

SEQ ID NO: 90447 - DNA, 25 bp, Homo sapien
tacgtgttcggctaattgcaaaaac

SEQ ID NO: 90448 - DNA, 25 bp, Homo sapien
tacgttaggctctaatgaaacctca

SEQ ID NO: 90449 - DNA, 25 bp, Homo sapien
tacgttaggctctgatgaaacctca

SEQ ID NO: 90450 - DNA, 25 bp, Homo sapien
tacgttcaaattcctcaattattgt

SEQ ID NO: 90451 - DNA, 25 bp, Homo sapien
tacgttcaagttcctcaattattgt

SEQ ID NO: 90452 - DNA, 25 bp, Homo sapien
tacgtttatccaaaagcatctcacc

SEQ ID NO: 90453 - DNA, 25 bp, Homo sapien
tacgtttattcaaaagcatctcacc

SEQ ID NO: 90454 - DNA, 25 bp, Homo sapien
tacgttttatgcaccgaacttactg

SEQ ID NO: 90455 - DNA, 25 bp, Homo sapien
tacgttttatgcacggaacttactg

SEQ ID NO: 90456 - DNA, 25 bp, Homo sapien
tactaaaaatccgaaacaattagcc

SEQ ID NO: 90457 - DNA, 25 bp, Homo sapien
tactaaaaatctgaaacaattagcc

SEQ ID NO: 90458 - DNA, 25 bp, Homo sapien
tactaaaatcagccttttttcattt

SEQ ID NO: 90459 - DNA, 25 bp, Homo sapien
tactaaaatcaggcttttttcattt

SEQ ID NO: 90460 - DNA, 25 bp, Homo sapien
tactaaaattacgaaatatctcttt

SEQ ID NO: 90461 - DNA, 25 bp, Homo sapien
tactaaaattatgaaatatctcttt

SEQ ID NO: 90462 - DNA, 25 bp, Homo sapien
tactaaacaacaacttctgagttaa

SEQ ID NO: 90463 - DNA, 25 bp, Homo sapien
tactaaacaacaatttctgagttaa

SEQ ID NO: 90464 - DNA, 25 bp, Homo sapien
tactaaacagatcccgaataaaggg

SEQ ID NO: 90465 - DNA, 25 bp, Homo sapien
tactaaacagatcctgaataaaggg

SEQ ID NO: 90466 - DNA, 25 bp, Homo sapien
tactaaaccattactgtagattaat

SEQ ID NO: 90467 - DNA, 25 bp, Homo sapien
tactaaaccattattgtagattaat

SEQ ID NO: 90468 - DNA, 25 bp, Homo sapien
tactaaacgttgatgagaatgtgga

SEQ ID NO: 90469 - DNA, 25 bp, Homo sapien
tactaaacgttggtgagaatgtgga

SEQ ID NO: 90470 - DNA, 25 bp, Homo sapien
tactaaaggagaacaaaagacagga

SEQ ID NO: 90471 - DNA, 25 bp, Homo sapien
tactaaaggagaacaagagacagga

SEQ ID NO: 90472 - DNA, 25 bp, Homo sapien
tactaaataaacgcttggagtgcgg

SEQ ID NO: 90473 - DNA, 25 bp, Homo sapien
tactaaataaatgcttggagtgcgg

SEQ ID NO: 90474 - DNA, 25 bp, Homo sapien
tactaaatagcttacatttcagagc

SEQ ID NO: 90475 - DNA, 25 bp, Homo sapien
tactaaatagcttgcatttcagagc

SEQ ID NO: 90476 - DNA, 25 bp, Homo sapien
tactaaatcatcaagagtaaaatgg

SEQ ID NO: 90477 - DNA, 25 bp, Homo sapien
tactaaatcatcgagagtaaaatgg

SEQ ID NO: 90478 - DNA, 25 bp, Homo sapien
tactaaattaaagacaacacggtac

SEQ ID NO: 90479 - DNA, 25 bp, Homo sapien
tactaaattaaagataacacggtac

SEQ ID NO: 90480 - DNA, 25 bp, Homo sapien
tactaaatttgattgttcctggact

SEQ ID NO: 90481 - DNA, 25 bp, Homo sapien
tactaaatttgtttgttcctggact

SEQ ID NO: 90482 - DNA, 25 bp, Homo sapien
tactaacaaccatattaatagggat

SEQ ID NO: 90483 - DNA, 25 bp, Homo sapien
tactaacaagcatattaatagggat

SEQ ID NO: 90484 - DNA, 25 bp, Homo sapien
tactaacatgaaccaggaaaagctg

SEQ ID NO: 90485 - DNA, 25 bp, Homo sapien
tactaacatgaactaggaaaagctg

SEQ ID NO: 90486 - DNA, 25 bp, Homo sapien
tactaacgcagtaacagtacaaaga

SEQ ID NO: 90487 - DNA, 25 bp, Homo sapien
tactaacgcagtgacagtacaaaga

SEQ ID NO: 90488 - DNA, 25 bp, Homo sapien
tactaactgcgtagctttagacttg

SEQ ID NO: 90489 - DNA, 25 bp, Homo sapien
tactaactgtgtagctttagacttg

SEQ ID NO: 90490 - DNA, 25 bp, Homo sapien
tactaagtgtaacaagtagtgtgct

SEQ ID NO: 90491 - DNA, 25 bp, Homo sapien
tactaagtgtaacaggtagtgtgct

SEQ ID NO: 90492 - DNA, 25 bp, Homo sapien
tactaatgcaaagtggccagtcaag

SEQ ID NO: 90493 - DNA, 25 bp, Homo sapien
tactaatggaaagtggccagtcaag

SEQ ID NO: 90494 - DNA, 25 bp, Homo sapien
tactaattaccaccaaagaatgtgt

SEQ ID NO: 90495 - DNA, 25 bp, Homo sapien
tactaattaccatcaaagaatgtgt

SEQ ID NO: 90496 - DNA, 25 bp, Homo sapien
tactaattatacgaagtcctttgaa

SEQ ID NO: 90497 - DNA, 25 bp, Homo sapien
tactaattatatgaagtcctttgaa

SEQ ID NO: 90498 - DNA, 25 bp, Homo sapien
tactacaatcaacagaataatgtag

SEQ ID NO: 90499 - DNA, 25 bp, Homo sapien
tactacaatcaacggaataatgtag

SEQ ID NO: 90500 - DNA, 25 bp, Homo sapien
tactacacatgaccgctatactatt

SEQ ID NO: 90501 - DNA, 25 bp, Homo sapien
tactacacatgcccgctatactatt

SEQ ID NO: 90502 - DNA, 25 bp, Homo sapien
tactacagggaaacaaaccaaaaca

SEQ ID NO: 90503 - DNA, 25 bp, Homo sapien
tactacagggaagcaaaccaaaaca

SEQ ID NO: 90504 - DNA, 25 bp, Homo sapien
tactacatataaagcgctctggaag

SEQ ID NO: 90505 - DNA, 25 bp, Homo sapien
tactacatataaagtgctctggaag

SEQ ID NO: 90506 - DNA, 25 bp, Homo sapien
tactacatcactgcagctgcaaatg

SEQ ID NO: 90507 - DNA, 25 bp, Homo sapien
tactacatcgctgcagctgcaaatg

SEQ ID NO: 90508 - DNA, 25 bp, Homo sapien
tactacggcattttcttttttttgc

SEQ ID NO: 90509 - DNA, 25 bp, Homo sapien
tactacggcatttttttttttttgc

SEQ ID NO: 90510 - DNA, 25 bp, Homo sapien
tactactgcacacctgtgaagccaa

SEQ ID NO: 90511 - DNA, 25 bp, Homo sapien
tactactgtacacctgtgaagccaa

SEQ ID NO: 90512 - DNA, 25 bp, Homo sapien
tactactgtgacctatagcatgtcc

SEQ ID NO: 90513 - DNA, 25 bp, Homo sapien
tactactgtgacctatggcatgtcc

SEQ ID NO: 90514 - DNA, 25 bp, Homo sapien
tactacttaatactgagccaagtaa

SEQ ID NO: 90515 - DNA, 25 bp, Homo sapien
tactacttactactgagccaagtaa

SEQ ID NO: 90516 - DNA, 25 bp, Homo sapien
tactacttgcttcctggacttgcca

SEQ ID NO: 90517 - DNA, 25 bp, Homo sapien
tactacttgcttcgtggacttgcca

SEQ ID NO: 90518 - DNA, 25 bp, Homo sapien
tactagaagctacctttttcctagg

SEQ ID NO: 90519 - DNA, 25 bp, Homo sapien
tactagaagctacttttttcctagg

SEQ ID NO: 90520 - DNA, 25 bp, Homo sapien
tactagacagtgcttaagcataatg

SEQ ID NO: 90521 - DNA, 25 bp, Homo sapien
tactagacggtgcttaagcataatg

SEQ ID NO: 90522 - DNA, 25 bp, Homo sapien
tactagagcagaaaagaatggtcaa

SEQ ID NO: 90523 - DNA, 25 bp, Homo sapien
tactagagcagagaagaatggtcaa

SEQ ID NO: 90524 - DNA, 25 bp, Homo sapien
tactagatccatctaattctactac

SEQ ID NO: 90525 - DNA, 25 bp, Homo sapien
tactagattcatctaattctactac

SEQ ID NO: 90526 - DNA, 25 bp, Homo sapien
tactagcattacgcattttgatgct

SEQ ID NO: 90527 - DNA, 25 bp, Homo sapien
tactagcattatgcattttgatgct

SEQ ID NO: 90528 - DNA, 25 bp, Homo sapien
tactagcccgggtgcccaacagcag

SEQ ID NO: 90529 - DNA, 25 bp, Homo sapien
tactagcctgggtgcccaacagcag

SEQ ID NO: 90530 - DNA, 25 bp, Homo sapien
tactagctctgtcataagagtcaca

SEQ ID NO: 90531 - DNA, 25 bp, Homo sapien
tactagctctgtcgtaagagtcaca

SEQ ID NO: 90532 - DNA, 25 bp, Homo sapien
tactaggtactacggaggagacaac

SEQ ID NO: 90533 - DNA, 25 bp, Homo sapien
tactaggtactatggaggagacaac

SEQ ID NO: 90534 - DNA, 25 bp, Homo sapien
tactagtagacattcataaccaaat

SEQ ID NO: 90535 - DNA, 25 bp, Homo sapien
tactagtagtcattcataaccaaat

SEQ ID NO: 90536 - DNA, 25 bp, Homo sapien
tactagttgtccggagcttcctagg

SEQ ID NO: 90537 - DNA, 25 bp, Homo sapien
tactagttgtctggagcttcctagg

SEQ ID NO: 90538 - DNA, 25 bp, Homo sapien
tactataattggtgattcctatcat

SEQ ID NO: 90539 - DNA, 25 bp, Homo sapien
tactataattggtggttcctatcat

SEQ ID NO: 90540 - DNA, 25 bp, Homo sapien
tactataattgtactgaggaatcat

SEQ ID NO: 90541 - DNA, 25 bp, Homo sapien
tactataattgtagtgaggaatcat

SEQ ID NO: 90542 - DNA, 25 bp, Homo sapien
tactatacattcatcctcttgccca

SEQ ID NO: 90543 - DNA, 25 bp, Homo sapien
tactatacattcattctcttgccca

SEQ ID NO: 90544 - DNA, 25 bp, Homo sapien
tactataggcatcagaaatgtgaga

SEQ ID NO: 90545 - DNA, 25 bp, Homo sapien
tactataggcattagaaatgtgaga

SEQ ID NO: 90546 - DNA, 25 bp, Homo sapien
tactatataatagaactgcagcctt

SEQ ID NO: 90547 - DNA, 25 bp, Homo sapien
tactatatattagaactgcagcctt

SEQ ID NO: 90548 - DNA, 25 bp, Homo sapien
tactatatgccaaatactgtgaagt

SEQ ID NO: 90549 - DNA, 25 bp, Homo sapien
tactatatgccaattactgtgaagt

SEQ ID NO: 90550 - DNA, 25 bp, Homo sapien
tactatccgagtattacattgccac

SEQ ID NO: 90551 - DNA, 25 bp, Homo sapien
tactatccgagtattatattgccac

SEQ ID NO: 90552 - DNA, 25 bp, Homo sapien
tactatctctctccgttgcatcata

SEQ ID NO: 90553 - DNA, 25 bp, Homo sapien
tactatctctctctgttgcatcata

SEQ ID NO: 90554 - DNA, 25 bp, Homo sapien
tactatctgtattacactttaaagc

SEQ ID NO: 90555 - DNA, 25 bp, Homo sapien
tactatctgtattatactttaaagc

SEQ ID NO: 90556 - DNA, 25 bp, Homo sapien
tactatgaattgacaatttgtagcc

SEQ ID NO: 90557 - DNA, 25 bp, Homo sapien
tactatgaattggcaatttgtagcc

SEQ ID NO: 90558 - DNA, 25 bp, Homo sapien
tactatgatcatctggccaattcta

SEQ ID NO: 90559 - DNA, 25 bp, Homo sapien
tactatgatcatctggtcaattcta

SEQ ID NO: 90560 - DNA, 25 bp, Homo sapien
tactatggcagcaaatcctgcaaaa

SEQ ID NO: 90561 - DNA, 25 bp, Homo sapien
tactatggcggcaaatcctgcaaaa

SEQ ID NO: 90562 - DNA, 25 bp, Homo sapien
tactatggtgtaatactagatccct

SEQ ID NO: 90563 - DNA, 25 bp, Homo sapien
tactatggtgtgatactagatccct

SEQ ID NO: 90564 - DNA, 25 bp, Homo sapien
tactatgtggcaacaaatggtggaa

SEQ ID NO: 90565 - DNA, 25 bp, Homo sapien
tactatgtggcaataaatggtggaa

SEQ ID NO: 90566 - DNA, 25 bp, Homo sapien
tactatgtttggcaagcatgtggga

SEQ ID NO: 90567 - DNA, 25 bp, Homo sapien
tactatgtttggtaagcatgtggga

SEQ ID NO: 90568 - DNA, 25 bp, Homo sapien
tactattactccacacttcaaggtc

SEQ ID NO: 90569 - DNA, 25 bp, Homo sapien
tactattactccatacttcaaggtc

SEQ ID NO: 90570 - DNA, 25 bp, Homo sapien
tactattagaacaggcttacaagag

SEQ ID NO: 90571 - DNA, 25 bp, Homo sapien
tactattagaaccggcttacaagag

SEQ ID NO: 90572 - DNA, 25 bp, Homo sapien
tactattccaaaaacaatgcccgca

SEQ ID NO: 90573 - DNA, 25 bp, Homo sapien
tactattccaaagacaatgcccgca

SEQ ID NO: 90574 - DNA, 25 bp, Homo sapien
tactattcccacgacaaaactggca

SEQ ID NO: 90575 - DNA, 25 bp, Homo sapien
tactattcccaggacaaaactggca

SEQ ID NO: 90576 - DNA, 25 bp, Homo sapien
tactattgctatatctctttcctca

SEQ ID NO: 90577 - DNA, 25 bp, Homo sapien
tactattgctatatgtctttcctca

SEQ ID NO: 90578 - DNA, 25 bp, Homo sapien
tactatttattacataccaactcaa

SEQ ID NO: 90579 - DNA, 25 bp, Homo sapien
tactatttattacctaccaactcaa

SEQ ID NO: 90580 - DNA, 25 bp, Homo sapien
tactatttgcttaaaaaggaatgca

SEQ ID NO: 90581 - DNA, 25 bp, Homo sapien
tactatttgcttgaaaaggaatgca

SEQ ID NO: 90582 - DNA, 25 bp, Homo sapien
tactcaaatataagtagacataagt

SEQ ID NO: 90583 - DNA, 25 bp, Homo sapien
tactcaaatgctcgtaagaatatga

SEQ ID NO: 90584 - DNA, 25 bp, Homo sapien
tactcaaatgcttgtaagaatatga

SEQ ID NO: 90585 - DNA, 25 bp, Homo sapien
tactcaaatgtaagtagacataagt

SEQ ID NO: 90586 - DNA, 25 bp, Homo sapien
tactcaactacttcacatttcataa

SEQ ID NO: 90587 - DNA, 25 bp, Homo sapien
tactcaactgcttcacatttcataa

SEQ ID NO: 90588 - DNA, 25 bp, Homo sapien
tactcaaggatggccaggtgtgttc

SEQ ID NO: 90589 - DNA, 25 bp, Homo sapien
tactcaaggatggtcaggtgtgttc

SEQ ID NO: 90590 - DNA, 25 bp, Homo sapien
tactcaagttgatataggtttaagt

SEQ ID NO: 90591 - DNA, 25 bp, Homo sapien
tactcaagttgatgtaggtttaagt

SEQ ID NO: 90592 - DNA, 25 bp, Homo sapien
tactcaattagacatttgtcagcac

SEQ ID NO: 90593 - DNA, 25 bp, Homo sapien
tactcaattagacttttgtcagcac

SEQ ID NO: 90594 - DNA, 25 bp, Homo sapien
tactcacaaccaggatgtcaggagg

SEQ ID NO: 90595 - DNA, 25 bp, Homo sapien
tactcacaatcacttaattgccctc

SEQ ID NO: 90596 - DNA, 25 bp, Homo sapien
tactcacaatcaggatgtcaggagg

SEQ ID NO: 90597 - DNA, 25 bp, Homo sapien
tactcacattcacttaattgccctc

SEQ ID NO: 90598 - DNA, 25 bp, Homo sapien
tactcacctctagagtaagatgtga

SEQ ID NO: 90599 - DNA, 25 bp, Homo sapien
tactcacctctagagtcagatgtga

SEQ ID NO: 90600 - DNA, 25 bp, Homo sapien
tactcagaatcttaccctattatgt

SEQ ID NO: 90601 - DNA, 25 bp, Homo sapien
tactcagacatacgtgaaaaggctg

SEQ ID NO: 90602 - DNA, 25 bp, Homo sapien
tactcagacataggtgaaaaggctg

SEQ ID NO: 90603 - DNA, 25 bp, Homo sapien
tactcagactcttaccctattatgt

SEQ ID NO: 90604 - DNA, 25 bp, Homo sapien
tactcagatttgatataagaggaca

SEQ ID NO: 90605 - DNA, 25 bp, Homo sapien
tactcagatttggtataagaggaca

SEQ ID NO: 90606 - DNA, 25 bp, Homo sapien
tactcagcatcttcgtcgtctccta

SEQ ID NO: 90607 - DNA, 25 bp, Homo sapien
tactcagcatcttcttcgtctccta

SEQ ID NO: 90608 - DNA, 25 bp, Homo sapien
tactcaggaaggcgccagagacacg

SEQ ID NO: 90609 - DNA, 25 bp, Homo sapien
tactcaggaaggtgccagagacacg

SEQ ID NO: 90610 - DNA, 25 bp, Homo sapien
tactcaggttcccgataatgtttgt

SEQ ID NO: 90611 - DNA, 25 bp, Homo sapien
tactcaggttcctgataatgtttgt

SEQ ID NO: 90612 - DNA, 25 bp, Homo sapien
tactcatacacttgacaacatgtgg

SEQ ID NO: 90613 - DNA, 25 bp, Homo sapien
tactcatagacttgacaacatgtgg

SEQ ID NO: 90614 - DNA, 25 bp, Homo sapien
tactcatcaaaattcctgccttaca

SEQ ID NO: 90615 - DNA, 25 bp, Homo sapien
tactcatcaaaatttctgccttaca

SEQ ID NO: 90616 - DNA, 25 bp, Homo sapien
tactcatcatatcagtgattggctt

SEQ ID NO: 90617 - DNA, 25 bp, Homo sapien
tactcatcgtatcagtgattggctt

SEQ ID NO: 90618 - DNA, 25 bp, Homo sapien
tactcatgaagacagatgggaagtg

SEQ ID NO: 90619 - DNA, 25 bp, Homo sapien
tactcatgaagccagatgggaagtg

SEQ ID NO: 90620 - DNA, 25 bp, Homo sapien
tactcatttctcttcatccaggaag

SEQ ID NO: 90621 - DNA, 25 bp, Homo sapien
tactcatttctctttatccaggaag

SEQ ID NO: 90622 - DNA, 25 bp, Homo sapien
tactccaactcaccttgtccacaga

SEQ ID NO: 90623 - DNA, 25 bp, Homo sapien
tactccaactcgccttgtccacaga

SEQ ID NO: 90624 - DNA, 25 bp, Homo sapien
tactccacgaaatctacgcacttgt

SEQ ID NO: 90625 - DNA, 25 bp, Homo sapien
tactccacgaaatctatgcacttgt

SEQ ID NO: 90626 - DNA, 25 bp, Homo sapien
tactccactaacaatcttgctccga

SEQ ID NO: 90627 - DNA, 25 bp, Homo sapien
tactccactaacagtcttgctccga

SEQ ID NO: 90628 - DNA, 25 bp, Homo sapien
tactccactgcattcccagtacctg

SEQ ID NO: 90629 - DNA, 25 bp, Homo sapien
tactccacttcattcccagtacctg

SEQ ID NO: 90630 - DNA, 25 bp, Homo sapien
tactcccaaaaaacagattgcacag

SEQ ID NO: 90631 - DNA, 25 bp, Homo sapien
tactcccaaaagacagattgcacag

SEQ ID NO: 90632 - DNA, 25 bp, Homo sapien
tactccggtggccaaggcatgaaaa

SEQ ID NO: 90633 - DNA, 25 bp, Homo sapien
tactccggtggccgaggcatgaaaa

SEQ ID NO: 90634 - DNA, 25 bp, Homo sapien
tactcctaaatagttacgaaaaaca

SEQ ID NO: 90635 - DNA, 25 bp, Homo sapien
tactcctaaatagttatgaaaaaca

SEQ ID NO: 90636 - DNA, 25 bp, Homo sapien
tactcctttttcctatccttgctgc

SEQ ID NO: 90637 - DNA, 25 bp, Homo sapien
tactcctttttcttatccttgctgc

SEQ ID NO: 90638 - DNA, 25 bp, Homo sapien
tactctaacgtttcgtattatttta

SEQ ID NO: 90639 - DNA, 25 bp, Homo sapien
tactctaatgtttcgtattatttta

SEQ ID NO: 90640 - DNA, 25 bp, Homo sapien
tactctactggattgctttacatat

SEQ ID NO: 90641 - DNA, 25 bp, Homo sapien
tactctactggtttgctttacatat

SEQ ID NO: 90642 - DNA, 25 bp, Homo sapien
tactctaggtggaccatcatgcata

SEQ ID NO: 90643 - DNA, 25 bp, Homo sapien
tactctaggtggactatcatgcata

SEQ ID NO: 90644 - DNA, 25 bp, Homo sapien
tactctatcgactatattgacaatt

SEQ ID NO: 90645 - DNA, 25 bp, Homo sapien
tactctattgactatattgacaatt

SEQ ID NO: 90646 - DNA, 25 bp, Homo sapien
tactctcaaaaatcagaaagttcct

SEQ ID NO: 90647 - DNA, 25 bp, Homo sapien
tactctcaattttgtctcccgcagc

SEQ ID NO: 90648 - DNA, 25 bp, Homo sapien
tactctcaccataggtaacttgcag

SEQ ID NO: 90649 - DNA, 25 bp, Homo sapien
tactctcacgacacattgtatgtat

SEQ ID NO: 90650 - DNA, 25 bp, Homo sapien
tactctcacgacgcattgtatgtat

SEQ ID NO: 90651 - DNA, 25 bp, Homo sapien
tactctcactataggtaacttgcag

SEQ ID NO: 90652 - DNA, 25 bp, Homo sapien
tactctcacttttgtctcccgcagc

SEQ ID NO: 90653 - DNA, 25 bp, Homo sapien
tactctcagaaatcagaaagttcct

SEQ ID NO: 90654 - DNA, 25 bp, Homo sapien
tactctccacgccataatttgtaaa

SEQ ID NO: 90655 - DNA, 25 bp, Homo sapien
tactctccacggcataatttgtaaa

SEQ ID NO: 90656 - DNA, 25 bp, Homo sapien
tactctcggtgtgaaagtagagtaa

SEQ ID NO: 90657 - DNA, 25 bp, Homo sapien
tactctcggtgtgaaattagagtaa

SEQ ID NO: 90658 - DNA, 25 bp, Homo sapien
tactctcttctcacctacaagaatt

SEQ ID NO: 90659 - DNA, 25 bp, Homo sapien
tactctcttctcacctgcaagaatt

SEQ ID NO: 90660 - DNA, 25 bp, Homo sapien
tactctgcaatatacgcggaatgtc

SEQ ID NO: 90661 - DNA, 25 bp, Homo sapien
tactctgcaatatacgtggaatgtc

SEQ ID NO: 90662 - DNA, 25 bp, Homo sapien
tactctgcaccatggtatatttact

SEQ ID NO: 90663 - DNA, 25 bp, Homo sapien
tactctgcaccgtggtatatttact

SEQ ID NO: 90664 - DNA, 25 bp, Homo sapien
tactctggctgtaactcactgaaac

SEQ ID NO: 90665 - DNA, 25 bp, Homo sapien
tactctggctgtgactcactgaaac

SEQ ID NO: 90666 - DNA, 25 bp, Homo sapien
tactctggtgccctagcttgtcagc

SEQ ID NO: 90667 - DNA, 25 bp, Homo sapien
tactctggtgccctagtttgtcagc

SEQ ID NO: 90668 - DNA, 25 bp, Homo sapien
tactctgtgactctgaagatggata

SEQ ID NO: 90669 - DNA, 25 bp, Homo sapien
tactctgtgactttgaagatggata

SEQ ID NO: 90670 - DNA, 25 bp, Homo sapien
tactcttatgtcagcctatttaact

SEQ ID NO: 90671 - DNA, 25 bp, Homo sapien
tactcttatgtcatcctatttaact

SEQ ID NO: 90672 - DNA, 25 bp, Homo sapien
tactcttgatcatatcacagattgc

SEQ ID NO: 90673 - DNA, 25 bp, Homo sapien
tactcttgatcgtatcacagattgc

SEQ ID NO: 90674 - DNA, 25 bp, Homo sapien
tactcttgcagttgtttacttgttg

SEQ ID NO: 90675 - DNA, 25 bp, Homo sapien
tactcttgcggttttgtgaatctag

SEQ ID NO: 90676 - DNA, 25 bp, Homo sapien
tactcttgtagttgtttacttgttg

SEQ ID NO: 90677 - DNA, 25 bp, Homo sapien
tactcttgtggttttgtgaatctag

SEQ ID NO: 90678 - DNA, 25 bp, Homo sapien
tactctttccataatcactccattc

SEQ ID NO: 90679 - DNA, 25 bp, Homo sapien
tactctttcttgaatttaatatact

SEQ ID NO: 90680 - DNA, 25 bp, Homo sapien
tactctttcttgattttaatatact

SEQ ID NO: 90681 - DNA, 25 bp, Homo sapien
tactcttttcataatcactccattc

SEQ ID NO: 90682 - DNA, 25 bp, Homo sapien
tactcttttcgttcagccttcaaag

SEQ ID NO: 90683 - DNA, 25 bp, Homo sapien
tactctttttgttcagccttcaaag

SEQ ID NO: 90684 - DNA, 25 bp, Homo sapien
tactgaaaaactgatttctaaagat

SEQ ID NO: 90685 - DNA, 25 bp, Homo sapien
tactgaaacactgatttctaaagat

SEQ ID NO: 90686 - DNA, 25 bp, Homo sapien
tactgaaagacactgaaataaaaac

SEQ ID NO: 90687 - DNA, 25 bp, Homo sapien
tactgaaaggcactgaaataaaaac

SEQ ID NO: 90688 - DNA, 25 bp, Homo sapien
tactgaaggaacggaatttgatcag

SEQ ID NO: 90689 - DNA, 25 bp, Homo sapien
tactgaaggaatggaatttgatcag

SEQ ID NO: 90690 - DNA, 25 bp, Homo sapien
tactgaaggcttgaaacttccaggg

SEQ ID NO: 90691 - DNA, 25 bp, Homo sapien
tactgaaggcttgcaacttccaggg

SEQ ID NO: 90692 - DNA, 25 bp, Homo sapien
tactgaatgcttttaacgacaccaa

SEQ ID NO: 90693 - DNA, 25 bp, Homo sapien
tactgaatgcttttaatgacaccaa

SEQ ID NO: 90694 - DNA, 25 bp, Homo sapien
tactgaatttctttacttaatctca

SEQ ID NO: 90695 - DNA, 25 bp, Homo sapien
tactgaatttcttttcttaatctca

SEQ ID NO: 90696 - DNA, 25 bp, Homo sapien
tactgaatttttgtcaaatatagga

SEQ ID NO: 90697 - DNA, 25 bp, Homo sapien
tactgaatttttgttaaatatagga

SEQ ID NO: 90698 - DNA, 25 bp, Homo sapien
tactgacaatactgacccagttgtt

SEQ ID NO: 90699 - DNA, 25 bp, Homo sapien
tactgacaatactgacgcagttgtt

SEQ ID NO: 90700 - DNA, 25 bp, Homo sapien
tactgacatgatgccccttcacccc

SEQ ID NO: 90701 - DNA, 25 bp, Homo sapien
tactgacattatgccccttcacccc

SEQ ID NO: 90702 - DNA, 25 bp, Homo sapien
tactgagagatctcggttgtgaagg

SEQ ID NO: 90703 - DNA, 25 bp, Homo sapien
tactgagagatctgggttgtgaagg

SEQ ID NO: 90704 - DNA, 25 bp, Homo sapien
tactgagccttcaatcttctaagat

SEQ ID NO: 90705 - DNA, 25 bp, Homo sapien
tactgagccttcagtcttctaagat

SEQ ID NO: 90706 - DNA, 25 bp, Homo sapien
tactgagcgtccactctgtgcctgg

SEQ ID NO: 90707 - DNA, 25 bp, Homo sapien
tactgagcgtctactctgtgcctgg

SEQ ID NO: 90708 - DNA, 25 bp, Homo sapien
tactgagcttagaatgcagatcact

SEQ ID NO: 90709 - DNA, 25 bp, Homo sapien
tactgagcttagaatgtagatcact

SEQ ID NO: 90710 - DNA, 25 bp, Homo sapien
tactgaggcacaaactctaaggtga

SEQ ID NO: 90711 - DNA, 25 bp, Homo sapien
tactgaggcgcaaactctaaggtga

SEQ ID NO: 90712 - DNA, 25 bp, Homo sapien
tactgattacctgtctgggatttct

SEQ ID NO: 90713 - DNA, 25 bp, Homo sapien
tactgattacctgtcttggatttct

SEQ ID NO: 90714 - DNA, 25 bp, Homo sapien
tactgcaagccaatgaggtccacag

SEQ ID NO: 90715 - DNA, 25 bp, Homo sapien
tactgcaagccgatgaggtccacag

SEQ ID NO: 90716 - DNA, 25 bp, Homo sapien
tactgcacttagctacacattaagg

SEQ ID NO: 90717 - DNA, 25 bp, Homo sapien
tactgcacttagttacacattaagg

SEQ ID NO: 90718 - DNA, 25 bp, Homo sapien
tactgcacttccaaatcttgaacaa

SEQ ID NO: 90719 - DNA, 25 bp, Homo sapien
tactgcacttctaaatcttgaacaa

SEQ ID NO: 90720 - DNA, 25 bp, Homo sapien
tactgcagtctataatatataaccc

SEQ ID NO: 90721 - DNA, 25 bp, Homo sapien
tactgcagtctatgatatataaccc

SEQ ID NO: 90722 - DNA, 25 bp, Homo sapien
tactgccacagtacagccaggttcc

SEQ ID NO: 90723 - DNA, 25 bp, Homo sapien
tactgccacggtacagccaggttcc

SEQ ID NO: 90724 - DNA, 25 bp, Homo sapien
tactgccggattactgctgatacta

SEQ ID NO: 90725 - DNA, 25 bp, Homo sapien
tactgccggattactgttgatacta

SEQ ID NO: 90726 - DNA, 25 bp, Homo sapien
tactgcctagattacttatgtttta

SEQ ID NO: 90727 - DNA, 25 bp, Homo sapien
tactgcctagattgcttatgtttta

SEQ ID NO: 90728 - DNA, 25 bp, Homo sapien
tactgcctctacgctctcttctttg

SEQ ID NO: 90729 - DNA, 25 bp, Homo sapien
tactgcctctatgctctcttctttg

SEQ ID NO: 90730 - DNA, 25 bp, Homo sapien
tactgcctctgatttaaaatcctgc

SEQ ID NO: 90731 - DNA, 25 bp, Homo sapien
tactgcctctgatttagaatcctgc

SEQ ID NO: 90732 - DNA, 25 bp, Homo sapien
tactgctgtaatatcctactcctct

SEQ ID NO: 90733 - DNA, 25 bp, Homo sapien
tactgctgtaatatgctactcctct

SEQ ID NO: 90734 - DNA, 25 bp, Homo sapien
tactggaaaaactgtgtccagatgt

SEQ ID NO: 90735 - DNA, 25 bp, Homo sapien
tactggaaaaattgtgtccagatgt

SEQ ID NO: 90736 - DNA, 25 bp, Homo sapien
tactggaacaaattagcacataaac

SEQ ID NO: 90737 - DNA, 25 bp, Homo sapien
tactggaataaattagcacataaac

SEQ ID NO: 90738 - DNA, 25 bp, Homo sapien
tactggaataaggacacagggaata

SEQ ID NO: 90739 - DNA, 25 bp, Homo sapien
tactggaatgaggacacagggaata

SEQ ID NO: 90740 - DNA, 25 bp, Homo sapien
tactggaattcacacgcttactgaa

SEQ ID NO: 90741 - DNA, 25 bp, Homo sapien
tactggaattcacatgcttactgaa

SEQ ID NO: 90742 - DNA, 25 bp, Homo sapien
tactggacataaacaacctcacaga

SEQ ID NO: 90743 - DNA, 25 bp, Homo sapien
tactggacataaacaatctcacaga

SEQ ID NO: 90744 - DNA, 25 bp, Homo sapien
tactggatcataaaggccaacttcc

SEQ ID NO: 90745 - DNA, 25 bp, Homo sapien
tactggattagagtaggccttaagt

SEQ ID NO: 90746 - DNA, 25 bp, Homo sapien
tactggattagcgtaggccttaagt

SEQ ID NO: 90747 - DNA, 25 bp, Homo sapien
tactggattataaaggccaacttcc

SEQ ID NO: 90748 - DNA, 25 bp, Homo sapien
tactggcatccaataggtagaggcc

SEQ ID NO: 90749 - DNA, 25 bp, Homo sapien
tactggcatccgataggtagaggcc

SEQ ID NO: 90750 - DNA, 25 bp, Homo sapien
tactggcttgaaggttgatgaaaat

SEQ ID NO: 90751 - DNA, 25 bp, Homo sapien
tactggcttgaagtttgatgaaaat

SEQ ID NO: 90752 - DNA, 25 bp, Homo sapien
tactgggatttccgacattcattcc

SEQ ID NO: 90753 - DNA, 25 bp, Homo sapien
tactgggatttctgacattcattcc

SEQ ID NO: 90754 - DNA, 25 bp, Homo sapien
tactggggaatcccttacatttcag

SEQ ID NO: 90755 - DNA, 25 bp, Homo sapien
tactggggaatcctttacatttcag

SEQ ID NO: 90756 - DNA, 25 bp, Homo sapien
tactggttgcgtgttaactggtatg

SEQ ID NO: 90757 - DNA, 25 bp, Homo sapien
tactggttgtgtgttaactggtatg

SEQ ID NO: 90758 - DNA, 25 bp, Homo sapien
tactggttttcaggacagtgtccta

SEQ ID NO: 90759 - DNA, 25 bp, Homo sapien
tactggttttcgggacagtgtccta

SEQ ID NO: 90760 - DNA, 25 bp, Homo sapien
tactgtaagcaaaattccacgctca

SEQ ID NO: 90761 - DNA, 25 bp, Homo sapien
tactgtaagcagaattccacgctca

SEQ ID NO: 90762 - DNA, 25 bp, Homo sapien
tactgtagctctgaacagagagtga

SEQ ID NO: 90763 - DNA, 25 bp, Homo sapien
tactgtagctctgaacggagagtga

SEQ ID NO: 90764 - DNA, 25 bp, Homo sapien
tactgtattggacaaaactagaggg

SEQ ID NO: 90765 - DNA, 25 bp, Homo sapien
tactgtattggataaaactagaggg

SEQ ID NO: 90766 - DNA, 25 bp, Homo sapien
tactgtattttcaccgcaattttct

SEQ ID NO: 90767 - DNA, 25 bp, Homo sapien
tactgtattttcactgcaattttct

SEQ ID NO: 90768 - DNA, 25 bp, Homo sapien
tactgtcaacattatgatcaaaggt

SEQ ID NO: 90769 - DNA, 25 bp, Homo sapien
tactgtcaacattatgctcaaaggt

SEQ ID NO: 90770 - DNA, 25 bp, Homo sapien
tactgtcaagtttcttattccatgt

SEQ ID NO: 90771 - DNA, 25 bp, Homo sapien
tactgtcaagttttttattccatgt

SEQ ID NO: 90772 - DNA, 25 bp, Homo sapien
tactgtcaccaccagataacaacaa

SEQ ID NO: 90773 - DNA, 25 bp, Homo sapien
tactgtcaccactagataacaacaa

SEQ ID NO: 90774 - DNA, 25 bp, Homo sapien
tactgtccctaggcatgaagccatt

SEQ ID NO: 90775 - DNA, 25 bp, Homo sapien
tactgtccctaggcgtgaagccatt

SEQ ID NO: 90776 - DNA, 25 bp, Homo sapien
tactgtctaatgcccagaggtgaag

SEQ ID NO: 90777 - DNA, 25 bp, Homo sapien
tactgtctactgcaagaaagagaaa

SEQ ID NO: 90778 - DNA, 25 bp, Homo sapien
tactgtctactgcacgaaagagaaa

SEQ ID NO: 90779 - DNA, 25 bp, Homo sapien
tactgtctactgcccagaggtgaag

SEQ ID NO: 90780 - DNA, 25 bp, Homo sapien
tactgtgaagctccaacagtcccaa

SEQ ID NO: 90781 - DNA, 25 bp, Homo sapien
tactgtgaagctgcaacagtcccaa

SEQ ID NO: 90782 - DNA, 25 bp, Homo sapien
tactgtgcttataacgattgccagt

SEQ ID NO: 90783 - DNA, 25 bp, Homo sapien
tactgtgcttataatgattgccagt

SEQ ID NO: 90784 - DNA, 25 bp, Homo sapien
tactgtgttcaatctttggttactc

SEQ ID NO: 90785 - DNA, 25 bp, Homo sapien
tactgtgttcagtctttggttactc

SEQ ID NO: 90786 - DNA, 25 bp, Homo sapien
tactgtgtttctctctatatatatg

SEQ ID NO: 90787 - DNA, 25 bp, Homo sapien
tactgtgtttctctctctatatatg

SEQ ID NO: 90788 - DNA, 25 bp, Homo sapien
tactgtgttttgcccagagttagga

SEQ ID NO: 90789 - DNA, 25 bp, Homo sapien
tactgtgttttgcgcagagttagga

SEQ ID NO: 90790 - DNA, 25 bp, Homo sapien
tactgttaacgagcagtaatctttt

SEQ ID NO: 90791 - DNA, 25 bp, Homo sapien
tactgttaatgaatatactgcttgt

SEQ ID NO: 90792 - DNA, 25 bp, Homo sapien
tactgttaatgagcagtaatctttt

SEQ ID NO: 90793 - DNA, 25 bp, Homo sapien
tactgttaatggatatactgcttgt

SEQ ID NO: 90794 - DNA, 25 bp, Homo sapien
tactgttccattcctgttacacttg

SEQ ID NO: 90795 - DNA, 25 bp, Homo sapien
tactgttccattcttgttacacttg

SEQ ID NO: 90796 - DNA, 25 bp, Homo sapien
tactgttggccgtagcgttaagtgt

SEQ ID NO: 90797 - DNA, 25 bp, Homo sapien
tactgttggccgtagctttaagtgt

SEQ ID NO: 90798 - DNA, 25 bp, Homo sapien
tactgttgtgcaactcgtgacttca

SEQ ID NO: 90799 - DNA, 25 bp, Homo sapien
tactgttgtgcaactcttgacttca

SEQ ID NO: 90800 - DNA, 25 bp, Homo sapien
tactgtttaatagcaggttaagatg

SEQ ID NO: 90801 - DNA, 25 bp, Homo sapien
tactgtttaatagcgggttaagatg

SEQ ID NO: 90802 - DNA, 25 bp, Homo sapien
tactgtttataagacgcctacaata

SEQ ID NO: 90803 - DNA, 25 bp, Homo sapien
tactgtttataagatgcctacaata

SEQ ID NO: 90804 - DNA, 25 bp, Homo sapien
tacttaaaaacctaaaatattagat

SEQ ID NO: 90805 - DNA, 25 bp, Homo sapien
tacttaaaaacctacaatattagat

SEQ ID NO: 90806 - DNA, 25 bp, Homo sapien
tacttaacagaacaacatggattta

SEQ ID NO: 90807 - DNA, 25 bp, Homo sapien
tacttaacagagcaacatggattta

SEQ ID NO: 90808 - DNA, 25 bp, Homo sapien
tacttaacgttacgccctctcaaaa

SEQ ID NO: 90809 - DNA, 25 bp, Homo sapien
tacttaacgttatgccctctcaaaa

SEQ ID NO: 90810 - DNA, 25 bp, Homo sapien
tacttaactggaaaatgaaacactt

SEQ ID NO: 90811 - DNA, 25 bp, Homo sapien
tacttaactggaaagtgaaacactt

SEQ ID NO: 90812 - DNA, 25 bp, Homo sapien
tacttaatttgcgtttctttaattt

SEQ ID NO: 90813 - DNA, 25 bp, Homo sapien
tacttaatttgtgtttctttaattt

SEQ ID NO: 90814 - DNA, 25 bp, Homo sapien
tacttaccatgcaatacttttccaa

SEQ ID NO: 90815 - DNA, 25 bp, Homo sapien
tacttaccatgcagtacttttccaa

SEQ ID NO: 90816 - DNA, 25 bp, Homo sapien
tacttactgtaacagagcttgattt

SEQ ID NO: 90817 - DNA, 25 bp, Homo sapien
tacttactgtaatagagcttgattt

SEQ ID NO: 90818 - DNA, 25 bp, Homo sapien
tacttagacatctttgaattttcaa

SEQ ID NO: 90819 - DNA, 25 bp, Homo sapien
tacttagacatgtttgaattttcaa

SEQ ID NO: 90820 - DNA, 25 bp, Homo sapien
tacttaggcattaggactttaaaaa

SEQ ID NO: 90821 - DNA, 25 bp, Homo sapien
tacttaggcattgggactttaaaaa

SEQ ID NO: 90822 - DNA, 25 bp, Homo sapien
tacttagtccatgactttcccttgc

SEQ ID NO: 90823 - DNA, 25 bp, Homo sapien
tacttagtccatgattttcccttgc

SEQ ID NO: 90824 - DNA, 25 bp, Homo sapien
tacttagtcgatacatctcttcgtg

SEQ ID NO: 90825 - DNA, 25 bp, Homo sapien
tacttagtcgatatatctcttcgtg

SEQ ID NO: 90826 - DNA, 25 bp, Homo sapien
tacttagtgagtcaaattcgaccat

SEQ ID NO: 90827 - DNA, 25 bp, Homo sapien
tacttagtgagttaaattcgaccat

SEQ ID NO: 90828 - DNA, 25 bp, Homo sapien
tacttagttcttcgacgcagagctt

SEQ ID NO: 90829 - DNA, 25 bp, Homo sapien
tacttagttctttgacgcagagctt

SEQ ID NO: 90830 - DNA, 25 bp, Homo sapien
tacttatctcaaagggcttttgtga

SEQ ID NO: 90831 - DNA, 25 bp, Homo sapien
tacttatctcaaagggtttttgtga

SEQ ID NO: 90832 - DNA, 25 bp, Homo sapien
tacttatctcggtctgagtcagtat

SEQ ID NO: 90833 - DNA, 25 bp, Homo sapien
tacttatcttggtctgagtcagtat

SEQ ID NO: 90834 - DNA, 25 bp, Homo sapien
tacttatgcaagtaagtcagatttt

SEQ ID NO: 90835 - DNA, 25 bp, Homo sapien
tacttatgcaagtgagtcagatttt

SEQ ID NO: 90836 - DNA, 25 bp, Homo sapien
tacttatgcatagtctctttgtgaa

SEQ ID NO: 90837 - DNA, 25 bp, Homo sapien
tacttatgcatattctctttgtgaa

SEQ ID NO: 90838 - DNA, 25 bp, Homo sapien
tacttatgctaccttacttctctat

SEQ ID NO: 90839 - DNA, 25 bp, Homo sapien
tacttatgctatcttacttctctat

SEQ ID NO: 90840 - DNA, 25 bp, Homo sapien
tacttatgctcgcatttcagtctca

SEQ ID NO: 90841 - DNA, 25 bp, Homo sapien
tacttatgctctcatttcagtctca

SEQ ID NO: 90842 - DNA, 25 bp, Homo sapien
tacttattctcttaacaattttctc

SEQ ID NO: 90843 - DNA, 25 bp, Homo sapien
tacttattctcttaacgattttctc

SEQ ID NO: 90844 - DNA, 25 bp, Homo sapien
tacttatttattctcgtggatggtc

SEQ ID NO: 90845 - DNA, 25 bp, Homo sapien
tacttatttattcttgtggatggtc

SEQ ID NO: 90846 - DNA, 25 bp, Homo sapien
tacttcacaactactagggtggctg

SEQ ID NO: 90847 - DNA, 25 bp, Homo sapien
tacttcacaactgctagggtggctg

SEQ ID NO: 90848 - DNA, 25 bp, Homo sapien
tacttcagatcctcgagtgctaaca

SEQ ID NO: 90849 - DNA, 25 bp, Homo sapien
tacttcagatccttgagtgctaaca

SEQ ID NO: 90850 - DNA, 25 bp, Homo sapien
tacttcagcttccccaatcactgat

SEQ ID NO: 90851 - DNA, 25 bp, Homo sapien
tacttcagcttccccagtcactgat

SEQ ID NO: 90852 - DNA, 25 bp, Homo sapien
tacttcaggcttcacaggccatgca

SEQ ID NO: 90853 - DNA, 25 bp, Homo sapien
tacttcaggcttcgcaggccatgca

SEQ ID NO: 90854 - DNA, 25 bp, Homo sapien
tacttcatcttcgtgtttcagctta

SEQ ID NO: 90855 - DNA, 25 bp, Homo sapien
tacttcatcttcgtttttcagctta

SEQ ID NO: 90856 - DNA, 25 bp, Homo sapien
tacttcatggtctcaaatagctatt

SEQ ID NO: 90857 - DNA, 25 bp, Homo sapien
tacttcattcgaccattttaattaa

SEQ ID NO: 90858 - DNA, 25 bp, Homo sapien
tacttcattgtctcaaatagctatt

SEQ ID NO: 90859 - DNA, 25 bp, Homo sapien
tacttcatttgaccattttaattaa

SEQ ID NO: 90860 - DNA, 25 bp, Homo sapien
tacttccaagtcctatcttcttttc

SEQ ID NO: 90861 - DNA, 25 bp, Homo sapien
tacttccaagtcctgtcttcttttc

SEQ ID NO: 90862 - DNA, 25 bp, Homo sapien
tacttcctagagctgttgtaaggct

SEQ ID NO: 90863 - DNA, 25 bp, Homo sapien
tacttcctagatctgttgtaaggct

SEQ ID NO: 90864 - DNA, 25 bp, Homo sapien
tacttcctcctattctcttactccc

SEQ ID NO: 90865 - DNA, 25 bp, Homo sapien
tacttcctcttattctcttactccc

SEQ ID NO: 90866 - DNA, 25 bp, Homo sapien
tacttcctgaacgtagccctgctgt

SEQ ID NO: 90867 - DNA, 25 bp, Homo sapien
tacttcctgaatgtagccctgctgt

SEQ ID NO: 90868 - DNA, 25 bp, Homo sapien
tacttctagacagctgctttttaca

SEQ ID NO: 90869 - DNA, 25 bp, Homo sapien
tacttctagacagttgctttttaca

SEQ ID NO: 90870 - DNA, 25 bp, Homo sapien
tacttctcattaacatgcaatcatc

SEQ ID NO: 90871 - DNA, 25 bp, Homo sapien
tacttctcattaatatgcaatcatc

SEQ ID NO: 90872 - DNA, 25 bp, Homo sapien
tacttctccaacaccgtgctctcta

SEQ ID NO: 90873 - DNA, 25 bp, Homo sapien
tacttctccaacactgtgctctcta

SEQ ID NO: 90874 - DNA, 25 bp, Homo sapien
tacttctccttgtctcactgatctt

SEQ ID NO: 90875 - DNA, 25 bp, Homo sapien
tacttctccttgtctcgctgatctt

SEQ ID NO: 90876 - DNA, 25 bp, Homo sapien
tacttctctattcagtttatgattc

SEQ ID NO: 90877 - DNA, 25 bp, Homo sapien
tacttctctattcggtttatgattc

SEQ ID NO: 90878 - DNA, 25 bp, Homo sapien
tacttctgcatttactcattgaatt

SEQ ID NO: 90879 - DNA, 25 bp, Homo sapien
tacttctgcctttactcattgaatt

SEQ ID NO: 90880 - DNA, 25 bp, Homo sapien
tacttctggtttttatacaagtctt

SEQ ID NO: 90881 - DNA, 25 bp, Homo sapien
tacttctggtttttattcaagtctt

SEQ ID NO: 90882 - DNA, 25 bp, Homo sapien
tacttctgtaacaaattgccagaaa

SEQ ID NO: 90883 - DNA, 25 bp, Homo sapien
tacttctgtaaccaattgccagaaa

SEQ ID NO: 90884 - DNA, 25 bp, Homo sapien
tacttctgtcccatcccaaatcaca

SEQ ID NO: 90885 - DNA, 25 bp, Homo sapien
tacttctgtcccgtcccaaatcaca

SEQ ID NO: 90886 - DNA, 25 bp, Homo sapien
tacttcttaaaatattactatgcaa

SEQ ID NO: 90887 - DNA, 25 bp, Homo sapien
tacttcttaaagtattactatgcaa

SEQ ID NO: 90888 - DNA, 25 bp, Homo sapien
tacttcttttagttgctgagcttaa

SEQ ID NO: 90889 - DNA, 25 bp, Homo sapien
tacttcttttagtttctgagcttaa

SEQ ID NO: 90890 - DNA, 25 bp, Homo sapien
tacttgaaaccaggacctggaactt

SEQ ID NO: 90891 - DNA, 25 bp, Homo sapien
tacttgaagccaggacctggaactt

SEQ ID NO: 90892 - DNA, 25 bp, Homo sapien
tacttgacagtgtcctcaataaaat

SEQ ID NO: 90893 - DNA, 25 bp, Homo sapien
tacttgacatttgaagaaactaggc

SEQ ID NO: 90894 - DNA, 25 bp, Homo sapien
tacttgacattttaagaaactaggc

SEQ ID NO: 90895 - DNA, 25 bp, Homo sapien
tacttgacggtgtcctcaataaaat

SEQ ID NO: 90896 - DNA, 25 bp, Homo sapien
tacttgactttcaacattatacaca

SEQ ID NO: 90897 - DNA, 25 bp, Homo sapien
tacttgacttttaacattatacaca

SEQ ID NO: 90898 - DNA, 25 bp, Homo sapien
tacttgattttttcagttaccggca

SEQ ID NO: 90899 - DNA, 25 bp, Homo sapien
tacttgattttttcggttaccggca

SEQ ID NO: 90900 - DNA, 25 bp, Homo sapien
tacttgcagcggccatagcagaaac

SEQ ID NO: 90901 - DNA, 25 bp, Homo sapien
tacttgcagtggccatagcagaaac

SEQ ID NO: 90902 - DNA, 25 bp, Homo sapien
tacttgcatccaagaggtccagcca

SEQ ID NO: 90903 - DNA, 25 bp, Homo sapien
tacttgcatcctagaggtccagcca

SEQ ID NO: 90904 - DNA, 25 bp, Homo sapien
tacttgcattacacctatgggtctt

SEQ ID NO: 90905 - DNA, 25 bp, Homo sapien
tacttgcattacatctatgggtctt

SEQ ID NO: 90906 - DNA, 25 bp, Homo sapien
tacttgccgttatttacatttatgt

SEQ ID NO: 90907 - DNA, 25 bp, Homo sapien
tacttgccgttgtttacatttatgt

SEQ ID NO: 90908 - DNA, 25 bp, Homo sapien
tacttgctgcctattgaaagcaaag

SEQ ID NO: 90909 - DNA, 25 bp, Homo sapien
tacttgctgcctattggaagcaaag

SEQ ID NO: 90910 - DNA, 25 bp, Homo sapien
tacttgctgcttcttcttaatcttc

SEQ ID NO: 90911 - DNA, 25 bp, Homo sapien
tacttgcttcttcttcttaatcttc

SEQ ID NO: 90912 - DNA, 25 bp, Homo sapien
tacttgtaatagcaaaatgtccttc

SEQ ID NO: 90913 - DNA, 25 bp, Homo sapien
tacttgtaatagcgaaatgtccttc

SEQ ID NO: 90914 - DNA, 25 bp, Homo sapien
tacttgtaattgcaagtgcaaaaac

SEQ ID NO: 90915 - DNA, 25 bp, Homo sapien
tacttgtaatttcaagtgcaaaaac

SEQ ID NO: 90916 - DNA, 25 bp, Homo sapien
tacttgtatatgatggagtaggtag

SEQ ID NO: 90917 - DNA, 25 bp, Homo sapien
tacttgtatatgatggtgtaggtag

SEQ ID NO: 90918 - DNA, 25 bp, Homo sapien
tacttgtatcacataagaaagcacc

SEQ ID NO: 90919 - DNA, 25 bp, Homo sapien
tacttgtatcacgtaagaaagcacc

SEQ ID NO: 90920 - DNA, 25 bp, Homo sapien
tacttgtatttgctcggtgaagtga

SEQ ID NO: 90921 - DNA, 25 bp, Homo sapien
tacttgtatttgcttggtgaagtga

SEQ ID NO: 90922 - DNA, 25 bp, Homo sapien
tacttgtcactcaagtaatgcctat

SEQ ID NO: 90923 - DNA, 25 bp, Homo sapien
tacttgtcacttaagtaatgcctat

SEQ ID NO: 90924 - DNA, 25 bp, Homo sapien
tacttgtcatgtcacgaaaacatct

SEQ ID NO: 90925 - DNA, 25 bp, Homo sapien
tacttgtcatgtcgcgaaaacatct

SEQ ID NO: 90926 - DNA, 25 bp, Homo sapien
tacttgtcccaaaccaccagagtgc

SEQ ID NO: 90927 - DNA, 25 bp, Homo sapien
tacttgtcccaaaccagcagagtgc

SEQ ID NO: 90928 - DNA, 25 bp, Homo sapien
tacttgtgcctcgattccagaagta

SEQ ID NO: 90929 - DNA, 25 bp, Homo sapien
tacttgtgccttgattccagaagta

SEQ ID NO: 90930 - DNA, 25 bp, Homo sapien
tactttaaatacactctaggcaatt

SEQ ID NO: 90931 - DNA, 25 bp, Homo sapien
tactttaaatactctctaggcaatt

SEQ ID NO: 90932 - DNA, 25 bp, Homo sapien
tactttacctgctctttcacttatt

SEQ ID NO: 90933 - DNA, 25 bp, Homo sapien
tactttacctgttctttcacttatt

SEQ ID NO: 90934 - DNA, 25 bp, Homo sapien
tactttactctttccataatcactc

SEQ ID NO: 90935 - DNA, 25 bp, Homo sapien
tactttactcttttcataatcactc

SEQ ID NO: 90936 - DNA, 25 bp, Homo sapien
tactttagcccaaaaagaaagccat

SEQ ID NO: 90937 - DNA, 25 bp, Homo sapien
tactttagcccataaagaaagccat

SEQ ID NO: 90938 - DNA, 25 bp, Homo sapien
tactttagttcaccaaacctagaac

SEQ ID NO: 90939 - DNA, 25 bp, Homo sapien
tactttagttcatcaaacctagaac

SEQ ID NO: 90940 - DNA, 25 bp, Homo sapien
tactttcacagaactgtaactataa

SEQ ID NO: 90941 - DNA, 25 bp, Homo sapien
tactttcactggacttattttgcta

SEQ ID NO: 90942 - DNA, 25 bp, Homo sapien
tactttcactgggcttattttgcta

SEQ ID NO: 90943 - DNA, 25 bp, Homo sapien
tactttcactttgcattttttgaac

SEQ ID NO: 90944 - DNA, 25 bp, Homo sapien
tactttcatagaactgtaactataa

SEQ ID NO: 90945 - DNA, 25 bp, Homo sapien
tactttcatagaatagaacaggaca

SEQ ID NO: 90946 - DNA, 25 bp, Homo sapien
tactttcatagactagaacaggaca

SEQ ID NO: 90947 - DNA, 25 bp, Homo sapien
tactttcatctatgtcatggtcagt

SEQ ID NO: 90948 - DNA, 25 bp, Homo sapien
tactttcatttatgtcatggtcagt

SEQ ID NO: 90949 - DNA, 25 bp, Homo sapien
tactttcattttgcattttttgaac

SEQ ID NO: 90950 - DNA, 25 bp, Homo sapien
tactttccaacatcgattttgattt

SEQ ID NO: 90951 - DNA, 25 bp, Homo sapien
tactttccaacgtcgattttgattt

SEQ ID NO: 90952 - DNA, 25 bp, Homo sapien
tactttctccaaaatatacagtctc

SEQ ID NO: 90953 - DNA, 25 bp, Homo sapien
tactttctccagaatatacagtctc

SEQ ID NO: 90954 - DNA, 25 bp, Homo sapien
tactttctcccaaatgaacagtgtt

SEQ ID NO: 90955 - DNA, 25 bp, Homo sapien
tactttctcccaactgaacagtgtt

SEQ ID NO: 90956 - DNA, 25 bp, Homo sapien
tactttcttactcccttgacggtgg

SEQ ID NO: 90957 - DNA, 25 bp, Homo sapien
tactttcttactctcttgacggtgg

SEQ ID NO: 90958 - DNA, 25 bp, Homo sapien
tactttcttagcactttttgagtat

SEQ ID NO: 90959 - DNA, 25 bp, Homo sapien
tactttcttagcagtttttgagtat

SEQ ID NO: 90960 - DNA, 25 bp, Homo sapien
tactttcttcttcggtgccaattag

SEQ ID NO: 90961 - DNA, 25 bp, Homo sapien
tactttcttctttggtgccaattag

SEQ ID NO: 90962 - DNA, 25 bp, Homo sapien
tactttgaaatacagaaaatcagag

SEQ ID NO: 90963 - DNA, 25 bp, Homo sapien
tactttgaaatacggaaaatcagag

SEQ ID NO: 90964 - DNA, 25 bp, Homo sapien
tactttgacgtttctcaaacaaagg

SEQ ID NO: 90965 - DNA, 25 bp, Homo sapien
tactttgagccatacagctgtgaag

SEQ ID NO: 90966 - DNA, 25 bp, Homo sapien
tactttgaggtttctcaaacaaagg

SEQ ID NO: 90967 - DNA, 25 bp, Homo sapien
tactttgagtcatacagctgtgaag

SEQ ID NO: 90968 - DNA, 25 bp, Homo sapien
tactttgcattgtaggatcagagtc

SEQ ID NO: 90969 - DNA, 25 bp, Homo sapien
tactttgcattgtgggatcagagtc

SEQ ID NO: 90970 - DNA, 25 bp, Homo sapien
tactttgctgcaactaattttttcc

SEQ ID NO: 90971 - DNA, 25 bp, Homo sapien
tactttgctgcaattaattttttcc

SEQ ID NO: 90972 - DNA, 25 bp, Homo sapien
tactttggctgtaaatatatagcaa

SEQ ID NO: 90973 - DNA, 25 bp, Homo sapien
tactttggctgtaagtatatagcaa

SEQ ID NO: 90974 - DNA, 25 bp, Homo sapien
tactttggctttttttggtccaact

SEQ ID NO: 90975 - DNA, 25 bp, Homo sapien
tactttggcttttttttgtccaact

SEQ ID NO: 90976 - DNA, 25 bp, Homo sapien
tactttgggacactgttctttccac

SEQ ID NO: 90977 - DNA, 25 bp, Homo sapien
tactttgggacattgttctttccac

SEQ ID NO: 90978 - DNA, 25 bp, Homo sapien
tactttggtgacatttgttatgcag

SEQ ID NO: 90979 - DNA, 25 bp, Homo sapien
tactttggtgatatttgttatgcag

SEQ ID NO: 90980 - DNA, 25 bp, Homo sapien
tactttgtatttcaatcattttgat

SEQ ID NO: 90981 - DNA, 25 bp, Homo sapien
tactttgtattttaatcattttgat

SEQ ID NO: 90982 - DNA, 25 bp, Homo sapien
tactttgtgacttccatatgctaag

SEQ ID NO: 90983 - DNA, 25 bp, Homo sapien
tactttgtgtcttccatatgctaag

SEQ ID NO: 90984 - DNA, 25 bp, Homo sapien
tacttttaaaatactagtgctacaa

SEQ ID NO: 90985 - DNA, 25 bp, Homo sapien
tacttttaaaattctagtgctacaa

SEQ ID NO: 90986 - DNA, 25 bp, Homo sapien
tacttttaaacaatcaatagaatat

SEQ ID NO: 90987 - DNA, 25 bp, Homo sapien
tacttttaaacaatcagtagaatat

SEQ ID NO: 90988 - DNA, 25 bp, Homo sapien
tacttttaattggcaacaagaaaaa

SEQ ID NO: 90989 - DNA, 25 bp, Homo sapien
tacttttaatttgcaacaagaaaaa

SEQ ID NO: 90990 - DNA, 25 bp, Homo sapien
tacttttagcgatggcaacttggat

SEQ ID NO: 90991 - DNA, 25 bp, Homo sapien
tacttttagtgatggcaacttggat

SEQ ID NO: 90992 - DNA, 25 bp, Homo sapien
tacttttatacatgaaatgggtcct

SEQ ID NO: 90993 - DNA, 25 bp, Homo sapien
tacttttatacgtgaaatgggtcct

SEQ ID NO: 90994 - DNA, 25 bp, Homo sapien
tacttttatgtaattctctgttttt

SEQ ID NO: 90995 - DNA, 25 bp, Homo sapien
tacttttatttaattctctgttttt

SEQ ID NO: 90996 - DNA, 25 bp, Homo sapien
tacttttcaaaagcctacattatat

SEQ ID NO: 90997 - DNA, 25 bp, Homo sapien
tacttttcaaaagcttacattatat

SEQ ID NO: 90998 - DNA, 25 bp, Homo sapien
tacttttcctgaacaaacacctctg

SEQ ID NO: 90999 - DNA, 25 bp, Homo sapien
tacttttcctgagcaaacacctctg

SEQ ID NO: 91000 - DNA, 25 bp, Homo sapien
tacttttcctgtacatctctgctta

SEQ ID NO: 91001 - DNA, 25 bp, Homo sapien
tacttttcttgtacatctctgctta

SEQ ID NO: 91002 - DNA, 25 bp, Homo sapien
tactttttagcagttaagtccactc

SEQ ID NO: 91003 - DNA, 25 bp, Homo sapien
tactttttataaatgttgaacacga

SEQ ID NO: 91004 - DNA, 25 bp, Homo sapien
tactttttataaattttgaacacga

SEQ ID NO: 91005 - DNA, 25 bp, Homo sapien
tactttttcagctctgaagtttcat

SEQ ID NO: 91006 - DNA, 25 bp, Homo sapien
tactttttcagttctgaagtttcat

SEQ ID NO: 91007 - DNA, 25 bp, Homo sapien
tactttttcgcagttaagtccactc

SEQ ID NO: 91008 - DNA, 25 bp, Homo sapien
tagaaaaaactgaattgccattatt

SEQ ID NO: 91009 - DNA, 25 bp, Homo sapien
tagaaaaaatcgacatatttgacta

SEQ ID NO: 91010 - DNA, 25 bp, Homo sapien
tagaaaaaatcggcatatttgacta

SEQ ID NO: 91011 - DNA, 25 bp, Homo sapien
tagaaaaaattgaattgccattatt

SEQ ID NO: 91012 - DNA, 25 bp, Homo sapien
tagaaaaaccctgcatctatgagct

SEQ ID NO: 91013 - DNA, 25 bp, Homo sapien
tagaaaaaccctgcgtctatgagct

SEQ ID NO: 91014 - DNA, 25 bp, Homo sapien
tagaaaaatatacggttggaaggaa

SEQ ID NO: 91015 - DNA, 25 bp, Homo sapien
tagaaaaatatatggttggaaggaa

SEQ ID NO: 91016 - DNA, 25 bp, Homo sapien
tagaaaaccagtagtaggcaaaacc

SEQ ID NO: 91017 - DNA, 25 bp, Homo sapien
tagaaaaccggtagtaggcaaaacc

SEQ ID NO: 91018 - DNA, 25 bp, Homo sapien
tagaaaacgaggtccattgtggcca

SEQ ID NO: 91019 - DNA, 25 bp, Homo sapien
tagaaaacgaggtctattgtggcca

SEQ ID NO: 91020 - DNA, 25 bp, Homo sapien
tagaaaactgtacactttccacatt

SEQ ID NO: 91021 - DNA, 25 bp, Homo sapien
tagaaaactgtacgctttccacatt

SEQ ID NO: 91022 - DNA, 25 bp, Homo sapien
tagaaaagccaatcctttaagtgga

SEQ ID NO: 91023 - DNA, 25 bp, Homo sapien
tagaaaaggatttgtgatctgtgca

SEQ ID NO: 91024 - DNA, 25 bp, Homo sapien
tagaaaaggctttgtgatctgtgca

SEQ ID NO: 91025 - DNA, 25 bp, Homo sapien
tagaaaagtaacagttgtcccaagt

SEQ ID NO: 91026 - DNA, 25 bp, Homo sapien
tagaaaagtcaatcctttaagtgga

SEQ ID NO: 91027 - DNA, 25 bp, Homo sapien
tagaaaagttacagttgtcccaagt

SEQ ID NO: 91028 - DNA, 25 bp, Homo sapien
tagaaaatgtcatcccacatttctc

SEQ ID NO: 91029 - DNA, 25 bp, Homo sapien
tagaaaatgtcatctcacatttctc

SEQ ID NO: 91030 - DNA, 25 bp, Homo sapien
tagaaaatgtgcagtaaaaatatgg

SEQ ID NO: 91031 - DNA, 25 bp, Homo sapien
tagaaaatgtgcattaaaaatatgg

SEQ ID NO: 91032 - DNA, 25 bp, Homo sapien
tagaaaattttgcccaaatgttatc

SEQ ID NO: 91033 - DNA, 25 bp, Homo sapien
tagaaaattttgcccagatgttatc

SEQ ID NO: 91034 - DNA, 25 bp, Homo sapien
tagaaacaaagtgcgaagttcagaa

SEQ ID NO: 91035 - DNA, 25 bp, Homo sapien
tagaaacaaagtgtgaagttcagaa

SEQ ID NO: 91036 - DNA, 25 bp, Homo sapien
tagaaacagatatagtcaaatgttt

SEQ ID NO: 91037 - DNA, 25 bp, Homo sapien
tagaaacagatatattcaaatgttt

SEQ ID NO: 91038 - DNA, 25 bp, Homo sapien
tagaaaccagtttagagaactgcat

SEQ ID NO: 91039 - DNA, 25 bp, Homo sapien
tagaaaccggtttagagaactgcat

SEQ ID NO: 91040 - DNA, 25 bp, Homo sapien
tagaaacgaactaataactaagtga

SEQ ID NO: 91041 - DNA, 25 bp, Homo sapien
tagaaacgacctaataactaagtga

SEQ ID NO: 91042 - DNA, 25 bp, Homo sapien
tagaaacttacacccattgattagt

SEQ ID NO: 91043 - DNA, 25 bp, Homo sapien
tagaaacttacgcccattgattagt

SEQ ID NO: 91044 - DNA, 25 bp, Homo sapien
tagaaagaacaataatgacctcatt

SEQ ID NO: 91045 - DNA, 25 bp, Homo sapien
tagaaagaagaaattgaagatgttg

SEQ ID NO: 91046 - DNA, 25 bp, Homo sapien
tagaaagaagagattgaagatgttg

SEQ ID NO: 91047 - DNA, 25 bp, Homo sapien
tagaaagaataataatgacctcatt

SEQ ID NO: 91048 - DNA, 25 bp, Homo sapien
tagaaagaattaggtaatgtggcca

SEQ ID NO: 91049 - DNA, 25 bp, Homo sapien
tagaaagaattagttaatgtggcca

SEQ ID NO: 91050 - DNA, 25 bp, Homo sapien
tagaaagagcaactgaatatgttgg

SEQ ID NO: 91051 - DNA, 25 bp, Homo sapien
tagaaagagcaattgaatatgttgg

SEQ ID NO: 91052 - DNA, 25 bp, Homo sapien
tagaaagagcatgtcaggaaaatga

SEQ ID NO: 91053 - DNA, 25 bp, Homo sapien
tagaaagagcatgttaggaaaatga

SEQ ID NO: 91054 - DNA, 25 bp, Homo sapien
tagaaagatcaccatgcatgcactg

SEQ ID NO: 91055 - DNA, 25 bp, Homo sapien
tagaaagatcatcatgcatgcactg

SEQ ID NO: 91056 - DNA, 25 bp, Homo sapien
tagaaagcctcagcaaagaaataga

SEQ ID NO: 91057 - DNA, 25 bp, Homo sapien
tagaaagcctcatcaaagaaataga

SEQ ID NO: 91058 - DNA, 25 bp, Homo sapien
tagaaaggagtgatgtgatctgatt

SEQ ID NO: 91059 - DNA, 25 bp, Homo sapien
tagaaaggatatatgaatgcaacaa

SEQ ID NO: 91060 - DNA, 25 bp, Homo sapien
tagaaagggtatatgaatgcaacaa

SEQ ID NO: 91061 - DNA, 25 bp, Homo sapien
tagaaaggtgtgatgtgatctgatt

SEQ ID NO: 91062 - DNA, 25 bp, Homo sapien
tagaaatacctgcacgtcatttcta

SEQ ID NO: 91063 - DNA, 25 bp, Homo sapien
tagaaatacctgcccgtcatttcta

SEQ ID NO: 91064 - DNA, 25 bp, Homo sapien
tagaaatgaatagagagtgcgttga

SEQ ID NO: 91065 - DNA, 25 bp, Homo sapien
tagaaatgaatagatagtgcgttga

SEQ ID NO: 91066 - DNA, 25 bp, Homo sapien
tagaaatgcctgacgaaggagttcc

SEQ ID NO: 91067 - DNA, 25 bp, Homo sapien
tagaaatgcctgatgaaggagttcc

SEQ ID NO: 91068 - DNA, 25 bp, Homo sapien
tagaaatgtaccaggtaatcatcaa

SEQ ID NO: 91069 - DNA, 25 bp, Homo sapien
tagaaatgtacgaggtaatcatcaa

SEQ ID NO: 91070 - DNA, 25 bp, Homo sapien
tagaaattaactctccttgcttatc

SEQ ID NO: 91071 - DNA, 25 bp, Homo sapien
tagaaattaactcttcttgcttatc

SEQ ID NO: 91072 - DNA, 25 bp, Homo sapien
tagaaattagatcttacggatttat

SEQ ID NO: 91073 - DNA, 25 bp, Homo sapien
tagaaattagatcttatggatttat

SEQ ID NO: 91074 - DNA, 25 bp, Homo sapien
tagaaattgggatcatcaaaggaga

SEQ ID NO: 91075 - DNA, 25 bp, Homo sapien
tagaaattgggatcattaaaggaga

SEQ ID NO: 91076 - DNA, 25 bp, Homo sapien
tagaaatttcagaaagagaaccaca

SEQ ID NO: 91077 - DNA, 25 bp, Homo sapien
tagaaatttcagaaggagaaccaca

SEQ ID NO: 91078 - DNA, 25 bp, Homo sapien
tagaacaaacagggacaggttggga

SEQ ID NO: 91079 - DNA, 25 bp, Homo sapien
tagaacaaatgcagcgaaatgttaa

SEQ ID NO: 91080 - DNA, 25 bp, Homo sapien
tagaacaaatgcagtgaaatgttaa

SEQ ID NO: 91081 - DNA, 25 bp, Homo sapien
tagaacaagcagggacaggttggga

SEQ ID NO: 91082 - DNA, 25 bp, Homo sapien
tagaacaatgtggagaattttttag

SEQ ID NO: 91083 - DNA, 25 bp, Homo sapien
tagaacaatgtggagatttttttag

SEQ ID NO: 91084 - DNA, 25 bp, Homo sapien
tagaacccaaccatttctaccatcg

SEQ ID NO: 91085 - DNA, 25 bp, Homo sapien
tagaacccagccatttctaccatcg

SEQ ID NO: 91086 - DNA, 25 bp, Homo sapien
tagaacctataatcaacttttaatc

SEQ ID NO: 91087 - DNA, 25 bp, Homo sapien
tagaacctatagtcaacttttaatc

SEQ ID NO: 91088 - DNA, 25 bp, Homo sapien
tagaacctccagatgtcttctgaga

SEQ ID NO: 91089 - DNA, 25 bp, Homo sapien
tagaacctgcagatgtcttctgaga

SEQ ID NO: 91090 - DNA, 25 bp, Homo sapien
tagaacgtcacttgatccttggatc

SEQ ID NO: 91091 - DNA, 25 bp, Homo sapien
tagaacgttacttgatccttggatc

SEQ ID NO: 91092 - DNA, 25 bp, Homo sapien
tagaactcacaggactcaaaaaagc

SEQ ID NO: 91093 - DNA, 25 bp, Homo sapien
tagaactcacagggctcaaaaaagc

SEQ ID NO: 91094 - DNA, 25 bp, Homo sapien
tagaactgcattaaattatttcatc

SEQ ID NO: 91095 - DNA, 25 bp, Homo sapien
tagaactgcgttaaattatttcatc

SEQ ID NO: 91096 - DNA, 25 bp, Homo sapien
tagaacttcaacttttgaatctgta

SEQ ID NO: 91097 - DNA, 25 bp, Homo sapien
tagaacttcaatttttgaatctgta

SEQ ID NO: 91098 - DNA, 25 bp, Homo sapien
tagaacttgaaaacgggccttgtgt

SEQ ID NO: 91099 - DNA, 25 bp, Homo sapien
tagaacttgaaaatgggccttgtgt

SEQ ID NO: 91100 - DNA, 25 bp, Homo sapien
tagaactttcattcagtgatatgta

SEQ ID NO: 91101 - DNA, 25 bp, Homo sapien
tagaactttcattgagtgatatgta

SEQ ID NO: 91102 - DNA, 25 bp, Homo sapien
tagaacttttgcataaattcactgc

SEQ ID NO: 91103 - DNA, 25 bp, Homo sapien
tagaacttttgtataaattcactgc

SEQ ID NO: 91104 - DNA, 25 bp, Homo sapien
tagaagaaactttatcacagtttta

SEQ ID NO: 91105 - DNA, 25 bp, Homo sapien
tagaagaacctttatcacagtttta

SEQ ID NO: 91106 - DNA, 25 bp, Homo sapien
tagaagaatatcatcttgaagagta

SEQ ID NO: 91107 - DNA, 25 bp, Homo sapien
tagaagaatatcgtcttgaagagta

SEQ ID NO: 91108 - DNA, 25 bp, Homo sapien
tagaagaattaaagatatacatttt

SEQ ID NO: 91109 - DNA, 25 bp, Homo sapien
tagaagaattaaagatgtacatttt

SEQ ID NO: 91110 - DNA, 25 bp, Homo sapien
tagaagacaatttaggagcctttct

SEQ ID NO: 91111 - DNA, 25 bp, Homo sapien
tagaagacaggaatgctgctatata

SEQ ID NO: 91112 - DNA, 25 bp, Homo sapien
tagaagacagggatgctgctatata

SEQ ID NO: 91113 - DNA, 25 bp, Homo sapien
tagaagacgatttaggagcctttct

SEQ ID NO: 91114 - DNA, 25 bp, Homo sapien
tagaagactgacattgcattaccac

SEQ ID NO: 91115 - DNA, 25 bp, Homo sapien
tagaagactgatattgcattaccac

SEQ ID NO: 91116 - DNA, 25 bp, Homo sapien
tagaagagaaaagtctgcctttgac

SEQ ID NO: 91117 - DNA, 25 bp, Homo sapien
tagaagagaaatgtctgcctttgac

SEQ ID NO: 91118 - DNA, 25 bp, Homo sapien
tagaagagaccatatatgatttaat

SEQ ID NO: 91119 - DNA, 25 bp, Homo sapien
tagaagagatgtcacatgttgcatt

SEQ ID NO: 91120 - DNA, 25 bp, Homo sapien
tagaagagatgttacatgttgcatt

SEQ ID NO: 91121 - DNA, 25 bp, Homo sapien
tagaagaggaaaagaatgtaagtgg

SEQ ID NO: 91122 - DNA, 25 bp, Homo sapien
tagaagaggagattctgacacagac

SEQ ID NO: 91123 - DNA, 25 bp, Homo sapien
tagaagaggagtttctgacacagac

SEQ ID NO: 91124 - DNA, 25 bp, Homo sapien
tagaagaggccatatatgatttaat

SEQ ID NO: 91125 - DNA, 25 bp, Homo sapien
tagaagaggtaaagaatgtaagtgg

SEQ ID NO: 91126 - DNA, 25 bp, Homo sapien
tagaagataaccgctatgacacact

SEQ ID NO: 91127 - DNA, 25 bp, Homo sapien
tagaagataactagcagtgttcctg

SEQ ID NO: 91128 - DNA, 25 bp, Homo sapien
tagaagataactgctatgacacact

SEQ ID NO: 91129 - DNA, 25 bp, Homo sapien
tagaagataactggcagtgttcctg

SEQ ID NO: 91130 - DNA, 25 bp, Homo sapien
tagaagatctaaatgaagaaaatga

SEQ ID NO: 91131 - DNA, 25 bp, Homo sapien
tagaagatctaaatgaggaaaatga

SEQ ID NO: 91132 - DNA, 25 bp, Homo sapien
tagaagcagtcaaaagtccattgat

SEQ ID NO: 91133 - DNA, 25 bp, Homo sapien
tagaagcagtcaaatgtccattgat

SEQ ID NO: 91134 - DNA, 25 bp, Homo sapien
tagaagcatttctacattaaacatg

SEQ ID NO: 91135 - DNA, 25 bp, Homo sapien
tagaagcatttctgcattaaacatg

SEQ ID NO: 91136 - DNA, 25 bp, Homo sapien
tagaagccacaagtttaaagaaaaa

SEQ ID NO: 91137 - DNA, 25 bp, Homo sapien
tagaagccatattcaaattcagcca

SEQ ID NO: 91138 - DNA, 25 bp, Homo sapien
tagaagccatattccaattcagcca

SEQ ID NO: 91139 - DNA, 25 bp, Homo sapien
tagaagccgcaagtttaaagaaaaa

SEQ ID NO: 91140 - DNA, 25 bp, Homo sapien
tagaagcctcattggagatttcttg

SEQ ID NO: 91141 - DNA, 25 bp, Homo sapien
tagaagccttattggagatttcttg

SEQ ID NO: 91142 - DNA, 25 bp, Homo sapien
tagaagctgcagaaaacacatagcc

SEQ ID NO: 91143 - DNA, 25 bp, Homo sapien
tagaagctgcagcaaacacatagcc

SEQ ID NO: 91144 - DNA, 25 bp, Homo sapien
tagaagctgtggaaagaaaaagagg

SEQ ID NO: 91145 - DNA, 25 bp, Homo sapien
tagaagctgtgggaagaaaaagagg

SEQ ID NO: 91146 - DNA, 25 bp, Homo sapien
tagaagctgtgtgctaaacctaaca

SEQ ID NO: 91147 - DNA, 25 bp, Homo sapien
tagaagctgtgtgttaaacctaaca

SEQ ID NO: 91148 - DNA, 25 bp, Homo sapien
tagaaggaaaattccgcactggtgc

SEQ ID NO: 91149 - DNA, 25 bp, Homo sapien
tagaaggaaaattctgcactggtgc

SEQ ID NO: 91150 - DNA, 25 bp, Homo sapien
tagaaggaaagaacaactctaccaa

SEQ ID NO: 91151 - DNA, 25 bp, Homo sapien
tagaaggaaagaacaattctaccaa

SEQ ID NO: 91152 - DNA, 25 bp, Homo sapien
tagaaggacgatactgaacggtcac

SEQ ID NO: 91153 - DNA, 25 bp, Homo sapien
tagaaggatgatactgaacggtcac

SEQ ID NO: 91154 - DNA, 25 bp, Homo sapien
tagaagggttaatgttttgtattat

SEQ ID NO: 91155 - DNA, 25 bp, Homo sapien
tagaagggttattgttttgtattat

SEQ ID NO: 91156 - DNA, 25 bp, Homo sapien
tagaaggtacgtggattagaaagga

SEQ ID NO: 91157 - DNA, 25 bp, Homo sapien
tagaaggtatgtggattagaaagga

SEQ ID NO: 91158 - DNA, 25 bp, Homo sapien
tagaaggttaaattataggtcaaga

SEQ ID NO: 91159 - DNA, 25 bp, Homo sapien
tagaaggttaaattgtaggtcaaga

SEQ ID NO: 91160 - DNA, 25 bp, Homo sapien
tagaagtataacttgaaagaggcag

SEQ ID NO: 91161 - DNA, 25 bp, Homo sapien
tagaagtatctgaattttattctgt

SEQ ID NO: 91162 - DNA, 25 bp, Homo sapien
tagaagtattacttgaaagaggcag

SEQ ID NO: 91163 - DNA, 25 bp, Homo sapien
tagaagtatttgaattttattctgt

SEQ ID NO: 91164 - DNA, 25 bp, Homo sapien
tagaagtcacaacatatccagttcg

SEQ ID NO: 91165 - DNA, 25 bp, Homo sapien
tagaagtcgcaacatatccagttcg

SEQ ID NO: 91166 - DNA, 25 bp, Homo sapien
tagaagtgaagcgtaaaatctaatc

SEQ ID NO: 91167 - DNA, 25 bp, Homo sapien
tagaagtgaagtgtaaaatctaatc

SEQ ID NO: 91168 - DNA, 25 bp, Homo sapien
tagaagtgcgtttaatgtagaggtg

SEQ ID NO: 91169 - DNA, 25 bp, Homo sapien
tagaagtgcgtttaatttagaggtg

SEQ ID NO: 91170 - DNA, 25 bp, Homo sapien
tagaagttaaagctgaagctatttg

SEQ ID NO: 91171 - DNA, 25 bp, Homo sapien
tagaagttaaagctgaggctatttg

SEQ ID NO: 91172 - DNA, 25 bp, Homo sapien
tagaagttgccatatccatttctgt

SEQ ID NO: 91173 - DNA, 25 bp, Homo sapien
tagaagttgccatatctatttctgt

SEQ ID NO: 91174 - DNA, 25 bp, Homo sapien
tagaagtttacatttcatattggac

SEQ ID NO: 91175 - DNA, 25 bp, Homo sapien
tagaagtttacttttcatattggac

SEQ ID NO: 91176 - DNA, 25 bp, Homo sapien
tagaatacctcatgagattgaaaaa

SEQ ID NO: 91177 - DNA, 25 bp, Homo sapien
tagaatacttcatgagattgaaaaa

SEQ ID NO: 91178 - DNA, 25 bp, Homo sapien
tagaatagcaataaaacctacttct

SEQ ID NO: 91179 - DNA, 25 bp, Homo sapien
tagaatagcaattaaacctacttct

SEQ ID NO: 91180 - DNA, 25 bp, Homo sapien
tagaatatagccaaacatgacaagt

SEQ ID NO: 91181 - DNA, 25 bp, Homo sapien
tagaatatggccaaacatgacaagt

SEQ ID NO: 91182 - DNA, 25 bp, Homo sapien
tagaatcacagcaaccttaggtgac

SEQ ID NO: 91183 - DNA, 25 bp, Homo sapien
tagaatcatagcaaccttaggtgac

SEQ ID NO: 91184 - DNA, 25 bp, Homo sapien
tagaatccacagtttacaacgcctt

SEQ ID NO: 91185 - DNA, 25 bp, Homo sapien
tagaatccatagtttacaacgcctt

SEQ ID NO: 91186 - DNA, 25 bp, Homo sapien
tagaatgagtgattaaaaccaggaa

SEQ ID NO: 91187 - DNA, 25 bp, Homo sapien
tagaatgagtggttaaaaccaggaa

SEQ ID NO: 91188 - DNA, 25 bp, Homo sapien
tagaatgatagaaaaggaaagagta

SEQ ID NO: 91189 - DNA, 25 bp, Homo sapien
tagaatgatagaaaagtaaagagta

SEQ ID NO: 91190 - DNA, 25 bp, Homo sapien
tagaatgccttcctttgtacttcag

SEQ ID NO: 91191 - DNA, 25 bp, Homo sapien
tagaatgccttcttttgtacttcag

SEQ ID NO: 91192 - DNA, 25 bp, Homo sapien
tagaattactacaatctataacgtc

SEQ ID NO: 91193 - DNA, 25 bp, Homo sapien
tagaattactataatctataacgtc

SEQ ID NO: 91194 - DNA, 25 bp, Homo sapien
tagaattaggtcacaaatggatatc

SEQ ID NO: 91195 - DNA, 25 bp, Homo sapien
tagaattaggttacaaatggatatc

SEQ ID NO: 91196 - DNA, 25 bp, Homo sapien
tagaattatgcagattgatttagct

SEQ ID NO: 91197 - DNA, 25 bp, Homo sapien
tagaattatgctcatattacaggtg

SEQ ID NO: 91198 - DNA, 25 bp, Homo sapien
tagaattatgctgatattacaggtg

SEQ ID NO: 91199 - DNA, 25 bp, Homo sapien
tagaattattcagattgatttagct

SEQ ID NO: 91200 - DNA, 25 bp, Homo sapien
tagaattattgcaactatcttttaa

SEQ ID NO: 91201 - DNA, 25 bp, Homo sapien
tagaattattgcaattatcttttaa

SEQ ID NO: 91202 - DNA, 25 bp, Homo sapien
tagaattcactaatcgagttgggct

SEQ ID NO: 91203 - DNA, 25 bp, Homo sapien
tagaattcactaattgagttgggct

SEQ ID NO: 91204 - DNA, 25 bp, Homo sapien
tagaattcaggaactcagttgaagt

SEQ ID NO: 91205 - DNA, 25 bp, Homo sapien
tagaattcaggtactcagttgaagt

SEQ ID NO: 91206 - DNA, 25 bp, Homo sapien
tagaattcatttggctccctggctc

SEQ ID NO: 91207 - DNA, 25 bp, Homo sapien
tagaattccttgttaggcaaaaacc

SEQ ID NO: 91208 - DNA, 25 bp, Homo sapien
tagaattccttgttagtcaaaaacc

SEQ ID NO: 91209 - DNA, 25 bp, Homo sapien
tagaattcgccatagcatggtctat

SEQ ID NO: 91210 - DNA, 25 bp, Homo sapien
tagaattcgccgtagcatggtctat

SEQ ID NO: 91211 - DNA, 25 bp, Homo sapien
tagaattcgtttggctccctggctc

SEQ ID NO: 91212 - DNA, 25 bp, Homo sapien
tagaattctgactcgctgatttatc

SEQ ID NO: 91213 - DNA, 25 bp, Homo sapien
tagaattctgacttgctgatttatc

SEQ ID NO: 91214 - DNA, 25 bp, Homo sapien
tagaattttgaagacacacaggcat

SEQ ID NO: 91215 - DNA, 25 bp, Homo sapien
tagaattttgaagagacacaggcat

SEQ ID NO: 91216 - DNA, 25 bp, Homo sapien
tagacaaccttcctacagctaacct

SEQ ID NO: 91217 - DNA, 25 bp, Homo sapien
tagacaaccttcttacagctaacct

SEQ ID NO: 91218 - DNA, 25 bp, Homo sapien
tagacaataacaaaatcaaggcaaa

SEQ ID NO: 91219 - DNA, 25 bp, Homo sapien
tagacaataacagaatcaaggcaaa

SEQ ID NO: 91220 - DNA, 25 bp, Homo sapien
tagacaataatacgacttgattagt

SEQ ID NO: 91221 - DNA, 25 bp, Homo sapien
tagacaataatacggcttgattagt

SEQ ID NO: 91222 - DNA, 25 bp, Homo sapien
tagacaataggagacttttttacat

SEQ ID NO: 91223 - DNA, 25 bp, Homo sapien
tagacaataggatacttttttacat

SEQ ID NO: 91224 - DNA, 25 bp, Homo sapien
tagacagaattgtatcctctctgca

SEQ ID NO: 91225 - DNA, 25 bp, Homo sapien
tagacagaattgtgtcctctctgca

SEQ ID NO: 91226 - DNA, 25 bp, Homo sapien
tagacagaccattccgcgtcagttg

SEQ ID NO: 91227 - DNA, 25 bp, Homo sapien
tagacagaccattccgtgtcagttg

SEQ ID NO: 91228 - DNA, 25 bp, Homo sapien
tagacagctagaggatcgaaggcca

SEQ ID NO: 91229 - DNA, 25 bp, Homo sapien
tagacagctagaggattgaaggcca

SEQ ID NO: 91230 - DNA, 25 bp, Homo sapien
tagacagctcatagaaacagaagac

SEQ ID NO: 91231 - DNA, 25 bp, Homo sapien
tagacagctcatagaagcagaagac

SEQ ID NO: 91232 - DNA, 25 bp, Homo sapien
tagacatacatacaaaaggttaatg

SEQ ID NO: 91233 - DNA, 25 bp, Homo sapien
tagacatacatacagaaggttaatg

SEQ ID NO: 91234 - DNA, 25 bp, Homo sapien
tagacatactgttcggatctgccaa

SEQ ID NO: 91235 - DNA, 25 bp, Homo sapien
tagacatactgtttggatctgccaa

SEQ ID NO: 91236 - DNA, 25 bp, Homo sapien
tagacatcctggcagctaagtcagc

SEQ ID NO: 91237 - DNA, 25 bp, Homo sapien
tagacatcttggcagctaagtcagc

SEQ ID NO: 91238 - DNA, 25 bp, Homo sapien
tagacatgattaagagcatcttgat

SEQ ID NO: 91239 - DNA, 25 bp, Homo sapien
tagacatggttaagagcatcttgat

SEQ ID NO: 91240 - DNA, 25 bp, Homo sapien
tagacattatagatcacaggcatgt

SEQ ID NO: 91241 - DNA, 25 bp, Homo sapien
tagacattatagatgacaggcatgt

SEQ ID NO: 91242 - DNA, 25 bp, Homo sapien
tagacatttcaatagttgcccagct

SEQ ID NO: 91243 - DNA, 25 bp, Homo sapien
tagacatttcagtagttgcccagct

SEQ ID NO: 91244 - DNA, 25 bp, Homo sapien
tagaccactctgaccttgcccagga

SEQ ID NO: 91245 - DNA, 25 bp, Homo sapien
tagaccactttgaccttgcccagga

SEQ ID NO: 91246 - DNA, 25 bp, Homo sapien
tagaccagatttcacggcaatccct

SEQ ID NO: 91247 - DNA, 25 bp, Homo sapien
tagaccagatttcatggcaatccct

SEQ ID NO: 91248 - DNA, 25 bp, Homo sapien
tagaccagccttaaaagagatcctt

SEQ ID NO: 91249 - DNA, 25 bp, Homo sapien
tagaccagccttaacagagatcctt

SEQ ID NO: 91250 - DNA, 25 bp, Homo sapien
tagaccattgaaagatccctgtctc

SEQ ID NO: 91251 - DNA, 25 bp, Homo sapien
tagaccatttaaagatccctgtctc

SEQ ID NO: 91252 - DNA, 25 bp, Homo sapien
tagacccaaaggccatagttataaa

SEQ ID NO: 91253 - DNA, 25 bp, Homo sapien
tagacccaaaggccgtagttataaa

SEQ ID NO: 91254 - DNA, 25 bp, Homo sapien
tagaccccaggtcatcagctgcact

SEQ ID NO: 91255 - DNA, 25 bp, Homo sapien
tagaccccaggtgatcagctgcact

SEQ ID NO: 91256 - DNA, 25 bp, Homo sapien
tagaccctgaataccgaaaaggctc

SEQ ID NO: 91257 - DNA, 25 bp, Homo sapien
tagaccctgaatactgaaaaggctc

SEQ ID NO: 91258 - DNA, 25 bp, Homo sapien
tagacctcagaaaaaaatgttccct

SEQ ID NO: 91259 - DNA, 25 bp, Homo sapien
tagacctcagaaaaaattgttccct

SEQ ID NO: 91260 - DNA, 25 bp, Homo sapien
tagacctcatcacttttccccaaca

SEQ ID NO: 91261 - DNA, 25 bp, Homo sapien
tagacctcatcagttttccccaaca

SEQ ID NO: 91262 - DNA, 25 bp, Homo sapien
tagacctgcacatatagaatcaatt

SEQ ID NO: 91263 - DNA, 25 bp, Homo sapien
tagacctgcacgtatagaatcaatt

SEQ ID NO: 91264 - DNA, 25 bp, Homo sapien
tagacctgcgttcatgggcaactgt

SEQ ID NO: 91265 - DNA, 25 bp, Homo sapien
tagacctgcgttcgtgggcaactgt

SEQ ID NO: 91266 - DNA, 25 bp, Homo sapien
tagacctgtagaggagacatttccc

SEQ ID NO: 91267 - DNA, 25 bp, Homo sapien
tagacctgtagaggaggcatttccc

SEQ ID NO: 91268 - DNA, 25 bp, Homo sapien
tagacgcagaaaagacttgataaaa

SEQ ID NO: 91269 - DNA, 25 bp, Homo sapien
tagacgcagaaaagtcttgataaaa

SEQ ID NO: 91270 - DNA, 25 bp, Homo sapien
tagactaatggataaaataaggcag

SEQ ID NO: 91271 - DNA, 25 bp, Homo sapien
tagactaatggatacaataaggcag

SEQ ID NO: 91272 - DNA, 25 bp, Homo sapien
tagactcaatgaagattcagagggc

SEQ ID NO: 91273 - DNA, 25 bp, Homo sapien
tagactcaatgaaggttcagagggc

SEQ ID NO: 91274 - DNA, 25 bp, Homo sapien
tagactcaccatacaaggagaagtt

SEQ ID NO: 91275 - DNA, 25 bp, Homo sapien
tagactcaccatacgaggagaagtt

SEQ ID NO: 91276 - DNA, 25 bp, Homo sapien
tagactcacctgacacataaagact

SEQ ID NO: 91277 - DNA, 25 bp, Homo sapien
tagactcagaaatgtctccgcaatc

SEQ ID NO: 91278 - DNA, 25 bp, Homo sapien
tagactcagaattgtctccgcaatc

SEQ ID NO: 91279 - DNA, 25 bp, Homo sapien
tagactcataagcccaggtttgaac

SEQ ID NO: 91280 - DNA, 25 bp, Homo sapien
tagactcataagcctaggtttgaac

SEQ ID NO: 91281 - DNA, 25 bp, Homo sapien
tagactcatctgacacataaagact

SEQ ID NO: 91282 - DNA, 25 bp, Homo sapien
tagactcgctttgctaacattttgt

SEQ ID NO: 91283 - DNA, 25 bp, Homo sapien
tagactcgttttgctaacattttgt

SEQ ID NO: 91284 - DNA, 25 bp, Homo sapien
tagactctgatgcatacggaattgt

SEQ ID NO: 91285 - DNA, 25 bp, Homo sapien
tagactctgatgcatatggaattgt

SEQ ID NO: 91286 - DNA, 25 bp, Homo sapien
tagacttattgcgaagaatgtactt

SEQ ID NO: 91287 - DNA, 25 bp, Homo sapien
tagacttattgtgaagaatgtactt

SEQ ID NO: 91288 - DNA, 25 bp, Homo sapien
tagacttcagtgccgattttctgac

SEQ ID NO: 91289 - DNA, 25 bp, Homo sapien
tagacttcagtgctgattttctgac

SEQ ID NO: 91290 - DNA, 25 bp, Homo sapien
tagacttgtcagtttccttatcacc

SEQ ID NO: 91291 - DNA, 25 bp, Homo sapien
tagacttgtcagtttctttatcacc

SEQ ID NO: 91292 - DNA, 25 bp, Homo sapien
tagacttttccagataggataattt

SEQ ID NO: 91293 - DNA, 25 bp, Homo sapien
tagactttttcagataggataattt

SEQ ID NO: 91294 - DNA, 25 bp, Homo sapien
tagactttttcagcaaaaccctaag

SEQ ID NO: 91295 - DNA, 25 bp, Homo sapien
tagactttttcagcgaaaccctaag

SEQ ID NO: 91296 - DNA, 25 bp, Homo sapien
tagagaaaaagcgattggttagttt

SEQ ID NO: 91297 - DNA, 25 bp, Homo sapien
tagagaaaaggcgattggttagttt

SEQ ID NO: 91298 - DNA, 25 bp, Homo sapien
tagagaagcgagtcttttttgaatg

SEQ ID NO: 91299 - DNA, 25 bp, Homo sapien
tagagaagctagtcttttttgaatg

SEQ ID NO: 91300 - DNA, 25 bp, Homo sapien
tagagaatatccaaattgaagtcga

SEQ ID NO: 91301 - DNA, 25 bp, Homo sapien
tagagaatatccgaattgaagtcga

SEQ ID NO: 91302 - DNA, 25 bp, Homo sapien
tagagaattcactatgatcttctat

SEQ ID NO: 91303 - DNA, 25 bp, Homo sapien
tagagaattcactgtgatcttctat

SEQ ID NO: 91304 - DNA, 25 bp, Homo sapien
tagagacagtgcaaccctgctggtt

SEQ ID NO: 91305 - DNA, 25 bp, Homo sapien
tagagacagtgcgaccctgctggtt

SEQ ID NO: 91306 - DNA, 25 bp, Homo sapien
tagagaccacaggtcataagaaaaa

SEQ ID NO: 91307 - DNA, 25 bp, Homo sapien
tagagaccacaggttataagaaaaa

SEQ ID NO: 91308 - DNA, 25 bp, Homo sapien
tagagacttaaaaagagcaacagta

SEQ ID NO: 91309 - DNA, 25 bp, Homo sapien
tagagacttaaatagagcaacagta

SEQ ID NO: 91310 - DNA, 25 bp, Homo sapien
tagagacttcaacccaggattttca

SEQ ID NO: 91311 - DNA, 25 bp, Homo sapien
tagagacttcaactcaggattttca

SEQ ID NO: 91312 - DNA, 25 bp, Homo sapien
tagagagaagaacaagaaagtgaat

SEQ ID NO: 91313 - DNA, 25 bp, Homo sapien
tagagagaagaacaggaaagtgaat

SEQ ID NO: 91314 - DNA, 25 bp, Homo sapien
tagagagaagtcaatgcttagcttt

SEQ ID NO: 91315 - DNA, 25 bp, Homo sapien
tagagagaagtcgatgcttagcttt

SEQ ID NO: 91316 - DNA, 25 bp, Homo sapien
tagagagaataacagttttcattct

SEQ ID NO: 91317 - DNA, 25 bp, Homo sapien
tagagagaataacatttttcattct

SEQ ID NO: 91318 - DNA, 25 bp, Homo sapien
tagagagacaactgcatcctaagta

SEQ ID NO: 91319 - DNA, 25 bp, Homo sapien
tagagagacaactggatcctaagta

SEQ ID NO: 91320 - DNA, 25 bp, Homo sapien
tagagagagatattcacatttaatt

SEQ ID NO: 91321 - DNA, 25 bp, Homo sapien
tagagagagatattgacatttaatt

SEQ ID NO: 91322 - DNA, 25 bp, Homo sapien
tagagagattaaattgcttgtccaa

SEQ ID NO: 91323 - DNA, 25 bp, Homo sapien
tagagagattaagttgcttgtccaa

SEQ ID NO: 91324 - DNA, 25 bp, Homo sapien
tagagaggaaaatacgtttggagag

SEQ ID NO: 91325 - DNA, 25 bp, Homo sapien
tagagaggaaaataggtttggagag

SEQ ID NO: 91326 - DNA, 25 bp, Homo sapien
tagagaggatgaaggtagccttgtt

SEQ ID NO: 91327 - DNA, 25 bp, Homo sapien
tagagaggatgaagttagccttgtt

SEQ ID NO: 91328 - DNA, 25 bp, Homo sapien
tagagaggtaaacgattcttctcat

SEQ ID NO: 91329 - DNA, 25 bp, Homo sapien
tagagaggtaaatgattcttctcat

SEQ ID NO: 91330 - DNA, 25 bp, Homo sapien
tagagagtcatcagtaacctcagaa

SEQ ID NO: 91331 - DNA, 25 bp, Homo sapien
tagagagtcattagtaacctcagaa

SEQ ID NO: 91332 - DNA, 25 bp, Homo sapien
tagagagtgatctgaacaactaagc

SEQ ID NO: 91333 - DNA, 25 bp, Homo sapien
tagagagtggtctgaacaactaagc

SEQ ID NO: 91334 - DNA, 25 bp, Homo sapien
tagagagtttgttcaacggaataat

SEQ ID NO: 91335 - DNA, 25 bp, Homo sapien
tagagagtttgttcaatggaataat

SEQ ID NO: 91336 - DNA, 25 bp, Homo sapien
tagagataagacagaggaaatataa

SEQ ID NO: 91337 - DNA, 25 bp, Homo sapien
tagagataagactgaggaaatataa

SEQ ID NO: 91338 - DNA, 25 bp, Homo sapien
tagagcaaggaaaagttataaatct

SEQ ID NO: 91339 - DNA, 25 bp, Homo sapien
tagagcaagtaaaagttataaatct

SEQ ID NO: 91340 - DNA, 25 bp, Homo sapien
tagagcaataaacattcttcaaact

SEQ ID NO: 91341 - DNA, 25 bp, Homo sapien
tagagcaataaagattcttcaaact

SEQ ID NO: 91342 - DNA, 25 bp, Homo sapien
tagagcacataagctttcacacaga

SEQ ID NO: 91343 - DNA, 25 bp, Homo sapien
tagagcacgtaagctttcacacaga

SEQ ID NO: 91344 - DNA, 25 bp, Homo sapien
tagagcacgtagcagtatcctgggg

SEQ ID NO: 91345 - DNA, 25 bp, Homo sapien
tagagcacttagcagtatcctgggg

SEQ ID NO: 91346 - DNA, 25 bp, Homo sapien
tagagcagaaaagaatggtcaaagg

SEQ ID NO: 91347 - DNA, 25 bp, Homo sapien
tagagcagagaagaatggtcaaagg

SEQ ID NO: 91348 - DNA, 25 bp, Homo sapien
tagagcagagaccttgatttttgtt

SEQ ID NO: 91349 - DNA, 25 bp, Homo sapien
tagagcagagaccttggtttttgtt

SEQ ID NO: 91350 - DNA, 25 bp, Homo sapien
tagagcagttctttccatttttgta

SEQ ID NO: 91351 - DNA, 25 bp, Homo sapien
tagagcagttctttccctttttgta

SEQ ID NO: 91352 - DNA, 25 bp, Homo sapien
tagagcatagctaattggcctaaca

SEQ ID NO: 91353 - DNA, 25 bp, Homo sapien
tagagcatagcttattggcctaaca

SEQ ID NO: 91354 - DNA, 25 bp, Homo sapien
tagagccatcaggcacaggaaagct

SEQ ID NO: 91355 - DNA, 25 bp, Homo sapien
tagagccatcaggcgcaggaaagct

SEQ ID NO: 91356 - DNA, 25 bp, Homo sapien
tagagctagtgaattgaccaattta

SEQ ID NO: 91357 - DNA, 25 bp, Homo sapien
tagagctagtgaattggccaattta

SEQ ID NO: 91358 - DNA, 25 bp, Homo sapien
tagagctttatcacttgatgaggta

SEQ ID NO: 91359 - DNA, 25 bp, Homo sapien
tagagctttatcgcttgatgaggta

SEQ ID NO: 91360 - DNA, 25 bp, Homo sapien
tagaggaaataacatgcctaaaaga

SEQ ID NO: 91361 - DNA, 25 bp, Homo sapien
tagaggaaataatatgcctaaaaga

SEQ ID NO: 91362 - DNA, 25 bp, Homo sapien
tagaggaacacattttcaactggct

SEQ ID NO: 91363 - DNA, 25 bp, Homo sapien
tagaggaacacatttttaactggct

SEQ ID NO: 91364 - DNA, 25 bp, Homo sapien
tagaggacaatcctaatctagtcat

SEQ ID NO: 91365 - DNA, 25 bp, Homo sapien
tagaggacaatcttaatctagtcat

SEQ ID NO: 91366 - DNA, 25 bp, Homo sapien
tagaggactgtgaatatcccatcag

SEQ ID NO: 91367 - DNA, 25 bp, Homo sapien
tagaggactgtgagtatcccatcag

SEQ ID NO: 91368 - DNA, 25 bp, Homo sapien
tagaggagacatttcccataccttt

SEQ ID NO: 91369 - DNA, 25 bp, Homo sapien
tagaggaggcatttcccataccttt

SEQ ID NO: 91370 - DNA, 25 bp, Homo sapien
tagaggatgttaaaagatccttaag

SEQ ID NO: 91371 - DNA, 25 bp, Homo sapien
tagaggatgttaaatgatccttaag

SEQ ID NO: 91372 - DNA, 25 bp, Homo sapien
tagaggcatggtcttggaaatctat

SEQ ID NO: 91373 - DNA, 25 bp, Homo sapien
tagaggcatggttttggaaatctat

SEQ ID NO: 91374 - DNA, 25 bp, Homo sapien
tagaggccactgtactttttctccc

SEQ ID NO: 91375 - DNA, 25 bp, Homo sapien
tagaggccgctgtactttttctccc

SEQ ID NO: 91376 - DNA, 25 bp, Homo sapien
tagaggctgatccctgtctgtacaa

SEQ ID NO: 91377 - DNA, 25 bp, Homo sapien
tagaggctgatctctgtctgtacaa

SEQ ID NO: 91378 - DNA, 25 bp, Homo sapien
tagaggcttcacagctaattgacag

SEQ ID NO: 91379 - DNA, 25 bp, Homo sapien
tagaggcttcacagttaattgacag

SEQ ID NO: 91380 - DNA, 25 bp, Homo sapien
tagagggaaaacaccaagacaaaaa

SEQ ID NO: 91381 - DNA, 25 bp, Homo sapien
tagagggaaaacatcaagacaaaaa

SEQ ID NO: 91382 - DNA, 25 bp, Homo sapien
tagagggatataagaggaaatttta

SEQ ID NO: 91383 - DNA, 25 bp, Homo sapien
tagagggatataagcggaaatttta

SEQ ID NO: 91384 - DNA, 25 bp, Homo sapien
tagaggtaacatcagatcccacagg

SEQ ID NO: 91385 - DNA, 25 bp, Homo sapien
tagaggtaatatcagatcccacagg

SEQ ID NO: 91386 - DNA, 25 bp, Homo sapien
tagaggtacaacatagcaaaacctc

SEQ ID NO: 91387 - DNA, 25 bp, Homo sapien
tagaggtataacatagcaaaacctc

SEQ ID NO: 91388 - DNA, 25 bp, Homo sapien
tagaggtggcaatacagaagtagcc

SEQ ID NO: 91389 - DNA, 25 bp, Homo sapien
tagaggtggcaatatagaagtagcc

SEQ ID NO: 91390 - DNA, 25 bp, Homo sapien
tagaggttagtggaattgttttttc

SEQ ID NO: 91391 - DNA, 25 bp, Homo sapien
tagaggttcgtggaattgttttttc

SEQ ID NO: 91392 - DNA, 25 bp, Homo sapien
tagaggtttgcctatgtgattaaat

SEQ ID NO: 91393 - DNA, 25 bp, Homo sapien
tagaggtttgcttatgtgattaaat

SEQ ID NO: 91394 - DNA, 25 bp, Homo sapien
tagagtaagcgtacatctaaagtgc

SEQ ID NO: 91395 - DNA, 25 bp, Homo sapien
tagagtaagtgtaaacaggtcaaaa

SEQ ID NO: 91396 - DNA, 25 bp, Homo sapien
tagagtaagtgtacatctaaagtgc

SEQ ID NO: 91397 - DNA, 25 bp, Homo sapien
tagagtaagtgtgaacaggtcaaaa

SEQ ID NO: 91398 - DNA, 25 bp, Homo sapien
tagagtacagtgcttacaggcagtt

SEQ ID NO: 91399 - DNA, 25 bp, Homo sapien
tagagtacagtgcttataggcagtt

SEQ ID NO: 91400 - DNA, 25 bp, Homo sapien
tagagtagcatccagagcagttttc

SEQ ID NO: 91401 - DNA, 25 bp, Homo sapien
tagagtagcatccggagcagttttc

SEQ ID NO: 91402 - DNA, 25 bp, Homo sapien
tagagtatatgaccagcacagtttt

SEQ ID NO: 91403 - DNA, 25 bp, Homo sapien
tagagtatatgactagcacagtttt

SEQ ID NO: 91404 - DNA, 25 bp, Homo sapien
tagagtcagcctagtatatgagcat

SEQ ID NO: 91405 - DNA, 25 bp, Homo sapien
tagagtcagcctcgtatatgagcat

SEQ ID NO: 91406 - DNA, 25 bp, Homo sapien
tagagtcattgttggagagcaggaa

SEQ ID NO: 91407 - DNA, 25 bp, Homo sapien
tagagtcattgttgtagagcaggaa

SEQ ID NO: 91408 - DNA, 25 bp, Homo sapien
tagagtccaccgtcctgatcccaga

SEQ ID NO: 91409 - DNA, 25 bp, Homo sapien
tagagtccaccgtcttgatcccaga

SEQ ID NO: 91410 - DNA, 25 bp, Homo sapien
tagagtccagacataaattcatgcc

SEQ ID NO: 91411 - DNA, 25 bp, Homo sapien
tagagtccagatataaattcatgcc

SEQ ID NO: 91412 - DNA, 25 bp, Homo sapien
tagagtccatcaggctcattctttt

SEQ ID NO: 91413 - DNA, 25 bp, Homo sapien
tagagtccatccggctcattctttt

SEQ ID NO: 91414 - DNA, 25 bp, Homo sapien
tagagtcccgatcagctagttttca

SEQ ID NO: 91415 - DNA, 25 bp, Homo sapien
tagagtcccgattagctagttttca

SEQ ID NO: 91416 - DNA, 25 bp, Homo sapien
tagagtgacggaagtgagcattgac

SEQ ID NO: 91417 - DNA, 25 bp, Homo sapien
tagagtgatggaagtgagcattgac

SEQ ID NO: 91418 - DNA, 25 bp, Homo sapien
tagagtgctacatataagtcaatct

SEQ ID NO: 91419 - DNA, 25 bp, Homo sapien
tagagtgctacatataggtcaatct

SEQ ID NO: 91420 - DNA, 25 bp, Homo sapien
tagagttatgaatggaaacagaaaa

SEQ ID NO: 91421 - DNA, 25 bp, Homo sapien
tagagttatgactggaaacagaaaa

SEQ ID NO: 91422 - DNA, 25 bp, Homo sapien
tagagttccagaaatgtgggttcaa

SEQ ID NO: 91423 - DNA, 25 bp, Homo sapien
tagagttccagagatgtgggttcaa

SEQ ID NO: 91424 - DNA, 25 bp, Homo sapien
tagataaaaggaggaatccctaccc

SEQ ID NO: 91425 - DNA, 25 bp, Homo sapien
tagataaaaggtaggcatgagagcc

SEQ ID NO: 91426 - DNA, 25 bp, Homo sapien
tagataaaaggtgggcatgagagcc

SEQ ID NO: 91427 - DNA, 25 bp, Homo sapien
tagataaaatgaggaatccctaccc

SEQ ID NO: 91428 - DNA, 25 bp, Homo sapien
tagataacacaaacgaagagaaaca

SEQ ID NO: 91429 - DNA, 25 bp, Homo sapien
tagataacacaaatgaagagaaaca

SEQ ID NO: 91430 - DNA, 25 bp, Homo sapien
tagataactagataaacaaagtctc

SEQ ID NO: 91431 - DNA, 25 bp, Homo sapien
tagataactctgcaattaagtggag

SEQ ID NO: 91432 - DNA, 25 bp, Homo sapien
tagataactctgtaattaagtggag

SEQ ID NO: 91433 - DNA, 25 bp, Homo sapien
tagataactggataaacaaagtctc

SEQ ID NO: 91434 - DNA, 25 bp, Homo sapien
tagataagttcagaatagtcacaat

SEQ ID NO: 91435 - DNA, 25 bp, Homo sapien
tagataagttccgaatagtcacaat

SEQ ID NO: 91436 - DNA, 25 bp, Homo sapien
tagataataaacagcggtcagtttt

SEQ ID NO: 91437 - DNA, 25 bp, Homo sapien
tagataataaacagtggtcagtttt

SEQ ID NO: 91438 - DNA, 25 bp, Homo sapien
tagataataagactgttgcctctag

SEQ ID NO: 91439 - DNA, 25 bp, Homo sapien
tagataatcagactgttgcctctag

SEQ ID NO: 91440 - DNA, 25 bp, Homo sapien
tagataatccaggatattctcctta

SEQ ID NO: 91441 - DNA, 25 bp, Homo sapien
tagataatccaggttattctcctta

SEQ ID NO: 91442 - DNA, 25 bp, Homo sapien
tagatactgcctgccattctccagg

SEQ ID NO: 91443 - DNA, 25 bp, Homo sapien
tagatactgcctgctattctccagg

SEQ ID NO: 91444 - DNA, 25 bp, Homo sapien
tagatagagacattcagccaaggat

SEQ ID NO: 91445 - DNA, 25 bp, Homo sapien
tagatagagacgttcagccaaggat

SEQ ID NO: 91446 - DNA, 25 bp, Homo sapien
tagatagatacaatagctagatgga

SEQ ID NO: 91447 - DNA, 25 bp, Homo sapien
tagatagatacgatagctagatgga

SEQ ID NO: 91448 - DNA, 25 bp, Homo sapien
tagatagatcatagatgacagatat

SEQ ID NO: 91449 - DNA, 25 bp, Homo sapien
tagatagatcatagttgacagatat

SEQ ID NO: 91450 - DNA, 25 bp, Homo sapien
tagatagatggacatcgagatagag

SEQ ID NO: 91451 - DNA, 25 bp, Homo sapien
tagatagatggatatcgagatagag

SEQ ID NO: 91452 - DNA, 25 bp, Homo sapien
tagatagccttacgtttctttttgt

SEQ ID NO: 91453 - DNA, 25 bp, Homo sapien
tagatagccttatgtttctttttgt

SEQ ID NO: 91454 - DNA, 25 bp, Homo sapien
tagatagctgacatttgattctcct

SEQ ID NO: 91455 - DNA, 25 bp, Homo sapien
tagatagctgacattttattctcct

SEQ ID NO: 91456 - DNA, 25 bp, Homo sapien
tagatagtaatgcctgtgatggatc

SEQ ID NO: 91457 - DNA, 25 bp, Homo sapien
tagatagtcgttatggcctcacaac

SEQ ID NO: 91458 - DNA, 25 bp, Homo sapien
tagatagtgatgcctgtgatggatc

SEQ ID NO: 91459 - DNA, 25 bp, Homo sapien
tagatagtggttatggcctcacaac

SEQ ID NO: 91460 - DNA, 25 bp, Homo sapien
tagatatcacaatactcacaatctc

SEQ ID NO: 91461 - DNA, 25 bp, Homo sapien
tagatatcagaatactcacaatctc

SEQ ID NO: 91462 - DNA, 25 bp, Homo sapien
tagatatgactcttttttggcttat

SEQ ID NO: 91463 - DNA, 25 bp, Homo sapien
tagatatggctcttttttggcttat

SEQ ID NO: 91464 - DNA, 25 bp, Homo sapien
tagatcaaagagcaagctaaacagt

SEQ ID NO: 91465 - DNA, 25 bp, Homo sapien
tagatcaaagagcgagctaaacagt

SEQ ID NO: 91466 - DNA, 25 bp, Homo sapien
tagatcagtactttacagccttcct

SEQ ID NO: 91467 - DNA, 25 bp, Homo sapien
tagatcagtacttttcagccttcct

SEQ ID NO: 91468 - DNA, 25 bp, Homo sapien
tagatcataccctgtttgtcctatc

SEQ ID NO: 91469 - DNA, 25 bp, Homo sapien
tagatcataccgtgtttgtcctatc

SEQ ID NO: 91470 - DNA, 25 bp, Homo sapien
tagatcatataaagcctttctactc

SEQ ID NO: 91471 - DNA, 25 bp, Homo sapien
tagatcatataaaggctttctactc

SEQ ID NO: 91472 - DNA, 25 bp, Homo sapien
tagatcattaactcaggtctgactc

SEQ ID NO: 91473 - DNA, 25 bp, Homo sapien
tagatcattaactcgggtctgactc

SEQ ID NO: 91474 - DNA, 25 bp, Homo sapien
tagatcattcttcagaggtcaggtc

SEQ ID NO: 91475 - DNA, 25 bp, Homo sapien
tagatcatttttcagaggtcaggtc

SEQ ID NO: 91476 - DNA, 25 bp, Homo sapien
tagatccaacaatatttgctataca

SEQ ID NO: 91477 - DNA, 25 bp, Homo sapien
tagatccatcaatatttgctataca

SEQ ID NO: 91478 - DNA, 25 bp, Homo sapien
tagatcgaacagccttctgctggaa

SEQ ID NO: 91479 - DNA, 25 bp, Homo sapien
tagatcgaccagccttctgctggaa

SEQ ID NO: 91480 - DNA, 25 bp, Homo sapien
tagatctaacactggactgctttga

SEQ ID NO: 91481 - DNA, 25 bp, Homo sapien
tagatctaacattggactgctttga

SEQ ID NO: 91482 - DNA, 25 bp, Homo sapien
tagatctcagtaaaaagaaatacca

SEQ ID NO: 91483 - DNA, 25 bp, Homo sapien
tagatctctgtaaaaagaaatacca

SEQ ID NO: 91484 - DNA, 25 bp, Homo sapien
tagatctgatcatgaattctcttag

SEQ ID NO: 91485 - DNA, 25 bp, Homo sapien
tagatctgatcgtgaattctcttag

SEQ ID NO: 91486 - DNA, 25 bp, Homo sapien
tagatctgcatgcctctatattgtt

SEQ ID NO: 91487 - DNA, 25 bp, Homo sapien
tagatctgcatgtctctatattgtt

SEQ ID NO: 91488 - DNA, 25 bp, Homo sapien
tagatcttacggatttatgagatcc

SEQ ID NO: 91489 - DNA, 25 bp, Homo sapien
tagatcttatggatttatgagatcc

SEQ ID NO: 91490 - DNA, 25 bp, Homo sapien
tagatgaaaaacctggcatgcactt

SEQ ID NO: 91491 - DNA, 25 bp, Homo sapien
tagatgaaaaatctggcatgcactt

SEQ ID NO: 91492 - DNA, 25 bp, Homo sapien
tagatgaaacctacttctagttcgt

SEQ ID NO: 91493 - DNA, 25 bp, Homo sapien
tagatgaaacctagttctagttcgt

SEQ ID NO: 91494 - DNA, 25 bp, Homo sapien
tagatgaactttaagtctagctgac

SEQ ID NO: 91495 - DNA, 25 bp, Homo sapien
tagatgaactttaattctagctgac

SEQ ID NO: 91496 - DNA, 25 bp, Homo sapien
tagatgagctaccagagatgaccaa

SEQ ID NO: 91497 - DNA, 25 bp, Homo sapien
tagatgagttaccagagatgaccaa

SEQ ID NO: 91498 - DNA, 25 bp, Homo sapien
tagatgatagcatctcatctgcagc

SEQ ID NO: 91499 - DNA, 25 bp, Homo sapien
tagatgatagcatgtcatctgcagc

SEQ ID NO: 91500 - DNA, 25 bp, Homo sapien
tagatgcaaatgacagcttgttatc

SEQ ID NO: 91501 - DNA, 25 bp, Homo sapien
tagatgcaaatggcagcttgttatc

SEQ ID NO: 91502 - DNA, 25 bp, Homo sapien
tagatgcagaaactacagccttgtt

SEQ ID NO: 91503 - DNA, 25 bp, Homo sapien
tagatgcagaaactacggccttgtt

SEQ ID NO: 91504 - DNA, 25 bp, Homo sapien
tagatgcagaaatgagagaggaaca

SEQ ID NO: 91505 - DNA, 25 bp, Homo sapien
tagatgcagaagtgagagaggaaca

SEQ ID NO: 91506 - DNA, 25 bp, Homo sapien
tagatgctacagccactgcacaccc

SEQ ID NO: 91507 - DNA, 25 bp, Homo sapien
tagatgctacagcgactgcacaccc

SEQ ID NO: 91508 - DNA, 25 bp, Homo sapien
tagatgctagaacttcactcccaga

SEQ ID NO: 91509 - DNA, 25 bp, Homo sapien
tagatgctagagcttcactcccaga

SEQ ID NO: 91510 - DNA, 25 bp, Homo sapien
tagatgcttatttatgaccttttaa

SEQ ID NO: 91511 - DNA, 25 bp, Homo sapien
tagatgcttatttgtgaccttttaa

SEQ ID NO: 91512 - DNA, 25 bp, Homo sapien
tagatgggtccaaaagcatgcagtt

SEQ ID NO: 91513 - DNA, 25 bp, Homo sapien
tagatgggtccgaaagcatgcagtt

SEQ ID NO: 91514 - DNA, 25 bp, Homo sapien
tagatggtcttgaatatacttcaaa

SEQ ID NO: 91515 - DNA, 25 bp, Homo sapien
tagatggtcttgagtatacttcaaa

SEQ ID NO: 91516 - DNA, 25 bp, Homo sapien
tagatgtccttttaaaatctgatct

SEQ ID NO: 91517 - DNA, 25 bp, Homo sapien
tagatgtccttttaaagtctgatct

SEQ ID NO: 91518 - DNA, 25 bp, Homo sapien
tagatgtgtctgcacaaggtctttt

SEQ ID NO: 91519 - DNA, 25 bp, Homo sapien
tagatgtgtctgtacaaggtctttt

SEQ ID NO: 91520 - DNA, 25 bp, Homo sapien
tagatgttacagtcagggaaatttt

SEQ ID NO: 91521 - DNA, 25 bp, Homo sapien
tagatgttacattcagggaaatttt

SEQ ID NO: 91522 - DNA, 25 bp, Homo sapien
tagatgttcaaaacttttcacttag

SEQ ID NO: 91523 - DNA, 25 bp, Homo sapien
tagatgttcaaaatttttcacttag

SEQ ID NO: 91524 - DNA, 25 bp, Homo sapien
tagatgttcatcaggcattgaagag

SEQ ID NO: 91525 - DNA, 25 bp, Homo sapien
tagatgttcgtcaggcattgaagag

SEQ ID NO: 91526 - DNA, 25 bp, Homo sapien
tagatgttgagcccaggtagcttgg

SEQ ID NO: 91527 - DNA, 25 bp, Homo sapien
tagatgttgagcccgggtagcttgg

SEQ ID NO: 91528 - DNA, 25 bp, Homo sapien
tagatgtttggacgaccatgaaaat

SEQ ID NO: 91529 - DNA, 25 bp, Homo sapien
tagatgtttggatgaccatgaaaat

SEQ ID NO: 91530 - DNA, 25 bp, Homo sapien
tagattaagacctgcctggaatgga

SEQ ID NO: 91531 - DNA, 25 bp, Homo sapien
tagattaaggcctgcctggaatgga

SEQ ID NO: 91532 - DNA, 25 bp, Homo sapien
tagattaatgcacaagcaaggaaag

SEQ ID NO: 91533 - DNA, 25 bp, Homo sapien
tagattaatgcacaagtaaggaaag

SEQ ID NO: 91534 - DNA, 25 bp, Homo sapien
tagattacttgtaattgcaagtgca

SEQ ID NO: 91535 - DNA, 25 bp, Homo sapien
tagattacttgtaatttcaagtgca

SEQ ID NO: 91536 - DNA, 25 bp, Homo sapien
tagattatatgctaatggctctcca

SEQ ID NO: 91537 - DNA, 25 bp, Homo sapien
tagattatatgctaattgctctcca

SEQ ID NO: 91538 - DNA, 25 bp, Homo sapien
tagattatgtggtcagtgatccagg

SEQ ID NO: 91539 - DNA, 25 bp, Homo sapien
tagattatgtggtcggtgatccagg

SEQ ID NO: 91540 - DNA, 25 bp, Homo sapien
tagattcagataatttttgtctttt

SEQ ID NO: 91541 - DNA, 25 bp, Homo sapien
tagattcagcctgagcctaaaggcc

SEQ ID NO: 91542 - DNA, 25 bp, Homo sapien
tagattcagcctgggcctaaaggcc

SEQ ID NO: 91543 - DNA, 25 bp, Homo sapien
tagattcatataatttttgtctttt

SEQ ID NO: 91544 - DNA, 25 bp, Homo sapien
tagattcccagatccagggctgcag

SEQ ID NO: 91545 - DNA, 25 bp, Homo sapien
tagattcccaggtccagggctgcag

SEQ ID NO: 91546 - DNA, 25 bp, Homo sapien
tagattcccgttgacataagctgga

SEQ ID NO: 91547 - DNA, 25 bp, Homo sapien
tagattcccgttgatataagctgga

SEQ ID NO: 91548 - DNA, 25 bp, Homo sapien
tagattcttagctcggccataagcc

SEQ ID NO: 91549 - DNA, 25 bp, Homo sapien
tagattcttagctgggccataagcc

SEQ ID NO: 91550 - DNA, 25 bp, Homo sapien
tagattgaaggaagcaaaatattgt

SEQ ID NO: 91551 - DNA, 25 bp, Homo sapien
tagattgaaggaaggaaaatattgt

SEQ ID NO: 91552 - DNA, 25 bp, Homo sapien
tagattgactaaaagcatggtgcat

SEQ ID NO: 91553 - DNA, 25 bp, Homo sapien
tagattgattaaaagcatggtgcat

SEQ ID NO: 91554 - DNA, 25 bp, Homo sapien
tagattggaacccctgcacatgcac

SEQ ID NO: 91555 - DNA, 25 bp, Homo sapien
tagattgggacccctgcacatgcac

SEQ ID NO: 91556 - DNA, 25 bp, Homo sapien
tagattgtatcacctctttacactc

SEQ ID NO: 91557 - DNA, 25 bp, Homo sapien
tagattgtatcatctctttacactc

SEQ ID NO: 91558 - DNA, 25 bp, Homo sapien
tagattgtgagacaggttcaggaac

SEQ ID NO: 91559 - DNA, 25 bp, Homo sapien
tagattgtgaggcaggttcaggaac

SEQ ID NO: 91560 - DNA, 25 bp, Homo sapien
tagatttattacctggatgatttta

SEQ ID NO: 91561 - DNA, 25 bp, Homo sapien
tagatttattatctggatgatttta

SEQ ID NO: 91562 - DNA, 25 bp, Homo sapien
tagatttccgcttcaggatgaaaat

SEQ ID NO: 91563 - DNA, 25 bp, Homo sapien
tagatttctgcttcaggatgaaaat

SEQ ID NO: 91564 - DNA, 25 bp, Homo sapien
tagatttgcacgtccgtcttttttc

SEQ ID NO: 91565 - DNA, 25 bp, Homo sapien
tagatttgcacgtctgtcttttttc

SEQ ID NO: 91566 - DNA, 25 bp, Homo sapien
tagatttgtagaaaggttgttggtt

SEQ ID NO: 91567 - DNA, 25 bp, Homo sapien
tagatttgtagaagggttgttggtt

SEQ ID NO: 91568 - DNA, 25 bp, Homo sapien
tagattttggctctgttctcaactt

SEQ ID NO: 91569 - DNA, 25 bp, Homo sapien
tagattttggctgtgttctcaactt

SEQ ID NO: 91570 - DNA, 25 bp, Homo sapien
tagcaaaaatgtccaggtataggag

SEQ ID NO: 91571 - DNA, 25 bp, Homo sapien
tagcaaaaatgtccgggtataggag

SEQ ID NO: 91572 - DNA, 25 bp, Homo sapien
tagcaaaagttagctcattacagat

SEQ ID NO: 91573 - DNA, 25 bp, Homo sapien
tagcaaaagttagctcgttacagat

SEQ ID NO: 91574 - DNA, 25 bp, Homo sapien
tagcaaaatagttcaaactacttag

SEQ ID NO: 91575 - DNA, 25 bp, Homo sapien
tagcaaaatagttcaacctacttag

SEQ ID NO: 91576 - DNA, 25 bp, Homo sapien
tagcaaaatatgagataagtgtcag

SEQ ID NO: 91577 - DNA, 25 bp, Homo sapien
tagcaaaatattagataagtgtcag

SEQ ID NO: 91578 - DNA, 25 bp, Homo sapien
tagcaaactctatgaactactgttt

SEQ ID NO: 91579 - DNA, 25 bp, Homo sapien
tagcaaactttatgaactactgttt

SEQ ID NO: 91580 - DNA, 25 bp, Homo sapien
tagcaaagacagaacaagggtatta

SEQ ID NO: 91581 - DNA, 25 bp, Homo sapien
tagcaaaggcagaacaagggtatta

SEQ ID NO: 91582 - DNA, 25 bp, Homo sapien
tagcaaatatacggctttagaagat

SEQ ID NO: 91583 - DNA, 25 bp, Homo sapien
tagcaaatatagggctttagaagat

SEQ ID NO: 91584 - DNA, 25 bp, Homo sapien
tagcaaatggccaggccaggattca

SEQ ID NO: 91585 - DNA, 25 bp, Homo sapien
tagcaaatggccgggccaggattca

SEQ ID NO: 91586 - DNA, 25 bp, Homo sapien
tagcaacacgatttctgaaaatgaa

SEQ ID NO: 91587 - DNA, 25 bp, Homo sapien
tagcaacacggctagtaaatattga

SEQ ID NO: 91588 - DNA, 25 bp, Homo sapien
tagcaacagggagcaactggccttc

SEQ ID NO: 91589 - DNA, 25 bp, Homo sapien
tagcaacagggagcaagtggccttc

SEQ ID NO: 91590 - DNA, 25 bp, Homo sapien
tagcaacatgatttctgaaaatgaa

SEQ ID NO: 91591 - DNA, 25 bp, Homo sapien
tagcaacatggctagtaaatattga

SEQ ID NO: 91592 - DNA, 25 bp, Homo sapien
tagcaactctacaatcctgcccact

SEQ ID NO: 91593 - DNA, 25 bp, Homo sapien
tagcaactctacagtcctgcccact

SEQ ID NO: 91594 - DNA, 25 bp, Homo sapien
tagcaacttacactgactctctcag

SEQ ID NO: 91595 - DNA, 25 bp, Homo sapien
tagcaacttacactgagtctctcag

SEQ ID NO: 91596 - DNA, 25 bp, Homo sapien
tagcaagcttcacaactttctccga

SEQ ID NO: 91597 - DNA, 25 bp, Homo sapien
tagcaagcttcacatctttctccga

SEQ ID NO: 91598 - DNA, 25 bp, Homo sapien
tagcaaggactccataggaattatg

SEQ ID NO: 91599 - DNA, 25 bp, Homo sapien
tagcaaggactctataggaattatg

SEQ ID NO: 91600 - DNA, 25 bp, Homo sapien
tagcaaggctcaatgcggaaattca

SEQ ID NO: 91601 - DNA, 25 bp, Homo sapien
tagcaaggctcaatgctgaaattca

SEQ ID NO: 91602 - DNA, 25 bp, Homo sapien
tagcaataagagataaacttctact

SEQ ID NO: 91603 - DNA, 25 bp, Homo sapien
tagcaataggagataaacttctact

SEQ ID NO: 91604 - DNA, 25 bp, Homo sapien
tagcaatagtaactatccaggatga

SEQ ID NO: 91605 - DNA, 25 bp, Homo sapien
tagcaatagtagctatccaggatga

SEQ ID NO: 91606 - DNA, 25 bp, Homo sapien
tagcaatatttatgactgcctggta

SEQ ID NO: 91607 - DNA, 25 bp, Homo sapien
tagcaatatttctgactgcctggta

SEQ ID NO: 91608 - DNA, 25 bp, Homo sapien
tagcaatccaaacagaaaagggaga

SEQ ID NO: 91609 - DNA, 25 bp, Homo sapien
tagcaatccaaagagaaaagggaga

SEQ ID NO: 91610 - DNA, 25 bp, Homo sapien
tagcaatgttctaacagttcaaatt

SEQ ID NO: 91611 - DNA, 25 bp, Homo sapien
tagcaatgttctaatagttcaaatt

SEQ ID NO: 91612 - DNA, 25 bp, Homo sapien
tagcaatttaatgagtgatttctga

SEQ ID NO: 91613 - DNA, 25 bp, Homo sapien
tagcaatttaatgcgtgatttctga

SEQ ID NO: 91614 - DNA, 25 bp, Homo sapien
tagcacaaaaaagaaagccacttat

SEQ ID NO: 91615 - DNA, 25 bp, Homo sapien
tagcacaaaagatattaccccagtg

SEQ ID NO: 91616 - DNA, 25 bp, Homo sapien
tagcacaaaagatatttccccagtg

SEQ ID NO: 91617 - DNA, 25 bp, Homo sapien
tagcacaagaaagaaagccacttat

SEQ ID NO: 91618 - DNA, 25 bp, Homo sapien
tagcacaatattgattgcacaatag

SEQ ID NO: 91619 - DNA, 25 bp, Homo sapien
tagcacaatatttattgcacaatag

SEQ ID NO: 91620 - DNA, 25 bp, Homo sapien
tagcacactcaaatgaggaaggtgt

SEQ ID NO: 91621 - DNA, 25 bp, Homo sapien
tagcacacttaaatgaggaaggtgt

SEQ ID NO: 91622 - DNA, 25 bp, Homo sapien
tagcacagaagaaagaacttttctc

SEQ ID NO: 91623 - DNA, 25 bp, Homo sapien
tagcacagactagtttttcagttta

SEQ ID NO: 91624 - DNA, 25 bp, Homo sapien
tagcacagactggtttttcagttta

SEQ ID NO: 91625 - DNA, 25 bp, Homo sapien
tagcacagcatttcttcattctact

SEQ ID NO: 91626 - DNA, 25 bp, Homo sapien
tagcacagcgtttcttcattctact

SEQ ID NO: 91627 - DNA, 25 bp, Homo sapien
tagcacagtagaaagaacttttctc

SEQ ID NO: 91628 - DNA, 25 bp, Homo sapien
tagcacagttgtacatgattttgat

SEQ ID NO: 91629 - DNA, 25 bp, Homo sapien
tagcacagttgtacgtgattttgat

SEQ ID NO: 91630 - DNA, 25 bp, Homo sapien
tagcacatcatcaactgtgtaatag

SEQ ID NO: 91631 - DNA, 25 bp, Homo sapien
tagcacatcatcacctgtgtaatag

SEQ ID NO: 91632 - DNA, 25 bp, Homo sapien
tagcacatcctgaatgacaaggttt

SEQ ID NO: 91633 - DNA, 25 bp, Homo sapien
tagcacatcttgaatgacaaggttt

SEQ ID NO: 91634 - DNA, 25 bp, Homo sapien
tagcacattgtgaatcctccataaa

SEQ ID NO: 91635 - DNA, 25 bp, Homo sapien
tagcacattgtgagtcctccataaa

SEQ ID NO: 91636 - DNA, 25 bp, Homo sapien
tagcacctgtttatgtaaataatgt

SEQ ID NO: 91637 - DNA, 25 bp, Homo sapien
tagcacctgtttttgtaaataatgt

SEQ ID NO: 91638 - DNA, 25 bp, Homo sapien
tagcacgtatggctcccaggcaatc

SEQ ID NO: 91639 - DNA, 25 bp, Homo sapien
tagcacgtgtggctcccaggcaatc

SEQ ID NO: 91640 - DNA, 25 bp, Homo sapien
tagcactaggatgcaagttgcagga

SEQ ID NO: 91641 - DNA, 25 bp, Homo sapien
tagcactaggatgtaagttgcagga

SEQ ID NO: 91642 - DNA, 25 bp, Homo sapien
tagcactaggcttgctgctgctgcg

SEQ ID NO: 91643 - DNA, 25 bp, Homo sapien
tagcactaggcttgttgctgctgcg

SEQ ID NO: 91644 - DNA, 25 bp, Homo sapien
tagcactatgcctctccactcgcaa

SEQ ID NO: 91645 - DNA, 25 bp, Homo sapien
tagcactatgcctctctactcgcaa

SEQ ID NO: 91646 - DNA, 25 bp, Homo sapien
tagcactgagggtcctcttgtcgta

SEQ ID NO: 91647 - DNA, 25 bp, Homo sapien
tagcactgggggtcctcttgtcgta

SEQ ID NO: 91648 - DNA, 25 bp, Homo sapien
tagcacttctaaaatcattgttgct

SEQ ID NO: 91649 - DNA, 25 bp, Homo sapien
tagcacttttaaaatcattgttgct

SEQ ID NO: 91650 - DNA, 25 bp, Homo sapien
tagcagaacatactccttataaatg

SEQ ID NO: 91651 - DNA, 25 bp, Homo sapien
tagcagaacatgctccttataaatg

SEQ ID NO: 91652 - DNA, 25 bp, Homo sapien
tagcagaattcacgccctgctaact

SEQ ID NO: 91653 - DNA, 25 bp, Homo sapien
tagcagaattcatgccctgctaact

SEQ ID NO: 91654 - DNA, 25 bp, Homo sapien
tagcagacacaattatatcccattc

SEQ ID NO: 91655 - DNA, 25 bp, Homo sapien
tagcagacgcaattatatcccattc

SEQ ID NO: 91656 - DNA, 25 bp, Homo sapien
tagcagactcaattatataaaagcc

SEQ ID NO: 91657 - DNA, 25 bp, Homo sapien
tagcagactcaattatttaaaagcc

SEQ ID NO: 91658 - DNA, 25 bp, Homo sapien
tagcagactctgtcagtgccttgcc

SEQ ID NO: 91659 - DNA, 25 bp, Homo sapien
tagcagactctgtcggtgccttgcc

SEQ ID NO: 91660 - DNA, 25 bp, Homo sapien
tagcagagaaaatgaagaaatttgg

SEQ ID NO: 91661 - DNA, 25 bp, Homo sapien
tagcagagacgaaataccaaaacag

SEQ ID NO: 91662 - DNA, 25 bp, Homo sapien
tagcagagagtggtatgtgaatcat

SEQ ID NO: 91663 - DNA, 25 bp, Homo sapien
tagcagagagtggtgtgtgaatcat

SEQ ID NO: 91664 - DNA, 25 bp, Homo sapien
tagcagagataatgaagaaatttgg

SEQ ID NO: 91665 - DNA, 25 bp, Homo sapien
tagcagagatgaaataccaaaacag

SEQ ID NO: 91666 - DNA, 25 bp, Homo sapien
tagcagatcaaaaacatcccgattc

SEQ ID NO: 91667 - DNA, 25 bp, Homo sapien
tagcagatcaaaagcatcccgattc

SEQ ID NO: 91668 - DNA, 25 bp, Homo sapien
tagcagatcctgccagattgcacct

SEQ ID NO: 91669 - DNA, 25 bp, Homo sapien
tagcagatcctgccagtttgcacct

SEQ ID NO: 91670 - DNA, 25 bp, Homo sapien
tagcagcaagcccgtgggagcgcag

SEQ ID NO: 91671 - DNA, 25 bp, Homo sapien
tagcagcaagcctgtgggagcgcag

SEQ ID NO: 91672 - DNA, 25 bp, Homo sapien
tagcagcaatagaaaatggacataa

SEQ ID NO: 91673 - DNA, 25 bp, Homo sapien
tagcagcagtagaaaatggacataa

SEQ ID NO: 91674 - DNA, 25 bp, Homo sapien
tagcagccgaactgtgcttttcaat

SEQ ID NO: 91675 - DNA, 25 bp, Homo sapien
tagcagcctaactgtgcttttcaat

SEQ ID NO: 91676 - DNA, 25 bp, Homo sapien
tagcagctaacacatgacattgggc

SEQ ID NO: 91677 - DNA, 25 bp, Homo sapien
tagcagctaacacatggcattgggc

SEQ ID NO: 91678 - DNA, 25 bp, Homo sapien
tagcagcttaccaagaccaaaaggg

SEQ ID NO: 91679 - DNA, 25 bp, Homo sapien
tagcagcttaccgagaccaaaaggg

SEQ ID NO: 91680 - DNA, 25 bp, Homo sapien
tagcaggacttcaatgtacattgca

SEQ ID NO: 91681 - DNA, 25 bp, Homo sapien
tagcaggagaaaggcacttggttag

SEQ ID NO: 91682 - DNA, 25 bp, Homo sapien
tagcaggagttcaatgtacattgca

SEQ ID NO: 91683 - DNA, 25 bp, Homo sapien
tagcaggataaaggcacttggttag

SEQ ID NO: 91684 - DNA, 25 bp, Homo sapien
tagcaggatatagggttcagtctag

SEQ ID NO: 91685 - DNA, 25 bp, Homo sapien
tagcaggatatatggttcagtctag

SEQ ID NO: 91686 - DNA, 25 bp, Homo sapien
tagcagggaaccatagcctagccaa

SEQ ID NO: 91687 - DNA, 25 bp, Homo sapien
tagcagggattaggatgtgaacgca

SEQ ID NO: 91688 - DNA, 25 bp, Homo sapien
tagcagggattgggatgtgaacgca

SEQ ID NO: 91689 - DNA, 25 bp, Homo sapien
tagcaggggaccatagcctagccaa

SEQ ID NO: 91690 - DNA, 25 bp, Homo sapien
tagcagggtctttctgcagacaaag

SEQ ID NO: 91691 - DNA, 25 bp, Homo sapien
tagcagggtctttgtgcagacaaag

SEQ ID NO: 91692 - DNA, 25 bp, Homo sapien
tagcaggtagtgtactttttgtgat

SEQ ID NO: 91693 - DNA, 25 bp, Homo sapien
tagcaggtagtgtgctttttgtgat

SEQ ID NO: 91694 - DNA, 25 bp, Homo sapien
tagcagtgcagttaatttgtgtaca

SEQ ID NO: 91695 - DNA, 25 bp, Homo sapien
tagcagtgctgttaatttgtgtaca

SEQ ID NO: 91696 - DNA, 25 bp, Homo sapien
tagcagttaggaacactggcattgg

SEQ ID NO: 91697 - DNA, 25 bp, Homo sapien
tagcagttaggagcactggcattgg

SEQ ID NO: 91698 - DNA, 25 bp, Homo sapien
tagcagtttatatacaggcttatgg

SEQ ID NO: 91699 - DNA, 25 bp, Homo sapien
tagcagtttatatataggcttatgg

SEQ ID NO: 91700 - DNA, 25 bp, Homo sapien
tagcataactgacagaaatgcagag

SEQ ID NO: 91701 - DNA, 25 bp, Homo sapien
tagcataactgacctttattgcaaa

SEQ ID NO: 91702 - DNA, 25 bp, Homo sapien
tagcataactggcagaaatgcagag

SEQ ID NO: 91703 - DNA, 25 bp, Homo sapien
tagcataactggcctttattgcaaa

SEQ ID NO: 91704 - DNA, 25 bp, Homo sapien
tagcataatggacttgtgaccagag

SEQ ID NO: 91705 - DNA, 25 bp, Homo sapien
tagcataatggccttgtgaccagag

SEQ ID NO: 91706 - DNA, 25 bp, Homo sapien
tagcatacaagacagcatctctgtc

SEQ ID NO: 91707 - DNA, 25 bp, Homo sapien
tagcatacaagatagcatctctgtc

SEQ ID NO: 91708 - DNA, 25 bp, Homo sapien
tagcatacagccacgtagggcctca

SEQ ID NO: 91709 - DNA, 25 bp, Homo sapien
tagcatacagccatgtagggcctca

SEQ ID NO: 91710 - DNA, 25 bp, Homo sapien
tagcatacctgttgaacgaaacatt

SEQ ID NO: 91711 - DNA, 25 bp, Homo sapien
tagcatacctgttgaatgaaacatt

SEQ ID NO: 91712 - DNA, 25 bp, Homo sapien
tagcatagtcttctaaagtagtagg

SEQ ID NO: 91713 - DNA, 25 bp, Homo sapien
tagcatagtcttctgaagtagtagg

SEQ ID NO: 91714 - DNA, 25 bp, Homo sapien
tagcatagtgtagcattttaagagt

SEQ ID NO: 91715 - DNA, 25 bp, Homo sapien
tagcatagtgtagctttttaagagt

SEQ ID NO: 91716 - DNA, 25 bp, Homo sapien
tagcatataccatcaggcaaaacta

SEQ ID NO: 91717 - DNA, 25 bp, Homo sapien
tagcatatatcatcaggcaaaacta

SEQ ID NO: 91718 - DNA, 25 bp, Homo sapien
tagcatattaatcacagttgtttta

SEQ ID NO: 91719 - DNA, 25 bp, Homo sapien
tagcatattaatcatagttgtttta

SEQ ID NO: 91720 - DNA, 25 bp, Homo sapien
tagcatattgtcataatcacttcat

SEQ ID NO: 91721 - DNA, 25 bp, Homo sapien
tagcatattgtcatgatcacttcat

SEQ ID NO: 91722 - DNA, 25 bp, Homo sapien
tagcatcaattgtttcatttcctct

SEQ ID NO: 91723 - DNA, 25 bp, Homo sapien
tagcatcacttgtttcatttcctct

SEQ ID NO: 91724 - DNA, 25 bp, Homo sapien
tagcatcccaataacggtgtgccct

SEQ ID NO: 91725 - DNA, 25 bp, Homo sapien
tagcatcccaataatggtgtgccct

SEQ ID NO: 91726 - DNA, 25 bp, Homo sapien
tagcatctgttaatgtaaatgtatt

SEQ ID NO: 91727 - DNA, 25 bp, Homo sapien
tagcatctgttaatgtgaatgtatt

SEQ ID NO: 91728 - DNA, 25 bp, Homo sapien
tagcattgcgtctgacatgtaacag

SEQ ID NO: 91729 - DNA, 25 bp, Homo sapien
tagcattgtctgacgtgattctaaa

SEQ ID NO: 91730 - DNA, 25 bp, Homo sapien
tagcattgtctgatgtgattctaaa

SEQ ID NO: 91731 - DNA, 25 bp, Homo sapien
tagcattgtgtctgacatgtaacag

SEQ ID NO: 91732 - DNA, 25 bp, Homo sapien
tagcattgttcttactcctagatat

SEQ ID NO: 91733 - DNA, 25 bp, Homo sapien
tagcattgttcttactgctagatat

SEQ ID NO: 91734 - DNA, 25 bp, Homo sapien
tagcatttccaaatagctgaactgt

SEQ ID NO: 91735 - DNA, 25 bp, Homo sapien
tagcatttccaaatagttgaactgt

SEQ ID NO: 91736 - DNA, 25 bp, Homo sapien
tagcatttgaatatgactggtatgg

SEQ ID NO: 91737 - DNA, 25 bp, Homo sapien
tagcatttgaatatgagtggtatgg

SEQ ID NO: 91738 - DNA, 25 bp, Homo sapien
tagcatttgagttactcaactggga

SEQ ID NO: 91739 - DNA, 25 bp, Homo sapien
tagcatttgagttactgaactggga

SEQ ID NO: 91740 - DNA, 25 bp, Homo sapien
tagcattttttaaagtctgttacag

SEQ ID NO: 91741 - DNA, 25 bp, Homo sapien
tagcatttttttaagtctgttacag

SEQ ID NO: 91742 - DNA, 25 bp, Homo sapien
tagccaaaattgaaagctattgaac

SEQ ID NO: 91743 - DNA, 25 bp, Homo sapien
tagccaaaattggaagctattgaac

SEQ ID NO: 91744 - DNA, 25 bp, Homo sapien
tagccaaagtgtctcacatctaaat

SEQ ID NO: 91745 - DNA, 25 bp, Homo sapien
tagccaaagtgtcttacatctaaat

SEQ ID NO: 91746 - DNA, 25 bp, Homo sapien
tagccaacccacactaaagcatgtt

SEQ ID NO: 91747 - DNA, 25 bp, Homo sapien
tagccaacgaattatgtcagaagca

SEQ ID NO: 91748 - DNA, 25 bp, Homo sapien
tagccaacgaattgtgtcagaagca

SEQ ID NO: 91749 - DNA, 25 bp, Homo sapien
tagccaactatcaacatcgggtaca

SEQ ID NO: 91750 - DNA, 25 bp, Homo sapien
tagccaactcacactaaagcatgtt

SEQ ID NO: 91751 - DNA, 25 bp, Homo sapien
tagccaactgtcaacatcgggtaca

SEQ ID NO: 91752 - DNA, 25 bp, Homo sapien
tagccacattacacctttgcattac

SEQ ID NO: 91753 - DNA, 25 bp, Homo sapien
tagccacattacgcctttgcattac

SEQ ID NO: 91754 - DNA, 25 bp, Homo sapien
tagccacgatgtacctccttccaat

SEQ ID NO: 91755 - DNA, 25 bp, Homo sapien
tagccacgttgtacctccttccaat

SEQ ID NO: 91756 - DNA, 25 bp, Homo sapien
tagccactagcttcatgatcatttg

SEQ ID NO: 91757 - DNA, 25 bp, Homo sapien
tagccactagcttcgtgatcatttg

SEQ ID NO: 91758 - DNA, 25 bp, Homo sapien
tagccagcagcaatggaagggataa

SEQ ID NO: 91759 - DNA, 25 bp, Homo sapien
tagccagcagcactggaagggataa

SEQ ID NO: 91760 - DNA, 25 bp, Homo sapien
tagccaggaagtacttacaggaagc

SEQ ID NO: 91761 - DNA, 25 bp, Homo sapien
tagccaggaagtagttacaggaagc

SEQ ID NO: 91762 - DNA, 25 bp, Homo sapien
tagccagtgagcaccctaggaggaa

SEQ ID NO: 91763 - DNA, 25 bp, Homo sapien
tagccagtgaggaccctaggaggaa

SEQ ID NO: 91764 - DNA, 25 bp, Homo sapien
tagccagttggtcaacatgcagatg

SEQ ID NO: 91765 - DNA, 25 bp, Homo sapien
tagccagttggtcaacgtgcagatg

SEQ ID NO: 91766 - DNA, 25 bp, Homo sapien
tagccagtttagccagtggaataat

SEQ ID NO: 91767 - DNA, 25 bp, Homo sapien
tagccagtttagctagtggaataat

SEQ ID NO: 91768 - DNA, 25 bp, Homo sapien
tagccatattgcttcactctcattt

SEQ ID NO: 91769 - DNA, 25 bp, Homo sapien
tagccatattgtttcactctcattt

SEQ ID NO: 91770 - DNA, 25 bp, Homo sapien
tagccatcctgtattttatccagca

SEQ ID NO: 91771 - DNA, 25 bp, Homo sapien
tagccatcttgtattttatccagca

SEQ ID NO: 91772 - DNA, 25 bp, Homo sapien
tagcccaaattgctgacccataaaa

SEQ ID NO: 91773 - DNA, 25 bp, Homo sapien
tagcccaaattgttgacccataaaa

SEQ ID NO: 91774 - DNA, 25 bp, Homo sapien
tagcccaactgcacctatgccctgc

SEQ ID NO: 91775 - DNA, 25 bp, Homo sapien
tagcccaactgcacttatgccctgc

SEQ ID NO: 91776 - DNA, 25 bp, Homo sapien
tagcccagactattcatatactaca

SEQ ID NO: 91777 - DNA, 25 bp, Homo sapien
tagcccagattattcatatactaca

SEQ ID NO: 91778 - DNA, 25 bp, Homo sapien
tagccctgccaactgaagacaaact

SEQ ID NO: 91779 - DNA, 25 bp, Homo sapien
tagccctggcaactgaagacaaact

SEQ ID NO: 91780 - DNA, 25 bp, Homo sapien
tagccgtataaaggagttgggcata

SEQ ID NO: 91781 - DNA, 25 bp, Homo sapien
tagccgtatgaaggagttgggcata

SEQ ID NO: 91782 - DNA, 25 bp, Homo sapien
tagccgttttcatcaatgatcttag

SEQ ID NO: 91783 - DNA, 25 bp, Homo sapien
tagccgttttcatgaatgatcttag

SEQ ID NO: 91784 - DNA, 25 bp, Homo sapien
tagcctacaggacccaaaaggagga

SEQ ID NO: 91785 - DNA, 25 bp, Homo sapien
tagcctacgggacccaaaaggagga

SEQ ID NO: 91786 - DNA, 25 bp, Homo sapien
tagcctatgtgaagccatgaaggcc

SEQ ID NO: 91787 - DNA, 25 bp, Homo sapien
tagcctatgtgaagtcatgaaggcc

SEQ ID NO: 91788 - DNA, 25 bp, Homo sapien
tagcctcaaattttcctttgaactc

SEQ ID NO: 91789 - DNA, 25 bp, Homo sapien
tagcctcaacatcctcatctgcaaa

SEQ ID NO: 91790 - DNA, 25 bp, Homo sapien
tagcctcaacatcttcatctgcaaa

SEQ ID NO: 91791 - DNA, 25 bp, Homo sapien
tagcctcaacttttcctttgaactc

SEQ ID NO: 91792 - DNA, 25 bp, Homo sapien
tagcctcatggtctgcttgtcctcc

SEQ ID NO: 91793 - DNA, 25 bp, Homo sapien
tagcctcatggtttgcttgtcctcc

SEQ ID NO: 91794 - DNA, 25 bp, Homo sapien
tagcctctcgtctttcattaaacct

SEQ ID NO: 91795 - DNA, 25 bp, Homo sapien
tagcctcttgtctttcattaaacct

SEQ ID NO: 91796 - DNA, 25 bp, Homo sapien
tagcctgaattctggaatagagtta

SEQ ID NO: 91797 - DNA, 25 bp, Homo sapien
tagcctgatgacctacttaatgttc

SEQ ID NO: 91798 - DNA, 25 bp, Homo sapien
tagcctgatgacttacttaatgttc

SEQ ID NO: 91799 - DNA, 25 bp, Homo sapien
tagcctgatttctggaatagagtta

SEQ ID NO: 91800 - DNA, 25 bp, Homo sapien
tagcctgtaccttttaaatcaaaac

SEQ ID NO: 91801 - DNA, 25 bp, Homo sapien
tagcctgtaccttttacatcaaaac

SEQ ID NO: 91802 - DNA, 25 bp, Homo sapien
tagccttacagaactcctatggggc

SEQ ID NO: 91803 - DNA, 25 bp, Homo sapien
tagccttacggaactcctatggggc

SEQ ID NO: 91804 - DNA, 25 bp, Homo sapien
tagccttcgctattgtttttaacat

SEQ ID NO: 91805 - DNA, 25 bp, Homo sapien
tagccttcgctattttttttaacat

SEQ ID NO: 91806 - DNA, 25 bp, Homo sapien
tagccttggcttcgtatccccacaa

SEQ ID NO: 91807 - DNA, 25 bp, Homo sapien
tagccttggctttgtatccccacaa

SEQ ID NO: 91808 - DNA, 25 bp, Homo sapien
tagcctttttgcgttctgaagtatg

SEQ ID NO: 91809 - DNA, 25 bp, Homo sapien
tagcctttttgggttctgaagtatg

SEQ ID NO: 91810 - DNA, 25 bp, Homo sapien
tagcgaaatgctatgagcataaatc

SEQ ID NO: 91811 - DNA, 25 bp, Homo sapien
tagcgaaatgctgtgagcataaatc

SEQ ID NO: 91812 - DNA, 25 bp, Homo sapien
tagcgatcatgtataaaaacattac

SEQ ID NO: 91813 - DNA, 25 bp, Homo sapien
tagcgatcatgtatgaaaacattac

SEQ ID NO: 91814 - DNA, 25 bp, Homo sapien
tagcgcagaacagtgtagccttgag

SEQ ID NO: 91815 - DNA, 25 bp, Homo sapien
tagcgcagcacagtgtagccttgag

SEQ ID NO: 91816 - DNA, 25 bp, Homo sapien
tagcggcagatgcatgatggagtag

SEQ ID NO: 91817 - DNA, 25 bp, Homo sapien
tagcggcagatgcgtgatggagtag

SEQ ID NO: 91818 - DNA, 25 bp, Homo sapien
tagctaaaaatcatgatcactaagt

SEQ ID NO: 91819 - DNA, 25 bp, Homo sapien
tagctaaaaatcctgatcactaagt

SEQ ID NO: 91820 - DNA, 25 bp, Homo sapien
tagctaaaaatcctttaaatcagtt

SEQ ID NO: 91821 - DNA, 25 bp, Homo sapien
tagctaaaaatcttttaaatcagtt

SEQ ID NO: 91822 - DNA, 25 bp, Homo sapien
tagctaaagcctattctatgaactt

SEQ ID NO: 91823 - DNA, 25 bp, Homo sapien
tagctaaaggtgacctctgcaacca

SEQ ID NO: 91824 - DNA, 25 bp, Homo sapien
tagctaaaggtggcctctgcaacca

SEQ ID NO: 91825 - DNA, 25 bp, Homo sapien
tagctaaatcctattctatgaactt

SEQ ID NO: 91826 - DNA, 25 bp, Homo sapien
tagctaacctacttgaaccagctgg

SEQ ID NO: 91827 - DNA, 25 bp, Homo sapien
tagctaacctactttaaccagctgg

SEQ ID NO: 91828 - DNA, 25 bp, Homo sapien
tagctaccttttcacatgtgtagtt

SEQ ID NO: 91829 - DNA, 25 bp, Homo sapien
tagctaccttttcatatgtgtagtt

SEQ ID NO: 91830 - DNA, 25 bp, Homo sapien
tagctagaaagaacaataatgacct

SEQ ID NO: 91831 - DNA, 25 bp, Homo sapien
tagctagaaagaataataatgacct

SEQ ID NO: 91832 - DNA, 25 bp, Homo sapien
tagctagaaattcaagactagagac

SEQ ID NO: 91833 - DNA, 25 bp, Homo sapien
tagctagaaattcacgactagagac

SEQ ID NO: 91834 - DNA, 25 bp, Homo sapien
tagctagagccaaacacaacaaaat

SEQ ID NO: 91835 - DNA, 25 bp, Homo sapien
tagctagaggcaaacacaacaaaat

SEQ ID NO: 91836 - DNA, 25 bp, Homo sapien
tagctagcagaggactcaatgatgc

SEQ ID NO: 91837 - DNA, 25 bp, Homo sapien
tagctagcagaggattcaatgatgc

SEQ ID NO: 91838 - DNA, 25 bp, Homo sapien
tagctagccagctgatgaaaaagag

SEQ ID NO: 91839 - DNA, 25 bp, Homo sapien
tagctagccagctggtgaaaaagag

SEQ ID NO: 91840 - DNA, 25 bp, Homo sapien
tagctaggaacattatttcccttgt

SEQ ID NO: 91841 - DNA, 25 bp, Homo sapien
tagctaggaacattgtttcccttgt

SEQ ID NO: 91842 - DNA, 25 bp, Homo sapien
tagctataaatatactgacttctct

SEQ ID NO: 91843 - DNA, 25 bp, Homo sapien
tagctataaatatattgacttctct

SEQ ID NO: 91844 - DNA, 25 bp, Homo sapien
tagctataactctgggagtgactcc

SEQ ID NO: 91845 - DNA, 25 bp, Homo sapien
tagctataattctgggagtgactcc

SEQ ID NO: 91846 - DNA, 25 bp, Homo sapien
tagctatacattgagacaaccaaaa

SEQ ID NO: 91847 - DNA, 25 bp, Homo sapien
tagctatatattgagacaaccaaaa

SEQ ID NO: 91848 - DNA, 25 bp, Homo sapien
tagctatggtaaaataaggaaatgt

SEQ ID NO: 91849 - DNA, 25 bp, Homo sapien
tagctatgttaaaataaggaaatgt

SEQ ID NO: 91850 - DNA, 25 bp, Homo sapien
tagctattaactctcaattactaga

SEQ ID NO: 91851 - DNA, 25 bp, Homo sapien
tagctattaactttcaattactaga

SEQ ID NO: 91852 - DNA, 25 bp, Homo sapien
tagctattcaaatcccaatgtgatg

SEQ ID NO: 91853 - DNA, 25 bp, Homo sapien
tagctattcaaatcccgatgtgatg

SEQ ID NO: 91854 - DNA, 25 bp, Homo sapien
tagctattgagaagacaatatatac

SEQ ID NO: 91855 - DNA, 25 bp, Homo sapien
tagctattgagaagacgatatatac

SEQ ID NO: 91856 - DNA, 25 bp, Homo sapien
tagctattgcgaatatttctgcaaa

SEQ ID NO: 91857 - DNA, 25 bp, Homo sapien
tagctattgtgaatatttctgcaaa

SEQ ID NO: 91858 - DNA, 25 bp, Homo sapien
tagctcaacgtgggatgaatgccat

SEQ ID NO: 91859 - DNA, 25 bp, Homo sapien
tagctcaacgttggatgaatgccat

SEQ ID NO: 91860 - DNA, 25 bp, Homo sapien
tagctcaatacatcagtgcaagctg

SEQ ID NO: 91861 - DNA, 25 bp, Homo sapien
tagctcaatacgtcagtgcaagctg

SEQ ID NO: 91862 - DNA, 25 bp, Homo sapien
tagctcactatgttctccatggggg

SEQ ID NO: 91863 - DNA, 25 bp, Homo sapien
tagctcactgtgttctccatggggg

SEQ ID NO: 91864 - DNA, 25 bp, Homo sapien
tagctcagaagagtaacgataactg

SEQ ID NO: 91865 - DNA, 25 bp, Homo sapien
tagctcagaagagtaatgataactg

SEQ ID NO: 91866 - DNA, 25 bp, Homo sapien
tagctcagcagagacacgtttcctg

SEQ ID NO: 91867 - DNA, 25 bp, Homo sapien
tagctcagcagagacatgtttcctg

SEQ ID NO: 91868 - DNA, 25 bp, Homo sapien
tagctcaggccactccaacaaaata

SEQ ID NO: 91869 - DNA, 25 bp, Homo sapien
tagctcaggccactgcaacaaaata

SEQ ID NO: 91870 - DNA, 25 bp, Homo sapien
tagctccacttatctggaatacagc

SEQ ID NO: 91871 - DNA, 25 bp, Homo sapien
tagctccacttgtctggaatacagc

SEQ ID NO: 91872 - DNA, 25 bp, Homo sapien
tagctcccaatctgcctgggaaggg

SEQ ID NO: 91873 - DNA, 25 bp, Homo sapien
tagctcccaatctgtctgggaaggg

SEQ ID NO: 91874 - DNA, 25 bp, Homo sapien
tagctcccagtaaaatttaagggca

SEQ ID NO: 91875 - DNA, 25 bp, Homo sapien
tagctcccagtacaatttaagggca

SEQ ID NO: 91876 - DNA, 25 bp, Homo sapien
tagctcccattttgaagagagaaca

SEQ ID NO: 91877 - DNA, 25 bp, Homo sapien
tagctcccatttttaagagagaaca

SEQ ID NO: 91878 - DNA, 25 bp, Homo sapien
tagctcctggaaatacagaattcta

SEQ ID NO: 91879 - DNA, 25 bp, Homo sapien
tagctcctggaaatactgaattcta

SEQ ID NO: 91880 - DNA, 25 bp, Homo sapien
tagctccttccagtgaaaagtgtag

SEQ ID NO: 91881 - DNA, 25 bp, Homo sapien
tagctccttccagtgagaagtgtag

SEQ ID NO: 91882 - DNA, 25 bp, Homo sapien
tagctctgaacagagagtgacatga

SEQ ID NO: 91883 - DNA, 25 bp, Homo sapien
tagctctgaacggagagtgacatga

SEQ ID NO: 91884 - DNA, 25 bp, Homo sapien
tagctctgtctctatcatctctatc

SEQ ID NO: 91885 - DNA, 25 bp, Homo sapien
tagctctgtctttatcatctctatc

SEQ ID NO: 91886 - DNA, 25 bp, Homo sapien
tagctcttcttcattagaactgttc

SEQ ID NO: 91887 - DNA, 25 bp, Homo sapien
tagctcttcttcgttagaactgttc

SEQ ID NO: 91888 - DNA, 25 bp, Homo sapien
tagctcttggcacacaaaaatagtt

SEQ ID NO: 91889 - DNA, 25 bp, Homo sapien
tagctcttggcacacagaaatagtt

SEQ ID NO: 91890 - DNA, 25 bp, Homo sapien
tagctgaaaccaccatatagagaaa

SEQ ID NO: 91891 - DNA, 25 bp, Homo sapien
tagctgaatccaccatatagagaaa

SEQ ID NO: 91892 - DNA, 25 bp, Homo sapien
tagctgacatttgattctcctctaa

SEQ ID NO: 91893 - DNA, 25 bp, Homo sapien
tagctgacattttattctcctctaa

SEQ ID NO: 91894 - DNA, 25 bp, Homo sapien
tagctgaggatcattctgctttatt

SEQ ID NO: 91895 - DNA, 25 bp, Homo sapien
tagctgaggctcattctgctttatt

SEQ ID NO: 91896 - DNA, 25 bp, Homo sapien
tagctgagggaactgaggtccaggg

SEQ ID NO: 91897 - DNA, 25 bp, Homo sapien
tagctgagggaattgaggtccaggg

SEQ ID NO: 91898 - DNA, 25 bp, Homo sapien
tagctgataatgatgatcctaagag

SEQ ID NO: 91899 - DNA, 25 bp, Homo sapien
tagctgataattatgatcctaagag

SEQ ID NO: 91900 - DNA, 25 bp, Homo sapien
tagctgatgtgacgagtggctccct

SEQ ID NO: 91901 - DNA, 25 bp, Homo sapien
tagctgatgtgatgagtggctccct

SEQ ID NO: 91902 - DNA, 25 bp, Homo sapien
tagctgcaaagttacaaattaagga

SEQ ID NO: 91903 - DNA, 25 bp, Homo sapien
tagctgcaaggagtactgaaagctt

SEQ ID NO: 91904 - DNA, 25 bp, Homo sapien
tagctgcaatagaaagtaaagctca

SEQ ID NO: 91905 - DNA, 25 bp, Homo sapien
tagctgcaatgagtactgaaagctt

SEQ ID NO: 91906 - DNA, 25 bp, Homo sapien
tagctgcacggctgaggagattgct

SEQ ID NO: 91907 - DNA, 25 bp, Homo sapien
tagctgcagtagaaagtaaagctca

SEQ ID NO: 91908 - DNA, 25 bp, Homo sapien
tagctgcatagttacaaattaagga

SEQ ID NO: 91909 - DNA, 25 bp, Homo sapien
tagctgcatatataatcctgtgaaa

SEQ ID NO: 91910 - DNA, 25 bp, Homo sapien
tagctgcatatgtaatcctgtgaaa

SEQ ID NO: 91911 - DNA, 25 bp, Homo sapien
tagctgcatggctgaggagattgct

SEQ ID NO: 91912 - DNA, 25 bp, Homo sapien
tagctgcctacagaattagagaact

SEQ ID NO: 91913 - DNA, 25 bp, Homo sapien
tagctgcctacagagttagagaact

SEQ ID NO: 91914 - DNA, 25 bp, Homo sapien
tagctgcttggaaagtcagtcacat

SEQ ID NO: 91915 - DNA, 25 bp, Homo sapien
tagctgcttgggaagtcagtcacat

SEQ ID NO: 91916 - DNA, 25 bp, Homo sapien
tagctggcactgagaatgaagagaa

SEQ ID NO: 91917 - DNA, 25 bp, Homo sapien
tagctggcattgagaatgaagagaa

SEQ ID NO: 91918 - DNA, 25 bp, Homo sapien
tagctggctcagttacgcactttaa

SEQ ID NO: 91919 - DNA, 25 bp, Homo sapien
tagctggctcagttactcactttaa

SEQ ID NO: 91920 - DNA, 25 bp, Homo sapien
tagctggctctccgtaattatctct

SEQ ID NO: 91921 - DNA, 25 bp, Homo sapien
tagctggctctccgtagttatctct

SEQ ID NO: 91922 - DNA, 25 bp, Homo sapien
tagctggctgtctaaagatatgttg

SEQ ID NO: 91923 - DNA, 25 bp, Homo sapien
tagctggctgtctacagatatgttg

SEQ ID NO: 91924 - DNA, 25 bp, Homo sapien
tagctgggctgatctgaatacaatt

SEQ ID NO: 91925 - DNA, 25 bp, Homo sapien
tagctgggctggtctgaatacaatt

SEQ ID NO: 91926 - DNA, 25 bp, Homo sapien
tagctgtgggcctttcatatattgt

SEQ ID NO: 91927 - DNA, 25 bp, Homo sapien
tagctgtgggcctttcgtatattgt

SEQ ID NO: 91928 - DNA, 25 bp, Homo sapien
tagcttacaaccgctatgagggcag

SEQ ID NO: 91929 - DNA, 25 bp, Homo sapien
tagcttacaacctctatgagggcag

SEQ ID NO: 91930 - DNA, 25 bp, Homo sapien
tagcttacaagcaacttaaatatgg

SEQ ID NO: 91931 - DNA, 25 bp, Homo sapien
tagcttaccactctgatacttttaa

SEQ ID NO: 91932 - DNA, 25 bp, Homo sapien
tagcttaccgctctgatacttttaa

SEQ ID NO: 91933 - DNA, 25 bp, Homo sapien
tagcttactagcaacttaaatatgg

SEQ ID NO: 91934 - DNA, 25 bp, Homo sapien
tagcttatctaggaatactgtttac

SEQ ID NO: 91935 - DNA, 25 bp, Homo sapien
tagcttatgatgatgcctagagatt

SEQ ID NO: 91936 - DNA, 25 bp, Homo sapien
tagcttatgatggtgcctagagatt

SEQ ID NO: 91937 - DNA, 25 bp, Homo sapien
tagcttatgtccttggaaatggaaa

SEQ ID NO: 91938 - DNA, 25 bp, Homo sapien
tagcttatgtctttggaaatggaaa

SEQ ID NO: 91939 - DNA, 25 bp, Homo sapien
tagcttatttaggaatactgtttac

SEQ ID NO: 91940 - DNA, 25 bp, Homo sapien
tagcttcaaaaccttacatgaattg

SEQ ID NO: 91941 - DNA, 25 bp, Homo sapien
tagcttcaaaactttacatgaattg

SEQ ID NO: 91942 - DNA, 25 bp, Homo sapien
tagcttcaatgtattcattactggt

SEQ ID NO: 91943 - DNA, 25 bp, Homo sapien
tagcttcactgtattcattactggt

SEQ ID NO: 91944 - DNA, 25 bp, Homo sapien
tagcttcatggcatctggatgcatg

SEQ ID NO: 91945 - DNA, 25 bp, Homo sapien
tagcttcatggtatctggatgcatg

SEQ ID NO: 91946 - DNA, 25 bp, Homo sapien
tagcttccacctttttttgaggtct

SEQ ID NO: 91947 - DNA, 25 bp, Homo sapien
tagcttccatctttttttgaggtct

SEQ ID NO: 91948 - DNA, 25 bp, Homo sapien
tagcttctaggtgtgcctgctgagt

SEQ ID NO: 91949 - DNA, 25 bp, Homo sapien
tagcttctaggtgttcctgctgagt

SEQ ID NO: 91950 - DNA, 25 bp, Homo sapien
tagcttggcggtatgtttgtagtga

SEQ ID NO: 91951 - DNA, 25 bp, Homo sapien
tagcttggtggtatgtttgtagtga

SEQ ID NO: 91952 - DNA, 25 bp, Homo sapien
tagctttcacgacaataaaatggat

SEQ ID NO: 91953 - DNA, 25 bp, Homo sapien
tagctttcatgacaataaaatggat

SEQ ID NO: 91954 - DNA, 25 bp, Homo sapien
tagctttcgaagaagcacagatgtc

SEQ ID NO: 91955 - DNA, 25 bp, Homo sapien
tagctttcgaagaagcgcagatgtc

SEQ ID NO: 91956 - DNA, 25 bp, Homo sapien
tagctttgggaaacaaacaacttgc

SEQ ID NO: 91957 - DNA, 25 bp, Homo sapien
tagctttgggaaacaaccaacttgc

SEQ ID NO: 91958 - DNA, 25 bp, Homo sapien
tagctttgggtcctctatagcactt

SEQ ID NO: 91959 - DNA, 25 bp, Homo sapien
tagctttgggtcctctgtagcactt

SEQ ID NO: 91960 - DNA, 25 bp, Homo sapien
tagctttgtaacaatttaggcgcta

SEQ ID NO: 91961 - DNA, 25 bp, Homo sapien
tagctttgtaacgatttaggcgcta

SEQ ID NO: 91962 - DNA, 25 bp, Homo sapien
taggaaaaaaagcaacggtaatgag

SEQ ID NO: 91963 - DNA, 25 bp, Homo sapien
taggaaaaaaagcaactgtaatgag

SEQ ID NO: 91964 - DNA, 25 bp, Homo sapien
taggaaaacatgatctgatcctaga

SEQ ID NO: 91965 - DNA, 25 bp, Homo sapien
taggaaaacatgatttgatcctaga

SEQ ID NO: 91966 - DNA, 25 bp, Homo sapien
taggaaaagcaactccattacatag

SEQ ID NO: 91967 - DNA, 25 bp, Homo sapien
taggaaaagcaagtccattacatag

SEQ ID NO: 91968 - DNA, 25 bp, Homo sapien
taggaaaatgtcatattgaatcaag

SEQ ID NO: 91969 - DNA, 25 bp, Homo sapien
taggaaaatgtcctattgaatcaag

SEQ ID NO: 91970 - DNA, 25 bp, Homo sapien
taggaaagctgcaaaggcaaattga

SEQ ID NO: 91971 - DNA, 25 bp, Homo sapien
taggaaagctgcaatggcaaattga

SEQ ID NO: 91972 - DNA, 25 bp, Homo sapien
taggaaagttgccatgactccacac

SEQ ID NO: 91973 - DNA, 25 bp, Homo sapien
taggaaagttgccgtgactccacac

SEQ ID NO: 91974 - DNA, 25 bp, Homo sapien
taggaaatagcacggtgagtaagaa

SEQ ID NO: 91975 - DNA, 25 bp, Homo sapien
taggaaatagcatggtgagtaagaa

SEQ ID NO: 91976 - DNA, 25 bp, Homo sapien
taggaaccgatctctcatccccaac

SEQ ID NO: 91977 - DNA, 25 bp, Homo sapien
taggaaccgatctgtcatccccaac

SEQ ID NO: 91978 - DNA, 25 bp, Homo sapien
taggaactatagtagatactgacta

SEQ ID NO: 91979 - DNA, 25 bp, Homo sapien
taggaactccagctgctgctgtgtg

SEQ ID NO: 91980 - DNA, 25 bp, Homo sapien
taggaactctagctgctgctgtgtg

SEQ ID NO: 91981 - DNA, 25 bp, Homo sapien
taggaactgaatcctgagttctaac

SEQ ID NO: 91982 - DNA, 25 bp, Homo sapien
taggaactgaatcttgagttctaac

SEQ ID NO: 91983 - DNA, 25 bp, Homo sapien
taggaactggaattcttagactgaa

SEQ ID NO: 91984 - DNA, 25 bp, Homo sapien
taggaactggaatttttagactgaa

SEQ ID NO: 91985 - DNA, 25 bp, Homo sapien
taggaactgtagtagatactgacta

SEQ ID NO: 91986 - DNA, 25 bp, Homo sapien
taggaacttagactctagttaggga

SEQ ID NO: 91987 - DNA, 25 bp, Homo sapien
taggaacttagagtctagttaggga

SEQ ID NO: 91988 - DNA, 25 bp, Homo sapien
taggaacttgttaaattgttgtgat

SEQ ID NO: 91989 - DNA, 25 bp, Homo sapien
taggaacttgttaatttgttgtgat

SEQ ID NO: 91990 - DNA, 25 bp, Homo sapien
taggaagaccgcactttgcaatcac

SEQ ID NO: 91991 - DNA, 25 bp, Homo sapien
taggaagactgcactttgcaatcac

SEQ ID NO: 91992 - DNA, 25 bp, Homo sapien
taggaagagcctactgaggtctgga

SEQ ID NO: 91993 - DNA, 25 bp, Homo sapien
taggaagagtctactgaggtctgga

SEQ ID NO: 91994 - DNA, 25 bp, Homo sapien
taggaagcacagcgtatcccaaaca

SEQ ID NO: 91995 - DNA, 25 bp, Homo sapien
taggaagcacagtgtatcccaaaca

SEQ ID NO: 91996 - DNA, 25 bp, Homo sapien
taggaatcttctcgctgaggttagt

SEQ ID NO: 91997 - DNA, 25 bp, Homo sapien
taggaatcttcttgctgaggttagt

SEQ ID NO: 91998 - DNA, 25 bp, Homo sapien
taggaatgtaaacactatatgcctg

SEQ ID NO: 91999 - DNA, 25 bp, Homo sapien
taggaatgtaaacagtatatgcctg

SEQ ID NO: 92000 - DNA, 25 bp, Homo sapien
taggaatttgtcatttaaagatcct

SEQ ID NO: 92001 - DNA, 25 bp, Homo sapien
taggaatttgtcgtttaaagatcct

SEQ ID NO: 92002 - DNA, 25 bp, Homo sapien
taggacacagtctgaaggggaatta

SEQ ID NO: 92003 - DNA, 25 bp, Homo sapien
taggacacagtctgaatgggaatta

SEQ ID NO: 92004 - DNA, 25 bp, Homo sapien
taggacatcagaaaaagactagacc

SEQ ID NO: 92005 - DNA, 25 bp, Homo sapien
taggacatcagaaaaatactagacc

SEQ ID NO: 92006 - DNA, 25 bp, Homo sapien
taggactacagtttcttgatgtatc

SEQ ID NO: 92007 - DNA, 25 bp, Homo sapien
taggactatagtttcttgatgtatc

SEQ ID NO: 92008 - DNA, 25 bp, Homo sapien
taggactcatttatctatttatata

SEQ ID NO: 92009 - DNA, 25 bp, Homo sapien
taggactcatttgtctatttatata

SEQ ID NO: 92010 - DNA, 25 bp, Homo sapien
taggacttaatcatccagcagtgtc

SEQ ID NO: 92011 - DNA, 25 bp, Homo sapien
taggacttaatcgtccagcagtgtc

SEQ ID NO: 92012 - DNA, 25 bp, Homo sapien
taggagaaaaggcaaatttattgct

SEQ ID NO: 92013 - DNA, 25 bp, Homo sapien
taggagaaagggcaaatttattgct

SEQ ID NO: 92014 - DNA, 25 bp, Homo sapien
taggagacatcacaggaggaaaacg

SEQ ID NO: 92015 - DNA, 25 bp, Homo sapien
taggagacatctcaggaggaaaacg

SEQ ID NO: 92016 - DNA, 25 bp, Homo sapien
taggagagccactatgtaggtgagg

SEQ ID NO: 92017 - DNA, 25 bp, Homo sapien
taggagagccattatgtaggtgagg

SEQ ID NO: 92018 - DNA, 25 bp, Homo sapien
taggagagttttcaacagagtagtg

SEQ ID NO: 92019 - DNA, 25 bp, Homo sapien
taggagagttttcatcagagtagtg

SEQ ID NO: 92020 - DNA, 25 bp, Homo sapien
taggagatcactataggcaaagctt

SEQ ID NO: 92021 - DNA, 25 bp, Homo sapien
taggagatgactataggcaaagctt

SEQ ID NO: 92022 - DNA, 25 bp, Homo sapien
taggagcacggaggccaagttagct

SEQ ID NO: 92023 - DNA, 25 bp, Homo sapien
taggagcatggaggccaagttagct

SEQ ID NO: 92024 - DNA, 25 bp, Homo sapien
taggagcttgatacagggccagggc

SEQ ID NO: 92025 - DNA, 25 bp, Homo sapien
taggagcttgatacggggccagggc

SEQ ID NO: 92026 - DNA, 25 bp, Homo sapien
taggagctttgtgatccgcttggct

SEQ ID NO: 92027 - DNA, 25 bp, Homo sapien
taggagctttgtgatctgcttggct

SEQ ID NO: 92028 - DNA, 25 bp, Homo sapien
taggaggaacgagctggaaataaat

SEQ ID NO: 92029 - DNA, 25 bp, Homo sapien
taggaggaatgagctggaaataaat

SEQ ID NO: 92030 - DNA, 25 bp, Homo sapien
taggagtaagttctgagcatgcagt

SEQ ID NO: 92031 - DNA, 25 bp, Homo sapien
taggagtaattaatcactcccgcca

SEQ ID NO: 92032 - DNA, 25 bp, Homo sapien
taggagtaattaatcattcccgcca

SEQ ID NO: 92033 - DNA, 25 bp, Homo sapien
taggagtaggttctgagcatgcagt

SEQ ID NO: 92034 - DNA, 25 bp, Homo sapien
taggagtatattccggtaacaaaga

SEQ ID NO: 92035 - DNA, 25 bp, Homo sapien
taggagtatattctggtaacaaaga

SEQ ID NO: 92036 - DNA, 25 bp, Homo sapien
taggagtggacttacagcgcaatcg

SEQ ID NO: 92037 - DNA, 25 bp, Homo sapien
taggagtggacttatagcgcaatcg

SEQ ID NO: 92038 - DNA, 25 bp, Homo sapien
taggataaaaatacacacatgaaga

SEQ ID NO: 92039 - DNA, 25 bp, Homo sapien
taggataaaaatatacacatgaaga

SEQ ID NO: 92040 - DNA, 25 bp, Homo sapien
taggatacaacaagaaggatccacg

SEQ ID NO: 92041 - DNA, 25 bp, Homo sapien
taggatacagtatcatggctagtgc

SEQ ID NO: 92042 - DNA, 25 bp, Homo sapien
taggatacagtatcgtggctagtgc

SEQ ID NO: 92043 - DNA, 25 bp, Homo sapien
taggataccacaagaaggatccacg

SEQ ID NO: 92044 - DNA, 25 bp, Homo sapien
taggatcacaaccagtgaaactatc

SEQ ID NO: 92045 - DNA, 25 bp, Homo sapien
taggatcacaactagtgaaactatc

SEQ ID NO: 92046 - DNA, 25 bp, Homo sapien
taggatcattggatttccatggttt

SEQ ID NO: 92047 - DNA, 25 bp, Homo sapien
taggatcattggattttcatggttt

SEQ ID NO: 92048 - DNA, 25 bp, Homo sapien
taggatctaacctcttcctacaagg

SEQ ID NO: 92049 - DNA, 25 bp, Homo sapien
taggatctagcctcttcctacaagg

SEQ ID NO: 92050 - DNA, 25 bp, Homo sapien
taggatctctacagaaagtggtgct

SEQ ID NO: 92051 - DNA, 25 bp, Homo sapien
taggatctctatagaaagtggtgct

SEQ ID NO: 92052 - DNA, 25 bp, Homo sapien
taggatgcctgcagttgtcaaggcc

SEQ ID NO: 92053 - DNA, 25 bp, Homo sapien
taggatgcctgcggttgtcaaggcc

SEQ ID NO: 92054 - DNA, 25 bp, Homo sapien
taggatgctaggtcagcgatcagca

SEQ ID NO: 92055 - DNA, 25 bp, Homo sapien
taggatgctaggtcagtgatcagca

SEQ ID NO: 92056 - DNA, 25 bp, Homo sapien
taggatggccaaacgcagcagacag

SEQ ID NO: 92057 - DNA, 25 bp, Homo sapien
taggatggccaaactcagcagacag

SEQ ID NO: 92058 - DNA, 25 bp, Homo sapien
taggatgtcatgacacttggtctgt

SEQ ID NO: 92059 - DNA, 25 bp, Homo sapien
taggatgtcatgacccttggtctgt

SEQ ID NO: 92060 - DNA, 25 bp, Homo sapien
taggatgtccattactaaaacaaag

SEQ ID NO: 92061 - DNA, 25 bp, Homo sapien
taggatgtccattactcaaacaaag

SEQ ID NO: 92062 - DNA, 25 bp, Homo sapien
taggatgtcttcatttaattcactg

SEQ ID NO: 92063 - DNA, 25 bp, Homo sapien
taggatgtcttcgtttaattcactg

SEQ ID NO: 92064 - DNA, 25 bp, Homo sapien
taggatgtcttggccaaccacagca

SEQ ID NO: 92065 - DNA, 25 bp, Homo sapien
taggatgtcttggccagccacagca

SEQ ID NO: 92066 - DNA, 25 bp, Homo sapien
taggattttcatacatccctctgca

SEQ ID NO: 92067 - DNA, 25 bp, Homo sapien
taggatttttatacatccctctgca

SEQ ID NO: 92068 - DNA, 25 bp, Homo sapien
taggcaaatgcacctctcgaatcct

SEQ ID NO: 92069 - DNA, 25 bp, Homo sapien
taggcaaatgcatctctcgaatcct

SEQ ID NO: 92070 - DNA, 25 bp, Homo sapien
taggcaagattttgatgaccaggta

SEQ ID NO: 92071 - DNA, 25 bp, Homo sapien
taggcaagattttggtgaccaggta

SEQ ID NO: 92072 - DNA, 25 bp, Homo sapien
taggcaagcacagaatgcccatgtt

SEQ ID NO: 92073 - DNA, 25 bp, Homo sapien
taggcaagcacggaatgcccatgtt

SEQ ID NO: 92074 - DNA, 25 bp, Homo sapien
taggcaagtctgatatttggttatg

SEQ ID NO: 92075 - DNA, 25 bp, Homo sapien
taggcaagtctgatctttggttatg

SEQ ID NO: 92076 - DNA, 25 bp, Homo sapien
taggcaatggtatgaaagttggctt

SEQ ID NO: 92077 - DNA, 25 bp, Homo sapien
taggcaatggtgtgaaagttggctt

SEQ ID NO: 92078 - DNA, 25 bp, Homo sapien
taggcagactcagaactacttttta

SEQ ID NO: 92079 - DNA, 25 bp, Homo sapien
taggcagagtcagaactacttttta

SEQ ID NO: 92080 - DNA, 25 bp, Homo sapien
taggcaggaaaatagataacattac

SEQ ID NO: 92081 - DNA, 25 bp, Homo sapien
taggcaggaaaatcgataacattac

SEQ ID NO: 92082 - DNA, 25 bp, Homo sapien
taggcaggctatcccaagaaaaagc

SEQ ID NO: 92083 - DNA, 25 bp, Homo sapien
taggcaggctggaaagtcagatgat

SEQ ID NO: 92084 - DNA, 25 bp, Homo sapien
taggcaggctgggaagtcagatgat

SEQ ID NO: 92085 - DNA, 25 bp, Homo sapien
taggcaggttatcccaagaaaaagc

SEQ ID NO: 92086 - DNA, 25 bp, Homo sapien
taggcagttgatttaaaaaaaaact

SEQ ID NO: 92087 - DNA, 25 bp, Homo sapien
taggcagttgattttaaaaaaaact

SEQ ID NO: 92088 - DNA, 25 bp, Homo sapien
taggcattaggactttaaaaaataa

SEQ ID NO: 92089 - DNA, 25 bp, Homo sapien
taggcattcgttcttatcaggttta

SEQ ID NO: 92090 - DNA, 25 bp, Homo sapien
taggcattgggactttaaaaaataa

SEQ ID NO: 92091 - DNA, 25 bp, Homo sapien
taggcatttgttcttatcaggttta

SEQ ID NO: 92092 - DNA, 25 bp, Homo sapien
taggccaacatgagtgcactgatgc

SEQ ID NO: 92093 - DNA, 25 bp, Homo sapien
taggccaacatgcgtgcactgatgc

SEQ ID NO: 92094 - DNA, 25 bp, Homo sapien
taggccatgagtaaggcgacttgac

SEQ ID NO: 92095 - DNA, 25 bp, Homo sapien
taggccatgagtaaggtgacttgac

SEQ ID NO: 92096 - DNA, 25 bp, Homo sapien
taggccctgaagaggcaaagacacc

SEQ ID NO: 92097 - DNA, 25 bp, Homo sapien
taggccctggagaggcaaagacacc

SEQ ID NO: 92098 - DNA, 25 bp, Homo sapien
taggccctgttgatggctgtggaag

SEQ ID NO: 92099 - DNA, 25 bp, Homo sapien
taggccctgttgattgctgtggaag

SEQ ID NO: 92100 - DNA, 25 bp, Homo sapien
taggcctgctactagttccaattct

SEQ ID NO: 92101 - DNA, 25 bp, Homo sapien
taggcctgctattagttccaattct

SEQ ID NO: 92102 - DNA, 25 bp, Homo sapien
taggcctggtaacgttcaccacaag

SEQ ID NO: 92103 - DNA, 25 bp, Homo sapien
taggcctggtaatgttcaccacaag

SEQ ID NO: 92104 - DNA, 25 bp, Homo sapien
taggccttgataaatactgacaaat

SEQ ID NO: 92105 - DNA, 25 bp, Homo sapien
taggccttgataaatattgacaaat

SEQ ID NO: 92106 - DNA, 25 bp, Homo sapien
taggctaatctaagtcagccatctg

SEQ ID NO: 92107 - DNA, 25 bp, Homo sapien
taggctaatctatgtcagccatctg

SEQ ID NO: 92108 - DNA, 25 bp, Homo sapien
taggctacatggaagatggaattaa

SEQ ID NO: 92109 - DNA, 25 bp, Homo sapien
taggctacatggcagatggaattaa

SEQ ID NO: 92110 - DNA, 25 bp, Homo sapien
taggctaggaactatagtagatact

SEQ ID NO: 92111 - DNA, 25 bp, Homo sapien
taggctaggaactgtagtagatact

SEQ ID NO: 92112 - DNA, 25 bp, Homo sapien
taggctatcagttgcccaatagcca

SEQ ID NO: 92113 - DNA, 25 bp, Homo sapien
taggctatccgttgcccaatagcca

SEQ ID NO: 92114 - DNA, 25 bp, Homo sapien
taggctatgcatttaaatctctctg

SEQ ID NO: 92115 - DNA, 25 bp, Homo sapien
taggctattcatttaaatctctctg

SEQ ID NO: 92116 - DNA, 25 bp, Homo sapien
taggctatttacataaaactttagt

SEQ ID NO: 92117 - DNA, 25 bp, Homo sapien
taggctatttacgtaaaactttagt

SEQ ID NO: 92118 - DNA, 25 bp, Homo sapien
taggctccatgaaagggcatccaga

SEQ ID NO: 92119 - DNA, 25 bp, Homo sapien
taggctccttgaaagggcatccaga

SEQ ID NO: 92120 - DNA, 25 bp, Homo sapien
taggctctatccctctcatttttca

SEQ ID NO: 92121 - DNA, 25 bp, Homo sapien
taggctctatccctcttatttttca

SEQ ID NO: 92122 - DNA, 25 bp, Homo sapien
taggctcttctgtcataatttggac

SEQ ID NO: 92123 - DNA, 25 bp, Homo sapien
taggctcttctgtcatgatttggac

SEQ ID NO: 92124 - DNA, 25 bp, Homo sapien
taggctggagaagacacagggagga

SEQ ID NO: 92125 - DNA, 25 bp, Homo sapien
taggctggagaagatacagggagga

SEQ ID NO: 92126 - DNA, 25 bp, Homo sapien
taggctggtggcaactctggctccc

SEQ ID NO: 92127 - DNA, 25 bp, Homo sapien
taggctggtggcaattctggctccc

SEQ ID NO: 92128 - DNA, 25 bp, Homo sapien
taggctgtgcacattactccagaac

SEQ ID NO: 92129 - DNA, 25 bp, Homo sapien
taggctgtgcacattattccagaac

SEQ ID NO: 92130 - DNA, 25 bp, Homo sapien
taggcttagcaatctgcagtttcac

SEQ ID NO: 92131 - DNA, 25 bp, Homo sapien
taggcttagcaatctgtagtttcac

SEQ ID NO: 92132 - DNA, 25 bp, Homo sapien
taggcttattcagcggcagcccagg

SEQ ID NO: 92133 - DNA, 25 bp, Homo sapien
taggcttattcagtggcagcccagg

SEQ ID NO: 92134 - DNA, 25 bp, Homo sapien
taggcttgctcgctcgctctctctc

SEQ ID NO: 92135 - DNA, 25 bp, Homo sapien
taggcttgctcgctggctctctctc

SEQ ID NO: 92136 - DNA, 25 bp, Homo sapien
taggcttgctgctgctgcgtggggt

SEQ ID NO: 92137 - DNA, 25 bp, Homo sapien
taggcttgttgctgctgcgtggggt

SEQ ID NO: 92138 - DNA, 25 bp, Homo sapien
taggctttaaaaagattcaaccaaa

SEQ ID NO: 92139 - DNA, 25 bp, Homo sapien
taggctttaaacagattcaaccaaa

SEQ ID NO: 92140 - DNA, 25 bp, Homo sapien
taggctttatccaggagatgtaagg

SEQ ID NO: 92141 - DNA, 25 bp, Homo sapien
taggctttatccatgagatgtaagg

SEQ ID NO: 92142 - DNA, 25 bp, Homo sapien
taggctttttgaaatgctaaataaa

SEQ ID NO: 92143 - DNA, 25 bp, Homo sapien
taggctttttgaaatggtaaataaa

SEQ ID NO: 92144 - DNA, 25 bp, Homo sapien
tagggaaaccacatttacccacagg

SEQ ID NO: 92145 - DNA, 25 bp, Homo sapien
tagggaaatcacatttacccacagg

SEQ ID NO: 92146 - DNA, 25 bp, Homo sapien
tagggaactatgtaaattgattgtg

SEQ ID NO: 92147 - DNA, 25 bp, Homo sapien
tagggaactatttaaattgattgtg

SEQ ID NO: 92148 - DNA, 25 bp, Homo sapien
tagggaagtgccttaaagttggact

SEQ ID NO: 92149 - DNA, 25 bp, Homo sapien
tagggaagtgccttgaagttggact

SEQ ID NO: 92150 - DNA, 25 bp, Homo sapien
tagggagaaaggccatatacacact

SEQ ID NO: 92151 - DNA, 25 bp, Homo sapien
tagggagaaaggtcatatacacact

SEQ ID NO: 92152 - DNA, 25 bp, Homo sapien
tagggagcgtatcctgggttattca

SEQ ID NO: 92153 - DNA, 25 bp, Homo sapien
tagggagcgtatcgtgggttattca

SEQ ID NO: 92154 - DNA, 25 bp, Homo sapien
tagggaggcacacccattccacatt

SEQ ID NO: 92155 - DNA, 25 bp, Homo sapien
tagggaggcacactcattccacatt

SEQ ID NO: 92156 - DNA, 25 bp, Homo sapien
tagggataaatcagttcagatctaa

SEQ ID NO: 92157 - DNA, 25 bp, Homo sapien
tagggataaatcagtttagatctaa

SEQ ID NO: 92158 - DNA, 25 bp, Homo sapien
tagggatacagtggattaatgcctt

SEQ ID NO: 92159 - DNA, 25 bp, Homo sapien
tagggatatagtggattaatgcctt

SEQ ID NO: 92160 - DNA, 25 bp, Homo sapien
tagggatctttagccttgaaaactg

SEQ ID NO: 92161 - DNA, 25 bp, Homo sapien
tagggatctttagctttgaaaactg

SEQ ID NO: 92162 - DNA, 25 bp, Homo sapien
tagggatgctcacagtaatggaaag

SEQ ID NO: 92163 - DNA, 25 bp, Homo sapien
tagggatgttcacagtaatggaaag

SEQ ID NO: 92164 - DNA, 25 bp, Homo sapien
tagggattcctctaacagatctggg

SEQ ID NO: 92165 - DNA, 25 bp, Homo sapien
tagggattcctgtaacagatctggg

SEQ ID NO: 92166 - DNA, 25 bp, Homo sapien
tagggcaaacgattatgagattgat

SEQ ID NO: 92167 - DNA, 25 bp, Homo sapien
tagggcaaacgattttgagattgat

SEQ ID NO: 92168 - DNA, 25 bp, Homo sapien
tagggcaggactctgtacttcaggg

SEQ ID NO: 92169 - DNA, 25 bp, Homo sapien
tagggcaggactgtgtacttcaggg

SEQ ID NO: 92170 - DNA, 25 bp, Homo sapien
tagggcatgctgatgagctgagatg

SEQ ID NO: 92171 - DNA, 25 bp, Homo sapien
tagggcatgctgttgagctgagatg

SEQ ID NO: 92172 - DNA, 25 bp, Homo sapien
tagggcattagacagattacccaca

SEQ ID NO: 92173 - DNA, 25 bp, Homo sapien
tagggcattagatagattacccaca

SEQ ID NO: 92174 - DNA, 25 bp, Homo sapien
tagggcctggtatacctattttgaa

SEQ ID NO: 92175 - DNA, 25 bp, Homo sapien
tagggcctggtatccctattttgaa

SEQ ID NO: 92176 - DNA, 25 bp, Homo sapien
tagggccttgtacgcctgagctctt

SEQ ID NO: 92177 - DNA, 25 bp, Homo sapien
tagggccttgtatgcctgagctctt

SEQ ID NO: 92178 - DNA, 25 bp, Homo sapien
tagggctcatcctcatattttctgt

SEQ ID NO: 92179 - DNA, 25 bp, Homo sapien
tagggctcatcctcgtattttctgt

SEQ ID NO: 92180 - DNA, 25 bp, Homo sapien
tagggctgtctgtaatgtctctcct

SEQ ID NO: 92181 - DNA, 25 bp, Homo sapien
tagggctgtttgtaatgtctctcct

SEQ ID NO: 92182 - DNA, 25 bp, Homo sapien
tagggcttagtgatatatttccacc

SEQ ID NO: 92183 - DNA, 25 bp, Homo sapien
tagggcttagtgatatctttccacc

SEQ ID NO: 92184 - DNA, 25 bp, Homo sapien
taggggaaagtctatgggatcaaag

SEQ ID NO: 92185 - DNA, 25 bp, Homo sapien
taggggaaagtctgtgggatcaaag

SEQ ID NO: 92186 - DNA, 25 bp, Homo sapien
taggggcagaagcaatgatcttcca

SEQ ID NO: 92187 - DNA, 25 bp, Homo sapien
taggggcagaaggaatgatcttcca

SEQ ID NO: 92188 - DNA, 25 bp, Homo sapien
taggggtcttaaacttgctaggata

SEQ ID NO: 92189 - DNA, 25 bp, Homo sapien
taggggtcttaagcttgctaggata

SEQ ID NO: 92190 - DNA, 25 bp, Homo sapien
tagggtaaatgctacttaactggta

SEQ ID NO: 92191 - DNA, 25 bp, Homo sapien
tagggtaaatgcttcttaactggta

SEQ ID NO: 92192 - DNA, 25 bp, Homo sapien
tagggtaccagtcagagtcatgagg

SEQ ID NO: 92193 - DNA, 25 bp, Homo sapien
tagggtaccagtccgagtcatgagg

SEQ ID NO: 92194 - DNA, 25 bp, Homo sapien
tagggtagacctgacagcaactgga

SEQ ID NO: 92195 - DNA, 25 bp, Homo sapien
tagggtagacctgatagcaactgga

SEQ ID NO: 92196 - DNA, 25 bp, Homo sapien
tagggtagcacatggcacacagcat

SEQ ID NO: 92197 - DNA, 25 bp, Homo sapien
tagggtagcacgtggcacacagcat

SEQ ID NO: 92198 - DNA, 25 bp, Homo sapien
tagggtatacacagtagcattgctt

SEQ ID NO: 92199 - DNA, 25 bp, Homo sapien
tagggtatagttcttgctcttatgg

SEQ ID NO: 92200 - DNA, 25 bp, Homo sapien
tagggtatatacagtagcattgctt

SEQ ID NO: 92201 - DNA, 25 bp, Homo sapien
tagggtatggttcttgctcttatgg

SEQ ID NO: 92202 - DNA, 25 bp, Homo sapien
tagggtcatcacacactagtcattc

SEQ ID NO: 92203 - DNA, 25 bp, Homo sapien
tagggtcatcacatactagtcattc

SEQ ID NO: 92204 - DNA, 25 bp, Homo sapien
tagggtggccaacttgtcccagttt

SEQ ID NO: 92205 - DNA, 25 bp, Homo sapien
tagggtggccaatttgtcccagttt

SEQ ID NO: 92206 - DNA, 25 bp, Homo sapien
tagggtgggtgtccaaactggtggt

SEQ ID NO: 92207 - DNA, 25 bp, Homo sapien
tagggtgggtgtccgaactggtggt

SEQ ID NO: 92208 - DNA, 25 bp, Homo sapien
tagggtgtaattgtcacatcactga

SEQ ID NO: 92209 - DNA, 25 bp, Homo sapien
tagggtgtacttgtcacatcactga

SEQ ID NO: 92210 - DNA, 25 bp, Homo sapien
taggtaaaaatacaattaggcagaa

SEQ ID NO: 92211 - DNA, 25 bp, Homo sapien
taggtaaaaatacagttaggcagaa

SEQ ID NO: 92212 - DNA, 25 bp, Homo sapien
taggtaaaagactttgtactgtgga

SEQ ID NO: 92213 - DNA, 25 bp, Homo sapien
taggtaaaatactttgtactgtgga

SEQ ID NO: 92214 - DNA, 25 bp, Homo sapien
taggtaaagggacatactaatttgt

SEQ ID NO: 92215 - DNA, 25 bp, Homo sapien
taggtaaatggacatactaatttgt

SEQ ID NO: 92216 - DNA, 25 bp, Homo sapien
taggtaacattcactgactctacac

SEQ ID NO: 92217 - DNA, 25 bp, Homo sapien
taggtaacattcactggctctacac

SEQ ID NO: 92218 - DNA, 25 bp, Homo sapien
taggtactattaattatccacttta

SEQ ID NO: 92219 - DNA, 25 bp, Homo sapien
taggtactattatttatccacttta

SEQ ID NO: 92220 - DNA, 25 bp, Homo sapien
taggtaggaaacctgccgggcacct

SEQ ID NO: 92221 - DNA, 25 bp, Homo sapien
taggtaggaaatctgccgggcacct

SEQ ID NO: 92222 - DNA, 25 bp, Homo sapien
taggtaggtgtactggaatgctccc

SEQ ID NO: 92223 - DNA, 25 bp, Homo sapien
taggtaggtgtgctggaatgctccc

SEQ ID NO: 92224 - DNA, 25 bp, Homo sapien
taggtagttaagagaaagtcaggca

SEQ ID NO: 92225 - DNA, 25 bp, Homo sapien
taggtagttaagggaaagtcaggca

SEQ ID NO: 92226 - DNA, 25 bp, Homo sapien
taggtatcgtatctctgaatgccgc

SEQ ID NO: 92227 - DNA, 25 bp, Homo sapien
taggtatcgtatctgtgaatgccgc

SEQ ID NO: 92228 - DNA, 25 bp, Homo sapien
taggtatcttaagtaagtgaagcag

SEQ ID NO: 92229 - DNA, 25 bp, Homo sapien
taggtatcttaagtgagtgaagcag

SEQ ID NO: 92230 - DNA, 25 bp, Homo sapien
taggtatgacaacagagacaaaggg

SEQ ID NO: 92231 - DNA, 25 bp, Homo sapien
taggtatgataacagagacaaaggg

SEQ ID NO: 92232 - DNA, 25 bp, Homo sapien
taggtattacggtggaagaatgtgc

SEQ ID NO: 92233 - DNA, 25 bp, Homo sapien
taggtattatggtggaagaatgtgc

SEQ ID NO: 92234 - DNA, 25 bp, Homo sapien
taggtcaagcaatattatcctcttt

SEQ ID NO: 92235 - DNA, 25 bp, Homo sapien
taggtcaagcaatgttatcctcttt

SEQ ID NO: 92236 - DNA, 25 bp, Homo sapien
taggtcaccgggtgcagaaccagtc

SEQ ID NO: 92237 - DNA, 25 bp, Homo sapien
taggtcactgggtgcagaaccagtc

SEQ ID NO: 92238 - DNA, 25 bp, Homo sapien
taggtcagcgatcagcaccaaatag

SEQ ID NO: 92239 - DNA, 25 bp, Homo sapien
taggtcagtgatcagcaccaaatag

SEQ ID NO: 92240 - DNA, 25 bp, Homo sapien
taggtcagtttatggcatactggag

SEQ ID NO: 92241 - DNA, 25 bp, Homo sapien
taggtcagtttatgtcatactggag

SEQ ID NO: 92242 - DNA, 25 bp, Homo sapien
taggtcatagtcatttgcttcaggt

SEQ ID NO: 92243 - DNA, 25 bp, Homo sapien
taggtcatagtgatttgcttcaggt

SEQ ID NO: 92244 - DNA, 25 bp, Homo sapien
taggtctgcagtagaggctgtgcat

SEQ ID NO: 92245 - DNA, 25 bp, Homo sapien
taggtctgcggtagaggctgtgcat

SEQ ID NO: 92246 - DNA, 25 bp, Homo sapien
taggtctgttctttctctattgttt

SEQ ID NO: 92247 - DNA, 25 bp, Homo sapien
taggtctgttctttctttattgttt

SEQ ID NO: 92248 - DNA, 25 bp, Homo sapien
taggtcttcaagacacagtcatcat

SEQ ID NO: 92249 - DNA, 25 bp, Homo sapien
taggtcttcaagacacggtcatcat

SEQ ID NO: 92250 - DNA, 25 bp, Homo sapien
taggtctttcgtaccaaacattcta

SEQ ID NO: 92251 - DNA, 25 bp, Homo sapien
taggtctttggtaccaaacattcta

SEQ ID NO: 92252 - DNA, 25 bp, Homo sapien
taggtgaaaaaaacagcttataggc

SEQ ID NO: 92253 - DNA, 25 bp, Homo sapien
taggtgaaaaaagcagcttataggc

SEQ ID NO: 92254 - DNA, 25 bp, Homo sapien
taggtgaaaagatttgcctgagtga

SEQ ID NO: 92255 - DNA, 25 bp, Homo sapien
taggtgaaagacgggagttcaggca

SEQ ID NO: 92256 - DNA, 25 bp, Homo sapien
taggtgaaagatgggagttcaggca

SEQ ID NO: 92257 - DNA, 25 bp, Homo sapien
taggtgaaatgatttgcctgagtga

SEQ ID NO: 92258 - DNA, 25 bp, Homo sapien
taggtgaacaaatacttttcatagt

SEQ ID NO: 92259 - DNA, 25 bp, Homo sapien
taggtgaacaactacttttcatagt

SEQ ID NO: 92260 - DNA, 25 bp, Homo sapien
taggtgacttttcggagaagattag

SEQ ID NO: 92261 - DNA, 25 bp, Homo sapien
taggtgactttttggagaagattag

SEQ ID NO: 92262 - DNA, 25 bp, Homo sapien
taggtgagcttcttcaacttgggcc

SEQ ID NO: 92263 - DNA, 25 bp, Homo sapien
taggtgagcttcttcatcttgggcc

SEQ ID NO: 92264 - DNA, 25 bp, Homo sapien
taggtgcactgatacagaagcaaga

SEQ ID NO: 92265 - DNA, 25 bp, Homo sapien
taggtgcataaaaagaacattcata

SEQ ID NO: 92266 - DNA, 25 bp, Homo sapien
taggtgcataaaaagagcattcata

SEQ ID NO: 92267 - DNA, 25 bp, Homo sapien
taggtgcattgatacagaagcaaga

SEQ ID NO: 92268 - DNA, 25 bp, Homo sapien
taggtgcttacaaacaattttgatt

SEQ ID NO: 92269 - DNA, 25 bp, Homo sapien
taggtgcttacaaataattttgatt

SEQ ID NO: 92270 - DNA, 25 bp, Homo sapien
taggtggaccaacgaagagggtgac

SEQ ID NO: 92271 - DNA, 25 bp, Homo sapien
taggtggaccagcgaagagggtgac

SEQ ID NO: 92272 - DNA, 25 bp, Homo sapien
taggtggactggccttagctggccg

SEQ ID NO: 92273 - DNA, 25 bp, Homo sapien
taggtggactggccttggctggccg

SEQ ID NO: 92274 - DNA, 25 bp, Homo sapien
taggtggtctttaaagcgatttcct

SEQ ID NO: 92275 - DNA, 25 bp, Homo sapien
taggtggtctttaaagtgatttcct

SEQ ID NO: 92276 - DNA, 25 bp, Homo sapien
taggtgtagattaaaactgtgcagc

SEQ ID NO: 92277 - DNA, 25 bp, Homo sapien
taggtgtaggttaaaactgtgcagc

SEQ ID NO: 92278 - DNA, 25 bp, Homo sapien
taggtgttcaaaccaactcctagta

SEQ ID NO: 92279 - DNA, 25 bp, Homo sapien
taggtgttcgaaccaactcctagta

SEQ ID NO: 92280 - DNA, 25 bp, Homo sapien
taggtgttgaataaatgagtcaatc

SEQ ID NO: 92281 - DNA, 25 bp, Homo sapien
taggtgttgaatacttgaagggaac

SEQ ID NO: 92282 - DNA, 25 bp, Homo sapien
taggtgttgaatagttgaagggaac

SEQ ID NO: 92283 - DNA, 25 bp, Homo sapien
taggtgttggataaatgagtcaatc

SEQ ID NO: 92284 - DNA, 25 bp, Homo sapien
taggttaaacaactcaagtatacat

SEQ ID NO: 92285 - DNA, 25 bp, Homo sapien
taggttaagcaactcaagtatacat

SEQ ID NO: 92286 - DNA, 25 bp, Homo sapien
taggttatacaatggaaaacaacaa

SEQ ID NO: 92287 - DNA, 25 bp, Homo sapien
taggttatacagtggaaaacaacaa

SEQ ID NO: 92288 - DNA, 25 bp, Homo sapien
taggttcacaggacgtcaaggctat

SEQ ID NO: 92289 - DNA, 25 bp, Homo sapien
taggttcacaggatgtcaaggctat

SEQ ID NO: 92290 - DNA, 25 bp, Homo sapien
taggttctagtggtacatggaagca

SEQ ID NO: 92291 - DNA, 25 bp, Homo sapien
taggttctggtggtacatggaagca

SEQ ID NO: 92292 - DNA, 25 bp, Homo sapien
taggttcttgccctatatgtgtgac

SEQ ID NO: 92293 - DNA, 25 bp, Homo sapien
taggttcttgccctgtatgtgtgac

SEQ ID NO: 92294 - DNA, 25 bp, Homo sapien
taggttgaccttcagacttattttc

SEQ ID NO: 92295 - DNA, 25 bp, Homo sapien
taggttgaccttcagatttattttc

SEQ ID NO: 92296 - DNA, 25 bp, Homo sapien
taggttgagtcagagattgcttcta

SEQ ID NO: 92297 - DNA, 25 bp, Homo sapien
taggttgagtcagggattgcttcta

SEQ ID NO: 92298 - DNA, 25 bp, Homo sapien
taggttgattgacagaaataagagt

SEQ ID NO: 92299 - DNA, 25 bp, Homo sapien
taggttgattgatagaaataagagt

SEQ ID NO: 92300 - DNA, 25 bp, Homo sapien
taggttgcaagacttttctgtgtac

SEQ ID NO: 92301 - DNA, 25 bp, Homo sapien
taggttgcaagccttttctgtgtac

SEQ ID NO: 92302 - DNA, 25 bp, Homo sapien
taggttgcactgtcctccttggaag

SEQ ID NO: 92303 - DNA, 25 bp, Homo sapien
taggttgcagtgtcctccttggaag

SEQ ID NO: 92304 - DNA, 25 bp, Homo sapien
taggttgcattcggttaattatatt

SEQ ID NO: 92305 - DNA, 25 bp, Homo sapien
taggttgcatttggttaattatatt

SEQ ID NO: 92306 - DNA, 25 bp, Homo sapien
taggttgtaattcgtatcactgcat

SEQ ID NO: 92307 - DNA, 25 bp, Homo sapien
taggttgtaatttgtatcactgcat

SEQ ID NO: 92308 - DNA, 25 bp, Homo sapien
taggttgtctcttcaatctgttggt

SEQ ID NO: 92309 - DNA, 25 bp, Homo sapien
taggttgtctcttgaatctgttggt

SEQ ID NO: 92310 - DNA, 25 bp, Homo sapien
taggtttctattctggatgctaaga

SEQ ID NO: 92311 - DNA, 25 bp, Homo sapien
taggtttctattctggttgctaaga

SEQ ID NO: 92312 - DNA, 25 bp, Homo sapien
taggtttctgaatccataatggcat

SEQ ID NO: 92313 - DNA, 25 bp, Homo sapien
taggtttctgaattcataatggcat

SEQ ID NO: 92314 - DNA, 25 bp, Homo sapien
taggttttcccagccatttccttgg

SEQ ID NO: 92315 - DNA, 25 bp, Homo sapien
taggttttcccagcgatttccttgg

SEQ ID NO: 92316 - DNA, 25 bp, Homo sapien
taggtttttgttacagcagtgcccc

SEQ ID NO: 92317 - DNA, 25 bp, Homo sapien
taggtttttgttagagcagtgcccc

SEQ ID NO: 92318 - DNA, 25 bp, Homo sapien
tagtaaaaaaaatagtgtgtcaaat

SEQ ID NO: 92319 - DNA, 25 bp, Homo sapien
tagtaaaacaaatagtgtgtcaaat

SEQ ID NO: 92320 - DNA, 25 bp, Homo sapien
tagtaaaacattagagcaataaggt

SEQ ID NO: 92321 - DNA, 25 bp, Homo sapien
tagtaaaacattagggcaataaggt

SEQ ID NO: 92322 - DNA, 25 bp, Homo sapien
tagtaaaagactgaatgctgtttct

SEQ ID NO: 92323 - DNA, 25 bp, Homo sapien
tagtaaaatactgaatgctgtttct

SEQ ID NO: 92324 - DNA, 25 bp, Homo sapien
tagtaaagaatacgagtaaacataa

SEQ ID NO: 92325 - DNA, 25 bp, Homo sapien
tagtaaagaatatgagtaaacataa

SEQ ID NO: 92326 - DNA, 25 bp, Homo sapien
tagtaaagtcggagttctttggctt

SEQ ID NO: 92327 - DNA, 25 bp, Homo sapien
tagtaaagttggagttctttggctt

SEQ ID NO: 92328 - DNA, 25 bp, Homo sapien
tagtaaatatcactggttctcccct

SEQ ID NO: 92329 - DNA, 25 bp, Homo sapien
tagtaaatatcattggttctcccct

SEQ ID NO: 92330 - DNA, 25 bp, Homo sapien
tagtaacaagttctgggaattaaga

SEQ ID NO: 92331 - DNA, 25 bp, Homo sapien
tagtaacacttatagtaaacatttt

SEQ ID NO: 92332 - DNA, 25 bp, Homo sapien
tagtaacacttatattaaacatttt

SEQ ID NO: 92333 - DNA, 25 bp, Homo sapien
tagtaacagggctcatttggttgca

SEQ ID NO: 92334 - DNA, 25 bp, Homo sapien
tagtaacagggttcatttggttgca

SEQ ID NO: 92335 - DNA, 25 bp, Homo sapien
tagtaacaggttctgggaattaaga

SEQ ID NO: 92336 - DNA, 25 bp, Homo sapien
tagtaaccattgcattttttgtctt

SEQ ID NO: 92337 - DNA, 25 bp, Homo sapien
tagtaaccgccagccaggtttgagc

SEQ ID NO: 92338 - DNA, 25 bp, Homo sapien
tagtaaccgccagccatgtttgagc

SEQ ID NO: 92339 - DNA, 25 bp, Homo sapien
tagtaaccgttgcattttttgtctt

SEQ ID NO: 92340 - DNA, 25 bp, Homo sapien
tagtaactctctaaagtctctggag

SEQ ID NO: 92341 - DNA, 25 bp, Homo sapien
tagtaactctctgaagtctctggag

SEQ ID NO: 92342 - DNA, 25 bp, Homo sapien
tagtaaggagtgttgaacctgcatt

SEQ ID NO: 92343 - DNA, 25 bp, Homo sapien
tagtaaggagtgttgagcctgcatt

SEQ ID NO: 92344 - DNA, 25 bp, Homo sapien
tagtaagtgacctacactggagtcc

SEQ ID NO: 92345 - DNA, 25 bp, Homo sapien
tagtaagtgacctacattggagtcc

SEQ ID NO: 92346 - DNA, 25 bp, Homo sapien
tagtaagtgctcaaagatatttcct

SEQ ID NO: 92347 - DNA, 25 bp, Homo sapien
tagtaagtgctcagagatatttcct

SEQ ID NO: 92348 - DNA, 25 bp, Homo sapien
tagtaatacataggaaatcctggag

SEQ ID NO: 92349 - DNA, 25 bp, Homo sapien
tagtaatacatgggaaatcctggag

SEQ ID NO: 92350 - DNA, 25 bp, Homo sapien
tagtaataccaacgatggggagtgg

SEQ ID NO: 92351 - DNA, 25 bp, Homo sapien
tagtaataccaatgatggggagtgg

SEQ ID NO: 92352 - DNA, 25 bp, Homo sapien
tagtaataggacagaactatcattc

SEQ ID NO: 92353 - DNA, 25 bp, Homo sapien
tagtaataggacagaagtatcattc

SEQ ID NO: 92354 - DNA, 25 bp, Homo sapien
tagtaatcaattttatgtatatgtt

SEQ ID NO: 92355 - DNA, 25 bp, Homo sapien
tagtaatcacaataatggcagcatt

SEQ ID NO: 92356 - DNA, 25 bp, Homo sapien
tagtaatcacagtaatggcagcatt

SEQ ID NO: 92357 - DNA, 25 bp, Homo sapien
tagtaatcactcactctgctattta

SEQ ID NO: 92358 - DNA, 25 bp, Homo sapien
tagtaatcactctctctgctattta

SEQ ID NO: 92359 - DNA, 25 bp, Homo sapien
tagtaatcatttttatgtatatgtt

SEQ ID NO: 92360 - DNA, 25 bp, Homo sapien
tagtaatctgttacgctctgtatgt

SEQ ID NO: 92361 - DNA, 25 bp, Homo sapien
tagtaatcttttacgctctgtatgt

SEQ ID NO: 92362 - DNA, 25 bp, Homo sapien
tagtaatttagatctcagtaaaaag

SEQ ID NO: 92363 - DNA, 25 bp, Homo sapien
tagtaatttagatctctgtaaaaag

SEQ ID NO: 92364 - DNA, 25 bp, Homo sapien
tagtacaaattttattggcttttct

SEQ ID NO: 92365 - DNA, 25 bp, Homo sapien
tagtacaacttttattggcttttct

SEQ ID NO: 92366 - DNA, 25 bp, Homo sapien
tagtacaagataatgccgctgtgct

SEQ ID NO: 92367 - DNA, 25 bp, Homo sapien
tagtacaagataatgctgctgtgct

SEQ ID NO: 92368 - DNA, 25 bp, Homo sapien
tagtacagctccaaaggtagaatca

SEQ ID NO: 92369 - DNA, 25 bp, Homo sapien
tagtacagctccgaaggtagaatca

SEQ ID NO: 92370 - DNA, 25 bp, Homo sapien
tagtacctcacgcattatgactgtc

SEQ ID NO: 92371 - DNA, 25 bp, Homo sapien
tagtacctcgcgcattatgactgtc

SEQ ID NO: 92372 - DNA, 25 bp, Homo sapien
tagtactgatatattggaacaatta

SEQ ID NO: 92373 - DNA, 25 bp, Homo sapien
tagtactgatatattgtaacaatta

SEQ ID NO: 92374 - DNA, 25 bp, Homo sapien
tagtagacactaagaaaatggagtc

SEQ ID NO: 92375 - DNA, 25 bp, Homo sapien
tagtagacagtaagaaaatggagtc

SEQ ID NO: 92376 - DNA, 25 bp, Homo sapien
tagtagactcgagctgctgtggggg

SEQ ID NO: 92377 - DNA, 25 bp, Homo sapien
tagtagacttgagctgctgtggggg

SEQ ID NO: 92378 - DNA, 25 bp, Homo sapien
tagtagcaaaaacagcagcagctat

SEQ ID NO: 92379 - DNA, 25 bp, Homo sapien
tagtagcaataacagcagcagctat

SEQ ID NO: 92380 - DNA, 25 bp, Homo sapien
tagtagctacggtgaacagtgctac

SEQ ID NO: 92381 - DNA, 25 bp, Homo sapien
tagtagctatggtgaacagtgctac

SEQ ID NO: 92382 - DNA, 25 bp, Homo sapien
tagtaggaataaaaccaaaaaagat

SEQ ID NO: 92383 - DNA, 25 bp, Homo sapien
tagtaggaataaagccaaaaaagat

SEQ ID NO: 92384 - DNA, 25 bp, Homo sapien
tagtagtataaagttcccaggccag

SEQ ID NO: 92385 - DNA, 25 bp, Homo sapien
tagtagtatgaagttcccaggccag

SEQ ID NO: 92386 - DNA, 25 bp, Homo sapien
tagtagtgacgccattaggtcttgg

SEQ ID NO: 92387 - DNA, 25 bp, Homo sapien
tagtagtgatgccattaggtcttgg

SEQ ID NO: 92388 - DNA, 25 bp, Homo sapien
tagtagtggcactctctaaccatta

SEQ ID NO: 92389 - DNA, 25 bp, Homo sapien
tagtagtggcactttctaaccatta

SEQ ID NO: 92390 - DNA, 25 bp, Homo sapien
tagtagtgggaattatgatagagat

SEQ ID NO: 92391 - DNA, 25 bp, Homo sapien
tagtagtgggaattgtgatagagat

SEQ ID NO: 92392 - DNA, 25 bp, Homo sapien
tagtataaagttgtacaggccactt

SEQ ID NO: 92393 - DNA, 25 bp, Homo sapien
tagtataacgttgtacaggccactt

SEQ ID NO: 92394 - DNA, 25 bp, Homo sapien
tagtataactgcaagtattctgagt

SEQ ID NO: 92395 - DNA, 25 bp, Homo sapien
tagtataactgcacgtattctgagt

SEQ ID NO: 92396 - DNA, 25 bp, Homo sapien
tagtatgaacaaaaaacgtatctca

SEQ ID NO: 92397 - DNA, 25 bp, Homo sapien
tagtatgaacaaaaaatgtatctca

SEQ ID NO: 92398 - DNA, 25 bp, Homo sapien
tagtatgcaaccttatatccatcag

SEQ ID NO: 92399 - DNA, 25 bp, Homo sapien
tagtatgcagccttatatccatcag

SEQ ID NO: 92400 - DNA, 25 bp, Homo sapien
tagtatgccttcaaattttttcttg

SEQ ID NO: 92401 - DNA, 25 bp, Homo sapien
tagtatgccttctaattttttcttg

SEQ ID NO: 92402 - DNA, 25 bp, Homo sapien
tagtatggagtcacaattacctatt

SEQ ID NO: 92403 - DNA, 25 bp, Homo sapien
tagtatggagtcgcaattacctatt

SEQ ID NO: 92404 - DNA, 25 bp, Homo sapien
tagtatggattggtgtatttctagt

SEQ ID NO: 92405 - DNA, 25 bp, Homo sapien
tagtatgggttggtgtatttctagt

SEQ ID NO: 92406 - DNA, 25 bp, Homo sapien
tagtatgtgtctcagaatgtaattg

SEQ ID NO: 92407 - DNA, 25 bp, Homo sapien
tagtatgtgtcttagaatgtaattg

SEQ ID NO: 92408 - DNA, 25 bp, Homo sapien
tagtattaaggatcatttttgagta

SEQ ID NO: 92409 - DNA, 25 bp, Homo sapien
tagtattaaggatcgtttttgagta

SEQ ID NO: 92410 - DNA, 25 bp, Homo sapien
tagtatttaagacactatttgcaaa

SEQ ID NO: 92411 - DNA, 25 bp, Homo sapien
tagtatttatctggttccctcatta

SEQ ID NO: 92412 - DNA, 25 bp, Homo sapien
tagtatttcagacactatttgcaaa

SEQ ID NO: 92413 - DNA, 25 bp, Homo sapien
tagtatttctctggttccctcatta

SEQ ID NO: 92414 - DNA, 25 bp, Homo sapien
tagtatttgcttttgtaataaaggc

SEQ ID NO: 92415 - DNA, 25 bp, Homo sapien
tagtatttgtttttgtaataaaggc

SEQ ID NO: 92416 - DNA, 25 bp, Homo sapien
tagtcaaaaatcgtgtgttctaaaa

SEQ ID NO: 92417 - DNA, 25 bp, Homo sapien
tagtcaaaaattgtgtgttctaaaa

SEQ ID NO: 92418 - DNA, 25 bp, Homo sapien
tagtcaaagaaattaaagcagagaa

SEQ ID NO: 92419 - DNA, 25 bp, Homo sapien
tagtcaaagagcctgtggacctccc

SEQ ID NO: 92420 - DNA, 25 bp, Homo sapien
tagtcaaataaattaaagcagagaa

SEQ ID NO: 92421 - DNA, 25 bp, Homo sapien
tagtcaaatagcctgtggacctccc

SEQ ID NO: 92422 - DNA, 25 bp, Homo sapien
tagtcaacagtttatgtgcaactca

SEQ ID NO: 92423 - DNA, 25 bp, Homo sapien
tagtcaacagtttgtgtgcaactca

SEQ ID NO: 92424 - DNA, 25 bp, Homo sapien
tagtcaatactgaaccactgctcct

SEQ ID NO: 92425 - DNA, 25 bp, Homo sapien
tagtcaatactgaatcactgctcct

SEQ ID NO: 92426 - DNA, 25 bp, Homo sapien
tagtcacaattgctaggggtctata

SEQ ID NO: 92427 - DNA, 25 bp, Homo sapien
tagtcacatttgctaggggtctata

SEQ ID NO: 92428 - DNA, 25 bp, Homo sapien
tagtcactgagccgcagcaggcgct

SEQ ID NO: 92429 - DNA, 25 bp, Homo sapien
tagtcactgagctgcagcaggcgct

SEQ ID NO: 92430 - DNA, 25 bp, Homo sapien
tagtcagaccgattatctgctctcg

SEQ ID NO: 92431 - DNA, 25 bp, Homo sapien
tagtcagaccggaaatgtactataa

SEQ ID NO: 92432 - DNA, 25 bp, Homo sapien
tagtcagactgattatctgctctcg

SEQ ID NO: 92433 - DNA, 25 bp, Homo sapien
tagtcagactggaaatgtactataa

SEQ ID NO: 92434 - DNA, 25 bp, Homo sapien
tagtcagaggaccttaagaaagagg

SEQ ID NO: 92435 - DNA, 25 bp, Homo sapien
tagtcagaggatcttaagaaagagg

SEQ ID NO: 92436 - DNA, 25 bp, Homo sapien
tagtcagatactaggcaagaaccag

SEQ ID NO: 92437 - DNA, 25 bp, Homo sapien
tagtcagatactcggcaagaaccag

SEQ ID NO: 92438 - DNA, 25 bp, Homo sapien
tagtcagcaagagaacacatatacg

SEQ ID NO: 92439 - DNA, 25 bp, Homo sapien
tagtcagcaagagaccacatatacg

SEQ ID NO: 92440 - DNA, 25 bp, Homo sapien
tagtcagccttctatgaaatgtaca

SEQ ID NO: 92441 - DNA, 25 bp, Homo sapien
tagtcagccttttatgaaatgtaca

SEQ ID NO: 92442 - DNA, 25 bp, Homo sapien
tagtcagtgaaagaccagaggatta

SEQ ID NO: 92443 - DNA, 25 bp, Homo sapien
tagtcagtgaaagaccggaggatta

SEQ ID NO: 92444 - DNA, 25 bp, Homo sapien
tagtcagtgccaattgaaacacata

SEQ ID NO: 92445 - DNA, 25 bp, Homo sapien
tagtcagtgccagttgaaacacata

SEQ ID NO: 92446 - DNA, 25 bp, Homo sapien
tagtcagttacaaatcaaacattta

SEQ ID NO: 92447 - DNA, 25 bp, Homo sapien
tagtcagttacaattcaaacattta

SEQ ID NO: 92448 - DNA, 25 bp, Homo sapien
tagtcataccttcccataattgttg

SEQ ID NO: 92449 - DNA, 25 bp, Homo sapien
tagtcatactttcccataattgttg

SEQ ID NO: 92450 - DNA, 25 bp, Homo sapien
tagtcatctttttctacaaatatga

SEQ ID NO: 92451 - DNA, 25 bp, Homo sapien
tagtcatctttttctataaatatga

SEQ ID NO: 92452 - DNA, 25 bp, Homo sapien
tagtcatgatatagggaattgaaaa

SEQ ID NO: 92453 - DNA, 25 bp, Homo sapien
tagtcatgatatatggaattgaaaa

SEQ ID NO: 92454 - DNA, 25 bp, Homo sapien
tagtcatgccttagaacatgcccat

SEQ ID NO: 92455 - DNA, 25 bp, Homo sapien
tagtcatgccttagaatatgcccat

SEQ ID NO: 92456 - DNA, 25 bp, Homo sapien
tagtccagcgttaaatgcctcctct

SEQ ID NO: 92457 - DNA, 25 bp, Homo sapien
tagtccagggttaaatgcctcctct

SEQ ID NO: 92458 - DNA, 25 bp, Homo sapien
tagtcctatcctcacacttcctgta

SEQ ID NO: 92459 - DNA, 25 bp, Homo sapien
tagtcctatcctcatacttcctgta

SEQ ID NO: 92460 - DNA, 25 bp, Homo sapien
tagtcctcacaggcacatagaaaat

SEQ ID NO: 92461 - DNA, 25 bp, Homo sapien
tagtcctcacagtcacatagaaaat

SEQ ID NO: 92462 - DNA, 25 bp, Homo sapien
tagtcctgcaaagttctgttccaaa

SEQ ID NO: 92463 - DNA, 25 bp, Homo sapien
tagtcctgcgaagttctgttccaaa

SEQ ID NO: 92464 - DNA, 25 bp, Homo sapien
tagtcctgttcattcagtcctaatc

SEQ ID NO: 92465 - DNA, 25 bp, Homo sapien
tagtcctgttcgttcagtcctaatc

SEQ ID NO: 92466 - DNA, 25 bp, Homo sapien
tagtcgatacatctcttcgtgtgac

SEQ ID NO: 92467 - DNA, 25 bp, Homo sapien
tagtcgatatatctcttcgtgtgac

SEQ ID NO: 92468 - DNA, 25 bp, Homo sapien
tagtcgcccacagtggtcacatgat

SEQ ID NO: 92469 - DNA, 25 bp, Homo sapien
tagtcgcccacggtggtcacatgat

SEQ ID NO: 92470 - DNA, 25 bp, Homo sapien
tagtctatgctggacacttccttct

SEQ ID NO: 92471 - DNA, 25 bp, Homo sapien
tagtctatgttggacacttccttct

SEQ ID NO: 92472 - DNA, 25 bp, Homo sapien
tagtctattcaggtatctaaacaag

SEQ ID NO: 92473 - DNA, 25 bp, Homo sapien
tagtctattcagttatctaaacaag

SEQ ID NO: 92474 - DNA, 25 bp, Homo sapien
tagtctcatcacaaattctgtttta

SEQ ID NO: 92475 - DNA, 25 bp, Homo sapien
tagtctcatcacaatttctgtttta

SEQ ID NO: 92476 - DNA, 25 bp, Homo sapien
tagtctctaccctgaccatgtgcct

SEQ ID NO: 92477 - DNA, 25 bp, Homo sapien
tagtctctaccttgaccatgtgcct

SEQ ID NO: 92478 - DNA, 25 bp, Homo sapien
tagtctctcaatttataaggtcgtt

SEQ ID NO: 92479 - DNA, 25 bp, Homo sapien
tagtctctcaatttatgaggtcgtt

SEQ ID NO: 92480 - DNA, 25 bp, Homo sapien
tagtctgactggaatccccatgggc

SEQ ID NO: 92481 - DNA, 25 bp, Homo sapien
tagtctgactgtaatccccatgggc

SEQ ID NO: 92482 - DNA, 25 bp, Homo sapien
tagtctgcaaagaggaacattgcca

SEQ ID NO: 92483 - DNA, 25 bp, Homo sapien
tagtctgcaaagaggagcattgcca

SEQ ID NO: 92484 - DNA, 25 bp, Homo sapien
tagtcttcattgtgtcatcttcatt

SEQ ID NO: 92485 - DNA, 25 bp, Homo sapien
tagtcttcattgtgtcgtcttcatt

SEQ ID NO: 92486 - DNA, 25 bp, Homo sapien
tagtcttctaaagtagtaggagcat

SEQ ID NO: 92487 - DNA, 25 bp, Homo sapien
tagtcttctgaagtagtaggagcat

SEQ ID NO: 92488 - DNA, 25 bp, Homo sapien
tagtcttggctgtgctatgaaacct

SEQ ID NO: 92489 - DNA, 25 bp, Homo sapien
tagtcttggctgtgctctgaaacct

SEQ ID NO: 92490 - DNA, 25 bp, Homo sapien
tagtgaaaaaccgaatattccaaga

SEQ ID NO: 92491 - DNA, 25 bp, Homo sapien
tagtgaaaatccgaatattccaaga

SEQ ID NO: 92492 - DNA, 25 bp, Homo sapien
tagtgaaagttaagataacacagaa

SEQ ID NO: 92493 - DNA, 25 bp, Homo sapien
tagtgaaatttaagataacacagaa

SEQ ID NO: 92494 - DNA, 25 bp, Homo sapien
tagtgaagcagaatggtaaaccagc

SEQ ID NO: 92495 - DNA, 25 bp, Homo sapien
tagtgaagcagagtggtaaaccagc

SEQ ID NO: 92496 - DNA, 25 bp, Homo sapien
tagtgaaggaatgagggaacaatga

SEQ ID NO: 92497 - DNA, 25 bp, Homo sapien
tagtgaaggaatgcgggaacaatga

SEQ ID NO: 92498 - DNA, 25 bp, Homo sapien
tagtgaatgtggtagcttctggaaa

SEQ ID NO: 92499 - DNA, 25 bp, Homo sapien
tagtgaatgtgttagcttctggaaa

SEQ ID NO: 92500 - DNA, 25 bp, Homo sapien
tagtgacaaagcgaaagaaaagggt

SEQ ID NO: 92501 - DNA, 25 bp, Homo sapien
tagtgacaaagtgaaagaaaagggt

SEQ ID NO: 92502 - DNA, 25 bp, Homo sapien
tagtgactttactcggatagagtgt

SEQ ID NO: 92503 - DNA, 25 bp, Homo sapien
tagtgactttacttggatagagtgt

SEQ ID NO: 92504 - DNA, 25 bp, Homo sapien
tagtgagaacactaggaaaatagaa

SEQ ID NO: 92505 - DNA, 25 bp, Homo sapien
tagtgagaatactaggaaaatagaa

SEQ ID NO: 92506 - DNA, 25 bp, Homo sapien
tagtgagattactaggtttgctttt

SEQ ID NO: 92507 - DNA, 25 bp, Homo sapien
tagtgagattactgggtttgctttt

SEQ ID NO: 92508 - DNA, 25 bp, Homo sapien
tagtgagcagcagagcaggaatttg

SEQ ID NO: 92509 - DNA, 25 bp, Homo sapien
tagtgagcagcatagcaggaatttg

SEQ ID NO: 92510 - DNA, 25 bp, Homo sapien
tagtgagtcaaattcgaccatttaa

SEQ ID NO: 92511 - DNA, 25 bp, Homo sapien
tagtgagttaaattcgaccatttaa

SEQ ID NO: 92512 - DNA, 25 bp, Homo sapien
tagtgatatatttccacctctgttt

SEQ ID NO: 92513 - DNA, 25 bp, Homo sapien
tagtgatatctttccacctctgttt

SEQ ID NO: 92514 - DNA, 25 bp, Homo sapien
tagtgatcagcacttatgagtgggg

SEQ ID NO: 92515 - DNA, 25 bp, Homo sapien
tagtgatcggcacttatgagtgggg

SEQ ID NO: 92516 - DNA, 25 bp, Homo sapien
tagtgatgattcaatgcattttttc

SEQ ID NO: 92517 - DNA, 25 bp, Homo sapien
tagtgatggttcaatgcattttttc

SEQ ID NO: 92518 - DNA, 25 bp, Homo sapien
tagtgattcaagcacacatgtggcc

SEQ ID NO: 92519 - DNA, 25 bp, Homo sapien
tagtgattcaaggacacatgtggcc

SEQ ID NO: 92520 - DNA, 25 bp, Homo sapien
tagtgatttttgcctcctacttagc

SEQ ID NO: 92521 - DNA, 25 bp, Homo sapien
tagtgatttttgcttcctacttagc

SEQ ID NO: 92522 - DNA, 25 bp, Homo sapien
tagtgcaaccaacaatgtttttgta

SEQ ID NO: 92523 - DNA, 25 bp, Homo sapien
tagtgcaaccaataatgtttttgta

SEQ ID NO: 92524 - DNA, 25 bp, Homo sapien
tagtgcagctacggaaggcaatcaa

SEQ ID NO: 92525 - DNA, 25 bp, Homo sapien
tagtgcagctatggaaggcaatcaa

SEQ ID NO: 92526 - DNA, 25 bp, Homo sapien
tagtgcatctcatggatacaatctc

SEQ ID NO: 92527 - DNA, 25 bp, Homo sapien
tagtgcattctatgtatggcccaag

SEQ ID NO: 92528 - DNA, 25 bp, Homo sapien
tagtgcattctgtgtatggcccaag

SEQ ID NO: 92529 - DNA, 25 bp, Homo sapien
tagtgcatttcatggatacaatctc

SEQ ID NO: 92530 - DNA, 25 bp, Homo sapien
tagtgcctacacacgccttttgaga

SEQ ID NO: 92531 - DNA, 25 bp, Homo sapien
tagtgcctacacatgccttttgaga

SEQ ID NO: 92532 - DNA, 25 bp, Homo sapien
tagtgcttcaatctaaagaggacac

SEQ ID NO: 92533 - DNA, 25 bp, Homo sapien
tagtgcttgctacaattcaacacca

SEQ ID NO: 92534 - DNA, 25 bp, Homo sapien
tagtgcttgctacagttcaacacca

SEQ ID NO: 92535 - DNA, 25 bp, Homo sapien
tagtgctttaatctaaagaggacac

SEQ ID NO: 92536 - DNA, 25 bp, Homo sapien
tagtgctttttaaactttggaaaat

SEQ ID NO: 92537 - DNA, 25 bp, Homo sapien
tagtgctttttaaagtttggaaaat

SEQ ID NO: 92538 - DNA, 25 bp, Homo sapien
tagtggatgcttaccaaatgctgac

SEQ ID NO: 92539 - DNA, 25 bp, Homo sapien
tagtggatgcttactaaatgctgac

SEQ ID NO: 92540 - DNA, 25 bp, Homo sapien
tagtggatgtgcttcttttggcaag

SEQ ID NO: 92541 - DNA, 25 bp, Homo sapien
tagtggatgtgtttcttttggcaag

SEQ ID NO: 92542 - DNA, 25 bp, Homo sapien
tagtggcacctcttcaccttccaca

SEQ ID NO: 92543 - DNA, 25 bp, Homo sapien
tagtggcacctcttgaccttccaca

SEQ ID NO: 92544 - DNA, 25 bp, Homo sapien
tagtggccagttacatttctcatca

SEQ ID NO: 92545 - DNA, 25 bp, Homo sapien
tagtggccagttgcatttctcatca

SEQ ID NO: 92546 - DNA, 25 bp, Homo sapien
tagtggctaatacatgaggtgcatt

SEQ ID NO: 92547 - DNA, 25 bp, Homo sapien
tagtggctaatatatgaggtgcatt

SEQ ID NO: 92548 - DNA, 25 bp, Homo sapien
tagtggctgagccttggtaatcaag

SEQ ID NO: 92549 - DNA, 25 bp, Homo sapien
tagtggctgagtcttggtaatcaag

SEQ ID NO: 92550 - DNA, 25 bp, Homo sapien
tagtgggaagccattgctgcatttt

SEQ ID NO: 92551 - DNA, 25 bp, Homo sapien
tagtgggaagccattggtgcatttt

SEQ ID NO: 92552 - DNA, 25 bp, Homo sapien
tagtgggtcaaaacaatacaacttc

SEQ ID NO: 92553 - DNA, 25 bp, Homo sapien
tagtgggttaaaacaatacaacttc

SEQ ID NO: 92554 - DNA, 25 bp, Homo sapien
tagtggtaatatgcataattttgga

SEQ ID NO: 92555 - DNA, 25 bp, Homo sapien
tagtggtaatatgcgtaattttgga

SEQ ID NO: 92556 - DNA, 25 bp, Homo sapien
tagtggtgttctctctctactgcac

SEQ ID NO: 92557 - DNA, 25 bp, Homo sapien
tagtggtgttctgtctctactgcac

SEQ ID NO: 92558 - DNA, 25 bp, Homo sapien
tagtggttatttaagtcacccgtga

SEQ ID NO: 92559 - DNA, 25 bp, Homo sapien
tagtggttatttaggtcacccgtga

SEQ ID NO: 92560 - DNA, 25 bp, Homo sapien
tagtggttttgctgacactgctgcc

SEQ ID NO: 92561 - DNA, 25 bp, Homo sapien
tagtggttttgctgacgctgctgcc

SEQ ID NO: 92562 - DNA, 25 bp, Homo sapien
tagtgtaaaatcaactgtctcacca

SEQ ID NO: 92563 - DNA, 25 bp, Homo sapien
tagtgtaaaatcgactgtctcacca

SEQ ID NO: 92564 - DNA, 25 bp, Homo sapien
tagtgtagaacctgtgaatattgtt

SEQ ID NO: 92565 - DNA, 25 bp, Homo sapien
tagtgtagatcctgtgaatattgtt

SEQ ID NO: 92566 - DNA, 25 bp, Homo sapien
tagtgtagtgacaaagcgaaagaaa

SEQ ID NO: 92567 - DNA, 25 bp, Homo sapien
tagtgtagtgacaaagtgaaagaaa

SEQ ID NO: 92568 - DNA, 25 bp, Homo sapien
tagtgtatcggtattgtgttaataa

SEQ ID NO: 92569 - DNA, 25 bp, Homo sapien
tagtgtatgtgcaacctaaaaatct

SEQ ID NO: 92570 - DNA, 25 bp, Homo sapien
tagtgtatgtgtaacctaaaaatct

SEQ ID NO: 92571 - DNA, 25 bp, Homo sapien
tagtgtattggtattgtgttaataa

SEQ ID NO: 92572 - DNA, 25 bp, Homo sapien
tagtgtcaaagagtttgcttttcct

SEQ ID NO: 92573 - DNA, 25 bp, Homo sapien
tagtgtcaaggagtttgcttttcct

SEQ ID NO: 92574 - DNA, 25 bp, Homo sapien
tagtgtccttgaaggttggtactct

SEQ ID NO: 92575 - DNA, 25 bp, Homo sapien
tagtgtccttgagggttggtactct

SEQ ID NO: 92576 - DNA, 25 bp, Homo sapien
tagtgtctgctaacaaaatgtcggt

SEQ ID NO: 92577 - DNA, 25 bp, Homo sapien
tagtgtctgctaccaaaatgtcggt

SEQ ID NO: 92578 - DNA, 25 bp, Homo sapien
tagtgtgattagctgtaattagctg

SEQ ID NO: 92579 - DNA, 25 bp, Homo sapien
tagtgtgattagttgtaattagctg

SEQ ID NO: 92580 - DNA, 25 bp, Homo sapien
tagtgtggtcatctagcttttgact

SEQ ID NO: 92581 - DNA, 25 bp, Homo sapien
tagtgtggttatctagcttttgact

SEQ ID NO: 92582 - DNA, 25 bp, Homo sapien
tagtgtgtacgtgactatatcttgt

SEQ ID NO: 92583 - DNA, 25 bp, Homo sapien
tagtgtgtacgtgactgtatcttgt

SEQ ID NO: 92584 - DNA, 25 bp, Homo sapien
tagtgtgtcagcatgtgaccttatt

SEQ ID NO: 92585 - DNA, 25 bp, Homo sapien
tagtgtgtcagcgtgtgaccttatt

SEQ ID NO: 92586 - DNA, 25 bp, Homo sapien
tagtgtgtccagtagaaacacctgt

SEQ ID NO: 92587 - DNA, 25 bp, Homo sapien
tagtgtgtgcagtagaaacacctgt

SEQ ID NO: 92588 - DNA, 25 bp, Homo sapien
tagtgtgtgttatttccatcatttt

SEQ ID NO: 92589 - DNA, 25 bp, Homo sapien
tagtgtgtgttatttcgatcatttt

SEQ ID NO: 92590 - DNA, 25 bp, Homo sapien
tagtgttactccaaattgctggctt

SEQ ID NO: 92591 - DNA, 25 bp, Homo sapien
tagtgttactctaaattgctggctt

SEQ ID NO: 92592 - DNA, 25 bp, Homo sapien
tagtgttagctcctataggatttag

SEQ ID NO: 92593 - DNA, 25 bp, Homo sapien
tagtgttagcttctataggatttag

SEQ ID NO: 92594 - DNA, 25 bp, Homo sapien
tagtgttctttactgttgatttttt

SEQ ID NO: 92595 - DNA, 25 bp, Homo sapien
tagtgttctttgctgttgatttttt

SEQ ID NO: 92596 - DNA, 25 bp, Homo sapien
tagtgttgatctgagaacataactc

SEQ ID NO: 92597 - DNA, 25 bp, Homo sapien
tagtgttgatctgataacataactc

SEQ ID NO: 92598 - DNA, 25 bp, Homo sapien
tagtgtttcaaattcccagaagacc

SEQ ID NO: 92599 - DNA, 25 bp, Homo sapien
tagtgtttcaaatttccagaagacc

SEQ ID NO: 92600 - DNA, 25 bp, Homo sapien
tagtgttttcttcaggtgtaagtag

SEQ ID NO: 92601 - DNA, 25 bp, Homo sapien
tagtgttttctttaggtgtaagtag

SEQ ID NO: 92602 - DNA, 25 bp, Homo sapien
tagttaactcgaggattttctattc

SEQ ID NO: 92603 - DNA, 25 bp, Homo sapien
tagttaactcgatgattttctattc

SEQ ID NO: 92604 - DNA, 25 bp, Homo sapien
tagttaactttttccttgcatacta

SEQ ID NO: 92605 - DNA, 25 bp, Homo sapien
tagttaacttttttcttgcatacta

SEQ ID NO: 92606 - DNA, 25 bp, Homo sapien
tagttaagagaaagtcaggcacact

SEQ ID NO: 92607 - DNA, 25 bp, Homo sapien
tagttaagggaaagtcaggcacact

SEQ ID NO: 92608 - DNA, 25 bp, Homo sapien
tagttaattacaccctgttgcctcc

SEQ ID NO: 92609 - DNA, 25 bp, Homo sapien
tagttaattacatcctgttgcctcc

SEQ ID NO: 92610 - DNA, 25 bp, Homo sapien
tagttacagccattggagcaaatga

SEQ ID NO: 92611 - DNA, 25 bp, Homo sapien
tagttacagccatttgagcaaatga

SEQ ID NO: 92612 - DNA, 25 bp, Homo sapien
tagttaccagtaagactgcttttat

SEQ ID NO: 92613 - DNA, 25 bp, Homo sapien
tagttaccggtaagactgcttttat

SEQ ID NO: 92614 - DNA, 25 bp, Homo sapien
tagttactcttggcccaccactctg

SEQ ID NO: 92615 - DNA, 25 bp, Homo sapien
tagttacttttggcccaccactctg

SEQ ID NO: 92616 - DNA, 25 bp, Homo sapien
tagttagctgcacagccagaatata

SEQ ID NO: 92617 - DNA, 25 bp, Homo sapien
tagttagctgcacggccagaatata

SEQ ID NO: 92618 - DNA, 25 bp, Homo sapien
tagttatgcaatgctaccacacatc

SEQ ID NO: 92619 - DNA, 25 bp, Homo sapien
tagttatgtaatgctaccacacatc

SEQ ID NO: 92620 - DNA, 25 bp, Homo sapien
tagttatgtagtggtaattcagtga

SEQ ID NO: 92621 - DNA, 25 bp, Homo sapien
tagttatgtagtggtatttcagtga

SEQ ID NO: 92622 - DNA, 25 bp, Homo sapien
tagttattgatacagggcaaagaat

SEQ ID NO: 92623 - DNA, 25 bp, Homo sapien
tagttattgatagagggcaaagaat

SEQ ID NO: 92624 - DNA, 25 bp, Homo sapien
tagttatttgctcaagaaaaatgaa

SEQ ID NO: 92625 - DNA, 25 bp, Homo sapien
tagttatttgctcaaggaaaatgaa

SEQ ID NO: 92626 - DNA, 25 bp, Homo sapien
tagttcaaactacttagacgttctt

SEQ ID NO: 92627 - DNA, 25 bp, Homo sapien
tagttcaacctacttagacgttctt

SEQ ID NO: 92628 - DNA, 25 bp, Homo sapien
tagttcaagtgcagtaaataatgaa

SEQ ID NO: 92629 - DNA, 25 bp, Homo sapien
tagttcaagtgtagtaaataatgaa

SEQ ID NO: 92630 - DNA, 25 bp, Homo sapien
tagttcactcactccgaaacatgct

SEQ ID NO: 92631 - DNA, 25 bp, Homo sapien
tagttcactcactctgaaacatgct

SEQ ID NO: 92632 - DNA, 25 bp, Homo sapien
tagttcagcttgtgacatggttgag

SEQ ID NO: 92633 - DNA, 25 bp, Homo sapien
tagttcagtttgtgacatggttgag

SEQ ID NO: 92634 - DNA, 25 bp, Homo sapien
tagttcatgaggcgttaagaaggag

SEQ ID NO: 92635 - DNA, 25 bp, Homo sapien
tagttcatgaggtgttaagaaggag

SEQ ID NO: 92636 - DNA, 25 bp, Homo sapien
tagttcctatgaaacagagaatttc

SEQ ID NO: 92637 - DNA, 25 bp, Homo sapien
tagttcctatgaagcagagaatttc

SEQ ID NO: 92638 - DNA, 25 bp, Homo sapien
tagttctacatgtgcatgttggatg

SEQ ID NO: 92639 - DNA, 25 bp, Homo sapien
tagttctacatgtgtatgttggatg

SEQ ID NO: 92640 - DNA, 25 bp, Homo sapien
tagttctaggcgcacttccttggac

SEQ ID NO: 92641 - DNA, 25 bp, Homo sapien
tagttctaggcgcatttccttggac

SEQ ID NO: 92642 - DNA, 25 bp, Homo sapien
tagttctcattgcctattgtttcta

SEQ ID NO: 92643 - DNA, 25 bp, Homo sapien
tagttctcattgtctattgtttcta

SEQ ID NO: 92644 - DNA, 25 bp, Homo sapien
tagttctctgtacccctgaaaataa

SEQ ID NO: 92645 - DNA, 25 bp, Homo sapien
tagttctctgtactcctgaaaataa

SEQ ID NO: 92646 - DNA, 25 bp, Homo sapien
tagttctgagatatcaatgcaatta

SEQ ID NO: 92647 - DNA, 25 bp, Homo sapien
tagttctgagatgtcaatgcaatta

SEQ ID NO: 92648 - DNA, 25 bp, Homo sapien
tagttcttcgacgcagagcttttcc

SEQ ID NO: 92649 - DNA, 25 bp, Homo sapien
tagttctttgacgcagagcttttcc

SEQ ID NO: 92650 - DNA, 25 bp, Homo sapien
tagttgacataaccttggcagccag

SEQ ID NO: 92651 - DNA, 25 bp, Homo sapien
tagttgacgtaaccttggcagccag

SEQ ID NO: 92652 - DNA, 25 bp, Homo sapien
tagttgagagacgagctatgggcaa

SEQ ID NO: 92653 - DNA, 25 bp, Homo sapien
tagttgagagatgagctatgggcaa

SEQ ID NO: 92654 - DNA, 25 bp, Homo sapien
tagttgagtcctccgaatgaaaagg

SEQ ID NO: 92655 - DNA, 25 bp, Homo sapien
tagttgagtcctctgaatgaaaagg

SEQ ID NO: 92656 - DNA, 25 bp, Homo sapien
tagttgatgccaatcgatactctga

SEQ ID NO: 92657 - DNA, 25 bp, Homo sapien
tagttgatgccaattgatactctga

SEQ ID NO: 92658 - DNA, 25 bp, Homo sapien
tagttgcaatgacggtgtaattttc

SEQ ID NO: 92659 - DNA, 25 bp, Homo sapien
tagttgcaatgactgtgtaattttc

SEQ ID NO: 92660 - DNA, 25 bp, Homo sapien
tagttgcctagactataaactttag

SEQ ID NO: 92661 - DNA, 25 bp, Homo sapien
tagttgcctagactgtaaactttag

SEQ ID NO: 92662 - DNA, 25 bp, Homo sapien
tagttgccttggcagctgaaacatg

SEQ ID NO: 92663 - DNA, 25 bp, Homo sapien
tagttgccttggcggctgaaacatg

SEQ ID NO: 92664 - DNA, 25 bp, Homo sapien
tagttgcttgacctatgttttttgc

SEQ ID NO: 92665 - DNA, 25 bp, Homo sapien
tagttgcttgacttatgttttttgc

SEQ ID NO: 92666 - DNA, 25 bp, Homo sapien
tagttggacatttccactcagacac

SEQ ID NO: 92667 - DNA, 25 bp, Homo sapien
tagttggacctttccactcagacac

SEQ ID NO: 92668 - DNA, 25 bp, Homo sapien
tagttggagccacaatagaactgcg

SEQ ID NO: 92669 - DNA, 25 bp, Homo sapien
tagttggagcctcaatagaactgcg

SEQ ID NO: 92670 - DNA, 25 bp, Homo sapien
tagttggctcagcatgccttaacag

SEQ ID NO: 92671 - DNA, 25 bp, Homo sapien
tagttggctcagcgtgccttaacag

SEQ ID NO: 92672 - DNA, 25 bp, Homo sapien
tagttggcttactcaaagcagagag

SEQ ID NO: 92673 - DNA, 25 bp, Homo sapien
tagttggcttattcaaagcagagag

SEQ ID NO: 92674 - DNA, 25 bp, Homo sapien
tagttgggtaaagaaactgccaagc

SEQ ID NO: 92675 - DNA, 25 bp, Homo sapien
tagttgggtaaggaaactgccaagc

SEQ ID NO: 92676 - DNA, 25 bp, Homo sapien
tagttggtagtcaaatctcaccatc

SEQ ID NO: 92677 - DNA, 25 bp, Homo sapien
tagttggtagtcacatctcaccatc

SEQ ID NO: 92678 - DNA, 25 bp, Homo sapien
tagttggttatataggttactacaa

SEQ ID NO: 92679 - DNA, 25 bp, Homo sapien
tagttggttcacccaaaattgaact

SEQ ID NO: 92680 - DNA, 25 bp, Homo sapien
tagttggttcacgcaaaattgaact

SEQ ID NO: 92681 - DNA, 25 bp, Homo sapien
tagttggttgtataggttactacaa

SEQ ID NO: 92682 - DNA, 25 bp, Homo sapien
tagttgtaacaaaactcatacaagc

SEQ ID NO: 92683 - DNA, 25 bp, Homo sapien
tagttgtaacaaaattcatacaagc

SEQ ID NO: 92684 - DNA, 25 bp, Homo sapien
tagttgtagttagaggcatcccaga

SEQ ID NO: 92685 - DNA, 25 bp, Homo sapien
tagttgtagttataggcatcccaga

SEQ ID NO: 92686 - DNA, 25 bp, Homo sapien
tagttgtatcattaaaaaaatgtca

SEQ ID NO: 92687 - DNA, 25 bp, Homo sapien
tagttgtatcattgaaaaaatgtca

SEQ ID NO: 92688 - DNA, 25 bp, Homo sapien
tagttgtcatcagtagggaacctag

SEQ ID NO: 92689 - DNA, 25 bp, Homo sapien
tagttgtccggagcttcctaggttc

SEQ ID NO: 92690 - DNA, 25 bp, Homo sapien
tagttgtcgtcagtagggaacctag

SEQ ID NO: 92691 - DNA, 25 bp, Homo sapien
tagttgtctggagcttcctaggttc

SEQ ID NO: 92692 - DNA, 25 bp, Homo sapien
tagttgtctgtaatgatttagtttt

SEQ ID NO: 92693 - DNA, 25 bp, Homo sapien
tagttgtctgtaattatttagtttt

SEQ ID NO: 92694 - DNA, 25 bp, Homo sapien
tagttgttactcatttgtgagaaaa

SEQ ID NO: 92695 - DNA, 25 bp, Homo sapien
tagttgttattcatttgtgagaaaa

SEQ ID NO: 92696 - DNA, 25 bp, Homo sapien
tagttgttcaacatcatctcagact

SEQ ID NO: 92697 - DNA, 25 bp, Homo sapien
tagttgttgaacatcatctcagact

SEQ ID NO: 92698 - DNA, 25 bp, Homo sapien
tagtttaaatctgaattcctgcaac

SEQ ID NO: 92699 - DNA, 25 bp, Homo sapien
tagtttaaatcttaattcctgcaac

SEQ ID NO: 92700 - DNA, 25 bp, Homo sapien
tagtttaatgaagtatggttgcaga

SEQ ID NO: 92701 - DNA, 25 bp, Homo sapien
tagtttaatgacgtatggttgcaga

SEQ ID NO: 92702 - DNA, 25 bp, Homo sapien
tagtttaccgttgaattgctttatt

SEQ ID NO: 92703 - DNA, 25 bp, Homo sapien
tagtttaccgttggattgctttatt

SEQ ID NO: 92704 - DNA, 25 bp, Homo sapien
tagtttatagaagaactttccatct

SEQ ID NO: 92705 - DNA, 25 bp, Homo sapien
tagtttatagaaggactttccatct

SEQ ID NO: 92706 - DNA, 25 bp, Homo sapien
tagtttatggccaatttgctacagc

SEQ ID NO: 92707 - DNA, 25 bp, Homo sapien
tagtttatggcctatttgctacagc

SEQ ID NO: 92708 - DNA, 25 bp, Homo sapien
tagtttcaaaaatcttaatgtagat

SEQ ID NO: 92709 - DNA, 25 bp, Homo sapien
tagtttcaaaagtcttaatgtagat

SEQ ID NO: 92710 - DNA, 25 bp, Homo sapien
tagtttcagcctttagaattaggtc

SEQ ID NO: 92711 - DNA, 25 bp, Homo sapien
tagtttcaggctttagaattaggtc

SEQ ID NO: 92712 - DNA, 25 bp, Homo sapien
tagtttccattacagaggtctttca

SEQ ID NO: 92713 - DNA, 25 bp, Homo sapien
tagtttccattatagaggtctttca

SEQ ID NO: 92714 - DNA, 25 bp, Homo sapien
tagtttccattctattcaatgttct

SEQ ID NO: 92715 - DNA, 25 bp, Homo sapien
tagtttccattttcttctgttccac

SEQ ID NO: 92716 - DNA, 25 bp, Homo sapien
tagtttccgttctattcaatgttct

SEQ ID NO: 92717 - DNA, 25 bp, Homo sapien
tagtttccgttttcttctgttccac

SEQ ID NO: 92718 - DNA, 25 bp, Homo sapien
tagtttccttactgggagagaccag

SEQ ID NO: 92719 - DNA, 25 bp, Homo sapien
tagtttccttattgggagagaccag

SEQ ID NO: 92720 - DNA, 25 bp, Homo sapien
tagtttcgcctactcttctttcccc

SEQ ID NO: 92721 - DNA, 25 bp, Homo sapien
tagtttcgtctactcttctttcccc

SEQ ID NO: 92722 - DNA, 25 bp, Homo sapien
tagtttctagtagactcgagctgct

SEQ ID NO: 92723 - DNA, 25 bp, Homo sapien
tagtttctagtagacttgagctgct

SEQ ID NO: 92724 - DNA, 25 bp, Homo sapien
tagtttctcatactacttgtctaat

SEQ ID NO: 92725 - DNA, 25 bp, Homo sapien
tagtttcttatactacttgtctaat

SEQ ID NO: 92726 - DNA, 25 bp, Homo sapien
tagtttgaagtacggcatcattaca

SEQ ID NO: 92727 - DNA, 25 bp, Homo sapien
tagtttgaggtacggcatcattaca

SEQ ID NO: 92728 - DNA, 25 bp, Homo sapien
tagtttgcactgtgcctggcacata

SEQ ID NO: 92729 - DNA, 25 bp, Homo sapien
tagtttgcattgtgcctggcacata

SEQ ID NO: 92730 - DNA, 25 bp, Homo sapien
tagtttgctcaaagattgtagttta

SEQ ID NO: 92731 - DNA, 25 bp, Homo sapien
tagtttgctcagagattgtagttta

SEQ ID NO: 92732 - DNA, 25 bp, Homo sapien
tagtttggacacaacagaagaaata

SEQ ID NO: 92733 - DNA, 25 bp, Homo sapien
tagtttggacacaatagaagaaata

SEQ ID NO: 92734 - DNA, 25 bp, Homo sapien
tagtttgtacacgtagctattttca

SEQ ID NO: 92735 - DNA, 25 bp, Homo sapien
tagtttgtacacttagctattttca

SEQ ID NO: 92736 - DNA, 25 bp, Homo sapien
tagttttaataagtcttaacttttt

SEQ ID NO: 92737 - DNA, 25 bp, Homo sapien
tagttttacctcttatatttcattc

SEQ ID NO: 92738 - DNA, 25 bp, Homo sapien
tagttttacctgttatatttcattc

SEQ ID NO: 92739 - DNA, 25 bp, Homo sapien
tagttttagtaagtcttaacttttt

SEQ ID NO: 92740 - DNA, 25 bp, Homo sapien
tagttttatggtaccagagaatttg

SEQ ID NO: 92741 - DNA, 25 bp, Homo sapien
tagttttatggtatcagagaatttg

SEQ ID NO: 92742 - DNA, 25 bp, Homo sapien
tagttttctcctctgtcctcacttg

SEQ ID NO: 92743 - DNA, 25 bp, Homo sapien
tagttttctcctgtgtcctcacttg

SEQ ID NO: 92744 - DNA, 25 bp, Homo sapien
tagttttgactgaatttcttagtag

SEQ ID NO: 92745 - DNA, 25 bp, Homo sapien
tagttttgattgaatttcttagtag

SEQ ID NO: 92746 - DNA, 25 bp, Homo sapien
tagttttgtagcataactagaagtc

SEQ ID NO: 92747 - DNA, 25 bp, Homo sapien
tagttttgtagcgtaactagaagtc

SEQ ID NO: 92748 - DNA, 25 bp, Homo sapien
tagtttttctgtcaagcagatggtg

SEQ ID NO: 92749 - DNA, 25 bp, Homo sapien
tagtttttctgtcaagtagatggtg

SEQ ID NO: 92750 - DNA, 25 bp, Homo sapien
tagttttttatcatgtgatattctg

SEQ ID NO: 92751 - DNA, 25 bp, Homo sapien
tagttttttatcgtgtgatattctg

SEQ ID NO: 92752 - DNA, 25 bp, Homo sapien
tataaaaacttacagagctagcatg

SEQ ID NO: 92753 - DNA, 25 bp, Homo sapien
tataaaaacttatagagctagcatg

SEQ ID NO: 92754 - DNA, 25 bp, Homo sapien
tataaaaatgccctggagaaattgt

SEQ ID NO: 92755 - DNA, 25 bp, Homo sapien
tataaaaatgctctggagaaattgt

SEQ ID NO: 92756 - DNA, 25 bp, Homo sapien
tataaaacacctagagaatagttta

SEQ ID NO: 92757 - DNA, 25 bp, Homo sapien
tataaaacagagggaccgaaagact

SEQ ID NO: 92758 - DNA, 25 bp, Homo sapien
tataaaacagagggtccgaaagact

SEQ ID NO: 92759 - DNA, 25 bp, Homo sapien
tataaaacatatagcaaacatgtgg

SEQ ID NO: 92760 - DNA, 25 bp, Homo sapien
tataaaacgcctagagaatagttta

SEQ ID NO: 92761 - DNA, 25 bp, Homo sapien
tataaaacgtatagcaaacatgtgg

SEQ ID NO: 92762 - DNA, 25 bp, Homo sapien
tataaaaggaaaaggcttaaatgcc

SEQ ID NO: 92763 - DNA, 25 bp, Homo sapien
tataaaaggaaaagtcttaaatgcc

SEQ ID NO: 92764 - DNA, 25 bp, Homo sapien
tataaaaggtcaaaaagctaaatac

SEQ ID NO: 92765 - DNA, 25 bp, Homo sapien
tataaaaggtcacaaagctaaatac

SEQ ID NO: 92766 - DNA, 25 bp, Homo sapien
tataaaagttaccaaaaatgttatg

SEQ ID NO: 92767 - DNA, 25 bp, Homo sapien
tataaaagttaccacaaatgttatg

SEQ ID NO: 92768 - DNA, 25 bp, Homo sapien
tataaaatagaaagcgtaggttgat

SEQ ID NO: 92769 - DNA, 25 bp, Homo sapien
tataaaatagaaagggtaggttgat

SEQ ID NO: 92770 - DNA, 25 bp, Homo sapien
tataaaatagaacgatgaatgctaa

SEQ ID NO: 92771 - DNA, 25 bp, Homo sapien
tataaaatagaatgatgaatgctaa

SEQ ID NO: 92772 - DNA, 25 bp, Homo sapien
tataaacatatttaggagaccctga

SEQ ID NO: 92773 - DNA, 25 bp, Homo sapien
tataaacatgtttaggagaccctga

SEQ ID NO: 92774 - DNA, 25 bp, Homo sapien
tataaaccactgactgcttcccgac

SEQ ID NO: 92775 - DNA, 25 bp, Homo sapien
tataaaccattgactgcttcccgac

SEQ ID NO: 92776 - DNA, 25 bp, Homo sapien
tataaactccacatgttgttttctc

SEQ ID NO: 92777 - DNA, 25 bp, Homo sapien
tataaactccacgtgttgttttctc

SEQ ID NO: 92778 - DNA, 25 bp, Homo sapien
tataaactggactatacgaatgcat

SEQ ID NO: 92779 - DNA, 25 bp, Homo sapien
tataaactggactatatgaatgcat

SEQ ID NO: 92780 - DNA, 25 bp, Homo sapien
tataaagaacttaccaacttaactg

SEQ ID NO: 92781 - DNA, 25 bp, Homo sapien
tataaagaacttatcaacttaactg

SEQ ID NO: 92782 - DNA, 25 bp, Homo sapien
tataaagaagaacaaagtgtggcat

SEQ ID NO: 92783 - DNA, 25 bp, Homo sapien
tataaagaagaccaaagtgtggcat

SEQ ID NO: 92784 - DNA, 25 bp, Homo sapien
tataaagaatctccgtgacattggc

SEQ ID NO: 92785 - DNA, 25 bp, Homo sapien
tataaagaatctctgtgacattggc

SEQ ID NO: 92786 - DNA, 25 bp, Homo sapien
tataaagagacacgtaggctaagaa

SEQ ID NO: 92787 - DNA, 25 bp, Homo sapien
tataaagagacgcgtaggctaagaa

SEQ ID NO: 92788 - DNA, 25 bp, Homo sapien
tataaagcactaacaataggccagg

SEQ ID NO: 92789 - DNA, 25 bp, Homo sapien
tataaagcactaacgataggccagg

SEQ ID NO: 92790 - DNA, 25 bp, Homo sapien
tataaagcactaagagataacaatc

SEQ ID NO: 92791 - DNA, 25 bp, Homo sapien
tataaagcactgagagataacaatc

SEQ ID NO: 92792 - DNA, 25 bp, Homo sapien
tataaagcatgctactactaatcaa

SEQ ID NO: 92793 - DNA, 25 bp, Homo sapien
tataaagcatgctactgctaatcaa

SEQ ID NO: 92794 - DNA, 25 bp, Homo sapien
tataaagccagacctcatgaaaagg

SEQ ID NO: 92795 - DNA, 25 bp, Homo sapien
tataaagccagccctcatgaaaagg

SEQ ID NO: 92796 - DNA, 25 bp, Homo sapien
tataaagtgcctggtgaagctacag

SEQ ID NO: 92797 - DNA, 25 bp, Homo sapien
tataaagtgcctggtggagctacag

SEQ ID NO: 92798 - DNA, 25 bp, Homo sapien
tataaatatacctttcagagtgagg

SEQ ID NO: 92799 - DNA, 25 bp, Homo sapien
tataaatatacttttcagagtgagg

SEQ ID NO: 92800 - DNA, 25 bp, Homo sapien
tataaatcaggcattcgaggcaatc

SEQ ID NO: 92801 - DNA, 25 bp, Homo sapien
tataaatcaggtattcgaggcaatc

SEQ ID NO: 92802 - DNA, 25 bp, Homo sapien
tataaatccattcactacccatcca

SEQ ID NO: 92803 - DNA, 25 bp, Homo sapien
tataaatccgttcactacccatcca

SEQ ID NO: 92804 - DNA, 25 bp, Homo sapien
tataaattattgatgagtaaagaga

SEQ ID NO: 92805 - DNA, 25 bp, Homo sapien
tataaattattggtgagtaaagaga

SEQ ID NO: 92806 - DNA, 25 bp, Homo sapien
tataaatttgttctcaccacaggca

SEQ ID NO: 92807 - DNA, 25 bp, Homo sapien
tataaatttgttctgaccacaggca

SEQ ID NO: 92808 - DNA, 25 bp, Homo sapien
tataacacaaagcaagatgtgataa

SEQ ID NO: 92809 - DNA, 25 bp, Homo sapien
tataacacaaagcaggatgtgataa

SEQ ID NO: 92810 - DNA, 25 bp, Homo sapien
tataacaggttttggtagtttgttc

SEQ ID NO: 92811 - DNA, 25 bp, Homo sapien
tataacaggttttggtcgtttgttc

SEQ ID NO: 92812 - DNA, 25 bp, Homo sapien
tataacatcaaacactaggagaatc

SEQ ID NO: 92813 - DNA, 25 bp, Homo sapien
tataacatcaaacgctaggagaatc

SEQ ID NO: 92814 - DNA, 25 bp, Homo sapien
tataaccagtgacccttctaagcat

SEQ ID NO: 92815 - DNA, 25 bp, Homo sapien
tataaccagtggcccttctaagcat

SEQ ID NO: 92816 - DNA, 25 bp, Homo sapien
tataaccctttggacgcaaatgtac

SEQ ID NO: 92817 - DNA, 25 bp, Homo sapien
tataaccctttggatgcaaatgtac

SEQ ID NO: 92818 - DNA, 25 bp, Homo sapien
tataacctcaggcaagactgatgag

SEQ ID NO: 92819 - DNA, 25 bp, Homo sapien
tataacctcaggcaagtctgatgag

SEQ ID NO: 92820 - DNA, 25 bp, Homo sapien
tataactaatcccattctagctaca

SEQ ID NO: 92821 - DNA, 25 bp, Homo sapien
tataactaatccctttctagctaca

SEQ ID NO: 92822 - DNA, 25 bp, Homo sapien
tataactacataatttcagcagtat

SEQ ID NO: 92823 - DNA, 25 bp, Homo sapien
tataactacatcatttcagcagtat

SEQ ID NO: 92824 - DNA, 25 bp, Homo sapien
tataactccaaagctcatttgattg

SEQ ID NO: 92825 - DNA, 25 bp, Homo sapien
tataactccaatgctcatttgattg

SEQ ID NO: 92826 - DNA, 25 bp, Homo sapien
tataactctccaaacggacccaggt

SEQ ID NO: 92827 - DNA, 25 bp, Homo sapien
tataactctccaaatggacccaggt

SEQ ID NO: 92828 - DNA, 25 bp, Homo sapien
tataacttcgcctcaaaattcagta

SEQ ID NO: 92829 - DNA, 25 bp, Homo sapien
tataacttctcctcaaaattcagta

SEQ ID NO: 92830 - DNA, 25 bp, Homo sapien
tataagaacctaaccgtagaagatc

SEQ ID NO: 92831 - DNA, 25 bp, Homo sapien
tataagaacctaatcgtagaagatc

SEQ ID NO: 92832 - DNA, 25 bp, Homo sapien
tataagaactgtggaaaaattattt

SEQ ID NO: 92833 - DNA, 25 bp, Homo sapien
tataagaactgtgggaaaattattt

SEQ ID NO: 92834 - DNA, 25 bp, Homo sapien
tataagacagttagtcatcaagatc

SEQ ID NO: 92835 - DNA, 25 bp, Homo sapien
tataagacagttattcatcaagatc

SEQ ID NO: 92836 - DNA, 25 bp, Homo sapien
tataagaccaacattccttgttaag

SEQ ID NO: 92837 - DNA, 25 bp, Homo sapien
tataagaccaacattctttgttaag

SEQ ID NO: 92838 - DNA, 25 bp, Homo sapien
tataagacttagcgtggcaacaaag

SEQ ID NO: 92839 - DNA, 25 bp, Homo sapien
tataagacttagtgtggcaacaaag

SEQ ID NO: 92840 - DNA, 25 bp, Homo sapien
tataagagaataaattcatgttgta

SEQ ID NO: 92841 - DNA, 25 bp, Homo sapien
tataagagcataaattcatgttgta

SEQ ID NO: 92842 - DNA, 25 bp, Homo sapien
tataagagtgaactagaaataaacc

SEQ ID NO: 92843 - DNA, 25 bp, Homo sapien
tataagagtgaattagaaataaacc

SEQ ID NO: 92844 - DNA, 25 bp, Homo sapien
tataagattgccagatatggaacat

SEQ ID NO: 92845 - DNA, 25 bp, Homo sapien
tataagattgccggatatggaacat

SEQ ID NO: 92846 - DNA, 25 bp, Homo sapien
tataagcacctaaaacatcaatttc

SEQ ID NO: 92847 - DNA, 25 bp, Homo sapien
tataagcacctaatacatcaatttc

SEQ ID NO: 92848 - DNA, 25 bp, Homo sapien
tataagcagtgacctcaaagtgaca

SEQ ID NO: 92849 - DNA, 25 bp, Homo sapien
tataagcagtgacttcaaagtgaca

SEQ ID NO: 92850 - DNA, 25 bp, Homo sapien
tataagccaaactacaatatctgcc

SEQ ID NO: 92851 - DNA, 25 bp, Homo sapien
tataagccaaactgcaatatctgcc

SEQ ID NO: 92852 - DNA, 25 bp, Homo sapien
tataagcttgttcagaattattatt

SEQ ID NO: 92853 - DNA, 25 bp, Homo sapien
tataagcttgttctgaattattatt

SEQ ID NO: 92854 - DNA, 25 bp, Homo sapien
tataaggaaacttgtaattgctttg

SEQ ID NO: 92855 - DNA, 25 bp, Homo sapien
tataaggaaattgaacatctgagga

SEQ ID NO: 92856 - DNA, 25 bp, Homo sapien
tataaggaaccttgtaattgctttg

SEQ ID NO: 92857 - DNA, 25 bp, Homo sapien
tataaggaacttgaacatctgagga

SEQ ID NO: 92858 - DNA, 25 bp, Homo sapien
tataaggaagacaaaaccaacaaca

SEQ ID NO: 92859 - DNA, 25 bp, Homo sapien
tataaggaagacaaaagcaacaaca

SEQ ID NO: 92860 - DNA, 25 bp, Homo sapien
tataagtgcagtcttccaggggact

SEQ ID NO: 92861 - DNA, 25 bp, Homo sapien
tataagtgcggtcttccaggggact

SEQ ID NO: 92862 - DNA, 25 bp, Homo sapien
tataagtgctgtaatgaaaagaaag

SEQ ID NO: 92863 - DNA, 25 bp, Homo sapien
tataagtgctgtattgaaaagaaag

SEQ ID NO: 92864 - DNA, 25 bp, Homo sapien
tataataaagaacgaacatctgcat

SEQ ID NO: 92865 - DNA, 25 bp, Homo sapien
tataataaagaatgaacatctgcat

SEQ ID NO: 92866 - DNA, 25 bp, Homo sapien
tataataaatatgtcatggagaagt

SEQ ID NO: 92867 - DNA, 25 bp, Homo sapien
tataataaatatgtgatggagaagt

SEQ ID NO: 92868 - DNA, 25 bp, Homo sapien
tataataataatgcgtatgaagcga

SEQ ID NO: 92869 - DNA, 25 bp, Homo sapien
tataataataatgtgtatgaagcga

SEQ ID NO: 92870 - DNA, 25 bp, Homo sapien
tataatacaaaaaacgctatgtcta

SEQ ID NO: 92871 - DNA, 25 bp, Homo sapien
tataatacgaaaaacgctatgtcta

SEQ ID NO: 92872 - DNA, 25 bp, Homo sapien
tataatcatggcagatgaaataaaa

SEQ ID NO: 92873 - DNA, 25 bp, Homo sapien
tataatcatggcggatgaaataaaa

SEQ ID NO: 92874 - DNA, 25 bp, Homo sapien
tataatctatccataagtgtgtgtg

SEQ ID NO: 92875 - DNA, 25 bp, Homo sapien
tataatctctccataagtgtgtgtg

SEQ ID NO: 92876 - DNA, 25 bp, Homo sapien
tataatctgtgaaaagtgtgttcag

SEQ ID NO: 92877 - DNA, 25 bp, Homo sapien
tataatctgtgaagagtgtgttcag

SEQ ID NO: 92878 - DNA, 25 bp, Homo sapien
tataatgcatgaatgtaaggtatga

SEQ ID NO: 92879 - DNA, 25 bp, Homo sapien
tataatgcatgattgtaaggtatga

SEQ ID NO: 92880 - DNA, 25 bp, Homo sapien
tataatgccttcttcggttgacaag

SEQ ID NO: 92881 - DNA, 25 bp, Homo sapien
tataatgccttctttggttgacaag

SEQ ID NO: 92882 - DNA, 25 bp, Homo sapien
tataatgtggcccacagcagccctg

SEQ ID NO: 92883 - DNA, 25 bp, Homo sapien
tataatgtggtaaagattagtattg

SEQ ID NO: 92884 - DNA, 25 bp, Homo sapien
tataatgtggtcaagattagtattg

SEQ ID NO: 92885 - DNA, 25 bp, Homo sapien
tataatgtgtcccacagcagccctg

SEQ ID NO: 92886 - DNA, 25 bp, Homo sapien
tataatgtttacagccatctccatg

SEQ ID NO: 92887 - DNA, 25 bp, Homo sapien
tataatgtttacggccatctccatg

SEQ ID NO: 92888 - DNA, 25 bp, Homo sapien
tataattcacggtagctttaaattc

SEQ ID NO: 92889 - DNA, 25 bp, Homo sapien
tataattcagctctaacactgtcta

SEQ ID NO: 92890 - DNA, 25 bp, Homo sapien
tataattcatggtagctttaaattc

SEQ ID NO: 92891 - DNA, 25 bp, Homo sapien
tataattcctctcatgccctgccta

SEQ ID NO: 92892 - DNA, 25 bp, Homo sapien
tataattcctctcgtgccctgccta

SEQ ID NO: 92893 - DNA, 25 bp, Homo sapien
tataattcggctctaacactgtcta

SEQ ID NO: 92894 - DNA, 25 bp, Homo sapien
tataattctagcgcagagacttcca

SEQ ID NO: 92895 - DNA, 25 bp, Homo sapien
tataattctagctcagagacttcca

SEQ ID NO: 92896 - DNA, 25 bp, Homo sapien
tataattctgatatgacttagtgta

SEQ ID NO: 92897 - DNA, 25 bp, Homo sapien
tataattctgatttgacttagtgta

SEQ ID NO: 92898 - DNA, 25 bp, Homo sapien
tataattcttcaactaaggtgttta

SEQ ID NO: 92899 - DNA, 25 bp, Homo sapien
tataattcttcagctaaggtgttta

SEQ ID NO: 92900 - DNA, 25 bp, Homo sapien
tataattgctaaatatggttttgaa

SEQ ID NO: 92901 - DNA, 25 bp, Homo sapien
tataattgttaaatatggttttgaa

SEQ ID NO: 92902 - DNA, 25 bp, Homo sapien
tataatttaattggcagcattattt

SEQ ID NO: 92903 - DNA, 25 bp, Homo sapien
tataatttcaaactgtagcattaat

SEQ ID NO: 92904 - DNA, 25 bp, Homo sapien
tataatttcaaattgtagcattaat

SEQ ID NO: 92905 - DNA, 25 bp, Homo sapien
tataatttcattggcagcattattt

SEQ ID NO: 92906 - DNA, 25 bp, Homo sapien
tatacaaaactcaatacccttcaat

SEQ ID NO: 92907 - DNA, 25 bp, Homo sapien
tatacaaaactccatacccttcaat

SEQ ID NO: 92908 - DNA, 25 bp, Homo sapien
tatacaaataagaaagaactttgag

SEQ ID NO: 92909 - DNA, 25 bp, Homo sapien
tatacaaataagaaaggactttgag

SEQ ID NO: 92910 - DNA, 25 bp, Homo sapien
tatacaaatggatgtcttttacagc

SEQ ID NO: 92911 - DNA, 25 bp, Homo sapien
tatacaaatgggtgtcttttacagc

SEQ ID NO: 92912 - DNA, 25 bp, Homo sapien
tatacaacatgatgatatggaacac

SEQ ID NO: 92913 - DNA, 25 bp, Homo sapien
tatacaacatgatgttatggaacac

SEQ ID NO: 92914 - DNA, 25 bp, Homo sapien
tatacaagatttgaaaagaaattgt

SEQ ID NO: 92915 - DNA, 25 bp, Homo sapien
tatacaagatttgaaaggaaattgt

SEQ ID NO: 92916 - DNA, 25 bp, Homo sapien
tatacaatgggagtagtgatcagga

SEQ ID NO: 92917 - DNA, 25 bp, Homo sapien
tatacaatgggagtggtgatcagga

SEQ ID NO: 92918 - DNA, 25 bp, Homo sapien
tatacactggagaccgaaaccatga

SEQ ID NO: 92919 - DNA, 25 bp, Homo sapien
tatacactggagactgaaaccatga

SEQ ID NO: 92920 - DNA, 25 bp, Homo sapien
tatacagaccactatctacacggaa

SEQ ID NO: 92921 - DNA, 25 bp, Homo sapien
tatacagaccactctctacacggaa

SEQ ID NO: 92922 - DNA, 25 bp, Homo sapien
tatacagactacataattgaagagt

SEQ ID NO: 92923 - DNA, 25 bp, Homo sapien
tatacagactacgtaattgaagagt

SEQ ID NO: 92924 - DNA, 25 bp, Homo sapien
tatacagagaaatttttaggctgaa

SEQ ID NO: 92925 - DNA, 25 bp, Homo sapien
tatacagataaatttttaggctgaa

SEQ ID NO: 92926 - DNA, 25 bp, Homo sapien
tatacagcaggataagcaataaagc

SEQ ID NO: 92927 - DNA, 25 bp, Homo sapien
tatacagcaggttaagcaataaagc

SEQ ID NO: 92928 - DNA, 25 bp, Homo sapien
tatacagcttgggtatggctatgtc

SEQ ID NO: 92929 - DNA, 25 bp, Homo sapien
tatacagcttggttatggctatgtc

SEQ ID NO: 92930 - DNA, 25 bp, Homo sapien
tatacagtcctcatcaacacacaaa

SEQ ID NO: 92931 - DNA, 25 bp, Homo sapien
tatacagtcctcgtcaacacacaaa

SEQ ID NO: 92932 - DNA, 25 bp, Homo sapien
tatacataattaaaggattcaaagg

SEQ ID NO: 92933 - DNA, 25 bp, Homo sapien
tatacataattcaaggattcaaagg

SEQ ID NO: 92934 - DNA, 25 bp, Homo sapien
tatacatacttttttctgttgcact

SEQ ID NO: 92935 - DNA, 25 bp, Homo sapien
tatacatagagccttgtaaaccttg

SEQ ID NO: 92936 - DNA, 25 bp, Homo sapien
tatacatagagtcttgtaaaccttg

SEQ ID NO: 92937 - DNA, 25 bp, Homo sapien
tatacatatttttttctgttgcact

SEQ ID NO: 92938 - DNA, 25 bp, Homo sapien
tatacatcatcactctctggaatgc

SEQ ID NO: 92939 - DNA, 25 bp, Homo sapien
tatacatccacactcgttttctgaa

SEQ ID NO: 92940 - DNA, 25 bp, Homo sapien
tatacatccgcactcgttttctgaa

SEQ ID NO: 92941 - DNA, 25 bp, Homo sapien
tatacatcgtcactctctggaatgc

SEQ ID NO: 92942 - DNA, 25 bp, Homo sapien
tatacatgcgggagaaactcagaga

SEQ ID NO: 92943 - DNA, 25 bp, Homo sapien
tatacatgtgggagaaactcagaga

SEQ ID NO: 92944 - DNA, 25 bp, Homo sapien
tatacattcctaccatctgtgtaaa

SEQ ID NO: 92945 - DNA, 25 bp, Homo sapien
tatacattcctagcatctgtgtaaa

SEQ ID NO: 92946 - DNA, 25 bp, Homo sapien
tatacattgcacttgatgtctattg

SEQ ID NO: 92947 - DNA, 25 bp, Homo sapien
tatacattggacttgatgtctattg

SEQ ID NO: 92948 - DNA, 25 bp, Homo sapien
tatacatttagaaaagagcaaaccg

SEQ ID NO: 92949 - DNA, 25 bp, Homo sapien
tatacatttagagaagagcaaaccg

SEQ ID NO: 92950 - DNA, 25 bp, Homo sapien
tatacattttcaatcctcagagatg

SEQ ID NO: 92951 - DNA, 25 bp, Homo sapien
tatacattttcagtcctcagagatg

SEQ ID NO: 92952 - DNA, 25 bp, Homo sapien
tatacccacttctttacctcaccac

SEQ ID NO: 92953 - DNA, 25 bp, Homo sapien
tatacccagatacagctgcagaaca

SEQ ID NO: 92954 - DNA, 25 bp, Homo sapien
tatacccagatgcagctgcagaaca

SEQ ID NO: 92955 - DNA, 25 bp, Homo sapien
tatacccagttctttacctcaccac

SEQ ID NO: 92956 - DNA, 25 bp, Homo sapien
tatacctactgacctggcgtctcac

SEQ ID NO: 92957 - DNA, 25 bp, Homo sapien
tatacctactgccctggcgtctcac

SEQ ID NO: 92958 - DNA, 25 bp, Homo sapien
tatacctagaaaaagaaccgctgca

SEQ ID NO: 92959 - DNA, 25 bp, Homo sapien
tatacctagaaatagaaccgctgca

SEQ ID NO: 92960 - DNA, 25 bp, Homo sapien
tatacctagagaacaccaaagattc

SEQ ID NO: 92961 - DNA, 25 bp, Homo sapien
tatacctagagaacactaaagattc

SEQ ID NO: 92962 - DNA, 25 bp, Homo sapien
tatacctatgcctatcatatttcgc

SEQ ID NO: 92963 - DNA, 25 bp, Homo sapien
tatacctatgcttatcatatttcgc

SEQ ID NO: 92964 - DNA, 25 bp, Homo sapien
tatacctgaatacatacaccctaat

SEQ ID NO: 92965 - DNA, 25 bp, Homo sapien
tatacctgaatacatataccctaat

SEQ ID NO: 92966 - DNA, 25 bp, Homo sapien
tatacctgctaacgcaatctagcta

SEQ ID NO: 92967 - DNA, 25 bp, Homo sapien
tatacctgctaacggaatctagcta

SEQ ID NO: 92968 - DNA, 25 bp, Homo sapien
tatacctggcatcgaatctataaac

SEQ ID NO: 92969 - DNA, 25 bp, Homo sapien
tatacctggcatctaatctataaac

SEQ ID NO: 92970 - DNA, 25 bp, Homo sapien
tatacgatgaaaacgatatgataaa

SEQ ID NO: 92971 - DNA, 25 bp, Homo sapien
tatacgatgaaaactatatgataaa

SEQ ID NO: 92972 - DNA, 25 bp, Homo sapien
tatacgcaaaaactggtaacacaag

SEQ ID NO: 92973 - DNA, 25 bp, Homo sapien
tatacgcaaaaattggtaacacaag

SEQ ID NO: 92974 - DNA, 25 bp, Homo sapien
tatacgctactgatagaatgtaaat

SEQ ID NO: 92975 - DNA, 25 bp, Homo sapien
tatacgctactgatggaatgtaaat

SEQ ID NO: 92976 - DNA, 25 bp, Homo sapien
tatactaacatgcgtcaaagaatac

SEQ ID NO: 92977 - DNA, 25 bp, Homo sapien
tatactaacatgtgtcaaagaatac

SEQ ID NO: 92978 - DNA, 25 bp, Homo sapien
tatactacagggaaacaaaccaaaa

SEQ ID NO: 92979 - DNA, 25 bp, Homo sapien
tatactacagggaagcaaaccaaaa

SEQ ID NO: 92980 - DNA, 25 bp, Homo sapien
tatactatcaccatcatcagtatca

SEQ ID NO: 92981 - DNA, 25 bp, Homo sapien
tatactattaccatcatcagtatca

SEQ ID NO: 92982 - DNA, 25 bp, Homo sapien
tatactcaacgttcaacaagaaagt

SEQ ID NO: 92983 - DNA, 25 bp, Homo sapien
tatactcaatgttcaacaagaaagt

SEQ ID NO: 92984 - DNA, 25 bp, Homo sapien
tatactcatctagccacaggtatgc

SEQ ID NO: 92985 - DNA, 25 bp, Homo sapien
tatactcatctcgccacaggtatgc

SEQ ID NO: 92986 - DNA, 25 bp, Homo sapien
tatactcatctgtacaaacaaggcc

SEQ ID NO: 92987 - DNA, 25 bp, Homo sapien
tatactcatgtgtacaaacaaggcc

SEQ ID NO: 92988 - DNA, 25 bp, Homo sapien
tatactccaactgtccacttcttca

SEQ ID NO: 92989 - DNA, 25 bp, Homo sapien
tatactccaactgtccgcttcttca

SEQ ID NO: 92990 - DNA, 25 bp, Homo sapien
tatactcctcagtccatgaaaccaa

SEQ ID NO: 92991 - DNA, 25 bp, Homo sapien
tatactcctgagtccatgaaaccaa

SEQ ID NO: 92992 - DNA, 25 bp, Homo sapien
tatactcttaccagtcaataaggca

SEQ ID NO: 92993 - DNA, 25 bp, Homo sapien
tatactcttaccggtcaataaggca

SEQ ID NO: 92994 - DNA, 25 bp, Homo sapien
tatactgtacaaccagcaagtagag

SEQ ID NO: 92995 - DNA, 25 bp, Homo sapien
tatactgtacatccagcaagtagag

SEQ ID NO: 92996 - DNA, 25 bp, Homo sapien
tatacttactgacctgctgccattc

SEQ ID NO: 92997 - DNA, 25 bp, Homo sapien
tatacttactgtaacagagcttgat

SEQ ID NO: 92998 - DNA, 25 bp, Homo sapien
tatacttactgtaatagagcttgat

SEQ ID NO: 92999 - DNA, 25 bp, Homo sapien
tatacttagacatctttgaattttc

SEQ ID NO: 93000 - DNA, 25 bp, Homo sapien
tatacttagacatgtttgaattttc

SEQ ID NO: 93001 - DNA, 25 bp, Homo sapien
tatacttattgacctgctgccattc

SEQ ID NO: 93002 - DNA, 25 bp, Homo sapien
tatacttctacaccacatgggataa

SEQ ID NO: 93003 - DNA, 25 bp, Homo sapien
tatacttctgcaccacatgggataa

SEQ ID NO: 93004 - DNA, 25 bp, Homo sapien
tatacttggcgcatgctattcttaa

SEQ ID NO: 93005 - DNA, 25 bp, Homo sapien
tatacttggtgcatgctattcttaa

SEQ ID NO: 93006 - DNA, 25 bp, Homo sapien
tatactttggttcaaaagcggggtt

SEQ ID NO: 93007 - DNA, 25 bp, Homo sapien
tatactttggtttaaaagcggggtt

SEQ ID NO: 93008 - DNA, 25 bp, Homo sapien
tatagaaagtctcttatgccatgga

SEQ ID NO: 93009 - DNA, 25 bp, Homo sapien
tatagaaagtcttttatgccatgga

SEQ ID NO: 93010 - DNA, 25 bp, Homo sapien
tatagaacaaaatttaagaaaactg

SEQ ID NO: 93011 - DNA, 25 bp, Homo sapien
tatagaaccaaatttaagaaaactg

SEQ ID NO: 93012 - DNA, 25 bp, Homo sapien
tatagaagaaaaaacgcaggcttca

SEQ ID NO: 93013 - DNA, 25 bp, Homo sapien
tatagaagaggaaaagaatgtaagt

SEQ ID NO: 93014 - DNA, 25 bp, Homo sapien
tatagaagaggtaaagaatgtaagt

SEQ ID NO: 93015 - DNA, 25 bp, Homo sapien
tatagaagcagcttattgaaatgaa

SEQ ID NO: 93016 - DNA, 25 bp, Homo sapien
tatagaagcaggttattgaaatgaa

SEQ ID NO: 93017 - DNA, 25 bp, Homo sapien
tatagaaggaaaaacgcaggcttca

SEQ ID NO: 93018 - DNA, 25 bp, Homo sapien
tatagaatcttgccctgtcttccag

SEQ ID NO: 93019 - DNA, 25 bp, Homo sapien
tatagaatcttgctctgtcttccag

SEQ ID NO: 93020 - DNA, 25 bp, Homo sapien
tatagaatgagaagggaaggggttt

SEQ ID NO: 93021 - DNA, 25 bp, Homo sapien
tatagaatgagaggggaaggggttt

SEQ ID NO: 93022 - DNA, 25 bp, Homo sapien
tatagacaaccatccaatttcattt

SEQ ID NO: 93023 - DNA, 25 bp, Homo sapien
tatagacagccatccaatttcattt

SEQ ID NO: 93024 - DNA, 25 bp, Homo sapien
tatagacatttcaatagttgcccag

SEQ ID NO: 93025 - DNA, 25 bp, Homo sapien
tatagacatttcagtagttgcccag

SEQ ID NO: 93026 - DNA, 25 bp, Homo sapien
tatagaccattgaaagatccctgtc

SEQ ID NO: 93027 - DNA, 25 bp, Homo sapien
tatagaccatttaaagatccctgtc

SEQ ID NO: 93028 - DNA, 25 bp, Homo sapien
tatagacgatgagttgaaagcccag

SEQ ID NO: 93029 - DNA, 25 bp, Homo sapien
tatagacgctgagttgaaagcccag

SEQ ID NO: 93030 - DNA, 25 bp, Homo sapien
tatagactggctaaatggatttttt

SEQ ID NO: 93031 - DNA, 25 bp, Homo sapien
tatagactggctgaatggatttttt

SEQ ID NO: 93032 - DNA, 25 bp, Homo sapien
tatagagaaaacactgtattggtta

SEQ ID NO: 93033 - DNA, 25 bp, Homo sapien
tatagagaaaacgctgtattggtta

SEQ ID NO: 93034 - DNA, 25 bp, Homo sapien
tatagagattcagttgcaggagatt

SEQ ID NO: 93035 - DNA, 25 bp, Homo sapien
tatagagattcagttgtaggagatt

SEQ ID NO: 93036 - DNA, 25 bp, Homo sapien
tatagagcaaggcatggctaaaata

SEQ ID NO: 93037 - DNA, 25 bp, Homo sapien
tatagagcaaggcgtggctaaaata

SEQ ID NO: 93038 - DNA, 25 bp, Homo sapien
tatagagcatttcaggaatggataa

SEQ ID NO: 93039 - DNA, 25 bp, Homo sapien
tatagagcatttgaggaatggataa

SEQ ID NO: 93040 - DNA, 25 bp, Homo sapien
tatagagcttaacgaaggaatagaa

SEQ ID NO: 93041 - DNA, 25 bp, Homo sapien
tatagagcttaatgaaggaatagaa

SEQ ID NO: 93042 - DNA, 25 bp, Homo sapien
tatagataataacttcctagtctac

SEQ ID NO: 93043 - DNA, 25 bp, Homo sapien
tatagataataatttcctagtctac

SEQ ID NO: 93044 - DNA, 25 bp, Homo sapien
tatagataataggagccgaaattcc

SEQ ID NO: 93045 - DNA, 25 bp, Homo sapien
tatagataataggagctgaaattcc

SEQ ID NO: 93046 - DNA, 25 bp, Homo sapien
tatagatacaaattcaggaaagcat

SEQ ID NO: 93047 - DNA, 25 bp, Homo sapien
tatagatacgaattcaggaaagcat

SEQ ID NO: 93048 - DNA, 25 bp, Homo sapien
tatagatagatggacatcgagatag

SEQ ID NO: 93049 - DNA, 25 bp, Homo sapien
tatagatagatggatatcgagatag

SEQ ID NO: 93050 - DNA, 25 bp, Homo sapien
tatagatctgatcatgaattctctt

SEQ ID NO: 93051 - DNA, 25 bp, Homo sapien
tatagatctgatcgtgaattctctt

SEQ ID NO: 93052 - DNA, 25 bp, Homo sapien
tatagattccaaatttctcctctta

SEQ ID NO: 93053 - DNA, 25 bp, Homo sapien
tatagattctaaatttctcctctta

SEQ ID NO: 93054 - DNA, 25 bp, Homo sapien
tatagatttggaatcctgttatgtt

SEQ ID NO: 93055 - DNA, 25 bp, Homo sapien
tatagatttggagtcctgttatgtt

SEQ ID NO: 93056 - DNA, 25 bp, Homo sapien
tatagcaaatatacggctttagaag

SEQ ID NO: 93057 - DNA, 25 bp, Homo sapien
tatagcaaatatagggctttagaag

SEQ ID NO: 93058 - DNA, 25 bp, Homo sapien
tatagcaacaataatagaatgatag

SEQ ID NO: 93059 - DNA, 25 bp, Homo sapien
tatagcaaccataatagaatgatag

SEQ ID NO: 93060 - DNA, 25 bp, Homo sapien
tatagcacaagtgatacatatttga

SEQ ID NO: 93061 - DNA, 25 bp, Homo sapien
tatagcacagactagtttttcagtt

SEQ ID NO: 93062 - DNA, 25 bp, Homo sapien
tatagcacagactggtttttcagtt

SEQ ID NO: 93063 - DNA, 25 bp, Homo sapien
tatagcacgagtgatacatatttga

SEQ ID NO: 93064 - DNA, 25 bp, Homo sapien
tatagcagcattttaaaaagtagcc

SEQ ID NO: 93065 - DNA, 25 bp, Homo sapien
tatagcagcgttttaaaaagtagcc

SEQ ID NO: 93066 - DNA, 25 bp, Homo sapien
tatagctaaaggtgacctctgcaac

SEQ ID NO: 93067 - DNA, 25 bp, Homo sapien
tatagctaaaggtggcctctgcaac

SEQ ID NO: 93068 - DNA, 25 bp, Homo sapien
tatagctgagggaactgaggtccag

SEQ ID NO: 93069 - DNA, 25 bp, Homo sapien
tatagctgagggaattgaggtccag

SEQ ID NO: 93070 - DNA, 25 bp, Homo sapien
tatagctggctgtctaaagatatgt

SEQ ID NO: 93071 - DNA, 25 bp, Homo sapien
tatagctggctgtctacagatatgt

SEQ ID NO: 93072 - DNA, 25 bp, Homo sapien
tatagcttaaaaaataatctccata

SEQ ID NO: 93073 - DNA, 25 bp, Homo sapien
tatagcttacaaaataatctccata

SEQ ID NO: 93074 - DNA, 25 bp, Homo sapien
tataggaaaacaactaaggtctact

SEQ ID NO: 93075 - DNA, 25 bp, Homo sapien
tataggaagacaactaaggtctact

SEQ ID NO: 93076 - DNA, 25 bp, Homo sapien
tataggagacatcacaggaggaaaa

SEQ ID NO: 93077 - DNA, 25 bp, Homo sapien
tataggagacatctcaggaggaaaa

SEQ ID NO: 93078 - DNA, 25 bp, Homo sapien
tataggagagccactatgtaggtga

SEQ ID NO: 93079 - DNA, 25 bp, Homo sapien
tataggagagccattatgtaggtga

SEQ ID NO: 93080 - DNA, 25 bp, Homo sapien
tataggagcttgatacagggccagg

SEQ ID NO: 93081 - DNA, 25 bp, Homo sapien
tataggagcttgatacggggccagg

SEQ ID NO: 93082 - DNA, 25 bp, Homo sapien
tataggcacaccactcatccactct

SEQ ID NO: 93083 - DNA, 25 bp, Homo sapien
tataggcacttagcgaatggagaga

SEQ ID NO: 93084 - DNA, 25 bp, Homo sapien
tataggcacttagtgaatggagaga

SEQ ID NO: 93085 - DNA, 25 bp, Homo sapien
tataggcataccactcatccactct

SEQ ID NO: 93086 - DNA, 25 bp, Homo sapien
tataggcatcagaaatgtgagaaat

SEQ ID NO: 93087 - DNA, 25 bp, Homo sapien
tataggcattagaaatgtgagaaat

SEQ ID NO: 93088 - DNA, 25 bp, Homo sapien
tataggctatatggagagtttattt

SEQ ID NO: 93089 - DNA, 25 bp, Homo sapien
tataggctatattgagagtttattt

SEQ ID NO: 93090 - DNA, 25 bp, Homo sapien
tataggcttaggctcaaaatactac

SEQ ID NO: 93091 - DNA, 25 bp, Homo sapien
tataggcttaggttcaaaatactac

SEQ ID NO: 93092 - DNA, 25 bp, Homo sapien
tatagggaacaattaagaagaaggc

SEQ ID NO: 93093 - DNA, 25 bp, Homo sapien
tatagggagcaattaagaagaaggc

SEQ ID NO: 93094 - DNA, 25 bp, Homo sapien
tataggtcatagtcatttgcttcag

SEQ ID NO: 93095 - DNA, 25 bp, Homo sapien
tataggtcatagtgatttgcttcag

SEQ ID NO: 93096 - DNA, 25 bp, Homo sapien
tataggtgaaaagatttgcctgagt

SEQ ID NO: 93097 - DNA, 25 bp, Homo sapien
tataggtgaaatgatttgcctgagt

SEQ ID NO: 93098 - DNA, 25 bp, Homo sapien
tataggtgcttacaaacaattttga

SEQ ID NO: 93099 - DNA, 25 bp, Homo sapien
tataggtgcttacaaataattttga

SEQ ID NO: 93100 - DNA, 25 bp, Homo sapien
tataggttcttactttattgcactg

SEQ ID NO: 93101 - DNA, 25 bp, Homo sapien
tataggttcttattttattgcactg

SEQ ID NO: 93102 - DNA, 25 bp, Homo sapien
tatagtaagcaatgaaaagtagtaa

SEQ ID NO: 93103 - DNA, 25 bp, Homo sapien
tatagtaagcactgaaaagtagtaa

SEQ ID NO: 93104 - DNA, 25 bp, Homo sapien
tatagtaatcaattttatgtatatg

SEQ ID NO: 93105 - DNA, 25 bp, Homo sapien
tatagtaatcacaataatggcagca

SEQ ID NO: 93106 - DNA, 25 bp, Homo sapien
tatagtaatcacagtaatggcagca

SEQ ID NO: 93107 - DNA, 25 bp, Homo sapien
tatagtaatcatttttatgtatatg

SEQ ID NO: 93108 - DNA, 25 bp, Homo sapien
tatagtacctcacgcattatgactg

SEQ ID NO: 93109 - DNA, 25 bp, Homo sapien
tatagtacctcgcgcattatgactg

SEQ ID NO: 93110 - DNA, 25 bp, Homo sapien
tatagtatgaagaagaaaacagcca

SEQ ID NO: 93111 - DNA, 25 bp, Homo sapien
tatagtatgcaaccttatatccatc

SEQ ID NO: 93112 - DNA, 25 bp, Homo sapien
tatagtatgcagccttatatccatc

SEQ ID NO: 93113 - DNA, 25 bp, Homo sapien
tatagtattaagaagaaaacagcca

SEQ ID NO: 93114 - DNA, 25 bp, Homo sapien
tatagtattaaggatcatttttgag

SEQ ID NO: 93115 - DNA, 25 bp, Homo sapien
tatagtattaaggatcgtttttgag

SEQ ID NO: 93116 - DNA, 25 bp, Homo sapien
tatagtcactaagcatctactatgg

SEQ ID NO: 93117 - DNA, 25 bp, Homo sapien
tatagtcagtaagcatctactatgg

SEQ ID NO: 93118 - DNA, 25 bp, Homo sapien
tatagtcctatcctcacacttcctg

SEQ ID NO: 93119 - DNA, 25 bp, Homo sapien
tatagtcctatcctcatacttcctg

SEQ ID NO: 93120 - DNA, 25 bp, Homo sapien
tatagtcctgttcattcagtcctaa

SEQ ID NO: 93121 - DNA, 25 bp, Homo sapien
tatagtcctgttcgttcagtcctaa

SEQ ID NO: 93122 - DNA, 25 bp, Homo sapien
tatagtctattcaggtatctaaaca

SEQ ID NO: 93123 - DNA, 25 bp, Homo sapien
tatagtctattcagttatctaaaca

SEQ ID NO: 93124 - DNA, 25 bp, Homo sapien
tatagtgaaaaaccgaatattccaa

SEQ ID NO: 93125 - DNA, 25 bp, Homo sapien
tatagtgaaaatccgaatattccaa

SEQ ID NO: 93126 - DNA, 25 bp, Homo sapien
tatagtgcacatcccctaaggcagg

SEQ ID NO: 93127 - DNA, 25 bp, Homo sapien
tatagtgcatatcccctaaggcagg

SEQ ID NO: 93128 - DNA, 25 bp, Homo sapien
tatagtgcttgctacaattcaacac

SEQ ID NO: 93129 - DNA, 25 bp, Homo sapien
tatagtgcttgctacagttcaacac

SEQ ID NO: 93130 - DNA, 25 bp, Homo sapien
tatagtggaccatcaacttatgata

SEQ ID NO: 93131 - DNA, 25 bp, Homo sapien
tatagtggaccgtcaacttatgata

SEQ ID NO: 93132 - DNA, 25 bp, Homo sapien
tatagtggccatagtaagaagaagg

SEQ ID NO: 93133 - DNA, 25 bp, Homo sapien
tatagtggccatggtaagaagaagg

SEQ ID NO: 93134 - DNA, 25 bp, Homo sapien
tatagtggctaatacatgaggtgca

SEQ ID NO: 93135 - DNA, 25 bp, Homo sapien
tatagtggctaatatatgaggtgca

SEQ ID NO: 93136 - DNA, 25 bp, Homo sapien
tatagtgtacgtctacatactaaat

SEQ ID NO: 93137 - DNA, 25 bp, Homo sapien
tatagtgtaggtctacatactaaat

SEQ ID NO: 93138 - DNA, 25 bp, Homo sapien
tatagttactgaacattgaatatct

SEQ ID NO: 93139 - DNA, 25 bp, Homo sapien
tatagttattgaacattgaatatct

SEQ ID NO: 93140 - DNA, 25 bp, Homo sapien
tatagttcactcactccgaaacatg

SEQ ID NO: 93141 - DNA, 25 bp, Homo sapien
tatagttcactcactctgaaacatg

SEQ ID NO: 93142 - DNA, 25 bp, Homo sapien
tatagttccaaaggccagaaatctg

SEQ ID NO: 93143 - DNA, 25 bp, Homo sapien
tatagttccgaaggccagaaatctg

SEQ ID NO: 93144 - DNA, 25 bp, Homo sapien
tatagttctgagatatcaatgcaat

SEQ ID NO: 93145 - DNA, 25 bp, Homo sapien
tatagttctgagatgtcaatgcaat

SEQ ID NO: 93146 - DNA, 25 bp, Homo sapien
tatagttgcatcttgaagaaagaag

SEQ ID NO: 93147 - DNA, 25 bp, Homo sapien
tatagttgcgtcttgaagaaagaag

SEQ ID NO: 93148 - DNA, 25 bp, Homo sapien
tatagtttatggccaatttgctaca

SEQ ID NO: 93149 - DNA, 25 bp, Homo sapien
tatagtttatggcctatttgctaca

SEQ ID NO: 93150 - DNA, 25 bp, Homo sapien
tatagtttcagcctttagaattagg

SEQ ID NO: 93151 - DNA, 25 bp, Homo sapien
tatagtttcaggctttagaattagg

SEQ ID NO: 93152 - DNA, 25 bp, Homo sapien
tatagtttctaagcctttaagaaga

SEQ ID NO: 93153 - DNA, 25 bp, Homo sapien
tatagttttaatgtttaatgagctt

SEQ ID NO: 93154 - DNA, 25 bp, Homo sapien
tatagttttaatttttaatgagctt

SEQ ID NO: 93155 - DNA, 25 bp, Homo sapien
tatagtttttaagcctttaagaaga

SEQ ID NO: 93156 - DNA, 25 bp, Homo sapien
tatataaggaaattgaacatctgag

SEQ ID NO: 93157 - DNA, 25 bp, Homo sapien
tatataaggaacttgaacatctgag

SEQ ID NO: 93158 - DNA, 25 bp, Homo sapien
tatatacaaatggatgtcttttaca

SEQ ID NO: 93159 - DNA, 25 bp, Homo sapien
tatatacaaatgggtgtcttttaca

SEQ ID NO: 93160 - DNA, 25 bp, Homo sapien
tatatacaagtaggcatgtcgacca

SEQ ID NO: 93161 - DNA, 25 bp, Homo sapien
tatatacaatttaaaaagccttcag

SEQ ID NO: 93162 - DNA, 25 bp, Homo sapien
tatatacaattttaaaagccttcag

SEQ ID NO: 93163 - DNA, 25 bp, Homo sapien
tatatacatgtaggcatgtcgacca

SEQ ID NO: 93164 - DNA, 25 bp, Homo sapien
tatatacattttcaatcctcagaga

SEQ ID NO: 93165 - DNA, 25 bp, Homo sapien
tatatacattttcagtcctcagaga

SEQ ID NO: 93166 - DNA, 25 bp, Homo sapien
tatatacctagaaaaagaaccgctg

SEQ ID NO: 93167 - DNA, 25 bp, Homo sapien
tatatacctagaaatagaaccgctg

SEQ ID NO: 93168 - DNA, 25 bp, Homo sapien
tatatactcaacgttcaacaagaaa

SEQ ID NO: 93169 - DNA, 25 bp, Homo sapien
tatatactcaatgttcaacaagaaa

SEQ ID NO: 93170 - DNA, 25 bp, Homo sapien
tatatactcttaccagtcaataagg

SEQ ID NO: 93171 - DNA, 25 bp, Homo sapien
tatatactcttaccggtcaataagg

SEQ ID NO: 93172 - DNA, 25 bp, Homo sapien
tatatagaaaaagaagttggatgag

SEQ ID NO: 93173 - DNA, 25 bp, Homo sapien
tatatagagaaagaagttggatgag

SEQ ID NO: 93174 - DNA, 25 bp, Homo sapien
tatatagctaaaggtgacctctgca

SEQ ID NO: 93175 - DNA, 25 bp, Homo sapien
tatatagctaaaggtggcctctgca

SEQ ID NO: 93176 - DNA, 25 bp, Homo sapien
tatatagcttatctaggaatactgt

SEQ ID NO: 93177 - DNA, 25 bp, Homo sapien
tatatagcttatttaggaatactgt

SEQ ID NO: 93178 - DNA, 25 bp, Homo sapien
tatataggctatatggagagtttat

SEQ ID NO: 93179 - DNA, 25 bp, Homo sapien
tatataggctatattgagagtttat

SEQ ID NO: 93180 - DNA, 25 bp, Homo sapien
tatataggtgaaaagatttgcctga

SEQ ID NO: 93181 - DNA, 25 bp, Homo sapien
tatataggtgaaatgatttgcctga

SEQ ID NO: 93182 - DNA, 25 bp, Homo sapien
tatataggttgacttagctttgttc

SEQ ID NO: 93183 - DNA, 25 bp, Homo sapien
tatataggttggcttagctttgttc

SEQ ID NO: 93184 - DNA, 25 bp, Homo sapien
tatatagtcaatatccgtgtagact

SEQ ID NO: 93185 - DNA, 25 bp, Homo sapien
tatatagtcgatatccgtgtagact

SEQ ID NO: 93186 - DNA, 25 bp, Homo sapien
tatatagtgaaaaaaactgggttga

SEQ ID NO: 93187 - DNA, 25 bp, Homo sapien
tatatagtgtaaaaaactgggttga

SEQ ID NO: 93188 - DNA, 25 bp, Homo sapien
tatatataagatagcatcaataaac

SEQ ID NO: 93189 - DNA, 25 bp, Homo sapien
tatatatacgatagcatcaataaac

SEQ ID NO: 93190 - DNA, 25 bp, Homo sapien
tatatatcattctcagctggacaag

SEQ ID NO: 93191 - DNA, 25 bp, Homo sapien
tatatatcgttctcagctggacaag

SEQ ID NO: 93192 - DNA, 25 bp, Homo sapien
tatatatgccttcaagcttgatcca

SEQ ID NO: 93193 - DNA, 25 bp, Homo sapien
tatatatggacaactgatttgcaac

SEQ ID NO: 93194 - DNA, 25 bp, Homo sapien
tatatatggacagctgatttgcaac

SEQ ID NO: 93195 - DNA, 25 bp, Homo sapien
tatatatggcttcaagcttgatcca

SEQ ID NO: 93196 - DNA, 25 bp, Homo sapien
tatatattaaacagaacagggccca

SEQ ID NO: 93197 - DNA, 25 bp, Homo sapien
tatatattaaacataacagggccca

SEQ ID NO: 93198 - DNA, 25 bp, Homo sapien
tatatattgctttaagaagtgcggt

SEQ ID NO: 93199 - DNA, 25 bp, Homo sapien
tatatattgctttgagaagtgcggt

SEQ ID NO: 93200 - DNA, 25 bp, Homo sapien
tatatatttaaagctgtgtgccagg

SEQ ID NO: 93201 - DNA, 25 bp, Homo sapien
tatatatttaaagttgtgtgccagg

SEQ ID NO: 93202 - DNA, 25 bp, Homo sapien
tatatatttctcacttacctttctc

SEQ ID NO: 93203 - DNA, 25 bp, Homo sapien
tatatatttctcttaacgacctgtt

SEQ ID NO: 93204 - DNA, 25 bp, Homo sapien
tatatatttgtcacttacctttctc

SEQ ID NO: 93205 - DNA, 25 bp, Homo sapien
tatatatttttcttaacgacctgtt

SEQ ID NO: 93206 - DNA, 25 bp, Homo sapien
tatatcagagcatcaagaacactgc

SEQ ID NO: 93207 - DNA, 25 bp, Homo sapien
tatatcagagcgtcaagaacactgc

SEQ ID NO: 93208 - DNA, 25 bp, Homo sapien
tatatccaaacaagtcaagctagaa

SEQ ID NO: 93209 - DNA, 25 bp, Homo sapien
tatatccaagcaagtcaagctagaa

SEQ ID NO: 93210 - DNA, 25 bp, Homo sapien
tatatcccaggaagttgaaagtaat

SEQ ID NO: 93211 - DNA, 25 bp, Homo sapien
tatatcccaggaatttgaaagtaat

SEQ ID NO: 93212 - DNA, 25 bp, Homo sapien
tatatccctgtggcattaacagtga

SEQ ID NO: 93213 - DNA, 25 bp, Homo sapien
tatatccctgtggcgttaacagtga

SEQ ID NO: 93214 - DNA, 25 bp, Homo sapien
tatatctattagctataccaaggtt

SEQ ID NO: 93215 - DNA, 25 bp, Homo sapien
tatatctattagctctaccaaggtt

SEQ ID NO: 93216 - DNA, 25 bp, Homo sapien
tatatctccagccaaactgcctgaa

SEQ ID NO: 93217 - DNA, 25 bp, Homo sapien
tatatctccagccaaagtgcctgaa

SEQ ID NO: 93218 - DNA, 25 bp, Homo sapien
tatatctggctacattttatccatc

SEQ ID NO: 93219 - DNA, 25 bp, Homo sapien
tatatctgtctacattttatccatc

SEQ ID NO: 93220 - DNA, 25 bp, Homo sapien
tatatctgttcatattctgtctgcc

SEQ ID NO: 93221 - DNA, 25 bp, Homo sapien
tatatctgttcgtattctgtctgcc

SEQ ID NO: 93222 - DNA, 25 bp, Homo sapien
tatatcttccacatgatagttatgg

SEQ ID NO: 93223 - DNA, 25 bp, Homo sapien
tatatcttccacgtgatagttatgg

SEQ ID NO: 93224 - DNA, 25 bp, Homo sapien
tatatgaatagtcctaaaatagagg

SEQ ID NO: 93225 - DNA, 25 bp, Homo sapien
tatatgaatagtcgtaaaatagagg

SEQ ID NO: 93226 - DNA, 25 bp, Homo sapien
tatatgaatcgataatcttccagac

SEQ ID NO: 93227 - DNA, 25 bp, Homo sapien
tatatgaatcggtaatcttccagac

SEQ ID NO: 93228 - DNA, 25 bp, Homo sapien
tatatgaatgtaagctggatgtact

SEQ ID NO: 93229 - DNA, 25 bp, Homo sapien
tatatgaatgtaagttggatgtact

SEQ ID NO: 93230 - DNA, 25 bp, Homo sapien
tatatgagcaaatgaatccaagtat

SEQ ID NO: 93231 - DNA, 25 bp, Homo sapien
tatatgagcaactgaatccaagtat

SEQ ID NO: 93232 - DNA, 25 bp, Homo sapien
tatatgatacaatgatggcacatat

SEQ ID NO: 93233 - DNA, 25 bp, Homo sapien
tatatgatataatgatggcacatat

SEQ ID NO: 93234 - DNA, 25 bp, Homo sapien
tatatgcaagaatggcaattattac

SEQ ID NO: 93235 - DNA, 25 bp, Homo sapien
tatatgcactgcctaacaacacccc

SEQ ID NO: 93236 - DNA, 25 bp, Homo sapien
tatatgcactgcgtaacaacacccc

SEQ ID NO: 93237 - DNA, 25 bp, Homo sapien
tatatgcaggaatggcaattattac

SEQ ID NO: 93238 - DNA, 25 bp, Homo sapien
tatatgccattttataacctttttt

SEQ ID NO: 93239 - DNA, 25 bp, Homo sapien
tatatgccgttttataacctttttt

SEQ ID NO: 93240 - DNA, 25 bp, Homo sapien
tatatggcaaaagattataagtaca

SEQ ID NO: 93241 - DNA, 25 bp, Homo sapien
tatatggcaaaggattataagtaca

SEQ ID NO: 93242 - DNA, 25 bp, Homo sapien
tatatggcttttttattcactgaat

SEQ ID NO: 93243 - DNA, 25 bp, Homo sapien
tatatggctttttttttcactgaat

SEQ ID NO: 93244 - DNA, 25 bp, Homo sapien
tatatggtacaggctattgttccta

SEQ ID NO: 93245 - DNA, 25 bp, Homo sapien
tatatggtataggctattgttccta

SEQ ID NO: 93246 - DNA, 25 bp, Homo sapien
tatatggtctgaccattgtctgttt

SEQ ID NO: 93247 - DNA, 25 bp, Homo sapien
tatatggtctgaccgttgtctgttt

SEQ ID NO: 93248 - DNA, 25 bp, Homo sapien
tatatggtggtaagagagctgacat

SEQ ID NO: 93249 - DNA, 25 bp, Homo sapien
tatatggtggtatgagagctgacat

SEQ ID NO: 93250 - DNA, 25 bp, Homo sapien
tatatggttccagagaacactgaac

SEQ ID NO: 93251 - DNA, 25 bp, Homo sapien
tatatggttccatagaacactgaac

SEQ ID NO: 93252 - DNA, 25 bp, Homo sapien
tatatgtacatacacatgcggatgt

SEQ ID NO: 93253 - DNA, 25 bp, Homo sapien
tatatgtacctacacatgcggatgt

SEQ ID NO: 93254 - DNA, 25 bp, Homo sapien
tatatgtatagctttgccaccagta

SEQ ID NO: 93255 - DNA, 25 bp, Homo sapien
tatatgtatagctttgtcaccagta

SEQ ID NO: 93256 - DNA, 25 bp, Homo sapien
tatatgtcttaaacttttgatatga

SEQ ID NO: 93257 - DNA, 25 bp, Homo sapien
tatatgtcttaatcttttgatatga

SEQ ID NO: 93258 - DNA, 25 bp, Homo sapien
tatatgtggttgaaaacgtgttaat

SEQ ID NO: 93259 - DNA, 25 bp, Homo sapien
tatatgtggttgaaaatgtgttaat

SEQ ID NO: 93260 - DNA, 25 bp, Homo sapien
tatatgtgttcgactttatatctgc

SEQ ID NO: 93261 - DNA, 25 bp, Homo sapien
tatatgtgttcggctttatatctgc

SEQ ID NO: 93262 - DNA, 25 bp, Homo sapien
tatatgttgaggtgttaagtttttt

SEQ ID NO: 93263 - DNA, 25 bp, Homo sapien
tatatgttggggtgttaagtttttt

SEQ ID NO: 93264 - DNA, 25 bp, Homo sapien
tatattaaacagaacagggcccatg

SEQ ID NO: 93265 - DNA, 25 bp, Homo sapien
tatattaaacataacagggcccatg

SEQ ID NO: 93266 - DNA, 25 bp, Homo sapien
tatattaaactgaaaacattctgca

SEQ ID NO: 93267 - DNA, 25 bp, Homo sapien
tatattaaactgaaaatattctgca

SEQ ID NO: 93268 - DNA, 25 bp, Homo sapien
tatattagagaaaaaaatgtctttt

SEQ ID NO: 93269 - DNA, 25 bp, Homo sapien
tatattagggaaaaaaatgtctttt

SEQ ID NO: 93270 - DNA, 25 bp, Homo sapien
tatattatcatccgagccataactg

SEQ ID NO: 93271 - DNA, 25 bp, Homo sapien
tatattatcatcggagccataactg

SEQ ID NO: 93272 - DNA, 25 bp, Homo sapien
tatattatccatcattatggcaaag

SEQ ID NO: 93273 - DNA, 25 bp, Homo sapien
tatattatccatctttatggcaaag

SEQ ID NO: 93274 - DNA, 25 bp, Homo sapien
tatattatctcaaatggcacaaggg

SEQ ID NO: 93275 - DNA, 25 bp, Homo sapien
tatattatctcacatggcacaaggg

SEQ ID NO: 93276 - DNA, 25 bp, Homo sapien
tatattatctttatgcagtatccct

SEQ ID NO: 93277 - DNA, 25 bp, Homo sapien
tatattatctttgtgcagtatccct

SEQ ID NO: 93278 - DNA, 25 bp, Homo sapien
tatattatgagaattagtggtcact

SEQ ID NO: 93279 - DNA, 25 bp, Homo sapien
tatattatgagagttagtggtcact

SEQ ID NO: 93280 - DNA, 25 bp, Homo sapien
tatattcagaaaatctgggataaat

SEQ ID NO: 93281 - DNA, 25 bp, Homo sapien
tatattcagaaaatcttggataaat

SEQ ID NO: 93282 - DNA, 25 bp, Homo sapien
tatattcagcattattcaagcagct

SEQ ID NO: 93283 - DNA, 25 bp, Homo sapien
tatattcagcattgttcaagcagct

SEQ ID NO: 93284 - DNA, 25 bp, Homo sapien
tatattctatcatttagagaggtct

SEQ ID NO: 93285 - DNA, 25 bp, Homo sapien
tatattctgtcatttagagaggtct

SEQ ID NO: 93286 - DNA, 25 bp, Homo sapien
tatattgacaaacactcagaccagt

SEQ ID NO: 93287 - DNA, 25 bp, Homo sapien
tatattgacaaatactcagaccagt

SEQ ID NO: 93288 - DNA, 25 bp, Homo sapien
tatattgctttaagaagtgcggtca

SEQ ID NO: 93289 - DNA, 25 bp, Homo sapien
tatattgctttgagaagtgcggtca

SEQ ID NO: 93290 - DNA, 25 bp, Homo sapien
tatattggatatcgtgaattgtctg

SEQ ID NO: 93291 - DNA, 25 bp, Homo sapien
tatattggatatcttgaattgtctg

SEQ ID NO: 93292 - DNA, 25 bp, Homo sapien
tatattggtgggatttaaatcaaac

SEQ ID NO: 93293 - DNA, 25 bp, Homo sapien
tatattggtgggattttaatcaaac

SEQ ID NO: 93294 - DNA, 25 bp, Homo sapien
tatatttaaagctgtgtgccaggtt

SEQ ID NO: 93295 - DNA, 25 bp, Homo sapien
tatatttaaagttgtgtgccaggtt

SEQ ID NO: 93296 - DNA, 25 bp, Homo sapien
tatatttcaacactaaaatttagcg

SEQ ID NO: 93297 - DNA, 25 bp, Homo sapien
tatatttcaacagtaaaatttagcg

SEQ ID NO: 93298 - DNA, 25 bp, Homo sapien
tatatttcagtagtcaggtatgttt

SEQ ID NO: 93299 - DNA, 25 bp, Homo sapien
tatatttcattagtcaggtatgttt

SEQ ID NO: 93300 - DNA, 25 bp, Homo sapien
tatatttcccattatctgatgactg

SEQ ID NO: 93301 - DNA, 25 bp, Homo sapien
tatatttctcattatctgatgactg

SEQ ID NO: 93302 - DNA, 25 bp, Homo sapien
tatatttcttttgccaacctgcatc

SEQ ID NO: 93303 - DNA, 25 bp, Homo sapien
tatatttcttttgtcaacctgcatc

SEQ ID NO: 93304 - DNA, 25 bp, Homo sapien
tatatttgaaaaaagacttcatatc

SEQ ID NO: 93305 - DNA, 25 bp, Homo sapien
tatatttgataaaagacttcatatc

SEQ ID NO: 93306 - DNA, 25 bp, Homo sapien
tatattttctcatgatgaattcttc

SEQ ID NO: 93307 - DNA, 25 bp, Homo sapien
tatattttctcttgatgaattcttc

SEQ ID NO: 93308 - DNA, 25 bp, Homo sapien
tatattttctgacttaatttttaat

SEQ ID NO: 93309 - DNA, 25 bp, Homo sapien
tatattttctgatttaatttttaat

SEQ ID NO: 93310 - DNA, 25 bp, Homo sapien
tatattttcttcaggccagctactc

SEQ ID NO: 93311 - DNA, 25 bp, Homo sapien
tatattttcttcgggccagctactc

SEQ ID NO: 93312 - DNA, 25 bp, Homo sapien
tatatttttcaaactacctccatga

SEQ ID NO: 93313 - DNA, 25 bp, Homo sapien
tatatttttgaaactacctccatga

SEQ ID NO: 93314 - DNA, 25 bp, Homo sapien
tatcaaaaaatgagttaaaccaatc

SEQ ID NO: 93315 - DNA, 25 bp, Homo sapien
tatcaaaaaatgagttgaaccaatc

SEQ ID NO: 93316 - DNA, 25 bp, Homo sapien
tatcaaaacatacgaaaacctaaat

SEQ ID NO: 93317 - DNA, 25 bp, Homo sapien
tatcaaaacatatgaaaacctaaat

SEQ ID NO: 93318 - DNA, 25 bp, Homo sapien
tatcaaaaccctgtgcatacttcaa

SEQ ID NO: 93319 - DNA, 25 bp, Homo sapien
tatcaaaaccctgtgcgtacttcaa

SEQ ID NO: 93320 - DNA, 25 bp, Homo sapien
tatcaaaacctaatcacctcccaag

SEQ ID NO: 93321 - DNA, 25 bp, Homo sapien
tatcaaaacctcatcacctcccaag

SEQ ID NO: 93322 - DNA, 25 bp, Homo sapien
tatcaaaattccaaaatataaaggc

SEQ ID NO: 93323 - DNA, 25 bp, Homo sapien
tatcaaaattccgaaatataaaggc

SEQ ID NO: 93324 - DNA, 25 bp, Homo sapien
tatcaaaatttgcaggatatggttg

SEQ ID NO: 93325 - DNA, 25 bp, Homo sapien
tatcaaaatttgtaggatatggttg

SEQ ID NO: 93326 - DNA, 25 bp, Homo sapien
tatcaaagatcacaaacagtgcaaa

SEQ ID NO: 93327 - DNA, 25 bp, Homo sapien
tatcaaagatcataaacagtgcaaa

SEQ ID NO: 93328 - DNA, 25 bp, Homo sapien
tatcaaagtcatacgtgtagagaag

SEQ ID NO: 93329 - DNA, 25 bp, Homo sapien
tatcaaagtcatatgtgtagagaag

SEQ ID NO: 93330 - DNA, 25 bp, Homo sapien
tatcaaatatgattagaaaacaatg

SEQ ID NO: 93331 - DNA, 25 bp, Homo sapien
tatcaaatatgattggaaaacaatg

SEQ ID NO: 93332 - DNA, 25 bp, Homo sapien
tatcaacacattgattctctaacgc

SEQ ID NO: 93333 - DNA, 25 bp, Homo sapien
tatcaacacatttattctctaacgc

SEQ ID NO: 93334 - DNA, 25 bp, Homo sapien
tatcaacacggataagcaaagaaat

SEQ ID NO: 93335 - DNA, 25 bp, Homo sapien
tatcaacacgggtaagcaaagaaat

SEQ ID NO: 93336 - DNA, 25 bp, Homo sapien
tatcaacagcacacaaaccttggta

SEQ ID NO: 93337 - DNA, 25 bp, Homo sapien
tatcaacatcacacaaaccttggta

SEQ ID NO: 93338 - DNA, 25 bp, Homo sapien
tatcaagaaagaggaattttgctaa

SEQ ID NO: 93339 - DNA, 25 bp, Homo sapien
tatcaagaaaggagaagcccaagca

SEQ ID NO: 93340 - DNA, 25 bp, Homo sapien
tatcaagaaggagataccgtatata

SEQ ID NO: 93341 - DNA, 25 bp, Homo sapien
tatcaagaaggaggtaccgtatata

SEQ ID NO: 93342 - DNA, 25 bp, Homo sapien
tatcaagaagggagaagcccaagca

SEQ ID NO: 93343 - DNA, 25 bp, Homo sapien
tatcaagaataaccccataaacaag

SEQ ID NO: 93344 - DNA, 25 bp, Homo sapien
tatcaagaataatcccataaacaag

SEQ ID NO: 93345 - DNA, 25 bp, Homo sapien
tatcaagaatgaggaattttgctaa

SEQ ID NO: 93346 - DNA, 25 bp, Homo sapien
tatcaatcaaatgtcagtaaacaat

SEQ ID NO: 93347 - DNA, 25 bp, Homo sapien
tatcaatcaaatttcagtaaacaat

SEQ ID NO: 93348 - DNA, 25 bp, Homo sapien
tatcaatgattaaaaagactaaaaa

SEQ ID NO: 93349 - DNA, 25 bp, Homo sapien
tatcaatgattagaaagactaaaaa

SEQ ID NO: 93350 - DNA, 25 bp, Homo sapien
tatcacaaacaaaagaaattcaaaa

SEQ ID NO: 93351 - DNA, 25 bp, Homo sapien
tatcacaaacaaaataaattcaaaa

SEQ ID NO: 93352 - DNA, 25 bp, Homo sapien
tatcacacacttagcagatgaaaac

SEQ ID NO: 93353 - DNA, 25 bp, Homo sapien
tatcacacatttagcagatgaaaac

SEQ ID NO: 93354 - DNA, 25 bp, Homo sapien
tatcacactgtctcgactaatgtac

SEQ ID NO: 93355 - DNA, 25 bp, Homo sapien
tatcacactgtcttgactaatgtac

SEQ ID NO: 93356 - DNA, 25 bp, Homo sapien
tatcacatgcatcctcacatgcaca

SEQ ID NO: 93357 - DNA, 25 bp, Homo sapien
tatcacatgcattctcacatgcaca

SEQ ID NO: 93358 - DNA, 25 bp, Homo sapien
tatcaccaaaggatttaaatgtata

SEQ ID NO: 93359 - DNA, 25 bp, Homo sapien
tatcaccaaaggttttaaatgtata

SEQ ID NO: 93360 - DNA, 25 bp, Homo sapien
tatcaccaacaacaataaatcagga

SEQ ID NO: 93361 - DNA, 25 bp, Homo sapien
tatcaccaacaataataaatcagga

SEQ ID NO: 93362 - DNA, 25 bp, Homo sapien
tatcaccacctaagaaaggcatgta

SEQ ID NO: 93363 - DNA, 25 bp, Homo sapien
tatcaccacctacgaaaggcatgta

SEQ ID NO: 93364 - DNA, 25 bp, Homo sapien
tatcaccatgaacgtaatgaatctt

SEQ ID NO: 93365 - DNA, 25 bp, Homo sapien
tatcaccatgaatgtaatgaatctt

SEQ ID NO: 93366 - DNA, 25 bp, Homo sapien
tatcaccccatacattttctagttg

SEQ ID NO: 93367 - DNA, 25 bp, Homo sapien
tatcaccccatacgttttctagttg

SEQ ID NO: 93368 - DNA, 25 bp, Homo sapien
tatcacctgcgctccgcctcctgtc

SEQ ID NO: 93369 - DNA, 25 bp, Homo sapien
tatcacctgtgctccgcctcctgtc

SEQ ID NO: 93370 - DNA, 25 bp, Homo sapien
tatcacctttgatgagtggccatct

SEQ ID NO: 93371 - DNA, 25 bp, Homo sapien
tatcacctttgttgagtggccatct

SEQ ID NO: 93372 - DNA, 25 bp, Homo sapien
tatcactatgcctacttgtaataag

SEQ ID NO: 93373 - DNA, 25 bp, Homo sapien
tatcactatgcctatttgtaataag

SEQ ID NO: 93374 - DNA, 25 bp, Homo sapien
tatcactcaagactattgtgtcaaa

SEQ ID NO: 93375 - DNA, 25 bp, Homo sapien
tatcactcaggactattgtgtcaaa

SEQ ID NO: 93376 - DNA, 25 bp, Homo sapien
tatcactgacaatagccgaaactta

SEQ ID NO: 93377 - DNA, 25 bp, Homo sapien
tatcactgacaatagcggaaactta

SEQ ID NO: 93378 - DNA, 25 bp, Homo sapien
tatcactgcttctggttgaatcatg

SEQ ID NO: 93379 - DNA, 25 bp, Homo sapien
tatcactgcttttggttgaatcatg

SEQ ID NO: 93380 - DNA, 25 bp, Homo sapien
tatcagaaatattgtcacatctaat

SEQ ID NO: 93381 - DNA, 25 bp, Homo sapien
tatcagaaatattgtcccatctaat

SEQ ID NO: 93382 - DNA, 25 bp, Homo sapien
tatcagaagcgttttgtgtaaatag

SEQ ID NO: 93383 - DNA, 25 bp, Homo sapien
tatcagaagtgttttgtgtaaatag

SEQ ID NO: 93384 - DNA, 25 bp, Homo sapien
tatcagaatcttgagtccaataatt

SEQ ID NO: 93385 - DNA, 25 bp, Homo sapien
tatcagaatcttgagtgcaataatt

SEQ ID NO: 93386 - DNA, 25 bp, Homo sapien
tatcagacattcaaaagagaattgg

SEQ ID NO: 93387 - DNA, 25 bp, Homo sapien
tatcagacgttcaaaagagaattgg

SEQ ID NO: 93388 - DNA, 25 bp, Homo sapien
tatcagagaattgggcatgagttta

SEQ ID NO: 93389 - DNA, 25 bp, Homo sapien
tatcagagaattgggcgtgagttta

SEQ ID NO: 93390 - DNA, 25 bp, Homo sapien
tatcagatatcgaacttataaacta

SEQ ID NO: 93391 - DNA, 25 bp, Homo sapien
tatcagatatcgaatttataaacta

SEQ ID NO: 93392 - DNA, 25 bp, Homo sapien
tatcagattatcagtaaaacaagtg

SEQ ID NO: 93393 - DNA, 25 bp, Homo sapien
tatcagattgtcagtaaaacaagtg

SEQ ID NO: 93394 - DNA, 25 bp, Homo sapien
tatcagcaactactgaatgtgaggc

SEQ ID NO: 93395 - DNA, 25 bp, Homo sapien
tatcagcaactattgaatgtgaggc

SEQ ID NO: 93396 - DNA, 25 bp, Homo sapien
tatcagcagagtcattatacaattg

SEQ ID NO: 93397 - DNA, 25 bp, Homo sapien
tatcagcagtgtcattatacaattg

SEQ ID NO: 93398 - DNA, 25 bp, Homo sapien
tatcagctcatcatctgcagttact

SEQ ID NO: 93399 - DNA, 25 bp, Homo sapien
tatcagctcgtcatctgcagttact

SEQ ID NO: 93400 - DNA, 25 bp, Homo sapien
tatcaggaaagtaacacaagtagtg

SEQ ID NO: 93401 - DNA, 25 bp, Homo sapien
tatcaggaaagtaatacaagtagtg

SEQ ID NO: 93402 - DNA, 25 bp, Homo sapien
tatcaggatctgcttgaatatttga

SEQ ID NO: 93403 - DNA, 25 bp, Homo sapien
tatcaggatctgcttggatatttga

SEQ ID NO: 93404 - DNA, 25 bp, Homo sapien
tatcagtcaggaacccatcagcaga

SEQ ID NO: 93405 - DNA, 25 bp, Homo sapien
tatcagtcaggaactcatcagcaga

SEQ ID NO: 93406 - DNA, 25 bp, Homo sapien
tatcagtcagtctcatactttcagg

SEQ ID NO: 93407 - DNA, 25 bp, Homo sapien
tatcagtcagtctcatcctttcagg

SEQ ID NO: 93408 - DNA, 25 bp, Homo sapien
tatcagtccatgagtaatactgctt

SEQ ID NO: 93409 - DNA, 25 bp, Homo sapien
tatcagtccgtgagtaatactgctt

SEQ ID NO: 93410 - DNA, 25 bp, Homo sapien
tatcagtgaagttaatcgtgcccca

SEQ ID NO: 93411 - DNA, 25 bp, Homo sapien
tatcagtgaagttcatcgtgcccca

SEQ ID NO: 93412 - DNA, 25 bp, Homo sapien
tatcagtggcttcatataccaaagt

SEQ ID NO: 93413 - DNA, 25 bp, Homo sapien
tatcagtggtaataggaggtgcatc

SEQ ID NO: 93414 - DNA, 25 bp, Homo sapien
tatcagtggtaataggcggtgcatc

SEQ ID NO: 93415 - DNA, 25 bp, Homo sapien
tatcagtgtcttcatataccaaagt

SEQ ID NO: 93416 - DNA, 25 bp, Homo sapien
tatcagttaggatctaacctcttcc

SEQ ID NO: 93417 - DNA, 25 bp, Homo sapien
tatcagttaggatctagcctcttcc

SEQ ID NO: 93418 - DNA, 25 bp, Homo sapien
tatcagttcagctgcttcaaacata

SEQ ID NO: 93419 - DNA, 25 bp, Homo sapien
tatcagttcagttgcttcaaacata

SEQ ID NO: 93420 - DNA, 25 bp, Homo sapien
tatcataaaattgactatggtagga

SEQ ID NO: 93421 - DNA, 25 bp, Homo sapien
tatcataaaattgactctggtagga

SEQ ID NO: 93422 - DNA, 25 bp, Homo sapien
tatcataaccagttccaccaaaaag

SEQ ID NO: 93423 - DNA, 25 bp, Homo sapien
tatcataatcagttccaccaaaaag

SEQ ID NO: 93424 - DNA, 25 bp, Homo sapien
tatcataatttttgagttacagctc

SEQ ID NO: 93425 - DNA, 25 bp, Homo sapien
tatcataattttttagttacagctc

SEQ ID NO: 93426 - DNA, 25 bp, Homo sapien
tatcatattatacgtaggagcaatc

SEQ ID NO: 93427 - DNA, 25 bp, Homo sapien
tatcatattatatgtaggagcaatc

SEQ ID NO: 93428 - DNA, 25 bp, Homo sapien
tatcatcaggtctctcctttggaga

SEQ ID NO: 93429 - DNA, 25 bp, Homo sapien
tatcatcagttctctcctttggaga

SEQ ID NO: 93430 - DNA, 25 bp, Homo sapien
tatcatcattgacccacattgtggt

SEQ ID NO: 93431 - DNA, 25 bp, Homo sapien
tatcatcattggcccacattgtggt

SEQ ID NO: 93432 - DNA, 25 bp, Homo sapien
tatcatctccaccgttattatttta

SEQ ID NO: 93433 - DNA, 25 bp, Homo sapien
tatcatctccactgttattatttta

SEQ ID NO: 93434 - DNA, 25 bp, Homo sapien
tatcatctttgccgtgatttgagtc

SEQ ID NO: 93435 - DNA, 25 bp, Homo sapien
tatcatctttgctgtgatttgagtc

SEQ ID NO: 93436 - DNA, 25 bp, Homo sapien
tatcatgaaatccaaacctcgtcag

SEQ ID NO: 93437 - DNA, 25 bp, Homo sapien
tatcatgaaattcaaacctcgtcag

SEQ ID NO: 93438 - DNA, 25 bp, Homo sapien
tatcatgaagcctgacaatttaaaa

SEQ ID NO: 93439 - DNA, 25 bp, Homo sapien
tatcatgaagcctgacgatttaaaa

SEQ ID NO: 93440 - DNA, 25 bp, Homo sapien
tatcatgccagctaaaattggccag

SEQ ID NO: 93441 - DNA, 25 bp, Homo sapien
tatcatgcgtgacccctgaagtctg

SEQ ID NO: 93442 - DNA, 25 bp, Homo sapien
tatcatgcgtgatccctgaagtctg

SEQ ID NO: 93443 - DNA, 25 bp, Homo sapien
tatcatgctagctaaaattggccag

SEQ ID NO: 93444 - DNA, 25 bp, Homo sapien
tatcatgctcccattgtgaacttca

SEQ ID NO: 93445 - DNA, 25 bp, Homo sapien
tatcatgctcccgttgtgaacttca

SEQ ID NO: 93446 - DNA, 25 bp, Homo sapien
tatcatggcactcagtctggtgggt

SEQ ID NO: 93447 - DNA, 25 bp, Homo sapien
tatcatggcactcagtgtggtgggt

SEQ ID NO: 93448 - DNA, 25 bp, Homo sapien
tatcattacggcatcatcgtcatct

SEQ ID NO: 93449 - DNA, 25 bp, Homo sapien
tatcattagtttctgtgatcacaaa

SEQ ID NO: 93450 - DNA, 25 bp, Homo sapien
tatcattatctttcaatctcctcca

SEQ ID NO: 93451 - DNA, 25 bp, Homo sapien
tatcattatctttcgatctcctcca

SEQ ID NO: 93452 - DNA, 25 bp, Homo sapien
tatcattatggcatcatcgtcatct

SEQ ID NO: 93453 - DNA, 25 bp, Homo sapien
tatcattattttctgtgatcacaaa

SEQ ID NO: 93454 - DNA, 25 bp, Homo sapien
tatcattcacctaaagacccactca

SEQ ID NO: 93455 - DNA, 25 bp, Homo sapien
tatcattcatctaaagacccactca

SEQ ID NO: 93456 - DNA, 25 bp, Homo sapien
tatcatttacatagcttaaaaaagg

SEQ ID NO: 93457 - DNA, 25 bp, Homo sapien
tatcatttagtataacattgatgcc

SEQ ID NO: 93458 - DNA, 25 bp, Homo sapien
tatcatttagtgtaacattgatgcc

SEQ ID NO: 93459 - DNA, 25 bp, Homo sapien
tatcatttatcatgagaagtgctgg

SEQ ID NO: 93460 - DNA, 25 bp, Homo sapien
tatcatttatcctgagaagtgctgg

SEQ ID NO: 93461 - DNA, 25 bp, Homo sapien
tatcatttctgcagttattaaaagt

SEQ ID NO: 93462 - DNA, 25 bp, Homo sapien
tatcatttctgcagttcttaaaagt

SEQ ID NO: 93463 - DNA, 25 bp, Homo sapien
tatcatttgaaaccagaaaactgtt

SEQ ID NO: 93464 - DNA, 25 bp, Homo sapien
tatcatttgaaactagaaaactgtt

SEQ ID NO: 93465 - DNA, 25 bp, Homo sapien
tatcatttgcatagcttaaaaaagg

SEQ ID NO: 93466 - DNA, 25 bp, Homo sapien
tatcatttggtagcatttaaggcac

SEQ ID NO: 93467 - DNA, 25 bp, Homo sapien
tatcatttggtggcatttaaggcac

SEQ ID NO: 93468 - DNA, 25 bp, Homo sapien
tatcatttgtgcattcactgaagta

SEQ ID NO: 93469 - DNA, 25 bp, Homo sapien
tatcatttgtgcgttcactgaagta

SEQ ID NO: 93470 - DNA, 25 bp, Homo sapien
tatcattttcttacatggctatata

SEQ ID NO: 93471 - DNA, 25 bp, Homo sapien
tatcatttttttacatggctatata

SEQ ID NO: 93472 - DNA, 25 bp, Homo sapien
tatccaaaggacgtgttaggctaat

SEQ ID NO: 93473 - DNA, 25 bp, Homo sapien
tatccaaaggaggtgttaggctaat

SEQ ID NO: 93474 - DNA, 25 bp, Homo sapien
tatccaactggcagcactgtaggtt

SEQ ID NO: 93475 - DNA, 25 bp, Homo sapien
tatccaactgggagcactgtaggtt

SEQ ID NO: 93476 - DNA, 25 bp, Homo sapien
tatccaatgcgtatgtgcaatgcca

SEQ ID NO: 93477 - DNA, 25 bp, Homo sapien
tatccaatgtgtatgtgcaatgcca

SEQ ID NO: 93478 - DNA, 25 bp, Homo sapien
tatccaccacattccatatttgtct

SEQ ID NO: 93479 - DNA, 25 bp, Homo sapien
tatccaccatattccatatttgtct

SEQ ID NO: 93480 - DNA, 25 bp, Homo sapien
tatccacctgcaggtttacaaaggt

SEQ ID NO: 93481 - DNA, 25 bp, Homo sapien
tatccacctgcgggtttacaaaggt

SEQ ID NO: 93482 - DNA, 25 bp, Homo sapien
tatccactctgttgctagatcacag

SEQ ID NO: 93483 - DNA, 25 bp, Homo sapien
tatccactctgttgttagatcacag

SEQ ID NO: 93484 - DNA, 25 bp, Homo sapien
tatccagcgccattcccacaggctt

SEQ ID NO: 93485 - DNA, 25 bp, Homo sapien
tatccagcggcattcccacaggctt

SEQ ID NO: 93486 - DNA, 25 bp, Homo sapien
tatccagctgttatttttgtatgtg

SEQ ID NO: 93487 - DNA, 25 bp, Homo sapien
tatccagctgttctttttgtatgtg

SEQ ID NO: 93488 - DNA, 25 bp, Homo sapien
tatccagggttacttctagccctcg

SEQ ID NO: 93489 - DNA, 25 bp, Homo sapien
tatccagggttccttctagccctcg

SEQ ID NO: 93490 - DNA, 25 bp, Homo sapien
tatccagtataagctaaacattatc

SEQ ID NO: 93491 - DNA, 25 bp, Homo sapien
tatccagtatatgctaaacattatc

SEQ ID NO: 93492 - DNA, 25 bp, Homo sapien
tatccagtctcactgcttcatctac

SEQ ID NO: 93493 - DNA, 25 bp, Homo sapien
tatccagtctcattgcttcatctac

SEQ ID NO: 93494 - DNA, 25 bp, Homo sapien
tatccagttctcaaatgaccatcag

SEQ ID NO: 93495 - DNA, 25 bp, Homo sapien
tatccagttttcaaatgaccatcag

SEQ ID NO: 93496 - DNA, 25 bp, Homo sapien
tatccataattctgtttcttttttc

SEQ ID NO: 93497 - DNA, 25 bp, Homo sapien
tatccataattttgtttcttttttc

SEQ ID NO: 93498 - DNA, 25 bp, Homo sapien
tatccatagagaagtttgtttgaga

SEQ ID NO: 93499 - DNA, 25 bp, Homo sapien
tatccatagggaagtttgtttgaga

SEQ ID NO: 93500 - DNA, 25 bp, Homo sapien
tatccatcagttggagacattaaca

SEQ ID NO: 93501 - DNA, 25 bp, Homo sapien
tatccatcagttggaggcattaaca

SEQ ID NO: 93502 - DNA, 25 bp, Homo sapien
tatccatgaatataatgctacaata

SEQ ID NO: 93503 - DNA, 25 bp, Homo sapien
tatccatgaatttaatgctacaata

SEQ ID NO: 93504 - DNA, 25 bp, Homo sapien
tatccatgcgcagtttaaaaatttc

SEQ ID NO: 93505 - DNA, 25 bp, Homo sapien
tatccatgcgcagttttaaaatttc

SEQ ID NO: 93506 - DNA, 25 bp, Homo sapien
tatccattcagggacttatatacca

SEQ ID NO: 93507 - DNA, 25 bp, Homo sapien
tatccattcaggggcttatatacca

SEQ ID NO: 93508 - DNA, 25 bp, Homo sapien
tatccattgtttagcgacttctcca

SEQ ID NO: 93509 - DNA, 25 bp, Homo sapien
tatccattgtttagtgacttctcca

SEQ ID NO: 93510 - DNA, 25 bp, Homo sapien
tatcccaaaaaaaagagcatgaatt

SEQ ID NO: 93511 - DNA, 25 bp, Homo sapien
tatcccaaaaaaaagatcatgaatt

SEQ ID NO: 93512 - DNA, 25 bp, Homo sapien
tatcccagacatgcaaggagattca

SEQ ID NO: 93513 - DNA, 25 bp, Homo sapien
tatcccagacattcaaggagattca

SEQ ID NO: 93514 - DNA, 25 bp, Homo sapien
tatcccagcttaacattttaaccca

SEQ ID NO: 93515 - DNA, 25 bp, Homo sapien
tatcccagcttaatattttaaccca

SEQ ID NO: 93516 - DNA, 25 bp, Homo sapien
tatcccaggaagttgaaagtaatga

SEQ ID NO: 93517 - DNA, 25 bp, Homo sapien
tatcccaggaatttgaaagtaatga

SEQ ID NO: 93518 - DNA, 25 bp, Homo sapien
tatcccatgcgtacttgcctaattt

SEQ ID NO: 93519 - DNA, 25 bp, Homo sapien
tatcccatgtgtacttgcctaattt

SEQ ID NO: 93520 - DNA, 25 bp, Homo sapien
tatccctcattcctaaccatcctca

SEQ ID NO: 93521 - DNA, 25 bp, Homo sapien
tatccctcattcttaaccatcctca

SEQ ID NO: 93522 - DNA, 25 bp, Homo sapien
tatccctctcatttttcaggcagct

SEQ ID NO: 93523 - DNA, 25 bp, Homo sapien
tatccctcttatttttcaggcagct

SEQ ID NO: 93524 - DNA, 25 bp, Homo sapien
tatccctgtggcattaacagtgatg

SEQ ID NO: 93525 - DNA, 25 bp, Homo sapien
tatccctgtggcgttaacagtgatg

SEQ ID NO: 93526 - DNA, 25 bp, Homo sapien
tatcccttcaccatcattgttccag

SEQ ID NO: 93527 - DNA, 25 bp, Homo sapien
tatcccttcgccatcattgttccag

SEQ ID NO: 93528 - DNA, 25 bp, Homo sapien
tatccgagtattacattgccactat

SEQ ID NO: 93529 - DNA, 25 bp, Homo sapien
tatccgagtattatattgccactat

SEQ ID NO: 93530 - DNA, 25 bp, Homo sapien
tatcctaaattttgcctacctccag

SEQ ID NO: 93531 - DNA, 25 bp, Homo sapien
tatcctaaattttgtctacctccag

SEQ ID NO: 93532 - DNA, 25 bp, Homo sapien
tatcctatgtcatatggcccaacgt

SEQ ID NO: 93533 - DNA, 25 bp, Homo sapien
tatcctatgtcgtatggcccaacgt

SEQ ID NO: 93534 - DNA, 25 bp, Homo sapien
tatcctcacagtactcattctcctt

SEQ ID NO: 93535 - DNA, 25 bp, Homo sapien
tatcctcacggtactcattctcctt

SEQ ID NO: 93536 - DNA, 25 bp, Homo sapien
tatcctctaagagaactttcagctc

SEQ ID NO: 93537 - DNA, 25 bp, Homo sapien
tatcctctaagggaactttcagctc

SEQ ID NO: 93538 - DNA, 25 bp, Homo sapien
tatccttaggagtcagaaatagcag

SEQ ID NO: 93539 - DNA, 25 bp, Homo sapien
tatccttaggagtctgaaatagcag

SEQ ID NO: 93540 - DNA, 25 bp, Homo sapien
tatccttgaaaagacggtccataac

SEQ ID NO: 93541 - DNA, 25 bp, Homo sapien
tatccttgaaaagatggtccataac

SEQ ID NO: 93542 - DNA, 25 bp, Homo sapien
tatccttggtccactgacttatctt

SEQ ID NO: 93543 - DNA, 25 bp, Homo sapien
tatccttggtccattgacttatctt

SEQ ID NO: 93544 - DNA, 25 bp, Homo sapien
tatcctttaaactcagaatttataa

SEQ ID NO: 93545 - DNA, 25 bp, Homo sapien
tatcctttaaactcggaatttataa

SEQ ID NO: 93546 - DNA, 25 bp, Homo sapien
tatcctttatgtccttttctctgaa

SEQ ID NO: 93547 - DNA, 25 bp, Homo sapien
tatcctttatgtctttttctctgaa

SEQ ID NO: 93548 - DNA, 25 bp, Homo sapien
tatcgaagctgaacagcagcagggg

SEQ ID NO: 93549 - DNA, 25 bp, Homo sapien
tatcgaagctgaacggcagcagggg

SEQ ID NO: 93550 - DNA, 25 bp, Homo sapien
tatcgaggcccaggctcatatgtcc

SEQ ID NO: 93551 - DNA, 25 bp, Homo sapien
tatcgaggcccgggctcatatgtcc

SEQ ID NO: 93552 - DNA, 25 bp, Homo sapien
tatcgataaatatgtgtgtggaggt

SEQ ID NO: 93553 - DNA, 25 bp, Homo sapien
tatcgataagtatgtgtgtggaggt

SEQ ID NO: 93554 - DNA, 25 bp, Homo sapien
tatcgccttgatttaccaggaaatt

SEQ ID NO: 93555 - DNA, 25 bp, Homo sapien
tatcgccttgatttactaggaaatt

SEQ ID NO: 93556 - DNA, 25 bp, Homo sapien
tatcggactatataaaaatcaaagc

SEQ ID NO: 93557 - DNA, 25 bp, Homo sapien
tatcggactatataaatatcaaagc

SEQ ID NO: 93558 - DNA, 25 bp, Homo sapien
tatcggccagatttaatccaaataa

SEQ ID NO: 93559 - DNA, 25 bp, Homo sapien
tatcggccagatttgatccaaataa

SEQ ID NO: 93560 - DNA, 25 bp, Homo sapien
tatcggtgtatatcaaattttcctg

SEQ ID NO: 93561 - DNA, 25 bp, Homo sapien
tatcggtgtatttcaaattttcctg

SEQ ID NO: 93562 - DNA, 25 bp, Homo sapien
tatcgtggtataacaggcactgcat

SEQ ID NO: 93563 - DNA, 25 bp, Homo sapien
tatcgtggtgtaacaggcactgcat

SEQ ID NO: 93564 - DNA, 25 bp, Homo sapien
tatctaactaagggctatttgtgac

SEQ ID NO: 93565 - DNA, 25 bp, Homo sapien
tatctaactaaggtctatttgtgac

SEQ ID NO: 93566 - DNA, 25 bp, Homo sapien
tatctaatacgttgggtggtacaag

SEQ ID NO: 93567 - DNA, 25 bp, Homo sapien
tatctaatgcgttgggtggtacaag

SEQ ID NO: 93568 - DNA, 25 bp, Homo sapien
tatctacacttagaaaaattgtgag

SEQ ID NO: 93569 - DNA, 25 bp, Homo sapien
tatctacacttagataaattgtgag

SEQ ID NO: 93570 - DNA, 25 bp, Homo sapien
tatctacagaaataattgtctctct

SEQ ID NO: 93571 - DNA, 25 bp, Homo sapien
tatctacagaagtaattgtctctct

SEQ ID NO: 93572 - DNA, 25 bp, Homo sapien
tatctaccctttaatatcttcctcc

SEQ ID NO: 93573 - DNA, 25 bp, Homo sapien
tatctaccttttaatatcttcctcc

SEQ ID NO: 93574 - DNA, 25 bp, Homo sapien
tatctactcagacatacgtgaaaag

SEQ ID NO: 93575 - DNA, 25 bp, Homo sapien
tatctactcagacataggtgaaaag

SEQ ID NO: 93576 - DNA, 25 bp, Homo sapien
tatctagtttatccattattctgaa

SEQ ID NO: 93577 - DNA, 25 bp, Homo sapien
tatctagtttatcccttattctgaa

SEQ ID NO: 93578 - DNA, 25 bp, Homo sapien
tatctatatgtacatacacatgcgg

SEQ ID NO: 93579 - DNA, 25 bp, Homo sapien
tatctatatgtacctacacatgcgg

SEQ ID NO: 93580 - DNA, 25 bp, Homo sapien
tatctatattgacaaacactcagac

SEQ ID NO: 93581 - DNA, 25 bp, Homo sapien
tatctatattgacaaatactcagac

SEQ ID NO: 93582 - DNA, 25 bp, Homo sapien
tatctatggccaactcatgcacaat

SEQ ID NO: 93583 - DNA, 25 bp, Homo sapien
tatctatggccagctcatgcacaat

SEQ ID NO: 93584 - DNA, 25 bp, Homo sapien
tatctattagctataccaaggttac

SEQ ID NO: 93585 - DNA, 25 bp, Homo sapien
tatctattagctctaccaaggttac

SEQ ID NO: 93586 - DNA, 25 bp, Homo sapien
tatctattcaagccttttttatttt

SEQ ID NO: 93587 - DNA, 25 bp, Homo sapien
tatctattcaaggcttttttatttt

SEQ ID NO: 93588 - DNA, 25 bp, Homo sapien
tatctcaaagggcttttgtgagcac

SEQ ID NO: 93589 - DNA, 25 bp, Homo sapien
tatctcaaagggtttttgtgagcac

SEQ ID NO: 93590 - DNA, 25 bp, Homo sapien
tatctcacaatgttcacaggatttg

SEQ ID NO: 93591 - DNA, 25 bp, Homo sapien
tatctcacagtgttcacaggatttg

SEQ ID NO: 93592 - DNA, 25 bp, Homo sapien
tatctcagcatatacaagttcagga

SEQ ID NO: 93593 - DNA, 25 bp, Homo sapien
tatctcagcatatacaggttcagga

SEQ ID NO: 93594 - DNA, 25 bp, Homo sapien
tatctcatacttatctcggtctgag

SEQ ID NO: 93595 - DNA, 25 bp, Homo sapien
tatctcatacttatcttggtctgag

SEQ ID NO: 93596 - DNA, 25 bp, Homo sapien
tatctcatgcggatttatgtccaca

SEQ ID NO: 93597 - DNA, 25 bp, Homo sapien
tatctcatgtggatttatgtccaca

SEQ ID NO: 93598 - DNA, 25 bp, Homo sapien
tatctccaatgttcagcagcttgca

SEQ ID NO: 93599 - DNA, 25 bp, Homo sapien
tatctccaatgtttagcagcttgca

SEQ ID NO: 93600 - DNA, 25 bp, Homo sapien
tatctccaccaatcatgttatacct

SEQ ID NO: 93601 - DNA, 25 bp, Homo sapien
tatctccaccaatcgtgttatacct

SEQ ID NO: 93602 - DNA, 25 bp, Homo sapien
tatctccacgaggttggtcattggc

SEQ ID NO: 93603 - DNA, 25 bp, Homo sapien
tatctccagccaaactgcctgaagt

SEQ ID NO: 93604 - DNA, 25 bp, Homo sapien
tatctccagccaaagtgcctgaagt

SEQ ID NO: 93605 - DNA, 25 bp, Homo sapien
tatctccatgaggttggtcattggc

SEQ ID NO: 93606 - DNA, 25 bp, Homo sapien
tatctcctccatcttgccatcatac

SEQ ID NO: 93607 - DNA, 25 bp, Homo sapien
tatctcctccattttgccatcatac

SEQ ID NO: 93608 - DNA, 25 bp, Homo sapien
tatctctgcttcctccctagcagtt

SEQ ID NO: 93609 - DNA, 25 bp, Homo sapien
tatctctgcttcttccctagcagtt

SEQ ID NO: 93610 - DNA, 25 bp, Homo sapien
tatctcttcacagtcatgatgtctc

SEQ ID NO: 93611 - DNA, 25 bp, Homo sapien
tatctcttcgcagtcatgatgtctc

SEQ ID NO: 93612 - DNA, 25 bp, Homo sapien
tatctcttgcgagtacgatttcaat

SEQ ID NO: 93613 - DNA, 25 bp, Homo sapien
tatctcttgggagtacgatttcaat

SEQ ID NO: 93614 - DNA, 25 bp, Homo sapien
tatctctttactatccattactttt

SEQ ID NO: 93615 - DNA, 25 bp, Homo sapien
tatctctttactatcccttactttt

SEQ ID NO: 93616 - DNA, 25 bp, Homo sapien
tatctgaactaattggtgatattcc

SEQ ID NO: 93617 - DNA, 25 bp, Homo sapien
tatctgaattaattggtgatattcc

SEQ ID NO: 93618 - DNA, 25 bp, Homo sapien
tatctgagatttccttctgcgcctc

SEQ ID NO: 93619 - DNA, 25 bp, Homo sapien
tatctgagatttctttctgcgcctc

SEQ ID NO: 93620 - DNA, 25 bp, Homo sapien
tatctgaggatgaaaaaatgacccc

SEQ ID NO: 93621 - DNA, 25 bp, Homo sapien
tatctgaggttgaaaaaatgacccc

SEQ ID NO: 93622 - DNA, 25 bp, Homo sapien
tatctgatactaatatagccattcc

SEQ ID NO: 93623 - DNA, 25 bp, Homo sapien
tatctgatactagtatagccattcc

SEQ ID NO: 93624 - DNA, 25 bp, Homo sapien
tatctgcacttcatttaaatgctta

SEQ ID NO: 93625 - DNA, 25 bp, Homo sapien
tatctgcactttatttaaatgctta

SEQ ID NO: 93626 - DNA, 25 bp, Homo sapien
tatctgccactgattgctgttaaaa

SEQ ID NO: 93627 - DNA, 25 bp, Homo sapien
tatctgccctgcaatgttgctaaat

SEQ ID NO: 93628 - DNA, 25 bp, Homo sapien
tatctgccgctgattgctgttaaaa

SEQ ID NO: 93629 - DNA, 25 bp, Homo sapien
tatctgcctactgctcaaactcagc

SEQ ID NO: 93630 - DNA, 25 bp, Homo sapien
tatctgcctactgttcaaactcagc

SEQ ID NO: 93631 - DNA, 25 bp, Homo sapien
tatctgccttctataactccatata

SEQ ID NO: 93632 - DNA, 25 bp, Homo sapien
tatctgccttctgtaactccatata

SEQ ID NO: 93633 - DNA, 25 bp, Homo sapien
tatctgccttgcaatgttgctaaat

SEQ ID NO: 93634 - DNA, 25 bp, Homo sapien
tatctgcttctatcacaacctgcag

SEQ ID NO: 93635 - DNA, 25 bp, Homo sapien
tatctgcttctatcacgacctgcag

SEQ ID NO: 93636 - DNA, 25 bp, Homo sapien
tatctggaaacattttttggttgtc

SEQ ID NO: 93637 - DNA, 25 bp, Homo sapien
tatctggaaacgttttttggttgtc

SEQ ID NO: 93638 - DNA, 25 bp, Homo sapien
tatctggacaactacccttttcagg

SEQ ID NO: 93639 - DNA, 25 bp, Homo sapien
tatctggacaactatccttttcagg

SEQ ID NO: 93640 - DNA, 25 bp, Homo sapien
tatctggagtcaggattcttcttta

SEQ ID NO: 93641 - DNA, 25 bp, Homo sapien
tatctggagtcagggttcttcttta

SEQ ID NO: 93642 - DNA, 25 bp, Homo sapien
tatctggatcaacacgtgagattag

SEQ ID NO: 93643 - DNA, 25 bp, Homo sapien
tatctggatcaacatgtgagattag

SEQ ID NO: 93644 - DNA, 25 bp, Homo sapien
tatctgggtcagctttctctcccat

SEQ ID NO: 93645 - DNA, 25 bp, Homo sapien
tatctgggtcagctttgtctcccat

SEQ ID NO: 93646 - DNA, 25 bp, Homo sapien
tatctgggttgaagtttaatttctg

SEQ ID NO: 93647 - DNA, 25 bp, Homo sapien
tatctgggttgaggtttaatttctg

SEQ ID NO: 93648 - DNA, 25 bp, Homo sapien
tatctggtataaattttcttcaaaa

SEQ ID NO: 93649 - DNA, 25 bp, Homo sapien
tatctggtataatttttcttcaaaa

SEQ ID NO: 93650 - DNA, 25 bp, Homo sapien
tatctggtcctggaaatgtcagact

SEQ ID NO: 93651 - DNA, 25 bp, Homo sapien
tatctggtcctgggaatgtcagact

SEQ ID NO: 93652 - DNA, 25 bp, Homo sapien
tatctgtaatcccttgtatcacatt

SEQ ID NO: 93653 - DNA, 25 bp, Homo sapien
tatctgtaatcctttgtatcacatt

SEQ ID NO: 93654 - DNA, 25 bp, Homo sapien
tatctgtgacaggtatacccttaca

SEQ ID NO: 93655 - DNA, 25 bp, Homo sapien
tatctgtggcaggtatacccttaca

SEQ ID NO: 93656 - DNA, 25 bp, Homo sapien
tatctgttacgtgatgccatcctag

SEQ ID NO: 93657 - DNA, 25 bp, Homo sapien
tatctgttatgtgatgccatcctag

SEQ ID NO: 93658 - DNA, 25 bp, Homo sapien
tatctgttcaatgtgactagtagaa

SEQ ID NO: 93659 - DNA, 25 bp, Homo sapien
tatctgttctgtccctacagtgatt

SEQ ID NO: 93660 - DNA, 25 bp, Homo sapien
tatctgttctgttcctacagtgatt

SEQ ID NO: 93661 - DNA, 25 bp, Homo sapien
tatctgtttaatgtgactagtagaa

SEQ ID NO: 93662 - DNA, 25 bp, Homo sapien
tatcttaaccattcacagagaaagc

SEQ ID NO: 93663 - DNA, 25 bp, Homo sapien
tatcttaaccattcgcagagaaagc

SEQ ID NO: 93664 - DNA, 25 bp, Homo sapien
tatcttattcaattcctggccattc

SEQ ID NO: 93665 - DNA, 25 bp, Homo sapien
tatcttatttaattcctggccattc

SEQ ID NO: 93666 - DNA, 25 bp, Homo sapien
tatcttcaggttagattgtcactgt

SEQ ID NO: 93667 - DNA, 25 bp, Homo sapien
tatcttcaggttaggttgtcactgt

SEQ ID NO: 93668 - DNA, 25 bp, Homo sapien
tatcttcagttcttacagtggggaa

SEQ ID NO: 93669 - DNA, 25 bp, Homo sapien
tatcttcatttcttacagtggggaa

SEQ ID NO: 93670 - DNA, 25 bp, Homo sapien
tatcttccaacaaatagattaggag

SEQ ID NO: 93671 - DNA, 25 bp, Homo sapien
tatcttccaacaagtagattaggag

SEQ ID NO: 93672 - DNA, 25 bp, Homo sapien
tatcttctaaataatccacccaatg

SEQ ID NO: 93673 - DNA, 25 bp, Homo sapien
tatcttctaaatactccacccaatg

SEQ ID NO: 93674 - DNA, 25 bp, Homo sapien
tatcttctctgacaacaaggaaata

SEQ ID NO: 93675 - DNA, 25 bp, Homo sapien
tatcttctctgactacaaggaaata

SEQ ID NO: 93676 - DNA, 25 bp, Homo sapien
tatcttgaaagtaacaaacttgctt

SEQ ID NO: 93677 - DNA, 25 bp, Homo sapien
tatcttgaaagtagcaaacttgctt

SEQ ID NO: 93678 - DNA, 25 bp, Homo sapien
tatcttgactagagctttgcacata

SEQ ID NO: 93679 - DNA, 25 bp, Homo sapien
tatcttgacttctactcttgagcag

SEQ ID NO: 93680 - DNA, 25 bp, Homo sapien
tatcttgactttatgtttttagtaa

SEQ ID NO: 93681 - DNA, 25 bp, Homo sapien
tatcttgacttttactcttgagcag

SEQ ID NO: 93682 - DNA, 25 bp, Homo sapien
tatcttgagaaaacagggctaaatg

SEQ ID NO: 93683 - DNA, 25 bp, Homo sapien
tatcttgagaagacagggctaaatg

SEQ ID NO: 93684 - DNA, 25 bp, Homo sapien
tatcttgagtagagctttgcacata

SEQ ID NO: 93685 - DNA, 25 bp, Homo sapien
tatcttgattttatgtttttagtaa

SEQ ID NO: 93686 - DNA, 25 bp, Homo sapien
tatcttgcatgaacttttgtaactg

SEQ ID NO: 93687 - DNA, 25 bp, Homo sapien
tatcttgcatggacttttgtaactg

SEQ ID NO: 93688 - DNA, 25 bp, Homo sapien
tatcttgctgaaaattgacacagaa

SEQ ID NO: 93689 - DNA, 25 bp, Homo sapien
tatcttgctgaagattgacacagaa

SEQ ID NO: 93690 - DNA, 25 bp, Homo sapien
tatcttgctgagttctagtcgcaga

SEQ ID NO: 93691 - DNA, 25 bp, Homo sapien
tatcttgcttagttctagtcgcaga

SEQ ID NO: 93692 - DNA, 25 bp, Homo sapien
tatcttgcttcttaagtgtatttat

SEQ ID NO: 93693 - DNA, 25 bp, Homo sapien
tatcttgcttcttaggtgtatttat

SEQ ID NO: 93694 - DNA, 25 bp, Homo sapien
tatcttgtcctgactaatggctgga

SEQ ID NO: 93695 - DNA, 25 bp, Homo sapien
tatcttgtcttgactaatggctgga

SEQ ID NO: 93696 - DNA, 25 bp, Homo sapien
tatctttacagaacttcagtatttc

SEQ ID NO: 93697 - DNA, 25 bp, Homo sapien
tatctttacagagcttcagtatttc

SEQ ID NO: 93698 - DNA, 25 bp, Homo sapien
tatctttacgcaacagcatcatttt

SEQ ID NO: 93699 - DNA, 25 bp, Homo sapien
tatctttactcaacagcatcatttt

SEQ ID NO: 93700 - DNA, 25 bp, Homo sapien
tatctttagtagaagtgctgccact

SEQ ID NO: 93701 - DNA, 25 bp, Homo sapien
tatctttagtaggagtgctgccact

SEQ ID NO: 93702 - DNA, 25 bp, Homo sapien
tatctttatgaccttgagattgcca

SEQ ID NO: 93703 - DNA, 25 bp, Homo sapien
tatctttatgaccttgcgattgcca

SEQ ID NO: 93704 - DNA, 25 bp, Homo sapien
tatctttcagagttacaatactcct

SEQ ID NO: 93705 - DNA, 25 bp, Homo sapien
tatctttcagagttccaatactcct

SEQ ID NO: 93706 - DNA, 25 bp, Homo sapien
tatctttcatccggtaaccactcat

SEQ ID NO: 93707 - DNA, 25 bp, Homo sapien
tatctttcatctggtaaccactcat

SEQ ID NO: 93708 - DNA, 25 bp, Homo sapien
tatctttgaaaatgccctcagctgt

SEQ ID NO: 93709 - DNA, 25 bp, Homo sapien
tatctttgaaaatgtcctcagctgt

SEQ ID NO: 93710 - DNA, 25 bp, Homo sapien
tatctttgagatgatgtcactagga

SEQ ID NO: 93711 - DNA, 25 bp, Homo sapien
tatctttgagatggtgtcactagga

SEQ ID NO: 93712 - DNA, 25 bp, Homo sapien
tatctttgctgcttcaacttgttct

SEQ ID NO: 93713 - DNA, 25 bp, Homo sapien
tatctttgctgcttcatcttgttct

SEQ ID NO: 93714 - DNA, 25 bp, Homo sapien
tatctttggtgcaaattattttatt

SEQ ID NO: 93715 - DNA, 25 bp, Homo sapien
tatctttggtgcaagttattttatt

SEQ ID NO: 93716 - DNA, 25 bp, Homo sapien
tatcttttgagagcatggtttagtg

SEQ ID NO: 93717 - DNA, 25 bp, Homo sapien
tatcttttgcagtgtttaaattttc

SEQ ID NO: 93718 - DNA, 25 bp, Homo sapien
tatcttttgcgagcatggtttagtg

SEQ ID NO: 93719 - DNA, 25 bp, Homo sapien
tatcttttgctagagaatgaaatca

SEQ ID NO: 93720 - DNA, 25 bp, Homo sapien
tatcttttgctatagaatgaaatca

SEQ ID NO: 93721 - DNA, 25 bp, Homo sapien
tatcttttgtagtgtttaaattttc

SEQ ID NO: 93722 - DNA, 25 bp, Homo sapien
tatgaaaaaaatatcacacaaattc

SEQ ID NO: 93723 - DNA, 25 bp, Homo sapien
tatgaaaaaaatatcagacaaattc

SEQ ID NO: 93724 - DNA, 25 bp, Homo sapien
tatgaaaagacatcctaactgatgt

SEQ ID NO: 93725 - DNA, 25 bp, Homo sapien
tatgaaaatacatcctaactgatgt

SEQ ID NO: 93726 - DNA, 25 bp, Homo sapien
tatgaaactttactatctgaatgtg

SEQ ID NO: 93727 - DNA, 25 bp, Homo sapien
tatgaaactttactatgtgaatgtg

SEQ ID NO: 93728 - DNA, 25 bp, Homo sapien
tatgaaagaccccattcaatatccg

SEQ ID NO: 93729 - DNA, 25 bp, Homo sapien
tatgaaagaccccgttcaatatccg

SEQ ID NO: 93730 - DNA, 25 bp, Homo sapien
tatgaaagtgtctacctaagatagg

SEQ ID NO: 93731 - DNA, 25 bp, Homo sapien
tatgaaagtgtctgcctaagatagg

SEQ ID NO: 93732 - DNA, 25 bp, Homo sapien
tatgaaatagctgctcctccagaaa

SEQ ID NO: 93733 - DNA, 25 bp, Homo sapien
tatgaaatagcttctcctccagaaa

SEQ ID NO: 93734 - DNA, 25 bp, Homo sapien
tatgaaatctgtggagcttgacaaa

SEQ ID NO: 93735 - DNA, 25 bp, Homo sapien
tatgaaatgctctttcagaggcacg

SEQ ID NO: 93736 - DNA, 25 bp, Homo sapien
tatgaaatggtctttcagaggcacg

SEQ ID NO: 93737 - DNA, 25 bp, Homo sapien
tatgaaatttgtggagcttgacaaa

SEQ ID NO: 93738 - DNA, 25 bp, Homo sapien
tatgaacaaaaatatcctagtgaaa

SEQ ID NO: 93739 - DNA, 25 bp, Homo sapien
tatgaacaattaacatttcttggac

SEQ ID NO: 93740 - DNA, 25 bp, Homo sapien
tatgaacagaaatatcctagtgaaa

SEQ ID NO: 93741 - DNA, 25 bp, Homo sapien
tatgaacagctatatactcacaaac

SEQ ID NO: 93742 - DNA, 25 bp, Homo sapien
tatgaacagctatttactcacaaac

SEQ ID NO: 93743 - DNA, 25 bp, Homo sapien
tatgaacagcttaacaaagatcagt

SEQ ID NO: 93744 - DNA, 25 bp, Homo sapien
tatgaacagcttaccaaagatcagt

SEQ ID NO: 93745 - DNA, 25 bp, Homo sapien
tatgaacagttaacatttcttggac

SEQ ID NO: 93746 - DNA, 25 bp, Homo sapien
tatgaaccatttacttctaaaataa

SEQ ID NO: 93747 - DNA, 25 bp, Homo sapien
tatgaaccgtttacttctaaaataa

SEQ ID NO: 93748 - DNA, 25 bp, Homo sapien
tatgaactacggtataacacgtctg

SEQ ID NO: 93749 - DNA, 25 bp, Homo sapien
tatgaactatggtataacacgtctg

SEQ ID NO: 93750 - DNA, 25 bp, Homo sapien
tatgaacttcatggtcttcagaata

SEQ ID NO: 93751 - DNA, 25 bp, Homo sapien
tatgaacttcattgtcttcagaata

SEQ ID NO: 93752 - DNA, 25 bp, Homo sapien
tatgaagaaaccagcctctgtgaag

SEQ ID NO: 93753 - DNA, 25 bp, Homo sapien
tatgaagaaaccaggctctgtgaag

SEQ ID NO: 93754 - DNA, 25 bp, Homo sapien
tatgaagctagaacccaatgggacc

SEQ ID NO: 93755 - DNA, 25 bp, Homo sapien
tatgaagctagaactcaatgggacc

SEQ ID NO: 93756 - DNA, 25 bp, Homo sapien
tatgaagtgatgcgataacagctcc

SEQ ID NO: 93757 - DNA, 25 bp, Homo sapien
tatgaagtgatgtgataacagctcc

SEQ ID NO: 93758 - DNA, 25 bp, Homo sapien
tatgaatcgataatcttccagactt

SEQ ID NO: 93759 - DNA, 25 bp, Homo sapien
tatgaatcggtaatcttccagactt

SEQ ID NO: 93760 - DNA, 25 bp, Homo sapien
tatgaatgagcaaacataaaaaaga

SEQ ID NO: 93761 - DNA, 25 bp, Homo sapien
tatgaatgagcaaagataaaaaaga

SEQ ID NO: 93762 - DNA, 25 bp, Homo sapien
tatgaatgcctaatatgcacatgaa

SEQ ID NO: 93763 - DNA, 25 bp, Homo sapien
tatgaatgcctagtatgcacatgaa

SEQ ID NO: 93764 - DNA, 25 bp, Homo sapien
tatgaatgtaagctggatgtactat

SEQ ID NO: 93765 - DNA, 25 bp, Homo sapien
tatgaatgtaagttggatgtactat

SEQ ID NO: 93766 - DNA, 25 bp, Homo sapien
tatgaatgtcacaacggaaaaggtg

SEQ ID NO: 93767 - DNA, 25 bp, Homo sapien
tatgaatgtcacaagggaaaaggtg

SEQ ID NO: 93768 - DNA, 25 bp, Homo sapien
tatgaattagaaacagagtagtctt

SEQ ID NO: 93769 - DNA, 25 bp, Homo sapien
tatgaattagaaccagagtagtctt

SEQ ID NO: 93770 - DNA, 25 bp, Homo sapien
tatgaattgacaatttgtagccttt

SEQ ID NO: 93771 - DNA, 25 bp, Homo sapien
tatgaattggcaatttgtagccttt

SEQ ID NO: 93772 - DNA, 25 bp, Homo sapien
tatgaatttgtccactttcactgat

SEQ ID NO: 93773 - DNA, 25 bp, Homo sapien
tatgaatttgttcactttcactgat

SEQ ID NO: 93774 - DNA, 25 bp, Homo sapien
tatgacaacaaataatttgatacgt

SEQ ID NO: 93775 - DNA, 25 bp, Homo sapien
tatgacaacaaatagtttgatacgt

SEQ ID NO: 93776 - DNA, 25 bp, Homo sapien
tatgacaaccgcgacagcaactcat

SEQ ID NO: 93777 - DNA, 25 bp, Homo sapien
tatgacaactgcgacagcaactcat

SEQ ID NO: 93778 - DNA, 25 bp, Homo sapien
tatgacaatatatctgtgaggattc

SEQ ID NO: 93779 - DNA, 25 bp, Homo sapien
tatgacaatgtatctgtgaggattc

SEQ ID NO: 93780 - DNA, 25 bp, Homo sapien
tatgacacttgttccggctctaatc

SEQ ID NO: 93781 - DNA, 25 bp, Homo sapien
tatgacacttgttctggctctaatc

SEQ ID NO: 93782 - DNA, 25 bp, Homo sapien
tatgacagacggtaagaaaataaca

SEQ ID NO: 93783 - DNA, 25 bp, Homo sapien
tatgacagagggtaagaaaataaca

SEQ ID NO: 93784 - DNA, 25 bp, Homo sapien
tatgacagcccagacaggtcatgga

SEQ ID NO: 93785 - DNA, 25 bp, Homo sapien
tatgacagcccagagaggtcatgga

SEQ ID NO: 93786 - DNA, 25 bp, Homo sapien
tatgacccaccctatcctagtatga

SEQ ID NO: 93787 - DNA, 25 bp, Homo sapien
tatgacccaccctatcttagtatga

SEQ ID NO: 93788 - DNA, 25 bp, Homo sapien
tatgactctcacgtacacacctatc

SEQ ID NO: 93789 - DNA, 25 bp, Homo sapien
tatgactctcatgtacacacctatc

SEQ ID NO: 93790 - DNA, 25 bp, Homo sapien
tatgactgggatatcatgaggttta

SEQ ID NO: 93791 - DNA, 25 bp, Homo sapien
tatgactgggatgtcatgaggttta

SEQ ID NO: 93792 - DNA, 25 bp, Homo sapien
tatgagaaaatactacaatggaaaa

SEQ ID NO: 93793 - DNA, 25 bp, Homo sapien
tatgagaaaatagtacaatggaaaa

SEQ ID NO: 93794 - DNA, 25 bp, Homo sapien
tatgagagcaccaaattatctacaa

SEQ ID NO: 93795 - DNA, 25 bp, Homo sapien
tatgagagcgccaaattatctacaa

SEQ ID NO: 93796 - DNA, 25 bp, Homo sapien
tatgagatggaattccaaagccaat

SEQ ID NO: 93797 - DNA, 25 bp, Homo sapien
tatgagatggaattccgaagccaat

SEQ ID NO: 93798 - DNA, 25 bp, Homo sapien
tatgagattgagtacaacagcaact

SEQ ID NO: 93799 - DNA, 25 bp, Homo sapien
tatgagattgagtacaccagcaact

SEQ ID NO: 93800 - DNA, 25 bp, Homo sapien
tatgagcaaatgaatccaagtatat

SEQ ID NO: 93801 - DNA, 25 bp, Homo sapien
tatgagcaactgaatccaagtatat

SEQ ID NO: 93802 - DNA, 25 bp, Homo sapien
tatgagcatcaaaaaagatggactg

SEQ ID NO: 93803 - DNA, 25 bp, Homo sapien
tatgagcatcagaaaagatggactg

SEQ ID NO: 93804 - DNA, 25 bp, Homo sapien
tatgagccctttccggtaaaaagca

SEQ ID NO: 93805 - DNA, 25 bp, Homo sapien
tatgagccctttctggtaaaaagca

SEQ ID NO: 93806 - DNA, 25 bp, Homo sapien
tatgagctggaatccgacttttctt

SEQ ID NO: 93807 - DNA, 25 bp, Homo sapien
tatgagctggaattcgacttttctt

SEQ ID NO: 93808 - DNA, 25 bp, Homo sapien
tatgagctgtaaaacaaaagcatca

SEQ ID NO: 93809 - DNA, 25 bp, Homo sapien
tatgagctgtaaagcaaaagcatca

SEQ ID NO: 93810 - DNA, 25 bp, Homo sapien
tatgaggctactgtttccatccact

SEQ ID NO: 93811 - DNA, 25 bp, Homo sapien
tatgaggctactttttccatccact

SEQ ID NO: 93812 - DNA, 25 bp, Homo sapien
tatgaggggctcttccaccttcgct

SEQ ID NO: 93813 - DNA, 25 bp, Homo sapien
tatgaggggcttttccaccttcgct

SEQ ID NO: 93814 - DNA, 25 bp, Homo sapien
tatgaggttttcgatttactttgtc

SEQ ID NO: 93815 - DNA, 25 bp, Homo sapien
tatgaggtttttgatttactttgtc

SEQ ID NO: 93816 - DNA, 25 bp, Homo sapien
tatgagtacactttacaggccaagg

SEQ ID NO: 93817 - DNA, 25 bp, Homo sapien
tatgagtacgctttacaggccaagg

SEQ ID NO: 93818 - DNA, 25 bp, Homo sapien
tatgagtatggaatcaagaaatgga

SEQ ID NO: 93819 - DNA, 25 bp, Homo sapien
tatgagtatggtatcaagaaatgga

SEQ ID NO: 93820 - DNA, 25 bp, Homo sapien
tatgagtcccaacaagataagagag

SEQ ID NO: 93821 - DNA, 25 bp, Homo sapien
tatgagtcccaacaaggtaagagag

SEQ ID NO: 93822 - DNA, 25 bp, Homo sapien
tatgagtgtgcataatctcttccag

SEQ ID NO: 93823 - DNA, 25 bp, Homo sapien
tatgagtgtgcatattctcttccag

SEQ ID NO: 93824 - DNA, 25 bp, Homo sapien
tatgagttcagcagatatttgactc

SEQ ID NO: 93825 - DNA, 25 bp, Homo sapien
tatgagttcagcaggtatttgactc

SEQ ID NO: 93826 - DNA, 25 bp, Homo sapien
tatgagttcattaaaaaatatatac

SEQ ID NO: 93827 - DNA, 25 bp, Homo sapien
tatgagttcattcaaaaatatatac

SEQ ID NO: 93828 - DNA, 25 bp, Homo sapien
tatgataatccactctcattctccg

SEQ ID NO: 93829 - DNA, 25 bp, Homo sapien
tatgataatccactcttattctccg

SEQ ID NO: 93830 - DNA, 25 bp, Homo sapien
tatgataccgtatcttctggaaaaa

SEQ ID NO: 93831 - DNA, 25 bp, Homo sapien
tatgatactgtatcttctggaaaaa

SEQ ID NO: 93832 - DNA, 25 bp, Homo sapien
tatgatcaacgatacggcagaagta

SEQ ID NO: 93833 - DNA, 25 bp, Homo sapien
tatgatcaacgatatggcagaagta

SEQ ID NO: 93834 - DNA, 25 bp, Homo sapien
tatgatcatagcatcgtgattttgt

SEQ ID NO: 93835 - DNA, 25 bp, Homo sapien
tatgatcatagcatggtgattttgt

SEQ ID NO: 93836 - DNA, 25 bp, Homo sapien
tatgatcatctggccaattctatag

SEQ ID NO: 93837 - DNA, 25 bp, Homo sapien
tatgatcatctggtcaattctatag

SEQ ID NO: 93838 - DNA, 25 bp, Homo sapien
tatgatctcacttgttcctcataac

SEQ ID NO: 93839 - DNA, 25 bp, Homo sapien
tatgatctcgcttgttcctcataac

SEQ ID NO: 93840 - DNA, 25 bp, Homo sapien
tatgatctgagtattcactggagaa

SEQ ID NO: 93841 - DNA, 25 bp, Homo sapien
tatgatctgtgtattcactggagaa

SEQ ID NO: 93842 - DNA, 25 bp, Homo sapien
tatgatgaacaatgaagagacaaca

SEQ ID NO: 93843 - DNA, 25 bp, Homo sapien
tatgatgaccaatgaagagacaaca

SEQ ID NO: 93844 - DNA, 25 bp, Homo sapien
tatgatgcctcagcggtgaccattc

SEQ ID NO: 93845 - DNA, 25 bp, Homo sapien
tatgatgcttcagcggtgaccattc

SEQ ID NO: 93846 - DNA, 25 bp, Homo sapien
tatgatggagtaggtagatgaagag

SEQ ID NO: 93847 - DNA, 25 bp, Homo sapien
tatgatggtgacaacaaaaatgaaa

SEQ ID NO: 93848 - DNA, 25 bp, Homo sapien
tatgatggtgacaacagaaatgaaa

SEQ ID NO: 93849 - DNA, 25 bp, Homo sapien
tatgatggtgtaggtagatgaagag

SEQ ID NO: 93850 - DNA, 25 bp, Homo sapien
tatgatgtgctaaatgttgccagat

SEQ ID NO: 93851 - DNA, 25 bp, Homo sapien
tatgatgtgctaagtgttgccagat

SEQ ID NO: 93852 - DNA, 25 bp, Homo sapien
tatgattaatccatcttctatctac

SEQ ID NO: 93853 - DNA, 25 bp, Homo sapien
tatgattaatccgtcttctatctac

SEQ ID NO: 93854 - DNA, 25 bp, Homo sapien
tatgattacagagtgaagacatttc

SEQ ID NO: 93855 - DNA, 25 bp, Homo sapien
tatgattacggagtgaagacatttc

SEQ ID NO: 93856 - DNA, 25 bp, Homo sapien
tatgattatgccaacattcacttac

SEQ ID NO: 93857 - DNA, 25 bp, Homo sapien
tatgattattcacagtgaaatgctg

SEQ ID NO: 93858 - DNA, 25 bp, Homo sapien
tatgattattcacagttaaatgctg

SEQ ID NO: 93859 - DNA, 25 bp, Homo sapien
tatgattattccaacattcacttac

SEQ ID NO: 93860 - DNA, 25 bp, Homo sapien
tatgattccaggctaagattggaca

SEQ ID NO: 93861 - DNA, 25 bp, Homo sapien
tatgattccaggttaagattggaca

SEQ ID NO: 93862 - DNA, 25 bp, Homo sapien
tatgattgacaattaccatgtaaga

SEQ ID NO: 93863 - DNA, 25 bp, Homo sapien
tatgattgataattaccatgtaaga

SEQ ID NO: 93864 - DNA, 25 bp, Homo sapien
tatgattgccctcattacgtagatg

SEQ ID NO: 93865 - DNA, 25 bp, Homo sapien
tatgattgctctcattacgtagatg

SEQ ID NO: 93866 - DNA, 25 bp, Homo sapien
tatgattgcttaggtaaggtatgta

SEQ ID NO: 93867 - DNA, 25 bp, Homo sapien
tatgattgcttatgtaaggtatgta

SEQ ID NO: 93868 - DNA, 25 bp, Homo sapien
tatgatttcggttagtaatgtacta

SEQ ID NO: 93869 - DNA, 25 bp, Homo sapien
tatgatttctttccacaatgtttgt

SEQ ID NO: 93870 - DNA, 25 bp, Homo sapien
tatgatttctttccgcaatgtttgt

SEQ ID NO: 93871 - DNA, 25 bp, Homo sapien
tatgattttaggctatgcatttaaa

SEQ ID NO: 93872 - DNA, 25 bp, Homo sapien
tatgattttaggctattcatttaaa

SEQ ID NO: 93873 - DNA, 25 bp, Homo sapien
tatgattttggttagtaatgtacta

SEQ ID NO: 93874 - DNA, 25 bp, Homo sapien
tatgcaaaaaagcctaaaacaaaag

SEQ ID NO: 93875 - DNA, 25 bp, Homo sapien
tatgcaaaaaaggctaaaacaaaag

SEQ ID NO: 93876 - DNA, 25 bp, Homo sapien
tatgcaaagaactcttacaagtcaa

SEQ ID NO: 93877 - DNA, 25 bp, Homo sapien
tatgcaaagtattaatcctgcgtgt

SEQ ID NO: 93878 - DNA, 25 bp, Homo sapien
tatgcaaagtattgatcctgcgtgt

SEQ ID NO: 93879 - DNA, 25 bp, Homo sapien
tatgcaaataactcttacaagtcaa

SEQ ID NO: 93880 - DNA, 25 bp, Homo sapien
tatgcaaatggaaatggtaataaac

SEQ ID NO: 93881 - DNA, 25 bp, Homo sapien
tatgcaaatggcaatggtaataaac

SEQ ID NO: 93882 - DNA, 25 bp, Homo sapien
tatgcaactctctaatggctaataa

SEQ ID NO: 93883 - DNA, 25 bp, Homo sapien
tatgcaactctttaatggctaataa

SEQ ID NO: 93884 - DNA, 25 bp, Homo sapien
tatgcaagtaagtcagattttgttt

SEQ ID NO: 93885 - DNA, 25 bp, Homo sapien
tatgcaagtgagtcagattttgttt

SEQ ID NO: 93886 - DNA, 25 bp, Homo sapien
tatgcaattgttccatcagagaatt

SEQ ID NO: 93887 - DNA, 25 bp, Homo sapien
tatgcaattgttccgtcagagaatt

SEQ ID NO: 93888 - DNA, 25 bp, Homo sapien
tatgcacccaaatacgcagtttcct

SEQ ID NO: 93889 - DNA, 25 bp, Homo sapien
tatgcacccaaatatgcagtttcct

SEQ ID NO: 93890 - DNA, 25 bp, Homo sapien
tatgcaccttctctgtcccatctct

SEQ ID NO: 93891 - DNA, 25 bp, Homo sapien
tatgcaccttctctttcccatctct

SEQ ID NO: 93892 - DNA, 25 bp, Homo sapien
tatgcactttccttaataaaaatgt

SEQ ID NO: 93893 - DNA, 25 bp, Homo sapien
tatgcactttcgttaataaaaatgt

SEQ ID NO: 93894 - DNA, 25 bp, Homo sapien
tatgcagaaatagtaaatttgacaa

SEQ ID NO: 93895 - DNA, 25 bp, Homo sapien
tatgcagaaatagtcaatttgacaa

SEQ ID NO: 93896 - DNA, 25 bp, Homo sapien
tatgcagagtttcacaacataaatg

SEQ ID NO: 93897 - DNA, 25 bp, Homo sapien
tatgcagagttttacaacataaatg

SEQ ID NO: 93898 - DNA, 25 bp, Homo sapien
tatgcaggcttcaggcacagtttga

SEQ ID NO: 93899 - DNA, 25 bp, Homo sapien
tatgcaggtaaacgtgtgctagtca

SEQ ID NO: 93900 - DNA, 25 bp, Homo sapien
tatgcaggtaatcgtgtgctagtca

SEQ ID NO: 93901 - DNA, 25 bp, Homo sapien
tatgcaggtatagaagtctgatgct

SEQ ID NO: 93902 - DNA, 25 bp, Homo sapien
tatgcaggtataggagtctgatgct

SEQ ID NO: 93903 - DNA, 25 bp, Homo sapien
tatgcaggtttcaggcacagtttga

SEQ ID NO: 93904 - DNA, 25 bp, Homo sapien
tatgcatagtctctttgtgaaaata

SEQ ID NO: 93905 - DNA, 25 bp, Homo sapien
tatgcatattctctttgtgaaaata

SEQ ID NO: 93906 - DNA, 25 bp, Homo sapien
tatgcatccttaactcaacattatt

SEQ ID NO: 93907 - DNA, 25 bp, Homo sapien
tatgcatccttagctcaacattatt

SEQ ID NO: 93908 - DNA, 25 bp, Homo sapien
tatgcatctgtcatctcttgctttc

SEQ ID NO: 93909 - DNA, 25 bp, Homo sapien
tatgcatctttcatctcttgctttc

SEQ ID NO: 93910 - DNA, 25 bp, Homo sapien
tatgcatgaaaacaccttcacaaag

SEQ ID NO: 93911 - DNA, 25 bp, Homo sapien
tatgcatgaaaataccttcacaaag

SEQ ID NO: 93912 - DNA, 25 bp, Homo sapien
tatgcatgtgttacaaagaatgagc

SEQ ID NO: 93913 - DNA, 25 bp, Homo sapien
tatgcatgttttacaaagaatgagc

SEQ ID NO: 93914 - DNA, 25 bp, Homo sapien
tatgcatttcacagcctcttctcaa

SEQ ID NO: 93915 - DNA, 25 bp, Homo sapien
tatgcatttcacatcctcttctcaa

SEQ ID NO: 93916 - DNA, 25 bp, Homo sapien
tatgccaaatactgtgaagtgttgg

SEQ ID NO: 93917 - DNA, 25 bp, Homo sapien
tatgccaaatgaaacaaatcaagat

SEQ ID NO: 93918 - DNA, 25 bp, Homo sapien
tatgccaagtgaaacaaatcaagat

SEQ ID NO: 93919 - DNA, 25 bp, Homo sapien
tatgccaattactgtgaagtgttgg

SEQ ID NO: 93920 - DNA, 25 bp, Homo sapien
tatgccacaagaaaggaacagagtt

SEQ ID NO: 93921 - DNA, 25 bp, Homo sapien
tatgccacaagagaggaacagagtt

SEQ ID NO: 93922 - DNA, 25 bp, Homo sapien
tatgccagatcactgaaggcagata

SEQ ID NO: 93923 - DNA, 25 bp, Homo sapien
tatgccagatcattgaaggcagata

SEQ ID NO: 93924 - DNA, 25 bp, Homo sapien
tatgccattcaagaataaaaatgat

SEQ ID NO: 93925 - DNA, 25 bp, Homo sapien
tatgccattcaaggataaaaatgat

SEQ ID NO: 93926 - DNA, 25 bp, Homo sapien
tatgccattgtaaagaagtagaatt

SEQ ID NO: 93927 - DNA, 25 bp, Homo sapien
tatgccattgtaaagaggtagaatt

SEQ ID NO: 93928 - DNA, 25 bp, Homo sapien
tatgcccaacatgttttcatttcat

SEQ ID NO: 93929 - DNA, 25 bp, Homo sapien
tatgcccaatatgttttcatttcat

SEQ ID NO: 93930 - DNA, 25 bp, Homo sapien
tatgcccatcaattcaagcatttat

SEQ ID NO: 93931 - DNA, 25 bp, Homo sapien
tatgcccatcagttcaagcatttat

SEQ ID NO: 93932 - DNA, 25 bp, Homo sapien
tatgccccagtgctcgtctggtcta

SEQ ID NO: 93933 - DNA, 25 bp, Homo sapien
tatgccccagtgcttgtctggtcta

SEQ ID NO: 93934 - DNA, 25 bp, Homo sapien
tatgcctagcaataagagataaact

SEQ ID NO: 93935 - DNA, 25 bp, Homo sapien
tatgcctagcaataggagataaact

SEQ ID NO: 93936 - DNA, 25 bp, Homo sapien
tatgcctgtgatgtgactaactttt

SEQ ID NO: 93937 - DNA, 25 bp, Homo sapien
tatgcctgtgatttgactaactttt

SEQ ID NO: 93938 - DNA, 25 bp, Homo sapien
tatgcctgttcttgtacgaaccaaa

SEQ ID NO: 93939 - DNA, 25 bp, Homo sapien
tatgcctgttcttgtatgaaccaaa

SEQ ID NO: 93940 - DNA, 25 bp, Homo sapien
tatgcgtacaagccgctgtgccgcc

SEQ ID NO: 93941 - DNA, 25 bp, Homo sapien
tatgcgtacaagcctctgtgccgcc

SEQ ID NO: 93942 - DNA, 25 bp, Homo sapien
tatgcgtttacatcgaagggcttga

SEQ ID NO: 93943 - DNA, 25 bp, Homo sapien
tatgcgtttacgtcgaagggcttga

SEQ ID NO: 93944 - DNA, 25 bp, Homo sapien
tatgctaaatttcaggccttgtggc

SEQ ID NO: 93945 - DNA, 25 bp, Homo sapien
tatgctaaatttcgggccttgtggc

SEQ ID NO: 93946 - DNA, 25 bp, Homo sapien
tatgctaatggctctccactcccat

SEQ ID NO: 93947 - DNA, 25 bp, Homo sapien
tatgctaattgctctccactcccat

SEQ ID NO: 93948 - DNA, 25 bp, Homo sapien
tatgctacactacacaacttgatac

SEQ ID NO: 93949 - DNA, 25 bp, Homo sapien
tatgctacactatacaacttgatac

SEQ ID NO: 93950 - DNA, 25 bp, Homo sapien
tatgctatgcgagccactatgaaga

SEQ ID NO: 93951 - DNA, 25 bp, Homo sapien
tatgctatgggagccactatgaaga

SEQ ID NO: 93952 - DNA, 25 bp, Homo sapien
tatgctcaattccaagcctcactac

SEQ ID NO: 93953 - DNA, 25 bp, Homo sapien
tatgctcagttccaagcctcactac

SEQ ID NO: 93954 - DNA, 25 bp, Homo sapien
tatgctctgatccgaaattttaata

SEQ ID NO: 93955 - DNA, 25 bp, Homo sapien
tatgctctgatctgaaattttaata

SEQ ID NO: 93956 - DNA, 25 bp, Homo sapien
tatgctctgccaatttgggattttt

SEQ ID NO: 93957 - DNA, 25 bp, Homo sapien
tatgctctgccattttgggattttt

SEQ ID NO: 93958 - DNA, 25 bp, Homo sapien
tatgctgaccaagatgaacactttg

SEQ ID NO: 93959 - DNA, 25 bp, Homo sapien
tatgctgaccaaggtgaacactttg

SEQ ID NO: 93960 - DNA, 25 bp, Homo sapien
tatgctgggtgactatgtaatctga

SEQ ID NO: 93961 - DNA, 25 bp, Homo sapien
tatgctgggtgattatgtaatctga

SEQ ID NO: 93962 - DNA, 25 bp, Homo sapien
tatgctggtatgtcaatattttaga

SEQ ID NO: 93963 - DNA, 25 bp, Homo sapien
tatgctggtatgtcgatattttaga

SEQ ID NO: 93964 - DNA, 25 bp, Homo sapien
tatgctgtcaatggtcaacactctt

SEQ ID NO: 93965 - DNA, 25 bp, Homo sapien
tatgctgtcaattgtcaacactctt

SEQ ID NO: 93966 - DNA, 25 bp, Homo sapien
tatgcttaaccggagttctcaccat

SEQ ID NO: 93967 - DNA, 25 bp, Homo sapien
tatgcttaaccggcgttctcaccat

SEQ ID NO: 93968 - DNA, 25 bp, Homo sapien
tatgcttactatgctcatgcagcta

SEQ ID NO: 93969 - DNA, 25 bp, Homo sapien
tatgcttactatgttcatgcagcta

SEQ ID NO: 93970 - DNA, 25 bp, Homo sapien
tatgcttagttttaactccacagaa

SEQ ID NO: 93971 - DNA, 25 bp, Homo sapien
tatgcttagttttatctccacagaa

SEQ ID NO: 93972 - DNA, 25 bp, Homo sapien
tatgcttattggtgcacggtagtat

SEQ ID NO: 93973 - DNA, 25 bp, Homo sapien
tatgcttattggtgtacggtagtat

SEQ ID NO: 93974 - DNA, 25 bp, Homo sapien
tatgcttctgcttgacaaacatgct

SEQ ID NO: 93975 - DNA, 25 bp, Homo sapien
tatgcttctgcttgaccaacatgct

SEQ ID NO: 93976 - DNA, 25 bp, Homo sapien
tatgctttcaaagtaaaacactgat

SEQ ID NO: 93977 - DNA, 25 bp, Homo sapien
tatgctttcaaagtaatacactgat

SEQ ID NO: 93978 - DNA, 25 bp, Homo sapien
tatgctttgcagtaacatgggattt

SEQ ID NO: 93979 - DNA, 25 bp, Homo sapien
tatgctttgtagtaacatgggattt

SEQ ID NO: 93980 - DNA, 25 bp, Homo sapien
tatgcttttgagtcccaatgtgggg

SEQ ID NO: 93981 - DNA, 25 bp, Homo sapien
tatgctttttagtcccaatgtgggg

SEQ ID NO: 93982 - DNA, 25 bp, Homo sapien
tatggaaaaaagtgagtgagctata

SEQ ID NO: 93983 - DNA, 25 bp, Homo sapien
tatggaaaaaagttagtgagctata

SEQ ID NO: 93984 - DNA, 25 bp, Homo sapien
tatggaaaatacgtataaggtccca

SEQ ID NO: 93985 - DNA, 25 bp, Homo sapien
tatggaaaatatgtataaggtccca

SEQ ID NO: 93986 - DNA, 25 bp, Homo sapien
tatggaaaatgatcgtttaaattta

SEQ ID NO: 93987 - DNA, 25 bp, Homo sapien
tatggaaaatgattgtttaaattta

SEQ ID NO: 93988 - DNA, 25 bp, Homo sapien
tatggaaactaatatctttgaacat

SEQ ID NO: 93989 - DNA, 25 bp, Homo sapien
tatggaaactagtatctttgaacat

SEQ ID NO: 93990 - DNA, 25 bp, Homo sapien
tatggaaatgttctgtatttgcact

SEQ ID NO: 93991 - DNA, 25 bp, Homo sapien
tatggaaatgttttgtatttgcact

SEQ ID NO: 93992 - DNA, 25 bp, Homo sapien
tatggaacactgcaacatatttctt

SEQ ID NO: 93993 - DNA, 25 bp, Homo sapien
tatggaacactggaacatatttctt

SEQ ID NO: 93994 - DNA, 25 bp, Homo sapien
tatggaacccagttttttctttaac

SEQ ID NO: 93995 - DNA, 25 bp, Homo sapien
tatggaacccatttttttctttaac

SEQ ID NO: 93996 - DNA, 25 bp, Homo sapien
tatggaagaggtaattgccccacca

SEQ ID NO: 93997 - DNA, 25 bp, Homo sapien
tatggaagaggtcattgccccacca

SEQ ID NO: 93998 - DNA, 25 bp, Homo sapien
tatggactaaacattgggtcaagca

SEQ ID NO: 93999 - DNA, 25 bp, Homo sapien
tatggactagacattgggtcaagca

SEQ ID NO: 94000 - DNA, 25 bp, Homo sapien
tatggagaattgcctttggtgcctc

SEQ ID NO: 94001 - DNA, 25 bp, Homo sapien
tatggagaattgcttttggtgcctc

SEQ ID NO: 94002 - DNA, 25 bp, Homo sapien
tatggagtacacattctgctgctgt

SEQ ID NO: 94003 - DNA, 25 bp, Homo sapien
tatggagtatacattctgctgctgt

SEQ ID NO: 94004 - DNA, 25 bp, Homo sapien
tatggagtcacaattacctattagt

SEQ ID NO: 94005 - DNA, 25 bp, Homo sapien
tatggagtcgcaattacctattagt

SEQ ID NO: 94006 - DNA, 25 bp, Homo sapien
tatggatacctgggttctaatctta

SEQ ID NO: 94007 - DNA, 25 bp, Homo sapien
tatggatacctgtgttctaatctta

SEQ ID NO: 94008 - DNA, 25 bp, Homo sapien
tatggatatttggcatgatatattg

SEQ ID NO: 94009 - DNA, 25 bp, Homo sapien
tatggatattttgcatgatatattg

SEQ ID NO: 94010 - DNA, 25 bp, Homo sapien
tatggatcgttaatacctcaatagt

SEQ ID NO: 94011 - DNA, 25 bp, Homo sapien
tatggatctgagtacctttagtagc

SEQ ID NO: 94012 - DNA, 25 bp, Homo sapien
tatggatctgagtatctttagtagc

SEQ ID NO: 94013 - DNA, 25 bp, Homo sapien
tatggatctttaatacctcaatagt

SEQ ID NO: 94014 - DNA, 25 bp, Homo sapien
tatggattcttgcaaaagatagtaa

SEQ ID NO: 94015 - DNA, 25 bp, Homo sapien
tatggattcttgcacaagatagtaa

SEQ ID NO: 94016 - DNA, 25 bp, Homo sapien
tatggattttgataaggattgtgtt

SEQ ID NO: 94017 - DNA, 25 bp, Homo sapien
tatggattttgttaaggattgtgtt

SEQ ID NO: 94018 - DNA, 25 bp, Homo sapien
tatggcaaaagattataagtacact

SEQ ID NO: 94019 - DNA, 25 bp, Homo sapien
tatggcaaactttttctgctttaag

SEQ ID NO: 94020 - DNA, 25 bp, Homo sapien
tatggcaaaggattataagtacact

SEQ ID NO: 94021 - DNA, 25 bp, Homo sapien
tatggcaaagtttttctgctttaag

SEQ ID NO: 94022 - DNA, 25 bp, Homo sapien
tatggcaaccttgacagctcagtca

SEQ ID NO: 94023 - DNA, 25 bp, Homo sapien
tatggcaatcttgacagctcagtca

SEQ ID NO: 94024 - DNA, 25 bp, Homo sapien
tatggcacaacatatggagtcctta

SEQ ID NO: 94025 - DNA, 25 bp, Homo sapien
tatggcacacaactctaaaatttta

SEQ ID NO: 94026 - DNA, 25 bp, Homo sapien
tatggcacacaagtctaaaatttta

SEQ ID NO: 94027 - DNA, 25 bp, Homo sapien
tatggcacagcatatggagtcctta

SEQ ID NO: 94028 - DNA, 25 bp, Homo sapien
tatggcacatggctggggacctgag

SEQ ID NO: 94029 - DNA, 25 bp, Homo sapien
tatggcacatggttggggacctgag

SEQ ID NO: 94030 - DNA, 25 bp, Homo sapien
tatggcagagtgcgtgatggagggc

SEQ ID NO: 94031 - DNA, 25 bp, Homo sapien
tatggcagagtgtgtgatggagggc

SEQ ID NO: 94032 - DNA, 25 bp, Homo sapien
tatggcaggatttacaggtaaagga

SEQ ID NO: 94033 - DNA, 25 bp, Homo sapien
tatggcaggatttagaggtaaagga

SEQ ID NO: 94034 - DNA, 25 bp, Homo sapien
tatggcatatgtaaaacaggaaagc

SEQ ID NO: 94035 - DNA, 25 bp, Homo sapien
tatggcatatgtacaacaggaaagc

SEQ ID NO: 94036 - DNA, 25 bp, Homo sapien
tatggcatctcctcagcttggactt

SEQ ID NO: 94037 - DNA, 25 bp, Homo sapien
tatggcatttcctcagcttggactt

SEQ ID NO: 94038 - DNA, 25 bp, Homo sapien
tatggccagagaactgaaaatggct

SEQ ID NO: 94039 - DNA, 25 bp, Homo sapien
tatggccagagaattgaaaatggct

SEQ ID NO: 94040 - DNA, 25 bp, Homo sapien
tatggccatacccttcatttttgta

SEQ ID NO: 94041 - DNA, 25 bp, Homo sapien
tatggccatactcttcatttttgta

SEQ ID NO: 94042 - DNA, 25 bp, Homo sapien
tatggcccaaccaatgctttcttgg

SEQ ID NO: 94043 - DNA, 25 bp, Homo sapien
tatggcccaaccgatgctttcttgg

SEQ ID NO: 94044 - DNA, 25 bp, Homo sapien
tatggcctaagaaaatgcagttaaa

SEQ ID NO: 94045 - DNA, 25 bp, Homo sapien
tatggcctaaggaaatgcagttaaa

SEQ ID NO: 94046 - DNA, 25 bp, Homo sapien
tatggcctatggacttactggcccc

SEQ ID NO: 94047 - DNA, 25 bp, Homo sapien
tatggcctgtggacttactggcccc

SEQ ID NO: 94048 - DNA, 25 bp, Homo sapien
tatggcggtggactatgacttataa

SEQ ID NO: 94049 - DNA, 25 bp, Homo sapien
tatggcggtggattatgacttataa

SEQ ID NO: 94050 - DNA, 25 bp, Homo sapien
tatggctaaagagtatacaagggtg

SEQ ID NO: 94051 - DNA, 25 bp, Homo sapien
tatggctaaagattatacaagggtg

SEQ ID NO: 94052 - DNA, 25 bp, Homo sapien
tatggctaagcataaagctgttatc

SEQ ID NO: 94053 - DNA, 25 bp, Homo sapien
tatggctaagcattaagctgttatc

SEQ ID NO: 94054 - DNA, 25 bp, Homo sapien
tatggctaatcatttgtctccagct

SEQ ID NO: 94055 - DNA, 25 bp, Homo sapien
tatggctagtcatttgtctccagct

SEQ ID NO: 94056 - DNA, 25 bp, Homo sapien
tatggctcacgactccacataaatt

SEQ ID NO: 94057 - DNA, 25 bp, Homo sapien
tatggctcgcgactccacataaatt

SEQ ID NO: 94058 - DNA, 25 bp, Homo sapien
tatggcttccaatttgagctccctg

SEQ ID NO: 94059 - DNA, 25 bp, Homo sapien
tatggctttcaatttgagctccctg

SEQ ID NO: 94060 - DNA, 25 bp, Homo sapien
tatggcttttgacaacatcagccag

SEQ ID NO: 94061 - DNA, 25 bp, Homo sapien
tatggcttttggcaacatcagccag

SEQ ID NO: 94062 - DNA, 25 bp, Homo sapien
tatggcttttttattcactgaatat

SEQ ID NO: 94063 - DNA, 25 bp, Homo sapien
tatggctttttttttcactgaatat

SEQ ID NO: 94064 - DNA, 25 bp, Homo sapien
tatgggaatctagtcaggactctca

SEQ ID NO: 94065 - DNA, 25 bp, Homo sapien
tatgggaatctattcaggactctca

SEQ ID NO: 94066 - DNA, 25 bp, Homo sapien
tatgggaggaaatgacaggtgacct

SEQ ID NO: 94067 - DNA, 25 bp, Homo sapien
tatgggaggaaatggcaggtgacct

SEQ ID NO: 94068 - DNA, 25 bp, Homo sapien
tatgggcacccaaaccaagcagttt

SEQ ID NO: 94069 - DNA, 25 bp, Homo sapien
tatgggcacccacaccaagcagttt

SEQ ID NO: 94070 - DNA, 25 bp, Homo sapien
tatgggccctttcgtcacctggact

SEQ ID NO: 94071 - DNA, 25 bp, Homo sapien
tatgggcccttttgtcacctggact

SEQ ID NO: 94072 - DNA, 25 bp, Homo sapien
tatggtaaaagcaatgtaggctgat

SEQ ID NO: 94073 - DNA, 25 bp, Homo sapien
tatggtaaaggcaatgtaggctgat

SEQ ID NO: 94074 - DNA, 25 bp, Homo sapien
tatggtaagagagacttttctaaca

SEQ ID NO: 94075 - DNA, 25 bp, Homo sapien
tatggtaagagatacttttctaaca

SEQ ID NO: 94076 - DNA, 25 bp, Homo sapien
tatggtaagatacagagaatttaga

SEQ ID NO: 94077 - DNA, 25 bp, Homo sapien
tatggtaagatagagagaatttaga

SEQ ID NO: 94078 - DNA, 25 bp, Homo sapien
tatggtattgatacttgcagatgtt

SEQ ID NO: 94079 - DNA, 25 bp, Homo sapien
tatggtattgatgcttgcagatgtt

SEQ ID NO: 94080 - DNA, 25 bp, Homo sapien
tatggtcacacctggcacaaccgcc

SEQ ID NO: 94081 - DNA, 25 bp, Homo sapien
tatggtcacgcctggcacaaccgcc

SEQ ID NO: 94082 - DNA, 25 bp, Homo sapien
tatggtctactggcggtatcctttc

SEQ ID NO: 94083 - DNA, 25 bp, Homo sapien
tatggtctactggtggtatcctttc

SEQ ID NO: 94084 - DNA, 25 bp, Homo sapien
tatggtctcacttacaatggaatat

SEQ ID NO: 94085 - DNA, 25 bp, Homo sapien
tatggtctcacttgcaatggaatat

SEQ ID NO: 94086 - DNA, 25 bp, Homo sapien
tatggtctgaccattgtctgtttgt

SEQ ID NO: 94087 - DNA, 25 bp, Homo sapien
tatggtctgaccgttgtctgtttgt

SEQ ID NO: 94088 - DNA, 25 bp, Homo sapien
tatggtgaaagcagatgaaacctga

SEQ ID NO: 94089 - DNA, 25 bp, Homo sapien
tatggtgaaaggagatgaaacctga

SEQ ID NO: 94090 - DNA, 25 bp, Homo sapien
tatggtgcacgcacatagccaccag

SEQ ID NO: 94091 - DNA, 25 bp, Homo sapien
tatggtgcacgtacatagccaccag

SEQ ID NO: 94092 - DNA, 25 bp, Homo sapien
tatggttaacgataatggtctccac

SEQ ID NO: 94093 - DNA, 25 bp, Homo sapien
tatggttaatgataatggtctccac

SEQ ID NO: 94094 - DNA, 25 bp, Homo sapien
tatggttccgtgatgctgactgatc

SEQ ID NO: 94095 - DNA, 25 bp, Homo sapien
tatggttctgtgatgctgactgatc

SEQ ID NO: 94096 - DNA, 25 bp, Homo sapien
tatggttgaattcccggaaatatgt

SEQ ID NO: 94097 - DNA, 25 bp, Homo sapien
tatggttgaattcctggaaatatgt

SEQ ID NO: 94098 - DNA, 25 bp, Homo sapien
tatggttgagattgtctcatagaga

SEQ ID NO: 94099 - DNA, 25 bp, Homo sapien
tatggttgagattttctcatagaga

SEQ ID NO: 94100 - DNA, 25 bp, Homo sapien
tatggttgtttcctttctatttgag

SEQ ID NO: 94101 - DNA, 25 bp, Homo sapien
tatggttgttttctttctatttgag

SEQ ID NO: 94102 - DNA, 25 bp, Homo sapien
tatggtttccagggctgtaatatta

SEQ ID NO: 94103 - DNA, 25 bp, Homo sapien
tatggtttccagggttgtaatatta

SEQ ID NO: 94104 - DNA, 25 bp, Homo sapien
tatgtaaaacacaatcgaagctatc

SEQ ID NO: 94105 - DNA, 25 bp, Homo sapien
tatgtaaaacacagtcgaagctatc

SEQ ID NO: 94106 - DNA, 25 bp, Homo sapien
tatgtaaaacggtaggatgctagga

SEQ ID NO: 94107 - DNA, 25 bp, Homo sapien
tatgtaaaatggtaggatgctagga

SEQ ID NO: 94108 - DNA, 25 bp, Homo sapien
tatgtaagagctgaaactgtaaaag

SEQ ID NO: 94109 - DNA, 25 bp, Homo sapien
tatgtaagagctgaaattgtaaaag

SEQ ID NO: 94110 - DNA, 25 bp, Homo sapien
tatgtaagtttgacgtgaagtgggc

SEQ ID NO: 94111 - DNA, 25 bp, Homo sapien
tatgtaagtttgaggtgaagtgggc

SEQ ID NO: 94112 - DNA, 25 bp, Homo sapien
tatgtaatgcggctaatgccaactt

SEQ ID NO: 94113 - DNA, 25 bp, Homo sapien
tatgtaatgctacaggcatctagtg

SEQ ID NO: 94114 - DNA, 25 bp, Homo sapien
tatgtaatgctacagggatctagtg

SEQ ID NO: 94115 - DNA, 25 bp, Homo sapien
tatgtaatggggctaatgccaactt

SEQ ID NO: 94116 - DNA, 25 bp, Homo sapien
tatgtacaactaggaagtatgaggg

SEQ ID NO: 94117 - DNA, 25 bp, Homo sapien
tatgtacaactgggaagtatgaggg

SEQ ID NO: 94118 - DNA, 25 bp, Homo sapien
tatgtacatattatgcacagttgga

SEQ ID NO: 94119 - DNA, 25 bp, Homo sapien
tatgtacatattatgcccagttgga

SEQ ID NO: 94120 - DNA, 25 bp, Homo sapien
tatgtaccattgcaacttggaagga

SEQ ID NO: 94121 - DNA, 25 bp, Homo sapien
tatgtaccattgtaacttggaagga

SEQ ID NO: 94122 - DNA, 25 bp, Homo sapien
tatgtacgttcaaattcctcaatta

SEQ ID NO: 94123 - DNA, 25 bp, Homo sapien
tatgtacgttcaagttcctcaatta

SEQ ID NO: 94124 - DNA, 25 bp, Homo sapien
tatgtagtggtaattcagtgaggtt

SEQ ID NO: 94125 - DNA, 25 bp, Homo sapien
tatgtagtggtatttcagtgaggtt

SEQ ID NO: 94126 - DNA, 25 bp, Homo sapien
tatgtataatttcaaactgtagcat

SEQ ID NO: 94127 - DNA, 25 bp, Homo sapien
tatgtataatttcaaattgtagcat

SEQ ID NO: 94128 - DNA, 25 bp, Homo sapien
tatgtatacgattgagcaggacatt

SEQ ID NO: 94129 - DNA, 25 bp, Homo sapien
tatgtatacgttaatctggaagctg

SEQ ID NO: 94130 - DNA, 25 bp, Homo sapien
tatgtatagctttgccaccagtatc

SEQ ID NO: 94131 - DNA, 25 bp, Homo sapien
tatgtatagctttgtcaccagtatc

SEQ ID NO: 94132 - DNA, 25 bp, Homo sapien
tatgtatatgattgagcaggacatt

SEQ ID NO: 94133 - DNA, 25 bp, Homo sapien
tatgtatatggtacaggctattgtt

SEQ ID NO: 94134 - DNA, 25 bp, Homo sapien
tatgtatatggtataggctattgtt

SEQ ID NO: 94135 - DNA, 25 bp, Homo sapien
tatgtatatgttaatctggaagctg

SEQ ID NO: 94136 - DNA, 25 bp, Homo sapien
tatgtatcacacagtgcaaacatag

SEQ ID NO: 94137 - DNA, 25 bp, Homo sapien
tatgtatcagacagtgcaaacatag

SEQ ID NO: 94138 - DNA, 25 bp, Homo sapien
tatgtatcttgtaaattgagacagc

SEQ ID NO: 94139 - DNA, 25 bp, Homo sapien
tatgtatcttgtaagttgagacagc

SEQ ID NO: 94140 - DNA, 25 bp, Homo sapien
tatgtatgtattcagatgagtttca

SEQ ID NO: 94141 - DNA, 25 bp, Homo sapien
tatgtatgtattgagatgagtttca

SEQ ID NO: 94142 - DNA, 25 bp, Homo sapien
tatgtattataagacctacagttgc

SEQ ID NO: 94143 - DNA, 25 bp, Homo sapien
tatgtattcagatgagtttcaagaa

SEQ ID NO: 94144 - DNA, 25 bp, Homo sapien
tatgtattctgcaaatatttcaaaa

SEQ ID NO: 94145 - DNA, 25 bp, Homo sapien
tatgtattctgtaaatatttcaaaa

SEQ ID NO: 94146 - DNA, 25 bp, Homo sapien
tatgtattgagatgagtttcaagaa

SEQ ID NO: 94147 - DNA, 25 bp, Homo sapien
tatgtattgtaagacctacagttgc

SEQ ID NO: 94148 - DNA, 25 bp, Homo sapien
tatgtcaaacttcatatcacttgac

SEQ ID NO: 94149 - DNA, 25 bp, Homo sapien
tatgtcaaacttcgtatcacttgac

SEQ ID NO: 94150 - DNA, 25 bp, Homo sapien
tatgtcaagtacagggctgcaaaaa

SEQ ID NO: 94151 - DNA, 25 bp, Homo sapien
tatgtcaagtacggggctgcaaaaa

SEQ ID NO: 94152 - DNA, 25 bp, Homo sapien
tatgtcaattccacgaaaaaaatat

SEQ ID NO: 94153 - DNA, 25 bp, Homo sapien
tatgtcaattccatgaaaaaaatat

SEQ ID NO: 94154 - DNA, 25 bp, Homo sapien
tatgtcacctctccttgaatgtaga

SEQ ID NO: 94155 - DNA, 25 bp, Homo sapien
tatgtcacctcttcttgaatgtaga

SEQ ID NO: 94156 - DNA, 25 bp, Homo sapien
tatgtcaggcactaatgctcagtat

SEQ ID NO: 94157 - DNA, 25 bp, Homo sapien
tatgtcaggcagtaatgctcagtat

SEQ ID NO: 94158 - DNA, 25 bp, Homo sapien
tatgtcagtagcacataagatccca

SEQ ID NO: 94159 - DNA, 25 bp, Homo sapien
tatgtcagtagcacgtaagatccca

SEQ ID NO: 94160 - DNA, 25 bp, Homo sapien
tatgtccacgttgagtacccccatc

SEQ ID NO: 94161 - DNA, 25 bp, Homo sapien
tatgtccagctgctatcatcacaca

SEQ ID NO: 94162 - DNA, 25 bp, Homo sapien
tatgtccagctgctgtcatcacaca

SEQ ID NO: 94163 - DNA, 25 bp, Homo sapien
tatgtccaggacctcaataacacct

SEQ ID NO: 94164 - DNA, 25 bp, Homo sapien
tatgtccaggacctcattaacacct

SEQ ID NO: 94165 - DNA, 25 bp, Homo sapien
tatgtccatgttgagtacccccatc

SEQ ID NO: 94166 - DNA, 25 bp, Homo sapien
tatgtcctgccttattggagattct

SEQ ID NO: 94167 - DNA, 25 bp, Homo sapien
tatgtcctgccttatttgagattct

SEQ ID NO: 94168 - DNA, 25 bp, Homo sapien
tatgtctccatttgtgcacgactgt

SEQ ID NO: 94169 - DNA, 25 bp, Homo sapien
tatgtctccatttgtgtacgactgt

SEQ ID NO: 94170 - DNA, 25 bp, Homo sapien
tatgtgaaatccgcaaatagagagg

SEQ ID NO: 94171 - DNA, 25 bp, Homo sapien
tatgtgaaatctgcaaatagagagg

SEQ ID NO: 94172 - DNA, 25 bp, Homo sapien
tatgtgaagccatgaaggccattca

SEQ ID NO: 94173 - DNA, 25 bp, Homo sapien
tatgtgaagtcatgaaggccattca

SEQ ID NO: 94174 - DNA, 25 bp, Homo sapien
tatgtgacctatgagacagcataga

SEQ ID NO: 94175 - DNA, 25 bp, Homo sapien
tatgtgacctggagtctgcacaatt

SEQ ID NO: 94176 - DNA, 25 bp, Homo sapien
tatgtgacttatgagacagcataga

SEQ ID NO: 94177 - DNA, 25 bp, Homo sapien
tatgtgacttcagccaaatcacttg

SEQ ID NO: 94178 - DNA, 25 bp, Homo sapien
tatgtgacttcggccaaatcacttg

SEQ ID NO: 94179 - DNA, 25 bp, Homo sapien
tatgtgacttggagtctgcacaatt

SEQ ID NO: 94180 - DNA, 25 bp, Homo sapien
tatgtgagggactaaaaaaacctga

SEQ ID NO: 94181 - DNA, 25 bp, Homo sapien
tatgtgagggattaaaaaaacctga

SEQ ID NO: 94182 - DNA, 25 bp, Homo sapien
tatgtgagtatctacttccttttta

SEQ ID NO: 94183 - DNA, 25 bp, Homo sapien
tatgtgagtatttacttccttttta

SEQ ID NO: 94184 - DNA, 25 bp, Homo sapien
tatgtgatagagtagtgaagaattt

SEQ ID NO: 94185 - DNA, 25 bp, Homo sapien
tatgtgatagattagtgaagaattt

SEQ ID NO: 94186 - DNA, 25 bp, Homo sapien
tatgtgattgccactggtcaagcct

SEQ ID NO: 94187 - DNA, 25 bp, Homo sapien
tatgtgattgccattggtcaagcct

SEQ ID NO: 94188 - DNA, 25 bp, Homo sapien
tatgtgcacggtagcagtgtgtaat

SEQ ID NO: 94189 - DNA, 25 bp, Homo sapien
tatgtgcatggtagcagtgtgtaat

SEQ ID NO: 94190 - DNA, 25 bp, Homo sapien
tatgtgccaatcctctaagtcctcc

SEQ ID NO: 94191 - DNA, 25 bp, Homo sapien
tatgtgccaattctctaagtcctcc

SEQ ID NO: 94192 - DNA, 25 bp, Homo sapien
tatgtgctgtaggtatatctgtact

SEQ ID NO: 94193 - DNA, 25 bp, Homo sapien
tatgtgctgtatgtatatctgtact

SEQ ID NO: 94194 - DNA, 25 bp, Homo sapien
tatgtggaaaatgtcaaatccaaag

SEQ ID NO: 94195 - DNA, 25 bp, Homo sapien
tatgtggaaaatgtcacatccaaag

SEQ ID NO: 94196 - DNA, 25 bp, Homo sapien
tatgtggagaagcaactgcttattg

SEQ ID NO: 94197 - DNA, 25 bp, Homo sapien
tatgtggaggagcaactgcttattg

SEQ ID NO: 94198 - DNA, 25 bp, Homo sapien
tatgtggtctgtaatgactgacttc

SEQ ID NO: 94199 - DNA, 25 bp, Homo sapien
tatgtggtctgtagtgactgacttc

SEQ ID NO: 94200 - DNA, 25 bp, Homo sapien
tatgtgtaataattcatgtatacaa

SEQ ID NO: 94201 - DNA, 25 bp, Homo sapien
tatgtgtaatggtaatgtgctgtat

SEQ ID NO: 94202 - DNA, 25 bp, Homo sapien
tatgtgtaatggtcatgtgctgtat

SEQ ID NO: 94203 - DNA, 25 bp, Homo sapien
tatgtgtagtaattcatgtatacaa

SEQ ID NO: 94204 - DNA, 25 bp, Homo sapien
tatgtgtagttttaataagtcttaa

SEQ ID NO: 94205 - DNA, 25 bp, Homo sapien
tatgtgtagttttagtaagtcttaa

SEQ ID NO: 94206 - DNA, 25 bp, Homo sapien
tatgtgtcaatccaccagaatttag

SEQ ID NO: 94207 - DNA, 25 bp, Homo sapien
tatgtgtcaatccaccggaatttag

SEQ ID NO: 94208 - DNA, 25 bp, Homo sapien
tatgtgtcttacaacttttagccat

SEQ ID NO: 94209 - DNA, 25 bp, Homo sapien
tatgtgtcttataacttttagccat

SEQ ID NO: 94210 - DNA, 25 bp, Homo sapien
tatgtgtgatatgtttgttatgtat

SEQ ID NO: 94211 - DNA, 25 bp, Homo sapien
tatgtgtgatatttttgttatgtat

SEQ ID NO: 94212 - DNA, 25 bp, Homo sapien
tatgtgtggcatgcgttatatttct

SEQ ID NO: 94213 - DNA, 25 bp, Homo sapien
tatgtgtggcatgtgttatatttct

SEQ ID NO: 94214 - DNA, 25 bp, Homo sapien
tatgtgttcatatcataaacattat

SEQ ID NO: 94215 - DNA, 25 bp, Homo sapien
tatgtgttcatatcgtaaacattat

SEQ ID NO: 94216 - DNA, 25 bp, Homo sapien
tatgttacagtcaaatcctctgcta

SEQ ID NO: 94217 - DNA, 25 bp, Homo sapien
tatgttactgtcaaatcctctgcta

SEQ ID NO: 94218 - DNA, 25 bp, Homo sapien
tatgttagaaccaaagtgctaagtt

SEQ ID NO: 94219 - DNA, 25 bp, Homo sapien
tatgttagaaccgaagtgctaagtt

SEQ ID NO: 94220 - DNA, 25 bp, Homo sapien
tatgttagaccattctggcagcaat

SEQ ID NO: 94221 - DNA, 25 bp, Homo sapien
tatgttagaccgttctggcagcaat

SEQ ID NO: 94222 - DNA, 25 bp, Homo sapien
tatgttcaatatacgtttgttgatt

SEQ ID NO: 94223 - DNA, 25 bp, Homo sapien
tatgttcaatatatgtttgttgatt

SEQ ID NO: 94224 - DNA, 25 bp, Homo sapien
tatgttcacgatatcactgattctt

SEQ ID NO: 94225 - DNA, 25 bp, Homo sapien
tatgttcagtgccttgaaataaaac

SEQ ID NO: 94226 - DNA, 25 bp, Homo sapien
tatgttcagtgtcttgaaataaaac

SEQ ID NO: 94227 - DNA, 25 bp, Homo sapien
tatgttcatgatatcactgattctt

SEQ ID NO: 94228 - DNA, 25 bp, Homo sapien
tatgttcattttatgtgagcaaatg

SEQ ID NO: 94229 - DNA, 25 bp, Homo sapien
tatgttcattttttgtgagcaaatg

SEQ ID NO: 94230 - DNA, 25 bp, Homo sapien
tatgttctgggaatcgctccatatc

SEQ ID NO: 94231 - DNA, 25 bp, Homo sapien
tatgttctgggaattgctccatatc

SEQ ID NO: 94232 - DNA, 25 bp, Homo sapien
tatgttctgttccactgcggctaag

SEQ ID NO: 94233 - DNA, 25 bp, Homo sapien
tatgttctgttctactgcggctaag

SEQ ID NO: 94234 - DNA, 25 bp, Homo sapien
tatgttgtagcttgaaatctcttat

SEQ ID NO: 94235 - DNA, 25 bp, Homo sapien
tatgttgtagctttaaatctcttat

SEQ ID NO: 94236 - DNA, 25 bp, Homo sapien
tatgttgttctagcaccatgcatgg

SEQ ID NO: 94237 - DNA, 25 bp, Homo sapien
tatgttgttctggcaccatgcatgg

SEQ ID NO: 94238 - DNA, 25 bp, Homo sapien
tatgtttaaggaagagaaagatagt

SEQ ID NO: 94239 - DNA, 25 bp, Homo sapien
tatgtttagggaagagaaagatagt

SEQ ID NO: 94240 - DNA, 25 bp, Homo sapien
tatgtttagtgtcggtaagatctat

SEQ ID NO: 94241 - DNA, 25 bp, Homo sapien
tatgtttagtgttggtaagatctat

SEQ ID NO: 94242 - DNA, 25 bp, Homo sapien
tatgtttattagaggtctagcagaa

SEQ ID NO: 94243 - DNA, 25 bp, Homo sapien
tatgtttattagaggtttagcagaa

SEQ ID NO: 94244 - DNA, 25 bp, Homo sapien
tatgtttcacttcgacctggaggcc

SEQ ID NO: 94245 - DNA, 25 bp, Homo sapien
tatgtttcacttcgacttggaggcc

SEQ ID NO: 94246 - DNA, 25 bp, Homo sapien
tatgtttgcagtgacaaaagttgac

SEQ ID NO: 94247 - DNA, 25 bp, Homo sapien
tatgtttgtagtgacaaaagttgac

SEQ ID NO: 94248 - DNA, 25 bp, Homo sapien
tatgttttatacgtatcctagtaga

SEQ ID NO: 94249 - DNA, 25 bp, Homo sapien
tatgttttatatgtatcctagtaga

SEQ ID NO: 94250 - DNA, 25 bp, Homo sapien
tatgttttattcacgttctcggtgg

SEQ ID NO: 94251 - DNA, 25 bp, Homo sapien
tatgttttattcatgttctcggtgg

SEQ ID NO: 94252 - DNA, 25 bp, Homo sapien
tatgttttcattcgctttgttgaag

SEQ ID NO: 94253 - DNA, 25 bp, Homo sapien
tatgttttcatttgctttgttgaag

SEQ ID NO: 94254 - DNA, 25 bp, Homo sapien
tatgttttccacaaggcttgcaatt

SEQ ID NO: 94255 - DNA, 25 bp, Homo sapien
tatgttttccacgaggcttgcaatt

SEQ ID NO: 94256 - DNA, 25 bp, Homo sapien
tatgttttctttgaccttacttaca

SEQ ID NO: 94257 - DNA, 25 bp, Homo sapien
tatgttttctttgcccttacttaca

SEQ ID NO: 94258 - DNA, 25 bp, Homo sapien
tattaaaacaacgttaggctccacc

SEQ ID NO: 94259 - DNA, 25 bp, Homo sapien
tattaaaacaactttaggctccacc

SEQ ID NO: 94260 - DNA, 25 bp, Homo sapien
tattaaaacacctcacgcctcaggt

SEQ ID NO: 94261 - DNA, 25 bp, Homo sapien
tattaaaacacttcacgcctcaggt

SEQ ID NO: 94262 - DNA, 25 bp, Homo sapien
tattaaaagataagccagtacatct

SEQ ID NO: 94263 - DNA, 25 bp, Homo sapien
tattaaaagataggccagtacatct

SEQ ID NO: 94264 - DNA, 25 bp, Homo sapien
tattaaaagttattccaaaattgta

SEQ ID NO: 94265 - DNA, 25 bp, Homo sapien
tattaaaagttattccgaaattgta

SEQ ID NO: 94266 - DNA, 25 bp, Homo sapien
tattaaaatggtcaataataggaga

SEQ ID NO: 94267 - DNA, 25 bp, Homo sapien
tattaaaatggtcgataataggaga

SEQ ID NO: 94268 - DNA, 25 bp, Homo sapien
tattaaaatgtgacacaagtgaagg

SEQ ID NO: 94269 - DNA, 25 bp, Homo sapien
tattaaaatgtgatacaagtgaagg

SEQ ID NO: 94270 - DNA, 25 bp, Homo sapien
tattaaacaagtcacacccttcttc

SEQ ID NO: 94271 - DNA, 25 bp, Homo sapien
tattaaacaagtcgcacccttcttc

SEQ ID NO: 94272 - DNA, 25 bp, Homo sapien
tattaaacagaacagggcccatgag

SEQ ID NO: 94273 - DNA, 25 bp, Homo sapien
tattaaacataacagggcccatgag

SEQ ID NO: 94274 - DNA, 25 bp, Homo sapien
tattaaacattacgatgcagttttt

SEQ ID NO: 94275 - DNA, 25 bp, Homo sapien
tattaaacattatgatgcagttttt

SEQ ID NO: 94276 - DNA, 25 bp, Homo sapien
tattaaactgaaaacattctgcaca

SEQ ID NO: 94277 - DNA, 25 bp, Homo sapien
tattaaactgaaaatattctgcaca

SEQ ID NO: 94278 - DNA, 25 bp, Homo sapien
tattaaagaaccacgcagaagtgct

SEQ ID NO: 94279 - DNA, 25 bp, Homo sapien
tattaaagaaccatgcagaagtgct

SEQ ID NO: 94280 - DNA, 25 bp, Homo sapien
tattaaagagtcttgtcaatgccta

SEQ ID NO: 94281 - DNA, 25 bp, Homo sapien
tattaaagggtcttgtcaatgccta

SEQ ID NO: 94282 - DNA, 25 bp, Homo sapien
tattaaagtggcaatgcaccatgca

SEQ ID NO: 94283 - DNA, 25 bp, Homo sapien
tattaaagtggccatgcaccatgca

SEQ ID NO: 94284 - DNA, 25 bp, Homo sapien
tattaaatcactcttagtacgcaga

SEQ ID NO: 94285 - DNA, 25 bp, Homo sapien
tattaaatcactgttagtacgcaga

SEQ ID NO: 94286 - DNA, 25 bp, Homo sapien
tattaaatttctgcttgtttttctc

SEQ ID NO: 94287 - DNA, 25 bp, Homo sapien
tattaaatttctgtttgtttttctc

SEQ ID NO: 94288 - DNA, 25 bp, Homo sapien
tattaacaatttttccataagctcc

SEQ ID NO: 94289 - DNA, 25 bp, Homo sapien
tattaacagattcacaagctctggc

SEQ ID NO: 94290 - DNA, 25 bp, Homo sapien
tattaacaggttcacaagctctggc

SEQ ID NO: 94291 - DNA, 25 bp, Homo sapien
tattaacagtttttccataagctcc

SEQ ID NO: 94292 - DNA, 25 bp, Homo sapien
tattaacatccaaacaaacttgcag

SEQ ID NO: 94293 - DNA, 25 bp, Homo sapien
tattaacatccaagcaaacttgcag

SEQ ID NO: 94294 - DNA, 25 bp, Homo sapien
tattaacttacccaatccttacaac

SEQ ID NO: 94295 - DNA, 25 bp, Homo sapien
tattaacttacctaatccttacaac

SEQ ID NO: 94296 - DNA, 25 bp, Homo sapien
tattaagagctgaccgtataaacga

SEQ ID NO: 94297 - DNA, 25 bp, Homo sapien
tattaagagctgactgtataaacga

SEQ ID NO: 94298 - DNA, 25 bp, Homo sapien
tattaagaggctttatacacttctt

SEQ ID NO: 94299 - DNA, 25 bp, Homo sapien
tattaagagtattgactccttcatg

SEQ ID NO: 94300 - DNA, 25 bp, Homo sapien
tattaagagtattgtctccttcatg

SEQ ID NO: 94301 - DNA, 25 bp, Homo sapien
tattaagatgctttatacacttctt

SEQ ID NO: 94302 - DNA, 25 bp, Homo sapien
tattaaggagataaggactggggtg

SEQ ID NO: 94303 - DNA, 25 bp, Homo sapien
tattaaggagataatgactggggtg

SEQ ID NO: 94304 - DNA, 25 bp, Homo sapien
tattaagtattgtattagtttcctc

SEQ ID NO: 94305 - DNA, 25 bp, Homo sapien
tattaagtattgtattcgtttcctc

SEQ ID NO: 94306 - DNA, 25 bp, Homo sapien
tattaatattacataacatgaggtc

SEQ ID NO: 94307 - DNA, 25 bp, Homo sapien
tattaatattacgtaacatgaggtc

SEQ ID NO: 94308 - DNA, 25 bp, Homo sapien
tattaatattgaggcctttttatct

SEQ ID NO: 94309 - DNA, 25 bp, Homo sapien
tattaatattgagggctttttatct

SEQ ID NO: 94310 - DNA, 25 bp, Homo sapien
tattaatccatcggcctcctgtcag

SEQ ID NO: 94311 - DNA, 25 bp, Homo sapien
tattaatccatctgcctcctgtcag

SEQ ID NO: 94312 - DNA, 25 bp, Homo sapien
tattaatccattcaactgttggtat

SEQ ID NO: 94313 - DNA, 25 bp, Homo sapien
tattaatccgttcaactgttggtat

SEQ ID NO: 94314 - DNA, 25 bp, Homo sapien
tattaatgatagcaattcacgctag

SEQ ID NO: 94315 - DNA, 25 bp, Homo sapien
tattaatgatagcgattcacgctag

SEQ ID NO: 94316 - DNA, 25 bp, Homo sapien
tattaattgcagctgaacttaaacc

SEQ ID NO: 94317 - DNA, 25 bp, Homo sapien
tattaattgcagcttaacttaaacc

SEQ ID NO: 94318 - DNA, 25 bp, Homo sapien
tattacaacaatgggaagttaagaa

SEQ ID NO: 94319 - DNA, 25 bp, Homo sapien
tattacaacaatgggaggttaagaa

SEQ ID NO: 94320 - DNA, 25 bp, Homo sapien
tattacaagaggaccttttgcttaa

SEQ ID NO: 94321 - DNA, 25 bp, Homo sapien
tattacaagagggccttttgcttaa

SEQ ID NO: 94322 - DNA, 25 bp, Homo sapien
tattacatctactggccgtaagtcg

SEQ ID NO: 94323 - DNA, 25 bp, Homo sapien
tattacatctactggctgtaagtcg

SEQ ID NO: 94324 - DNA, 25 bp, Homo sapien
tattacatgccaatacgacatactt

SEQ ID NO: 94325 - DNA, 25 bp, Homo sapien
tattacatgccaatactacatactt

SEQ ID NO: 94326 - DNA, 25 bp, Homo sapien
tattacatttgctcagcatcttgcc

SEQ ID NO: 94327 - DNA, 25 bp, Homo sapien
tattacatttgctcggcatcttgcc

SEQ ID NO: 94328 - DNA, 25 bp, Homo sapien
tattaccaatgctactgataaagct

SEQ ID NO: 94329 - DNA, 25 bp, Homo sapien
tattaccagtgctactgataaagct

SEQ ID NO: 94330 - DNA, 25 bp, Homo sapien
tattacctgtaaccggtccttgtct

SEQ ID NO: 94331 - DNA, 25 bp, Homo sapien
tattacctgtaactggtccttgtct

SEQ ID NO: 94332 - DNA, 25 bp, Homo sapien
tattactcacaatttttgccatggt

SEQ ID NO: 94333 - DNA, 25 bp, Homo sapien
tattactcacagtttttgccatggt

SEQ ID NO: 94334 - DNA, 25 bp, Homo sapien
tattactcttgcagttgtttacttg

SEQ ID NO: 94335 - DNA, 25 bp, Homo sapien
tattactcttgtagttgtttacttg

SEQ ID NO: 94336 - DNA, 25 bp, Homo sapien
tattacttacgcatcacacatcaat

SEQ ID NO: 94337 - DNA, 25 bp, Homo sapien
tattacttatgcatcacacatcaat

SEQ ID NO: 94338 - DNA, 25 bp, Homo sapien
tattacttcaattcaactctcatac

SEQ ID NO: 94339 - DNA, 25 bp, Homo sapien
tattacttcgattcaactctcatac

SEQ ID NO: 94340 - DNA, 25 bp, Homo sapien
tattacttctgcatttactcattga

SEQ ID NO: 94341 - DNA, 25 bp, Homo sapien
tattacttctgcctttactcattga

SEQ ID NO: 94342 - DNA, 25 bp, Homo sapien
tattacttttcctgtacatctctgc

SEQ ID NO: 94343 - DNA, 25 bp, Homo sapien
tattacttttcttgtacatctctgc

SEQ ID NO: 94344 - DNA, 25 bp, Homo sapien
tattagaaagtttcaataaattaac

SEQ ID NO: 94345 - DNA, 25 bp, Homo sapien
tattagaaagtttgaataaattaac

SEQ ID NO: 94346 - DNA, 25 bp, Homo sapien
tattagaacaggcttacaagagacc

SEQ ID NO: 94347 - DNA, 25 bp, Homo sapien
tattagaaccggcttacaagagacc

SEQ ID NO: 94348 - DNA, 25 bp, Homo sapien
tattagaagagaaaagtctgccttt

SEQ ID NO: 94349 - DNA, 25 bp, Homo sapien
tattagaagagaaatgtctgccttt

SEQ ID NO: 94350 - DNA, 25 bp, Homo sapien
tattagacaaacgagacttaggtaa

SEQ ID NO: 94351 - DNA, 25 bp, Homo sapien
tattagacacaagtacttaggcagc

SEQ ID NO: 94352 - DNA, 25 bp, Homo sapien
tattagaccaacgagacttaggtaa

SEQ ID NO: 94353 - DNA, 25 bp, Homo sapien
tattagacctgcgttctacctaact

SEQ ID NO: 94354 - DNA, 25 bp, Homo sapien
tattagacctgtgttctacctaact

SEQ ID NO: 94355 - DNA, 25 bp, Homo sapien
tattagacgcaagtacttaggcagc

SEQ ID NO: 94356 - DNA, 25 bp, Homo sapien
tattagatgagctaccagagatgac

SEQ ID NO: 94357 - DNA, 25 bp, Homo sapien
tattagatgagttaccagagatgac

SEQ ID NO: 94358 - DNA, 25 bp, Homo sapien
tattagattgactaaaagcatggtg

SEQ ID NO: 94359 - DNA, 25 bp, Homo sapien
tattagattgattaaaagcatggtg

SEQ ID NO: 94360 - DNA, 25 bp, Homo sapien
tattagctagaaagaacaataatga

SEQ ID NO: 94361 - DNA, 25 bp, Homo sapien
tattagctagaaagaataataatga

SEQ ID NO: 94362 - DNA, 25 bp, Homo sapien
tattagctataccaaggttacttcc

SEQ ID NO: 94363 - DNA, 25 bp, Homo sapien
tattagctctaccaaggttacttcc

SEQ ID NO: 94364 - DNA, 25 bp, Homo sapien
tattaggctgccatatgatccagag

SEQ ID NO: 94365 - DNA, 25 bp, Homo sapien
tattaggcttccatatgatccagag

SEQ ID NO: 94366 - DNA, 25 bp, Homo sapien
tattagggatttaggtcagtcaatg

SEQ ID NO: 94367 - DNA, 25 bp, Homo sapien
tattagggttttaggtcagtcaatg

SEQ ID NO: 94368 - DNA, 25 bp, Homo sapien
tattagtacattttccctggaatct

SEQ ID NO: 94369 - DNA, 25 bp, Homo sapien
tattagtacgttttccctggaatct

SEQ ID NO: 94370 - DNA, 25 bp, Homo sapien
tattagtagctacggtgaacagtgc

SEQ ID NO: 94371 - DNA, 25 bp, Homo sapien
tattagtagctatggtgaacagtgc

SEQ ID NO: 94372 - DNA, 25 bp, Homo sapien
tattagtcatgatatagggaattga

SEQ ID NO: 94373 - DNA, 25 bp, Homo sapien
tattagtcatgatatatggaattga

SEQ ID NO: 94374 - DNA, 25 bp, Homo sapien
tattagtgatcagcacttatgagtg

SEQ ID NO: 94375 - DNA, 25 bp, Homo sapien
tattagtgatcggcacttatgagtg

SEQ ID NO: 94376 - DNA, 25 bp, Homo sapien
tattagtgatgattcaatgcatttt

SEQ ID NO: 94377 - DNA, 25 bp, Homo sapien
tattagtgatggttcaatgcatttt

SEQ ID NO: 94378 - DNA, 25 bp, Homo sapien
tattagttgttactcatttgtgaga

SEQ ID NO: 94379 - DNA, 25 bp, Homo sapien
tattagttgttattcatttgtgaga

SEQ ID NO: 94380 - DNA, 25 bp, Homo sapien
tattagtttttagcagtgtcaaaaa

SEQ ID NO: 94381 - DNA, 25 bp, Homo sapien
tattagtttttagtagtgtcaaaaa

SEQ ID NO: 94382 - DNA, 25 bp, Homo sapien
tattataaaatgacgacatattcaa

SEQ ID NO: 94383 - DNA, 25 bp, Homo sapien
tattataaaatgatgacatattcaa

SEQ ID NO: 94384 - DNA, 25 bp, Homo sapien
tattataaacatatttaggagaccc

SEQ ID NO: 94385 - DNA, 25 bp, Homo sapien
tattataaacatgtttaggagaccc

SEQ ID NO: 94386 - DNA, 25 bp, Homo sapien
tattataacttcgcctcaaaattca

SEQ ID NO: 94387 - DNA, 25 bp, Homo sapien
tattataacttctcctcaaaattca

SEQ ID NO: 94388 - DNA, 25 bp, Homo sapien
tattataagcagtgacctcaaagtg

SEQ ID NO: 94389 - DNA, 25 bp, Homo sapien
tattataagcagtgacttcaaagtg

SEQ ID NO: 94390 - DNA, 25 bp, Homo sapien
tattataagccataggtacagaact

SEQ ID NO: 94391 - DNA, 25 bp, Homo sapien
tattataagtcataggtacagaact

SEQ ID NO: 94392 - DNA, 25 bp, Homo sapien
tattataatgtgcaaccagattaag

SEQ ID NO: 94393 - DNA, 25 bp, Homo sapien
tattataatgtgcgaccagattaag

SEQ ID NO: 94394 - DNA, 25 bp, Homo sapien
tattatactgtacaaccagcaagta

SEQ ID NO: 94395 - DNA, 25 bp, Homo sapien
tattatactgtacatccagcaagta

SEQ ID NO: 94396 - DNA, 25 bp, Homo sapien
tattatcaacacgacagaagagaaa

SEQ ID NO: 94397 - DNA, 25 bp, Homo sapien
tattatcaacatgacagaagagaaa

SEQ ID NO: 94398 - DNA, 25 bp, Homo sapien
tattatccaattgttttgattttgg

SEQ ID NO: 94399 - DNA, 25 bp, Homo sapien
tattatccagttgttttgattttgg

SEQ ID NO: 94400 - DNA, 25 bp, Homo sapien
tattatccatcattatggcaaagaa

SEQ ID NO: 94401 - DNA, 25 bp, Homo sapien
tattatccatctttatggcaaagaa

SEQ ID NO: 94402 - DNA, 25 bp, Homo sapien
tattatccattcagggacttatata

SEQ ID NO: 94403 - DNA, 25 bp, Homo sapien
tattatccattcaggggcttatata

SEQ ID NO: 94404 - DNA, 25 bp, Homo sapien
tattatgaagctaaaacctgggtct

SEQ ID NO: 94405 - DNA, 25 bp, Homo sapien
tattatgaataacccatctgtggac

SEQ ID NO: 94406 - DNA, 25 bp, Homo sapien
tattatgaataacgcatctgtggac

SEQ ID NO: 94407 - DNA, 25 bp, Homo sapien
tattatgaggctaaaacctgggtct

SEQ ID NO: 94408 - DNA, 25 bp, Homo sapien
tattatggactaaacattgggtcaa

SEQ ID NO: 94409 - DNA, 25 bp, Homo sapien
tattatggactagacattgggtcaa

SEQ ID NO: 94410 - DNA, 25 bp, Homo sapien
tattatgtgatttttcctgcttaaa

SEQ ID NO: 94411 - DNA, 25 bp, Homo sapien
tattatgtggagaagcaactgctta

SEQ ID NO: 94412 - DNA, 25 bp, Homo sapien
tattatgtggaggagcaactgctta

SEQ ID NO: 94413 - DNA, 25 bp, Homo sapien
tattatgtggtttttcctgcttaaa

SEQ ID NO: 94414 - DNA, 25 bp, Homo sapien
tattatgtgtcttacaacttttagc

SEQ ID NO: 94415 - DNA, 25 bp, Homo sapien
tattatgtgtcttataacttttagc

SEQ ID NO: 94416 - DNA, 25 bp, Homo sapien
tattattaaatttctgcttgttttt

SEQ ID NO: 94417 - DNA, 25 bp, Homo sapien
tattattaaatttctgtttgttttt

SEQ ID NO: 94418 - DNA, 25 bp, Homo sapien
tattattgcataaggtagtgtacct

SEQ ID NO: 94419 - DNA, 25 bp, Homo sapien
tattattgcgtaaggtagtgtacct

SEQ ID NO: 94420 - DNA, 25 bp, Homo sapien
tattatttccatcattccattgtgt

SEQ ID NO: 94421 - DNA, 25 bp, Homo sapien
tattatttccatctttccattgtgt

SEQ ID NO: 94422 - DNA, 25 bp, Homo sapien
tattatttgttcattaaggtgatta

SEQ ID NO: 94423 - DNA, 25 bp, Homo sapien
tattatttgttcattagggtgatta

SEQ ID NO: 94424 - DNA, 25 bp, Homo sapien
tattattttatgagcgcatgatatc

SEQ ID NO: 94425 - DNA, 25 bp, Homo sapien
tattattttatgagtgcatgatatc

SEQ ID NO: 94426 - DNA, 25 bp, Homo sapien
tattattttgatacagattacaatt

SEQ ID NO: 94427 - DNA, 25 bp, Homo sapien
tattattttgatagagattacaatt

SEQ ID NO: 94428 - DNA, 25 bp, Homo sapien
tattcaaaacttaatgtaggcttat

SEQ ID NO: 94429 - DNA, 25 bp, Homo sapien
tattcaaaatttaatgtaggcttat

SEQ ID NO: 94430 - DNA, 25 bp, Homo sapien
tattcaaagagccacgaagagaaaa

SEQ ID NO: 94431 - DNA, 25 bp, Homo sapien
tattcaaagagctacgaagagaaaa

SEQ ID NO: 94432 - DNA, 25 bp, Homo sapien
tattcaaagccaacctgcacattag

SEQ ID NO: 94433 - DNA, 25 bp, Homo sapien
tattcaaagccaatctgcacattag

SEQ ID NO: 94434 - DNA, 25 bp, Homo sapien
tattcaaatactctgcttggttccg

SEQ ID NO: 94435 - DNA, 25 bp, Homo sapien
tattcaaatcccaatgtgatgctga

SEQ ID NO: 94436 - DNA, 25 bp, Homo sapien
tattcaaatcccgatgtgatgctga

SEQ ID NO: 94437 - DNA, 25 bp, Homo sapien
tattcaaatgctctgcttggttccg

SEQ ID NO: 94438 - DNA, 25 bp, Homo sapien
tattcaacaacagtttattcaaaag

SEQ ID NO: 94439 - DNA, 25 bp, Homo sapien
tattcaacaacagtttgttcaaaag

SEQ ID NO: 94440 - DNA, 25 bp, Homo sapien
tattcaatggatgtcaactttttct

SEQ ID NO: 94441 - DNA, 25 bp, Homo sapien
tattcaatggatgttaactttttct

SEQ ID NO: 94442 - DNA, 25 bp, Homo sapien
tattcaattctcttatacttgatta

SEQ ID NO: 94443 - DNA, 25 bp, Homo sapien
tattcaattttcttatacttgatta

SEQ ID NO: 94444 - DNA, 25 bp, Homo sapien
tattcactacaggttgttcttggtc

SEQ ID NO: 94445 - DNA, 25 bp, Homo sapien
tattcactcatatcgaattgggctt

SEQ ID NO: 94446 - DNA, 25 bp, Homo sapien
tattcactcgtatcgaattgggctt

SEQ ID NO: 94447 - DNA, 25 bp, Homo sapien
tattcactcttacattttaactcat

SEQ ID NO: 94448 - DNA, 25 bp, Homo sapien
tattcactcttagattttaactcat

SEQ ID NO: 94449 - DNA, 25 bp, Homo sapien
tattcactctttgacatgtagggca

SEQ ID NO: 94450 - DNA, 25 bp, Homo sapien
tattcactctttggcatgtagggca

SEQ ID NO: 94451 - DNA, 25 bp, Homo sapien
tattcactgatgactgttataattt

SEQ ID NO: 94452 - DNA, 25 bp, Homo sapien
tattcactgatggctgttataattt

SEQ ID NO: 94453 - DNA, 25 bp, Homo sapien
tattcactgcaggttgttcttggtc

SEQ ID NO: 94454 - DNA, 25 bp, Homo sapien
tattcactttccggtcttgttatat

SEQ ID NO: 94455 - DNA, 25 bp, Homo sapien
tattcactttctggtcttgttatat

SEQ ID NO: 94456 - DNA, 25 bp, Homo sapien
tattcagtctccaaaaagcaaagtc

SEQ ID NO: 94457 - DNA, 25 bp, Homo sapien
tattcagtctccagaaagcaaagtc

SEQ ID NO: 94458 - DNA, 25 bp, Homo sapien
tattcagtttccagggcttagaatg

SEQ ID NO: 94459 - DNA, 25 bp, Homo sapien
tattcagtttccagggtttagaatg

SEQ ID NO: 94460 - DNA, 25 bp, Homo sapien
tattcataaatcatagcatcacatt

SEQ ID NO: 94461 - DNA, 25 bp, Homo sapien
tattcataaatcattgcatcacatt

SEQ ID NO: 94462 - DNA, 25 bp, Homo sapien
tattcataaccacccaaacttggaa

SEQ ID NO: 94463 - DNA, 25 bp, Homo sapien
tattcataaccatccaaacttggaa

SEQ ID NO: 94464 - DNA, 25 bp, Homo sapien
tattcatacctatagcccactttac

SEQ ID NO: 94465 - DNA, 25 bp, Homo sapien
tattcatacttatagcccactttac

SEQ ID NO: 94466 - DNA, 25 bp, Homo sapien
tattcatcacggcatctttcattgc

SEQ ID NO: 94467 - DNA, 25 bp, Homo sapien
tattcatcacggtatctttcattgc

SEQ ID NO: 94468 - DNA, 25 bp, Homo sapien
tattcatccaagtccttgagtggaa

SEQ ID NO: 94469 - DNA, 25 bp, Homo sapien
tattcatccaagtgcttgagtggaa

SEQ ID NO: 94470 - DNA, 25 bp, Homo sapien
tattcatgtacctaacagcatatgt

SEQ ID NO: 94471 - DNA, 25 bp, Homo sapien
tattcatgtacctaaccgcatatgt

SEQ ID NO: 94472 - DNA, 25 bp, Homo sapien
tattcattaaggatgtctaacacca

SEQ ID NO: 94473 - DNA, 25 bp, Homo sapien
tattcattaaggatttctaacacca

SEQ ID NO: 94474 - DNA, 25 bp, Homo sapien
tattcattactataaagttccaaag

SEQ ID NO: 94475 - DNA, 25 bp, Homo sapien
tattcattattataaagttccaaag

SEQ ID NO: 94476 - DNA, 25 bp, Homo sapien
tattcattggttttcattgttagtt

SEQ ID NO: 94477 - DNA, 25 bp, Homo sapien
tattcatttgttttcattgttagtt

SEQ ID NO: 94478 - DNA, 25 bp, Homo sapien
tattccaaaaacaatgcccgcaatt

SEQ ID NO: 94479 - DNA, 25 bp, Homo sapien
tattccaaagacaatgcccgcaatt

SEQ ID NO: 94480 - DNA, 25 bp, Homo sapien
tattccaactaatatcatgaaactg

SEQ ID NO: 94481 - DNA, 25 bp, Homo sapien
tattccaactaatatcgtgaaactg

SEQ ID NO: 94482 - DNA, 25 bp, Homo sapien
tattccaactttgtgtttctactcc

SEQ ID NO: 94483 - DNA, 25 bp, Homo sapien
tattccaatgttacaatctctaaag

SEQ ID NO: 94484 - DNA, 25 bp, Homo sapien
tattccaatgttgcaatctctaaag

SEQ ID NO: 94485 - DNA, 25 bp, Homo sapien
tattccaattttgtgtttctactcc

SEQ ID NO: 94486 - DNA, 25 bp, Homo sapien
tattccagaagcactcataatgggc

SEQ ID NO: 94487 - DNA, 25 bp, Homo sapien
tattccagaagtactcataatgggc

SEQ ID NO: 94488 - DNA, 25 bp, Homo sapien
tattccagcccatgatgttggagag

SEQ ID NO: 94489 - DNA, 25 bp, Homo sapien
tattccagcccgtgatgttggagag

SEQ ID NO: 94490 - DNA, 25 bp, Homo sapien
tattccagggtgacagactcctagc

SEQ ID NO: 94491 - DNA, 25 bp, Homo sapien
tattccagggtggcagactcctagc

SEQ ID NO: 94492 - DNA, 25 bp, Homo sapien
tattccatcaacacagtattgacag

SEQ ID NO: 94493 - DNA, 25 bp, Homo sapien
tattccatcgacacagtattgacag

SEQ ID NO: 94494 - DNA, 25 bp, Homo sapien
tattccatgcaagaccatacaagtg

SEQ ID NO: 94495 - DNA, 25 bp, Homo sapien
tattccatgcacgaccatacaagtg

SEQ ID NO: 94496 - DNA, 25 bp, Homo sapien
tattccattctgcggataggccaca

SEQ ID NO: 94497 - DNA, 25 bp, Homo sapien
tattccattctgtggataggccaca

SEQ ID NO: 94498 - DNA, 25 bp, Homo sapien
tattcccacgacaaaactggcacat

SEQ ID NO: 94499 - DNA, 25 bp, Homo sapien
tattcccaggacaaaactggcacat

SEQ ID NO: 94500 - DNA, 25 bp, Homo sapien
tattccctatactcttcctctctcc

SEQ ID NO: 94501 - DNA, 25 bp, Homo sapien
tattccctatagtcttcctctctcc

SEQ ID NO: 94502 - DNA, 25 bp, Homo sapien
tattccctttgccgatggttgggat

SEQ ID NO: 94503 - DNA, 25 bp, Homo sapien
tattccctttgctgatggttgggat

SEQ ID NO: 94504 - DNA, 25 bp, Homo sapien
tattccgctcctgtctcaacagaat

SEQ ID NO: 94505 - DNA, 25 bp, Homo sapien
tattccgctcctgtgtcaacagaat

SEQ ID NO: 94506 - DNA, 25 bp, Homo sapien
tattcctagatatggtagctatgga

SEQ ID NO: 94507 - DNA, 25 bp, Homo sapien
tattcctagctatggtagctatgga

SEQ ID NO: 94508 - DNA, 25 bp, Homo sapien
tattcctatgcttctacctatggaa

SEQ ID NO: 94509 - DNA, 25 bp, Homo sapien
tattcctattcttctacctatggaa

SEQ ID NO: 94510 - DNA, 25 bp, Homo sapien
tattcctcaacaagccaaattcagt

SEQ ID NO: 94511 - DNA, 25 bp, Homo sapien
tattcctcaacaggccaaattcagt

SEQ ID NO: 94512 - DNA, 25 bp, Homo sapien
tattcctcagctatgacattctaaa

SEQ ID NO: 94513 - DNA, 25 bp, Homo sapien
tattcctcagctgtgacattctaaa

SEQ ID NO: 94514 - DNA, 25 bp, Homo sapien
tattcctctttaatttatctgactt

SEQ ID NO: 94515 - DNA, 25 bp, Homo sapien
tattcctctttgatttatctgactt

SEQ ID NO: 94516 - DNA, 25 bp, Homo sapien
tattcctgaattacttttaatactg

SEQ ID NO: 94517 - DNA, 25 bp, Homo sapien
tattcctgaattatttttaatactg

SEQ ID NO: 94518 - DNA, 25 bp, Homo sapien
tattccttcaagaaaaaattctccc

SEQ ID NO: 94519 - DNA, 25 bp, Homo sapien
tattccttccagaaaaaattctccc

SEQ ID NO: 94520 - DNA, 25 bp, Homo sapien
tattccttctcctcctctttattca

SEQ ID NO: 94521 - DNA, 25 bp, Homo sapien
tattccttctcttcctctttattca

SEQ ID NO: 94522 - DNA, 25 bp, Homo sapien
tattcgaacggtctgggttaggagc

SEQ ID NO: 94523 - DNA, 25 bp, Homo sapien
tattcgaatggtctgggttaggagc

SEQ ID NO: 94524 - DNA, 25 bp, Homo sapien
tattcgggtacttgttgctttacag

SEQ ID NO: 94525 - DNA, 25 bp, Homo sapien
tattcgggtgcttgttgctttacag

SEQ ID NO: 94526 - DNA, 25 bp, Homo sapien
tattcgtaatttctgacactcagct

SEQ ID NO: 94527 - DNA, 25 bp, Homo sapien
tattcgtagtttctgacactcagct

SEQ ID NO: 94528 - DNA, 25 bp, Homo sapien
tattctaaaacagactgaatgattg

SEQ ID NO: 94529 - DNA, 25 bp, Homo sapien
tattctaacacagactgaatgattg

SEQ ID NO: 94530 - DNA, 25 bp, Homo sapien
tattctacactcacttccagctcta

SEQ ID NO: 94531 - DNA, 25 bp, Homo sapien
tattctacactcacttgcagctcta

SEQ ID NO: 94532 - DNA, 25 bp, Homo sapien
tattctactttgagccatacagctg

SEQ ID NO: 94533 - DNA, 25 bp, Homo sapien
tattctactttgagtcatacagctg

SEQ ID NO: 94534 - DNA, 25 bp, Homo sapien
tattctagcataactgacctttatt

SEQ ID NO: 94535 - DNA, 25 bp, Homo sapien
tattctagcataactggcctttatt

SEQ ID NO: 94536 - DNA, 25 bp, Homo sapien
tattctagcctgttaggtgaacaaa

SEQ ID NO: 94537 - DNA, 25 bp, Homo sapien
tattctagtctgttaggtgaacaaa

SEQ ID NO: 94538 - DNA, 25 bp, Homo sapien
tattctatgattatgccaacattca

SEQ ID NO: 94539 - DNA, 25 bp, Homo sapien
tattctatgattattccaacattca

SEQ ID NO: 94540 - DNA, 25 bp, Homo sapien
tattctcaacacggcaatgattttt

SEQ ID NO: 94541 - DNA, 25 bp, Homo sapien
tattctcaacatggcaatgattttt

SEQ ID NO: 94542 - DNA, 25 bp, Homo sapien
tattctcattgtgaattctgggacc

SEQ ID NO: 94543 - DNA, 25 bp, Homo sapien
tattctcattgttaattctgggacc

SEQ ID NO: 94544 - DNA, 25 bp, Homo sapien
tattctcgtgttctccatttccatt

SEQ ID NO: 94545 - DNA, 25 bp, Homo sapien
tattctcgttttctccatttccatt

SEQ ID NO: 94546 - DNA, 25 bp, Homo sapien
tattctctaatgaaaaggatcaagg

SEQ ID NO: 94547 - DNA, 25 bp, Homo sapien
tattctctcgggctgcatttatgta

SEQ ID NO: 94548 - DNA, 25 bp, Homo sapien
tattctctctggctgcatttatgta

SEQ ID NO: 94549 - DNA, 25 bp, Homo sapien
tattctctgaggttcaatcatttgt

SEQ ID NO: 94550 - DNA, 25 bp, Homo sapien
tattctctgaggttcagtcatttgt

SEQ ID NO: 94551 - DNA, 25 bp, Homo sapien
tattctctgagtgttacctctctat

SEQ ID NO: 94552 - DNA, 25 bp, Homo sapien
tattctctgagtgttatctctctat

SEQ ID NO: 94553 - DNA, 25 bp, Homo sapien
tattctctgtttccatttttctttt

SEQ ID NO: 94554 - DNA, 25 bp, Homo sapien
tattctctgtttccgtttttctttt

SEQ ID NO: 94555 - DNA, 25 bp, Homo sapien
tattctcttaacaattttctcccct

SEQ ID NO: 94556 - DNA, 25 bp, Homo sapien
tattctcttaacgattttctcccct

SEQ ID NO: 94557 - DNA, 25 bp, Homo sapien
tattctcttatgaaaaggatcaagg

SEQ ID NO: 94558 - DNA, 25 bp, Homo sapien
tattctcttggtgcctctgtcacat

SEQ ID NO: 94559 - DNA, 25 bp, Homo sapien
tattctcttggtgtctctgtcacat

SEQ ID NO: 94560 - DNA, 25 bp, Homo sapien
tattctgctataaattaaacagtac

SEQ ID NO: 94561 - DNA, 25 bp, Homo sapien
tattctgctgtaaattaaacagtac

SEQ ID NO: 94562 - DNA, 25 bp, Homo sapien
tattctggatgctaagaataaaatt

SEQ ID NO: 94563 - DNA, 25 bp, Homo sapien
tattctggttgctaagaataaaatt

SEQ ID NO: 94564 - DNA, 25 bp, Homo sapien
tattcttacagcagcgctccactac

SEQ ID NO: 94565 - DNA, 25 bp, Homo sapien
tattcttacagctgcgctccactac

SEQ ID NO: 94566 - DNA, 25 bp, Homo sapien
tattcttacgtggtagaacgctttt

SEQ ID NO: 94567 - DNA, 25 bp, Homo sapien
tattcttagagattatgtcaggaat

SEQ ID NO: 94568 - DNA, 25 bp, Homo sapien
tattcttagcgattatgtcaggaat

SEQ ID NO: 94569 - DNA, 25 bp, Homo sapien
tattcttagtgtcctcatctttgag

SEQ ID NO: 94570 - DNA, 25 bp, Homo sapien
tattcttagtgtcttcatctttgag

SEQ ID NO: 94571 - DNA, 25 bp, Homo sapien
tattcttatgtggtagaacgctttt

SEQ ID NO: 94572 - DNA, 25 bp, Homo sapien
tattcttcacgcatcttaatatagt

SEQ ID NO: 94573 - DNA, 25 bp, Homo sapien
tattcttcatgcatcttaatatagt

SEQ ID NO: 94574 - DNA, 25 bp, Homo sapien
tattcttctctggttgatgagattc

SEQ ID NO: 94575 - DNA, 25 bp, Homo sapien
tattcttctttggttgatgagattc

SEQ ID NO: 94576 - DNA, 25 bp, Homo sapien
tattcttgtataccgagactatatc

SEQ ID NO: 94577 - DNA, 25 bp, Homo sapien
tattcttgtgtaccgagactatatc

SEQ ID NO: 94578 - DNA, 25 bp, Homo sapien
tattctttatgtaaaacggtaggat

SEQ ID NO: 94579 - DNA, 25 bp, Homo sapien
tattctttatgtaaaatggtaggat

SEQ ID NO: 94580 - DNA, 25 bp, Homo sapien
tattctttcaaaactccattgacta

SEQ ID NO: 94581 - DNA, 25 bp, Homo sapien
tattctttcaaatctccattgacta

SEQ ID NO: 94582 - DNA, 25 bp, Homo sapien
tattctttcacttaagagatctgag

SEQ ID NO: 94583 - DNA, 25 bp, Homo sapien
tattctttcccttaagagatctgag

SEQ ID NO: 94584 - DNA, 25 bp, Homo sapien
tattcttttcaatatgtcagtcttg

SEQ ID NO: 94585 - DNA, 25 bp, Homo sapien
tattcttttcagtatgtcagtcttg

SEQ ID NO: 94586 - DNA, 25 bp, Homo sapien
tattcttttccaactgaattgtctt

SEQ ID NO: 94587 - DNA, 25 bp, Homo sapien
tattcttttccgactgaattgtctt

SEQ ID NO: 94588 - DNA, 25 bp, Homo sapien
tattgaaaagcagattccaaagtta

SEQ ID NO: 94589 - DNA, 25 bp, Homo sapien
tattgaaaagcaggttccaaagtta

SEQ ID NO: 94590 - DNA, 25 bp, Homo sapien
tattgaaacggcaactcctcataac

SEQ ID NO: 94591 - DNA, 25 bp, Homo sapien
tattgaaatggcaactcctcataac

SEQ ID NO: 94592 - DNA, 25 bp, Homo sapien
tattgaacatgcactgaatttacaa

SEQ ID NO: 94593 - DNA, 25 bp, Homo sapien
tattgaacatgcgctgaatttacaa

SEQ ID NO: 94594 - DNA, 25 bp, Homo sapien
tattgacagaaattcaaaaaagttc

SEQ ID NO: 94595 - DNA, 25 bp, Homo sapien
tattgacagcaattcaaaaaagttc

SEQ ID NO: 94596 - DNA, 25 bp, Homo sapien
tattgacatatgacggacataatga

SEQ ID NO: 94597 - DNA, 25 bp, Homo sapien
tattgacatatgatggacataatga

SEQ ID NO: 94598 - DNA, 25 bp, Homo sapien
tattgactaaaatcaggtggtggaa

SEQ ID NO: 94599 - DNA, 25 bp, Homo sapien
tattgactaaaatcagttggtggaa

SEQ ID NO: 94600 - DNA, 25 bp, Homo sapien
tattgactaaatgacagaacataaa

SEQ ID NO: 94601 - DNA, 25 bp, Homo sapien
tattgactaaatgagagaacataaa

SEQ ID NO: 94602 - DNA, 25 bp, Homo sapien
tattgactactagctagaaatatgt

SEQ ID NO: 94603 - DNA, 25 bp, Homo sapien
tattgactagtagctagaaatatgt

SEQ ID NO: 94604 - DNA, 25 bp, Homo sapien
tattgactgcagtttacacttttct

SEQ ID NO: 94605 - DNA, 25 bp, Homo sapien
tattgactgcagtttatacttttct

SEQ ID NO: 94606 - DNA, 25 bp, Homo sapien
tattgactggaacgcttttggccga

SEQ ID NO: 94607 - DNA, 25 bp, Homo sapien
tattgactggaacgtttttggccga

SEQ ID NO: 94608 - DNA, 25 bp, Homo sapien
tattgactgggaacaagccgagaat

SEQ ID NO: 94609 - DNA, 25 bp, Homo sapien
tattgactgggaataagccgagaat

SEQ ID NO: 94610 - DNA, 25 bp, Homo sapien
tattgagaagacaatatatacataa

SEQ ID NO: 94611 - DNA, 25 bp, Homo sapien
tattgagaagacgatatatacataa

SEQ ID NO: 94612 - DNA, 25 bp, Homo sapien
tattgagaagagttaggaaataaag

SEQ ID NO: 94613 - DNA, 25 bp, Homo sapien
tattgagaagagtttggaaataaag

SEQ ID NO: 94614 - DNA, 25 bp, Homo sapien
tattgagcattacaataagtgctga

SEQ ID NO: 94615 - DNA, 25 bp, Homo sapien
tattgagcattataataagtgctga

SEQ ID NO: 94616 - DNA, 25 bp, Homo sapien
tattgagccaagcagcttaaaacaa

SEQ ID NO: 94617 - DNA, 25 bp, Homo sapien
tattgagccaagctgcttaaaacaa

SEQ ID NO: 94618 - DNA, 25 bp, Homo sapien
tattgaggcctgtataacattctaa

SEQ ID NO: 94619 - DNA, 25 bp, Homo sapien
tattgaggcctttttatctgaggtt

SEQ ID NO: 94620 - DNA, 25 bp, Homo sapien
tattgaggcttctcaggcaatgggc

SEQ ID NO: 94621 - DNA, 25 bp, Homo sapien
tattgagggctttttatctgaggtt

SEQ ID NO: 94622 - DNA, 25 bp, Homo sapien
tattgaggtcaaatgaactgtcagc

SEQ ID NO: 94623 - DNA, 25 bp, Homo sapien
tattgaggtcaactgaactgtcagc

SEQ ID NO: 94624 - DNA, 25 bp, Homo sapien
tattgaggtctgtataacattctaa

SEQ ID NO: 94625 - DNA, 25 bp, Homo sapien
tattgaggtgactgataaagtttga

SEQ ID NO: 94626 - DNA, 25 bp, Homo sapien
tattgaggtgattgataaagtttga

SEQ ID NO: 94627 - DNA, 25 bp, Homo sapien
tattgaggtttctcaggcaatgggc

SEQ ID NO: 94628 - DNA, 25 bp, Homo sapien
tattgagtacctattgatatgtgtg

SEQ ID NO: 94629 - DNA, 25 bp, Homo sapien
tattgagtacctgttgatatgtgtg

SEQ ID NO: 94630 - DNA, 25 bp, Homo sapien
tattgataactatcctcaccctcaa

SEQ ID NO: 94631 - DNA, 25 bp, Homo sapien
tattgatacagggcaaagaatcggg

SEQ ID NO: 94632 - DNA, 25 bp, Homo sapien
tattgatacattttgactttaggca

SEQ ID NO: 94633 - DNA, 25 bp, Homo sapien
tattgatagagggcaaagaatcggg

SEQ ID NO: 94634 - DNA, 25 bp, Homo sapien
tattgatagattttgactttaggca

SEQ ID NO: 94635 - DNA, 25 bp, Homo sapien
tattgatatctatcctcaccctcaa

SEQ ID NO: 94636 - DNA, 25 bp, Homo sapien
tattgatcaataggttaaatgtgat

SEQ ID NO: 94637 - DNA, 25 bp, Homo sapien
tattgatcaataggttcaatgtgat

SEQ ID NO: 94638 - DNA, 25 bp, Homo sapien
tattgattaactagtatggaaacag

SEQ ID NO: 94639 - DNA, 25 bp, Homo sapien
tattgattccacaccacttactgat

SEQ ID NO: 94640 - DNA, 25 bp, Homo sapien
tattgattgactagtatggaaacag

SEQ ID NO: 94641 - DNA, 25 bp, Homo sapien
tattgatttcacaccacttactgat

SEQ ID NO: 94642 - DNA, 25 bp, Homo sapien
tattgcaaactgattttgggcaaaa

SEQ ID NO: 94643 - DNA, 25 bp, Homo sapien
tattgcaaactggttttgggcaaaa

SEQ ID NO: 94644 - DNA, 25 bp, Homo sapien
tattgcaactatcttttaacaagct

SEQ ID NO: 94645 - DNA, 25 bp, Homo sapien
tattgcaatgaatcttctcattcta

SEQ ID NO: 94646 - DNA, 25 bp, Homo sapien
tattgcaattaatcttctcattcta

SEQ ID NO: 94647 - DNA, 25 bp, Homo sapien
tattgcaattatcttttaacaagct

SEQ ID NO: 94648 - DNA, 25 bp, Homo sapien
tattgcacacagtagctttgagcga

SEQ ID NO: 94649 - DNA, 25 bp, Homo sapien
tattgcacatgagataaagatgatt

SEQ ID NO: 94650 - DNA, 25 bp, Homo sapien
tattgcacgcagtagctttgagcga

SEQ ID NO: 94651 - DNA, 25 bp, Homo sapien
tattgcacgtgagataaagatgatt

SEQ ID NO: 94652 - DNA, 25 bp, Homo sapien
tattgcagccaggaaatgaataaag

SEQ ID NO: 94653 - DNA, 25 bp, Homo sapien
tattgcagggagttggtatgacact

SEQ ID NO: 94654 - DNA, 25 bp, Homo sapien
tattgcagggagtttgtatgacact

SEQ ID NO: 94655 - DNA, 25 bp, Homo sapien
tattgcagtaaccacgatggcagct

SEQ ID NO: 94656 - DNA, 25 bp, Homo sapien
tattgcagtaaccatgatggcagct

SEQ ID NO: 94657 - DNA, 25 bp, Homo sapien
tattgcagtcaggaaatgaataaag

SEQ ID NO: 94658 - DNA, 25 bp, Homo sapien
tattgcatgcctccgctgagctgtc

SEQ ID NO: 94659 - DNA, 25 bp, Homo sapien
tattgcatgcctctgctgagctgtc

SEQ ID NO: 94660 - DNA, 25 bp, Homo sapien
tattgcattaaagttactggtgctt

SEQ ID NO: 94661 - DNA, 25 bp, Homo sapien
tattgcattaaagttattggtgctt

SEQ ID NO: 94662 - DNA, 25 bp, Homo sapien
tattgccaagcacaagtaaaataag

SEQ ID NO: 94663 - DNA, 25 bp, Homo sapien
tattgccaagcataagtaaaataag

SEQ ID NO: 94664 - DNA, 25 bp, Homo sapien
tattgccacaatctacatgacaggg

SEQ ID NO: 94665 - DNA, 25 bp, Homo sapien
tattgccacaatctacgtgacaggg

SEQ ID NO: 94666 - DNA, 25 bp, Homo sapien
tattgccactatttatttttctgat

SEQ ID NO: 94667 - DNA, 25 bp, Homo sapien
tattgccactatttctttttctgat

SEQ ID NO: 94668 - DNA, 25 bp, Homo sapien
tattgctaaactacgcaggccctct

SEQ ID NO: 94669 - DNA, 25 bp, Homo sapien
tattgctaaactatgcaggccctct

SEQ ID NO: 94670 - DNA, 25 bp, Homo sapien
tattgctaaacttctggtattgttt

SEQ ID NO: 94671 - DNA, 25 bp, Homo sapien
tattgctaaagagaagtagctgaga

SEQ ID NO: 94672 - DNA, 25 bp, Homo sapien
tattgctaaggagaagtagctgaga

SEQ ID NO: 94673 - DNA, 25 bp, Homo sapien
tattgctaatcttctggtattgttt

SEQ ID NO: 94674 - DNA, 25 bp, Homo sapien
tattgctagactcgctttgctaaca

SEQ ID NO: 94675 - DNA, 25 bp, Homo sapien
tattgctagactcgttttgctaaca

SEQ ID NO: 94676 - DNA, 25 bp, Homo sapien
tattgctagccctgccaactgaaga

SEQ ID NO: 94677 - DNA, 25 bp, Homo sapien
tattgctagccctggcaactgaaga

SEQ ID NO: 94678 - DNA, 25 bp, Homo sapien
tattgctatatctctttcctcattg

SEQ ID NO: 94679 - DNA, 25 bp, Homo sapien
tattgctatatgtctttcctcattg

SEQ ID NO: 94680 - DNA, 25 bp, Homo sapien
tattgctatcaacaacgtattatgc

SEQ ID NO: 94681 - DNA, 25 bp, Homo sapien
tattgctatcagcaacgtattatgc

SEQ ID NO: 94682 - DNA, 25 bp, Homo sapien
tattgctcagttattctcattcatg

SEQ ID NO: 94683 - DNA, 25 bp, Homo sapien
tattgctcatagtactggaggcaag

SEQ ID NO: 94684 - DNA, 25 bp, Homo sapien
tattgctcatagtagtggaggcaag

SEQ ID NO: 94685 - DNA, 25 bp, Homo sapien
tattgctcatttattctcattcatg

SEQ ID NO: 94686 - DNA, 25 bp, Homo sapien
tattgctcctcacaagcttaaaatc

SEQ ID NO: 94687 - DNA, 25 bp, Homo sapien
tattgctcctcataagcttaaaatc

SEQ ID NO: 94688 - DNA, 25 bp, Homo sapien
tattgctgtcatagaacgcagctga

SEQ ID NO: 94689 - DNA, 25 bp, Homo sapien
tattgctgtcatagaatgcagctga

SEQ ID NO: 94690 - DNA, 25 bp, Homo sapien
tattgcttcaccatcaattaatgtt

SEQ ID NO: 94691 - DNA, 25 bp, Homo sapien
tattgcttcaccgtcaattaatgtt

SEQ ID NO: 94692 - DNA, 25 bp, Homo sapien
tattgctttaagaagtgcggtcatt

SEQ ID NO: 94693 - DNA, 25 bp, Homo sapien
tattgctttgagaagtgcggtcatt

SEQ ID NO: 94694 - DNA, 25 bp, Homo sapien
tattgctttttcatgggaatgtaga

SEQ ID NO: 94695 - DNA, 25 bp, Homo sapien
tattgctttttcgtgggaatgtaga

SEQ ID NO: 94696 - DNA, 25 bp, Homo sapien
tattggaacacactatgtaatgtct

SEQ ID NO: 94697 - DNA, 25 bp, Homo sapien
tattggaagacactatgtaatgtct

SEQ ID NO: 94698 - DNA, 25 bp, Homo sapien
tattggataggtaacccacagtcac

SEQ ID NO: 94699 - DNA, 25 bp, Homo sapien
tattggataggtaccccacagtcac

SEQ ID NO: 94700 - DNA, 25 bp, Homo sapien
tattggcaaaccatgtgttgttatt

SEQ ID NO: 94701 - DNA, 25 bp, Homo sapien
tattggcaaactatgtgttgttatt

SEQ ID NO: 94702 - DNA, 25 bp, Homo sapien
tattggcaactaatatcaccatgag

SEQ ID NO: 94703 - DNA, 25 bp, Homo sapien
tattggcaactaatgtcaccatgag

SEQ ID NO: 94704 - DNA, 25 bp, Homo sapien
tattggcagggaccaaaataacata

SEQ ID NO: 94705 - DNA, 25 bp, Homo sapien
tattggcagggacgaaaataacata

SEQ ID NO: 94706 - DNA, 25 bp, Homo sapien
tattggccaaggacgtcgtagttgg

SEQ ID NO: 94707 - DNA, 25 bp, Homo sapien
tattggccaaggacttcgtagttgg

SEQ ID NO: 94708 - DNA, 25 bp, Homo sapien
tattggccatctctctgactgggtt

SEQ ID NO: 94709 - DNA, 25 bp, Homo sapien
tattggccgtctctctgactgggtt

SEQ ID NO: 94710 - DNA, 25 bp, Homo sapien
tattgggagaatataaagccaatgt

SEQ ID NO: 94711 - DNA, 25 bp, Homo sapien
tattgggagaatatgaagccaatgt

SEQ ID NO: 94712 - DNA, 25 bp, Homo sapien
tattgggtgcttattccctggctcc

SEQ ID NO: 94713 - DNA, 25 bp, Homo sapien
tattgggtgtttattccctggctcc

SEQ ID NO: 94714 - DNA, 25 bp, Homo sapien
tattggtgcacggtagtatgaaatt

SEQ ID NO: 94715 - DNA, 25 bp, Homo sapien
tattggtgtacggtagtatgaaatt

SEQ ID NO: 94716 - DNA, 25 bp, Homo sapien
tattggtgtttctactctttagcat

SEQ ID NO: 94717 - DNA, 25 bp, Homo sapien
tattggtgtttctactttttagcat

SEQ ID NO: 94718 - DNA, 25 bp, Homo sapien
tattgtaatcggagcagggctgcag

SEQ ID NO: 94719 - DNA, 25 bp, Homo sapien
tattgtaattggagcagggctgcag

SEQ ID NO: 94720 - DNA, 25 bp, Homo sapien
tattgtatccagtctgataggtgtg

SEQ ID NO: 94721 - DNA, 25 bp, Homo sapien
tattgtatccattctgataggtgtg

SEQ ID NO: 94722 - DNA, 25 bp, Homo sapien
tattgtatgtgaaacttttgaaaca

SEQ ID NO: 94723 - DNA, 25 bp, Homo sapien
tattgtatgtgaaatttttgaaaca

SEQ ID NO: 94724 - DNA, 25 bp, Homo sapien
tattgtcaaaacggccatactacca

SEQ ID NO: 94725 - DNA, 25 bp, Homo sapien
tattgtcaaaagggccatactacca

SEQ ID NO: 94726 - DNA, 25 bp, Homo sapien
tattgtcaaaggtaaaatattctgc

SEQ ID NO: 94727 - DNA, 25 bp, Homo sapien
tattgtcaaaggtgaaatattctgc

SEQ ID NO: 94728 - DNA, 25 bp, Homo sapien
tattgtcaatagcagtgagattggt

SEQ ID NO: 94729 - DNA, 25 bp, Homo sapien
tattgtcagtagcagtgagattggt

SEQ ID NO: 94730 - DNA, 25 bp, Homo sapien
tattgtcatcagtcacttggaggac

SEQ ID NO: 94731 - DNA, 25 bp, Homo sapien
tattgtcatcagttacttggaggac

SEQ ID NO: 94732 - DNA, 25 bp, Homo sapien
tattgtcattactttcaaccccatc

SEQ ID NO: 94733 - DNA, 25 bp, Homo sapien
tattgtcattactttcgaccccatc

SEQ ID NO: 94734 - DNA, 25 bp, Homo sapien
tattgtccatctcctctgccattcc

SEQ ID NO: 94735 - DNA, 25 bp, Homo sapien
tattgtccgtctcctctgccattcc

SEQ ID NO: 94736 - DNA, 25 bp, Homo sapien
tattgtccttttaagttttttgata

SEQ ID NO: 94737 - DNA, 25 bp, Homo sapien
tattgtccttttacgttttttgata

SEQ ID NO: 94738 - DNA, 25 bp, Homo sapien
tattgtctcttcccatacctcttat

SEQ ID NO: 94739 - DNA, 25 bp, Homo sapien
tattgtctcttctcatacctcttat

SEQ ID NO: 94740 - DNA, 25 bp, Homo sapien
tattgtctgtacaacccagcacatc

SEQ ID NO: 94741 - DNA, 25 bp, Homo sapien
tattgtctgtaccacccagcacatc

SEQ ID NO: 94742 - DNA, 25 bp, Homo sapien
tattgtcttctagcacatggggcag

SEQ ID NO: 94743 - DNA, 25 bp, Homo sapien
tattgtcttctagcgcatggggcag

SEQ ID NO: 94744 - DNA, 25 bp, Homo sapien
tattgtgaatactacataagtgagt

SEQ ID NO: 94745 - DNA, 25 bp, Homo sapien
tattgtgaatattacataagtgagt

SEQ ID NO: 94746 - DNA, 25 bp, Homo sapien
tattgtgcatgacacctagaaaaca

SEQ ID NO: 94747 - DNA, 25 bp, Homo sapien
tattgtgcatgtccatcctccatat

SEQ ID NO: 94748 - DNA, 25 bp, Homo sapien
tattgtgcatgtccgtcctccatat

SEQ ID NO: 94749 - DNA, 25 bp, Homo sapien
tattgtgcgtgacacctagaaaaca

SEQ ID NO: 94750 - DNA, 25 bp, Homo sapien
tattgtgtcaggagcagctctaaga

SEQ ID NO: 94751 - DNA, 25 bp, Homo sapien
tattgtgtcgggagcagctctaaga

SEQ ID NO: 94752 - DNA, 25 bp, Homo sapien
tattgttcaggcaaagaagaaggag

SEQ ID NO: 94753 - DNA, 25 bp, Homo sapien
tattgttcaggcaaggaagaaggag

SEQ ID NO: 94754 - DNA, 25 bp, Homo sapien
tattgttccataacctgttaaagat

SEQ ID NO: 94755 - DNA, 25 bp, Homo sapien
tattgttctataacctgttaaagat

SEQ ID NO: 94756 - DNA, 25 bp, Homo sapien
tattgttcttggacgcataaacaaa

SEQ ID NO: 94757 - DNA, 25 bp, Homo sapien
tattgttcttggaggcataaacaaa

SEQ ID NO: 94758 - DNA, 25 bp, Homo sapien
tattgttggactcattaaggttgct

SEQ ID NO: 94759 - DNA, 25 bp, Homo sapien
tattgttggagagaaaggttacaga

SEQ ID NO: 94760 - DNA, 25 bp, Homo sapien
tattgttggagcgaaaggttacaga

SEQ ID NO: 94761 - DNA, 25 bp, Homo sapien
tattgttgtactcattaaggttgct

SEQ ID NO: 94762 - DNA, 25 bp, Homo sapien
tattgttgtgttagaaaggcatgta

SEQ ID NO: 94763 - DNA, 25 bp, Homo sapien
tattgttgtgttataaaggcatgta

SEQ ID NO: 94764 - DNA, 25 bp, Homo sapien
tattgttgttgacacggggaaaatt

SEQ ID NO: 94765 - DNA, 25 bp, Homo sapien
tattgttgttgatacggggaaaatt

SEQ ID NO: 94766 - DNA, 25 bp, Homo sapien
tattgtttatttgtaggcattattg

SEQ ID NO: 94767 - DNA, 25 bp, Homo sapien
tattgtttatttgtgggcattattg

SEQ ID NO: 94768 - DNA, 25 bp, Homo sapien
tattgtttgaagcccaccacggcat

SEQ ID NO: 94769 - DNA, 25 bp, Homo sapien
tattgtttgaagtccaccacggcat

SEQ ID NO: 94770 - DNA, 25 bp, Homo sapien
tattgttttaaacccggtaagagag

SEQ ID NO: 94771 - DNA, 25 bp, Homo sapien
tattgttttaaacctggtaagagag

SEQ ID NO: 94772 - DNA, 25 bp, Homo sapien
tattgttttgtctataactttgtgt

SEQ ID NO: 94773 - DNA, 25 bp, Homo sapien
tattgttttttctataactttgtgt

SEQ ID NO: 94774 - DNA, 25 bp, Homo sapien
tatttaaaaatacgaccactttggt

SEQ ID NO: 94775 - DNA, 25 bp, Homo sapien
tatttaaaaatatgaccactttggt

SEQ ID NO: 94776 - DNA, 25 bp, Homo sapien
tatttaacctatcaaaaaattgtgt

SEQ ID NO: 94777 - DNA, 25 bp, Homo sapien
tatttaacctatcaaagaattgtgt

SEQ ID NO: 94778 - DNA, 25 bp, Homo sapien
tatttaactcaacttccttccctgc

SEQ ID NO: 94779 - DNA, 25 bp, Homo sapien
tatttaactcagcttccttccctgc

SEQ ID NO: 94780 - DNA, 25 bp, Homo sapien
tatttaacttaccgctaatctcaat

SEQ ID NO: 94781 - DNA, 25 bp, Homo sapien
tatttaacttactgctaatctcaat

SEQ ID NO: 94782 - DNA, 25 bp, Homo sapien
tatttaagaaggctactttgcacct

SEQ ID NO: 94783 - DNA, 25 bp, Homo sapien
tatttaagcaggctactttgcacct

SEQ ID NO: 94784 - DNA, 25 bp, Homo sapien
tatttaagcctcagttcctatatct

SEQ ID NO: 94785 - DNA, 25 bp, Homo sapien
tatttaagccttagttcctatatct

SEQ ID NO: 94786 - DNA, 25 bp, Homo sapien
tatttaagcgtacaattcagcagca

SEQ ID NO: 94787 - DNA, 25 bp, Homo sapien
tatttaagtgtacaattcagcagca

SEQ ID NO: 94788 - DNA, 25 bp, Homo sapien
tatttaatgcttggtattatgtgag

SEQ ID NO: 94789 - DNA, 25 bp, Homo sapien
tatttaatgtttggtattatgtgag

SEQ ID NO: 94790 - DNA, 25 bp, Homo sapien
tatttacaaagctccctgttttatt

SEQ ID NO: 94791 - DNA, 25 bp, Homo sapien
tatttacacaccgatggatttggct

SEQ ID NO: 94792 - DNA, 25 bp, Homo sapien
tatttacacaccgttggatttggct

SEQ ID NO: 94793 - DNA, 25 bp, Homo sapien
tatttacagagaccaacagcaaaat

SEQ ID NO: 94794 - DNA, 25 bp, Homo sapien
tatttacagaggccaacagcaaaat

SEQ ID NO: 94795 - DNA, 25 bp, Homo sapien
tatttacatagctccctgttttatt

SEQ ID NO: 94796 - DNA, 25 bp, Homo sapien
tatttacatatatagcacacaatca

SEQ ID NO: 94797 - DNA, 25 bp, Homo sapien
tatttacatatatatcacacaatca

SEQ ID NO: 94798 - DNA, 25 bp, Homo sapien
tatttacatattagtgctcttctga

SEQ ID NO: 94799 - DNA, 25 bp, Homo sapien
tatttacatgttagtgctcttctga

SEQ ID NO: 94800 - DNA, 25 bp, Homo sapien
tatttacattacacattgcggtgcc

SEQ ID NO: 94801 - DNA, 25 bp, Homo sapien
tatttacattacacgttgcggtgcc

SEQ ID NO: 94802 - DNA, 25 bp, Homo sapien
tatttaccagtcagctacaattcag

SEQ ID NO: 94803 - DNA, 25 bp, Homo sapien
tatttaccagtcagctgcaattcag

SEQ ID NO: 94804 - DNA, 25 bp, Homo sapien
tatttacctggacaattcttccaat

SEQ ID NO: 94805 - DNA, 25 bp, Homo sapien
tatttacctggacagttcttccaat

SEQ ID NO: 94806 - DNA, 25 bp, Homo sapien
tatttactaaccattcaatcccttt

SEQ ID NO: 94807 - DNA, 25 bp, Homo sapien
tatttactaactattcaatcccttt

SEQ ID NO: 94808 - DNA, 25 bp, Homo sapien
tatttactaattttcacaatagttt

SEQ ID NO: 94809 - DNA, 25 bp, Homo sapien
tatttactaatttttacaatagttt

SEQ ID NO: 94810 - DNA, 25 bp, Homo sapien
tatttactccagaagcagtttcaag

SEQ ID NO: 94811 - DNA, 25 bp, Homo sapien
tatttacttcagaagcagtttcaag

SEQ ID NO: 94812 - DNA, 25 bp, Homo sapien
tatttagaattatgatttgagcttt

SEQ ID NO: 94813 - DNA, 25 bp, Homo sapien
tatttagaattgtgatttgagcttt

SEQ ID NO: 94814 - DNA, 25 bp, Homo sapien
tatttagcccagactattcatatac

SEQ ID NO: 94815 - DNA, 25 bp, Homo sapien
tatttagcccagattattcatatac

SEQ ID NO: 94816 - DNA, 25 bp, Homo sapien
tatttagccgtcactatataccagt

SEQ ID NO: 94817 - DNA, 25 bp, Homo sapien
tatttagccttcactatataccagt

SEQ ID NO: 94818 - DNA, 25 bp, Homo sapien
tatttaggcaaatgcacctctcgaa

SEQ ID NO: 94819 - DNA, 25 bp, Homo sapien
tatttaggcaaatgcatctctcgaa

SEQ ID NO: 94820 - DNA, 25 bp, Homo sapien
tatttagttgtagttagaggcatcc

SEQ ID NO: 94821 - DNA, 25 bp, Homo sapien
tatttagttgtagttataggcatcc

SEQ ID NO: 94822 - DNA, 25 bp, Homo sapien
tatttataaagcagaaaaaatctct

SEQ ID NO: 94823 - DNA, 25 bp, Homo sapien
tatttataaggcagaaaaaatctct

SEQ ID NO: 94824 - DNA, 25 bp, Homo sapien
tatttatacacataagccactttca

SEQ ID NO: 94825 - DNA, 25 bp, Homo sapien
tatttatacggcaccctctcatgcc

SEQ ID NO: 94826 - DNA, 25 bp, Homo sapien
tatttatagtcctgcaattatcagc

SEQ ID NO: 94827 - DNA, 25 bp, Homo sapien
tatttatagtcttgcaattatcagc

SEQ ID NO: 94828 - DNA, 25 bp, Homo sapien
tatttatatacataagccactttca

SEQ ID NO: 94829 - DNA, 25 bp, Homo sapien
tatttatatggcaccctctcatgcc

SEQ ID NO: 94830 - DNA, 25 bp, Homo sapien
tatttatcaatgtgcaaaacagctt

SEQ ID NO: 94831 - DNA, 25 bp, Homo sapien
tatttatcacgtcttggtgtttcac

SEQ ID NO: 94832 - DNA, 25 bp, Homo sapien
tatttatcatgtcttggtgtttcac

SEQ ID NO: 94833 - DNA, 25 bp, Homo sapien
tatttatccgacatttttctttttt

SEQ ID NO: 94834 - DNA, 25 bp, Homo sapien
tatttatcgatgtgcaaaacagctt

SEQ ID NO: 94835 - DNA, 25 bp, Homo sapien
tatttatctgacatttttctttttt

SEQ ID NO: 94836 - DNA, 25 bp, Homo sapien
tatttatcttgctgagttctagtcg

SEQ ID NO: 94837 - DNA, 25 bp, Homo sapien
tatttatcttgcttagttctagtcg

SEQ ID NO: 94838 - DNA, 25 bp, Homo sapien
tatttattatcaacaatgataccac

SEQ ID NO: 94839 - DNA, 25 bp, Homo sapien
tatttattatcaactatgataccac

SEQ ID NO: 94840 - DNA, 25 bp, Homo sapien
tatttattgcagtatatttttgaag

SEQ ID NO: 94841 - DNA, 25 bp, Homo sapien
tatttattggagtatatttttgaag

SEQ ID NO: 94842 - DNA, 25 bp, Homo sapien
tatttatttgcatattgtggttcac

SEQ ID NO: 94843 - DNA, 25 bp, Homo sapien
tatttatttgcatgttgtggttcac

SEQ ID NO: 94844 - DNA, 25 bp, Homo sapien
tatttattttccacataaatccatc

SEQ ID NO: 94845 - DNA, 25 bp, Homo sapien
tatttattttccacgtaaatccatc

SEQ ID NO: 94846 - DNA, 25 bp, Homo sapien
tatttattttggcaattattggaga

SEQ ID NO: 94847 - DNA, 25 bp, Homo sapien
tatttattttggtaattattggaga

SEQ ID NO: 94848 - DNA, 25 bp, Homo sapien
tatttcaacataggttctattttcc

SEQ ID NO: 94849 - DNA, 25 bp, Homo sapien
tatttcaacgtaggttctattttcc

SEQ ID NO: 94850 - DNA, 25 bp, Homo sapien
tatttcaagtataagagagatgtat

SEQ ID NO: 94851 - DNA, 25 bp, Homo sapien
tatttcaagtatgagagagatgtat

SEQ ID NO: 94852 - DNA, 25 bp, Homo sapien
tatttcacagtcgaattgttcataa

SEQ ID NO: 94853 - DNA, 25 bp, Homo sapien
tatttcacagtctaattgttcataa

SEQ ID NO: 94854 - DNA, 25 bp, Homo sapien
tatttcagaaaggtgaagatgaagt

SEQ ID NO: 94855 - DNA, 25 bp, Homo sapien
tatttcagaaagttgaagatgaagt

SEQ ID NO: 94856 - DNA, 25 bp, Homo sapien
tatttcagatacattgtgaagaaaa

SEQ ID NO: 94857 - DNA, 25 bp, Homo sapien
tatttcagatagattgtgaagaaaa

SEQ ID NO: 94858 - DNA, 25 bp, Homo sapien
tatttcagccttacagtgggagcct

SEQ ID NO: 94859 - DNA, 25 bp, Homo sapien
tatttcagccttagagtgggagcct

SEQ ID NO: 94860 - DNA, 25 bp, Homo sapien
tatttcagctgtgtcacatgcctta

SEQ ID NO: 94861 - DNA, 25 bp, Homo sapien
tatttcagctgtgtcatatgcctta

SEQ ID NO: 94862 - DNA, 25 bp, Homo sapien
tatttcagtcactaatggggcttca

SEQ ID NO: 94863 - DNA, 25 bp, Homo sapien
tatttcagtcactactggggcttca

SEQ ID NO: 94864 - DNA, 25 bp, Homo sapien
tatttcagttttctccttctgccac

SEQ ID NO: 94865 - DNA, 25 bp, Homo sapien
tatttcagttttgtccttctgccac

SEQ ID NO: 94866 - DNA, 25 bp, Homo sapien
tatttcatcagtccctgttagctct

SEQ ID NO: 94867 - DNA, 25 bp, Homo sapien
tatttcatcagttcctgttagctct

SEQ ID NO: 94868 - DNA, 25 bp, Homo sapien
tatttcatcatctgatctcatcatt

SEQ ID NO: 94869 - DNA, 25 bp, Homo sapien
tatttcatcatctggtctcatcatt

SEQ ID NO: 94870 - DNA, 25 bp, Homo sapien
tatttcatgctgacgaacgtttgag

SEQ ID NO: 94871 - DNA, 25 bp, Homo sapien
tatttcatgctgatgaacgtttgag

SEQ ID NO: 94872 - DNA, 25 bp, Homo sapien
tatttcatttaattgaatcaccggt

SEQ ID NO: 94873 - DNA, 25 bp, Homo sapien
tatttcatttatttgaatcaccggt

SEQ ID NO: 94874 - DNA, 25 bp, Homo sapien
tatttccaagtgggtatagcaagct

SEQ ID NO: 94875 - DNA, 25 bp, Homo sapien
tatttccaagtggttatagcaagct

SEQ ID NO: 94876 - DNA, 25 bp, Homo sapien
tatttccaatggccatacatttact

SEQ ID NO: 94877 - DNA, 25 bp, Homo sapien
tatttccaatggccttacatttact

SEQ ID NO: 94878 - DNA, 25 bp, Homo sapien
tatttccataaacagcagaaagcca

SEQ ID NO: 94879 - DNA, 25 bp, Homo sapien
tatttccataagcagcagaaagcca

SEQ ID NO: 94880 - DNA, 25 bp, Homo sapien
tatttccatttaccaagttttaggg

SEQ ID NO: 94881 - DNA, 25 bp, Homo sapien
tatttccatttatcaagttttaggg

SEQ ID NO: 94882 - DNA, 25 bp, Homo sapien
tatttcccaagttaaggcaaatttc

SEQ ID NO: 94883 - DNA, 25 bp, Homo sapien
tatttcccaagttaagtcaaatttc

SEQ ID NO: 94884 - DNA, 25 bp, Homo sapien
tatttccttcctacatatttgacct

SEQ ID NO: 94885 - DNA, 25 bp, Homo sapien
tatttccttcctacgtatttgacct

SEQ ID NO: 94886 - DNA, 25 bp, Homo sapien
tatttctaaccacaagatttttttc

SEQ ID NO: 94887 - DNA, 25 bp, Homo sapien
tatttctaaccacaaggtttttttc

SEQ ID NO: 94888 - DNA, 25 bp, Homo sapien
tatttctcacagtcggaaactctaa

SEQ ID NO: 94889 - DNA, 25 bp, Homo sapien
tatttctcacagtctgaaactctaa

SEQ ID NO: 94890 - DNA, 25 bp, Homo sapien
tatttctcttgcctttcggagagtt

SEQ ID NO: 94891 - DNA, 25 bp, Homo sapien
tatttctcttgtctttcggagagtt

SEQ ID NO: 94892 - DNA, 25 bp, Homo sapien
tatttctgatgttttaaaatgtcta

SEQ ID NO: 94893 - DNA, 25 bp, Homo sapien
tatttctgccacaactaagaggaag

SEQ ID NO: 94894 - DNA, 25 bp, Homo sapien
tatttctgccacgactaagaggaag

SEQ ID NO: 94895 - DNA, 25 bp, Homo sapien
tatttctgccttttattttaatgtc

SEQ ID NO: 94896 - DNA, 25 bp, Homo sapien
tatttctgctgttttaaaatgtcta

SEQ ID NO: 94897 - DNA, 25 bp, Homo sapien
tatttctggcttttattttaatgtc

SEQ ID NO: 94898 - DNA, 25 bp, Homo sapien
tatttctggtccacgtagatttcta

SEQ ID NO: 94899 - DNA, 25 bp, Homo sapien
tatttctggtccacgtggatttcta

SEQ ID NO: 94900 - DNA, 25 bp, Homo sapien
tatttctgtgtacattttgagaaat

SEQ ID NO: 94901 - DNA, 25 bp, Homo sapien
tatttctgtgtatattttgagaaat

SEQ ID NO: 94902 - DNA, 25 bp, Homo sapien
tatttcttaaaagccacgacataga

SEQ ID NO: 94903 - DNA, 25 bp, Homo sapien
tatttcttaaaagccatgacataga

SEQ ID NO: 94904 - DNA, 25 bp, Homo sapien
tatttcttcgtgtactagtagtgga

SEQ ID NO: 94905 - DNA, 25 bp, Homo sapien
tatttcttcttctcatttctcgcca

SEQ ID NO: 94906 - DNA, 25 bp, Homo sapien
tatttcttcttctgatttctcgcca

SEQ ID NO: 94907 - DNA, 25 bp, Homo sapien
tatttcttgagccgagactttttgt

SEQ ID NO: 94908 - DNA, 25 bp, Homo sapien
tatttcttgagctgagactttttgt

SEQ ID NO: 94909 - DNA, 25 bp, Homo sapien
tatttcttggtggattagctaaatc

SEQ ID NO: 94910 - DNA, 25 bp, Homo sapien
tatttcttggtggatttgctaaatc

SEQ ID NO: 94911 - DNA, 25 bp, Homo sapien
tatttctttctctcggctcattacc

SEQ ID NO: 94912 - DNA, 25 bp, Homo sapien
tatttctttctcttggctcattacc

SEQ ID NO: 94913 - DNA, 25 bp, Homo sapien
tatttctttgtgtactagtagtgga

SEQ ID NO: 94914 - DNA, 25 bp, Homo sapien
tatttgaaattctgctatccaacga

SEQ ID NO: 94915 - DNA, 25 bp, Homo sapien
tatttgaaattctgctttccaacga

SEQ ID NO: 94916 - DNA, 25 bp, Homo sapien
tatttgaacctgtctttttttacag

SEQ ID NO: 94917 - DNA, 25 bp, Homo sapien
tatttgaaccttttttgaccacaaa

SEQ ID NO: 94918 - DNA, 25 bp, Homo sapien
tatttgaacttgtctttttttacag

SEQ ID NO: 94919 - DNA, 25 bp, Homo sapien
tatttgaactttttttgaccacaaa

SEQ ID NO: 94920 - DNA, 25 bp, Homo sapien
tatttgaagagtttaattttttcct

SEQ ID NO: 94921 - DNA, 25 bp, Homo sapien
tatttgaagagttttattttttcct

SEQ ID NO: 94922 - DNA, 25 bp, Homo sapien
tatttgaattattccagtccataga

SEQ ID NO: 94923 - DNA, 25 bp, Homo sapien
tatttgaattattgcagtccataga

SEQ ID NO: 94924 - DNA, 25 bp, Homo sapien
tatttgacaaaatttctcatgtaca

SEQ ID NO: 94925 - DNA, 25 bp, Homo sapien
tatttgacataatttctcatgtaca

SEQ ID NO: 94926 - DNA, 25 bp, Homo sapien
tatttgacatggaaagtctaggtat

SEQ ID NO: 94927 - DNA, 25 bp, Homo sapien
tatttgacatggcttcctccttcac

SEQ ID NO: 94928 - DNA, 25 bp, Homo sapien
tatttgacatgggaagtctaggtat

SEQ ID NO: 94929 - DNA, 25 bp, Homo sapien
tatttgacgtggcttcctccttcac

SEQ ID NO: 94930 - DNA, 25 bp, Homo sapien
tatttgactgcctaacttttcaggg

SEQ ID NO: 94931 - DNA, 25 bp, Homo sapien
tatttgactgcttaacttttcaggg

SEQ ID NO: 94932 - DNA, 25 bp, Homo sapien
tatttgatccatgtgttacttagaa

SEQ ID NO: 94933 - DNA, 25 bp, Homo sapien
tatttgatgaggccgtgaaatgcca

SEQ ID NO: 94934 - DNA, 25 bp, Homo sapien
tatttgatgaggctgtgaaatgcca

SEQ ID NO: 94935 - DNA, 25 bp, Homo sapien
tatttgattaaatgaccacatgaaa

SEQ ID NO: 94936 - DNA, 25 bp, Homo sapien
tatttgattaaatggccacatgaaa

SEQ ID NO: 94937 - DNA, 25 bp, Homo sapien
tatttgattcatgtgttacttagaa

SEQ ID NO: 94938 - DNA, 25 bp, Homo sapien
tatttgcatagtatactcatttgag

SEQ ID NO: 94939 - DNA, 25 bp, Homo sapien
tatttgcatagtgtactcatttgag

SEQ ID NO: 94940 - DNA, 25 bp, Homo sapien
tatttgcattgcatcttctttgatt

SEQ ID NO: 94941 - DNA, 25 bp, Homo sapien
tatttgcattgcgtcttctttgatt

SEQ ID NO: 94942 - DNA, 25 bp, Homo sapien
tatttgcctacatatttggcatgtc

SEQ ID NO: 94943 - DNA, 25 bp, Homo sapien
tatttgcctacatgtttggcatgtc

SEQ ID NO: 94944 - DNA, 25 bp, Homo sapien
tatttgcctcgactgtctctaattt

SEQ ID NO: 94945 - DNA, 25 bp, Homo sapien
tatttgcctggatttggccttatcc

SEQ ID NO: 94946 - DNA, 25 bp, Homo sapien
tatttgcctgggtttggccttatcc

SEQ ID NO: 94947 - DNA, 25 bp, Homo sapien
tatttgccttgactgtctctaattt

SEQ ID NO: 94948 - DNA, 25 bp, Homo sapien
tatttgctaggcatcgaccacccaa

SEQ ID NO: 94949 - DNA, 25 bp, Homo sapien
tatttgctcaagaaaaatgaaatta

SEQ ID NO: 94950 - DNA, 25 bp, Homo sapien
tatttgctcaaggaaaatgaaatta

SEQ ID NO: 94951 - DNA, 25 bp, Homo sapien
tatttgctcggtgaagtgaaatgtt

SEQ ID NO: 94952 - DNA, 25 bp, Homo sapien
tatttgctgggcatcgaccacccaa

SEQ ID NO: 94953 - DNA, 25 bp, Homo sapien
tatttgcttaaaaaggaatgcaaat

SEQ ID NO: 94954 - DNA, 25 bp, Homo sapien
tatttgcttgaaaaggaatgcaaat

SEQ ID NO: 94955 - DNA, 25 bp, Homo sapien
tatttgcttgcttaggattttcata

SEQ ID NO: 94956 - DNA, 25 bp, Homo sapien
tatttgcttgcttgggattttcata

SEQ ID NO: 94957 - DNA, 25 bp, Homo sapien
tatttgcttggcctcggaacccaaa

SEQ ID NO: 94958 - DNA, 25 bp, Homo sapien
tatttgcttggccttggaacccaaa

SEQ ID NO: 94959 - DNA, 25 bp, Homo sapien
tatttgcttggtgaagtgaaatgtt

SEQ ID NO: 94960 - DNA, 25 bp, Homo sapien
tatttggaaattaaatgtctgagaa

SEQ ID NO: 94961 - DNA, 25 bp, Homo sapien
tatttggaaattaagtgtctgagaa

SEQ ID NO: 94962 - DNA, 25 bp, Homo sapien
tatttggagcagtgattgatgaaaa

SEQ ID NO: 94963 - DNA, 25 bp, Homo sapien
tatttggagctcatttgtctgacgg

SEQ ID NO: 94964 - DNA, 25 bp, Homo sapien
tatttggagctcatttttctgacgg

SEQ ID NO: 94965 - DNA, 25 bp, Homo sapien
tatttggagtagtgattgatgaaaa

SEQ ID NO: 94966 - DNA, 25 bp, Homo sapien
tatttggatcaaccctcagaacaca

SEQ ID NO: 94967 - DNA, 25 bp, Homo sapien
tatttggatcaactctcagaacaca

SEQ ID NO: 94968 - DNA, 25 bp, Homo sapien
tatttggatgtctggatctctatca

SEQ ID NO: 94969 - DNA, 25 bp, Homo sapien
tatttggatttctggatctctatca

SEQ ID NO: 94970 - DNA, 25 bp, Homo sapien
tatttgggaacaactctttggcagg

SEQ ID NO: 94971 - DNA, 25 bp, Homo sapien
tatttgggaacaattctttggcagg

SEQ ID NO: 94972 - DNA, 25 bp, Homo sapien
tatttgggcgcctcaatccatctcc

SEQ ID NO: 94973 - DNA, 25 bp, Homo sapien
tatttgggctcctcaatccatctcc

SEQ ID NO: 94974 - DNA, 25 bp, Homo sapien
tatttggggctgcacctaacttctg

SEQ ID NO: 94975 - DNA, 25 bp, Homo sapien
tatttggggctgcatctaacttctg

SEQ ID NO: 94976 - DNA, 25 bp, Homo sapien
tatttgtaacttttatgagttaaaa

SEQ ID NO: 94977 - DNA, 25 bp, Homo sapien
tatttgtaatcaagagtggccgctc

SEQ ID NO: 94978 - DNA, 25 bp, Homo sapien
tatttgtaatttttatgagttaaaa

SEQ ID NO: 94979 - DNA, 25 bp, Homo sapien
tatttgtagaactgaggtaataata

SEQ ID NO: 94980 - DNA, 25 bp, Homo sapien
tatttgtagaattgaggtaataata

SEQ ID NO: 94981 - DNA, 25 bp, Homo sapien
tatttgtagtcaagagtggccgctc

SEQ ID NO: 94982 - DNA, 25 bp, Homo sapien
tatttgtccctcggaacagagcaca

SEQ ID NO: 94983 - DNA, 25 bp, Homo sapien
tatttgtcccttggaacagagcaca

SEQ ID NO: 94984 - DNA, 25 bp, Homo sapien
tatttgtgctaacgatctctgtctc

SEQ ID NO: 94985 - DNA, 25 bp, Homo sapien
tatttgtgctaatgatctctgtctc

SEQ ID NO: 94986 - DNA, 25 bp, Homo sapien
tatttgttcattaaggtgattattg

SEQ ID NO: 94987 - DNA, 25 bp, Homo sapien
tatttgttcattagggtgattattg

SEQ ID NO: 94988 - DNA, 25 bp, Homo sapien
tatttgttgtatcatttctattttt

SEQ ID NO: 94989 - DNA, 25 bp, Homo sapien
tatttgttgtatcgtttctattttt

SEQ ID NO: 94990 - DNA, 25 bp, Homo sapien
tatttgtttatccatgagttgttta

SEQ ID NO: 94991 - DNA, 25 bp, Homo sapien
tatttgtttatccgtgagttgttta

SEQ ID NO: 94992 - DNA, 25 bp, Homo sapien
tatttgtttttagtttctcaggctg

SEQ ID NO: 94993 - DNA, 25 bp, Homo sapien
tatttgttttttgtttctcaggctg

SEQ ID NO: 94994 - DNA, 25 bp, Homo sapien
tattttaaaacgaggtaagagttta

SEQ ID NO: 94995 - DNA, 25 bp, Homo sapien
tattttaaaacgagttaagagttta

SEQ ID NO: 94996 - DNA, 25 bp, Homo sapien
tattttaaagaatctgctgactgat

SEQ ID NO: 94997 - DNA, 25 bp, Homo sapien
tattttaaagaatctggtgactgat

SEQ ID NO: 94998 - DNA, 25 bp, Homo sapien
tattttaaagaattgacgaaggaaa

SEQ ID NO: 94999 - DNA, 25 bp, Homo sapien
tattttaaagaattgatgaaggaaa

SEQ ID NO: 95000 - DNA, 25 bp, Homo sapien
tattttaaatggaagaacttggaaa

SEQ ID NO: 95001 - DNA, 25 bp, Homo sapien
tattttaaattggccattccacctt

SEQ ID NO: 95002 - DNA, 25 bp, Homo sapien
tattttaaattggtcattccacctt

SEQ ID NO: 95003 - DNA, 25 bp, Homo sapien
tattttaacagtccaggtgaaaaat

SEQ ID NO: 95004 - DNA, 25 bp, Homo sapien
tattttaacgtaaaacatgcaggac

SEQ ID NO: 95005 - DNA, 25 bp, Homo sapien
tattttaagtggaagaacttggaaa

SEQ ID NO: 95006 - DNA, 25 bp, Homo sapien
tattttaatagtccaggtgaaaaat

SEQ ID NO: 95007 - DNA, 25 bp, Homo sapien
tattttaatgtaaaacatgcaggac

SEQ ID NO: 95008 - DNA, 25 bp, Homo sapien
tattttactttactcaccattgtat

SEQ ID NO: 95009 - DNA, 25 bp, Homo sapien
tattttactttattcaccattgtat

SEQ ID NO: 95010 - DNA, 25 bp, Homo sapien
tattttagaagccacaagtttaaag

SEQ ID NO: 95011 - DNA, 25 bp, Homo sapien
tattttagaagccgcaagtttaaag

SEQ ID NO: 95012 - DNA, 25 bp, Homo sapien
tattttagatgaaaaacctggcatg

SEQ ID NO: 95013 - DNA, 25 bp, Homo sapien
tattttagatgaaaaatctggcatg

SEQ ID NO: 95014 - DNA, 25 bp, Homo sapien
tattttagcagtacgaaacagacta

SEQ ID NO: 95015 - DNA, 25 bp, Homo sapien
tattttagcagtatgaaacagacta

SEQ ID NO: 95016 - DNA, 25 bp, Homo sapien
tattttagcataagctcatttgtac

SEQ ID NO: 95017 - DNA, 25 bp, Homo sapien
tattttagcgtaagctcatttgtac

SEQ ID NO: 95018 - DNA, 25 bp, Homo sapien
tattttatagacgatgagttgaaag

SEQ ID NO: 95019 - DNA, 25 bp, Homo sapien
tattttatagacgctgagttgaaag

SEQ ID NO: 95020 - DNA, 25 bp, Homo sapien
tattttatagcaacaataatagaat

SEQ ID NO: 95021 - DNA, 25 bp, Homo sapien
tattttatagcaaccataatagaat

SEQ ID NO: 95022 - DNA, 25 bp, Homo sapien
tattttatcatttctgtcattttct

SEQ ID NO: 95023 - DNA, 25 bp, Homo sapien
tattttatcgtttctgtcattttct

SEQ ID NO: 95024 - DNA, 25 bp, Homo sapien
tattttatgagcgcatgatatctgc

SEQ ID NO: 95025 - DNA, 25 bp, Homo sapien
tattttatgagtgcatgatatctgc

SEQ ID NO: 95026 - DNA, 25 bp, Homo sapien
tattttatttatccgacatttttct

SEQ ID NO: 95027 - DNA, 25 bp, Homo sapien
tattttatttatctgacatttttct

SEQ ID NO: 95028 - DNA, 25 bp, Homo sapien
tattttcaaataactccatggtgtt

SEQ ID NO: 95029 - DNA, 25 bp, Homo sapien
tattttcaagtaactccatggtgtt

SEQ ID NO: 95030 - DNA, 25 bp, Homo sapien
tattttcaccctcctgtcagattct

SEQ ID NO: 95031 - DNA, 25 bp, Homo sapien
tattttcactctcctgtcagattct

SEQ ID NO: 95032 - DNA, 25 bp, Homo sapien
tattttcagttgacttctcaatttt

SEQ ID NO: 95033 - DNA, 25 bp, Homo sapien
tattttcagttgccttctcaatttt

SEQ ID NO: 95034 - DNA, 25 bp, Homo sapien
tattttccaaagacgatttattgaa

SEQ ID NO: 95035 - DNA, 25 bp, Homo sapien
tattttccaaagatgatttattgaa

SEQ ID NO: 95036 - DNA, 25 bp, Homo sapien
tattttccattcccattcttatttg

SEQ ID NO: 95037 - DNA, 25 bp, Homo sapien
tattttccgttcccattcttatttg

SEQ ID NO: 95038 - DNA, 25 bp, Homo sapien
tattttcctatgataccgtatcttc

SEQ ID NO: 95039 - DNA, 25 bp, Homo sapien
tattttcctatgatactgtatcttc

SEQ ID NO: 95040 - DNA, 25 bp, Homo sapien
tattttctacctaattggcacattt

SEQ ID NO: 95041 - DNA, 25 bp, Homo sapien
tattttctcaagaacctgggtttct

SEQ ID NO: 95042 - DNA, 25 bp, Homo sapien
tattttctcaagatcctgggtttct

SEQ ID NO: 95043 - DNA, 25 bp, Homo sapien
tattttctcatgatgaattcttctg

SEQ ID NO: 95044 - DNA, 25 bp, Homo sapien
tattttctcatgcctaagtgacagt

SEQ ID NO: 95045 - DNA, 25 bp, Homo sapien
tattttctcatggctaagtgacagt

SEQ ID NO: 95046 - DNA, 25 bp, Homo sapien
tattttctccctaattggcacattt

SEQ ID NO: 95047 - DNA, 25 bp, Homo sapien
tattttctcttgatgaattcttctg

SEQ ID NO: 95048 - DNA, 25 bp, Homo sapien
tattttctggaggccttttctggaa

SEQ ID NO: 95049 - DNA, 25 bp, Homo sapien
tattttctggaggtcttttctggaa

SEQ ID NO: 95050 - DNA, 25 bp, Homo sapien
tattttctgtagcatgtatttacat

SEQ ID NO: 95051 - DNA, 25 bp, Homo sapien
tattttctgtagcgtgtatttacat

SEQ ID NO: 95052 - DNA, 25 bp, Homo sapien
tattttcttgccaaactccattgaa

SEQ ID NO: 95053 - DNA, 25 bp, Homo sapien
tattttcttgccgaactccattgaa

SEQ ID NO: 95054 - DNA, 25 bp, Homo sapien
tattttgacgaatctccaaaggtga

SEQ ID NO: 95055 - DNA, 25 bp, Homo sapien
tattttgagcaagtaaataagtaaa

SEQ ID NO: 95056 - DNA, 25 bp, Homo sapien
tattttgagcaagtaagtaagtaaa

SEQ ID NO: 95057 - DNA, 25 bp, Homo sapien
tattttgatgaatctccaaaggtga

SEQ ID NO: 95058 - DNA, 25 bp, Homo sapien
tattttgcatcatttcctttgtatt

SEQ ID NO: 95059 - DNA, 25 bp, Homo sapien
tattttgcatcatttcttttgtatt

SEQ ID NO: 95060 - DNA, 25 bp, Homo sapien
tattttgccaagcttagattcacca

SEQ ID NO: 95061 - DNA, 25 bp, Homo sapien
tattttgcctgatgagatttactta

SEQ ID NO: 95062 - DNA, 25 bp, Homo sapien
tattttgctaagcttagattcacca

SEQ ID NO: 95063 - DNA, 25 bp, Homo sapien
tattttgcttgatgagatttactta

SEQ ID NO: 95064 - DNA, 25 bp, Homo sapien
tattttggcaattattggagagatt

SEQ ID NO: 95065 - DNA, 25 bp, Homo sapien
tattttggtaattattggagagatt

SEQ ID NO: 95066 - DNA, 25 bp, Homo sapien
tattttggtagacaaatgcagtatg

SEQ ID NO: 95067 - DNA, 25 bp, Homo sapien
tattttggtagacatatgcagtatg

SEQ ID NO: 95068 - DNA, 25 bp, Homo sapien
tattttggttctaagccaacctatg

SEQ ID NO: 95069 - DNA, 25 bp, Homo sapien
tattttggttctaggccaacctatg

SEQ ID NO: 95070 - DNA, 25 bp, Homo sapien
tattttgtcatcattgaggccttca

SEQ ID NO: 95071 - DNA, 25 bp, Homo sapien
tattttgtcgtcattgaggccttca

SEQ ID NO: 95072 - DNA, 25 bp, Homo sapien
tattttgtgctcacgtcctatgtat

SEQ ID NO: 95073 - DNA, 25 bp, Homo sapien
tattttgtgctcatgtcctatgtat

SEQ ID NO: 95074 - DNA, 25 bp, Homo sapien
tattttgtgggtaacagtacctgct

SEQ ID NO: 95075 - DNA, 25 bp, Homo sapien
tattttgtgggtaatagtacctgct

SEQ ID NO: 95076 - DNA, 25 bp, Homo sapien
tattttgttcacatttttaacagaa

SEQ ID NO: 95077 - DNA, 25 bp, Homo sapien
tattttgttcacgtttttaacagaa

SEQ ID NO: 95078 - DNA, 25 bp, Homo sapien
tattttgttttcttaacatttgtgt

SEQ ID NO: 95079 - DNA, 25 bp, Homo sapien
tattttgttttcttaatatttgtgt

SEQ ID NO: 95080 - DNA, 25 bp, Homo sapien
tatttttaatagagctcaacattat

SEQ ID NO: 95081 - DNA, 25 bp, Homo sapien
tatttttagagcacttctgcaacaa

SEQ ID NO: 95082 - DNA, 25 bp, Homo sapien
tatttttagagcccttctgcaacaa

SEQ ID NO: 95083 - DNA, 25 bp, Homo sapien
tatttttagtagagctcaacattat

SEQ ID NO: 95084 - DNA, 25 bp, Homo sapien
tatttttatagcttggcggtatgtt

SEQ ID NO: 95085 - DNA, 25 bp, Homo sapien
tatttttatagcttggtggtatgtt

SEQ ID NO: 95086 - DNA, 25 bp, Homo sapien
tatttttatccatcttccttcattt

SEQ ID NO: 95087 - DNA, 25 bp, Homo sapien
tatttttatccttcttccttcattt

SEQ ID NO: 95088 - DNA, 25 bp, Homo sapien
tatttttcactttagattcatttat

SEQ ID NO: 95089 - DNA, 25 bp, Homo sapien
tatttttcataccctgctctcaaat

SEQ ID NO: 95090 - DNA, 25 bp, Homo sapien
tatttttcatacgctgctctcaaat

SEQ ID NO: 95091 - DNA, 25 bp, Homo sapien
tatttttcattttagattcatttat

SEQ ID NO: 95092 - DNA, 25 bp, Homo sapien
tatttttccatataaacgaatccat

SEQ ID NO: 95093 - DNA, 25 bp, Homo sapien
tatttttcccacataagcctccaga

SEQ ID NO: 95094 - DNA, 25 bp, Homo sapien
tatttttccgctcataatgttatta

SEQ ID NO: 95095 - DNA, 25 bp, Homo sapien
tatttttcgcacataagcctccaga

SEQ ID NO: 95096 - DNA, 25 bp, Homo sapien
tatttttctatataaacgaatccat

SEQ ID NO: 95097 - DNA, 25 bp, Homo sapien
tatttttctgctaaaaggaaaggcc

SEQ ID NO: 95098 - DNA, 25 bp, Homo sapien
tatttttctgctaacaggaaaggcc

SEQ ID NO: 95099 - DNA, 25 bp, Homo sapien
tatttttctgctcataatgttatta

SEQ ID NO: 95100 - DNA, 25 bp, Homo sapien
tatttttctgtttatttaaggctga

SEQ ID NO: 95101 - DNA, 25 bp, Homo sapien
tatttttctgtttgtttaaggctga

SEQ ID NO: 95102 - DNA, 25 bp, Homo sapien
tatttttgccaacatttaagggagg

SEQ ID NO: 95103 - DNA, 25 bp, Homo sapien
tatttttgccaacgtttaagggagg

SEQ ID NO: 95104 - DNA, 25 bp, Homo sapien
tatttttgctgaaggaatttttatt

SEQ ID NO: 95105 - DNA, 25 bp, Homo sapien
tatttttgctggaggaatttttatt

SEQ ID NO: 95106 - DNA, 25 bp, Homo sapien
tattttttatgatctgagtattcac

SEQ ID NO: 95107 - DNA, 25 bp, Homo sapien
tattttttatgatctgtgtattcac

SEQ ID NO: 95108 - DNA, 25 bp, Homo sapien
tattttttgagaccgaattttgctc

SEQ ID NO: 95109 - DNA, 25 bp, Homo sapien
tattttttgagactgaattttgctc

SEQ ID NO: 95110 - DNA, 25 bp, Homo sapien
tatttttttaaggcaagtattttaa

SEQ ID NO: 95111 - DNA, 25 bp, Homo sapien
tatttttttaatgcaagtattttaa

SEQ ID NO: 95112 - DNA, 25 bp, Homo sapien
tatttttttgcagagatggcttcac

SEQ ID NO: 95113 - DNA, 25 bp, Homo sapien
tatttttttgccgagatggcttcac

SEQ ID NO: 95114 - DNA, 25 bp, Homo sapien
tcaaaaaaaatactaggaaactgaa

SEQ ID NO: 95115 - DNA, 25 bp, Homo sapien
tcaaaaaaaatgctaggaaactgaa

SEQ ID NO: 95116 - DNA, 25 bp, Homo sapien
tcaaaaaacggtcagctgatcgaat

SEQ ID NO: 95117 - DNA, 25 bp, Homo sapien
tcaaaaaagcacagatagtcctctg

SEQ ID NO: 95118 - DNA, 25 bp, Homo sapien
tcaaaaaagcacagctagtcctctg

SEQ ID NO: 95119 - DNA, 25 bp, Homo sapien
tcaaaaaagcatgatattagtacaa

SEQ ID NO: 95120 - DNA, 25 bp, Homo sapien
tcaaaaaagcatggtattagtacaa

SEQ ID NO: 95121 - DNA, 25 bp, Homo sapien
tcaaaaaatgagttaaaccaatcaa

SEQ ID NO: 95122 - DNA, 25 bp, Homo sapien
tcaaaaaatgagttgaaccaatcaa

SEQ ID NO: 95123 - DNA, 25 bp, Homo sapien
tcaaaaaatggtcagctgatcgaat

SEQ ID NO: 95124 - DNA, 25 bp, Homo sapien
tcaaaaaccaaggtagcgaggttgg

SEQ ID NO: 95125 - DNA, 25 bp, Homo sapien
tcaaaaaccaaggtagtgaggttgg

SEQ ID NO: 95126 - DNA, 25 bp, Homo sapien
tcaaaaagaagcagtagatgattaa

SEQ ID NO: 95127 - DNA, 25 bp, Homo sapien
tcaaaaagaagtagtagatgattaa

SEQ ID NO: 95128 - DNA, 25 bp, Homo sapien
tcaaaaataaacatatatgccatga

SEQ ID NO: 95129 - DNA, 25 bp, Homo sapien
tcaaaaataaacgtatatgccatga

SEQ ID NO: 95130 - DNA, 25 bp, Homo sapien
tcaaaaatcagtcgggtgcagtgac

SEQ ID NO: 95131 - DNA, 25 bp, Homo sapien
tcaaaaatgctgataatcatgcaag

SEQ ID NO: 95132 - DNA, 25 bp, Homo sapien
tcaaaaatgctgatgatcatgcaag

SEQ ID NO: 95133 - DNA, 25 bp, Homo sapien
tcaaaaattagtcgggtgcagtgac

SEQ ID NO: 95134 - DNA, 25 bp, Homo sapien
tcaaaacaataaacgcatctctttt

SEQ ID NO: 95135 - DNA, 25 bp, Homo sapien
tcaaaacaataaatgcatctctttt

SEQ ID NO: 95136 - DNA, 25 bp, Homo sapien
tcaaaacacaaaagtataaagtgaa

SEQ ID NO: 95137 - DNA, 25 bp, Homo sapien
tcaaaacacttgcgtcaggacaaga

SEQ ID NO: 95138 - DNA, 25 bp, Homo sapien
tcaaaacacttgtgtcaggacaaga

SEQ ID NO: 95139 - DNA, 25 bp, Homo sapien
tcaaaacagctttgatagaatcaga

SEQ ID NO: 95140 - DNA, 25 bp, Homo sapien
tcaaaacagctttgatggaatcaga

SEQ ID NO: 95141 - DNA, 25 bp, Homo sapien
tcaaaacagtgtacaacatttccct

SEQ ID NO: 95142 - DNA, 25 bp, Homo sapien
tcaaaacagtgtacaatatttccct

SEQ ID NO: 95143 - DNA, 25 bp, Homo sapien
tcaaaacataaaagtataaagtgaa

SEQ ID NO: 95144 - DNA, 25 bp, Homo sapien
tcaaaacattctatcttgtaatccc

SEQ ID NO: 95145 - DNA, 25 bp, Homo sapien
tcaaaacattctgtcttgtaatccc

SEQ ID NO: 95146 - DNA, 25 bp, Homo sapien
tcaaaacattgctatgaacatagga

SEQ ID NO: 95147 - DNA, 25 bp, Homo sapien
tcaaaacattgctgtgaacatagga

SEQ ID NO: 95148 - DNA, 25 bp, Homo sapien
tcaaaaccagcataagcaacagacc

SEQ ID NO: 95149 - DNA, 25 bp, Homo sapien
tcaaaaccagcataggcaacagacc

SEQ ID NO: 95150 - DNA, 25 bp, Homo sapien
tcaaaaccctgtgcatacttcaagc

SEQ ID NO: 95151 - DNA, 25 bp, Homo sapien
tcaaaaccctgtgcgtacttcaagc

SEQ ID NO: 95152 - DNA, 25 bp, Homo sapien
tcaaaacctaatcacctcccaaggt

SEQ ID NO: 95153 - DNA, 25 bp, Homo sapien
tcaaaacctcatcacctcccaaggt

SEQ ID NO: 95154 - DNA, 25 bp, Homo sapien
tcaaaacctgcaaatatgttatctt

SEQ ID NO: 95155 - DNA, 25 bp, Homo sapien
tcaaaacctgcgaatatgttatctt

SEQ ID NO: 95156 - DNA, 25 bp, Homo sapien
tcaaaacgagtagaaatgaaactat

SEQ ID NO: 95157 - DNA, 25 bp, Homo sapien
tcaaaacgagtggaaatgaaactat

SEQ ID NO: 95158 - DNA, 25 bp, Homo sapien
tcaaaactattttgccatctatcaa

SEQ ID NO: 95159 - DNA, 25 bp, Homo sapien
tcaaaactattttgccgtctatcaa

SEQ ID NO: 95160 - DNA, 25 bp, Homo sapien
tcaaaagacatgtacgagaataatc

SEQ ID NO: 95161 - DNA, 25 bp, Homo sapien
tcaaaagacatgtatgagaataatc

SEQ ID NO: 95162 - DNA, 25 bp, Homo sapien
tcaaaagcatctgacaattggccta

SEQ ID NO: 95163 - DNA, 25 bp, Homo sapien
tcaaaagcatctgacagttggccta

SEQ ID NO: 95164 - DNA, 25 bp, Homo sapien
tcaaaagccattgcaaaatttgaaa

SEQ ID NO: 95165 - DNA, 25 bp, Homo sapien
tcaaaagccattgtaaaatttgaaa

SEQ ID NO: 95166 - DNA, 25 bp, Homo sapien
tcaaaagcctacattatataaaaag

SEQ ID NO: 95167 - DNA, 25 bp, Homo sapien
tcaaaagcttacattatataaaaag

SEQ ID NO: 95168 - DNA, 25 bp, Homo sapien
tcaaaaggccctaagaggaaagtgg

SEQ ID NO: 95169 - DNA, 25 bp, Homo sapien
tcaaaaggcgaatccgatcatgtgg

SEQ ID NO: 95170 - DNA, 25 bp, Homo sapien
tcaaaaggcgaatctgatcatgtgg

SEQ ID NO: 95171 - DNA, 25 bp, Homo sapien
tcaaaaggtcctaagaggaaagtgg

SEQ ID NO: 95172 - DNA, 25 bp, Homo sapien
tcaaaagtcaagccagtgcctgtga

SEQ ID NO: 95173 - DNA, 25 bp, Homo sapien
tcaaaagtcaatccagtgcctgtga

SEQ ID NO: 95174 - DNA, 25 bp, Homo sapien
tcaaaagtgctaagaatataaatat

SEQ ID NO: 95175 - DNA, 25 bp, Homo sapien
tcaaaagtgctaggaatataaatat

SEQ ID NO: 95176 - DNA, 25 bp, Homo sapien
tcaaaagtgtggttcaactatgtga

SEQ ID NO: 95177 - DNA, 25 bp, Homo sapien
tcaaaagtgtggttcacctatgtga

SEQ ID NO: 95178 - DNA, 25 bp, Homo sapien
tcaaaagttccaagagagtgtaaaa

SEQ ID NO: 95179 - DNA, 25 bp, Homo sapien
tcaaaagttccaagggagtgtaaaa

SEQ ID NO: 95180 - DNA, 25 bp, Homo sapien
tcaaaataaccacaaacagaagtcc

SEQ ID NO: 95181 - DNA, 25 bp, Homo sapien
tcaaaataaccacaaagagaagtcc

SEQ ID NO: 95182 - DNA, 25 bp, Homo sapien
tcaaaatagcctgtctctggaacac

SEQ ID NO: 95183 - DNA, 25 bp, Homo sapien
tcaaaataggctgtctctggaacac

SEQ ID NO: 95184 - DNA, 25 bp, Homo sapien
tcaaaatatgcaaagaactcttaca

SEQ ID NO: 95185 - DNA, 25 bp, Homo sapien
tcaaaatatgcaaataactcttaca

SEQ ID NO: 95186 - DNA, 25 bp, Homo sapien
tcaaaatcaactatttcaagtgaca

SEQ ID NO: 95187 - DNA, 25 bp, Homo sapien
tcaaaatcacacttaaactgaactg

SEQ ID NO: 95188 - DNA, 25 bp, Homo sapien
tcaaaatcagctatttcaagtgaca

SEQ ID NO: 95189 - DNA, 25 bp, Homo sapien
tcaaaatcgcacttaaactgaactg

SEQ ID NO: 95190 - DNA, 25 bp, Homo sapien
tcaaaatctcggccagctttcacat

SEQ ID NO: 95191 - DNA, 25 bp, Homo sapien
tcaaaatcttggccagctttcacat

SEQ ID NO: 95192 - DNA, 25 bp, Homo sapien
tcaaaatgccctttgcaatgatctc

SEQ ID NO: 95193 - DNA, 25 bp, Homo sapien
tcaaaatgctacaggccggcgagct

SEQ ID NO: 95194 - DNA, 25 bp, Homo sapien
tcaaaatgctacaggctggcgagct

SEQ ID NO: 95195 - DNA, 25 bp, Homo sapien
tcaaaatgtcctttgcaatgatctc

SEQ ID NO: 95196 - DNA, 25 bp, Homo sapien
tcaaaatgtgaacagaccagtcaaa

SEQ ID NO: 95197 - DNA, 25 bp, Homo sapien
tcaaaatgtgaatagaccagtcaaa

SEQ ID NO: 95198 - DNA, 25 bp, Homo sapien
tcaaaattcctgccttacactaaca

SEQ ID NO: 95199 - DNA, 25 bp, Homo sapien
tcaaaatttctgccttacactaaca

SEQ ID NO: 95200 - DNA, 25 bp, Homo sapien
tcaaaatttgccagcctttttcact

SEQ ID NO: 95201 - DNA, 25 bp, Homo sapien
tcaaaatttgccagtctttttcact

SEQ ID NO: 95202 - DNA, 25 bp, Homo sapien
tcaaacaatattccacttttaccta

SEQ ID NO: 95203 - DNA, 25 bp, Homo sapien
tcaaacaatattcgacttttaccta

SEQ ID NO: 95204 - DNA, 25 bp, Homo sapien
tcaaacacaatgctccgctctattc

SEQ ID NO: 95205 - DNA, 25 bp, Homo sapien
tcaaacacagtgctccgctctattc

SEQ ID NO: 95206 - DNA, 25 bp, Homo sapien
tcaaacactgacattggtgctagac

SEQ ID NO: 95207 - DNA, 25 bp, Homo sapien
tcaaacactgacgttggtgctagac

SEQ ID NO: 95208 - DNA, 25 bp, Homo sapien
tcaaacagagaatcagaatcaccac

SEQ ID NO: 95209 - DNA, 25 bp, Homo sapien
tcaaacagctcatcagtgtctggca

SEQ ID NO: 95210 - DNA, 25 bp, Homo sapien
tcaaacagggaatcagaatcaccac

SEQ ID NO: 95211 - DNA, 25 bp, Homo sapien
tcaaacagttcatcagtgtctggca

SEQ ID NO: 95212 - DNA, 25 bp, Homo sapien
tcaaacataaaatgcactataaatc

SEQ ID NO: 95213 - DNA, 25 bp, Homo sapien
tcaaacatattcataaagcagaaca

SEQ ID NO: 95214 - DNA, 25 bp, Homo sapien
tcaaacatattttcaatctctgatt

SEQ ID NO: 95215 - DNA, 25 bp, Homo sapien
tcaaacatattttctatctctgatt

SEQ ID NO: 95216 - DNA, 25 bp, Homo sapien
tcaaacatcaaatgcactataaatc

SEQ ID NO: 95217 - DNA, 25 bp, Homo sapien
tcaaacatgatataaacagtgaata

SEQ ID NO: 95218 - DNA, 25 bp, Homo sapien
tcaaacatggtataaacagtgaata

SEQ ID NO: 95219 - DNA, 25 bp, Homo sapien
tcaaacatgttcataaagcagaaca

SEQ ID NO: 95220 - DNA, 25 bp, Homo sapien
tcaaacattcttcattatgatcctc

SEQ ID NO: 95221 - DNA, 25 bp, Homo sapien
tcaaacattcttcgttatgatcctc

SEQ ID NO: 95222 - DNA, 25 bp, Homo sapien
tcaaacatttatactcaacttgcct

SEQ ID NO: 95223 - DNA, 25 bp, Homo sapien
tcaaacatttatattcaacttgcct

SEQ ID NO: 95224 - DNA, 25 bp, Homo sapien
tcaaaccaatatcacaaatggatgc

SEQ ID NO: 95225 - DNA, 25 bp, Homo sapien
tcaaaccactactaattccaggtca

SEQ ID NO: 95226 - DNA, 25 bp, Homo sapien
tcaaaccactactacttccaggtca

SEQ ID NO: 95227 - DNA, 25 bp, Homo sapien
tcaaaccagtatcacaaatggatgc

SEQ ID NO: 95228 - DNA, 25 bp, Homo sapien
tcaaacgatactataaggcactagt

SEQ ID NO: 95229 - DNA, 25 bp, Homo sapien
tcaaacgatactgtaaggcactagt

SEQ ID NO: 95230 - DNA, 25 bp, Homo sapien
tcaaacgccttcgtggtgcttccat

SEQ ID NO: 95231 - DNA, 25 bp, Homo sapien
tcaaacgccttcttggtgcttccat

SEQ ID NO: 95232 - DNA, 25 bp, Homo sapien
tcaaacggacctctgcaactttcaa

SEQ ID NO: 95233 - DNA, 25 bp, Homo sapien
tcaaacggagctctgcaactttcaa

SEQ ID NO: 95234 - DNA, 25 bp, Homo sapien
tcaaacgtggcaacacggcaggact

SEQ ID NO: 95235 - DNA, 25 bp, Homo sapien
tcaaacgtggcaacactgcaggact

SEQ ID NO: 95236 - DNA, 25 bp, Homo sapien
tcaaactaaagaactcctacatagc

SEQ ID NO: 95237 - DNA, 25 bp, Homo sapien
tcaaactaaagaagtcctacatagc

SEQ ID NO: 95238 - DNA, 25 bp, Homo sapien
tcaaactaacgcagccataactggt

SEQ ID NO: 95239 - DNA, 25 bp, Homo sapien
tcaaactaacgcagccgtaactggt

SEQ ID NO: 95240 - DNA, 25 bp, Homo sapien
tcaaactccctggcctagtatttaa

SEQ ID NO: 95241 - DNA, 25 bp, Homo sapien
tcaaactccctggcctggtatttaa

SEQ ID NO: 95242 - DNA, 25 bp, Homo sapien
tcaaactctgagcactaaaatatac

SEQ ID NO: 95243 - DNA, 25 bp, Homo sapien
tcaaactctgagctctaaaatatac

SEQ ID NO: 95244 - DNA, 25 bp, Homo sapien
tcaaacttcatatcacttgacatgg

SEQ ID NO: 95245 - DNA, 25 bp, Homo sapien
tcaaacttcgtatcacttgacatgg

SEQ ID NO: 95246 - DNA, 25 bp, Homo sapien
tcaaacttctgagctgagagagcat

SEQ ID NO: 95247 - DNA, 25 bp, Homo sapien
tcaaacttgtgtttcatgaatcctc

SEQ ID NO: 95248 - DNA, 25 bp, Homo sapien
tcaaacttgtgttttatgaatcctc

SEQ ID NO: 95249 - DNA, 25 bp, Homo sapien
tcaaacttttccatagcagctgtgc

SEQ ID NO: 95250 - DNA, 25 bp, Homo sapien
tcaaacttttccgtagcagctgtgc

SEQ ID NO: 95251 - DNA, 25 bp, Homo sapien
tcaaacttttgagctgagagagcat

SEQ ID NO: 95252 - DNA, 25 bp, Homo sapien
tcaaagaacaatgacgactataaca

SEQ ID NO: 95253 - DNA, 25 bp, Homo sapien
tcaaagaacaatgatgactataaca

SEQ ID NO: 95254 - DNA, 25 bp, Homo sapien
tcaaagaactacataagcttctgaa

SEQ ID NO: 95255 - DNA, 25 bp, Homo sapien
tcaaagaactacgtaagcttctgaa

SEQ ID NO: 95256 - DNA, 25 bp, Homo sapien
tcaaagaaggttcagttggatatca

SEQ ID NO: 95257 - DNA, 25 bp, Homo sapien
tcaaagaagtttcagttggatatca

SEQ ID NO: 95258 - DNA, 25 bp, Homo sapien
tcaaagaattagccattgatacaag

SEQ ID NO: 95259 - DNA, 25 bp, Homo sapien
tcaaagaattagtcattgatacaag

SEQ ID NO: 95260 - DNA, 25 bp, Homo sapien
tcaaagacacggaggtatcagaaat

SEQ ID NO: 95261 - DNA, 25 bp, Homo sapien
tcaaagacacggcggtatcagaaat

SEQ ID NO: 95262 - DNA, 25 bp, Homo sapien
tcaaagagcaagctaaacagtccac

SEQ ID NO: 95263 - DNA, 25 bp, Homo sapien
tcaaagagccacgaagagaaaatgg

SEQ ID NO: 95264 - DNA, 25 bp, Homo sapien
tcaaagagcgagctaaacagtccac

SEQ ID NO: 95265 - DNA, 25 bp, Homo sapien
tcaaagagctacgaagagaaaatgg

SEQ ID NO: 95266 - DNA, 25 bp, Homo sapien
tcaaagaggtcactttactttccta

SEQ ID NO: 95267 - DNA, 25 bp, Homo sapien
tcaaagaggtcgctttactttccta

SEQ ID NO: 95268 - DNA, 25 bp, Homo sapien
tcaaagatatacgcatgagatgttc

SEQ ID NO: 95269 - DNA, 25 bp, Homo sapien
tcaaagatggcatagctgatagatg

SEQ ID NO: 95270 - DNA, 25 bp, Homo sapien
tcaaagatggcgtagctgatagatg

SEQ ID NO: 95271 - DNA, 25 bp, Homo sapien
tcaaagatgtacgcatgagatgttc

SEQ ID NO: 95272 - DNA, 25 bp, Homo sapien
tcaaagcaacaacctgcctggtttg

SEQ ID NO: 95273 - DNA, 25 bp, Homo sapien
tcaaagcaacagcctgcctggtttg

SEQ ID NO: 95274 - DNA, 25 bp, Homo sapien
tcaaagcaccgtaacttggggtatt

SEQ ID NO: 95275 - DNA, 25 bp, Homo sapien
tcaaagcaccgtatcttggggtatt

SEQ ID NO: 95276 - DNA, 25 bp, Homo sapien
tcaaagcacggatttcaagcaagct

SEQ ID NO: 95277 - DNA, 25 bp, Homo sapien
tcaaagcagcgctattcatattacc

SEQ ID NO: 95278 - DNA, 25 bp, Homo sapien
tcaaagcagtgctattcatattacc

SEQ ID NO: 95279 - DNA, 25 bp, Homo sapien
tcaaagcatggatttcaagcaagct

SEQ ID NO: 95280 - DNA, 25 bp, Homo sapien
tcaaagctgtatgaagtaagactgt

SEQ ID NO: 95281 - DNA, 25 bp, Homo sapien
tcaaagcttcccatgtgatttgagt

SEQ ID NO: 95282 - DNA, 25 bp, Homo sapien
tcaaagcttcccatgttatttgagt

SEQ ID NO: 95283 - DNA, 25 bp, Homo sapien
tcaaagctttatgaagtaagactgt

SEQ ID NO: 95284 - DNA, 25 bp, Homo sapien
tcaaaggaaagagtgcaatcagagg

SEQ ID NO: 95285 - DNA, 25 bp, Homo sapien
tcaaaggaaagggtgcaatcagagg

SEQ ID NO: 95286 - DNA, 25 bp, Homo sapien
tcaaaggccagggcgatccaagctg

SEQ ID NO: 95287 - DNA, 25 bp, Homo sapien
tcaaaggccagggtgatccaagctg

SEQ ID NO: 95288 - DNA, 25 bp, Homo sapien
tcaaagggcttttgtgagcactaca

SEQ ID NO: 95289 - DNA, 25 bp, Homo sapien
tcaaagggtttttgtgagcactaca

SEQ ID NO: 95290 - DNA, 25 bp, Homo sapien
tcaaaggtaaaatattctgccccag

SEQ ID NO: 95291 - DNA, 25 bp, Homo sapien
tcaaaggtaaccaactatccgaact

SEQ ID NO: 95292 - DNA, 25 bp, Homo sapien
tcaaaggtaaccagctatccgaact

SEQ ID NO: 95293 - DNA, 25 bp, Homo sapien
tcaaaggtgaaatattctgccccag

SEQ ID NO: 95294 - DNA, 25 bp, Homo sapien
tcaaaggtgcaactgaagatcatcg

SEQ ID NO: 95295 - DNA, 25 bp, Homo sapien
tcaaaggtgcaattgaagatcatcg

SEQ ID NO: 95296 - DNA, 25 bp, Homo sapien
tcaaagtagaatgagagatggcatt

SEQ ID NO: 95297 - DNA, 25 bp, Homo sapien
tcaaagtagaattagagatggcatt

SEQ ID NO: 95298 - DNA, 25 bp, Homo sapien
tcaaagtcatacgtgtagagaagag

SEQ ID NO: 95299 - DNA, 25 bp, Homo sapien
tcaaagtcatatgtgtagagaagag

SEQ ID NO: 95300 - DNA, 25 bp, Homo sapien
tcaaagtccacatgcaagttgagac

SEQ ID NO: 95301 - DNA, 25 bp, Homo sapien
tcaaagtccacatgtaagttgagac

SEQ ID NO: 95302 - DNA, 25 bp, Homo sapien
tcaaagtccataacatttatctgac

SEQ ID NO: 95303 - DNA, 25 bp, Homo sapien
tcaaagtccctaacatttatctgac

SEQ ID NO: 95304 - DNA, 25 bp, Homo sapien
tcaaagtgaacacccttttttgcca

SEQ ID NO: 95305 - DNA, 25 bp, Homo sapien
tcaaagtgaacagccttttttgcca

SEQ ID NO: 95306 - DNA, 25 bp, Homo sapien
tcaaagtggagtgttctttctgagt

SEQ ID NO: 95307 - DNA, 25 bp, Homo sapien
tcaaagtggagttttctttctgagt

SEQ ID NO: 95308 - DNA, 25 bp, Homo sapien
tcaaagttatgtcctccaatctaaa

SEQ ID NO: 95309 - DNA, 25 bp, Homo sapien
tcaaagttatgttctccaatctaaa

SEQ ID NO: 95310 - DNA, 25 bp, Homo sapien
tcaaagttttgcctgagctatagga

SEQ ID NO: 95311 - DNA, 25 bp, Homo sapien
tcaaagttttgcttgagctatagga

SEQ ID NO: 95312 - DNA, 25 bp, Homo sapien
tcaaataaaatataatctgtgtatg

SEQ ID NO: 95313 - DNA, 25 bp, Homo sapien
tcaaataaaatatgatctgtgtatg

SEQ ID NO: 95314 - DNA, 25 bp, Homo sapien
tcaaataaaatatttcaaaactcag

SEQ ID NO: 95315 - DNA, 25 bp, Homo sapien
tcaaataaagtatttcaaaactcag

SEQ ID NO: 95316 - DNA, 25 bp, Homo sapien
tcaaatacaaacagatggaaagcta

SEQ ID NO: 95317 - DNA, 25 bp, Homo sapien
tcaaatacaaatcgacaatccagag

SEQ ID NO: 95318 - DNA, 25 bp, Homo sapien
tcaaatacaaattgacaatccagag

SEQ ID NO: 95319 - DNA, 25 bp, Homo sapien
tcaaatacacacagatggaaagcta

SEQ ID NO: 95320 - DNA, 25 bp, Homo sapien
tcaaatactctactggattgcttta

SEQ ID NO: 95321 - DNA, 25 bp, Homo sapien
tcaaatactctactggtttgcttta

SEQ ID NO: 95322 - DNA, 25 bp, Homo sapien
tcaaatatattaaacacagcaatta

SEQ ID NO: 95323 - DNA, 25 bp, Homo sapien
tcaaatatattaaccacagcaatta

SEQ ID NO: 95324 - DNA, 25 bp, Homo sapien
tcaaatatcacaggcagaagaattc

SEQ ID NO: 95325 - DNA, 25 bp, Homo sapien
tcaaatatcacatgcagaagaattc

SEQ ID NO: 95326 - DNA, 25 bp, Homo sapien
tcaaatatctccggcatttcaaagg

SEQ ID NO: 95327 - DNA, 25 bp, Homo sapien
tcaaatatctctggcatttcaaagg

SEQ ID NO: 95328 - DNA, 25 bp, Homo sapien
tcaaatatgattagaaaacaatgca

SEQ ID NO: 95329 - DNA, 25 bp, Homo sapien
tcaaatatgattggaaaacaatgca

SEQ ID NO: 95330 - DNA, 25 bp, Homo sapien
tcaaatatgtacaactaggaagtat

SEQ ID NO: 95331 - DNA, 25 bp, Homo sapien
tcaaatatgtacaactgggaagtat

SEQ ID NO: 95332 - DNA, 25 bp, Homo sapien
tcaaatattccatgagtgttccaat

SEQ ID NO: 95333 - DNA, 25 bp, Homo sapien
tcaaatattccgtgagtgttccaat

SEQ ID NO: 95334 - DNA, 25 bp, Homo sapien
tcaaatcaattttcgatgctcatgg

SEQ ID NO: 95335 - DNA, 25 bp, Homo sapien
tcaaatcaatttttgatgctcatgg

SEQ ID NO: 95336 - DNA, 25 bp, Homo sapien
tcaaatcacacaatctatctcaaat

SEQ ID NO: 95337 - DNA, 25 bp, Homo sapien
tcaaatcacacaatctgtctcaaat

SEQ ID NO: 95338 - DNA, 25 bp, Homo sapien
tcaaatcagctgtgacattagactc

SEQ ID NO: 95339 - DNA, 25 bp, Homo sapien
tcaaatcagctgtggcattagactc

SEQ ID NO: 95340 - DNA, 25 bp, Homo sapien
tcaaatccaagtctttcctacttca

SEQ ID NO: 95341 - DNA, 25 bp, Homo sapien
tcaaatccaattatctgcttacaag

SEQ ID NO: 95342 - DNA, 25 bp, Homo sapien
tcaaatccactgacaatgttatatt

SEQ ID NO: 95343 - DNA, 25 bp, Homo sapien
tcaaatccactgccaatgttatatt

SEQ ID NO: 95344 - DNA, 25 bp, Homo sapien
tcaaatccaggtctttcctacttca

SEQ ID NO: 95345 - DNA, 25 bp, Homo sapien
tcaaatccagttatctgcttacaag

SEQ ID NO: 95346 - DNA, 25 bp, Homo sapien
tcaaatccattaaatttttccatct

SEQ ID NO: 95347 - DNA, 25 bp, Homo sapien
tcaaatcccagtggcatctactaac

SEQ ID NO: 95348 - DNA, 25 bp, Homo sapien
tcaaatcccggtggcatctactaac

SEQ ID NO: 95349 - DNA, 25 bp, Homo sapien
tcaaatccgttaaatttttccatct

SEQ ID NO: 95350 - DNA, 25 bp, Homo sapien
tcaaatcctggagagacgtccgcaa

SEQ ID NO: 95351 - DNA, 25 bp, Homo sapien
tcaaatcctggagagatgtccgcaa

SEQ ID NO: 95352 - DNA, 25 bp, Homo sapien
tcaaatcctggctttgctactttct

SEQ ID NO: 95353 - DNA, 25 bp, Homo sapien
tcaaatcctgggtttgctactttct

SEQ ID NO: 95354 - DNA, 25 bp, Homo sapien
tcaaatcttaaggcagcattttctc

SEQ ID NO: 95355 - DNA, 25 bp, Homo sapien
tcaaatcttaagtcagcattttctc

SEQ ID NO: 95356 - DNA, 25 bp, Homo sapien
tcaaatgaaaccaaaaggaattaca

SEQ ID NO: 95357 - DNA, 25 bp, Homo sapien
tcaaatgaaaccgaaaggaattaca

SEQ ID NO: 95358 - DNA, 25 bp, Homo sapien
tcaaatgacaatagtttaccttctc

SEQ ID NO: 95359 - DNA, 25 bp, Homo sapien
tcaaatgacgatagtttaccttctc

SEQ ID NO: 95360 - DNA, 25 bp, Homo sapien
tcaaatgataatacaagctcataaa

SEQ ID NO: 95361 - DNA, 25 bp, Homo sapien
tcaaatgataattcaagctcataaa

SEQ ID NO: 95362 - DNA, 25 bp, Homo sapien
tcaaatgctcgtaagaatatgacaa

SEQ ID NO: 95363 - DNA, 25 bp, Homo sapien
tcaaatgcttgtaagaatatgacaa

SEQ ID NO: 95364 - DNA, 25 bp, Homo sapien
tcaaatggcttagttgatccctttg

SEQ ID NO: 95365 - DNA, 25 bp, Homo sapien
tcaaatggcttatttgatccctttg

SEQ ID NO: 95366 - DNA, 25 bp, Homo sapien
tcaaatgtacagttgagtagtgtta

SEQ ID NO: 95367 - DNA, 25 bp, Homo sapien
tcaaatgtacagtttagtagtgtta

SEQ ID NO: 95368 - DNA, 25 bp, Homo sapien
tcaaatgttcaaagcgcttgcaacc

SEQ ID NO: 95369 - DNA, 25 bp, Homo sapien
tcaaatgttcaacgcgcttgcaacc

SEQ ID NO: 95370 - DNA, 25 bp, Homo sapien
tcaaattaaattgcatgttcttgga

SEQ ID NO: 95371 - DNA, 25 bp, Homo sapien
tcaaattaaattgcttgttcttgga

SEQ ID NO: 95372 - DNA, 25 bp, Homo sapien
tcaaattagttaactccaaattttc

SEQ ID NO: 95373 - DNA, 25 bp, Homo sapien
tcaaattagttatctccaaattttc

SEQ ID NO: 95374 - DNA, 25 bp, Homo sapien
tcaaattctatgaaactcaaaagtg

SEQ ID NO: 95375 - DNA, 25 bp, Homo sapien
tcaaattctatggaactcaaaagtg

SEQ ID NO: 95376 - DNA, 25 bp, Homo sapien
tcaaattggttgtcttatttcatct

SEQ ID NO: 95377 - DNA, 25 bp, Homo sapien
tcaaattggttgttttatttcatct

SEQ ID NO: 95378 - DNA, 25 bp, Homo sapien
tcaaattgtacaataattcccagtg

SEQ ID NO: 95379 - DNA, 25 bp, Homo sapien
tcaaattgtacagtaattcccagtg

SEQ ID NO: 95380 - DNA, 25 bp, Homo sapien
tcaaatttctatagccaagtagtag

SEQ ID NO: 95381 - DNA, 25 bp, Homo sapien
tcaaatttctataggcaagtagtag

SEQ ID NO: 95382 - DNA, 25 bp, Homo sapien
tcaaatttcttaatgcaataggagg

SEQ ID NO: 95383 - DNA, 25 bp, Homo sapien
tcaaatttcttaatgcgataggagg

SEQ ID NO: 95384 - DNA, 25 bp, Homo sapien
tcaacaaaatactcgaaaattgcat

SEQ ID NO: 95385 - DNA, 25 bp, Homo sapien
tcaacaaaatacttgaaaattgcat

SEQ ID NO: 95386 - DNA, 25 bp, Homo sapien
tcaacaaaccttcaatctgcaaaaa

SEQ ID NO: 95387 - DNA, 25 bp, Homo sapien
tcaacaaaccttcaatttgcaaaaa

SEQ ID NO: 95388 - DNA, 25 bp, Homo sapien
tcaacaaagatgaaacaagaatgaa

SEQ ID NO: 95389 - DNA, 25 bp, Homo sapien
tcaacaaagatgaagcaagaatgaa

SEQ ID NO: 95390 - DNA, 25 bp, Homo sapien
tcaacaaatcctatcaattttacct

SEQ ID NO: 95391 - DNA, 25 bp, Homo sapien
tcaacaaatgctatcaattttacct

SEQ ID NO: 95392 - DNA, 25 bp, Homo sapien
tcaacaacagtttattcaaaagttt

SEQ ID NO: 95393 - DNA, 25 bp, Homo sapien
tcaacaacagtttgttcaaaagttt

SEQ ID NO: 95394 - DNA, 25 bp, Homo sapien
tcaacaaccttaacatatgcaaata

SEQ ID NO: 95395 - DNA, 25 bp, Homo sapien
tcaacaaccttaacatgtgcaaata

SEQ ID NO: 95396 - DNA, 25 bp, Homo sapien
tcaacaactaaagtaggtgatcctt

SEQ ID NO: 95397 - DNA, 25 bp, Homo sapien
tcaacaactaaggtaggtgatcctt

SEQ ID NO: 95398 - DNA, 25 bp, Homo sapien
tcaacaagatacatatttactcaac

SEQ ID NO: 95399 - DNA, 25 bp, Homo sapien
tcaacaagatacttatttactcaac

SEQ ID NO: 95400 - DNA, 25 bp, Homo sapien
tcaacaatcccaacttcgttccact

SEQ ID NO: 95401 - DNA, 25 bp, Homo sapien
tcaacaatcccaactttgttccact

SEQ ID NO: 95402 - DNA, 25 bp, Homo sapien
tcaacaatgttacataaaaggaatc

SEQ ID NO: 95403 - DNA, 25 bp, Homo sapien
tcaacaatgttacgtaaaaggaatc

SEQ ID NO: 95404 - DNA, 25 bp, Homo sapien
tcaacaatttttaaatcagggtttc

SEQ ID NO: 95405 - DNA, 25 bp, Homo sapien
tcaacaattttttaatcagggtttc

SEQ ID NO: 95406 - DNA, 25 bp, Homo sapien
tcaacacatgcactgcacacatgcc

SEQ ID NO: 95407 - DNA, 25 bp, Homo sapien
tcaacacatgcgctgcacacatgcc

SEQ ID NO: 95408 - DNA, 25 bp, Homo sapien
tcaacacggataagcaaagaaatgc

SEQ ID NO: 95409 - DNA, 25 bp, Homo sapien
tcaacacgggtaagcaaagaaatgc

SEQ ID NO: 95410 - DNA, 25 bp, Homo sapien
tcaacactccttattaactgctgtc

SEQ ID NO: 95411 - DNA, 25 bp, Homo sapien
tcaacactgtactatgcgtctgcct

SEQ ID NO: 95412 - DNA, 25 bp, Homo sapien
tcaacactgtactgtgcgtctgcct

SEQ ID NO: 95413 - DNA, 25 bp, Homo sapien
tcaacacttcttattaactgctgtc

SEQ ID NO: 95414 - DNA, 25 bp, Homo sapien
tcaacactttgaaaacccaaggcag

SEQ ID NO: 95415 - DNA, 25 bp, Homo sapien
tcaacactttggaaacccaaggcag

SEQ ID NO: 95416 - DNA, 25 bp, Homo sapien
tcaacagaatgcacggtcccaaaca

SEQ ID NO: 95417 - DNA, 25 bp, Homo sapien
tcaacagaatgcatggtcccaaaca

SEQ ID NO: 95418 - DNA, 25 bp, Homo sapien
tcaacagagtataatgtttaaatgc

SEQ ID NO: 95419 - DNA, 25 bp, Homo sapien
tcaacagagtatagtgtttaaatgc

SEQ ID NO: 95420 - DNA, 25 bp, Homo sapien
tcaacagtccttatccaaacttgcc

SEQ ID NO: 95421 - DNA, 25 bp, Homo sapien
tcaacagttcttatccaaacttgcc

SEQ ID NO: 95422 - DNA, 25 bp, Homo sapien
tcaacataaaaccttgaagcaaact

SEQ ID NO: 95423 - DNA, 25 bp, Homo sapien
tcaacataagtacaagtcaattttt

SEQ ID NO: 95424 - DNA, 25 bp, Homo sapien
tcaacataagtataagtcaattttt

SEQ ID NO: 95425 - DNA, 25 bp, Homo sapien
tcaacatacaaatattaaaggaacc

SEQ ID NO: 95426 - DNA, 25 bp, Homo sapien
tcaacatacgaatattaaaggaacc

SEQ ID NO: 95427 - DNA, 25 bp, Homo sapien
tcaacatataaccttgaagcaaact

SEQ ID NO: 95428 - DNA, 25 bp, Homo sapien
tcaacatcactgattagtagagaaa

SEQ ID NO: 95429 - DNA, 25 bp, Homo sapien
tcaacatcattcgctatgctgagct

SEQ ID NO: 95430 - DNA, 25 bp, Homo sapien
tcaacatcattgattagtagagaaa

SEQ ID NO: 95431 - DNA, 25 bp, Homo sapien
tcaacatcattggctatgctgagct

SEQ ID NO: 95432 - DNA, 25 bp, Homo sapien
tcaacatgaaagcgttagtatgaaa

SEQ ID NO: 95433 - DNA, 25 bp, Homo sapien
tcaacatgaaagtgttagtatgaaa

SEQ ID NO: 95434 - DNA, 25 bp, Homo sapien
tcaacatgctccgaatttatgagta

SEQ ID NO: 95435 - DNA, 25 bp, Homo sapien
tcaacatgctctgaatttatgagta

SEQ ID NO: 95436 - DNA, 25 bp, Homo sapien
tcaacattatgatcaaaggtgaaag

SEQ ID NO: 95437 - DNA, 25 bp, Homo sapien
tcaacattatgctcaaaggtgaaag

SEQ ID NO: 95438 - DNA, 25 bp, Homo sapien
tcaacattatttattcactaaaacc

SEQ ID NO: 95439 - DNA, 25 bp, Homo sapien
tcaacattgtttattcactaaaacc

SEQ ID NO: 95440 - DNA, 25 bp, Homo sapien
tcaacatttttgtgaacttcccaaa

SEQ ID NO: 95441 - DNA, 25 bp, Homo sapien
tcaacatttttgtggacttcccaaa

SEQ ID NO: 95442 - DNA, 25 bp, Homo sapien
tcaaccaacatcgaccctttgagca

SEQ ID NO: 95443 - DNA, 25 bp, Homo sapien
tcaaccaacattgaccctttgagca

SEQ ID NO: 95444 - DNA, 25 bp, Homo sapien
tcaaccaattctatgaaaacaagcg

SEQ ID NO: 95445 - DNA, 25 bp, Homo sapien
tcaaccaattctgtgaaaacaagcg

SEQ ID NO: 95446 - DNA, 25 bp, Homo sapien
tcaaccagacatcacaaaccagaca

SEQ ID NO: 95447 - DNA, 25 bp, Homo sapien
tcaaccagacatcgcaaaccagaca

SEQ ID NO: 95448 - DNA, 25 bp, Homo sapien
tcaaccagggctgcgctaattagat

SEQ ID NO: 95449 - DNA, 25 bp, Homo sapien
tcaaccagggctgctctaattagat

SEQ ID NO: 95450 - DNA, 25 bp, Homo sapien
tcaaccatgaaaataaagtgggctc

SEQ ID NO: 95451 - DNA, 25 bp, Homo sapien
tcaaccatgaatataaagtgggctc

SEQ ID NO: 95452 - DNA, 25 bp, Homo sapien
tcaaccatgctacaaatgtttattg

SEQ ID NO: 95453 - DNA, 25 bp, Homo sapien
tcaaccatgctacagatgtttattg

SEQ ID NO: 95454 - DNA, 25 bp, Homo sapien
tcaacccatgcctatggaatttcat

SEQ ID NO: 95455 - DNA, 25 bp, Homo sapien
tcaacccatgcttatggaatttcat

SEQ ID NO: 95456 - DNA, 25 bp, Homo sapien
tcaacctacattgagaagtacgcct

SEQ ID NO: 95457 - DNA, 25 bp, Homo sapien
tcaacctacatttagaagtacgcct

SEQ ID NO: 95458 - DNA, 25 bp, Homo sapien
tcaacctcactcttcacatgaagaa

SEQ ID NO: 95459 - DNA, 25 bp, Homo sapien
tcaacctcactctttacatgaagaa

SEQ ID NO: 95460 - DNA, 25 bp, Homo sapien
tcaaccttgatcacatctgaaaaat

SEQ ID NO: 95461 - DNA, 25 bp, Homo sapien
tcaaccttgatcatatctgaaaaat

SEQ ID NO: 95462 - DNA, 25 bp, Homo sapien
tcaacgaataaatagatggatcttt

SEQ ID NO: 95463 - DNA, 25 bp, Homo sapien
tcaacgaataaatggatggatcttt

SEQ ID NO: 95464 - DNA, 25 bp, Homo sapien
tcaacgacttaaaatcatctgcatc

SEQ ID NO: 95465 - DNA, 25 bp, Homo sapien
tcaacgacttacaatcatctgcatc

SEQ ID NO: 95466 - DNA, 25 bp, Homo sapien
tcaactaatactctgcttttggtta

SEQ ID NO: 95467 - DNA, 25 bp, Homo sapien
tcaactaatactgtgcttttggtta

SEQ ID NO: 95468 - DNA, 25 bp, Homo sapien
tcaactaccacattcatgccaatga

SEQ ID NO: 95469 - DNA, 25 bp, Homo sapien
tcaactacgacattcatgccaatga

SEQ ID NO: 95470 - DNA, 25 bp, Homo sapien
tcaactacttcaattgcctcctacc

SEQ ID NO: 95471 - DNA, 25 bp, Homo sapien
tcaactacttcagttgcctcctacc

SEQ ID NO: 95472 - DNA, 25 bp, Homo sapien
tcaactcatttaccctgagttagtg

SEQ ID NO: 95473 - DNA, 25 bp, Homo sapien
tcaactcatttaccgtgagttagtg

SEQ ID NO: 95474 - DNA, 25 bp, Homo sapien
tcaactcccatacagaaaaaaaaat

SEQ ID NO: 95475 - DNA, 25 bp, Homo sapien
tcaactcccatatagaaaaaaaaat

SEQ ID NO: 95476 - DNA, 25 bp, Homo sapien
tcaactccgttaatttcagagctga

SEQ ID NO: 95477 - DNA, 25 bp, Homo sapien
tcaactcctttaatttcagagctga

SEQ ID NO: 95478 - DNA, 25 bp, Homo sapien
tcaactgattgtaaacattaatgcc

SEQ ID NO: 95479 - DNA, 25 bp, Homo sapien
tcaactgattgtaaacgttaatgcc

SEQ ID NO: 95480 - DNA, 25 bp, Homo sapien
tcaactggattaattggatgcttta

SEQ ID NO: 95481 - DNA, 25 bp, Homo sapien
tcaactggattgattggatgcttta

SEQ ID NO: 95482 - DNA, 25 bp, Homo sapien
tcaactggctcatgactcatactag

SEQ ID NO: 95483 - DNA, 25 bp, Homo sapien
tcaactggctcatggctcatactag

SEQ ID NO: 95484 - DNA, 25 bp, Homo sapien
tcaacttatacctatcatatagcac

SEQ ID NO: 95485 - DNA, 25 bp, Homo sapien
tcaacttatacctgtcatatagcac

SEQ ID NO: 95486 - DNA, 25 bp, Homo sapien
tcaacttatgaggataactaataca

SEQ ID NO: 95487 - DNA, 25 bp, Homo sapien
tcaacttatgaggatagctaataca

SEQ ID NO: 95488 - DNA, 25 bp, Homo sapien
tcaacttctaacaaaacaaacatat

SEQ ID NO: 95489 - DNA, 25 bp, Homo sapien
tcaacttctaacaaaagaaacatat

SEQ ID NO: 95490 - DNA, 25 bp, Homo sapien
tcaactttgcagactcaaataaatc

SEQ ID NO: 95491 - DNA, 25 bp, Homo sapien
tcaactttgcagattcaaataaatc

SEQ ID NO: 95492 - DNA, 25 bp, Homo sapien
tcaagaaaatgcacagggtcacgac

SEQ ID NO: 95493 - DNA, 25 bp, Homo sapien
tcaagaaactgcacagggtcacgac

SEQ ID NO: 95494 - DNA, 25 bp, Homo sapien
tcaagaaatatacatccatcatcta

SEQ ID NO: 95495 - DNA, 25 bp, Homo sapien
tcaagaaatatatatccatcatcta

SEQ ID NO: 95496 - DNA, 25 bp, Homo sapien
tcaagaaatgacaattgactttgaa

SEQ ID NO: 95497 - DNA, 25 bp, Homo sapien
tcaagaaatgataattgactttgaa

SEQ ID NO: 95498 - DNA, 25 bp, Homo sapien
tcaagaagaatgtttactggagtgg

SEQ ID NO: 95499 - DNA, 25 bp, Homo sapien
tcaagaagacgctaaaaggatagta

SEQ ID NO: 95500 - DNA, 25 bp, Homo sapien
tcaagaagactgtttactggagtgg

SEQ ID NO: 95501 - DNA, 25 bp, Homo sapien
tcaagaagatgctaaaaggatagta

SEQ ID NO: 95502 - DNA, 25 bp, Homo sapien
tcaagaaggagataccgtatataaa

SEQ ID NO: 95503 - DNA, 25 bp, Homo sapien
tcaagaaggaggtaccgtatataaa

SEQ ID NO: 95504 - DNA, 25 bp, Homo sapien
tcaagaatcctcacatggctgtaaa

SEQ ID NO: 95505 - DNA, 25 bp, Homo sapien
tcaagaatcctcacctggctgtaaa

SEQ ID NO: 95506 - DNA, 25 bp, Homo sapien
tcaagaatcctcatacaaattgtcc

SEQ ID NO: 95507 - DNA, 25 bp, Homo sapien
tcaagaatcctcgtacaaattgtcc

SEQ ID NO: 95508 - DNA, 25 bp, Homo sapien
tcaagaatggatatataactttgac

SEQ ID NO: 95509 - DNA, 25 bp, Homo sapien
tcaagaatggatatgtaactttgac

SEQ ID NO: 95510 - DNA, 25 bp, Homo sapien
tcaagacacatttaagagataagac

SEQ ID NO: 95511 - DNA, 25 bp, Homo sapien
tcaagacacgcaatctctgcaaacc

SEQ ID NO: 95512 - DNA, 25 bp, Homo sapien
tcaagacagatttaagagataagac

SEQ ID NO: 95513 - DNA, 25 bp, Homo sapien
tcaagacatgcaatctctgcaaacc

SEQ ID NO: 95514 - DNA, 25 bp, Homo sapien
tcaagaccacaacaggaacatagcc

SEQ ID NO: 95515 - DNA, 25 bp, Homo sapien
tcaagaccacaacgggaacatagcc

SEQ ID NO: 95516 - DNA, 25 bp, Homo sapien
tcaagacgccaggcacagtgctaaa

SEQ ID NO: 95517 - DNA, 25 bp, Homo sapien
tcaagacgccaggcaccgtgctaaa

SEQ ID NO: 95518 - DNA, 25 bp, Homo sapien
tcaagacttgctcaacttagacatg

SEQ ID NO: 95519 - DNA, 25 bp, Homo sapien
tcaagacttgctcaccttagacatg

SEQ ID NO: 95520 - DNA, 25 bp, Homo sapien
tcaagagacacttacaagatgacca

SEQ ID NO: 95521 - DNA, 25 bp, Homo sapien
tcaagagatacttacaagatgacca

SEQ ID NO: 95522 - DNA, 25 bp, Homo sapien
tcaagagggacatgagaatttgctt

SEQ ID NO: 95523 - DNA, 25 bp, Homo sapien
tcaagaggtacatgagaatttgctt

SEQ ID NO: 95524 - DNA, 25 bp, Homo sapien
tcaagagttcacacaagtattaagt

SEQ ID NO: 95525 - DNA, 25 bp, Homo sapien
tcaagagttcacgcaagtattaagt

SEQ ID NO: 95526 - DNA, 25 bp, Homo sapien
tcaagatacgtttgaccatagaacc

SEQ ID NO: 95527 - DNA, 25 bp, Homo sapien
tcaagatagagttgtcatttttagg

SEQ ID NO: 95528 - DNA, 25 bp, Homo sapien
tcaagatagagttgtcgtttttagg

SEQ ID NO: 95529 - DNA, 25 bp, Homo sapien
tcaagatatgtttgaccatagaacc

SEQ ID NO: 95530 - DNA, 25 bp, Homo sapien
tcaagattaggcatctgcatttggt

SEQ ID NO: 95531 - DNA, 25 bp, Homo sapien
tcaagattaggcttctgcatttggt

SEQ ID NO: 95532 - DNA, 25 bp, Homo sapien
tcaagcaagaggtgagagctggttg

SEQ ID NO: 95533 - DNA, 25 bp, Homo sapien
tcaagcaagagttgagagctggttg

SEQ ID NO: 95534 - DNA, 25 bp, Homo sapien
tcaagcaatattatcctcttttatg

SEQ ID NO: 95535 - DNA, 25 bp, Homo sapien
tcaagcaatgttatcctcttttatg

SEQ ID NO: 95536 - DNA, 25 bp, Homo sapien
tcaagcacgttcatgaggagttacc

SEQ ID NO: 95537 - DNA, 25 bp, Homo sapien
tcaagcacttgtaaagaaacacaag

SEQ ID NO: 95538 - DNA, 25 bp, Homo sapien
tcaagcacttgtaaggaaacacaag

SEQ ID NO: 95539 - DNA, 25 bp, Homo sapien
tcaagcactttcatgaggagttacc

SEQ ID NO: 95540 - DNA, 25 bp, Homo sapien
tcaagcatacaacgatagaaaactc

SEQ ID NO: 95541 - DNA, 25 bp, Homo sapien
tcaagcatacaaggatagaaaactc

SEQ ID NO: 95542 - DNA, 25 bp, Homo sapien
tcaagccagaatgactctgaacttt

SEQ ID NO: 95543 - DNA, 25 bp, Homo sapien
tcaagccagaatgtctctgaacttt

SEQ ID NO: 95544 - DNA, 25 bp, Homo sapien
tcaagccctgcagatctttttcctg

SEQ ID NO: 95545 - DNA, 25 bp, Homo sapien
tcaagccctgcatatctttttcctg

SEQ ID NO: 95546 - DNA, 25 bp, Homo sapien
tcaagcccttacgaacaaaagatgg

SEQ ID NO: 95547 - DNA, 25 bp, Homo sapien
tcaagcccttactaacaaaagatgg

SEQ ID NO: 95548 - DNA, 25 bp, Homo sapien
tcaagcctatgagtacactttacag

SEQ ID NO: 95549 - DNA, 25 bp, Homo sapien
tcaagcctatgagtacgctttacag

SEQ ID NO: 95550 - DNA, 25 bp, Homo sapien
tcaagctcttcaggaccaagcctga

SEQ ID NO: 95551 - DNA, 25 bp, Homo sapien
tcaagctcttcgggaccaagcctga

SEQ ID NO: 95552 - DNA, 25 bp, Homo sapien
tcaagctgtgcaaagtcaattcaac

SEQ ID NO: 95553 - DNA, 25 bp, Homo sapien
tcaagctgtgcagagtcaattcaac

SEQ ID NO: 95554 - DNA, 25 bp, Homo sapien
tcaagcttctaggatagtttgttgc

SEQ ID NO: 95555 - DNA, 25 bp, Homo sapien
tcaagcttgtaggatagtttgttgc

SEQ ID NO: 95556 - DNA, 25 bp, Homo sapien
tcaaggaacaagatcatggcagtaa

SEQ ID NO: 95557 - DNA, 25 bp, Homo sapien
tcaaggaaccagatcatggcagtaa

SEQ ID NO: 95558 - DNA, 25 bp, Homo sapien
tcaaggaacttacccacggatatac

SEQ ID NO: 95559 - DNA, 25 bp, Homo sapien
tcaaggaacttacccatggatatac

SEQ ID NO: 95560 - DNA, 25 bp, Homo sapien
tcaaggaagacaatgacagataaag

SEQ ID NO: 95561 - DNA, 25 bp, Homo sapien
tcaaggaagccaatgacagataaag

SEQ ID NO: 95562 - DNA, 25 bp, Homo sapien
tcaaggaagctgcaaaaaggctgtg

SEQ ID NO: 95563 - DNA, 25 bp, Homo sapien
tcaaggaagctgcagaaaggctgtg

SEQ ID NO: 95564 - DNA, 25 bp, Homo sapien
tcaaggaattgaaagaaataatgtg

SEQ ID NO: 95565 - DNA, 25 bp, Homo sapien
tcaaggaattgcaagaaataatgtg

SEQ ID NO: 95566 - DNA, 25 bp, Homo sapien
tcaaggacagcaaaaatgagggata

SEQ ID NO: 95567 - DNA, 25 bp, Homo sapien
tcaaggacagcgaaaatgagggata

SEQ ID NO: 95568 - DNA, 25 bp, Homo sapien
tcaaggagaataaattgatacttcc

SEQ ID NO: 95569 - DNA, 25 bp, Homo sapien
tcaaggagtataaattgatacttcc

SEQ ID NO: 95570 - DNA, 25 bp, Homo sapien
tcaaggataacatccctttgctgtg

SEQ ID NO: 95571 - DNA, 25 bp, Homo sapien
tcaaggataattaaagcatgagctc

SEQ ID NO: 95572 - DNA, 25 bp, Homo sapien
tcaaggataattgaagcatgagctc

SEQ ID NO: 95573 - DNA, 25 bp, Homo sapien
tcaaggatagcatccctttgctgtg

SEQ ID NO: 95574 - DNA, 25 bp, Homo sapien
tcaaggatgatcaagttccaccaag

SEQ ID NO: 95575 - DNA, 25 bp, Homo sapien
tcaaggatgatcaatttccaccaag

SEQ ID NO: 95576 - DNA, 25 bp, Homo sapien
tcaaggcaaaagactagagagtgac

SEQ ID NO: 95577 - DNA, 25 bp, Homo sapien
tcaaggcaaaagattagagagtgac

SEQ ID NO: 95578 - DNA, 25 bp, Homo sapien
tcaaggcacggtataaataaagtac

SEQ ID NO: 95579 - DNA, 25 bp, Homo sapien
tcaaggcatggtataaataaagtac

SEQ ID NO: 95580 - DNA, 25 bp, Homo sapien
tcaaggctacataagacctagatat

SEQ ID NO: 95581 - DNA, 25 bp, Homo sapien
tcaaggctacatacgacctagatat

SEQ ID NO: 95582 - DNA, 25 bp, Homo sapien
tcaaggctgagacccgctgtgtttc

SEQ ID NO: 95583 - DNA, 25 bp, Homo sapien
tcaaggctgagacctgctgtgtttc

SEQ ID NO: 95584 - DNA, 25 bp, Homo sapien
tcaaggcttttgacacttattgcca

SEQ ID NO: 95585 - DNA, 25 bp, Homo sapien
tcaaggcttttgatacttattgcca

SEQ ID NO: 95586 - DNA, 25 bp, Homo sapien
tcaagggaaatattaacaggtcttg

SEQ ID NO: 95587 - DNA, 25 bp, Homo sapien
tcaagggaaatattaataggtcttg

SEQ ID NO: 95588 - DNA, 25 bp, Homo sapien
tcaagggagactaaactggatgacc

SEQ ID NO: 95589 - DNA, 25 bp, Homo sapien
tcaagggaggctaaactggatgacc

SEQ ID NO: 95590 - DNA, 25 bp, Homo sapien
tcaaggtggattgtttacctgtctg

SEQ ID NO: 95591 - DNA, 25 bp, Homo sapien
tcaaggtggattgtttccctgtctg

SEQ ID NO: 95592 - DNA, 25 bp, Homo sapien
tcaaggttaatttgatatgtgaagt

SEQ ID NO: 95593 - DNA, 25 bp, Homo sapien
tcaaggttattttgatatgtgaagt

SEQ ID NO: 95594 - DNA, 25 bp, Homo sapien
tcaagtacagggctgcaaaaaacca

SEQ ID NO: 95595 - DNA, 25 bp, Homo sapien
tcaagtaccggagttcccaatggta

SEQ ID NO: 95596 - DNA, 25 bp, Homo sapien
tcaagtaccttctcaataacacatg

SEQ ID NO: 95597 - DNA, 25 bp, Homo sapien
tcaagtaccttgtcaataacacatg

SEQ ID NO: 95598 - DNA, 25 bp, Homo sapien
tcaagtacggggctgcaaaaaacca

SEQ ID NO: 95599 - DNA, 25 bp, Homo sapien
tcaagtactggagttcccaatggta

SEQ ID NO: 95600 - DNA, 25 bp, Homo sapien
tcaagtagatgcagaaatgagagag

SEQ ID NO: 95601 - DNA, 25 bp, Homo sapien
tcaagtagatgcagaagtgagagag

SEQ ID NO: 95602 - DNA, 25 bp, Homo sapien
tcaagtagcctatttcctctaaata

SEQ ID NO: 95603 - DNA, 25 bp, Homo sapien
tcaagtagcctgtttcctctaaata

SEQ ID NO: 95604 - DNA, 25 bp, Homo sapien
tcaagtaggaaaggttacagaggct

SEQ ID NO: 95605 - DNA, 25 bp, Homo sapien
tcaagtaggaaatgttacagaggct

SEQ ID NO: 95606 - DNA, 25 bp, Homo sapien
tcaagtaggctttaaaaagattcaa

SEQ ID NO: 95607 - DNA, 25 bp, Homo sapien
tcaagtaggctttaaacagattcaa

SEQ ID NO: 95608 - DNA, 25 bp, Homo sapien
tcaagtagtcgataattggacctga

SEQ ID NO: 95609 - DNA, 25 bp, Homo sapien
tcaagtagtcggtaattggacctga

SEQ ID NO: 95610 - DNA, 25 bp, Homo sapien
tcaagtataagagagatgtatatag

SEQ ID NO: 95611 - DNA, 25 bp, Homo sapien
tcaagtatataatgacaaaaactac

SEQ ID NO: 95612 - DNA, 25 bp, Homo sapien
tcaagtatctggtaaagtgacaaaa

SEQ ID NO: 95613 - DNA, 25 bp, Homo sapien
tcaagtatctggtgaagtgacaaaa

SEQ ID NO: 95614 - DNA, 25 bp, Homo sapien
tcaagtatgagagagatgtatatag

SEQ ID NO: 95615 - DNA, 25 bp, Homo sapien
tcaagtatgtaatgacaaaaactac

SEQ ID NO: 95616 - DNA, 25 bp, Homo sapien
tcaagtcaacgtttgattggtgtgt

SEQ ID NO: 95617 - DNA, 25 bp, Homo sapien
tcaagtcaatgtttgattggtgtgt

SEQ ID NO: 95618 - DNA, 25 bp, Homo sapien
tcaagtcctattattgaattatccc

SEQ ID NO: 95619 - DNA, 25 bp, Homo sapien
tcaagtcctattcttgaattatccc

SEQ ID NO: 95620 - DNA, 25 bp, Homo sapien
tcaagtcctgtctcctataacgtgg

SEQ ID NO: 95621 - DNA, 25 bp, Homo sapien
tcaagtcctttctcctataacgtgg

SEQ ID NO: 95622 - DNA, 25 bp, Homo sapien
tcaagtctgcttagaaaggaaagag

SEQ ID NO: 95623 - DNA, 25 bp, Homo sapien
tcaagtctgtttagaaaggaaagag

SEQ ID NO: 95624 - DNA, 25 bp, Homo sapien
tcaagtcttggagcatgcttataat

SEQ ID NO: 95625 - DNA, 25 bp, Homo sapien
tcaagtctttgagcatgcttataat

SEQ ID NO: 95626 - DNA, 25 bp, Homo sapien
tcaagtgctaattcattataaggtt

SEQ ID NO: 95627 - DNA, 25 bp, Homo sapien
tcaagtgctaattcgttataaggtt

SEQ ID NO: 95628 - DNA, 25 bp, Homo sapien
tcaagtgtacactgcagcattgttg

SEQ ID NO: 95629 - DNA, 25 bp, Homo sapien
tcaagtgtacactgtagcattgttg

SEQ ID NO: 95630 - DNA, 25 bp, Homo sapien
tcaagtgtgagactcaaagttagac

SEQ ID NO: 95631 - DNA, 25 bp, Homo sapien
tcaagtgtgagcctcaaagttagac

SEQ ID NO: 95632 - DNA, 25 bp, Homo sapien
tcaagttagtatttgtaagtggtgt

SEQ ID NO: 95633 - DNA, 25 bp, Homo sapien
tcaagttagtatttgtgagtggtgt

SEQ ID NO: 95634 - DNA, 25 bp, Homo sapien
tcaagttcagtgacaaaacaacaag

SEQ ID NO: 95635 - DNA, 25 bp, Homo sapien
tcaagttcagtgtcaaaacaacaag

SEQ ID NO: 95636 - DNA, 25 bp, Homo sapien
tcaagttgacacccgatcactcaat

SEQ ID NO: 95637 - DNA, 25 bp, Homo sapien
tcaagttgacaccggatcactcaat

SEQ ID NO: 95638 - DNA, 25 bp, Homo sapien
tcaagttggtaactgatatatgtga

SEQ ID NO: 95639 - DNA, 25 bp, Homo sapien
tcaagttggtaattgatatatgtga

SEQ ID NO: 95640 - DNA, 25 bp, Homo sapien
tcaagtttgacttcgcaacagtgca

SEQ ID NO: 95641 - DNA, 25 bp, Homo sapien
tcaagtttgactttgcaacagtgca

SEQ ID NO: 95642 - DNA, 25 bp, Homo sapien
tcaagttttgttatcaatattatac

SEQ ID NO: 95643 - DNA, 25 bp, Homo sapien
tcaagttttgttgtcaatattatac

SEQ ID NO: 95644 - DNA, 25 bp, Homo sapien
tcaataaatggctaagtcaaaaaag

SEQ ID NO: 95645 - DNA, 25 bp, Homo sapien
tcaataaatggctacgtcaaaaaag

SEQ ID NO: 95646 - DNA, 25 bp, Homo sapien
tcaataagtgatacctttttctgtc

SEQ ID NO: 95647 - DNA, 25 bp, Homo sapien
tcaataagtgatacgtttttctgtc

SEQ ID NO: 95648 - DNA, 25 bp, Homo sapien
tcaataattcccaagatgtttcaga

SEQ ID NO: 95649 - DNA, 25 bp, Homo sapien
tcaataattcccaggatgtttcaga

SEQ ID NO: 95650 - DNA, 25 bp, Homo sapien
tcaataattctatcattttgtcaaa

SEQ ID NO: 95651 - DNA, 25 bp, Homo sapien
tcaataattctatccttttgtcaaa

SEQ ID NO: 95652 - DNA, 25 bp, Homo sapien
tcaatacaacacccagcttcatttt

SEQ ID NO: 95653 - DNA, 25 bp, Homo sapien
tcaatacaacatccagcttcatttt

SEQ ID NO: 95654 - DNA, 25 bp, Homo sapien
tcaatactcaaaacttaaagtttac

SEQ ID NO: 95655 - DNA, 25 bp, Homo sapien
tcaatactgaaaacttaaagtttac

SEQ ID NO: 95656 - DNA, 25 bp, Homo sapien
tcaatactgaaccactgctcctggg

SEQ ID NO: 95657 - DNA, 25 bp, Homo sapien
tcaatactgaatcactgctcctggg

SEQ ID NO: 95658 - DNA, 25 bp, Homo sapien
tcaatagaaaagccaatcctttaag

SEQ ID NO: 95659 - DNA, 25 bp, Homo sapien
tcaatagaaaagtcaatcctttaag

SEQ ID NO: 95660 - DNA, 25 bp, Homo sapien
tcaatagaactgcattaaattattt

SEQ ID NO: 95661 - DNA, 25 bp, Homo sapien
tcaatagaactgcgttaaattattt

SEQ ID NO: 95662 - DNA, 25 bp, Homo sapien
tcaatagagctacgagtctctgtat

SEQ ID NO: 95663 - DNA, 25 bp, Homo sapien
tcaatagagctacgcgtctctgtat

SEQ ID NO: 95664 - DNA, 25 bp, Homo sapien
tcaatagccttggcttcgtatcccc

SEQ ID NO: 95665 - DNA, 25 bp, Homo sapien
tcaatagccttggctttgtatcccc

SEQ ID NO: 95666 - DNA, 25 bp, Homo sapien
tcaatagctatacgttggatgacat

SEQ ID NO: 95667 - DNA, 25 bp, Homo sapien
tcaatagctatatgttggatgacat

SEQ ID NO: 95668 - DNA, 25 bp, Homo sapien
tcaataggagcgactcacgcgctgg

SEQ ID NO: 95669 - DNA, 25 bp, Homo sapien
tcaataggagcgtctcacgcgctgg

SEQ ID NO: 95670 - DNA, 25 bp, Homo sapien
tcaatatacgtttgttgattaagag

SEQ ID NO: 95671 - DNA, 25 bp, Homo sapien
tcaatatatgtttgttgattaagag

SEQ ID NO: 95672 - DNA, 25 bp, Homo sapien
tcaatatgaaatagctgctcctcca

SEQ ID NO: 95673 - DNA, 25 bp, Homo sapien
tcaatatgaaatagcttctcctcca

SEQ ID NO: 95674 - DNA, 25 bp, Homo sapien
tcaatatgatccctgtaaagcatag

SEQ ID NO: 95675 - DNA, 25 bp, Homo sapien
tcaatatgatcgctgtaaagcatag

SEQ ID NO: 95676 - DNA, 25 bp, Homo sapien
tcaatatgcatagcaagtcaacatt

SEQ ID NO: 95677 - DNA, 25 bp, Homo sapien
tcaatatgcgtagcaagtcaacatt

SEQ ID NO: 95678 - DNA, 25 bp, Homo sapien
tcaatatgttttatcatcctgtttc

SEQ ID NO: 95679 - DNA, 25 bp, Homo sapien
tcaatatgttttattatcctgtttc

SEQ ID NO: 95680 - DNA, 25 bp, Homo sapien
tcaatcagatatccttagaaccaat

SEQ ID NO: 95681 - DNA, 25 bp, Homo sapien
tcaatcagggcacgatctgtctcca

SEQ ID NO: 95682 - DNA, 25 bp, Homo sapien
tcaatcagggcaggatctgtctcca

SEQ ID NO: 95683 - DNA, 25 bp, Homo sapien
tcaatcaggtatccttagaaccaat

SEQ ID NO: 95684 - DNA, 25 bp, Homo sapien
tcaatcataatcaaaaagcatcatc

SEQ ID NO: 95685 - DNA, 25 bp, Homo sapien
tcaatcataatccaaaagcatcatc

SEQ ID NO: 95686 - DNA, 25 bp, Homo sapien
tcaatcattttctcaccatattgct

SEQ ID NO: 95687 - DNA, 25 bp, Homo sapien
tcaatcattttctcactatattgct

SEQ ID NO: 95688 - DNA, 25 bp, Homo sapien
tcaatcctaaaatttaataaggcaa

SEQ ID NO: 95689 - DNA, 25 bp, Homo sapien
tcaatcctaaaatttagtaaggcaa

SEQ ID NO: 95690 - DNA, 25 bp, Homo sapien
tcaatcctctctcaaaaaaaatcaa

SEQ ID NO: 95691 - DNA, 25 bp, Homo sapien
tcaatcctctcttaaaaaaaatcaa

SEQ ID NO: 95692 - DNA, 25 bp, Homo sapien
tcaatcctgcttctttttctgtgtt

SEQ ID NO: 95693 - DNA, 25 bp, Homo sapien
tcaatcctgcttttttttctgtgtt

SEQ ID NO: 95694 - DNA, 25 bp, Homo sapien
tcaatctccatacaaatgagaactg

SEQ ID NO: 95695 - DNA, 25 bp, Homo sapien
tcaatctctatacaaatgagaactg

SEQ ID NO: 95696 - DNA, 25 bp, Homo sapien
tcaatctgctccacacaatttctca

SEQ ID NO: 95697 - DNA, 25 bp, Homo sapien
tcaatctgctccacgcaatttctca

SEQ ID NO: 95698 - DNA, 25 bp, Homo sapien
tcaatcttcaaatgagtctgatgaa

SEQ ID NO: 95699 - DNA, 25 bp, Homo sapien
tcaatctttaaatgagtctgatgaa

SEQ ID NO: 95700 - DNA, 25 bp, Homo sapien
tcaatctttgcactcagggttgaaa

SEQ ID NO: 95701 - DNA, 25 bp, Homo sapien
tcaatctttgcgctcagggttgaaa

SEQ ID NO: 95702 - DNA, 25 bp, Homo sapien
tcaatgaaaccaaagtctttgacag

SEQ ID NO: 95703 - DNA, 25 bp, Homo sapien
tcaatgaaattcagaagatgtaaga

SEQ ID NO: 95704 - DNA, 25 bp, Homo sapien
tcaatgaaattcggaagatgtaaga

SEQ ID NO: 95705 - DNA, 25 bp, Homo sapien
tcaatgaacatttattatctctggg

SEQ ID NO: 95706 - DNA, 25 bp, Homo sapien
tcaatgaacatttattctctctggg

SEQ ID NO: 95707 - DNA, 25 bp, Homo sapien
tcaatgaacttgacctttagtgcaa

SEQ ID NO: 95708 - DNA, 25 bp, Homo sapien
tcaatgaagccaaagtctttgacag

SEQ ID NO: 95709 - DNA, 25 bp, Homo sapien
tcaatgaagttgacctttagtgcaa

SEQ ID NO: 95710 - DNA, 25 bp, Homo sapien
tcaatgaagtttatgtaatattcta

SEQ ID NO: 95711 - DNA, 25 bp, Homo sapien
tcaatgaattttatgtaatattcta

SEQ ID NO: 95712 - DNA, 25 bp, Homo sapien
tcaatgacaacactcactcaatggg

SEQ ID NO: 95713 - DNA, 25 bp, Homo sapien
tcaatgacaacattcactcaatggg

SEQ ID NO: 95714 - DNA, 25 bp, Homo sapien
tcaatgacaagggagcaaagatggg

SEQ ID NO: 95715 - DNA, 25 bp, Homo sapien
tcaatgacaagggagcgaagatggg

SEQ ID NO: 95716 - DNA, 25 bp, Homo sapien
tcaatgacataatattcccattcat

SEQ ID NO: 95717 - DNA, 25 bp, Homo sapien
tcaatgacatagtattcccattcat

SEQ ID NO: 95718 - DNA, 25 bp, Homo sapien
tcaatgaccatgagagaatgccagc

SEQ ID NO: 95719 - DNA, 25 bp, Homo sapien
tcaatgactaacgaaaaaactacca

SEQ ID NO: 95720 - DNA, 25 bp, Homo sapien
tcaatgactaatgaaaaaactacca

SEQ ID NO: 95721 - DNA, 25 bp, Homo sapien
tcaatgactatgagagaatgccagc

SEQ ID NO: 95722 - DNA, 25 bp, Homo sapien
tcaatgcaacagaattcagtccaga

SEQ ID NO: 95723 - DNA, 25 bp, Homo sapien
tcaatgcaacataattcagtccaga

SEQ ID NO: 95724 - DNA, 25 bp, Homo sapien
tcaatgcctcagctgcaataaaaaa

SEQ ID NO: 95725 - DNA, 25 bp, Homo sapien
tcaatgcctcagctgcgataaaaaa

SEQ ID NO: 95726 - DNA, 25 bp, Homo sapien
tcaatgcggaaaacgctgccaagac

SEQ ID NO: 95727 - DNA, 25 bp, Homo sapien
tcaatgcggaaaatgctgccaagac

SEQ ID NO: 95728 - DNA, 25 bp, Homo sapien
tcaatggatgtcaactttttctgct

SEQ ID NO: 95729 - DNA, 25 bp, Homo sapien
tcaatggatgttaactttttctgct

SEQ ID NO: 95730 - DNA, 25 bp, Homo sapien
tcaatgggatcaatcaagaacctta

SEQ ID NO: 95731 - DNA, 25 bp, Homo sapien
tcaatgggatcagtcaagaacctta

SEQ ID NO: 95732 - DNA, 25 bp, Homo sapien
tcaatggtaagatgttggactaagt

SEQ ID NO: 95733 - DNA, 25 bp, Homo sapien
tcaatggtaagattttggactaagt

SEQ ID NO: 95734 - DNA, 25 bp, Homo sapien
tcaatgtcagttacgacttatggat

SEQ ID NO: 95735 - DNA, 25 bp, Homo sapien
tcaatgtcagttaggacttatggat

SEQ ID NO: 95736 - DNA, 25 bp, Homo sapien
tcaatgtctccatgtttctttttgt

SEQ ID NO: 95737 - DNA, 25 bp, Homo sapien
tcaatgtctccatttttctttttgt

SEQ ID NO: 95738 - DNA, 25 bp, Homo sapien
tcaatgtttatcagcaatattggcc

SEQ ID NO: 95739 - DNA, 25 bp, Homo sapien
tcaatgtttatcaggaatattggcc

SEQ ID NO: 95740 - DNA, 25 bp, Homo sapien
tcaattaatgtaaactaccaaatca

SEQ ID NO: 95741 - DNA, 25 bp, Homo sapien
tcaattaatgtaatctaccaaatca

SEQ ID NO: 95742 - DNA, 25 bp, Homo sapien
tcaattacaccaactccatctgttt

SEQ ID NO: 95743 - DNA, 25 bp, Homo sapien
tcaattacaccgactccatctgttt

SEQ ID NO: 95744 - DNA, 25 bp, Homo sapien
tcaattacagccgtgtaagacattt

SEQ ID NO: 95745 - DNA, 25 bp, Homo sapien
tcaattacagccgtttaagacattt

SEQ ID NO: 95746 - DNA, 25 bp, Homo sapien
tcaattactagcattacgcattttg

SEQ ID NO: 95747 - DNA, 25 bp, Homo sapien
tcaattactagcattatgcattttg

SEQ ID NO: 95748 - DNA, 25 bp, Homo sapien
tcaattataacccaacctactaatc

SEQ ID NO: 95749 - DNA, 25 bp, Homo sapien
tcaattataactcaacctactaatc

SEQ ID NO: 95750 - DNA, 25 bp, Homo sapien
tcaattatagaagcagcttattgaa

SEQ ID NO: 95751 - DNA, 25 bp, Homo sapien
tcaattatagaagcaggttattgaa

SEQ ID NO: 95752 - DNA, 25 bp, Homo sapien
tcaattcatgcttcgttgaatccac

SEQ ID NO: 95753 - DNA, 25 bp, Homo sapien
tcaattcatgcttggttgaatccac

SEQ ID NO: 95754 - DNA, 25 bp, Homo sapien
tcaattccacgaaaaaaatatgcta

SEQ ID NO: 95755 - DNA, 25 bp, Homo sapien
tcaattccatgaaaaaaatatgcta

SEQ ID NO: 95756 - DNA, 25 bp, Homo sapien
tcaattcgacggttagttattcagc

SEQ ID NO: 95757 - DNA, 25 bp, Homo sapien
tcaattcgatggttagttattcagc

SEQ ID NO: 95758 - DNA, 25 bp, Homo sapien
tcaattgaaattcgcttccggtgcc

SEQ ID NO: 95759 - DNA, 25 bp, Homo sapien
tcaattgaaattcggttccggtgcc

SEQ ID NO: 95760 - DNA, 25 bp, Homo sapien
tcaattgaatgaaggctttgtggaa

SEQ ID NO: 95761 - DNA, 25 bp, Homo sapien
tcaattgaatgatggctttgtggaa

SEQ ID NO: 95762 - DNA, 25 bp, Homo sapien
tcaattgacgtctcaggatagctct

SEQ ID NO: 95763 - DNA, 25 bp, Homo sapien
tcaattgatgtctcaggatagctct

SEQ ID NO: 95764 - DNA, 25 bp, Homo sapien
tcaattgcagagacaaccaccaata

SEQ ID NO: 95765 - DNA, 25 bp, Homo sapien
tcaattgcagagacaatcaccaata

SEQ ID NO: 95766 - DNA, 25 bp, Homo sapien
tcaattgggccagaagaaagttcta

SEQ ID NO: 95767 - DNA, 25 bp, Homo sapien
tcaattgggccagaaggaagttcta

SEQ ID NO: 95768 - DNA, 25 bp, Homo sapien
tcaatttcaagccacctgccaaatt

SEQ ID NO: 95769 - DNA, 25 bp, Homo sapien
tcaatttccagccacctgccaaatt

SEQ ID NO: 95770 - DNA, 25 bp, Homo sapien
tcaatttccatatgaagatgctgta

SEQ ID NO: 95771 - DNA, 25 bp, Homo sapien
tcaatttccatttttctactatgca

SEQ ID NO: 95772 - DNA, 25 bp, Homo sapien
tcaatttcccttggcagtaaatttt

SEQ ID NO: 95773 - DNA, 25 bp, Homo sapien
tcaatttccgtttttctactatgca

SEQ ID NO: 95774 - DNA, 25 bp, Homo sapien
tcaatttccttatgaagatgctgta

SEQ ID NO: 95775 - DNA, 25 bp, Homo sapien
tcaatttcctttggcagtaaatttt

SEQ ID NO: 95776 - DNA, 25 bp, Homo sapien
tcaatttctgtggtttgtaagccac

SEQ ID NO: 95777 - DNA, 25 bp, Homo sapien
tcaatttctgttgtttgtaagccac

SEQ ID NO: 95778 - DNA, 25 bp, Homo sapien
tcaatttggctgttgttctccagaa

SEQ ID NO: 95779 - DNA, 25 bp, Homo sapien
tcaatttggctgtttttctccagaa

SEQ ID NO: 95780 - DNA, 25 bp, Homo sapien
tcaattttttaaagacatgttcaat

SEQ ID NO: 95781 - DNA, 25 bp, Homo sapien
tcaattttttaaggacatgttcaat

SEQ ID NO: 95782 - DNA, 25 bp, Homo sapien
tcaatttttttcgttttaatccatg

SEQ ID NO: 95783 - DNA, 25 bp, Homo sapien
tcaatttttttctttttaatccatg

SEQ ID NO: 95784 - DNA, 25 bp, Homo sapien
tcacaaaaccacagacacatttcac

SEQ ID NO: 95785 - DNA, 25 bp, Homo sapien
tcacaaaaccacggacacatttcac

SEQ ID NO: 95786 - DNA, 25 bp, Homo sapien
tcacaaaatggcacatcccgcccca

SEQ ID NO: 95787 - DNA, 25 bp, Homo sapien
tcacaaaatggctcatcccgcccca

SEQ ID NO: 95788 - DNA, 25 bp, Homo sapien
tcacaaacaaaagaaattcaaaact

SEQ ID NO: 95789 - DNA, 25 bp, Homo sapien
tcacaaacaaaataaattcaaaact

SEQ ID NO: 95790 - DNA, 25 bp, Homo sapien
tcacaaagatggaatgaatatggtt

SEQ ID NO: 95791 - DNA, 25 bp, Homo sapien
tcacaaagatggaatggatatggtt

SEQ ID NO: 95792 - DNA, 25 bp, Homo sapien
tcacaaatcaattaaccattaatgt

SEQ ID NO: 95793 - DNA, 25 bp, Homo sapien
tcacaaatcaatttaccattaatgt

SEQ ID NO: 95794 - DNA, 25 bp, Homo sapien
tcacaaattgccatctgaaaaacta

SEQ ID NO: 95795 - DNA, 25 bp, Homo sapien
tcacaaattgccatcttaaaaacta

SEQ ID NO: 95796 - DNA, 25 bp, Homo sapien
tcacaacatccaaacaggtgagcaa

SEQ ID NO: 95797 - DNA, 25 bp, Homo sapien
tcacaacatccatacaggtgagcaa

SEQ ID NO: 95798 - DNA, 25 bp, Homo sapien
tcacaacattcatctcctctgagtc

SEQ ID NO: 95799 - DNA, 25 bp, Homo sapien
tcacaacattcatgtcctctgagtc

SEQ ID NO: 95800 - DNA, 25 bp, Homo sapien
tcacaactgctgacgatcacgagat

SEQ ID NO: 95801 - DNA, 25 bp, Homo sapien
tcacaactgctgatgatcacgagat

SEQ ID NO: 95802 - DNA, 25 bp, Homo sapien
tcacaactggtgataccgtttgacc

SEQ ID NO: 95803 - DNA, 25 bp, Homo sapien
tcacaactggtgatactgtttgacc

SEQ ID NO: 95804 - DNA, 25 bp, Homo sapien
tcacaagacctatcgcaagccctca

SEQ ID NO: 95805 - DNA, 25 bp, Homo sapien
tcacaagacctattgcaagccctca

SEQ ID NO: 95806 - DNA, 25 bp, Homo sapien
tcacaaggagtacacacattggctt

SEQ ID NO: 95807 - DNA, 25 bp, Homo sapien
tcacaaggattacacacattggctt

SEQ ID NO: 95808 - DNA, 25 bp, Homo sapien
tcacaaggcacatagtatcctcagc

SEQ ID NO: 95809 - DNA, 25 bp, Homo sapien
tcacaaggcacatggtatcctcagc

SEQ ID NO: 95810 - DNA, 25 bp, Homo sapien
tcacaagttgaaattgaataaccac

SEQ ID NO: 95811 - DNA, 25 bp, Homo sapien
tcacaagttgaagttgaataaccac

SEQ ID NO: 95812 - DNA, 25 bp, Homo sapien
tcacaagtttccaagtggtgctgat

SEQ ID NO: 95813 - DNA, 25 bp, Homo sapien
tcacaagtttcccagtggtgctgat

SEQ ID NO: 95814 - DNA, 25 bp, Homo sapien
tcacaagttttgcaatttcctgttc

SEQ ID NO: 95815 - DNA, 25 bp, Homo sapien
tcacaagttttgcattttcctgttc

SEQ ID NO: 95816 - DNA, 25 bp, Homo sapien
tcacaataacatcggtatgacacag

SEQ ID NO: 95817 - DNA, 25 bp, Homo sapien
tcacaataacattggtatgacacag

SEQ ID NO: 95818 - DNA, 25 bp, Homo sapien
tcacaatacaacattccctttggat

SEQ ID NO: 95819 - DNA, 25 bp, Homo sapien
tcacaatacgacattccctttggat

SEQ ID NO: 95820 - DNA, 25 bp, Homo sapien
tcacaataggacactcagctaatga

SEQ ID NO: 95821 - DNA, 25 bp, Homo sapien
tcacaataggacgctcagctaatga

SEQ ID NO: 95822 - DNA, 25 bp, Homo sapien
tcacaatgaaggttcggattgtggc

SEQ ID NO: 95823 - DNA, 25 bp, Homo sapien
tcacaatgaaggtttggattgtggc

SEQ ID NO: 95824 - DNA, 25 bp, Homo sapien
tcacaatgaatacgacagcgacaac

SEQ ID NO: 95825 - DNA, 25 bp, Homo sapien
tcacaatgaatacgacggcgacaac

SEQ ID NO: 95826 - DNA, 25 bp, Homo sapien
tcacaattccagcacgtctcaattc

SEQ ID NO: 95827 - DNA, 25 bp, Homo sapien
tcacaattccagcatgtctcaattc

SEQ ID NO: 95828 - DNA, 25 bp, Homo sapien
tcacaattgaggaatggaggaactg

SEQ ID NO: 95829 - DNA, 25 bp, Homo sapien
tcacaattgaggactggaggaactg

SEQ ID NO: 95830 - DNA, 25 bp, Homo sapien
tcacacaaatctaaattttattact

SEQ ID NO: 95831 - DNA, 25 bp, Homo sapien
tcacacaaattcatctttgcctatc

SEQ ID NO: 95832 - DNA, 25 bp, Homo sapien
tcacacaactcatagtatgtctaca

SEQ ID NO: 95833 - DNA, 25 bp, Homo sapien
tcacacaactcatcgtatgtctaca

SEQ ID NO: 95834 - DNA, 25 bp, Homo sapien
tcacacaagtctaaattttattact

SEQ ID NO: 95835 - DNA, 25 bp, Homo sapien
tcacacaagttcatctttgcctatc

SEQ ID NO: 95836 - DNA, 25 bp, Homo sapien
tcacacacaaattacacgaagagtg

SEQ ID NO: 95837 - DNA, 25 bp, Homo sapien
tcacacacaaattacatgaagagtg

SEQ ID NO: 95838 - DNA, 25 bp, Homo sapien
tcacacaggccaactcctccattgt

SEQ ID NO: 95839 - DNA, 25 bp, Homo sapien
tcacacaggccatctcctccattgt

SEQ ID NO: 95840 - DNA, 25 bp, Homo sapien
tcacacagtttcttctctgtgcatg

SEQ ID NO: 95841 - DNA, 25 bp, Homo sapien
tcacacagtttcttctttgtgcatg

SEQ ID NO: 95842 - DNA, 25 bp, Homo sapien
tcacacatacgtagttcacaataga

SEQ ID NO: 95843 - DNA, 25 bp, Homo sapien
tcacacatatgtagttcacaataga

SEQ ID NO: 95844 - DNA, 25 bp, Homo sapien
tcacacatcggtattcaaattctta

SEQ ID NO: 95845 - DNA, 25 bp, Homo sapien
tcacacatctgtattcaaattctta

SEQ ID NO: 95846 - DNA, 25 bp, Homo sapien
tcacacattgacggacattcaggtt

SEQ ID NO: 95847 - DNA, 25 bp, Homo sapien
tcacacattgatggacattcaggtt

SEQ ID NO: 95848 - DNA, 25 bp, Homo sapien
tcacaccaagaacgaaagggacgat

SEQ ID NO: 95849 - DNA, 25 bp, Homo sapien
tcacaccaagaatgaaagggacgat

SEQ ID NO: 95850 - DNA, 25 bp, Homo sapien
tcacaccataaaatgatacattcta

SEQ ID NO: 95851 - DNA, 25 bp, Homo sapien
tcacaccataagatgatacattcta

SEQ ID NO: 95852 - DNA, 25 bp, Homo sapien
tcacaccgaagaagcctggagtaaa

SEQ ID NO: 95853 - DNA, 25 bp, Homo sapien
tcacaccgaagaaggctggagtaaa

SEQ ID NO: 95854 - DNA, 25 bp, Homo sapien
tcacacctataggaactagaaaatc

SEQ ID NO: 95855 - DNA, 25 bp, Homo sapien
tcacacctataggagctagaaaatc

SEQ ID NO: 95856 - DNA, 25 bp, Homo sapien
tcacacctgatgtcagcatgtctca

SEQ ID NO: 95857 - DNA, 25 bp, Homo sapien
tcacacctgatgtccgcatgtctca

SEQ ID NO: 95858 - DNA, 25 bp, Homo sapien
tcacacgtttctcccgtgctcactc

SEQ ID NO: 95859 - DNA, 25 bp, Homo sapien
tcacacgtttctcctgtgctcactc

SEQ ID NO: 95860 - DNA, 25 bp, Homo sapien
tcacactagccatttccacaactgg

SEQ ID NO: 95861 - DNA, 25 bp, Homo sapien
tcacactagtcatttccacaactgg

SEQ ID NO: 95862 - DNA, 25 bp, Homo sapien
tcacactagttattggactatctgc

SEQ ID NO: 95863 - DNA, 25 bp, Homo sapien
tcacactatttattggactatctgc

SEQ ID NO: 95864 - DNA, 25 bp, Homo sapien
tcacactcccacgtccattcagcag

SEQ ID NO: 95865 - DNA, 25 bp, Homo sapien
tcacactcccacttccattcagcag

SEQ ID NO: 95866 - DNA, 25 bp, Homo sapien
tcacactgacagcaatacatttccc

SEQ ID NO: 95867 - DNA, 25 bp, Homo sapien
tcacactgacagcaatgcatttccc

SEQ ID NO: 95868 - DNA, 25 bp, Homo sapien
tcacactgtctcgactaatgtacct

SEQ ID NO: 95869 - DNA, 25 bp, Homo sapien
tcacactgtcttgactaatgtacct

SEQ ID NO: 95870 - DNA, 25 bp, Homo sapien
tcacacttccggacagcaaatgggg

SEQ ID NO: 95871 - DNA, 25 bp, Homo sapien
tcacacttctggacagcaaatgggg

SEQ ID NO: 95872 - DNA, 25 bp, Homo sapien
tcacacttgtcacgtcacaatgttc

SEQ ID NO: 95873 - DNA, 25 bp, Homo sapien
tcacacttgtcatgtcacaatgttc

SEQ ID NO: 95874 - DNA, 25 bp, Homo sapien
tcacagaagatctgagaagacccta

SEQ ID NO: 95875 - DNA, 25 bp, Homo sapien
tcacagaatatctgagaagacccta

SEQ ID NO: 95876 - DNA, 25 bp, Homo sapien
tcacagaattagtccacacaggtag

SEQ ID NO: 95877 - DNA, 25 bp, Homo sapien
tcacagaattagtccagacaggtag

SEQ ID NO: 95878 - DNA, 25 bp, Homo sapien
tcacagaatttacactggagcctaa

SEQ ID NO: 95879 - DNA, 25 bp, Homo sapien
tcacagaatttacattggagcctaa

SEQ ID NO: 95880 - DNA, 25 bp, Homo sapien
tcacagaccgcagtgaaagaaaaat

SEQ ID NO: 95881 - DNA, 25 bp, Homo sapien
tcacagacctcagtgaaagaaaaat

SEQ ID NO: 95882 - DNA, 25 bp, Homo sapien
tcacagagagagcacggactgtgaa

SEQ ID NO: 95883 - DNA, 25 bp, Homo sapien
tcacagagagagtacggactgtgaa

SEQ ID NO: 95884 - DNA, 25 bp, Homo sapien
tcacagagtgagtgttgctccagct

SEQ ID NO: 95885 - DNA, 25 bp, Homo sapien
tcacagagtgagtgtttctccagct

SEQ ID NO: 95886 - DNA, 25 bp, Homo sapien
tcacagatcctaccacaacagtgtt

SEQ ID NO: 95887 - DNA, 25 bp, Homo sapien
tcacagattctaccacaacagtgtt

SEQ ID NO: 95888 - DNA, 25 bp, Homo sapien
tcacagattgtggagtccaattgcc

SEQ ID NO: 95889 - DNA, 25 bp, Homo sapien
tcacagatttacaacactgtattat

SEQ ID NO: 95890 - DNA, 25 bp, Homo sapien
tcacagatttaccacactgtattat

SEQ ID NO: 95891 - DNA, 25 bp, Homo sapien
tcacagattttggagtccaattgcc

SEQ ID NO: 95892 - DNA, 25 bp, Homo sapien
tcacagctaattgactagtgactaa

SEQ ID NO: 95893 - DNA, 25 bp, Homo sapien
tcacagctaatttactagtgactaa

SEQ ID NO: 95894 - DNA, 25 bp, Homo sapien
tcacagctccttgcatcccatctct

SEQ ID NO: 95895 - DNA, 25 bp, Homo sapien
tcacagcttcttgcatcccatctct

SEQ ID NO: 95896 - DNA, 25 bp, Homo sapien
tcacaggaaccacggcctcagcaca

SEQ ID NO: 95897 - DNA, 25 bp, Homo sapien
tcacaggaaccatggcctcagcaca

SEQ ID NO: 95898 - DNA, 25 bp, Homo sapien
tcacaggaagcagcgtgtgtgcctt

SEQ ID NO: 95899 - DNA, 25 bp, Homo sapien
tcacaggaagcagggtgtgtgcctt

SEQ ID NO: 95900 - DNA, 25 bp, Homo sapien
tcacaggaaggcatactacagtgga

SEQ ID NO: 95901 - DNA, 25 bp, Homo sapien
tcacaggacaaaacttgaaatgagg

SEQ ID NO: 95902 - DNA, 25 bp, Homo sapien
tcacaggacaaaccttgaaatgagg

SEQ ID NO: 95903 - DNA, 25 bp, Homo sapien
tcacaggacgtcaaggctattatat

SEQ ID NO: 95904 - DNA, 25 bp, Homo sapien
tcacaggagggcatactacagtgga

SEQ ID NO: 95905 - DNA, 25 bp, Homo sapien
tcacaggatgtcaaggctattatat

SEQ ID NO: 95906 - DNA, 25 bp, Homo sapien
tcacaggcatcacagataggaagat

SEQ ID NO: 95907 - DNA, 25 bp, Homo sapien
tcacaggcatctcagataggaagat

SEQ ID NO: 95908 - DNA, 25 bp, Homo sapien
tcacagggtccctataagagaagac

SEQ ID NO: 95909 - DNA, 25 bp, Homo sapien
tcacagggttcctataagagaagac

SEQ ID NO: 95910 - DNA, 25 bp, Homo sapien
tcacaggtccctctgacaaactggt

SEQ ID NO: 95911 - DNA, 25 bp, Homo sapien
tcacaggtccctttgacaaactggt

SEQ ID NO: 95912 - DNA, 25 bp, Homo sapien
tcacagtatagacgctggagccaga

SEQ ID NO: 95913 - DNA, 25 bp, Homo sapien
tcacagtatagatgctggagccaga

SEQ ID NO: 95914 - DNA, 25 bp, Homo sapien
tcacagtcgaattgttcataataga

SEQ ID NO: 95915 - DNA, 25 bp, Homo sapien
tcacagtcggaaactctaagatctc

SEQ ID NO: 95916 - DNA, 25 bp, Homo sapien
tcacagtctaattgttcataataga

SEQ ID NO: 95917 - DNA, 25 bp, Homo sapien
tcacagtctgaaactctaagatctc

SEQ ID NO: 95918 - DNA, 25 bp, Homo sapien
tcacagtgagttacatgacctggta

SEQ ID NO: 95919 - DNA, 25 bp, Homo sapien
tcacagtgagttatatgacctggta

SEQ ID NO: 95920 - DNA, 25 bp, Homo sapien
tcacagttacaggagctagaggttt

SEQ ID NO: 95921 - DNA, 25 bp, Homo sapien
tcacagttataggagctagaggttt

SEQ ID NO: 95922 - DNA, 25 bp, Homo sapien
tcacagttatttttcaagtactttt

SEQ ID NO: 95923 - DNA, 25 bp, Homo sapien
tcacagttattttttaagtactttt

SEQ ID NO: 95924 - DNA, 25 bp, Homo sapien
tcacagtttagcctagcctacctta

SEQ ID NO: 95925 - DNA, 25 bp, Homo sapien
tcacagtttagtctagcctacctta

SEQ ID NO: 95926 - DNA, 25 bp, Homo sapien
tcacagtttgcttcaaggtctacaa

SEQ ID NO: 95927 - DNA, 25 bp, Homo sapien
tcacagtttgctttaaggtctacaa

SEQ ID NO: 95928 - DNA, 25 bp, Homo sapien
tcacagtttttatctatctgaagtt

SEQ ID NO: 95929 - DNA, 25 bp, Homo sapien
tcacagtttttgtctatctgaagtt

SEQ ID NO: 95930 - DNA, 25 bp, Homo sapien
tcacataaaagcacacgagaccatt

SEQ ID NO: 95931 - DNA, 25 bp, Homo sapien
tcacataaaagtacacgagaccatt

SEQ ID NO: 95932 - DNA, 25 bp, Homo sapien
tcacataaaccaaaacttacacatt

SEQ ID NO: 95933 - DNA, 25 bp, Homo sapien
tcacataatccaaaacttacacatt

SEQ ID NO: 95934 - DNA, 25 bp, Homo sapien
tcacataatgatgacagaattaagt

SEQ ID NO: 95935 - DNA, 25 bp, Homo sapien
tcacataatgatgatagaattaagt

SEQ ID NO: 95936 - DNA, 25 bp, Homo sapien
tcacataattactaaaaactgtggc

SEQ ID NO: 95937 - DNA, 25 bp, Homo sapien
tcacataattactgaaaactgtggc

SEQ ID NO: 95938 - DNA, 25 bp, Homo sapien
tcacatacatgccataagtccctga

SEQ ID NO: 95939 - DNA, 25 bp, Homo sapien
tcacatacgtgccataagtccctga

SEQ ID NO: 95940 - DNA, 25 bp, Homo sapien
tcacatagactttcatgtaacggaa

SEQ ID NO: 95941 - DNA, 25 bp, Homo sapien
tcacatagactttcatttaacggaa

SEQ ID NO: 95942 - DNA, 25 bp, Homo sapien
tcacatatgagagcccaataactgt

SEQ ID NO: 95943 - DNA, 25 bp, Homo sapien
tcacatatgagagcccgataactgt

SEQ ID NO: 95944 - DNA, 25 bp, Homo sapien
tcacatcagagccacgctaggaaat

SEQ ID NO: 95945 - DNA, 25 bp, Homo sapien
tcacatcagagccatgctaggaaat

SEQ ID NO: 95946 - DNA, 25 bp, Homo sapien
tcacatcagtagaaagagcgctgga

SEQ ID NO: 95947 - DNA, 25 bp, Homo sapien
tcacatcagtataaagagcgctgga

SEQ ID NO: 95948 - DNA, 25 bp, Homo sapien
tcacatccagaggttaattaagcca

SEQ ID NO: 95949 - DNA, 25 bp, Homo sapien
tcacatccataggttaattaagcca

SEQ ID NO: 95950 - DNA, 25 bp, Homo sapien
tcacatcctaaaaacggtactggtg

SEQ ID NO: 95951 - DNA, 25 bp, Homo sapien
tcacatcctgaaaacggtactggtg

SEQ ID NO: 95952 - DNA, 25 bp, Homo sapien
tcacatgaactaaaaagcattacag

SEQ ID NO: 95953 - DNA, 25 bp, Homo sapien
tcacatgaactgaaaagcattacag

SEQ ID NO: 95954 - DNA, 25 bp, Homo sapien
tcacatgacacagattctaaaccct

SEQ ID NO: 95955 - DNA, 25 bp, Homo sapien
tcacatgacacagtttctaaaccct

SEQ ID NO: 95956 - DNA, 25 bp, Homo sapien
tcacatgcaaggatggctcttgaag

SEQ ID NO: 95957 - DNA, 25 bp, Homo sapien
tcacatgcagggatggctcttgaag

SEQ ID NO: 95958 - DNA, 25 bp, Homo sapien
tcacatggtactgatgataaaaaaa

SEQ ID NO: 95959 - DNA, 25 bp, Homo sapien
tcacatggtactgatgttaaaaaaa

SEQ ID NO: 95960 - DNA, 25 bp, Homo sapien
tcacatggtctttccttggtgtgtg

SEQ ID NO: 95961 - DNA, 25 bp, Homo sapien
tcacatggtcttttcttggtgtgtg

SEQ ID NO: 95962 - DNA, 25 bp, Homo sapien
tcacattatatacatgacacattcc

SEQ ID NO: 95963 - DNA, 25 bp, Homo sapien
tcacattatgaggtccaaaaattgg

SEQ ID NO: 95964 - DNA, 25 bp, Homo sapien
tcacattatgaggttcaaaaattgg

SEQ ID NO: 95965 - DNA, 25 bp, Homo sapien
tcacattatgtacatgacacattcc

SEQ ID NO: 95966 - DNA, 25 bp, Homo sapien
tcacattcagattgttggtaagagg

SEQ ID NO: 95967 - DNA, 25 bp, Homo sapien
tcacattcagattgtttgtaagagg

SEQ ID NO: 95968 - DNA, 25 bp, Homo sapien
tcacattcatcacagtaatgacaat

SEQ ID NO: 95969 - DNA, 25 bp, Homo sapien
tcacattcatcacggtaatgacaat

SEQ ID NO: 95970 - DNA, 25 bp, Homo sapien
tcacattccaacatatattagtctg

SEQ ID NO: 95971 - DNA, 25 bp, Homo sapien
tcacattccaacatgtattagtctg

SEQ ID NO: 95972 - DNA, 25 bp, Homo sapien
tcacattgatgatcaactgattttt

SEQ ID NO: 95973 - DNA, 25 bp, Homo sapien
tcacattgatgatcaattgattttt

SEQ ID NO: 95974 - DNA, 25 bp, Homo sapien
tcacattgtcctccttggttacatc

SEQ ID NO: 95975 - DNA, 25 bp, Homo sapien
tcacattgttctccttggttacatc

SEQ ID NO: 95976 - DNA, 25 bp, Homo sapien
tcacatttagttgcgttgaactcaa

SEQ ID NO: 95977 - DNA, 25 bp, Homo sapien
tcacatttagttgggttgaactcaa

SEQ ID NO: 95978 - DNA, 25 bp, Homo sapien
tcacatttcatcggcaggcactcag

SEQ ID NO: 95979 - DNA, 25 bp, Homo sapien
tcacatttcatctgcaggcactcag

SEQ ID NO: 95980 - DNA, 25 bp, Homo sapien
tcacatttcctcatagtttcaccac

SEQ ID NO: 95981 - DNA, 25 bp, Homo sapien
tcacatttccttatagtttcaccac

SEQ ID NO: 95982 - DNA, 25 bp, Homo sapien
tcacatttttcacatttgattttgc

SEQ ID NO: 95983 - DNA, 25 bp, Homo sapien
tcacatttttcagatttgattttgc

SEQ ID NO: 95984 - DNA, 25 bp, Homo sapien
tcacattttttccgacctcaaacct

SEQ ID NO: 95985 - DNA, 25 bp, Homo sapien
tcacattttttctgacctcaaacct

SEQ ID NO: 95986 - DNA, 25 bp, Homo sapien
tcaccaaaagcgttgtctgtaaatc

SEQ ID NO: 95987 - DNA, 25 bp, Homo sapien
tcaccaaaagctttgtctgtaaatc

SEQ ID NO: 95988 - DNA, 25 bp, Homo sapien
tcaccaaacatactaaatgaggtac

SEQ ID NO: 95989 - DNA, 25 bp, Homo sapien
tcaccaaacgtactaaatgaggtac

SEQ ID NO: 95990 - DNA, 25 bp, Homo sapien
tcaccaacacgtttgccctgtatga

SEQ ID NO: 95991 - DNA, 25 bp, Homo sapien
tcaccaacccgtttgccctgtatga

SEQ ID NO: 95992 - DNA, 25 bp, Homo sapien
tcaccaagagtcaactatagatctt

SEQ ID NO: 95993 - DNA, 25 bp, Homo sapien
tcaccaagagtcgactatagatctt

SEQ ID NO: 95994 - DNA, 25 bp, Homo sapien
tcaccaatggccactaaaatcatca

SEQ ID NO: 95995 - DNA, 25 bp, Homo sapien
tcaccaatggctactaaaatcatca

SEQ ID NO: 95996 - DNA, 25 bp, Homo sapien
tcaccaatggttgccagcatacact

SEQ ID NO: 95997 - DNA, 25 bp, Homo sapien
tcaccaatggttgtcagcatacact

SEQ ID NO: 95998 - DNA, 25 bp, Homo sapien
tcaccacaacaatttttcccttcga

SEQ ID NO: 95999 - DNA, 25 bp, Homo sapien
tcaccacagcaatttttcccttcga

SEQ ID NO: 96000 - DNA, 25 bp, Homo sapien
tcaccactcgaaaaacaaactcaag

SEQ ID NO: 96001 - DNA, 25 bp, Homo sapien
tcaccactggcttaagaaactcccg

SEQ ID NO: 96002 - DNA, 25 bp, Homo sapien
tcaccactggcttaggaaactcccg

SEQ ID NO: 96003 - DNA, 25 bp, Homo sapien
tcaccactgtcacttgtactcacac

SEQ ID NO: 96004 - DNA, 25 bp, Homo sapien
tcaccactgtcatttgtactcacac

SEQ ID NO: 96005 - DNA, 25 bp, Homo sapien
tcaccacttgaaaaacaaactcaag

SEQ ID NO: 96006 - DNA, 25 bp, Homo sapien
tcaccagagtggaccacaaaaataa

SEQ ID NO: 96007 - DNA, 25 bp, Homo sapien
tcaccagagtggaccagaaaaataa

SEQ ID NO: 96008 - DNA, 25 bp, Homo sapien
tcaccagcagaacgaagaaaaaata

SEQ ID NO: 96009 - DNA, 25 bp, Homo sapien
tcaccagcagaatgaagaaaaaata

SEQ ID NO: 96010 - DNA, 25 bp, Homo sapien
tcaccagctagtttcacctataccc

SEQ ID NO: 96011 - DNA, 25 bp, Homo sapien
tcaccagctagttttacctataccc

SEQ ID NO: 96012 - DNA, 25 bp, Homo sapien
tcaccagcttaggcggctatagagt

SEQ ID NO: 96013 - DNA, 25 bp, Homo sapien
tcaccagcttaggtggctatagagt

SEQ ID NO: 96014 - DNA, 25 bp, Homo sapien
tcaccaggaataagttgtgtaaggc

SEQ ID NO: 96015 - DNA, 25 bp, Homo sapien
tcaccaggagtaagttgtgtaaggc

SEQ ID NO: 96016 - DNA, 25 bp, Homo sapien
tcaccaggggaatttctgaaaccag

SEQ ID NO: 96017 - DNA, 25 bp, Homo sapien
tcaccaggggagtttctgaaaccag

SEQ ID NO: 96018 - DNA, 25 bp, Homo sapien
tcaccagtaatatctaaactatgca

SEQ ID NO: 96019 - DNA, 25 bp, Homo sapien
tcaccagtaatatttaaactatgca

SEQ ID NO: 96020 - DNA, 25 bp, Homo sapien
tcaccagttaccagagctgcaaatt

SEQ ID NO: 96021 - DNA, 25 bp, Homo sapien
tcaccagttgccagagctgcaaatt

SEQ ID NO: 96022 - DNA, 25 bp, Homo sapien
tcaccataacagtgttgggcttcct

SEQ ID NO: 96023 - DNA, 25 bp, Homo sapien
tcaccataacattgttgggcttcct

SEQ ID NO: 96024 - DNA, 25 bp, Homo sapien
tcaccataagcgtgcatgcagttaa

SEQ ID NO: 96025 - DNA, 25 bp, Homo sapien
tcaccatacaaggagaagttccttg

SEQ ID NO: 96026 - DNA, 25 bp, Homo sapien
tcaccatacgaggagaagttccttg

SEQ ID NO: 96027 - DNA, 25 bp, Homo sapien
tcaccataggcgtgcatgcagttaa

SEQ ID NO: 96028 - DNA, 25 bp, Homo sapien
tcaccatcaatgcagtcgaggtgtg

SEQ ID NO: 96029 - DNA, 25 bp, Homo sapien
tcaccatcagtgcagtcgaggtgtg

SEQ ID NO: 96030 - DNA, 25 bp, Homo sapien
tcaccatgccagcctaaggtttgta

SEQ ID NO: 96031 - DNA, 25 bp, Homo sapien
tcaccatgccaggctaaggtttgta

SEQ ID NO: 96032 - DNA, 25 bp, Homo sapien
tcaccattatagcttgattatttgt

SEQ ID NO: 96033 - DNA, 25 bp, Homo sapien
tcaccattataggttgattatttgt

SEQ ID NO: 96034 - DNA, 25 bp, Homo sapien
tcacccaagggacataaactgagga

SEQ ID NO: 96035 - DNA, 25 bp, Homo sapien
tcacccaagggagataaactgagga

SEQ ID NO: 96036 - DNA, 25 bp, Homo sapien
tcacccacaaccacattttcctgct

SEQ ID NO: 96037 - DNA, 25 bp, Homo sapien
tcacccacaaccaccttttcctgct

SEQ ID NO: 96038 - DNA, 25 bp, Homo sapien
tcacccacaagcagcatgagggcag

SEQ ID NO: 96039 - DNA, 25 bp, Homo sapien
tcacccacaagcggcatgagggcag

SEQ ID NO: 96040 - DNA, 25 bp, Homo sapien
tcacccacctcaccatgttagagaa

SEQ ID NO: 96041 - DNA, 25 bp, Homo sapien
tcacccacctcaccgtgttagagaa

SEQ ID NO: 96042 - DNA, 25 bp, Homo sapien
tcacccatcagtgacgctcttctct

SEQ ID NO: 96043 - DNA, 25 bp, Homo sapien
tcacccatcagtgatgctcttctct

SEQ ID NO: 96044 - DNA, 25 bp, Homo sapien
tcaccccaccttaaaacggacacat

SEQ ID NO: 96045 - DNA, 25 bp, Homo sapien
tcaccccaccttaaaatggacacat

SEQ ID NO: 96046 - DNA, 25 bp, Homo sapien
tcaccccatacattttctagttggc

SEQ ID NO: 96047 - DNA, 25 bp, Homo sapien
tcaccccatacgttttctagttggc

SEQ ID NO: 96048 - DNA, 25 bp, Homo sapien
tcacccgtcaaatctttactagcta

SEQ ID NO: 96049 - DNA, 25 bp, Homo sapien
tcacccgtcgaatctttactagcta

SEQ ID NO: 96050 - DNA, 25 bp, Homo sapien
tcaccctagaggccactgtactttt

SEQ ID NO: 96051 - DNA, 25 bp, Homo sapien
tcaccctagaggccgctgtactttt

SEQ ID NO: 96052 - DNA, 25 bp, Homo sapien
tcaccctctttgcaccactatcaca

SEQ ID NO: 96053 - DNA, 25 bp, Homo sapien
tcaccctctttgcaccgctatcaca

SEQ ID NO: 96054 - DNA, 25 bp, Homo sapien
tcaccctgtgttagacagcccagga

SEQ ID NO: 96055 - DNA, 25 bp, Homo sapien
tcaccctgtgtttgacagcccagga

SEQ ID NO: 96056 - DNA, 25 bp, Homo sapien
tcaccctttgcaaactaatagtttc

SEQ ID NO: 96057 - DNA, 25 bp, Homo sapien
tcacccttttcaaactaatagtttc

SEQ ID NO: 96058 - DNA, 25 bp, Homo sapien
tcaccgtggacccttcatgttaatc

SEQ ID NO: 96059 - DNA, 25 bp, Homo sapien
tcaccgtggacctttcatgttaatc

SEQ ID NO: 96060 - DNA, 25 bp, Homo sapien
tcacctaaagttcaatttaagattc

SEQ ID NO: 96061 - DNA, 25 bp, Homo sapien
tcacctaaagttctatttaagattc

SEQ ID NO: 96062 - DNA, 25 bp, Homo sapien
tcacctaacagcatgtggccctggc

SEQ ID NO: 96063 - DNA, 25 bp, Homo sapien
tcacctaaccccaagctgcaaagct

SEQ ID NO: 96064 - DNA, 25 bp, Homo sapien
tcacctaaccctaagctgcaaagct

SEQ ID NO: 96065 - DNA, 25 bp, Homo sapien
tcacctaatagcatgtggccctggc

SEQ ID NO: 96066 - DNA, 25 bp, Homo sapien
tcacctaattctcgtcaggccagtc

SEQ ID NO: 96067 - DNA, 25 bp, Homo sapien
tcacctaattcttgtcaggccagtc

SEQ ID NO: 96068 - DNA, 25 bp, Homo sapien
tcacctccctttgtatctcactctg

SEQ ID NO: 96069 - DNA, 25 bp, Homo sapien
tcacctccctttgtctctcactctg

SEQ ID NO: 96070 - DNA, 25 bp, Homo sapien
tcacctctccttgaatgtagagcta

SEQ ID NO: 96071 - DNA, 25 bp, Homo sapien
tcacctcttcttgaatgtagagcta

SEQ ID NO: 96072 - DNA, 25 bp, Homo sapien
tcacctgaatgagactatgagcaca

SEQ ID NO: 96073 - DNA, 25 bp, Homo sapien
tcacctgaatggcatggctttccat

SEQ ID NO: 96074 - DNA, 25 bp, Homo sapien
tcacctgaatggcgtggctttccat

SEQ ID NO: 96075 - DNA, 25 bp, Homo sapien
tcacctgactgctcacctttaccct

SEQ ID NO: 96076 - DNA, 25 bp, Homo sapien
tcacctgactgctcacttttaccct

SEQ ID NO: 96077 - DNA, 25 bp, Homo sapien
tcacctgacttctacagggctcttc

SEQ ID NO: 96078 - DNA, 25 bp, Homo sapien
tcacctgagtgagactatgagcaca

SEQ ID NO: 96079 - DNA, 25 bp, Homo sapien
tcacctgatctagcacctgggtctt

SEQ ID NO: 96080 - DNA, 25 bp, Homo sapien
tcacctgatttagcacctgggtctt

SEQ ID NO: 96081 - DNA, 25 bp, Homo sapien
tcacctgatttctacagggctcttc

SEQ ID NO: 96082 - DNA, 25 bp, Homo sapien
tcacctgcatttctttgtgaggatg

SEQ ID NO: 96083 - DNA, 25 bp, Homo sapien
tcacctgcatttttttgtgaggatg

SEQ ID NO: 96084 - DNA, 25 bp, Homo sapien
tcacctgccttgctagctgcatttc

SEQ ID NO: 96085 - DNA, 25 bp, Homo sapien
tcacctgccttgttagctgcatttc

SEQ ID NO: 96086 - DNA, 25 bp, Homo sapien
tcacctgctggataattgtaacata

SEQ ID NO: 96087 - DNA, 25 bp, Homo sapien
tcacctgctggctaattgtaacata

SEQ ID NO: 96088 - DNA, 25 bp, Homo sapien
tcacctgtcgataacatttgcattg

SEQ ID NO: 96089 - DNA, 25 bp, Homo sapien
tcacctgtcgatagcatttgcattg

SEQ ID NO: 96090 - DNA, 25 bp, Homo sapien
tcaccttacttgcataggcacttta

SEQ ID NO: 96091 - DNA, 25 bp, Homo sapien
tcaccttactttcataggcacttta

SEQ ID NO: 96092 - DNA, 25 bp, Homo sapien
tcaccttagaggccataaaaaaagt

SEQ ID NO: 96093 - DNA, 25 bp, Homo sapien
tcaccttaggggccataaaaaaagt

SEQ ID NO: 96094 - DNA, 25 bp, Homo sapien
tcaccttccgagaaatgctcgccct

SEQ ID NO: 96095 - DNA, 25 bp, Homo sapien
tcaccttctgagaaatgctcgccct

SEQ ID NO: 96096 - DNA, 25 bp, Homo sapien
tcaccttgaacatgcgcacagaaag

SEQ ID NO: 96097 - DNA, 25 bp, Homo sapien
tcaccttgaacatgtgcacagaaag

SEQ ID NO: 96098 - DNA, 25 bp, Homo sapien
tcaccttgactatatggcattatgt

SEQ ID NO: 96099 - DNA, 25 bp, Homo sapien
tcaccttgtctatatggcattatgt

SEQ ID NO: 96100 - DNA, 25 bp, Homo sapien
tcaccttgttgtgagaccagacaaa

SEQ ID NO: 96101 - DNA, 25 bp, Homo sapien
tcaccttgttgtgagatcagacaaa

SEQ ID NO: 96102 - DNA, 25 bp, Homo sapien
tcacctttcctacctggcaacatag

SEQ ID NO: 96103 - DNA, 25 bp, Homo sapien
tcacctttcctgcctggcaacatag

SEQ ID NO: 96104 - DNA, 25 bp, Homo sapien
tcacctttcttcgtgtacctgctga

SEQ ID NO: 96105 - DNA, 25 bp, Homo sapien
tcacctttctttgtgtacctgctga

SEQ ID NO: 96106 - DNA, 25 bp, Homo sapien
tcacctttgatgagtggccatcttc

SEQ ID NO: 96107 - DNA, 25 bp, Homo sapien
tcacctttgttgagtggccatcttc

SEQ ID NO: 96108 - DNA, 25 bp, Homo sapien
tcaccttttcataagactcgcccac

SEQ ID NO: 96109 - DNA, 25 bp, Homo sapien
tcaccttttcataagattcgcccac

SEQ ID NO: 96110 - DNA, 25 bp, Homo sapien
tcacgaagagagccctgaaaaatct

SEQ ID NO: 96111 - DNA, 25 bp, Homo sapien
tcacgaagagagccttgaaaaatct

SEQ ID NO: 96112 - DNA, 25 bp, Homo sapien
tcacgagtcctacgggaaaccagct

SEQ ID NO: 96113 - DNA, 25 bp, Homo sapien
tcacgagtcctgcgggaaaccagct

SEQ ID NO: 96114 - DNA, 25 bp, Homo sapien
tcacgatacttatcgcgtttccatc

SEQ ID NO: 96115 - DNA, 25 bp, Homo sapien
tcacgatacttatctcgtttccatc

SEQ ID NO: 96116 - DNA, 25 bp, Homo sapien
tcacgatttatcttcctttttcagg

SEQ ID NO: 96117 - DNA, 25 bp, Homo sapien
tcacgatttctcttcctttttcagg

SEQ ID NO: 96118 - DNA, 25 bp, Homo sapien
tcacgctaaaactgagattctttca

SEQ ID NO: 96119 - DNA, 25 bp, Homo sapien
tcacgctaaaattgagattctttca

SEQ ID NO: 96120 - DNA, 25 bp, Homo sapien
tcacgctcatttgttcaaagcacag

SEQ ID NO: 96121 - DNA, 25 bp, Homo sapien
tcacgctcattttttcaaagcacag

SEQ ID NO: 96122 - DNA, 25 bp, Homo sapien
tcacgtataggtttcatcagtcata

SEQ ID NO: 96123 - DNA, 25 bp, Homo sapien
tcacgtatatgtttcatcagtcata

SEQ ID NO: 96124 - DNA, 25 bp, Homo sapien
tcacgtcacatgcacatatggattt

SEQ ID NO: 96125 - DNA, 25 bp, Homo sapien
tcacgtcacatgtacatatggattt

SEQ ID NO: 96126 - DNA, 25 bp, Homo sapien
tcacgtctgtgctcctggttaggtc

SEQ ID NO: 96127 - DNA, 25 bp, Homo sapien
tcacgtctgtgttcctggttaggtc

SEQ ID NO: 96128 - DNA, 25 bp, Homo sapien
tcacgtgatcaagcatcatagtcct

SEQ ID NO: 96129 - DNA, 25 bp, Homo sapien
tcacgtgatcaagtatcatagtcct

SEQ ID NO: 96130 - DNA, 25 bp, Homo sapien
tcacgtggtcaaacccagagaagag

SEQ ID NO: 96131 - DNA, 25 bp, Homo sapien
tcacgtggtcaaatccagagaagag

SEQ ID NO: 96132 - DNA, 25 bp, Homo sapien
tcacgtgtacataggcatacccact

SEQ ID NO: 96133 - DNA, 25 bp, Homo sapien
tcacgtgtacattggcatacccact

SEQ ID NO: 96134 - DNA, 25 bp, Homo sapien
tcactaaaattcaagaatattcaaa

SEQ ID NO: 96135 - DNA, 25 bp, Homo sapien
tcactaaaattcgagaatattcaaa

SEQ ID NO: 96136 - DNA, 25 bp, Homo sapien
tcactaagcatgttttgacctgatt

SEQ ID NO: 96137 - DNA, 25 bp, Homo sapien
tcactaagcatgtttttacctgatt

SEQ ID NO: 96138 - DNA, 25 bp, Homo sapien
tcactaagtctaatagttcctactg

SEQ ID NO: 96139 - DNA, 25 bp, Homo sapien
tcactaagtctaatggttcctactg

SEQ ID NO: 96140 - DNA, 25 bp, Homo sapien
tcactacaaactaaacaaggtacca

SEQ ID NO: 96141 - DNA, 25 bp, Homo sapien
tcactacactgtcatcacatgtgat

SEQ ID NO: 96142 - DNA, 25 bp, Homo sapien
tcactacactgtcgtcacatgtgat

SEQ ID NO: 96143 - DNA, 25 bp, Homo sapien
tcactacagaaaagaaatgcttgtg

SEQ ID NO: 96144 - DNA, 25 bp, Homo sapien
tcactacagaaaagaactgcttgtg

SEQ ID NO: 96145 - DNA, 25 bp, Homo sapien
tcactacagactaaacaaggtacca

SEQ ID NO: 96146 - DNA, 25 bp, Homo sapien
tcactaccactctcctgatctttca

SEQ ID NO: 96147 - DNA, 25 bp, Homo sapien
tcactaccactctcttgatctttca

SEQ ID NO: 96148 - DNA, 25 bp, Homo sapien
tcactactacacagtgcatcttggg

SEQ ID NO: 96149 - DNA, 25 bp, Homo sapien
tcactactccacagtgcatcttggg

SEQ ID NO: 96150 - DNA, 25 bp, Homo sapien
tcactactctcaaaaatcagaaagt

SEQ ID NO: 96151 - DNA, 25 bp, Homo sapien
tcactactctcagaaatcagaaagt

SEQ ID NO: 96152 - DNA, 25 bp, Homo sapien
tcactagaccccaggtcatcagctg

SEQ ID NO: 96153 - DNA, 25 bp, Homo sapien
tcactagaccccaggtgatcagctg

SEQ ID NO: 96154 - DNA, 25 bp, Homo sapien
tcactagtttccattacagaggtct

SEQ ID NO: 96155 - DNA, 25 bp, Homo sapien
tcactagtttccattatagaggtct

SEQ ID NO: 96156 - DNA, 25 bp, Homo sapien
tcactataagaagttgcttttatat

SEQ ID NO: 96157 - DNA, 25 bp, Homo sapien
tcactataagaggttgcttttatat

SEQ ID NO: 96158 - DNA, 25 bp, Homo sapien
tcactatactcctaaagaaataaaa

SEQ ID NO: 96159 - DNA, 25 bp, Homo sapien
tcactatactcgtaaagaaataaaa

SEQ ID NO: 96160 - DNA, 25 bp, Homo sapien
tcactatactgttttataatttttt

SEQ ID NO: 96161 - DNA, 25 bp, Homo sapien
tcactatattgttttataatttttt

SEQ ID NO: 96162 - DNA, 25 bp, Homo sapien
tcactatcatttacatagcttaaaa

SEQ ID NO: 96163 - DNA, 25 bp, Homo sapien
tcactatcatttgcatagcttaaaa

SEQ ID NO: 96164 - DNA, 25 bp, Homo sapien
tcactatgcctacttgtaataagag

SEQ ID NO: 96165 - DNA, 25 bp, Homo sapien
tcactatgcctatttgtaataagag

SEQ ID NO: 96166 - DNA, 25 bp, Homo sapien
tcactattcccacagaggctgtgag

SEQ ID NO: 96167 - DNA, 25 bp, Homo sapien
tcactattcccgcagaggctgtgag

SEQ ID NO: 96168 - DNA, 25 bp, Homo sapien
tcactatttccacatctcattggcc

SEQ ID NO: 96169 - DNA, 25 bp, Homo sapien
tcactatttccacgtctcattggcc

SEQ ID NO: 96170 - DNA, 25 bp, Homo sapien
tcactcaaagtctcatagataggca

SEQ ID NO: 96171 - DNA, 25 bp, Homo sapien
tcactcaactgcctaaaaacgaatg

SEQ ID NO: 96172 - DNA, 25 bp, Homo sapien
tcactcaaggtctcatagataggca

SEQ ID NO: 96173 - DNA, 25 bp, Homo sapien
tcactcaattgcctaaaaacgaatg

SEQ ID NO: 96174 - DNA, 25 bp, Homo sapien
tcactcacactcttctgtccaattg

SEQ ID NO: 96175 - DNA, 25 bp, Homo sapien
tcactcacgctcttctgtccaattg

SEQ ID NO: 96176 - DNA, 25 bp, Homo sapien
tcactcagataatcatagtgcccct

SEQ ID NO: 96177 - DNA, 25 bp, Homo sapien
tcactcagatagtcatagtgcccct

SEQ ID NO: 96178 - DNA, 25 bp, Homo sapien
tcactcagatttaatacattttaac

SEQ ID NO: 96179 - DNA, 25 bp, Homo sapien
tcactcagatttgatacattttaac

SEQ ID NO: 96180 - DNA, 25 bp, Homo sapien
tcactcagtacagacagtcttcatg

SEQ ID NO: 96181 - DNA, 25 bp, Homo sapien
tcactcagtacagacattcttcatg

SEQ ID NO: 96182 - DNA, 25 bp, Homo sapien
tcactcagtgatacaacccttttat

SEQ ID NO: 96183 - DNA, 25 bp, Homo sapien
tcactcagtgatacgacccttttat

SEQ ID NO: 96184 - DNA, 25 bp, Homo sapien
tcactcatcaattccacaactctct

SEQ ID NO: 96185 - DNA, 25 bp, Homo sapien
tcactcattaattccacaactctct

SEQ ID NO: 96186 - DNA, 25 bp, Homo sapien
tcactccaaataaaactgtatttat

SEQ ID NO: 96187 - DNA, 25 bp, Homo sapien
tcactccaaatataactgtatttat

SEQ ID NO: 96188 - DNA, 25 bp, Homo sapien
tcactccaatttctacctccatctt

SEQ ID NO: 96189 - DNA, 25 bp, Homo sapien
tcactccagtttctacctccatctt

SEQ ID NO: 96190 - DNA, 25 bp, Homo sapien
tcactcctaccactacaagagacac

SEQ ID NO: 96191 - DNA, 25 bp, Homo sapien
tcactcctaccgctacaagagacac

SEQ ID NO: 96192 - DNA, 25 bp, Homo sapien
tcactcctgaagtcaaacaagacca

SEQ ID NO: 96193 - DNA, 25 bp, Homo sapien
tcactcctgaagtcaagcaagacca

SEQ ID NO: 96194 - DNA, 25 bp, Homo sapien
tcactctaccaaaaaaaggcaaaat

SEQ ID NO: 96195 - DNA, 25 bp, Homo sapien
tcactctaccaacaaaaggcaaaat

SEQ ID NO: 96196 - DNA, 25 bp, Homo sapien
tcactctattgcacggaatatatag

SEQ ID NO: 96197 - DNA, 25 bp, Homo sapien
tcactctattgcatggaatatatag

SEQ ID NO: 96198 - DNA, 25 bp, Homo sapien
tcactctattggtactattaactgc

SEQ ID NO: 96199 - DNA, 25 bp, Homo sapien
tcactctattggtactgttaactgc

SEQ ID NO: 96200 - DNA, 25 bp, Homo sapien
tcactctgcaagatattgtaggaaa

SEQ ID NO: 96201 - DNA, 25 bp, Homo sapien
tcactctgcaaggtattgtaggaaa

SEQ ID NO: 96202 - DNA, 25 bp, Homo sapien
tcactctggaaaatggcttgacagt

SEQ ID NO: 96203 - DNA, 25 bp, Homo sapien
tcactctggaaaatggtttgacagt

SEQ ID NO: 96204 - DNA, 25 bp, Homo sapien
tcactctggcaaaatgggatgagtt

SEQ ID NO: 96205 - DNA, 25 bp, Homo sapien
tcactctggcaagatgggatgagtt

SEQ ID NO: 96206 - DNA, 25 bp, Homo sapien
tcactctgtttcatcctagtttttt

SEQ ID NO: 96207 - DNA, 25 bp, Homo sapien
tcactctgtttcttcctagtttttt

SEQ ID NO: 96208 - DNA, 25 bp, Homo sapien
tcactcttaatacaatcgccaaaat

SEQ ID NO: 96209 - DNA, 25 bp, Homo sapien
tcactcttaatagaaactgctgcta

SEQ ID NO: 96210 - DNA, 25 bp, Homo sapien
tcactcttacattttaactcattct

SEQ ID NO: 96211 - DNA, 25 bp, Homo sapien
tcactcttagattttaactcattct

SEQ ID NO: 96212 - DNA, 25 bp, Homo sapien
tcactcttagtagaaactgctgcta

SEQ ID NO: 96213 - DNA, 25 bp, Homo sapien
tcactcttcacatgaagaattccaa

SEQ ID NO: 96214 - DNA, 25 bp, Homo sapien
tcactcttcatacaatcgccaaaat

SEQ ID NO: 96215 - DNA, 25 bp, Homo sapien
tcactcttgaataactaataggagt

SEQ ID NO: 96216 - DNA, 25 bp, Homo sapien
tcactcttgaatcactaataggagt

SEQ ID NO: 96217 - DNA, 25 bp, Homo sapien
tcactctttacatgaagaattccaa

SEQ ID NO: 96218 - DNA, 25 bp, Homo sapien
tcactctttctcgccgctagtgttc

SEQ ID NO: 96219 - DNA, 25 bp, Homo sapien
tcactctttctcgctgctagtgttc

SEQ ID NO: 96220 - DNA, 25 bp, Homo sapien
tcactgaaacgtgggtcagatgttg

SEQ ID NO: 96221 - DNA, 25 bp, Homo sapien
tcactgaaatgtgggtcagatgttg

SEQ ID NO: 96222 - DNA, 25 bp, Homo sapien
tcactgagacaggtgcatatctgat

SEQ ID NO: 96223 - DNA, 25 bp, Homo sapien
tcactgagacaggtgcgtatctgat

SEQ ID NO: 96224 - DNA, 25 bp, Homo sapien
tcactgagccgcagcaggcgctcga

SEQ ID NO: 96225 - DNA, 25 bp, Homo sapien
tcactgagctgcagcaggcgctcga

SEQ ID NO: 96226 - DNA, 25 bp, Homo sapien
tcactgataaacagactcacctgtc

SEQ ID NO: 96227 - DNA, 25 bp, Homo sapien
tcactgataaatagactcacctgtc

SEQ ID NO: 96228 - DNA, 25 bp, Homo sapien
tcactgatgactgttataattttag

SEQ ID NO: 96229 - DNA, 25 bp, Homo sapien
tcactgatggctgttataattttag

SEQ ID NO: 96230 - DNA, 25 bp, Homo sapien
tcactgatttgtcactatttgacct

SEQ ID NO: 96231 - DNA, 25 bp, Homo sapien
tcactgatttgtcactttttgacct

SEQ ID NO: 96232 - DNA, 25 bp, Homo sapien
tcactgcacacatgttctccaagaa

SEQ ID NO: 96233 - DNA, 25 bp, Homo sapien
tcactgcacacgtgttctccaagaa

SEQ ID NO: 96234 - DNA, 25 bp, Homo sapien
tcactgcacttgcatgagggacttg

SEQ ID NO: 96235 - DNA, 25 bp, Homo sapien
tcactgcacttgcttgagggacttg

SEQ ID NO: 96236 - DNA, 25 bp, Homo sapien
tcactgcagcaataaggaagtaata

SEQ ID NO: 96237 - DNA, 25 bp, Homo sapien
tcactgcagcaatagggaagtaata

SEQ ID NO: 96238 - DNA, 25 bp, Homo sapien
tcactgcagccagatccctaacccc

SEQ ID NO: 96239 - DNA, 25 bp, Homo sapien
tcactgcagccggatccctaacccc

SEQ ID NO: 96240 - DNA, 25 bp, Homo sapien
tcactgccctaattttccacatcag

SEQ ID NO: 96241 - DNA, 25 bp, Homo sapien
tcactgccttaattttccacatcag

SEQ ID NO: 96242 - DNA, 25 bp, Homo sapien
tcactgccttcattgctatccgact

SEQ ID NO: 96243 - DNA, 25 bp, Homo sapien
tcactgccttcgttgctatccgact

SEQ ID NO: 96244 - DNA, 25 bp, Homo sapien
tcactgcttctggttgaatcatgac

SEQ ID NO: 96245 - DNA, 25 bp, Homo sapien
tcactgcttttggttgaatcatgac

SEQ ID NO: 96246 - DNA, 25 bp, Homo sapien
tcactggaaataccctcacaatcac

SEQ ID NO: 96247 - DNA, 25 bp, Homo sapien
tcactggaaattccctcacaatcac

SEQ ID NO: 96248 - DNA, 25 bp, Homo sapien
tcactggactgttccttttggttag

SEQ ID NO: 96249 - DNA, 25 bp, Homo sapien
tcactggactgttctttttggttag

SEQ ID NO: 96250 - DNA, 25 bp, Homo sapien
tcactggatttagtaactgcaggta

SEQ ID NO: 96251 - DNA, 25 bp, Homo sapien
tcactggatttagtaattgcaggta

SEQ ID NO: 96252 - DNA, 25 bp, Homo sapien
tcactggggcacgaagactccaagt

SEQ ID NO: 96253 - DNA, 25 bp, Homo sapien
tcactggggcatgaagactccaagt

SEQ ID NO: 96254 - DNA, 25 bp, Homo sapien
tcactgtaaggatcttcattcaaac

SEQ ID NO: 96255 - DNA, 25 bp, Homo sapien
tcactgtaaggttcttcattcaaac

SEQ ID NO: 96256 - DNA, 25 bp, Homo sapien
tcactgtaatgcatttatcacaaac

SEQ ID NO: 96257 - DNA, 25 bp, Homo sapien
tcactgtaatgcgtttatcacaaac

SEQ ID NO: 96258 - DNA, 25 bp, Homo sapien
tcactgtacaatcaggacgcaaagg

SEQ ID NO: 96259 - DNA, 25 bp, Homo sapien
tcactgtagaactctaacatgggat

SEQ ID NO: 96260 - DNA, 25 bp, Homo sapien
tcactgtagaagtctaacatgggat

SEQ ID NO: 96261 - DNA, 25 bp, Homo sapien
tcactgtataatcaggacgcaaagg

SEQ ID NO: 96262 - DNA, 25 bp, Homo sapien
tcactgtattaagcgtccagtcaga

SEQ ID NO: 96263 - DNA, 25 bp, Homo sapien
tcactgtattaagtgtccagtcaga

SEQ ID NO: 96264 - DNA, 25 bp, Homo sapien
tcactgtattcacacacttcttttg

SEQ ID NO: 96265 - DNA, 25 bp, Homo sapien
tcactgtattcacatacttcttttg

SEQ ID NO: 96266 - DNA, 25 bp, Homo sapien
tcactgtcaagaccggagtttcagt

SEQ ID NO: 96267 - DNA, 25 bp, Homo sapien
tcactgtcaagacctgagtttcagt

SEQ ID NO: 96268 - DNA, 25 bp, Homo sapien
tcactgtccactccatagaagaaca

SEQ ID NO: 96269 - DNA, 25 bp, Homo sapien
tcactgtccactccgtagaagaaca

SEQ ID NO: 96270 - DNA, 25 bp, Homo sapien
tcactgtgaacacgtttcttgtgta

SEQ ID NO: 96271 - DNA, 25 bp, Homo sapien
tcactgtgaacatgtttcttgtgta

SEQ ID NO: 96272 - DNA, 25 bp, Homo sapien
tcactgtgaggataagcaagaaaaa

SEQ ID NO: 96273 - DNA, 25 bp, Homo sapien
tcactgtgaggatgagcaagaaaaa

SEQ ID NO: 96274 - DNA, 25 bp, Homo sapien
tcactgtgcatatgtgagaggattt

SEQ ID NO: 96275 - DNA, 25 bp, Homo sapien
tcactgtgcgggttatccatgctct

SEQ ID NO: 96276 - DNA, 25 bp, Homo sapien
tcactgtgcgtatgtgagaggattt

SEQ ID NO: 96277 - DNA, 25 bp, Homo sapien
tcactgtgctaagcagtgaagtcct

SEQ ID NO: 96278 - DNA, 25 bp, Homo sapien
tcactgtgctaagtagtgaagtcct

SEQ ID NO: 96279 - DNA, 25 bp, Homo sapien
tcactgtggctgcagcaccgccact

SEQ ID NO: 96280 - DNA, 25 bp, Homo sapien
tcactgtggctgcggcaccgccact

SEQ ID NO: 96281 - DNA, 25 bp, Homo sapien
tcactgtgtgggttatccatgctct

SEQ ID NO: 96282 - DNA, 25 bp, Homo sapien
tcactgttaaaaagaaatgatgtca

SEQ ID NO: 96283 - DNA, 25 bp, Homo sapien
tcactgttaaaatgaaatgatgtca

SEQ ID NO: 96284 - DNA, 25 bp, Homo sapien
tcactgttcaatgtccatattccta

SEQ ID NO: 96285 - DNA, 25 bp, Homo sapien
tcactgttcaatgttcatattccta

SEQ ID NO: 96286 - DNA, 25 bp, Homo sapien
tcacttaacaacgtcttttgcagag

SEQ ID NO: 96287 - DNA, 25 bp, Homo sapien
tcacttaacaatgtcttttgcagag

SEQ ID NO: 96288 - DNA, 25 bp, Homo sapien
tcacttaacatggccataattctct

SEQ ID NO: 96289 - DNA, 25 bp, Homo sapien
tcacttaacatggctataattctct

SEQ ID NO: 96290 - DNA, 25 bp, Homo sapien
tcacttaatgacaatgatacattct

SEQ ID NO: 96291 - DNA, 25 bp, Homo sapien
tcacttaatgacgatgatacattct

SEQ ID NO: 96292 - DNA, 25 bp, Homo sapien
tcacttacaattattactaggtgct

SEQ ID NO: 96293 - DNA, 25 bp, Homo sapien
tcacttacaatttttactaggtgct

SEQ ID NO: 96294 - DNA, 25 bp, Homo sapien
tcacttacacaaaaaatttcgcagt

SEQ ID NO: 96295 - DNA, 25 bp, Homo sapien
tcacttacacagaaaatttcgcagt

SEQ ID NO: 96296 - DNA, 25 bp, Homo sapien
tcacttactatcatgcgaacagcag

SEQ ID NO: 96297 - DNA, 25 bp, Homo sapien
tcacttactatcgtgcgaacagcag

SEQ ID NO: 96298 - DNA, 25 bp, Homo sapien
tcacttagaacttcaacttttgaat

SEQ ID NO: 96299 - DNA, 25 bp, Homo sapien
tcacttagaacttcaatttttgaat

SEQ ID NO: 96300 - DNA, 25 bp, Homo sapien
tcacttatgtcacatttctctcact

SEQ ID NO: 96301 - DNA, 25 bp, Homo sapien
tcacttatgtcagatttctctcact

SEQ ID NO: 96302 - DNA, 25 bp, Homo sapien
tcacttcacaccgggatggctggca

SEQ ID NO: 96303 - DNA, 25 bp, Homo sapien
tcacttcacactgggatggctggca

SEQ ID NO: 96304 - DNA, 25 bp, Homo sapien
tcacttcataagcttcatcagggca

SEQ ID NO: 96305 - DNA, 25 bp, Homo sapien
tcacttcatgagcttcatcagggca

SEQ ID NO: 96306 - DNA, 25 bp, Homo sapien
tcacttccgctcatttccagtgatc

SEQ ID NO: 96307 - DNA, 25 bp, Homo sapien
tcacttccgctcattttcagtgatc

SEQ ID NO: 96308 - DNA, 25 bp, Homo sapien
tcacttcctattggagtcttttggt

SEQ ID NO: 96309 - DNA, 25 bp, Homo sapien
tcacttcctcatgatacaatggcat

SEQ ID NO: 96310 - DNA, 25 bp, Homo sapien
tcacttcctcatgatagaatggcat

SEQ ID NO: 96311 - DNA, 25 bp, Homo sapien
tcacttcctgttggagtcttttggt

SEQ ID NO: 96312 - DNA, 25 bp, Homo sapien
tcacttctcatgttttcttagcact

SEQ ID NO: 96313 - DNA, 25 bp, Homo sapien
tcacttctcgtgttttcttagcact

SEQ ID NO: 96314 - DNA, 25 bp, Homo sapien
tcacttgactctatatcgaatgcac

SEQ ID NO: 96315 - DNA, 25 bp, Homo sapien
tcacttgactctatattgaatgcac

SEQ ID NO: 96316 - DNA, 25 bp, Homo sapien
tcacttgatgcctttccattgcttt

SEQ ID NO: 96317 - DNA, 25 bp, Homo sapien
tcacttgatgcctttctattgcttt

SEQ ID NO: 96318 - DNA, 25 bp, Homo sapien
tcacttggcaaaactagtgatggag

SEQ ID NO: 96319 - DNA, 25 bp, Homo sapien
tcacttggcaaagctagtgatggag

SEQ ID NO: 96320 - DNA, 25 bp, Homo sapien
tcacttgtcttcaatttagaaagct

SEQ ID NO: 96321 - DNA, 25 bp, Homo sapien
tcacttgtcttccatttagaaagct

SEQ ID NO: 96322 - DNA, 25 bp, Homo sapien
tcacttgtgagtattccggagacat

SEQ ID NO: 96323 - DNA, 25 bp, Homo sapien
tcacttgtgagtattctggagacat

SEQ ID NO: 96324 - DNA, 25 bp, Homo sapien
tcactttacggtgctgccaaaaact

SEQ ID NO: 96325 - DNA, 25 bp, Homo sapien
tcactttacggtgctgtcaaaaact

SEQ ID NO: 96326 - DNA, 25 bp, Homo sapien
tcactttagacagtaacagaaagta

SEQ ID NO: 96327 - DNA, 25 bp, Homo sapien
tcactttagacagtaatagaaagta

SEQ ID NO: 96328 - DNA, 25 bp, Homo sapien
tcactttccatagaactctagcttg

SEQ ID NO: 96329 - DNA, 25 bp, Homo sapien
tcactttccggtcttgttatattta

SEQ ID NO: 96330 - DNA, 25 bp, Homo sapien
tcactttccgtagaactctagcttg

SEQ ID NO: 96331 - DNA, 25 bp, Homo sapien
tcactttctggtcttgttatattta

SEQ ID NO: 96332 - DNA, 25 bp, Homo sapien
tcactttcttaacagtgttttttga

SEQ ID NO: 96333 - DNA, 25 bp, Homo sapien
tcactttcttaacggtgttttttga

SEQ ID NO: 96334 - DNA, 25 bp, Homo sapien
tcactttcttaccatacacgacagg

SEQ ID NO: 96335 - DNA, 25 bp, Homo sapien
tcactttcttaccgtacacgacagg

SEQ ID NO: 96336 - DNA, 25 bp, Homo sapien
tcactttgaatatctaggtagaatc

SEQ ID NO: 96337 - DNA, 25 bp, Homo sapien
tcactttggatatctaggtagaatc

SEQ ID NO: 96338 - DNA, 25 bp, Homo sapien
tcactttgtcctcactcggtctttc

SEQ ID NO: 96339 - DNA, 25 bp, Homo sapien
tcactttgttctcactcggtctttc

SEQ ID NO: 96340 - DNA, 25 bp, Homo sapien
tcagaaaaaaacctgaggagagaat

SEQ ID NO: 96341 - DNA, 25 bp, Homo sapien
tcagaaaaaaatctgaggagagaat

SEQ ID NO: 96342 - DNA, 25 bp, Homo sapien
tcagaaaacaccatttatagtcatg

SEQ ID NO: 96343 - DNA, 25 bp, Homo sapien
tcagaaaacaccctttatagtcatg

SEQ ID NO: 96344 - DNA, 25 bp, Homo sapien
tcagaaaacgaagtcattactggag

SEQ ID NO: 96345 - DNA, 25 bp, Homo sapien
tcagaaaagtctcagtgttttagga

SEQ ID NO: 96346 - DNA, 25 bp, Homo sapien
tcagaaaagtctcggtgttttagga

SEQ ID NO: 96347 - DNA, 25 bp, Homo sapien
tcagaaaatctgggataaataattg

SEQ ID NO: 96348 - DNA, 25 bp, Homo sapien
tcagaaaatcttggataaataattg

SEQ ID NO: 96349 - DNA, 25 bp, Homo sapien
tcagaaaatgaagtcattactggag

SEQ ID NO: 96350 - DNA, 25 bp, Homo sapien
tcagaaacaatttgaaccttagctt

SEQ ID NO: 96351 - DNA, 25 bp, Homo sapien
tcagaaacacagcgagtggccctgt

SEQ ID NO: 96352 - DNA, 25 bp, Homo sapien
tcagaaacacagtgagtggccctgt

SEQ ID NO: 96353 - DNA, 25 bp, Homo sapien
tcagaaacagcaagacttctttcct

SEQ ID NO: 96354 - DNA, 25 bp, Homo sapien
tcagaaacagcaagccttctttcct

SEQ ID NO: 96355 - DNA, 25 bp, Homo sapien
tcagaaacagccaggatacagtgac

SEQ ID NO: 96356 - DNA, 25 bp, Homo sapien
tcagaaacagccgggatacagtgac

SEQ ID NO: 96357 - DNA, 25 bp, Homo sapien
tcagaaacagtttgaaccttagctt

SEQ ID NO: 96358 - DNA, 25 bp, Homo sapien
tcagaaacctaatttttgtgctggc

SEQ ID NO: 96359 - DNA, 25 bp, Homo sapien
tcagaaacctagtttttgtgctggc

SEQ ID NO: 96360 - DNA, 25 bp, Homo sapien
tcagaaagcttctttcagtttggct

SEQ ID NO: 96361 - DNA, 25 bp, Homo sapien
tcagaaagcttgtttcagtttggct

SEQ ID NO: 96362 - DNA, 25 bp, Homo sapien
tcagaaaggtgaagatgaagtctag

SEQ ID NO: 96363 - DNA, 25 bp, Homo sapien
tcagaaaggttattagagatagttg

SEQ ID NO: 96364 - DNA, 25 bp, Homo sapien
tcagaaaggttattggagatagttg

SEQ ID NO: 96365 - DNA, 25 bp, Homo sapien
tcagaaagttgaagatgaagtctag

SEQ ID NO: 96366 - DNA, 25 bp, Homo sapien
tcagaaatattgtcacatctaattt

SEQ ID NO: 96367 - DNA, 25 bp, Homo sapien
tcagaaatattgtcccatctaattt

SEQ ID NO: 96368 - DNA, 25 bp, Homo sapien
tcagaacaaaatcattcaagcccat

SEQ ID NO: 96369 - DNA, 25 bp, Homo sapien
tcagaacaaaatcgttcaagcccat

SEQ ID NO: 96370 - DNA, 25 bp, Homo sapien
tcagaacccaaggctcaattttaat

SEQ ID NO: 96371 - DNA, 25 bp, Homo sapien
tcagaacccgaggctcaattttaat

SEQ ID NO: 96372 - DNA, 25 bp, Homo sapien
tcagaactgttcaacttccaagcaa

SEQ ID NO: 96373 - DNA, 25 bp, Homo sapien
tcagaactgtttaacttccaagcaa

SEQ ID NO: 96374 - DNA, 25 bp, Homo sapien
tcagaagaaaaagataacagccaat

SEQ ID NO: 96375 - DNA, 25 bp, Homo sapien
tcagaagaagaagataacagccaat

SEQ ID NO: 96376 - DNA, 25 bp, Homo sapien
tcagaagacatctgcaggttctaat

SEQ ID NO: 96377 - DNA, 25 bp, Homo sapien
tcagaagacatctggaggttctaat

SEQ ID NO: 96378 - DNA, 25 bp, Homo sapien
tcagaagaggcactgagggtaatct

SEQ ID NO: 96379 - DNA, 25 bp, Homo sapien
tcagaagagtaacgataactgttct

SEQ ID NO: 96380 - DNA, 25 bp, Homo sapien
tcagaagagtaatgataactgttct

SEQ ID NO: 96381 - DNA, 25 bp, Homo sapien
tcagaagagtcactgagggtaatct

SEQ ID NO: 96382 - DNA, 25 bp, Homo sapien
tcagaagctaatcataaagtggacc

SEQ ID NO: 96383 - DNA, 25 bp, Homo sapien
tcagaagctaatcgtaaagtggacc

SEQ ID NO: 96384 - DNA, 25 bp, Homo sapien
tcagaagctcgtagaattgttctgc

SEQ ID NO: 96385 - DNA, 25 bp, Homo sapien
tcagaagcttgtagaattgttctgc

SEQ ID NO: 96386 - DNA, 25 bp, Homo sapien
tcagaagtaagtttctatgttaggt

SEQ ID NO: 96387 - DNA, 25 bp, Homo sapien
tcagaagtatgtttctatgttaggt

SEQ ID NO: 96388 - DNA, 25 bp, Homo sapien
tcagaagtattaatagcagaagaga

SEQ ID NO: 96389 - DNA, 25 bp, Homo sapien
tcagaagtattaatggcagaagaga

SEQ ID NO: 96390 - DNA, 25 bp, Homo sapien
tcagaatacctgggatatctgggat

SEQ ID NO: 96391 - DNA, 25 bp, Homo sapien
tcagaatacctgggttatctgggat

SEQ ID NO: 96392 - DNA, 25 bp, Homo sapien
tcagaatagtcctgcaaagccagag

SEQ ID NO: 96393 - DNA, 25 bp, Homo sapien
tcagaatagtccttcaaagccagag

SEQ ID NO: 96394 - DNA, 25 bp, Homo sapien
tcagaatcacctattcaaaaggcga

SEQ ID NO: 96395 - DNA, 25 bp, Homo sapien
tcagaatcacctattcgaaaggcga

SEQ ID NO: 96396 - DNA, 25 bp, Homo sapien
tcagaatcttgagtccaataattag

SEQ ID NO: 96397 - DNA, 25 bp, Homo sapien
tcagaatcttgagtgcaataattag

SEQ ID NO: 96398 - DNA, 25 bp, Homo sapien
tcagaatggcgtcctcagagagtag

SEQ ID NO: 96399 - DNA, 25 bp, Homo sapien
tcagaatggcgtcctcggagagtag

SEQ ID NO: 96400 - DNA, 25 bp, Homo sapien
tcagaatggttaagtaacttgccaa

SEQ ID NO: 96401 - DNA, 25 bp, Homo sapien
tcagaatggttaggtaacttgccaa

SEQ ID NO: 96402 - DNA, 25 bp, Homo sapien
tcagaatgtttgctgccctccaaaa

SEQ ID NO: 96403 - DNA, 25 bp, Homo sapien
tcagaatgtttgttgccctccaaaa

SEQ ID NO: 96404 - DNA, 25 bp, Homo sapien
tcagaattaagcatagtagatatgt

SEQ ID NO: 96405 - DNA, 25 bp, Homo sapien
tcagaattaagcgtagtagatatgt

SEQ ID NO: 96406 - DNA, 25 bp, Homo sapien
tcagaattacggtgttgttagaaga

SEQ ID NO: 96407 - DNA, 25 bp, Homo sapien
tcagaattacggttttgttagaaga

SEQ ID NO: 96408 - DNA, 25 bp, Homo sapien
tcagaatttaagccactcttttctg

SEQ ID NO: 96409 - DNA, 25 bp, Homo sapien
tcagaatttaagtcactcttttctg

SEQ ID NO: 96410 - DNA, 25 bp, Homo sapien
tcagacaaactacatgactggcttc

SEQ ID NO: 96411 - DNA, 25 bp, Homo sapien
tcagacaaactacctgactggcttc

SEQ ID NO: 96412 - DNA, 25 bp, Homo sapien
tcagacaagagataaaaagataata

SEQ ID NO: 96413 - DNA, 25 bp, Homo sapien
tcagacaagagatagaaagataata

SEQ ID NO: 96414 - DNA, 25 bp, Homo sapien
tcagacaagggttaaacgtagtggt

SEQ ID NO: 96415 - DNA, 25 bp, Homo sapien
tcagacaagggttaaatgtagtggt

SEQ ID NO: 96416 - DNA, 25 bp, Homo sapien
tcagacacaaaagtgcaaacaaaag

SEQ ID NO: 96417 - DNA, 25 bp, Homo sapien
tcagacacagaagtgcaaacaaaag

SEQ ID NO: 96418 - DNA, 25 bp, Homo sapien
tcagacactggttttgcgggagcag

SEQ ID NO: 96419 - DNA, 25 bp, Homo sapien
tcagacactggttttgtgggagcag

SEQ ID NO: 96420 - DNA, 25 bp, Homo sapien
tcagacagttctgcgtaggcggcca

SEQ ID NO: 96421 - DNA, 25 bp, Homo sapien
tcagacagttctgtgtaggcggcca

SEQ ID NO: 96422 - DNA, 25 bp, Homo sapien
tcagacataaacaacataagcacag

SEQ ID NO: 96423 - DNA, 25 bp, Homo sapien
tcagacataaacgacataagcacag

SEQ ID NO: 96424 - DNA, 25 bp, Homo sapien
tcagacatacgtgaaaaggctgatg

SEQ ID NO: 96425 - DNA, 25 bp, Homo sapien
tcagacataggtgaaaaggctgatg

SEQ ID NO: 96426 - DNA, 25 bp, Homo sapien
tcagaccactgtgcatttcacaaat

SEQ ID NO: 96427 - DNA, 25 bp, Homo sapien
tcagaccactgtgcttttcacaaat

SEQ ID NO: 96428 - DNA, 25 bp, Homo sapien
tcagaccatcagagaactcagccag

SEQ ID NO: 96429 - DNA, 25 bp, Homo sapien
tcagaccatcagagaattcagccag

SEQ ID NO: 96430 - DNA, 25 bp, Homo sapien
tcagacccaaaatttttgctctaaa

SEQ ID NO: 96431 - DNA, 25 bp, Homo sapien
tcagacccagaatttttgctctaaa

SEQ ID NO: 96432 - DNA, 25 bp, Homo sapien
tcagaccctatcactcctctactca

SEQ ID NO: 96433 - DNA, 25 bp, Homo sapien
tcagaccctatcagtcctctactca

SEQ ID NO: 96434 - DNA, 25 bp, Homo sapien
tcagacgtctgaaactggtgttcct

SEQ ID NO: 96435 - DNA, 25 bp, Homo sapien
tcagacgtctgatactggtgttcct

SEQ ID NO: 96436 - DNA, 25 bp, Homo sapien
tcagactaattttgtccagacctag

SEQ ID NO: 96437 - DNA, 25 bp, Homo sapien
tcagactaattttttccagacctag

SEQ ID NO: 96438 - DNA, 25 bp, Homo sapien
tcagactacatattacagaagaaaa

SEQ ID NO: 96439 - DNA, 25 bp, Homo sapien
tcagactagatattacagaagaaaa

SEQ ID NO: 96440 - DNA, 25 bp, Homo sapien
tcagactcaagatacgtttgaccat

SEQ ID NO: 96441 - DNA, 25 bp, Homo sapien
tcagactcaagatatgtttgaccat

SEQ ID NO: 96442 - DNA, 25 bp, Homo sapien
tcagagaacgatttcttaagcacta

SEQ ID NO: 96443 - DNA, 25 bp, Homo sapien
tcagagaagacttttcctttgagta

SEQ ID NO: 96444 - DNA, 25 bp, Homo sapien
tcagagaagccttttcctttgagta

SEQ ID NO: 96445 - DNA, 25 bp, Homo sapien
tcagagaaggaggattgcattgtga

SEQ ID NO: 96446 - DNA, 25 bp, Homo sapien
tcagagaaggagggttgcattgtga

SEQ ID NO: 96447 - DNA, 25 bp, Homo sapien
tcagagaatgatttcttaagcacta

SEQ ID NO: 96448 - DNA, 25 bp, Homo sapien
tcagagaattgggcatgagtttaga

SEQ ID NO: 96449 - DNA, 25 bp, Homo sapien
tcagagaattgggcgtgagtttaga

SEQ ID NO: 96450 - DNA, 25 bp, Homo sapien
tcagagagagatcaagataaaacga

SEQ ID NO: 96451 - DNA, 25 bp, Homo sapien
tcagagagagatcaaggtaaaacga

SEQ ID NO: 96452 - DNA, 25 bp, Homo sapien
tcagagagcgtctaccctcaagttt

SEQ ID NO: 96453 - DNA, 25 bp, Homo sapien
tcagagagtgtctaccctcaagttt

SEQ ID NO: 96454 - DNA, 25 bp, Homo sapien
tcagagatcttgtatatttggacaa

SEQ ID NO: 96455 - DNA, 25 bp, Homo sapien
tcagagatcttgtgtatttggacaa

SEQ ID NO: 96456 - DNA, 25 bp, Homo sapien
tcagagcaatattgtcttggctatg

SEQ ID NO: 96457 - DNA, 25 bp, Homo sapien
tcagagcaatattttcttggctatg

SEQ ID NO: 96458 - DNA, 25 bp, Homo sapien
tcagagcccagaacagcagaatata

SEQ ID NO: 96459 - DNA, 25 bp, Homo sapien
tcagagcccagaatagcagaatata

SEQ ID NO: 96460 - DNA, 25 bp, Homo sapien
tcagagccttcccgagcaggtgaac

SEQ ID NO: 96461 - DNA, 25 bp, Homo sapien
tcagagccttcctgagcaggtgaac

SEQ ID NO: 96462 - DNA, 25 bp, Homo sapien
tcagagctggaacggtgtactaagt

SEQ ID NO: 96463 - DNA, 25 bp, Homo sapien
tcagagctggaatggtgtactaagt

SEQ ID NO: 96464 - DNA, 25 bp, Homo sapien
tcagagcttttggaccccttttctg

SEQ ID NO: 96465 - DNA, 25 bp, Homo sapien
tcagagcttttggacctcttttctg

SEQ ID NO: 96466 - DNA, 25 bp, Homo sapien
tcagaggaaaatctgaactgtcctg

SEQ ID NO: 96467 - DNA, 25 bp, Homo sapien
tcagaggaatatctgaactgtcctg

SEQ ID NO: 96468 - DNA, 25 bp, Homo sapien
tcagaggacaccatcgggaatgtgc

SEQ ID NO: 96469 - DNA, 25 bp, Homo sapien
tcagaggacaccattgggaatgtgc

SEQ ID NO: 96470 - DNA, 25 bp, Homo sapien
tcagaggataaattaatctcttcaa

SEQ ID NO: 96471 - DNA, 25 bp, Homo sapien
tcagaggatgaattaatctcttcaa

SEQ ID NO: 96472 - DNA, 25 bp, Homo sapien
tcagaggctattacgaacagcacta

SEQ ID NO: 96473 - DNA, 25 bp, Homo sapien
tcagaggctattatgaacagcacta

SEQ ID NO: 96474 - DNA, 25 bp, Homo sapien
tcagagggttgcattgcatgtcagt

SEQ ID NO: 96475 - DNA, 25 bp, Homo sapien
tcagagggttgcgttgcatgtcagt

SEQ ID NO: 96476 - DNA, 25 bp, Homo sapien
tcagaggttcctcgtgccatcttca

SEQ ID NO: 96477 - DNA, 25 bp, Homo sapien
tcagaggttcctcgtgtcatcttca

SEQ ID NO: 96478 - DNA, 25 bp, Homo sapien
tcagaggttgccatctagccttcct

SEQ ID NO: 96479 - DNA, 25 bp, Homo sapien
tcagaggttgccgtctagccttcct

SEQ ID NO: 96480 - DNA, 25 bp, Homo sapien
tcagagtctcaccaaaggtttttga

SEQ ID NO: 96481 - DNA, 25 bp, Homo sapien
tcagagtctcatcaaaggtttttga

SEQ ID NO: 96482 - DNA, 25 bp, Homo sapien
tcagagtcttagagatagtatccca

SEQ ID NO: 96483 - DNA, 25 bp, Homo sapien
tcagagtcttagagatggtatccca

SEQ ID NO: 96484 - DNA, 25 bp, Homo sapien
tcagagtggagccgataatcggaat

SEQ ID NO: 96485 - DNA, 25 bp, Homo sapien
tcagagtggagctgataatcggaat

SEQ ID NO: 96486 - DNA, 25 bp, Homo sapien
tcagagttacaatactcctacccca

SEQ ID NO: 96487 - DNA, 25 bp, Homo sapien
tcagagttccaatactcctacccca

SEQ ID NO: 96488 - DNA, 25 bp, Homo sapien
tcagagtttcggaatcagtaggtct

SEQ ID NO: 96489 - DNA, 25 bp, Homo sapien
tcagagtttgacacacaataggcac

SEQ ID NO: 96490 - DNA, 25 bp, Homo sapien
tcagagtttgacatacaataggcac

SEQ ID NO: 96491 - DNA, 25 bp, Homo sapien
tcagagtttgccgcccaaaaaagtt

SEQ ID NO: 96492 - DNA, 25 bp, Homo sapien
tcagagtttgctgcccaaaaaagtt

SEQ ID NO: 96493 - DNA, 25 bp, Homo sapien
tcagagttttggaatcagtaggtct

SEQ ID NO: 96494 - DNA, 25 bp, Homo sapien
tcagatacaggtacttgtttttctg

SEQ ID NO: 96495 - DNA, 25 bp, Homo sapien
tcagatacaggtatttgtttttctg

SEQ ID NO: 96496 - DNA, 25 bp, Homo sapien
tcagatagactacgcattctcttat

SEQ ID NO: 96497 - DNA, 25 bp, Homo sapien
tcagatagactatgcattctcttat

SEQ ID NO: 96498 - DNA, 25 bp, Homo sapien
tcagatagtccagcgttaaatgcct

SEQ ID NO: 96499 - DNA, 25 bp, Homo sapien
tcagatagtccagggttaaatgcct

SEQ ID NO: 96500 - DNA, 25 bp, Homo sapien
tcagatatcgaacttataaactaca

SEQ ID NO: 96501 - DNA, 25 bp, Homo sapien
tcagatatcgaatttataaactaca

SEQ ID NO: 96502 - DNA, 25 bp, Homo sapien
tcagatcctcgagtgctaacattat

SEQ ID NO: 96503 - DNA, 25 bp, Homo sapien
tcagatccttgagtgctaacattat

SEQ ID NO: 96504 - DNA, 25 bp, Homo sapien
tcagatctacctcacatttaaaact

SEQ ID NO: 96505 - DNA, 25 bp, Homo sapien
tcagatctatctcacatttaaaact

SEQ ID NO: 96506 - DNA, 25 bp, Homo sapien
tcagatctccacgtcctactaagaa

SEQ ID NO: 96507 - DNA, 25 bp, Homo sapien
tcagatctccatgtcctactaagaa

SEQ ID NO: 96508 - DNA, 25 bp, Homo sapien
tcagatgaaacgaatcactctaact

SEQ ID NO: 96509 - DNA, 25 bp, Homo sapien
tcagatgaaacgagtcactctaact

SEQ ID NO: 96510 - DNA, 25 bp, Homo sapien
tcagatgagttcctgacaggttact

SEQ ID NO: 96511 - DNA, 25 bp, Homo sapien
tcagatgagttcctgataggttact

SEQ ID NO: 96512 - DNA, 25 bp, Homo sapien
tcagatgcctattgtattaccgaga

SEQ ID NO: 96513 - DNA, 25 bp, Homo sapien
tcagatgcctattttattaccgaga

SEQ ID NO: 96514 - DNA, 25 bp, Homo sapien
tcagatggctatgcaataggttccc

SEQ ID NO: 96515 - DNA, 25 bp, Homo sapien
tcagatggctatgtaataggttccc

SEQ ID NO: 96516 - DNA, 25 bp, Homo sapien
tcagatggtcaacaacttcatattg

SEQ ID NO: 96517 - DNA, 25 bp, Homo sapien
tcagatggtcagcaacttcatattg

SEQ ID NO: 96518 - DNA, 25 bp, Homo sapien
tcagatgtcactttctcagaaagga

SEQ ID NO: 96519 - DNA, 25 bp, Homo sapien
tcagatgtcgctttctcagaaagga

SEQ ID NO: 96520 - DNA, 25 bp, Homo sapien
tcagatgtttgcacctttctttaaa

SEQ ID NO: 96521 - DNA, 25 bp, Homo sapien
tcagatgtttgtacctttctttaaa

SEQ ID NO: 96522 - DNA, 25 bp, Homo sapien
tcagatgtttgtctgctctttgttg

SEQ ID NO: 96523 - DNA, 25 bp, Homo sapien
tcagatgtttgtttgctctttgttg

SEQ ID NO: 96524 - DNA, 25 bp, Homo sapien
tcagattaacttgaaaaccactccc

SEQ ID NO: 96525 - DNA, 25 bp, Homo sapien
tcagattaagttgaaaaccactccc

SEQ ID NO: 96526 - DNA, 25 bp, Homo sapien
tcagattacattaatacagcttctc

SEQ ID NO: 96527 - DNA, 25 bp, Homo sapien
tcagattacattattacagcttctc

SEQ ID NO: 96528 - DNA, 25 bp, Homo sapien
tcagattcatcagcaagtcttgata

SEQ ID NO: 96529 - DNA, 25 bp, Homo sapien
tcagattcatcagcaattcttgata

SEQ ID NO: 96530 - DNA, 25 bp, Homo sapien
tcagattctgtttacggagaacaga

SEQ ID NO: 96531 - DNA, 25 bp, Homo sapien
tcagattctgtttatggagaacaga

SEQ ID NO: 96532 - DNA, 25 bp, Homo sapien
tcagattgccttagaagacttttaa

SEQ ID NO: 96533 - DNA, 25 bp, Homo sapien
tcagattgccttaggagacttttaa

SEQ ID NO: 96534 - DNA, 25 bp, Homo sapien
tcagattgtcagaaaagtagcttta

SEQ ID NO: 96535 - DNA, 25 bp, Homo sapien
tcagattgtcagataagtagcttta

SEQ ID NO: 96536 - DNA, 25 bp, Homo sapien
tcagatttatgcctgtagaaaaaac

SEQ ID NO: 96537 - DNA, 25 bp, Homo sapien
tcagatttatgcttgtagaaaaaac

SEQ ID NO: 96538 - DNA, 25 bp, Homo sapien
tcagatttcggaacgtgctgatctc

SEQ ID NO: 96539 - DNA, 25 bp, Homo sapien
tcagatttcggaatgtgctgatctc

SEQ ID NO: 96540 - DNA, 25 bp, Homo sapien
tcagatttgatataagaggacagaa

SEQ ID NO: 96541 - DNA, 25 bp, Homo sapien
tcagatttggtataagaggacagaa

SEQ ID NO: 96542 - DNA, 25 bp, Homo sapien
tcagcaaagcgctgtaactatggcc

SEQ ID NO: 96543 - DNA, 25 bp, Homo sapien
tcagcaaagtgctgtaactatggcc

SEQ ID NO: 96544 - DNA, 25 bp, Homo sapien
tcagcaaataaacaaacagtatgtc

SEQ ID NO: 96545 - DNA, 25 bp, Homo sapien
tcagcaaataaacaaatagtatgtc

SEQ ID NO: 96546 - DNA, 25 bp, Homo sapien
tcagcaactctaccaaacaccaact

SEQ ID NO: 96547 - DNA, 25 bp, Homo sapien
tcagcaactctaccaagcaccaact

SEQ ID NO: 96548 - DNA, 25 bp, Homo sapien
tcagcaactgaaatgatatgacctc

SEQ ID NO: 96549 - DNA, 25 bp, Homo sapien
tcagcaactgaagtgatatgacctc

SEQ ID NO: 96550 - DNA, 25 bp, Homo sapien
tcagcaatagatgaggacattttgg

SEQ ID NO: 96551 - DNA, 25 bp, Homo sapien
tcagcaatagatgatgacattttgg

SEQ ID NO: 96552 - DNA, 25 bp, Homo sapien
tcagcacagaaagaaagacttcatt

SEQ ID NO: 96553 - DNA, 25 bp, Homo sapien
tcagcacagcaagaaagacttcatt

SEQ ID NO: 96554 - DNA, 25 bp, Homo sapien
tcagcacagttaattccagggctgc

SEQ ID NO: 96555 - DNA, 25 bp, Homo sapien
tcagcacagttaattctagggctgc

SEQ ID NO: 96556 - DNA, 25 bp, Homo sapien
tcagcaccatccgtgatgccatgta

SEQ ID NO: 96557 - DNA, 25 bp, Homo sapien
tcagcaccatctgtgatgccatgta

SEQ ID NO: 96558 - DNA, 25 bp, Homo sapien
tcagcacctactgtcaatgtaggcc

SEQ ID NO: 96559 - DNA, 25 bp, Homo sapien
tcagcacctgctgtcaatgtaggcc

SEQ ID NO: 96560 - DNA, 25 bp, Homo sapien
tcagcagagacacgtttcctgaatt

SEQ ID NO: 96561 - DNA, 25 bp, Homo sapien
tcagcagagacatgtttcctgaatt

SEQ ID NO: 96562 - DNA, 25 bp, Homo sapien
tcagcagagcaggcagagccgttct

SEQ ID NO: 96563 - DNA, 25 bp, Homo sapien
tcagcagagcaggtagagccgttct

SEQ ID NO: 96564 - DNA, 25 bp, Homo sapien
tcagcagccgcctctgctgatgtca

SEQ ID NO: 96565 - DNA, 25 bp, Homo sapien
tcagcagctgcctctgctgatgtca

SEQ ID NO: 96566 - DNA, 25 bp, Homo sapien
tcagcagtgatgccattgggtacta

SEQ ID NO: 96567 - DNA, 25 bp, Homo sapien
tcagcagtgatgtcattgggtacta

SEQ ID NO: 96568 - DNA, 25 bp, Homo sapien
tcagcatacccaacctgaaagaatc

SEQ ID NO: 96569 - DNA, 25 bp, Homo sapien
tcagcatacccatcctgaaagaatc

SEQ ID NO: 96570 - DNA, 25 bp, Homo sapien
tcagcatacttcaaacaattccttt

SEQ ID NO: 96571 - DNA, 25 bp, Homo sapien
tcagcatacttcaaaccattccttt

SEQ ID NO: 96572 - DNA, 25 bp, Homo sapien
tcagcatatacaagttcaggaaagt

SEQ ID NO: 96573 - DNA, 25 bp, Homo sapien
tcagcatatacaggttcaggaaagt

SEQ ID NO: 96574 - DNA, 25 bp, Homo sapien
tcagcatcactccctttaaaggata

SEQ ID NO: 96575 - DNA, 25 bp, Homo sapien
tcagcatcactccttttaaaggata

SEQ ID NO: 96576 - DNA, 25 bp, Homo sapien
tcagcatccatacataggtgcatta

SEQ ID NO: 96577 - DNA, 25 bp, Homo sapien
tcagcatccatacatatgtgcatta

SEQ ID NO: 96578 - DNA, 25 bp, Homo sapien
tcagcatctgtgagattatttcatt

SEQ ID NO: 96579 - DNA, 25 bp, Homo sapien
tcagcatctttgagattatttcatt

SEQ ID NO: 96580 - DNA, 25 bp, Homo sapien
tcagcattattcaagcagctaatta

SEQ ID NO: 96581 - DNA, 25 bp, Homo sapien
tcagcattgttcaagcagctaatta

SEQ ID NO: 96582 - DNA, 25 bp, Homo sapien
tcagccaacacatctctaaaaatta

SEQ ID NO: 96583 - DNA, 25 bp, Homo sapien
tcagccaacgcatctctaaaaatta

SEQ ID NO: 96584 - DNA, 25 bp, Homo sapien
tcagccaatcatccaagcctgtgca

SEQ ID NO: 96585 - DNA, 25 bp, Homo sapien
tcagccaatcatcccagcctgtgca

SEQ ID NO: 96586 - DNA, 25 bp, Homo sapien
tcagccacaccgggaatgatgcttc

SEQ ID NO: 96587 - DNA, 25 bp, Homo sapien
tcagccacattgcatactctgatta

SEQ ID NO: 96588 - DNA, 25 bp, Homo sapien
tcagccacatttatttactgtctgt

SEQ ID NO: 96589 - DNA, 25 bp, Homo sapien
tcagccacgccgggaatgatgcttc

SEQ ID NO: 96590 - DNA, 25 bp, Homo sapien
tcagccacgttgcatactctgatta

SEQ ID NO: 96591 - DNA, 25 bp, Homo sapien
tcagccacgtttatttactgtctgt

SEQ ID NO: 96592 - DNA, 25 bp, Homo sapien
tcagccagaaagatcatgatgaggg

SEQ ID NO: 96593 - DNA, 25 bp, Homo sapien
tcagccaggaagatcatgatgaggg

SEQ ID NO: 96594 - DNA, 25 bp, Homo sapien
tcagccaggctacaacaaggagtct

SEQ ID NO: 96595 - DNA, 25 bp, Homo sapien
tcagccaggctgcaacaaggagtct

SEQ ID NO: 96596 - DNA, 25 bp, Homo sapien
tcagcccagatgcggagtcacagag

SEQ ID NO: 96597 - DNA, 25 bp, Homo sapien
tcagcccagatgtggagtcacagag

SEQ ID NO: 96598 - DNA, 25 bp, Homo sapien
tcagcccatgcccacttcaatctgt

SEQ ID NO: 96599 - DNA, 25 bp, Homo sapien
tcagcccatgccctcttcaatctgt

SEQ ID NO: 96600 - DNA, 25 bp, Homo sapien
tcagccctgatgaatgattttgaag

SEQ ID NO: 96601 - DNA, 25 bp, Homo sapien
tcagccctgatgcatgattttgaag

SEQ ID NO: 96602 - DNA, 25 bp, Homo sapien
tcagccgtagtttcgtcatttcata

SEQ ID NO: 96603 - DNA, 25 bp, Homo sapien
tcagccgtagtttcttcatttcata

SEQ ID NO: 96604 - DNA, 25 bp, Homo sapien
tcagcctagggatgctcacagtaat

SEQ ID NO: 96605 - DNA, 25 bp, Homo sapien
tcagcctagggatgttcacagtaat

SEQ ID NO: 96606 - DNA, 25 bp, Homo sapien
tcagcctcaaatttaacttctggga

SEQ ID NO: 96607 - DNA, 25 bp, Homo sapien
tcagcctctaatttaacttctggga

SEQ ID NO: 96608 - DNA, 25 bp, Homo sapien
tcagcctctcagcgatctctcgtca

SEQ ID NO: 96609 - DNA, 25 bp, Homo sapien
tcagcctctcagtgatctctcgtca

SEQ ID NO: 96610 - DNA, 25 bp, Homo sapien
tcagcctgagcctaaaggcctctag

SEQ ID NO: 96611 - DNA, 25 bp, Homo sapien
tcagcctgcaggtaagccaagtggg

SEQ ID NO: 96612 - DNA, 25 bp, Homo sapien
tcagcctgcaggtaaggcaagtggg

SEQ ID NO: 96613 - DNA, 25 bp, Homo sapien
tcagcctgccaaggttccaataaat

SEQ ID NO: 96614 - DNA, 25 bp, Homo sapien
tcagcctgccaatgttccaataaat

SEQ ID NO: 96615 - DNA, 25 bp, Homo sapien
tcagcctggcatgagttaagttcag

SEQ ID NO: 96616 - DNA, 25 bp, Homo sapien
tcagcctgggatgagttaagttcag

SEQ ID NO: 96617 - DNA, 25 bp, Homo sapien
tcagcctgggcctaaaggcctctag

SEQ ID NO: 96618 - DNA, 25 bp, Homo sapien
tcagccttacaaccttatctcgttg

SEQ ID NO: 96619 - DNA, 25 bp, Homo sapien
tcagccttacaagcttatctcgttg

SEQ ID NO: 96620 - DNA, 25 bp, Homo sapien
tcagccttctatgaaatgtacacct

SEQ ID NO: 96621 - DNA, 25 bp, Homo sapien
tcagccttctctgccacgaattttg

SEQ ID NO: 96622 - DNA, 25 bp, Homo sapien
tcagccttttatgaaatgtacacct

SEQ ID NO: 96623 - DNA, 25 bp, Homo sapien
tcagccttttctgccacgaattttg

SEQ ID NO: 96624 - DNA, 25 bp, Homo sapien
tcagcgaaaacttctaaggatggaa

SEQ ID NO: 96625 - DNA, 25 bp, Homo sapien
tcagcgaaaacttgtaaggatggaa

SEQ ID NO: 96626 - DNA, 25 bp, Homo sapien
tcagcgtgggcctatgatcaagcct

SEQ ID NO: 96627 - DNA, 25 bp, Homo sapien
tcagcgtgggcctatggtcaagcct

SEQ ID NO: 96628 - DNA, 25 bp, Homo sapien
tcagctaaatagagacgttgcagga

SEQ ID NO: 96629 - DNA, 25 bp, Homo sapien
tcagctaaatagaggcgttgcagga

SEQ ID NO: 96630 - DNA, 25 bp, Homo sapien
tcagctaagagacgaagaccatccc

SEQ ID NO: 96631 - DNA, 25 bp, Homo sapien
tcagctaagagactaagaccatccc

SEQ ID NO: 96632 - DNA, 25 bp, Homo sapien
tcagctacagtgcaagctaaaaaca

SEQ ID NO: 96633 - DNA, 25 bp, Homo sapien
tcagctacagtgcgagctaaaaaca

SEQ ID NO: 96634 - DNA, 25 bp, Homo sapien
tcagctacatactgtttcattctca

SEQ ID NO: 96635 - DNA, 25 bp, Homo sapien
tcagctaccaacactgtgttctttg

SEQ ID NO: 96636 - DNA, 25 bp, Homo sapien
tcagctaccaagactgtgttctttg

SEQ ID NO: 96637 - DNA, 25 bp, Homo sapien
tcagctacgtactgtttcattctca

SEQ ID NO: 96638 - DNA, 25 bp, Homo sapien
tcagctcattctttgaatcatttta

SEQ ID NO: 96639 - DNA, 25 bp, Homo sapien
tcagctcattctttgattcatttta

SEQ ID NO: 96640 - DNA, 25 bp, Homo sapien
tcagctccaaccagaatactgcgat

SEQ ID NO: 96641 - DNA, 25 bp, Homo sapien
tcagctccacccagaatactgcgat

SEQ ID NO: 96642 - DNA, 25 bp, Homo sapien
tcagctcttctctcatggtaataca

SEQ ID NO: 96643 - DNA, 25 bp, Homo sapien
tcagctcttctcttatggtaataca

SEQ ID NO: 96644 - DNA, 25 bp, Homo sapien
tcagctctttcattactgtctttta

SEQ ID NO: 96645 - DNA, 25 bp, Homo sapien
tcagctctttcgttactgtctttta

SEQ ID NO: 96646 - DNA, 25 bp, Homo sapien
tcagctgaacagcagtgagtgccag

SEQ ID NO: 96647 - DNA, 25 bp, Homo sapien
tcagctgaatgcagccctatcagtg

SEQ ID NO: 96648 - DNA, 25 bp, Homo sapien
tcagctgaatgtagccctatcagtg

SEQ ID NO: 96649 - DNA, 25 bp, Homo sapien
tcagctgaccagcagtgagtgccag

SEQ ID NO: 96650 - DNA, 25 bp, Homo sapien
tcagctgatccacagtatcttccat

SEQ ID NO: 96651 - DNA, 25 bp, Homo sapien
tcagctgatccgcagtatcttccat

SEQ ID NO: 96652 - DNA, 25 bp, Homo sapien
tcagctgccacttaatgactttacc

SEQ ID NO: 96653 - DNA, 25 bp, Homo sapien
tcagctgccgcttaatgactttacc

SEQ ID NO: 96654 - DNA, 25 bp, Homo sapien
tcagctggggtgctcagaggacgcc

SEQ ID NO: 96655 - DNA, 25 bp, Homo sapien
tcagctggggtgttcagaggacgcc

SEQ ID NO: 96656 - DNA, 25 bp, Homo sapien
tcagctgtaaaaacaccttctctgc

SEQ ID NO: 96657 - DNA, 25 bp, Homo sapien
tcagctgtaaaagcaccttctctgc

SEQ ID NO: 96658 - DNA, 25 bp, Homo sapien
tcagctgtagacctctctgaatagt

SEQ ID NO: 96659 - DNA, 25 bp, Homo sapien
tcagctgtagatctctctgaatagt

SEQ ID NO: 96660 - DNA, 25 bp, Homo sapien
tcagctgtgacattagactctcaca

SEQ ID NO: 96661 - DNA, 25 bp, Homo sapien
tcagctgtggcattagactctcaca

SEQ ID NO: 96662 - DNA, 25 bp, Homo sapien
tcagctgtgtcacatgccttagttt

SEQ ID NO: 96663 - DNA, 25 bp, Homo sapien
tcagctgtgtcatatgccttagttt

SEQ ID NO: 96664 - DNA, 25 bp, Homo sapien
tcagctgttagtatgatatgctgat

SEQ ID NO: 96665 - DNA, 25 bp, Homo sapien
tcagctgttagtgtgatatgctgat

SEQ ID NO: 96666 - DNA, 25 bp, Homo sapien
tcagcttaccaggactttaaactct

SEQ ID NO: 96667 - DNA, 25 bp, Homo sapien
tcagcttaccaggattttaaactct

SEQ ID NO: 96668 - DNA, 25 bp, Homo sapien
tcagcttaccatattttcagagtta

SEQ ID NO: 96669 - DNA, 25 bp, Homo sapien
tcagcttaccatgttttcagagtta

SEQ ID NO: 96670 - DNA, 25 bp, Homo sapien
tcagcttataaacaacattgaaata

SEQ ID NO: 96671 - DNA, 25 bp, Homo sapien
tcagcttataaactacattgaaata

SEQ ID NO: 96672 - DNA, 25 bp, Homo sapien
tcagcttcatatgccggaaattaag

SEQ ID NO: 96673 - DNA, 25 bp, Homo sapien
tcagcttcatatgctggaaattaag

SEQ ID NO: 96674 - DNA, 25 bp, Homo sapien
tcagcttccccaatcactgataact

SEQ ID NO: 96675 - DNA, 25 bp, Homo sapien
tcagcttccccagtcactgataact

SEQ ID NO: 96676 - DNA, 25 bp, Homo sapien
tcagcttcttaaatctgtagactca

SEQ ID NO: 96677 - DNA, 25 bp, Homo sapien
tcagcttcttaactctgtagactca

SEQ ID NO: 96678 - DNA, 25 bp, Homo sapien
tcagcttcttagatgtacttagggc

SEQ ID NO: 96679 - DNA, 25 bp, Homo sapien
tcagcttcttagatgtccttagggc

SEQ ID NO: 96680 - DNA, 25 bp, Homo sapien
tcagcttggcagaaaatgtaatgct

SEQ ID NO: 96681 - DNA, 25 bp, Homo sapien
tcagcttggcaggaaatgtaatgct

SEQ ID NO: 96682 - DNA, 25 bp, Homo sapien
tcagctttcctcctgcttgggtaga

SEQ ID NO: 96683 - DNA, 25 bp, Homo sapien
tcagctttccttctgcttgggtaga

SEQ ID NO: 96684 - DNA, 25 bp, Homo sapien
tcagctttcgatatgcctccctaag

SEQ ID NO: 96685 - DNA, 25 bp, Homo sapien
tcagctttctctcccattctggcat

SEQ ID NO: 96686 - DNA, 25 bp, Homo sapien
tcagctttggcaccaaggccaggga

SEQ ID NO: 96687 - DNA, 25 bp, Homo sapien
tcagctttggcactaaggccaggga

SEQ ID NO: 96688 - DNA, 25 bp, Homo sapien
tcagctttggtgcaatcaaaggaat

SEQ ID NO: 96689 - DNA, 25 bp, Homo sapien
tcagctttggtgcaattaaaggaat

SEQ ID NO: 96690 - DNA, 25 bp, Homo sapien
tcagctttgtctcccattctggcat

SEQ ID NO: 96691 - DNA, 25 bp, Homo sapien
tcagcttttgatatgcctccctaag

SEQ ID NO: 96692 - DNA, 25 bp, Homo sapien
tcaggaaaaatatagccctgaggat

SEQ ID NO: 96693 - DNA, 25 bp, Homo sapien
tcaggaaaaatatggccctgaggat

SEQ ID NO: 96694 - DNA, 25 bp, Homo sapien
tcaggaaaatttagtcgttaccaaa

SEQ ID NO: 96695 - DNA, 25 bp, Homo sapien
tcaggaaagggtgtcggcagggaga

SEQ ID NO: 96696 - DNA, 25 bp, Homo sapien
tcaggaaagggtgttggcagggaga

SEQ ID NO: 96697 - DNA, 25 bp, Homo sapien
tcaggaaagtaacacaagtagtgct

SEQ ID NO: 96698 - DNA, 25 bp, Homo sapien
tcaggaaagtaatacaagtagtgct

SEQ ID NO: 96699 - DNA, 25 bp, Homo sapien
tcaggaaagtttagtcgttaccaaa

SEQ ID NO: 96700 - DNA, 25 bp, Homo sapien
tcaggaaatgtatacgcccgcttag

SEQ ID NO: 96701 - DNA, 25 bp, Homo sapien
tcaggaaatgtatatgcccgcttag

SEQ ID NO: 96702 - DNA, 25 bp, Homo sapien
tcaggaacccatcagcagaaaagaa

SEQ ID NO: 96703 - DNA, 25 bp, Homo sapien
tcaggaacctggacagtgataggac

SEQ ID NO: 96704 - DNA, 25 bp, Homo sapien
tcaggaacctgggcagtgataggac

SEQ ID NO: 96705 - DNA, 25 bp, Homo sapien
tcaggaactcatcagcagaaaagaa

SEQ ID NO: 96706 - DNA, 25 bp, Homo sapien
tcaggaactttaggaatatactgtg

SEQ ID NO: 96707 - DNA, 25 bp, Homo sapien
tcaggaactttagggatatactgtg

SEQ ID NO: 96708 - DNA, 25 bp, Homo sapien
tcaggaagccattaagagattatta

SEQ ID NO: 96709 - DNA, 25 bp, Homo sapien
tcaggaagccattaggagattatta

SEQ ID NO: 96710 - DNA, 25 bp, Homo sapien
tcaggaaggcgccagagacacgatg

SEQ ID NO: 96711 - DNA, 25 bp, Homo sapien
tcaggaaggtgccagagacacgatg

SEQ ID NO: 96712 - DNA, 25 bp, Homo sapien
tcaggaagttgagttttgaatatgc

SEQ ID NO: 96713 - DNA, 25 bp, Homo sapien
tcaggaagttgcgttttgaatatgc

SEQ ID NO: 96714 - DNA, 25 bp, Homo sapien
tcaggaatgacttgagtagtcaaag

SEQ ID NO: 96715 - DNA, 25 bp, Homo sapien
tcaggaatgacttgcgtagtcaaag

SEQ ID NO: 96716 - DNA, 25 bp, Homo sapien
tcaggactgaaacgttatgtaactt

SEQ ID NO: 96717 - DNA, 25 bp, Homo sapien
tcaggactgaaatgttatgtaactt

SEQ ID NO: 96718 - DNA, 25 bp, Homo sapien
tcaggactttgctcgcattactatt

SEQ ID NO: 96719 - DNA, 25 bp, Homo sapien
tcaggactttgctctcattactatt

SEQ ID NO: 96720 - DNA, 25 bp, Homo sapien
tcaggagcaagccagggaagaaagc

SEQ ID NO: 96721 - DNA, 25 bp, Homo sapien
tcaggagcaagtcagggaagaaagc

SEQ ID NO: 96722 - DNA, 25 bp, Homo sapien
tcaggagcctgctgggtgattcaca

SEQ ID NO: 96723 - DNA, 25 bp, Homo sapien
tcaggagcctgttgggtgattcaca

SEQ ID NO: 96724 - DNA, 25 bp, Homo sapien
tcaggagtatcagacgcatttattt

SEQ ID NO: 96725 - DNA, 25 bp, Homo sapien
tcaggagtatcagatgcatttattt

SEQ ID NO: 96726 - DNA, 25 bp, Homo sapien
tcaggagtgcattttgatcatgtta

SEQ ID NO: 96727 - DNA, 25 bp, Homo sapien
tcaggagtgcattttggtcatgtta

SEQ ID NO: 96728 - DNA, 25 bp, Homo sapien
tcaggatcacacaacattctaggtt

SEQ ID NO: 96729 - DNA, 25 bp, Homo sapien
tcaggatcacacagcattctaggtt

SEQ ID NO: 96730 - DNA, 25 bp, Homo sapien
tcaggatccaattactcccattgca

SEQ ID NO: 96731 - DNA, 25 bp, Homo sapien
tcaggatcgaattactcccattgca

SEQ ID NO: 96732 - DNA, 25 bp, Homo sapien
tcaggatctggccacgccaaattgg

SEQ ID NO: 96733 - DNA, 25 bp, Homo sapien
tcaggatctggccatgccaaattgg

SEQ ID NO: 96734 - DNA, 25 bp, Homo sapien
tcaggatgggtacaatgaagcagag

SEQ ID NO: 96735 - DNA, 25 bp, Homo sapien
tcaggatgggtgcaatgaagcagag

SEQ ID NO: 96736 - DNA, 25 bp, Homo sapien
tcaggatgtgtaaaacacttcacat

SEQ ID NO: 96737 - DNA, 25 bp, Homo sapien
tcaggatgtgtaagacacttcacat

SEQ ID NO: 96738 - DNA, 25 bp, Homo sapien
tcaggatttcaaggccaacctgggc

SEQ ID NO: 96739 - DNA, 25 bp, Homo sapien
tcaggatttcaaggtcaacctgggc

SEQ ID NO: 96740 - DNA, 25 bp, Homo sapien
tcaggattttctcattgcctggctg

SEQ ID NO: 96741 - DNA, 25 bp, Homo sapien
tcaggattttctcgttgcctggctg

SEQ ID NO: 96742 - DNA, 25 bp, Homo sapien
tcaggcaaatcatctaagtccccgg

SEQ ID NO: 96743 - DNA, 25 bp, Homo sapien
tcaggcaactatactattatgccaa

SEQ ID NO: 96744 - DNA, 25 bp, Homo sapien
tcaggcaactatattattatgccaa

SEQ ID NO: 96745 - DNA, 25 bp, Homo sapien
tcaggcaactgacaatcatggcaga

SEQ ID NO: 96746 - DNA, 25 bp, Homo sapien
tcaggcaactgacagtcatggcaga

SEQ ID NO: 96747 - DNA, 25 bp, Homo sapien
tcaggcaagtcatctaagtccccgg

SEQ ID NO: 96748 - DNA, 25 bp, Homo sapien
tcaggcaccagggcttcaatgaaac

SEQ ID NO: 96749 - DNA, 25 bp, Homo sapien
tcaggcaccaggtcttcaatgaaac

SEQ ID NO: 96750 - DNA, 25 bp, Homo sapien
tcaggcagaaggcacgacgattgta

SEQ ID NO: 96751 - DNA, 25 bp, Homo sapien
tcaggcagcgaaaaagttctaaaat

SEQ ID NO: 96752 - DNA, 25 bp, Homo sapien
tcaggcaggaggcacgacgattgta

SEQ ID NO: 96753 - DNA, 25 bp, Homo sapien
tcaggcagtgaaaaagttctaaaat

SEQ ID NO: 96754 - DNA, 25 bp, Homo sapien
tcaggcattaatcgaaagtttgaaa

SEQ ID NO: 96755 - DNA, 25 bp, Homo sapien
tcaggcattaattgaaagtttgaaa

SEQ ID NO: 96756 - DNA, 25 bp, Homo sapien
tcaggcatttcacagctttgtgtct

SEQ ID NO: 96757 - DNA, 25 bp, Homo sapien
tcaggcatttcgcagctttgtgtct

SEQ ID NO: 96758 - DNA, 25 bp, Homo sapien
tcaggctaagctgttaattgatgtg

SEQ ID NO: 96759 - DNA, 25 bp, Homo sapien
tcaggctaagctgttatttgatgtg

SEQ ID NO: 96760 - DNA, 25 bp, Homo sapien
tcaggctacataattctttgttgag

SEQ ID NO: 96761 - DNA, 25 bp, Homo sapien
tcaggctacctaattctttgttgag

SEQ ID NO: 96762 - DNA, 25 bp, Homo sapien
tcaggctacggttccagctacacat

SEQ ID NO: 96763 - DNA, 25 bp, Homo sapien
tcaggctatggttccagctacacat

SEQ ID NO: 96764 - DNA, 25 bp, Homo sapien
tcaggctcaggatgaaatcgagtct

SEQ ID NO: 96765 - DNA, 25 bp, Homo sapien
tcaggctcaggttgaaatcgagtct

SEQ ID NO: 96766 - DNA, 25 bp, Homo sapien
tcaggctccttaagtctcatattca

SEQ ID NO: 96767 - DNA, 25 bp, Homo sapien
tcaggctcgttaagtctcatattca

SEQ ID NO: 96768 - DNA, 25 bp, Homo sapien
tcaggctgcatgaatcactttcaag

SEQ ID NO: 96769 - DNA, 25 bp, Homo sapien
tcaggctgcgtgaatcactttcaag

SEQ ID NO: 96770 - DNA, 25 bp, Homo sapien
tcaggcttcacaggccatgcagtct

SEQ ID NO: 96771 - DNA, 25 bp, Homo sapien
tcaggcttcgcaggccatgcagtct

SEQ ID NO: 96772 - DNA, 25 bp, Homo sapien
tcagggaaaattatagatgtccata

SEQ ID NO: 96773 - DNA, 25 bp, Homo sapien
tcagggaaaattatggatgtccata

SEQ ID NO: 96774 - DNA, 25 bp, Homo sapien
tcagggaaagtccacagtgcaaagt

SEQ ID NO: 96775 - DNA, 25 bp, Homo sapien
tcagggaaagtccgcagtgcaaagt

SEQ ID NO: 96776 - DNA, 25 bp, Homo sapien
tcagggaacggggtcacaatgtaat

SEQ ID NO: 96777 - DNA, 25 bp, Homo sapien
tcagggaatggggtcacaatgtaat

SEQ ID NO: 96778 - DNA, 25 bp, Homo sapien
tcagggacgtttcctggaggagctg

SEQ ID NO: 96779 - DNA, 25 bp, Homo sapien
tcagggacttttcctggaggagctg

SEQ ID NO: 96780 - DNA, 25 bp, Homo sapien
tcagggagctcattaactcacaagg

SEQ ID NO: 96781 - DNA, 25 bp, Homo sapien
tcagggagctcattaattcacaagg

SEQ ID NO: 96782 - DNA, 25 bp, Homo sapien
tcagggaggattaaaaagcactggt

SEQ ID NO: 96783 - DNA, 25 bp, Homo sapien
tcagggaggattaacaagcactggt

SEQ ID NO: 96784 - DNA, 25 bp, Homo sapien
tcagggagtaggaaataagagagat

SEQ ID NO: 96785 - DNA, 25 bp, Homo sapien
tcagggagtaggaaatgagagagat

SEQ ID NO: 96786 - DNA, 25 bp, Homo sapien
tcagggatcctttcgatgcactgac

SEQ ID NO: 96787 - DNA, 25 bp, Homo sapien
tcagggatccttttgatgcactgac

SEQ ID NO: 96788 - DNA, 25 bp, Homo sapien
tcagggcaaagaagacaggcatgga

SEQ ID NO: 96789 - DNA, 25 bp, Homo sapien
tcagggcacgatctgtctccaattt

SEQ ID NO: 96790 - DNA, 25 bp, Homo sapien
tcagggcaggatctgtctccaattt

SEQ ID NO: 96791 - DNA, 25 bp, Homo sapien
tcagggcatagaagacaggcatgga

SEQ ID NO: 96792 - DNA, 25 bp, Homo sapien
tcagggcattttgataaataaagga

SEQ ID NO: 96793 - DNA, 25 bp, Homo sapien
tcagggcattttggtaaataaagga

SEQ ID NO: 96794 - DNA, 25 bp, Homo sapien
tcagggccaggcgaggagcttgcag

SEQ ID NO: 96795 - DNA, 25 bp, Homo sapien
tcagggccaggcgtggagcttgcag

SEQ ID NO: 96796 - DNA, 25 bp, Homo sapien
tcagggcctttcacattatttttct

SEQ ID NO: 96797 - DNA, 25 bp, Homo sapien
tcagggcctttcatattatttttct

SEQ ID NO: 96798 - DNA, 25 bp, Homo sapien
tcagggctctgctgtaaatcctaaa

SEQ ID NO: 96799 - DNA, 25 bp, Homo sapien
tcagggctgaagcagtccgcaaggt

SEQ ID NO: 96800 - DNA, 25 bp, Homo sapien
tcagggctgaagcagtgcgcaaggt

SEQ ID NO: 96801 - DNA, 25 bp, Homo sapien
tcagggctttgctgtaaatcctaaa

SEQ ID NO: 96802 - DNA, 25 bp, Homo sapien
tcaggggaaaaaataagcttcagag

SEQ ID NO: 96803 - DNA, 25 bp, Homo sapien
tcaggggaaaaaatgagcttcagag

SEQ ID NO: 96804 - DNA, 25 bp, Homo sapien
tcagggtcattagaaaattggccta

SEQ ID NO: 96805 - DNA, 25 bp, Homo sapien
tcagggtcgttagaaaattggccta

SEQ ID NO: 96806 - DNA, 25 bp, Homo sapien
tcagggtctcacataaaccaaaact

SEQ ID NO: 96807 - DNA, 25 bp, Homo sapien
tcagggtctcacataatccaaaact

SEQ ID NO: 96808 - DNA, 25 bp, Homo sapien
tcagggtttgcaggcagagaaaagg

SEQ ID NO: 96809 - DNA, 25 bp, Homo sapien
tcagggtttgcaggtagagaaaagg

SEQ ID NO: 96810 - DNA, 25 bp, Homo sapien
tcaggtataaaggcaggcgagacag

SEQ ID NO: 96811 - DNA, 25 bp, Homo sapien
tcaggtataaagtcaggcgagacag

SEQ ID NO: 96812 - DNA, 25 bp, Homo sapien
tcaggtcctcaaacttggtcaccca

SEQ ID NO: 96813 - DNA, 25 bp, Homo sapien
tcaggtccttaaacttggtcaccca

SEQ ID NO: 96814 - DNA, 25 bp, Homo sapien
tcaggtctccttaccggcaagtgtt

SEQ ID NO: 96815 - DNA, 25 bp, Homo sapien
tcaggtctccttactggcaagtgtt

SEQ ID NO: 96816 - DNA, 25 bp, Homo sapien
tcaggtctctttttccatgaaatgc

SEQ ID NO: 96817 - DNA, 25 bp, Homo sapien
tcaggtctctttttccgtgaaatgc

SEQ ID NO: 96818 - DNA, 25 bp, Homo sapien
tcaggtgcattccattaaattcctc

SEQ ID NO: 96819 - DNA, 25 bp, Homo sapien
tcaggtgcattccatttaattcctc

SEQ ID NO: 96820 - DNA, 25 bp, Homo sapien
tcaggtggcaggagaaaagcaagaa

SEQ ID NO: 96821 - DNA, 25 bp, Homo sapien
tcaggtggcaggagaacagcaagaa

SEQ ID NO: 96822 - DNA, 25 bp, Homo sapien
tcaggtggcgaacatcccgtccttc

SEQ ID NO: 96823 - DNA, 25 bp, Homo sapien
tcaggtggtgaacatcccgtccttc

SEQ ID NO: 96824 - DNA, 25 bp, Homo sapien
tcaggtgtaaattctgaaacagatg

SEQ ID NO: 96825 - DNA, 25 bp, Homo sapien
tcaggtgtgaattctgaaacagatg

SEQ ID NO: 96826 - DNA, 25 bp, Homo sapien
tcaggttactgagactatgtgagct

SEQ ID NO: 96827 - DNA, 25 bp, Homo sapien
tcaggttactgggactatgtgagct

SEQ ID NO: 96828 - DNA, 25 bp, Homo sapien
tcaggttagattgtcactgtggaag

SEQ ID NO: 96829 - DNA, 25 bp, Homo sapien
tcaggttaggttgtcactgtggaag

SEQ ID NO: 96830 - DNA, 25 bp, Homo sapien
tcaggttatgtcagtttatttggaa

SEQ ID NO: 96831 - DNA, 25 bp, Homo sapien
tcaggttatgtgagtttatttggaa

SEQ ID NO: 96832 - DNA, 25 bp, Homo sapien
tcaggttccagcccatgctgaggtt

SEQ ID NO: 96833 - DNA, 25 bp, Homo sapien
tcaggttccagcccgtgctgaggtt

SEQ ID NO: 96834 - DNA, 25 bp, Homo sapien
tcaggttcccgataatgtttgtcgc

SEQ ID NO: 96835 - DNA, 25 bp, Homo sapien
tcaggttcctgataatgtttgtcgc

SEQ ID NO: 96836 - DNA, 25 bp, Homo sapien
tcaggttgccaagcgccacccttcc

SEQ ID NO: 96837 - DNA, 25 bp, Homo sapien
tcaggttgccaagtgccacccttcc

SEQ ID NO: 96838 - DNA, 25 bp, Homo sapien
tcaggtttgccatactggagcaagt

SEQ ID NO: 96839 - DNA, 25 bp, Homo sapien
tcaggtttgccatagtggagcaagt

SEQ ID NO: 96840 - DNA, 25 bp, Homo sapien
tcagtaaaaggaaagagtaagccaa

SEQ ID NO: 96841 - DNA, 25 bp, Homo sapien
tcagtaaaatgaaagagtaagccaa

SEQ ID NO: 96842 - DNA, 25 bp, Homo sapien
tcagtaaacatactcaagtctctat

SEQ ID NO: 96843 - DNA, 25 bp, Homo sapien
tcagtaaacatagtcaagtctctat

SEQ ID NO: 96844 - DNA, 25 bp, Homo sapien
tcagtaaagcggattcacctgtttg

SEQ ID NO: 96845 - DNA, 25 bp, Homo sapien
tcagtaaagtggattcacctgtttg

SEQ ID NO: 96846 - DNA, 25 bp, Homo sapien
tcagtaacctcacggccacttagca

SEQ ID NO: 96847 - DNA, 25 bp, Homo sapien
tcagtaacctcagggccacttagca

SEQ ID NO: 96848 - DNA, 25 bp, Homo sapien
tcagtaacttcctataagctgaaag

SEQ ID NO: 96849 - DNA, 25 bp, Homo sapien
tcagtaacttcctgtaagctgaaag

SEQ ID NO: 96850 - DNA, 25 bp, Homo sapien
tcagtaatagtaataataatagtag

SEQ ID NO: 96851 - DNA, 25 bp, Homo sapien
tcagtaatagtagtaataatagtag

SEQ ID NO: 96852 - DNA, 25 bp, Homo sapien
tcagtaatgccaacgttctgttagc

SEQ ID NO: 96853 - DNA, 25 bp, Homo sapien
tcagtaatgccaaggttctgttagc

SEQ ID NO: 96854 - DNA, 25 bp, Homo sapien
tcagtaattacaacatggaaaacaa

SEQ ID NO: 96855 - DNA, 25 bp, Homo sapien
tcagtaattccaacatggaaaacaa

SEQ ID NO: 96856 - DNA, 25 bp, Homo sapien
tcagtacagacagtcttcatgcaaa

SEQ ID NO: 96857 - DNA, 25 bp, Homo sapien
tcagtacagacattcttcatgcaaa

SEQ ID NO: 96858 - DNA, 25 bp, Homo sapien
tcagtaccagtttatgacaaaatct

SEQ ID NO: 96859 - DNA, 25 bp, Homo sapien
tcagtacctgtttatgacaaaatct

SEQ ID NO: 96860 - DNA, 25 bp, Homo sapien
tcagtagactcacctgacacataaa

SEQ ID NO: 96861 - DNA, 25 bp, Homo sapien
tcagtagactcatctgacacataaa

SEQ ID NO: 96862 - DNA, 25 bp, Homo sapien
tcagtagcagacacaattatatccc

SEQ ID NO: 96863 - DNA, 25 bp, Homo sapien
tcagtagcagacgcaattatatccc

SEQ ID NO: 96864 - DNA, 25 bp, Homo sapien
tcagtagctgatgtgacgagtggct

SEQ ID NO: 96865 - DNA, 25 bp, Homo sapien
tcagtagctgatgtgatgagtggct

SEQ ID NO: 96866 - DNA, 25 bp, Homo sapien
tcagtagtggtgctgagaggttcct

SEQ ID NO: 96867 - DNA, 25 bp, Homo sapien
tcagtagtggtgcttagaggttcct

SEQ ID NO: 96868 - DNA, 25 bp, Homo sapien
tcagtagtgtcaaagagtttgcttt

SEQ ID NO: 96869 - DNA, 25 bp, Homo sapien
tcagtagtgtcaaggagtttgcttt

SEQ ID NO: 96870 - DNA, 25 bp, Homo sapien
tcagtatagacaaccatccaatttc

SEQ ID NO: 96871 - DNA, 25 bp, Homo sapien
tcagtatagacagccatccaatttc

SEQ ID NO: 96872 - DNA, 25 bp, Homo sapien
tcagtattttgacaagaatttagtg

SEQ ID NO: 96873 - DNA, 25 bp, Homo sapien
tcagtattttggcaagaatttagtg

SEQ ID NO: 96874 - DNA, 25 bp, Homo sapien
tcagtcaaaaggccctaagaggaaa

SEQ ID NO: 96875 - DNA, 25 bp, Homo sapien
tcagtcaaaaggtcctaagaggaaa

SEQ ID NO: 96876 - DNA, 25 bp, Homo sapien
tcagtcaggaacccatcagcagaaa

SEQ ID NO: 96877 - DNA, 25 bp, Homo sapien
tcagtcaggaactcatcagcagaaa

SEQ ID NO: 96878 - DNA, 25 bp, Homo sapien
tcagtcagtctcatactttcaggtt

SEQ ID NO: 96879 - DNA, 25 bp, Homo sapien
tcagtcagtctcatcctttcaggtt

SEQ ID NO: 96880 - DNA, 25 bp, Homo sapien
tcagtcatttgctattctcattgca

SEQ ID NO: 96881 - DNA, 25 bp, Homo sapien
tcagtcatttgctgttctcattgca

SEQ ID NO: 96882 - DNA, 25 bp, Homo sapien
tcagtccagctaaattagaaatata

SEQ ID NO: 96883 - DNA, 25 bp, Homo sapien
tcagtccagttaaattagaaatata

SEQ ID NO: 96884 - DNA, 25 bp, Homo sapien
tcagtccatttctcaggtgaggaaa

SEQ ID NO: 96885 - DNA, 25 bp, Homo sapien
tcagtccatttctcgggtgaggaaa

SEQ ID NO: 96886 - DNA, 25 bp, Homo sapien
tcagtccttgtcaacaaaatggatg

SEQ ID NO: 96887 - DNA, 25 bp, Homo sapien
tcagtccttgtcgacaaaatggatg

SEQ ID NO: 96888 - DNA, 25 bp, Homo sapien
tcagtcgaggccagtttggacaaag

SEQ ID NO: 96889 - DNA, 25 bp, Homo sapien
tcagtcgatgccagtttggacaaag

SEQ ID NO: 96890 - DNA, 25 bp, Homo sapien
tcagtcgtgtttctctaatgagatg

SEQ ID NO: 96891 - DNA, 25 bp, Homo sapien
tcagtcgtgtttgtctaatgagatg

SEQ ID NO: 96892 - DNA, 25 bp, Homo sapien
tcagtctcacacagaaatattaact

SEQ ID NO: 96893 - DNA, 25 bp, Homo sapien
tcagtctcacacggaaatattaact

SEQ ID NO: 96894 - DNA, 25 bp, Homo sapien
tcagtctcagctacatactgtttca

SEQ ID NO: 96895 - DNA, 25 bp, Homo sapien
tcagtctcagctacgtactgtttca

SEQ ID NO: 96896 - DNA, 25 bp, Homo sapien
tcagtctccctgatgattctatcac

SEQ ID NO: 96897 - DNA, 25 bp, Homo sapien
tcagtctctctgatgattctatcac

SEQ ID NO: 96898 - DNA, 25 bp, Homo sapien
tcagtctctggaacgtgggatctaa

SEQ ID NO: 96899 - DNA, 25 bp, Homo sapien
tcagtctctggaatgtgggatctaa

SEQ ID NO: 96900 - DNA, 25 bp, Homo sapien
tcagtcttcatctactttctcagtc

SEQ ID NO: 96901 - DNA, 25 bp, Homo sapien
tcagtcttcgtctactttctcagtc

SEQ ID NO: 96902 - DNA, 25 bp, Homo sapien
tcagtgaaaactaccgaaaacacaa

SEQ ID NO: 96903 - DNA, 25 bp, Homo sapien
tcagtgaaaactacggaaaacacaa

SEQ ID NO: 96904 - DNA, 25 bp, Homo sapien
tcagtgaaagaccagaggattaaat

SEQ ID NO: 96905 - DNA, 25 bp, Homo sapien
tcagtgaaagaccggaggattaaat

SEQ ID NO: 96906 - DNA, 25 bp, Homo sapien
tcagtgaagttaatcgtgccccaaa

SEQ ID NO: 96907 - DNA, 25 bp, Homo sapien
tcagtgaagttcatcgtgccccaaa

SEQ ID NO: 96908 - DNA, 25 bp, Homo sapien
tcagtgacaaagtacaaactgttgg

SEQ ID NO: 96909 - DNA, 25 bp, Homo sapien
tcagtgaccaagtacaaactgttgg

SEQ ID NO: 96910 - DNA, 25 bp, Homo sapien
tcagtgaccatatgttgcctgtttc

SEQ ID NO: 96911 - DNA, 25 bp, Homo sapien
tcagtgaccatattttgcctgtttc

SEQ ID NO: 96912 - DNA, 25 bp, Homo sapien
tcagtgagtcatccaatgccctata

SEQ ID NO: 96913 - DNA, 25 bp, Homo sapien
tcagtgagtcatgcaatgccctata

SEQ ID NO: 96914 - DNA, 25 bp, Homo sapien
tcagtgcatcttacttcatgagaaa

SEQ ID NO: 96915 - DNA, 25 bp, Homo sapien
tcagtgcatcttactttatgagaaa

SEQ ID NO: 96916 - DNA, 25 bp, Homo sapien
tcagtgccaattgaaacacatatac

SEQ ID NO: 96917 - DNA, 25 bp, Homo sapien
tcagtgccagctctgtgacagtgct

SEQ ID NO: 96918 - DNA, 25 bp, Homo sapien
tcagtgccagctttgtgacagtgct

SEQ ID NO: 96919 - DNA, 25 bp, Homo sapien
tcagtgccagttgaaacacatatac

SEQ ID NO: 96920 - DNA, 25 bp, Homo sapien
tcagtgccgagtaaagtgtgataca

SEQ ID NO: 96921 - DNA, 25 bp, Homo sapien
tcagtgccgagtgaagtgtgataca

SEQ ID NO: 96922 - DNA, 25 bp, Homo sapien
tcagtgctattgtagagttggggca

SEQ ID NO: 96923 - DNA, 25 bp, Homo sapien
tcagtgctgttcatgactcaatttc

SEQ ID NO: 96924 - DNA, 25 bp, Homo sapien
tcagtgctgttcgtgactcaatttc

SEQ ID NO: 96925 - DNA, 25 bp, Homo sapien
tcagtgctgttgtagagttggggca

SEQ ID NO: 96926 - DNA, 25 bp, Homo sapien
tcagtggaacctttcacattctttt

SEQ ID NO: 96927 - DNA, 25 bp, Homo sapien
tcagtggaagctttcacattctttt

SEQ ID NO: 96928 - DNA, 25 bp, Homo sapien
tcagtggagccctgtcatccttaaa

SEQ ID NO: 96929 - DNA, 25 bp, Homo sapien
tcagtggagccctgtcgtccttaaa

SEQ ID NO: 96930 - DNA, 25 bp, Homo sapien
tcagtggctgaagtgtggttttaat

SEQ ID NO: 96931 - DNA, 25 bp, Homo sapien
tcagtggctgaggtgtggttttaat

SEQ ID NO: 96932 - DNA, 25 bp, Homo sapien
tcagtgggcaaaaacctaccaacac

SEQ ID NO: 96933 - DNA, 25 bp, Homo sapien
tcagtgggcaaaaagctaccaacac

SEQ ID NO: 96934 - DNA, 25 bp, Homo sapien
tcagtggtgctcccagaggctcggg

SEQ ID NO: 96935 - DNA, 25 bp, Homo sapien
tcagtggtgcttccagaggctcggg

SEQ ID NO: 96936 - DNA, 25 bp, Homo sapien
tcagtggttctcgcactcccaaagc

SEQ ID NO: 96937 - DNA, 25 bp, Homo sapien
tcagtggttcttgcactcccaaagc

SEQ ID NO: 96938 - DNA, 25 bp, Homo sapien
tcagtgtaaacatcaaagatcttat

SEQ ID NO: 96939 - DNA, 25 bp, Homo sapien
tcagtgtaaacgtcaaagatcttat

SEQ ID NO: 96940 - DNA, 25 bp, Homo sapien
tcagtgtcacatgaccatcccagtt

SEQ ID NO: 96941 - DNA, 25 bp, Homo sapien
tcagtgtcacatgaccgtcccagtt

SEQ ID NO: 96942 - DNA, 25 bp, Homo sapien
tcagtgtccaacctctttgctcatt

SEQ ID NO: 96943 - DNA, 25 bp, Homo sapien
tcagtgtccaatctctttgctcatt

SEQ ID NO: 96944 - DNA, 25 bp, Homo sapien
tcagtgtgggaacatgcacttgtgt

SEQ ID NO: 96945 - DNA, 25 bp, Homo sapien
tcagtgtggtaacatgcacttgtgt

SEQ ID NO: 96946 - DNA, 25 bp, Homo sapien
tcagtgttgaactcagtatgtttaa

SEQ ID NO: 96947 - DNA, 25 bp, Homo sapien
tcagtgttgaactcggtatgtttaa

SEQ ID NO: 96948 - DNA, 25 bp, Homo sapien
tcagttaatcggtaatatctcctag

SEQ ID NO: 96949 - DNA, 25 bp, Homo sapien
tcagttaatgtgacttttgttttta

SEQ ID NO: 96950 - DNA, 25 bp, Homo sapien
tcagttaatgtgatttttgttttta

SEQ ID NO: 96951 - DNA, 25 bp, Homo sapien
tcagttaattggtaatatctcctag

SEQ ID NO: 96952 - DNA, 25 bp, Homo sapien
tcagttacaccctacgcacatgaag

SEQ ID NO: 96953 - DNA, 25 bp, Homo sapien
tcagttacaccctatgcacatgaag

SEQ ID NO: 96954 - DNA, 25 bp, Homo sapien
tcagttacattaacggctcaaagtt

SEQ ID NO: 96955 - DNA, 25 bp, Homo sapien
tcagttacattgacggctcaaagtt

SEQ ID NO: 96956 - DNA, 25 bp, Homo sapien
tcagttaccagctcatcttcccagg

SEQ ID NO: 96957 - DNA, 25 bp, Homo sapien
tcagttaccagcttatcttcccagg

SEQ ID NO: 96958 - DNA, 25 bp, Homo sapien
tcagttacgcactttaaatccatgc

SEQ ID NO: 96959 - DNA, 25 bp, Homo sapien
tcagttactcactttaaatccatgc

SEQ ID NO: 96960 - DNA, 25 bp, Homo sapien
tcagttagcattttcagcttcccaa

SEQ ID NO: 96961 - DNA, 25 bp, Homo sapien
tcagttagtattttcagcttcccaa

SEQ ID NO: 96962 - DNA, 25 bp, Homo sapien
tcagttcagctgcttcaaacataga

SEQ ID NO: 96963 - DNA, 25 bp, Homo sapien
tcagttcagttgcttcaaacataga

SEQ ID NO: 96964 - DNA, 25 bp, Homo sapien
tcagttcatcaattgaattttacag

SEQ ID NO: 96965 - DNA, 25 bp, Homo sapien
tcagttcatcatttgaattttacag

SEQ ID NO: 96966 - DNA, 25 bp, Homo sapien
tcagttccgactctaacttgtgatc

SEQ ID NO: 96967 - DNA, 25 bp, Homo sapien
tcagttccgcctctaacttgtgatc

SEQ ID NO: 96968 - DNA, 25 bp, Homo sapien
tcagttcctccacgcgtaaatacaa

SEQ ID NO: 96969 - DNA, 25 bp, Homo sapien
tcagttcctccatgcgtaaatacaa

SEQ ID NO: 96970 - DNA, 25 bp, Homo sapien
tcagttcttttagcatatgtgaaaa

SEQ ID NO: 96971 - DNA, 25 bp, Homo sapien
tcagttcttttagcatgtgtgaaaa

SEQ ID NO: 96972 - DNA, 25 bp, Homo sapien
tcagttgaagacctcacttattatt

SEQ ID NO: 96973 - DNA, 25 bp, Homo sapien
tcagttgaagatctcacttattatt

SEQ ID NO: 96974 - DNA, 25 bp, Homo sapien
tcagttgcgtttctgtgatttgcag

SEQ ID NO: 96975 - DNA, 25 bp, Homo sapien
tcagttgcgtttttgtgatttgcag

SEQ ID NO: 96976 - DNA, 25 bp, Homo sapien
tcagttggattttgcttccattaat

SEQ ID NO: 96977 - DNA, 25 bp, Homo sapien
tcagttggattttgtttccattaat

SEQ ID NO: 96978 - DNA, 25 bp, Homo sapien
tcagttggctgggataaaaactcat

SEQ ID NO: 96979 - DNA, 25 bp, Homo sapien
tcagttggttgggataaaaactcat

SEQ ID NO: 96980 - DNA, 25 bp, Homo sapien
tcagttgtgatagctccttgatttt

SEQ ID NO: 96981 - DNA, 25 bp, Homo sapien
tcagttgtgatatctccttgatttt

SEQ ID NO: 96982 - DNA, 25 bp, Homo sapien
tcagtttaatcaaaccaacaagcat

SEQ ID NO: 96983 - DNA, 25 bp, Homo sapien
tcagtttaatcaaatcaacaagcat

SEQ ID NO: 96984 - DNA, 25 bp, Homo sapien
tcagtttattttccttctattgaat

SEQ ID NO: 96985 - DNA, 25 bp, Homo sapien
tcagtttattttctttctattgaat

SEQ ID NO: 96986 - DNA, 25 bp, Homo sapien
tcagtttcaattcagtttcttttca

SEQ ID NO: 96987 - DNA, 25 bp, Homo sapien
tcagtttcagttcagtttcttttca

SEQ ID NO: 96988 - DNA, 25 bp, Homo sapien
tcagtttccagggcttagaatgtgg

SEQ ID NO: 96989 - DNA, 25 bp, Homo sapien
tcagtttccagggtttagaatgtgg

SEQ ID NO: 96990 - DNA, 25 bp, Homo sapien
tcagtttggattaaagacaattcat

SEQ ID NO: 96991 - DNA, 25 bp, Homo sapien
tcagtttggattaaaggcaattcat

SEQ ID NO: 96992 - DNA, 25 bp, Homo sapien
tcagttttaaccttgctagcctaat

SEQ ID NO: 96993 - DNA, 25 bp, Homo sapien
tcagttttaacgttgctagcctaat

SEQ ID NO: 96994 - DNA, 25 bp, Homo sapien
tcagttttatggctgcagtatttaa

SEQ ID NO: 96995 - DNA, 25 bp, Homo sapien
tcagttttatggttcgatacatttc

SEQ ID NO: 96996 - DNA, 25 bp, Homo sapien
tcagttttatggttgcagtatttaa

SEQ ID NO: 96997 - DNA, 25 bp, Homo sapien
tcagttttatggtttgatacatttc

SEQ ID NO: 96998 - DNA, 25 bp, Homo sapien
tcagttttcagcgatcaggaagact

SEQ ID NO: 96999 - DNA, 25 bp, Homo sapien
tcagttttcagggatcaggaagact

SEQ ID NO: 97000 - DNA, 25 bp, Homo sapien
tcataaaaattacaaataaaacatt

SEQ ID NO: 97001 - DNA, 25 bp, Homo sapien
tcataaaacactccaaatacccaga

SEQ ID NO: 97002 - DNA, 25 bp, Homo sapien
tcataaaacactccgaatacccaga

SEQ ID NO: 97003 - DNA, 25 bp, Homo sapien
tcataaaagttacaaataaaacatt

SEQ ID NO: 97004 - DNA, 25 bp, Homo sapien
tcataaaatatacctgattacattt

SEQ ID NO: 97005 - DNA, 25 bp, Homo sapien
tcataaaatatacctgtttacattt

SEQ ID NO: 97006 - DNA, 25 bp, Homo sapien
tcataaaattgactatggtaggaga

SEQ ID NO: 97007 - DNA, 25 bp, Homo sapien
tcataaaattgactctggtaggaga

SEQ ID NO: 97008 - DNA, 25 bp, Homo sapien
tcataaacctgacctggacggtgtg

SEQ ID NO: 97009 - DNA, 25 bp, Homo sapien
tcataaacgtgacctggacggtgtg

SEQ ID NO: 97010 - DNA, 25 bp, Homo sapien
tcataaactattacacatttgccaa

SEQ ID NO: 97011 - DNA, 25 bp, Homo sapien
tcataaactattatacatttgccaa

SEQ ID NO: 97012 - DNA, 25 bp, Homo sapien
tcataaagacggtaaagagtctatt

SEQ ID NO: 97013 - DNA, 25 bp, Homo sapien
tcataaagatggtaaagagtctatt

SEQ ID NO: 97014 - DNA, 25 bp, Homo sapien
tcataaagttactaagaagaggcaa

SEQ ID NO: 97015 - DNA, 25 bp, Homo sapien
tcataaagttactcagaagaggcaa

SEQ ID NO: 97016 - DNA, 25 bp, Homo sapien
tcataacacacaaatgtaagggaag

SEQ ID NO: 97017 - DNA, 25 bp, Homo sapien
tcataacacgcaaatgtaagggaag

SEQ ID NO: 97018 - DNA, 25 bp, Homo sapien
tcataacataatcaatttagatgca

SEQ ID NO: 97019 - DNA, 25 bp, Homo sapien
tcataacataatcagtttagatgca

SEQ ID NO: 97020 - DNA, 25 bp, Homo sapien
tcataaccacccaaacttggaagca

SEQ ID NO: 97021 - DNA, 25 bp, Homo sapien
tcataaccatccaaacttggaagca

SEQ ID NO: 97022 - DNA, 25 bp, Homo sapien
tcataacttagtcatatttctcttg

SEQ ID NO: 97023 - DNA, 25 bp, Homo sapien
tcataacttagtcgtatttctcttg

SEQ ID NO: 97024 - DNA, 25 bp, Homo sapien
tcataagactcgcccaccaatgtcg

SEQ ID NO: 97025 - DNA, 25 bp, Homo sapien
tcataagatcaataccaatgtatct

SEQ ID NO: 97026 - DNA, 25 bp, Homo sapien
tcataagatcaatatcaatgtatct

SEQ ID NO: 97027 - DNA, 25 bp, Homo sapien
tcataagattcgcccaccaatgtcg

SEQ ID NO: 97028 - DNA, 25 bp, Homo sapien
tcataagattgagagattaccctgg

SEQ ID NO: 97029 - DNA, 25 bp, Homo sapien
tcataagattgggagattaccctgg

SEQ ID NO: 97030 - DNA, 25 bp, Homo sapien
tcataagcctgcaaaaataagattt

SEQ ID NO: 97031 - DNA, 25 bp, Homo sapien
tcataagcctgcgaaaataagattt

SEQ ID NO: 97032 - DNA, 25 bp, Homo sapien
tcataaggaagaaagtttggtttgg

SEQ ID NO: 97033 - DNA, 25 bp, Homo sapien
tcataaggaagcaagtttggtttgg

SEQ ID NO: 97034 - DNA, 25 bp, Homo sapien
tcataaggacagaaagtatttgttg

SEQ ID NO: 97035 - DNA, 25 bp, Homo sapien
tcataaggacagaaggtatttgttg

SEQ ID NO: 97036 - DNA, 25 bp, Homo sapien
tcataagggaaacataacttgcaac

SEQ ID NO: 97037 - DNA, 25 bp, Homo sapien
tcataagggaaccataacttgcaac

SEQ ID NO: 97038 - DNA, 25 bp, Homo sapien
tcataagggtctataaaagtagaaa

SEQ ID NO: 97039 - DNA, 25 bp, Homo sapien
tcataagggtctgtaaaagtagaaa

SEQ ID NO: 97040 - DNA, 25 bp, Homo sapien
tcataaggttactaagaggattgag

SEQ ID NO: 97041 - DNA, 25 bp, Homo sapien
tcataaggttactatgaggattgag

SEQ ID NO: 97042 - DNA, 25 bp, Homo sapien
tcataagtgctctaggacataacca

SEQ ID NO: 97043 - DNA, 25 bp, Homo sapien
tcataagtgctctagggcataacca

SEQ ID NO: 97044 - DNA, 25 bp, Homo sapien
tcataatatttcctgacatgtgaac

SEQ ID NO: 97045 - DNA, 25 bp, Homo sapien
tcataatattttctgacatgtgaac

SEQ ID NO: 97046 - DNA, 25 bp, Homo sapien
tcataatcaaaaagcatcatctaat

SEQ ID NO: 97047 - DNA, 25 bp, Homo sapien
tcataatccaaaagcatcatctaat

SEQ ID NO: 97048 - DNA, 25 bp, Homo sapien
tcataattctagcaaagagtcctaa

SEQ ID NO: 97049 - DNA, 25 bp, Homo sapien
tcataattctaggaaagagtcctaa

SEQ ID NO: 97050 - DNA, 25 bp, Homo sapien
tcataatttttgagttacagctcaa

SEQ ID NO: 97051 - DNA, 25 bp, Homo sapien
tcataattttttagttacagctcaa

SEQ ID NO: 97052 - DNA, 25 bp, Homo sapien
tcatacaaccacagcagtcctaaaa

SEQ ID NO: 97053 - DNA, 25 bp, Homo sapien
tcatacaaccagagcagtcctaaaa

SEQ ID NO: 97054 - DNA, 25 bp, Homo sapien
tcatacaataagctcaagaaacaaa

SEQ ID NO: 97055 - DNA, 25 bp, Homo sapien
tcatacaatgagctcaagaaacaaa

SEQ ID NO: 97056 - DNA, 25 bp, Homo sapien
tcatacacagctactggggatgtaa

SEQ ID NO: 97057 - DNA, 25 bp, Homo sapien
tcatacaccgctactggggatgtaa

SEQ ID NO: 97058 - DNA, 25 bp, Homo sapien
tcatacacctcataaaaacttcagt

SEQ ID NO: 97059 - DNA, 25 bp, Homo sapien
tcatacacctcgtaaaaacttcagt

SEQ ID NO: 97060 - DNA, 25 bp, Homo sapien
tcatacacgtaaatctcaatctgga

SEQ ID NO: 97061 - DNA, 25 bp, Homo sapien
tcatacacgtaaatcttaatctgga

SEQ ID NO: 97062 - DNA, 25 bp, Homo sapien
tcatacacttgctgttgtctctgtg

SEQ ID NO: 97063 - DNA, 25 bp, Homo sapien
tcatacacttgcttttgtctctgtg

SEQ ID NO: 97064 - DNA, 25 bp, Homo sapien
tcataccaaaaaaataaaaaggaaa

SEQ ID NO: 97065 - DNA, 25 bp, Homo sapien
tcataccacaaaaataaaaaggaaa

SEQ ID NO: 97066 - DNA, 25 bp, Homo sapien
tcataccaccttaagtttttcaaat

SEQ ID NO: 97067 - DNA, 25 bp, Homo sapien
tcataccatcttaagtttttcaaat

SEQ ID NO: 97068 - DNA, 25 bp, Homo sapien
tcataccctatagttaaaaaatgta

SEQ ID NO: 97069 - DNA, 25 bp, Homo sapien
tcataccctatggttaaaaaatgta

SEQ ID NO: 97070 - DNA, 25 bp, Homo sapien
tcataccctgtgctctgaacattgc

SEQ ID NO: 97071 - DNA, 25 bp, Homo sapien
tcataccctgtgttctgaacattgc

SEQ ID NO: 97072 - DNA, 25 bp, Homo sapien
tcatactgcccacaatgcagctgca

SEQ ID NO: 97073 - DNA, 25 bp, Homo sapien
tcatactgcccaccatgcagctgca

SEQ ID NO: 97074 - DNA, 25 bp, Homo sapien
tcatactggatcataaaggccaact

SEQ ID NO: 97075 - DNA, 25 bp, Homo sapien
tcatactggattagagtaggcctta

SEQ ID NO: 97076 - DNA, 25 bp, Homo sapien
tcatactggattagcgtaggcctta

SEQ ID NO: 97077 - DNA, 25 bp, Homo sapien
tcatactggattataaaggccaact

SEQ ID NO: 97078 - DNA, 25 bp, Homo sapien
tcatacttaatttgcgtttctttaa

SEQ ID NO: 97079 - DNA, 25 bp, Homo sapien
tcatacttaatttgtgtttctttaa

SEQ ID NO: 97080 - DNA, 25 bp, Homo sapien
tcatacttatctcggtctgagtcag

SEQ ID NO: 97081 - DNA, 25 bp, Homo sapien
tcatacttatcttggtctgagtcag

SEQ ID NO: 97082 - DNA, 25 bp, Homo sapien
tcatactttcacagaactgtaacta

SEQ ID NO: 97083 - DNA, 25 bp, Homo sapien
tcatactttcatagaactgtaacta

SEQ ID NO: 97084 - DNA, 25 bp, Homo sapien
tcatactttttggtttcctggcttc

SEQ ID NO: 97085 - DNA, 25 bp, Homo sapien
tcatacttttttgtttcctggcttc

SEQ ID NO: 97086 - DNA, 25 bp, Homo sapien
tcatagaaacagaagacatgacttt

SEQ ID NO: 97087 - DNA, 25 bp, Homo sapien
tcatagaagcagaagacatgacttt

SEQ ID NO: 97088 - DNA, 25 bp, Homo sapien
tcatagaattcacataggattcatg

SEQ ID NO: 97089 - DNA, 25 bp, Homo sapien
tcatagaattcacgtaggattcatg

SEQ ID NO: 97090 - DNA, 25 bp, Homo sapien
tcatagacatcctggcagctaagtc

SEQ ID NO: 97091 - DNA, 25 bp, Homo sapien
tcatagacatcttggcagctaagtc

SEQ ID NO: 97092 - DNA, 25 bp, Homo sapien
tcatagagtttgcagactagtgaga

SEQ ID NO: 97093 - DNA, 25 bp, Homo sapien
tcatagagtttggagactagtgaga

SEQ ID NO: 97094 - DNA, 25 bp, Homo sapien
tcatagataacacaaacgaagagaa

SEQ ID NO: 97095 - DNA, 25 bp, Homo sapien
tcatagataacacaaatgaagagaa

SEQ ID NO: 97096 - DNA, 25 bp, Homo sapien
tcatagatacatgtcaaaacttacc

SEQ ID NO: 97097 - DNA, 25 bp, Homo sapien
tcatagatatatgtcaaaacttacc

SEQ ID NO: 97098 - DNA, 25 bp, Homo sapien
tcatagatattcacattatctgtag

SEQ ID NO: 97099 - DNA, 25 bp, Homo sapien
tcatagatattcgcattatctgtag

SEQ ID NO: 97100 - DNA, 25 bp, Homo sapien
tcatagccacgatgtacctccttcc

SEQ ID NO: 97101 - DNA, 25 bp, Homo sapien
tcatagccacgttgtacctccttcc

SEQ ID NO: 97102 - DNA, 25 bp, Homo sapien
tcatagccagctacaacttgggcag

SEQ ID NO: 97103 - DNA, 25 bp, Homo sapien
tcatagccagctacgacttgggcag

SEQ ID NO: 97104 - DNA, 25 bp, Homo sapien
tcatagctgttactgccacttaaag

SEQ ID NO: 97105 - DNA, 25 bp, Homo sapien
tcatagctgttattgccacttaaag

SEQ ID NO: 97106 - DNA, 25 bp, Homo sapien
tcatagctttcacgacaataaaatg

SEQ ID NO: 97107 - DNA, 25 bp, Homo sapien
tcatagctttcatgacaataaaatg

SEQ ID NO: 97108 - DNA, 25 bp, Homo sapien
tcataggtaaaagactttgtactgt

SEQ ID NO: 97109 - DNA, 25 bp, Homo sapien
tcataggtaaaatactttgtactgt

SEQ ID NO: 97110 - DNA, 25 bp, Homo sapien
tcataggttcttccatttctgttat

SEQ ID NO: 97111 - DNA, 25 bp, Homo sapien
tcataggttcttccgtttctgttat

SEQ ID NO: 97112 - DNA, 25 bp, Homo sapien
tcatagtagacactaagaaaatgga

SEQ ID NO: 97113 - DNA, 25 bp, Homo sapien
tcatagtagacagtaagaaaatgga

SEQ ID NO: 97114 - DNA, 25 bp, Homo sapien
tcatagtagcacatgactttgaaag

SEQ ID NO: 97115 - DNA, 25 bp, Homo sapien
tcatagtagcacgtgactttgaaag

SEQ ID NO: 97116 - DNA, 25 bp, Homo sapien
tcatagtcaaacagctcatcagtgt

SEQ ID NO: 97117 - DNA, 25 bp, Homo sapien
tcatagtcaaacagttcatcagtgt

SEQ ID NO: 97118 - DNA, 25 bp, Homo sapien
tcatagtctcaaatgttcatgagat

SEQ ID NO: 97119 - DNA, 25 bp, Homo sapien
tcatagtctcacatgttcatgagat

SEQ ID NO: 97120 - DNA, 25 bp, Homo sapien
tcatagtctgtttcctgcttctata

SEQ ID NO: 97121 - DNA, 25 bp, Homo sapien
tcatagtctgttttctgcttctata

SEQ ID NO: 97122 - DNA, 25 bp, Homo sapien
tcatagtgcgagttcagatattccc

SEQ ID NO: 97123 - DNA, 25 bp, Homo sapien
tcatagtgggagttcagatattccc

SEQ ID NO: 97124 - DNA, 25 bp, Homo sapien
tcatagttttctactggaccccacc

SEQ ID NO: 97125 - DNA, 25 bp, Homo sapien
tcatagttttctattggaccccacc

SEQ ID NO: 97126 - DNA, 25 bp, Homo sapien
tcatatacctccaattgtaaacacc

SEQ ID NO: 97127 - DNA, 25 bp, Homo sapien
tcatatacctccagttgtaaacacc

SEQ ID NO: 97128 - DNA, 25 bp, Homo sapien
tcatatataggtgaaaagatttgcc

SEQ ID NO: 97129 - DNA, 25 bp, Homo sapien
tcatatataggtgaaatgatttgcc

SEQ ID NO: 97130 - DNA, 25 bp, Homo sapien
tcatatatttttcaaactacctcca

SEQ ID NO: 97131 - DNA, 25 bp, Homo sapien
tcatatatttttgaaactacctcca

SEQ ID NO: 97132 - DNA, 25 bp, Homo sapien
tcatatcaagaaaggagaagcccaa

SEQ ID NO: 97133 - DNA, 25 bp, Homo sapien
tcatatcaagaagggagaagcccaa

SEQ ID NO: 97134 - DNA, 25 bp, Homo sapien
tcatatcagaacatacagatctacc

SEQ ID NO: 97135 - DNA, 25 bp, Homo sapien
tcatatcagcacatacagatctacc

SEQ ID NO: 97136 - DNA, 25 bp, Homo sapien
tcatatctgtttaggtgcaactttg

SEQ ID NO: 97137 - DNA, 25 bp, Homo sapien
tcatatctgtttaggttcaactttg

SEQ ID NO: 97138 - DNA, 25 bp, Homo sapien
tcatatgaggtttaggtcctctttc

SEQ ID NO: 97139 - DNA, 25 bp, Homo sapien
tcatatgaggtttgggtcctctttc

SEQ ID NO: 97140 - DNA, 25 bp, Homo sapien
tcatatgctcacatgacatctgtgt

SEQ ID NO: 97141 - DNA, 25 bp, Homo sapien
tcatatgcttacatgacatctgtgt

SEQ ID NO: 97142 - DNA, 25 bp, Homo sapien
tcatatgtactcattgcaacaaatg

SEQ ID NO: 97143 - DNA, 25 bp, Homo sapien
tcatatgtactcgttgcaacaaatg

SEQ ID NO: 97144 - DNA, 25 bp, Homo sapien
tcatattagacctgcgttctaccta

SEQ ID NO: 97145 - DNA, 25 bp, Homo sapien
tcatattagacctgtgttctaccta

SEQ ID NO: 97146 - DNA, 25 bp, Homo sapien
tcatattatctctaggcagtaaatc

SEQ ID NO: 97147 - DNA, 25 bp, Homo sapien
tcatattatttctaggcagtaaatc

SEQ ID NO: 97148 - DNA, 25 bp, Homo sapien
tcatattcaaatactctgcttggtt

SEQ ID NO: 97149 - DNA, 25 bp, Homo sapien
tcatattcaaatgctctgcttggtt

SEQ ID NO: 97150 - DNA, 25 bp, Homo sapien
tcatattctgctataaattaaacag

SEQ ID NO: 97151 - DNA, 25 bp, Homo sapien
tcatattctgctgtaaattaaacag

SEQ ID NO: 97152 - DNA, 25 bp, Homo sapien
tcatatttcttaaactagcctgaca

SEQ ID NO: 97153 - DNA, 25 bp, Homo sapien
tcatattttttaaactagcctgaca

SEQ ID NO: 97154 - DNA, 25 bp, Homo sapien
tcatattttttgtatgcttcctttc

SEQ ID NO: 97155 - DNA, 25 bp, Homo sapien
tcatattttttgtgtgcttcctttc

SEQ ID NO: 97156 - DNA, 25 bp, Homo sapien
tcatcaaaattcctgccttacacta

SEQ ID NO: 97157 - DNA, 25 bp, Homo sapien
tcatcaaaatttctgccttacacta

SEQ ID NO: 97158 - DNA, 25 bp, Homo sapien
tcatcaacactccttattaactgct

SEQ ID NO: 97159 - DNA, 25 bp, Homo sapien
tcatcaacacttcttattaactgct

SEQ ID NO: 97160 - DNA, 25 bp, Homo sapien
tcatcaacttcattgcacttttccc

SEQ ID NO: 97161 - DNA, 25 bp, Homo sapien
tcatcaacttcatttcacttttccc

SEQ ID NO: 97162 - DNA, 25 bp, Homo sapien
tcatcaattaggtttttttgtttat

SEQ ID NO: 97163 - DNA, 25 bp, Homo sapien
tcatcaattagttttttttgtttat

SEQ ID NO: 97164 - DNA, 25 bp, Homo sapien
tcatcacaaaactctttattctcca

SEQ ID NO: 97165 - DNA, 25 bp, Homo sapien
tcatcacaaacaccctagttcaatc

SEQ ID NO: 97166 - DNA, 25 bp, Homo sapien
tcatcacaaacgccctagttcaatc

SEQ ID NO: 97167 - DNA, 25 bp, Homo sapien
tcatcacaagactctttattctcca

SEQ ID NO: 97168 - DNA, 25 bp, Homo sapien
tcatcacacactagtcattctattt

SEQ ID NO: 97169 - DNA, 25 bp, Homo sapien
tcatcacatactagtcattctattt

SEQ ID NO: 97170 - DNA, 25 bp, Homo sapien
tcatcacgagtagagtttgtttcaa

SEQ ID NO: 97171 - DNA, 25 bp, Homo sapien
tcatcacgagtagattttgtttcaa

SEQ ID NO: 97172 - DNA, 25 bp, Homo sapien
tcatcacggcatctttcattgcagt

SEQ ID NO: 97173 - DNA, 25 bp, Homo sapien
tcatcacggtatctttcattgcagt

SEQ ID NO: 97174 - DNA, 25 bp, Homo sapien
tcatcactagaaacaaaaagggtcc

SEQ ID NO: 97175 - DNA, 25 bp, Homo sapien
tcatcactctgacgttggtgcgctt

SEQ ID NO: 97176 - DNA, 25 bp, Homo sapien
tcatcactctgatgttggtgcgctt

SEQ ID NO: 97177 - DNA, 25 bp, Homo sapien
tcatcactggaaacaaaaagggtcc

SEQ ID NO: 97178 - DNA, 25 bp, Homo sapien
tcatcacttcacaccgggatggctg

SEQ ID NO: 97179 - DNA, 25 bp, Homo sapien
tcatcacttcacactgggatggctg

SEQ ID NO: 97180 - DNA, 25 bp, Homo sapien
tcatcagcatattctgtaaagatag

SEQ ID NO: 97181 - DNA, 25 bp, Homo sapien
tcatcagcgtattctgtaaagatag

SEQ ID NO: 97182 - DNA, 25 bp, Homo sapien
tcatcaggctggctggactctcgct

SEQ ID NO: 97183 - DNA, 25 bp, Homo sapien
tcatcaggctggttggactctcgct

SEQ ID NO: 97184 - DNA, 25 bp, Homo sapien
tcatcagtaaagcggattcacctgt

SEQ ID NO: 97185 - DNA, 25 bp, Homo sapien
tcatcagtaaagtggattcacctgt

SEQ ID NO: 97186 - DNA, 25 bp, Homo sapien
tcatcagtaattacaacatggaaaa

SEQ ID NO: 97187 - DNA, 25 bp, Homo sapien
tcatcagtaattccaacatggaaaa

SEQ ID NO: 97188 - DNA, 25 bp, Homo sapien
tcatcagtcacttggaggacaaatt

SEQ ID NO: 97189 - DNA, 25 bp, Homo sapien
tcatcagtgtgcaccttatcccact

SEQ ID NO: 97190 - DNA, 25 bp, Homo sapien
tcatcagtgtgcactttatcccact

SEQ ID NO: 97191 - DNA, 25 bp, Homo sapien
tcatcagttacttggaggacaaatt

SEQ ID NO: 97192 - DNA, 25 bp, Homo sapien
tcatcataaggaagaaagtttggtt

SEQ ID NO: 97193 - DNA, 25 bp, Homo sapien
tcatcataaggaagcaagtttggtt

SEQ ID NO: 97194 - DNA, 25 bp, Homo sapien
tcatcatacaaaagaatcatacagt

SEQ ID NO: 97195 - DNA, 25 bp, Homo sapien
tcatcatataaaagaatcatacagt

SEQ ID NO: 97196 - DNA, 25 bp, Homo sapien
tcatcatcatcccgcaaacaattaa

SEQ ID NO: 97197 - DNA, 25 bp, Homo sapien
tcatcatcatcctgcaaacaattaa

SEQ ID NO: 97198 - DNA, 25 bp, Homo sapien
tcatcatcattaggtgtcacccggg

SEQ ID NO: 97199 - DNA, 25 bp, Homo sapien
tcatcatcccgcaaacaattaaata

SEQ ID NO: 97200 - DNA, 25 bp, Homo sapien
tcatcatcctgcaaacaattaaata

SEQ ID NO: 97201 - DNA, 25 bp, Homo sapien
tcatcatcggaaaatatccaggagc

SEQ ID NO: 97202 - DNA, 25 bp, Homo sapien
tcatcatcggacaatatccaggagc

SEQ ID NO: 97203 - DNA, 25 bp, Homo sapien
tcatcatcgttaggtgtcacccggg

SEQ ID NO: 97204 - DNA, 25 bp, Homo sapien
tcatcatgcaccaggtagcgtgcca

SEQ ID NO: 97205 - DNA, 25 bp, Homo sapien
tcatcatgcgccaggtagcgtgcca

SEQ ID NO: 97206 - DNA, 25 bp, Homo sapien
tcatcattaattctgcactaacttt

SEQ ID NO: 97207 - DNA, 25 bp, Homo sapien
tcatcattaattttgcactaacttt

SEQ ID NO: 97208 - DNA, 25 bp, Homo sapien
tcatcattaccaaattccaggcatg

SEQ ID NO: 97209 - DNA, 25 bp, Homo sapien
tcatcattgccaaattccaggcatg

SEQ ID NO: 97210 - DNA, 25 bp, Homo sapien
tcatcatttaatgagcatcttagtt

SEQ ID NO: 97211 - DNA, 25 bp, Homo sapien
tcatcatttaatgagcgtcttagtt

SEQ ID NO: 97212 - DNA, 25 bp, Homo sapien
tcatcattttaatcaattaattggg

SEQ ID NO: 97213 - DNA, 25 bp, Homo sapien
tcatcattttactcaattaattggg

SEQ ID NO: 97214 - DNA, 25 bp, Homo sapien
tcatccaaattgctttggctctgcc

SEQ ID NO: 97215 - DNA, 25 bp, Homo sapien
tcatccaaattgttttggctctgcc

SEQ ID NO: 97216 - DNA, 25 bp, Homo sapien
tcatccaaccctgtaagccagcagg

SEQ ID NO: 97217 - DNA, 25 bp, Homo sapien
tcatccaaccctttaagccagcagg

SEQ ID NO: 97218 - DNA, 25 bp, Homo sapien
tcatccacatttacccagggcttag

SEQ ID NO: 97219 - DNA, 25 bp, Homo sapien
tcatccacatttgcccagggcttag

SEQ ID NO: 97220 - DNA, 25 bp, Homo sapien
tcatccaccagaagaatgtgagtgg

SEQ ID NO: 97221 - DNA, 25 bp, Homo sapien
tcatccaccaggagaatgtgagtgg

SEQ ID NO: 97222 - DNA, 25 bp, Homo sapien
tcatccatgacatcaatagtttagc

SEQ ID NO: 97223 - DNA, 25 bp, Homo sapien
tcatccatgacattaatagtttagc

SEQ ID NO: 97224 - DNA, 25 bp, Homo sapien
tcatcccatttttcaagttaggttg

SEQ ID NO: 97225 - DNA, 25 bp, Homo sapien
tcatcccatttttccagttaggttg

SEQ ID NO: 97226 - DNA, 25 bp, Homo sapien
tcatccgggtcctccatccacaggg

SEQ ID NO: 97227 - DNA, 25 bp, Homo sapien
tcatccgggtcctctatccacaggg

SEQ ID NO: 97228 - DNA, 25 bp, Homo sapien
tcatcctaagcaaaattccctaagt

SEQ ID NO: 97229 - DNA, 25 bp, Homo sapien
tcatcctaagcaacattccctaagt

SEQ ID NO: 97230 - DNA, 25 bp, Homo sapien
tcatcctcattattatcattatcat

SEQ ID NO: 97231 - DNA, 25 bp, Homo sapien
tcatcctcgttattatcattatcat

SEQ ID NO: 97232 - DNA, 25 bp, Homo sapien
tcatcctgggaatcaaaatcagact

SEQ ID NO: 97233 - DNA, 25 bp, Homo sapien
tcatcctgggagtcaaaatcagact

SEQ ID NO: 97234 - DNA, 25 bp, Homo sapien
tcatccttacctcactttacagcaa

SEQ ID NO: 97235 - DNA, 25 bp, Homo sapien
tcatccttatctcactttacagcaa

SEQ ID NO: 97236 - DNA, 25 bp, Homo sapien
tcatccttcactgtgcatatgtgag

SEQ ID NO: 97237 - DNA, 25 bp, Homo sapien
tcatccttcactgtgcgtatgtgag

SEQ ID NO: 97238 - DNA, 25 bp, Homo sapien
tcatccttggctgccttctcttgcc

SEQ ID NO: 97239 - DNA, 25 bp, Homo sapien
tcatccttgtctgccttctcttgcc

SEQ ID NO: 97240 - DNA, 25 bp, Homo sapien
tcatcctttcacattttgacacaca

SEQ ID NO: 97241 - DNA, 25 bp, Homo sapien
tcatcctttcaccttttgacacaca

SEQ ID NO: 97242 - DNA, 25 bp, Homo sapien
tcatcgagttctcgtcatgagccca

SEQ ID NO: 97243 - DNA, 25 bp, Homo sapien
tcatcgagttcttgtcatgagccca

SEQ ID NO: 97244 - DNA, 25 bp, Homo sapien
tcatctaaagctgacattttttata

SEQ ID NO: 97245 - DNA, 25 bp, Homo sapien
tcatctaatgctgacattttttata

SEQ ID NO: 97246 - DNA, 25 bp, Homo sapien
tcatctacaaaaataggtaggtagt

SEQ ID NO: 97247 - DNA, 25 bp, Homo sapien
tcatctacaaaactaggtaggtagt

SEQ ID NO: 97248 - DNA, 25 bp, Homo sapien
tcatctacatggatactgaaatcac

SEQ ID NO: 97249 - DNA, 25 bp, Homo sapien
tcatctacgtggatactgaaatcac

SEQ ID NO: 97250 - DNA, 25 bp, Homo sapien
tcatctagagttatgaatggaaaca

SEQ ID NO: 97251 - DNA, 25 bp, Homo sapien
tcatctagagttatgactggaaaca

SEQ ID NO: 97252 - DNA, 25 bp, Homo sapien
tcatctagattcgagtcctttcctg

SEQ ID NO: 97253 - DNA, 25 bp, Homo sapien
tcatctagattcgagttctttcctg

SEQ ID NO: 97254 - DNA, 25 bp, Homo sapien
tcatctagggtctaatgggtagaat

SEQ ID NO: 97255 - DNA, 25 bp, Homo sapien
tcatctagtgtctaatgggtagaat

SEQ ID NO: 97256 - DNA, 25 bp, Homo sapien
tcatctataaaacaggttctttgaa

SEQ ID NO: 97257 - DNA, 25 bp, Homo sapien
tcatctataaaagaggttctttgaa

SEQ ID NO: 97258 - DNA, 25 bp, Homo sapien
tcatctatagtaatcaattttatgt

SEQ ID NO: 97259 - DNA, 25 bp, Homo sapien
tcatctatagtaatcatttttatgt

SEQ ID NO: 97260 - DNA, 25 bp, Homo sapien
tcatctattcatgaatttcctttca

SEQ ID NO: 97261 - DNA, 25 bp, Homo sapien
tcatctatttatgaatttcctttca

SEQ ID NO: 97262 - DNA, 25 bp, Homo sapien
tcatctatttttatccatcttcctt

SEQ ID NO: 97263 - DNA, 25 bp, Homo sapien
tcatctatttttatccttcttcctt

SEQ ID NO: 97264 - DNA, 25 bp, Homo sapien
tcatctcagctttcgatatgcctcc

SEQ ID NO: 97265 - DNA, 25 bp, Homo sapien
tcatctcagcttttgatatgcctcc

SEQ ID NO: 97266 - DNA, 25 bp, Homo sapien
tcatctccaagttctgaaatgctca

SEQ ID NO: 97267 - DNA, 25 bp, Homo sapien
tcatctccaatcaaaaccttggagt

SEQ ID NO: 97268 - DNA, 25 bp, Homo sapien
tcatctccaatcaacaccttggagt

SEQ ID NO: 97269 - DNA, 25 bp, Homo sapien
tcatctccacaattgttgctttagg

SEQ ID NO: 97270 - DNA, 25 bp, Homo sapien
tcatctccacaatttttgctttagg

SEQ ID NO: 97271 - DNA, 25 bp, Homo sapien
tcatctccatgttctgaaatgctca

SEQ ID NO: 97272 - DNA, 25 bp, Homo sapien
tcatctccttcaacgagcttgttgt

SEQ ID NO: 97273 - DNA, 25 bp, Homo sapien
tcatctccttcaatgagcttgttgt

SEQ ID NO: 97274 - DNA, 25 bp, Homo sapien
tcatctctactctctctcaaaggaa

SEQ ID NO: 97275 - DNA, 25 bp, Homo sapien
tcatctctattctctctcaaaggaa

SEQ ID NO: 97276 - DNA, 25 bp, Homo sapien
tcatctctgtaagcctgttttgctc

SEQ ID NO: 97277 - DNA, 25 bp, Homo sapien
tcatctctgtaagtctgttttgctc

SEQ ID NO: 97278 - DNA, 25 bp, Homo sapien
tcatctgaatccatgcagaaaaaaa

SEQ ID NO: 97279 - DNA, 25 bp, Homo sapien
tcatctgaatctatgcagaaaaaaa

SEQ ID NO: 97280 - DNA, 25 bp, Homo sapien
tcatctgagaacctagaggaagatg

SEQ ID NO: 97281 - DNA, 25 bp, Homo sapien
tcatctgagaacctggaggaagatg

SEQ ID NO: 97282 - DNA, 25 bp, Homo sapien
tcatctgcagcaagcatctgttatt

SEQ ID NO: 97283 - DNA, 25 bp, Homo sapien
tcatctgcagcgagcatctgttatt

SEQ ID NO: 97284 - DNA, 25 bp, Homo sapien
tcatctgccaaaacatccttagaat

SEQ ID NO: 97285 - DNA, 25 bp, Homo sapien
tcatctgccaaagcatccttagaat

SEQ ID NO: 97286 - DNA, 25 bp, Homo sapien
tcatctgccatttgcttccccgtat

SEQ ID NO: 97287 - DNA, 25 bp, Homo sapien
tcatctgccatttgtttccccgtat

SEQ ID NO: 97288 - DNA, 25 bp, Homo sapien
tcatctgccgtcactcagacatcat

SEQ ID NO: 97289 - DNA, 25 bp, Homo sapien
tcatctgccttttctctcctgggac

SEQ ID NO: 97290 - DNA, 25 bp, Homo sapien
tcatctgcgttttctctcctgggac

SEQ ID NO: 97291 - DNA, 25 bp, Homo sapien
tcatctgctagcagggatcagtgag

SEQ ID NO: 97292 - DNA, 25 bp, Homo sapien
tcatctgctagcagggctcagtgag

SEQ ID NO: 97293 - DNA, 25 bp, Homo sapien
tcatctgctctgacgccctagggac

SEQ ID NO: 97294 - DNA, 25 bp, Homo sapien
tcatctgctctgatgccctagggac

SEQ ID NO: 97295 - DNA, 25 bp, Homo sapien
tcatctgctgtcactcagacatcat

SEQ ID NO: 97296 - DNA, 25 bp, Homo sapien
tcatctgggaagtcaaatgcctctt

SEQ ID NO: 97297 - DNA, 25 bp, Homo sapien
tcatctgggaagtcgaatgcctctt

SEQ ID NO: 97298 - DNA, 25 bp, Homo sapien
tcatctggtaaccgtgtgtttaata

SEQ ID NO: 97299 - DNA, 25 bp, Homo sapien
tcatctggtaactgtgtgtttaata

SEQ ID NO: 97300 - DNA, 25 bp, Homo sapien
tcatctgtcttatatggcatgcttc

SEQ ID NO: 97301 - DNA, 25 bp, Homo sapien
tcatctgtcttatgtggcatgcttc

SEQ ID NO: 97302 - DNA, 25 bp, Homo sapien
tcatctgtgctgatcgttgtagtgt

SEQ ID NO: 97303 - DNA, 25 bp, Homo sapien
tcatctgtgctgattgttgtagtgt

SEQ ID NO: 97304 - DNA, 25 bp, Homo sapien
tcatctgtggacctgttattttcca

SEQ ID NO: 97305 - DNA, 25 bp, Homo sapien
tcatctgtggaccttttattttcca

SEQ ID NO: 97306 - DNA, 25 bp, Homo sapien
tcatctgttcatatatctgcttccc

SEQ ID NO: 97307 - DNA, 25 bp, Homo sapien
tcatctgttcatatgtctgcttccc

SEQ ID NO: 97308 - DNA, 25 bp, Homo sapien
tcatctgttctcctttgtttgcagt

SEQ ID NO: 97309 - DNA, 25 bp, Homo sapien
tcatctgttctcgtttgtttgcagt

SEQ ID NO: 97310 - DNA, 25 bp, Homo sapien
tcatcttctcccacaaatctgtctt

SEQ ID NO: 97311 - DNA, 25 bp, Homo sapien
tcatcttctcccacaagtctgtctt

SEQ ID NO: 97312 - DNA, 25 bp, Homo sapien
tcatcttctcctgcctaaacaacag

SEQ ID NO: 97313 - DNA, 25 bp, Homo sapien
tcatcttctcctgtctaaacaacag

SEQ ID NO: 97314 - DNA, 25 bp, Homo sapien
tcatcttgcaaaaaatgaaactctt

SEQ ID NO: 97315 - DNA, 25 bp, Homo sapien
tcatcttgcaaataatgaaactctt

SEQ ID NO: 97316 - DNA, 25 bp, Homo sapien
tcatcttggaacacatgaacatggc

SEQ ID NO: 97317 - DNA, 25 bp, Homo sapien
tcatcttgggacacatgaacatggc

SEQ ID NO: 97318 - DNA, 25 bp, Homo sapien
tcatcttgtcacctttttatttaga

SEQ ID NO: 97319 - DNA, 25 bp, Homo sapien
tcatcttgtcacttttttatttaga

SEQ ID NO: 97320 - DNA, 25 bp, Homo sapien
tcatctttattctcaatctaattca

SEQ ID NO: 97321 - DNA, 25 bp, Homo sapien
tcatctttcaagacacagcgcagga

SEQ ID NO: 97322 - DNA, 25 bp, Homo sapien
tcatctttcaaggcacagcgcagga

SEQ ID NO: 97323 - DNA, 25 bp, Homo sapien
tcatctttgttctcaatctaattca

SEQ ID NO: 97324 - DNA, 25 bp, Homo sapien
tcatcttttatccaacaaagtataa

SEQ ID NO: 97325 - DNA, 25 bp, Homo sapien
tcatcttttatccatcaaagtataa

SEQ ID NO: 97326 - DNA, 25 bp, Homo sapien
tcatgaaagttgtaaatttgaagaa

SEQ ID NO: 97327 - DNA, 25 bp, Homo sapien
tcatgaaagttgtacatttgaagaa

SEQ ID NO: 97328 - DNA, 25 bp, Homo sapien
tcatgaaatccaaacctcgtcagga

SEQ ID NO: 97329 - DNA, 25 bp, Homo sapien
tcatgaaatgccaaatatgctggag

SEQ ID NO: 97330 - DNA, 25 bp, Homo sapien
tcatgaaatgccaaatctgctggag

SEQ ID NO: 97331 - DNA, 25 bp, Homo sapien
tcatgaaattcaaacctcgtcagga

SEQ ID NO: 97332 - DNA, 25 bp, Homo sapien
tcatgaacaattttaagaattacat

SEQ ID NO: 97333 - DNA, 25 bp, Homo sapien
tcatgaacacttttaagaattacat

SEQ ID NO: 97334 - DNA, 25 bp, Homo sapien
tcatgaactcagcattggaagtttt

SEQ ID NO: 97335 - DNA, 25 bp, Homo sapien
tcatgaactcagcgttggaagtttt

SEQ ID NO: 97336 - DNA, 25 bp, Homo sapien
tcatgaagcctgacaatttaaaaag

SEQ ID NO: 97337 - DNA, 25 bp, Homo sapien
tcatgaagcctgacgatttaaaaag

SEQ ID NO: 97338 - DNA, 25 bp, Homo sapien
tcatgaatatcacatccaaaaccta

SEQ ID NO: 97339 - DNA, 25 bp, Homo sapien
tcatgaatatcagatccaaaaccta

SEQ ID NO: 97340 - DNA, 25 bp, Homo sapien
tcatgacaccacggactagagtagc

SEQ ID NO: 97341 - DNA, 25 bp, Homo sapien
tcatgacaccatggactagagtagc

SEQ ID NO: 97342 - DNA, 25 bp, Homo sapien
tcatgacagataatccactgctgtg

SEQ ID NO: 97343 - DNA, 25 bp, Homo sapien
tcatgacagataatccgctgctgtg

SEQ ID NO: 97344 - DNA, 25 bp, Homo sapien
tcatgacattagcaaagtgtaagta

SEQ ID NO: 97345 - DNA, 25 bp, Homo sapien
tcatgacattagtaaagtgtaagta

SEQ ID NO: 97346 - DNA, 25 bp, Homo sapien
tcatgactatcagtaatttacaccc

SEQ ID NO: 97347 - DNA, 25 bp, Homo sapien
tcatgactatcggtaatttacaccc

SEQ ID NO: 97348 - DNA, 25 bp, Homo sapien
tcatgagaaaccctgatagaaggaa

SEQ ID NO: 97349 - DNA, 25 bp, Homo sapien
tcatgagaaaccttgatagaaggaa

SEQ ID NO: 97350 - DNA, 25 bp, Homo sapien
tcatgagagaagacacactctttgg

SEQ ID NO: 97351 - DNA, 25 bp, Homo sapien
tcatgagagaagacacgctctttgg

SEQ ID NO: 97352 - DNA, 25 bp, Homo sapien
tcatgagcgtactagaggctatggc

SEQ ID NO: 97353 - DNA, 25 bp, Homo sapien
tcatgagcgtagtagaggctatggc

SEQ ID NO: 97354 - DNA, 25 bp, Homo sapien
tcatgagctacaaaaggttgcaaaa

SEQ ID NO: 97355 - DNA, 25 bp, Homo sapien
tcatgagctacagaaggttgcaaaa

SEQ ID NO: 97356 - DNA, 25 bp, Homo sapien
tcatgaggcgttaagaaggagaggt

SEQ ID NO: 97357 - DNA, 25 bp, Homo sapien
tcatgagggaaaaaaacagaccaat

SEQ ID NO: 97358 - DNA, 25 bp, Homo sapien
tcatgagggaaagaaacagaccaat

SEQ ID NO: 97359 - DNA, 25 bp, Homo sapien
tcatgaggtgttaagaaggagaggt

SEQ ID NO: 97360 - DNA, 25 bp, Homo sapien
tcatgagttccttgagtgtgagaaa

SEQ ID NO: 97361 - DNA, 25 bp, Homo sapien
tcatgagtttcttgagtgtgagaaa

SEQ ID NO: 97362 - DNA, 25 bp, Homo sapien
tcatgatctaatacaaatgcactgt

SEQ ID NO: 97363 - DNA, 25 bp, Homo sapien
tcatgatctcatacaaatgcactgt

SEQ ID NO: 97364 - DNA, 25 bp, Homo sapien
tcatgattcatcagcaacctaagag

SEQ ID NO: 97365 - DNA, 25 bp, Homo sapien
tcatgattcatcagcagcctaagag

SEQ ID NO: 97366 - DNA, 25 bp, Homo sapien
tcatgattcctgagaaatattgcac

SEQ ID NO: 97367 - DNA, 25 bp, Homo sapien
tcatgattcttgagaaatattgcac

SEQ ID NO: 97368 - DNA, 25 bp, Homo sapien
tcatgattttctctgcaatttaaca

SEQ ID NO: 97369 - DNA, 25 bp, Homo sapien
tcatgattttctcttcaatttaaca

SEQ ID NO: 97370 - DNA, 25 bp, Homo sapien
tcatgcacaataccgacttataaaa

SEQ ID NO: 97371 - DNA, 25 bp, Homo sapien
tcatgcacaatactgacttataaaa

SEQ ID NO: 97372 - DNA, 25 bp, Homo sapien
tcatgcaccgagttgatggtcttct

SEQ ID NO: 97373 - DNA, 25 bp, Homo sapien
tcatgcacctagttgatggtcttct

SEQ ID NO: 97374 - DNA, 25 bp, Homo sapien
tcatgcagtctaaagataaaatgat

SEQ ID NO: 97375 - DNA, 25 bp, Homo sapien
tcatgcagtctaaggataaaatgat

SEQ ID NO: 97376 - DNA, 25 bp, Homo sapien
tcatgcatataaggagatggtagtc

SEQ ID NO: 97377 - DNA, 25 bp, Homo sapien
tcatgcatataaggagttggtagtc

SEQ ID NO: 97378 - DNA, 25 bp, Homo sapien
tcatgcatggaagccactgggttca

SEQ ID NO: 97379 - DNA, 25 bp, Homo sapien
tcatgcatggaagccattgggttca

SEQ ID NO: 97380 - DNA, 25 bp, Homo sapien
tcatgccaagtggaataagccagac

SEQ ID NO: 97381 - DNA, 25 bp, Homo sapien
tcatgccaagtggagtaagccagac

SEQ ID NO: 97382 - DNA, 25 bp, Homo sapien
tcatgccaagttgaagaagcagaca

SEQ ID NO: 97383 - DNA, 25 bp, Homo sapien
tcatgccaagttgcagaagcagaca

SEQ ID NO: 97384 - DNA, 25 bp, Homo sapien
tcatgcctgactactgcagaaccat

SEQ ID NO: 97385 - DNA, 25 bp, Homo sapien
tcatgcctgccaacgcaacatccat

SEQ ID NO: 97386 - DNA, 25 bp, Homo sapien
tcatgcctgccaatgcaacatccat

SEQ ID NO: 97387 - DNA, 25 bp, Homo sapien
tcatgcctgtctactgcagaaccat

SEQ ID NO: 97388 - DNA, 25 bp, Homo sapien
tcatgccttaaccatgggtaacagt

SEQ ID NO: 97389 - DNA, 25 bp, Homo sapien
tcatgccttaaccgtgggtaacagt

SEQ ID NO: 97390 - DNA, 25 bp, Homo sapien
tcatgccttagaacatgcccatgaa

SEQ ID NO: 97391 - DNA, 25 bp, Homo sapien
tcatgccttagaatatgcccatgaa

SEQ ID NO: 97392 - DNA, 25 bp, Homo sapien
tcatgctaacaattctcattggtta

SEQ ID NO: 97393 - DNA, 25 bp, Homo sapien
tcatgctaacaattcttattggtta

SEQ ID NO: 97394 - DNA, 25 bp, Homo sapien
tcatgctagaaatcagtgacaaata

SEQ ID NO: 97395 - DNA, 25 bp, Homo sapien
tcatgctagaaatccaatacttggc

SEQ ID NO: 97396 - DNA, 25 bp, Homo sapien
tcatgctagaactccaatacttggc

SEQ ID NO: 97397 - DNA, 25 bp, Homo sapien
tcatgctaggaatcagtgacaaata

SEQ ID NO: 97398 - DNA, 25 bp, Homo sapien
tcatgctcttgaagttcgtgatgag

SEQ ID NO: 97399 - DNA, 25 bp, Homo sapien
tcatgctcttgacgttcgtgatgag

SEQ ID NO: 97400 - DNA, 25 bp, Homo sapien
tcatgctgcaattttctttattcct

SEQ ID NO: 97401 - DNA, 25 bp, Homo sapien
tcatgctgccggccactgaaagcat

SEQ ID NO: 97402 - DNA, 25 bp, Homo sapien
tcatgctgcgattttctttattcct

SEQ ID NO: 97403 - DNA, 25 bp, Homo sapien
tcatgctgctggccactgaaagcat

SEQ ID NO: 97404 - DNA, 25 bp, Homo sapien
tcatgctgttaaaatggctgagtat

SEQ ID NO: 97405 - DNA, 25 bp, Homo sapien
tcatgctgttaaagtggctgagtat

SEQ ID NO: 97406 - DNA, 25 bp, Homo sapien
tcatgcttcaacacccttctccttc

SEQ ID NO: 97407 - DNA, 25 bp, Homo sapien
tcatgcttcgacacccttctccttc

SEQ ID NO: 97408 - DNA, 25 bp, Homo sapien
tcatgctttgtgttttcagttgtta

SEQ ID NO: 97409 - DNA, 25 bp, Homo sapien
tcatgctttgtgtttttagttgtta

SEQ ID NO: 97410 - DNA, 25 bp, Homo sapien
tcatggagatttgtgagtaacaggg

SEQ ID NO: 97411 - DNA, 25 bp, Homo sapien
tcatggagatttttgagtaacaggg

SEQ ID NO: 97412 - DNA, 25 bp, Homo sapien
tcatggagctagtgcagtagacaga

SEQ ID NO: 97413 - DNA, 25 bp, Homo sapien
tcatggagctagtggagtagacaga

SEQ ID NO: 97414 - DNA, 25 bp, Homo sapien
tcatggattccaataaaacaaatca

SEQ ID NO: 97415 - DNA, 25 bp, Homo sapien
tcatggattccagtaaaacaaatca

SEQ ID NO: 97416 - DNA, 25 bp, Homo sapien
tcatggattttaaatgtaaatgacc

SEQ ID NO: 97417 - DNA, 25 bp, Homo sapien
tcatggattttaagtgtaaatgacc

SEQ ID NO: 97418 - DNA, 25 bp, Homo sapien
tcatggcacccaggcttcttctgtt

SEQ ID NO: 97419 - DNA, 25 bp, Homo sapien
tcatggcacccaggtttcttctgtt

SEQ ID NO: 97420 - DNA, 25 bp, Homo sapien
tcatggcactcagtctggtgggtat

SEQ ID NO: 97421 - DNA, 25 bp, Homo sapien
tcatggcactcagtgtggtgggtat

SEQ ID NO: 97422 - DNA, 25 bp, Homo sapien
tcatgggatgcattttctaaacaac

SEQ ID NO: 97423 - DNA, 25 bp, Homo sapien
tcatgggatgcgttttctaaacaac

SEQ ID NO: 97424 - DNA, 25 bp, Homo sapien
tcatgggattcctataagcattgta

SEQ ID NO: 97425 - DNA, 25 bp, Homo sapien
tcatgggattcctgtaagcattgta

SEQ ID NO: 97426 - DNA, 25 bp, Homo sapien
tcatgggcagtctcattttctagaa

SEQ ID NO: 97427 - DNA, 25 bp, Homo sapien
tcatgggcagtctctttttctagaa

SEQ ID NO: 97428 - DNA, 25 bp, Homo sapien
tcatgggtcccacatgcaaattcaa

SEQ ID NO: 97429 - DNA, 25 bp, Homo sapien
tcatgggtcccacgtgcaaattcaa

SEQ ID NO: 97430 - DNA, 25 bp, Homo sapien
tcatgggtgtttccatatatccaaa

SEQ ID NO: 97431 - DNA, 25 bp, Homo sapien
tcatgggtgtttccatgtatccaaa

SEQ ID NO: 97432 - DNA, 25 bp, Homo sapien
tcatggtaagcagacacctacctgc

SEQ ID NO: 97433 - DNA, 25 bp, Homo sapien
tcatggtaagcggacacctacctgc

SEQ ID NO: 97434 - DNA, 25 bp, Homo sapien
tcatggtaccattgcaatcaaactc

SEQ ID NO: 97435 - DNA, 25 bp, Homo sapien
tcatggtactattgcaatcaaactc

SEQ ID NO: 97436 - DNA, 25 bp, Homo sapien
tcatggtcactgagttccttggagc

SEQ ID NO: 97437 - DNA, 25 bp, Homo sapien
tcatggtcattgagttccttggagc

SEQ ID NO: 97438 - DNA, 25 bp, Homo sapien
tcatggtcctgtgcaaattaataac

SEQ ID NO: 97439 - DNA, 25 bp, Homo sapien
tcatggtcttgtgcaaattaataac

SEQ ID NO: 97440 - DNA, 25 bp, Homo sapien
tcatggtgatcctacaagattataa

SEQ ID NO: 97441 - DNA, 25 bp, Homo sapien
tcatggtgatcctataagattataa

SEQ ID NO: 97442 - DNA, 25 bp, Homo sapien
tcatgtaggtgcagacgtttagcaa

SEQ ID NO: 97443 - DNA, 25 bp, Homo sapien
tcatgtaggtgtagacgtttagcaa

SEQ ID NO: 97444 - DNA, 25 bp, Homo sapien
tcatgtatccagtataagctaaaca

SEQ ID NO: 97445 - DNA, 25 bp, Homo sapien
tcatgtatccagtatatgctaaaca

SEQ ID NO: 97446 - DNA, 25 bp, Homo sapien
tcatgtcaactgtgtcaccctttac

SEQ ID NO: 97447 - DNA, 25 bp, Homo sapien
tcatgtcaactgtgtcgccctttac

SEQ ID NO: 97448 - DNA, 25 bp, Homo sapien
tcatgtcacctagtcagaagttcat

SEQ ID NO: 97449 - DNA, 25 bp, Homo sapien
tcatgtcacctattcagaagttcat

SEQ ID NO: 97450 - DNA, 25 bp, Homo sapien
tcatgtcagcactatggctcagaag

SEQ ID NO: 97451 - DNA, 25 bp, Homo sapien
tcatgtcagcagtatggctcagaag

SEQ ID NO: 97452 - DNA, 25 bp, Homo sapien
tcatgtccagtaagagacaaggact

SEQ ID NO: 97453 - DNA, 25 bp, Homo sapien
tcatgtccagtaggagacaaggact

SEQ ID NO: 97454 - DNA, 25 bp, Homo sapien
tcatgtcccgagccaataataacta

SEQ ID NO: 97455 - DNA, 25 bp, Homo sapien
tcatgtcctgagccaataataacta

SEQ ID NO: 97456 - DNA, 25 bp, Homo sapien
tcatgtctgtgtccagatgtccact

SEQ ID NO: 97457 - DNA, 25 bp, Homo sapien
tcatgtctttgtccagatgtccact

SEQ ID NO: 97458 - DNA, 25 bp, Homo sapien
tcatgtgaaatccatagaaccagaa

SEQ ID NO: 97459 - DNA, 25 bp, Homo sapien
tcatgtgaaatcgatagaaccagaa

SEQ ID NO: 97460 - DNA, 25 bp, Homo sapien
tcatgtgaaatcttttggagattct

SEQ ID NO: 97461 - DNA, 25 bp, Homo sapien
tcatgtgaattcttttggagattct

SEQ ID NO: 97462 - DNA, 25 bp, Homo sapien
tcatgtgatgaccgggaaatttaag

SEQ ID NO: 97463 - DNA, 25 bp, Homo sapien
tcatgtgatgactgggaaatttaag

SEQ ID NO: 97464 - DNA, 25 bp, Homo sapien
tcatgtggaaatacaaaagagccta

SEQ ID NO: 97465 - DNA, 25 bp, Homo sapien
tcatgtggaaatacaatagagccta

SEQ ID NO: 97466 - DNA, 25 bp, Homo sapien
tcatgtggaacagggaaagatattt

SEQ ID NO: 97467 - DNA, 25 bp, Homo sapien
tcatgtggaacagtgaaagatattt

SEQ ID NO: 97468 - DNA, 25 bp, Homo sapien
tcatgtggatggccgaggtgcccac

SEQ ID NO: 97469 - DNA, 25 bp, Homo sapien
tcatgtggatggctgaggtgcccac

SEQ ID NO: 97470 - DNA, 25 bp, Homo sapien
tcatgtggcactgttatgctatgca

SEQ ID NO: 97471 - DNA, 25 bp, Homo sapien
tcatgtggcacttttatgctatgca

SEQ ID NO: 97472 - DNA, 25 bp, Homo sapien
tcatgtggcgttactgactggagtc

SEQ ID NO: 97473 - DNA, 25 bp, Homo sapien
tcatgtgggagacaggagaagaagc

SEQ ID NO: 97474 - DNA, 25 bp, Homo sapien
tcatgtgggagataggagaagaagc

SEQ ID NO: 97475 - DNA, 25 bp, Homo sapien
tcatgtggtgttactgactggagtc

SEQ ID NO: 97476 - DNA, 25 bp, Homo sapien
tcatgttatatactgatcacactag

SEQ ID NO: 97477 - DNA, 25 bp, Homo sapien
tcatgttatgtactgatcacactag

SEQ ID NO: 97478 - DNA, 25 bp, Homo sapien
tcatgttttggtatacacactaaag

SEQ ID NO: 97479 - DNA, 25 bp, Homo sapien
tcatgttttggtattcacactaaag

SEQ ID NO: 97480 - DNA, 25 bp, Homo sapien
tcattaaacgttacctaaaactcaa

SEQ ID NO: 97481 - DNA, 25 bp, Homo sapien
tcattaaacgttatctaaaactcaa

SEQ ID NO: 97482 - DNA, 25 bp, Homo sapien
tcattaaactttggtcagttatgtc

SEQ ID NO: 97483 - DNA, 25 bp, Homo sapien
tcattaaacttttgtcagttatgtc

SEQ ID NO: 97484 - DNA, 25 bp, Homo sapien
tcattaaccaaaagagttgttgttt

SEQ ID NO: 97485 - DNA, 25 bp, Homo sapien
tcattaaccaaaagggttgttgttt

SEQ ID NO: 97486 - DNA, 25 bp, Homo sapien
tcattaagaaggtggaacaggaagc

SEQ ID NO: 97487 - DNA, 25 bp, Homo sapien
tcattaagatggtggaacaggaagc

SEQ ID NO: 97488 - DNA, 25 bp, Homo sapien
tcattaaggatgtctaacaccaaac

SEQ ID NO: 97489 - DNA, 25 bp, Homo sapien
tcattaaggatttctaacaccaaac

SEQ ID NO: 97490 - DNA, 25 bp, Homo sapien
tcattacaaacagtagatatgacac

SEQ ID NO: 97491 - DNA, 25 bp, Homo sapien
tcattacaaacagtggatatgacac

SEQ ID NO: 97492 - DNA, 25 bp, Homo sapien
tcattacataagccactggctcatc

SEQ ID NO: 97493 - DNA, 25 bp, Homo sapien
tcattacataagccgctggctcatc

SEQ ID NO: 97494 - DNA, 25 bp, Homo sapien
tcattaccaagctcaatgaataaat

SEQ ID NO: 97495 - DNA, 25 bp, Homo sapien
tcattaccaagctcgatgaataaat

SEQ ID NO: 97496 - DNA, 25 bp, Homo sapien
tcattagcacgtcactaactaactt

SEQ ID NO: 97497 - DNA, 25 bp, Homo sapien
tcattagcatgtcactaactaactt

SEQ ID NO: 97498 - DNA, 25 bp, Homo sapien
tcattagggctgtctgtaatgtctc

SEQ ID NO: 97499 - DNA, 25 bp, Homo sapien
tcattagggctgtttgtaatgtctc

SEQ ID NO: 97500 - DNA, 25 bp, Homo sapien
tcattataaaccatcttttgaaaag

SEQ ID NO: 97501 - DNA, 25 bp, Homo sapien
tcattataaaccattttttgaaaag

SEQ ID NO: 97502 - DNA, 25 bp, Homo sapien
tcattatagtgaacgagtctcacga

SEQ ID NO: 97503 - DNA, 25 bp, Homo sapien
tcattatagtgaatgagtctcacga

SEQ ID NO: 97504 - DNA, 25 bp, Homo sapien
tcattatatctggctacattttatc

SEQ ID NO: 97505 - DNA, 25 bp, Homo sapien
tcattatatctgtctacattttatc

SEQ ID NO: 97506 - DNA, 25 bp, Homo sapien
tcattatcatgccagctaaaattgg

SEQ ID NO: 97507 - DNA, 25 bp, Homo sapien
tcattatcatgctagctaaaattgg

SEQ ID NO: 97508 - DNA, 25 bp, Homo sapien
tcattatcctatcccatttcttcct

SEQ ID NO: 97509 - DNA, 25 bp, Homo sapien
tcattatcttatcccatttcttcct

SEQ ID NO: 97510 - DNA, 25 bp, Homo sapien
tcattatctttcaatctcctccata

SEQ ID NO: 97511 - DNA, 25 bp, Homo sapien
tcattatctttcgatctcctccata

SEQ ID NO: 97512 - DNA, 25 bp, Homo sapien
tcattatggaaattctagcactctt

SEQ ID NO: 97513 - DNA, 25 bp, Homo sapien
tcattatggaaattgtagcactctt

SEQ ID NO: 97514 - DNA, 25 bp, Homo sapien
tcattatgtccacgttgagtacccc

SEQ ID NO: 97515 - DNA, 25 bp, Homo sapien
tcattatgtccatgttgagtacccc

SEQ ID NO: 97516 - DNA, 25 bp, Homo sapien
tcattattacaagaggaccttttgc

SEQ ID NO: 97517 - DNA, 25 bp, Homo sapien
tcattattacaagagggccttttgc

SEQ ID NO: 97518 - DNA, 25 bp, Homo sapien
tcattatttgaccgtacatgtgtgg

SEQ ID NO: 97519 - DNA, 25 bp, Homo sapien
tcattatttgactgtacatgtgtgg

SEQ ID NO: 97520 - DNA, 25 bp, Homo sapien
tcattatttgcctcgactgtctcta

SEQ ID NO: 97521 - DNA, 25 bp, Homo sapien
tcattatttgccttgactgtctcta

SEQ ID NO: 97522 - DNA, 25 bp, Homo sapien
tcattcaaactgttggctgaaaaca

SEQ ID NO: 97523 - DNA, 25 bp, Homo sapien
tcattcaaattgttggctgaaaaca

SEQ ID NO: 97524 - DNA, 25 bp, Homo sapien
tcattcacatggaaccttcaactat

SEQ ID NO: 97525 - DNA, 25 bp, Homo sapien
tcattcacatggaatcttcaactat

SEQ ID NO: 97526 - DNA, 25 bp, Homo sapien
tcattcaccaagccaactgtgacaa

SEQ ID NO: 97527 - DNA, 25 bp, Homo sapien
tcattcaccgagccaactgtgacaa

SEQ ID NO: 97528 - DNA, 25 bp, Homo sapien
tcattcagaagaggcactgagggta

SEQ ID NO: 97529 - DNA, 25 bp, Homo sapien
tcattcagaagagtcactgagggta

SEQ ID NO: 97530 - DNA, 25 bp, Homo sapien
tcattcagattgaggtagcagcagg

SEQ ID NO: 97531 - DNA, 25 bp, Homo sapien
tcattcagcttcttaaatctgtaga

SEQ ID NO: 97532 - DNA, 25 bp, Homo sapien
tcattcagcttcttaactctgtaga

SEQ ID NO: 97533 - DNA, 25 bp, Homo sapien
tcattcaggttgaggtagcagcagg

SEQ ID NO: 97534 - DNA, 25 bp, Homo sapien
tcattcatctttattctcaatctaa

SEQ ID NO: 97535 - DNA, 25 bp, Homo sapien
tcattcatctttgttctcaatctaa

SEQ ID NO: 97536 - DNA, 25 bp, Homo sapien
tcattcattacctgccattcaatag

SEQ ID NO: 97537 - DNA, 25 bp, Homo sapien
tcattcattacgtgccattcaatag

SEQ ID NO: 97538 - DNA, 25 bp, Homo sapien
tcattccaaaaatcagcttactggt

SEQ ID NO: 97539 - DNA, 25 bp, Homo sapien
tcattccaaaaatcggcttactggt

SEQ ID NO: 97540 - DNA, 25 bp, Homo sapien
tcattccaaacagagactagcaggt

SEQ ID NO: 97541 - DNA, 25 bp, Homo sapien
tcattccaaaccgagactagcaggt

SEQ ID NO: 97542 - DNA, 25 bp, Homo sapien
tcattccacatctcctttctgcaca

SEQ ID NO: 97543 - DNA, 25 bp, Homo sapien
tcattccacatctcttttctgcaca

SEQ ID NO: 97544 - DNA, 25 bp, Homo sapien
tcattccaggaacttctactgagca

SEQ ID NO: 97545 - DNA, 25 bp, Homo sapien
tcattccaggagcttctactgagca

SEQ ID NO: 97546 - DNA, 25 bp, Homo sapien
tcattcctacaagccagtataataa

SEQ ID NO: 97547 - DNA, 25 bp, Homo sapien
tcattcctacaggccagtataataa

SEQ ID NO: 97548 - DNA, 25 bp, Homo sapien
tcattctccatcagctcactttcca

SEQ ID NO: 97549 - DNA, 25 bp, Homo sapien
tcattctccatcatctcactttcca

SEQ ID NO: 97550 - DNA, 25 bp, Homo sapien
tcattctctcagaaaacactgttga

SEQ ID NO: 97551 - DNA, 25 bp, Homo sapien
tcattctctcagagaacactgttga

SEQ ID NO: 97552 - DNA, 25 bp, Homo sapien
tcattctggcagcgccccctgctat

SEQ ID NO: 97553 - DNA, 25 bp, Homo sapien
tcattctggcagtgccccctgctat

SEQ ID NO: 97554 - DNA, 25 bp, Homo sapien
tcattcttttaccaatttcccctta

SEQ ID NO: 97555 - DNA, 25 bp, Homo sapien
tcattcttttaccattttcccctta

SEQ ID NO: 97556 - DNA, 25 bp, Homo sapien
tcattgaagttattactgtttcttg

SEQ ID NO: 97557 - DNA, 25 bp, Homo sapien
tcattgaagttattcctgtttcttg

SEQ ID NO: 97558 - DNA, 25 bp, Homo sapien
tcattgacaggcattttggcaactc

SEQ ID NO: 97559 - DNA, 25 bp, Homo sapien
tcattgacaggtattttggcaactc

SEQ ID NO: 97560 - DNA, 25 bp, Homo sapien
tcattgacatggcaagacttcacaa

SEQ ID NO: 97561 - DNA, 25 bp, Homo sapien
tcattgacattacatatgcccagta

SEQ ID NO: 97562 - DNA, 25 bp, Homo sapien
tcattgacattgcatatgcccagta

SEQ ID NO: 97563 - DNA, 25 bp, Homo sapien
tcattgacttggcaagacttcacaa

SEQ ID NO: 97564 - DNA, 25 bp, Homo sapien
tcattgagtaacttctatgtgccag

SEQ ID NO: 97565 - DNA, 25 bp, Homo sapien
tcattgagtaacttctgtgtgccag

SEQ ID NO: 97566 - DNA, 25 bp, Homo sapien
tcattgattcaacaatagctagaaa

SEQ ID NO: 97567 - DNA, 25 bp, Homo sapien
tcattgattcaagaatagctagaaa

SEQ ID NO: 97568 - DNA, 25 bp, Homo sapien
tcattgcaacagtaaattcaaagat

SEQ ID NO: 97569 - DNA, 25 bp, Homo sapien
tcattgcaatagtaaattcaaagat

SEQ ID NO: 97570 - DNA, 25 bp, Homo sapien
tcattgcatctcaattatccaggca

SEQ ID NO: 97571 - DNA, 25 bp, Homo sapien
tcattgcatctcaattttccaggca

SEQ ID NO: 97572 - DNA, 25 bp, Homo sapien
tcattgcccaacgtcacactaggca

SEQ ID NO: 97573 - DNA, 25 bp, Homo sapien
tcattgcccaatgtcacactaggca

SEQ ID NO: 97574 - DNA, 25 bp, Homo sapien
tcattgcctggccatgtatcttttg

SEQ ID NO: 97575 - DNA, 25 bp, Homo sapien
tcattgcctggccttgtatcttttg

SEQ ID NO: 97576 - DNA, 25 bp, Homo sapien
tcattgctagagaggctttaggatc

SEQ ID NO: 97577 - DNA, 25 bp, Homo sapien
tcattgctccttacatgtcagaagc

SEQ ID NO: 97578 - DNA, 25 bp, Homo sapien
tcattgctccttacgtgtcagaagc

SEQ ID NO: 97579 - DNA, 25 bp, Homo sapien
tcattgctctctatcaatacctgga

SEQ ID NO: 97580 - DNA, 25 bp, Homo sapien
tcattgctctctgtcaatacctgga

SEQ ID NO: 97581 - DNA, 25 bp, Homo sapien
tcattgctggagaggctttaggatc

SEQ ID NO: 97582 - DNA, 25 bp, Homo sapien
tcattgctgtcactgacttccattt

SEQ ID NO: 97583 - DNA, 25 bp, Homo sapien
tcattgctgtcattgacttccattt

SEQ ID NO: 97584 - DNA, 25 bp, Homo sapien
tcattggacttcaattatgcaacta

SEQ ID NO: 97585 - DNA, 25 bp, Homo sapien
tcattggacttcagttatgcaacta

SEQ ID NO: 97586 - DNA, 25 bp, Homo sapien
tcattggcacaatatgcagggctca

SEQ ID NO: 97587 - DNA, 25 bp, Homo sapien
tcattggcagaatatgcagggctca

SEQ ID NO: 97588 - DNA, 25 bp, Homo sapien
tcattggctggaaagagacaaggag

SEQ ID NO: 97589 - DNA, 25 bp, Homo sapien
tcattggctggagagagacaaggag

SEQ ID NO: 97590 - DNA, 25 bp, Homo sapien
tcattggtcaatatgcatagcaagt

SEQ ID NO: 97591 - DNA, 25 bp, Homo sapien
tcattggtcaatatgcgtagcaagt

SEQ ID NO: 97592 - DNA, 25 bp, Homo sapien
tcattgtaagtaaatttttggaaag

SEQ ID NO: 97593 - DNA, 25 bp, Homo sapien
tcattgtacaactgcactccaactt

SEQ ID NO: 97594 - DNA, 25 bp, Homo sapien
tcattgtacgactgcactccaactt

SEQ ID NO: 97595 - DNA, 25 bp, Homo sapien
tcattgtacgatttatacctgaaag

SEQ ID NO: 97596 - DNA, 25 bp, Homo sapien
tcattgtagagatatttggttaatt

SEQ ID NO: 97597 - DNA, 25 bp, Homo sapien
tcattgtagagatctttggttaatt

SEQ ID NO: 97598 - DNA, 25 bp, Homo sapien
tcattgtaggaagcggaagtatttt

SEQ ID NO: 97599 - DNA, 25 bp, Homo sapien
tcattgtaggaagtggaagtatttt

SEQ ID NO: 97600 - DNA, 25 bp, Homo sapien
tcattgtaggtaaatttttggaaag

SEQ ID NO: 97601 - DNA, 25 bp, Homo sapien
tcattgtagtgcccattggaggttg

SEQ ID NO: 97602 - DNA, 25 bp, Homo sapien
tcattgtagtgccctttggaggttg

SEQ ID NO: 97603 - DNA, 25 bp, Homo sapien
tcattgtatgatttatacctgaaag

SEQ ID NO: 97604 - DNA, 25 bp, Homo sapien
tcattgtccagaccttcatgtttta

SEQ ID NO: 97605 - DNA, 25 bp, Homo sapien
tcattgtccaggccttcatgtttta

SEQ ID NO: 97606 - DNA, 25 bp, Homo sapien
tcattgtgggaattttaagcatttt

SEQ ID NO: 97607 - DNA, 25 bp, Homo sapien
tcattgtgggagttttaagcatttt

SEQ ID NO: 97608 - DNA, 25 bp, Homo sapien
tcattgtggtcaaaaaccacgagct

SEQ ID NO: 97609 - DNA, 25 bp, Homo sapien
tcattgtggtcagaaaccacgagct

SEQ ID NO: 97610 - DNA, 25 bp, Homo sapien
tcattgttattctccagtgcattga

SEQ ID NO: 97611 - DNA, 25 bp, Homo sapien
tcattgttcttctccagtgcattga

SEQ ID NO: 97612 - DNA, 25 bp, Homo sapien
tcattgttgcctgcccaaaatagta

SEQ ID NO: 97613 - DNA, 25 bp, Homo sapien
tcattgttgcctgtccaaaatagta

SEQ ID NO: 97614 - DNA, 25 bp, Homo sapien
tcattgttgctcttgatggttttaa

SEQ ID NO: 97615 - DNA, 25 bp, Homo sapien
tcattgttgcttttgatggttttaa

SEQ ID NO: 97616 - DNA, 25 bp, Homo sapien
tcatttaaataaatatctgcaatca

SEQ ID NO: 97617 - DNA, 25 bp, Homo sapien
tcatttaaatagatatctgcaatca

SEQ ID NO: 97618 - DNA, 25 bp, Homo sapien
tcatttaagctaaaacatactaaca

SEQ ID NO: 97619 - DNA, 25 bp, Homo sapien
tcatttaagctaaaacttactaaca

SEQ ID NO: 97620 - DNA, 25 bp, Homo sapien
tcatttaatcctcataataactcca

SEQ ID NO: 97621 - DNA, 25 bp, Homo sapien
tcatttaatgagcatcttagttata

SEQ ID NO: 97622 - DNA, 25 bp, Homo sapien
tcatttaatgagcgtcttagttata

SEQ ID NO: 97623 - DNA, 25 bp, Homo sapien
tcatttaattctcataataactcca

SEQ ID NO: 97624 - DNA, 25 bp, Homo sapien
tcatttacacttactgacaacagaa

SEQ ID NO: 97625 - DNA, 25 bp, Homo sapien
tcatttacagttactgacaacagaa

SEQ ID NO: 97626 - DNA, 25 bp, Homo sapien
tcatttacatgtcgtctgggctgct

SEQ ID NO: 97627 - DNA, 25 bp, Homo sapien
tcatttacatgttgtctgggctgct

SEQ ID NO: 97628 - DNA, 25 bp, Homo sapien
tcatttaccctgagttagtgtttct

SEQ ID NO: 97629 - DNA, 25 bp, Homo sapien
tcatttaccgtgagttagtgtttct

SEQ ID NO: 97630 - DNA, 25 bp, Homo sapien
tcatttacttttcgtcatgctggat

SEQ ID NO: 97631 - DNA, 25 bp, Homo sapien
tcatttacttttggtcatgctggat

SEQ ID NO: 97632 - DNA, 25 bp, Homo sapien
tcatttagctgatttaaactcaatg

SEQ ID NO: 97633 - DNA, 25 bp, Homo sapien
tcatttagctgatttagactcaatg

SEQ ID NO: 97634 - DNA, 25 bp, Homo sapien
tcatttaggcgtctaaaggtgacac

SEQ ID NO: 97635 - DNA, 25 bp, Homo sapien
tcatttaggtgtctaaaggtgacac

SEQ ID NO: 97636 - DNA, 25 bp, Homo sapien
tcatttagtataacattgatgccgc

SEQ ID NO: 97637 - DNA, 25 bp, Homo sapien
tcatttagtgtaacattgatgccgc

SEQ ID NO: 97638 - DNA, 25 bp, Homo sapien
tcatttatctgaaactagagttcgt

SEQ ID NO: 97639 - DNA, 25 bp, Homo sapien
tcatttatctgaaattagagttcgt

SEQ ID NO: 97640 - DNA, 25 bp, Homo sapien
tcatttcaccgtcttctcatggatg

SEQ ID NO: 97641 - DNA, 25 bp, Homo sapien
tcatttcactgtcttctcatggatg

SEQ ID NO: 97642 - DNA, 25 bp, Homo sapien
tcatttccttttgaagtagatgttt

SEQ ID NO: 97643 - DNA, 25 bp, Homo sapien
tcatttccttttgaggtagatgttt

SEQ ID NO: 97644 - DNA, 25 bp, Homo sapien
tcatttctcttcatccaggaaggca

SEQ ID NO: 97645 - DNA, 25 bp, Homo sapien
tcatttctctttatccaggaaggca

SEQ ID NO: 97646 - DNA, 25 bp, Homo sapien
tcatttctgcataacttgtgtgtgt

SEQ ID NO: 97647 - DNA, 25 bp, Homo sapien
tcatttctgcataatttgtgtgtgt

SEQ ID NO: 97648 - DNA, 25 bp, Homo sapien
tcatttcttctcattaaatctcctg

SEQ ID NO: 97649 - DNA, 25 bp, Homo sapien
tcatttcttctgattaaatctcctg

SEQ ID NO: 97650 - DNA, 25 bp, Homo sapien
tcatttcttgcctggattatagtaa

SEQ ID NO: 97651 - DNA, 25 bp, Homo sapien
tcatttcttgcttggattatagtaa

SEQ ID NO: 97652 - DNA, 25 bp, Homo sapien
tcatttcttgtgacacctaactttt

SEQ ID NO: 97653 - DNA, 25 bp, Homo sapien
tcatttcttgtggcacctaactttt

SEQ ID NO: 97654 - DNA, 25 bp, Homo sapien
tcatttctttccaagtctgcataag

SEQ ID NO: 97655 - DNA, 25 bp, Homo sapien
tcatttctttccaattctgcataag

SEQ ID NO: 97656 - DNA, 25 bp, Homo sapien
tcatttctttctcatcttagatgct

SEQ ID NO: 97657 - DNA, 25 bp, Homo sapien
tcatttctttctcgtcttagatgct

SEQ ID NO: 97658 - DNA, 25 bp, Homo sapien
tcatttgatctttgtaaatatctca

SEQ ID NO: 97659 - DNA, 25 bp, Homo sapien
tcatttgatgtttgtaaatatctca

SEQ ID NO: 97660 - DNA, 25 bp, Homo sapien
tcatttgctattctcattgcacatc

SEQ ID NO: 97661 - DNA, 25 bp, Homo sapien
tcatttgctgttctcattgcacatc

SEQ ID NO: 97662 - DNA, 25 bp, Homo sapien
tcatttggaaatctacatgccactg

SEQ ID NO: 97663 - DNA, 25 bp, Homo sapien
tcatttggaaatctacctgccactg

SEQ ID NO: 97664 - DNA, 25 bp, Homo sapien
tcatttgggagtttctactgctctg

SEQ ID NO: 97665 - DNA, 25 bp, Homo sapien
tcatttgggagtttctcctgctctg

SEQ ID NO: 97666 - DNA, 25 bp, Homo sapien
tcatttggtagcatttaaggcacag

SEQ ID NO: 97667 - DNA, 25 bp, Homo sapien
tcatttggtggcatttaaggcacag

SEQ ID NO: 97668 - DNA, 25 bp, Homo sapien
tcatttgtctcaaggaatttttaaa

SEQ ID NO: 97669 - DNA, 25 bp, Homo sapien
tcatttgtctcgaggaatttttaaa

SEQ ID NO: 97670 - DNA, 25 bp, Homo sapien
tcatttgtgagacgcacaattcaca

SEQ ID NO: 97671 - DNA, 25 bp, Homo sapien
tcatttgtgagatgcacaattcaca

SEQ ID NO: 97672 - DNA, 25 bp, Homo sapien
tcatttgtgtttacgcatttacctt

SEQ ID NO: 97673 - DNA, 25 bp, Homo sapien
tcatttgtgtttatgcatttacctt

SEQ ID NO: 97674 - DNA, 25 bp, Homo sapien
tcatttgttaaacttacctgatagg

SEQ ID NO: 97675 - DNA, 25 bp, Homo sapien
tcatttgttaaacttatctgatagg

SEQ ID NO: 97676 - DNA, 25 bp, Homo sapien
tcatttgtttctgagaccaggaaat

SEQ ID NO: 97677 - DNA, 25 bp, Homo sapien
tcatttgtttcttagaccaggaaat

SEQ ID NO: 97678 - DNA, 25 bp, Homo sapien
tcattttaatcaattaattgggtaa

SEQ ID NO: 97679 - DNA, 25 bp, Homo sapien
tcattttacagacagcagaaactgt

SEQ ID NO: 97680 - DNA, 25 bp, Homo sapien
tcattttacagacagcggaaactgt

SEQ ID NO: 97681 - DNA, 25 bp, Homo sapien
tcattttactcaattaattgggtaa

SEQ ID NO: 97682 - DNA, 25 bp, Homo sapien
tcattttagaatacctcatgagatt

SEQ ID NO: 97683 - DNA, 25 bp, Homo sapien
tcattttagaatacttcatgagatt

SEQ ID NO: 97684 - DNA, 25 bp, Homo sapien
tcattttagatgtcttgcttaatta

SEQ ID NO: 97685 - DNA, 25 bp, Homo sapien
tcattttagttgtcttgcttaatta

SEQ ID NO: 97686 - DNA, 25 bp, Homo sapien
tcattttatactcctactaacagtg

SEQ ID NO: 97687 - DNA, 25 bp, Homo sapien
tcattttatactgctactaacagtg

SEQ ID NO: 97688 - DNA, 25 bp, Homo sapien
tcattttatccagtgttaaggctta

SEQ ID NO: 97689 - DNA, 25 bp, Homo sapien
tcattttatccggtgttaaggctta

SEQ ID NO: 97690 - DNA, 25 bp, Homo sapien
tcattttatcctatctgagtcccca

SEQ ID NO: 97691 - DNA, 25 bp, Homo sapien
tcattttattctatctgagtcccca

SEQ ID NO: 97692 - DNA, 25 bp, Homo sapien
tcattttcccgattatctctgtttc

SEQ ID NO: 97693 - DNA, 25 bp, Homo sapien
tcattttcccgattatgtctgtttc

SEQ ID NO: 97694 - DNA, 25 bp, Homo sapien
tcattttctcaccatattgctcaaa

SEQ ID NO: 97695 - DNA, 25 bp, Homo sapien
tcattttctcactatattgctcaaa

SEQ ID NO: 97696 - DNA, 25 bp, Homo sapien
tcattttgaaaaacgacacagcaca

SEQ ID NO: 97697 - DNA, 25 bp, Homo sapien
tcattttgaaaagcgacacagcaca

SEQ ID NO: 97698 - DNA, 25 bp, Homo sapien
tcattttgctaagtttgtttatttt

SEQ ID NO: 97699 - DNA, 25 bp, Homo sapien
tcattttggcacaattttgcagagg

SEQ ID NO: 97700 - DNA, 25 bp, Homo sapien
tcattttggcacagttttgcagagg

SEQ ID NO: 97701 - DNA, 25 bp, Homo sapien
tcattttgggttcatttgttgatgg

SEQ ID NO: 97702 - DNA, 25 bp, Homo sapien
tcattttggtaagtttgtttatttt

SEQ ID NO: 97703 - DNA, 25 bp, Homo sapien
tcattttgtattcctgctctgtagt

SEQ ID NO: 97704 - DNA, 25 bp, Homo sapien
tcattttgtatttctgctctgtagt

SEQ ID NO: 97705 - DNA, 25 bp, Homo sapien
tcattttgtgttcatttgttgatgg

SEQ ID NO: 97706 - DNA, 25 bp, Homo sapien
tcatttttaattctctgagccacaa

SEQ ID NO: 97707 - DNA, 25 bp, Homo sapien
tcatttttagcattacccactagac

SEQ ID NO: 97708 - DNA, 25 bp, Homo sapien
tcatttttagcattccccactagac

SEQ ID NO: 97709 - DNA, 25 bp, Homo sapien
tcatttttatttctctgagccacaa

SEQ ID NO: 97710 - DNA, 25 bp, Homo sapien
tcatttttcatgacgaactttgagg

SEQ ID NO: 97711 - DNA, 25 bp, Homo sapien
tcatttttcatgatgaactttgagg

SEQ ID NO: 97712 - DNA, 25 bp, Homo sapien
tcattttttgctctatacccatcaa

SEQ ID NO: 97713 - DNA, 25 bp, Homo sapien
tcattttttgctctctacccatcaa

SEQ ID NO: 97714 - DNA, 25 bp, Homo sapien
tccaaaaactaaagtaggaattgaa

SEQ ID NO: 97715 - DNA, 25 bp, Homo sapien
tccaaaaactaatgtaggaattgaa

SEQ ID NO: 97716 - DNA, 25 bp, Homo sapien
tccaaaaactttcccaatgtattta

SEQ ID NO: 97717 - DNA, 25 bp, Homo sapien
tccaaaaactttgccaatgtattta

SEQ ID NO: 97718 - DNA, 25 bp, Homo sapien
tccaaaaaggttagaagagatcagc

SEQ ID NO: 97719 - DNA, 25 bp, Homo sapien
tccaaaaaggtttgaagagatcagc

SEQ ID NO: 97720 - DNA, 25 bp, Homo sapien
tccaaaaatagaccctaggttttct

SEQ ID NO: 97721 - DNA, 25 bp, Homo sapien
tccaaaaataggccctaggttttct

SEQ ID NO: 97722 - DNA, 25 bp, Homo sapien
tccaaaaatccaacttcctaaacac

SEQ ID NO: 97723 - DNA, 25 bp, Homo sapien
tccaaaaatccaagttcctaaacac

SEQ ID NO: 97724 - DNA, 25 bp, Homo sapien
tccaaaacaataaaagtagtaacct

SEQ ID NO: 97725 - DNA, 25 bp, Homo sapien
tccaaaacaataaaggtagtaacct

SEQ ID NO: 97726 - DNA, 25 bp, Homo sapien
tccaaaacataacggctaaagccac

SEQ ID NO: 97727 - DNA, 25 bp, Homo sapien
tccaaaacataatggctaaagccac

SEQ ID NO: 97728 - DNA, 25 bp, Homo sapien
tccaaaacgcgtaaatcatctattg

SEQ ID NO: 97729 - DNA, 25 bp, Homo sapien
tccaaaacgtgtaaatcatctattg

SEQ ID NO: 97730 - DNA, 25 bp, Homo sapien
tccaaaagaaaatgccttcagtacc

SEQ ID NO: 97731 - DNA, 25 bp, Homo sapien
tccaaaagaaaatggcttcagtacc

SEQ ID NO: 97732 - DNA, 25 bp, Homo sapien
tccaaaaggtcatatcatactgcaa

SEQ ID NO: 97733 - DNA, 25 bp, Homo sapien
tccaaaaggtcgtatcatactgcaa

SEQ ID NO: 97734 - DNA, 25 bp, Homo sapien
tccaaaataaaacctttgtggtcta

SEQ ID NO: 97735 - DNA, 25 bp, Homo sapien
tccaaaataaaatctttgtggtcta

SEQ ID NO: 97736 - DNA, 25 bp, Homo sapien
tccaaaataactacatgcacatact

SEQ ID NO: 97737 - DNA, 25 bp, Homo sapien
tccaaaataactacattcacatact

SEQ ID NO: 97738 - DNA, 25 bp, Homo sapien
tccaaaatgtgattcaaatataatc

SEQ ID NO: 97739 - DNA, 25 bp, Homo sapien
tccaaaatgtgattcagatataatc

SEQ ID NO: 97740 - DNA, 25 bp, Homo sapien
tccaaaattacaccctatgctgtga

SEQ ID NO: 97741 - DNA, 25 bp, Homo sapien
tccaaaattacgccctatgctgtga

SEQ ID NO: 97742 - DNA, 25 bp, Homo sapien
tccaaacaatgatacatttagagtt

SEQ ID NO: 97743 - DNA, 25 bp, Homo sapien
tccaaacactgatacatttagagtt

SEQ ID NO: 97744 - DNA, 25 bp, Homo sapien
tccaaaccatagacttcgtagtatg

SEQ ID NO: 97745 - DNA, 25 bp, Homo sapien
tccaaaccatagccttcgtagtatg

SEQ ID NO: 97746 - DNA, 25 bp, Homo sapien
tccaaacttcacgatcgggtagtat

SEQ ID NO: 97747 - DNA, 25 bp, Homo sapien
tccaaacttcatgatcgggtagtat

SEQ ID NO: 97748 - DNA, 25 bp, Homo sapien
tccaaagaaggcataagttgtttca

SEQ ID NO: 97749 - DNA, 25 bp, Homo sapien
tccaaagacgatttattgaaaagac

SEQ ID NO: 97750 - DNA, 25 bp, Homo sapien
tccaaagatgatttattgaaaagac

SEQ ID NO: 97751 - DNA, 25 bp, Homo sapien
tccaaagatggcataagttgtttca

SEQ ID NO: 97752 - DNA, 25 bp, Homo sapien
tccaaagcctatgcctgaataagta

SEQ ID NO: 97753 - DNA, 25 bp, Homo sapien
tccaaagcctattcctgaataagta

SEQ ID NO: 97754 - DNA, 25 bp, Homo sapien
tccaaagctattaggactatgcact

SEQ ID NO: 97755 - DNA, 25 bp, Homo sapien
tccaaagctattgggactatgcact

SEQ ID NO: 97756 - DNA, 25 bp, Homo sapien
tccaaaggatggagaaaacagatct

SEQ ID NO: 97757 - DNA, 25 bp, Homo sapien
tccaaaggatggataaaacagatct

SEQ ID NO: 97758 - DNA, 25 bp, Homo sapien
tccaaaggcactaatagcctcaaca

SEQ ID NO: 97759 - DNA, 25 bp, Homo sapien
tccaaaggcactagtagcctcaaca

SEQ ID NO: 97760 - DNA, 25 bp, Homo sapien
tccaaagtctaaaaaaaccctgaaa

SEQ ID NO: 97761 - DNA, 25 bp, Homo sapien
tccaaagtctaaaaaacccctgaaa

SEQ ID NO: 97762 - DNA, 25 bp, Homo sapien
tccaaagtggtcctccatgatctcc

SEQ ID NO: 97763 - DNA, 25 bp, Homo sapien
tccaaagtggtcctccgtgatctcc

SEQ ID NO: 97764 - DNA, 25 bp, Homo sapien
tccaaataaaaatgtcaagagtatg

SEQ ID NO: 97765 - DNA, 25 bp, Homo sapien
tccaaataaaaatgtcgagagtatg

SEQ ID NO: 97766 - DNA, 25 bp, Homo sapien
tccaaataaaactgtatttatggat

SEQ ID NO: 97767 - DNA, 25 bp, Homo sapien
tccaaataatccctgaataacatat

SEQ ID NO: 97768 - DNA, 25 bp, Homo sapien
tccaaataatccttgaataacatat

SEQ ID NO: 97769 - DNA, 25 bp, Homo sapien
tccaaatagcagaaacagagactcc

SEQ ID NO: 97770 - DNA, 25 bp, Homo sapien
tccaaatagcagaaacggagactcc

SEQ ID NO: 97771 - DNA, 25 bp, Homo sapien
tccaaatataactgtatttatggat

SEQ ID NO: 97772 - DNA, 25 bp, Homo sapien
tccaaatgatgctatacgctttata

SEQ ID NO: 97773 - DNA, 25 bp, Homo sapien
tccaaatgatgctatatgctttata

SEQ ID NO: 97774 - DNA, 25 bp, Homo sapien
tccaaatggctcacggttggagtct

SEQ ID NO: 97775 - DNA, 25 bp, Homo sapien
tccaaatggctcatggttggagtct

SEQ ID NO: 97776 - DNA, 25 bp, Homo sapien
tccaaatgtcaataatcagttggaa

SEQ ID NO: 97777 - DNA, 25 bp, Homo sapien
tccaaatgtcagtaatcagttggaa

SEQ ID NO: 97778 - DNA, 25 bp, Homo sapien
tccaacaaaacacagtggctcagta

SEQ ID NO: 97779 - DNA, 25 bp, Homo sapien
tccaacaaaacacggtggctcagta

SEQ ID NO: 97780 - DNA, 25 bp, Homo sapien
tccaacaaacccattcataggtata

SEQ ID NO: 97781 - DNA, 25 bp, Homo sapien
tccaacaaacccgttcataggtata

SEQ ID NO: 97782 - DNA, 25 bp, Homo sapien
tccaacaagcatactttccagagat

SEQ ID NO: 97783 - DNA, 25 bp, Homo sapien
tccaacaagcatattttccagagat

SEQ ID NO: 97784 - DNA, 25 bp, Homo sapien
tccaacaatcttcatttgggagtat

SEQ ID NO: 97785 - DNA, 25 bp, Homo sapien
tccaacaatcttcgtttgggagtat

SEQ ID NO: 97786 - DNA, 25 bp, Homo sapien
tccaacacaatacaaagagctgtat

SEQ ID NO: 97787 - DNA, 25 bp, Homo sapien
tccaacacaatacgaagagctgtat

SEQ ID NO: 97788 - DNA, 25 bp, Homo sapien
tccaacacactctaatgaatcttgt

SEQ ID NO: 97789 - DNA, 25 bp, Homo sapien
tccaacacactgtaatgaatcttgt

SEQ ID NO: 97790 - DNA, 25 bp, Homo sapien
tccaacagcacatagttaatatgaa

SEQ ID NO: 97791 - DNA, 25 bp, Homo sapien
tccaacagcacgtagttaatatgaa

SEQ ID NO: 97792 - DNA, 25 bp, Homo sapien
tccaacagggaaaaactctgaagga

SEQ ID NO: 97793 - DNA, 25 bp, Homo sapien
tccaacagggaacaactctgaagga

SEQ ID NO: 97794 - DNA, 25 bp, Homo sapien
tccaacatatattagtctgccatct

SEQ ID NO: 97795 - DNA, 25 bp, Homo sapien
tccaacatgtattagtctgccatct

SEQ ID NO: 97796 - DNA, 25 bp, Homo sapien
tccaacattaaagggcctagttgaa

SEQ ID NO: 97797 - DNA, 25 bp, Homo sapien
tccaacattgaagggcctagttgaa

SEQ ID NO: 97798 - DNA, 25 bp, Homo sapien
tccaacatttaaagtatctgtcagt

SEQ ID NO: 97799 - DNA, 25 bp, Homo sapien
tccaacatttaaggtatctgtcagt

SEQ ID NO: 97800 - DNA, 25 bp, Homo sapien
tccaaccaaccacaaaattccacag

SEQ ID NO: 97801 - DNA, 25 bp, Homo sapien
tccaaccaaccataaaattccacag

SEQ ID NO: 97802 - DNA, 25 bp, Homo sapien
tccaacccacgttctcctcagttct

SEQ ID NO: 97803 - DNA, 25 bp, Homo sapien
tccaacccatgttctcctcagttct

SEQ ID NO: 97804 - DNA, 25 bp, Homo sapien
tccaacccttccagctctacaactc

SEQ ID NO: 97805 - DNA, 25 bp, Homo sapien
tccaacccttccagctttacaactc

SEQ ID NO: 97806 - DNA, 25 bp, Homo sapien
tccaaccgattgaaattcaactctt

SEQ ID NO: 97807 - DNA, 25 bp, Homo sapien
tccaaccgattgaagttcaactctt

SEQ ID NO: 97808 - DNA, 25 bp, Homo sapien
tccaacgaacatgcaccctttagct

SEQ ID NO: 97809 - DNA, 25 bp, Homo sapien
tccaacgaacatgcactctttagct

SEQ ID NO: 97810 - DNA, 25 bp, Homo sapien
tccaacggactctccagacaactct

SEQ ID NO: 97811 - DNA, 25 bp, Homo sapien
tccaacggactgtccagacaactct

SEQ ID NO: 97812 - DNA, 25 bp, Homo sapien
tccaactacctgctatattcaagag

SEQ ID NO: 97813 - DNA, 25 bp, Homo sapien
tccaactacctgctatcttcaagag

SEQ ID NO: 97814 - DNA, 25 bp, Homo sapien
tccaactcaaaacgagaagaagctt

SEQ ID NO: 97815 - DNA, 25 bp, Homo sapien
tccaactcaaaactagaagaagctt

SEQ ID NO: 97816 - DNA, 25 bp, Homo sapien
tccaactgacctactgatttccatc

SEQ ID NO: 97817 - DNA, 25 bp, Homo sapien
tccaactgacctcctgatttccatc

SEQ ID NO: 97818 - DNA, 25 bp, Homo sapien
tccaactggcagcactgtaggtttg

SEQ ID NO: 97819 - DNA, 25 bp, Homo sapien
tccaactgggagcactgtaggtttg

SEQ ID NO: 97820 - DNA, 25 bp, Homo sapien
tccaactgtccacttcttcaatctc

SEQ ID NO: 97821 - DNA, 25 bp, Homo sapien
tccaactgtccgcttcttcaatctc

SEQ ID NO: 97822 - DNA, 25 bp, Homo sapien
tccaacttatatcaaccccatttga

SEQ ID NO: 97823 - DNA, 25 bp, Homo sapien
tccaacttgctcaagaaggtggcca

SEQ ID NO: 97824 - DNA, 25 bp, Homo sapien
tccaacttgctcatgaaggtggcca

SEQ ID NO: 97825 - DNA, 25 bp, Homo sapien
tccaacttgtatcaaccccatttga

SEQ ID NO: 97826 - DNA, 25 bp, Homo sapien
tccaagaacttacacgacaattttc

SEQ ID NO: 97827 - DNA, 25 bp, Homo sapien
tccaagaacttacatgacaattttc

SEQ ID NO: 97828 - DNA, 25 bp, Homo sapien
tccaagagcatcttctgtacaatta

SEQ ID NO: 97829 - DNA, 25 bp, Homo sapien
tccaagagcatcttttgtacaatta

SEQ ID NO: 97830 - DNA, 25 bp, Homo sapien
tccaagagtcagcgagatggtgccc

SEQ ID NO: 97831 - DNA, 25 bp, Homo sapien
tccaagagtcagtgagatggtgccc

SEQ ID NO: 97832 - DNA, 25 bp, Homo sapien
tccaagatataattgcacaaacatg

SEQ ID NO: 97833 - DNA, 25 bp, Homo sapien
tccaagatataatttcacaaacatg

SEQ ID NO: 97834 - DNA, 25 bp, Homo sapien
tccaagattaaacctttctacgcat

SEQ ID NO: 97835 - DNA, 25 bp, Homo sapien
tccaagattcaacctttctacgcat

SEQ ID NO: 97836 - DNA, 25 bp, Homo sapien
tccaagcaagctctcgtattccagg

SEQ ID NO: 97837 - DNA, 25 bp, Homo sapien
tccaagcaagctcttgtattccagg

SEQ ID NO: 97838 - DNA, 25 bp, Homo sapien
tccaagcaagtaaattattctttct

SEQ ID NO: 97839 - DNA, 25 bp, Homo sapien
tccaagcaagtaacttattctttct

SEQ ID NO: 97840 - DNA, 25 bp, Homo sapien
tccaagcaatggcgtcagtcattta

SEQ ID NO: 97841 - DNA, 25 bp, Homo sapien
tccaagcaatggtgtcagtcattta

SEQ ID NO: 97842 - DNA, 25 bp, Homo sapien
tccaagcctaactctctgctttagc

SEQ ID NO: 97843 - DNA, 25 bp, Homo sapien
tccaagcctgactctctgctttagc

SEQ ID NO: 97844 - DNA, 25 bp, Homo sapien
tccaagcgacatcaggtgttttagt

SEQ ID NO: 97845 - DNA, 25 bp, Homo sapien
tccaagcgacattaggtgttttagt

SEQ ID NO: 97846 - DNA, 25 bp, Homo sapien
tccaagcgcggtcggctgtgtcagg

SEQ ID NO: 97847 - DNA, 25 bp, Homo sapien
tccaagcgcggttggctgtgtcagg

SEQ ID NO: 97848 - DNA, 25 bp, Homo sapien
tccaagctaagaccatgtgcgccct

SEQ ID NO: 97849 - DNA, 25 bp, Homo sapien
tccaagctaagtccatgtgcgccct

SEQ ID NO: 97850 - DNA, 25 bp, Homo sapien
tccaagctatttgcaactgtaaaca

SEQ ID NO: 97851 - DNA, 25 bp, Homo sapien
tccaagctctttgcaactgtaaaca

SEQ ID NO: 97852 - DNA, 25 bp, Homo sapien
tccaaggactctgggtcagcagctg

SEQ ID NO: 97853 - DNA, 25 bp, Homo sapien
tccaaggactctgtgtcagcagctg

SEQ ID NO: 97854 - DNA, 25 bp, Homo sapien
tccaaggctcccattctgagcatct

SEQ ID NO: 97855 - DNA, 25 bp, Homo sapien
tccaaggctcctattctgagcatct

SEQ ID NO: 97856 - DNA, 25 bp, Homo sapien
tccaaggtccacatcaaagttctca

SEQ ID NO: 97857 - DNA, 25 bp, Homo sapien
tccaaggttcacatcaaagttctca

SEQ ID NO: 97858 - DNA, 25 bp, Homo sapien
tccaagtccaaggtccacatcaaag

SEQ ID NO: 97859 - DNA, 25 bp, Homo sapien
tccaagtccaaggttcacatcaaag

SEQ ID NO: 97860 - DNA, 25 bp, Homo sapien
tccaagtgggtatagcaagctggca

SEQ ID NO: 97861 - DNA, 25 bp, Homo sapien
tccaagtggttatagcaagctggca

SEQ ID NO: 97862 - DNA, 25 bp, Homo sapien
tccaagttagaggtccacattcaaa

SEQ ID NO: 97863 - DNA, 25 bp, Homo sapien
tccaagttggaggtccacattcaaa

SEQ ID NO: 97864 - DNA, 25 bp, Homo sapien
tccaagttttacgagatgacaaaat

SEQ ID NO: 97865 - DNA, 25 bp, Homo sapien
tccaagttttatgagatgacaaaat

SEQ ID NO: 97866 - DNA, 25 bp, Homo sapien
tccaatacggtatccaccagccata

SEQ ID NO: 97867 - DNA, 25 bp, Homo sapien
tccaatacggtgtccaccagccata

SEQ ID NO: 97868 - DNA, 25 bp, Homo sapien
tccaatagacggctgtgttgtctac

SEQ ID NO: 97869 - DNA, 25 bp, Homo sapien
tccaatagagggctgtgttgtctac

SEQ ID NO: 97870 - DNA, 25 bp, Homo sapien
tccaatatttatcacgtcttggtgt

SEQ ID NO: 97871 - DNA, 25 bp, Homo sapien
tccaatatttatcatgtcttggtgt

SEQ ID NO: 97872 - DNA, 25 bp, Homo sapien
tccaatcaagtgaattctagccact

SEQ ID NO: 97873 - DNA, 25 bp, Homo sapien
tccaatcaagtgaattttagccact

SEQ ID NO: 97874 - DNA, 25 bp, Homo sapien
tccaatcaattactgacttaacaat

SEQ ID NO: 97875 - DNA, 25 bp, Homo sapien
tccaatcaattattgacttaacaat

SEQ ID NO: 97876 - DNA, 25 bp, Homo sapien
tccaatcacaccatattgtttctga

SEQ ID NO: 97877 - DNA, 25 bp, Homo sapien
tccaatcacaccgtattgtttctga

SEQ ID NO: 97878 - DNA, 25 bp, Homo sapien
tccaatccaaattatacctttgtga

SEQ ID NO: 97879 - DNA, 25 bp, Homo sapien
tccaatccaaattatatctttgtga

SEQ ID NO: 97880 - DNA, 25 bp, Homo sapien
tccaatctcaccattggctgactcc

SEQ ID NO: 97881 - DNA, 25 bp, Homo sapien
tccaatctcaccgttggctgactcc

SEQ ID NO: 97882 - DNA, 25 bp, Homo sapien
tccaatgacaaacgtccttataaat

SEQ ID NO: 97883 - DNA, 25 bp, Homo sapien
tccaatgacaaatgtccttataaat

SEQ ID NO: 97884 - DNA, 25 bp, Homo sapien
tccaatgacatcaacttttattaat

SEQ ID NO: 97885 - DNA, 25 bp, Homo sapien
tccaatgacatctacttttattaat

SEQ ID NO: 97886 - DNA, 25 bp, Homo sapien
tccaatgattcaaagacggttagag

SEQ ID NO: 97887 - DNA, 25 bp, Homo sapien
tccaatgattcaaagatggttagag

SEQ ID NO: 97888 - DNA, 25 bp, Homo sapien
tccaatgccaaaacggaaagtcaag

SEQ ID NO: 97889 - DNA, 25 bp, Homo sapien
tccaatgccaaaatggaaagtcaag

SEQ ID NO: 97890 - DNA, 25 bp, Homo sapien
tccaatgcccagtctctgatgataa

SEQ ID NO: 97891 - DNA, 25 bp, Homo sapien
tccaatgcccagtgtctgatgataa

SEQ ID NO: 97892 - DNA, 25 bp, Homo sapien
tccaatgcttgtcaattctgccttt

SEQ ID NO: 97893 - DNA, 25 bp, Homo sapien
tccaatgcttgtcagttctgccttt

SEQ ID NO: 97894 - DNA, 25 bp, Homo sapien
tccaatggtcaccctttaggcagtg

SEQ ID NO: 97895 - DNA, 25 bp, Homo sapien
tccaatggtgaccctttaggcagtg

SEQ ID NO: 97896 - DNA, 25 bp, Homo sapien
tccaatgttacaatctctaaagtta

SEQ ID NO: 97897 - DNA, 25 bp, Homo sapien
tccaatgttgcaatctctaaagtta

SEQ ID NO: 97898 - DNA, 25 bp, Homo sapien
tccaattactttatgggtagtctgt

SEQ ID NO: 97899 - DNA, 25 bp, Homo sapien
tccaattattttatgggtagtctgt

SEQ ID NO: 97900 - DNA, 25 bp, Homo sapien
tccaattgcagcaattcggttcagt

SEQ ID NO: 97901 - DNA, 25 bp, Homo sapien
tccaattgcatcagcaaataattat

SEQ ID NO: 97902 - DNA, 25 bp, Homo sapien
tccaattgcatcagtaaataattat

SEQ ID NO: 97903 - DNA, 25 bp, Homo sapien
tccaattgcattgctccatagctgt

SEQ ID NO: 97904 - DNA, 25 bp, Homo sapien
tccaattgcattgttccatagctgt

SEQ ID NO: 97905 - DNA, 25 bp, Homo sapien
tccaattgctgcaattcggttcagt

SEQ ID NO: 97906 - DNA, 25 bp, Homo sapien
tccaatttcaacatttaggactcta

SEQ ID NO: 97907 - DNA, 25 bp, Homo sapien
tccaatttcaagatttaggactcta

SEQ ID NO: 97908 - DNA, 25 bp, Homo sapien
tccaatttcagaggaaaatctgaac

SEQ ID NO: 97909 - DNA, 25 bp, Homo sapien
tccaatttcagaggaatatctgaac

SEQ ID NO: 97910 - DNA, 25 bp, Homo sapien
tccacaaaagctaggagtaataata

SEQ ID NO: 97911 - DNA, 25 bp, Homo sapien
tccacaaaagctgggagtaataata

SEQ ID NO: 97912 - DNA, 25 bp, Homo sapien
tccacaacaatttctttttttgttt

SEQ ID NO: 97913 - DNA, 25 bp, Homo sapien
tccacaacatatccgctcctccagg

SEQ ID NO: 97914 - DNA, 25 bp, Homo sapien
tccacaacatatctgctcctccagg

SEQ ID NO: 97915 - DNA, 25 bp, Homo sapien
tccacaaccatttctttttttgttt

SEQ ID NO: 97916 - DNA, 25 bp, Homo sapien
tccacaactccccttctaatcaggt

SEQ ID NO: 97917 - DNA, 25 bp, Homo sapien
tccacaacttcccttctaatcaggt

SEQ ID NO: 97918 - DNA, 25 bp, Homo sapien
tccacaagcgtcaagaccattcagg

SEQ ID NO: 97919 - DNA, 25 bp, Homo sapien
tccacaagtgtcaagaccattcagg

SEQ ID NO: 97920 - DNA, 25 bp, Homo sapien
tccacaatctacaaagtgctgaaac

SEQ ID NO: 97921 - DNA, 25 bp, Homo sapien
tccacaatctacagagtgctgaaac

SEQ ID NO: 97922 - DNA, 25 bp, Homo sapien
tccacaatgaacgtgtccttctgct

SEQ ID NO: 97923 - DNA, 25 bp, Homo sapien
tccacaatgaatgtgtccttctgct

SEQ ID NO: 97924 - DNA, 25 bp, Homo sapien
tccacaccacagctgtagcctaatg

SEQ ID NO: 97925 - DNA, 25 bp, Homo sapien
tccacacctagaagaggaaaagcta

SEQ ID NO: 97926 - DNA, 25 bp, Homo sapien
tccacacctagcagaggaaaagcta

SEQ ID NO: 97927 - DNA, 25 bp, Homo sapien
tccacacctcagctgtagcctaatg

SEQ ID NO: 97928 - DNA, 25 bp, Homo sapien
tccacactaatttctctaagtcttc

SEQ ID NO: 97929 - DNA, 25 bp, Homo sapien
tccacactacatgactggtagactt

SEQ ID NO: 97930 - DNA, 25 bp, Homo sapien
tccacactatatgactggtagactt

SEQ ID NO: 97931 - DNA, 25 bp, Homo sapien
tccacactcatttctctaagtcttc

SEQ ID NO: 97932 - DNA, 25 bp, Homo sapien
tccacactccaagaagctttatctt

SEQ ID NO: 97933 - DNA, 25 bp, Homo sapien
tccacactccaagaagttttatctt

SEQ ID NO: 97934 - DNA, 25 bp, Homo sapien
tccacacttgctctttcggaaaggt

SEQ ID NO: 97935 - DNA, 25 bp, Homo sapien
tccacacttgctcttttggaaaggt

SEQ ID NO: 97936 - DNA, 25 bp, Homo sapien
tccacataaagtagataaatgttcc

SEQ ID NO: 97937 - DNA, 25 bp, Homo sapien
tccacataaagtaggtaaatgttcc

SEQ ID NO: 97938 - DNA, 25 bp, Homo sapien
tccacatcttcttgcctgggctcag

SEQ ID NO: 97939 - DNA, 25 bp, Homo sapien
tccacatcttcttgtctgggctcag

SEQ ID NO: 97940 - DNA, 25 bp, Homo sapien
tccacatgaacacctgttatgctct

SEQ ID NO: 97941 - DNA, 25 bp, Homo sapien
tccacatgacacttctgacaccagc

SEQ ID NO: 97942 - DNA, 25 bp, Homo sapien
tccacatgacacttttgacaccagc

SEQ ID NO: 97943 - DNA, 25 bp, Homo sapien
tccacatgcaagttgagacctggaa

SEQ ID NO: 97944 - DNA, 25 bp, Homo sapien
tccacatgcccactttcatttctct

SEQ ID NO: 97945 - DNA, 25 bp, Homo sapien
tccacatgcccacttttatttctct

SEQ ID NO: 97946 - DNA, 25 bp, Homo sapien
tccacatggacacctgttatgctct

SEQ ID NO: 97947 - DNA, 25 bp, Homo sapien
tccacatgtaagttgagacctggaa

SEQ ID NO: 97948 - DNA, 25 bp, Homo sapien
tccacattaagataaggctgggaga

SEQ ID NO: 97949 - DNA, 25 bp, Homo sapien
tccacattccgttgatggttgaaac

SEQ ID NO: 97950 - DNA, 25 bp, Homo sapien
tccacattctgttgatggttgaaac

SEQ ID NO: 97951 - DNA, 25 bp, Homo sapien
tccacattgagataaggctgggaga

SEQ ID NO: 97952 - DNA, 25 bp, Homo sapien
tccacattgatagtgacatggcttt

SEQ ID NO: 97953 - DNA, 25 bp, Homo sapien
tccacattgatattgacatggcttt

SEQ ID NO: 97954 - DNA, 25 bp, Homo sapien
tccacattgtcttccttgtgctgtg

SEQ ID NO: 97955 - DNA, 25 bp, Homo sapien
tccacattgtcttctttgtgctgtg

SEQ ID NO: 97956 - DNA, 25 bp, Homo sapien
tccacatttctttcactaagttatc

SEQ ID NO: 97957 - DNA, 25 bp, Homo sapien
tccacatttctttcgctaagttatc

SEQ ID NO: 97958 - DNA, 25 bp, Homo sapien
tccacatttttagacgatattgcat

SEQ ID NO: 97959 - DNA, 25 bp, Homo sapien
tccacatttttagatgatattgcat

SEQ ID NO: 97960 - DNA, 25 bp, Homo sapien
tccaccaaccaggccaaaataaaca

SEQ ID NO: 97961 - DNA, 25 bp, Homo sapien
tccaccaaccaggtcaaaataaaca

SEQ ID NO: 97962 - DNA, 25 bp, Homo sapien
tccaccaatagcgtgtgaatggaag

SEQ ID NO: 97963 - DNA, 25 bp, Homo sapien
tccaccaatagcttgtgaatggaag

SEQ ID NO: 97964 - DNA, 25 bp, Homo sapien
tccaccaatcaagagggacatgaga

SEQ ID NO: 97965 - DNA, 25 bp, Homo sapien
tccaccaatcaagaggtacatgaga

SEQ ID NO: 97966 - DNA, 25 bp, Homo sapien
tccacccattcacacttgtactttt

SEQ ID NO: 97967 - DNA, 25 bp, Homo sapien
tccacccattcacgcttgtactttt

SEQ ID NO: 97968 - DNA, 25 bp, Homo sapien
tccaccgtcctgatcccagatgtga

SEQ ID NO: 97969 - DNA, 25 bp, Homo sapien
tccaccgtcttgatcccagatgtga

SEQ ID NO: 97970 - DNA, 25 bp, Homo sapien
tccacctaaccaagaaggctgcttg

SEQ ID NO: 97971 - DNA, 25 bp, Homo sapien
tccacctaagcaagaaggctgcttg

SEQ ID NO: 97972 - DNA, 25 bp, Homo sapien
tccacctatcaaggggacaatgatg

SEQ ID NO: 97973 - DNA, 25 bp, Homo sapien
tccacctatcacggggacaatgatg

SEQ ID NO: 97974 - DNA, 25 bp, Homo sapien
tccacctcttgatgagagaagctgt

SEQ ID NO: 97975 - DNA, 25 bp, Homo sapien
tccacctcttgatgggagaagctgt

SEQ ID NO: 97976 - DNA, 25 bp, Homo sapien
tccacctctttgatatagacccagg

SEQ ID NO: 97977 - DNA, 25 bp, Homo sapien
tccacctctttgttatagacccagg

SEQ ID NO: 97978 - DNA, 25 bp, Homo sapien
tccacctgcaggtttacaaaggttt

SEQ ID NO: 97979 - DNA, 25 bp, Homo sapien
tccacctgcgggtttacaaaggttt

SEQ ID NO: 97980 - DNA, 25 bp, Homo sapien
tccacctttgaatagttgccatctt

SEQ ID NO: 97981 - DNA, 25 bp, Homo sapien
tccacctttgaatatttgccatctt

SEQ ID NO: 97982 - DNA, 25 bp, Homo sapien
tccacgccaatgcatttaccactct

SEQ ID NO: 97983 - DNA, 25 bp, Homo sapien
tccacgccaatgcgtttaccactct

SEQ ID NO: 97984 - DNA, 25 bp, Homo sapien
tccacgctgccatcgtgttccctca

SEQ ID NO: 97985 - DNA, 25 bp, Homo sapien
tccacgctgccgtcgtgttccctca

SEQ ID NO: 97986 - DNA, 25 bp, Homo sapien
tccacggtgcttcatacagctctag

SEQ ID NO: 97987 - DNA, 25 bp, Homo sapien
tccacggtgcttcatatagctctag

SEQ ID NO: 97988 - DNA, 25 bp, Homo sapien
tccacggttagaggcattcctgggt

SEQ ID NO: 97989 - DNA, 25 bp, Homo sapien
tccacggttagatgcattcctgggt

SEQ ID NO: 97990 - DNA, 25 bp, Homo sapien
tccacgtctctcagtttctgtgtca

SEQ ID NO: 97991 - DNA, 25 bp, Homo sapien
tccacgtctttcagtttctgtgtca

SEQ ID NO: 97992 - DNA, 25 bp, Homo sapien
tccacgtgattgctaaaccctagga

SEQ ID NO: 97993 - DNA, 25 bp, Homo sapien
tccacgtggttgctaaaccctagga

SEQ ID NO: 97994 - DNA, 25 bp, Homo sapien
tccactcaacaaggctgacttggct

SEQ ID NO: 97995 - DNA, 25 bp, Homo sapien
tccactcaccaaggctgacttggct

SEQ ID NO: 97996 - DNA, 25 bp, Homo sapien
tccactccatagaagaacaaggcat

SEQ ID NO: 97997 - DNA, 25 bp, Homo sapien
tccactccgtagaagaacaaggcat

SEQ ID NO: 97998 - DNA, 25 bp, Homo sapien
tccactccttactagctgtgtgatc

SEQ ID NO: 97999 - DNA, 25 bp, Homo sapien
tccactccttactatctgtgtgatc

SEQ ID NO: 98000 - DNA, 25 bp, Homo sapien
tccactctcattctccgagatccat

SEQ ID NO: 98001 - DNA, 25 bp, Homo sapien
tccactctgttgctagatcacagaa

SEQ ID NO: 98002 - DNA, 25 bp, Homo sapien
tccactctgttgttagatcacagaa

SEQ ID NO: 98003 - DNA, 25 bp, Homo sapien
tccactcttattctccgagatccat

SEQ ID NO: 98004 - DNA, 25 bp, Homo sapien
tccactgccgatctaaactatttct

SEQ ID NO: 98005 - DNA, 25 bp, Homo sapien
tccactgccgatttaaactatttct

SEQ ID NO: 98006 - DNA, 25 bp, Homo sapien
tccactggaatccagtatctgcctt

SEQ ID NO: 98007 - DNA, 25 bp, Homo sapien
tccactggaatccagtgtctgcctt

SEQ ID NO: 98008 - DNA, 25 bp, Homo sapien
tccactgtttctgctctgctccaga

SEQ ID NO: 98009 - DNA, 25 bp, Homo sapien
tccactgtttctgttctgctccaga

SEQ ID NO: 98010 - DNA, 25 bp, Homo sapien
tccactgtttttatactggagttct

SEQ ID NO: 98011 - DNA, 25 bp, Homo sapien
tccactgtttttgtactggagttct

SEQ ID NO: 98012 - DNA, 25 bp, Homo sapien
tccacttccacgatccaaatacctc

SEQ ID NO: 98013 - DNA, 25 bp, Homo sapien
tccacttccactatccaaatacctc

SEQ ID NO: 98014 - DNA, 25 bp, Homo sapien
tccacttccgacggactacagctct

SEQ ID NO: 98015 - DNA, 25 bp, Homo sapien
tccacttccgatggactacagctct

SEQ ID NO: 98016 - DNA, 25 bp, Homo sapien
tccacttggagaacgtttttttgtg

SEQ ID NO: 98017 - DNA, 25 bp, Homo sapien
tccacttggagaatgtttttttgtg

SEQ ID NO: 98018 - DNA, 25 bp, Homo sapien
tccacttggtaaaatattggtctat

SEQ ID NO: 98019 - DNA, 25 bp, Homo sapien
tccacttggtagaatattggtctat

SEQ ID NO: 98020 - DNA, 25 bp, Homo sapien
tccactttgtgcgccagaattgagc

SEQ ID NO: 98021 - DNA, 25 bp, Homo sapien
tccactttgtgtgccagaattgagc

SEQ ID NO: 98022 - DNA, 25 bp, Homo sapien
tccagaaaacaatcataaagaaggc

SEQ ID NO: 98023 - DNA, 25 bp, Homo sapien
tccagaaaacaatcgtaaagaaggc

SEQ ID NO: 98024 - DNA, 25 bp, Homo sapien
tccagaaaacttgctaaaagtgagt

SEQ ID NO: 98025 - DNA, 25 bp, Homo sapien
tccagaaaagactgatgagtactgt

SEQ ID NO: 98026 - DNA, 25 bp, Homo sapien
tccagaaaagactggtgagtactgt

SEQ ID NO: 98027 - DNA, 25 bp, Homo sapien
tccagaaagagacctgaaggtggga

SEQ ID NO: 98028 - DNA, 25 bp, Homo sapien
tccagaaagagagctgaaggtggga

SEQ ID NO: 98029 - DNA, 25 bp, Homo sapien
tccagaaagcttgctaaaagtgagt

SEQ ID NO: 98030 - DNA, 25 bp, Homo sapien
tccagaaataaaatccgaggcccaa

SEQ ID NO: 98031 - DNA, 25 bp, Homo sapien
tccagaaataacatccgaggcccaa

SEQ ID NO: 98032 - DNA, 25 bp, Homo sapien
tccagaagcactcataatgggctta

SEQ ID NO: 98033 - DNA, 25 bp, Homo sapien
tccagaagcattgccagtgctaaga

SEQ ID NO: 98034 - DNA, 25 bp, Homo sapien
tccagaagcattgtcagtgctaaga

SEQ ID NO: 98035 - DNA, 25 bp, Homo sapien
tccagaaggcttcccaagggactgg

SEQ ID NO: 98036 - DNA, 25 bp, Homo sapien
tccagaaggtagacatttactctcc

SEQ ID NO: 98037 - DNA, 25 bp, Homo sapien
tccagaaggtagacgtttactctcc

SEQ ID NO: 98038 - DNA, 25 bp, Homo sapien
tccagaagtactcataatgggctta

SEQ ID NO: 98039 - DNA, 25 bp, Homo sapien
tccagaagtcttcccaagggactgg

SEQ ID NO: 98040 - DNA, 25 bp, Homo sapien
tccagaatggttccctaagatattc

SEQ ID NO: 98041 - DNA, 25 bp, Homo sapien
tccagaattgttccctaagatattc

SEQ ID NO: 98042 - DNA, 25 bp, Homo sapien
tccagactgcttccattctgaggct

SEQ ID NO: 98043 - DNA, 25 bp, Homo sapien
tccagactgcttccgttctgaggct

SEQ ID NO: 98044 - DNA, 25 bp, Homo sapien
tccagactgtgacgaactgggcaaa

SEQ ID NO: 98045 - DNA, 25 bp, Homo sapien
tccagactgtgatgaactgggcaaa

SEQ ID NO: 98046 - DNA, 25 bp, Homo sapien
tccagagaatataagaaggatcacc

SEQ ID NO: 98047 - DNA, 25 bp, Homo sapien
tccagagactataagaaggatcacc

SEQ ID NO: 98048 - DNA, 25 bp, Homo sapien
tccagagactgccgcttttcccttt

SEQ ID NO: 98049 - DNA, 25 bp, Homo sapien
tccagagactgctgcttttcccttt

SEQ ID NO: 98050 - DNA, 25 bp, Homo sapien
tccagagatactatgtgcaaaatat

SEQ ID NO: 98051 - DNA, 25 bp, Homo sapien
tccagagatactgtgtgcaaaatat

SEQ ID NO: 98052 - DNA, 25 bp, Homo sapien
tccagagcaaagcaaagagagggaa

SEQ ID NO: 98053 - DNA, 25 bp, Homo sapien
tccagagcaaaggaaagagagggaa

SEQ ID NO: 98054 - DNA, 25 bp, Homo sapien
tccagagcaatgtaaaaatcacagc

SEQ ID NO: 98055 - DNA, 25 bp, Homo sapien
tccagagcaatgtagaaatcacagc

SEQ ID NO: 98056 - DNA, 25 bp, Homo sapien
tccagaggacactgctctgtaccag

SEQ ID NO: 98057 - DNA, 25 bp, Homo sapien
tccagaggccactgctctgtaccag

SEQ ID NO: 98058 - DNA, 25 bp, Homo sapien
tccagatatttgacatggcttcctc

SEQ ID NO: 98059 - DNA, 25 bp, Homo sapien
tccagatatttgacgtggcttcctc

SEQ ID NO: 98060 - DNA, 25 bp, Homo sapien
tccagatcaaaacacagtgtgcctt

SEQ ID NO: 98061 - DNA, 25 bp, Homo sapien
tccagatcaaaacagagtgtgcctt

SEQ ID NO: 98062 - DNA, 25 bp, Homo sapien
tccagatccctgatacaaaagatca

SEQ ID NO: 98063 - DNA, 25 bp, Homo sapien
tccagatctctgatacaaaagatca

SEQ ID NO: 98064 - DNA, 25 bp, Homo sapien
tccagatggaagatgttctttaagg

SEQ ID NO: 98065 - DNA, 25 bp, Homo sapien
tccagatggaagttgttctttaagg

SEQ ID NO: 98066 - DNA, 25 bp, Homo sapien
tccagattctccattcattcttaag

SEQ ID NO: 98067 - DNA, 25 bp, Homo sapien
tccagattctccattcgttcttaag

SEQ ID NO: 98068 - DNA, 25 bp, Homo sapien
tccagattttcaacctgtgcagtga

SEQ ID NO: 98069 - DNA, 25 bp, Homo sapien
tccagattttcgacctgtgcagtga

SEQ ID NO: 98070 - DNA, 25 bp, Homo sapien
tccagcaacggatgatgtgcttttg

SEQ ID NO: 98071 - DNA, 25 bp, Homo sapien
tccagcaagggatgatgtgcttttg

SEQ ID NO: 98072 - DNA, 25 bp, Homo sapien
tccagcaatagcatctaaagacaat

SEQ ID NO: 98073 - DNA, 25 bp, Homo sapien
tccagcaatagcatctgaagacaat

SEQ ID NO: 98074 - DNA, 25 bp, Homo sapien
tccagcacagtgaattaacgtaaac

SEQ ID NO: 98075 - DNA, 25 bp, Homo sapien
tccagcacagtgcattaacgtaaac

SEQ ID NO: 98076 - DNA, 25 bp, Homo sapien
tccagcaccgactttctcaccattg

SEQ ID NO: 98077 - DNA, 25 bp, Homo sapien
tccagcacctaaactggtatatatt

SEQ ID NO: 98078 - DNA, 25 bp, Homo sapien
tccagcactgactttctcaccattg

SEQ ID NO: 98079 - DNA, 25 bp, Homo sapien
tccagcacttaaactggtatatatt

SEQ ID NO: 98080 - DNA, 25 bp, Homo sapien
tccagcagccctactagtcaggagg

SEQ ID NO: 98081 - DNA, 25 bp, Homo sapien
tccagcagccctgctagtcaggagg

SEQ ID NO: 98082 - DNA, 25 bp, Homo sapien
tccagcagctatcttgggccataag

SEQ ID NO: 98083 - DNA, 25 bp, Homo sapien
tccagcaggactaggtaccaaagcc

SEQ ID NO: 98084 - DNA, 25 bp, Homo sapien
tccagcaggactgggtaccaaagcc

SEQ ID NO: 98085 - DNA, 25 bp, Homo sapien
tccagcagttatcttgggccataag

SEQ ID NO: 98086 - DNA, 25 bp, Homo sapien
tccagccacacacagcaggtccttt

SEQ ID NO: 98087 - DNA, 25 bp, Homo sapien
tccagccacagacagctcccgatgc

SEQ ID NO: 98088 - DNA, 25 bp, Homo sapien
tccagccacagacggctcccgatgc

SEQ ID NO: 98089 - DNA, 25 bp, Homo sapien
tccagccacgcacagcaggtccttt

SEQ ID NO: 98090 - DNA, 25 bp, Homo sapien
tccagccatgtcatcgaatcgtctt

SEQ ID NO: 98091 - DNA, 25 bp, Homo sapien
tccagccatttcatcgaatcgtctt

SEQ ID NO: 98092 - DNA, 25 bp, Homo sapien
tccagcccatgatgttggagagaca

SEQ ID NO: 98093 - DNA, 25 bp, Homo sapien
tccagcccgtgatgttggagagaca

SEQ ID NO: 98094 - DNA, 25 bp, Homo sapien
tccagcctttgccacagagcgagat

SEQ ID NO: 98095 - DNA, 25 bp, Homo sapien
tccagcctttgccatagagcgagat

SEQ ID NO: 98096 - DNA, 25 bp, Homo sapien
tccagctcagagcacccaactaagt

SEQ ID NO: 98097 - DNA, 25 bp, Homo sapien
tccagctcagagtacccaactaagt

SEQ ID NO: 98098 - DNA, 25 bp, Homo sapien
tccagctgggaaagtgttgggaaaa

SEQ ID NO: 98099 - DNA, 25 bp, Homo sapien
tccagctgggaaggtgttgggaaaa

SEQ ID NO: 98100 - DNA, 25 bp, Homo sapien
tccagcttctcaacgtgttacttgt

SEQ ID NO: 98101 - DNA, 25 bp, Homo sapien
tccagcttctcaatgtgttacttgt

SEQ ID NO: 98102 - DNA, 25 bp, Homo sapien
tccaggaaaatattgccttcttatt

SEQ ID NO: 98103 - DNA, 25 bp, Homo sapien
tccaggaaaatgttgccttcttatt

SEQ ID NO: 98104 - DNA, 25 bp, Homo sapien
tccaggaagcagactgtggacttag

SEQ ID NO: 98105 - DNA, 25 bp, Homo sapien
tccaggaagcagattgtggacttag

SEQ ID NO: 98106 - DNA, 25 bp, Homo sapien
tccaggaataaaaagatttagagtc

SEQ ID NO: 98107 - DNA, 25 bp, Homo sapien
tccaggaataaacagatttagagtc

SEQ ID NO: 98108 - DNA, 25 bp, Homo sapien
tccaggaccacaatttgcttgctgt

SEQ ID NO: 98109 - DNA, 25 bp, Homo sapien
tccaggaccacgatttgcttgctgt

SEQ ID NO: 98110 - DNA, 25 bp, Homo sapien
tccaggacccattcccactcatcat

SEQ ID NO: 98111 - DNA, 25 bp, Homo sapien
tccaggacccattcccgctcatcat

SEQ ID NO: 98112 - DNA, 25 bp, Homo sapien
tccaggaccgggttgctcagccttg

SEQ ID NO: 98113 - DNA, 25 bp, Homo sapien
tccaggaccgggtttctcagccttg

SEQ ID NO: 98114 - DNA, 25 bp, Homo sapien
tccaggacctcaataacacctaatt

SEQ ID NO: 98115 - DNA, 25 bp, Homo sapien
tccaggacctcattaacacctaatt

SEQ ID NO: 98116 - DNA, 25 bp, Homo sapien
tccaggaggaagactgaggaaataa

SEQ ID NO: 98117 - DNA, 25 bp, Homo sapien
tccaggaggaagtctgaggaaataa

SEQ ID NO: 98118 - DNA, 25 bp, Homo sapien
tccaggagtgccctgtatataagtc

SEQ ID NO: 98119 - DNA, 25 bp, Homo sapien
tccaggagtgctctgtatataagtc

SEQ ID NO: 98120 - DNA, 25 bp, Homo sapien
tccaggcacatcctaactcaggata

SEQ ID NO: 98121 - DNA, 25 bp, Homo sapien
tccaggcacattctaactcaggata

SEQ ID NO: 98122 - DNA, 25 bp, Homo sapien
tccaggcactatcgtagatccagat

SEQ ID NO: 98123 - DNA, 25 bp, Homo sapien
tccaggcactattgtagatccagat

SEQ ID NO: 98124 - DNA, 25 bp, Homo sapien
tccaggccatgtgtcccgatgttcc

SEQ ID NO: 98125 - DNA, 25 bp, Homo sapien
tccaggccatgtgtcctgatgttcc

SEQ ID NO: 98126 - DNA, 25 bp, Homo sapien
tccaggccgcctgtttttactcaac

SEQ ID NO: 98127 - DNA, 25 bp, Homo sapien
tccaggcctcctgtttttactcaac

SEQ ID NO: 98128 - DNA, 25 bp, Homo sapien
tccaggctatgattgacaattacca

SEQ ID NO: 98129 - DNA, 25 bp, Homo sapien
tccaggctatgattgataattacca

SEQ ID NO: 98130 - DNA, 25 bp, Homo sapien
tccaggctcaaaaaaacaccgagtc

SEQ ID NO: 98131 - DNA, 25 bp, Homo sapien
tccaggctcaaaaacacaccgagtc

SEQ ID NO: 98132 - DNA, 25 bp, Homo sapien
tccaggctgccatacactgaggttg

SEQ ID NO: 98133 - DNA, 25 bp, Homo sapien
tccaggctgtcatacactgaggttg

SEQ ID NO: 98134 - DNA, 25 bp, Homo sapien
tccaggggccaatgtcagaacatgg

SEQ ID NO: 98135 - DNA, 25 bp, Homo sapien
tccaggggccagtgtcagaacatgg

SEQ ID NO: 98136 - DNA, 25 bp, Homo sapien
tccagggtgacagactcctagctaa

SEQ ID NO: 98137 - DNA, 25 bp, Homo sapien
tccagggtggcagactcctagctaa

SEQ ID NO: 98138 - DNA, 25 bp, Homo sapien
tccaggtgagcccttgctttgccca

SEQ ID NO: 98139 - DNA, 25 bp, Homo sapien
tccaggtgagcccttgttttgccca

SEQ ID NO: 98140 - DNA, 25 bp, Homo sapien
tccaggttttcctcttctacctcta

SEQ ID NO: 98141 - DNA, 25 bp, Homo sapien
tccaggttttccttttctacctcta

SEQ ID NO: 98142 - DNA, 25 bp, Homo sapien
tccagtataagctaaacattatccc

SEQ ID NO: 98143 - DNA, 25 bp, Homo sapien
tccagtatatgctaaacattatccc

SEQ ID NO: 98144 - DNA, 25 bp, Homo sapien
tccagtatcttcttttttgatcctt

SEQ ID NO: 98145 - DNA, 25 bp, Homo sapien
tccagtatgttcttttttgatcctt

SEQ ID NO: 98146 - DNA, 25 bp, Homo sapien
tccagtccccaaagattgatctcac

SEQ ID NO: 98147 - DNA, 25 bp, Homo sapien
tccagtccgcaaagattgatctcac

SEQ ID NO: 98148 - DNA, 25 bp, Homo sapien
tccagtgaaaagtgtagacatttac

SEQ ID NO: 98149 - DNA, 25 bp, Homo sapien
tccagtgagaagtgtagacatttac

SEQ ID NO: 98150 - DNA, 25 bp, Homo sapien
tccagtggctctcctacctcctttt

SEQ ID NO: 98151 - DNA, 25 bp, Homo sapien
tccagtggctctcttacctcctttt

SEQ ID NO: 98152 - DNA, 25 bp, Homo sapien
tccagtgtactaccaccaacaattc

SEQ ID NO: 98153 - DNA, 25 bp, Homo sapien
tccagtgtactactaccaacaattc

SEQ ID NO: 98154 - DNA, 25 bp, Homo sapien
tccagtgtatgatatttagggtgta

SEQ ID NO: 98155 - DNA, 25 bp, Homo sapien
tccagtgtatgatttttagggtgta

SEQ ID NO: 98156 - DNA, 25 bp, Homo sapien
tccagttcatttttttccctcaaag

SEQ ID NO: 98157 - DNA, 25 bp, Homo sapien
tccagttcattttttttcctcaaag

SEQ ID NO: 98158 - DNA, 25 bp, Homo sapien
tccagttccaagttagaggtccaca

SEQ ID NO: 98159 - DNA, 25 bp, Homo sapien
tccagttccaagttggaggtccaca

SEQ ID NO: 98160 - DNA, 25 bp, Homo sapien
tccagttgcctaaaccacttatctg

SEQ ID NO: 98161 - DNA, 25 bp, Homo sapien
tccagttgcctaaatcacttatctg

SEQ ID NO: 98162 - DNA, 25 bp, Homo sapien
tccagttgcctccataagttaagat

SEQ ID NO: 98163 - DNA, 25 bp, Homo sapien
tccagttgcctccgtaagttaagat

SEQ ID NO: 98164 - DNA, 25 bp, Homo sapien
tccagttgctctcctccctctttgt

SEQ ID NO: 98165 - DNA, 25 bp, Homo sapien
tccagttgctctgctccctctttgt

SEQ ID NO: 98166 - DNA, 25 bp, Homo sapien
tccagttgttttctcacgactcatt

SEQ ID NO: 98167 - DNA, 25 bp, Homo sapien
tccagttgttttctcatgactcatt

SEQ ID NO: 98168 - DNA, 25 bp, Homo sapien
tccagtttagacagagtctgctttt

SEQ ID NO: 98169 - DNA, 25 bp, Homo sapien
tccagtttagatagagtctgctttt

SEQ ID NO: 98170 - DNA, 25 bp, Homo sapien
tccagtttatccaagtccaagaagt

SEQ ID NO: 98171 - DNA, 25 bp, Homo sapien
tccagtttatccaggtccaagaagt

SEQ ID NO: 98172 - DNA, 25 bp, Homo sapien
tccataaataccttatatcattctc

SEQ ID NO: 98173 - DNA, 25 bp, Homo sapien
tccataaataccttgtatcattctc

SEQ ID NO: 98174 - DNA, 25 bp, Homo sapien
tccataagacaatgtcaccatagtg

SEQ ID NO: 98175 - DNA, 25 bp, Homo sapien
tccataagacagtgtcaccatagtg

SEQ ID NO: 98176 - DNA, 25 bp, Homo sapien
tccataagcgattaagtggtatttt

SEQ ID NO: 98177 - DNA, 25 bp, Homo sapien
tccataagtgattaagtggtatttt

SEQ ID NO: 98178 - DNA, 25 bp, Homo sapien
tccataatatactcaacaagtggca

SEQ ID NO: 98179 - DNA, 25 bp, Homo sapien
tccataatatattcaacaagtggca

SEQ ID NO: 98180 - DNA, 25 bp, Homo sapien
tccataatgcaggaagaaaccttcg

SEQ ID NO: 98181 - DNA, 25 bp, Homo sapien
tccataattcaggaagaaaccttcg

SEQ ID NO: 98182 - DNA, 25 bp, Homo sapien
tccataccacactctcttcactatt

SEQ ID NO: 98183 - DNA, 25 bp, Homo sapien
tccataccacagtctcttcactatt

SEQ ID NO: 98184 - DNA, 25 bp, Homo sapien
tccatagaaagacgatagagataat

SEQ ID NO: 98185 - DNA, 25 bp, Homo sapien
tccatagaaagatgatagagataat

SEQ ID NO: 98186 - DNA, 25 bp, Homo sapien
tccatagacactgacgttcagtttt

SEQ ID NO: 98187 - DNA, 25 bp, Homo sapien
tccatagacactgatgttcagtttt

SEQ ID NO: 98188 - DNA, 25 bp, Homo sapien
tccataggtctcatgccacattttg

SEQ ID NO: 98189 - DNA, 25 bp, Homo sapien
tccataggtcttatgccacattttg

SEQ ID NO: 98190 - DNA, 25 bp, Homo sapien
tccatagtcgtcatgagctaacaca

SEQ ID NO: 98191 - DNA, 25 bp, Homo sapien
tccatagttgtcatgagctaacaca

SEQ ID NO: 98192 - DNA, 25 bp, Homo sapien
tccatatcaagatatttggcacatt

SEQ ID NO: 98193 - DNA, 25 bp, Homo sapien
tccatatcacatgcatcctcacatg

SEQ ID NO: 98194 - DNA, 25 bp, Homo sapien
tccatatcacatgcattctcacatg

SEQ ID NO: 98195 - DNA, 25 bp, Homo sapien
tccatatcgagatatttggcacatt

SEQ ID NO: 98196 - DNA, 25 bp, Homo sapien
tccatatcttattcaattcctggcc

SEQ ID NO: 98197 - DNA, 25 bp, Homo sapien
tccatatcttatttaattcctggcc

SEQ ID NO: 98198 - DNA, 25 bp, Homo sapien
tccatatgcaaaaacatgaacttca

SEQ ID NO: 98199 - DNA, 25 bp, Homo sapien
tccatatgcaaaaatatgaacttca

SEQ ID NO: 98200 - DNA, 25 bp, Homo sapien
tccatatgcctgaacatttgattgg

SEQ ID NO: 98201 - DNA, 25 bp, Homo sapien
tccatatgcctggacatttgattgg

SEQ ID NO: 98202 - DNA, 25 bp, Homo sapien
tccatattgtttggcatcaatatca

SEQ ID NO: 98203 - DNA, 25 bp, Homo sapien
tccatattgttttgcatcaatatca

SEQ ID NO: 98204 - DNA, 25 bp, Homo sapien
tccatatttttgccagtatgtagtg

SEQ ID NO: 98205 - DNA, 25 bp, Homo sapien
tccatattttttccagtatgtagtg

SEQ ID NO: 98206 - DNA, 25 bp, Homo sapien
tccatcaatattagagaaatgcaaa

SEQ ID NO: 98207 - DNA, 25 bp, Homo sapien
tccatcaatgttagagaaatgcaaa

SEQ ID NO: 98208 - DNA, 25 bp, Homo sapien
tccatcagtaaacatactcaagtct

SEQ ID NO: 98209 - DNA, 25 bp, Homo sapien
tccatcagtaaacatagtcaagtct

SEQ ID NO: 98210 - DNA, 25 bp, Homo sapien
tccatcagttggagacattaacagc

SEQ ID NO: 98211 - DNA, 25 bp, Homo sapien
tccatcagttggaggcattaacagc

SEQ ID NO: 98212 - DNA, 25 bp, Homo sapien
tccatcatagctgttactgccactt

SEQ ID NO: 98213 - DNA, 25 bp, Homo sapien
tccatcatagctgttattgccactt

SEQ ID NO: 98214 - DNA, 25 bp, Homo sapien
tccatccacaggttcctgtcctcag

SEQ ID NO: 98215 - DNA, 25 bp, Homo sapien
tccatccataggttcctgtcctcag

SEQ ID NO: 98216 - DNA, 25 bp, Homo sapien
tccatcctggcattaaaaagtagaa

SEQ ID NO: 98217 - DNA, 25 bp, Homo sapien
tccatcctggcgttaaaaagtagaa

SEQ ID NO: 98218 - DNA, 25 bp, Homo sapien
tccatccttaaagacagaataggat

SEQ ID NO: 98219 - DNA, 25 bp, Homo sapien
tccatccttaaatacagaataggat

SEQ ID NO: 98220 - DNA, 25 bp, Homo sapien
tccatctagtgctatgaagtatttc

SEQ ID NO: 98221 - DNA, 25 bp, Homo sapien
tccatctagtgctatggagtatttc

SEQ ID NO: 98222 - DNA, 25 bp, Homo sapien
tccatctcatcccttggtcttaacc

SEQ ID NO: 98223 - DNA, 25 bp, Homo sapien
tccatctcgtcccttggtcttaacc

SEQ ID NO: 98224 - DNA, 25 bp, Homo sapien
tccatctctatcgcatggcagcctt

SEQ ID NO: 98225 - DNA, 25 bp, Homo sapien
tccatctctattgcatggcagcctt

SEQ ID NO: 98226 - DNA, 25 bp, Homo sapien
tccatctgtcccacgcaaattcctt

SEQ ID NO: 98227 - DNA, 25 bp, Homo sapien
tccatctgtcccatgcaaattcctt

SEQ ID NO: 98228 - DNA, 25 bp, Homo sapien
tccatcttgtatattttcaaaacac

SEQ ID NO: 98229 - DNA, 25 bp, Homo sapien
tccatcttgtatcttttcaaaacac

SEQ ID NO: 98230 - DNA, 25 bp, Homo sapien
tccatcttgttcattcttctgcttc

SEQ ID NO: 98231 - DNA, 25 bp, Homo sapien
tccatcttgttcgttcttctgcttc

SEQ ID NO: 98232 - DNA, 25 bp, Homo sapien
tccatctttgccattggtttgtaca

SEQ ID NO: 98233 - DNA, 25 bp, Homo sapien
tccatctttgccattgttttgtaca

SEQ ID NO: 98234 - DNA, 25 bp, Homo sapien
tccatcttttaagaatgcttgtaat

SEQ ID NO: 98235 - DNA, 25 bp, Homo sapien
tccatcttttaaggatgcttgtaat

SEQ ID NO: 98236 - DNA, 25 bp, Homo sapien
tccatgaaaaccaacgctttgtctc

SEQ ID NO: 98237 - DNA, 25 bp, Homo sapien
tccatgaaaaccaatgctttgtctc

SEQ ID NO: 98238 - DNA, 25 bp, Homo sapien
tccatgaaactcggaggaaatctga

SEQ ID NO: 98239 - DNA, 25 bp, Homo sapien
tccatgaacacgatatttttgtaac

SEQ ID NO: 98240 - DNA, 25 bp, Homo sapien
tccatgaacactatatttttgtaac

SEQ ID NO: 98241 - DNA, 25 bp, Homo sapien
tccatgaacctcggaggaaatctga

SEQ ID NO: 98242 - DNA, 25 bp, Homo sapien
tccatgaatataatgctacaatata

SEQ ID NO: 98243 - DNA, 25 bp, Homo sapien
tccatgaatttaatgctacaatata

SEQ ID NO: 98244 - DNA, 25 bp, Homo sapien
tccatgagaccttcagagatccatt

SEQ ID NO: 98245 - DNA, 25 bp, Homo sapien
tccatgagatcacttaggaaatgag

SEQ ID NO: 98246 - DNA, 25 bp, Homo sapien
tccatgagatcgcttaggaaatgag

SEQ ID NO: 98247 - DNA, 25 bp, Homo sapien
tccatgaggccttcagagatccatt

SEQ ID NO: 98248 - DNA, 25 bp, Homo sapien
tccatgagtgtcaaaaaccgatgat

SEQ ID NO: 98249 - DNA, 25 bp, Homo sapien
tccatgagtgtcaaaacccgatgat

SEQ ID NO: 98250 - DNA, 25 bp, Homo sapien
tccatgcaagaccatacaagtgagg

SEQ ID NO: 98251 - DNA, 25 bp, Homo sapien
tccatgcacgaccatacaagtgagg

SEQ ID NO: 98252 - DNA, 25 bp, Homo sapien
tccatgcaggccatgacaggctcat

SEQ ID NO: 98253 - DNA, 25 bp, Homo sapien
tccatgcaggccatgataggctcat

SEQ ID NO: 98254 - DNA, 25 bp, Homo sapien
tccatgcgcagtttaaaaatttcca

SEQ ID NO: 98255 - DNA, 25 bp, Homo sapien
tccatgcgcagttttaaaatttcca

SEQ ID NO: 98256 - DNA, 25 bp, Homo sapien
tccatggaacaagcagatgatgttg

SEQ ID NO: 98257 - DNA, 25 bp, Homo sapien
tccatggaacaagcagctgatgttg

SEQ ID NO: 98258 - DNA, 25 bp, Homo sapien
tccatgggcttacagtcgtgtgtgc

SEQ ID NO: 98259 - DNA, 25 bp, Homo sapien
tccatgggcttccagtcgtgtgtgc

SEQ ID NO: 98260 - DNA, 25 bp, Homo sapien
tccatggtcagatctacgtaaacgg

SEQ ID NO: 98261 - DNA, 25 bp, Homo sapien
tccatggtcagatctatgtaaacgg

SEQ ID NO: 98262 - DNA, 25 bp, Homo sapien
tccatggttttacgcaaatgtctgt

SEQ ID NO: 98263 - DNA, 25 bp, Homo sapien
tccatggttttatgcaaatgtctgt

SEQ ID NO: 98264 - DNA, 25 bp, Homo sapien
tccatgtaaaagtgaatctatgcag

SEQ ID NO: 98265 - DNA, 25 bp, Homo sapien
tccatgtaatctgaaaaatcaaatg

SEQ ID NO: 98266 - DNA, 25 bp, Homo sapien
tccatgtacaagtgaatctatgcag

SEQ ID NO: 98267 - DNA, 25 bp, Homo sapien
tccatgtatccatcttaattctgcc

SEQ ID NO: 98268 - DNA, 25 bp, Homo sapien
tccatgtatccctcttaattctgcc

SEQ ID NO: 98269 - DNA, 25 bp, Homo sapien
tccatgtattctgaaaaatcaaatg

SEQ ID NO: 98270 - DNA, 25 bp, Homo sapien
tccatgtgcagaatagattgaagaa

SEQ ID NO: 98271 - DNA, 25 bp, Homo sapien
tccatgtgcgcagaactcagaagga

SEQ ID NO: 98272 - DNA, 25 bp, Homo sapien
tccatgtggagaatagattgaagaa

SEQ ID NO: 98273 - DNA, 25 bp, Homo sapien
tccatgtgtgcagaactcagaagga

SEQ ID NO: 98274 - DNA, 25 bp, Homo sapien
tccatgttaaccctactaccacatt

SEQ ID NO: 98275 - DNA, 25 bp, Homo sapien
tccatgttaaccttactaccacatt

SEQ ID NO: 98276 - DNA, 25 bp, Homo sapien
tccatgttcctataaaaatggggtt

SEQ ID NO: 98277 - DNA, 25 bp, Homo sapien
tccatgttgaatattcccagtgcac

SEQ ID NO: 98278 - DNA, 25 bp, Homo sapien
tccatgttgctataaaaatggggtt

SEQ ID NO: 98279 - DNA, 25 bp, Homo sapien
tccatgttggatattcccagtgcac

SEQ ID NO: 98280 - DNA, 25 bp, Homo sapien
tccatgtttaaaaacaaagccttga

SEQ ID NO: 98281 - DNA, 25 bp, Homo sapien
tccatgtttaaaatcaaagccttga

SEQ ID NO: 98282 - DNA, 25 bp, Homo sapien
tccattaattgcgtctcttttctat

SEQ ID NO: 98283 - DNA, 25 bp, Homo sapien
tccattaattgtgtctcttttctat

SEQ ID NO: 98284 - DNA, 25 bp, Homo sapien
tccattagagtgacggaagtgagca

SEQ ID NO: 98285 - DNA, 25 bp, Homo sapien
tccattagagtgatggaagtgagca

SEQ ID NO: 98286 - DNA, 25 bp, Homo sapien
tccattagatgacgtgtgatcagag

SEQ ID NO: 98287 - DNA, 25 bp, Homo sapien
tccattagatgatgtgtgatcagag

SEQ ID NO: 98288 - DNA, 25 bp, Homo sapien
tccattataattccatatgttgtat

SEQ ID NO: 98289 - DNA, 25 bp, Homo sapien
tccattataattccgtatgttgtat

SEQ ID NO: 98290 - DNA, 25 bp, Homo sapien
tccattatatttcccattatctgat

SEQ ID NO: 98291 - DNA, 25 bp, Homo sapien
tccattatatttctcattatctgat

SEQ ID NO: 98292 - DNA, 25 bp, Homo sapien
tccattatcgaggcccaggctcata

SEQ ID NO: 98293 - DNA, 25 bp, Homo sapien
tccattatcgaggcccgggctcata

SEQ ID NO: 98294 - DNA, 25 bp, Homo sapien
tccattatgcttccaaatgcagcac

SEQ ID NO: 98295 - DNA, 25 bp, Homo sapien
tccattatgctttcaaatgcagcac

SEQ ID NO: 98296 - DNA, 25 bp, Homo sapien
tccattattcccattgttggtttag

SEQ ID NO: 98297 - DNA, 25 bp, Homo sapien
tccattattcccgttgttggtttag

SEQ ID NO: 98298 - DNA, 25 bp, Homo sapien
tccattcacagatcctaccacaaca

SEQ ID NO: 98299 - DNA, 25 bp, Homo sapien
tccattcacagattctaccacaaca

SEQ ID NO: 98300 - DNA, 25 bp, Homo sapien
tccattcatttaccgccttacctgg

SEQ ID NO: 98301 - DNA, 25 bp, Homo sapien
tccattcatttgccgccttacctgg

SEQ ID NO: 98302 - DNA, 25 bp, Homo sapien
tccattctacgggacatcaagcaag

SEQ ID NO: 98303 - DNA, 25 bp, Homo sapien
tccattctagttctacccatggaca

SEQ ID NO: 98304 - DNA, 25 bp, Homo sapien
tccattctatgggacatcaagcaag

SEQ ID NO: 98305 - DNA, 25 bp, Homo sapien
tccattctcagggctcaaatgcctt

SEQ ID NO: 98306 - DNA, 25 bp, Homo sapien
tccattctcagtgctcaaatgcctt

SEQ ID NO: 98307 - DNA, 25 bp, Homo sapien
tccattctgcacttggtggccacaa

SEQ ID NO: 98308 - DNA, 25 bp, Homo sapien
tccattctgcatttggtggccacaa

SEQ ID NO: 98309 - DNA, 25 bp, Homo sapien
tccattctggttctacccatggaca

SEQ ID NO: 98310 - DNA, 25 bp, Homo sapien
tccattcttgcagctgttcaggcag

SEQ ID NO: 98311 - DNA, 25 bp, Homo sapien
tccattcttgcagttgttcaggcag

SEQ ID NO: 98312 - DNA, 25 bp, Homo sapien
tccattgaatccaggaatatatcta

SEQ ID NO: 98313 - DNA, 25 bp, Homo sapien
tccattgacagcagtgattgaaagc

SEQ ID NO: 98314 - DNA, 25 bp, Homo sapien
tccattgacagcggtgattgaaagc

SEQ ID NO: 98315 - DNA, 25 bp, Homo sapien
tccattgaccgatggcccagaacaa

SEQ ID NO: 98316 - DNA, 25 bp, Homo sapien
tccattgactgatggcccagaacaa

SEQ ID NO: 98317 - DNA, 25 bp, Homo sapien
tccattgagatacgtattacatgtt

SEQ ID NO: 98318 - DNA, 25 bp, Homo sapien
tccattgagatatgtattacatgtt

SEQ ID NO: 98319 - DNA, 25 bp, Homo sapien
tccattgattccaggaatatatcta

SEQ ID NO: 98320 - DNA, 25 bp, Homo sapien
tccattgcatttagagaacatccaa

SEQ ID NO: 98321 - DNA, 25 bp, Homo sapien
tccattgcgtttagagaacatccaa

SEQ ID NO: 98322 - DNA, 25 bp, Homo sapien
tccattgtaataaatgcggacagac

SEQ ID NO: 98323 - DNA, 25 bp, Homo sapien
tccattgtaataaatgtggacagac

SEQ ID NO: 98324 - DNA, 25 bp, Homo sapien
tccattgtatgaacgctattgtgcc

SEQ ID NO: 98325 - DNA, 25 bp, Homo sapien
tccattgtatgaatgctattgtgcc

SEQ ID NO: 98326 - DNA, 25 bp, Homo sapien
tccattgtctttactgggctgtgtc

SEQ ID NO: 98327 - DNA, 25 bp, Homo sapien
tccattgtttagcgacttctccaaa

SEQ ID NO: 98328 - DNA, 25 bp, Homo sapien
tccattgtttagtgacttctccaaa

SEQ ID NO: 98329 - DNA, 25 bp, Homo sapien
tccattgtttttactgggctgtgtc

SEQ ID NO: 98330 - DNA, 25 bp, Homo sapien
tccatttacaaagacaaagagcctc

SEQ ID NO: 98331 - DNA, 25 bp, Homo sapien
tccatttaccaagttttagggaata

SEQ ID NO: 98332 - DNA, 25 bp, Homo sapien
tccatttagaaagacaaagagcctc

SEQ ID NO: 98333 - DNA, 25 bp, Homo sapien
tccatttagtctacataatacatcc

SEQ ID NO: 98334 - DNA, 25 bp, Homo sapien
tccatttagtctacgtaatacatcc

SEQ ID NO: 98335 - DNA, 25 bp, Homo sapien
tccatttatcaagttttagggaata

SEQ ID NO: 98336 - DNA, 25 bp, Homo sapien
tccatttctctctgatgtcaaagat

SEQ ID NO: 98337 - DNA, 25 bp, Homo sapien
tccatttctctctggtgtcaaagat

SEQ ID NO: 98338 - DNA, 25 bp, Homo sapien
tccatttctgctgtatatccattgg

SEQ ID NO: 98339 - DNA, 25 bp, Homo sapien
tccatttctgtatatgttcatgttc

SEQ ID NO: 98340 - DNA, 25 bp, Homo sapien
tccatttcttctgtatatccattgg

SEQ ID NO: 98341 - DNA, 25 bp, Homo sapien
tccatttctttatatgttcatgttc

SEQ ID NO: 98342 - DNA, 25 bp, Homo sapien
tccatttcttttatacatcataggt

SEQ ID NO: 98343 - DNA, 25 bp, Homo sapien
tccatttcttttgtacatcataggt

SEQ ID NO: 98344 - DNA, 25 bp, Homo sapien
tccatttgggatgactaaaaagttt

SEQ ID NO: 98345 - DNA, 25 bp, Homo sapien
tccatttgggatgattaaaaagttt

SEQ ID NO: 98346 - DNA, 25 bp, Homo sapien
tccatttgtattattgtctcagacc

SEQ ID NO: 98347 - DNA, 25 bp, Homo sapien
tccatttgtattcttgtctcagacc

SEQ ID NO: 98348 - DNA, 25 bp, Homo sapien
tccattttacaatcagacagttcag

SEQ ID NO: 98349 - DNA, 25 bp, Homo sapien
tccattttataatcagacagttcag

SEQ ID NO: 98350 - DNA, 25 bp, Homo sapien
tccattttgaatcggtgctactttg

SEQ ID NO: 98351 - DNA, 25 bp, Homo sapien
tccattttgaattggtgctactttg

SEQ ID NO: 98352 - DNA, 25 bp, Homo sapien
tcccaaaagaaatgttgcctgttgc

SEQ ID NO: 98353 - DNA, 25 bp, Homo sapien
tcccaaaataaatgttgcctgttgc

SEQ ID NO: 98354 - DNA, 25 bp, Homo sapien
tcccaaacacactttaaaaacacag

SEQ ID NO: 98355 - DNA, 25 bp, Homo sapien
tcccaaacacactttagaaacacag

SEQ ID NO: 98356 - DNA, 25 bp, Homo sapien
tcccaaataggcgttctccctcctt

SEQ ID NO: 98357 - DNA, 25 bp, Homo sapien
tcccaaataggctttctccctcctt

SEQ ID NO: 98358 - DNA, 25 bp, Homo sapien
tcccaaatatagcacattcgcaact

SEQ ID NO: 98359 - DNA, 25 bp, Homo sapien
tcccaaatatagtacattcgcaact

SEQ ID NO: 98360 - DNA, 25 bp, Homo sapien
tcccaaatccaggtcctggctcctg

SEQ ID NO: 98361 - DNA, 25 bp, Homo sapien
tcccaaatccaggttctggctcctg

SEQ ID NO: 98362 - DNA, 25 bp, Homo sapien
tcccaaatctgctataaagcaaagc

SEQ ID NO: 98363 - DNA, 25 bp, Homo sapien
tcccaaatctgctgtaaagcaaagc

SEQ ID NO: 98364 - DNA, 25 bp, Homo sapien
tcccaaattattcgtcattggcaga

SEQ ID NO: 98365 - DNA, 25 bp, Homo sapien
tcccaaattatttgtcattggcaga

SEQ ID NO: 98366 - DNA, 25 bp, Homo sapien
tcccaacaagtctggctacgagtcc

SEQ ID NO: 98367 - DNA, 25 bp, Homo sapien
tcccaacaagtttggctacgagtcc

SEQ ID NO: 98368 - DNA, 25 bp, Homo sapien
tcccaacccaggaaaaaggaaagac

SEQ ID NO: 98369 - DNA, 25 bp, Homo sapien
tcccaacctaggaaaaaggaaagac

SEQ ID NO: 98370 - DNA, 25 bp, Homo sapien
tcccaacttcgttccactacaggca

SEQ ID NO: 98371 - DNA, 25 bp, Homo sapien
tcccaactttgttccactacaggca

SEQ ID NO: 98372 - DNA, 25 bp, Homo sapien
tcccaagaagccaagaaatgttact

SEQ ID NO: 98373 - DNA, 25 bp, Homo sapien
tcccaagaagccgagaaatgttact

SEQ ID NO: 98374 - DNA, 25 bp, Homo sapien
tcccaagccttatcaaagaagaata

SEQ ID NO: 98375 - DNA, 25 bp, Homo sapien
tcccaagccttatcaaggaagaata

SEQ ID NO: 98376 - DNA, 25 bp, Homo sapien
tcccaagttaaggcaaatttcaaaa

SEQ ID NO: 98377 - DNA, 25 bp, Homo sapien
tcccaagttaagtcaaatttcaaaa

SEQ ID NO: 98378 - DNA, 25 bp, Homo sapien
tcccaagttcataggtagtaacaaa

SEQ ID NO: 98379 - DNA, 25 bp, Homo sapien
tcccaagttcatagttagtaacaaa

SEQ ID NO: 98380 - DNA, 25 bp, Homo sapien
tcccaatggaaggcggacagcggcc

SEQ ID NO: 98381 - DNA, 25 bp, Homo sapien
tcccaatggaaggtggacagcggcc

SEQ ID NO: 98382 - DNA, 25 bp, Homo sapien
tcccaattctaccacgtcaatatta

SEQ ID NO: 98383 - DNA, 25 bp, Homo sapien
tcccaattctaccatgtcaatatta

SEQ ID NO: 98384 - DNA, 25 bp, Homo sapien
tcccacaaatctgtctttagcggaa

SEQ ID NO: 98385 - DNA, 25 bp, Homo sapien
tcccacaagtctgtctttagcggaa

SEQ ID NO: 98386 - DNA, 25 bp, Homo sapien
tcccacagaagcgggtagatctgct

SEQ ID NO: 98387 - DNA, 25 bp, Homo sapien
tcccacagaagcgtgtagatctgct

SEQ ID NO: 98388 - DNA, 25 bp, Homo sapien
tcccacgaaacaatgacttctcttc

SEQ ID NO: 98389 - DNA, 25 bp, Homo sapien
tcccacgaaacgatgacttctcttc

SEQ ID NO: 98390 - DNA, 25 bp, Homo sapien
tcccacgatcagcttcaagaacctt

SEQ ID NO: 98391 - DNA, 25 bp, Homo sapien
tcccacgatcagtttcaagaacctt

SEQ ID NO: 98392 - DNA, 25 bp, Homo sapien
tcccagaaatccaacaaagaatgga

SEQ ID NO: 98393 - DNA, 25 bp, Homo sapien
tcccagaaatccaagaaagaatgga

SEQ ID NO: 98394 - DNA, 25 bp, Homo sapien
tcccagaattttcactgacagaaag

SEQ ID NO: 98395 - DNA, 25 bp, Homo sapien
tcccagaattttcattgacagaaag

SEQ ID NO: 98396 - DNA, 25 bp, Homo sapien
tcccagacatctgagcagcagtcct

SEQ ID NO: 98397 - DNA, 25 bp, Homo sapien
tcccagacatctgggcagcagtcct

SEQ ID NO: 98398 - DNA, 25 bp, Homo sapien
tcccagactgccatgtcaaagtttc

SEQ ID NO: 98399 - DNA, 25 bp, Homo sapien
tcccagactgctatgtcaaagtttc

SEQ ID NO: 98400 - DNA, 25 bp, Homo sapien
tcccagatacgtacccaagagaaat

SEQ ID NO: 98401 - DNA, 25 bp, Homo sapien
tcccagatatgtacccaagagaaat

SEQ ID NO: 98402 - DNA, 25 bp, Homo sapien
tcccagcacattacaggctccatgg

SEQ ID NO: 98403 - DNA, 25 bp, Homo sapien
tcccagcacattacgggctccatgg

SEQ ID NO: 98404 - DNA, 25 bp, Homo sapien
tcccagctccaatgttttcactcta

SEQ ID NO: 98405 - DNA, 25 bp, Homo sapien
tcccagctccagtgttttcactcta

SEQ ID NO: 98406 - DNA, 25 bp, Homo sapien
tcccagcttaacattttaacccagc

SEQ ID NO: 98407 - DNA, 25 bp, Homo sapien
tcccagcttaatattttaacccagc

SEQ ID NO: 98408 - DNA, 25 bp, Homo sapien
tcccaggaaggagatatgtgagagt

SEQ ID NO: 98409 - DNA, 25 bp, Homo sapien
tcccaggaaggaggtatgtgagagt

SEQ ID NO: 98410 - DNA, 25 bp, Homo sapien
tcccaggaagttgaaagtaatgatt

SEQ ID NO: 98411 - DNA, 25 bp, Homo sapien
tcccaggaatttgaaagtaatgatt

SEQ ID NO: 98412 - DNA, 25 bp, Homo sapien
tcccaggacagctgccagtagtgcc

SEQ ID NO: 98413 - DNA, 25 bp, Homo sapien
tcccaggacagctgccggtagtgcc

SEQ ID NO: 98414 - DNA, 25 bp, Homo sapien
tcccaggagccactgcaaatgatga

SEQ ID NO: 98415 - DNA, 25 bp, Homo sapien
tcccaggagccattgcaaatgatga

SEQ ID NO: 98416 - DNA, 25 bp, Homo sapien
tcccaggattcatttccatcttttc

SEQ ID NO: 98417 - DNA, 25 bp, Homo sapien
tcccaggattcgtttccatcttttc

SEQ ID NO: 98418 - DNA, 25 bp, Homo sapien
tcccaggccattctaacgtatggtc

SEQ ID NO: 98419 - DNA, 25 bp, Homo sapien
tcccaggcgattctaacgtatggtc

SEQ ID NO: 98420 - DNA, 25 bp, Homo sapien
tcccaggtgaacgaaccctagctct

SEQ ID NO: 98421 - DNA, 25 bp, Homo sapien
tcccaggtgaactaaccctagctct

SEQ ID NO: 98422 - DNA, 25 bp, Homo sapien
tcccaggtgattttaaggcaggagg

SEQ ID NO: 98423 - DNA, 25 bp, Homo sapien
tcccaggtgattttaatgcaggagg

SEQ ID NO: 98424 - DNA, 25 bp, Homo sapien
tcccaggtgttgaccctctaccatt

SEQ ID NO: 98425 - DNA, 25 bp, Homo sapien
tcccaggtgtttaccctctaccatt

SEQ ID NO: 98426 - DNA, 25 bp, Homo sapien
tcccagtcagctgtcacttcggaaa

SEQ ID NO: 98427 - DNA, 25 bp, Homo sapien
tcccagtcagctgtcatttcggaaa

SEQ ID NO: 98428 - DNA, 25 bp, Homo sapien
tcccagtgatcacactatttcacct

SEQ ID NO: 98429 - DNA, 25 bp, Homo sapien
tcccagtgatcatactatttcacct

SEQ ID NO: 98430 - DNA, 25 bp, Homo sapien
tcccagttaggagaactatttaata

SEQ ID NO: 98431 - DNA, 25 bp, Homo sapien
tcccagttatgagaactatttaata

SEQ ID NO: 98432 - DNA, 25 bp, Homo sapien
tcccagtttataagcagcccttttt

SEQ ID NO: 98433 - DNA, 25 bp, Homo sapien
tcccagtttctaagcagcccttttt

SEQ ID NO: 98434 - DNA, 25 bp, Homo sapien
tcccataggattttcatacatccct

SEQ ID NO: 98435 - DNA, 25 bp, Homo sapien
tcccataggatttttatacatccct

SEQ ID NO: 98436 - DNA, 25 bp, Homo sapien
tcccatatccagcgccattcccaca

SEQ ID NO: 98437 - DNA, 25 bp, Homo sapien
tcccatatccagcggcattcccaca

SEQ ID NO: 98438 - DNA, 25 bp, Homo sapien
tcccatcaaaacataaaggtcagtt

SEQ ID NO: 98439 - DNA, 25 bp, Homo sapien
tcccatcaaaagataaaggtcagtt

SEQ ID NO: 98440 - DNA, 25 bp, Homo sapien
tcccatcaacacttcatgaaagacc

SEQ ID NO: 98441 - DNA, 25 bp, Homo sapien
tcccatcaccacttcatgaaagacc

SEQ ID NO: 98442 - DNA, 25 bp, Homo sapien
tcccatcgattccaacttttcccct

SEQ ID NO: 98443 - DNA, 25 bp, Homo sapien
tcccatcgattgcaacttttcccct

SEQ ID NO: 98444 - DNA, 25 bp, Homo sapien
tcccatctctaagttccaaataagt

SEQ ID NO: 98445 - DNA, 25 bp, Homo sapien
tcccatctctaagttctaaataagt

SEQ ID NO: 98446 - DNA, 25 bp, Homo sapien
tcccatctgcgcactttgagcttct

SEQ ID NO: 98447 - DNA, 25 bp, Homo sapien
tcccatctgctgaacacacatttta

SEQ ID NO: 98448 - DNA, 25 bp, Homo sapien
tcccatctgctgaacatacatttta

SEQ ID NO: 98449 - DNA, 25 bp, Homo sapien
tcccatctgggcactttgagcttct

SEQ ID NO: 98450 - DNA, 25 bp, Homo sapien
tcccatgacacacctattgatatgt

SEQ ID NO: 98451 - DNA, 25 bp, Homo sapien
tcccatgacacagctattgatatgt

SEQ ID NO: 98452 - DNA, 25 bp, Homo sapien
tcccatgacccaaatttaccatcct

SEQ ID NO: 98453 - DNA, 25 bp, Homo sapien
tcccatgacccagatttaccatcct

SEQ ID NO: 98454 - DNA, 25 bp, Homo sapien
tcccatgacgagttacagaaggtag

SEQ ID NO: 98455 - DNA, 25 bp, Homo sapien
tcccatgacgagttacggaaggtag

SEQ ID NO: 98456 - DNA, 25 bp, Homo sapien
tcccatgatatacactgaaattagg

SEQ ID NO: 98457 - DNA, 25 bp, Homo sapien
tcccatgatatacattgaaattagg

SEQ ID NO: 98458 - DNA, 25 bp, Homo sapien
tcccatgtgatttgagtgtgcatgc

SEQ ID NO: 98459 - DNA, 25 bp, Homo sapien
tcccatgttataattccctgtcttt

SEQ ID NO: 98460 - DNA, 25 bp, Homo sapien
tcccatgttatacttccctgtcttt

SEQ ID NO: 98461 - DNA, 25 bp, Homo sapien
tcccatgttatttgagtgtgcatgc

SEQ ID NO: 98462 - DNA, 25 bp, Homo sapien
tcccattaactgtggatgttgtcat

SEQ ID NO: 98463 - DNA, 25 bp, Homo sapien
tcccattaactgttgatgttgtcat

SEQ ID NO: 98464 - DNA, 25 bp, Homo sapien
tcccattagatcctgacctgcctcg

SEQ ID NO: 98465 - DNA, 25 bp, Homo sapien
tcccattagatcttgacctgcctcg

SEQ ID NO: 98466 - DNA, 25 bp, Homo sapien
tcccattatccacgtttatcctccc

SEQ ID NO: 98467 - DNA, 25 bp, Homo sapien
tcccattatccatgtttatcctccc

SEQ ID NO: 98468 - DNA, 25 bp, Homo sapien
tcccattcataagggcagagtctcc

SEQ ID NO: 98469 - DNA, 25 bp, Homo sapien
tcccattcatgatttcaacaatact

SEQ ID NO: 98470 - DNA, 25 bp, Homo sapien
tcccattcatgatttccacaatact

SEQ ID NO: 98471 - DNA, 25 bp, Homo sapien
tcccattctccacatggtagtggct

SEQ ID NO: 98472 - DNA, 25 bp, Homo sapien
tcccattctccacgtggtagtggct

SEQ ID NO: 98473 - DNA, 25 bp, Homo sapien
tcccattcttaagggcagagtctcc

SEQ ID NO: 98474 - DNA, 25 bp, Homo sapien
tcccattcttcctctagtgcgcagc

SEQ ID NO: 98475 - DNA, 25 bp, Homo sapien
tcccattcttcctgtagtgcgcagc

SEQ ID NO: 98476 - DNA, 25 bp, Homo sapien
tcccatttacttgtggccgatgagt

SEQ ID NO: 98477 - DNA, 25 bp, Homo sapien
tcccatttacttgtggtcgatgagt

SEQ ID NO: 98478 - DNA, 25 bp, Homo sapien
tcccatttctctatccatgtacctt

SEQ ID NO: 98479 - DNA, 25 bp, Homo sapien
tcccatttctctatccgtgtacctt

SEQ ID NO: 98480 - DNA, 25 bp, Homo sapien
tccccaaaattaacgcttagcttca

SEQ ID NO: 98481 - DNA, 25 bp, Homo sapien
tccccaaaattaatgcttagcttca

SEQ ID NO: 98482 - DNA, 25 bp, Homo sapien
tccccaacagatgcgtccatcccag

SEQ ID NO: 98483 - DNA, 25 bp, Homo sapien
tccccaacagatgcttccatcccag

SEQ ID NO: 98484 - DNA, 25 bp, Homo sapien
tccccacagggctaggatgattaag

SEQ ID NO: 98485 - DNA, 25 bp, Homo sapien
tccccacagggttaggatgattaag

SEQ ID NO: 98486 - DNA, 25 bp, Homo sapien
tccccacattgtacgacaatcaatc

SEQ ID NO: 98487 - DNA, 25 bp, Homo sapien
tccccacattgtatgacaatcaatc

SEQ ID NO: 98488 - DNA, 25 bp, Homo sapien
tccccagagatgatcattgctaaca

SEQ ID NO: 98489 - DNA, 25 bp, Homo sapien
tccccagagatgattattgctaaca

SEQ ID NO: 98490 - DNA, 25 bp, Homo sapien
tccccagctttatcaacgggtccaa

SEQ ID NO: 98491 - DNA, 25 bp, Homo sapien
tccccagctttatcaatgggtccaa

SEQ ID NO: 98492 - DNA, 25 bp, Homo sapien
tccccaggagacgacatctgagcat

SEQ ID NO: 98493 - DNA, 25 bp, Homo sapien
tccccaggagacgatatctgagcat

SEQ ID NO: 98494 - DNA, 25 bp, Homo sapien
tccccaggcctctttacttttggtt

SEQ ID NO: 98495 - DNA, 25 bp, Homo sapien
tccccaggcctctttagttttggtt

SEQ ID NO: 98496 - DNA, 25 bp, Homo sapien
tccccaggcttgttatgcccacttt

SEQ ID NO: 98497 - DNA, 25 bp, Homo sapien
tccccaggcttgttgtgcccacttt

SEQ ID NO: 98498 - DNA, 25 bp, Homo sapien
tccccagggtctacacttttagaaa

SEQ ID NO: 98499 - DNA, 25 bp, Homo sapien
tccccagggtctacgcttttagaaa

SEQ ID NO: 98500 - DNA, 25 bp, Homo sapien
tccccaggtctgatttaactcacct

SEQ ID NO: 98501 - DNA, 25 bp, Homo sapien
tccccaggtctgatttgactcacct

SEQ ID NO: 98502 - DNA, 25 bp, Homo sapien
tccccattacttgttgcgattacca

SEQ ID NO: 98503 - DNA, 25 bp, Homo sapien
tccccattactttttgcgattacca

SEQ ID NO: 98504 - DNA, 25 bp, Homo sapien
tcccccaacagtaagagcagtgttg

SEQ ID NO: 98505 - DNA, 25 bp, Homo sapien
tcccccaacagtgagagcagtgttg

SEQ ID NO: 98506 - DNA, 25 bp, Homo sapien
tcccccagaattcgtacgggcttag

SEQ ID NO: 98507 - DNA, 25 bp, Homo sapien
tcccccagaattcgtatgggcttag

SEQ ID NO: 98508 - DNA, 25 bp, Homo sapien
tccccctccacacgctgagaaaggg

SEQ ID NO: 98509 - DNA, 25 bp, Homo sapien
tccccctccacaggctgagaaaggg

SEQ ID NO: 98510 - DNA, 25 bp, Homo sapien
tccccctccaccgcaaatgtgtatg

SEQ ID NO: 98511 - DNA, 25 bp, Homo sapien
tccccctccactgcaaatgtgtatg

SEQ ID NO: 98512 - DNA, 25 bp, Homo sapien
tcccctaaaaggaccagcatgttca

SEQ ID NO: 98513 - DNA, 25 bp, Homo sapien
tcccctaaaaggatcagcatgttca

SEQ ID NO: 98514 - DNA, 25 bp, Homo sapien
tcccctagcacaaaaaagaaagcca

SEQ ID NO: 98515 - DNA, 25 bp, Homo sapien
tcccctagcacaagaaagaaagcca

SEQ ID NO: 98516 - DNA, 25 bp, Homo sapien
tcccctagtcaaagagcctgtggac

SEQ ID NO: 98517 - DNA, 25 bp, Homo sapien
tcccctagtcaaatagcctgtggac

SEQ ID NO: 98518 - DNA, 25 bp, Homo sapien
tcccctattacttacgcatcacaca

SEQ ID NO: 98519 - DNA, 25 bp, Homo sapien
tcccctattacttatgcatcacaca

SEQ ID NO: 98520 - DNA, 25 bp, Homo sapien
tcccctcacgggtgcaagctgaaat

SEQ ID NO: 98521 - DNA, 25 bp, Homo sapien
tcccctcatgcttcaacacccttct

SEQ ID NO: 98522 - DNA, 25 bp, Homo sapien
tcccctcatgcttcgacacccttct

SEQ ID NO: 98523 - DNA, 25 bp, Homo sapien
tcccctcatgggtgcaagctgaaat

SEQ ID NO: 98524 - DNA, 25 bp, Homo sapien
tcccctcctttggctactttcaaga

SEQ ID NO: 98525 - DNA, 25 bp, Homo sapien
tcccctcctttggctattttcaaga

SEQ ID NO: 98526 - DNA, 25 bp, Homo sapien
tcccctcttcctaacaaagcatcca

SEQ ID NO: 98527 - DNA, 25 bp, Homo sapien
tcccctcttcctatcaaagcatcca

SEQ ID NO: 98528 - DNA, 25 bp, Homo sapien
tcccctgaaattcgtatgttgaaac

SEQ ID NO: 98529 - DNA, 25 bp, Homo sapien
tcccctgaaatttgtatgttgaaac

SEQ ID NO: 98530 - DNA, 25 bp, Homo sapien
tcccctgattaacgagaacactcta

SEQ ID NO: 98531 - DNA, 25 bp, Homo sapien
tcccctgattaaggagaacactcta

SEQ ID NO: 98532 - DNA, 25 bp, Homo sapien
tcccctggcacacggtttgagatgg

SEQ ID NO: 98533 - DNA, 25 bp, Homo sapien
tcccctggcacagggtttgagatgg

SEQ ID NO: 98534 - DNA, 25 bp, Homo sapien
tcccctggcctcagcaactccattc

SEQ ID NO: 98535 - DNA, 25 bp, Homo sapien
tcccctggcctcagcagctccattc

SEQ ID NO: 98536 - DNA, 25 bp, Homo sapien
tcccctggtcccagaattaaggctg

SEQ ID NO: 98537 - DNA, 25 bp, Homo sapien
tcccctggtcccggaattaaggctg

SEQ ID NO: 98538 - DNA, 25 bp, Homo sapien
tccccttgccagcgaaaacttgggg

SEQ ID NO: 98539 - DNA, 25 bp, Homo sapien
tccccttgccagtgaaaacttgggg

SEQ ID NO: 98540 - DNA, 25 bp, Homo sapien
tcccgaaatggcgactcatgccctc

SEQ ID NO: 98541 - DNA, 25 bp, Homo sapien
tcccgaaatggtgactcatgccctc

SEQ ID NO: 98542 - DNA, 25 bp, Homo sapien
tcccgaaggacaccacattgaaccc

SEQ ID NO: 98543 - DNA, 25 bp, Homo sapien
tcccgaaggacaccacgttgaaccc

SEQ ID NO: 98544 - DNA, 25 bp, Homo sapien
tcccgactctactcttttcctcttc

SEQ ID NO: 98545 - DNA, 25 bp, Homo sapien
tcccgactgtactcttttcctcttc

SEQ ID NO: 98546 - DNA, 25 bp, Homo sapien
tcccgatgactaacttcaacagcta

SEQ ID NO: 98547 - DNA, 25 bp, Homo sapien
tcccgatgactaatttcaacagcta

SEQ ID NO: 98548 - DNA, 25 bp, Homo sapien
tcccgcaacattcacatctgcatcc

SEQ ID NO: 98549 - DNA, 25 bp, Homo sapien
tcccgcaacatttacatctgcatcc

SEQ ID NO: 98550 - DNA, 25 bp, Homo sapien
tcccgcagggggaatttccgcagtg

SEQ ID NO: 98551 - DNA, 25 bp, Homo sapien
tcccgcagggggagtttccgcagtg

SEQ ID NO: 98552 - DNA, 25 bp, Homo sapien
tcccgctaccttctattttggtcta

SEQ ID NO: 98553 - DNA, 25 bp, Homo sapien
tcccgctaccttctgttttggtcta

SEQ ID NO: 98554 - DNA, 25 bp, Homo sapien
tcccggcaaggatcttaaacagatt

SEQ ID NO: 98555 - DNA, 25 bp, Homo sapien
tcccggcaaggttcttaaacagatt

SEQ ID NO: 98556 - DNA, 25 bp, Homo sapien
tcccgtgaaaaagtagaatttatac

SEQ ID NO: 98557 - DNA, 25 bp, Homo sapien
tcccgtgaaaaattagaatttatac

SEQ ID NO: 98558 - DNA, 25 bp, Homo sapien
tcccgttgacataagctggaaatgt

SEQ ID NO: 98559 - DNA, 25 bp, Homo sapien
tcccgttgatataagctggaaatgt

SEQ ID NO: 98560 - DNA, 25 bp, Homo sapien
tcccgttggagaagctacaaagaaa

SEQ ID NO: 98561 - DNA, 25 bp, Homo sapien
tcccgttggagaggctacaaagaaa

SEQ ID NO: 98562 - DNA, 25 bp, Homo sapien
tccctaaaattctcccaagttaaat

SEQ ID NO: 98563 - DNA, 25 bp, Homo sapien
tccctaaaattttcccaagttaaat

SEQ ID NO: 98564 - DNA, 25 bp, Homo sapien
tccctaacaaaaattgcctggcata

SEQ ID NO: 98565 - DNA, 25 bp, Homo sapien
tccctaacacaaattgcctggcata

SEQ ID NO: 98566 - DNA, 25 bp, Homo sapien
tccctaacattaagcatttttgcta

SEQ ID NO: 98567 - DNA, 25 bp, Homo sapien
tccctaacgttaagcatttttgcta

SEQ ID NO: 98568 - DNA, 25 bp, Homo sapien
tccctaatgcacccatgcttctaaa

SEQ ID NO: 98569 - DNA, 25 bp, Homo sapien
tccctaatgcacgcatgcttctaaa

SEQ ID NO: 98570 - DNA, 25 bp, Homo sapien
tccctacctgaacctacgaacacca

SEQ ID NO: 98571 - DNA, 25 bp, Homo sapien
tccctacctgaccctacgaacacca

SEQ ID NO: 98572 - DNA, 25 bp, Homo sapien
tccctacgatgggactctctcaact

SEQ ID NO: 98573 - DNA, 25 bp, Homo sapien
tccctacgatgggattctctcaact

SEQ ID NO: 98574 - DNA, 25 bp, Homo sapien
tccctacgcagcgatgttggctccc

SEQ ID NO: 98575 - DNA, 25 bp, Homo sapien
tccctacgcagctatgttggctccc

SEQ ID NO: 98576 - DNA, 25 bp, Homo sapien
tccctagcaaaaggagcctcgccct

SEQ ID NO: 98577 - DNA, 25 bp, Homo sapien
tccctagcagaaggagcctcgccct

SEQ ID NO: 98578 - DNA, 25 bp, Homo sapien
tccctaggaagtgtaaaagccagtt

SEQ ID NO: 98579 - DNA, 25 bp, Homo sapien
tccctaggatgtgtaaaagccagtt

SEQ ID NO: 98580 - DNA, 25 bp, Homo sapien
tccctaggtgcgctttctcgactgt

SEQ ID NO: 98581 - DNA, 25 bp, Homo sapien
tccctaggtgctctttctcgactgt

SEQ ID NO: 98582 - DNA, 25 bp, Homo sapien
tccctatacaccaaggtttgctatt

SEQ ID NO: 98583 - DNA, 25 bp, Homo sapien
tccctatataccaaggtttgctatt

SEQ ID NO: 98584 - DNA, 25 bp, Homo sapien
tccctatccttgaaaaatgatagca

SEQ ID NO: 98585 - DNA, 25 bp, Homo sapien
tccctatccttgaacaatgatagca

SEQ ID NO: 98586 - DNA, 25 bp, Homo sapien
tccctatgattaatccatcttctat

SEQ ID NO: 98587 - DNA, 25 bp, Homo sapien
tccctatgattaatccgtcttctat

SEQ ID NO: 98588 - DNA, 25 bp, Homo sapien
tccctatggcctatggacttactgg

SEQ ID NO: 98589 - DNA, 25 bp, Homo sapien
tccctatggcctgtggacttactgg

SEQ ID NO: 98590 - DNA, 25 bp, Homo sapien
tccctattccagggtgacagactcc

SEQ ID NO: 98591 - DNA, 25 bp, Homo sapien
tccctattccagggtggcagactcc

SEQ ID NO: 98592 - DNA, 25 bp, Homo sapien
tccctattttgccaagcttagattc

SEQ ID NO: 98593 - DNA, 25 bp, Homo sapien
tccctattttgctaagcttagattc

SEQ ID NO: 98594 - DNA, 25 bp, Homo sapien
tccctcaaaacattctatcttgtaa

SEQ ID NO: 98595 - DNA, 25 bp, Homo sapien
tccctcaaaacattctgtcttgtaa

SEQ ID NO: 98596 - DNA, 25 bp, Homo sapien
tccctcactttcccagagcatctat

SEQ ID NO: 98597 - DNA, 25 bp, Homo sapien
tccctcacttttccagagcatctat

SEQ ID NO: 98598 - DNA, 25 bp, Homo sapien
tccctcagctccaaccagaatactg

SEQ ID NO: 98599 - DNA, 25 bp, Homo sapien
tccctcagctccacccagaatactg

SEQ ID NO: 98600 - DNA, 25 bp, Homo sapien
tccctcaggcatgtgacttttctat

SEQ ID NO: 98601 - DNA, 25 bp, Homo sapien
tccctcagggatgtgacttttctat

SEQ ID NO: 98602 - DNA, 25 bp, Homo sapien
tccctccagtcggtaaaatgtctta

SEQ ID NO: 98603 - DNA, 25 bp, Homo sapien
tccctccagtctgtaaaatgtctta

SEQ ID NO: 98604 - DNA, 25 bp, Homo sapien
tccctctagtgtattttgtatagca

SEQ ID NO: 98605 - DNA, 25 bp, Homo sapien
tccctctagtgtgttttgtatagca

SEQ ID NO: 98606 - DNA, 25 bp, Homo sapien
tccctctctaatgcatcaaatccat

SEQ ID NO: 98607 - DNA, 25 bp, Homo sapien
tccctctctaatgtatcaaatccat

SEQ ID NO: 98608 - DNA, 25 bp, Homo sapien
tccctctcttatgatgaggaaagtt

SEQ ID NO: 98609 - DNA, 25 bp, Homo sapien
tccctctcttatgatggggaaagtt

SEQ ID NO: 98610 - DNA, 25 bp, Homo sapien
tccctctgagttctatctaccttct

SEQ ID NO: 98611 - DNA, 25 bp, Homo sapien
tccctctgagttctgtctaccttct

SEQ ID NO: 98612 - DNA, 25 bp, Homo sapien
tccctctgcgttgacacgaacatca

SEQ ID NO: 98613 - DNA, 25 bp, Homo sapien
tccctctgcgttgacatgaacatca

SEQ ID NO: 98614 - DNA, 25 bp, Homo sapien
tccctcttaaattgcgaagttgtca

SEQ ID NO: 98615 - DNA, 25 bp, Homo sapien
tccctcttaaattgtgaagttgtca

SEQ ID NO: 98616 - DNA, 25 bp, Homo sapien
tccctcttttgagttgctggaacat

SEQ ID NO: 98617 - DNA, 25 bp, Homo sapien
tccctcttttgagttgttggaacat

SEQ ID NO: 98618 - DNA, 25 bp, Homo sapien
tccctgaagaaacataagtagcagg

SEQ ID NO: 98619 - DNA, 25 bp, Homo sapien
tccctgaagaaacgtaagtagcagg

SEQ ID NO: 98620 - DNA, 25 bp, Homo sapien
tccctgacaaaaacttagccaatgt

SEQ ID NO: 98621 - DNA, 25 bp, Homo sapien
tccctgacaaaaccttagccaatgt

SEQ ID NO: 98622 - DNA, 25 bp, Homo sapien
tccctgacatcactccctcctggtt

SEQ ID NO: 98623 - DNA, 25 bp, Homo sapien
tccctgacatcactccttcctggtt

SEQ ID NO: 98624 - DNA, 25 bp, Homo sapien
tccctgaggccacataaagttagat

SEQ ID NO: 98625 - DNA, 25 bp, Homo sapien
tccctgaggccacgtaaagttagat

SEQ ID NO: 98626 - DNA, 25 bp, Homo sapien
tccctgattatttacaagtttctcc

SEQ ID NO: 98627 - DNA, 25 bp, Homo sapien
tccctgattctttacaagtttctcc

SEQ ID NO: 98628 - DNA, 25 bp, Homo sapien
tccctgcacaatccaggtccttggt

SEQ ID NO: 98629 - DNA, 25 bp, Homo sapien
tccctgcacgatccaggtccttggt

SEQ ID NO: 98630 - DNA, 25 bp, Homo sapien
tccctgcatctgtactatatcttta

SEQ ID NO: 98631 - DNA, 25 bp, Homo sapien
tccctgcatctgtactgtatcttta

SEQ ID NO: 98632 - DNA, 25 bp, Homo sapien
tccctgccaactgcgaaccgccagc

SEQ ID NO: 98633 - DNA, 25 bp, Homo sapien
tccctgccaactgcgagccgccagc

SEQ ID NO: 98634 - DNA, 25 bp, Homo sapien
tccctggagggtcgtgaatagcagt

SEQ ID NO: 98635 - DNA, 25 bp, Homo sapien
tccctggagggttgtgaatagcagt

SEQ ID NO: 98636 - DNA, 25 bp, Homo sapien
tccctggctccaattattcccattc

SEQ ID NO: 98637 - DNA, 25 bp, Homo sapien
tccctggctccgattattcccattc

SEQ ID NO: 98638 - DNA, 25 bp, Homo sapien
tccctgggataaatcgcacttggtc

SEQ ID NO: 98639 - DNA, 25 bp, Homo sapien
tccctgggataaattgcacttggtc

SEQ ID NO: 98640 - DNA, 25 bp, Homo sapien
tccctgggattagtctccaggcatg

SEQ ID NO: 98641 - DNA, 25 bp, Homo sapien
tccctgggattcgtctccaggcatg

SEQ ID NO: 98642 - DNA, 25 bp, Homo sapien
tccctgggctaccatttttctgttt

SEQ ID NO: 98643 - DNA, 25 bp, Homo sapien
tccctgggctatcatttttctgttt

SEQ ID NO: 98644 - DNA, 25 bp, Homo sapien
tccctgtaatcacagaaaaacgcac

SEQ ID NO: 98645 - DNA, 25 bp, Homo sapien
tccctgtaatcatagaaaaacgcac

SEQ ID NO: 98646 - DNA, 25 bp, Homo sapien
tccctgtatttcttggtttcagtat

SEQ ID NO: 98647 - DNA, 25 bp, Homo sapien
tccctgtatttgttggtttcagtat

SEQ ID NO: 98648 - DNA, 25 bp, Homo sapien
tccctgtgtttataggccttcagtg

SEQ ID NO: 98649 - DNA, 25 bp, Homo sapien
tccctgtgtttatagggcttcagtg

SEQ ID NO: 98650 - DNA, 25 bp, Homo sapien
tccctgttgattcactaaacaaatg

SEQ ID NO: 98651 - DNA, 25 bp, Homo sapien
tccctgttgattcactgaacaaatg

SEQ ID NO: 98652 - DNA, 25 bp, Homo sapien
tcccttaactcccagcataatctct

SEQ ID NO: 98653 - DNA, 25 bp, Homo sapien
tcccttaactcctagcataatctct

SEQ ID NO: 98654 - DNA, 25 bp, Homo sapien
tcccttagaacagactagaaaatgt

SEQ ID NO: 98655 - DNA, 25 bp, Homo sapien
tcccttagaacggactagaaaatgt

SEQ ID NO: 98656 - DNA, 25 bp, Homo sapien
tcccttatcataaatgctagaagac

SEQ ID NO: 98657 - DNA, 25 bp, Homo sapien
tcccttatcatacatgctagaagac

SEQ ID NO: 98658 - DNA, 25 bp, Homo sapien
tcccttatcttgtcctgactaatgg

SEQ ID NO: 98659 - DNA, 25 bp, Homo sapien
tcccttatcttgtcttgactaatgg

SEQ ID NO: 98660 - DNA, 25 bp, Homo sapien
tcccttctaagcaccctggtgatta

SEQ ID NO: 98661 - DNA, 25 bp, Homo sapien
tcccttctaaggaccctggtgatta

SEQ ID NO: 98662 - DNA, 25 bp, Homo sapien
tcccttctcccaaggactgagctct

SEQ ID NO: 98663 - DNA, 25 bp, Homo sapien
tcccttctcccgaggactgagctct

SEQ ID NO: 98664 - DNA, 25 bp, Homo sapien
tcccttctgccatacatgtgaagtg

SEQ ID NO: 98665 - DNA, 25 bp, Homo sapien
tcccttctgtcatacatgtgaagtg

SEQ ID NO: 98666 - DNA, 25 bp, Homo sapien
tcccttcttccgttatcaaaactag

SEQ ID NO: 98667 - DNA, 25 bp, Homo sapien
tcccttcttccgttgtcaaaactag

SEQ ID NO: 98668 - DNA, 25 bp, Homo sapien
tcccttgcagtgcaacatggagcta

SEQ ID NO: 98669 - DNA, 25 bp, Homo sapien
tcccttgcagtgcagcatggagcta

SEQ ID NO: 98670 - DNA, 25 bp, Homo sapien
tcccttgctcaagataatctacttt

SEQ ID NO: 98671 - DNA, 25 bp, Homo sapien
tcccttgctcaaggtaatctacttt

SEQ ID NO: 98672 - DNA, 25 bp, Homo sapien
tcccttggaagacagtggtagaaat

SEQ ID NO: 98673 - DNA, 25 bp, Homo sapien
tcccttggaagagagtggtagaaat

SEQ ID NO: 98674 - DNA, 25 bp, Homo sapien
tcccttggtgacaacatcactattt

SEQ ID NO: 98675 - DNA, 25 bp, Homo sapien
tcccttggtgacagcatcactattt

SEQ ID NO: 98676 - DNA, 25 bp, Homo sapien
tccctttaaaacagagaccttgttt

SEQ ID NO: 98677 - DNA, 25 bp, Homo sapien
tccctttaaaacagaggccttgttt

SEQ ID NO: 98678 - DNA, 25 bp, Homo sapien
tccctttatccagcttcctcttcct

SEQ ID NO: 98679 - DNA, 25 bp, Homo sapien
tccctttatcctgcttcctcttcct

SEQ ID NO: 98680 - DNA, 25 bp, Homo sapien
tccctttcactgcttctgaattaca

SEQ ID NO: 98681 - DNA, 25 bp, Homo sapien
tccctttccaccttcactgacttgc

SEQ ID NO: 98682 - DNA, 25 bp, Homo sapien
tccctttccactttcactgacttgc

SEQ ID NO: 98683 - DNA, 25 bp, Homo sapien
tccctttcgctgcttctgaattaca

SEQ ID NO: 98684 - DNA, 25 bp, Homo sapien
tcccttttgtagcgcaaatcagtag

SEQ ID NO: 98685 - DNA, 25 bp, Homo sapien
tcccttttgtagtgcaaatcagtag

SEQ ID NO: 98686 - DNA, 25 bp, Homo sapien
tccctttttctcattgactggtgtg

SEQ ID NO: 98687 - DNA, 25 bp, Homo sapien
tccctttttctcgttgactggtgtg

SEQ ID NO: 98688 - DNA, 25 bp, Homo sapien
tccctttttgacctctcatttcctc

SEQ ID NO: 98689 - DNA, 25 bp, Homo sapien
tccctttttgacctgtcatttcctc

SEQ ID NO: 98690 - DNA, 25 bp, Homo sapien
tccgaataaagctgaataagctccc

SEQ ID NO: 98691 - DNA, 25 bp, Homo sapien
tccgaatagagctgaataagctccc

SEQ ID NO: 98692 - DNA, 25 bp, Homo sapien
tccgacctctgcagacatgtggaga

SEQ ID NO: 98693 - DNA, 25 bp, Homo sapien
tccgacctctgcagacgtgtggaga

SEQ ID NO: 98694 - DNA, 25 bp, Homo sapien
tccgacctgcaccgtgctctcttcc

SEQ ID NO: 98695 - DNA, 25 bp, Homo sapien
tccgacctgcactgtgctctcttcc

SEQ ID NO: 98696 - DNA, 25 bp, Homo sapien
tccgactgcagtgcggacaatgtat

SEQ ID NO: 98697 - DNA, 25 bp, Homo sapien
tccgactgcggtgcggacaatgtat

SEQ ID NO: 98698 - DNA, 25 bp, Homo sapien
tccgagtattacattgccactattt

SEQ ID NO: 98699 - DNA, 25 bp, Homo sapien
tccgagtattatattgccactattt

SEQ ID NO: 98700 - DNA, 25 bp, Homo sapien
tccgagtcttgaaggaagagtgaga

SEQ ID NO: 98701 - DNA, 25 bp, Homo sapien
tccgagtcttgagggaagagtgaga

SEQ ID NO: 98702 - DNA, 25 bp, Homo sapien
tccgatcacttacctgtttgttctg

SEQ ID NO: 98703 - DNA, 25 bp, Homo sapien
tccgatcacttatctgtttgttctg

SEQ ID NO: 98704 - DNA, 25 bp, Homo sapien
tccgccatcctgagttcctgtgtga

SEQ ID NO: 98705 - DNA, 25 bp, Homo sapien
tccgccatcttgagttcctgtgtga

SEQ ID NO: 98706 - DNA, 25 bp, Homo sapien
tccgcctccgacctgtagctggcct

SEQ ID NO: 98707 - DNA, 25 bp, Homo sapien
tccgcctccgacctgtggctggcct

SEQ ID NO: 98708 - DNA, 25 bp, Homo sapien
tccgcctctagcactcttttgcctg

SEQ ID NO: 98709 - DNA, 25 bp, Homo sapien
tccgcctctagcgctcttttgcctg

SEQ ID NO: 98710 - DNA, 25 bp, Homo sapien
tccgctatccaattcagcccctctc

SEQ ID NO: 98711 - DNA, 25 bp, Homo sapien
tccgctatccatttcagcccctctc

SEQ ID NO: 98712 - DNA, 25 bp, Homo sapien
tccgctctgtcaacttctctctttc

SEQ ID NO: 98713 - DNA, 25 bp, Homo sapien
tccgctctgtcagcttctctctttc

SEQ ID NO: 98714 - DNA, 25 bp, Homo sapien
tccggaggtagacaggccactagga

SEQ ID NO: 98715 - DNA, 25 bp, Homo sapien
tccggaggtagacgggccactagga

SEQ ID NO: 98716 - DNA, 25 bp, Homo sapien
tccggatatcagcaccaactaaact

SEQ ID NO: 98717 - DNA, 25 bp, Homo sapien
tccggatatcagctccaactaaact

SEQ ID NO: 98718 - DNA, 25 bp, Homo sapien
tccggcataggactgtgacaattaa

SEQ ID NO: 98719 - DNA, 25 bp, Homo sapien
tccggcataggattgtgacaattaa

SEQ ID NO: 98720 - DNA, 25 bp, Homo sapien
tccggcatcctattttcctggacag

SEQ ID NO: 98721 - DNA, 25 bp, Homo sapien
tccggcatcctgttttcctggacag

SEQ ID NO: 98722 - DNA, 25 bp, Homo sapien
tccggccgacgtttctggggtagga

SEQ ID NO: 98723 - DNA, 25 bp, Homo sapien
tccggccgatgtttctggggtagga

SEQ ID NO: 98724 - DNA, 25 bp, Homo sapien
tccggctgtggaagtgtgagatgga

SEQ ID NO: 98725 - DNA, 25 bp, Homo sapien
tccggctgtgggagtgtgagatgga

SEQ ID NO: 98726 - DNA, 25 bp, Homo sapien
tccgggtcctccatccacaggggct

SEQ ID NO: 98727 - DNA, 25 bp, Homo sapien
tccgggtcctctatccacaggggct

SEQ ID NO: 98728 - DNA, 25 bp, Homo sapien
tccggtacaatgcagcatattaaaa

SEQ ID NO: 98729 - DNA, 25 bp, Homo sapien
tccggtacaatgcagcgtattaaaa

SEQ ID NO: 98730 - DNA, 25 bp, Homo sapien
tccggtctgttaaaaaatgcctcct

SEQ ID NO: 98731 - DNA, 25 bp, Homo sapien
tccggtctgttaaaaagtgcctcct

SEQ ID NO: 98732 - DNA, 25 bp, Homo sapien
tccgtaacgcaagtagagtacactc

SEQ ID NO: 98733 - DNA, 25 bp, Homo sapien
tccgtaacgcaggtagagtacactc

SEQ ID NO: 98734 - DNA, 25 bp, Homo sapien
tccgtctctgccatcatgacagaaa

SEQ ID NO: 98735 - DNA, 25 bp, Homo sapien
tccgtctctgccttcatgacagaaa

SEQ ID NO: 98736 - DNA, 25 bp, Homo sapien
tccgtcttgactcagcttcatttgt

SEQ ID NO: 98737 - DNA, 25 bp, Homo sapien
tccgtcttgactgagcttcatttgt

SEQ ID NO: 98738 - DNA, 25 bp, Homo sapien
tccgtgcagcaggatggtatacaga

SEQ ID NO: 98739 - DNA, 25 bp, Homo sapien
tccgtgcagcagggtggtatacaga

SEQ ID NO: 98740 - DNA, 25 bp, Homo sapien
tccgtgccctcctgtttttgatctt

SEQ ID NO: 98741 - DNA, 25 bp, Homo sapien
tccgtgccttcctgtttttgatctt

SEQ ID NO: 98742 - DNA, 25 bp, Homo sapien
tccgtgctttgtggctacaaactga

SEQ ID NO: 98743 - DNA, 25 bp, Homo sapien
tccgtgctttgtggctgcaaactga

SEQ ID NO: 98744 - DNA, 25 bp, Homo sapien
tcctaaaatttaataaggcaaatgt

SEQ ID NO: 98745 - DNA, 25 bp, Homo sapien
tcctaaaatttagtaaggcaaatgt

SEQ ID NO: 98746 - DNA, 25 bp, Homo sapien
tcctaaacacactctaccatcttag

SEQ ID NO: 98747 - DNA, 25 bp, Homo sapien
tcctaaacacattctaccatcttag

SEQ ID NO: 98748 - DNA, 25 bp, Homo sapien
tcctaaactgcaattcctccagaat

SEQ ID NO: 98749 - DNA, 25 bp, Homo sapien
tcctaaactgcacttcctccagaat

SEQ ID NO: 98750 - DNA, 25 bp, Homo sapien
tcctaaagcagataaagattgaatc

SEQ ID NO: 98751 - DNA, 25 bp, Homo sapien
tcctaaagcagatacagattgaatc

SEQ ID NO: 98752 - DNA, 25 bp, Homo sapien
tcctaaagtgcccattaaactgtag

SEQ ID NO: 98753 - DNA, 25 bp, Homo sapien
tcctaaagtgcccattgaactgtag

SEQ ID NO: 98754 - DNA, 25 bp, Homo sapien
tcctaaatagttacgaaaaacagaa

SEQ ID NO: 98755 - DNA, 25 bp, Homo sapien
tcctaaatagttatgaaaaacagaa

SEQ ID NO: 98756 - DNA, 25 bp, Homo sapien
tcctaaatatgctctgtaaaacact

SEQ ID NO: 98757 - DNA, 25 bp, Homo sapien
tcctaaatcatgatcccagtgctgt

SEQ ID NO: 98758 - DNA, 25 bp, Homo sapien
tcctaaatcctgaatctctatgctg

SEQ ID NO: 98759 - DNA, 25 bp, Homo sapien
tcctaaatcctgtatctctatgctg

SEQ ID NO: 98760 - DNA, 25 bp, Homo sapien
tcctaaatgtgctctgtaaaacact

SEQ ID NO: 98761 - DNA, 25 bp, Homo sapien
tcctaaattatgatcccagtgctgt

SEQ ID NO: 98762 - DNA, 25 bp, Homo sapien
tcctaaattgctgcgattacagttg

SEQ ID NO: 98763 - DNA, 25 bp, Homo sapien
tcctaaattgctgtgattacagttg

SEQ ID NO: 98764 - DNA, 25 bp, Homo sapien
tcctaaattttgcctacctccagtt

SEQ ID NO: 98765 - DNA, 25 bp, Homo sapien
tcctaaattttgtctacctccagtt

SEQ ID NO: 98766 - DNA, 25 bp, Homo sapien
tcctaacaataaaccacattctagt

SEQ ID NO: 98767 - DNA, 25 bp, Homo sapien
tcctaacacggcaagaaagtaggct

SEQ ID NO: 98768 - DNA, 25 bp, Homo sapien
tcctaacactaaaccacattctagt

SEQ ID NO: 98769 - DNA, 25 bp, Homo sapien
tcctaacatggcaagaaagtaggct

SEQ ID NO: 98770 - DNA, 25 bp, Homo sapien
tcctaacctctaaggcatttcagaa

SEQ ID NO: 98771 - DNA, 25 bp, Homo sapien
tcctaacctctgaggcatttcagaa

SEQ ID NO: 98772 - DNA, 25 bp, Homo sapien
tcctaactaaacagctccatagtgg

SEQ ID NO: 98773 - DNA, 25 bp, Homo sapien
tcctaactaaacggctccatagtgg

SEQ ID NO: 98774 - DNA, 25 bp, Homo sapien
tcctaactgtgatggcaaaattctc

SEQ ID NO: 98775 - DNA, 25 bp, Homo sapien
tcctaactgtgatggccaaattctc

SEQ ID NO: 98776 - DNA, 25 bp, Homo sapien
tcctaagaatttccgtccttgttgt

SEQ ID NO: 98777 - DNA, 25 bp, Homo sapien
tcctaagaatttctgtccttgttgt

SEQ ID NO: 98778 - DNA, 25 bp, Homo sapien
tcctaagacatttcaacatgtgatc

SEQ ID NO: 98779 - DNA, 25 bp, Homo sapien
tcctaagatatttcaacatgtgatc

SEQ ID NO: 98780 - DNA, 25 bp, Homo sapien
tcctaagattcaacttcctctgttt

SEQ ID NO: 98781 - DNA, 25 bp, Homo sapien
tcctaagattcatcttcctctgttt

SEQ ID NO: 98782 - DNA, 25 bp, Homo sapien
tcctaagcaagactatctactgctc

SEQ ID NO: 98783 - DNA, 25 bp, Homo sapien
tcctaagcacgactatctactgctc

SEQ ID NO: 98784 - DNA, 25 bp, Homo sapien
tcctaaggtggttgtccgagtgccc

SEQ ID NO: 98785 - DNA, 25 bp, Homo sapien
tcctaaggtggttgtctgagtgccc

SEQ ID NO: 98786 - DNA, 25 bp, Homo sapien
tcctaaggtttccgactcagatcct

SEQ ID NO: 98787 - DNA, 25 bp, Homo sapien
tcctaaggtttctgactcagatcct

SEQ ID NO: 98788 - DNA, 25 bp, Homo sapien
tcctaagtctctccctatgtgtcag

SEQ ID NO: 98789 - DNA, 25 bp, Homo sapien
tcctaagtctctccctgtgtgtcag

SEQ ID NO: 98790 - DNA, 25 bp, Homo sapien
tcctaatccactgaaaatacaaacc

SEQ ID NO: 98791 - DNA, 25 bp, Homo sapien
tcctaatccactgagaatacaaacc

SEQ ID NO: 98792 - DNA, 25 bp, Homo sapien
tcctaatctgaaaaatctttttatc

SEQ ID NO: 98793 - DNA, 25 bp, Homo sapien
tcctaatctgagaaatctttttatc

SEQ ID NO: 98794 - DNA, 25 bp, Homo sapien
tcctaatttatattgcacttacaac

SEQ ID NO: 98795 - DNA, 25 bp, Homo sapien
tcctaatttatgttgcacttacaac

SEQ ID NO: 98796 - DNA, 25 bp, Homo sapien
tcctaatttcaatctaagttagcca

SEQ ID NO: 98797 - DNA, 25 bp, Homo sapien
tcctaatttcaatgtaagttagcca

SEQ ID NO: 98798 - DNA, 25 bp, Homo sapien
tcctacaataacacatgacagagcc

SEQ ID NO: 98799 - DNA, 25 bp, Homo sapien
tcctacaattacacatgacagagcc

SEQ ID NO: 98800 - DNA, 25 bp, Homo sapien
tcctacacccatcctcagagctcca

SEQ ID NO: 98801 - DNA, 25 bp, Homo sapien
tcctacacccatcttcagagctcca

SEQ ID NO: 98802 - DNA, 25 bp, Homo sapien
tcctacagccccttagatttcgttg

SEQ ID NO: 98803 - DNA, 25 bp, Homo sapien
tcctacagccccttaggtttcgttg

SEQ ID NO: 98804 - DNA, 25 bp, Homo sapien
tcctacagtagacaaacatacccaa

SEQ ID NO: 98805 - DNA, 25 bp, Homo sapien
tcctacagtagataaacatacccaa

SEQ ID NO: 98806 - DNA, 25 bp, Homo sapien
tcctacatttccaacaagatataat

SEQ ID NO: 98807 - DNA, 25 bp, Homo sapien
tcctacatttcgaacaagatataat

SEQ ID NO: 98808 - DNA, 25 bp, Homo sapien
tcctaccacacataacgccaagggg

SEQ ID NO: 98809 - DNA, 25 bp, Homo sapien
tcctaccacgcataacgccaagggg

SEQ ID NO: 98810 - DNA, 25 bp, Homo sapien
tcctacctttcaaaataggagccaa

SEQ ID NO: 98811 - DNA, 25 bp, Homo sapien
tcctacctttcaatataggagccaa

SEQ ID NO: 98812 - DNA, 25 bp, Homo sapien
tcctactacggaatggagagctcag

SEQ ID NO: 98813 - DNA, 25 bp, Homo sapien
tcctactactcccatcttgctcact

SEQ ID NO: 98814 - DNA, 25 bp, Homo sapien
tcctactactcccgtcttgctcact

SEQ ID NO: 98815 - DNA, 25 bp, Homo sapien
tcctactagctataagagtgttctg

SEQ ID NO: 98816 - DNA, 25 bp, Homo sapien
tcctactagctgtaagagtgttctg

SEQ ID NO: 98817 - DNA, 25 bp, Homo sapien
tcctactatggaatggagagctcag

SEQ ID NO: 98818 - DNA, 25 bp, Homo sapien
tcctactggaaaaactgtgtccaga

SEQ ID NO: 98819 - DNA, 25 bp, Homo sapien
tcctactggaaaaattgtgtccaga

SEQ ID NO: 98820 - DNA, 25 bp, Homo sapien
tcctactgtttgatttgtccttttt

SEQ ID NO: 98821 - DNA, 25 bp, Homo sapien
tcctactgttttatttgtccttttt

SEQ ID NO: 98822 - DNA, 25 bp, Homo sapien
tcctagaaaggatatatgaatgcaa

SEQ ID NO: 98823 - DNA, 25 bp, Homo sapien
tcctagaaagggtatatgaatgcaa

SEQ ID NO: 98824 - DNA, 25 bp, Homo sapien
tcctagaattcgccatagcatggtc

SEQ ID NO: 98825 - DNA, 25 bp, Homo sapien
tcctagaattcgccgtagcatggtc

SEQ ID NO: 98826 - DNA, 25 bp, Homo sapien
tcctagaccactctgaccttgccca

SEQ ID NO: 98827 - DNA, 25 bp, Homo sapien
tcctagaccactttgaccttgccca

SEQ ID NO: 98828 - DNA, 25 bp, Homo sapien
tcctagagagaagaaagacacattc

SEQ ID NO: 98829 - DNA, 25 bp, Homo sapien
tcctagagggaagaaagacacattc

SEQ ID NO: 98830 - DNA, 25 bp, Homo sapien
tcctagattaagacctgcctggaat

SEQ ID NO: 98831 - DNA, 25 bp, Homo sapien
tcctagattaaggcctgcctggaat

SEQ ID NO: 98832 - DNA, 25 bp, Homo sapien
tcctagcacagcatttcttcattct

SEQ ID NO: 98833 - DNA, 25 bp, Homo sapien
tcctagcacagcgtttcttcattct

SEQ ID NO: 98834 - DNA, 25 bp, Homo sapien
tcctagcataataaagatacgtagg

SEQ ID NO: 98835 - DNA, 25 bp, Homo sapien
tcctagcataatacagatacgtagg

SEQ ID NO: 98836 - DNA, 25 bp, Homo sapien
tcctaggatggctgcaacctcaaaa

SEQ ID NO: 98837 - DNA, 25 bp, Homo sapien
tcctaggatggctgcatcctcaaaa

SEQ ID NO: 98838 - DNA, 25 bp, Homo sapien
tcctaggtgttcaaattcattcatc

SEQ ID NO: 98839 - DNA, 25 bp, Homo sapien
tcctaggtgttcacattcattcatc

SEQ ID NO: 98840 - DNA, 25 bp, Homo sapien
tcctagtagaaggcgcttaccatat

SEQ ID NO: 98841 - DNA, 25 bp, Homo sapien
tcctagtagaaggtgcttaccatat

SEQ ID NO: 98842 - DNA, 25 bp, Homo sapien
tcctagtcaaagtagttgggatggt

SEQ ID NO: 98843 - DNA, 25 bp, Homo sapien
tcctagtcaaagtggttgggatggt

SEQ ID NO: 98844 - DNA, 25 bp, Homo sapien
tcctagtcaagatggccacacctcc

SEQ ID NO: 98845 - DNA, 25 bp, Homo sapien
tcctagtcgagatggccacacctcc

SEQ ID NO: 98846 - DNA, 25 bp, Homo sapien
tcctatagtaatcacaataatggca

SEQ ID NO: 98847 - DNA, 25 bp, Homo sapien
tcctatagtaatcacagtaatggca

SEQ ID NO: 98848 - DNA, 25 bp, Homo sapien
tcctatataacatcttccaatataa

SEQ ID NO: 98849 - DNA, 25 bp, Homo sapien
tcctatataacgtcttccaatataa

SEQ ID NO: 98850 - DNA, 25 bp, Homo sapien
tcctatcaaattgtgttacaacatt

SEQ ID NO: 98851 - DNA, 25 bp, Homo sapien
tcctatcaatttgtgttacaacatt

SEQ ID NO: 98852 - DNA, 25 bp, Homo sapien
tcctatcatcattgacccacattgt

SEQ ID NO: 98853 - DNA, 25 bp, Homo sapien
tcctatcatcattggcccacattgt

SEQ ID NO: 98854 - DNA, 25 bp, Homo sapien
tcctatccacctgcaggtttacaaa

SEQ ID NO: 98855 - DNA, 25 bp, Homo sapien
tcctatccacctgcgggtttacaaa

SEQ ID NO: 98856 - DNA, 25 bp, Homo sapien
tcctatcctcacacttcctgtacat

SEQ ID NO: 98857 - DNA, 25 bp, Homo sapien
tcctatcctcatacttcctgtacat

SEQ ID NO: 98858 - DNA, 25 bp, Homo sapien
tcctatgaaacagagaatttcaatg

SEQ ID NO: 98859 - DNA, 25 bp, Homo sapien
tcctatgaagcagagaatttcaatg

SEQ ID NO: 98860 - DNA, 25 bp, Homo sapien
tcctatgataccgtatcttctggaa

SEQ ID NO: 98861 - DNA, 25 bp, Homo sapien
tcctatgatactgtatcttctggaa

SEQ ID NO: 98862 - DNA, 25 bp, Homo sapien
tcctatggttacacgtccttccctg

SEQ ID NO: 98863 - DNA, 25 bp, Homo sapien
tcctatggttacatgtccttccctg

SEQ ID NO: 98864 - DNA, 25 bp, Homo sapien
tcctatgtcatatggcccaacgtta

SEQ ID NO: 98865 - DNA, 25 bp, Homo sapien
tcctatgtcgtatggcccaacgtta

SEQ ID NO: 98866 - DNA, 25 bp, Homo sapien
tcctattaaaacaattttggcaact

SEQ ID NO: 98867 - DNA, 25 bp, Homo sapien
tcctattaaaagaattttggcaact

SEQ ID NO: 98868 - DNA, 25 bp, Homo sapien
tcctattcctatgcttctacctatg

SEQ ID NO: 98869 - DNA, 25 bp, Homo sapien
tcctattcctattcttctacctatg

SEQ ID NO: 98870 - DNA, 25 bp, Homo sapien
tcctattgactaggtccgtgttaag

SEQ ID NO: 98871 - DNA, 25 bp, Homo sapien
tcctattgactaggtctgtgttaag

SEQ ID NO: 98872 - DNA, 25 bp, Homo sapien
tcctatttgctaggcatcgaccacc

SEQ ID NO: 98873 - DNA, 25 bp, Homo sapien
tcctatttgctgggcatcgaccacc

SEQ ID NO: 98874 - DNA, 25 bp, Homo sapien
tcctatttgtttatccatgagttgt

SEQ ID NO: 98875 - DNA, 25 bp, Homo sapien
tcctatttgtttatccgtgagttgt

SEQ ID NO: 98876 - DNA, 25 bp, Homo sapien
tcctcaaaacctgcaaatatgttat

SEQ ID NO: 98877 - DNA, 25 bp, Homo sapien
tcctcaaaacctgcgaatatgttat

SEQ ID NO: 98878 - DNA, 25 bp, Homo sapien
tcctcaaagaaggttcagttggata

SEQ ID NO: 98879 - DNA, 25 bp, Homo sapien
tcctcaaagaagtttcagttggata

SEQ ID NO: 98880 - DNA, 25 bp, Homo sapien
tcctcaaatctatgtgtatagtcga

SEQ ID NO: 98881 - DNA, 25 bp, Homo sapien
tcctcaaatctatttgtatagtcga

SEQ ID NO: 98882 - DNA, 25 bp, Homo sapien
tcctcaacagtagccactagatatc

SEQ ID NO: 98883 - DNA, 25 bp, Homo sapien
tcctcaacagtagccattagatatc

SEQ ID NO: 98884 - DNA, 25 bp, Homo sapien
tcctcaaccttgatcacatctgaaa

SEQ ID NO: 98885 - DNA, 25 bp, Homo sapien
tcctcaaccttgatcatatctgaaa

SEQ ID NO: 98886 - DNA, 25 bp, Homo sapien
tcctcaagtcggcattccttcttgt

SEQ ID NO: 98887 - DNA, 25 bp, Homo sapien
tcctcaagttggcattccttcttgt

SEQ ID NO: 98888 - DNA, 25 bp, Homo sapien
tcctcacacggcaccatggctgtag

SEQ ID NO: 98889 - DNA, 25 bp, Homo sapien
tcctcacagcgtagtggaagagaaa

SEQ ID NO: 98890 - DNA, 25 bp, Homo sapien
tcctcacaggcacatagaaaattag

SEQ ID NO: 98891 - DNA, 25 bp, Homo sapien
tcctcacagggcaccatggctgtag

SEQ ID NO: 98892 - DNA, 25 bp, Homo sapien
tcctcacagtcacatagaaaattag

SEQ ID NO: 98893 - DNA, 25 bp, Homo sapien
tcctcacagtgtagtggaagagaaa

SEQ ID NO: 98894 - DNA, 25 bp, Homo sapien
tcctcactaatatctataagggcag

SEQ ID NO: 98895 - DNA, 25 bp, Homo sapien
tcctcactaatctctataagggcag

SEQ ID NO: 98896 - DNA, 25 bp, Homo sapien
tcctcagatatccgtcctctttagg

SEQ ID NO: 98897 - DNA, 25 bp, Homo sapien
tcctcagatatctgtcctctttagg

SEQ ID NO: 98898 - DNA, 25 bp, Homo sapien
tcctcagcaaccacagggaggatcc

SEQ ID NO: 98899 - DNA, 25 bp, Homo sapien
tcctcagcaactacagggaggatcc

SEQ ID NO: 98900 - DNA, 25 bp, Homo sapien
tcctcagggactatacaaaagatcc

SEQ ID NO: 98901 - DNA, 25 bp, Homo sapien
tcctcagggtctatacaaaagatcc

SEQ ID NO: 98902 - DNA, 25 bp, Homo sapien
tcctcatcactagaaacaaaaaggg

SEQ ID NO: 98903 - DNA, 25 bp, Homo sapien
tcctcatcactggaaacaaaaaggg

SEQ ID NO: 98904 - DNA, 25 bp, Homo sapien
tcctcatccatgacatcaatagttt

SEQ ID NO: 98905 - DNA, 25 bp, Homo sapien
tcctcatccatgacattaatagttt

SEQ ID NO: 98906 - DNA, 25 bp, Homo sapien
tcctcatctccttcaacgagcttgt

SEQ ID NO: 98907 - DNA, 25 bp, Homo sapien
tcctcatctccttcaatgagcttgt

SEQ ID NO: 98908 - DNA, 25 bp, Homo sapien
tcctcatgaccctgagttaagccaa

SEQ ID NO: 98909 - DNA, 25 bp, Homo sapien
tcctcatgaccttgagttaagccaa

SEQ ID NO: 98910 - DNA, 25 bp, Homo sapien
tcctcatgttcagttgatagctgca

SEQ ID NO: 98911 - DNA, 25 bp, Homo sapien
tcctcatgttcatttgatagctgca

SEQ ID NO: 98912 - DNA, 25 bp, Homo sapien
tcctcattggcacaatatgcagggc

SEQ ID NO: 98913 - DNA, 25 bp, Homo sapien
tcctcattggcagaatatgcagggc

SEQ ID NO: 98914 - DNA, 25 bp, Homo sapien
tcctccaaaataccgagtgaggtct

SEQ ID NO: 98915 - DNA, 25 bp, Homo sapien
tcctccaaaatactgagtgaggtct

SEQ ID NO: 98916 - DNA, 25 bp, Homo sapien
tcctccaacattaaagggcctagtt

SEQ ID NO: 98917 - DNA, 25 bp, Homo sapien
tcctccaacattgaagggcctagtt

SEQ ID NO: 98918 - DNA, 25 bp, Homo sapien
tcctccacactaatttctctaagtc

SEQ ID NO: 98919 - DNA, 25 bp, Homo sapien
tcctccacactcatttctctaagtc

SEQ ID NO: 98920 - DNA, 25 bp, Homo sapien
tcctccaggggccaatgtcagaaca

SEQ ID NO: 98921 - DNA, 25 bp, Homo sapien
tcctccaggggccagtgtcagaaca

SEQ ID NO: 98922 - DNA, 25 bp, Homo sapien
tcctccatcttgccatcataccaaa

SEQ ID NO: 98923 - DNA, 25 bp, Homo sapien
tcctccattttgccatcataccaaa

SEQ ID NO: 98924 - DNA, 25 bp, Homo sapien
tcctcccaggagaatgtgtattttt

SEQ ID NO: 98925 - DNA, 25 bp, Homo sapien
tcctcccaggagagtgtgtattttt

SEQ ID NO: 98926 - DNA, 25 bp, Homo sapien
tcctccctccagtcggtaaaatgtc

SEQ ID NO: 98927 - DNA, 25 bp, Homo sapien
tcctccctccagtctgtaaaatgtc

SEQ ID NO: 98928 - DNA, 25 bp, Homo sapien
tcctccctgggctaccatttttctg

SEQ ID NO: 98929 - DNA, 25 bp, Homo sapien
tcctccctgggctatcatttttctg

SEQ ID NO: 98930 - DNA, 25 bp, Homo sapien
tcctcctgagcaacatgactgagta

SEQ ID NO: 98931 - DNA, 25 bp, Homo sapien
tcctcctgagcaacgtgactgagta

SEQ ID NO: 98932 - DNA, 25 bp, Homo sapien
tcctccttctttcattcgtttttgg

SEQ ID NO: 98933 - DNA, 25 bp, Homo sapien
tcctccttctttcgttcgtttttgg

SEQ ID NO: 98934 - DNA, 25 bp, Homo sapien
tcctccttgactctggatttaaagc

SEQ ID NO: 98935 - DNA, 25 bp, Homo sapien
tcctccttgactttggatttaaagc

SEQ ID NO: 98936 - DNA, 25 bp, Homo sapien
tcctcctttgaccttctatttgggc

SEQ ID NO: 98937 - DNA, 25 bp, Homo sapien
tcctcctttgacgttctatttgggc

SEQ ID NO: 98938 - DNA, 25 bp, Homo sapien
tcctcgtgccatcttcaggagaaat

SEQ ID NO: 98939 - DNA, 25 bp, Homo sapien
tcctcgtgtcatcttcaggagaaat

SEQ ID NO: 98940 - DNA, 25 bp, Homo sapien
tcctctaacttgctttgtctctatt

SEQ ID NO: 98941 - DNA, 25 bp, Homo sapien
tcctctaacttgttttgtctctatt

SEQ ID NO: 98942 - DNA, 25 bp, Homo sapien
tcctctcactcttagactcaggaaa

SEQ ID NO: 98943 - DNA, 25 bp, Homo sapien
tcctctcactcttagattcaggaaa

SEQ ID NO: 98944 - DNA, 25 bp, Homo sapien
tcctctcatacgcaaaatatattca

SEQ ID NO: 98945 - DNA, 25 bp, Homo sapien
tcctctcatacgcgaaatatattca

SEQ ID NO: 98946 - DNA, 25 bp, Homo sapien
tcctctcatgctagaaatccaatac

SEQ ID NO: 98947 - DNA, 25 bp, Homo sapien
tcctctcatgctagaactccaatac

SEQ ID NO: 98948 - DNA, 25 bp, Homo sapien
tcctctccgtcatcagcctattttc

SEQ ID NO: 98949 - DNA, 25 bp, Homo sapien
tcctctccgtcattagcctattttc

SEQ ID NO: 98950 - DNA, 25 bp, Homo sapien
tcctctcctggctcctggtcattac

SEQ ID NO: 98951 - DNA, 25 bp, Homo sapien
tcctctcctggctccttgtcattac

SEQ ID NO: 98952 - DNA, 25 bp, Homo sapien
tcctctctcaaaaaaaatcaatccc

SEQ ID NO: 98953 - DNA, 25 bp, Homo sapien
tcctctctcaagtcaacgtttgatt

SEQ ID NO: 98954 - DNA, 25 bp, Homo sapien
tcctctctcaagtcaatgtttgatt

SEQ ID NO: 98955 - DNA, 25 bp, Homo sapien
tcctctctgaaaacgtccatggata

SEQ ID NO: 98956 - DNA, 25 bp, Homo sapien
tcctctctgaaaatgtccatggata

SEQ ID NO: 98957 - DNA, 25 bp, Homo sapien
tcctctcttaaaaaaaatcaatccc

SEQ ID NO: 98958 - DNA, 25 bp, Homo sapien
tcctctctttggacttcagaagcaa

SEQ ID NO: 98959 - DNA, 25 bp, Homo sapien
tcctctctttggactttagaagcaa

SEQ ID NO: 98960 - DNA, 25 bp, Homo sapien
tcctctgaattatattggtctacat

SEQ ID NO: 98961 - DNA, 25 bp, Homo sapien
tcctctgaattatgttggtctacat

SEQ ID NO: 98962 - DNA, 25 bp, Homo sapien
tcctctgacaaacgtctctcagcat

SEQ ID NO: 98963 - DNA, 25 bp, Homo sapien
tcctctgacaaatgtctctcagcat

SEQ ID NO: 98964 - DNA, 25 bp, Homo sapien
tcctctgacactattttatcaagga

SEQ ID NO: 98965 - DNA, 25 bp, Homo sapien
tcctctgacactgttttatcaagga

SEQ ID NO: 98966 - DNA, 25 bp, Homo sapien
tcctctgcatcactcttaacccttt

SEQ ID NO: 98967 - DNA, 25 bp, Homo sapien
tcctctgcatcattcttaacccttt

SEQ ID NO: 98968 - DNA, 25 bp, Homo sapien
tcctctggcgtgacttcatcttgac

SEQ ID NO: 98969 - DNA, 25 bp, Homo sapien
tcctctggcgtgagttcatcttgac

SEQ ID NO: 98970 - DNA, 25 bp, Homo sapien
tcctctgtgcctaagccactatgaa

SEQ ID NO: 98971 - DNA, 25 bp, Homo sapien
tcctctgtgcctaagcgactatgaa

SEQ ID NO: 98972 - DNA, 25 bp, Homo sapien
tcctcttaatcaaactgacagaaac

SEQ ID NO: 98973 - DNA, 25 bp, Homo sapien
tcctcttaatcaaattgacagaaac

SEQ ID NO: 98974 - DNA, 25 bp, Homo sapien
tcctcttattacgtgaattgtctag

SEQ ID NO: 98975 - DNA, 25 bp, Homo sapien
tcctcttattatgtgaattgtctag

SEQ ID NO: 98976 - DNA, 25 bp, Homo sapien
tcctcttcattgtcaaaactacctc

SEQ ID NO: 98977 - DNA, 25 bp, Homo sapien
tcctcttcattttcaaaactacctc

SEQ ID NO: 98978 - DNA, 25 bp, Homo sapien
tcctcttccacagtccaacaagata

SEQ ID NO: 98979 - DNA, 25 bp, Homo sapien
tcctcttccacggtccaacaagata

SEQ ID NO: 98980 - DNA, 25 bp, Homo sapien
tcctcttcctgcattcaggtgtagt

SEQ ID NO: 98981 - DNA, 25 bp, Homo sapien
tcctcttcctgcgttcaggtgtagt

SEQ ID NO: 98982 - DNA, 25 bp, Homo sapien
tcctcttgccttcatctttcattgt

SEQ ID NO: 98983 - DNA, 25 bp, Homo sapien
tcctcttgccttcctctttcattgt

SEQ ID NO: 98984 - DNA, 25 bp, Homo sapien
tcctctttaatttatctgactttca

SEQ ID NO: 98985 - DNA, 25 bp, Homo sapien
tcctctttagtttagtgtgttgtct

SEQ ID NO: 98986 - DNA, 25 bp, Homo sapien
tcctctttgatttatctgactttca

SEQ ID NO: 98987 - DNA, 25 bp, Homo sapien
tcctctttgcacattgtctcatatc

SEQ ID NO: 98988 - DNA, 25 bp, Homo sapien
tcctctttgcagattgtctcatatc

SEQ ID NO: 98989 - DNA, 25 bp, Homo sapien
tcctctttgctctgttatttattta

SEQ ID NO: 98990 - DNA, 25 bp, Homo sapien
tcctctttgctgtgttatttattta

SEQ ID NO: 98991 - DNA, 25 bp, Homo sapien
tcctcttttgtttagtgtgttgtct

SEQ ID NO: 98992 - DNA, 25 bp, Homo sapien
tcctgaaaatgttcctatctacttt

SEQ ID NO: 98993 - DNA, 25 bp, Homo sapien
tcctgaaaatgtttctatctacttt

SEQ ID NO: 98994 - DNA, 25 bp, Homo sapien
tcctgaaccctggttagtccttggt

SEQ ID NO: 98995 - DNA, 25 bp, Homo sapien
tcctgaactaaaaaatttattggag

SEQ ID NO: 98996 - DNA, 25 bp, Homo sapien
tcctgaactaaaaagtttattggag

SEQ ID NO: 98997 - DNA, 25 bp, Homo sapien
tcctgaactatacatggtaggatac

SEQ ID NO: 98998 - DNA, 25 bp, Homo sapien
tcctgaactatacgtggtaggatac

SEQ ID NO: 98999 - DNA, 25 bp, Homo sapien
tcctgaactctggttagtccttggt

SEQ ID NO: 99000 - DNA, 25 bp, Homo sapien
tcctgaagtcaaacaagaccatgaa

SEQ ID NO: 99001 - DNA, 25 bp, Homo sapien
tcctgaagtcaagcaagaccatgaa

SEQ ID NO: 99002 - DNA, 25 bp, Homo sapien
tcctgaagtcttcttgcagttacta

SEQ ID NO: 99003 - DNA, 25 bp, Homo sapien
tcctgaagtctttttgcagttacta

SEQ ID NO: 99004 - DNA, 25 bp, Homo sapien
tcctgaatattgcaaggtctggagc

SEQ ID NO: 99005 - DNA, 25 bp, Homo sapien
tcctgaatcttgcaaggtctggagc

SEQ ID NO: 99006 - DNA, 25 bp, Homo sapien
tcctgaatgatttctaagtaaacaa

SEQ ID NO: 99007 - DNA, 25 bp, Homo sapien
tcctgaatgatttctaggtaaacaa

SEQ ID NO: 99008 - DNA, 25 bp, Homo sapien
tcctgaattcttcttcaggcaaatc

SEQ ID NO: 99009 - DNA, 25 bp, Homo sapien
tcctgaattctttttcaggcaaatc

SEQ ID NO: 99010 - DNA, 25 bp, Homo sapien
tcctgacaaatcatgaaaatatgag

SEQ ID NO: 99011 - DNA, 25 bp, Homo sapien
tcctgacaaatcatgagaatatgag

SEQ ID NO: 99012 - DNA, 25 bp, Homo sapien
tcctgacatccttgcgaagtatttg

SEQ ID NO: 99013 - DNA, 25 bp, Homo sapien
tcctgacatccttgtgaagtatttg

SEQ ID NO: 99014 - DNA, 25 bp, Homo sapien
tcctgacccaaaaggtagactggac

SEQ ID NO: 99015 - DNA, 25 bp, Homo sapien
tcctgacccaagaggtagactggac

SEQ ID NO: 99016 - DNA, 25 bp, Homo sapien
tcctgactccaaatataagtctaac

SEQ ID NO: 99017 - DNA, 25 bp, Homo sapien
tcctgactccaattataagtctaac

SEQ ID NO: 99018 - DNA, 25 bp, Homo sapien
tcctgagaaaaaattccacaaatgt

SEQ ID NO: 99019 - DNA, 25 bp, Homo sapien
tcctgagaaataccaaagtcctcaa

SEQ ID NO: 99020 - DNA, 25 bp, Homo sapien
tcctgagaaataccaaggtcctcaa

SEQ ID NO: 99021 - DNA, 25 bp, Homo sapien
tcctgagaataaattccacaaatgt

SEQ ID NO: 99022 - DNA, 25 bp, Homo sapien
tcctgagaatttgcaggtctaacaa

SEQ ID NO: 99023 - DNA, 25 bp, Homo sapien
tcctgagaatttgtaggtctaacaa

SEQ ID NO: 99024 - DNA, 25 bp, Homo sapien
tcctgagacaactcctggtgataat

SEQ ID NO: 99025 - DNA, 25 bp, Homo sapien
tcctgagaccactcctggtgataat

SEQ ID NO: 99026 - DNA, 25 bp, Homo sapien
tcctgagagaggagaaccaaatgag

SEQ ID NO: 99027 - DNA, 25 bp, Homo sapien
tcctgagagcggagaaccaaatgag

SEQ ID NO: 99028 - DNA, 25 bp, Homo sapien
tcctgagcaacatgactgagtattc

SEQ ID NO: 99029 - DNA, 25 bp, Homo sapien
tcctgagcaacgtgactgagtattc

SEQ ID NO: 99030 - DNA, 25 bp, Homo sapien
tcctgagcaatactggtgctaagta

SEQ ID NO: 99031 - DNA, 25 bp, Homo sapien
tcctgagcaatagtggtgctaagta

SEQ ID NO: 99032 - DNA, 25 bp, Homo sapien
tcctgaggcacctgtttggaatctg

SEQ ID NO: 99033 - DNA, 25 bp, Homo sapien
tcctgaggcgcctgtttggaatctg

SEQ ID NO: 99034 - DNA, 25 bp, Homo sapien
tcctgagtaacccaccgtgtaccac

SEQ ID NO: 99035 - DNA, 25 bp, Homo sapien
tcctgagtaacctaccgtgtaccac

SEQ ID NO: 99036 - DNA, 25 bp, Homo sapien
tcctgagtcctttcgaaaccactgt

SEQ ID NO: 99037 - DNA, 25 bp, Homo sapien
tcctgagtccttttgaaaccactgt

SEQ ID NO: 99038 - DNA, 25 bp, Homo sapien
tcctgagtttgaaccatcttccagc

SEQ ID NO: 99039 - DNA, 25 bp, Homo sapien
tcctgagtttgagccatcttccagc

SEQ ID NO: 99040 - DNA, 25 bp, Homo sapien
tcctgatgacacgtgcacaaggtgg

SEQ ID NO: 99041 - DNA, 25 bp, Homo sapien
tcctgatgacatgtgcacaaggtgg

SEQ ID NO: 99042 - DNA, 25 bp, Homo sapien
tcctgatgataaatcaagttgagca

SEQ ID NO: 99043 - DNA, 25 bp, Homo sapien
tcctgatgataaatgaagttgagca

SEQ ID NO: 99044 - DNA, 25 bp, Homo sapien
tcctgatggtcctcgcaacttctga

SEQ ID NO: 99045 - DNA, 25 bp, Homo sapien
tcctgatggtcctcgccacttctga

SEQ ID NO: 99046 - DNA, 25 bp, Homo sapien
tcctgatgtcaaatctaaaaatccc

SEQ ID NO: 99047 - DNA, 25 bp, Homo sapien
tcctgatgtcaagtctaaaaatccc

SEQ ID NO: 99048 - DNA, 25 bp, Homo sapien
tcctgcacaaccatctggcaaactc

SEQ ID NO: 99049 - DNA, 25 bp, Homo sapien
tcctgcacagatacgaaggcttact

SEQ ID NO: 99050 - DNA, 25 bp, Homo sapien
tcctgcacagatatgaaggcttact

SEQ ID NO: 99051 - DNA, 25 bp, Homo sapien
tcctgcacatccatctggcaaactc

SEQ ID NO: 99052 - DNA, 25 bp, Homo sapien
tcctgcactagaccaactgtaagag

SEQ ID NO: 99053 - DNA, 25 bp, Homo sapien
tcctgcactagactaactgtaagag

SEQ ID NO: 99054 - DNA, 25 bp, Homo sapien
tcctgcagacaagactgcttctgga

SEQ ID NO: 99055 - DNA, 25 bp, Homo sapien
tcctgcagataagactgcttctgga

SEQ ID NO: 99056 - DNA, 25 bp, Homo sapien
tcctgcatgcttcatcacatagcca

SEQ ID NO: 99057 - DNA, 25 bp, Homo sapien
tcctgcatgcttcgtcacatagcca

SEQ ID NO: 99058 - DNA, 25 bp, Homo sapien
tcctgccagattgcaccttattagc

SEQ ID NO: 99059 - DNA, 25 bp, Homo sapien
tcctgccagcgctactcggtgacca

SEQ ID NO: 99060 - DNA, 25 bp, Homo sapien
tcctgccagcgctacttggtgacca

SEQ ID NO: 99061 - DNA, 25 bp, Homo sapien
tcctgccagtttgcaccttattagc

SEQ ID NO: 99062 - DNA, 25 bp, Homo sapien
tcctgccccctgtagagaaaagact

SEQ ID NO: 99063 - DNA, 25 bp, Homo sapien
tcctgccccctgtatagaaaagact

SEQ ID NO: 99064 - DNA, 25 bp, Homo sapien
tcctgcctccttatttgactgttaa

SEQ ID NO: 99065 - DNA, 25 bp, Homo sapien
tcctgcctctatttcttgtttattt

SEQ ID NO: 99066 - DNA, 25 bp, Homo sapien
tcctgcctctattttttgtttattt

SEQ ID NO: 99067 - DNA, 25 bp, Homo sapien
tcctgcctgccacagaccgaatcag

SEQ ID NO: 99068 - DNA, 25 bp, Homo sapien
tcctgcctgccacagagcgaatcag

SEQ ID NO: 99069 - DNA, 25 bp, Homo sapien
tcctgcctgccacatgccataccac

SEQ ID NO: 99070 - DNA, 25 bp, Homo sapien
tcctgcctgccacgtgccataccac

SEQ ID NO: 99071 - DNA, 25 bp, Homo sapien
tcctgcctgcttatttgactgttaa

SEQ ID NO: 99072 - DNA, 25 bp, Homo sapien
tcctgccttattggagattctagat

SEQ ID NO: 99073 - DNA, 25 bp, Homo sapien
tcctgccttatttgagattctagat

SEQ ID NO: 99074 - DNA, 25 bp, Homo sapien
tcctgccttggttcttctcaaacca

SEQ ID NO: 99075 - DNA, 25 bp, Homo sapien
tcctgccttggttgttctcaaacca

SEQ ID NO: 99076 - DNA, 25 bp, Homo sapien
tcctgcgagaataacaagtggacaa

SEQ ID NO: 99077 - DNA, 25 bp, Homo sapien
tcctgcgagaataagaagtggacaa

SEQ ID NO: 99078 - DNA, 25 bp, Homo sapien
tcctgcgccatttaattgagtgaat

SEQ ID NO: 99079 - DNA, 25 bp, Homo sapien
tcctgcgccttttaattgagtgaat

SEQ ID NO: 99080 - DNA, 25 bp, Homo sapien
tcctgctacatttcacttcttaatt

SEQ ID NO: 99081 - DNA, 25 bp, Homo sapien
tcctgctacttttcacttcttaatt

SEQ ID NO: 99082 - DNA, 25 bp, Homo sapien
tcctgctataacttcgtagtcctgg

SEQ ID NO: 99083 - DNA, 25 bp, Homo sapien
tcctgctataactttgtagtcctgg

SEQ ID NO: 99084 - DNA, 25 bp, Homo sapien
tcctgctataagaagatggaagatt

SEQ ID NO: 99085 - DNA, 25 bp, Homo sapien
tcctgctataataagatggaagatt

SEQ ID NO: 99086 - DNA, 25 bp, Homo sapien
tcctgctcatcactgaaaagtagac

SEQ ID NO: 99087 - DNA, 25 bp, Homo sapien
tcctgctcatcgctgaaaagtagac

SEQ ID NO: 99088 - DNA, 25 bp, Homo sapien
tcctgctgaacaatctccatgcact

SEQ ID NO: 99089 - DNA, 25 bp, Homo sapien
tcctgctgaacagtctccatgcact

SEQ ID NO: 99090 - DNA, 25 bp, Homo sapien
tcctgctgaagctattcccaaaaaa

SEQ ID NO: 99091 - DNA, 25 bp, Homo sapien
tcctgctgaagctgttcccaaaaaa

SEQ ID NO: 99092 - DNA, 25 bp, Homo sapien
tcctgctgagacccttgcaatatta

SEQ ID NO: 99093 - DNA, 25 bp, Homo sapien
tcctgctgcgacccttgcaatatta

SEQ ID NO: 99094 - DNA, 25 bp, Homo sapien
tcctgcttaccgcacgattattttg

SEQ ID NO: 99095 - DNA, 25 bp, Homo sapien
tcctgcttaccgcatgattattttg

SEQ ID NO: 99096 - DNA, 25 bp, Homo sapien
tcctgcttaccgcggtcgtttttag

SEQ ID NO: 99097 - DNA, 25 bp, Homo sapien
tcctgcttaccgcggtggtttttag

SEQ ID NO: 99098 - DNA, 25 bp, Homo sapien
tcctgcttctttttctgtgttctct

SEQ ID NO: 99099 - DNA, 25 bp, Homo sapien
tcctgcttttcatgcatcttggtgg

SEQ ID NO: 99100 - DNA, 25 bp, Homo sapien
tcctgcttttcgtgcatcttggtgg

SEQ ID NO: 99101 - DNA, 25 bp, Homo sapien
tcctgcttttttttctgtgttctct

SEQ ID NO: 99102 - DNA, 25 bp, Homo sapien
tcctggaaagttaggcaatgagtcc

SEQ ID NO: 99103 - DNA, 25 bp, Homo sapien
tcctggaaagttaggcgatgagtcc

SEQ ID NO: 99104 - DNA, 25 bp, Homo sapien
tcctggaaatacagaattctatcca

SEQ ID NO: 99105 - DNA, 25 bp, Homo sapien
tcctggaaatactgaattctatcca

SEQ ID NO: 99106 - DNA, 25 bp, Homo sapien
tcctggaaatagattcttggagaca

SEQ ID NO: 99107 - DNA, 25 bp, Homo sapien
tcctggaaataggttcttggagaca

SEQ ID NO: 99108 - DNA, 25 bp, Homo sapien
tcctggactctaaaaaaacggaatt

SEQ ID NO: 99109 - DNA, 25 bp, Homo sapien
tcctggactctgaaaaaacggaatt

SEQ ID NO: 99110 - DNA, 25 bp, Homo sapien
tcctggacttcccactcttgttagc

SEQ ID NO: 99111 - DNA, 25 bp, Homo sapien
tcctggacttcccgctcttgttagc

SEQ ID NO: 99112 - DNA, 25 bp, Homo sapien
tcctggagatcagcgtggatgagaa

SEQ ID NO: 99113 - DNA, 25 bp, Homo sapien
tcctggagatcagtgtggatgagaa

SEQ ID NO: 99114 - DNA, 25 bp, Homo sapien
tcctggagccacctctgggccagag

SEQ ID NO: 99115 - DNA, 25 bp, Homo sapien
tcctggaggcacctctgggccagag

SEQ ID NO: 99116 - DNA, 25 bp, Homo sapien
tcctggaggcatccgaaatcggttc

SEQ ID NO: 99117 - DNA, 25 bp, Homo sapien
tcctggaggcatcggaaatcggttc

SEQ ID NO: 99118 - DNA, 25 bp, Homo sapien
tcctggcaattaataggaaccaagc

SEQ ID NO: 99119 - DNA, 25 bp, Homo sapien
tcctggcaattactaggaaccaagc

SEQ ID NO: 99120 - DNA, 25 bp, Homo sapien
tcctggcactctctatgaacattct

SEQ ID NO: 99121 - DNA, 25 bp, Homo sapien
tcctggcactctctgtgaacattct

SEQ ID NO: 99122 - DNA, 25 bp, Homo sapien
tcctggcagcatgccgtgagagtca

SEQ ID NO: 99123 - DNA, 25 bp, Homo sapien
tcctggcagcatgctgtgagagtca

SEQ ID NO: 99124 - DNA, 25 bp, Homo sapien
tcctggccaaatgtgcagtggggac

SEQ ID NO: 99125 - DNA, 25 bp, Homo sapien
tcctggccaaatgtgccgtggggac

SEQ ID NO: 99126 - DNA, 25 bp, Homo sapien
tcctggctcagttaatgagaacacc

SEQ ID NO: 99127 - DNA, 25 bp, Homo sapien
tcctggctctcagttcagagattca

SEQ ID NO: 99128 - DNA, 25 bp, Homo sapien
tcctggctctcggttcagagattca

SEQ ID NO: 99129 - DNA, 25 bp, Homo sapien
tcctggcttagttaatgagaacacc

SEQ ID NO: 99130 - DNA, 25 bp, Homo sapien
tcctgggccttatctcaccaagttt

SEQ ID NO: 99131 - DNA, 25 bp, Homo sapien
tcctgggccttatgtcaccaagttt

SEQ ID NO: 99132 - DNA, 25 bp, Homo sapien
tcctggggatacagaaatggagaag

SEQ ID NO: 99133 - DNA, 25 bp, Homo sapien
tcctggggatagagaaatggagaag

SEQ ID NO: 99134 - DNA, 25 bp, Homo sapien
tcctgggtgagtagatgccctgccc

SEQ ID NO: 99135 - DNA, 25 bp, Homo sapien
tcctgggtgagtcgatgccctgccc

SEQ ID NO: 99136 - DNA, 25 bp, Homo sapien
tcctgggtgatcctgaaggtcatgg

SEQ ID NO: 99137 - DNA, 25 bp, Homo sapien
tcctgggtgatcctgatggtcatgg

SEQ ID NO: 99138 - DNA, 25 bp, Homo sapien
tcctggtaaacatacaactgaggtg

SEQ ID NO: 99139 - DNA, 25 bp, Homo sapien
tcctggtaaacatacagctgaggtg

SEQ ID NO: 99140 - DNA, 25 bp, Homo sapien
tcctggtctttcaaagccatctctg

SEQ ID NO: 99141 - DNA, 25 bp, Homo sapien
tcctggtctttccggaggtacttta

SEQ ID NO: 99142 - DNA, 25 bp, Homo sapien
tcctggtctttcgaagccatctctg

SEQ ID NO: 99143 - DNA, 25 bp, Homo sapien
tcctggtctttctggaggtacttta

SEQ ID NO: 99144 - DNA, 25 bp, Homo sapien
tcctggtgacaatctgagtaggtta

SEQ ID NO: 99145 - DNA, 25 bp, Homo sapien
tcctggtgacaatttgagtaggtta

SEQ ID NO: 99146 - DNA, 25 bp, Homo sapien
tcctggtgatcacattcccaactgt

SEQ ID NO: 99147 - DNA, 25 bp, Homo sapien
tcctggtgatcatattcccaactgt

SEQ ID NO: 99148 - DNA, 25 bp, Homo sapien
tcctggtggaacacgatccaactcc

SEQ ID NO: 99149 - DNA, 25 bp, Homo sapien
tcctggtggaacatgatccaactcc

SEQ ID NO: 99150 - DNA, 25 bp, Homo sapien
tcctggttcatctttgagtaatttg

SEQ ID NO: 99151 - DNA, 25 bp, Homo sapien
tcctggttccaattacgcctaatta

SEQ ID NO: 99152 - DNA, 25 bp, Homo sapien
tcctggttccaattactcctaatta

SEQ ID NO: 99153 - DNA, 25 bp, Homo sapien
tcctggtttatctttgagtaatttg

SEQ ID NO: 99154 - DNA, 25 bp, Homo sapien
tcctgtaaatacaccttaagtaaac

SEQ ID NO: 99155 - DNA, 25 bp, Homo sapien
tcctgtaaatacgccttaagtaaac

SEQ ID NO: 99156 - DNA, 25 bp, Homo sapien
tcctgtaacgccagccaggagatct

SEQ ID NO: 99157 - DNA, 25 bp, Homo sapien
tcctgtaaggcagagcagtgagtga

SEQ ID NO: 99158 - DNA, 25 bp, Homo sapien
tcctgtaaggcagagctgtgagtga

SEQ ID NO: 99159 - DNA, 25 bp, Homo sapien
tcctgtaatgccagccaggagatct

SEQ ID NO: 99160 - DNA, 25 bp, Homo sapien
tcctgtacagactggaccaaaacag

SEQ ID NO: 99161 - DNA, 25 bp, Homo sapien
tcctgtacagggacaagaaatggaa

SEQ ID NO: 99162 - DNA, 25 bp, Homo sapien
tcctgtacagggacgagaaatggaa

SEQ ID NO: 99163 - DNA, 25 bp, Homo sapien
tcctgtacatactggaccaaaacag

SEQ ID NO: 99164 - DNA, 25 bp, Homo sapien
tcctgtatttacaaagctccctgtt

SEQ ID NO: 99165 - DNA, 25 bp, Homo sapien
tcctgtatttacatagctccctgtt

SEQ ID NO: 99166 - DNA, 25 bp, Homo sapien
tcctgtcatgccaccttgctccctg

SEQ ID NO: 99167 - DNA, 25 bp, Homo sapien
tcctgtcatgccgccttgctccctg

SEQ ID NO: 99168 - DNA, 25 bp, Homo sapien
tcctgtgacttataaataatgcttt

SEQ ID NO: 99169 - DNA, 25 bp, Homo sapien
tcctgtgacttatagataatgcttt

SEQ ID NO: 99170 - DNA, 25 bp, Homo sapien
tcctgtgagcttgcattgcccacca

SEQ ID NO: 99171 - DNA, 25 bp, Homo sapien
tcctgtgaggcactgccaagtcgca

SEQ ID NO: 99172 - DNA, 25 bp, Homo sapien
tcctgtgaggcattgccaagtcgca

SEQ ID NO: 99173 - DNA, 25 bp, Homo sapien
tcctgtgatcttgcattgcccacca

SEQ ID NO: 99174 - DNA, 25 bp, Homo sapien
tcctgtgcacataatgggtcctgag

SEQ ID NO: 99175 - DNA, 25 bp, Homo sapien
tcctgtgcacatagtgggtcctgag

SEQ ID NO: 99176 - DNA, 25 bp, Homo sapien
tcctgtgccaaatttttatgtgatg

SEQ ID NO: 99177 - DNA, 25 bp, Homo sapien
tcctgtgctaaatttttatgtgatg

SEQ ID NO: 99178 - DNA, 25 bp, Homo sapien
tcctgtgggagagcatcctagccag

SEQ ID NO: 99179 - DNA, 25 bp, Homo sapien
tcctgtgggagagcgtcctagccag

SEQ ID NO: 99180 - DNA, 25 bp, Homo sapien
tcctgtgtatccttcaccactttct

SEQ ID NO: 99181 - DNA, 25 bp, Homo sapien
tcctgtgtatggtgggctccaccca

SEQ ID NO: 99182 - DNA, 25 bp, Homo sapien
tcctgtgtgtccttcaccactttct

SEQ ID NO: 99183 - DNA, 25 bp, Homo sapien
tcctgtgtgtggtgggctccaccca

SEQ ID NO: 99184 - DNA, 25 bp, Homo sapien
tcctgtgttaccataaaggacaact

SEQ ID NO: 99185 - DNA, 25 bp, Homo sapien
tcctgtgttaccgtaaaggacaact

SEQ ID NO: 99186 - DNA, 25 bp, Homo sapien
tcctgtgttgcctattgatttcaag

SEQ ID NO: 99187 - DNA, 25 bp, Homo sapien
tcctgtgttgcctgttgatttcaag

SEQ ID NO: 99188 - DNA, 25 bp, Homo sapien
tcctgttatagccagtttgtgttgg

SEQ ID NO: 99189 - DNA, 25 bp, Homo sapien
tcctgttatagccggtttgtgttgg

SEQ ID NO: 99190 - DNA, 25 bp, Homo sapien
tcctgttcttccctacacctgcttt

SEQ ID NO: 99191 - DNA, 25 bp, Homo sapien
tcctgttcttctctacacctgcttt

SEQ ID NO: 99192 - DNA, 25 bp, Homo sapien
tcctgttgagcatagcagagatgaa

SEQ ID NO: 99193 - DNA, 25 bp, Homo sapien
tcctgttgagcgtagcagagatgaa

SEQ ID NO: 99194 - DNA, 25 bp, Homo sapien
tcctgttgatcaatgacactaatct

SEQ ID NO: 99195 - DNA, 25 bp, Homo sapien
tcctgttgatcagtgacactaatct

SEQ ID NO: 99196 - DNA, 25 bp, Homo sapien
tcctgtttaagaaaagtttgcctat

SEQ ID NO: 99197 - DNA, 25 bp, Homo sapien
tcctgtttaagaaatgtttgcctat

SEQ ID NO: 99198 - DNA, 25 bp, Homo sapien
tcctgtttacttcactcaggcaaat

SEQ ID NO: 99199 - DNA, 25 bp, Homo sapien
tcctgtttctgattgtagctgggca

SEQ ID NO: 99200 - DNA, 25 bp, Homo sapien
tcctgtttgacagacaatcattcag

SEQ ID NO: 99201 - DNA, 25 bp, Homo sapien
tcctgtttgacagacagtcattcag

SEQ ID NO: 99202 - DNA, 25 bp, Homo sapien
tcctgttttcttcactcaggcaaat

SEQ ID NO: 99203 - DNA, 25 bp, Homo sapien
tcctgttttgatatctatcaatgga

SEQ ID NO: 99204 - DNA, 25 bp, Homo sapien
tcctgttttgatatctctcaatgga

SEQ ID NO: 99205 - DNA, 25 bp, Homo sapien
tcctgtttttgattgtagctgggca

SEQ ID NO: 99206 - DNA, 25 bp, Homo sapien
tccttaaaaaattgtgaaatttggg

SEQ ID NO: 99207 - DNA, 25 bp, Homo sapien
tccttaaaaaattgtggaatttggg

SEQ ID NO: 99208 - DNA, 25 bp, Homo sapien
tccttaaggcctaggtctaccttca

SEQ ID NO: 99209 - DNA, 25 bp, Homo sapien
tccttaaggcctatgtctaccttca

SEQ ID NO: 99210 - DNA, 25 bp, Homo sapien
tccttaaggtcccatcatcttttaa

SEQ ID NO: 99211 - DNA, 25 bp, Homo sapien
tccttaaggtccgatcatcttttaa

SEQ ID NO: 99212 - DNA, 25 bp, Homo sapien
tccttaagtacaattggattttcca

SEQ ID NO: 99213 - DNA, 25 bp, Homo sapien
tccttaagttcaattggattttcca

SEQ ID NO: 99214 - DNA, 25 bp, Homo sapien
tccttaatagttttttacatgcctg

SEQ ID NO: 99215 - DNA, 25 bp, Homo sapien
tccttaatatttttttacatgcctg

SEQ ID NO: 99216 - DNA, 25 bp, Homo sapien
tccttaattggatactctgtgggtg

SEQ ID NO: 99217 - DNA, 25 bp, Homo sapien
tccttaattggatactttgtgggtg

SEQ ID NO: 99218 - DNA, 25 bp, Homo sapien
tccttacaacttcatttctccctgc

SEQ ID NO: 99219 - DNA, 25 bp, Homo sapien
tccttacaactttatttctccctgc

SEQ ID NO: 99220 - DNA, 25 bp, Homo sapien
tccttacctattgcccattaggcac

SEQ ID NO: 99221 - DNA, 25 bp, Homo sapien
tccttacctgttgcccattaggcac

SEQ ID NO: 99222 - DNA, 25 bp, Homo sapien
tccttagcaatctgctactgatata

SEQ ID NO: 99223 - DNA, 25 bp, Homo sapien
tccttagcaatctgttactgatata

SEQ ID NO: 99224 - DNA, 25 bp, Homo sapien
tccttagcacgagagcagactcttg

SEQ ID NO: 99225 - DNA, 25 bp, Homo sapien
tccttagcatgagagcagactcttg

SEQ ID NO: 99226 - DNA, 25 bp, Homo sapien
tccttagcgcagaacagtgtagcct

SEQ ID NO: 99227 - DNA, 25 bp, Homo sapien
tccttagcgcagcacagtgtagcct

SEQ ID NO: 99228 - DNA, 25 bp, Homo sapien
tccttaggaaactgcatagattaat

SEQ ID NO: 99229 - DNA, 25 bp, Homo sapien
tccttaggaaactggatagattaat

SEQ ID NO: 99230 - DNA, 25 bp, Homo sapien
tccttaggagtcagaaatagcaggt

SEQ ID NO: 99231 - DNA, 25 bp, Homo sapien
tccttaggagtctgaaatagcaggt

SEQ ID NO: 99232 - DNA, 25 bp, Homo sapien
tccttaggcccatatcctaatttag

SEQ ID NO: 99233 - DNA, 25 bp, Homo sapien
tccttaggcccgtatcctaatttag

SEQ ID NO: 99234 - DNA, 25 bp, Homo sapien
tccttagttaccagtaagactgctt

SEQ ID NO: 99235 - DNA, 25 bp, Homo sapien
tccttagttaccggtaagactgctt

SEQ ID NO: 99236 - DNA, 25 bp, Homo sapien
tccttataaaacgacaaattcagcc

SEQ ID NO: 99237 - DNA, 25 bp, Homo sapien
tccttataaaatgacaaattcagcc

SEQ ID NO: 99238 - DNA, 25 bp, Homo sapien
tccttatctaccctttaatatcttc

SEQ ID NO: 99239 - DNA, 25 bp, Homo sapien
tccttatctaccttttaatatcttc

SEQ ID NO: 99240 - DNA, 25 bp, Homo sapien
tccttattatacaagagaggccctt

SEQ ID NO: 99241 - DNA, 25 bp, Homo sapien
tccttattctacaagagaggccctt

SEQ ID NO: 99242 - DNA, 25 bp, Homo sapien
tccttatttctctcagccttcatgg

SEQ ID NO: 99243 - DNA, 25 bp, Homo sapien
tccttatttgtctcagccttcatgg

SEQ ID NO: 99244 - DNA, 25 bp, Homo sapien
tccttcaaaacacttgcgtcaggac

SEQ ID NO: 99245 - DNA, 25 bp, Homo sapien
tccttcaaaacacttgtgtcaggac

SEQ ID NO: 99246 - DNA, 25 bp, Homo sapien
tccttcaagtcttggagcatgctta

SEQ ID NO: 99247 - DNA, 25 bp, Homo sapien
tccttcaagtctttgagcatgctta

SEQ ID NO: 99248 - DNA, 25 bp, Homo sapien
tccttcacttttgcagaataatttc

SEQ ID NO: 99249 - DNA, 25 bp, Homo sapien
tccttcacttttgcggaataatttc

SEQ ID NO: 99250 - DNA, 25 bp, Homo sapien
tccttcagttcctgcttttgaacaa

SEQ ID NO: 99251 - DNA, 25 bp, Homo sapien
tccttcagttcctgtttttgaacaa

SEQ ID NO: 99252 - DNA, 25 bp, Homo sapien
tccttcatcagcatatatgcaaaga

SEQ ID NO: 99253 - DNA, 25 bp, Homo sapien
tccttcatcggcatatatgcaaaga

SEQ ID NO: 99254 - DNA, 25 bp, Homo sapien
tccttcatgcctgactactgcagaa

SEQ ID NO: 99255 - DNA, 25 bp, Homo sapien
tccttcatgcctgtctactgcagaa

SEQ ID NO: 99256 - DNA, 25 bp, Homo sapien
tccttcatggataccaacggacaag

SEQ ID NO: 99257 - DNA, 25 bp, Homo sapien
tccttcatggatatcaacggacaag

SEQ ID NO: 99258 - DNA, 25 bp, Homo sapien
tccttccacggatacctgaagcatt

SEQ ID NO: 99259 - DNA, 25 bp, Homo sapien
tccttccacttcatgtctatctcta

SEQ ID NO: 99260 - DNA, 25 bp, Homo sapien
tccttccacttcatttctatctcta

SEQ ID NO: 99261 - DNA, 25 bp, Homo sapien
tccttccagtgaaaagtgtagacat

SEQ ID NO: 99262 - DNA, 25 bp, Homo sapien
tccttccagtgagaagtgtagacat

SEQ ID NO: 99263 - DNA, 25 bp, Homo sapien
tccttccatggatacctgaagcatt

SEQ ID NO: 99264 - DNA, 25 bp, Homo sapien
tccttccattagatgacgtgtgatc

SEQ ID NO: 99265 - DNA, 25 bp, Homo sapien
tccttccattagatgatgtgtgatc

SEQ ID NO: 99266 - DNA, 25 bp, Homo sapien
tccttcccttacaagctgaatgtcc

SEQ ID NO: 99267 - DNA, 25 bp, Homo sapien
tccttcccttaccagctgaatgtcc

SEQ ID NO: 99268 - DNA, 25 bp, Homo sapien
tccttcctaaatcctgaatctctat

SEQ ID NO: 99269 - DNA, 25 bp, Homo sapien
tccttcctaaatcctgtatctctat

SEQ ID NO: 99270 - DNA, 25 bp, Homo sapien
tccttcctccttgactctggattta

SEQ ID NO: 99271 - DNA, 25 bp, Homo sapien
tccttcctccttgactttggattta

SEQ ID NO: 99272 - DNA, 25 bp, Homo sapien
tccttcctgtacacaccagcttgag

SEQ ID NO: 99273 - DNA, 25 bp, Homo sapien
tccttcctgtacagactggaccaaa

SEQ ID NO: 99274 - DNA, 25 bp, Homo sapien
tccttcctgtacataccagcttgag

SEQ ID NO: 99275 - DNA, 25 bp, Homo sapien
tccttcctgtacatactggaccaaa

SEQ ID NO: 99276 - DNA, 25 bp, Homo sapien
tccttcgtcctacagtcccaaggag

SEQ ID NO: 99277 - DNA, 25 bp, Homo sapien
tccttcgtcctgcagtcccaaggag

SEQ ID NO: 99278 - DNA, 25 bp, Homo sapien
tccttctatacctcgcaaccttgca

SEQ ID NO: 99279 - DNA, 25 bp, Homo sapien
tccttctataccttgcaaccttgca

SEQ ID NO: 99280 - DNA, 25 bp, Homo sapien
tccttctcctcctctttattcagtc

SEQ ID NO: 99281 - DNA, 25 bp, Homo sapien
tccttctcttcctctttattcagtc

SEQ ID NO: 99282 - DNA, 25 bp, Homo sapien
tccttctgaattcaggattaaagta

SEQ ID NO: 99283 - DNA, 25 bp, Homo sapien
tccttctgaattcagggttaaagta

SEQ ID NO: 99284 - DNA, 25 bp, Homo sapien
tccttctgtgttactgattgggagg

SEQ ID NO: 99285 - DNA, 25 bp, Homo sapien
tccttctgtgttcctgattgggagg

SEQ ID NO: 99286 - DNA, 25 bp, Homo sapien
tccttctgttcaaccagaagttctg

SEQ ID NO: 99287 - DNA, 25 bp, Homo sapien
tccttctgttcaagcagaagttctg

SEQ ID NO: 99288 - DNA, 25 bp, Homo sapien
tccttcttaacaagaaattggtgcc

SEQ ID NO: 99289 - DNA, 25 bp, Homo sapien
tccttcttaacaataaattggtgcc

SEQ ID NO: 99290 - DNA, 25 bp, Homo sapien
tccttctttctgcgccatcctattg

SEQ ID NO: 99291 - DNA, 25 bp, Homo sapien
tccttctttctgtgccatcctattg

SEQ ID NO: 99292 - DNA, 25 bp, Homo sapien
tccttgaaaaatgatagcatgactt

SEQ ID NO: 99293 - DNA, 25 bp, Homo sapien
tccttgaaaagacggtccataacaa

SEQ ID NO: 99294 - DNA, 25 bp, Homo sapien
tccttgaaaagatggtccataacaa

SEQ ID NO: 99295 - DNA, 25 bp, Homo sapien
tccttgaaatcctgtgctcagggga

SEQ ID NO: 99296 - DNA, 25 bp, Homo sapien
tccttgaaatcgtgtgctcagggga

SEQ ID NO: 99297 - DNA, 25 bp, Homo sapien
tccttgaacaatgatagcatgactt

SEQ ID NO: 99298 - DNA, 25 bp, Homo sapien
tccttgaactctgtgtctgaaagtc

SEQ ID NO: 99299 - DNA, 25 bp, Homo sapien
tccttgaactctttgtctgaaagtc

SEQ ID NO: 99300 - DNA, 25 bp, Homo sapien
tccttgaagataggataatggatga

SEQ ID NO: 99301 - DNA, 25 bp, Homo sapien
tccttgaagatgggataatggatga

SEQ ID NO: 99302 - DNA, 25 bp, Homo sapien
tccttgacacgctaccgctagacca

SEQ ID NO: 99303 - DNA, 25 bp, Homo sapien
tccttgacatgctaccgctagacca

SEQ ID NO: 99304 - DNA, 25 bp, Homo sapien
tccttgacctagaaccaaagctagg

SEQ ID NO: 99305 - DNA, 25 bp, Homo sapien
tccttgacctagaatcaaagctagg

SEQ ID NO: 99306 - DNA, 25 bp, Homo sapien
tccttgacgtcactggctacaggct

SEQ ID NO: 99307 - DNA, 25 bp, Homo sapien
tccttgacgtcattggctacaggct

SEQ ID NO: 99308 - DNA, 25 bp, Homo sapien
tccttgactctggatttaaagcttt

SEQ ID NO: 99309 - DNA, 25 bp, Homo sapien
tccttgactttggatttaaagcttt

SEQ ID NO: 99310 - DNA, 25 bp, Homo sapien
tccttgagcacagtaaggagagtaa

SEQ ID NO: 99311 - DNA, 25 bp, Homo sapien
tccttgagcacggtaaggagagtaa

SEQ ID NO: 99312 - DNA, 25 bp, Homo sapien
tccttgagtgactgacctctcttag

SEQ ID NO: 99313 - DNA, 25 bp, Homo sapien
tccttgagtgattgacctctcttag

SEQ ID NO: 99314 - DNA, 25 bp, Homo sapien
tccttgattagattcagataatttt

SEQ ID NO: 99315 - DNA, 25 bp, Homo sapien
tccttgattagattcatataatttt

SEQ ID NO: 99316 - DNA, 25 bp, Homo sapien
tccttgatttctcttgcgtctgcag

SEQ ID NO: 99317 - DNA, 25 bp, Homo sapien
tccttgatttctcttgtgtctgcag

SEQ ID NO: 99318 - DNA, 25 bp, Homo sapien
tccttgccacggaatttgctggcgg

SEQ ID NO: 99319 - DNA, 25 bp, Homo sapien
tccttgccatggaatttgctggcgg

SEQ ID NO: 99320 - DNA, 25 bp, Homo sapien
tccttgcctgactaaaacgtgaaaa

SEQ ID NO: 99321 - DNA, 25 bp, Homo sapien
tccttgcctgacttaaacgtgaaaa

SEQ ID NO: 99322 - DNA, 25 bp, Homo sapien
tccttgctcatctcagatctgccag

SEQ ID NO: 99323 - DNA, 25 bp, Homo sapien
tccttgctcgtctcagatctgccag

SEQ ID NO: 99324 - DNA, 25 bp, Homo sapien
tccttggacagatcatataatctct

SEQ ID NO: 99325 - DNA, 25 bp, Homo sapien
tccttggacagatcgtataatctct

SEQ ID NO: 99326 - DNA, 25 bp, Homo sapien
tccttggattgactaagtgtttatg

SEQ ID NO: 99327 - DNA, 25 bp, Homo sapien
tccttggattgactgagtgtttatg

SEQ ID NO: 99328 - DNA, 25 bp, Homo sapien
tccttggcaagagttcactgcagat

SEQ ID NO: 99329 - DNA, 25 bp, Homo sapien
tccttggccgccggacagggcataa

SEQ ID NO: 99330 - DNA, 25 bp, Homo sapien
tccttggcgagagttcactgcagat

SEQ ID NO: 99331 - DNA, 25 bp, Homo sapien
tccttggctgccggacagggcataa

SEQ ID NO: 99332 - DNA, 25 bp, Homo sapien
tccttggtgcttatgcatggagaga

SEQ ID NO: 99333 - DNA, 25 bp, Homo sapien
tccttggtgcttatgcttggagaga

SEQ ID NO: 99334 - DNA, 25 bp, Homo sapien
tccttgtcaacaaaatggatgttaa

SEQ ID NO: 99335 - DNA, 25 bp, Homo sapien
tccttgtcgacaaaatggatgttaa

SEQ ID NO: 99336 - DNA, 25 bp, Homo sapien
tccttgttctcttggcaagttcata

SEQ ID NO: 99337 - DNA, 25 bp, Homo sapien
tccttgttctcttggccagttcata

SEQ ID NO: 99338 - DNA, 25 bp, Homo sapien
tccttgttttatgaatggaaactag

SEQ ID NO: 99339 - DNA, 25 bp, Homo sapien
tccttgttttattaatggaaactag

SEQ ID NO: 99340 - DNA, 25 bp, Homo sapien
tcctttaaactcagaatttataact

SEQ ID NO: 99341 - DNA, 25 bp, Homo sapien
tcctttaaactcggaatttataact

SEQ ID NO: 99342 - DNA, 25 bp, Homo sapien
tcctttaaatcacgaaaagcccact

SEQ ID NO: 99343 - DNA, 25 bp, Homo sapien
tcctttaaatcatgaaaagcccact

SEQ ID NO: 99344 - DNA, 25 bp, Homo sapien
tcctttaatgcaatgggtttccttc

SEQ ID NO: 99345 - DNA, 25 bp, Homo sapien
tcctttaatgcagtgggtttccttc

SEQ ID NO: 99346 - DNA, 25 bp, Homo sapien
tcctttacaatgtggccatcttcag

SEQ ID NO: 99347 - DNA, 25 bp, Homo sapien
tcctttaccatgtggccatcttcag

SEQ ID NO: 99348 - DNA, 25 bp, Homo sapien
tcctttactatcctcttagtcttct

SEQ ID NO: 99349 - DNA, 25 bp, Homo sapien
tcctttactattctcttagtcttct

SEQ ID NO: 99350 - DNA, 25 bp, Homo sapien
tcctttagggcaagcaccatctctg

SEQ ID NO: 99351 - DNA, 25 bp, Homo sapien
tcctttagggcaggcaccatctctg

SEQ ID NO: 99352 - DNA, 25 bp, Homo sapien
tcctttatcagccttttaatgtctg

SEQ ID NO: 99353 - DNA, 25 bp, Homo sapien
tcctttatgtccttttctctgaatg

SEQ ID NO: 99354 - DNA, 25 bp, Homo sapien
tcctttatgtctttttctctgaatg

SEQ ID NO: 99355 - DNA, 25 bp, Homo sapien
tcctttattagccttttaatgtctg

SEQ ID NO: 99356 - DNA, 25 bp, Homo sapien
tcctttattccatattaaaacattt

SEQ ID NO: 99357 - DNA, 25 bp, Homo sapien
tcctttattccgtattaaaacattt

SEQ ID NO: 99358 - DNA, 25 bp, Homo sapien
tcctttatttcccaatcttatagac

SEQ ID NO: 99359 - DNA, 25 bp, Homo sapien
tcctttatttcccaatgttatagac

SEQ ID NO: 99360 - DNA, 25 bp, Homo sapien
tcctttcacattttgacacacaaaa

SEQ ID NO: 99361 - DNA, 25 bp, Homo sapien
tcctttcacctgcgcagtcacaccc

SEQ ID NO: 99362 - DNA, 25 bp, Homo sapien
tcctttcacctgggcagtcacaccc

SEQ ID NO: 99363 - DNA, 25 bp, Homo sapien
tcctttcaccttttgacacacaaaa

SEQ ID NO: 99364 - DNA, 25 bp, Homo sapien
tcctttcattcaccagttttgaaac

SEQ ID NO: 99365 - DNA, 25 bp, Homo sapien
tcctttcattcgccagttttgaaac

SEQ ID NO: 99366 - DNA, 25 bp, Homo sapien
tcctttccaatagagtgagcagttg

SEQ ID NO: 99367 - DNA, 25 bp, Homo sapien
tcctttccaatggagtgagcagttg

SEQ ID NO: 99368 - DNA, 25 bp, Homo sapien
tcctttccacaaattaccatgcata

SEQ ID NO: 99369 - DNA, 25 bp, Homo sapien
tcctttccataaattaccatgcata

SEQ ID NO: 99370 - DNA, 25 bp, Homo sapien
tcctttcctctcgttctaatggcaa

SEQ ID NO: 99371 - DNA, 25 bp, Homo sapien
tcctttcctctctttctaatggcaa

SEQ ID NO: 99372 - DNA, 25 bp, Homo sapien
tcctttcctggaatctgtctgaagt

SEQ ID NO: 99373 - DNA, 25 bp, Homo sapien
tcctttcctgggatctgtctgaagt

SEQ ID NO: 99374 - DNA, 25 bp, Homo sapien
tcctttctcagccgtcttctacctc

SEQ ID NO: 99375 - DNA, 25 bp, Homo sapien
tcctttctcagtcgtcttctacctc

SEQ ID NO: 99376 - DNA, 25 bp, Homo sapien
tcctttctctcatagtcagggttct

SEQ ID NO: 99377 - DNA, 25 bp, Homo sapien
tcctttctctcgtagtcagggttct

SEQ ID NO: 99378 - DNA, 25 bp, Homo sapien
tcctttctgcacatgtctgagttgt

SEQ ID NO: 99379 - DNA, 25 bp, Homo sapien
tcctttctgcacgtgtctgagttgt

SEQ ID NO: 99380 - DNA, 25 bp, Homo sapien
tcctttcttattataccacatgcaa

SEQ ID NO: 99381 - DNA, 25 bp, Homo sapien
tcctttcttgttataccacatgcaa

SEQ ID NO: 99382 - DNA, 25 bp, Homo sapien
tcctttgaaatacaagaagtttgtc

SEQ ID NO: 99383 - DNA, 25 bp, Homo sapien
tcctttgaaatataagaagtttgtc

SEQ ID NO: 99384 - DNA, 25 bp, Homo sapien
tcctttgacctaggattatcttctc

SEQ ID NO: 99385 - DNA, 25 bp, Homo sapien
tcctttgaccttctatttgggccga

SEQ ID NO: 99386 - DNA, 25 bp, Homo sapien
tcctttgacgttctatttgggccga

SEQ ID NO: 99387 - DNA, 25 bp, Homo sapien
tcctttgatctaggattatcttctc

SEQ ID NO: 99388 - DNA, 25 bp, Homo sapien
tcctttgatgtagaaattatggagt

SEQ ID NO: 99389 - DNA, 25 bp, Homo sapien
tcctttgatgtagcaattatggagt

SEQ ID NO: 99390 - DNA, 25 bp, Homo sapien
tcctttgctcatcttaaaatctggt

SEQ ID NO: 99391 - DNA, 25 bp, Homo sapien
tcctttgctcattttaaaatctggt

SEQ ID NO: 99392 - DNA, 25 bp, Homo sapien
tcctttgggaaaccttccatccctt

SEQ ID NO: 99393 - DNA, 25 bp, Homo sapien
tcctttgggaaacgttccatccctt

SEQ ID NO: 99394 - DNA, 25 bp, Homo sapien
tccttttaagttttttgatatacgt

SEQ ID NO: 99395 - DNA, 25 bp, Homo sapien
tccttttaattgcttatagtgtggt

SEQ ID NO: 99396 - DNA, 25 bp, Homo sapien
tccttttacaaacttacagaaactg

SEQ ID NO: 99397 - DNA, 25 bp, Homo sapien
tccttttacaaatttacagaaactg

SEQ ID NO: 99398 - DNA, 25 bp, Homo sapien
tccttttacgttttttgatatacgt

SEQ ID NO: 99399 - DNA, 25 bp, Homo sapien
tccttttagagtaaagcaggtaaac

SEQ ID NO: 99400 - DNA, 25 bp, Homo sapien
tccttttagagtgaagcaggtaaac

SEQ ID NO: 99401 - DNA, 25 bp, Homo sapien
tccttttatttgcttatagtgtggt

SEQ ID NO: 99402 - DNA, 25 bp, Homo sapien
tccttttcccaatttgcgtttttat

SEQ ID NO: 99403 - DNA, 25 bp, Homo sapien
tccttttcccaatttgtgtttttat

SEQ ID NO: 99404 - DNA, 25 bp, Homo sapien
tccttttctaccatacgtcacaaac

SEQ ID NO: 99405 - DNA, 25 bp, Homo sapien
tccttttctaccatgcgtcacaaac

SEQ ID NO: 99406 - DNA, 25 bp, Homo sapien
tccttttgaagtagatgtttatcag

SEQ ID NO: 99407 - DNA, 25 bp, Homo sapien
tccttttgaggtagatgtttatcag

SEQ ID NO: 99408 - DNA, 25 bp, Homo sapien
tccttttgagttcttggcattgatt

SEQ ID NO: 99409 - DNA, 25 bp, Homo sapien
tccttttgcagcaaagcctttccca

SEQ ID NO: 99410 - DNA, 25 bp, Homo sapien
tccttttgcagcagagcctttccca

SEQ ID NO: 99411 - DNA, 25 bp, Homo sapien
tccttttgtcaagagacacttacaa

SEQ ID NO: 99412 - DNA, 25 bp, Homo sapien
tccttttgtcaagagatacttacaa

SEQ ID NO: 99413 - DNA, 25 bp, Homo sapien
tccttttgtgttcttggcattgatt

SEQ ID NO: 99414 - DNA, 25 bp, Homo sapien
tcctttttatccagttgttctcaag

SEQ ID NO: 99415 - DNA, 25 bp, Homo sapien
tcctttttatccggttgttctcaag

SEQ ID NO: 99416 - DNA, 25 bp, Homo sapien
tcctttttcctatccttgctgctgg

SEQ ID NO: 99417 - DNA, 25 bp, Homo sapien
tcctttttcttatccttgctgctgg

SEQ ID NO: 99418 - DNA, 25 bp, Homo sapien
tcctttttgttccattggtctgtat

SEQ ID NO: 99419 - DNA, 25 bp, Homo sapien
tcctttttgttccgttggtctgtat

SEQ ID NO: 99420 - DNA, 25 bp, Homo sapien
tccttttttaacacttaataagcag

SEQ ID NO: 99421 - DNA, 25 bp, Homo sapien
tccttttttaacatttaataagcag

SEQ ID NO: 99422 - DNA, 25 bp, Homo sapien
tcgaaactcccacatgtccttcttt

SEQ ID NO: 99423 - DNA, 25 bp, Homo sapien
tcgaaactcccacgtgtccttcttt

SEQ ID NO: 99424 - DNA, 25 bp, Homo sapien
tcgaaatgcaatacatttggaactg

SEQ ID NO: 99425 - DNA, 25 bp, Homo sapien
tcgaaatgcaatccatttggaactg

SEQ ID NO: 99426 - DNA, 25 bp, Homo sapien
tcgaacttacctcatatttgtgtta

SEQ ID NO: 99427 - DNA, 25 bp, Homo sapien
tcgaacttacctcttatttgtgtta

SEQ ID NO: 99428 - DNA, 25 bp, Homo sapien
tcgaacttggccttccaggtggaga

SEQ ID NO: 99429 - DNA, 25 bp, Homo sapien
tcgaacttggcctttcaggtggaga

SEQ ID NO: 99430 - DNA, 25 bp, Homo sapien
tcgaagagcaacatcagacctgcta

SEQ ID NO: 99431 - DNA, 25 bp, Homo sapien
tcgaagaggaacatcagacctgcta

SEQ ID NO: 99432 - DNA, 25 bp, Homo sapien
tcgaagctgaacagcagcaggggtg

SEQ ID NO: 99433 - DNA, 25 bp, Homo sapien
tcgaagctgaacggcagcaggggtg

SEQ ID NO: 99434 - DNA, 25 bp, Homo sapien
tcgaagtctgattatcctgagcagg

SEQ ID NO: 99435 - DNA, 25 bp, Homo sapien
tcgaagtctgattgtcctgagcagg

SEQ ID NO: 99436 - DNA, 25 bp, Homo sapien
tcgaatgacccatctcaacatgttt

SEQ ID NO: 99437 - DNA, 25 bp, Homo sapien
tcgaatgacccatctctacatgttt

SEQ ID NO: 99438 - DNA, 25 bp, Homo sapien
tcgaatgtttggcatggtgctagtt

SEQ ID NO: 99439 - DNA, 25 bp, Homo sapien
tcgaatgtttggcgtggtgctagtt

SEQ ID NO: 99440 - DNA, 25 bp, Homo sapien
tcgacaaggccattgaaccagacag

SEQ ID NO: 99441 - DNA, 25 bp, Homo sapien
tcgacaaggccattgacccagacag

SEQ ID NO: 99442 - DNA, 25 bp, Homo sapien
tcgacagttttacacaacattctga

SEQ ID NO: 99443 - DNA, 25 bp, Homo sapien
tcgacagttttacagaacattctga

SEQ ID NO: 99444 - DNA, 25 bp, Homo sapien
tcgaccatttaatatacaactccca

SEQ ID NO: 99445 - DNA, 25 bp, Homo sapien
tcgaccatttaatgtacaactccca

SEQ ID NO: 99446 - DNA, 25 bp, Homo sapien
tcgaccattttaacacatgatataa

SEQ ID NO: 99447 - DNA, 25 bp, Homo sapien
tcgaccattttaacgcatgatataa

SEQ ID NO: 99448 - DNA, 25 bp, Homo sapien
tcgacctctacgtcagcagttccat

SEQ ID NO: 99449 - DNA, 25 bp, Homo sapien
tcgacctctacgttagcagttccat

SEQ ID NO: 99450 - DNA, 25 bp, Homo sapien
tcgacttttcctgtgagcttgcatt

SEQ ID NO: 99451 - DNA, 25 bp, Homo sapien
tcgacttttcctgtgatcttgcatt

SEQ ID NO: 99452 - DNA, 25 bp, Homo sapien
tcgagaaccacagcactagagaagg

SEQ ID NO: 99453 - DNA, 25 bp, Homo sapien
tcgagaaccacggcactagagaagg

SEQ ID NO: 99454 - DNA, 25 bp, Homo sapien
tcgagaagagtaattccaagacacg

SEQ ID NO: 99455 - DNA, 25 bp, Homo sapien
tcgagaagagtgattccaagacacg

SEQ ID NO: 99456 - DNA, 25 bp, Homo sapien
tcgagatgatatcttgattttcaag

SEQ ID NO: 99457 - DNA, 25 bp, Homo sapien
tcgagatgatattttgattttcaag

SEQ ID NO: 99458 - DNA, 25 bp, Homo sapien
tcgagcagatacttataggaaagag

SEQ ID NO: 99459 - DNA, 25 bp, Homo sapien
tcgagcagatacttctaggaaagag

SEQ ID NO: 99460 - DNA, 25 bp, Homo sapien
tcgaggctgtcagaccatgagagga

SEQ ID NO: 99461 - DNA, 25 bp, Homo sapien
tcgaggctgtcaggccatgagagga

SEQ ID NO: 99462 - DNA, 25 bp, Homo sapien
tcgagggaccttctatcgcccatgt

SEQ ID NO: 99463 - DNA, 25 bp, Homo sapien
tcgagggaccttctgtcgcccatgt

SEQ ID NO: 99464 - DNA, 25 bp, Homo sapien
tcgagttctcgtcatgagcccataa

SEQ ID NO: 99465 - DNA, 25 bp, Homo sapien
tcgagttcttgtcatgagcccataa

SEQ ID NO: 99466 - DNA, 25 bp, Homo sapien
tcgagttgtctggtcactttagtga

SEQ ID NO: 99467 - DNA, 25 bp, Homo sapien
tcgagttgtctgttcactttagtga

SEQ ID NO: 99468 - DNA, 25 bp, Homo sapien
tcgagtttgactttgaaatgtgctc

SEQ ID NO: 99469 - DNA, 25 bp, Homo sapien
tcgagttttactttgaaatgtgctc

SEQ ID NO: 99470 - DNA, 25 bp, Homo sapien
tcgatatggatcacatgggtataat

SEQ ID NO: 99471 - DNA, 25 bp, Homo sapien
tcgatatggatcacgtgggtataat

SEQ ID NO: 99472 - DNA, 25 bp, Homo sapien
tcgatccaatcgccctaaagaatga

SEQ ID NO: 99473 - DNA, 25 bp, Homo sapien
tcgatccaatcgccttaaagaatga

SEQ ID NO: 99474 - DNA, 25 bp, Homo sapien
tcgatctggctgacttctcttcaag

SEQ ID NO: 99475 - DNA, 25 bp, Homo sapien
tcgatctggctgccttctcttcaag

SEQ ID NO: 99476 - DNA, 25 bp, Homo sapien
tcgatgaaaaaaatcataaactcat

SEQ ID NO: 99477 - DNA, 25 bp, Homo sapien
tcgatgaaaaaaatgataaactcat

SEQ ID NO: 99478 - DNA, 25 bp, Homo sapien
tcgattcctctacgtaaatcttcac

SEQ ID NO: 99479 - DNA, 25 bp, Homo sapien
tcgattcctctatgtaaatcttcac

SEQ ID NO: 99480 - DNA, 25 bp, Homo sapien
tcgcaaagccacagacactgtaacc

SEQ ID NO: 99481 - DNA, 25 bp, Homo sapien
tcgcaaagccacaggcactgtaacc

SEQ ID NO: 99482 - DNA, 25 bp, Homo sapien
tcgcagtgaaccaaaatagggccac

SEQ ID NO: 99483 - DNA, 25 bp, Homo sapien
tcgcagtgaaccgaaatagggccac

SEQ ID NO: 99484 - DNA, 25 bp, Homo sapien
tcgcccacagtggtcacatgatcag

SEQ ID NO: 99485 - DNA, 25 bp, Homo sapien
tcgcccacggtggtcacatgatcag

SEQ ID NO: 99486 - DNA, 25 bp, Homo sapien
tcgccctttaccaagcaagccaacc

SEQ ID NO: 99487 - DNA, 25 bp, Homo sapien
tcgccctttaccgagcaagccaacc

SEQ ID NO: 99488 - DNA, 25 bp, Homo sapien
tcgcctgtcaccatgttctttggct

SEQ ID NO: 99489 - DNA, 25 bp, Homo sapien
tcgcctgtcaccgtgttctttggct

SEQ ID NO: 99490 - DNA, 25 bp, Homo sapien
tcgccttgatttaccaggaaattac

SEQ ID NO: 99491 - DNA, 25 bp, Homo sapien
tcgccttgatttactaggaaattac

SEQ ID NO: 99492 - DNA, 25 bp, Homo sapien
tcgctattattcaatgtggcaaaaa

SEQ ID NO: 99493 - DNA, 25 bp, Homo sapien
tcgctattgttcaatgtggcaaaaa

SEQ ID NO: 99494 - DNA, 25 bp, Homo sapien
tcgctattgtttttaacatgtcctc

SEQ ID NO: 99495 - DNA, 25 bp, Homo sapien
tcgctattttttttaacatgtcctc

SEQ ID NO: 99496 - DNA, 25 bp, Homo sapien
tcgctctccttttactcggtgactc

SEQ ID NO: 99497 - DNA, 25 bp, Homo sapien
tcgctctccttttacttggtgactc

SEQ ID NO: 99498 - DNA, 25 bp, Homo sapien
tcgctgagtcacaggggcaggcgtg

SEQ ID NO: 99499 - DNA, 25 bp, Homo sapien
tcgctgagtcacgggggcaggcgtg

SEQ ID NO: 99500 - DNA, 25 bp, Homo sapien
tcgctgatattaaatgcagactctg

SEQ ID NO: 99501 - DNA, 25 bp, Homo sapien
tcgctgatattaaatgtagactctg

SEQ ID NO: 99502 - DNA, 25 bp, Homo sapien
tcgctggacaacgaaacactgcagc

SEQ ID NO: 99503 - DNA, 25 bp, Homo sapien
tcgctggacaatgaaacactgcagc

SEQ ID NO: 99504 - DNA, 25 bp, Homo sapien
tcgctggcatgttgctggcagggtt

SEQ ID NO: 99505 - DNA, 25 bp, Homo sapien
tcgctggcgtgttgctggcagggtt

SEQ ID NO: 99506 - DNA, 25 bp, Homo sapien
tcgctgttattaatgtactccgtgg

SEQ ID NO: 99507 - DNA, 25 bp, Homo sapien
tcgctgttattagtgtactccgtgg

SEQ ID NO: 99508 - DNA, 25 bp, Homo sapien
tcgcttaattcaggaggcagaggtt

SEQ ID NO: 99509 - DNA, 25 bp, Homo sapien
tcgcttaattcgggaggcagaggtt

SEQ ID NO: 99510 - DNA, 25 bp, Homo sapien
tcgcttctatcatattctgagtctc

SEQ ID NO: 99511 - DNA, 25 bp, Homo sapien
tcgcttctatcatgttctgagtctc

SEQ ID NO: 99512 - DNA, 25 bp, Homo sapien
tcggagaaccaccaatgcacaggat

SEQ ID NO: 99513 - DNA, 25 bp, Homo sapien
tcggagaaccaccgatgcacaggat

SEQ ID NO: 99514 - DNA, 25 bp, Homo sapien
tcggagacaatttgtaggtgcaggg

SEQ ID NO: 99515 - DNA, 25 bp, Homo sapien
tcggagactatttgtaggtgcaggg

SEQ ID NO: 99516 - DNA, 25 bp, Homo sapien
tcggatccacgctgccatcgtgttc

SEQ ID NO: 99517 - DNA, 25 bp, Homo sapien
tcggatccacgctgccgtcgtgttc

SEQ ID NO: 99518 - DNA, 25 bp, Homo sapien
tcggattgaggtctcaatatctggg

SEQ ID NO: 99519 - DNA, 25 bp, Homo sapien
tcggattgaggtttcaatatctggg

SEQ ID NO: 99520 - DNA, 25 bp, Homo sapien
tcggcattaagcactgaagagaaag

SEQ ID NO: 99521 - DNA, 25 bp, Homo sapien
tcggcattaagcgctgaagagaaag

SEQ ID NO: 99522 - DNA, 25 bp, Homo sapien
tcggccagatttaatccaaataaac

SEQ ID NO: 99523 - DNA, 25 bp, Homo sapien
tcggccagatttgatccaaataaac

SEQ ID NO: 99524 - DNA, 25 bp, Homo sapien
tcggctaaagtccacgagggccacg

SEQ ID NO: 99525 - DNA, 25 bp, Homo sapien
tcggctaaagtctacgagggccacg

SEQ ID NO: 99526 - DNA, 25 bp, Homo sapien
tcggctgaccctgcctctgaccctt

SEQ ID NO: 99527 - DNA, 25 bp, Homo sapien
tcggctgaccctgcttctgaccctt

SEQ ID NO: 99528 - DNA, 25 bp, Homo sapien
tcggctgagataaaacaaggccaat

SEQ ID NO: 99529 - DNA, 25 bp, Homo sapien
tcggctgaggtaaaacaaggccaat

SEQ ID NO: 99530 - DNA, 25 bp, Homo sapien
tcggcttatctaatacgttgggtgg

SEQ ID NO: 99531 - DNA, 25 bp, Homo sapien
tcggcttatctaatgcgttgggtgg

SEQ ID NO: 99532 - DNA, 25 bp, Homo sapien
tcgggacaattgtgaaagtcttcaa

SEQ ID NO: 99533 - DNA, 25 bp, Homo sapien
tcgggacagttgtgaaagtcttcaa

SEQ ID NO: 99534 - DNA, 25 bp, Homo sapien
tcgggcgggcagaaatacttgtctc

SEQ ID NO: 99535 - DNA, 25 bp, Homo sapien
tcgggcgggcaggaatacttgtctc

SEQ ID NO: 99536 - DNA, 25 bp, Homo sapien
tcgggtaaatgattcttctctaaag

SEQ ID NO: 99537 - DNA, 25 bp, Homo sapien
tcgggtaagtgattcttctctaaag

SEQ ID NO: 99538 - DNA, 25 bp, Homo sapien
tcgggtgaaggacaattatttttta

SEQ ID NO: 99539 - DNA, 25 bp, Homo sapien
tcgggtgaaggacgattatttttta

SEQ ID NO: 99540 - DNA, 25 bp, Homo sapien
tcgggtttgctgaaaattcaggagg

SEQ ID NO: 99541 - DNA, 25 bp, Homo sapien
tcgggtttgctgaacattcaggagg

SEQ ID NO: 99542 - DNA, 25 bp, Homo sapien
tcggtcatgaaacagcccaaggcag

SEQ ID NO: 99543 - DNA, 25 bp, Homo sapien
tcggtcatgaaagagcccaaggcag

SEQ ID NO: 99544 - DNA, 25 bp, Homo sapien
tcggtctacatctgatcctaagggt

SEQ ID NO: 99545 - DNA, 25 bp, Homo sapien
tcggtctacatgtgatcctaagggt

SEQ ID NO: 99546 - DNA, 25 bp, Homo sapien
tcggtgcaaatataacaatagattt

SEQ ID NO: 99547 - DNA, 25 bp, Homo sapien
tcggtgcaaatatgacaatagattt

SEQ ID NO: 99548 - DNA, 25 bp, Homo sapien
tcggtggccgacctattcctggcta

SEQ ID NO: 99549 - DNA, 25 bp, Homo sapien
tcggtggccgacgtattcctggcta

SEQ ID NO: 99550 - DNA, 25 bp, Homo sapien
tcggtgtatatcaaattttcctggg

SEQ ID NO: 99551 - DNA, 25 bp, Homo sapien
tcggtgtatttcaaattttcctggg

SEQ ID NO: 99552 - DNA, 25 bp, Homo sapien
tcggtgttggtcacgcccaagacaa

SEQ ID NO: 99553 - DNA, 25 bp, Homo sapien
tcggtgttggtcatgcccaagacaa

SEQ ID NO: 99554 - DNA, 25 bp, Homo sapien
tcggtgtttattgtccatctcctct

SEQ ID NO: 99555 - DNA, 25 bp, Homo sapien
tcggtgtttattgtccgtctcctct

SEQ ID NO: 99556 - DNA, 25 bp, Homo sapien
tcggttgtagacataacatgcttat

SEQ ID NO: 99557 - DNA, 25 bp, Homo sapien
tcggttgtagacataatatgcttat

SEQ ID NO: 99558 - DNA, 25 bp, Homo sapien
tcggtttgcaaaataaatttggtct

SEQ ID NO: 99559 - DNA, 25 bp, Homo sapien
tcggtttgcaaaataagtttggtct

SEQ ID NO: 99560 - DNA, 25 bp, Homo sapien
tcgtaaccccgtctggacgtatttt

SEQ ID NO: 99561 - DNA, 25 bp, Homo sapien
tcgtaaccctgtctggacgtatttt

SEQ ID NO: 99562 - DNA, 25 bp, Homo sapien
tcgtaagtgctcaaattcagattgg

SEQ ID NO: 99563 - DNA, 25 bp, Homo sapien
tcgtaagtgttcaaattcagattgg

SEQ ID NO: 99564 - DNA, 25 bp, Homo sapien
tcgtactaaatagcttacatttcag

SEQ ID NO: 99565 - DNA, 25 bp, Homo sapien
tcgtactaaatagcttgcatttcag

SEQ ID NO: 99566 - DNA, 25 bp, Homo sapien
tcgtaggtatcaacatattttatct

SEQ ID NO: 99567 - DNA, 25 bp, Homo sapien
tcgtaggtatcaacgtattttatct

SEQ ID NO: 99568 - DNA, 25 bp, Homo sapien
tcgtagtgatttttgcctcctactt

SEQ ID NO: 99569 - DNA, 25 bp, Homo sapien
tcgtagtgatttttgcttcctactt

SEQ ID NO: 99570 - DNA, 25 bp, Homo sapien
tcgtataccctgtgatgaaaactag

SEQ ID NO: 99571 - DNA, 25 bp, Homo sapien
tcgtataccttgtgatgaaaactag

SEQ ID NO: 99572 - DNA, 25 bp, Homo sapien
tcgtataggagagccactatgtagg

SEQ ID NO: 99573 - DNA, 25 bp, Homo sapien
tcgtataggagagccattatgtagg

SEQ ID NO: 99574 - DNA, 25 bp, Homo sapien
tcgtatgactttcggttctttttta

SEQ ID NO: 99575 - DNA, 25 bp, Homo sapien
tcgtatgacttttggttctttttta

SEQ ID NO: 99576 - DNA, 25 bp, Homo sapien
tcgtatgttctatgaagagccacac

SEQ ID NO: 99577 - DNA, 25 bp, Homo sapien
tcgtatgttctgtgaagagccacac

SEQ ID NO: 99578 - DNA, 25 bp, Homo sapien
tcgtcaaagctgaaagcctgtttga

SEQ ID NO: 99579 - DNA, 25 bp, Homo sapien
tcgtcaaagctgaatgcctgtttga

SEQ ID NO: 99580 - DNA, 25 bp, Homo sapien
tcgtcattgtcctatgatgatactt

SEQ ID NO: 99581 - DNA, 25 bp, Homo sapien
tcgtcattgtcctgtgatgatactt

SEQ ID NO: 99582 - DNA, 25 bp, Homo sapien
tcgtccttcaagacttcttcatttt

SEQ ID NO: 99583 - DNA, 25 bp, Homo sapien
tcgtccttcgagacttcttcatttt

SEQ ID NO: 99584 - DNA, 25 bp, Homo sapien
tcgtctataatgtcttgcagcagtg

SEQ ID NO: 99585 - DNA, 25 bp, Homo sapien
tcgtctataatttcttgcagcagtg

SEQ ID NO: 99586 - DNA, 25 bp, Homo sapien
tcgtctcatgccattctcctaactc

SEQ ID NO: 99587 - DNA, 25 bp, Homo sapien
tcgtctcatgccgttctcctaactc

SEQ ID NO: 99588 - DNA, 25 bp, Homo sapien
tcgtctggtagatgaatagaatgca

SEQ ID NO: 99589 - DNA, 25 bp, Homo sapien
tcgtctggtaggtgaatagaatgca

SEQ ID NO: 99590 - DNA, 25 bp, Homo sapien
tcgtgatccgcctgcctggactatc

SEQ ID NO: 99591 - DNA, 25 bp, Homo sapien
tcgtgatccgcgtgcctggactatc

SEQ ID NO: 99592 - DNA, 25 bp, Homo sapien
tcgtgattggagtcacaatgcatag

SEQ ID NO: 99593 - DNA, 25 bp, Homo sapien
tcgtgattggagtcaccatgcatag

SEQ ID NO: 99594 - DNA, 25 bp, Homo sapien
tcgtgcaccgctgacatgcacctgt

SEQ ID NO: 99595 - DNA, 25 bp, Homo sapien
tcgtgcactgctgacatgcacctgt

SEQ ID NO: 99596 - DNA, 25 bp, Homo sapien
tcgtgccaatccatcatgtcaggca

SEQ ID NO: 99597 - DNA, 25 bp, Homo sapien
tcgtgccaatctatcatgtcaggca

SEQ ID NO: 99598 - DNA, 25 bp, Homo sapien
tcgtggaaacaagaaattcaactaa

SEQ ID NO: 99599 - DNA, 25 bp, Homo sapien
tcgtggaaataagaaattcaactaa

SEQ ID NO: 99600 - DNA, 25 bp, Homo sapien
tcgtggagacatgacagagatctgg

SEQ ID NO: 99601 - DNA, 25 bp, Homo sapien
tcgtggagacatgatagagatctgg

SEQ ID NO: 99602 - DNA, 25 bp, Homo sapien
tcgtggcagtgatataacacaattt

SEQ ID NO: 99603 - DNA, 25 bp, Homo sapien
tcgtggcagtgatataccacaattt

SEQ ID NO: 99604 - DNA, 25 bp, Homo sapien
tcgtggccaaattagatcacatcaa

SEQ ID NO: 99605 - DNA, 25 bp, Homo sapien
tcgtggcctaattagatcacatcaa

SEQ ID NO: 99606 - DNA, 25 bp, Homo sapien
tcgtgtaatgtctcatggcttttaa

SEQ ID NO: 99607 - DNA, 25 bp, Homo sapien
tcgtgtaatgtcttatggcttttaa

SEQ ID NO: 99608 - DNA, 25 bp, Homo sapien
tcgtgtcaaaaacagcacaccagtg

SEQ ID NO: 99609 - DNA, 25 bp, Homo sapien
tcgtgtcaaaaatagcacaccagtg

SEQ ID NO: 99610 - DNA, 25 bp, Homo sapien
tcgtgtggtgaccctgaccctaaga

SEQ ID NO: 99611 - DNA, 25 bp, Homo sapien
tcgtgtggtgactctgaccctaaga

SEQ ID NO: 99612 - DNA, 25 bp, Homo sapien
tcgtgtgtttgtacatgtatcttgt

SEQ ID NO: 99613 - DNA, 25 bp, Homo sapien
tcgtgtgtttgtacgtgtatcttgt

SEQ ID NO: 99614 - DNA, 25 bp, Homo sapien
tcgttaagaccatcatcatctctca

SEQ ID NO: 99615 - DNA, 25 bp, Homo sapien
tcgttaagaccatcgtcatctctca

SEQ ID NO: 99616 - DNA, 25 bp, Homo sapien
tcgttatccatgactgcttttaaca

SEQ ID NO: 99617 - DNA, 25 bp, Homo sapien
tcgttatctatgactgcttttaaca

SEQ ID NO: 99618 - DNA, 25 bp, Homo sapien
tcgttcagtcgaggccagtttggac

SEQ ID NO: 99619 - DNA, 25 bp, Homo sapien
tcgttcagtcgatgccagtttggac

SEQ ID NO: 99620 - DNA, 25 bp, Homo sapien
tcgttgaaacacaatagcattacaa

SEQ ID NO: 99621 - DNA, 25 bp, Homo sapien
tcgttgaaacacagtagcattacaa

SEQ ID NO: 99622 - DNA, 25 bp, Homo sapien
tcgttgaatttccaacatctcactt

SEQ ID NO: 99623 - DNA, 25 bp, Homo sapien
tcgttgaatttgcaacatctcactt

SEQ ID NO: 99624 - DNA, 25 bp, Homo sapien
tcgttgatgtttcacaagactgctc

SEQ ID NO: 99625 - DNA, 25 bp, Homo sapien
tcgttgatgtttcacacgactgctc

SEQ ID NO: 99626 - DNA, 25 bp, Homo sapien
tcgtttctggatttttccataatcg

SEQ ID NO: 99627 - DNA, 25 bp, Homo sapien
tcgtttctggattttttcataatcg

SEQ ID NO: 99628 - DNA, 25 bp, Homo sapien
tcgtttggaattatcttctagtata

SEQ ID NO: 99629 - DNA, 25 bp, Homo sapien
tcgtttggaattctcttctagtata

SEQ ID NO: 99630 - DNA, 25 bp, Homo sapien
tcgtttgtgcccacagtaactccct

SEQ ID NO: 99631 - DNA, 25 bp, Homo sapien
tcgtttgtgcccaccgtaactccct

SEQ ID NO: 99632 - DNA, 25 bp, Homo sapien
tctaaaaaaaccctgaaatctgaaa

SEQ ID NO: 99633 - DNA, 25 bp, Homo sapien
tctaaaaaacccctgaaatctgaaa

SEQ ID NO: 99634 - DNA, 25 bp, Homo sapien
tctaaaaagctatattcctacattt

SEQ ID NO: 99635 - DNA, 25 bp, Homo sapien
tctaaaaagctatatttctacattt

SEQ ID NO: 99636 - DNA, 25 bp, Homo sapien
tctaaaacagatgaagattaagctg

SEQ ID NO: 99637 - DNA, 25 bp, Homo sapien
tctaaaacggatgaagattaagctg

SEQ ID NO: 99638 - DNA, 25 bp, Homo sapien
tctaaaactctaatctctttccctt

SEQ ID NO: 99639 - DNA, 25 bp, Homo sapien
tctaaaactttaatctctttccctt

SEQ ID NO: 99640 - DNA, 25 bp, Homo sapien
tctaaaagcaataaactcatttgca

SEQ ID NO: 99641 - DNA, 25 bp, Homo sapien
tctaaaagcaataagctcatttgca

SEQ ID NO: 99642 - DNA, 25 bp, Homo sapien
tctaaaagctgctagtactacagag

SEQ ID NO: 99643 - DNA, 25 bp, Homo sapien
tctaaaagctgctggtactacagag

SEQ ID NO: 99644 - DNA, 25 bp, Homo sapien
tctaaaagtcataccttgattttca

SEQ ID NO: 99645 - DNA, 25 bp, Homo sapien
tctaaaagtcatactttgattttca

SEQ ID NO: 99646 - DNA, 25 bp, Homo sapien
tctaaaatagttctctaagttgctc

SEQ ID NO: 99647 - DNA, 25 bp, Homo sapien
tctaaaatagttttctaagttgctc

SEQ ID NO: 99648 - DNA, 25 bp, Homo sapien
tctaaaatggattaccaggatgatt

SEQ ID NO: 99649 - DNA, 25 bp, Homo sapien
tctaaaattagatagtcgttatggc

SEQ ID NO: 99650 - DNA, 25 bp, Homo sapien
tctaaaattagatagtggttatggc

SEQ ID NO: 99651 - DNA, 25 bp, Homo sapien
tctaaaattcactgtgatgtagaac

SEQ ID NO: 99652 - DNA, 25 bp, Homo sapien
tctaaaattgattaccaggatgatt

SEQ ID NO: 99653 - DNA, 25 bp, Homo sapien
tctaaaatttactgtgatgtagaac

SEQ ID NO: 99654 - DNA, 25 bp, Homo sapien
tctaaaatttgttatacgcacaatt

SEQ ID NO: 99655 - DNA, 25 bp, Homo sapien
tctaaaatttgttatatgcacaatt

SEQ ID NO: 99656 - DNA, 25 bp, Homo sapien
tctaaacaacccttccatgtccact

SEQ ID NO: 99657 - DNA, 25 bp, Homo sapien
tctaaacaacctttccatgtccact

SEQ ID NO: 99658 - DNA, 25 bp, Homo sapien
tctaaacacagattatatcctattt

SEQ ID NO: 99659 - DNA, 25 bp, Homo sapien
tctaaacacaggttatatcctattt

SEQ ID NO: 99660 - DNA, 25 bp, Homo sapien
tctaaactcattacgtttaacatgc

SEQ ID NO: 99661 - DNA, 25 bp, Homo sapien
tctaaactcattatgtttaacatgc

SEQ ID NO: 99662 - DNA, 25 bp, Homo sapien
tctaaactgcaagtgacttataatg

SEQ ID NO: 99663 - DNA, 25 bp, Homo sapien
tctaaacttcaagtgacttataatg

SEQ ID NO: 99664 - DNA, 25 bp, Homo sapien
tctaaagaataaagtcatgtaacct

SEQ ID NO: 99665 - DNA, 25 bp, Homo sapien
tctaaagaatcgatctgatttccac

SEQ ID NO: 99666 - DNA, 25 bp, Homo sapien
tctaaagaatctatctgatttccac

SEQ ID NO: 99667 - DNA, 25 bp, Homo sapien
tctaaagaattaatgtacagagcat

SEQ ID NO: 99668 - DNA, 25 bp, Homo sapien
tctaaagactgagcatagggttccc

SEQ ID NO: 99669 - DNA, 25 bp, Homo sapien
tctaaagactgagcgtagggttccc

SEQ ID NO: 99670 - DNA, 25 bp, Homo sapien
tctaaagagtaaagtcatgtaacct

SEQ ID NO: 99671 - DNA, 25 bp, Homo sapien
tctaaagagttaatgtacagagcat

SEQ ID NO: 99672 - DNA, 25 bp, Homo sapien
tctaaagcaataaaaacatacccct

SEQ ID NO: 99673 - DNA, 25 bp, Homo sapien
tctaaagcaatagaaacatacccct

SEQ ID NO: 99674 - DNA, 25 bp, Homo sapien
tctaaagcatgcatacactcacaaa

SEQ ID NO: 99675 - DNA, 25 bp, Homo sapien
tctaaagcatgcgtacactcacaaa

SEQ ID NO: 99676 - DNA, 25 bp, Homo sapien
tctaaaggaaagtactgtgggccat

SEQ ID NO: 99677 - DNA, 25 bp, Homo sapien
tctaaaggaatcaaacaaatccaat

SEQ ID NO: 99678 - DNA, 25 bp, Homo sapien
tctaaaggaatcaaactaatccaat

SEQ ID NO: 99679 - DNA, 25 bp, Homo sapien
tctaaaggcctccaaatcttcaact

SEQ ID NO: 99680 - DNA, 25 bp, Homo sapien
tctaaaggcctccacatcttcaact

SEQ ID NO: 99681 - DNA, 25 bp, Homo sapien
tctaaagggaagtactgtgggccat

SEQ ID NO: 99682 - DNA, 25 bp, Homo sapien
tctaaagggttctagtccaattcac

SEQ ID NO: 99683 - DNA, 25 bp, Homo sapien
tctaaagggttctggtccaattcac

SEQ ID NO: 99684 - DNA, 25 bp, Homo sapien
tctaaagttttgtcggttcaaacta

SEQ ID NO: 99685 - DNA, 25 bp, Homo sapien
tctaaagttttgtctgttcaaacta

SEQ ID NO: 99686 - DNA, 25 bp, Homo sapien
tctaaataaatgtctgcgattaggt

SEQ ID NO: 99687 - DNA, 25 bp, Homo sapien
tctaaataaatgtctgtgattaggt

SEQ ID NO: 99688 - DNA, 25 bp, Homo sapien
tctaaataacttcaccagaacccaa

SEQ ID NO: 99689 - DNA, 25 bp, Homo sapien
tctaaatacttgaagacctgttatg

SEQ ID NO: 99690 - DNA, 25 bp, Homo sapien
tctaaatacttgaggacctgttatg

SEQ ID NO: 99691 - DNA, 25 bp, Homo sapien
tctaaatagcttcaccagaacccaa

SEQ ID NO: 99692 - DNA, 25 bp, Homo sapien
tctaaatgaagaaaatgatttgcct

SEQ ID NO: 99693 - DNA, 25 bp, Homo sapien
tctaaatgaggaaaatgatttgcct

SEQ ID NO: 99694 - DNA, 25 bp, Homo sapien
tctaaatgctgaatagctccccttg

SEQ ID NO: 99695 - DNA, 25 bp, Homo sapien
tctaaatgctgcatagctccccttg

SEQ ID NO: 99696 - DNA, 25 bp, Homo sapien
tctaaatttgccatcaggtagttca

SEQ ID NO: 99697 - DNA, 25 bp, Homo sapien
tctaaatttgccattaggtagttca

SEQ ID NO: 99698 - DNA, 25 bp, Homo sapien
tctaacaaacatgaataaaacctag

SEQ ID NO: 99699 - DNA, 25 bp, Homo sapien
tctaacaaacatgaatgaaacctag

SEQ ID NO: 99700 - DNA, 25 bp, Homo sapien
tctaacacacggcagctgcttacaa

SEQ ID NO: 99701 - DNA, 25 bp, Homo sapien
tctaacacatggcagctgcttacaa

SEQ ID NO: 99702 - DNA, 25 bp, Homo sapien
tctaacactcatttttaaaaaagca

SEQ ID NO: 99703 - DNA, 25 bp, Homo sapien
tctaacactcattttttaaaaagca

SEQ ID NO: 99704 - DNA, 25 bp, Homo sapien
tctaacactgtggcaaaataggtgg

SEQ ID NO: 99705 - DNA, 25 bp, Homo sapien
tctaacactgtggcgaaataggtgg

SEQ ID NO: 99706 - DNA, 25 bp, Homo sapien
tctaacatgttacatacaccatgag

SEQ ID NO: 99707 - DNA, 25 bp, Homo sapien
tctaacatgttacatagaccatgag

SEQ ID NO: 99708 - DNA, 25 bp, Homo sapien
tctaacatttgaaagtgatttgaaa

SEQ ID NO: 99709 - DNA, 25 bp, Homo sapien
tctaacatttgatagtgatttgaaa

SEQ ID NO: 99710 - DNA, 25 bp, Homo sapien
tctaaccacaagatttttttctggt

SEQ ID NO: 99711 - DNA, 25 bp, Homo sapien
tctaaccacaaggtttttttctggt

SEQ ID NO: 99712 - DNA, 25 bp, Homo sapien
tctaaccacatctcctagaattgac

SEQ ID NO: 99713 - DNA, 25 bp, Homo sapien
tctaaccacatctgctagaattgac

SEQ ID NO: 99714 - DNA, 25 bp, Homo sapien
tctaaccatggctgcttttaaggca

SEQ ID NO: 99715 - DNA, 25 bp, Homo sapien
tctaaccatggctgtttttaaggca

SEQ ID NO: 99716 - DNA, 25 bp, Homo sapien
tctaaccattgaccatattggacat

SEQ ID NO: 99717 - DNA, 25 bp, Homo sapien
tctaaccattgaccgtattggacat

SEQ ID NO: 99718 - DNA, 25 bp, Homo sapien
tctaacccacacagagaactgagac

SEQ ID NO: 99719 - DNA, 25 bp, Homo sapien
tctaacccacacagcgaactgagac

SEQ ID NO: 99720 - DNA, 25 bp, Homo sapien
tctaacccagtcattttgtagccca

SEQ ID NO: 99721 - DNA, 25 bp, Homo sapien
tctaacccagtcgttttgtagccca

SEQ ID NO: 99722 - DNA, 25 bp, Homo sapien
tctaacctctggtacctcagaatgt

SEQ ID NO: 99723 - DNA, 25 bp, Homo sapien
tctaacctgtggtacctcagaatgt

SEQ ID NO: 99724 - DNA, 25 bp, Homo sapien
tctaactaagggctatttgtgactc

SEQ ID NO: 99725 - DNA, 25 bp, Homo sapien
tctaactaaggtctatttgtgactc

SEQ ID NO: 99726 - DNA, 25 bp, Homo sapien
tctaactcactacaagtactacagt

SEQ ID NO: 99727 - DNA, 25 bp, Homo sapien
tctaactcactgcaagtactacagt

SEQ ID NO: 99728 - DNA, 25 bp, Homo sapien
tctaactccacatagaaagtatcag

SEQ ID NO: 99729 - DNA, 25 bp, Homo sapien
tctaactccacgtagaaagtatcag

SEQ ID NO: 99730 - DNA, 25 bp, Homo sapien
tctaactctcggcttcactagcaga

SEQ ID NO: 99731 - DNA, 25 bp, Homo sapien
tctaactctgaggtttaagcactct

SEQ ID NO: 99732 - DNA, 25 bp, Homo sapien
tctaactctgaggtttgagcactct

SEQ ID NO: 99733 - DNA, 25 bp, Homo sapien
tctaactcttggcttcactagcaga

SEQ ID NO: 99734 - DNA, 25 bp, Homo sapien
tctaactggcttcgtattgcacttt

SEQ ID NO: 99735 - DNA, 25 bp, Homo sapien
tctaactggctttgtattgcacttt

SEQ ID NO: 99736 - DNA, 25 bp, Homo sapien
tctaactggtgataaagcatcatga

SEQ ID NO: 99737 - DNA, 25 bp, Homo sapien
tctaactggtgatgaagcatcatga

SEQ ID NO: 99738 - DNA, 25 bp, Homo sapien
tctaacttactattcacacatgcta

SEQ ID NO: 99739 - DNA, 25 bp, Homo sapien
tctaacttattattcacacatgcta

SEQ ID NO: 99740 - DNA, 25 bp, Homo sapien
tctaacttattttgttaatagaggc

SEQ ID NO: 99741 - DNA, 25 bp, Homo sapien
tctaacttcttttgttaatagaggc

SEQ ID NO: 99742 - DNA, 25 bp, Homo sapien
tctaagaaagcctgctcttgaatca

SEQ ID NO: 99743 - DNA, 25 bp, Homo sapien
tctaagaaagcctgttcttgaatca

SEQ ID NO: 99744 - DNA, 25 bp, Homo sapien
tctaagaactgtaaatcagaagcaa

SEQ ID NO: 99745 - DNA, 25 bp, Homo sapien
tctaagaagaaacatgtttgaggcc

SEQ ID NO: 99746 - DNA, 25 bp, Homo sapien
tctaagaagaaatatgtttgaggcc

SEQ ID NO: 99747 - DNA, 25 bp, Homo sapien
tctaagaattgtaaatcagaagcaa

SEQ ID NO: 99748 - DNA, 25 bp, Homo sapien
tctaagacaaattaaacctctgact

SEQ ID NO: 99749 - DNA, 25 bp, Homo sapien
tctaagacaaattaaatctctgact

SEQ ID NO: 99750 - DNA, 25 bp, Homo sapien
tctaagacttcagaaagaaacaaac

SEQ ID NO: 99751 - DNA, 25 bp, Homo sapien
tctaagacttcggaaagaaacaaac

SEQ ID NO: 99752 - DNA, 25 bp, Homo sapien
tctaagagaaaaatgattgtgctat

SEQ ID NO: 99753 - DNA, 25 bp, Homo sapien
tctaagagaaacatgattgtgctat

SEQ ID NO: 99754 - DNA, 25 bp, Homo sapien
tctaagatacagggttcaaaggagt

SEQ ID NO: 99755 - DNA, 25 bp, Homo sapien
tctaagatacttctcttttattgtg

SEQ ID NO: 99756 - DNA, 25 bp, Homo sapien
tctaagatacttttcttttattgtg

SEQ ID NO: 99757 - DNA, 25 bp, Homo sapien
tctaagatagtaacttggtcagcta

SEQ ID NO: 99758 - DNA, 25 bp, Homo sapien
tctaagatagttacttggtcagcta

SEQ ID NO: 99759 - DNA, 25 bp, Homo sapien
tctaagatatagggttcaaaggagt

SEQ ID NO: 99760 - DNA, 25 bp, Homo sapien
tctaagatattcaactctcaacatt

SEQ ID NO: 99761 - DNA, 25 bp, Homo sapien
tctaagatattcagctctcaacatt

SEQ ID NO: 99762 - DNA, 25 bp, Homo sapien
tctaagcatgaaaatgatttagtag

SEQ ID NO: 99763 - DNA, 25 bp, Homo sapien
tctaagcatgaaactgatttagtag

SEQ ID NO: 99764 - DNA, 25 bp, Homo sapien
tctaagcatttggcttgtttgaaga

SEQ ID NO: 99765 - DNA, 25 bp, Homo sapien
tctaagcatttggtttgtttgaaga

SEQ ID NO: 99766 - DNA, 25 bp, Homo sapien
tctaaggacaccaggctctgttatc

SEQ ID NO: 99767 - DNA, 25 bp, Homo sapien
tctaaggacgccaggctctgttatc

SEQ ID NO: 99768 - DNA, 25 bp, Homo sapien
tctaaggctcttgctggaaaccata

SEQ ID NO: 99769 - DNA, 25 bp, Homo sapien
tctaaggctcttgttggaaaccata

SEQ ID NO: 99770 - DNA, 25 bp, Homo sapien
tctaagtaaactctggccccagaac

SEQ ID NO: 99771 - DNA, 25 bp, Homo sapien
tctaagtaaactctgggcccagaac

SEQ ID NO: 99772 - DNA, 25 bp, Homo sapien
tctaagtaacagcctgaaagaacac

SEQ ID NO: 99773 - DNA, 25 bp, Homo sapien
tctaagtaacaggctgaaagaacac

SEQ ID NO: 99774 - DNA, 25 bp, Homo sapien
tctaagtacacactggaaaattaca

SEQ ID NO: 99775 - DNA, 25 bp, Homo sapien
tctaagtacaccctggaaaattaca

SEQ ID NO: 99776 - DNA, 25 bp, Homo sapien
tctaagtatagttgacataaccttg

SEQ ID NO: 99777 - DNA, 25 bp, Homo sapien
tctaagtatagttgacgtaaccttg

SEQ ID NO: 99778 - DNA, 25 bp, Homo sapien
tctaagtcactacggcacacaggaa

SEQ ID NO: 99779 - DNA, 25 bp, Homo sapien
tctaagtcactatggcacacaggaa

SEQ ID NO: 99780 - DNA, 25 bp, Homo sapien
tctaagtgctgcaaaaacactggac

SEQ ID NO: 99781 - DNA, 25 bp, Homo sapien
tctaagtgctgcgaaaacactggac

SEQ ID NO: 99782 - DNA, 25 bp, Homo sapien
tctaagtggaaaccacaagcctccc

SEQ ID NO: 99783 - DNA, 25 bp, Homo sapien
tctaagtggaatccacaagcctccc

SEQ ID NO: 99784 - DNA, 25 bp, Homo sapien
tctaagtgtttcatctagtgtggaa

SEQ ID NO: 99785 - DNA, 25 bp, Homo sapien
tctaagtgtttcatttagtgtggaa

SEQ ID NO: 99786 - DNA, 25 bp, Homo sapien
tctaagttccaaataagtgaatttt

SEQ ID NO: 99787 - DNA, 25 bp, Homo sapien
tctaagttctaaataagtgaatttt

SEQ ID NO: 99788 - DNA, 25 bp, Homo sapien
tctaagttcttaatgtactccaatg

SEQ ID NO: 99789 - DNA, 25 bp, Homo sapien
tctaagttcttaatgtgctccaatg

SEQ ID NO: 99790 - DNA, 25 bp, Homo sapien
tctaataaacattgatacattttcg

SEQ ID NO: 99791 - DNA, 25 bp, Homo sapien
tctaataaagaggaatagctacagt

SEQ ID NO: 99792 - DNA, 25 bp, Homo sapien
tctaataaagaggagtagctacagt

SEQ ID NO: 99793 - DNA, 25 bp, Homo sapien
tctaataagcattgatacattttcg

SEQ ID NO: 99794 - DNA, 25 bp, Homo sapien
tctaatactttcaggaagaaacaac

SEQ ID NO: 99795 - DNA, 25 bp, Homo sapien
tctaatactttgaggaagaaacaac

SEQ ID NO: 99796 - DNA, 25 bp, Homo sapien
tctaatagagttcaaaaaaatcaag

SEQ ID NO: 99797 - DNA, 25 bp, Homo sapien
tctaatagagttcaaagaaatcaag

SEQ ID NO: 99798 - DNA, 25 bp, Homo sapien
tctaatagtactccatcatagagtt

SEQ ID NO: 99799 - DNA, 25 bp, Homo sapien
tctaatagtacttcatcatagagtt

SEQ ID NO: 99800 - DNA, 25 bp, Homo sapien
tctaatatattccaatgcaatccta

SEQ ID NO: 99801 - DNA, 25 bp, Homo sapien
tctaatatattccagtgcaatccta

SEQ ID NO: 99802 - DNA, 25 bp, Homo sapien
tctaatatcagttataaggactaga

SEQ ID NO: 99803 - DNA, 25 bp, Homo sapien
tctaatatcagttttaaggactaga

SEQ ID NO: 99804 - DNA, 25 bp, Homo sapien
tctaatatgctatcgtgaacatctg

SEQ ID NO: 99805 - DNA, 25 bp, Homo sapien
tctaatatgctgtcgtgaacatctg

SEQ ID NO: 99806 - DNA, 25 bp, Homo sapien
tctaatcactgaattaaatagcaca

SEQ ID NO: 99807 - DNA, 25 bp, Homo sapien
tctaatcactggggcacgaagactc

SEQ ID NO: 99808 - DNA, 25 bp, Homo sapien
tctaatcactggggcatgaagactc

SEQ ID NO: 99809 - DNA, 25 bp, Homo sapien
tctaatcattgaattaaatagcaca

SEQ ID NO: 99810 - DNA, 25 bp, Homo sapien
tctaatcccattcataagggcagag

SEQ ID NO: 99811 - DNA, 25 bp, Homo sapien
tctaatcccattcttaagggcagag

SEQ ID NO: 99812 - DNA, 25 bp, Homo sapien
tctaatcttacaaaaacagaacctc

SEQ ID NO: 99813 - DNA, 25 bp, Homo sapien
tctaatcttacaacaacagaacctc

SEQ ID NO: 99814 - DNA, 25 bp, Homo sapien
tctaatgaatgtacgggttagcagg

SEQ ID NO: 99815 - DNA, 25 bp, Homo sapien
tctaatgaatgtatgggttagcagg

SEQ ID NO: 99816 - DNA, 25 bp, Homo sapien
tctaatgaattccctttcttcttgt

SEQ ID NO: 99817 - DNA, 25 bp, Homo sapien
tctaatgaattctctttcttcttgt

SEQ ID NO: 99818 - DNA, 25 bp, Homo sapien
tctaatgattcagcatagttcacta

SEQ ID NO: 99819 - DNA, 25 bp, Homo sapien
tctaatgattcagcgtagttcacta

SEQ ID NO: 99820 - DNA, 25 bp, Homo sapien
tctaatgattggatataggttgagg

SEQ ID NO: 99821 - DNA, 25 bp, Homo sapien
tctaatgattggatgtaggttgagg

SEQ ID NO: 99822 - DNA, 25 bp, Homo sapien
tctaatggcgaataaagagaatgaa

SEQ ID NO: 99823 - DNA, 25 bp, Homo sapien
tctaatggctcatggggaaaaacaa

SEQ ID NO: 99824 - DNA, 25 bp, Homo sapien
tctaatggctcgtggggaaaaacaa

SEQ ID NO: 99825 - DNA, 25 bp, Homo sapien
tctaatggtgaataaagagaatgaa

SEQ ID NO: 99826 - DNA, 25 bp, Homo sapien
tctaatggtttccaggcttacagag

SEQ ID NO: 99827 - DNA, 25 bp, Homo sapien
tctaatggtttccaggtttacagag

SEQ ID NO: 99828 - DNA, 25 bp, Homo sapien
tctaattcttcctcactatcttcac

SEQ ID NO: 99829 - DNA, 25 bp, Homo sapien
tctaattcttcctcgctatcttcac

SEQ ID NO: 99830 - DNA, 25 bp, Homo sapien
tctaattggagcctcttaaattgaa

SEQ ID NO: 99831 - DNA, 25 bp, Homo sapien
tctaattggagcttcttaaattgaa

SEQ ID NO: 99832 - DNA, 25 bp, Homo sapien
tctaatttgcgccaaaatctctgac

SEQ ID NO: 99833 - DNA, 25 bp, Homo sapien
tctaatttgggaaatgatcaatggt

SEQ ID NO: 99834 - DNA, 25 bp, Homo sapien
tctaatttgggccaaaatctctgac

SEQ ID NO: 99835 - DNA, 25 bp, Homo sapien
tctaattttatccacatcattctcc

SEQ ID NO: 99836 - DNA, 25 bp, Homo sapien
tctaattttatccgcatcattctcc

SEQ ID NO: 99837 - DNA, 25 bp, Homo sapien
tctaattttcagccacatttattta

SEQ ID NO: 99838 - DNA, 25 bp, Homo sapien
tctaattttcagccacgtttattta

SEQ ID NO: 99839 - DNA, 25 bp, Homo sapien
tctaattttggaaatgatcaatggt

SEQ ID NO: 99840 - DNA, 25 bp, Homo sapien
tctacaaaaataggtaggtagttat

SEQ ID NO: 99841 - DNA, 25 bp, Homo sapien
tctacaaaactaggtaggtagttat

SEQ ID NO: 99842 - DNA, 25 bp, Homo sapien
tctacaaattgcccagggaaggtat

SEQ ID NO: 99843 - DNA, 25 bp, Homo sapien
tctacaaattgctcagggaaggtat

SEQ ID NO: 99844 - DNA, 25 bp, Homo sapien
tctacaactagacctggttggatca

SEQ ID NO: 99845 - DNA, 25 bp, Homo sapien
tctacaactagagctggttggatca

SEQ ID NO: 99846 - DNA, 25 bp, Homo sapien
tctacaagaacttcattttatgcat

SEQ ID NO: 99847 - DNA, 25 bp, Homo sapien
tctacaagagcttcattttatgcat

SEQ ID NO: 99848 - DNA, 25 bp, Homo sapien
tctacaaggacaattctttgccttt

SEQ ID NO: 99849 - DNA, 25 bp, Homo sapien
tctacaaggacagttctttgccttt

SEQ ID NO: 99850 - DNA, 25 bp, Homo sapien
tctacaatattctatgtcatctaga

SEQ ID NO: 99851 - DNA, 25 bp, Homo sapien
tctacaatattttatgtcatctaga

SEQ ID NO: 99852 - DNA, 25 bp, Homo sapien
tctacaatgaaatatctatgcaaat

SEQ ID NO: 99853 - DNA, 25 bp, Homo sapien
tctacaatgaaatgtctatgcaaat

SEQ ID NO: 99854 - DNA, 25 bp, Homo sapien
tctacacagagtgaaggagaaagac

SEQ ID NO: 99855 - DNA, 25 bp, Homo sapien
tctacacagggtgaaggagaaagac

SEQ ID NO: 99856 - DNA, 25 bp, Homo sapien
tctacaccaattcttccaaaaagtt

SEQ ID NO: 99857 - DNA, 25 bp, Homo sapien
tctacaccgttgtcagaattaaatt

SEQ ID NO: 99858 - DNA, 25 bp, Homo sapien
tctacaccgttgtcggaattaaatt

SEQ ID NO: 99859 - DNA, 25 bp, Homo sapien
tctacacctattcttccaaaaagtt

SEQ ID NO: 99860 - DNA, 25 bp, Homo sapien
tctacactatatataccagactctg

SEQ ID NO: 99861 - DNA, 25 bp, Homo sapien
tctacactatatgtaccagactctg

SEQ ID NO: 99862 - DNA, 25 bp, Homo sapien
tctacacttagaaaaattgtgagca

SEQ ID NO: 99863 - DNA, 25 bp, Homo sapien
tctacacttagataaattgtgagca

SEQ ID NO: 99864 - DNA, 25 bp, Homo sapien
tctacagaaataattgtctctctca

SEQ ID NO: 99865 - DNA, 25 bp, Homo sapien
tctacagaagatgttggaagcttag

SEQ ID NO: 99866 - DNA, 25 bp, Homo sapien
tctacagaagattttggaagcttag

SEQ ID NO: 99867 - DNA, 25 bp, Homo sapien
tctacagaagtaattgtctctctca

SEQ ID NO: 99868 - DNA, 25 bp, Homo sapien
tctacagcacaacctagcatatcct

SEQ ID NO: 99869 - DNA, 25 bp, Homo sapien
tctacagcataacctagcatatcct

SEQ ID NO: 99870 - DNA, 25 bp, Homo sapien
tctacaggcaacatgttacatatag

SEQ ID NO: 99871 - DNA, 25 bp, Homo sapien
tctacaggcaacgtgttacatatag

SEQ ID NO: 99872 - DNA, 25 bp, Homo sapien
tctacaggcctttaagcctctggtt

SEQ ID NO: 99873 - DNA, 25 bp, Homo sapien
tctacaggcgtttaagcctctggtt

SEQ ID NO: 99874 - DNA, 25 bp, Homo sapien
tctacagtgaacattgatcacaaga

SEQ ID NO: 99875 - DNA, 25 bp, Homo sapien
tctacagtgaacgttgatcacaaga

SEQ ID NO: 99876 - DNA, 25 bp, Homo sapien
tctacagttaacaacatacttactg

SEQ ID NO: 99877 - DNA, 25 bp, Homo sapien
tctacagttaacatcatacttactg

SEQ ID NO: 99878 - DNA, 25 bp, Homo sapien
tctacagttctgatttcattctctg

SEQ ID NO: 99879 - DNA, 25 bp, Homo sapien
tctacagttttgatttcattctctg

SEQ ID NO: 99880 - DNA, 25 bp, Homo sapien
tctacatagcgtttgaaaacaaagc

SEQ ID NO: 99881 - DNA, 25 bp, Homo sapien
tctacatagtgtttgaaaacaaagc

SEQ ID NO: 99882 - DNA, 25 bp, Homo sapien
tctacatgcatgtccgtcagagagg

SEQ ID NO: 99883 - DNA, 25 bp, Homo sapien
tctacatgcatgtctgtcagagagg

SEQ ID NO: 99884 - DNA, 25 bp, Homo sapien
tctacatggcttaaatatctctagc

SEQ ID NO: 99885 - DNA, 25 bp, Homo sapien
tctacatggcttaaatgtctctagc

SEQ ID NO: 99886 - DNA, 25 bp, Homo sapien
tctacattatcctccttagtgcagc

SEQ ID NO: 99887 - DNA, 25 bp, Homo sapien
tctacattgtcctccttagtgcagc

SEQ ID NO: 99888 - DNA, 25 bp, Homo sapien
tctaccaaacagaatttgaagtctt

SEQ ID NO: 99889 - DNA, 25 bp, Homo sapien
tctaccaaacagtatttgaagtctt

SEQ ID NO: 99890 - DNA, 25 bp, Homo sapien
tctaccaacagggtgagattactcc

SEQ ID NO: 99891 - DNA, 25 bp, Homo sapien
tctaccaatagggtgagattactcc

SEQ ID NO: 99892 - DNA, 25 bp, Homo sapien
tctaccaattatgaaaacctgtgat

SEQ ID NO: 99893 - DNA, 25 bp, Homo sapien
tctaccaattatgaaagcctgtgat

SEQ ID NO: 99894 - DNA, 25 bp, Homo sapien
tctaccagcacccattattcttcct

SEQ ID NO: 99895 - DNA, 25 bp, Homo sapien
tctaccagcaccctttattcttcct

SEQ ID NO: 99896 - DNA, 25 bp, Homo sapien
tctaccaggtcatataactcactgt

SEQ ID NO: 99897 - DNA, 25 bp, Homo sapien
tctaccaggtcatgtaactcactgt

SEQ ID NO: 99898 - DNA, 25 bp, Homo sapien
tctaccatcatagcccaagccattt

SEQ ID NO: 99899 - DNA, 25 bp, Homo sapien
tctaccatcgtagcccaagccattt

SEQ ID NO: 99900 - DNA, 25 bp, Homo sapien
tctacccacaatcgattccttctcc

SEQ ID NO: 99901 - DNA, 25 bp, Homo sapien
tctacccacaattgattccttctcc

SEQ ID NO: 99902 - DNA, 25 bp, Homo sapien
tctacccctgatagactgcaatata

SEQ ID NO: 99903 - DNA, 25 bp, Homo sapien
tctacccctgataggctgcaatata

SEQ ID NO: 99904 - DNA, 25 bp, Homo sapien
tctaccctggagaactttatagtcc

SEQ ID NO: 99905 - DNA, 25 bp, Homo sapien
tctaccctggagaattttatagtcc

SEQ ID NO: 99906 - DNA, 25 bp, Homo sapien
tctacctaaacattcattgccaaga

SEQ ID NO: 99907 - DNA, 25 bp, Homo sapien
tctacctaaacgttcattgccaaga

SEQ ID NO: 99908 - DNA, 25 bp, Homo sapien
tctacctcctaaacatctcttgaat

SEQ ID NO: 99909 - DNA, 25 bp, Homo sapien
tctacctcctaaacatttcttgaat

SEQ ID NO: 99910 - DNA, 25 bp, Homo sapien
tctacctctcttaatgaagaaaatg

SEQ ID NO: 99911 - DNA, 25 bp, Homo sapien
tctacctctcttaatggagaaaatg

SEQ ID NO: 99912 - DNA, 25 bp, Homo sapien
tctaccttaaactctctctccctcc

SEQ ID NO: 99913 - DNA, 25 bp, Homo sapien
tctaccttcaactctctctccctcc

SEQ ID NO: 99914 - DNA, 25 bp, Homo sapien
tctaccttgtatcgttctatggaaa

SEQ ID NO: 99915 - DNA, 25 bp, Homo sapien
tctaccttgtattgttctatggaaa

SEQ ID NO: 99916 - DNA, 25 bp, Homo sapien
tctacctttagatccaacaatattt

SEQ ID NO: 99917 - DNA, 25 bp, Homo sapien
tctacctttagatccatcaatattt

SEQ ID NO: 99918 - DNA, 25 bp, Homo sapien
tctacctttccaagtgtatggctct

SEQ ID NO: 99919 - DNA, 25 bp, Homo sapien
tctaccttttcaagtgtatggctct

SEQ ID NO: 99920 - DNA, 25 bp, Homo sapien
tctacctttttttcccttaaacatt

SEQ ID NO: 99921 - DNA, 25 bp, Homo sapien
tctaccttttttttccttaaacatt

SEQ ID NO: 99922 - DNA, 25 bp, Homo sapien
tctactaaaaatccgaaacaattag

SEQ ID NO: 99923 - DNA, 25 bp, Homo sapien
tctactaaaaatctgaaacaattag

SEQ ID NO: 99924 - DNA, 25 bp, Homo sapien
tctactacatacatgagctgtagat

SEQ ID NO: 99925 - DNA, 25 bp, Homo sapien
tctactacatacgtgagctgtagat

SEQ ID NO: 99926 - DNA, 25 bp, Homo sapien
tctactacatataaagcgctctgga

SEQ ID NO: 99927 - DNA, 25 bp, Homo sapien
tctactacatataaagtgctctgga

SEQ ID NO: 99928 - DNA, 25 bp, Homo sapien
tctactacatcactgcagctgcaaa

SEQ ID NO: 99929 - DNA, 25 bp, Homo sapien
tctactacatcgctgcagctgcaaa

SEQ ID NO: 99930 - DNA, 25 bp, Homo sapien
tctactatgtaacagataattacaa

SEQ ID NO: 99931 - DNA, 25 bp, Homo sapien
tctactatgtatcagataattacaa

SEQ ID NO: 99932 - DNA, 25 bp, Homo sapien
tctactcaaccttctaatcatttca

SEQ ID NO: 99933 - DNA, 25 bp, Homo sapien
tctactcaatcttctaatcatttca

SEQ ID NO: 99934 - DNA, 25 bp, Homo sapien
tctactcagacatacgtgaaaaggc

SEQ ID NO: 99935 - DNA, 25 bp, Homo sapien
tctactcagacataggtgaaaaggc

SEQ ID NO: 99936 - DNA, 25 bp, Homo sapien
tctactcatcaaaattcctgcctta

SEQ ID NO: 99937 - DNA, 25 bp, Homo sapien
tctactcatcaaaatttctgcctta

SEQ ID NO: 99938 - DNA, 25 bp, Homo sapien
tctactcccaaaaaacagattgcac

SEQ ID NO: 99939 - DNA, 25 bp, Homo sapien
tctactcccaaaagacagattgcac

SEQ ID NO: 99940 - DNA, 25 bp, Homo sapien
tctactcgtggtccctgaaatattc

SEQ ID NO: 99941 - DNA, 25 bp, Homo sapien
tctactcgttgtccctgaaatattc

SEQ ID NO: 99942 - DNA, 25 bp, Homo sapien
tctactctgtctgcagatttaaatg

SEQ ID NO: 99943 - DNA, 25 bp, Homo sapien
tctactctgtcttcagatttaaatg

SEQ ID NO: 99944 - DNA, 25 bp, Homo sapien
tctactctttcacgcatttgttagc

SEQ ID NO: 99945 - DNA, 25 bp, Homo sapien
tctactctttcatgcatttgttagc

SEQ ID NO: 99946 - DNA, 25 bp, Homo sapien
tctactgaagagaagagcatcaaga

SEQ ID NO: 99947 - DNA, 25 bp, Homo sapien
tctactgaagagaagatcatcaaga

SEQ ID NO: 99948 - DNA, 25 bp, Homo sapien
tctactgactttttcctacccttac

SEQ ID NO: 99949 - DNA, 25 bp, Homo sapien
tctactgattttttcctacccttac

SEQ ID NO: 99950 - DNA, 25 bp, Homo sapien
tctactgcaagaaagagaaaatagg

SEQ ID NO: 99951 - DNA, 25 bp, Homo sapien
tctactgcacgaaagagaaaatagg

SEQ ID NO: 99952 - DNA, 25 bp, Homo sapien
tctactgctcctgtttttttttttt

SEQ ID NO: 99953 - DNA, 25 bp, Homo sapien
tctactgcttctgtttttttttttt

SEQ ID NO: 99954 - DNA, 25 bp, Homo sapien
tctactgtattggacaaaactagag

SEQ ID NO: 99955 - DNA, 25 bp, Homo sapien
tctactgtattggataaaactagag

SEQ ID NO: 99956 - DNA, 25 bp, Homo sapien
tctacttagcattttgcctacctcg

SEQ ID NO: 99957 - DNA, 25 bp, Homo sapien
tctacttagtattttgcctacctcg

SEQ ID NO: 99958 - DNA, 25 bp, Homo sapien
tctacttgcggtcacttatactgtg

SEQ ID NO: 99959 - DNA, 25 bp, Homo sapien
tctacttgctgtcacttatactgtg

SEQ ID NO: 99960 - DNA, 25 bp, Homo sapien
tctactttctacagttctgatttca

SEQ ID NO: 99961 - DNA, 25 bp, Homo sapien
tctactttctacagttttgatttca

SEQ ID NO: 99962 - DNA, 25 bp, Homo sapien
tctactttgagccatacagctgtga

SEQ ID NO: 99963 - DNA, 25 bp, Homo sapien
tctactttgagtcatacagctgtga

SEQ ID NO: 99964 - DNA, 25 bp, Homo sapien
tctagaagctgtggaaagaaaaaga

SEQ ID NO: 99965 - DNA, 25 bp, Homo sapien
tctagaagctgtgggaagaaaaaga

SEQ ID NO: 99966 - DNA, 25 bp, Homo sapien
tctagacagagaagttgaaaatcat

SEQ ID NO: 99967 - DNA, 25 bp, Homo sapien
tctagacagcgaagttgaaaatcat

SEQ ID NO: 99968 - DNA, 25 bp, Homo sapien
tctagacagctgctttttacaaata

SEQ ID NO: 99969 - DNA, 25 bp, Homo sapien
tctagacagttgctttttacaaata

SEQ ID NO: 99970 - DNA, 25 bp, Homo sapien
tctagacatacatacaaaaggttaa

SEQ ID NO: 99971 - DNA, 25 bp, Homo sapien
tctagacatacatacagaaggttaa

SEQ ID NO: 99972 - DNA, 25 bp, Homo sapien
tctagacattaccggactcactaac

SEQ ID NO: 99973 - DNA, 25 bp, Homo sapien
tctagacattactggactcactaac

SEQ ID NO: 99974 - DNA, 25 bp, Homo sapien
tctagagacatcacgaatcctgtaa

SEQ ID NO: 99975 - DNA, 25 bp, Homo sapien
tctagagacttcacgaatcctgtaa

SEQ ID NO: 99976 - DNA, 25 bp, Homo sapien
tctagagtaagatgtgatggtaaca

SEQ ID NO: 99977 - DNA, 25 bp, Homo sapien
tctagagtcagatgtgatggtaaca

SEQ ID NO: 99978 - DNA, 25 bp, Homo sapien
tctagagttatgaatggaaacagaa

SEQ ID NO: 99979 - DNA, 25 bp, Homo sapien
tctagagttatgactggaaacagaa

SEQ ID NO: 99980 - DNA, 25 bp, Homo sapien
tctagatcttgtactttaaactctg

SEQ ID NO: 99981 - DNA, 25 bp, Homo sapien
tctagatcttgtgctttaaactctg

SEQ ID NO: 99982 - DNA, 25 bp, Homo sapien
tctagatgaatactcaccctgtatg

SEQ ID NO: 99983 - DNA, 25 bp, Homo sapien
tctagatgaatattcaccctgtatg

SEQ ID NO: 99984 - DNA, 25 bp, Homo sapien
tctagattcgagtcctttcctgata

SEQ ID NO: 99985 - DNA, 25 bp, Homo sapien
tctagattcgagttctttcctgata

SEQ ID NO: 99986 - DNA, 25 bp, Homo sapien
tctagcacagatgctatatctctag

SEQ ID NO: 99987 - DNA, 25 bp, Homo sapien
tctagcacagatgttatatctctag

SEQ ID NO: 99988 - DNA, 25 bp, Homo sapien
tctagctaaaaatcatgatcactaa

SEQ ID NO: 99989 - DNA, 25 bp, Homo sapien
tctagctaaaaatcctgatcactaa

SEQ ID NO: 99990 - DNA, 25 bp, Homo sapien
tctagctcactatgttctccatggg

SEQ ID NO: 99991 - DNA, 25 bp, Homo sapien
tctagctcactgtgttctccatggg

SEQ ID NO: 99992 - DNA, 25 bp, Homo sapien
tctagctctctaaaaaaaaagattt

SEQ ID NO: 99993 - DNA, 25 bp, Homo sapien
tctagctctctcaaaaaaaagattt

SEQ ID NO: 99994 - DNA, 25 bp, Homo sapien
tctagctcttcttcattagaactgt

SEQ ID NO: 99995 - DNA, 25 bp, Homo sapien
tctagctcttcttcgttagaactgt

SEQ ID NO: 99996 - DNA, 25 bp, Homo sapien
tctagcttgcaaaatatcttggtat

SEQ ID NO: 99997 - DNA, 25 bp, Homo sapien
tctagcttgcaaattatcttggtat

SEQ ID NO: 99998 - DNA, 25 bp, Homo sapien
tctaggaaaaaaagaacacaataaa

SEQ ID NO: 99999 - DNA, 25 bp, Homo sapien
tctaggaaaaaaggaacacaataaa

SEQ ID NO: 100000 - DNA, 25 bp, Homo sapien
tctaggaaccaataatcagcacact

SEQ ID NO: 100001 - DNA, 25 bp, Homo sapien
tctaggaaccagtaatcagcacact

SEQ ID NO: 100002 - DNA, 25 bp, Homo sapien
tctaggagagtagggagaaaatctt

SEQ ID NO: 100003 - DNA, 25 bp, Homo sapien
tctaggagtgtagggagaaaatctt

SEQ ID NO: 100004 - DNA, 25 bp, Homo sapien
tctaggataagacgaaaacgaaggg

SEQ ID NO: 100005 - DNA, 25 bp, Homo sapien
tctaggatgagacgaaaacgaaggg

SEQ ID NO: 100006 - DNA, 25 bp, Homo sapien
tctaggcaatgatcatcagtgaatg

SEQ ID NO: 100007 - DNA, 25 bp, Homo sapien
tctaggcattgatcatcagtgaatg

SEQ ID NO: 100008 - DNA, 25 bp, Homo sapien
tctagggtatacacagtagcattgc

SEQ ID NO: 100009 - DNA, 25 bp, Homo sapien
tctagggtatatacagtagcattgc

SEQ ID NO: 100010 - DNA, 25 bp, Homo sapien
tctagggtgctatatgcttaggata

SEQ ID NO: 100011 - DNA, 25 bp, Homo sapien
tctagggtggtatatgcttaggata

SEQ ID NO: 100012 - DNA, 25 bp, Homo sapien
tctaggtcaggtccaaacaatacta

SEQ ID NO: 100013 - DNA, 25 bp, Homo sapien
tctaggtcgggtccaaacaatacta

SEQ ID NO: 100014 - DNA, 25 bp, Homo sapien
tctaggtgaaagacgggagttcagg

SEQ ID NO: 100015 - DNA, 25 bp, Homo sapien
tctaggtgaaagatgggagttcagg

SEQ ID NO: 100016 - DNA, 25 bp, Homo sapien
tctaggtggaccatcatgcataccc

SEQ ID NO: 100017 - DNA, 25 bp, Homo sapien
tctaggtggactatcatgcataccc

SEQ ID NO: 100018 - DNA, 25 bp, Homo sapien
tctaggtgtgcctgctgagtagatg

SEQ ID NO: 100019 - DNA, 25 bp, Homo sapien
tctaggtgttcctgctgagtagatg

SEQ ID NO: 100020 - DNA, 25 bp, Homo sapien
tctaggttccacattcgtctcccat

SEQ ID NO: 100021 - DNA, 25 bp, Homo sapien
tctaggttgcacattcgtctcccat

SEQ ID NO: 100022 - DNA, 25 bp, Homo sapien
tctagtaaaaattctaaacagtgta

SEQ ID NO: 100023 - DNA, 25 bp, Homo sapien
tctagtaaagattctaaacagtgta

SEQ ID NO: 100024 - DNA, 25 bp, Homo sapien
tctagtaactctctaaagtctctgg

SEQ ID NO: 100025 - DNA, 25 bp, Homo sapien
tctagtaactctctgaagtctctgg

SEQ ID NO: 100026 - DNA, 25 bp, Homo sapien
tctagtaagccaattcctctcttgt

SEQ ID NO: 100027 - DNA, 25 bp, Homo sapien
tctagtaagccagttcctctcttgt

SEQ ID NO: 100028 - DNA, 25 bp, Homo sapien
tctagtaatcaagacagtgtgcata

SEQ ID NO: 100029 - DNA, 25 bp, Homo sapien
tctagtaattaagacagtgtgcata

SEQ ID NO: 100030 - DNA, 25 bp, Homo sapien
tctagtagcaaaaacagcagcagct

SEQ ID NO: 100031 - DNA, 25 bp, Homo sapien
tctagtagcaataacagcagcagct

SEQ ID NO: 100032 - DNA, 25 bp, Homo sapien
tctagtatcaaaacatgttcaactg

SEQ ID NO: 100033 - DNA, 25 bp, Homo sapien
tctagtatcaaagcatgttcaactg

SEQ ID NO: 100034 - DNA, 25 bp, Homo sapien
tctagtcagaccgattatctgctct

SEQ ID NO: 100035 - DNA, 25 bp, Homo sapien
tctagtcagactgattatctgctct

SEQ ID NO: 100036 - DNA, 25 bp, Homo sapien
tctagtcagtaaactcaccaatgtc

SEQ ID NO: 100037 - DNA, 25 bp, Homo sapien
tctagtcagtaagctcaccaatgtc

SEQ ID NO: 100038 - DNA, 25 bp, Homo sapien
tctagtctatcaagctatttactga

SEQ ID NO: 100039 - DNA, 25 bp, Homo sapien
tctagtctatcaggctatttactga

SEQ ID NO: 100040 - DNA, 25 bp, Homo sapien
tctagtcttcactgtccttcttgtg

SEQ ID NO: 100041 - DNA, 25 bp, Homo sapien
tctagtcttcattgtccttcttgtg

SEQ ID NO: 100042 - DNA, 25 bp, Homo sapien
tctagtgaatgagctgagaggtgag

SEQ ID NO: 100043 - DNA, 25 bp, Homo sapien
tctagtgaatgggctgagaggtgag

SEQ ID NO: 100044 - DNA, 25 bp, Homo sapien
tctagtgctatgaagtatttcctag

SEQ ID NO: 100045 - DNA, 25 bp, Homo sapien
tctagtgctatggagtatttcctag

SEQ ID NO: 100046 - DNA, 25 bp, Homo sapien
tctagtgtagaacctgtgaatattg

SEQ ID NO: 100047 - DNA, 25 bp, Homo sapien
tctagtgtagatcctgtgaatattg

SEQ ID NO: 100048 - DNA, 25 bp, Homo sapien
tctagtgtattttgtatagcattgc

SEQ ID NO: 100049 - DNA, 25 bp, Homo sapien
tctagtgtccttcttaagaagtcta

SEQ ID NO: 100050 - DNA, 25 bp, Homo sapien
tctagtgtgttttgtatagcattgc

SEQ ID NO: 100051 - DNA, 25 bp, Homo sapien
tctagtgttcttcttaagaagtcta

SEQ ID NO: 100052 - DNA, 25 bp, Homo sapien
tctagtgttgatctgagaacataac

SEQ ID NO: 100053 - DNA, 25 bp, Homo sapien
tctagtgttgatctgataacataac

SEQ ID NO: 100054 - DNA, 25 bp, Homo sapien
tctagttaactcgaggattttctat

SEQ ID NO: 100055 - DNA, 25 bp, Homo sapien
tctagttaactcgatgattttctat

SEQ ID NO: 100056 - DNA, 25 bp, Homo sapien
tctagttcatgaggcgttaagaagg

SEQ ID NO: 100057 - DNA, 25 bp, Homo sapien
tctagttcatgaggtgttaagaagg

SEQ ID NO: 100058 - DNA, 25 bp, Homo sapien
tctagtttatcacttggacaactta

SEQ ID NO: 100059 - DNA, 25 bp, Homo sapien
tctagtttatccattattctgaata

SEQ ID NO: 100060 - DNA, 25 bp, Homo sapien
tctagtttatcccttattctgaata

SEQ ID NO: 100061 - DNA, 25 bp, Homo sapien
tctagtttctcacttggacaactta

SEQ ID NO: 100062 - DNA, 25 bp, Homo sapien
tctagttttttatcatgtgatattc

SEQ ID NO: 100063 - DNA, 25 bp, Homo sapien
tctagttttttatcgtgtgatattc

SEQ ID NO: 100064 - DNA, 25 bp, Homo sapien
tctataaaaccctgtaaaatcttga

SEQ ID NO: 100065 - DNA, 25 bp, Homo sapien
tctataaaagacatagatcacctag

SEQ ID NO: 100066 - DNA, 25 bp, Homo sapien
tctataaaagacgtagatcacctag

SEQ ID NO: 100067 - DNA, 25 bp, Homo sapien
tctataaaagttaccaaaaatgtta

SEQ ID NO: 100068 - DNA, 25 bp, Homo sapien
tctataaaagttaccacaaatgtta

SEQ ID NO: 100069 - DNA, 25 bp, Homo sapien
tctataaaatcctgtaaaatcttga

SEQ ID NO: 100070 - DNA, 25 bp, Homo sapien
tctataaatttgttctcaccacagg

SEQ ID NO: 100071 - DNA, 25 bp, Homo sapien
tctataaatttgttctgaccacagg

SEQ ID NO: 100072 - DNA, 25 bp, Homo sapien
tctataatgaacggttaatactttt

SEQ ID NO: 100073 - DNA, 25 bp, Homo sapien
tctataatgaatggttaatactttt

SEQ ID NO: 100074 - DNA, 25 bp, Homo sapien
tctataatgtcttgcagcagtgttt

SEQ ID NO: 100075 - DNA, 25 bp, Homo sapien
tctataattctagcgcagagacttc

SEQ ID NO: 100076 - DNA, 25 bp, Homo sapien
tctataattctagctcagagacttc

SEQ ID NO: 100077 - DNA, 25 bp, Homo sapien
tctataatttcttgcagcagtgttt

SEQ ID NO: 100078 - DNA, 25 bp, Homo sapien
tctatacaagcaactatgcccagtg

SEQ ID NO: 100079 - DNA, 25 bp, Homo sapien
tctatacactgcccaaactcagcaa

SEQ ID NO: 100080 - DNA, 25 bp, Homo sapien
tctatacactgtccaaactcagcaa

SEQ ID NO: 100081 - DNA, 25 bp, Homo sapien
tctatacagcaggataagcaataaa

SEQ ID NO: 100082 - DNA, 25 bp, Homo sapien
tctatacagcaggttaagcaataaa

SEQ ID NO: 100083 - DNA, 25 bp, Homo sapien
tctatacatgcaactatgcccagtg

SEQ ID NO: 100084 - DNA, 25 bp, Homo sapien
tctataccaattcccacaggttaag

SEQ ID NO: 100085 - DNA, 25 bp, Homo sapien
tctataccagttcccacaggttaag

SEQ ID NO: 100086 - DNA, 25 bp, Homo sapien
tctatacctcgcaaccttgcatgta

SEQ ID NO: 100087 - DNA, 25 bp, Homo sapien
tctataccttgcaaccttgcatgta

SEQ ID NO: 100088 - DNA, 25 bp, Homo sapien
tctatactcacacaaatttattcta

SEQ ID NO: 100089 - DNA, 25 bp, Homo sapien
tctatactcagcaaaatgacatctt

SEQ ID NO: 100090 - DNA, 25 bp, Homo sapien
tctatacttacacaaatttattcta

SEQ ID NO: 100091 - DNA, 25 bp, Homo sapien
tctatacttagcaaaatgacatctt

SEQ ID NO: 100092 - DNA, 25 bp, Homo sapien
tctatacttgttccctggccagcct

SEQ ID NO: 100093 - DNA, 25 bp, Homo sapien
tctatacttgtttcctggccagcct

SEQ ID NO: 100094 - DNA, 25 bp, Homo sapien
tctatagaggcatggtcttggaaat

SEQ ID NO: 100095 - DNA, 25 bp, Homo sapien
tctatagaggcatggttttggaaat

SEQ ID NO: 100096 - DNA, 25 bp, Homo sapien
tctatagcttaaaaaataatctcca

SEQ ID NO: 100097 - DNA, 25 bp, Homo sapien
tctatagcttacaaaataatctcca

SEQ ID NO: 100098 - DNA, 25 bp, Homo sapien
tctatagtcaaagaaattaaagcag

SEQ ID NO: 100099 - DNA, 25 bp, Homo sapien
tctatagtcaaataaattaaagcag

SEQ ID NO: 100100 - DNA, 25 bp, Homo sapien
tctatatccgataggctacagttct

SEQ ID NO: 100101 - DNA, 25 bp, Homo sapien
tctatatctaaagtacaaaagcttc

SEQ ID NO: 100102 - DNA, 25 bp, Homo sapien
tctatatctgataggctacagttct

SEQ ID NO: 100103 - DNA, 25 bp, Homo sapien
tctatatcttaagtacaaaagcttc

SEQ ID NO: 100104 - DNA, 25 bp, Homo sapien
tctatattcgaacggtctgggttag

SEQ ID NO: 100105 - DNA, 25 bp, Homo sapien
tctatattcgaatggtctgggttag

SEQ ID NO: 100106 - DNA, 25 bp, Homo sapien
tctatcacaacctgcagagggtgca

SEQ ID NO: 100107 - DNA, 25 bp, Homo sapien
tctatcacagatttacaacactgta

SEQ ID NO: 100108 - DNA, 25 bp, Homo sapien
tctatcacagatttaccacactgta

SEQ ID NO: 100109 - DNA, 25 bp, Homo sapien
tctatcaccattgcaaacctgatat

SEQ ID NO: 100110 - DNA, 25 bp, Homo sapien
tctatcaccgttgcaaacctgatat

SEQ ID NO: 100111 - DNA, 25 bp, Homo sapien
tctatcacgacctgcagagggtgca

SEQ ID NO: 100112 - DNA, 25 bp, Homo sapien
tctatcagggtcattagaaaattgg

SEQ ID NO: 100113 - DNA, 25 bp, Homo sapien
tctatcagggtcgttagaaaattgg

SEQ ID NO: 100114 - DNA, 25 bp, Homo sapien
tctatcatattctgagtctcagttt

SEQ ID NO: 100115 - DNA, 25 bp, Homo sapien
tctatcatgttctgagtctcagttt

SEQ ID NO: 100116 - DNA, 25 bp, Homo sapien
tctatcattatctttcaatctcctc

SEQ ID NO: 100117 - DNA, 25 bp, Homo sapien
tctatcattatctttcgatctcctc

SEQ ID NO: 100118 - DNA, 25 bp, Homo sapien
tctatcattttatcctatctgagtc

SEQ ID NO: 100119 - DNA, 25 bp, Homo sapien
tctatcattttattctatctgagtc

SEQ ID NO: 100120 - DNA, 25 bp, Homo sapien
tctatccagctgttatttttgtatg

SEQ ID NO: 100121 - DNA, 25 bp, Homo sapien
tctatccagctgttctttttgtatg

SEQ ID NO: 100122 - DNA, 25 bp, Homo sapien
tctatctattcgcgaacaaaaggaa

SEQ ID NO: 100123 - DNA, 25 bp, Homo sapien
tctatctattcgggaacaaaaggaa

SEQ ID NO: 100124 - DNA, 25 bp, Homo sapien
tctatctcaatgatatacccagttg

SEQ ID NO: 100125 - DNA, 25 bp, Homo sapien
tctatctcagtgatatacccagttg

SEQ ID NO: 100126 - DNA, 25 bp, Homo sapien
tctatctcatgcggatttatgtcca

SEQ ID NO: 100127 - DNA, 25 bp, Homo sapien
tctatctcatgtggatttatgtcca

SEQ ID NO: 100128 - DNA, 25 bp, Homo sapien
tctatctgggttgaagtttaatttc

SEQ ID NO: 100129 - DNA, 25 bp, Homo sapien
tctatctgggttgaggtttaatttc

SEQ ID NO: 100130 - DNA, 25 bp, Homo sapien
tctatcttgagaatggaatttgcca

SEQ ID NO: 100131 - DNA, 25 bp, Homo sapien
tctatcttgagagtggaatttgcca

SEQ ID NO: 100132 - DNA, 25 bp, Homo sapien
tctatcttgcttcttaagtgtattt

SEQ ID NO: 100133 - DNA, 25 bp, Homo sapien
tctatcttgcttcttaggtgtattt

SEQ ID NO: 100134 - DNA, 25 bp, Homo sapien
tctatgaaatccataagcctccata

SEQ ID NO: 100135 - DNA, 25 bp, Homo sapien
tctatgaaatccgtaagcctccata

SEQ ID NO: 100136 - DNA, 25 bp, Homo sapien
tctatgaataagaaagacccaaggt

SEQ ID NO: 100137 - DNA, 25 bp, Homo sapien
tctatgaatgagaaagacccaaggt

SEQ ID NO: 100138 - DNA, 25 bp, Homo sapien
tctatgagacggactaacacccatg

SEQ ID NO: 100139 - DNA, 25 bp, Homo sapien
tctatgagatggactaacacccatg

SEQ ID NO: 100140 - DNA, 25 bp, Homo sapien
tctatgaggttttcgatttactttg

SEQ ID NO: 100141 - DNA, 25 bp, Homo sapien
tctatgaggtttttgatttactttg

SEQ ID NO: 100142 - DNA, 25 bp, Homo sapien
tctatgatttctttccacaatgttt

SEQ ID NO: 100143 - DNA, 25 bp, Homo sapien
tctatgatttctttccgcaatgttt

SEQ ID NO: 100144 - DNA, 25 bp, Homo sapien
tctatgcagcttaccaatgacggtc

SEQ ID NO: 100145 - DNA, 25 bp, Homo sapien
tctatgcagcttaccagtgacggtc

SEQ ID NO: 100146 - DNA, 25 bp, Homo sapien
tctatgcataccacaaaaggaaaag

SEQ ID NO: 100147 - DNA, 25 bp, Homo sapien
tctatgcataccataaaaggaaaag

SEQ ID NO: 100148 - DNA, 25 bp, Homo sapien
tctatgccatacttatcactgtgtt

SEQ ID NO: 100149 - DNA, 25 bp, Homo sapien
tctatgccgtacttatcactgtgtt

SEQ ID NO: 100150 - DNA, 25 bp, Homo sapien
tctatgcctgagattgagaagggaa

SEQ ID NO: 100151 - DNA, 25 bp, Homo sapien
tctatgcctgagtttgagaagggaa

SEQ ID NO: 100152 - DNA, 25 bp, Homo sapien
tctatgcgtacaagccgctgtgccg

SEQ ID NO: 100153 - DNA, 25 bp, Homo sapien
tctatgcgtacaagcctctgtgccg

SEQ ID NO: 100154 - DNA, 25 bp, Homo sapien
tctatgctggtatgtcaatatttta

SEQ ID NO: 100155 - DNA, 25 bp, Homo sapien
tctatgctggtatgtcgatatttta

SEQ ID NO: 100156 - DNA, 25 bp, Homo sapien
tctatgcttttgagtcccaatgtgg

SEQ ID NO: 100157 - DNA, 25 bp, Homo sapien
tctatgctttttagtcccaatgtgg

SEQ ID NO: 100158 - DNA, 25 bp, Homo sapien
tctatggatctgagtacctttagta

SEQ ID NO: 100159 - DNA, 25 bp, Homo sapien
tctatggatctgagtatctttagta

SEQ ID NO: 100160 - DNA, 25 bp, Homo sapien
tctatggcaaactttttctgcttta

SEQ ID NO: 100161 - DNA, 25 bp, Homo sapien
tctatggcaaagtttttctgcttta

SEQ ID NO: 100162 - DNA, 25 bp, Homo sapien
tctatggcagttacggatgtatgaa

SEQ ID NO: 100163 - DNA, 25 bp, Homo sapien
tctatggcagttatggatgtatgaa

SEQ ID NO: 100164 - DNA, 25 bp, Homo sapien
tctatggccggcatgactcagcaag

SEQ ID NO: 100165 - DNA, 25 bp, Homo sapien
tctatggctggcatgactcagcaag

SEQ ID NO: 100166 - DNA, 25 bp, Homo sapien
tctatgtgttcaatacagatgcagc

SEQ ID NO: 100167 - DNA, 25 bp, Homo sapien
tctatgtgttcagtacagatgcagc

SEQ ID NO: 100168 - DNA, 25 bp, Homo sapien
tctatgttacatatattcatagact

SEQ ID NO: 100169 - DNA, 25 bp, Homo sapien
tctatgttacatgtattcatagact

SEQ ID NO: 100170 - DNA, 25 bp, Homo sapien
tctatgttgccatactcccataacg

SEQ ID NO: 100171 - DNA, 25 bp, Homo sapien
tctatgttgtcatactcccataacg

SEQ ID NO: 100172 - DNA, 25 bp, Homo sapien
tctatgttgtctaagctaatcataa

SEQ ID NO: 100173 - DNA, 25 bp, Homo sapien
tctatgttgtctgagctaatcataa

SEQ ID NO: 100174 - DNA, 25 bp, Homo sapien
tctatgttttatcatttatcagttg

SEQ ID NO: 100175 - DNA, 25 bp, Homo sapien
tctatgttttatgatttatcagttg

SEQ ID NO: 100176 - DNA, 25 bp, Homo sapien
tctattaaagtggcaatgcaccatg

SEQ ID NO: 100177 - DNA, 25 bp, Homo sapien
tctattaaagtggccatgcaccatg

SEQ ID NO: 100178 - DNA, 25 bp, Homo sapien
tctattaattgcagctgaacttaaa

SEQ ID NO: 100179 - DNA, 25 bp, Homo sapien
tctattaattgcagcttaacttaaa

SEQ ID NO: 100180 - DNA, 25 bp, Homo sapien
tctattacattacccagcatagtaa

SEQ ID NO: 100181 - DNA, 25 bp, Homo sapien
tctattacgttacccagcatagtaa

SEQ ID NO: 100182 - DNA, 25 bp, Homo sapien
tctattacttcaattcaactctcat

SEQ ID NO: 100183 - DNA, 25 bp, Homo sapien
tctattacttcgattcaactctcat

SEQ ID NO: 100184 - DNA, 25 bp, Homo sapien
tctattagatgagctaccagagatg

SEQ ID NO: 100185 - DNA, 25 bp, Homo sapien
tctattagatgagttaccagagatg

SEQ ID NO: 100186 - DNA, 25 bp, Homo sapien
tctattataaccagtgacccttcta

SEQ ID NO: 100187 - DNA, 25 bp, Homo sapien
tctattataaccagtggcccttcta

SEQ ID NO: 100188 - DNA, 25 bp, Homo sapien
tctattattcctacgtgtttctttt

SEQ ID NO: 100189 - DNA, 25 bp, Homo sapien
tctattattcctatgtgtttctttt

SEQ ID NO: 100190 - DNA, 25 bp, Homo sapien
tctattatttcagatacattgtgaa

SEQ ID NO: 100191 - DNA, 25 bp, Homo sapien
tctattatttcagatagattgtgaa

SEQ ID NO: 100192 - DNA, 25 bp, Homo sapien
tctattatttgtcaagtattaaagg

SEQ ID NO: 100193 - DNA, 25 bp, Homo sapien
tctattatttgttaagtattaaagg

SEQ ID NO: 100194 - DNA, 25 bp, Homo sapien
tctattcaggagcctgctgggtgat

SEQ ID NO: 100195 - DNA, 25 bp, Homo sapien
tctattcaggagcctgttgggtgat

SEQ ID NO: 100196 - DNA, 25 bp, Homo sapien
tctattcatttccttttacatctct

SEQ ID NO: 100197 - DNA, 25 bp, Homo sapien
tctattcatttctttttacatctct

SEQ ID NO: 100198 - DNA, 25 bp, Homo sapien
tctattcctcaacaagccaaattca

SEQ ID NO: 100199 - DNA, 25 bp, Homo sapien
tctattcctcaacaggccaaattca

SEQ ID NO: 100200 - DNA, 25 bp, Homo sapien
tctattcgcgaacaaaaggaagttg

SEQ ID NO: 100201 - DNA, 25 bp, Homo sapien
tctattcgggaacaaaaggaagttg

SEQ ID NO: 100202 - DNA, 25 bp, Homo sapien
tctattctttcacttaagagatctg

SEQ ID NO: 100203 - DNA, 25 bp, Homo sapien
tctattctttcccttaagagatctg

SEQ ID NO: 100204 - DNA, 25 bp, Homo sapien
tctattggaagaagatgccttgtag

SEQ ID NO: 100205 - DNA, 25 bp, Homo sapien
tctattggcagaagatgccttgtag

SEQ ID NO: 100206 - DNA, 25 bp, Homo sapien
tctattggtactattaactgccaac

SEQ ID NO: 100207 - DNA, 25 bp, Homo sapien
tctattggtactgttaactgccaac

SEQ ID NO: 100208 - DNA, 25 bp, Homo sapien
tctattgtgtatgattttaactgtg

SEQ ID NO: 100209 - DNA, 25 bp, Homo sapien
tctattgtgtatgtttttaactgtg

SEQ ID NO: 100210 - DNA, 25 bp, Homo sapien
tctatttaactcaacttccttccct

SEQ ID NO: 100211 - DNA, 25 bp, Homo sapien
tctatttaactcagcttccttccct

SEQ ID NO: 100212 - DNA, 25 bp, Homo sapien
tctatttcaactaagcaatggtgat

SEQ ID NO: 100213 - DNA, 25 bp, Homo sapien
tctatttcagatgtggaatcgcgac

SEQ ID NO: 100214 - DNA, 25 bp, Homo sapien
tctatttcagatttggaatcgcgac

SEQ ID NO: 100215 - DNA, 25 bp, Homo sapien
tctatttccactaagcaatggtgat

SEQ ID NO: 100216 - DNA, 25 bp, Homo sapien
tctatttctcttgcctttcggagag

SEQ ID NO: 100217 - DNA, 25 bp, Homo sapien
tctatttctcttgtctttcggagag

SEQ ID NO: 100218 - DNA, 25 bp, Homo sapien
tctatttgaaaatttcactattttg

SEQ ID NO: 100219 - DNA, 25 bp, Homo sapien
tctatttgaaaatttccctattttg

SEQ ID NO: 100220 - DNA, 25 bp, Homo sapien
tctattttacgcagcaggtttagat

SEQ ID NO: 100221 - DNA, 25 bp, Homo sapien
tctattttatgcagcaggtttagat

SEQ ID NO: 100222 - DNA, 25 bp, Homo sapien
tctattttcataactagaagacgaa

SEQ ID NO: 100223 - DNA, 25 bp, Homo sapien
tctattttcgtaactagaagacgaa

SEQ ID NO: 100224 - DNA, 25 bp, Homo sapien
tctattttctcatgcctaagtgaca

SEQ ID NO: 100225 - DNA, 25 bp, Homo sapien
tctattttctcatggctaagtgaca

SEQ ID NO: 100226 - DNA, 25 bp, Homo sapien
tctattttgagccttttttgacttt

SEQ ID NO: 100227 - DNA, 25 bp, Homo sapien
tctattttgagcgttttttgacttt

SEQ ID NO: 100228 - DNA, 25 bp, Homo sapien
tctattttgatacagtttgttagaa

SEQ ID NO: 100229 - DNA, 25 bp, Homo sapien
tctattttgatatagtttgttagaa

SEQ ID NO: 100230 - DNA, 25 bp, Homo sapien
tctattttgtggcacataatgcata

SEQ ID NO: 100231 - DNA, 25 bp, Homo sapien
tctattttgtgtcacataatgcata

SEQ ID NO: 100232 - DNA, 25 bp, Homo sapien
tctattttttcatttacgttgaatg

SEQ ID NO: 100233 - DNA, 25 bp, Homo sapien
tctattttttcatttatgttgaatg

SEQ ID NO: 100234 - DNA, 25 bp, Homo sapien
tctcaaaatctcctttaccacatga

SEQ ID NO: 100235 - DNA, 25 bp, Homo sapien
tctcaaaatttcctttaccacatga

SEQ ID NO: 100236 - DNA, 25 bp, Homo sapien
tctcaaagctgattggaacctttga

SEQ ID NO: 100237 - DNA, 25 bp, Homo sapien
tctcaaagctgattgggacctttga

SEQ ID NO: 100238 - DNA, 25 bp, Homo sapien
tctcaaagtccataacatttatctg

SEQ ID NO: 100239 - DNA, 25 bp, Homo sapien
tctcaaagtccctaacatttatctg

SEQ ID NO: 100240 - DNA, 25 bp, Homo sapien
tctcaaagtggagtgttctttctga

SEQ ID NO: 100241 - DNA, 25 bp, Homo sapien
tctcaaagtggagttttctttctga

SEQ ID NO: 100242 - DNA, 25 bp, Homo sapien
tctcaacaaccaaagtttgaacaac

SEQ ID NO: 100243 - DNA, 25 bp, Homo sapien
tctcaacaaccaatgtttgaacaac

SEQ ID NO: 100244 - DNA, 25 bp, Homo sapien
tctcaacactttgaaaacccaaggc

SEQ ID NO: 100245 - DNA, 25 bp, Homo sapien
tctcaacactttggaaacccaaggc

SEQ ID NO: 100246 - DNA, 25 bp, Homo sapien
tctcaacatttttgtgaacttccca

SEQ ID NO: 100247 - DNA, 25 bp, Homo sapien
tctcaacatttttgtggacttccca

SEQ ID NO: 100248 - DNA, 25 bp, Homo sapien
tctcaactaatactctgcttttggt

SEQ ID NO: 100249 - DNA, 25 bp, Homo sapien
tctcaactaatactgtgcttttggt

SEQ ID NO: 100250 - DNA, 25 bp, Homo sapien
tctcaacttttaactccaccctttc

SEQ ID NO: 100251 - DNA, 25 bp, Homo sapien
tctcaacttttcactccaccctttc

SEQ ID NO: 100252 - DNA, 25 bp, Homo sapien
tctcaagaaataagctgcaaatata

SEQ ID NO: 100253 - DNA, 25 bp, Homo sapien
tctcaagaaatatgctgcaaatata

SEQ ID NO: 100254 - DNA, 25 bp, Homo sapien
tctcaagaacctgggtttctcctct

SEQ ID NO: 100255 - DNA, 25 bp, Homo sapien
tctcaagatcctgggtttctcctct

SEQ ID NO: 100256 - DNA, 25 bp, Homo sapien
tctcaagcacttgtaaagaaacaca

SEQ ID NO: 100257 - DNA, 25 bp, Homo sapien
tctcaagcacttgtaaggaaacaca

SEQ ID NO: 100258 - DNA, 25 bp, Homo sapien
tctcaagtgaacctggagaagcaac

SEQ ID NO: 100259 - DNA, 25 bp, Homo sapien
tctcaagtgaatctggagaagcaac

SEQ ID NO: 100260 - DNA, 25 bp, Homo sapien
tctcaagtgttctcccatagaaata

SEQ ID NO: 100261 - DNA, 25 bp, Homo sapien
tctcaagtgttctcccgtagaaata

SEQ ID NO: 100262 - DNA, 25 bp, Homo sapien
tctcaagttttgttatcaatattat

SEQ ID NO: 100263 - DNA, 25 bp, Homo sapien
tctcaagttttgttgtcaatattat

SEQ ID NO: 100264 - DNA, 25 bp, Homo sapien
tctcaataccttatctaaatgccaa

SEQ ID NO: 100265 - DNA, 25 bp, Homo sapien
tctcaataccttttctaaatgccaa

SEQ ID NO: 100266 - DNA, 25 bp, Homo sapien
tctcaatatcttcacttaatcatct

SEQ ID NO: 100267 - DNA, 25 bp, Homo sapien
tctcaatatcttcccttaatcatct

SEQ ID NO: 100268 - DNA, 25 bp, Homo sapien
tctcaatgtgctcaagcatttaaag

SEQ ID NO: 100269 - DNA, 25 bp, Homo sapien
tctcaatgtgctcaaggatttaaag

SEQ ID NO: 100270 - DNA, 25 bp, Homo sapien
tctcaattacagccgtgtaagacat

SEQ ID NO: 100271 - DNA, 25 bp, Homo sapien
tctcaattacagccgtttaagacat

SEQ ID NO: 100272 - DNA, 25 bp, Homo sapien
tctcaattatccaggcatggtccgg

SEQ ID NO: 100273 - DNA, 25 bp, Homo sapien
tctcaatttataaggtcgtttaatt

SEQ ID NO: 100274 - DNA, 25 bp, Homo sapien
tctcaatttatgaggtcgtttaatt

SEQ ID NO: 100275 - DNA, 25 bp, Homo sapien
tctcaattttccaggcatggtccgg

SEQ ID NO: 100276 - DNA, 25 bp, Homo sapien
tctcacaatgaacgaggacatccaa

SEQ ID NO: 100277 - DNA, 25 bp, Homo sapien
tctcacaatgaatgaggacatccaa

SEQ ID NO: 100278 - DNA, 25 bp, Homo sapien
tctcacacatacgtagttcacaata

SEQ ID NO: 100279 - DNA, 25 bp, Homo sapien
tctcacacatataattttttaaaac

SEQ ID NO: 100280 - DNA, 25 bp, Homo sapien
tctcacacatatgtagttcacaata

SEQ ID NO: 100281 - DNA, 25 bp, Homo sapien
tctcacaccaagttttatgggttct

SEQ ID NO: 100282 - DNA, 25 bp, Homo sapien
tctcacaccaagttttgtgggttct

SEQ ID NO: 100283 - DNA, 25 bp, Homo sapien
tctcacacgtataattttttaaaac

SEQ ID NO: 100284 - DNA, 25 bp, Homo sapien
tctcacagcatgattttattacagg

SEQ ID NO: 100285 - DNA, 25 bp, Homo sapien
tctcacagtatgattttattacagg

SEQ ID NO: 100286 - DNA, 25 bp, Homo sapien
tctcacagttacaggagctagaggt

SEQ ID NO: 100287 - DNA, 25 bp, Homo sapien
tctcacagttataggagctagaggt

SEQ ID NO: 100288 - DNA, 25 bp, Homo sapien
tctcacatgtaatgtcatcacattt

SEQ ID NO: 100289 - DNA, 25 bp, Homo sapien
tctcacatgtaatgtcgtcacattt

SEQ ID NO: 100290 - DNA, 25 bp, Homo sapien
tctcaccctagaggccactgtactt

SEQ ID NO: 100291 - DNA, 25 bp, Homo sapien
tctcaccctagaggccgctgtactt

SEQ ID NO: 100292 - DNA, 25 bp, Homo sapien
tctcacctgtgtgctccctgactgg

SEQ ID NO: 100293 - DNA, 25 bp, Homo sapien
tctcacctgtgtgctctctgactgg

SEQ ID NO: 100294 - DNA, 25 bp, Homo sapien
tctcacgacacattgtatgtatcca

SEQ ID NO: 100295 - DNA, 25 bp, Homo sapien
tctcacgacgcattgtatgtatcca

SEQ ID NO: 100296 - DNA, 25 bp, Homo sapien
tctcacggcgaatcaaatgtcagtt

SEQ ID NO: 100297 - DNA, 25 bp, Homo sapien
tctcacggctaatcaaatgtcagtt

SEQ ID NO: 100298 - DNA, 25 bp, Homo sapien
tctcactaaaattcaagaatattca

SEQ ID NO: 100299 - DNA, 25 bp, Homo sapien
tctcactaaaattcgagaatattca

SEQ ID NO: 100300 - DNA, 25 bp, Homo sapien
tctcactcatctctgtaacagttca

SEQ ID NO: 100301 - DNA, 25 bp, Homo sapien
tctcactcatctttgtaacagttca

SEQ ID NO: 100302 - DNA, 25 bp, Homo sapien
tctcactcttaatagaaactgctgc

SEQ ID NO: 100303 - DNA, 25 bp, Homo sapien
tctcactcttagactcaggaaatta

SEQ ID NO: 100304 - DNA, 25 bp, Homo sapien
tctcactcttagattcaggaaatta

SEQ ID NO: 100305 - DNA, 25 bp, Homo sapien
tctcactcttagtagaaactgctgc

SEQ ID NO: 100306 - DNA, 25 bp, Homo sapien
tctcactctttctcgccgctagtgt

SEQ ID NO: 100307 - DNA, 25 bp, Homo sapien
tctcactctttctcgctgctagtgt

SEQ ID NO: 100308 - DNA, 25 bp, Homo sapien
tctcactgaagaagatttgtttatg

SEQ ID NO: 100309 - DNA, 25 bp, Homo sapien
tctcactgaagaggatttgtttatg

SEQ ID NO: 100310 - DNA, 25 bp, Homo sapien
tctcactgccactaatttagagctt

SEQ ID NO: 100311 - DNA, 25 bp, Homo sapien
tctcactgctactaatttagagctt

SEQ ID NO: 100312 - DNA, 25 bp, Homo sapien
tctcactttcgctgttcttcctgcc

SEQ ID NO: 100313 - DNA, 25 bp, Homo sapien
tctcactttgtgccactctgatgct

SEQ ID NO: 100314 - DNA, 25 bp, Homo sapien
tctcactttgtgtcactctgatgct

SEQ ID NO: 100315 - DNA, 25 bp, Homo sapien
tctcacttttgctgttcttcctgcc

SEQ ID NO: 100316 - DNA, 25 bp, Homo sapien
tctcagaaacagccaggatacagtg

SEQ ID NO: 100317 - DNA, 25 bp, Homo sapien
tctcagaaacagccgggatacagtg

SEQ ID NO: 100318 - DNA, 25 bp, Homo sapien
tctcagaaaccatggagccatattg

SEQ ID NO: 100319 - DNA, 25 bp, Homo sapien
tctcagaaataatgttttccaataa

SEQ ID NO: 100320 - DNA, 25 bp, Homo sapien
tctcagaaatagtgttttccaataa

SEQ ID NO: 100321 - DNA, 25 bp, Homo sapien
tctcagaaatcatggagccatattg

SEQ ID NO: 100322 - DNA, 25 bp, Homo sapien
tctcagaacgttaccacactttata

SEQ ID NO: 100323 - DNA, 25 bp, Homo sapien
tctcagaagacatctgcaggttcta

SEQ ID NO: 100324 - DNA, 25 bp, Homo sapien
tctcagaagacatctggaggttcta

SEQ ID NO: 100325 - DNA, 25 bp, Homo sapien
tctcagaatatactgatgaatgcaa

SEQ ID NO: 100326 - DNA, 25 bp, Homo sapien
tctcagaatatattgatgaatgcaa

SEQ ID NO: 100327 - DNA, 25 bp, Homo sapien
tctcagaatgttaccacactttata

SEQ ID NO: 100328 - DNA, 25 bp, Homo sapien
tctcagaattttgcaagtgcttcag

SEQ ID NO: 100329 - DNA, 25 bp, Homo sapien
tctcagaattttggaagtgcttcag

SEQ ID NO: 100330 - DNA, 25 bp, Homo sapien
tctcagagaccaaagagcaagagtt

SEQ ID NO: 100331 - DNA, 25 bp, Homo sapien
tctcagagatcaaagagcaagagtt

SEQ ID NO: 100332 - DNA, 25 bp, Homo sapien
tctcagaggacaccatcgggaatgt

SEQ ID NO: 100333 - DNA, 25 bp, Homo sapien
tctcagaggacaccattgggaatgt

SEQ ID NO: 100334 - DNA, 25 bp, Homo sapien
tctcagaggttattaataccagctg

SEQ ID NO: 100335 - DNA, 25 bp, Homo sapien
tctcagaggttgttaataccagctg

SEQ ID NO: 100336 - DNA, 25 bp, Homo sapien
tctcagagtctcaccaaaggttttt

SEQ ID NO: 100337 - DNA, 25 bp, Homo sapien
tctcagagtctcatcaaaggttttt

SEQ ID NO: 100338 - DNA, 25 bp, Homo sapien
tctcagattctgtttacggagaaca

SEQ ID NO: 100339 - DNA, 25 bp, Homo sapien
tctcagattctgtttatggagaaca

SEQ ID NO: 100340 - DNA, 25 bp, Homo sapien
tctcagcatatacaagttcaggaaa

SEQ ID NO: 100341 - DNA, 25 bp, Homo sapien
tctcagcatatacaggttcaggaaa

SEQ ID NO: 100342 - DNA, 25 bp, Homo sapien
tctcagccacgaattaacttgctct

SEQ ID NO: 100343 - DNA, 25 bp, Homo sapien
tctcagccaggctacaacaaggagt

SEQ ID NO: 100344 - DNA, 25 bp, Homo sapien
tctcagccaggctgcaacaaggagt

SEQ ID NO: 100345 - DNA, 25 bp, Homo sapien
tctcagccatgaattaacttgctct

SEQ ID NO: 100346 - DNA, 25 bp, Homo sapien
tctcagccctgagagtccttgcctg

SEQ ID NO: 100347 - DNA, 25 bp, Homo sapien
tctcagccctgagggtccttgcctg

SEQ ID NO: 100348 - DNA, 25 bp, Homo sapien
tctcagcgctagttgacggctagcc

SEQ ID NO: 100349 - DNA, 25 bp, Homo sapien
tctcagcgctagttgatggctagcc

SEQ ID NO: 100350 - DNA, 25 bp, Homo sapien
tctcagctgccacttaatgacttta

SEQ ID NO: 100351 - DNA, 25 bp, Homo sapien
tctcagctgccgcttaatgacttta

SEQ ID NO: 100352 - DNA, 25 bp, Homo sapien
tctcagcttgccgcaatcttggtct

SEQ ID NO: 100353 - DNA, 25 bp, Homo sapien
tctcagcttgctgcaatcttggtct

SEQ ID NO: 100354 - DNA, 25 bp, Homo sapien
tctcaggacatccgctagcaaatct

SEQ ID NO: 100355 - DNA, 25 bp, Homo sapien
tctcaggacatctgctagcaaatct

SEQ ID NO: 100356 - DNA, 25 bp, Homo sapien
tctcaggcattacaggagggagcaa

SEQ ID NO: 100357 - DNA, 25 bp, Homo sapien
tctcaggcattagaggagggagcaa

SEQ ID NO: 100358 - DNA, 25 bp, Homo sapien
tctcaggccagtcactttctttttt

SEQ ID NO: 100359 - DNA, 25 bp, Homo sapien
tctcaggccgcatataaaatacacc

SEQ ID NO: 100360 - DNA, 25 bp, Homo sapien
tctcaggccggtcactttctttttt

SEQ ID NO: 100361 - DNA, 25 bp, Homo sapien
tctcaggctgcatataaaatacacc

SEQ ID NO: 100362 - DNA, 25 bp, Homo sapien
tctcagggcacgacgagaagcccat

SEQ ID NO: 100363 - DNA, 25 bp, Homo sapien
tctcagggcacgatgagaagcccat

SEQ ID NO: 100364 - DNA, 25 bp, Homo sapien
tctcagtcatcaagaacaactagaa

SEQ ID NO: 100365 - DNA, 25 bp, Homo sapien
tctcagtcatcaggaacaactagaa

SEQ ID NO: 100366 - DNA, 25 bp, Homo sapien
tctcagtccttgtcaacaaaatgga

SEQ ID NO: 100367 - DNA, 25 bp, Homo sapien
tctcagtccttgtcgacaaaatgga

SEQ ID NO: 100368 - DNA, 25 bp, Homo sapien
tctcagtcgtgtttctctaatgaga

SEQ ID NO: 100369 - DNA, 25 bp, Homo sapien
tctcagtcgtgtttgtctaatgaga

SEQ ID NO: 100370 - DNA, 25 bp, Homo sapien
tctcagtctcacacagaaatattaa

SEQ ID NO: 100371 - DNA, 25 bp, Homo sapien
tctcagtctcacacggaaatattaa

SEQ ID NO: 100372 - DNA, 25 bp, Homo sapien
tctcagtctccatagttatatgagc

SEQ ID NO: 100373 - DNA, 25 bp, Homo sapien
tctcagtctgcatagttatatgagc

SEQ ID NO: 100374 - DNA, 25 bp, Homo sapien
tctcagtctggacgtaggagttggc

SEQ ID NO: 100375 - DNA, 25 bp, Homo sapien
tctcagtctggatgtaggagttggc

SEQ ID NO: 100376 - DNA, 25 bp, Homo sapien
tctcagtggtccacgtgctacaact

SEQ ID NO: 100377 - DNA, 25 bp, Homo sapien
tctcagtggtccatgtgctacaact

SEQ ID NO: 100378 - DNA, 25 bp, Homo sapien
tctcagtgtaaacatcaaagatctt

SEQ ID NO: 100379 - DNA, 25 bp, Homo sapien
tctcagtgtaaacgtcaaagatctt

SEQ ID NO: 100380 - DNA, 25 bp, Homo sapien
tctcagtgtctccgtaaatttgtct

SEQ ID NO: 100381 - DNA, 25 bp, Homo sapien
tctcagtgtttccgtaaatttgtct

SEQ ID NO: 100382 - DNA, 25 bp, Homo sapien
tctcagttcaggtcttctagcttta

SEQ ID NO: 100383 - DNA, 25 bp, Homo sapien
tctcagttcgggtcttctagcttta

SEQ ID NO: 100384 - DNA, 25 bp, Homo sapien
tctcagttgaagacctcacttatta

SEQ ID NO: 100385 - DNA, 25 bp, Homo sapien
tctcagttgaagatctcacttatta

SEQ ID NO: 100386 - DNA, 25 bp, Homo sapien
tctcagttggacatgaatgttgctc

SEQ ID NO: 100387 - DNA, 25 bp, Homo sapien
tctcagttggatatgaatgttgctc

SEQ ID NO: 100388 - DNA, 25 bp, Homo sapien
tctcagtttgggagagaatatgatt

SEQ ID NO: 100389 - DNA, 25 bp, Homo sapien
tctcagttttggagagaatatgatt

SEQ ID NO: 100390 - DNA, 25 bp, Homo sapien
tctcagtttttacgtcacttaaatg

SEQ ID NO: 100391 - DNA, 25 bp, Homo sapien
tctcagtttttatgtcacttaaatg

SEQ ID NO: 100392 - DNA, 25 bp, Homo sapien
tctcataagcggcctttggagtatt

SEQ ID NO: 100393 - DNA, 25 bp, Homo sapien
tctcataagcgggctttggagtatt

SEQ ID NO: 100394 - DNA, 25 bp, Homo sapien
tctcataatgtgcttcctgaactcc

SEQ ID NO: 100395 - DNA, 25 bp, Homo sapien
tctcataatgtgcttcttgaactcc

SEQ ID NO: 100396 - DNA, 25 bp, Homo sapien
tctcataattctagcaaagagtcct

SEQ ID NO: 100397 - DNA, 25 bp, Homo sapien
tctcataattctaggaaagagtcct

SEQ ID NO: 100398 - DNA, 25 bp, Homo sapien
tctcatacacgcaattgtgtgaaga

SEQ ID NO: 100399 - DNA, 25 bp, Homo sapien
tctcatacatgcaattgtgtgaaga

SEQ ID NO: 100400 - DNA, 25 bp, Homo sapien
tctcatacccagccgaggctttctc

SEQ ID NO: 100401 - DNA, 25 bp, Homo sapien
tctcatacccaggcgaggctttctc

SEQ ID NO: 100402 - DNA, 25 bp, Homo sapien
tctcatacttatctcggtctgagtc

SEQ ID NO: 100403 - DNA, 25 bp, Homo sapien
tctcatacttatcttggtctgagtc

SEQ ID NO: 100404 - DNA, 25 bp, Homo sapien
tctcatagagtttgcagactagtga

SEQ ID NO: 100405 - DNA, 25 bp, Homo sapien
tctcatagagtttggagactagtga

SEQ ID NO: 100406 - DNA, 25 bp, Homo sapien
tctcatagtagcacatgactttgaa

SEQ ID NO: 100407 - DNA, 25 bp, Homo sapien
tctcatagtagcacgtgactttgaa

SEQ ID NO: 100408 - DNA, 25 bp, Homo sapien
tctcatatatggctttcattgtgtt

SEQ ID NO: 100409 - DNA, 25 bp, Homo sapien
tctcatatatgggtttcattgtgtt

SEQ ID NO: 100410 - DNA, 25 bp, Homo sapien
tctcatcaacactccttattaactg

SEQ ID NO: 100411 - DNA, 25 bp, Homo sapien
tctcatcaacacttcttattaactg

SEQ ID NO: 100412 - DNA, 25 bp, Homo sapien
tctcatcacggcttctatgggggca

SEQ ID NO: 100413 - DNA, 25 bp, Homo sapien
tctcatcaggttactgagactatgt

SEQ ID NO: 100414 - DNA, 25 bp, Homo sapien
tctcatcaggttactgggactatgt

SEQ ID NO: 100415 - DNA, 25 bp, Homo sapien
tctcatcatggcttctatgggggca

SEQ ID NO: 100416 - DNA, 25 bp, Homo sapien
tctcatccatatcattgtcactgat

SEQ ID NO: 100417 - DNA, 25 bp, Homo sapien
tctcatccatattattgtcactgat

SEQ ID NO: 100418 - DNA, 25 bp, Homo sapien
tctcatcccagtagaatatgtagca

SEQ ID NO: 100419 - DNA, 25 bp, Homo sapien
tctcatcccagtggaatatgtagca

SEQ ID NO: 100420 - DNA, 25 bp, Homo sapien
tctcatcgagttctcgtcatgagcc

SEQ ID NO: 100421 - DNA, 25 bp, Homo sapien
tctcatcgagttcttgtcatgagcc

SEQ ID NO: 100422 - DNA, 25 bp, Homo sapien
tctcatctccaatcaaaaccttgga

SEQ ID NO: 100423 - DNA, 25 bp, Homo sapien
tctcatctccaatcaacaccttgga

SEQ ID NO: 100424 - DNA, 25 bp, Homo sapien
tctcatctccacaattgttgcttta

SEQ ID NO: 100425 - DNA, 25 bp, Homo sapien
tctcatctccacaatttttgcttta

SEQ ID NO: 100426 - DNA, 25 bp, Homo sapien
tctcatctctactctctctcaaagg

SEQ ID NO: 100427 - DNA, 25 bp, Homo sapien
tctcatctctattctctctcaaagg

SEQ ID NO: 100428 - DNA, 25 bp, Homo sapien
tctcatctgtccaaattgtaattag

SEQ ID NO: 100429 - DNA, 25 bp, Homo sapien
tctcatctgtccgaattgtaattag

SEQ ID NO: 100430 - DNA, 25 bp, Homo sapien
tctcatcttgcaaaaaatgaaactc

SEQ ID NO: 100431 - DNA, 25 bp, Homo sapien
tctcatcttgcaaataatgaaactc

SEQ ID NO: 100432 - DNA, 25 bp, Homo sapien
tctcatctttgctctaggcactgtt

SEQ ID NO: 100433 - DNA, 25 bp, Homo sapien
tctcatctttgctttaggcactgtt

SEQ ID NO: 100434 - DNA, 25 bp, Homo sapien
tctcatgaaagactccaacaaggca

SEQ ID NO: 100435 - DNA, 25 bp, Homo sapien
tctcatgaaagattccaacaaggca

SEQ ID NO: 100436 - DNA, 25 bp, Homo sapien
tctcatgaacccagccattcgtcat

SEQ ID NO: 100437 - DNA, 25 bp, Homo sapien
tctcatgaccccagccattcgtcat

SEQ ID NO: 100438 - DNA, 25 bp, Homo sapien
tctcatgccattctcctaactcata

SEQ ID NO: 100439 - DNA, 25 bp, Homo sapien
tctcatgccgttctcctaactcata

SEQ ID NO: 100440 - DNA, 25 bp, Homo sapien
tctcatgctagaaatccaatacttg

SEQ ID NO: 100441 - DNA, 25 bp, Homo sapien
tctcatgctagaactccaatacttg

SEQ ID NO: 100442 - DNA, 25 bp, Homo sapien
tctcatgctcttgaagttcgtgatg

SEQ ID NO: 100443 - DNA, 25 bp, Homo sapien
tctcatgctcttgacgttcgtgatg

SEQ ID NO: 100444 - DNA, 25 bp, Homo sapien
tctcatggcggaaggcacgggagga

SEQ ID NO: 100445 - DNA, 25 bp, Homo sapien
tctcatgggcagtctcattttctag

SEQ ID NO: 100446 - DNA, 25 bp, Homo sapien
tctcatgggcagtctctttttctag

SEQ ID NO: 100447 - DNA, 25 bp, Homo sapien
tctcatggtggaaggcacgggagga

SEQ ID NO: 100448 - DNA, 25 bp, Homo sapien
tctcatggttacgtgaatatggact

SEQ ID NO: 100449 - DNA, 25 bp, Homo sapien
tctcatggttatgtgaatatggact

SEQ ID NO: 100450 - DNA, 25 bp, Homo sapien
tctcatgtcagcactatggctcaga

SEQ ID NO: 100451 - DNA, 25 bp, Homo sapien
tctcatgtcagcagtatggctcaga

SEQ ID NO: 100452 - DNA, 25 bp, Homo sapien
tctcattaaacacttatttctggca

SEQ ID NO: 100453 - DNA, 25 bp, Homo sapien
tctcattaaacatttatttctggca

SEQ ID NO: 100454 - DNA, 25 bp, Homo sapien
tctcattctcacaaatgtgcacata

SEQ ID NO: 100455 - DNA, 25 bp, Homo sapien
tctcattctggcagcgccccctgct

SEQ ID NO: 100456 - DNA, 25 bp, Homo sapien
tctcattctggcagtgccccctgct

SEQ ID NO: 100457 - DNA, 25 bp, Homo sapien
tctcattcttacaaatgtgcacata

SEQ ID NO: 100458 - DNA, 25 bp, Homo sapien
tctcattcttttaccaatttcccct

SEQ ID NO: 100459 - DNA, 25 bp, Homo sapien
tctcattcttttaccattttcccct

SEQ ID NO: 100460 - DNA, 25 bp, Homo sapien
tctcattgcctattgtttctatttt

SEQ ID NO: 100461 - DNA, 25 bp, Homo sapien
tctcattgcgtgaattcaagtcaca

SEQ ID NO: 100462 - DNA, 25 bp, Homo sapien
tctcattgtccagaccttcatgttt

SEQ ID NO: 100463 - DNA, 25 bp, Homo sapien
tctcattgtccaggccttcatgttt

SEQ ID NO: 100464 - DNA, 25 bp, Homo sapien
tctcattgtctattgtttctatttt

SEQ ID NO: 100465 - DNA, 25 bp, Homo sapien
tctcattgtgaattctgggacccag

SEQ ID NO: 100466 - DNA, 25 bp, Homo sapien
tctcattgtgtgaattcaagtcaca

SEQ ID NO: 100467 - DNA, 25 bp, Homo sapien
tctcattgttaattctgggacccag

SEQ ID NO: 100468 - DNA, 25 bp, Homo sapien
tctcatttaatcctcataataactc

SEQ ID NO: 100469 - DNA, 25 bp, Homo sapien
tctcatttaattctcataataactc

SEQ ID NO: 100470 - DNA, 25 bp, Homo sapien
tctcatttacaatctctgagaacca

SEQ ID NO: 100471 - DNA, 25 bp, Homo sapien
tctcatttatctccacattctttgt

SEQ ID NO: 100472 - DNA, 25 bp, Homo sapien
tctcatttgcaatctctgagaacca

SEQ ID NO: 100473 - DNA, 25 bp, Homo sapien
tctcatttgtctccacattctttgt

SEQ ID NO: 100474 - DNA, 25 bp, Homo sapien
tctcatttgtctgtgatccctgaag

SEQ ID NO: 100475 - DNA, 25 bp, Homo sapien
tctcatttgtctttgatccctgaag

SEQ ID NO: 100476 - DNA, 25 bp, Homo sapien
tctccaaaaactaaagtaggaattg

SEQ ID NO: 100477 - DNA, 25 bp, Homo sapien
tctccaaaaactaatgtaggaattg

SEQ ID NO: 100478 - DNA, 25 bp, Homo sapien
tctccaaaaactttcccaatgtatt

SEQ ID NO: 100479 - DNA, 25 bp, Homo sapien
tctccaaaaactttgccaatgtatt

SEQ ID NO: 100480 - DNA, 25 bp, Homo sapien
tctccaaacggacccaggttgtgag

SEQ ID NO: 100481 - DNA, 25 bp, Homo sapien
tctccaaatcggagtgtcagatgct

SEQ ID NO: 100482 - DNA, 25 bp, Homo sapien
tctccaaatggacccaggttgtgag

SEQ ID NO: 100483 - DNA, 25 bp, Homo sapien
tctccaaattggagtgtcagatgct

SEQ ID NO: 100484 - DNA, 25 bp, Homo sapien
tctccaaggcatatcattgaccttt

SEQ ID NO: 100485 - DNA, 25 bp, Homo sapien
tctccaaggcatgtcattgaccttt

SEQ ID NO: 100486 - DNA, 25 bp, Homo sapien
tctccaatatgaaaggtgtgagccc

SEQ ID NO: 100487 - DNA, 25 bp, Homo sapien
tctccaatcaaaaccttggagtaat

SEQ ID NO: 100488 - DNA, 25 bp, Homo sapien
tctccaatcaacaccttggagtaat

SEQ ID NO: 100489 - DNA, 25 bp, Homo sapien
tctccaatctgaaaggtgtgagccc

SEQ ID NO: 100490 - DNA, 25 bp, Homo sapien
tctccaatgttcagcagcttgcatc

SEQ ID NO: 100491 - DNA, 25 bp, Homo sapien
tctccaatgtttagcagcttgcatc

SEQ ID NO: 100492 - DNA, 25 bp, Homo sapien
tctccacaattgttgctttaggaat

SEQ ID NO: 100493 - DNA, 25 bp, Homo sapien
tctccacaatttttgctttaggaat

SEQ ID NO: 100494 - DNA, 25 bp, Homo sapien
tctccaccaatcatgttatacctgg

SEQ ID NO: 100495 - DNA, 25 bp, Homo sapien
tctccaccaatcgtgttatacctgg

SEQ ID NO: 100496 - DNA, 25 bp, Homo sapien
tctccactatgtttctaaaactttc

SEQ ID NO: 100497 - DNA, 25 bp, Homo sapien
tctccactctgaatacccagtgagt

SEQ ID NO: 100498 - DNA, 25 bp, Homo sapien
tctccactctgagtacccagtgagt

SEQ ID NO: 100499 - DNA, 25 bp, Homo sapien
tctccactgtgtttctaaaactttc

SEQ ID NO: 100500 - DNA, 25 bp, Homo sapien
tctccagaaaatgcggttttgtttt

SEQ ID NO: 100501 - DNA, 25 bp, Homo sapien
tctccagaaaatgtggttttgtttt

SEQ ID NO: 100502 - DNA, 25 bp, Homo sapien
tctccagagcaatgtaaaaatcaca

SEQ ID NO: 100503 - DNA, 25 bp, Homo sapien
tctccagagcaatgtagaaatcaca

SEQ ID NO: 100504 - DNA, 25 bp, Homo sapien
tctccagatagcaggatagctgaac

SEQ ID NO: 100505 - DNA, 25 bp, Homo sapien
tctccagatccttaatatcatcaca

SEQ ID NO: 100506 - DNA, 25 bp, Homo sapien
tctccagatccttaatgtcatcaca

SEQ ID NO: 100507 - DNA, 25 bp, Homo sapien
tctccagatcgcaggatagctgaac

SEQ ID NO: 100508 - DNA, 25 bp, Homo sapien
tctccagatggaagatgttctttaa

SEQ ID NO: 100509 - DNA, 25 bp, Homo sapien
tctccagatggaagttgttctttaa

SEQ ID NO: 100510 - DNA, 25 bp, Homo sapien
tctccagattttcaacctgtgcagt

SEQ ID NO: 100511 - DNA, 25 bp, Homo sapien
tctccagattttcgacctgtgcagt

SEQ ID NO: 100512 - DNA, 25 bp, Homo sapien
tctccagccaaactgcctgaagtat

SEQ ID NO: 100513 - DNA, 25 bp, Homo sapien
tctccagccaaagtgcctgaagtat

SEQ ID NO: 100514 - DNA, 25 bp, Homo sapien
tctccagccatacttgggtaacaga

SEQ ID NO: 100515 - DNA, 25 bp, Homo sapien
tctccagccatatttgggtaacaga

SEQ ID NO: 100516 - DNA, 25 bp, Homo sapien
tctccaggaaaatattgccttctta

SEQ ID NO: 100517 - DNA, 25 bp, Homo sapien
tctccaggaaaatgttgccttctta

SEQ ID NO: 100518 - DNA, 25 bp, Homo sapien
tctccataacaataggctgttttat

SEQ ID NO: 100519 - DNA, 25 bp, Homo sapien
tctccatagctgtttcactgtcaga

SEQ ID NO: 100520 - DNA, 25 bp, Homo sapien
tctccatagctgtttcgctgtcaga

SEQ ID NO: 100521 - DNA, 25 bp, Homo sapien
tctccataggtctcatgccacattt

SEQ ID NO: 100522 - DNA, 25 bp, Homo sapien
tctccataggtcttatgccacattt

SEQ ID NO: 100523 - DNA, 25 bp, Homo sapien
tctccatatcaataggctgttttat

SEQ ID NO: 100524 - DNA, 25 bp, Homo sapien
tctccatatgcctgaacatttgatt

SEQ ID NO: 100525 - DNA, 25 bp, Homo sapien
tctccatatgcctggacatttgatt

SEQ ID NO: 100526 - DNA, 25 bp, Homo sapien
tctccatcaacactgctactgcact

SEQ ID NO: 100527 - DNA, 25 bp, Homo sapien
tctccatcaagcatcaacctttagg

SEQ ID NO: 100528 - DNA, 25 bp, Homo sapien
tctccatcaagcatcagcctttagg

SEQ ID NO: 100529 - DNA, 25 bp, Homo sapien
tctccatcagctcactttccatttt

SEQ ID NO: 100530 - DNA, 25 bp, Homo sapien
tctccatcatctcactttccatttt

SEQ ID NO: 100531 - DNA, 25 bp, Homo sapien
tctccatcgacactgctactgcact

SEQ ID NO: 100532 - DNA, 25 bp, Homo sapien
tctccatctctttggtcttgtccac

SEQ ID NO: 100533 - DNA, 25 bp, Homo sapien
tctccatctgtttggtcttgtccac

SEQ ID NO: 100534 - DNA, 25 bp, Homo sapien
tctccatgacttggtgctcatgttt

SEQ ID NO: 100535 - DNA, 25 bp, Homo sapien
tctccatggcttggtgctcatgttt

SEQ ID NO: 100536 - DNA, 25 bp, Homo sapien
tctccatgggcttacagtcgtgtgt

SEQ ID NO: 100537 - DNA, 25 bp, Homo sapien
tctccatgggcttccagtcgtgtgt

SEQ ID NO: 100538 - DNA, 25 bp, Homo sapien
tctccatgtcacctttcaccaagta

SEQ ID NO: 100539 - DNA, 25 bp, Homo sapien
tctccatgtcacgtttcaccaagta

SEQ ID NO: 100540 - DNA, 25 bp, Homo sapien
tctccatgtttcagagtcatcgtat

SEQ ID NO: 100541 - DNA, 25 bp, Homo sapien
tctccatgtttcggagtcatcgtat

SEQ ID NO: 100542 - DNA, 25 bp, Homo sapien
tctccattcattcttaagtgcaaaa

SEQ ID NO: 100543 - DNA, 25 bp, Homo sapien
tctccattcgttcttaagtgcaaaa

SEQ ID NO: 100544 - DNA, 25 bp, Homo sapien
tctccatttcattctagttgctggg

SEQ ID NO: 100545 - DNA, 25 bp, Homo sapien
tctccatttgtgcacgactgttcta

SEQ ID NO: 100546 - DNA, 25 bp, Homo sapien
tctccatttgtgtacgactgttcta

SEQ ID NO: 100547 - DNA, 25 bp, Homo sapien
tctccattttattctagttgctggg

SEQ ID NO: 100548 - DNA, 25 bp, Homo sapien
tctcccaaatgaacagtgttcctct

SEQ ID NO: 100549 - DNA, 25 bp, Homo sapien
tctcccaactgaacagtgttcctct

SEQ ID NO: 100550 - DNA, 25 bp, Homo sapien
tctcccaagtctaacttgtttcatg

SEQ ID NO: 100551 - DNA, 25 bp, Homo sapien
tctcccaagtctaccttgtttcatg

SEQ ID NO: 100552 - DNA, 25 bp, Homo sapien
tctcccagactgccatgtcaaagtt

SEQ ID NO: 100553 - DNA, 25 bp, Homo sapien
tctcccagactgctatgtcaaagtt

SEQ ID NO: 100554 - DNA, 25 bp, Homo sapien
tctcccagcttccgctaatacatgt

SEQ ID NO: 100555 - DNA, 25 bp, Homo sapien
tctcccagcttctgctaatacatgt

SEQ ID NO: 100556 - DNA, 25 bp, Homo sapien
tctcccaggtgttgaccctctacca

SEQ ID NO: 100557 - DNA, 25 bp, Homo sapien
tctcccaggtgtttaccctctacca

SEQ ID NO: 100558 - DNA, 25 bp, Homo sapien
tctcccatcgattccaacttttccc

SEQ ID NO: 100559 - DNA, 25 bp, Homo sapien
tctcccatcgattgcaacttttccc

SEQ ID NO: 100560 - DNA, 25 bp, Homo sapien
tctcccattatccacgtttatcctc

SEQ ID NO: 100561 - DNA, 25 bp, Homo sapien
tctcccattatccatgtttatcctc

SEQ ID NO: 100562 - DNA, 25 bp, Homo sapien
tctccccaatacgcacagtaatatg

SEQ ID NO: 100563 - DNA, 25 bp, Homo sapien
tctccccagtacgcacagtaatatg

SEQ ID NO: 100564 - DNA, 25 bp, Homo sapien
tctcccgaatgatgggatctgtcca

SEQ ID NO: 100565 - DNA, 25 bp, Homo sapien
tctcccgagtgatgggatctgtcca

SEQ ID NO: 100566 - DNA, 25 bp, Homo sapien
tctcccgcaacattcacatctgcat

SEQ ID NO: 100567 - DNA, 25 bp, Homo sapien
tctcccgcaacatttacatctgcat

SEQ ID NO: 100568 - DNA, 25 bp, Homo sapien
tctcccgggcctacgcagcgctggg

SEQ ID NO: 100569 - DNA, 25 bp, Homo sapien
tctcccgggtctacgcagcgctggg

SEQ ID NO: 100570 - DNA, 25 bp, Homo sapien
tctccctcactttcccagagcatct

SEQ ID NO: 100571 - DNA, 25 bp, Homo sapien
tctccctcacttttccagagcatct

SEQ ID NO: 100572 - DNA, 25 bp, Homo sapien
tctccctctagtgtattttgtatag

SEQ ID NO: 100573 - DNA, 25 bp, Homo sapien
tctccctctagtgtgttttgtatag

SEQ ID NO: 100574 - DNA, 25 bp, Homo sapien
tctccctctgcgctgacacgaacat

SEQ ID NO: 100575 - DNA, 25 bp, Homo sapien
tctccctctgcgttgacacgaacat

SEQ ID NO: 100576 - DNA, 25 bp, Homo sapien
tctccctgctttgcgtcttgtgctc

SEQ ID NO: 100577 - DNA, 25 bp, Homo sapien
tctccctgctttgtgtcttgtgctc

SEQ ID NO: 100578 - DNA, 25 bp, Homo sapien
tctcccttcctccgtaatcattaca

SEQ ID NO: 100579 - DNA, 25 bp, Homo sapien
tctcccttcctctgtaatcattaca

SEQ ID NO: 100580 - DNA, 25 bp, Homo sapien
tctcccttgaatcaatgaatgagaa

SEQ ID NO: 100581 - DNA, 25 bp, Homo sapien
tctcccttgaatgaatgaatgagaa

SEQ ID NO: 100582 - DNA, 25 bp, Homo sapien
tctccgagccgcaccttcctaagta

SEQ ID NO: 100583 - DNA, 25 bp, Homo sapien
tctccgagctgcaccttcctaagta

SEQ ID NO: 100584 - DNA, 25 bp, Homo sapien
tctccgcactgaataggactcaagg

SEQ ID NO: 100585 - DNA, 25 bp, Homo sapien
tctccgcattgaataggactcaagg

SEQ ID NO: 100586 - DNA, 25 bp, Homo sapien
tctcctaccacacataacgccaagg

SEQ ID NO: 100587 - DNA, 25 bp, Homo sapien
tctcctaccacgcataacgccaagg

SEQ ID NO: 100588 - DNA, 25 bp, Homo sapien
tctcctagacatcatggttactttc

SEQ ID NO: 100589 - DNA, 25 bp, Homo sapien
tctcctaggcatcatggttactttc

SEQ ID NO: 100590 - DNA, 25 bp, Homo sapien
tctcctatccacctgcaggtttaca

SEQ ID NO: 100591 - DNA, 25 bp, Homo sapien
tctcctatccacctgcgggtttaca

SEQ ID NO: 100592 - DNA, 25 bp, Homo sapien
tctcctcaaggagttcatggccaaa

SEQ ID NO: 100593 - DNA, 25 bp, Homo sapien
tctcctcaccgcaagcttcacctcc

SEQ ID NO: 100594 - DNA, 25 bp, Homo sapien
tctcctcaccgcaggcttcacctcc

SEQ ID NO: 100595 - DNA, 25 bp, Homo sapien
tctcctcatggagttcatggccaaa

SEQ ID NO: 100596 - DNA, 25 bp, Homo sapien
tctcctcttattacgtgaattgtct

SEQ ID NO: 100597 - DNA, 25 bp, Homo sapien
tctcctcttattatgtgaattgtct

SEQ ID NO: 100598 - DNA, 25 bp, Homo sapien
tctcctgactccaaatataagtcta

SEQ ID NO: 100599 - DNA, 25 bp, Homo sapien
tctcctgactccaattataagtcta

SEQ ID NO: 100600 - DNA, 25 bp, Homo sapien
tctcctgcatagagagacgatagtc

SEQ ID NO: 100601 - DNA, 25 bp, Homo sapien
tctcctgcgtagagagacgatagtc

SEQ ID NO: 100602 - DNA, 25 bp, Homo sapien
tctcctgctacatttcacttcttaa

SEQ ID NO: 100603 - DNA, 25 bp, Homo sapien
tctcctgctacttttcacttcttaa

SEQ ID NO: 100604 - DNA, 25 bp, Homo sapien
tctcctgctcatcactgaaaagtag

SEQ ID NO: 100605 - DNA, 25 bp, Homo sapien
tctcctgctcatcgctgaaaagtag

SEQ ID NO: 100606 - DNA, 25 bp, Homo sapien
tctcctggctcctggtcattacggg

SEQ ID NO: 100607 - DNA, 25 bp, Homo sapien
tctcctggctccttgtcattacggg

SEQ ID NO: 100608 - DNA, 25 bp, Homo sapien
tctcctggctctcagttcagagatt

SEQ ID NO: 100609 - DNA, 25 bp, Homo sapien
tctcctggctctcggttcagagatt

SEQ ID NO: 100610 - DNA, 25 bp, Homo sapien
tctccttagttaccagtaagactgc

SEQ ID NO: 100611 - DNA, 25 bp, Homo sapien
tctccttagttaccggtaagactgc

SEQ ID NO: 100612 - DNA, 25 bp, Homo sapien
tctccttatctaccctttaatatct

SEQ ID NO: 100613 - DNA, 25 bp, Homo sapien
tctccttatctaccttttaatatct

SEQ ID NO: 100614 - DNA, 25 bp, Homo sapien
tctccttcactcattgtatgttacc

SEQ ID NO: 100615 - DNA, 25 bp, Homo sapien
tctccttcactctttgtatgttacc

SEQ ID NO: 100616 - DNA, 25 bp, Homo sapien
tctccttccatggttcttcactcac

SEQ ID NO: 100617 - DNA, 25 bp, Homo sapien
tctccttctatggttcttcactcac

SEQ ID NO: 100618 - DNA, 25 bp, Homo sapien
tctccttgccacggaatttgctggc

SEQ ID NO: 100619 - DNA, 25 bp, Homo sapien
tctccttgccatggaatttgctggc

SEQ ID NO: 100620 - DNA, 25 bp, Homo sapien
tctccttgcgtaattgagagtgatg

SEQ ID NO: 100621 - DNA, 25 bp, Homo sapien
tctccttgctgaatcctcgattatg

SEQ ID NO: 100622 - DNA, 25 bp, Homo sapien
tctccttgtctcactgatcttagat

SEQ ID NO: 100623 - DNA, 25 bp, Homo sapien
tctccttgtctcgctgatcttagat

SEQ ID NO: 100624 - DNA, 25 bp, Homo sapien
tctccttgtgtaattgagagtgatg

SEQ ID NO: 100625 - DNA, 25 bp, Homo sapien
tctccttgttgaatcctcgattatg

SEQ ID NO: 100626 - DNA, 25 bp, Homo sapien
tctccttgttttatgaatggaaact

SEQ ID NO: 100627 - DNA, 25 bp, Homo sapien
tctccttgttttattaatggaaact

SEQ ID NO: 100628 - DNA, 25 bp, Homo sapien
tctcctttctctcggatcaattaca

SEQ ID NO: 100629 - DNA, 25 bp, Homo sapien
tctcctttctcttggatcaattaca

SEQ ID NO: 100630 - DNA, 25 bp, Homo sapien
tctcctttctgcacatgtctgagtt

SEQ ID NO: 100631 - DNA, 25 bp, Homo sapien
tctcctttctgcacgtgtctgagtt

SEQ ID NO: 100632 - DNA, 25 bp, Homo sapien
tctccttttactcggtgactcttcc

SEQ ID NO: 100633 - DNA, 25 bp, Homo sapien
tctccttttacttggtgactcttcc

SEQ ID NO: 100634 - DNA, 25 bp, Homo sapien
tctcgatgacctatgaacaggaaca

SEQ ID NO: 100635 - DNA, 25 bp, Homo sapien
tctcgatgagctatgaacaggaaca

SEQ ID NO: 100636 - DNA, 25 bp, Homo sapien
tctcgatgggacatatgaagacaat

SEQ ID NO: 100637 - DNA, 25 bp, Homo sapien
tctcgatgggatatatgaagacaat

SEQ ID NO: 100638 - DNA, 25 bp, Homo sapien
tctcgcaaatccctgagtactctct

SEQ ID NO: 100639 - DNA, 25 bp, Homo sapien
tctcgcaaatccgtgagtactctct

SEQ ID NO: 100640 - DNA, 25 bp, Homo sapien
tctcgcaaggatgttcaaatgccac

SEQ ID NO: 100641 - DNA, 25 bp, Homo sapien
tctcgcaaggattttcaaatgccac

SEQ ID NO: 100642 - DNA, 25 bp, Homo sapien
tctcgcttttctcggacacaccaca

SEQ ID NO: 100643 - DNA, 25 bp, Homo sapien
tctcgcttttcttggacacaccaca

SEQ ID NO: 100644 - DNA, 25 bp, Homo sapien
tctcggcagatgtttactttgattt

SEQ ID NO: 100645 - DNA, 25 bp, Homo sapien
tctcggcaggtgtttactttgattt

SEQ ID NO: 100646 - DNA, 25 bp, Homo sapien
tctcggctgagataaaacaaggcca

SEQ ID NO: 100647 - DNA, 25 bp, Homo sapien
tctcggctgaggtaaaacaaggcca

SEQ ID NO: 100648 - DNA, 25 bp, Homo sapien
tctcgggggaatcgttctggaggct

SEQ ID NO: 100649 - DNA, 25 bp, Homo sapien
tctcgggggaattgttctggaggct

SEQ ID NO: 100650 - DNA, 25 bp, Homo sapien
tctcggtgtgaaagtagagtaataa

SEQ ID NO: 100651 - DNA, 25 bp, Homo sapien
tctcggtgtgaaattagagtaataa

SEQ ID NO: 100652 - DNA, 25 bp, Homo sapien
tctcgtggaaacaagaaattcaact

SEQ ID NO: 100653 - DNA, 25 bp, Homo sapien
tctcgtggaaataagaaattcaact

SEQ ID NO: 100654 - DNA, 25 bp, Homo sapien
tctcgtggagacatgacagagatct

SEQ ID NO: 100655 - DNA, 25 bp, Homo sapien
tctcgtggagacatgatagagatct

SEQ ID NO: 100656 - DNA, 25 bp, Homo sapien
tctctaaactaccactggcaagaga

SEQ ID NO: 100657 - DNA, 25 bp, Homo sapien
tctctaaactatcactggcaagaga

SEQ ID NO: 100658 - DNA, 25 bp, Homo sapien
tctctaagttccaaataagtgaatt

SEQ ID NO: 100659 - DNA, 25 bp, Homo sapien
tctctaagttctaaataagtgaatt

SEQ ID NO: 100660 - DNA, 25 bp, Homo sapien
tctctaataatacacagagtggaaa

SEQ ID NO: 100661 - DNA, 25 bp, Homo sapien
tctctaataatatacagagtggaaa

SEQ ID NO: 100662 - DNA, 25 bp, Homo sapien
tctctaatcttcattgtgaaaacct

SEQ ID NO: 100663 - DNA, 25 bp, Homo sapien
tctctaatcttcgttgtgaaaacct

SEQ ID NO: 100664 - DNA, 25 bp, Homo sapien
tctctaatgcatcaaatccatgatc

SEQ ID NO: 100665 - DNA, 25 bp, Homo sapien
tctctaatgctcatatagtgcggac

SEQ ID NO: 100666 - DNA, 25 bp, Homo sapien
tctctaatgtatcaaatccatgatc

SEQ ID NO: 100667 - DNA, 25 bp, Homo sapien
tctctaatgttcatatagtgcggac

SEQ ID NO: 100668 - DNA, 25 bp, Homo sapien
tctctactatgtacatggagcgtga

SEQ ID NO: 100669 - DNA, 25 bp, Homo sapien
tctctactcgccttcataaataaga

SEQ ID NO: 100670 - DNA, 25 bp, Homo sapien
tctctactctgtacatggagcgtga

SEQ ID NO: 100671 - DNA, 25 bp, Homo sapien
tctctactgtattggacaaaactag

SEQ ID NO: 100672 - DNA, 25 bp, Homo sapien
tctctactgtattggataaaactag

SEQ ID NO: 100673 - DNA, 25 bp, Homo sapien
tctctacttgccttcataaataaga

SEQ ID NO: 100674 - DNA, 25 bp, Homo sapien
tctctacttgctgcttcttcttaat

SEQ ID NO: 100675 - DNA, 25 bp, Homo sapien
tctctacttgcttcttcttcttaat

SEQ ID NO: 100676 - DNA, 25 bp, Homo sapien
tctctagacattaccggactcacta

SEQ ID NO: 100677 - DNA, 25 bp, Homo sapien
tctctagacattactggactcacta

SEQ ID NO: 100678 - DNA, 25 bp, Homo sapien
tctctagcaatctttccctcttacc

SEQ ID NO: 100679 - DNA, 25 bp, Homo sapien
tctctagcagtctttccctcttacc

SEQ ID NO: 100680 - DNA, 25 bp, Homo sapien
tctctagcatttataggagactggc

SEQ ID NO: 100681 - DNA, 25 bp, Homo sapien
tctctagccacctctcatacctact

SEQ ID NO: 100682 - DNA, 25 bp, Homo sapien
tctctagcctcctctcatacctact

SEQ ID NO: 100683 - DNA, 25 bp, Homo sapien
tctctagcgctttatttgtgtgatt

SEQ ID NO: 100684 - DNA, 25 bp, Homo sapien
tctctagcgtttataggagactggc

SEQ ID NO: 100685 - DNA, 25 bp, Homo sapien
tctctagctcttcttcattagaact

SEQ ID NO: 100686 - DNA, 25 bp, Homo sapien
tctctagctcttcttcgttagaact

SEQ ID NO: 100687 - DNA, 25 bp, Homo sapien
tctctagctctttatttgtgtgatt

SEQ ID NO: 100688 - DNA, 25 bp, Homo sapien
tctctatccatgtaccttaagcata

SEQ ID NO: 100689 - DNA, 25 bp, Homo sapien
tctctatccgtgtaccttaagcata

SEQ ID NO: 100690 - DNA, 25 bp, Homo sapien
tctctatctcatgcggatttatgtc

SEQ ID NO: 100691 - DNA, 25 bp, Homo sapien
tctctatctcatgtggatttatgtc

SEQ ID NO: 100692 - DNA, 25 bp, Homo sapien
tctctatgtgttcaatacagatgca

SEQ ID NO: 100693 - DNA, 25 bp, Homo sapien
tctctatgtgttcagtacagatgca

SEQ ID NO: 100694 - DNA, 25 bp, Homo sapien
tctctattcagtttatgattctata

SEQ ID NO: 100695 - DNA, 25 bp, Homo sapien
tctctattcggtttatgattctata

SEQ ID NO: 100696 - DNA, 25 bp, Homo sapien
tctctcaactgtacgtcagaagtcc

SEQ ID NO: 100697 - DNA, 25 bp, Homo sapien
tctctcaactgtatgtcagaagtcc

SEQ ID NO: 100698 - DNA, 25 bp, Homo sapien
tctctcaagtcaacgtttgattggt

SEQ ID NO: 100699 - DNA, 25 bp, Homo sapien
tctctcaagtcaatgtttgattggt

SEQ ID NO: 100700 - DNA, 25 bp, Homo sapien
tctctcaatttataaggtcgtttaa

SEQ ID NO: 100701 - DNA, 25 bp, Homo sapien
tctctcaatttatgaggtcgtttaa

SEQ ID NO: 100702 - DNA, 25 bp, Homo sapien
tctctcacagttacaggagctagag

SEQ ID NO: 100703 - DNA, 25 bp, Homo sapien
tctctcacagttataggagctagag

SEQ ID NO: 100704 - DNA, 25 bp, Homo sapien
tctctcacatgcttttacagtcttc

SEQ ID NO: 100705 - DNA, 25 bp, Homo sapien
tctctcacatgtttttacagtcttc

SEQ ID NO: 100706 - DNA, 25 bp, Homo sapien
tctctcactgccactaatttagagc

SEQ ID NO: 100707 - DNA, 25 bp, Homo sapien
tctctcactgctactaatttagagc

SEQ ID NO: 100708 - DNA, 25 bp, Homo sapien
tctctcagttggacatgaatgttgc

SEQ ID NO: 100709 - DNA, 25 bp, Homo sapien
tctctcagttggatatgaatgttgc

SEQ ID NO: 100710 - DNA, 25 bp, Homo sapien
tctctcatacccagccgaggctttc

SEQ ID NO: 100711 - DNA, 25 bp, Homo sapien
tctctcatacccaggcgaggctttc

SEQ ID NO: 100712 - DNA, 25 bp, Homo sapien
tctctcatatatggctttcattgtg

SEQ ID NO: 100713 - DNA, 25 bp, Homo sapien
tctctcatatatgggtttcattgtg

SEQ ID NO: 100714 - DNA, 25 bp, Homo sapien
tctctcatcccagtagaatatgtag

SEQ ID NO: 100715 - DNA, 25 bp, Homo sapien
tctctcatcccagtggaatatgtag

SEQ ID NO: 100716 - DNA, 25 bp, Homo sapien
tctctcatctattcatgaatttcct

SEQ ID NO: 100717 - DNA, 25 bp, Homo sapien
tctctcatctatttatgaatttcct

SEQ ID NO: 100718 - DNA, 25 bp, Homo sapien
tctctcatgctcttgaagttcgtga

SEQ ID NO: 100719 - DNA, 25 bp, Homo sapien
tctctcatgctcttgacgttcgtga

SEQ ID NO: 100720 - DNA, 25 bp, Homo sapien
tctctcattcacattgtgtctcatt

SEQ ID NO: 100721 - DNA, 25 bp, Homo sapien
tctctcattcacgttgtgtctcatt

SEQ ID NO: 100722 - DNA, 25 bp, Homo sapien
tctctcattctcacaaatgtgcaca

SEQ ID NO: 100723 - DNA, 25 bp, Homo sapien
tctctcattcttacaaatgtgcaca

SEQ ID NO: 100724 - DNA, 25 bp, Homo sapien
tctctccaaatcggagtgtcagatg

SEQ ID NO: 100725 - DNA, 25 bp, Homo sapien
tctctccaaattggagtgtcagatg

SEQ ID NO: 100726 - DNA, 25 bp, Homo sapien
tctctccaacaactacctgctctaa

SEQ ID NO: 100727 - DNA, 25 bp, Homo sapien
tctctccaacaattacctgctctaa

SEQ ID NO: 100728 - DNA, 25 bp, Homo sapien
tctctccatgtttcagagtcatcgt

SEQ ID NO: 100729 - DNA, 25 bp, Homo sapien
tctctccatgtttcggagtcatcgt

SEQ ID NO: 100730 - DNA, 25 bp, Homo sapien
tctctccattgtctttactgggctg

SEQ ID NO: 100731 - DNA, 25 bp, Homo sapien
tctctccattgtttttactgggctg

SEQ ID NO: 100732 - DNA, 25 bp, Homo sapien
tctctcccttgaatcaatgaatgag

SEQ ID NO: 100733 - DNA, 25 bp, Homo sapien
tctctcccttgaatgaatgaatgag

SEQ ID NO: 100734 - DNA, 25 bp, Homo sapien
tctctccctttcactgcttctgaat

SEQ ID NO: 100735 - DNA, 25 bp, Homo sapien
tctctccctttcgctgcttctgaat

SEQ ID NO: 100736 - DNA, 25 bp, Homo sapien
tctctcctccacgttactttgatta

SEQ ID NO: 100737 - DNA, 25 bp, Homo sapien
tctctcctccatgttactttgatta

SEQ ID NO: 100738 - DNA, 25 bp, Homo sapien
tctctcctgaagtcttcttgcagtt

SEQ ID NO: 100739 - DNA, 25 bp, Homo sapien
tctctcctgaagtctttttgcagtt

SEQ ID NO: 100740 - DNA, 25 bp, Homo sapien
tctctcggcagatgtttactttgat

SEQ ID NO: 100741 - DNA, 25 bp, Homo sapien
tctctcggcaggtgtttactttgat

SEQ ID NO: 100742 - DNA, 25 bp, Homo sapien
tctctctaaaatagttctctaagtt

SEQ ID NO: 100743 - DNA, 25 bp, Homo sapien
tctctctaaaatagttttctaagtt

SEQ ID NO: 100744 - DNA, 25 bp, Homo sapien
tctctctaccttttcaccaaaatct

SEQ ID NO: 100745 - DNA, 25 bp, Homo sapien
tctctctatcttttcaccaaaatct

SEQ ID NO: 100746 - DNA, 25 bp, Homo sapien
tctctctcactcatctctgtaacag

SEQ ID NO: 100747 - DNA, 25 bp, Homo sapien
tctctctcactcatctttgtaacag

SEQ ID NO: 100748 - DNA, 25 bp, Homo sapien
tctctctcatacccagccgaggctt

SEQ ID NO: 100749 - DNA, 25 bp, Homo sapien
tctctctcatacccaggcgaggctt

SEQ ID NO: 100750 - DNA, 25 bp, Homo sapien
tctctctcatgtatgaacaaatcaa

SEQ ID NO: 100751 - DNA, 25 bp, Homo sapien
tctctctcatgtttgaacaaatcaa

SEQ ID NO: 100752 - DNA, 25 bp, Homo sapien
tctctctcattcacattgtgtctca

SEQ ID NO: 100753 - DNA, 25 bp, Homo sapien
tctctctcattcacgttgtgtctca

SEQ ID NO: 100754 - DNA, 25 bp, Homo sapien
tctctctcattctcacaaatgtgca

SEQ ID NO: 100755 - DNA, 25 bp, Homo sapien
tctctctcattcttacaaatgtgca

SEQ ID NO: 100756 - DNA, 25 bp, Homo sapien
tctctctccaaatcggagtgtcaga

SEQ ID NO: 100757 - DNA, 25 bp, Homo sapien
tctctctccaaattggagtgtcaga

SEQ ID NO: 100758 - DNA, 25 bp, Homo sapien
tctctctccgttgcatcatatgttt

SEQ ID NO: 100759 - DNA, 25 bp, Homo sapien
tctctctctgctctgtcaagcttcc

SEQ ID NO: 100760 - DNA, 25 bp, Homo sapien
tctctctctgctctgtgaagcttcc

SEQ ID NO: 100761 - DNA, 25 bp, Homo sapien
tctctctctgtatgtttgaatataa

SEQ ID NO: 100762 - DNA, 25 bp, Homo sapien
tctctctctgtgtgtttgaatataa

SEQ ID NO: 100763 - DNA, 25 bp, Homo sapien
tctctctctgttgcatcatatgttt

SEQ ID NO: 100764 - DNA, 25 bp, Homo sapien
tctctctgatgtcaaagatttttac

SEQ ID NO: 100765 - DNA, 25 bp, Homo sapien
tctctctgcggctaaagtagaaaca

SEQ ID NO: 100766 - DNA, 25 bp, Homo sapien
tctctctgctctgtcaagcttccaa

SEQ ID NO: 100767 - DNA, 25 bp, Homo sapien
tctctctgctctgtgaagcttccaa

SEQ ID NO: 100768 - DNA, 25 bp, Homo sapien
tctctctggtgtcaaagatttttac

SEQ ID NO: 100769 - DNA, 25 bp, Homo sapien
tctctctgtatgtttgaatataata

SEQ ID NO: 100770 - DNA, 25 bp, Homo sapien
tctctctgtgccaaaactttttgta

SEQ ID NO: 100771 - DNA, 25 bp, Homo sapien
tctctctgtgccagaactttttgta

SEQ ID NO: 100772 - DNA, 25 bp, Homo sapien
tctctctgtggctaaagtagaaaca

SEQ ID NO: 100773 - DNA, 25 bp, Homo sapien
tctctctgtgtcctgaggaaccttc

SEQ ID NO: 100774 - DNA, 25 bp, Homo sapien
tctctctgtgtgctgaggaaccttc

SEQ ID NO: 100775 - DNA, 25 bp, Homo sapien
tctctctgtgtgtttgaatataata

SEQ ID NO: 100776 - DNA, 25 bp, Homo sapien
tctctcttatgaaaaggcatgtgat

SEQ ID NO: 100777 - DNA, 25 bp, Homo sapien
tctctcttatgaaaagtcatgtgat

SEQ ID NO: 100778 - DNA, 25 bp, Homo sapien
tctctctttggatatcaaggtctgg

SEQ ID NO: 100779 - DNA, 25 bp, Homo sapien
tctctctttgggtatcaaggtctgg

SEQ ID NO: 100780 - DNA, 25 bp, Homo sapien
tctctgaaagaaaactaacagcccc

SEQ ID NO: 100781 - DNA, 25 bp, Homo sapien
tctctgaaagaaagctaacagcccc

SEQ ID NO: 100782 - DNA, 25 bp, Homo sapien
tctctgacaacaaggaaataaaact

SEQ ID NO: 100783 - DNA, 25 bp, Homo sapien
tctctgacattcaaccacatgctct

SEQ ID NO: 100784 - DNA, 25 bp, Homo sapien
tctctgaccccatagcatccttctg

SEQ ID NO: 100785 - DNA, 25 bp, Homo sapien
tctctgaccccgtagcatccttctg

SEQ ID NO: 100786 - DNA, 25 bp, Homo sapien
tctctgacgttcaaccacatgctct

SEQ ID NO: 100787 - DNA, 25 bp, Homo sapien
tctctgactacaaggaaataaaact

SEQ ID NO: 100788 - DNA, 25 bp, Homo sapien
tctctgactctcactgatatttatt

SEQ ID NO: 100789 - DNA, 25 bp, Homo sapien
tctctgactctcgctgatatttatt

SEQ ID NO: 100790 - DNA, 25 bp, Homo sapien
tctctgagacacatatctctgtctc

SEQ ID NO: 100791 - DNA, 25 bp, Homo sapien
tctctgagacacatttctctgtctc

SEQ ID NO: 100792 - DNA, 25 bp, Homo sapien
tctctgaggagctaccatttgagca

SEQ ID NO: 100793 - DNA, 25 bp, Homo sapien
tctctgaggagttaccatttgagca

SEQ ID NO: 100794 - DNA, 25 bp, Homo sapien
tctctgagtgttacctctctattaa

SEQ ID NO: 100795 - DNA, 25 bp, Homo sapien
tctctgagtgttatctctctattaa

SEQ ID NO: 100796 - DNA, 25 bp, Homo sapien
tctctgatcacaagattttggaaaa

SEQ ID NO: 100797 - DNA, 25 bp, Homo sapien
tctctgatcacaaggttttggaaaa

SEQ ID NO: 100798 - DNA, 25 bp, Homo sapien
tctctgatcctcttccttgtttcgt

SEQ ID NO: 100799 - DNA, 25 bp, Homo sapien
tctctgatccttttccttgtttcgt

SEQ ID NO: 100800 - DNA, 25 bp, Homo sapien
tctctgcaaatacctagtactgttg

SEQ ID NO: 100801 - DNA, 25 bp, Homo sapien
tctctgcaaatagctagtactgttg

SEQ ID NO: 100802 - DNA, 25 bp, Homo sapien
tctctgcaacaaaatgccaggtgta

SEQ ID NO: 100803 - DNA, 25 bp, Homo sapien
tctctgcaacagaatgccaggtgta

SEQ ID NO: 100804 - DNA, 25 bp, Homo sapien
tctctgcagattaatccacttccat

SEQ ID NO: 100805 - DNA, 25 bp, Homo sapien
tctctgcagattaatctacttccat

SEQ ID NO: 100806 - DNA, 25 bp, Homo sapien
tctctgcatggtcattatcctttta

SEQ ID NO: 100807 - DNA, 25 bp, Homo sapien
tctctgcatggtcgttatcctttta

SEQ ID NO: 100808 - DNA, 25 bp, Homo sapien
tctctgccctcgtcgatcttacatt

SEQ ID NO: 100809 - DNA, 25 bp, Homo sapien
tctctgcctatacatgggtccagac

SEQ ID NO: 100810 - DNA, 25 bp, Homo sapien
tctctgcctatacctgggtccagac

SEQ ID NO: 100811 - DNA, 25 bp, Homo sapien
tctctgccttcgtcgatcttacatt

SEQ ID NO: 100812 - DNA, 25 bp, Homo sapien
tctctgcctttcaccttcttagttt

SEQ ID NO: 100813 - DNA, 25 bp, Homo sapien
tctctgcctttcgccttcttagttt

SEQ ID NO: 100814 - DNA, 25 bp, Homo sapien
tctctgccttttctagtctaaagac

SEQ ID NO: 100815 - DNA, 25 bp, Homo sapien
tctctgccttttcttgtctaaagac

SEQ ID NO: 100816 - DNA, 25 bp, Homo sapien
tctctgctctgtcaagcttccaaac

SEQ ID NO: 100817 - DNA, 25 bp, Homo sapien
tctctgctctgtgaagcttccaaac

SEQ ID NO: 100818 - DNA, 25 bp, Homo sapien
tctctgctgctctgatgaaggcatg

SEQ ID NO: 100819 - DNA, 25 bp, Homo sapien
tctctgctgttctgatgaaggcatg

SEQ ID NO: 100820 - DNA, 25 bp, Homo sapien
tctctgcttaaataaccaagatgtg

SEQ ID NO: 100821 - DNA, 25 bp, Homo sapien
tctctgcttaagtaaccaagatgtg

SEQ ID NO: 100822 - DNA, 25 bp, Homo sapien
tctctgctttactgtgaaaatgtat

SEQ ID NO: 100823 - DNA, 25 bp, Homo sapien
tctctgctttattgtgaaaatgtat

SEQ ID NO: 100824 - DNA, 25 bp, Homo sapien
tctctgctttgaaattatttatccc

SEQ ID NO: 100825 - DNA, 25 bp, Homo sapien
tctctgctttgaagttatttatccc

SEQ ID NO: 100826 - DNA, 25 bp, Homo sapien
tctctggctctctcaattttgaatt

SEQ ID NO: 100827 - DNA, 25 bp, Homo sapien
tctctggctctcttaattttgaatt

SEQ ID NO: 100828 - DNA, 25 bp, Homo sapien
tctctggcttctacctatagtatat

SEQ ID NO: 100829 - DNA, 25 bp, Homo sapien
tctctggcttctacctgtagtatat

SEQ ID NO: 100830 - DNA, 25 bp, Homo sapien
tctctgggaaggattgtggtataat

SEQ ID NO: 100831 - DNA, 25 bp, Homo sapien
tctctgggcgagactcatggattct

SEQ ID NO: 100832 - DNA, 25 bp, Homo sapien
tctctgggcgagtctcatggattct

SEQ ID NO: 100833 - DNA, 25 bp, Homo sapien
tctctgggtaggattgtggtataat

SEQ ID NO: 100834 - DNA, 25 bp, Homo sapien
tctctggtatatggtaggtagtgtg

SEQ ID NO: 100835 - DNA, 25 bp, Homo sapien
tctctggtatattgtaggtagtgtg

SEQ ID NO: 100836 - DNA, 25 bp, Homo sapien
tctctggtggcataaaacagaaaga

SEQ ID NO: 100837 - DNA, 25 bp, Homo sapien
tctctggtggcgtaaaacagaaaga

SEQ ID NO: 100838 - DNA, 25 bp, Homo sapien
tctctgtaaagcagaactcacaatc

SEQ ID NO: 100839 - DNA, 25 bp, Homo sapien
tctctgtaaagtagaactcacaatc

SEQ ID NO: 100840 - DNA, 25 bp, Homo sapien
tctctgtaagagaggctttcatgta

SEQ ID NO: 100841 - DNA, 25 bp, Homo sapien
tctctgtaagagatgctttcatgta

SEQ ID NO: 100842 - DNA, 25 bp, Homo sapien
tctctgtacttacatgaatttgatt

SEQ ID NO: 100843 - DNA, 25 bp, Homo sapien
tctctgtacttatatgaatttgatt

SEQ ID NO: 100844 - DNA, 25 bp, Homo sapien
tctctgtagatttagaattaaatga

SEQ ID NO: 100845 - DNA, 25 bp, Homo sapien
tctctgtagattttgaattaaatga

SEQ ID NO: 100846 - DNA, 25 bp, Homo sapien
tctctgtcactaaggaatgttttct

SEQ ID NO: 100847 - DNA, 25 bp, Homo sapien
tctctgtcattaaggaatgttttct

SEQ ID NO: 100848 - DNA, 25 bp, Homo sapien
tctctgtgattccaagtgttttgat

SEQ ID NO: 100849 - DNA, 25 bp, Homo sapien
tctctgtgccaaaactttttgtaaa

SEQ ID NO: 100850 - DNA, 25 bp, Homo sapien
tctctgtgccagaactttttgtaaa

SEQ ID NO: 100851 - DNA, 25 bp, Homo sapien
tctctgtggagatgatagcaattca

SEQ ID NO: 100852 - DNA, 25 bp, Homo sapien
tctctgtggagattatagcaattca

SEQ ID NO: 100853 - DNA, 25 bp, Homo sapien
tctctgtggccggtttctgtaatcc

SEQ ID NO: 100854 - DNA, 25 bp, Homo sapien
tctctgtggccggtttttgtaatcc

SEQ ID NO: 100855 - DNA, 25 bp, Homo sapien
tctctgtggtaacggaatgtctgtg

SEQ ID NO: 100856 - DNA, 25 bp, Homo sapien
tctctgtggtaatggaatgtctgtg

SEQ ID NO: 100857 - DNA, 25 bp, Homo sapien
tctctgtggtggaactgaaccatct

SEQ ID NO: 100858 - DNA, 25 bp, Homo sapien
tctctgtggtggaattgaaccatct

SEQ ID NO: 100859 - DNA, 25 bp, Homo sapien
tctctgtggttccaagtgttttgat

SEQ ID NO: 100860 - DNA, 25 bp, Homo sapien
tctctgtgtcctgaggaaccttcgg

SEQ ID NO: 100861 - DNA, 25 bp, Homo sapien
tctctgtgtgctgaggaaccttcgg

SEQ ID NO: 100862 - DNA, 25 bp, Homo sapien
tctctgttcaaccagaacagccatg

SEQ ID NO: 100863 - DNA, 25 bp, Homo sapien
tctctgttcagcatgaagtttttgg

SEQ ID NO: 100864 - DNA, 25 bp, Homo sapien
tctctgttcagcgtgaagtttttgg

SEQ ID NO: 100865 - DNA, 25 bp, Homo sapien
tctctgttcattcccagcacctaaa

SEQ ID NO: 100866 - DNA, 25 bp, Homo sapien
tctctgttccaccagaacagccatg

SEQ ID NO: 100867 - DNA, 25 bp, Homo sapien
tctctgttgatgtatacactgaaaa

SEQ ID NO: 100868 - DNA, 25 bp, Homo sapien
tctctgttgatttatacactgaaaa

SEQ ID NO: 100869 - DNA, 25 bp, Homo sapien
tctctgttgctcaactgcactctct

SEQ ID NO: 100870 - DNA, 25 bp, Homo sapien
tctctgttgctcgactgcactctct

SEQ ID NO: 100871 - DNA, 25 bp, Homo sapien
tctctgtttattcccagcacctaaa

SEQ ID NO: 100872 - DNA, 25 bp, Homo sapien
tctctgtttccatttttcttttttg

SEQ ID NO: 100873 - DNA, 25 bp, Homo sapien
tctctgtttccgtttttcttttttg

SEQ ID NO: 100874 - DNA, 25 bp, Homo sapien
tctcttaacaattttctcccctaac

SEQ ID NO: 100875 - DNA, 25 bp, Homo sapien
tctcttaacgattttctcccctaac

SEQ ID NO: 100876 - DNA, 25 bp, Homo sapien
tctcttaagcgcataggaatctcta

SEQ ID NO: 100877 - DNA, 25 bp, Homo sapien
tctcttaagcgcgtaggaatctcta

SEQ ID NO: 100878 - DNA, 25 bp, Homo sapien
tctcttaatgtgggtgcttgctctc

SEQ ID NO: 100879 - DNA, 25 bp, Homo sapien
tctcttaatgtgggtgtttgctctc

SEQ ID NO: 100880 - DNA, 25 bp, Homo sapien
tctcttagttcttcgacctctctga

SEQ ID NO: 100881 - DNA, 25 bp, Homo sapien
tctcttagttctttgacctctctga

SEQ ID NO: 100882 - DNA, 25 bp, Homo sapien
tctcttagtttttgctgctgcttag

SEQ ID NO: 100883 - DNA, 25 bp, Homo sapien
tctcttagtttttggtgctgcttag

SEQ ID NO: 100884 - DNA, 25 bp, Homo sapien
tctcttatgaaaaggcatgtgatta

SEQ ID NO: 100885 - DNA, 25 bp, Homo sapien
tctcttatgaaaagtcatgtgatta

SEQ ID NO: 100886 - DNA, 25 bp, Homo sapien
tctcttatgatgaggaaagtttgaa

SEQ ID NO: 100887 - DNA, 25 bp, Homo sapien
tctcttatgatggggaaagtttgaa

SEQ ID NO: 100888 - DNA, 25 bp, Homo sapien
tctcttattgcaaaattctattgcc

SEQ ID NO: 100889 - DNA, 25 bp, Homo sapien
tctcttatttcaaaattctattgcc

SEQ ID NO: 100890 - DNA, 25 bp, Homo sapien
tctcttcacaaacgtggggtagagc

SEQ ID NO: 100891 - DNA, 25 bp, Homo sapien
tctcttcacaaatgtggggtagagc

SEQ ID NO: 100892 - DNA, 25 bp, Homo sapien
tctcttcagtagctcatttacatta

SEQ ID NO: 100893 - DNA, 25 bp, Homo sapien
tctcttcatcacaaacaccctagtt

SEQ ID NO: 100894 - DNA, 25 bp, Homo sapien
tctcttcatcacaaacgccctagtt

SEQ ID NO: 100895 - DNA, 25 bp, Homo sapien
tctcttcatcattttaatcaattaa

SEQ ID NO: 100896 - DNA, 25 bp, Homo sapien
tctcttcatcattttactcaattaa

SEQ ID NO: 100897 - DNA, 25 bp, Homo sapien
tctcttcattagctcatttacatta

SEQ ID NO: 100898 - DNA, 25 bp, Homo sapien
tctcttccctcgcaatggtgtcttt

SEQ ID NO: 100899 - DNA, 25 bp, Homo sapien
tctcttccctcggaatggtgtcttt

SEQ ID NO: 100900 - DNA, 25 bp, Homo sapien
tctcttcgcttcctgtaaatagatg

SEQ ID NO: 100901 - DNA, 25 bp, Homo sapien
tctcttcgctttctgtaaatagatg

SEQ ID NO: 100902 - DNA, 25 bp, Homo sapien
tctcttctaaccatcttattctcaa

SEQ ID NO: 100903 - DNA, 25 bp, Homo sapien
tctcttctaactatcttattctcaa

SEQ ID NO: 100904 - DNA, 25 bp, Homo sapien
tctcttctcacctacaagaatttat

SEQ ID NO: 100905 - DNA, 25 bp, Homo sapien
tctcttctcacctgcaagaatttat

SEQ ID NO: 100906 - DNA, 25 bp, Homo sapien
tctcttctcatcccaggaaataatc

SEQ ID NO: 100907 - DNA, 25 bp, Homo sapien
tctcttctcatctcaggaaataatc

SEQ ID NO: 100908 - DNA, 25 bp, Homo sapien
tctcttctgtttcactggacataca

SEQ ID NO: 100909 - DNA, 25 bp, Homo sapien
tctcttctgtttcagtggacataca

SEQ ID NO: 100910 - DNA, 25 bp, Homo sapien
tctcttcttgctattgtcagacaac

SEQ ID NO: 100911 - DNA, 25 bp, Homo sapien
tctcttcttgctgttgtcagacaac

SEQ ID NO: 100912 - DNA, 25 bp, Homo sapien
tctcttgagtgcctttaaagatttc

SEQ ID NO: 100913 - DNA, 25 bp, Homo sapien
tctcttgagtgcctttgaagatttc

SEQ ID NO: 100914 - DNA, 25 bp, Homo sapien
tctcttggatacagattgctaagat

SEQ ID NO: 100915 - DNA, 25 bp, Homo sapien
tctcttggataccgattgctaagat

SEQ ID NO: 100916 - DNA, 25 bp, Homo sapien
tctcttgggacaagaaatactaaac

SEQ ID NO: 100917 - DNA, 25 bp, Homo sapien
tctcttgggaccagaaatactaaac

SEQ ID NO: 100918 - DNA, 25 bp, Homo sapien
tctcttgtagacagtccagatcctg

SEQ ID NO: 100919 - DNA, 25 bp, Homo sapien
tctcttgtagactgtccagatcctg

SEQ ID NO: 100920 - DNA, 25 bp, Homo sapien
tctcttgttcatgttgcaatttgag

SEQ ID NO: 100921 - DNA, 25 bp, Homo sapien
tctcttgttcattttgcaatttgag

SEQ ID NO: 100922 - DNA, 25 bp, Homo sapien
tctctttactatccattacttttta

SEQ ID NO: 100923 - DNA, 25 bp, Homo sapien
tctctttactatcccttacttttta

SEQ ID NO: 100924 - DNA, 25 bp, Homo sapien
tctctttatgaatagcagctgtttt

SEQ ID NO: 100925 - DNA, 25 bp, Homo sapien
tctctttatgagtagcagctgtttt

SEQ ID NO: 100926 - DNA, 25 bp, Homo sapien
tctctttatgctctcacatgctgca

SEQ ID NO: 100927 - DNA, 25 bp, Homo sapien
tctctttatgctgtcacatgctgca

SEQ ID NO: 100928 - DNA, 25 bp, Homo sapien
tctctttcaatgtcagaagccagcc

SEQ ID NO: 100929 - DNA, 25 bp, Homo sapien
tctctttcatcagttggaggtattt

SEQ ID NO: 100930 - DNA, 25 bp, Homo sapien
tctctttccatcaaacataataaat

SEQ ID NO: 100931 - DNA, 25 bp, Homo sapien
tctctttccatcaaacgtaataaat

SEQ ID NO: 100932 - DNA, 25 bp, Homo sapien
tctctttccatctgggtctaggttc

SEQ ID NO: 100933 - DNA, 25 bp, Homo sapien
tctctttccgtctgggtctaggttc

SEQ ID NO: 100934 - DNA, 25 bp, Homo sapien
tctctttcgtcaattggaggtattt

SEQ ID NO: 100935 - DNA, 25 bp, Homo sapien
tctctttcgtcagttggaggtattt

SEQ ID NO: 100936 - DNA, 25 bp, Homo sapien
tctctttctatgtcagaagccagcc

SEQ ID NO: 100937 - DNA, 25 bp, Homo sapien
tctctttgcgtggcatttctcttct

SEQ ID NO: 100938 - DNA, 25 bp, Homo sapien
tctctttggaccaaacttcctcctt

SEQ ID NO: 100939 - DNA, 25 bp, Homo sapien
tctctttggaccaaccttcctcctt

SEQ ID NO: 100940 - DNA, 25 bp, Homo sapien
tctctttggacttcagaagcaatcc

SEQ ID NO: 100941 - DNA, 25 bp, Homo sapien
tctctttggactttagaagcaatcc

SEQ ID NO: 100942 - DNA, 25 bp, Homo sapien
tctctttggatatcaaggtctggta

SEQ ID NO: 100943 - DNA, 25 bp, Homo sapien
tctctttgggtatcaaggtctggta

SEQ ID NO: 100944 - DNA, 25 bp, Homo sapien
tctctttggtggaaacattgctaac

SEQ ID NO: 100945 - DNA, 25 bp, Homo sapien
tctctttggtggaaacgttgctaac

SEQ ID NO: 100946 - DNA, 25 bp, Homo sapien
tctctttgtacatcaccttcagaag

SEQ ID NO: 100947 - DNA, 25 bp, Homo sapien
tctctttgtacgtcaccttcagaag

SEQ ID NO: 100948 - DNA, 25 bp, Homo sapien
tctctttgtgtggcatttctcttct

SEQ ID NO: 100949 - DNA, 25 bp, Homo sapien
tctctttgtttcctttttagacata

SEQ ID NO: 100950 - DNA, 25 bp, Homo sapien
tctctttgtttcttttttagacata

SEQ ID NO: 100951 - DNA, 25 bp, Homo sapien
tctcttttaccacatgaaatgacat

SEQ ID NO: 100952 - DNA, 25 bp, Homo sapien
tctcttttaccgcatgaaatgacat

SEQ ID NO: 100953 - DNA, 25 bp, Homo sapien
tctcttttagcagccctattccaga

SEQ ID NO: 100954 - DNA, 25 bp, Homo sapien
tctcttttagcagctctattccaga

SEQ ID NO: 100955 - DNA, 25 bp, Homo sapien
tctcttttattaccagtgaatagtg

SEQ ID NO: 100956 - DNA, 25 bp, Homo sapien
tctcttttattatcagtgaatagtg

SEQ ID NO: 100957 - DNA, 25 bp, Homo sapien
tctcttttcgcatctctgccctacc

SEQ ID NO: 100958 - DNA, 25 bp, Homo sapien
tctctttttacaaactgtgcttatc

SEQ ID NO: 100959 - DNA, 25 bp, Homo sapien
tctctttttacgaactgtgcttatc

SEQ ID NO: 100960 - DNA, 25 bp, Homo sapien
tctctttttgcatctctgccctacc

SEQ ID NO: 100961 - DNA, 25 bp, Homo sapien
tctcttttttttgaacaactacctt

SEQ ID NO: 100962 - DNA, 25 bp, Homo sapien
tctcttttttttgagcaactacctt

SEQ ID NO: 100963 - DNA, 25 bp, Homo sapien
tctgaaaaagtttgtgtagaatcag

SEQ ID NO: 100964 - DNA, 25 bp, Homo sapien
tctgaaaaggtttgtgtagaatcag

SEQ ID NO: 100965 - DNA, 25 bp, Homo sapien
tctgaaaatttcttgaactttatac

SEQ ID NO: 100966 - DNA, 25 bp, Homo sapien
tctgaaaatttcttgagctttatac

SEQ ID NO: 100967 - DNA, 25 bp, Homo sapien
tctgaaacggacaacgaactggaag

SEQ ID NO: 100968 - DNA, 25 bp, Homo sapien
tctgaaacggacaaggaactggaag

SEQ ID NO: 100969 - DNA, 25 bp, Homo sapien
tctgaaagaaaactaacagccccag

SEQ ID NO: 100970 - DNA, 25 bp, Homo sapien
tctgaaagaaagctaacagccccag

SEQ ID NO: 100971 - DNA, 25 bp, Homo sapien
tctgaaagacctcatatttctgcag

SEQ ID NO: 100972 - DNA, 25 bp, Homo sapien
tctgaaagaccttatatttctgcag

SEQ ID NO: 100973 - DNA, 25 bp, Homo sapien
tctgaaagactttaatcttaacctc

SEQ ID NO: 100974 - DNA, 25 bp, Homo sapien
tctgaaagactttaattttaacctc

SEQ ID NO: 100975 - DNA, 25 bp, Homo sapien
tctgaaaggaaggaaagctttagtc

SEQ ID NO: 100976 - DNA, 25 bp, Homo sapien
tctgaaaggtaggaaagctttagtc

SEQ ID NO: 100977 - DNA, 25 bp, Homo sapien
tctgaaagtgtaaacacgagtccca

SEQ ID NO: 100978 - DNA, 25 bp, Homo sapien
tctgaaagtgtaaagacgagtccca

SEQ ID NO: 100979 - DNA, 25 bp, Homo sapien
tctgaaatctccacttatctcttaa

SEQ ID NO: 100980 - DNA, 25 bp, Homo sapien
tctgaaatctccgcttatctcttaa

SEQ ID NO: 100981 - DNA, 25 bp, Homo sapien
tctgaaatgcctattagatagttgt

SEQ ID NO: 100982 - DNA, 25 bp, Homo sapien
tctgaaatgcctattatatagttgt

SEQ ID NO: 100983 - DNA, 25 bp, Homo sapien
tctgaaattaacgggacatggaggc

SEQ ID NO: 100984 - DNA, 25 bp, Homo sapien
tctgaaattaatgggacatggaggc

SEQ ID NO: 100985 - DNA, 25 bp, Homo sapien
tctgaacacagcctacacaggggac

SEQ ID NO: 100986 - DNA, 25 bp, Homo sapien
tctgaacacctactatgagtcacga

SEQ ID NO: 100987 - DNA, 25 bp, Homo sapien
tctgaacacctactgtgagtcacga

SEQ ID NO: 100988 - DNA, 25 bp, Homo sapien
tctgaacataccgtacttgtccaaa

SEQ ID NO: 100989 - DNA, 25 bp, Homo sapien
tctgaacatactgtacttgtccaaa

SEQ ID NO: 100990 - DNA, 25 bp, Homo sapien
tctgaacatagcctacacaggggac

SEQ ID NO: 100991 - DNA, 25 bp, Homo sapien
tctgaaccaactaacgatggcatgg

SEQ ID NO: 100992 - DNA, 25 bp, Homo sapien
tctgaaccagctaacgatggcatgg

SEQ ID NO: 100993 - DNA, 25 bp, Homo sapien
tctgaacctatgaattttggacagt

SEQ ID NO: 100994 - DNA, 25 bp, Homo sapien
tctgaacctgtgaattttggacagt

SEQ ID NO: 100995 - DNA, 25 bp, Homo sapien
tctgaacgcttgcatgattgcttct

SEQ ID NO: 100996 - DNA, 25 bp, Homo sapien
tctgaacgcttgtatgattgcttct

SEQ ID NO: 100997 - DNA, 25 bp, Homo sapien
tctgaacgtgtacaactgaaagcac

SEQ ID NO: 100998 - DNA, 25 bp, Homo sapien
tctgaacgtgtataactgaaagcac

SEQ ID NO: 100999 - DNA, 25 bp, Homo sapien
tctgaactaaacgatacgtgttttg

SEQ ID NO: 101000 - DNA, 25 bp, Homo sapien
tctgaactaaacgatatgtgttttg

SEQ ID NO: 101001 - DNA, 25 bp, Homo sapien
tctgaactgttgacagagctgtcgt

SEQ ID NO: 101002 - DNA, 25 bp, Homo sapien
tctgaactgttgacagtgctgtcgt

SEQ ID NO: 101003 - DNA, 25 bp, Homo sapien
tctgaacttctgaatgaaataactg

SEQ ID NO: 101004 - DNA, 25 bp, Homo sapien
tctgaacttttgaatgaaataactg

SEQ ID NO: 101005 - DNA, 25 bp, Homo sapien
tctgaagaatgcgttgggccagtgt

SEQ ID NO: 101006 - DNA, 25 bp, Homo sapien
tctgaagaatgctttgggccagtgt

SEQ ID NO: 101007 - DNA, 25 bp, Homo sapien
tctgaagacgtaattgtatcattgt

SEQ ID NO: 101008 - DNA, 25 bp, Homo sapien
tctgaagatgaatcctatgttttca

SEQ ID NO: 101009 - DNA, 25 bp, Homo sapien
tctgaagatgactcctatgttttca

SEQ ID NO: 101010 - DNA, 25 bp, Homo sapien
tctgaagatgtaattgtatcattgt

SEQ ID NO: 101011 - DNA, 25 bp, Homo sapien
tctgaagatgtgcttcgttattaat

SEQ ID NO: 101012 - DNA, 25 bp, Homo sapien
tctgaagatgtgcttctttattaat

SEQ ID NO: 101013 - DNA, 25 bp, Homo sapien
tctgaagccaagagggctaacagga

SEQ ID NO: 101014 - DNA, 25 bp, Homo sapien
tctgaagccaagtgggctaacagga

SEQ ID NO: 101015 - DNA, 25 bp, Homo sapien
tctgaaggaccctaacgaatacacc

SEQ ID NO: 101016 - DNA, 25 bp, Homo sapien
tctgaaggaccctaactaatacacc

SEQ ID NO: 101017 - DNA, 25 bp, Homo sapien
tctgaaggactatgaagcttggctc

SEQ ID NO: 101018 - DNA, 25 bp, Homo sapien
tctgaaggactgtgaagcttggctc

SEQ ID NO: 101019 - DNA, 25 bp, Homo sapien
tctgaagggtattctgctgttaaga

SEQ ID NO: 101020 - DNA, 25 bp, Homo sapien
tctgaaggttattctgctgttaaga

SEQ ID NO: 101021 - DNA, 25 bp, Homo sapien
tctgaagtaacagtcacaacagcat

SEQ ID NO: 101022 - DNA, 25 bp, Homo sapien
tctgaagtaacagttacaacagcat

SEQ ID NO: 101023 - DNA, 25 bp, Homo sapien
tctgaagtccacatttttcttaaat

SEQ ID NO: 101024 - DNA, 25 bp, Homo sapien
tctgaagtccatatttttcttaaat

SEQ ID NO: 101025 - DNA, 25 bp, Homo sapien
tctgaagtggtctgtttgttcttct

SEQ ID NO: 101026 - DNA, 25 bp, Homo sapien
tctgaagttgtctgtttgttcttct

SEQ ID NO: 101027 - DNA, 25 bp, Homo sapien
tctgaagttttccgtaatgtgaatt

SEQ ID NO: 101028 - DNA, 25 bp, Homo sapien
tctgaagttttccttaatgtgaatt

SEQ ID NO: 101029 - DNA, 25 bp, Homo sapien
tctgaatacgttcaatgcatggagg

SEQ ID NO: 101030 - DNA, 25 bp, Homo sapien
tctgaatatgttcaatgcatggagg

SEQ ID NO: 101031 - DNA, 25 bp, Homo sapien
tctgaatcacttctttctgtgcatg

SEQ ID NO: 101032 - DNA, 25 bp, Homo sapien
tctgaatcccatttcatttattgta

SEQ ID NO: 101033 - DNA, 25 bp, Homo sapien
tctgaatcctatttcatttattgta

SEQ ID NO: 101034 - DNA, 25 bp, Homo sapien
tctgaatcgcttctttctgtgcatg

SEQ ID NO: 101035 - DNA, 25 bp, Homo sapien
tctgaatctccaaacaatgatacat

SEQ ID NO: 101036 - DNA, 25 bp, Homo sapien
tctgaatctccaaacactgatacat

SEQ ID NO: 101037 - DNA, 25 bp, Homo sapien
tctgaatgaactacggtgatggcca

SEQ ID NO: 101038 - DNA, 25 bp, Homo sapien
tctgaatgaactagggtgatggcca

SEQ ID NO: 101039 - DNA, 25 bp, Homo sapien
tctgaatgacagttgccctaaaaag

SEQ ID NO: 101040 - DNA, 25 bp, Homo sapien
tctgaatgagagttgccctaaaaag

SEQ ID NO: 101041 - DNA, 25 bp, Homo sapien
tctgaatggactacataacttgggt

SEQ ID NO: 101042 - DNA, 25 bp, Homo sapien
tctgaatggactatataacttgggt

SEQ ID NO: 101043 - DNA, 25 bp, Homo sapien
tctgaattaattaagccttgagaca

SEQ ID NO: 101044 - DNA, 25 bp, Homo sapien
tctgaattaattaggccttgagaca

SEQ ID NO: 101045 - DNA, 25 bp, Homo sapien
tctgaattcaggattaaagtagaaa

SEQ ID NO: 101046 - DNA, 25 bp, Homo sapien
tctgaattcagggttaaagtagaaa

SEQ ID NO: 101047 - DNA, 25 bp, Homo sapien
tctgaatttatagtaacgactcaac

SEQ ID NO: 101048 - DNA, 25 bp, Homo sapien
tctgaatttttagtaacgactcaac

SEQ ID NO: 101049 - DNA, 25 bp, Homo sapien
tctgaatttttctactgtggaattt

SEQ ID NO: 101050 - DNA, 25 bp, Homo sapien
tctgaatttttgtactgtggaattt

SEQ ID NO: 101051 - DNA, 25 bp, Homo sapien
tctgacaaacgtctctcagcattga

SEQ ID NO: 101052 - DNA, 25 bp, Homo sapien
tctgacaaatgtctctcagcattga

SEQ ID NO: 101053 - DNA, 25 bp, Homo sapien
tctgacaatcggatctccatgaaca

SEQ ID NO: 101054 - DNA, 25 bp, Homo sapien
tctgacaatcgggtctccatgaaca

SEQ ID NO: 101055 - DNA, 25 bp, Homo sapien
tctgacaatgaacagggtaagtata

SEQ ID NO: 101056 - DNA, 25 bp, Homo sapien
tctgacaatgaacatggtaagtata

SEQ ID NO: 101057 - DNA, 25 bp, Homo sapien
tctgacagcttccgtggtcccttag

SEQ ID NO: 101058 - DNA, 25 bp, Homo sapien
tctgacaggttccgtggtcccttag

SEQ ID NO: 101059 - DNA, 25 bp, Homo sapien
tctgacattccaggaaaagcaaact

SEQ ID NO: 101060 - DNA, 25 bp, Homo sapien
tctgacattccaggcaaagcaaact

SEQ ID NO: 101061 - DNA, 25 bp, Homo sapien
tctgaccactatctcttgccacttc

SEQ ID NO: 101062 - DNA, 25 bp, Homo sapien
tctgaccactatttcttgccacttc

SEQ ID NO: 101063 - DNA, 25 bp, Homo sapien
tctgaccccatagcatccttctgac

SEQ ID NO: 101064 - DNA, 25 bp, Homo sapien
tctgaccccgtagcatccttctgac

SEQ ID NO: 101065 - DNA, 25 bp, Homo sapien
tctgaccgcttgttcactttatgtg

SEQ ID NO: 101066 - DNA, 25 bp, Homo sapien
tctgaccgcttgtttactttatgtg

SEQ ID NO: 101067 - DNA, 25 bp, Homo sapien
tctgaccgtgcatccactcacctta

SEQ ID NO: 101068 - DNA, 25 bp, Homo sapien
tctgaccgtgcatcgactcacctta

SEQ ID NO: 101069 - DNA, 25 bp, Homo sapien
tctgacctccataatcataagataa

SEQ ID NO: 101070 - DNA, 25 bp, Homo sapien
tctgacctccataatcgtaagataa

SEQ ID NO: 101071 - DNA, 25 bp, Homo sapien
tctgaccttctaattcctttcttta

SEQ ID NO: 101072 - DNA, 25 bp, Homo sapien
tctgaccttctcattcctttcttta

SEQ ID NO: 101073 - DNA, 25 bp, Homo sapien
tctgactatatgagtactaatagca

SEQ ID NO: 101074 - DNA, 25 bp, Homo sapien
tctgactatatgggtactaatagca

SEQ ID NO: 101075 - DNA, 25 bp, Homo sapien
tctgactcaattatgtggaaagtgt

SEQ ID NO: 101076 - DNA, 25 bp, Homo sapien
tctgactcgattatgtggaaagtgt

SEQ ID NO: 101077 - DNA, 25 bp, Homo sapien
tctgactctgacaggtacttaaaac

SEQ ID NO: 101078 - DNA, 25 bp, Homo sapien
tctgactctgacaggtccttaaaac

SEQ ID NO: 101079 - DNA, 25 bp, Homo sapien
tctgactggaatccccatgggcctg

SEQ ID NO: 101080 - DNA, 25 bp, Homo sapien
tctgactgtaatccccatgggcctg

SEQ ID NO: 101081 - DNA, 25 bp, Homo sapien
tctgactgttacggagaaaagattt

SEQ ID NO: 101082 - DNA, 25 bp, Homo sapien
tctgactgttatggagaaaagattt

SEQ ID NO: 101083 - DNA, 25 bp, Homo sapien
tctgagaacctagaggaagatgctg

SEQ ID NO: 101084 - DNA, 25 bp, Homo sapien
tctgagaacctggaggaagatgctg

SEQ ID NO: 101085 - DNA, 25 bp, Homo sapien
tctgagacacatatctctgtctctt

SEQ ID NO: 101086 - DNA, 25 bp, Homo sapien
tctgagacacatttctctgtctctt

SEQ ID NO: 101087 - DNA, 25 bp, Homo sapien
tctgagacatactggtttcaggaga

SEQ ID NO: 101088 - DNA, 25 bp, Homo sapien
tctgagaccctttgtcaccctatga

SEQ ID NO: 101089 - DNA, 25 bp, Homo sapien
tctgagaccctttttcaccctatga

SEQ ID NO: 101090 - DNA, 25 bp, Homo sapien
tctgagacgtactggtttcaggaga

SEQ ID NO: 101091 - DNA, 25 bp, Homo sapien
tctgagactccgcataccagacggg

SEQ ID NO: 101092 - DNA, 25 bp, Homo sapien
tctgagactccgtataccagacggg

SEQ ID NO: 101093 - DNA, 25 bp, Homo sapien
tctgagagtcacaaacccacctgtg

SEQ ID NO: 101094 - DNA, 25 bp, Homo sapien
tctgagagtcaccaacccacctgtg

SEQ ID NO: 101095 - DNA, 25 bp, Homo sapien
tctgagataaacagccagagtcttt

SEQ ID NO: 101096 - DNA, 25 bp, Homo sapien
tctgagataaatagccagagtcttt

SEQ ID NO: 101097 - DNA, 25 bp, Homo sapien
tctgagatatcaatgcaattaatgt

SEQ ID NO: 101098 - DNA, 25 bp, Homo sapien
tctgagatgcctatccagcctttcc

SEQ ID NO: 101099 - DNA, 25 bp, Homo sapien
tctgagatgcctatccggcctttcc

SEQ ID NO: 101100 - DNA, 25 bp, Homo sapien
tctgagatgtcaatgcaattaatgt

SEQ ID NO: 101101 - DNA, 25 bp, Homo sapien
tctgagatttccttctgcgcctcag

SEQ ID NO: 101102 - DNA, 25 bp, Homo sapien
tctgagatttctttctgcgcctcag

SEQ ID NO: 101103 - DNA, 25 bp, Homo sapien
tctgagcaacccaaagctggatgtg

SEQ ID NO: 101104 - DNA, 25 bp, Homo sapien
tctgagcaacccgaagctggatgtg

SEQ ID NO: 101105 - DNA, 25 bp, Homo sapien
tctgagcatctcagaatagccctct

SEQ ID NO: 101106 - DNA, 25 bp, Homo sapien
tctgagcatgtcagaatagccctct

SEQ ID NO: 101107 - DNA, 25 bp, Homo sapien
tctgagccagaaaattccttcagtg

SEQ ID NO: 101108 - DNA, 25 bp, Homo sapien
tctgagccagaaatttccttcagtg

SEQ ID NO: 101109 - DNA, 25 bp, Homo sapien
tctgagccagagatcgacatgcagg

SEQ ID NO: 101110 - DNA, 25 bp, Homo sapien
tctgagccagagatcggcatgcagg

SEQ ID NO: 101111 - DNA, 25 bp, Homo sapien
tctgagccataacatcctttctcat

SEQ ID NO: 101112 - DNA, 25 bp, Homo sapien
tctgagccataatatcctttctcat

SEQ ID NO: 101113 - DNA, 25 bp, Homo sapien
tctgagccatacgctttaacaggga

SEQ ID NO: 101114 - DNA, 25 bp, Homo sapien
tctgagccatatgctttaacaggga

SEQ ID NO: 101115 - DNA, 25 bp, Homo sapien
tctgagcctctatattttcatttct

SEQ ID NO: 101116 - DNA, 25 bp, Homo sapien
tctgagcctctatgttttcatttct

SEQ ID NO: 101117 - DNA, 25 bp, Homo sapien
tctgagctataaccacattcacgtg

SEQ ID NO: 101118 - DNA, 25 bp, Homo sapien
tctgagctataacgacattcacgtg

SEQ ID NO: 101119 - DNA, 25 bp, Homo sapien
tctgagctcaaacatcccaaggtca

SEQ ID NO: 101120 - DNA, 25 bp, Homo sapien
tctgagctcaaagatcccaaggtca

SEQ ID NO: 101121 - DNA, 25 bp, Homo sapien
tctgagctccccatagatgaaatgc

SEQ ID NO: 101122 - DNA, 25 bp, Homo sapien
tctgagctccccatggatgaaatgc

SEQ ID NO: 101123 - DNA, 25 bp, Homo sapien
tctgaggaaccttcataatgctttc

SEQ ID NO: 101124 - DNA, 25 bp, Homo sapien
tctgaggaaccttcctaatgctttc

SEQ ID NO: 101125 - DNA, 25 bp, Homo sapien
tctgaggaactgaatgccagggtaa

SEQ ID NO: 101126 - DNA, 25 bp, Homo sapien
tctgaggaattgaatgccagggtaa

SEQ ID NO: 101127 - DNA, 25 bp, Homo sapien
tctgaggacatatgccaatgaagga

SEQ ID NO: 101128 - DNA, 25 bp, Homo sapien
tctgaggacattacgctagtgaaat

SEQ ID NO: 101129 - DNA, 25 bp, Homo sapien
tctgaggacattatgctagtgaaat

SEQ ID NO: 101130 - DNA, 25 bp, Homo sapien
tctgaggacctatgccaatgaagga

SEQ ID NO: 101131 - DNA, 25 bp, Homo sapien
tctgaggagctaccatttgagcaga

SEQ ID NO: 101132 - DNA, 25 bp, Homo sapien
tctgaggagttaccatttgagcaga

SEQ ID NO: 101133 - DNA, 25 bp, Homo sapien
tctgaggtgaagttcgaaggatcac

SEQ ID NO: 101134 - DNA, 25 bp, Homo sapien
tctgaggtgaagtttgaaggatcac

SEQ ID NO: 101135 - DNA, 25 bp, Homo sapien
tctgaggttaaactctgttaatatg

SEQ ID NO: 101136 - DNA, 25 bp, Homo sapien
tctgaggttaaactcttttaatatg

SEQ ID NO: 101137 - DNA, 25 bp, Homo sapien
tctgaggttcaatcatttgtcactt

SEQ ID NO: 101138 - DNA, 25 bp, Homo sapien
tctgaggttcagtcatttgtcactt

SEQ ID NO: 101139 - DNA, 25 bp, Homo sapien
tctgaggttgtgcgtttaagaagac

SEQ ID NO: 101140 - DNA, 25 bp, Homo sapien
tctgaggttgtgtgtttaagaagac

SEQ ID NO: 101141 - DNA, 25 bp, Homo sapien
tctgagtacctttagtagcacattg

SEQ ID NO: 101142 - DNA, 25 bp, Homo sapien
tctgagtatctttagtagcacattg

SEQ ID NO: 101143 - DNA, 25 bp, Homo sapien
tctgagtcactgattgatgtaaact

SEQ ID NO: 101144 - DNA, 25 bp, Homo sapien
tctgagtcacttctcagcaacatct

SEQ ID NO: 101145 - DNA, 25 bp, Homo sapien
tctgagtcacttttcagcaacatct

SEQ ID NO: 101146 - DNA, 25 bp, Homo sapien
tctgagtcagtgattgatgtaaact

SEQ ID NO: 101147 - DNA, 25 bp, Homo sapien
tctgagtgattattatttatttgct

SEQ ID NO: 101148 - DNA, 25 bp, Homo sapien
tctgagtgattattctttatttgct

SEQ ID NO: 101149 - DNA, 25 bp, Homo sapien
tctgagtgctttccatttgctaatt

SEQ ID NO: 101150 - DNA, 25 bp, Homo sapien
tctgagtgctttccgtttgctaatt

SEQ ID NO: 101151 - DNA, 25 bp, Homo sapien
tctgagtggtgctaaaagaatctac

SEQ ID NO: 101152 - DNA, 25 bp, Homo sapien
tctgagtggtgttaaaagaatctac

SEQ ID NO: 101153 - DNA, 25 bp, Homo sapien
tctgagttgaaattcagttagatcc

SEQ ID NO: 101154 - DNA, 25 bp, Homo sapien
tctgagttgaatttcagttagatcc

SEQ ID NO: 101155 - DNA, 25 bp, Homo sapien
tctgagtttggtatgatcattaggt

SEQ ID NO: 101156 - DNA, 25 bp, Homo sapien
tctgagtttggtgtgatcattaggt

SEQ ID NO: 101157 - DNA, 25 bp, Homo sapien
tctgataaacaatatgtttggcatt

SEQ ID NO: 101158 - DNA, 25 bp, Homo sapien
tctgataaacagtatgtttggcatt

SEQ ID NO: 101159 - DNA, 25 bp, Homo sapien
tctgataatgccccagtttggcttc

SEQ ID NO: 101160 - DNA, 25 bp, Homo sapien
tctgataatgccccggtttggcttc

SEQ ID NO: 101161 - DNA, 25 bp, Homo sapien
tctgataatgttcagacatccagtt

SEQ ID NO: 101162 - DNA, 25 bp, Homo sapien
tctgataatgttcagatatccagtt

SEQ ID NO: 101163 - DNA, 25 bp, Homo sapien
tctgatagaatacatgttccatgaa

SEQ ID NO: 101164 - DNA, 25 bp, Homo sapien
tctgatagactacatgttccatgaa

SEQ ID NO: 101165 - DNA, 25 bp, Homo sapien
tctgatatagcataataccaagaag

SEQ ID NO: 101166 - DNA, 25 bp, Homo sapien
tctgatatggcataataccaagaag

SEQ ID NO: 101167 - DNA, 25 bp, Homo sapien
tctgatattgatcaccttattacct

SEQ ID NO: 101168 - DNA, 25 bp, Homo sapien
tctgatattgattaccttattacct

SEQ ID NO: 101169 - DNA, 25 bp, Homo sapien
tctgatcaactaccacattcatgcc

SEQ ID NO: 101170 - DNA, 25 bp, Homo sapien
tctgatcaactacgacattcatgcc

SEQ ID NO: 101171 - DNA, 25 bp, Homo sapien
tctgatcacaagattttggaaaagc

SEQ ID NO: 101172 - DNA, 25 bp, Homo sapien
tctgatcacaaggttttggaaaagc

SEQ ID NO: 101173 - DNA, 25 bp, Homo sapien
tctgatcacagtgatatatgagtag

SEQ ID NO: 101174 - DNA, 25 bp, Homo sapien
tctgatcacagtggtatatgagtag

SEQ ID NO: 101175 - DNA, 25 bp, Homo sapien
tctgatcccactattgaaataaaaa

SEQ ID NO: 101176 - DNA, 25 bp, Homo sapien
tctgatcccgctattgaaataaaaa

SEQ ID NO: 101177 - DNA, 25 bp, Homo sapien
tctgatcctcttccttgtttcgtct

SEQ ID NO: 101178 - DNA, 25 bp, Homo sapien
tctgatccttttccttgtttcgtct

SEQ ID NO: 101179 - DNA, 25 bp, Homo sapien
tctgatctatacgtaaccaatctct

SEQ ID NO: 101180 - DNA, 25 bp, Homo sapien
tctgatctgatcttgtgctgctcct

SEQ ID NO: 101181 - DNA, 25 bp, Homo sapien
tctgatctgtacgtaaccaatctct

SEQ ID NO: 101182 - DNA, 25 bp, Homo sapien
tctgatcttatcttgtgctgctcct

SEQ ID NO: 101183 - DNA, 25 bp, Homo sapien
tctgatgaatgtactttagaattcc

SEQ ID NO: 101184 - DNA, 25 bp, Homo sapien
tctgatgaatgtcctttagaattcc

SEQ ID NO: 101185 - DNA, 25 bp, Homo sapien
tctgatgaggttaacactgatgatc

SEQ ID NO: 101186 - DNA, 25 bp, Homo sapien
tctgatgaggttaacattgatgatc

SEQ ID NO: 101187 - DNA, 25 bp, Homo sapien
tctgatgatagaaagccatcacagg

SEQ ID NO: 101188 - DNA, 25 bp, Homo sapien
tctgatgatagaaggccatcacagg

SEQ ID NO: 101189 - DNA, 25 bp, Homo sapien
tctgatgcattgtttcatatgccaa

SEQ ID NO: 101190 - DNA, 25 bp, Homo sapien
tctgatgcattgtttcgtatgccaa

SEQ ID NO: 101191 - DNA, 25 bp, Homo sapien
tctgatgtcaaccaggagaatgagt

SEQ ID NO: 101192 - DNA, 25 bp, Homo sapien
tctgatgtcaacccggagaatgagt

SEQ ID NO: 101193 - DNA, 25 bp, Homo sapien
tctgatgtgcctctaggtttgatca

SEQ ID NO: 101194 - DNA, 25 bp, Homo sapien
tctgatgtgcctctagttttgatca

SEQ ID NO: 101195 - DNA, 25 bp, Homo sapien
tctgatgttccttgcagccctcaag

SEQ ID NO: 101196 - DNA, 25 bp, Homo sapien
tctgatgtttcttgcagccctcaag

SEQ ID NO: 101197 - DNA, 25 bp, Homo sapien
tctgattacattgtagagttttatt

SEQ ID NO: 101198 - DNA, 25 bp, Homo sapien
tctgattaggtgccttttcattcaa

SEQ ID NO: 101199 - DNA, 25 bp, Homo sapien
tctgattaggtgtcttttcattcaa

SEQ ID NO: 101200 - DNA, 25 bp, Homo sapien
tctgattatattgtagagttttatt

SEQ ID NO: 101201 - DNA, 25 bp, Homo sapien
tctgattctatcatgagttactcta

SEQ ID NO: 101202 - DNA, 25 bp, Homo sapien
tctgattctatcctgagttactcta

SEQ ID NO: 101203 - DNA, 25 bp, Homo sapien
tctgattctcacaaatggcctagca

SEQ ID NO: 101204 - DNA, 25 bp, Homo sapien
tctgattctcataaatggcctagca

SEQ ID NO: 101205 - DNA, 25 bp, Homo sapien
tctgattgggaacgttgggtactaa

SEQ ID NO: 101206 - DNA, 25 bp, Homo sapien
tctgattgggaatgttgggtactaa

SEQ ID NO: 101207 - DNA, 25 bp, Homo sapien
tctgattgtgaattttgagacctgg

SEQ ID NO: 101208 - DNA, 25 bp, Homo sapien
tctgattgtgatttttgagacctgg

SEQ ID NO: 101209 - DNA, 25 bp, Homo sapien
tctgatttaaaactatttatgcagc

SEQ ID NO: 101210 - DNA, 25 bp, Homo sapien
tctgatttaaaagtatttatgcagc

SEQ ID NO: 101211 - DNA, 25 bp, Homo sapien
tctgatttacaatcgagaccactac

SEQ ID NO: 101212 - DNA, 25 bp, Homo sapien
tctgatttacaattgagaccactac

SEQ ID NO: 101213 - DNA, 25 bp, Homo sapien
tctgatttagttgcaagatgtaaaa

SEQ ID NO: 101214 - DNA, 25 bp, Homo sapien
tctgatttagtttcaagatgtaaaa

SEQ ID NO: 101215 - DNA, 25 bp, Homo sapien
tctgattttaatccgtcaggtttcc

SEQ ID NO: 101216 - DNA, 25 bp, Homo sapien
tctgattttaatctgtcaggtttcc

SEQ ID NO: 101217 - DNA, 25 bp, Homo sapien
tctgatttttacagtattgcaaacc

SEQ ID NO: 101218 - DNA, 25 bp, Homo sapien
tctgatttttacattattgcaaacc

SEQ ID NO: 101219 - DNA, 25 bp, Homo sapien
tctgatttttgtgctgtaaagtgtc

SEQ ID NO: 101220 - DNA, 25 bp, Homo sapien
tctgatttttgttctgtaaagtgtc

SEQ ID NO: 101221 - DNA, 25 bp, Homo sapien
tctgcaaaaataacgtcaatgcttt

SEQ ID NO: 101222 - DNA, 25 bp, Homo sapien
tctgcaaaaataatgtcaatgcttt

SEQ ID NO: 101223 - DNA, 25 bp, Homo sapien
tctgcaaagaggaacattgccaaat

SEQ ID NO: 101224 - DNA, 25 bp, Homo sapien
tctgcaaagaggagcattgccaaat

SEQ ID NO: 101225 - DNA, 25 bp, Homo sapien
tctgcaacataaccattcagaatat

SEQ ID NO: 101226 - DNA, 25 bp, Homo sapien
tctgcaacatatccattcagaatat

SEQ ID NO: 101227 - DNA, 25 bp, Homo sapien
tctgcaacatttcatttaatatttg

SEQ ID NO: 101228 - DNA, 25 bp, Homo sapien
tctgcaacttttcatttaatatttg

SEQ ID NO: 101229 - DNA, 25 bp, Homo sapien
tctgcaagagccaagcattactggg

SEQ ID NO: 101230 - DNA, 25 bp, Homo sapien
tctgcaagagtgctcttgtttcaca

SEQ ID NO: 101231 - DNA, 25 bp, Homo sapien
tctgcaagagtggtcttgtttcaca

SEQ ID NO: 101232 - DNA, 25 bp, Homo sapien
tctgcaagatatcacacgatcaagt

SEQ ID NO: 101233 - DNA, 25 bp, Homo sapien
tctgcaagatatcacatgatcaagt

SEQ ID NO: 101234 - DNA, 25 bp, Homo sapien
tctgcaagatccaagcattactggg

SEQ ID NO: 101235 - DNA, 25 bp, Homo sapien
tctgcaaggaatttgcccaacaaag

SEQ ID NO: 101236 - DNA, 25 bp, Homo sapien
tctgcaaggaattttcccaacaaag

SEQ ID NO: 101237 - DNA, 25 bp, Homo sapien
tctgcaataatgtaataatagttca

SEQ ID NO: 101238 - DNA, 25 bp, Homo sapien
tctgcaatagtgtaataatagttca

SEQ ID NO: 101239 - DNA, 25 bp, Homo sapien
tctgcaatgatgtatcagaccattc

SEQ ID NO: 101240 - DNA, 25 bp, Homo sapien
tctgcaatgatgtatctgaccattc

SEQ ID NO: 101241 - DNA, 25 bp, Homo sapien
tctgcaatttgactgtaagctcttt

SEQ ID NO: 101242 - DNA, 25 bp, Homo sapien
tctgcaatttgattgtaagctcttt

SEQ ID NO: 101243 - DNA, 25 bp, Homo sapien
tctgcaccatggtatatttacttag

SEQ ID NO: 101244 - DNA, 25 bp, Homo sapien
tctgcaccgtggtatatttacttag

SEQ ID NO: 101245 - DNA, 25 bp, Homo sapien
tctgcactgaatactatctgcgaaa

SEQ ID NO: 101246 - DNA, 25 bp, Homo sapien
tctgcactgaatcctatctgcgaaa

SEQ ID NO: 101247 - DNA, 25 bp, Homo sapien
tctgcactggaatcagatgttccca

SEQ ID NO: 101248 - DNA, 25 bp, Homo sapien
tctgcactggaatcaggtgttccca

SEQ ID NO: 101249 - DNA, 25 bp, Homo sapien
tctgcagacatgtggagaccaagtc

SEQ ID NO: 101250 - DNA, 25 bp, Homo sapien
tctgcagacgtggactgagggtgct

SEQ ID NO: 101251 - DNA, 25 bp, Homo sapien
tctgcagacgtgtggagaccaagtc

SEQ ID NO: 101252 - DNA, 25 bp, Homo sapien
tctgcagatgtggactgagggtgct

SEQ ID NO: 101253 - DNA, 25 bp, Homo sapien
tctgcagattaatccacttccatgc

SEQ ID NO: 101254 - DNA, 25 bp, Homo sapien
tctgcagattaatctacttccatgc

SEQ ID NO: 101255 - DNA, 25 bp, Homo sapien
tctgcagcaagcatctgttatttag

SEQ ID NO: 101256 - DNA, 25 bp, Homo sapien
tctgcagcctaaatacttgaaagca

SEQ ID NO: 101257 - DNA, 25 bp, Homo sapien
tctgcagcctagatacttgaaagca

SEQ ID NO: 101258 - DNA, 25 bp, Homo sapien
tctgcagcgagcatctgttatttag

SEQ ID NO: 101259 - DNA, 25 bp, Homo sapien
tctgcaggagaactggtgcccttca

SEQ ID NO: 101260 - DNA, 25 bp, Homo sapien
tctgcaggagagctggtgcccttca

SEQ ID NO: 101261 - DNA, 25 bp, Homo sapien
tctgcagtagcaaccactgcattgt

SEQ ID NO: 101262 - DNA, 25 bp, Homo sapien
tctgcagtagcaaccattgcattgt

SEQ ID NO: 101263 - DNA, 25 bp, Homo sapien
tctgcataacttgtgtgtgtgtcta

SEQ ID NO: 101264 - DNA, 25 bp, Homo sapien
tctgcataatttgtgtgtgtgtcta

SEQ ID NO: 101265 - DNA, 25 bp, Homo sapien
tctgcatcactcttaaccctttgcc

SEQ ID NO: 101266 - DNA, 25 bp, Homo sapien
tctgcatcatgggacacacttctga

SEQ ID NO: 101267 - DNA, 25 bp, Homo sapien
tctgcatcatggggcacacttctga

SEQ ID NO: 101268 - DNA, 25 bp, Homo sapien
tctgcatcattcttaaccctttgcc

SEQ ID NO: 101269 - DNA, 25 bp, Homo sapien
tctgcatgattttccttaaatagtt

SEQ ID NO: 101270 - DNA, 25 bp, Homo sapien
tctgcatggctggattcacagaccc

SEQ ID NO: 101271 - DNA, 25 bp, Homo sapien
tctgcatggcttgattcacagaccc

SEQ ID NO: 101272 - DNA, 25 bp, Homo sapien
tctgcatgtttttccttaaatagtt

SEQ ID NO: 101273 - DNA, 25 bp, Homo sapien
tctgcattcctcaacataggagtga

SEQ ID NO: 101274 - DNA, 25 bp, Homo sapien
tctgcattcgttaaaggaaaactat

SEQ ID NO: 101275 - DNA, 25 bp, Homo sapien
tctgcattgctcaacataggagtga

SEQ ID NO: 101276 - DNA, 25 bp, Homo sapien
tctgcatttcaagcagcaaaatgga

SEQ ID NO: 101277 - DNA, 25 bp, Homo sapien
tctgcatttcaagtagcaaaatgga

SEQ ID NO: 101278 - DNA, 25 bp, Homo sapien
tctgcatttcactttaatgaatctc

SEQ ID NO: 101279 - DNA, 25 bp, Homo sapien
tctgcatttcagtttaatgaatctc

SEQ ID NO: 101280 - DNA, 25 bp, Homo sapien
tctgcatttgttaaaggaaaactat

SEQ ID NO: 101281 - DNA, 25 bp, Homo sapien
tctgcattttggacgtgccagcttc

SEQ ID NO: 101282 - DNA, 25 bp, Homo sapien
tctgcattttggatgtgccagcttc

SEQ ID NO: 101283 - DNA, 25 bp, Homo sapien
tctgccaaagttctaagttttcatg

SEQ ID NO: 101284 - DNA, 25 bp, Homo sapien
tctgccaaagttgtaagttttcatg

SEQ ID NO: 101285 - DNA, 25 bp, Homo sapien
tctgccacaactaagaggaagctgg

SEQ ID NO: 101286 - DNA, 25 bp, Homo sapien
tctgccacactatatttattcccct

SEQ ID NO: 101287 - DNA, 25 bp, Homo sapien
tctgccacactatgtttattcccct

SEQ ID NO: 101288 - DNA, 25 bp, Homo sapien
tctgccacataattaaaagtaggta

SEQ ID NO: 101289 - DNA, 25 bp, Homo sapien
tctgccacgactaagaggaagctgg

SEQ ID NO: 101290 - DNA, 25 bp, Homo sapien
tctgccacgtaattaaaagtaggta

SEQ ID NO: 101291 - DNA, 25 bp, Homo sapien
tctgccactttctctcggtgctaat

SEQ ID NO: 101292 - DNA, 25 bp, Homo sapien
tctgccactttctgtcggtgctaat

SEQ ID NO: 101293 - DNA, 25 bp, Homo sapien
tctgccatatagccacctgtgtttc

SEQ ID NO: 101294 - DNA, 25 bp, Homo sapien
tctgccatatagtcacctgtgtttc

SEQ ID NO: 101295 - DNA, 25 bp, Homo sapien
tctgccatcaggagataataaaaag

SEQ ID NO: 101296 - DNA, 25 bp, Homo sapien
tctgccatcaggagttaataaaaag

SEQ ID NO: 101297 - DNA, 25 bp, Homo sapien
tctgccatcctgaggctaattttat

SEQ ID NO: 101298 - DNA, 25 bp, Homo sapien
tctgccatcttgaggctaattttat

SEQ ID NO: 101299 - DNA, 25 bp, Homo sapien
tctgccattccacgtgattgctaaa

SEQ ID NO: 101300 - DNA, 25 bp, Homo sapien
tctgccattccacgtggttgctaaa

SEQ ID NO: 101301 - DNA, 25 bp, Homo sapien
tctgccatttgcttccccgtatatg

SEQ ID NO: 101302 - DNA, 25 bp, Homo sapien
tctgccatttgtttccccgtatatg

SEQ ID NO: 101303 - DNA, 25 bp, Homo sapien
tctgcccagttgctcagccagaaga

SEQ ID NO: 101304 - DNA, 25 bp, Homo sapien
tctgcccagttgttcagccagaaga

SEQ ID NO: 101305 - DNA, 25 bp, Homo sapien
tctgcccatcgcgtatatcaactca

SEQ ID NO: 101306 - DNA, 25 bp, Homo sapien
tctgcccatcgcgtctatcaactca

SEQ ID NO: 101307 - DNA, 25 bp, Homo sapien
tctgcccattccagaacattcatct

SEQ ID NO: 101308 - DNA, 25 bp, Homo sapien
tctgcccattcccgaacattcatct

SEQ ID NO: 101309 - DNA, 25 bp, Homo sapien
tctgcctaagacaccacactctgtt

SEQ ID NO: 101310 - DNA, 25 bp, Homo sapien
tctgcctaagacgccacactctgtt

SEQ ID NO: 101311 - DNA, 25 bp, Homo sapien
tctgcctactgctcaaactcagcga

SEQ ID NO: 101312 - DNA, 25 bp, Homo sapien
tctgcctactgttcaaactcagcga

SEQ ID NO: 101313 - DNA, 25 bp, Homo sapien
tctgcctatacatgggtccagactc

SEQ ID NO: 101314 - DNA, 25 bp, Homo sapien
tctgcctatacctgggtccagactc

SEQ ID NO: 101315 - DNA, 25 bp, Homo sapien
tctgcctcattgaggatattttgag

SEQ ID NO: 101316 - DNA, 25 bp, Homo sapien
tctgcctcgttgaggatattttgag

SEQ ID NO: 101317 - DNA, 25 bp, Homo sapien
tctgcctctgatgcattaccatata

SEQ ID NO: 101318 - DNA, 25 bp, Homo sapien
tctgcctctgatgccttaccatata

SEQ ID NO: 101319 - DNA, 25 bp, Homo sapien
tctgcctgaacgagccatgtaaatt

SEQ ID NO: 101320 - DNA, 25 bp, Homo sapien
tctgcctgaacgagtcatgtaaatt

SEQ ID NO: 101321 - DNA, 25 bp, Homo sapien
tctgcctgcctctgtgctgtggttt

SEQ ID NO: 101322 - DNA, 25 bp, Homo sapien
tctgcctgcctctgtgttgtggttt

SEQ ID NO: 101323 - DNA, 25 bp, Homo sapien
tctgccttactccttctctttttgg

SEQ ID NO: 101324 - DNA, 25 bp, Homo sapien
tctgccttactctttctctttttgg

SEQ ID NO: 101325 - DNA, 25 bp, Homo sapien
tctgccttccacttcccaggctggg

SEQ ID NO: 101326 - DNA, 25 bp, Homo sapien
tctgccttctacttcccaggctggg

SEQ ID NO: 101327 - DNA, 25 bp, Homo sapien
tctgccttcttcctttgttggcagc

SEQ ID NO: 101328 - DNA, 25 bp, Homo sapien
tctgccttcttcgtttgttggcagc

SEQ ID NO: 101329 - DNA, 25 bp, Homo sapien
tctgccttttctagtctaaagacag

SEQ ID NO: 101330 - DNA, 25 bp, Homo sapien
tctgccttttcttgtctaaagacag

SEQ ID NO: 101331 - DNA, 25 bp, Homo sapien
tctgcgggacagttaagaaaatgga

SEQ ID NO: 101332 - DNA, 25 bp, Homo sapien
tctgcgggacagttgagaaaatgga

SEQ ID NO: 101333 - DNA, 25 bp, Homo sapien
tctgcggtaataacaagtctattct

SEQ ID NO: 101334 - DNA, 25 bp, Homo sapien
tctgcggtaatagcaagtctattct

SEQ ID NO: 101335 - DNA, 25 bp, Homo sapien
tctgcgtccacctcttctcttgtta

SEQ ID NO: 101336 - DNA, 25 bp, Homo sapien
tctgcgtccaccttttctcttgtta

SEQ ID NO: 101337 - DNA, 25 bp, Homo sapien
tctgcgtgtccttgggaaacttgct

SEQ ID NO: 101338 - DNA, 25 bp, Homo sapien
tctgcgtgtccttgggcaacttgct

SEQ ID NO: 101339 - DNA, 25 bp, Homo sapien
tctgcgttgacacgaacatcatact

SEQ ID NO: 101340 - DNA, 25 bp, Homo sapien
tctgcgttgacatgaacatcatact

SEQ ID NO: 101341 - DNA, 25 bp, Homo sapien
tctgctaatgtgacatttgtttggt

SEQ ID NO: 101342 - DNA, 25 bp, Homo sapien
tctgctaatgtggcatttgtttggt

SEQ ID NO: 101343 - DNA, 25 bp, Homo sapien
tctgctaccatgaagtccaagaaga

SEQ ID NO: 101344 - DNA, 25 bp, Homo sapien
tctgctaccttgaagtccaagaaga

SEQ ID NO: 101345 - DNA, 25 bp, Homo sapien
tctgctagaaagtcagcatcttaca

SEQ ID NO: 101346 - DNA, 25 bp, Homo sapien
tctgctagaaattcagcatcttaca

SEQ ID NO: 101347 - DNA, 25 bp, Homo sapien
tctgctagcagggatcagtgaggga

SEQ ID NO: 101348 - DNA, 25 bp, Homo sapien
tctgctagcagggctcagtgaggga

SEQ ID NO: 101349 - DNA, 25 bp, Homo sapien
tctgctcaattgacgtctcaggata

SEQ ID NO: 101350 - DNA, 25 bp, Homo sapien
tctgctcaattgatgtctcaggata

SEQ ID NO: 101351 - DNA, 25 bp, Homo sapien
tctgctcagggacctacaagactac

SEQ ID NO: 101352 - DNA, 25 bp, Homo sapien
tctgctcagggatctacaagactac

SEQ ID NO: 101353 - DNA, 25 bp, Homo sapien
tctgctccatccacaggttcctgtc

SEQ ID NO: 101354 - DNA, 25 bp, Homo sapien
tctgctccatccataggttcctgtc

SEQ ID NO: 101355 - DNA, 25 bp, Homo sapien
tctgctcctcctcactgttgctttg

SEQ ID NO: 101356 - DNA, 25 bp, Homo sapien
tctgctcctcgaagtagggacctta

SEQ ID NO: 101357 - DNA, 25 bp, Homo sapien
tctgctccttctcactgttgctttg

SEQ ID NO: 101358 - DNA, 25 bp, Homo sapien
tctgctccttgaagtagggacctta

SEQ ID NO: 101359 - DNA, 25 bp, Homo sapien
tctgctctatccacaatgacctact

SEQ ID NO: 101360 - DNA, 25 bp, Homo sapien
tctgctctatccactatgacctact

SEQ ID NO: 101361 - DNA, 25 bp, Homo sapien
tctgctgaacacacattttaataca

SEQ ID NO: 101362 - DNA, 25 bp, Homo sapien
tctgctgaacatacattttaataca

SEQ ID NO: 101363 - DNA, 25 bp, Homo sapien
tctgctgagctcatgttgtcacaag

SEQ ID NO: 101364 - DNA, 25 bp, Homo sapien
tctgctgagctcttgttgtcacaag

SEQ ID NO: 101365 - DNA, 25 bp, Homo sapien
tctgctgtctaaaatccttttcatg

SEQ ID NO: 101366 - DNA, 25 bp, Homo sapien
tctgctgtctaagatccttttcatg

SEQ ID NO: 101367 - DNA, 25 bp, Homo sapien
tctgctgtctgatgttccttgcagc

SEQ ID NO: 101368 - DNA, 25 bp, Homo sapien
tctgctgtctgatgtttcttgcagc

SEQ ID NO: 101369 - DNA, 25 bp, Homo sapien
tctgcttaaataaccaagatgtgtt

SEQ ID NO: 101370 - DNA, 25 bp, Homo sapien
tctgcttaagtaaccaagatgtgtt

SEQ ID NO: 101371 - DNA, 25 bp, Homo sapien
tctgcttcaatgaaagtgagcgtat

SEQ ID NO: 101372 - DNA, 25 bp, Homo sapien
tctgcttccatgaaagtgagcgtat

SEQ ID NO: 101373 - DNA, 25 bp, Homo sapien
tctgcttccattgccacatcttcgt

SEQ ID NO: 101374 - DNA, 25 bp, Homo sapien
tctgcttccgttgccacatcttcgt

SEQ ID NO: 101375 - DNA, 25 bp, Homo sapien
tctgcttcctccctagcagttgcat

SEQ ID NO: 101376 - DNA, 25 bp, Homo sapien
tctgcttctatcacaacctgcagag

SEQ ID NO: 101377 - DNA, 25 bp, Homo sapien
tctgcttctatcacgacctgcagag

SEQ ID NO: 101378 - DNA, 25 bp, Homo sapien
tctgcttcttccctagcagttgcat

SEQ ID NO: 101379 - DNA, 25 bp, Homo sapien
tctgcttgaatatttgaggcacggt

SEQ ID NO: 101380 - DNA, 25 bp, Homo sapien
tctgcttgcctgagattggtaccag

SEQ ID NO: 101381 - DNA, 25 bp, Homo sapien
tctgcttgcctgggattggtaccag

SEQ ID NO: 101382 - DNA, 25 bp, Homo sapien
tctgcttggatatttgaggcacggt

SEQ ID NO: 101383 - DNA, 25 bp, Homo sapien
tctgcttggcagggcttagcggtga

SEQ ID NO: 101384 - DNA, 25 bp, Homo sapien
tctgcttggcagtgcttagcggtga

SEQ ID NO: 101385 - DNA, 25 bp, Homo sapien
tctgctttactgtgaaaatgtataa

SEQ ID NO: 101386 - DNA, 25 bp, Homo sapien
tctgctttattgtgaaaatgtataa

SEQ ID NO: 101387 - DNA, 25 bp, Homo sapien
tctgctttccctgattatttacaag

SEQ ID NO: 101388 - DNA, 25 bp, Homo sapien
tctgctttccctgattctttacaag

SEQ ID NO: 101389 - DNA, 25 bp, Homo sapien
tctgctttcctcttgacctgcataa

SEQ ID NO: 101390 - DNA, 25 bp, Homo sapien
tctgctttgaaattatttatccctc

SEQ ID NO: 101391 - DNA, 25 bp, Homo sapien
tctgctttgaagttatttatccctc

SEQ ID NO: 101392 - DNA, 25 bp, Homo sapien
tctgcttttctcttgacctgcataa

SEQ ID NO: 101393 - DNA, 25 bp, Homo sapien
tctggaaaatggcttgacagttttt

SEQ ID NO: 101394 - DNA, 25 bp, Homo sapien
tctggaaaatggtttgacagttttt

SEQ ID NO: 101395 - DNA, 25 bp, Homo sapien
tctggaaaccactataatagctcta

SEQ ID NO: 101396 - DNA, 25 bp, Homo sapien
tctggaaaccactctaatagctcta

SEQ ID NO: 101397 - DNA, 25 bp, Homo sapien
tctggaacttatttcacactgtata

SEQ ID NO: 101398 - DNA, 25 bp, Homo sapien
tctggaacttatttcatactgtata

SEQ ID NO: 101399 - DNA, 25 bp, Homo sapien
tctggaaggctctgcaactagatct

SEQ ID NO: 101400 - DNA, 25 bp, Homo sapien
tctggaaggctctgcagctagatct

SEQ ID NO: 101401 - DNA, 25 bp, Homo sapien
tctggaagggacccgcagcttcaat

SEQ ID NO: 101402 - DNA, 25 bp, Homo sapien
tctggaagggacctgcagcttcaat

SEQ ID NO: 101403 - DNA, 25 bp, Homo sapien
tctggaagttttccctacctaacac

SEQ ID NO: 101404 - DNA, 25 bp, Homo sapien
tctggaagttttctctacctaacac

SEQ ID NO: 101405 - DNA, 25 bp, Homo sapien
tctggaatacttatgcaggacatgc

SEQ ID NO: 101406 - DNA, 25 bp, Homo sapien
tctggaatacttgtgcaggacatgc

SEQ ID NO: 101407 - DNA, 25 bp, Homo sapien
tctggacaactacccttttcaggaa

SEQ ID NO: 101408 - DNA, 25 bp, Homo sapien
tctggacaactatccttttcaggaa

SEQ ID NO: 101409 - DNA, 25 bp, Homo sapien
tctggacacagagcggcgctgccac

SEQ ID NO: 101410 - DNA, 25 bp, Homo sapien
tctggacacagagcggtgctgccac

SEQ ID NO: 101411 - DNA, 25 bp, Homo sapien
tctggacatcatcagtgccagcgga

SEQ ID NO: 101412 - DNA, 25 bp, Homo sapien
tctggacattatcagtgccagcgga

SEQ ID NO: 101413 - DNA, 25 bp, Homo sapien
tctggaccaactactacgggagttt

SEQ ID NO: 101414 - DNA, 25 bp, Homo sapien
tctggaccaactactatgggagttt

SEQ ID NO: 101415 - DNA, 25 bp, Homo sapien
tctggaccggctcactggactcatt

SEQ ID NO: 101416 - DNA, 25 bp, Homo sapien
tctggaccggcttactggactcatt

SEQ ID NO: 101417 - DNA, 25 bp, Homo sapien
tctggagatctggtctttatcagac

SEQ ID NO: 101418 - DNA, 25 bp, Homo sapien
tctggagatcttgtctttatcagac

SEQ ID NO: 101419 - DNA, 25 bp, Homo sapien
tctggagcatccatgtggctgaatt

SEQ ID NO: 101420 - DNA, 25 bp, Homo sapien
tctggagcgtccatgtggctgaatt

SEQ ID NO: 101421 - DNA, 25 bp, Homo sapien
tctggaggccttttctggaaacgat

SEQ ID NO: 101422 - DNA, 25 bp, Homo sapien
tctggaggtcttttctggaaacgat

SEQ ID NO: 101423 - DNA, 25 bp, Homo sapien
tctggagtcaggattcttctttagc

SEQ ID NO: 101424 - DNA, 25 bp, Homo sapien
tctggagtcagggttcttctttagc

SEQ ID NO: 101425 - DNA, 25 bp, Homo sapien
tctggagtcccagcgcggcaggaaa

SEQ ID NO: 101426 - DNA, 25 bp, Homo sapien
tctggagtcccagtgcggcaggaaa

SEQ ID NO: 101427 - DNA, 25 bp, Homo sapien
tctggataaagctatgcactgtgtt

SEQ ID NO: 101428 - DNA, 25 bp, Homo sapien
tctggataaagctatgtactgtgtt

SEQ ID NO: 101429 - DNA, 25 bp, Homo sapien
tctggataaggtaactgccataaca

SEQ ID NO: 101430 - DNA, 25 bp, Homo sapien
tctggataaggtcactgccataaca

SEQ ID NO: 101431 - DNA, 25 bp, Homo sapien
tctggataatctccccatcacatga

SEQ ID NO: 101432 - DNA, 25 bp, Homo sapien
tctggataatttagaacttctcagg

SEQ ID NO: 101433 - DNA, 25 bp, Homo sapien
tctggatagtctccccatcacatga

SEQ ID NO: 101434 - DNA, 25 bp, Homo sapien
tctggatagtttagaacttctcagg

SEQ ID NO: 101435 - DNA, 25 bp, Homo sapien
tctggatcaacacgtgagattagct

SEQ ID NO: 101436 - DNA, 25 bp, Homo sapien
tctggatcaacatgtgagattagct

SEQ ID NO: 101437 - DNA, 25 bp, Homo sapien
tctggatctttatccaccttctcct

SEQ ID NO: 101438 - DNA, 25 bp, Homo sapien
tctggatctttattcaccttctcct

SEQ ID NO: 101439 - DNA, 25 bp, Homo sapien
tctggatgactgatatgggttattt

SEQ ID NO: 101440 - DNA, 25 bp, Homo sapien
tctggatgatcccacaatcatgaat

SEQ ID NO: 101441 - DNA, 25 bp, Homo sapien
tctggatgccctttcaaggagccta

SEQ ID NO: 101442 - DNA, 25 bp, Homo sapien
tctggatgccctttcatggagccta

SEQ ID NO: 101443 - DNA, 25 bp, Homo sapien
tctggatgctcccacaatcatgaat

SEQ ID NO: 101444 - DNA, 25 bp, Homo sapien
tctggatgtctgatatgggttattt

SEQ ID NO: 101445 - DNA, 25 bp, Homo sapien
tctggattcagtaattggtagtact

SEQ ID NO: 101446 - DNA, 25 bp, Homo sapien
tctggattcggtaattggtagtact

SEQ ID NO: 101447 - DNA, 25 bp, Homo sapien
tctggattggaagtactctgcatct

SEQ ID NO: 101448 - DNA, 25 bp, Homo sapien
tctggattggaagtgctctgcatct

SEQ ID NO: 101449 - DNA, 25 bp, Homo sapien
tctggatttcacagctagtattttt

SEQ ID NO: 101450 - DNA, 25 bp, Homo sapien
tctggatttcacggctagtattttt

SEQ ID NO: 101451 - DNA, 25 bp, Homo sapien
tctggatttttccataatcgccatt

SEQ ID NO: 101452 - DNA, 25 bp, Homo sapien
tctggattttttcataatcgccatt

SEQ ID NO: 101453 - DNA, 25 bp, Homo sapien
tctggcaaaatgggatgagttctca

SEQ ID NO: 101454 - DNA, 25 bp, Homo sapien
tctggcaagatgggatgagttctca

SEQ ID NO: 101455 - DNA, 25 bp, Homo sapien
tctggcaagtttttatcaggccttc

SEQ ID NO: 101456 - DNA, 25 bp, Homo sapien
tctggcaagtttttattaggccttc

SEQ ID NO: 101457 - DNA, 25 bp, Homo sapien
tctggcacactgcagtaccctgtaa

SEQ ID NO: 101458 - DNA, 25 bp, Homo sapien
tctggcacactgcggtaccctgtaa

SEQ ID NO: 101459 - DNA, 25 bp, Homo sapien
tctggcagctaagtacctatttttc

SEQ ID NO: 101460 - DNA, 25 bp, Homo sapien
tctggcagctaggtacctatttttc

SEQ ID NO: 101461 - DNA, 25 bp, Homo sapien
tctggcataataaactatttgggcg

SEQ ID NO: 101462 - DNA, 25 bp, Homo sapien
tctggcataataagctatttgggcg

SEQ ID NO: 101463 - DNA, 25 bp, Homo sapien
tctggccaactcaacgatacaaaaa

SEQ ID NO: 101464 - DNA, 25 bp, Homo sapien
tctggccaactcatcgatacaaaaa

SEQ ID NO: 101465 - DNA, 25 bp, Homo sapien
tctggccacgccaaattggaacctg

SEQ ID NO: 101466 - DNA, 25 bp, Homo sapien
tctggccatgccaaattggaacctg

SEQ ID NO: 101467 - DNA, 25 bp, Homo sapien
tctggcctactaactgttaccactg

SEQ ID NO: 101468 - DNA, 25 bp, Homo sapien
tctggcctactatctgttaccactg

SEQ ID NO: 101469 - DNA, 25 bp, Homo sapien
tctggctcaaaaaccactgcaccat

SEQ ID NO: 101470 - DNA, 25 bp, Homo sapien
tctggctcaaaagccactgcaccat

SEQ ID NO: 101471 - DNA, 25 bp, Homo sapien
tctggctcctaccagcctgctcagc

SEQ ID NO: 101472 - DNA, 25 bp, Homo sapien
tctggctcctactagcctgctcagc

SEQ ID NO: 101473 - DNA, 25 bp, Homo sapien
tctggctgacttctcttcaagcttt

SEQ ID NO: 101474 - DNA, 25 bp, Homo sapien
tctggctgccttctcttcaagcttt

SEQ ID NO: 101475 - DNA, 25 bp, Homo sapien
tctggctgcctttgaaatatattat

SEQ ID NO: 101476 - DNA, 25 bp, Homo sapien
tctggctggaccatgctaagcagac

SEQ ID NO: 101477 - DNA, 25 bp, Homo sapien
tctggctggaccgtgctaagcagac

SEQ ID NO: 101478 - DNA, 25 bp, Homo sapien
tctggctgtctttgaaatatattat

SEQ ID NO: 101479 - DNA, 25 bp, Homo sapien
tctggcttctacctatagtatatta

SEQ ID NO: 101480 - DNA, 25 bp, Homo sapien
tctggcttctacctgtagtatatta

SEQ ID NO: 101481 - DNA, 25 bp, Homo sapien
tctggctttaaatatctgccttacc

SEQ ID NO: 101482 - DNA, 25 bp, Homo sapien
tctggctttcgcaacatcccataat

SEQ ID NO: 101483 - DNA, 25 bp, Homo sapien
tctggctttgaatatctgccttacc

SEQ ID NO: 101484 - DNA, 25 bp, Homo sapien
tctggcttttgcaacatcccataat

SEQ ID NO: 101485 - DNA, 25 bp, Homo sapien
tctgggaaataacagatactcatca

SEQ ID NO: 101486 - DNA, 25 bp, Homo sapien
tctgggaaataatagatactcatca

SEQ ID NO: 101487 - DNA, 25 bp, Homo sapien
tctgggaatcgctccatatcaatag

SEQ ID NO: 101488 - DNA, 25 bp, Homo sapien
tctgggaattgctccatatcaatag

SEQ ID NO: 101489 - DNA, 25 bp, Homo sapien
tctgggaccaggagttgtgcagccc

SEQ ID NO: 101490 - DNA, 25 bp, Homo sapien
tctgggaccaggcgttgtgcagccc

SEQ ID NO: 101491 - DNA, 25 bp, Homo sapien
tctgggagactgttccctattgagt

SEQ ID NO: 101492 - DNA, 25 bp, Homo sapien
tctgggagagtgttccctattgagt

SEQ ID NO: 101493 - DNA, 25 bp, Homo sapien
tctgggagctgtggacattccttgc

SEQ ID NO: 101494 - DNA, 25 bp, Homo sapien
tctgggagctgtggactttccttgc

SEQ ID NO: 101495 - DNA, 25 bp, Homo sapien
tctgggcaaagaaaatgaaagcacc

SEQ ID NO: 101496 - DNA, 25 bp, Homo sapien
tctgggcaaagaaaattaaagcacc

SEQ ID NO: 101497 - DNA, 25 bp, Homo sapien
tctgggccagtctctccacccagaa

SEQ ID NO: 101498 - DNA, 25 bp, Homo sapien
tctgggccagtctgtccacccagaa

SEQ ID NO: 101499 - DNA, 25 bp, Homo sapien
tctgggctgattattctcaaagccc

SEQ ID NO: 101500 - DNA, 25 bp, Homo sapien
tctgggctgattgttctcaaagccc

SEQ ID NO: 101501 - DNA, 25 bp, Homo sapien
tctgggcttgtgattcctggtataa

SEQ ID NO: 101502 - DNA, 25 bp, Homo sapien
tctgggcttttgattcctggtataa

SEQ ID NO: 101503 - DNA, 25 bp, Homo sapien
tctggggataatccagctaagcaga

SEQ ID NO: 101504 - DNA, 25 bp, Homo sapien
tctggggataattcagctaagcaga

SEQ ID NO: 101505 - DNA, 25 bp, Homo sapien
tctgggtattttgttcttttagcat

SEQ ID NO: 101506 - DNA, 25 bp, Homo sapien
tctgggtatttttttcttttagcat

SEQ ID NO: 101507 - DNA, 25 bp, Homo sapien
tctgggtccctcagtatcagagtca

SEQ ID NO: 101508 - DNA, 25 bp, Homo sapien
tctgggtccctgagtatcagagtca

SEQ ID NO: 101509 - DNA, 25 bp, Homo sapien
tctgggtcggcccaaagcaaacatt

SEQ ID NO: 101510 - DNA, 25 bp, Homo sapien
tctgggtctgcccaaagcaaacatt

SEQ ID NO: 101511 - DNA, 25 bp, Homo sapien
tctgggtgcattacacttctacaaa

SEQ ID NO: 101512 - DNA, 25 bp, Homo sapien
tctgggtgctttacacttctacaaa

SEQ ID NO: 101513 - DNA, 25 bp, Homo sapien
tctgggttttctcgtccatttcttc

SEQ ID NO: 101514 - DNA, 25 bp, Homo sapien
tctgggttttcttgtccatttcttc

SEQ ID NO: 101515 - DNA, 25 bp, Homo sapien
tctggtaaatgctgaccatttgttt

SEQ ID NO: 101516 - DNA, 25 bp, Homo sapien
tctggtaaatgttgaccatttgttt

SEQ ID NO: 101517 - DNA, 25 bp, Homo sapien
tctggtactctgctctttgtactct

SEQ ID NO: 101518 - DNA, 25 bp, Homo sapien
tctggtactctgctttttgtactct

SEQ ID NO: 101519 - DNA, 25 bp, Homo sapien
tctggtagatgaatagaatgcagta

SEQ ID NO: 101520 - DNA, 25 bp, Homo sapien
tctggtaggtgaatagaatgcagta

SEQ ID NO: 101521 - DNA, 25 bp, Homo sapien
tctggtcaaagtcctattctaaggt

SEQ ID NO: 101522 - DNA, 25 bp, Homo sapien
tctggtcaaggtcctattctaaggt

SEQ ID NO: 101523 - DNA, 25 bp, Homo sapien
tctggtcagaaacctaatttttgtg

SEQ ID NO: 101524 - DNA, 25 bp, Homo sapien
tctggtcagaaacctagtttttgtg

SEQ ID NO: 101525 - DNA, 25 bp, Homo sapien
tctggtccacgtagatttctatgaa

SEQ ID NO: 101526 - DNA, 25 bp, Homo sapien
tctggtccacgtggatttctatgaa

SEQ ID NO: 101527 - DNA, 25 bp, Homo sapien
tctggtccatgatattgatagtagc

SEQ ID NO: 101528 - DNA, 25 bp, Homo sapien
tctggtccctgatattgatagtagc

SEQ ID NO: 101529 - DNA, 25 bp, Homo sapien
tctggtcctggaaatgtcagactca

SEQ ID NO: 101530 - DNA, 25 bp, Homo sapien
tctggtcctgggaatgtcagactca

SEQ ID NO: 101531 - DNA, 25 bp, Homo sapien
tctggtctaaactgcaagtgactta

SEQ ID NO: 101532 - DNA, 25 bp, Homo sapien
tctggtctaaacttcaagtgactta

SEQ ID NO: 101533 - DNA, 25 bp, Homo sapien
tctggtctagcaaaaaatcggatat

SEQ ID NO: 101534 - DNA, 25 bp, Homo sapien
tctggtctagcacaaaatcggatat

SEQ ID NO: 101535 - DNA, 25 bp, Homo sapien
tctggtgagctagtttgtataaagt

SEQ ID NO: 101536 - DNA, 25 bp, Homo sapien
tctggtgagcttgtttgtataaagt

SEQ ID NO: 101537 - DNA, 25 bp, Homo sapien
tctggtgatcattatttgcctgatg

SEQ ID NO: 101538 - DNA, 25 bp, Homo sapien
tctggtgatgattatttgcctgatg

SEQ ID NO: 101539 - DNA, 25 bp, Homo sapien
tctggtgccctagcttgtcagccaa

SEQ ID NO: 101540 - DNA, 25 bp, Homo sapien
tctggtgccctagtttgtcagccaa

SEQ ID NO: 101541 - DNA, 25 bp, Homo sapien
tctggtgctaggcgagatcaatatt

SEQ ID NO: 101542 - DNA, 25 bp, Homo sapien
tctggtgctaggcgagatcaattat

SEQ ID NO: 101543 - DNA, 25 bp, Homo sapien
tctggtgctaggtgagatcaatatt

SEQ ID NO: 101544 - DNA, 25 bp, Homo sapien
tctggtgctaggtgagatcaattat

SEQ ID NO: 101545 - DNA, 25 bp, Homo sapien
tctggtggcataaaacagaaagaag

SEQ ID NO: 101546 - DNA, 25 bp, Homo sapien
tctggtggcgtaaaacagaaagaag

SEQ ID NO: 101547 - DNA, 25 bp, Homo sapien
tctggtggttatgatcagcatgtac

SEQ ID NO: 101548 - DNA, 25 bp, Homo sapien
tctggtggttatgatccgcatgtac

SEQ ID NO: 101549 - DNA, 25 bp, Homo sapien
tctggtgtgctcacttggccagaag

SEQ ID NO: 101550 - DNA, 25 bp, Homo sapien
tctggtgtgctcatttggccagaag

SEQ ID NO: 101551 - DNA, 25 bp, Homo sapien
tctggttaaaatgggtagactcttc

SEQ ID NO: 101552 - DNA, 25 bp, Homo sapien
tctggttaaaatgtgtagactcttc

SEQ ID NO: 101553 - DNA, 25 bp, Homo sapien
tctggttcagaacatcacaaggtgt

SEQ ID NO: 101554 - DNA, 25 bp, Homo sapien
tctggttcagaatatcacaaggtgt

SEQ ID NO: 101555 - DNA, 25 bp, Homo sapien
tctggttcagttgatataatacaat

SEQ ID NO: 101556 - DNA, 25 bp, Homo sapien
tctggttcagttggtataatacaat

SEQ ID NO: 101557 - DNA, 25 bp, Homo sapien
tctggttgaaagaatgcttgtctcc

SEQ ID NO: 101558 - DNA, 25 bp, Homo sapien
tctggttgaaagagtgcttgtctcc

SEQ ID NO: 101559 - DNA, 25 bp, Homo sapien
tctggttgttctcaaatggaataaa

SEQ ID NO: 101560 - DNA, 25 bp, Homo sapien
tctggttgttctcgaatggaataaa

SEQ ID NO: 101561 - DNA, 25 bp, Homo sapien
tctggtttaattatatcgcacaatg

SEQ ID NO: 101562 - DNA, 25 bp, Homo sapien
tctggtttaattgtatcgcacaatg

SEQ ID NO: 101563 - DNA, 25 bp, Homo sapien
tctggtttcaagcggtgagcctagc

SEQ ID NO: 101564 - DNA, 25 bp, Homo sapien
tctggtttcaagtggtgagcctagc

SEQ ID NO: 101565 - DNA, 25 bp, Homo sapien
tctggtttctgtagaagctgggctg

SEQ ID NO: 101566 - DNA, 25 bp, Homo sapien
tctggtttctgtaggagctgggctg

SEQ ID NO: 101567 - DNA, 25 bp, Homo sapien
tctggtttttatacaagtcttctag

SEQ ID NO: 101568 - DNA, 25 bp, Homo sapien
tctggtttttattcaagtcttctag

SEQ ID NO: 101569 - DNA, 25 bp, Homo sapien
tctgtaaaactgcactgataggatc

SEQ ID NO: 101570 - DNA, 25 bp, Homo sapien
tctgtaaaattgcactgataggatc

SEQ ID NO: 101571 - DNA, 25 bp, Homo sapien
tctgtaaagcagaactcacaatccc

SEQ ID NO: 101572 - DNA, 25 bp, Homo sapien
tctgtaaagtagaactcacaatccc

SEQ ID NO: 101573 - DNA, 25 bp, Homo sapien
tctgtaagagaggctttcatgtagt

SEQ ID NO: 101574 - DNA, 25 bp, Homo sapien
tctgtaagagatgctttcatgtagt

SEQ ID NO: 101575 - DNA, 25 bp, Homo sapien
tctgtaatgaatcagttgaattcag

SEQ ID NO: 101576 - DNA, 25 bp, Homo sapien
tctgtaatgaatcggttgaattcag

SEQ ID NO: 101577 - DNA, 25 bp, Homo sapien
tctgtacagaaaacagtaagaaatc

SEQ ID NO: 101578 - DNA, 25 bp, Homo sapien
tctgtacagaaaatagtaagaaatc

SEQ ID NO: 101579 - DNA, 25 bp, Homo sapien
tctgtacatcaggaagtataacaag

SEQ ID NO: 101580 - DNA, 25 bp, Homo sapien
tctgtacatcatgaagtataacaag

SEQ ID NO: 101581 - DNA, 25 bp, Homo sapien
tctgtaccagaaaattcctccaacg

SEQ ID NO: 101582 - DNA, 25 bp, Homo sapien
tctgtacctgaaaattcctccaacg

SEQ ID NO: 101583 - DNA, 25 bp, Homo sapien
tctgtacctgcacgtgactttgagg

SEQ ID NO: 101584 - DNA, 25 bp, Homo sapien
tctgtacctgcatgtgactttgagg

SEQ ID NO: 101585 - DNA, 25 bp, Homo sapien
tctgtacgataccataatggtggat

SEQ ID NO: 101586 - DNA, 25 bp, Homo sapien
tctgtacgatatcataatggtggat

SEQ ID NO: 101587 - DNA, 25 bp, Homo sapien
tctgtactatatctttatcactgaa

SEQ ID NO: 101588 - DNA, 25 bp, Homo sapien
tctgtactgtatctttatcactgaa

SEQ ID NO: 101589 - DNA, 25 bp, Homo sapien
tctgtaggcaatttagatgatgaaa

SEQ ID NO: 101590 - DNA, 25 bp, Homo sapien
tctgtaggcaatttggatgatgaaa

SEQ ID NO: 101591 - DNA, 25 bp, Homo sapien
tctgtagtactgccttgatttaaat

SEQ ID NO: 101592 - DNA, 25 bp, Homo sapien
tctgtagtagtgccttgatttaaat

SEQ ID NO: 101593 - DNA, 25 bp, Homo sapien
tctgtatacgagtttaagtccactt

SEQ ID NO: 101594 - DNA, 25 bp, Homo sapien
tctgtatactttacttgcctttatt

SEQ ID NO: 101595 - DNA, 25 bp, Homo sapien
tctgtatactttccttgcctttatt

SEQ ID NO: 101596 - DNA, 25 bp, Homo sapien
tctgtatagtttcaattctcacatg

SEQ ID NO: 101597 - DNA, 25 bp, Homo sapien
tctgtatagtttctattctcacatg

SEQ ID NO: 101598 - DNA, 25 bp, Homo sapien
tctgtatatgagtttaagtccactt

SEQ ID NO: 101599 - DNA, 25 bp, Homo sapien
tctgtatcaaccaagacatttttta

SEQ ID NO: 101600 - DNA, 25 bp, Homo sapien
tctgtatccaccaagacatttttta

SEQ ID NO: 101601 - DNA, 25 bp, Homo sapien
tctgtatctgaactaattggtgata

SEQ ID NO: 101602 - DNA, 25 bp, Homo sapien
tctgtatctgaattaattggtgata

SEQ ID NO: 101603 - DNA, 25 bp, Homo sapien
tctgtatgaaacgcccctgctctgt

SEQ ID NO: 101604 - DNA, 25 bp, Homo sapien
tctgtatgaaatgcccctgctctgt

SEQ ID NO: 101605 - DNA, 25 bp, Homo sapien
tctgtatgacctctaattcttatcc

SEQ ID NO: 101606 - DNA, 25 bp, Homo sapien
tctgtatggcctctaattcttatcc

SEQ ID NO: 101607 - DNA, 25 bp, Homo sapien
tctgtattaaaatcacaagaaaagc

SEQ ID NO: 101608 - DNA, 25 bp, Homo sapien
tctgtattaaagtcacaagaaaagc

SEQ ID NO: 101609 - DNA, 25 bp, Homo sapien
tctgtattacactttaaagcaaaca

SEQ ID NO: 101610 - DNA, 25 bp, Homo sapien
tctgtattatactttaaagcaaaca

SEQ ID NO: 101611 - DNA, 25 bp, Homo sapien
tctgtattctcattgtgaattctgg

SEQ ID NO: 101612 - DNA, 25 bp, Homo sapien
tctgtattctcattgttaattctgg

SEQ ID NO: 101613 - DNA, 25 bp, Homo sapien
tctgtcaaagtaggatgagatttat

SEQ ID NO: 101614 - DNA, 25 bp, Homo sapien
tctgtcaaagtgggatgagatttat

SEQ ID NO: 101615 - DNA, 25 bp, Homo sapien
tctgtcagaattccatgtgggcctg

SEQ ID NO: 101616 - DNA, 25 bp, Homo sapien
tctgtcagaattccctgtgggcctg

SEQ ID NO: 101617 - DNA, 25 bp, Homo sapien
tctgtcagtgttgtgaaaggaaata

SEQ ID NO: 101618 - DNA, 25 bp, Homo sapien
tctgtcagtgttttgaaaggaaata

SEQ ID NO: 101619 - DNA, 25 bp, Homo sapien
tctgtcatgcaccgagttgatggtc

SEQ ID NO: 101620 - DNA, 25 bp, Homo sapien
tctgtcatgcacctagttgatggtc

SEQ ID NO: 101621 - DNA, 25 bp, Homo sapien
tctgtcatgcttgaaaagttttctt

SEQ ID NO: 101622 - DNA, 25 bp, Homo sapien
tctgtcattaaaaacgatgccagaa

SEQ ID NO: 101623 - DNA, 25 bp, Homo sapien
tctgtcattaaaaatgatgccagaa

SEQ ID NO: 101624 - DNA, 25 bp, Homo sapien
tctgtcattatatctggctacattt

SEQ ID NO: 101625 - DNA, 25 bp, Homo sapien
tctgtcattatatctgtctacattt

SEQ ID NO: 101626 - DNA, 25 bp, Homo sapien
tctgtcattcttgaaaagttttctt

SEQ ID NO: 101627 - DNA, 25 bp, Homo sapien
tctgtcccacgcaaattcctttcaa

SEQ ID NO: 101628 - DNA, 25 bp, Homo sapien
tctgtcccatgcaaattcctttcaa

SEQ ID NO: 101629 - DNA, 25 bp, Homo sapien
tctgtccctatgcaatgagaaagca

SEQ ID NO: 101630 - DNA, 25 bp, Homo sapien
tctgtccctatgcgatgagaaagca

SEQ ID NO: 101631 - DNA, 25 bp, Homo sapien
tctgtctacgctcccatcttttgcc

SEQ ID NO: 101632 - DNA, 25 bp, Homo sapien
tctgtctatcggtctcacttccaaa

SEQ ID NO: 101633 - DNA, 25 bp, Homo sapien
tctgtctatgctcccatcttttgcc

SEQ ID NO: 101634 - DNA, 25 bp, Homo sapien
tctgtctatgggtctcacttccaaa

SEQ ID NO: 101635 - DNA, 25 bp, Homo sapien
tctgtctctctaccttttcaccaaa

SEQ ID NO: 101636 - DNA, 25 bp, Homo sapien
tctgtctctctatcttttcaccaaa

SEQ ID NO: 101637 - DNA, 25 bp, Homo sapien
tctgtctgtgattgacacttcctta

SEQ ID NO: 101638 - DNA, 25 bp, Homo sapien
tctgtctgtgattgacgcttcctta

SEQ ID NO: 101639 - DNA, 25 bp, Homo sapien
tctgtcttggccccagattttgtta

SEQ ID NO: 101640 - DNA, 25 bp, Homo sapien
tctgtcttggctccagattttgtta

SEQ ID NO: 101641 - DNA, 25 bp, Homo sapien
tctgtgaaacctttcaaagaggaat

SEQ ID NO: 101642 - DNA, 25 bp, Homo sapien
tctgtgaaatctttcaaagaggaat

SEQ ID NO: 101643 - DNA, 25 bp, Homo sapien
tctgtgaagacatactgaagttaag

SEQ ID NO: 101644 - DNA, 25 bp, Homo sapien
tctgtgaagtcatactgaagttaag

SEQ ID NO: 101645 - DNA, 25 bp, Homo sapien
tctgtgaccaaaccaggccatttcc

SEQ ID NO: 101646 - DNA, 25 bp, Homo sapien
tctgtgactaaaccaggccatttcc

SEQ ID NO: 101647 - DNA, 25 bp, Homo sapien
tctgtgactattacctgcctgacaa

SEQ ID NO: 101648 - DNA, 25 bp, Homo sapien
tctgtgactctgaagatggataaag

SEQ ID NO: 101649 - DNA, 25 bp, Homo sapien
tctgtgactgttacctgcctgacaa

SEQ ID NO: 101650 - DNA, 25 bp, Homo sapien
tctgtgactttgaagatggataaag

SEQ ID NO: 101651 - DNA, 25 bp, Homo sapien
tctgtgagaagaagcctgaagggtg

SEQ ID NO: 101652 - DNA, 25 bp, Homo sapien
tctgtgagaagaaggctgaagggtg

SEQ ID NO: 101653 - DNA, 25 bp, Homo sapien
tctgtgagtttccatttaatagttt

SEQ ID NO: 101654 - DNA, 25 bp, Homo sapien
tctgtgagttttcatttaatagttt

SEQ ID NO: 101655 - DNA, 25 bp, Homo sapien
tctgtgattgacacttccttacaac

SEQ ID NO: 101656 - DNA, 25 bp, Homo sapien
tctgtgattgacgcttccttacaac

SEQ ID NO: 101657 - DNA, 25 bp, Homo sapien
tctgtgcaacaggatatgtccttca

SEQ ID NO: 101658 - DNA, 25 bp, Homo sapien
tctgtgcaaggatcgtctttattta

SEQ ID NO: 101659 - DNA, 25 bp, Homo sapien
tctgtgcaaggatcttctttattta

SEQ ID NO: 101660 - DNA, 25 bp, Homo sapien
tctgtgcaataggatatgtccttca

SEQ ID NO: 101661 - DNA, 25 bp, Homo sapien
tctgtgcagaagaaagtaactatga

SEQ ID NO: 101662 - DNA, 25 bp, Homo sapien
tctgtgcaggagaaagtaactatga

SEQ ID NO: 101663 - DNA, 25 bp, Homo sapien
tctgtgcctaagccactatgaaata

SEQ ID NO: 101664 - DNA, 25 bp, Homo sapien
tctgtgcctaagcgactatgaaata

SEQ ID NO: 101665 - DNA, 25 bp, Homo sapien
tctgtgctaaatacgagtggtgatt

SEQ ID NO: 101666 - DNA, 25 bp, Homo sapien
tctgtgctaaataggagtggtgatt

SEQ ID NO: 101667 - DNA, 25 bp, Homo sapien
tctgtgcttctcataactactgggt

SEQ ID NO: 101668 - DNA, 25 bp, Homo sapien
tctgtgcttctcctaactactgggt

SEQ ID NO: 101669 - DNA, 25 bp, Homo sapien
tctgtgcttggtacatttcatttgg

SEQ ID NO: 101670 - DNA, 25 bp, Homo sapien
tctgtgcttggttcatttcatttgg

SEQ ID NO: 101671 - DNA, 25 bp, Homo sapien
tctgtggaaaacagagattgtatct

SEQ ID NO: 101672 - DNA, 25 bp, Homo sapien
tctgtggaaaacagggattgtatct

SEQ ID NO: 101673 - DNA, 25 bp, Homo sapien
tctgtggaattttaaaaactgcctg

SEQ ID NO: 101674 - DNA, 25 bp, Homo sapien
tctgtggaattttaaacactgcctg

SEQ ID NO: 101675 - DNA, 25 bp, Homo sapien
tctgtggacagactcaagccagctg

SEQ ID NO: 101676 - DNA, 25 bp, Homo sapien
tctgtggacagattcaagccagctg

SEQ ID NO: 101677 - DNA, 25 bp, Homo sapien
tctgtggagatgatagcaattcatg

SEQ ID NO: 101678 - DNA, 25 bp, Homo sapien
tctgtggagattatagcaattcatg

SEQ ID NO: 101679 - DNA, 25 bp, Homo sapien
tctgtggctcatctatagtgctgct

SEQ ID NO: 101680 - DNA, 25 bp, Homo sapien
tctgtggctcatctgtagtgctgct

SEQ ID NO: 101681 - DNA, 25 bp, Homo sapien
tctgtgggcataggacccgccaagc

SEQ ID NO: 101682 - DNA, 25 bp, Homo sapien
tctgtggggtgaatggtaatgtcgc

SEQ ID NO: 101683 - DNA, 25 bp, Homo sapien
tctgtggggtgtcctttttctagat

SEQ ID NO: 101684 - DNA, 25 bp, Homo sapien
tctgtggggtgtcttttttctagat

SEQ ID NO: 101685 - DNA, 25 bp, Homo sapien
tctgtgggtataggacccgccaagc

SEQ ID NO: 101686 - DNA, 25 bp, Homo sapien
tctgtgggttgaatggtaatgtcgc

SEQ ID NO: 101687 - DNA, 25 bp, Homo sapien
tctgtggtggaactgaaccatcttt

SEQ ID NO: 101688 - DNA, 25 bp, Homo sapien
tctgtggtggaattgaaccatcttt

SEQ ID NO: 101689 - DNA, 25 bp, Homo sapien
tctgtggttcttcacccagacataa

SEQ ID NO: 101690 - DNA, 25 bp, Homo sapien
tctgtggttcttcgcccagacataa

SEQ ID NO: 101691 - DNA, 25 bp, Homo sapien
tctgtggtttaagcttttcactaaa

SEQ ID NO: 101692 - DNA, 25 bp, Homo sapien
tctgtggtttacgcttttcactaaa

SEQ ID NO: 101693 - DNA, 25 bp, Homo sapien
tctgtgtacattttgagaaataaat

SEQ ID NO: 101694 - DNA, 25 bp, Homo sapien
tctgtgtatatgtctacgcattctt

SEQ ID NO: 101695 - DNA, 25 bp, Homo sapien
tctgtgtatatgtctatgcattctt

SEQ ID NO: 101696 - DNA, 25 bp, Homo sapien
tctgtgtatattttgagaaataaat

SEQ ID NO: 101697 - DNA, 25 bp, Homo sapien
tctgtgtattgcactaaatggactg

SEQ ID NO: 101698 - DNA, 25 bp, Homo sapien
tctgtgtattgtactaaatggactg

SEQ ID NO: 101699 - DNA, 25 bp, Homo sapien
tctgtgtatttaaacgtttccatta

SEQ ID NO: 101700 - DNA, 25 bp, Homo sapien
tctgtgtatttaaatgtttccatta

SEQ ID NO: 101701 - DNA, 25 bp, Homo sapien
tctgtgtcagggctccaacttcata

SEQ ID NO: 101702 - DNA, 25 bp, Homo sapien
tctgtgtcagggctccgacttcata

SEQ ID NO: 101703 - DNA, 25 bp, Homo sapien
tctgtgtctacacataaaggatata

SEQ ID NO: 101704 - DNA, 25 bp, Homo sapien
tctgtgtctccacataaaggatata

SEQ ID NO: 101705 - DNA, 25 bp, Homo sapien
tctgtgtgtatgctttgaactgcaa

SEQ ID NO: 101706 - DNA, 25 bp, Homo sapien
tctgtgtgtattctttgaactgcaa

SEQ ID NO: 101707 - DNA, 25 bp, Homo sapien
tctgtgtgttaggcaaggcaacctc

SEQ ID NO: 101708 - DNA, 25 bp, Homo sapien
tctgtgtgttaggcgaggcaacctc

SEQ ID NO: 101709 - DNA, 25 bp, Homo sapien
tctgtgttactgattgggaggctga

SEQ ID NO: 101710 - DNA, 25 bp, Homo sapien
tctgtgttcctacatatagacgtat

SEQ ID NO: 101711 - DNA, 25 bp, Homo sapien
tctgtgttcctgattgggaggctga

SEQ ID NO: 101712 - DNA, 25 bp, Homo sapien
tctgtgtttctacatatagacgtat

SEQ ID NO: 101713 - DNA, 25 bp, Homo sapien
tctgttaaccaatctctgactattc

SEQ ID NO: 101714 - DNA, 25 bp, Homo sapien
tctgttaaccaatttctgactattc

SEQ ID NO: 101715 - DNA, 25 bp, Homo sapien
tctgttaataaaagtctcatcctcc

SEQ ID NO: 101716 - DNA, 25 bp, Homo sapien
tctgttaataaaggtctcatcctcc

SEQ ID NO: 101717 - DNA, 25 bp, Homo sapien
tctgttaataaggaatttttggagg

SEQ ID NO: 101718 - DNA, 25 bp, Homo sapien
tctgttaatgaggaatttttggagg

SEQ ID NO: 101719 - DNA, 25 bp, Homo sapien
tctgttacaactctcctggggctct

SEQ ID NO: 101720 - DNA, 25 bp, Homo sapien
tctgttacaattattaattcacaaa

SEQ ID NO: 101721 - DNA, 25 bp, Homo sapien
tctgttacaattgttaattcacaaa

SEQ ID NO: 101722 - DNA, 25 bp, Homo sapien
tctgttacgactctcctggggctct

SEQ ID NO: 101723 - DNA, 25 bp, Homo sapien
tctgttacgtacctatgcttctttt

SEQ ID NO: 101724 - DNA, 25 bp, Homo sapien
tctgttacgtacctgtgcttctttt

SEQ ID NO: 101725 - DNA, 25 bp, Homo sapien
tctgttactagttgtccggagcttc

SEQ ID NO: 101726 - DNA, 25 bp, Homo sapien
tctgttactagttgtctggagcttc

SEQ ID NO: 101727 - DNA, 25 bp, Homo sapien
tctgttcaaccagaagttctgactc

SEQ ID NO: 101728 - DNA, 25 bp, Homo sapien
tctgttcaagcagaagttctgactc

SEQ ID NO: 101729 - DNA, 25 bp, Homo sapien
tctgttcatatgcctattatttcac

SEQ ID NO: 101730 - DNA, 25 bp, Homo sapien
tctgttcatatgtctattatttcac

SEQ ID NO: 101731 - DNA, 25 bp, Homo sapien
tctgttcatcagcatattctgtaaa

SEQ ID NO: 101732 - DNA, 25 bp, Homo sapien
tctgttcatcagcgtattctgtaaa

SEQ ID NO: 101733 - DNA, 25 bp, Homo sapien
tctgttcctcagccttctggacccg

SEQ ID NO: 101734 - DNA, 25 bp, Homo sapien
tctgttcctcaggcttctggacccg

SEQ ID NO: 101735 - DNA, 25 bp, Homo sapien
tctgttctaccaaggactcggtttc

SEQ ID NO: 101736 - DNA, 25 bp, Homo sapien
tctgttctaccagggactcggtttc

SEQ ID NO: 101737 - DNA, 25 bp, Homo sapien
tctgttctcagttttcttttgcaga

SEQ ID NO: 101738 - DNA, 25 bp, Homo sapien
tctgttctccgttttcttttgcaga

SEQ ID NO: 101739 - DNA, 25 bp, Homo sapien
tctgttctcctttgtttgcagtttg

SEQ ID NO: 101740 - DNA, 25 bp, Homo sapien
tctgttctcgtttgtttgcagtttg

SEQ ID NO: 101741 - DNA, 25 bp, Homo sapien
tctgttctttctctattgtttggat

SEQ ID NO: 101742 - DNA, 25 bp, Homo sapien
tctgttctttctttattgtttggat

SEQ ID NO: 101743 - DNA, 25 bp, Homo sapien
tctgttgaattttctcctttgtttc

SEQ ID NO: 101744 - DNA, 25 bp, Homo sapien
tctgttgaattttctcttttgtttc

SEQ ID NO: 101745 - DNA, 25 bp, Homo sapien
tctgttgatattgggtaagtttctg

SEQ ID NO: 101746 - DNA, 25 bp, Homo sapien
tctgttgatattgggtgagtttctg

SEQ ID NO: 101747 - DNA, 25 bp, Homo sapien
tctgttgatgtatacactgaaaaca

SEQ ID NO: 101748 - DNA, 25 bp, Homo sapien
tctgttgatttatacactgaaaaca

SEQ ID NO: 101749 - DNA, 25 bp, Homo sapien
tctgttgctatgacagaggtattaa

SEQ ID NO: 101750 - DNA, 25 bp, Homo sapien
tctgttgctatgagagaggtattaa

SEQ ID NO: 101751 - DNA, 25 bp, Homo sapien
tctgttgggactgcaataaaacatg

SEQ ID NO: 101752 - DNA, 25 bp, Homo sapien
tctgttgggactgccataaaacatg

SEQ ID NO: 101753 - DNA, 25 bp, Homo sapien
tctgttgtacttacatggagtcttc

SEQ ID NO: 101754 - DNA, 25 bp, Homo sapien
tctgttgttaggaagaataaatacg

SEQ ID NO: 101755 - DNA, 25 bp, Homo sapien
tctgttgttaggatgaataaatacg

SEQ ID NO: 101756 - DNA, 25 bp, Homo sapien
tctgttgttcttacatggagtcttc

SEQ ID NO: 101757 - DNA, 25 bp, Homo sapien
tctgttgtttaaagaagcaaatacc

SEQ ID NO: 101758 - DNA, 25 bp, Homo sapien
tctgttgtttaaagtagcaaatacc

SEQ ID NO: 101759 - DNA, 25 bp, Homo sapien
tctgtttaatgagagtgatgcagta

SEQ ID NO: 101760 - DNA, 25 bp, Homo sapien
tctgtttaatgatagtgatgcagta

SEQ ID NO: 101761 - DNA, 25 bp, Homo sapien
tctgtttacggagaacagaagccaa

SEQ ID NO: 101762 - DNA, 25 bp, Homo sapien
tctgtttaggtgcaactttgctttt

SEQ ID NO: 101763 - DNA, 25 bp, Homo sapien
tctgtttaggttcaactttgctttt

SEQ ID NO: 101764 - DNA, 25 bp, Homo sapien
tctgtttatagagcacatccacagt

SEQ ID NO: 101765 - DNA, 25 bp, Homo sapien
tctgtttatagagtacatccacagt

SEQ ID NO: 101766 - DNA, 25 bp, Homo sapien
tctgtttatggagaacagaagccaa

SEQ ID NO: 101767 - DNA, 25 bp, Homo sapien
tctgtttcactggacatacaatact

SEQ ID NO: 101768 - DNA, 25 bp, Homo sapien
tctgtttcagaaagaataggttccc

SEQ ID NO: 101769 - DNA, 25 bp, Homo sapien
tctgtttcagagagaataggttccc

SEQ ID NO: 101770 - DNA, 25 bp, Homo sapien
tctgtttcagtggacatacaatact

SEQ ID NO: 101771 - DNA, 25 bp, Homo sapien
tctgtttcatcctagtttttttcct

SEQ ID NO: 101772 - DNA, 25 bp, Homo sapien
tctgtttcttcctagtttttttcct

SEQ ID NO: 101773 - DNA, 25 bp, Homo sapien
tctgttttaaccattgaccttcatc

SEQ ID NO: 101774 - DNA, 25 bp, Homo sapien
tctgttttaacgattgaccttcatc

SEQ ID NO: 101775 - DNA, 25 bp, Homo sapien
tctgttttctgccagtgagtaaatt

SEQ ID NO: 101776 - DNA, 25 bp, Homo sapien
tctgttttctgctagtgagtaaatt

SEQ ID NO: 101777 - DNA, 25 bp, Homo sapien
tctgtttttatcaggaaagaagatc

SEQ ID NO: 101778 - DNA, 25 bp, Homo sapien
tctgtttttatcgggaaagaagatc

SEQ ID NO: 101779 - DNA, 25 bp, Homo sapien
tcttaaaagccacgacatagaacaa

SEQ ID NO: 101780 - DNA, 25 bp, Homo sapien
tcttaaaagccatgacatagaacaa

SEQ ID NO: 101781 - DNA, 25 bp, Homo sapien
tcttaaaatctcattgaatcttaca

SEQ ID NO: 101782 - DNA, 25 bp, Homo sapien
tcttaaaatgccaactgacttgtgt

SEQ ID NO: 101783 - DNA, 25 bp, Homo sapien
tcttaaaatgccagctgacttgtgt

SEQ ID NO: 101784 - DNA, 25 bp, Homo sapien
tcttaaaatttcattgaatcttaca

SEQ ID NO: 101785 - DNA, 25 bp, Homo sapien
tcttaaaattttatggatacgaatt

SEQ ID NO: 101786 - DNA, 25 bp, Homo sapien
tcttaaaattttgtggatacgaatt

SEQ ID NO: 101787 - DNA, 25 bp, Homo sapien
tcttaaataagatttgaaagtccag

SEQ ID NO: 101788 - DNA, 25 bp, Homo sapien
tcttaaataagatttggaagtccag

SEQ ID NO: 101789 - DNA, 25 bp, Homo sapien
tcttaaataggtaggtattgaagtc

SEQ ID NO: 101790 - DNA, 25 bp, Homo sapien
tcttaaattggtaggtattgaagtc

SEQ ID NO: 101791 - DNA, 25 bp, Homo sapien
tcttaacaagaaattggtgccagtc

SEQ ID NO: 101792 - DNA, 25 bp, Homo sapien
tcttaacaataaattggtgccagtc

SEQ ID NO: 101793 - DNA, 25 bp, Homo sapien
tcttaacactttcgtcactaagcac

SEQ ID NO: 101794 - DNA, 25 bp, Homo sapien
tcttaacacttttgtcactaagcac

SEQ ID NO: 101795 - DNA, 25 bp, Homo sapien
tcttaaccacattgccaactggagc

SEQ ID NO: 101796 - DNA, 25 bp, Homo sapien
tcttaaccatattgccaactggagc

SEQ ID NO: 101797 - DNA, 25 bp, Homo sapien
tcttaaccattcacagagaaagcag

SEQ ID NO: 101798 - DNA, 25 bp, Homo sapien
tcttaaccattcgcagagaaagcag

SEQ ID NO: 101799 - DNA, 25 bp, Homo sapien
tcttaaccgttctaatgcgctgacc

SEQ ID NO: 101800 - DNA, 25 bp, Homo sapien
tcttaacctcaattctgcttcttat

SEQ ID NO: 101801 - DNA, 25 bp, Homo sapien
tcttaacctcagttctgcttcttat

SEQ ID NO: 101802 - DNA, 25 bp, Homo sapien
tcttaacctttctaatgcgctgacc

SEQ ID NO: 101803 - DNA, 25 bp, Homo sapien
tcttaacttctgaatcacttctttc

SEQ ID NO: 101804 - DNA, 25 bp, Homo sapien
tcttaacttctgaatcgcttctttc

SEQ ID NO: 101805 - DNA, 25 bp, Homo sapien
tcttaacttgaacacgactcatttt

SEQ ID NO: 101806 - DNA, 25 bp, Homo sapien
tcttaacttgaacatgactcatttt

SEQ ID NO: 101807 - DNA, 25 bp, Homo sapien
tcttaaggtgaaagtgacttgactt

SEQ ID NO: 101808 - DNA, 25 bp, Homo sapien
tcttaaggtgaaattgacttgactt

SEQ ID NO: 101809 - DNA, 25 bp, Homo sapien
tcttaagtgaaatatctcttcatga

SEQ ID NO: 101810 - DNA, 25 bp, Homo sapien
tcttaagtgaaatgtctcttcatga

SEQ ID NO: 101811 - DNA, 25 bp, Homo sapien
tcttaataatcaatactttggctgc

SEQ ID NO: 101812 - DNA, 25 bp, Homo sapien
tcttaataatcaatcctttggctgc

SEQ ID NO: 101813 - DNA, 25 bp, Homo sapien
tcttaatctgcagacgtggactgag

SEQ ID NO: 101814 - DNA, 25 bp, Homo sapien
tcttaatctgcagatgtggactgag

SEQ ID NO: 101815 - DNA, 25 bp, Homo sapien
tcttaatgcaataggagggcaacaa

SEQ ID NO: 101816 - DNA, 25 bp, Homo sapien
tcttaatgcagcaatctcaggcttt

SEQ ID NO: 101817 - DNA, 25 bp, Homo sapien
tcttaatgcagcgatctcaggcttt

SEQ ID NO: 101818 - DNA, 25 bp, Homo sapien
tcttaatgccttttgagtaaacaaa

SEQ ID NO: 101819 - DNA, 25 bp, Homo sapien
tcttaatgccttttgattaaacaaa

SEQ ID NO: 101820 - DNA, 25 bp, Homo sapien
tcttaatgcgataggagggcaacaa

SEQ ID NO: 101821 - DNA, 25 bp, Homo sapien
tcttaatggttcatagttttggtat

SEQ ID NO: 101822 - DNA, 25 bp, Homo sapien
tcttaatggttcattgttttggtat

SEQ ID NO: 101823 - DNA, 25 bp, Homo sapien
tcttaatgtgggtgcttgctctctt

SEQ ID NO: 101824 - DNA, 25 bp, Homo sapien
tcttaatgtgggtgtttgctctctt

SEQ ID NO: 101825 - DNA, 25 bp, Homo sapien
tcttaattaggaaaccatatttgta

SEQ ID NO: 101826 - DNA, 25 bp, Homo sapien
tcttaattaggagaccatatttgta

SEQ ID NO: 101827 - DNA, 25 bp, Homo sapien
tcttaattctggaattatttttgct

SEQ ID NO: 101828 - DNA, 25 bp, Homo sapien
tcttaattctggcattatttttgct

SEQ ID NO: 101829 - DNA, 25 bp, Homo sapien
tcttaattgtccacttggagtgttt

SEQ ID NO: 101830 - DNA, 25 bp, Homo sapien
tcttaattgtctacttggagtgttt

SEQ ID NO: 101831 - DNA, 25 bp, Homo sapien
tcttacaaaaacagaacctctgttc

SEQ ID NO: 101832 - DNA, 25 bp, Homo sapien
tcttacaaaattcacatggtagagc

SEQ ID NO: 101833 - DNA, 25 bp, Homo sapien
tcttacaaaatttacatggtagagc

SEQ ID NO: 101834 - DNA, 25 bp, Homo sapien
tcttacaacaacagaacctctgttc

SEQ ID NO: 101835 - DNA, 25 bp, Homo sapien
tcttacactttttaaatgaagtttc

SEQ ID NO: 101836 - DNA, 25 bp, Homo sapien
tcttacacttttttaatgaagtttc

SEQ ID NO: 101837 - DNA, 25 bp, Homo sapien
tcttacagagtacatgtgtctgtct

SEQ ID NO: 101838 - DNA, 25 bp, Homo sapien
tcttacaggctcttcaaggtaacga

SEQ ID NO: 101839 - DNA, 25 bp, Homo sapien
tcttacagggtacatgtgtctgtct

SEQ ID NO: 101840 - DNA, 25 bp, Homo sapien
tcttacagtctcttcaaggtaacga

SEQ ID NO: 101841 - DNA, 25 bp, Homo sapien
tcttacatcgcagaaaatgttaatg

SEQ ID NO: 101842 - DNA, 25 bp, Homo sapien
tcttacatcgcagcaaatgttaatg

SEQ ID NO: 101843 - DNA, 25 bp, Homo sapien
tcttaccaaactagagagagaagga

SEQ ID NO: 101844 - DNA, 25 bp, Homo sapien
tcttaccaacagccctcagtgaacc

SEQ ID NO: 101845 - DNA, 25 bp, Homo sapien
tcttaccaacagctctcagtgaacc

SEQ ID NO: 101846 - DNA, 25 bp, Homo sapien
tcttaccacactagagagagaagga

SEQ ID NO: 101847 - DNA, 25 bp, Homo sapien
tcttaccagaagttatgtaccaaat

SEQ ID NO: 101848 - DNA, 25 bp, Homo sapien
tcttaccagaatttatgtaccaaat

SEQ ID NO: 101849 - DNA, 25 bp, Homo sapien
tcttacctttgacgtcagaggccac

SEQ ID NO: 101850 - DNA, 25 bp, Homo sapien
tcttacctttgatgtcagaggccac

SEQ ID NO: 101851 - DNA, 25 bp, Homo sapien
tcttacgttaaacacctaatcttgt

SEQ ID NO: 101852 - DNA, 25 bp, Homo sapien
tcttacgttaatcacctaatcttgt

SEQ ID NO: 101853 - DNA, 25 bp, Homo sapien
tcttactaccattcctctctgaaat

SEQ ID NO: 101854 - DNA, 25 bp, Homo sapien
tcttactatcattcctctctgaaat

SEQ ID NO: 101855 - DNA, 25 bp, Homo sapien
tcttactgatcatttataaaaggtg

SEQ ID NO: 101856 - DNA, 25 bp, Homo sapien
tcttactgatcgtttataaaaggtg

SEQ ID NO: 101857 - DNA, 25 bp, Homo sapien
tcttactgcaaagcattcaagagct

SEQ ID NO: 101858 - DNA, 25 bp, Homo sapien
tcttactgcaaagcgttcaagagct

SEQ ID NO: 101859 - DNA, 25 bp, Homo sapien
tcttactttgtcttagcccacagga

SEQ ID NO: 101860 - DNA, 25 bp, Homo sapien
tcttactttgttttagcccacagga

SEQ ID NO: 101861 - DNA, 25 bp, Homo sapien
tcttagaaaaggatttgtgatctgt

SEQ ID NO: 101862 - DNA, 25 bp, Homo sapien
tcttagaaaaggctttgtgatctgt

SEQ ID NO: 101863 - DNA, 25 bp, Homo sapien
tcttagagaagcgagtcttttttga

SEQ ID NO: 101864 - DNA, 25 bp, Homo sapien
tcttagagaagctagtcttttttga

SEQ ID NO: 101865 - DNA, 25 bp, Homo sapien
tcttagcaaagacagaacaagggta

SEQ ID NO: 101866 - DNA, 25 bp, Homo sapien
tcttagcaaaggcagaacaagggta

SEQ ID NO: 101867 - DNA, 25 bp, Homo sapien
tcttagcactgagggtcctcttgtc

SEQ ID NO: 101868 - DNA, 25 bp, Homo sapien
tcttagcactgggggtcctcttgtc

SEQ ID NO: 101869 - DNA, 25 bp, Homo sapien
tcttagcctttttgcgttctgaagt

SEQ ID NO: 101870 - DNA, 25 bp, Homo sapien
tcttagcctttttgggttctgaagt

SEQ ID NO: 101871 - DNA, 25 bp, Homo sapien
tcttagctactaaaatctgtttctc

SEQ ID NO: 101872 - DNA, 25 bp, Homo sapien
tcttagctccacttatctggaatac

SEQ ID NO: 101873 - DNA, 25 bp, Homo sapien
tcttagctccacttgtctggaatac

SEQ ID NO: 101874 - DNA, 25 bp, Homo sapien
tcttagctcggccataagcccccca

SEQ ID NO: 101875 - DNA, 25 bp, Homo sapien
tcttagctgctaaaatctgtttctc

SEQ ID NO: 101876 - DNA, 25 bp, Homo sapien
tcttagctgggccataagcccccca

SEQ ID NO: 101877 - DNA, 25 bp, Homo sapien
tcttaggaaaagccattcacatcaa

SEQ ID NO: 101878 - DNA, 25 bp, Homo sapien
tcttaggaaaagccgttcacatcaa

SEQ ID NO: 101879 - DNA, 25 bp, Homo sapien
tcttaggtgttcaggcaaggttggg

SEQ ID NO: 101880 - DNA, 25 bp, Homo sapien
tcttaggtgttgaggcaaggttggg

SEQ ID NO: 101881 - DNA, 25 bp, Homo sapien
tcttagtgacgatttttcttgtgat

SEQ ID NO: 101882 - DNA, 25 bp, Homo sapien
tcttagtgatgatttttcttgtgat

SEQ ID NO: 101883 - DNA, 25 bp, Homo sapien
tcttagttccaagaaccgtagtaaa

SEQ ID NO: 101884 - DNA, 25 bp, Homo sapien
tcttagttcttcgacctctctgact

SEQ ID NO: 101885 - DNA, 25 bp, Homo sapien
tcttagttctttgacctctctgact

SEQ ID NO: 101886 - DNA, 25 bp, Homo sapien
tcttagttgagtcctccgaatgaaa

SEQ ID NO: 101887 - DNA, 25 bp, Homo sapien
tcttagttgagtcctctgaatgaaa

SEQ ID NO: 101888 - DNA, 25 bp, Homo sapien
tcttagttggacatttccactcaga

SEQ ID NO: 101889 - DNA, 25 bp, Homo sapien
tcttagttggacctttccactcaga

SEQ ID NO: 101890 - DNA, 25 bp, Homo sapien
tcttagtttcaagaaccgtagtaaa

SEQ ID NO: 101891 - DNA, 25 bp, Homo sapien
tcttagtttttgctgctgcttagag

SEQ ID NO: 101892 - DNA, 25 bp, Homo sapien
tcttagtttttggtgctgcttagag

SEQ ID NO: 101893 - DNA, 25 bp, Homo sapien
tcttagttttttcattttctacagc

SEQ ID NO: 101894 - DNA, 25 bp, Homo sapien
tcttagttttttcgttttctacagc

SEQ ID NO: 101895 - DNA, 25 bp, Homo sapien
tcttataaggaaacttgtaattgct

SEQ ID NO: 101896 - DNA, 25 bp, Homo sapien
tcttataaggaaccttgtaattgct

SEQ ID NO: 101897 - DNA, 25 bp, Homo sapien
tcttatagttccaaaggccagaaat

SEQ ID NO: 101898 - DNA, 25 bp, Homo sapien
tcttatagttccgaaggccagaaat

SEQ ID NO: 101899 - DNA, 25 bp, Homo sapien
tcttatatgtgatagagtagtgaag

SEQ ID NO: 101900 - DNA, 25 bp, Homo sapien
tcttatatgtgatagattagtgaag

SEQ ID NO: 101901 - DNA, 25 bp, Homo sapien
tcttatcacgagtcctacgggaaac

SEQ ID NO: 101902 - DNA, 25 bp, Homo sapien
tcttatcacgagtcctgcgggaaac

SEQ ID NO: 101903 - DNA, 25 bp, Homo sapien
tcttatcatatcttactctcccatc

SEQ ID NO: 101904 - DNA, 25 bp, Homo sapien
tcttatcatgtcttactctcccatc

SEQ ID NO: 101905 - DNA, 25 bp, Homo sapien
tcttatccatgaccttttttgcccc

SEQ ID NO: 101906 - DNA, 25 bp, Homo sapien
tcttatccgtgaccttttttgcccc

SEQ ID NO: 101907 - DNA, 25 bp, Homo sapien
tcttatctaaaggaaagtactgtgg

SEQ ID NO: 101908 - DNA, 25 bp, Homo sapien
tcttatctaaagggaagtactgtgg

SEQ ID NO: 101909 - DNA, 25 bp, Homo sapien
tcttatctgttcaatgtgactagta

SEQ ID NO: 101910 - DNA, 25 bp, Homo sapien
tcttatctgtttaatgtgactagta

SEQ ID NO: 101911 - DNA, 25 bp, Homo sapien
tcttatgaaaaggcatgtgattaca

SEQ ID NO: 101912 - DNA, 25 bp, Homo sapien
tcttatgaaaagtcatgtgattaca

SEQ ID NO: 101913 - DNA, 25 bp, Homo sapien
tcttatgacaatatatctgtgagga

SEQ ID NO: 101914 - DNA, 25 bp, Homo sapien
tcttatgacaatgtatctgtgagga

SEQ ID NO: 101915 - DNA, 25 bp, Homo sapien
tcttatgagaccactattactctga

SEQ ID NO: 101916 - DNA, 25 bp, Homo sapien
tcttatgaggccactattactctga

SEQ ID NO: 101917 - DNA, 25 bp, Homo sapien
tcttatggagaattgcctttggtgc

SEQ ID NO: 101918 - DNA, 25 bp, Homo sapien
tcttatggagaattgcttttggtgc

SEQ ID NO: 101919 - DNA, 25 bp, Homo sapien
tcttatggtgaaagcagatgaaacc

SEQ ID NO: 101920 - DNA, 25 bp, Homo sapien
tcttatggtgaaaggagatgaaacc

SEQ ID NO: 101921 - DNA, 25 bp, Homo sapien
tcttattacaacctggaaattacca

SEQ ID NO: 101922 - DNA, 25 bp, Homo sapien
tcttattaccacctggaaattacca

SEQ ID NO: 101923 - DNA, 25 bp, Homo sapien
tcttattacgtgaattgtctaggtt

SEQ ID NO: 101924 - DNA, 25 bp, Homo sapien
tcttattagtacattttccctggaa

SEQ ID NO: 101925 - DNA, 25 bp, Homo sapien
tcttattagtacgttttccctggaa

SEQ ID NO: 101926 - DNA, 25 bp, Homo sapien
tcttattatcaggcatatatgcata

SEQ ID NO: 101927 - DNA, 25 bp, Homo sapien
tcttattatccaattgttttgattt

SEQ ID NO: 101928 - DNA, 25 bp, Homo sapien
tcttattatccagttgttttgattt

SEQ ID NO: 101929 - DNA, 25 bp, Homo sapien
tcttattatgaggcatatatgcata

SEQ ID NO: 101930 - DNA, 25 bp, Homo sapien
tcttattatgtgaattgtctaggtt

SEQ ID NO: 101931 - DNA, 25 bp, Homo sapien
tcttattctctctaatcctgttttg

SEQ ID NO: 101932 - DNA, 25 bp, Homo sapien
tcttattctgtctaatcctgttttg

SEQ ID NO: 101933 - DNA, 25 bp, Homo sapien
tcttattgacgctcaaaaattcttt

SEQ ID NO: 101934 - DNA, 25 bp, Homo sapien
tcttattgactactagctagaaata

SEQ ID NO: 101935 - DNA, 25 bp, Homo sapien
tcttattgactagtagctagaaata

SEQ ID NO: 101936 - DNA, 25 bp, Homo sapien
tcttattgaggctcaaaaattcttt

SEQ ID NO: 101937 - DNA, 25 bp, Homo sapien
tcttattgctccagcactcggtaga

SEQ ID NO: 101938 - DNA, 25 bp, Homo sapien
tcttattgttccagcactcggtaga

SEQ ID NO: 101939 - DNA, 25 bp, Homo sapien
tcttatttaacttatttggtagctg

SEQ ID NO: 101940 - DNA, 25 bp, Homo sapien
tcttatttacacaccgatggatttg

SEQ ID NO: 101941 - DNA, 25 bp, Homo sapien
tcttatttacacaccgttggatttg

SEQ ID NO: 101942 - DNA, 25 bp, Homo sapien
tcttatttatcttatttggtagctg

SEQ ID NO: 101943 - DNA, 25 bp, Homo sapien
tcttatttcttgcttgtgttgggtg

SEQ ID NO: 101944 - DNA, 25 bp, Homo sapien
tcttatttgatccatgtgttactta

SEQ ID NO: 101945 - DNA, 25 bp, Homo sapien
tcttatttgattcatgtgttactta

SEQ ID NO: 101946 - DNA, 25 bp, Homo sapien
tcttatttgttgcttgtgttgggtg

SEQ ID NO: 101947 - DNA, 25 bp, Homo sapien
tcttatttttgctgaaggaattttt

SEQ ID NO: 101948 - DNA, 25 bp, Homo sapien
tcttatttttgctggaggaattttt

SEQ ID NO: 101949 - DNA, 25 bp, Homo sapien
tcttcaaaaggacaaaattataagc

SEQ ID NO: 101950 - DNA, 25 bp, Homo sapien
tcttcaaaaggataaaattataagc

SEQ ID NO: 101951 - DNA, 25 bp, Homo sapien
tcttcaaaatgacaaggccatgtgg

SEQ ID NO: 101952 - DNA, 25 bp, Homo sapien
tcttcaaagtgacaaggccatgtgg

SEQ ID NO: 101953 - DNA, 25 bp, Homo sapien
tcttcaaatatattaaacacagcaa

SEQ ID NO: 101954 - DNA, 25 bp, Homo sapien
tcttcaaatatattaaccacagcaa

SEQ ID NO: 101955 - DNA, 25 bp, Homo sapien
tcttcaaccttcgctttctggcctt

SEQ ID NO: 101956 - DNA, 25 bp, Homo sapien
tcttcaaccttggctttctggcctt

SEQ ID NO: 101957 - DNA, 25 bp, Homo sapien
tcttcaagacacagtcatcatcaat

SEQ ID NO: 101958 - DNA, 25 bp, Homo sapien
tcttcaagacacggtcatcatcaat

SEQ ID NO: 101959 - DNA, 25 bp, Homo sapien
tcttcaagacaggacaaactcactt

SEQ ID NO: 101960 - DNA, 25 bp, Homo sapien
tcttcaagagaggacaaactcactt

SEQ ID NO: 101961 - DNA, 25 bp, Homo sapien
tcttcaaggataacatccctttgct

SEQ ID NO: 101962 - DNA, 25 bp, Homo sapien
tcttcaaggatagcatccctttgct

SEQ ID NO: 101963 - DNA, 25 bp, Homo sapien
tcttcaagtcaacattatttattca

SEQ ID NO: 101964 - DNA, 25 bp, Homo sapien
tcttcaagtcaacattgtttattca

SEQ ID NO: 101965 - DNA, 25 bp, Homo sapien
tcttcaatataagttctcagcacat

SEQ ID NO: 101966 - DNA, 25 bp, Homo sapien
tcttcaatgtaagttctcagcacat

SEQ ID NO: 101967 - DNA, 25 bp, Homo sapien
tcttcaatttccatatgaagatgct

SEQ ID NO: 101968 - DNA, 25 bp, Homo sapien
tcttcaatttcccttggcagtaaat

SEQ ID NO: 101969 - DNA, 25 bp, Homo sapien
tcttcaatttccttatgaagatgct

SEQ ID NO: 101970 - DNA, 25 bp, Homo sapien
tcttcaatttcctttggcagtaaat

SEQ ID NO: 101971 - DNA, 25 bp, Homo sapien
tcttcacaactgttggaccgttacc

SEQ ID NO: 101972 - DNA, 25 bp, Homo sapien
tcttcacagctgttggaccgttacc

SEQ ID NO: 101973 - DNA, 25 bp, Homo sapien
tcttcacaggaagcagcgtgtgtgc

SEQ ID NO: 101974 - DNA, 25 bp, Homo sapien
tcttcacaggaagcagggtgtgtgc

SEQ ID NO: 101975 - DNA, 25 bp, Homo sapien
tcttcaccagccagacatcgtcacc

SEQ ID NO: 101976 - DNA, 25 bp, Homo sapien
tcttcaccagctagacatcgtcacc

SEQ ID NO: 101977 - DNA, 25 bp, Homo sapien
tcttcacgtataggtttcatcagtc

SEQ ID NO: 101978 - DNA, 25 bp, Homo sapien
tcttcacgtatatgtttcatcagtc

SEQ ID NO: 101979 - DNA, 25 bp, Homo sapien
tcttcactttccatagaactctagc

SEQ ID NO: 101980 - DNA, 25 bp, Homo sapien
tcttcactttccgtagaactctagc

SEQ ID NO: 101981 - DNA, 25 bp, Homo sapien
tcttcagacacaaaagtgcaaacaa

SEQ ID NO: 101982 - DNA, 25 bp, Homo sapien
tcttcagacacagaagtgcaaacaa

SEQ ID NO: 101983 - DNA, 25 bp, Homo sapien
tcttcagaggctattacgaacagca

SEQ ID NO: 101984 - DNA, 25 bp, Homo sapien
tcttcagaggctattatgaacagca

SEQ ID NO: 101985 - DNA, 25 bp, Homo sapien
tcttcagatcctcctcactggctgt

SEQ ID NO: 101986 - DNA, 25 bp, Homo sapien
tcttcagatcctcttcactggctgt

SEQ ID NO: 101987 - DNA, 25 bp, Homo sapien
tcttcagattaacttgaaaaccact

SEQ ID NO: 101988 - DNA, 25 bp, Homo sapien
tcttcagattaagttgaaaaccact

SEQ ID NO: 101989 - DNA, 25 bp, Homo sapien
tcttcagattgtcagaaaagtagct

SEQ ID NO: 101990 - DNA, 25 bp, Homo sapien
tcttcagattgtcagataagtagct

SEQ ID NO: 101991 - DNA, 25 bp, Homo sapien
tcttcagctgggacagttgtcacta

SEQ ID NO: 101992 - DNA, 25 bp, Homo sapien
tcttcagctgggacggttgtcacta

SEQ ID NO: 101993 - DNA, 25 bp, Homo sapien
tcttcaggttagattgtcactgtgg

SEQ ID NO: 101994 - DNA, 25 bp, Homo sapien
tcttcaggttaggttgtcactgtgg

SEQ ID NO: 101995 - DNA, 25 bp, Homo sapien
tcttcagtccttatccacattttgc

SEQ ID NO: 101996 - DNA, 25 bp, Homo sapien
tcttcagtccttgtccacattttgc

SEQ ID NO: 101997 - DNA, 25 bp, Homo sapien
tcttcagtgtccaacctctttgctc

SEQ ID NO: 101998 - DNA, 25 bp, Homo sapien
tcttcagtgtccaatctctttgctc

SEQ ID NO: 101999 - DNA, 25 bp, Homo sapien
tcttcagttggctgggataaaaact

SEQ ID NO: 102000 - DNA, 25 bp, Homo sapien
tcttcagttggttgggataaaaact

SEQ ID NO: 102001 - DNA, 25 bp, Homo sapien
tcttcataaacctgacctggacggt

SEQ ID NO: 102002 - DNA, 25 bp, Homo sapien
tcttcataaacgtgacctggacggt

SEQ ID NO: 102003 - DNA, 25 bp, Homo sapien
tcttcatacaaccacagcagtccta

SEQ ID NO: 102004 - DNA, 25 bp, Homo sapien
tcttcatacaaccagagcagtccta

SEQ ID NO: 102005 - DNA, 25 bp, Homo sapien
tcttcatacaaggcattgaacacag

SEQ ID NO: 102006 - DNA, 25 bp, Homo sapien
tcttcatacaaggccttgaacacag

SEQ ID NO: 102007 - DNA, 25 bp, Homo sapien
tcttcatacgtaggcaaaaataact

SEQ ID NO: 102008 - DNA, 25 bp, Homo sapien
tcttcatagcatggtaagaagacat

SEQ ID NO: 102009 - DNA, 25 bp, Homo sapien
tcttcatatcatggtaagaagacat

SEQ ID NO: 102010 - DNA, 25 bp, Homo sapien
tcttcatatgtaggcaaaaataact

SEQ ID NO: 102011 - DNA, 25 bp, Homo sapien
tcttcatcagtttatttcttctgag

SEQ ID NO: 102012 - DNA, 25 bp, Homo sapien
tcttcatcatgcaccaggtagcgtg

SEQ ID NO: 102013 - DNA, 25 bp, Homo sapien
tcttcatcatgcgccaggtagcgtg

SEQ ID NO: 102014 - DNA, 25 bp, Homo sapien
tcttcatcattttaatcaattaatt

SEQ ID NO: 102015 - DNA, 25 bp, Homo sapien
tcttcatcattttactcaattaatt

SEQ ID NO: 102016 - DNA, 25 bp, Homo sapien
tcttcatccataaggcatgaggccg

SEQ ID NO: 102017 - DNA, 25 bp, Homo sapien
tcttcatccataatgcatgaggccg

SEQ ID NO: 102018 - DNA, 25 bp, Homo sapien
tcttcatcggtttatttcttctgag

SEQ ID NO: 102019 - DNA, 25 bp, Homo sapien
tcttcatgcattctctttcccccct

SEQ ID NO: 102020 - DNA, 25 bp, Homo sapien
tcttcatgcgttctctttcccccct

SEQ ID NO: 102021 - DNA, 25 bp, Homo sapien
tcttcattgtcaaaactacctcagg

SEQ ID NO: 102022 - DNA, 25 bp, Homo sapien
tcttcattgtgtcatcttcattgaa

SEQ ID NO: 102023 - DNA, 25 bp, Homo sapien
tcttcattgtgtcgtcttcattgaa

SEQ ID NO: 102024 - DNA, 25 bp, Homo sapien
tcttcattttcaaaactacctcagg

SEQ ID NO: 102025 - DNA, 25 bp, Homo sapien
tcttccaaatgcattagcctcctac

SEQ ID NO: 102026 - DNA, 25 bp, Homo sapien
tcttccaaatgcgttagcctcctac

SEQ ID NO: 102027 - DNA, 25 bp, Homo sapien
tcttccaacaaatagattaggagga

SEQ ID NO: 102028 - DNA, 25 bp, Homo sapien
tcttccaacaagtagattaggagga

SEQ ID NO: 102029 - DNA, 25 bp, Homo sapien
tcttccaacaagttacttctaggca

SEQ ID NO: 102030 - DNA, 25 bp, Homo sapien
tcttccaaccagttacttctaggca

SEQ ID NO: 102031 - DNA, 25 bp, Homo sapien
tcttccaagacagttacagattaat

SEQ ID NO: 102032 - DNA, 25 bp, Homo sapien
tcttccaagaccgttacagattaat

SEQ ID NO: 102033 - DNA, 25 bp, Homo sapien
tcttccaaggttccgtgcaccaaat

SEQ ID NO: 102034 - DNA, 25 bp, Homo sapien
tcttccaaggttctgtgcaccaaat

SEQ ID NO: 102035 - DNA, 25 bp, Homo sapien
tcttccaatagacggctgtgttgtc

SEQ ID NO: 102036 - DNA, 25 bp, Homo sapien
tcttccaatagagggctgtgttgtc

SEQ ID NO: 102037 - DNA, 25 bp, Homo sapien
tcttccaattgcagcaattcggttc

SEQ ID NO: 102038 - DNA, 25 bp, Homo sapien
tcttccaattgctgcaattcggttc

SEQ ID NO: 102039 - DNA, 25 bp, Homo sapien
tcttccacagtccaacaagataaac

SEQ ID NO: 102040 - DNA, 25 bp, Homo sapien
tcttccacatgatagttatggctta

SEQ ID NO: 102041 - DNA, 25 bp, Homo sapien
tcttccacattccgttgatggttga

SEQ ID NO: 102042 - DNA, 25 bp, Homo sapien
tcttccacattctgttgatggttga

SEQ ID NO: 102043 - DNA, 25 bp, Homo sapien
tcttccacatttttagaatcactta

SEQ ID NO: 102044 - DNA, 25 bp, Homo sapien
tcttccacattttttgaatcactta

SEQ ID NO: 102045 - DNA, 25 bp, Homo sapien
tcttccacggtccaacaagataaac

SEQ ID NO: 102046 - DNA, 25 bp, Homo sapien
tcttccacgtgatagttatggctta

SEQ ID NO: 102047 - DNA, 25 bp, Homo sapien
tcttccactacaagacactagagct

SEQ ID NO: 102048 - DNA, 25 bp, Homo sapien
tcttccactgcaagacactagagct

SEQ ID NO: 102049 - DNA, 25 bp, Homo sapien
tcttccagagaatataagaaggatc

SEQ ID NO: 102050 - DNA, 25 bp, Homo sapien
tcttccagagactataagaaggatc

SEQ ID NO: 102051 - DNA, 25 bp, Homo sapien
tcttccagcctttctattgaagttt

SEQ ID NO: 102052 - DNA, 25 bp, Homo sapien
tcttccagcctttttattgaagttt

SEQ ID NO: 102053 - DNA, 25 bp, Homo sapien
tcttcccaggattcatttccatctt

SEQ ID NO: 102054 - DNA, 25 bp, Homo sapien
tcttcccaggattcgtttccatctt

SEQ ID NO: 102055 - DNA, 25 bp, Homo sapien
tcttcccagttaggagaactattta

SEQ ID NO: 102056 - DNA, 25 bp, Homo sapien
tcttcccagttatgagaactattta

SEQ ID NO: 102057 - DNA, 25 bp, Homo sapien
tcttccgttatcaaaactagcaata

SEQ ID NO: 102058 - DNA, 25 bp, Homo sapien
tcttccgttgtcaaaactagcaata

SEQ ID NO: 102059 - DNA, 25 bp, Homo sapien
tcttcctaacaaagcatccaatctg

SEQ ID NO: 102060 - DNA, 25 bp, Homo sapien
tcttcctaatctgaaaaatcttttt

SEQ ID NO: 102061 - DNA, 25 bp, Homo sapien
tcttcctaatctgagaaatcttttt

SEQ ID NO: 102062 - DNA, 25 bp, Homo sapien
tcttcctacactacagtttggttcc

SEQ ID NO: 102063 - DNA, 25 bp, Homo sapien
tcttcctacactatagtttggttcc

SEQ ID NO: 102064 - DNA, 25 bp, Homo sapien
tcttcctactgtttgatttgtcctt

SEQ ID NO: 102065 - DNA, 25 bp, Homo sapien
tcttcctactgttttatttgtcctt

SEQ ID NO: 102066 - DNA, 25 bp, Homo sapien
tcttcctagccaatctcctgttgaa

SEQ ID NO: 102067 - DNA, 25 bp, Homo sapien
tcttcctagtcaatctcctgttgaa

SEQ ID NO: 102068 - DNA, 25 bp, Homo sapien
tcttcctatacctaccactacttga

SEQ ID NO: 102069 - DNA, 25 bp, Homo sapien
tcttcctatacttaccactacttga

SEQ ID NO: 102070 - DNA, 25 bp, Homo sapien
tcttcctatcaaagcatccaatctg

SEQ ID NO: 102071 - DNA, 25 bp, Homo sapien
tcttcctcatcaatgagcacacgtc

SEQ ID NO: 102072 - DNA, 25 bp, Homo sapien
tcttcctcatcagtgagcacacgtc

SEQ ID NO: 102073 - DNA, 25 bp, Homo sapien
tcttccttagaaaacaaaaccactg

SEQ ID NO: 102074 - DNA, 25 bp, Homo sapien
tcttccttggaaaacaaaaccactg

SEQ ID NO: 102075 - DNA, 25 bp, Homo sapien
tcttcctttctgatctgatcttgtg

SEQ ID NO: 102076 - DNA, 25 bp, Homo sapien
tcttcctttctgatcttatcttgtg

SEQ ID NO: 102077 - DNA, 25 bp, Homo sapien
tcttcgaatgtttggcatggtgcta

SEQ ID NO: 102078 - DNA, 25 bp, Homo sapien
tcttcgaatgtttggcgtggtgcta

SEQ ID NO: 102079 - DNA, 25 bp, Homo sapien
tcttcgtctggtagatgaatagaat

SEQ ID NO: 102080 - DNA, 25 bp, Homo sapien
tcttcgtctggtaggtgaatagaat

SEQ ID NO: 102081 - DNA, 25 bp, Homo sapien
tcttctaaataatccacccaatgcc

SEQ ID NO: 102082 - DNA, 25 bp, Homo sapien
tcttctaaatactccacccaatgcc

SEQ ID NO: 102083 - DNA, 25 bp, Homo sapien
tcttctaacttactattcacacatg

SEQ ID NO: 102084 - DNA, 25 bp, Homo sapien
tcttctaacttattattcacacatg

SEQ ID NO: 102085 - DNA, 25 bp, Homo sapien
tcttctaatgaatgtacgggttagc

SEQ ID NO: 102086 - DNA, 25 bp, Homo sapien
tcttctaatgaatgtatgggttagc

SEQ ID NO: 102087 - DNA, 25 bp, Homo sapien
tcttctacaatattctatgtcatct

SEQ ID NO: 102088 - DNA, 25 bp, Homo sapien
tcttctacaatattttatgtcatct

SEQ ID NO: 102089 - DNA, 25 bp, Homo sapien
tcttctaccacctgtatcattttat

SEQ ID NO: 102090 - DNA, 25 bp, Homo sapien
tcttctaccgcctgtatcattttat

SEQ ID NO: 102091 - DNA, 25 bp, Homo sapien
tcttctagcacatggggcagtgagc

SEQ ID NO: 102092 - DNA, 25 bp, Homo sapien
tcttctagcgcatggggcagtgagc

SEQ ID NO: 102093 - DNA, 25 bp, Homo sapien
tcttctagtgtagaacctgtgaata

SEQ ID NO: 102094 - DNA, 25 bp, Homo sapien
tcttctagtgtagatcctgtgaata

SEQ ID NO: 102095 - DNA, 25 bp, Homo sapien
tcttctatatctaaagtacaaaagc

SEQ ID NO: 102096 - DNA, 25 bp, Homo sapien
tcttctatatcttaagtacaaaagc

SEQ ID NO: 102097 - DNA, 25 bp, Homo sapien
tcttctatggccggcatgactcagc

SEQ ID NO: 102098 - DNA, 25 bp, Homo sapien
tcttctatggctggcatgactcagc

SEQ ID NO: 102099 - DNA, 25 bp, Homo sapien
tcttctattcacgcacttcaggaac

SEQ ID NO: 102100 - DNA, 25 bp, Homo sapien
tcttctattcatgcacttcaggaac

SEQ ID NO: 102101 - DNA, 25 bp, Homo sapien
tcttctcaatttcaagccacctgcc

SEQ ID NO: 102102 - DNA, 25 bp, Homo sapien
tcttctcaatttccagccacctgcc

SEQ ID NO: 102103 - DNA, 25 bp, Homo sapien
tcttctcacatggaaggagactttt

SEQ ID NO: 102104 - DNA, 25 bp, Homo sapien
tcttctcacattgaaggagactttt

SEQ ID NO: 102105 - DNA, 25 bp, Homo sapien
tcttctcacctacaagaatttataa

SEQ ID NO: 102106 - DNA, 25 bp, Homo sapien
tcttctcacctgcaagaatttataa

SEQ ID NO: 102107 - DNA, 25 bp, Homo sapien
tcttctcccacaaatctgtctttag

SEQ ID NO: 102108 - DNA, 25 bp, Homo sapien
tcttctcccacaagtctgtctttag

SEQ ID NO: 102109 - DNA, 25 bp, Homo sapien
tcttctctaatgctcatatagtgcg

SEQ ID NO: 102110 - DNA, 25 bp, Homo sapien
tcttctctaatgttcatatagtgcg

SEQ ID NO: 102111 - DNA, 25 bp, Homo sapien
tcttctctcatggtaatacaatgac

SEQ ID NO: 102112 - DNA, 25 bp, Homo sapien
tcttctctgagcttagaattgcatt

SEQ ID NO: 102113 - DNA, 25 bp, Homo sapien
tcttctctgtgattccaagtgtttt

SEQ ID NO: 102114 - DNA, 25 bp, Homo sapien
tcttctctgtgcttagaattgcatt

SEQ ID NO: 102115 - DNA, 25 bp, Homo sapien
tcttctctgtggttccaagtgtttt

SEQ ID NO: 102116 - DNA, 25 bp, Homo sapien
tcttctcttatggtaatacaatgac

SEQ ID NO: 102117 - DNA, 25 bp, Homo sapien
tcttctcttggaacttgttcttatt

SEQ ID NO: 102118 - DNA, 25 bp, Homo sapien
tcttctcttggaactttttcttatt

SEQ ID NO: 102119 - DNA, 25 bp, Homo sapien
tcttctcttggggcctcccgccttc

SEQ ID NO: 102120 - DNA, 25 bp, Homo sapien
tcttctctttgggcctcccgccttc

SEQ ID NO: 102121 - DNA, 25 bp, Homo sapien
tcttctgaacttcgacttcgcactt

SEQ ID NO: 102122 - DNA, 25 bp, Homo sapien
tcttctgaactttgacttcgcactt

SEQ ID NO: 102123 - DNA, 25 bp, Homo sapien
tcttctgctagaaagtcagcatctt

SEQ ID NO: 102124 - DNA, 25 bp, Homo sapien
tcttctgctagaaattcagcatctt

SEQ ID NO: 102125 - DNA, 25 bp, Homo sapien
tcttctggacactagattaattatc

SEQ ID NO: 102126 - DNA, 25 bp, Homo sapien
tcttctggctctgagaatatcttca

SEQ ID NO: 102127 - DNA, 25 bp, Homo sapien
tcttctggctctgagattatcttca

SEQ ID NO: 102128 - DNA, 25 bp, Homo sapien
tcttctgggcactagattaattatc

SEQ ID NO: 102129 - DNA, 25 bp, Homo sapien
tcttctgggcttgtgattcctggta

SEQ ID NO: 102130 - DNA, 25 bp, Homo sapien
tcttctgggcttttgattcctggta

SEQ ID NO: 102131 - DNA, 25 bp, Homo sapien
tcttctggtcgaattgggaataaat

SEQ ID NO: 102132 - DNA, 25 bp, Homo sapien
tcttctggttgaattgggaataaat

SEQ ID NO: 102133 - DNA, 25 bp, Homo sapien
tcttctgtacgtaagccactatgta

SEQ ID NO: 102134 - DNA, 25 bp, Homo sapien
tcttctgtagtactgccttgattta

SEQ ID NO: 102135 - DNA, 25 bp, Homo sapien
tcttctgtagtagtgccttgattta

SEQ ID NO: 102136 - DNA, 25 bp, Homo sapien
tcttctgtatgtaagccactatgta

SEQ ID NO: 102137 - DNA, 25 bp, Homo sapien
tcttctgtcataatttggaccttaa

SEQ ID NO: 102138 - DNA, 25 bp, Homo sapien
tcttctgtcatgatttggaccttaa

SEQ ID NO: 102139 - DNA, 25 bp, Homo sapien
tcttctgtcttccaaatcttgagtg

SEQ ID NO: 102140 - DNA, 25 bp, Homo sapien
tcttctgtcttccacatcttgagtg

SEQ ID NO: 102141 - DNA, 25 bp, Homo sapien
tcttctgtttcactggacatacaat

SEQ ID NO: 102142 - DNA, 25 bp, Homo sapien
tcttctgtttcagtggacatacaat

SEQ ID NO: 102143 - DNA, 25 bp, Homo sapien
tcttctgttttcacgctcttatgtc

SEQ ID NO: 102144 - DNA, 25 bp, Homo sapien
tcttctgttttcatgctcttatgtc

SEQ ID NO: 102145 - DNA, 25 bp, Homo sapien
tcttctgtttttccctctttatttg

SEQ ID NO: 102146 - DNA, 25 bp, Homo sapien
tcttctgtttttctctctttatttg

SEQ ID NO: 102147 - DNA, 25 bp, Homo sapien
tcttcttacatttgcagtgtgcccc

SEQ ID NO: 102148 - DNA, 25 bp, Homo sapien
tcttcttacattttcagtgtgcccc

SEQ ID NO: 102149 - DNA, 25 bp, Homo sapien
tcttcttagaaacgtcagaattgca

SEQ ID NO: 102150 - DNA, 25 bp, Homo sapien
tcttcttagaaatgtcagaattgca

SEQ ID NO: 102151 - DNA, 25 bp, Homo sapien
tcttcttcaaccttcgctttctggc

SEQ ID NO: 102152 - DNA, 25 bp, Homo sapien
tcttcttcaaccttggctttctggc

SEQ ID NO: 102153 - DNA, 25 bp, Homo sapien
tcttcttcacaactgttggaccgtt

SEQ ID NO: 102154 - DNA, 25 bp, Homo sapien
tcttcttcacagctgttggaccgtt

SEQ ID NO: 102155 - DNA, 25 bp, Homo sapien
tcttcttcacttacccgcaagcacc

SEQ ID NO: 102156 - DNA, 25 bp, Homo sapien
tcttcttcacttgcccgcaagcacc

SEQ ID NO: 102157 - DNA, 25 bp, Homo sapien
tcttcttcagatcctcctcactggc

SEQ ID NO: 102158 - DNA, 25 bp, Homo sapien
tcttcttcagatcctcttcactggc

SEQ ID NO: 102159 - DNA, 25 bp, Homo sapien
tcttcttgcaccaaagtttgattga

SEQ ID NO: 102160 - DNA, 25 bp, Homo sapien
tcttcttgcaccaacgtttgattga

SEQ ID NO: 102161 - DNA, 25 bp, Homo sapien
tcttcttgcctgggctcagcaagca

SEQ ID NO: 102162 - DNA, 25 bp, Homo sapien
tcttcttgctaaagtctgtacagtc

SEQ ID NO: 102163 - DNA, 25 bp, Homo sapien
tcttcttgctaatgtctgtacagtc

SEQ ID NO: 102164 - DNA, 25 bp, Homo sapien
tcttcttgctttgggaaatattaag

SEQ ID NO: 102165 - DNA, 25 bp, Homo sapien
tcttcttggtgtcatctttctttac

SEQ ID NO: 102166 - DNA, 25 bp, Homo sapien
tcttcttggtgtcgtctttctttac

SEQ ID NO: 102167 - DNA, 25 bp, Homo sapien
tcttcttgtctgggctcagcaagca

SEQ ID NO: 102168 - DNA, 25 bp, Homo sapien
tcttcttgttgttgttccaaagtta

SEQ ID NO: 102169 - DNA, 25 bp, Homo sapien
tcttcttgttgttgtttcaaagtta

SEQ ID NO: 102170 - DNA, 25 bp, Homo sapien
tcttcttgttttgggaaatattaag

SEQ ID NO: 102171 - DNA, 25 bp, Homo sapien
tcttctttactgcatcattaatttt

SEQ ID NO: 102172 - DNA, 25 bp, Homo sapien
tcttctttactgcatcgttaatttt

SEQ ID NO: 102173 - DNA, 25 bp, Homo sapien
tcttctttgactgcaaatcttgcca

SEQ ID NO: 102174 - DNA, 25 bp, Homo sapien
tcttctttgactgcgaatcttgcca

SEQ ID NO: 102175 - DNA, 25 bp, Homo sapien
tcttctttgtagatgggagacccta

SEQ ID NO: 102176 - DNA, 25 bp, Homo sapien
tcttctttgtagttgggagacccta

SEQ ID NO: 102177 - DNA, 25 bp, Homo sapien
tcttctttgttcctttctaccatta

SEQ ID NO: 102178 - DNA, 25 bp, Homo sapien
tcttctttgttcttttctaccatta

SEQ ID NO: 102179 - DNA, 25 bp, Homo sapien
tcttcttttacatgtcatcttagag

SEQ ID NO: 102180 - DNA, 25 bp, Homo sapien
tcttcttttacgtgtcatcttagag

SEQ ID NO: 102181 - DNA, 25 bp, Homo sapien
tcttcttttatcttgccacagctat

SEQ ID NO: 102182 - DNA, 25 bp, Homo sapien
tcttcttttctcttgccacagctat

SEQ ID NO: 102183 - DNA, 25 bp, Homo sapien
tcttgaaactttctatttagtcgtt

SEQ ID NO: 102184 - DNA, 25 bp, Homo sapien
tcttgaaactttgtatttagtcgtt

SEQ ID NO: 102185 - DNA, 25 bp, Homo sapien
tcttgaaagtaacaaacttgcttat

SEQ ID NO: 102186 - DNA, 25 bp, Homo sapien
tcttgaaagtagcaaacttgcttat

SEQ ID NO: 102187 - DNA, 25 bp, Homo sapien
tcttgaaataaatagcaagagcaaa

SEQ ID NO: 102188 - DNA, 25 bp, Homo sapien
tcttgaaatgaatagcaagagcaaa

SEQ ID NO: 102189 - DNA, 25 bp, Homo sapien
tcttgaagtatgagtaagagtttct

SEQ ID NO: 102190 - DNA, 25 bp, Homo sapien
tcttgaagtttgagtaagagtttct

SEQ ID NO: 102191 - DNA, 25 bp, Homo sapien
tcttgaataactaataggagttttg

SEQ ID NO: 102192 - DNA, 25 bp, Homo sapien
tcttgaatcaccaatgccaccactc

SEQ ID NO: 102193 - DNA, 25 bp, Homo sapien
tcttgaatcactaataggagttttg

SEQ ID NO: 102194 - DNA, 25 bp, Homo sapien
tcttgaatcgccaatgccaccactc

SEQ ID NO: 102195 - DNA, 25 bp, Homo sapien
tcttgaatgatgtgtgcttcacatt

SEQ ID NO: 102196 - DNA, 25 bp, Homo sapien
tcttgaatgatgtgtggttcacatt

SEQ ID NO: 102197 - DNA, 25 bp, Homo sapien
tcttgacaaatctggtgagttctca

SEQ ID NO: 102198 - DNA, 25 bp, Homo sapien
tcttgacaaatctggttagttctca

SEQ ID NO: 102199 - DNA, 25 bp, Homo sapien
tcttgacatgttgtggcgagactga

SEQ ID NO: 102200 - DNA, 25 bp, Homo sapien
tcttgacatgttgtggtgagactga

SEQ ID NO: 102201 - DNA, 25 bp, Homo sapien
tcttgaccttggctatctctgtcta

SEQ ID NO: 102202 - DNA, 25 bp, Homo sapien
tcttgaccttggctgtctctgtcta

SEQ ID NO: 102203 - DNA, 25 bp, Homo sapien
tcttgacttctactcttgagcagct

SEQ ID NO: 102204 - DNA, 25 bp, Homo sapien
tcttgacttttactcttgagcagct

SEQ ID NO: 102205 - DNA, 25 bp, Homo sapien
tcttgagaaaacagggctaaatggt

SEQ ID NO: 102206 - DNA, 25 bp, Homo sapien
tcttgagaagacacagcaggggatg

SEQ ID NO: 102207 - DNA, 25 bp, Homo sapien
tcttgagaagacagggctaaatggt

SEQ ID NO: 102208 - DNA, 25 bp, Homo sapien
tcttgagaagacgcagcaggggatg

SEQ ID NO: 102209 - DNA, 25 bp, Homo sapien
tcttgagagtacatggcatttcaaa

SEQ ID NO: 102210 - DNA, 25 bp, Homo sapien
tcttgagagtacgtggcatttcaaa

SEQ ID NO: 102211 - DNA, 25 bp, Homo sapien
tcttgagcaatccactcggtgtcca

SEQ ID NO: 102212 - DNA, 25 bp, Homo sapien
tcttgagcaatccactgggtgtcca

SEQ ID NO: 102213 - DNA, 25 bp, Homo sapien
tcttgaggcctaattactttcaatt

SEQ ID NO: 102214 - DNA, 25 bp, Homo sapien
tcttgaggcctgattactttcaatt

SEQ ID NO: 102215 - DNA, 25 bp, Homo sapien
tcttgagtctatccttgtctctgta

SEQ ID NO: 102216 - DNA, 25 bp, Homo sapien
tcttgagtctattcttgtctctgta

SEQ ID NO: 102217 - DNA, 25 bp, Homo sapien
tcttgagtgcctttaaagatttccg

SEQ ID NO: 102218 - DNA, 25 bp, Homo sapien
tcttgagtgcctttgaagatttccg

SEQ ID NO: 102219 - DNA, 25 bp, Homo sapien
tcttgataaagtgtctatcaagtgc

SEQ ID NO: 102220 - DNA, 25 bp, Homo sapien
tcttgataaagtgtctctcaagtgc

SEQ ID NO: 102221 - DNA, 25 bp, Homo sapien
tcttgatcatatcacagattgcctg

SEQ ID NO: 102222 - DNA, 25 bp, Homo sapien
tcttgatcccctgaaaaaaagagtc

SEQ ID NO: 102223 - DNA, 25 bp, Homo sapien
tcttgatcgtatcacagattgcctg

SEQ ID NO: 102224 - DNA, 25 bp, Homo sapien
tcttgatctcctgaaaaaaagagtc

SEQ ID NO: 102225 - DNA, 25 bp, Homo sapien
tcttgatttaattttccacttgtgc

SEQ ID NO: 102226 - DNA, 25 bp, Homo sapien
tcttgatttaattttctacttgtgc

SEQ ID NO: 102227 - DNA, 25 bp, Homo sapien
tcttgatttgtacaaactgctatac

SEQ ID NO: 102228 - DNA, 25 bp, Homo sapien
tcttgatttgtgcaaactgctatac

SEQ ID NO: 102229 - DNA, 25 bp, Homo sapien
tcttgcaaaaaatgaaactctttat

SEQ ID NO: 102230 - DNA, 25 bp, Homo sapien
tcttgcaaataatgaaactctttat

SEQ ID NO: 102231 - DNA, 25 bp, Homo sapien
tcttgcaataactcttgatggaaag

SEQ ID NO: 102232 - DNA, 25 bp, Homo sapien
tcttgcaataactgttgatggaaag

SEQ ID NO: 102233 - DNA, 25 bp, Homo sapien
tcttgcaccaaagtttgattgattt

SEQ ID NO: 102234 - DNA, 25 bp, Homo sapien
tcttgcaccaacgtttgattgattt

SEQ ID NO: 102235 - DNA, 25 bp, Homo sapien
tcttgcaccatcaaggattttagga

SEQ ID NO: 102236 - DNA, 25 bp, Homo sapien
tcttgcaccatcgaggattttagga

SEQ ID NO: 102237 - DNA, 25 bp, Homo sapien
tcttgcacccagttcacacagactt

SEQ ID NO: 102238 - DNA, 25 bp, Homo sapien
tcttgcactcagttcacacagactt

SEQ ID NO: 102239 - DNA, 25 bp, Homo sapien
tcttgcactctcaaaatgagtgtag

SEQ ID NO: 102240 - DNA, 25 bp, Homo sapien
tcttgcactctcgaaatgagtgtag

SEQ ID NO: 102241 - DNA, 25 bp, Homo sapien
tcttgcactgtgacattgagtaaca

SEQ ID NO: 102242 - DNA, 25 bp, Homo sapien
tcttgcactgtgatattgagtaaca

SEQ ID NO: 102243 - DNA, 25 bp, Homo sapien
tcttgcagaagacaatggatatcgg

SEQ ID NO: 102244 - DNA, 25 bp, Homo sapien
tcttgcagaaggcaatggatatcgg

SEQ ID NO: 102245 - DNA, 25 bp, Homo sapien
tcttgcagctgttcaggcagaaaac

SEQ ID NO: 102246 - DNA, 25 bp, Homo sapien
tcttgcagttgttcaggcagaaaac

SEQ ID NO: 102247 - DNA, 25 bp, Homo sapien
tcttgcatctgagctttaacgttga

SEQ ID NO: 102248 - DNA, 25 bp, Homo sapien
tcttgcatgttatatggcttttgct

SEQ ID NO: 102249 - DNA, 25 bp, Homo sapien
tcttgcatgttttatggcttttgct

SEQ ID NO: 102250 - DNA, 25 bp, Homo sapien
tcttgcattgctccctccaaaaggt

SEQ ID NO: 102251 - DNA, 25 bp, Homo sapien
tcttgcatttctccctccaaaaggt

SEQ ID NO: 102252 - DNA, 25 bp, Homo sapien
tcttgcatttgagctttaacgttga

SEQ ID NO: 102253 - DNA, 25 bp, Homo sapien
tcttgcccataggccacttaacagc

SEQ ID NO: 102254 - DNA, 25 bp, Homo sapien
tcttgcccataggccagttaacagc

SEQ ID NO: 102255 - DNA, 25 bp, Homo sapien
tcttgccttgagatatgaggctgta

SEQ ID NO: 102256 - DNA, 25 bp, Homo sapien
tcttgccttgatatatgaggctgta

SEQ ID NO: 102257 - DNA, 25 bp, Homo sapien
tcttgcctttgctaagcacctcggt

SEQ ID NO: 102258 - DNA, 25 bp, Homo sapien
tcttgcctttgctaagtacctcggt

SEQ ID NO: 102259 - DNA, 25 bp, Homo sapien
tcttgccttttcagctgcttctggc

SEQ ID NO: 102260 - DNA, 25 bp, Homo sapien
tcttgccttttcagcttcttctggc

SEQ ID NO: 102261 - DNA, 25 bp, Homo sapien
tcttgctaaagtctgtacagtcatt

SEQ ID NO: 102262 - DNA, 25 bp, Homo sapien
tcttgctaagtgtattttctgaggc

SEQ ID NO: 102263 - DNA, 25 bp, Homo sapien
tcttgctaatctttttgatcctcca

SEQ ID NO: 102264 - DNA, 25 bp, Homo sapien
tcttgctaatcttttttatcctcca

SEQ ID NO: 102265 - DNA, 25 bp, Homo sapien
tcttgctaatgtctgtacagtcatt

SEQ ID NO: 102266 - DNA, 25 bp, Homo sapien
tcttgctaattgtattttctgaggc

SEQ ID NO: 102267 - DNA, 25 bp, Homo sapien
tcttgctacagataaacagggagga

SEQ ID NO: 102268 - DNA, 25 bp, Homo sapien
tcttgctacagataaagagggagga

SEQ ID NO: 102269 - DNA, 25 bp, Homo sapien
tcttgctactgatattctcttccat

SEQ ID NO: 102270 - DNA, 25 bp, Homo sapien
tcttgctactgatattgtcttccat

SEQ ID NO: 102271 - DNA, 25 bp, Homo sapien
tcttgctcactcaactgcctaaaaa

SEQ ID NO: 102272 - DNA, 25 bp, Homo sapien
tcttgctcactcaattgcctaaaaa

SEQ ID NO: 102273 - DNA, 25 bp, Homo sapien
tcttgctccctactgccttgtgctc

SEQ ID NO: 102274 - DNA, 25 bp, Homo sapien
tcttgctccctcctgccttgtgctc

SEQ ID NO: 102275 - DNA, 25 bp, Homo sapien
tcttgctcttaaacctaaatctaag

SEQ ID NO: 102276 - DNA, 25 bp, Homo sapien
tcttgctcttaagcctaaatctaag

SEQ ID NO: 102277 - DNA, 25 bp, Homo sapien
tcttgctgtgttcttctcgagtaga

SEQ ID NO: 102278 - DNA, 25 bp, Homo sapien
tcttgctgtgtttttctcgagtaga

SEQ ID NO: 102279 - DNA, 25 bp, Homo sapien
tcttgcttagcccatgcacacagca

SEQ ID NO: 102280 - DNA, 25 bp, Homo sapien
tcttgcttagcccgtgcacacagca

SEQ ID NO: 102281 - DNA, 25 bp, Homo sapien
tcttgcttcctacaaggtctggtga

SEQ ID NO: 102282 - DNA, 25 bp, Homo sapien
tcttgcttcctacagggtctggtga

SEQ ID NO: 102283 - DNA, 25 bp, Homo sapien
tcttgcttcttaagtgtatttatag

SEQ ID NO: 102284 - DNA, 25 bp, Homo sapien
tcttgcttcttaggtgtatttatag

SEQ ID NO: 102285 - DNA, 25 bp, Homo sapien
tcttggactctcaagtagtgtatac

SEQ ID NO: 102286 - DNA, 25 bp, Homo sapien
tcttggactgtcaagtagtgtatac

SEQ ID NO: 102287 - DNA, 25 bp, Homo sapien
tcttggagaaaacctgttaatatcc

SEQ ID NO: 102288 - DNA, 25 bp, Homo sapien
tcttggagaatcaattttagcctaa

SEQ ID NO: 102289 - DNA, 25 bp, Homo sapien
tcttggagaattaattttagcctaa

SEQ ID NO: 102290 - DNA, 25 bp, Homo sapien
tcttggaggctgcatctgctcttct

SEQ ID NO: 102291 - DNA, 25 bp, Homo sapien
tcttggaggctgtatctgctcttct

SEQ ID NO: 102292 - DNA, 25 bp, Homo sapien
tcttggagtaaacctgttaatatcc

SEQ ID NO: 102293 - DNA, 25 bp, Homo sapien
tcttggagtaaacgatttttgcagg

SEQ ID NO: 102294 - DNA, 25 bp, Homo sapien
tcttggagtaaatgatttttgcagg

SEQ ID NO: 102295 - DNA, 25 bp, Homo sapien
tcttggcacacaaaaatagtttact

SEQ ID NO: 102296 - DNA, 25 bp, Homo sapien
tcttggcacacagaaatagtttact

SEQ ID NO: 102297 - DNA, 25 bp, Homo sapien
tcttggccaaccacagcaacaataa

SEQ ID NO: 102298 - DNA, 25 bp, Homo sapien
tcttggccagccacagcaacaataa

SEQ ID NO: 102299 - DNA, 25 bp, Homo sapien
tcttggccatattctgagccaccta

SEQ ID NO: 102300 - DNA, 25 bp, Homo sapien
tcttggccgtattctgagccaccta

SEQ ID NO: 102301 - DNA, 25 bp, Homo sapien
tcttggctgaactcttagagaggca

SEQ ID NO: 102302 - DNA, 25 bp, Homo sapien
tcttggctgaactcttggagaggca

SEQ ID NO: 102303 - DNA, 25 bp, Homo sapien
tcttggctgtgctatgaaacctgga

SEQ ID NO: 102304 - DNA, 25 bp, Homo sapien
tcttggctgtgctctgaaacctgga

SEQ ID NO: 102305 - DNA, 25 bp, Homo sapien
tcttggctttgtatacttccacggt

SEQ ID NO: 102306 - DNA, 25 bp, Homo sapien
tcttggctttgtgtacttccacggt

SEQ ID NO: 102307 - DNA, 25 bp, Homo sapien
tcttgggacaagaaatactaaacac

SEQ ID NO: 102308 - DNA, 25 bp, Homo sapien
tcttgggaccagaaatactaaacac

SEQ ID NO: 102309 - DNA, 25 bp, Homo sapien
tcttgggcttttacttattattaca

SEQ ID NO: 102310 - DNA, 25 bp, Homo sapien
tcttgggcttttactttttattaca

SEQ ID NO: 102311 - DNA, 25 bp, Homo sapien
tcttggggcaggacgttctccttct

SEQ ID NO: 102312 - DNA, 25 bp, Homo sapien
tcttggggcaggatgttctccttct

SEQ ID NO: 102313 - DNA, 25 bp, Homo sapien
tcttggtaatgaagaccactgcagt

SEQ ID NO: 102314 - DNA, 25 bp, Homo sapien
tcttggtaatgaggaccactgcagt

SEQ ID NO: 102315 - DNA, 25 bp, Homo sapien
tcttggtcagggttgttgtcttagt

SEQ ID NO: 102316 - DNA, 25 bp, Homo sapien
tcttggtcattttgggttcatttgt

SEQ ID NO: 102317 - DNA, 25 bp, Homo sapien
tcttggtcattttgtgttcatttgt

SEQ ID NO: 102318 - DNA, 25 bp, Homo sapien
tcttggtccacctcatatcagatga

SEQ ID NO: 102319 - DNA, 25 bp, Homo sapien
tcttggtccacctcatgtcagatga

SEQ ID NO: 102320 - DNA, 25 bp, Homo sapien
tcttggtccataagttttaactaac

SEQ ID NO: 102321 - DNA, 25 bp, Homo sapien
tcttggtccatatgttttaactaac

SEQ ID NO: 102322 - DNA, 25 bp, Homo sapien
tcttggtccgggttgttgtcttagt

SEQ ID NO: 102323 - DNA, 25 bp, Homo sapien
tcttggtgcctctgtcacattgcct

SEQ ID NO: 102324 - DNA, 25 bp, Homo sapien
tcttggtggacattaacggaatcac

SEQ ID NO: 102325 - DNA, 25 bp, Homo sapien
tcttggtggacattaatggaatcac

SEQ ID NO: 102326 - DNA, 25 bp, Homo sapien
tcttggtggattagctaaatctgcc

SEQ ID NO: 102327 - DNA, 25 bp, Homo sapien
tcttggtggatttgctaaatctgcc

SEQ ID NO: 102328 - DNA, 25 bp, Homo sapien
tcttggtgtctctgtcacattgcct

SEQ ID NO: 102329 - DNA, 25 bp, Homo sapien
tcttggtttttgacatctgaaaagc

SEQ ID NO: 102330 - DNA, 25 bp, Homo sapien
tcttggtttttgacgtctgaaaagc

SEQ ID NO: 102331 - DNA, 25 bp, Homo sapien
tcttgtaatttcagcagaaaaatct

SEQ ID NO: 102332 - DNA, 25 bp, Homo sapien
tcttgtaatttcagtagaaaaatct

SEQ ID NO: 102333 - DNA, 25 bp, Homo sapien
tcttgtacatcacattgccagatga

SEQ ID NO: 102334 - DNA, 25 bp, Homo sapien
tcttgtacatctcattgccagatga

SEQ ID NO: 102335 - DNA, 25 bp, Homo sapien
tcttgtaccgcaaacaaaaaaaaca

SEQ ID NO: 102336 - DNA, 25 bp, Homo sapien
tcttgtactccactgcattcccagt

SEQ ID NO: 102337 - DNA, 25 bp, Homo sapien
tcttgtactccacttcattcccagt

SEQ ID NO: 102338 - DNA, 25 bp, Homo sapien
tcttgtactgcaaacaaaaaaaaca

SEQ ID NO: 102339 - DNA, 25 bp, Homo sapien
tcttgtacttttcttttggtggcca

SEQ ID NO: 102340 - DNA, 25 bp, Homo sapien
tcttgtactttttttttggtggcca

SEQ ID NO: 102341 - DNA, 25 bp, Homo sapien
tcttgtaggatcccgcaaagaacaa

SEQ ID NO: 102342 - DNA, 25 bp, Homo sapien
tcttgtaggatcctgcaaagaacaa

SEQ ID NO: 102343 - DNA, 25 bp, Homo sapien
tcttgtatattttcaaaacactcat

SEQ ID NO: 102344 - DNA, 25 bp, Homo sapien
tcttgtatcttttcaaaacactcat

SEQ ID NO: 102345 - DNA, 25 bp, Homo sapien
tcttgtcaaatccaattatctgctt

SEQ ID NO: 102346 - DNA, 25 bp, Homo sapien
tcttgtcaaatccagttatctgctt

SEQ ID NO: 102347 - DNA, 25 bp, Homo sapien
tcttgtcacctttttatttagatat

SEQ ID NO: 102348 - DNA, 25 bp, Homo sapien
tcttgtcacttttttatttagatat

SEQ ID NO: 102349 - DNA, 25 bp, Homo sapien
tcttgtcatattccaactttgtgtt

SEQ ID NO: 102350 - DNA, 25 bp, Homo sapien
tcttgtcatattccaattttgtgtt

SEQ ID NO: 102351 - DNA, 25 bp, Homo sapien
tcttgtcattcaggttaaagagaaa

SEQ ID NO: 102352 - DNA, 25 bp, Homo sapien
tcttgtcattcagtttaaagagaaa

SEQ ID NO: 102353 - DNA, 25 bp, Homo sapien
tcttgtcctcaagatttcaaaagct

SEQ ID NO: 102354 - DNA, 25 bp, Homo sapien
tcttgtcctcaaggtttcaaaagct

SEQ ID NO: 102355 - DNA, 25 bp, Homo sapien
tcttgtgaaataagactgagctttt

SEQ ID NO: 102356 - DNA, 25 bp, Homo sapien
tcttgtgaaataggactgagctttt

SEQ ID NO: 102357 - DNA, 25 bp, Homo sapien
tcttgtggagaccattttaaccatt

SEQ ID NO: 102358 - DNA, 25 bp, Homo sapien
tcttgtggagatcattttaaccatt

SEQ ID NO: 102359 - DNA, 25 bp, Homo sapien
tcttgtgtggataagttttcaattt

SEQ ID NO: 102360 - DNA, 25 bp, Homo sapien
tcttgtgtggataatttttcaattt

SEQ ID NO: 102361 - DNA, 25 bp, Homo sapien
tcttgtgttcatgatattctgtctt

SEQ ID NO: 102362 - DNA, 25 bp, Homo sapien
tcttgtgttcgccatctaccgcagc

SEQ ID NO: 102363 - DNA, 25 bp, Homo sapien
tcttgtgttcggcatctaccgcagc

SEQ ID NO: 102364 - DNA, 25 bp, Homo sapien
tcttgtgtttatgatattctgtctt

SEQ ID NO: 102365 - DNA, 25 bp, Homo sapien
tcttgttaaatacctaagcatctca

SEQ ID NO: 102366 - DNA, 25 bp, Homo sapien
tcttgttaaatacctaggcatctca

SEQ ID NO: 102367 - DNA, 25 bp, Homo sapien
tcttgttacctaaccatcttccaaa

SEQ ID NO: 102368 - DNA, 25 bp, Homo sapien
tcttgttaggtttgctctattcttt

SEQ ID NO: 102369 - DNA, 25 bp, Homo sapien
tcttgttaggtttgctttattcttt

SEQ ID NO: 102370 - DNA, 25 bp, Homo sapien
tcttgttagtgccatcccgtaagct

SEQ ID NO: 102371 - DNA, 25 bp, Homo sapien
tcttgttagtgtcatcccgtaagct

SEQ ID NO: 102372 - DNA, 25 bp, Homo sapien
tcttgttatctaaccatcttccaaa

SEQ ID NO: 102373 - DNA, 25 bp, Homo sapien
tcttgttatgtcttcaagctcaccc

SEQ ID NO: 102374 - DNA, 25 bp, Homo sapien
tcttgttatgtcttcaggctcaccc

SEQ ID NO: 102375 - DNA, 25 bp, Homo sapien
tcttgttcatcactcccgattgctc

SEQ ID NO: 102376 - DNA, 25 bp, Homo sapien
tcttgttcatcactcctgattgctc

SEQ ID NO: 102377 - DNA, 25 bp, Homo sapien
tcttgttcattcaataatgcctgtt

SEQ ID NO: 102378 - DNA, 25 bp, Homo sapien
tcttgttcattcaatattgcctgtt

SEQ ID NO: 102379 - DNA, 25 bp, Homo sapien
tcttgttcattcttctgcttcagga

SEQ ID NO: 102380 - DNA, 25 bp, Homo sapien
tcttgttcgttcttctgcttcagga

SEQ ID NO: 102381 - DNA, 25 bp, Homo sapien
tcttgttctttctcccagtctgagg

SEQ ID NO: 102382 - DNA, 25 bp, Homo sapien
tcttgttctttttcccagtctgagg

SEQ ID NO: 102383 - DNA, 25 bp, Homo sapien
tcttgttgatgacagtctccaggcc

SEQ ID NO: 102384 - DNA, 25 bp, Homo sapien
tcttgttgatgacggtctccaggcc

SEQ ID NO: 102385 - DNA, 25 bp, Homo sapien
tcttgttggctacaccctctggctc

SEQ ID NO: 102386 - DNA, 25 bp, Homo sapien
tcttgttggctccaccctctggctc

SEQ ID NO: 102387 - DNA, 25 bp, Homo sapien
tcttgtttgctaacaatgatgaaac

SEQ ID NO: 102388 - DNA, 25 bp, Homo sapien
tcttgtttgctagcaatgatgaaac

SEQ ID NO: 102389 - DNA, 25 bp, Homo sapien
tctttaaaaatacccaaattgttca

SEQ ID NO: 102390 - DNA, 25 bp, Homo sapien
tctttaaaaatacccagattgttca

SEQ ID NO: 102391 - DNA, 25 bp, Homo sapien
tctttaaaaatgattagcagagtct

SEQ ID NO: 102392 - DNA, 25 bp, Homo sapien
tctttaaaaatgattatcagagtct

SEQ ID NO: 102393 - DNA, 25 bp, Homo sapien
tctttaaaactttcattaaacatgg

SEQ ID NO: 102394 - DNA, 25 bp, Homo sapien
tctttaaaactttcgttaaacatgg

SEQ ID NO: 102395 - DNA, 25 bp, Homo sapien
tctttaaagcacattatcacagatg

SEQ ID NO: 102396 - DNA, 25 bp, Homo sapien
tctttaaagcacgttatcacagatg

SEQ ID NO: 102397 - DNA, 25 bp, Homo sapien
tctttaagttaagtggtattacctg

SEQ ID NO: 102398 - DNA, 25 bp, Homo sapien
tctttaagttaggtggtattacctg

SEQ ID NO: 102399 - DNA, 25 bp, Homo sapien
tctttaataatggctacttgatcca

SEQ ID NO: 102400 - DNA, 25 bp, Homo sapien
tctttaataattgctacttgatcca

SEQ ID NO: 102401 - DNA, 25 bp, Homo sapien
tctttaatactgaattatgccacag

SEQ ID NO: 102402 - DNA, 25 bp, Homo sapien
tctttaatatacggttagtgtgtga

SEQ ID NO: 102403 - DNA, 25 bp, Homo sapien
tctttaatatactgttagtgtgtga

SEQ ID NO: 102404 - DNA, 25 bp, Homo sapien
tctttaatccagccaatgtcatttc

SEQ ID NO: 102405 - DNA, 25 bp, Homo sapien
tctttaatccagcccatgtcatttc

SEQ ID NO: 102406 - DNA, 25 bp, Homo sapien
tctttaatgctgaattatgccacag

SEQ ID NO: 102407 - DNA, 25 bp, Homo sapien
tctttaatttacttgtagcacagac

SEQ ID NO: 102408 - DNA, 25 bp, Homo sapien
tctttaatttacttgtggcacagac

SEQ ID NO: 102409 - DNA, 25 bp, Homo sapien
tctttacaagacctgagccatagaa

SEQ ID NO: 102410 - DNA, 25 bp, Homo sapien
tctttacaagagctgagccatagaa

SEQ ID NO: 102411 - DNA, 25 bp, Homo sapien
tctttactatccattactttttaaa

SEQ ID NO: 102412 - DNA, 25 bp, Homo sapien
tctttactatcccttactttttaaa

SEQ ID NO: 102413 - DNA, 25 bp, Homo sapien
tctttactgcatcattaattttttc

SEQ ID NO: 102414 - DNA, 25 bp, Homo sapien
tctttactgcatcgttaattttttc

SEQ ID NO: 102415 - DNA, 25 bp, Homo sapien
tctttactggaacaaattagcacat

SEQ ID NO: 102416 - DNA, 25 bp, Homo sapien
tctttactggaataaattagcacat

SEQ ID NO: 102417 - DNA, 25 bp, Homo sapien
tctttactgggcttcgcagcataca

SEQ ID NO: 102418 - DNA, 25 bp, Homo sapien
tctttactgtgcttcgcagcataca

SEQ ID NO: 102419 - DNA, 25 bp, Homo sapien
tctttacttgtttggtctgcctgta

SEQ ID NO: 102420 - DNA, 25 bp, Homo sapien
tctttacttgtttgttctgcctgta

SEQ ID NO: 102421 - DNA, 25 bp, Homo sapien
tctttactttcatctatgtcatggt

SEQ ID NO: 102422 - DNA, 25 bp, Homo sapien
tctttactttcatttatgtcatggt

SEQ ID NO: 102423 - DNA, 25 bp, Homo sapien
tctttagaagcctcattggagattt

SEQ ID NO: 102424 - DNA, 25 bp, Homo sapien
tctttagaagccttattggagattt

SEQ ID NO: 102425 - DNA, 25 bp, Homo sapien
tctttagctttcaaagtagatcttg

SEQ ID NO: 102426 - DNA, 25 bp, Homo sapien
tctttagctttgaaagtagatcttg

SEQ ID NO: 102427 - DNA, 25 bp, Homo sapien
tctttaggtattacggtggaagaat

SEQ ID NO: 102428 - DNA, 25 bp, Homo sapien
tctttaggtattatggtggaagaat

SEQ ID NO: 102429 - DNA, 25 bp, Homo sapien
tctttagtacaaattttattggctt

SEQ ID NO: 102430 - DNA, 25 bp, Homo sapien
tctttagtacaacttttattggctt

SEQ ID NO: 102431 - DNA, 25 bp, Homo sapien
tctttagtacgctccctgtctcact

SEQ ID NO: 102432 - DNA, 25 bp, Homo sapien
tctttagtacgttccctgtctcact

SEQ ID NO: 102433 - DNA, 25 bp, Homo sapien
tctttataacagtgtcttattttac

SEQ ID NO: 102434 - DNA, 25 bp, Homo sapien
tctttataatagtgtcttattttac

SEQ ID NO: 102435 - DNA, 25 bp, Homo sapien
tctttatcatgcgtgacccctgaag

SEQ ID NO: 102436 - DNA, 25 bp, Homo sapien
tctttatcatgcgtgatccctgaag

SEQ ID NO: 102437 - DNA, 25 bp, Homo sapien
tctttatcattttcttacatggcta

SEQ ID NO: 102438 - DNA, 25 bp, Homo sapien
tctttatcatttttttacatggcta

SEQ ID NO: 102439 - DNA, 25 bp, Homo sapien
tctttatctggacgtagcaatgaga

SEQ ID NO: 102440 - DNA, 25 bp, Homo sapien
tctttatctggatgtagcaatgaga

SEQ ID NO: 102441 - DNA, 25 bp, Homo sapien
tctttatgaccttgagattgccagt

SEQ ID NO: 102442 - DNA, 25 bp, Homo sapien
tctttatgaccttgcgattgccagt

SEQ ID NO: 102443 - DNA, 25 bp, Homo sapien
tctttatgcatctgtcatctcttgc

SEQ ID NO: 102444 - DNA, 25 bp, Homo sapien
tctttatgcatctttcatctcttgc

SEQ ID NO: 102445 - DNA, 25 bp, Homo sapien
tctttatgcatgaaaacaccttcac

SEQ ID NO: 102446 - DNA, 25 bp, Homo sapien
tctttatgcatgaaaataccttcac

SEQ ID NO: 102447 - DNA, 25 bp, Homo sapien
tctttatgccaatgtgtgcccaacg

SEQ ID NO: 102448 - DNA, 25 bp, Homo sapien
tctttatgccagtgtgtgcccaacg

SEQ ID NO: 102449 - DNA, 25 bp, Homo sapien
tctttatgtaaaacggtaggatgct

SEQ ID NO: 102450 - DNA, 25 bp, Homo sapien
tctttatgtaaaatggtaggatgct

SEQ ID NO: 102451 - DNA, 25 bp, Homo sapien
tctttattatgaagctaaaacctgg

SEQ ID NO: 102452 - DNA, 25 bp, Homo sapien
tctttattatgaggctaaaacctgg

SEQ ID NO: 102453 - DNA, 25 bp, Homo sapien
tctttattcactacaggttgttctt

SEQ ID NO: 102454 - DNA, 25 bp, Homo sapien
tctttattcactgcaggttgttctt

SEQ ID NO: 102455 - DNA, 25 bp, Homo sapien
tctttattgaaacggcaactcctca

SEQ ID NO: 102456 - DNA, 25 bp, Homo sapien
tctttattgaaatggcaactcctca

SEQ ID NO: 102457 - DNA, 25 bp, Homo sapien
tctttcaaaaaagaaaaactggcaa

SEQ ID NO: 102458 - DNA, 25 bp, Homo sapien
tctttcaaaaaaggaaaactggcaa

SEQ ID NO: 102459 - DNA, 25 bp, Homo sapien
tctttcaaaactccattgactagat

SEQ ID NO: 102460 - DNA, 25 bp, Homo sapien
tctttcaaacagagaatcagaatca

SEQ ID NO: 102461 - DNA, 25 bp, Homo sapien
tctttcaaacagggaatcagaatca

SEQ ID NO: 102462 - DNA, 25 bp, Homo sapien
tctttcaaacgcttcagggcaatgc

SEQ ID NO: 102463 - DNA, 25 bp, Homo sapien
tctttcaaatctccattgactagat

SEQ ID NO: 102464 - DNA, 25 bp, Homo sapien
tctttcaaatgcttcagggcaatgc

SEQ ID NO: 102465 - DNA, 25 bp, Homo sapien
tctttcaagacacagcgcaggactt

SEQ ID NO: 102466 - DNA, 25 bp, Homo sapien
tctttcaaggcacagcgcaggactt

SEQ ID NO: 102467 - DNA, 25 bp, Homo sapien
tctttcacaggtatgaaggttgact

SEQ ID NO: 102468 - DNA, 25 bp, Homo sapien
tctttcacgggtatgaaggttgact

SEQ ID NO: 102469 - DNA, 25 bp, Homo sapien
tctttcactgtgaaatttgatgata

SEQ ID NO: 102470 - DNA, 25 bp, Homo sapien
tctttcactgtggaatttgatgata

SEQ ID NO: 102471 - DNA, 25 bp, Homo sapien
tctttcagagttacaatactcctac

SEQ ID NO: 102472 - DNA, 25 bp, Homo sapien
tctttcagagttccaatactcctac

SEQ ID NO: 102473 - DNA, 25 bp, Homo sapien
tctttcatccggtaaccactcatga

SEQ ID NO: 102474 - DNA, 25 bp, Homo sapien
tctttcatctggtaaccactcatga

SEQ ID NO: 102475 - DNA, 25 bp, Homo sapien
tctttccacatattcgatttgctaa

SEQ ID NO: 102476 - DNA, 25 bp, Homo sapien
tctttccacatatttgatttgctaa

SEQ ID NO: 102477 - DNA, 25 bp, Homo sapien
tctttccacgtctctcagtttctgt

SEQ ID NO: 102478 - DNA, 25 bp, Homo sapien
tctttccacgtctttcagtttctgt

SEQ ID NO: 102479 - DNA, 25 bp, Homo sapien
tctttccagaaggcttcccaaggga

SEQ ID NO: 102480 - DNA, 25 bp, Homo sapien
tctttccagaagtcttcccaaggga

SEQ ID NO: 102481 - DNA, 25 bp, Homo sapien
tctttccatcaaacataataaatcc

SEQ ID NO: 102482 - DNA, 25 bp, Homo sapien
tctttccatcaaacgtaataaatcc

SEQ ID NO: 102483 - DNA, 25 bp, Homo sapien
tctttccattgagatacgtattaca

SEQ ID NO: 102484 - DNA, 25 bp, Homo sapien
tctttccattgagatatgtattaca

SEQ ID NO: 102485 - DNA, 25 bp, Homo sapien
tctttccccgtcgactgactcaaat

SEQ ID NO: 102486 - DNA, 25 bp, Homo sapien
tctttccctgtcgactgactcaaat

SEQ ID NO: 102487 - DNA, 25 bp, Homo sapien
tctttcctaagacatttcaacatgt

SEQ ID NO: 102488 - DNA, 25 bp, Homo sapien
tctttcctaagatatttcaacatgt

SEQ ID NO: 102489 - DNA, 25 bp, Homo sapien
tctttcctcaagggatcaaatcaaa

SEQ ID NO: 102490 - DNA, 25 bp, Homo sapien
tctttcctcaatggatcaaatcaaa

SEQ ID NO: 102491 - DNA, 25 bp, Homo sapien
tctttcctgcttacctcacatggta

SEQ ID NO: 102492 - DNA, 25 bp, Homo sapien
tctttcctgcttacgtcacatggta

SEQ ID NO: 102493 - DNA, 25 bp, Homo sapien
tctttccttggctaacttcttcgag

SEQ ID NO: 102494 - DNA, 25 bp, Homo sapien
tctttccttggttaacttcttcgag

SEQ ID NO: 102495 - DNA, 25 bp, Homo sapien
tctttcgcctggaattagcagagac

SEQ ID NO: 102496 - DNA, 25 bp, Homo sapien
tctttcgcctgggattagcagagac

SEQ ID NO: 102497 - DNA, 25 bp, Homo sapien
tctttcgggtaaatgattcttctct

SEQ ID NO: 102498 - DNA, 25 bp, Homo sapien
tctttcgggtaagtgattcttctct

SEQ ID NO: 102499 - DNA, 25 bp, Homo sapien
tctttcgtccagccaggcttatgat

SEQ ID NO: 102500 - DNA, 25 bp, Homo sapien
tctttcgtctagccaggcttatgat

SEQ ID NO: 102501 - DNA, 25 bp, Homo sapien
tctttctacgccctgaagatgaaac

SEQ ID NO: 102502 - DNA, 25 bp, Homo sapien
tctttctacgcctctgtttgctcat

SEQ ID NO: 102503 - DNA, 25 bp, Homo sapien
tctttctactgtggatgaaggaaga

SEQ ID NO: 102504 - DNA, 25 bp, Homo sapien
tctttctaggtcaggtccaaacaat

SEQ ID NO: 102505 - DNA, 25 bp, Homo sapien
tctttctaggtcgggtccaaacaat

SEQ ID NO: 102506 - DNA, 25 bp, Homo sapien
tctttctatgccctgaagatgaaac

SEQ ID NO: 102507 - DNA, 25 bp, Homo sapien
tctttctatgcctctgtttgctcat

SEQ ID NO: 102508 - DNA, 25 bp, Homo sapien
tctttctattgtggatgaaggaaga

SEQ ID NO: 102509 - DNA, 25 bp, Homo sapien
tctttctcatcttagatgcttcctt

SEQ ID NO: 102510 - DNA, 25 bp, Homo sapien
tctttctcattacagggttagctaa

SEQ ID NO: 102511 - DNA, 25 bp, Homo sapien
tctttctcattagagggttagctaa

SEQ ID NO: 102512 - DNA, 25 bp, Homo sapien
tctttctcctcaaggagttcatggc

SEQ ID NO: 102513 - DNA, 25 bp, Homo sapien
tctttctcctcatggagttcatggc

SEQ ID NO: 102514 - DNA, 25 bp, Homo sapien
tctttctcgtcttagatgcttcctt

SEQ ID NO: 102515 - DNA, 25 bp, Homo sapien
tctttctctcggctcattaccctgc

SEQ ID NO: 102516 - DNA, 25 bp, Homo sapien
tctttctcttggctcattaccctgc

SEQ ID NO: 102517 - DNA, 25 bp, Homo sapien
tctttctgaaacatgtatctggctg

SEQ ID NO: 102518 - DNA, 25 bp, Homo sapien
tctttctgattctatcatgagttac

SEQ ID NO: 102519 - DNA, 25 bp, Homo sapien
tctttctgattctatcctgagttac

SEQ ID NO: 102520 - DNA, 25 bp, Homo sapien
tctttctgcgccatcctattgtttc

SEQ ID NO: 102521 - DNA, 25 bp, Homo sapien
tctttctgcggtaataacaagtcta

SEQ ID NO: 102522 - DNA, 25 bp, Homo sapien
tctttctgcggtaatagcaagtcta

SEQ ID NO: 102523 - DNA, 25 bp, Homo sapien
tctttctggaacatgtatctggctg

SEQ ID NO: 102524 - DNA, 25 bp, Homo sapien
tctttctgggcactattatatacaa

SEQ ID NO: 102525 - DNA, 25 bp, Homo sapien
tctttctgggcgctattatatacaa

SEQ ID NO: 102526 - DNA, 25 bp, Homo sapien
tctttctgtctacgctcccatcttt

SEQ ID NO: 102527 - DNA, 25 bp, Homo sapien
tctttctgtctatgctcccatcttt

SEQ ID NO: 102528 - DNA, 25 bp, Homo sapien
tctttctgtgactattacctgcctg

SEQ ID NO: 102529 - DNA, 25 bp, Homo sapien
tctttctgtgactgttacctgcctg

SEQ ID NO: 102530 - DNA, 25 bp, Homo sapien
tctttctgtgccatcctattgtttc

SEQ ID NO: 102531 - DNA, 25 bp, Homo sapien
tctttctgtgcttggtacatttcat

SEQ ID NO: 102532 - DNA, 25 bp, Homo sapien
tctttctgtgcttggttcatttcat

SEQ ID NO: 102533 - DNA, 25 bp, Homo sapien
tctttcttaaactacaaaagcaatc

SEQ ID NO: 102534 - DNA, 25 bp, Homo sapien
tctttcttactaccattcctctctg

SEQ ID NO: 102535 - DNA, 25 bp, Homo sapien
tctttcttactatcattcctctctg

SEQ ID NO: 102536 - DNA, 25 bp, Homo sapien
tctttcttcctgccatctttttgga

SEQ ID NO: 102537 - DNA, 25 bp, Homo sapien
tctttcttcctgccgtctttttgga

SEQ ID NO: 102538 - DNA, 25 bp, Homo sapien
tctttcttctgctgaatcaattcta

SEQ ID NO: 102539 - DNA, 25 bp, Homo sapien
tctttcttctgctggatcaattcta

SEQ ID NO: 102540 - DNA, 25 bp, Homo sapien
tctttcttgaactacaaaagcaatc

SEQ ID NO: 102541 - DNA, 25 bp, Homo sapien
tctttcttgcacccaagattttctc

SEQ ID NO: 102542 - DNA, 25 bp, Homo sapien
tctttcttgcatctgagctttaacg

SEQ ID NO: 102543 - DNA, 25 bp, Homo sapien
tctttcttgcatttgagctttaacg

SEQ ID NO: 102544 - DNA, 25 bp, Homo sapien
tctttctttcacccaagattttctc

SEQ ID NO: 102545 - DNA, 25 bp, Homo sapien
tctttctttcccaaaatcaccatag

SEQ ID NO: 102546 - DNA, 25 bp, Homo sapien
tctttctttcttgcatctgagcttt

SEQ ID NO: 102547 - DNA, 25 bp, Homo sapien
tctttctttcttgcatttgagcttt

SEQ ID NO: 102548 - DNA, 25 bp, Homo sapien
tctttcttttccaaaatcaccatag

SEQ ID NO: 102549 - DNA, 25 bp, Homo sapien
tctttgaaaatgccctcagctgtgc

SEQ ID NO: 102550 - DNA, 25 bp, Homo sapien
tctttgaaaatgtcctcagctgtgc

SEQ ID NO: 102551 - DNA, 25 bp, Homo sapien
tctttgaaacaacagagataccaga

SEQ ID NO: 102552 - DNA, 25 bp, Homo sapien
tctttgaaacaatagagataccaga

SEQ ID NO: 102553 - DNA, 25 bp, Homo sapien
tctttgacaccaggttatttctagc

SEQ ID NO: 102554 - DNA, 25 bp, Homo sapien
tctttgacatcaggttatttctagc

SEQ ID NO: 102555 - DNA, 25 bp, Homo sapien
tctttgaccacagcctggcacagga

SEQ ID NO: 102556 - DNA, 25 bp, Homo sapien
tctttgaccacaggctggcacagga

SEQ ID NO: 102557 - DNA, 25 bp, Homo sapien
tctttgacctatcaattgaggccat

SEQ ID NO: 102558 - DNA, 25 bp, Homo sapien
tctttgacctatcagttgaggccat

SEQ ID NO: 102559 - DNA, 25 bp, Homo sapien
tctttgacgttgaccttcctgccat

SEQ ID NO: 102560 - DNA, 25 bp, Homo sapien
tctttgacgttgatcttcctgccat

SEQ ID NO: 102561 - DNA, 25 bp, Homo sapien
tctttgactcattaatgctgcatct

SEQ ID NO: 102562 - DNA, 25 bp, Homo sapien
tctttgactgcaaatcttgccatgt

SEQ ID NO: 102563 - DNA, 25 bp, Homo sapien
tctttgactgcgaatcttgccatgt

SEQ ID NO: 102564 - DNA, 25 bp, Homo sapien
tctttgacttattaatgctgcatct

SEQ ID NO: 102565 - DNA, 25 bp, Homo sapien
tctttgagatgatgtcactaggatt

SEQ ID NO: 102566 - DNA, 25 bp, Homo sapien
tctttgagatggtgtcactaggatt

SEQ ID NO: 102567 - DNA, 25 bp, Homo sapien
tctttgagctgtgtttgtaagtttc

SEQ ID NO: 102568 - DNA, 25 bp, Homo sapien
tctttgagctgtgtttttaagtttc

SEQ ID NO: 102569 - DNA, 25 bp, Homo sapien
tctttgagtggcataggaattatga

SEQ ID NO: 102570 - DNA, 25 bp, Homo sapien
tctttgagtggcgtaggaattatga

SEQ ID NO: 102571 - DNA, 25 bp, Homo sapien
tctttgatatcatgctggcattaac

SEQ ID NO: 102572 - DNA, 25 bp, Homo sapien
tctttgatatcatgttggcattaac

SEQ ID NO: 102573 - DNA, 25 bp, Homo sapien
tctttgatttgtaaacttgtggtaa

SEQ ID NO: 102574 - DNA, 25 bp, Homo sapien
tctttgatttgtatacttgtggtaa

SEQ ID NO: 102575 - DNA, 25 bp, Homo sapien
tctttgcacattgtctcatatctct

SEQ ID NO: 102576 - DNA, 25 bp, Homo sapien
tctttgcacccaaaactccaaactg

SEQ ID NO: 102577 - DNA, 25 bp, Homo sapien
tctttgcacccacaactccaaactg

SEQ ID NO: 102578 - DNA, 25 bp, Homo sapien
tctttgcagattgtctcatatctct

SEQ ID NO: 102579 - DNA, 25 bp, Homo sapien
tctttgcatcaaattaacataatgc

SEQ ID NO: 102580 - DNA, 25 bp, Homo sapien
tctttgcatcagattaacataatgc

SEQ ID NO: 102581 - DNA, 25 bp, Homo sapien
tctttgcatgtacacaatatgtttt

SEQ ID NO: 102582 - DNA, 25 bp, Homo sapien
tctttgcatgtacacattatgtttt

SEQ ID NO: 102583 - DNA, 25 bp, Homo sapien
tctttgccattggtttgtacaagtg

SEQ ID NO: 102584 - DNA, 25 bp, Homo sapien
tctttgccattgttttgtacaagtg

SEQ ID NO: 102585 - DNA, 25 bp, Homo sapien
tctttgctctaggcactgttcagtg

SEQ ID NO: 102586 - DNA, 25 bp, Homo sapien
tctttgctctgttatttatttatct

SEQ ID NO: 102587 - DNA, 25 bp, Homo sapien
tctttgctcttggagtttttaagat

SEQ ID NO: 102588 - DNA, 25 bp, Homo sapien
tctttgctcttggattttttaagat

SEQ ID NO: 102589 - DNA, 25 bp, Homo sapien
tctttgctgtgttatttatttatct

SEQ ID NO: 102590 - DNA, 25 bp, Homo sapien
tctttgctttaggcactgttcagtg

SEQ ID NO: 102591 - DNA, 25 bp, Homo sapien
tctttggaccaaacttcctccttca

SEQ ID NO: 102592 - DNA, 25 bp, Homo sapien
tctttggaccaaccttcctccttca

SEQ ID NO: 102593 - DNA, 25 bp, Homo sapien
tctttggacttcagaagcaatcctt

SEQ ID NO: 102594 - DNA, 25 bp, Homo sapien
tctttggactttagaagcaatcctt

SEQ ID NO: 102595 - DNA, 25 bp, Homo sapien
tctttggataacgacagtgactaat

SEQ ID NO: 102596 - DNA, 25 bp, Homo sapien
tctttggataatgacagtgactaat

SEQ ID NO: 102597 - DNA, 25 bp, Homo sapien
tctttgggtttcgcgagatactctc

SEQ ID NO: 102598 - DNA, 25 bp, Homo sapien
tctttgggtttcgctagatactctc

SEQ ID NO: 102599 - DNA, 25 bp, Homo sapien
tctttggtgaggtatgcgttaaggt

SEQ ID NO: 102600 - DNA, 25 bp, Homo sapien
tctttggtgaggtatgtgttaaggt

SEQ ID NO: 102601 - DNA, 25 bp, Homo sapien
tctttggtgcaaattattttattgt

SEQ ID NO: 102602 - DNA, 25 bp, Homo sapien
tctttggtgcaagttattttattgt

SEQ ID NO: 102603 - DNA, 25 bp, Homo sapien
tctttggtggaaacattgctaacac

SEQ ID NO: 102604 - DNA, 25 bp, Homo sapien
tctttggtggaaacgttgctaacac

SEQ ID NO: 102605 - DNA, 25 bp, Homo sapien
tctttggttacatgaactgactttt

SEQ ID NO: 102606 - DNA, 25 bp, Homo sapien
tctttggttacattaactgactttt

SEQ ID NO: 102607 - DNA, 25 bp, Homo sapien
tctttgtacatcaccttcagaaggc

SEQ ID NO: 102608 - DNA, 25 bp, Homo sapien
tctttgtaccttagttgttacatct

SEQ ID NO: 102609 - DNA, 25 bp, Homo sapien
tctttgtaccttagtttttacatct

SEQ ID NO: 102610 - DNA, 25 bp, Homo sapien
tctttgtacgtcaccttcagaaggc

SEQ ID NO: 102611 - DNA, 25 bp, Homo sapien
tctttgtacttcctgtcagtcaggc

SEQ ID NO: 102612 - DNA, 25 bp, Homo sapien
tctttgtacttcctgttagtcaggc

SEQ ID NO: 102613 - DNA, 25 bp, Homo sapien
tctttgtagatgggagaccctaaga

SEQ ID NO: 102614 - DNA, 25 bp, Homo sapien
tctttgtagttgggagaccctaaga

SEQ ID NO: 102615 - DNA, 25 bp, Homo sapien
tctttgtcacacgaagagagctgtg

SEQ ID NO: 102616 - DNA, 25 bp, Homo sapien
tctttgtcacatgaagagagctgtg

SEQ ID NO: 102617 - DNA, 25 bp, Homo sapien
tctttgtcagagaaccaccagctcc

SEQ ID NO: 102618 - DNA, 25 bp, Homo sapien
tctttgtcagagaagcaccagctcc

SEQ ID NO: 102619 - DNA, 25 bp, Homo sapien
tctttgtcctatacctgtgaagatg

SEQ ID NO: 102620 - DNA, 25 bp, Homo sapien
tctttgtcctatacgtgtgaagatg

SEQ ID NO: 102621 - DNA, 25 bp, Homo sapien
tctttgtccttacagagtttgtggt

SEQ ID NO: 102622 - DNA, 25 bp, Homo sapien
tctttgtccttacggagtttgtggt

SEQ ID NO: 102623 - DNA, 25 bp, Homo sapien
tctttgtggcagtgacatgttgaag

SEQ ID NO: 102624 - DNA, 25 bp, Homo sapien
tctttgtggcagtgacttgttgaag

SEQ ID NO: 102625 - DNA, 25 bp, Homo sapien
tctttgtgtcaggaaaagcctattt

SEQ ID NO: 102626 - DNA, 25 bp, Homo sapien
tctttgtgtcaggaaaggcctattt

SEQ ID NO: 102627 - DNA, 25 bp, Homo sapien
tctttgttcctttctaccattactg

SEQ ID NO: 102628 - DNA, 25 bp, Homo sapien
tctttgttcttttctaccattactg

SEQ ID NO: 102629 - DNA, 25 bp, Homo sapien
tctttgttgatctaccaatctccat

SEQ ID NO: 102630 - DNA, 25 bp, Homo sapien
tctttgttggtctaccaatctccat

SEQ ID NO: 102631 - DNA, 25 bp, Homo sapien
tcttttaaacattggttctccttag

SEQ ID NO: 102632 - DNA, 25 bp, Homo sapien
tcttttaagcattggttctccttag

SEQ ID NO: 102633 - DNA, 25 bp, Homo sapien
tcttttacaccacttcttggattgc

SEQ ID NO: 102634 - DNA, 25 bp, Homo sapien
tcttttacaccatttcttggattgc

SEQ ID NO: 102635 - DNA, 25 bp, Homo sapien
tcttttacagggtcagagtagataa

SEQ ID NO: 102636 - DNA, 25 bp, Homo sapien
tcttttacagggtgagagtagataa

SEQ ID NO: 102637 - DNA, 25 bp, Homo sapien
tcttttacagtctgcagagaaaaat

SEQ ID NO: 102638 - DNA, 25 bp, Homo sapien
tcttttacagtcttcagagaaaaat

SEQ ID NO: 102639 - DNA, 25 bp, Homo sapien
tcttttacatgtcatcttagaggaa

SEQ ID NO: 102640 - DNA, 25 bp, Homo sapien
tcttttacatttttcacttaaacta

SEQ ID NO: 102641 - DNA, 25 bp, Homo sapien
tcttttaccacatgaaatgacatat

SEQ ID NO: 102642 - DNA, 25 bp, Homo sapien
tcttttaccagaactttgaatacta

SEQ ID NO: 102643 - DNA, 25 bp, Homo sapien
tcttttaccagcactttgaatacta

SEQ ID NO: 102644 - DNA, 25 bp, Homo sapien
tcttttaccgcatgaaatgacatat

SEQ ID NO: 102645 - DNA, 25 bp, Homo sapien
tcttttacgtgtcatcttagaggaa

SEQ ID NO: 102646 - DNA, 25 bp, Homo sapien
tcttttacgtttttcacttaaacta

SEQ ID NO: 102647 - DNA, 25 bp, Homo sapien
tcttttagactggtggttgtcaata

SEQ ID NO: 102648 - DNA, 25 bp, Homo sapien
tcttttagattggtggttgtcaata

SEQ ID NO: 102649 - DNA, 25 bp, Homo sapien
tcttttagcagccctattccagaaa

SEQ ID NO: 102650 - DNA, 25 bp, Homo sapien
tcttttagcagctctattccagaaa

SEQ ID NO: 102651 - DNA, 25 bp, Homo sapien
tcttttagcatatgtgaaaaacaga

SEQ ID NO: 102652 - DNA, 25 bp, Homo sapien
tcttttagcatgtgtgaaaaacaga

SEQ ID NO: 102653 - DNA, 25 bp, Homo sapien
tcttttaggatcaattgacccttga

SEQ ID NO: 102654 - DNA, 25 bp, Homo sapien
tcttttaggatcagttgacccttga

SEQ ID NO: 102655 - DNA, 25 bp, Homo sapien
tcttttagtcaaatgtatcaaactc

SEQ ID NO: 102656 - DNA, 25 bp, Homo sapien
tcttttagtcaagtgtatcaaactc

SEQ ID NO: 102657 - DNA, 25 bp, Homo sapien
tcttttatcattcacctaaagaccc

SEQ ID NO: 102658 - DNA, 25 bp, Homo sapien
tcttttatcattcatctaaagaccc

SEQ ID NO: 102659 - DNA, 25 bp, Homo sapien
tcttttattgcaatgaatcttctca

SEQ ID NO: 102660 - DNA, 25 bp, Homo sapien
tcttttattgcaattaatcttctca

SEQ ID NO: 102661 - DNA, 25 bp, Homo sapien
tcttttcaactatgtgtttaaatct

SEQ ID NO: 102662 - DNA, 25 bp, Homo sapien
tcttttcaactgtgtgtttaaatct

SEQ ID NO: 102663 - DNA, 25 bp, Homo sapien
tcttttcaatatgtcagtcttgtgt

SEQ ID NO: 102664 - DNA, 25 bp, Homo sapien
tcttttcacatagttaaccaatcaa

SEQ ID NO: 102665 - DNA, 25 bp, Homo sapien
tcttttcacatggttaaccaatcaa

SEQ ID NO: 102666 - DNA, 25 bp, Homo sapien
tcttttcacctaataaacctgtcct

SEQ ID NO: 102667 - DNA, 25 bp, Homo sapien
tcttttcacctaataagcctgtcct

SEQ ID NO: 102668 - DNA, 25 bp, Homo sapien
tcttttcactactacacagtgcatc

SEQ ID NO: 102669 - DNA, 25 bp, Homo sapien
tcttttcactactccacagtgcatc

SEQ ID NO: 102670 - DNA, 25 bp, Homo sapien
tcttttcagtatgtcagtcttgtgt

SEQ ID NO: 102671 - DNA, 25 bp, Homo sapien
tcttttcatctgcctgctccttaaa

SEQ ID NO: 102672 - DNA, 25 bp, Homo sapien
tcttttcatctgtctgctccttaaa

SEQ ID NO: 102673 - DNA, 25 bp, Homo sapien
tcttttcattttgctaagtttgttt

SEQ ID NO: 102674 - DNA, 25 bp, Homo sapien
tcttttcattttggtaagtttgttt

SEQ ID NO: 102675 - DNA, 25 bp, Homo sapien
tcttttccaactgaattgtctttgc

SEQ ID NO: 102676 - DNA, 25 bp, Homo sapien
tcttttccacaactccccttctaat

SEQ ID NO: 102677 - DNA, 25 bp, Homo sapien
tcttttccacaacttcccttctaat

SEQ ID NO: 102678 - DNA, 25 bp, Homo sapien
tcttttccattgaatccaggaatat

SEQ ID NO: 102679 - DNA, 25 bp, Homo sapien
tcttttccattgattccaggaatat

SEQ ID NO: 102680 - DNA, 25 bp, Homo sapien
tcttttccgactgaattgtctttgc

SEQ ID NO: 102681 - DNA, 25 bp, Homo sapien
tcttttcctccagccaacaaccccc

SEQ ID NO: 102682 - DNA, 25 bp, Homo sapien
tcttttcctccggccaacaaccccc

SEQ ID NO: 102683 - DNA, 25 bp, Homo sapien
tcttttctcccgaatgatgggatct

SEQ ID NO: 102684 - DNA, 25 bp, Homo sapien
tcttttctcccgagtgatgggatct

SEQ ID NO: 102685 - DNA, 25 bp, Homo sapien
tcttttctctgcaccatccagcgct

SEQ ID NO: 102686 - DNA, 25 bp, Homo sapien
tcttttctctgcgccatccagcgct

SEQ ID NO: 102687 - DNA, 25 bp, Homo sapien
tcttttcttattctctctaatcctg

SEQ ID NO: 102688 - DNA, 25 bp, Homo sapien
tcttttcttattctgtctaatcctg

SEQ ID NO: 102689 - DNA, 25 bp, Homo sapien
tcttttcttctctgtgattccaagt

SEQ ID NO: 102690 - DNA, 25 bp, Homo sapien
tcttttcttctctgtggttccaagt

SEQ ID NO: 102691 - DNA, 25 bp, Homo sapien
tcttttctttctttcacctgcatgt

SEQ ID NO: 102692 - DNA, 25 bp, Homo sapien
tcttttctttctttcatctgcatgt

SEQ ID NO: 102693 - DNA, 25 bp, Homo sapien
tcttttgacaccaagaagtatggga

SEQ ID NO: 102694 - DNA, 25 bp, Homo sapien
tcttttgacaccaggaagtatggga

SEQ ID NO: 102695 - DNA, 25 bp, Homo sapien
tcttttgagctagtttttatatcct

SEQ ID NO: 102696 - DNA, 25 bp, Homo sapien
tcttttgagcttgtttttatatcct

SEQ ID NO: 102697 - DNA, 25 bp, Homo sapien
tcttttgagttgctggaacataaat

SEQ ID NO: 102698 - DNA, 25 bp, Homo sapien
tcttttgagttgttggaacataaat

SEQ ID NO: 102699 - DNA, 25 bp, Homo sapien
tcttttgatggcactgattggaaca

SEQ ID NO: 102700 - DNA, 25 bp, Homo sapien
tcttttgattgcactgattggaaca

SEQ ID NO: 102701 - DNA, 25 bp, Homo sapien
tcttttgcaccttaaaatacttcat

SEQ ID NO: 102702 - DNA, 25 bp, Homo sapien
tcttttgccaacatttgtactcctc

SEQ ID NO: 102703 - DNA, 25 bp, Homo sapien
tcttttgccaacatttttactcctc

SEQ ID NO: 102704 - DNA, 25 bp, Homo sapien
tcttttgccagaacataccacaatt

SEQ ID NO: 102705 - DNA, 25 bp, Homo sapien
tcttttgccagagcataccacaatt

SEQ ID NO: 102706 - DNA, 25 bp, Homo sapien
tcttttgctccttaaaatacttcat

SEQ ID NO: 102707 - DNA, 25 bp, Homo sapien
tcttttgctggttaatgagatgact

SEQ ID NO: 102708 - DNA, 25 bp, Homo sapien
tcttttgcttgttaatgagatgact

SEQ ID NO: 102709 - DNA, 25 bp, Homo sapien
tcttttgctttaatagtaaggtgaa

SEQ ID NO: 102710 - DNA, 25 bp, Homo sapien
tcttttgctttagtagtaaggtgaa

SEQ ID NO: 102711 - DNA, 25 bp, Homo sapien
tcttttgtactcagctggtcataaa

SEQ ID NO: 102712 - DNA, 25 bp, Homo sapien
tcttttgtactctgctggtcataaa

SEQ ID NO: 102713 - DNA, 25 bp, Homo sapien
tcttttgtatcagcttcctccatta

SEQ ID NO: 102714 - DNA, 25 bp, Homo sapien
tcttttgtatcagtttcctccatta

SEQ ID NO: 102715 - DNA, 25 bp, Homo sapien
tcttttgtcagacagcatgttctta

SEQ ID NO: 102716 - DNA, 25 bp, Homo sapien
tcttttgtcaggcagcatgttctta

SEQ ID NO: 102717 - DNA, 25 bp, Homo sapien
tcttttgtctaggcacattgtccca

SEQ ID NO: 102718 - DNA, 25 bp, Homo sapien
tcttttgtctagtcacattgtccca

SEQ ID NO: 102719 - DNA, 25 bp, Homo sapien
tcttttgtgcacgaggcattttaaa

SEQ ID NO: 102720 - DNA, 25 bp, Homo sapien
tcttttgtgcatgaggcattttaaa

SEQ ID NO: 102721 - DNA, 25 bp, Homo sapien
tcttttgttatttcgctgagaatga

SEQ ID NO: 102722 - DNA, 25 bp, Homo sapien
tcttttgttattttgctgagaatga

SEQ ID NO: 102723 - DNA, 25 bp, Homo sapien
tcttttgttcagacttgccttccca

SEQ ID NO: 102724 - DNA, 25 bp, Homo sapien
tcttttgttcagatttgccttccca

SEQ ID NO: 102725 - DNA, 25 bp, Homo sapien
tcttttgttttttcatgactgcgta

SEQ ID NO: 102726 - DNA, 25 bp, Homo sapien
tcttttgtttttttatgactgcgta

SEQ ID NO: 102727 - DNA, 25 bp, Homo sapien
tctttttacaaactgtgcttatccc

SEQ ID NO: 102728 - DNA, 25 bp, Homo sapien
tctttttacatacttggttgcttcc

SEQ ID NO: 102729 - DNA, 25 bp, Homo sapien
tctttttacatagttggttgcttcc

SEQ ID NO: 102730 - DNA, 25 bp, Homo sapien
tctttttacgaactgtgcttatccc

SEQ ID NO: 102731 - DNA, 25 bp, Homo sapien
tctttttactgaggtatactgtggg

SEQ ID NO: 102732 - DNA, 25 bp, Homo sapien
tctttttagtgaggtatactgtggg

SEQ ID NO: 102733 - DNA, 25 bp, Homo sapien
tctttttcacagaacagttgcttag

SEQ ID NO: 102734 - DNA, 25 bp, Homo sapien
tctttttcacagcacagttgcttag

SEQ ID NO: 102735 - DNA, 25 bp, Homo sapien
tctttttcccgttcaatctatctta

SEQ ID NO: 102736 - DNA, 25 bp, Homo sapien
tctttttcccgttgaatctatctta

SEQ ID NO: 102737 - DNA, 25 bp, Homo sapien
tctttttccttgcactgggcagcct

SEQ ID NO: 102738 - DNA, 25 bp, Homo sapien
tctttttccttgcgctgggcagcct

SEQ ID NO: 102739 - DNA, 25 bp, Homo sapien
tctttttcgtagtataataatgttg

SEQ ID NO: 102740 - DNA, 25 bp, Homo sapien
tctttttcttagtataataatgttg

SEQ ID NO: 102741 - DNA, 25 bp, Homo sapien
tctttttcttggtgttggtgctggt

SEQ ID NO: 102742 - DNA, 25 bp, Homo sapien
tctttttcttggtgtttgtgctggt

SEQ ID NO: 102743 - DNA, 25 bp, Homo sapien
tctttttctttcagatatcagctca

SEQ ID NO: 102744 - DNA, 25 bp, Homo sapien
tctttttcttttagatatcagctca

SEQ ID NO: 102745 - DNA, 25 bp, Homo sapien
tctttttgaatctactacacccact

SEQ ID NO: 102746 - DNA, 25 bp, Homo sapien
tctttttgcccaatttgtaagactt

SEQ ID NO: 102747 - DNA, 25 bp, Homo sapien
tctttttgcgcaatttgtaagactt

SEQ ID NO: 102748 - DNA, 25 bp, Homo sapien
tctttttggatctactacacccact

SEQ ID NO: 102749 - DNA, 25 bp, Homo sapien
tctttttgtgcaacatcggtgcagt

SEQ ID NO: 102750 - DNA, 25 bp, Homo sapien
tctttttgtgcaacattggtgcagt

SEQ ID NO: 102751 - DNA, 25 bp, Homo sapien
tcttttttcctatagcaattatcac

SEQ ID NO: 102752 - DNA, 25 bp, Homo sapien
tcttttttcctgtagcaattatcac

SEQ ID NO: 102753 - DNA, 25 bp, Homo sapien
tcttttttcggacaaagggtaaaga

SEQ ID NO: 102754 - DNA, 25 bp, Homo sapien
tctttttttccacaagaacatgaga

SEQ ID NO: 102755 - DNA, 25 bp, Homo sapien
tctttttttcggttatctgtgatag

SEQ ID NO: 102756 - DNA, 25 bp, Homo sapien
tctttttttggacaaagggtaaaga

SEQ ID NO: 102757 - DNA, 25 bp, Homo sapien
tcttttttttcacaagaacatgaga

SEQ ID NO: 102758 - DNA, 25 bp, Homo sapien
tcttttttttgaacaactacctttg

SEQ ID NO: 102759 - DNA, 25 bp, Homo sapien
tcttttttttgagcaactacctttg

SEQ ID NO: 102760 - DNA, 25 bp, Homo sapien
tcttttttttggttatctgtgatag

SEQ ID NO: 102761 - DNA, 25 bp, Homo sapien
tgaaaaaaacagcttataggctgtg

SEQ ID NO: 102762 - DNA, 25 bp, Homo sapien
tgaaaaaaagtcctgaaattgctat

SEQ ID NO: 102763 - DNA, 25 bp, Homo sapien
tgaaaaaaatatcacacaaattcca

SEQ ID NO: 102764 - DNA, 25 bp, Homo sapien
tgaaaaaaatatcagacaaattcca

SEQ ID NO: 102765 - DNA, 25 bp, Homo sapien
tgaaaaaacattaagttaccagctg

SEQ ID NO: 102766 - DNA, 25 bp, Homo sapien
tgaaaaaagaagaatttgggatcta

SEQ ID NO: 102767 - DNA, 25 bp, Homo sapien
tgaaaaaagaagtatttgggatcta

SEQ ID NO: 102768 - DNA, 25 bp, Homo sapien
tgaaaaaagcacaccaatgtgaggt

SEQ ID NO: 102769 - DNA, 25 bp, Homo sapien
tgaaaaaagcacaccagtgtgaggt

SEQ ID NO: 102770 - DNA, 25 bp, Homo sapien
tgaaaaaagcagcttataggctgtg

SEQ ID NO: 102771 - DNA, 25 bp, Homo sapien
tgaaaaaatattaagttaccagctg

SEQ ID NO: 102772 - DNA, 25 bp, Homo sapien
tgaaaaaatgtcctgaaattgctat

SEQ ID NO: 102773 - DNA, 25 bp, Homo sapien
tgaaaaacaaacatcatgctcaaat

SEQ ID NO: 102774 - DNA, 25 bp, Homo sapien
tgaaaaacaaacgtcatgctcaaat

SEQ ID NO: 102775 - DNA, 25 bp, Homo sapien
tgaaaaacacaatggttgcatgagt

SEQ ID NO: 102776 - DNA, 25 bp, Homo sapien
tgaaaaacacagtggttgcatgagt

SEQ ID NO: 102777 - DNA, 25 bp, Homo sapien
tgaaaaaccaactgtttgcttcact

SEQ ID NO: 102778 - DNA, 25 bp, Homo sapien
tgaaaaaccaactttttgcttcact

SEQ ID NO: 102779 - DNA, 25 bp, Homo sapien
tgaaaaactaagatccatatgccaa

SEQ ID NO: 102780 - DNA, 25 bp, Homo sapien
tgaaaaactaagatccctatgccaa

SEQ ID NO: 102781 - DNA, 25 bp, Homo sapien
tgaaaaactcaggctaggatgagaa

SEQ ID NO: 102782 - DNA, 25 bp, Homo sapien
tgaaaaactcaggttaggatgagaa

SEQ ID NO: 102783 - DNA, 25 bp, Homo sapien
tgaaaaatataaaaagtgttgtgga

SEQ ID NO: 102784 - DNA, 25 bp, Homo sapien
tgaaaaatctaaaaagtgttgtgga

SEQ ID NO: 102785 - DNA, 25 bp, Homo sapien
tgaaaaattgtgcgaaattaatatt

SEQ ID NO: 102786 - DNA, 25 bp, Homo sapien
tgaaaaattgtgtgaaattaatatt

SEQ ID NO: 102787 - DNA, 25 bp, Homo sapien
tgaaaacaaagtgtggattgggaga

SEQ ID NO: 102788 - DNA, 25 bp, Homo sapien
tgaaaacaaggtgtggattgggaga

SEQ ID NO: 102789 - DNA, 25 bp, Homo sapien
tgaaaaccaaaactaagaaatactt

SEQ ID NO: 102790 - DNA, 25 bp, Homo sapien
tgaaaaccaatttaccatagacatg

SEQ ID NO: 102791 - DNA, 25 bp, Homo sapien
tgaaaaccaatttaccgtagacatg

SEQ ID NO: 102792 - DNA, 25 bp, Homo sapien
tgaaaaccagaactaagaaatactt

SEQ ID NO: 102793 - DNA, 25 bp, Homo sapien
tgaaaacgattgtcaaagaaagagg

SEQ ID NO: 102794 - DNA, 25 bp, Homo sapien
tgaaaacgattgttaaagaaagagg

SEQ ID NO: 102795 - DNA, 25 bp, Homo sapien
tgaaaactgagacttacgagattcg

SEQ ID NO: 102796 - DNA, 25 bp, Homo sapien
tgaaaactgagacttatgagattcg

SEQ ID NO: 102797 - DNA, 25 bp, Homo sapien
tgaaaagaaactaagcacgtgcacc

SEQ ID NO: 102798 - DNA, 25 bp, Homo sapien
tgaaaagactacagtggcttagcct

SEQ ID NO: 102799 - DNA, 25 bp, Homo sapien
tgaaaagactagagtggcttagcct

SEQ ID NO: 102800 - DNA, 25 bp, Homo sapien
tgaaaagatactaagcacgtgcacc

SEQ ID NO: 102801 - DNA, 25 bp, Homo sapien
tgaaaagattttccgacatgataat

SEQ ID NO: 102802 - DNA, 25 bp, Homo sapien
tgaaaagattttcggacatgataat

SEQ ID NO: 102803 - DNA, 25 bp, Homo sapien
tgaaaagctgcaggaccttgaatta

SEQ ID NO: 102804 - DNA, 25 bp, Homo sapien
tgaaaagctgcgggaccttgaatta

SEQ ID NO: 102805 - DNA, 25 bp, Homo sapien
tgaaaaggacgctatgtgctgggca

SEQ ID NO: 102806 - DNA, 25 bp, Homo sapien
tgaaaaggatgctatgtgctgggca

SEQ ID NO: 102807 - DNA, 25 bp, Homo sapien
tgaaaagtaagtaaaaaataatctg

SEQ ID NO: 102808 - DNA, 25 bp, Homo sapien
tgaaaagtaagtaaaatataatctg

SEQ ID NO: 102809 - DNA, 25 bp, Homo sapien
tgaaaagtagtctctacaaacacag

SEQ ID NO: 102810 - DNA, 25 bp, Homo sapien
tgaaaagtagtctctataaacacag

SEQ ID NO: 102811 - DNA, 25 bp, Homo sapien
tgaaaagtggctatcggccaggaat

SEQ ID NO: 102812 - DNA, 25 bp, Homo sapien
tgaaaagtggctattggccaggaat

SEQ ID NO: 102813 - DNA, 25 bp, Homo sapien
tgaaaagttaagcgattatttttat

SEQ ID NO: 102814 - DNA, 25 bp, Homo sapien
tgaaaagttaagtgattatttttat

SEQ ID NO: 102815 - DNA, 25 bp, Homo sapien
tgaaaagttgtgtaatcattgtgtt

SEQ ID NO: 102816 - DNA, 25 bp, Homo sapien
tgaaaagttgtgtcatcattgtgtt

SEQ ID NO: 102817 - DNA, 25 bp, Homo sapien
tgaaaataacagcggttaaagggca

SEQ ID NO: 102818 - DNA, 25 bp, Homo sapien
tgaaaataacagtggttaaagggca

SEQ ID NO: 102819 - DNA, 25 bp, Homo sapien
tgaaaataagcaagttaccaaagct

SEQ ID NO: 102820 - DNA, 25 bp, Homo sapien
tgaaaataagcgagttaccaaagct

SEQ ID NO: 102821 - DNA, 25 bp, Homo sapien
tgaaaataatcatcatctccaaaat

SEQ ID NO: 102822 - DNA, 25 bp, Homo sapien
tgaaaatagtcatcatctccaaaat

SEQ ID NO: 102823 - DNA, 25 bp, Homo sapien
tgaaaatcagtagaccatgttggag

SEQ ID NO: 102824 - DNA, 25 bp, Homo sapien
tgaaaatcatgggtttctctagtgt

SEQ ID NO: 102825 - DNA, 25 bp, Homo sapien
tgaaaatcatggttttctctagtgt

SEQ ID NO: 102826 - DNA, 25 bp, Homo sapien
tgaaaatcggtagaccatgttggag

SEQ ID NO: 102827 - DNA, 25 bp, Homo sapien
tgaaaatgaatcaagccctttattc

SEQ ID NO: 102828 - DNA, 25 bp, Homo sapien
tgaaaatgaatcgagccctttattc

SEQ ID NO: 102829 - DNA, 25 bp, Homo sapien
tgaaaatgcaattgacacactgaag

SEQ ID NO: 102830 - DNA, 25 bp, Homo sapien
tgaaaatgcgattgacacactgaag

SEQ ID NO: 102831 - DNA, 25 bp, Homo sapien
tgaaaatgtcatcccactgtcatct

SEQ ID NO: 102832 - DNA, 25 bp, Homo sapien
tgaaaatgtcatcccagtgtcatct

SEQ ID NO: 102833 - DNA, 25 bp, Homo sapien
tgaaaattccctcaaacttggaaat

SEQ ID NO: 102834 - DNA, 25 bp, Homo sapien
tgaaaattccctcgaacttggaaat

SEQ ID NO: 102835 - DNA, 25 bp, Homo sapien
tgaaaattgaggactgcgtatcaac

SEQ ID NO: 102836 - DNA, 25 bp, Homo sapien
tgaaaattgaggactgtgtatcaac

SEQ ID NO: 102837 - DNA, 25 bp, Homo sapien
tgaaacaacagagataccagaagct

SEQ ID NO: 102838 - DNA, 25 bp, Homo sapien
tgaaacaagctgtgcatggcaggac

SEQ ID NO: 102839 - DNA, 25 bp, Homo sapien
tgaaacaagttgtgcatggcaggac

SEQ ID NO: 102840 - DNA, 25 bp, Homo sapien
tgaaacaataaaggcttgctaacaa

SEQ ID NO: 102841 - DNA, 25 bp, Homo sapien
tgaaacaataaagtcttgctaacaa

SEQ ID NO: 102842 - DNA, 25 bp, Homo sapien
tgaaacaatagagataccagaagct

SEQ ID NO: 102843 - DNA, 25 bp, Homo sapien
tgaaacacaatagcattacaagggt

SEQ ID NO: 102844 - DNA, 25 bp, Homo sapien
tgaaacacagtagcattacaagggt

SEQ ID NO: 102845 - DNA, 25 bp, Homo sapien
tgaaacagcgttcggtggccactga

SEQ ID NO: 102846 - DNA, 25 bp, Homo sapien
tgaaacagcgtttggtggccactga

SEQ ID NO: 102847 - DNA, 25 bp, Homo sapien
tgaaacatattaccatcatattgat

SEQ ID NO: 102848 - DNA, 25 bp, Homo sapien
tgaaacatattatcatcatattgat

SEQ ID NO: 102849 - DNA, 25 bp, Homo sapien
tgaaacatcgttcatggtgactaat

SEQ ID NO: 102850 - DNA, 25 bp, Homo sapien
tgaaacatggttcatggtgactaat

SEQ ID NO: 102851 - DNA, 25 bp, Homo sapien
tgaaacattttcagcaagttcatta

SEQ ID NO: 102852 - DNA, 25 bp, Homo sapien
tgaaacattttcagtaagttcatta

SEQ ID NO: 102853 - DNA, 25 bp, Homo sapien
tgaaacggacaacgaactggaagaa

SEQ ID NO: 102854 - DNA, 25 bp, Homo sapien
tgaaacggacaaggaactggaagaa

SEQ ID NO: 102855 - DNA, 25 bp, Homo sapien
tgaaactaccatctagccctttata

SEQ ID NO: 102856 - DNA, 25 bp, Homo sapien
tgaaactactatctagccctttata

SEQ ID NO: 102857 - DNA, 25 bp, Homo sapien
tgaaactataaagtcacacactctt

SEQ ID NO: 102858 - DNA, 25 bp, Homo sapien
tgaaactataaagtcagacactctt

SEQ ID NO: 102859 - DNA, 25 bp, Homo sapien
tgaaactcacaccaccaatgaggca

SEQ ID NO: 102860 - DNA, 25 bp, Homo sapien
tgaaactcacaccgccaatgaggca

SEQ ID NO: 102861 - DNA, 25 bp, Homo sapien
tgaaactgatacaatcatgtcaaag

SEQ ID NO: 102862 - DNA, 25 bp, Homo sapien
tgaaactgatacgatcatgtcaaag

SEQ ID NO: 102863 - DNA, 25 bp, Homo sapien
tgaaactgggtatctgcgttcgctt

SEQ ID NO: 102864 - DNA, 25 bp, Homo sapien
tgaaactggttatctgcgttcgctt

SEQ ID NO: 102865 - DNA, 25 bp, Homo sapien
tgaaactgtggagcaaccaagcatc

SEQ ID NO: 102866 - DNA, 25 bp, Homo sapien
tgaaactgtggagcaagcaagcatc

SEQ ID NO: 102867 - DNA, 25 bp, Homo sapien
tgaaacttccaccctacagatgggg

SEQ ID NO: 102868 - DNA, 25 bp, Homo sapien
tgaaactttactatctgaatgtgta

SEQ ID NO: 102869 - DNA, 25 bp, Homo sapien
tgaaactttactatgtgaatgtgta

SEQ ID NO: 102870 - DNA, 25 bp, Homo sapien
tgaaactttcaccctacagatgggg

SEQ ID NO: 102871 - DNA, 25 bp, Homo sapien
tgaaagaaaaaatactgaatttgaa

SEQ ID NO: 102872 - DNA, 25 bp, Homo sapien
tgaaagaaaaaatattgaatttgaa

SEQ ID NO: 102873 - DNA, 25 bp, Homo sapien
tgaaagaaaaggctgggaaaattgg

SEQ ID NO: 102874 - DNA, 25 bp, Homo sapien
tgaaagaaatggctgggaaaattgg

SEQ ID NO: 102875 - DNA, 25 bp, Homo sapien
tgaaagacaaaagtacctctgattg

SEQ ID NO: 102876 - DNA, 25 bp, Homo sapien
tgaaagacagaaacagatattctat

SEQ ID NO: 102877 - DNA, 25 bp, Homo sapien
tgaaagaccccattcaatatccggg

SEQ ID NO: 102878 - DNA, 25 bp, Homo sapien
tgaaagaccccgttcaatatccggg

SEQ ID NO: 102879 - DNA, 25 bp, Homo sapien
tgaaagacgaaagtacctctgattg

SEQ ID NO: 102880 - DNA, 25 bp, Homo sapien
tgaaagacggaaacagatattctat

SEQ ID NO: 102881 - DNA, 25 bp, Homo sapien
tgaaagactttaatcttaacctcta

SEQ ID NO: 102882 - DNA, 25 bp, Homo sapien
tgaaagactttaattttaacctcta

SEQ ID NO: 102883 - DNA, 25 bp, Homo sapien
tgaaagagaagacctaagatgaaca

SEQ ID NO: 102884 - DNA, 25 bp, Homo sapien
tgaaagagaagagctaagatgaaca

SEQ ID NO: 102885 - DNA, 25 bp, Homo sapien
tgaaagagatagcggatatggcaaa

SEQ ID NO: 102886 - DNA, 25 bp, Homo sapien
tgaaagagatagtggatatggcaaa

SEQ ID NO: 102887 - DNA, 25 bp, Homo sapien
tgaaagagcaactagttatgggaaa

SEQ ID NO: 102888 - DNA, 25 bp, Homo sapien
tgaaagagcaattagttatgggaaa

SEQ ID NO: 102889 - DNA, 25 bp, Homo sapien
tgaaagagccagctccacaaccaga

SEQ ID NO: 102890 - DNA, 25 bp, Homo sapien
tgaaagagccagcttcacaaccaga

SEQ ID NO: 102891 - DNA, 25 bp, Homo sapien
tgaaagagctaagagttacctcaaa

SEQ ID NO: 102892 - DNA, 25 bp, Homo sapien
tgaaagagctaatagttacctcaaa

SEQ ID NO: 102893 - DNA, 25 bp, Homo sapien
tgaaagaggtacgtcaaagatagaa

SEQ ID NO: 102894 - DNA, 25 bp, Homo sapien
tgaaagaggtatgtcaaagatagaa

SEQ ID NO: 102895 - DNA, 25 bp, Homo sapien
tgaaagagttaatttgatggcttga

SEQ ID NO: 102896 - DNA, 25 bp, Homo sapien
tgaaagagttaatttggtggcttga

SEQ ID NO: 102897 - DNA, 25 bp, Homo sapien
tgaaagatctgatgaaacccagcgt

SEQ ID NO: 102898 - DNA, 25 bp, Homo sapien
tgaaagatctgatgaagcccagcgt

SEQ ID NO: 102899 - DNA, 25 bp, Homo sapien
tgaaagcacagtgcagaaatggtta

SEQ ID NO: 102900 - DNA, 25 bp, Homo sapien
tgaaagcacagtgccgaaatggtta

SEQ ID NO: 102901 - DNA, 25 bp, Homo sapien
tgaaagcagaaaacagatatcagcc

SEQ ID NO: 102902 - DNA, 25 bp, Homo sapien
tgaaagcagaaaacaggtatcagcc

SEQ ID NO: 102903 - DNA, 25 bp, Homo sapien
tgaaagcagtccttcctttctgaga

SEQ ID NO: 102904 - DNA, 25 bp, Homo sapien
tgaaagcagtctttcctttctgaga

SEQ ID NO: 102905 - DNA, 25 bp, Homo sapien
tgaaagctatttctgaacatgaggc

SEQ ID NO: 102906 - DNA, 25 bp, Homo sapien
tgaaagctatttttgaacatgaggc

SEQ ID NO: 102907 - DNA, 25 bp, Homo sapien
tgaaagctgctgaaaaacttcagaa

SEQ ID NO: 102908 - DNA, 25 bp, Homo sapien
tgaaagctgctgaaaatcttcagaa

SEQ ID NO: 102909 - DNA, 25 bp, Homo sapien
tgaaagctgtagaaaagtttacata

SEQ ID NO: 102910 - DNA, 25 bp, Homo sapien
tgaaagctgtataaaagtttacata

SEQ ID NO: 102911 - DNA, 25 bp, Homo sapien
tgaaagctgtgtaatcgattgtgaa

SEQ ID NO: 102912 - DNA, 25 bp, Homo sapien
tgaaagctgtgtaatctattgtgaa

SEQ ID NO: 102913 - DNA, 25 bp, Homo sapien
tgaaaggaagacgagacacataaac

SEQ ID NO: 102914 - DNA, 25 bp, Homo sapien
tgaaaggaagatgagacacataaac

SEQ ID NO: 102915 - DNA, 25 bp, Homo sapien
tgaaaggaagtaaagtacacttaga

SEQ ID NO: 102916 - DNA, 25 bp, Homo sapien
tgaaaggaagtaaagtgcacttaga

SEQ ID NO: 102917 - DNA, 25 bp, Homo sapien
tgaaaggacagtcatttagataaga

SEQ ID NO: 102918 - DNA, 25 bp, Homo sapien
tgaaaggacagtcgtttagataaga

SEQ ID NO: 102919 - DNA, 25 bp, Homo sapien
tgaaaggatctcccacaatcatctg

SEQ ID NO: 102920 - DNA, 25 bp, Homo sapien
tgaaaggattaatgctgccatcatg

SEQ ID NO: 102921 - DNA, 25 bp, Homo sapien
tgaaaggattaatgttgccatcatg

SEQ ID NO: 102922 - DNA, 25 bp, Homo sapien
tgaaaggatttcccacaatcatctg

SEQ ID NO: 102923 - DNA, 25 bp, Homo sapien
tgaaagggaaggtgctactgacatg

SEQ ID NO: 102924 - DNA, 25 bp, Homo sapien
tgaaagggaaggtggtactgacatg

SEQ ID NO: 102925 - DNA, 25 bp, Homo sapien
tgaaaggtagcatcatcaaaacagc

SEQ ID NO: 102926 - DNA, 25 bp, Homo sapien
tgaaaggtagcgtcatcaaaacagc

SEQ ID NO: 102927 - DNA, 25 bp, Homo sapien
tgaaaggtgcataacggactccctt

SEQ ID NO: 102928 - DNA, 25 bp, Homo sapien
tgaaaggtgcataatggactccctt

SEQ ID NO: 102929 - DNA, 25 bp, Homo sapien
tgaaagtaggcagacacattaggtg

SEQ ID NO: 102930 - DNA, 25 bp, Homo sapien
tgaaagtaggcagacatattaggtg

SEQ ID NO: 102931 - DNA, 25 bp, Homo sapien
tgaaagtatagtcgtcctttaaatg

SEQ ID NO: 102932 - DNA, 25 bp, Homo sapien
tgaaagtatagttgtcctttaaatg

SEQ ID NO: 102933 - DNA, 25 bp, Homo sapien
tgaaagtcattttcttcctgctgtt

SEQ ID NO: 102934 - DNA, 25 bp, Homo sapien
tgaaagtcattttgttcctgctgtt

SEQ ID NO: 102935 - DNA, 25 bp, Homo sapien
tgaaagtcctttgagaaaaacattg

SEQ ID NO: 102936 - DNA, 25 bp, Homo sapien
tgaaagtcctttgggaaaaacattg

SEQ ID NO: 102937 - DNA, 25 bp, Homo sapien
tgaaagtctttcgattgtttccatt

SEQ ID NO: 102938 - DNA, 25 bp, Homo sapien
tgaaagtcttttgattgtttccatt

SEQ ID NO: 102939 - DNA, 25 bp, Homo sapien
tgaaagtgaaagacagaaacagata

SEQ ID NO: 102940 - DNA, 25 bp, Homo sapien
tgaaagtgaaagacggaaacagata

SEQ ID NO: 102941 - DNA, 25 bp, Homo sapien
tgaaagtggaaaaggataggctgag

SEQ ID NO: 102942 - DNA, 25 bp, Homo sapien
tgaaagtggaataggataggctgag

SEQ ID NO: 102943 - DNA, 25 bp, Homo sapien
tgaaagtgtaaacacgagtcccagg

SEQ ID NO: 102944 - DNA, 25 bp, Homo sapien
tgaaagtgtaaagacgagtcccagg

SEQ ID NO: 102945 - DNA, 25 bp, Homo sapien
tgaaagtgtctacctaagataggct

SEQ ID NO: 102946 - DNA, 25 bp, Homo sapien
tgaaagtgtctgcctaagataggct

SEQ ID NO: 102947 - DNA, 25 bp, Homo sapien
tgaaagttgtatacgttaatgattg

SEQ ID NO: 102948 - DNA, 25 bp, Homo sapien
tgaaagttgtatatgttaatgattg

SEQ ID NO: 102949 - DNA, 25 bp, Homo sapien
tgaaagttgtatgaaattatatgaa

SEQ ID NO: 102950 - DNA, 25 bp, Homo sapien
tgaaagttgtatgagattatatgaa

SEQ ID NO: 102951 - DNA, 25 bp, Homo sapien
tgaaagtttactctcaattttgtct

SEQ ID NO: 102952 - DNA, 25 bp, Homo sapien
tgaaagtttactctcacttttgtct

SEQ ID NO: 102953 - DNA, 25 bp, Homo sapien
tgaaataacgcaactacaaaccaag

SEQ ID NO: 102954 - DNA, 25 bp, Homo sapien
tgaaataacgcatctacaaaccaag

SEQ ID NO: 102955 - DNA, 25 bp, Homo sapien
tgaaatagaactccaaggcatcttg

SEQ ID NO: 102956 - DNA, 25 bp, Homo sapien
tgaaatagcaatacgtatctgtaca

SEQ ID NO: 102957 - DNA, 25 bp, Homo sapien
tgaaatagcaatatgtatctgtaca

SEQ ID NO: 102958 - DNA, 25 bp, Homo sapien
tgaaatagcactccaaggcatcttg

SEQ ID NO: 102959 - DNA, 25 bp, Homo sapien
tgaaatagtgtatgtgcaacctaaa

SEQ ID NO: 102960 - DNA, 25 bp, Homo sapien
tgaaatagtgtatgtgtaacctaaa

SEQ ID NO: 102961 - DNA, 25 bp, Homo sapien
tgaaatatctgcgcatgcaatagag

SEQ ID NO: 102962 - DNA, 25 bp, Homo sapien
tgaaatatctgtgcatgcaatagag

SEQ ID NO: 102963 - DNA, 25 bp, Homo sapien
tgaaatcaaggtgtaaagagggccc

SEQ ID NO: 102964 - DNA, 25 bp, Homo sapien
tgaaatcaatgtgtaaagagggccc

SEQ ID NO: 102965 - DNA, 25 bp, Homo sapien
tgaaatcacataaaccttagcaccc

SEQ ID NO: 102966 - DNA, 25 bp, Homo sapien
tgaaatcacatcaaccttagcaccc

SEQ ID NO: 102967 - DNA, 25 bp, Homo sapien
tgaaatcacatctgatacagaagct

SEQ ID NO: 102968 - DNA, 25 bp, Homo sapien
tgaaatcacatctggtacagaagct

SEQ ID NO: 102969 - DNA, 25 bp, Homo sapien
tgaaatcacctttaactgtgtcatc

SEQ ID NO: 102970 - DNA, 25 bp, Homo sapien
tgaaatcagctttaactgtgtcatc

SEQ ID NO: 102971 - DNA, 25 bp, Homo sapien
tgaaatccaaggctcccattctgag

SEQ ID NO: 102972 - DNA, 25 bp, Homo sapien
tgaaatccaaggctcctattctgag

SEQ ID NO: 102973 - DNA, 25 bp, Homo sapien
tgaaatcctgagttgactaagagca

SEQ ID NO: 102974 - DNA, 25 bp, Homo sapien
tgaaatcctgatttgactaagagca

SEQ ID NO: 102975 - DNA, 25 bp, Homo sapien
tgaaatcgtcctcaatgaaaaacct

SEQ ID NO: 102976 - DNA, 25 bp, Homo sapien
tgaaatcgtcctcagtgaaaaacct

SEQ ID NO: 102977 - DNA, 25 bp, Homo sapien
tgaaatctcaacctaggagcaggtt

SEQ ID NO: 102978 - DNA, 25 bp, Homo sapien
tgaaatctcaacgtaggagcaggtt

SEQ ID NO: 102979 - DNA, 25 bp, Homo sapien
tgaaatcttacgcgtactcagtttg

SEQ ID NO: 102980 - DNA, 25 bp, Homo sapien
tgaaatcttacgtgtactcagtttg

SEQ ID NO: 102981 - DNA, 25 bp, Homo sapien
tgaaatgaacctttctaaactttac

SEQ ID NO: 102982 - DNA, 25 bp, Homo sapien
tgaaatgaatctttctaaactttac

SEQ ID NO: 102983 - DNA, 25 bp, Homo sapien
tgaaatgcaaaactatggattaatt

SEQ ID NO: 102984 - DNA, 25 bp, Homo sapien
tgaaatgccaaatatgctggagtcc

SEQ ID NO: 102985 - DNA, 25 bp, Homo sapien
tgaaatgccaaatctgctggagtcc

SEQ ID NO: 102986 - DNA, 25 bp, Homo sapien
tgaaatgcctattagatagttgtgg

SEQ ID NO: 102987 - DNA, 25 bp, Homo sapien
tgaaatgcctattatatagttgtgg

SEQ ID NO: 102988 - DNA, 25 bp, Homo sapien
tgaaatgcgaaactatggattaatt

SEQ ID NO: 102989 - DNA, 25 bp, Homo sapien
tgaaatgcttagaaacctgagaact

SEQ ID NO: 102990 - DNA, 25 bp, Homo sapien
tgaaatgcttagaatcctgagaact

SEQ ID NO: 102991 - DNA, 25 bp, Homo sapien
tgaaatggggacaaaaatgcactct

SEQ ID NO: 102992 - DNA, 25 bp, Homo sapien
tgaaatggggacagaaatgcactct

SEQ ID NO: 102993 - DNA, 25 bp, Homo sapien
tgaaatggtccaagcaagagtttcc

SEQ ID NO: 102994 - DNA, 25 bp, Homo sapien
tgaaatggtccaggcaagagtttcc

SEQ ID NO: 102995 - DNA, 25 bp, Homo sapien
tgaaatgtcattatgtggtatgtga

SEQ ID NO: 102996 - DNA, 25 bp, Homo sapien
tgaaatgtcgttatgtggtatgtga

SEQ ID NO: 102997 - DNA, 25 bp, Homo sapien
tgaaatgtgtttaacttgaattgct

SEQ ID NO: 102998 - DNA, 25 bp, Homo sapien
tgaaatgtgtttatcttgaattgct

SEQ ID NO: 102999 - DNA, 25 bp, Homo sapien
tgaaattaaaacactgatgagacct

SEQ ID NO: 103000 - DNA, 25 bp, Homo sapien
tgaaattaaaacattgatgagacct

SEQ ID NO: 103001 - DNA, 25 bp, Homo sapien
tgaaattaaatgatatataggattt

SEQ ID NO: 103002 - DNA, 25 bp, Homo sapien
tgaaattaaatgatgtataggattt

SEQ ID NO: 103003 - DNA, 25 bp, Homo sapien
tgaaattaacgggacatggaggctt

SEQ ID NO: 103004 - DNA, 25 bp, Homo sapien
tgaaattaatgggacatggaggctt

SEQ ID NO: 103005 - DNA, 25 bp, Homo sapien
tgaaattactccttactccatgggc

SEQ ID NO: 103006 - DNA, 25 bp, Homo sapien
tgaaattagtccttactccatgggc

SEQ ID NO: 103007 - DNA, 25 bp, Homo sapien
tgaaattcaaacccaggtggttcta

SEQ ID NO: 103008 - DNA, 25 bp, Homo sapien
tgaaattcccatgcaaactcagatc

SEQ ID NO: 103009 - DNA, 25 bp, Homo sapien
tgaaattcccatgcaacctcagatc

SEQ ID NO: 103010 - DNA, 25 bp, Homo sapien
tgaaattcgaacccaggtggttcta

SEQ ID NO: 103011 - DNA, 25 bp, Homo sapien
tgaaattcgcttccggtgccaggtg

SEQ ID NO: 103012 - DNA, 25 bp, Homo sapien
tgaaattcggttccggtgccaggtg

SEQ ID NO: 103013 - DNA, 25 bp, Homo sapien
tgaaattcgttgactcgtactgtgc

SEQ ID NO: 103014 - DNA, 25 bp, Homo sapien
tgaaattcgttgtctcgtactgtgc

SEQ ID NO: 103015 - DNA, 25 bp, Homo sapien
tgaaattctgctatccaacgaatca

SEQ ID NO: 103016 - DNA, 25 bp, Homo sapien
tgaaattctgctttccaacgaatca

SEQ ID NO: 103017 - DNA, 25 bp, Homo sapien
tgaaattgtccagacttggctaaag

SEQ ID NO: 103018 - DNA, 25 bp, Homo sapien
tgaaattgtccagatttggctaaag

SEQ ID NO: 103019 - DNA, 25 bp, Homo sapien
tgaaatttcctgggcgatagaagca

SEQ ID NO: 103020 - DNA, 25 bp, Homo sapien
tgaaatttcctgggtgatagaagca

SEQ ID NO: 103021 - DNA, 25 bp, Homo sapien
tgaaatttctgatttgtaaatgttc

SEQ ID NO: 103022 - DNA, 25 bp, Homo sapien
tgaaatttgtgatttgtaaatgttc

SEQ ID NO: 103023 - DNA, 25 bp, Homo sapien
tgaacaaaaaacgtatctcattaat

SEQ ID NO: 103024 - DNA, 25 bp, Homo sapien
tgaacaaaaaatgtatctcattaat

SEQ ID NO: 103025 - DNA, 25 bp, Homo sapien
tgaacaaaaatgaagactgccacat

SEQ ID NO: 103026 - DNA, 25 bp, Homo sapien
tgaacaaaaatgaagattgccacat

SEQ ID NO: 103027 - DNA, 25 bp, Homo sapien
tgaacaaaactcttaaacagccttc

SEQ ID NO: 103028 - DNA, 25 bp, Homo sapien
tgaacaaacctcttaaacagccttc

SEQ ID NO: 103029 - DNA, 25 bp, Homo sapien
tgaacaaactctcttgattagctta

SEQ ID NO: 103030 - DNA, 25 bp, Homo sapien
tgaacaaaggattgtttctccaaat

SEQ ID NO: 103031 - DNA, 25 bp, Homo sapien
tgaacaaatgattgtttctccaaat

SEQ ID NO: 103032 - DNA, 25 bp, Homo sapien
tgaacaaattctcttgattagctta

SEQ ID NO: 103033 - DNA, 25 bp, Homo sapien
tgaacaacatcattgcctgggttgc

SEQ ID NO: 103034 - DNA, 25 bp, Homo sapien
tgaacaacatcattgcttgggttgc

SEQ ID NO: 103035 - DNA, 25 bp, Homo sapien
tgaacaagcgagattttaatagctc

SEQ ID NO: 103036 - DNA, 25 bp, Homo sapien
tgaacaaggaagataatctttttta

SEQ ID NO: 103037 - DNA, 25 bp, Homo sapien
tgaacaaggaagattatctttttta

SEQ ID NO: 103038 - DNA, 25 bp, Homo sapien
tgaacaagtgagattttaatagctc

SEQ ID NO: 103039 - DNA, 25 bp, Homo sapien
tgaacaatctaaaatagtcatgttc

SEQ ID NO: 103040 - DNA, 25 bp, Homo sapien
tgaacaatctaaactagtcatgttc

SEQ ID NO: 103041 - DNA, 25 bp, Homo sapien
tgaacaatctcgtgtatctacagct

SEQ ID NO: 103042 - DNA, 25 bp, Homo sapien
tgaacaatctcttgtatctacagct

SEQ ID NO: 103043 - DNA, 25 bp, Homo sapien
tgaacacaattgaatcttattctgc

SEQ ID NO: 103044 - DNA, 25 bp, Homo sapien
tgaacacaattggatcttattctgc

SEQ ID NO: 103045 - DNA, 25 bp, Homo sapien
tgaacacctactatgagtcacgagc

SEQ ID NO: 103046 - DNA, 25 bp, Homo sapien
tgaacacctactgtgagtcacgagc

SEQ ID NO: 103047 - DNA, 25 bp, Homo sapien
tgaacactcagctcaaagtccattg

SEQ ID NO: 103048 - DNA, 25 bp, Homo sapien
tgaacactcggctcaaagtccattg

SEQ ID NO: 103049 - DNA, 25 bp, Homo sapien
tgaacagccacagaaataactaaag

SEQ ID NO: 103050 - DNA, 25 bp, Homo sapien
tgaacagccgcagaaataactaaag

SEQ ID NO: 103051 - DNA, 25 bp, Homo sapien
tgaacagctatatactcacaaacca

SEQ ID NO: 103052 - DNA, 25 bp, Homo sapien
tgaacagctatttactcacaaacca

SEQ ID NO: 103053 - DNA, 25 bp, Homo sapien
tgaacaggatactatgaaaaaagaa

SEQ ID NO: 103054 - DNA, 25 bp, Homo sapien
tgaacaggatattatgaaaaaagaa

SEQ ID NO: 103055 - DNA, 25 bp, Homo sapien
tgaacaggtaaaaaaaaatgcgaaa

SEQ ID NO: 103056 - DNA, 25 bp, Homo sapien
tgaacaggttaaaaaaaatgcgaaa

SEQ ID NO: 103057 - DNA, 25 bp, Homo sapien
tgaacataccgtacttgtccaaatg

SEQ ID NO: 103058 - DNA, 25 bp, Homo sapien
tgaacatactgtacttgtccaaatg

SEQ ID NO: 103059 - DNA, 25 bp, Homo sapien
tgaacatcagcactagccaggcagt

SEQ ID NO: 103060 - DNA, 25 bp, Homo sapien
tgaacatcagcactaggcaggcagt

SEQ ID NO: 103061 - DNA, 25 bp, Homo sapien
tgaacatccacaagcgtcaagacca

SEQ ID NO: 103062 - DNA, 25 bp, Homo sapien
tgaacatccacaagtgtcaagacca

SEQ ID NO: 103063 - DNA, 25 bp, Homo sapien
tgaacatgcactgaatttacaaatc

SEQ ID NO: 103064 - DNA, 25 bp, Homo sapien
tgaacatgcgcacagaaagggcctg

SEQ ID NO: 103065 - DNA, 25 bp, Homo sapien
tgaacatgcgctgaatttacaaatc

SEQ ID NO: 103066 - DNA, 25 bp, Homo sapien
tgaacatggcaagaggcatcatcca

SEQ ID NO: 103067 - DNA, 25 bp, Homo sapien
tgaacatggcaagaggtatcatcca

SEQ ID NO: 103068 - DNA, 25 bp, Homo sapien
tgaacatgtgcacagaaagggcctg

SEQ ID NO: 103069 - DNA, 25 bp, Homo sapien
tgaacattaggaagagcctactgag

SEQ ID NO: 103070 - DNA, 25 bp, Homo sapien
tgaacattaggaagagtctactgag

SEQ ID NO: 103071 - DNA, 25 bp, Homo sapien
tgaacatttatcacttctacatttt

SEQ ID NO: 103072 - DNA, 25 bp, Homo sapien
tgaacatttatcatttctacatttt

SEQ ID NO: 103073 - DNA, 25 bp, Homo sapien
tgaacatttattatctctgggctgt

SEQ ID NO: 103074 - DNA, 25 bp, Homo sapien
tgaacatttattctctctgggctgt

SEQ ID NO: 103075 - DNA, 25 bp, Homo sapien
tgaaccaaagagatgcaggttaatt

SEQ ID NO: 103076 - DNA, 25 bp, Homo sapien
tgaaccaaagagattcaggttaatt

SEQ ID NO: 103077 - DNA, 25 bp, Homo sapien
tgaaccacacacagtctaagtctag

SEQ ID NO: 103078 - DNA, 25 bp, Homo sapien
tgaaccacgcacagtctaagtctag

SEQ ID NO: 103079 - DNA, 25 bp, Homo sapien
tgaaccacttctacaacatttaatt

SEQ ID NO: 103080 - DNA, 25 bp, Homo sapien
tgaaccacttctactacatttaatt

SEQ ID NO: 103081 - DNA, 25 bp, Homo sapien
tgaaccaggccacgtcttaaaaatg

SEQ ID NO: 103082 - DNA, 25 bp, Homo sapien
tgaaccaggccaggtcttaaaaatg

SEQ ID NO: 103083 - DNA, 25 bp, Homo sapien
tgaaccagtctccgggacatggaag

SEQ ID NO: 103084 - DNA, 25 bp, Homo sapien
tgaaccagtcttcgggacatggaag

SEQ ID NO: 103085 - DNA, 25 bp, Homo sapien
tgaaccatggcaatgaaaaggagaa

SEQ ID NO: 103086 - DNA, 25 bp, Homo sapien
tgaaccatggcagtgaaaaggagaa

SEQ ID NO: 103087 - DNA, 25 bp, Homo sapien
tgaaccctcaaacacaaaacacaag

SEQ ID NO: 103088 - DNA, 25 bp, Homo sapien
tgaaccctcaagcacaaaacacaag

SEQ ID NO: 103089 - DNA, 25 bp, Homo sapien
tgaaccgatcaaaccttaaccgtct

SEQ ID NO: 103090 - DNA, 25 bp, Homo sapien
tgaaccgatcaaactttaaccgtct

SEQ ID NO: 103091 - DNA, 25 bp, Homo sapien
tgaacctaagtaatgtccattttac

SEQ ID NO: 103092 - DNA, 25 bp, Homo sapien
tgaacctaagtaatgttcattttac

SEQ ID NO: 103093 - DNA, 25 bp, Homo sapien
tgaacctaggctgcctggcttcagg

SEQ ID NO: 103094 - DNA, 25 bp, Homo sapien
tgaacctaggctgcttggcttcagg

SEQ ID NO: 103095 - DNA, 25 bp, Homo sapien
tgaacctataaaactcctagatcat

SEQ ID NO: 103096 - DNA, 25 bp, Homo sapien
tgaacctataaaactcttagatcat

SEQ ID NO: 103097 - DNA, 25 bp, Homo sapien
tgaacctgtaaaattgcaaatggta

SEQ ID NO: 103098 - DNA, 25 bp, Homo sapien
tgaacctgtaacagccagaacacag

SEQ ID NO: 103099 - DNA, 25 bp, Homo sapien
tgaacctgtaacagccggaacacag

SEQ ID NO: 103100 - DNA, 25 bp, Homo sapien
tgaacctgtaacattgcaaatggta

SEQ ID NO: 103101 - DNA, 25 bp, Homo sapien
tgaacctgtagcaggagaaaggcac

SEQ ID NO: 103102 - DNA, 25 bp, Homo sapien
tgaacctgtagcaggataaaggcac

SEQ ID NO: 103103 - DNA, 25 bp, Homo sapien
tgaacctgtcaaattgagttctcct

SEQ ID NO: 103104 - DNA, 25 bp, Homo sapien
tgaacctgttaaattgagttctcct

SEQ ID NO: 103105 - DNA, 25 bp, Homo sapien
tgaaccttattaacttattttgcaa

SEQ ID NO: 103106 - DNA, 25 bp, Homo sapien
tgaacctttttaacttattttgcaa

SEQ ID NO: 103107 - DNA, 25 bp, Homo sapien
tgaacgagccaccttttccatgaag

SEQ ID NO: 103108 - DNA, 25 bp, Homo sapien
tgaacgagccactttttccatgaag

SEQ ID NO: 103109 - DNA, 25 bp, Homo sapien
tgaacgagccatgtaaattaagttc

SEQ ID NO: 103110 - DNA, 25 bp, Homo sapien
tgaacgagtcatgtaaattaagttc

SEQ ID NO: 103111 - DNA, 25 bp, Homo sapien
tgaacgatattgaggtgactgataa

SEQ ID NO: 103112 - DNA, 25 bp, Homo sapien
tgaacgatgttgaggtgactgataa

SEQ ID NO: 103113 - DNA, 25 bp, Homo sapien
tgaactaaaaaatttattggaggct

SEQ ID NO: 103114 - DNA, 25 bp, Homo sapien
tgaactaaaaagtttattggaggct

SEQ ID NO: 103115 - DNA, 25 bp, Homo sapien
tgaactaaacaggatgtgtaagtgg

SEQ ID NO: 103116 - DNA, 25 bp, Homo sapien
tgaactaaacagggtgtgtaagtgg

SEQ ID NO: 103117 - DNA, 25 bp, Homo sapien
tgaactaaacgatacgtgttttgca

SEQ ID NO: 103118 - DNA, 25 bp, Homo sapien
tgaactaaacgatatgtgttttgca

SEQ ID NO: 103119 - DNA, 25 bp, Homo sapien
tgaactactgcagggtaatcagagt

SEQ ID NO: 103120 - DNA, 25 bp, Homo sapien
tgaactactgcggggtaatcagagt

SEQ ID NO: 103121 - DNA, 25 bp, Homo sapien
tgaactactggaataaggacacagg

SEQ ID NO: 103122 - DNA, 25 bp, Homo sapien
tgaactactggaatgaggacacagg

SEQ ID NO: 103123 - DNA, 25 bp, Homo sapien
tgaactaggctctgaggagataatt

SEQ ID NO: 103124 - DNA, 25 bp, Homo sapien
tgaactaggctttgaggagataatt

SEQ ID NO: 103125 - DNA, 25 bp, Homo sapien
tgaactatccataattctgtttctt

SEQ ID NO: 103126 - DNA, 25 bp, Homo sapien
tgaactatccataattttgtttctt

SEQ ID NO: 103127 - DNA, 25 bp, Homo sapien
tgaactcaaagatgacatctggtgt

SEQ ID NO: 103128 - DNA, 25 bp, Homo sapien
tgaactcagagatgacatctggtgt

SEQ ID NO: 103129 - DNA, 25 bp, Homo sapien
tgaactcagttgaaccattcagata

SEQ ID NO: 103130 - DNA, 25 bp, Homo sapien
tgaactcagttgagccattcagata

SEQ ID NO: 103131 - DNA, 25 bp, Homo sapien
tgaactcggatccttaaaaatagga

SEQ ID NO: 103132 - DNA, 25 bp, Homo sapien
tgaactcggatccttagaaatagga

SEQ ID NO: 103133 - DNA, 25 bp, Homo sapien
tgaactctgatacaggatattttac

SEQ ID NO: 103134 - DNA, 25 bp, Homo sapien
tgaactctgatataggatattttac

SEQ ID NO: 103135 - DNA, 25 bp, Homo sapien
tgaactctgtgtctgaaagtcaaca

SEQ ID NO: 103136 - DNA, 25 bp, Homo sapien
tgaactcttagagaggcaggcagac

SEQ ID NO: 103137 - DNA, 25 bp, Homo sapien
tgaactcttggagaggcaggcagac

SEQ ID NO: 103138 - DNA, 25 bp, Homo sapien
tgaactctttgtctgaaagtcaaca

SEQ ID NO: 103139 - DNA, 25 bp, Homo sapien
tgaactgaaagctcagtccaagtct

SEQ ID NO: 103140 - DNA, 25 bp, Homo sapien
tgaactgaagaaaccttgggccatg

SEQ ID NO: 103141 - DNA, 25 bp, Homo sapien
tgaactgaagaacccttgggccatg

SEQ ID NO: 103142 - DNA, 25 bp, Homo sapien
tgaactgaatgctcagtccaagtct

SEQ ID NO: 103143 - DNA, 25 bp, Homo sapien
tgaactgaccttcccattcctgagt

SEQ ID NO: 103144 - DNA, 25 bp, Homo sapien
tgaactgacctttccattcctgagt

SEQ ID NO: 103145 - DNA, 25 bp, Homo sapien
tgaactgcaatagcataaaccagta

SEQ ID NO: 103146 - DNA, 25 bp, Homo sapien
tgaactgcaatagcatgaaccagta

SEQ ID NO: 103147 - DNA, 25 bp, Homo sapien
tgaactggtggacctacaagtaagt

SEQ ID NO: 103148 - DNA, 25 bp, Homo sapien
tgaactggtggccctacaagtaagt

SEQ ID NO: 103149 - DNA, 25 bp, Homo sapien
tgaactgtaaaagaaattgtgctgc

SEQ ID NO: 103150 - DNA, 25 bp, Homo sapien
tgaactgtaaggtatgcaaaattta

SEQ ID NO: 103151 - DNA, 25 bp, Homo sapien
tgaactgtgaaagaaattgtgctgc

SEQ ID NO: 103152 - DNA, 25 bp, Homo sapien
tgaactgtgaggtatgcaaaattta

SEQ ID NO: 103153 - DNA, 25 bp, Homo sapien
tgaactgttgacagagctgtcgtcc

SEQ ID NO: 103154 - DNA, 25 bp, Homo sapien
tgaactgttgacagtgctgtcgtcc

SEQ ID NO: 103155 - DNA, 25 bp, Homo sapien
tgaacttaactcatcccaggctgaa

SEQ ID NO: 103156 - DNA, 25 bp, Homo sapien
tgaacttaactcatgccaggctgaa

SEQ ID NO: 103157 - DNA, 25 bp, Homo sapien
tgaacttacaagcacgaagcacaaa

SEQ ID NO: 103158 - DNA, 25 bp, Homo sapien
tgaacttacaagcatgaagcacaaa

SEQ ID NO: 103159 - DNA, 25 bp, Homo sapien
tgaacttacgactacatgggttctt

SEQ ID NO: 103160 - DNA, 25 bp, Homo sapien
tgaacttacgccaataacttgcacc

SEQ ID NO: 103161 - DNA, 25 bp, Homo sapien
tgaacttagttcggagctaccttga

SEQ ID NO: 103162 - DNA, 25 bp, Homo sapien
tgaacttagtttggagctaccttga

SEQ ID NO: 103163 - DNA, 25 bp, Homo sapien
tgaacttatgactacatgggttctt

SEQ ID NO: 103164 - DNA, 25 bp, Homo sapien
tgaacttatgccaataacttgcacc

SEQ ID NO: 103165 - DNA, 25 bp, Homo sapien
tgaacttggagacttagattactct

SEQ ID NO: 103166 - DNA, 25 bp, Homo sapien
tgaacttggggacttagattactct

SEQ ID NO: 103167 - DNA, 25 bp, Homo sapien
tgaactttccttcctggaatttgtc

SEQ ID NO: 103168 - DNA, 25 bp, Homo sapien
tgaactttccttcttggaatttgtc

SEQ ID NO: 103169 - DNA, 25 bp, Homo sapien
tgaactttggctgcatgttggtgtc

SEQ ID NO: 103170 - DNA, 25 bp, Homo sapien
tgaactttggctgcctgttggtgtc

SEQ ID NO: 103171 - DNA, 25 bp, Homo sapien
tgaacttttctaaagaattaatgta

SEQ ID NO: 103172 - DNA, 25 bp, Homo sapien
tgaacttttctaaagagttaatgta

SEQ ID NO: 103173 - DNA, 25 bp, Homo sapien
tgaagaaaatgaatataagtgtggt

SEQ ID NO: 103174 - DNA, 25 bp, Homo sapien
tgaagaaaatgaatgtaagtgtggt

SEQ ID NO: 103175 - DNA, 25 bp, Homo sapien
tgaagaaaatgtcaagattttaaat

SEQ ID NO: 103176 - DNA, 25 bp, Homo sapien
tgaagaaaatgtcaggattttaaat

SEQ ID NO: 103177 - DNA, 25 bp, Homo sapien
tgaagaaacataagtagcaggccat

SEQ ID NO: 103178 - DNA, 25 bp, Homo sapien
tgaagaaaccagcctctgtgaagag

SEQ ID NO: 103179 - DNA, 25 bp, Homo sapien
tgaagaaaccaggctctgtgaagag

SEQ ID NO: 103180 - DNA, 25 bp, Homo sapien
tgaagaaacgtaagtagcaggccat

SEQ ID NO: 103181 - DNA, 25 bp, Homo sapien
tgaagaaataggcaaaaatttgtta

SEQ ID NO: 103182 - DNA, 25 bp, Homo sapien
tgaagaaataggcataaatttgtta

SEQ ID NO: 103183 - DNA, 25 bp, Homo sapien
tgaagaaatgggcttaaatctgcat

SEQ ID NO: 103184 - DNA, 25 bp, Homo sapien
tgaagaaatgggtttaaatctgcat

SEQ ID NO: 103185 - DNA, 25 bp, Homo sapien
tgaagaacagaatacggcactagat

SEQ ID NO: 103186 - DNA, 25 bp, Homo sapien
tgaagaacagaatatggcactagat

SEQ ID NO: 103187 - DNA, 25 bp, Homo sapien
tgaagaacataatataaagcagtat

SEQ ID NO: 103188 - DNA, 25 bp, Homo sapien
tgaagaacatattataaagcagtat

SEQ ID NO: 103189 - DNA, 25 bp, Homo sapien
tgaagaactgtttcaccttcccaaa

SEQ ID NO: 103190 - DNA, 25 bp, Homo sapien
tgaagaactttttcaccttcccaaa

SEQ ID NO: 103191 - DNA, 25 bp, Homo sapien
tgaagaagaagaacaagtcggagga

SEQ ID NO: 103192 - DNA, 25 bp, Homo sapien
tgaagaagaagaagaagtcggagga

SEQ ID NO: 103193 - DNA, 25 bp, Homo sapien
tgaagaagaagagaagatgcccaag

SEQ ID NO: 103194 - DNA, 25 bp, Homo sapien
tgaagaagaggagaagatgcccaag

SEQ ID NO: 103195 - DNA, 25 bp, Homo sapien
tgaagaagctcagacaatctgtgct

SEQ ID NO: 103196 - DNA, 25 bp, Homo sapien
tgaagaagctctgacaatctgtgct

SEQ ID NO: 103197 - DNA, 25 bp, Homo sapien
tgaagaagctggaacctttgtgcac

SEQ ID NO: 103198 - DNA, 25 bp, Homo sapien
tgaagaagttggaacctttgtgcac

SEQ ID NO: 103199 - DNA, 25 bp, Homo sapien
tgaagaattcagtgcagatattcgc

SEQ ID NO: 103200 - DNA, 25 bp, Homo sapien
tgaagaattcagtgtagatattcgc

SEQ ID NO: 103201 - DNA, 25 bp, Homo sapien
tgaagaccatttacttacaagtgca

SEQ ID NO: 103202 - DNA, 25 bp, Homo sapien
tgaagaccatttgcttacaagtgca

SEQ ID NO: 103203 - DNA, 25 bp, Homo sapien
tgaagactcttagtgcatgatattt

SEQ ID NO: 103204 - DNA, 25 bp, Homo sapien
tgaagactcttcgtgcatgatattt

SEQ ID NO: 103205 - DNA, 25 bp, Homo sapien
tgaagagaacactggaaaagaggcc

SEQ ID NO: 103206 - DNA, 25 bp, Homo sapien
tgaagagaacattggaaaagaggcc

SEQ ID NO: 103207 - DNA, 25 bp, Homo sapien
tgaagagaatgtggtcacaatcaat

SEQ ID NO: 103208 - DNA, 25 bp, Homo sapien
tgaagagaatgtggtcgcaatcaat

SEQ ID NO: 103209 - DNA, 25 bp, Homo sapien
tgaagagagtgactgatcctgacaa

SEQ ID NO: 103210 - DNA, 25 bp, Homo sapien
tgaagagagtggctgatcctgacaa

SEQ ID NO: 103211 - DNA, 25 bp, Homo sapien
tgaagaggatgggacttttcagttg

SEQ ID NO: 103212 - DNA, 25 bp, Homo sapien
tgaagaggatgggccttttcagttg

SEQ ID NO: 103213 - DNA, 25 bp, Homo sapien
tgaagaggtgccataattattaaac

SEQ ID NO: 103214 - DNA, 25 bp, Homo sapien
tgaagaggtgccgtaattattaaac

SEQ ID NO: 103215 - DNA, 25 bp, Homo sapien
tgaagagtgacagcaaaaatcatag

SEQ ID NO: 103216 - DNA, 25 bp, Homo sapien
tgaagagtgacatcaaaaatcatag

SEQ ID NO: 103217 - DNA, 25 bp, Homo sapien
tgaagagtggctagagtttcttctt

SEQ ID NO: 103218 - DNA, 25 bp, Homo sapien
tgaagagttgctagagtttcttctt

SEQ ID NO: 103219 - DNA, 25 bp, Homo sapien
tgaagataggctctttgaaaatatg

SEQ ID NO: 103220 - DNA, 25 bp, Homo sapien
tgaagataggctgtttgaaaatatg

SEQ ID NO: 103221 - DNA, 25 bp, Homo sapien
tgaagatcaaatagttgcaggtgtg

SEQ ID NO: 103222 - DNA, 25 bp, Homo sapien
tgaagatcaaatggttgcaggtgtg

SEQ ID NO: 103223 - DNA, 25 bp, Homo sapien
tgaagatcattgcaggaaaggaaga

SEQ ID NO: 103224 - DNA, 25 bp, Homo sapien
tgaagatcattgcagggaaggaaga

SEQ ID NO: 103225 - DNA, 25 bp, Homo sapien
tgaagatgaatcctatgttttcagt

SEQ ID NO: 103226 - DNA, 25 bp, Homo sapien
tgaagatgactcctatgttttcagt

SEQ ID NO: 103227 - DNA, 25 bp, Homo sapien
tgaagatgctgccctctttcttatc

SEQ ID NO: 103228 - DNA, 25 bp, Homo sapien
tgaagatgctgccttctttcttatc

SEQ ID NO: 103229 - DNA, 25 bp, Homo sapien
tgaagattaagagacacaaaagttt

SEQ ID NO: 103230 - DNA, 25 bp, Homo sapien
tgaagattaagagccacaaaagttt

SEQ ID NO: 103231 - DNA, 25 bp, Homo sapien
tgaagattgaatgtgaatatgcaag

SEQ ID NO: 103232 - DNA, 25 bp, Homo sapien
tgaagattgaatgtgactatgcaag

SEQ ID NO: 103233 - DNA, 25 bp, Homo sapien
tgaagattgagaaaggagatggatg

SEQ ID NO: 103234 - DNA, 25 bp, Homo sapien
tgaagattgaggaaggagatggatg

SEQ ID NO: 103235 - DNA, 25 bp, Homo sapien
tgaagatttttatggcaattccaag

SEQ ID NO: 103236 - DNA, 25 bp, Homo sapien
tgaagatttttgtggcaattccaag

SEQ ID NO: 103237 - DNA, 25 bp, Homo sapien
tgaagcaacagcaatcgtattcata

SEQ ID NO: 103238 - DNA, 25 bp, Homo sapien
tgaagcaacagcgatcgtattcata

SEQ ID NO: 103239 - DNA, 25 bp, Homo sapien
tgaagcagaccataatatgatacct

SEQ ID NO: 103240 - DNA, 25 bp, Homo sapien
tgaagcagaccatgatatgatacct

SEQ ID NO: 103241 - DNA, 25 bp, Homo sapien
tgaagcagccggaaagatctatgcc

SEQ ID NO: 103242 - DNA, 25 bp, Homo sapien
tgaagcagctggaaagatctatgcc

SEQ ID NO: 103243 - DNA, 25 bp, Homo sapien
tgaagcagggtcaacactgccaggt

SEQ ID NO: 103244 - DNA, 25 bp, Homo sapien
tgaagcagggtccacactgccaggt

SEQ ID NO: 103245 - DNA, 25 bp, Homo sapien
tgaagcagtccgcaaggttaactcc

SEQ ID NO: 103246 - DNA, 25 bp, Homo sapien
tgaagcagtgcgcaaggttaactcc

SEQ ID NO: 103247 - DNA, 25 bp, Homo sapien
tgaagcataatagacggagtgtgtg

SEQ ID NO: 103248 - DNA, 25 bp, Homo sapien
tgaagcataatagatggagtgtgtg

SEQ ID NO: 103249 - DNA, 25 bp, Homo sapien
tgaagcatgtggcctgtactttcta

SEQ ID NO: 103250 - DNA, 25 bp, Homo sapien
tgaagcatgtggcgtgtactttcta

SEQ ID NO: 103251 - DNA, 25 bp, Homo sapien
tgaagccaaatagaattttttattc

SEQ ID NO: 103252 - DNA, 25 bp, Homo sapien
tgaagccaaatataattttttattc

SEQ ID NO: 103253 - DNA, 25 bp, Homo sapien
tgaagccatactatcaataggagag

SEQ ID NO: 103254 - DNA, 25 bp, Homo sapien
tgaagccatactgtcaataggagag

SEQ ID NO: 103255 - DNA, 25 bp, Homo sapien
tgaagctacatctgaattacttcaa

SEQ ID NO: 103256 - DNA, 25 bp, Homo sapien
tgaagctagaacccaatgggaccta

SEQ ID NO: 103257 - DNA, 25 bp, Homo sapien
tgaagctagaactcaatgggaccta

SEQ ID NO: 103258 - DNA, 25 bp, Homo sapien
tgaagctatatctgaattacttcaa

SEQ ID NO: 103259 - DNA, 25 bp, Homo sapien
tgaagctcaagtaccggagttccca

SEQ ID NO: 103260 - DNA, 25 bp, Homo sapien
tgaagctcaagtactggagttccca

SEQ ID NO: 103261 - DNA, 25 bp, Homo sapien
tgaagctggtgcactctgaaaacaa

SEQ ID NO: 103262 - DNA, 25 bp, Homo sapien
tgaagctggtgcattctgaaaacaa

SEQ ID NO: 103263 - DNA, 25 bp, Homo sapien
tgaagcttcccaaagttttaagtgg

SEQ ID NO: 103264 - DNA, 25 bp, Homo sapien
tgaagcttctcaaagttttaagtgg

SEQ ID NO: 103265 - DNA, 25 bp, Homo sapien
tgaagcttgtaacagaaataggata

SEQ ID NO: 103266 - DNA, 25 bp, Homo sapien
tgaagcttgtaccagaaataggata

SEQ ID NO: 103267 - DNA, 25 bp, Homo sapien
tgaaggaacagctcaggtctcagtc

SEQ ID NO: 103268 - DNA, 25 bp, Homo sapien
tgaaggaacggaatttgatcaggat

SEQ ID NO: 103269 - DNA, 25 bp, Homo sapien
tgaaggaacggctcaggtctcagtc

SEQ ID NO: 103270 - DNA, 25 bp, Homo sapien
tgaaggaataactacttgttcattt

SEQ ID NO: 103271 - DNA, 25 bp, Homo sapien
tgaaggaataattacttgttcattt

SEQ ID NO: 103272 - DNA, 25 bp, Homo sapien
tgaaggaatggaatttgatcaggat

SEQ ID NO: 103273 - DNA, 25 bp, Homo sapien
tgaaggagaaaaacaagataaatta

SEQ ID NO: 103274 - DNA, 25 bp, Homo sapien
tgaaggagaaaagcaagataaatta

SEQ ID NO: 103275 - DNA, 25 bp, Homo sapien
tgaaggagaatgaaggagttaggtt

SEQ ID NO: 103276 - DNA, 25 bp, Homo sapien
tgaaggagaatgagaacgagatgga

SEQ ID NO: 103277 - DNA, 25 bp, Homo sapien
tgaaggagaatgagggagttaggtt

SEQ ID NO: 103278 - DNA, 25 bp, Homo sapien
tgaaggagcatgagaacgagatgga

SEQ ID NO: 103279 - DNA, 25 bp, Homo sapien
tgaaggagtatgattaccacctgcc

SEQ ID NO: 103280 - DNA, 25 bp, Homo sapien
tgaaggagtgtgattaccacctgcc

SEQ ID NO: 103281 - DNA, 25 bp, Homo sapien
tgaaggatggagcatccaaatggca

SEQ ID NO: 103282 - DNA, 25 bp, Homo sapien
tgaaggatggagtatccaaatggca

SEQ ID NO: 103283 - DNA, 25 bp, Homo sapien
tgaaggcacagaggcacgctgatca

SEQ ID NO: 103284 - DNA, 25 bp, Homo sapien
tgaaggcacagaggcatgctgatca

SEQ ID NO: 103285 - DNA, 25 bp, Homo sapien
tgaaggcactgaaaaaatatatatt

SEQ ID NO: 103286 - DNA, 25 bp, Homo sapien
tgaaggcactgagaaaatatatatt

SEQ ID NO: 103287 - DNA, 25 bp, Homo sapien
tgaaggcaggtgcctctgctttgcc

SEQ ID NO: 103288 - DNA, 25 bp, Homo sapien
tgaaggcaggtgcttctgctttgcc

SEQ ID NO: 103289 - DNA, 25 bp, Homo sapien
tgaaggccagactgaagaggtcaca

SEQ ID NO: 103290 - DNA, 25 bp, Homo sapien
tgaaggccagacttaagaggtcaca

SEQ ID NO: 103291 - DNA, 25 bp, Homo sapien
tgaaggctcactctactttcaagat

SEQ ID NO: 103292 - DNA, 25 bp, Homo sapien
tgaaggctcactgtactttcaagat

SEQ ID NO: 103293 - DNA, 25 bp, Homo sapien
tgaaggctgcaatagctgtgtcaat

SEQ ID NO: 103294 - DNA, 25 bp, Homo sapien
tgaaggctgcatcgtcagcttccct

SEQ ID NO: 103295 - DNA, 25 bp, Homo sapien
tgaaggctgcattgtcagcttccct

SEQ ID NO: 103296 - DNA, 25 bp, Homo sapien
tgaaggctggaatagctgtgtcaat

SEQ ID NO: 103297 - DNA, 25 bp, Homo sapien
tgaagggaagccaacttccgatgat

SEQ ID NO: 103298 - DNA, 25 bp, Homo sapien
tgaagggaagccaatttccgatgat

SEQ ID NO: 103299 - DNA, 25 bp, Homo sapien
tgaagggagatcaacatgaaatgaa

SEQ ID NO: 103300 - DNA, 25 bp, Homo sapien
tgaagggagatcaatatgaaatgaa

SEQ ID NO: 103301 - DNA, 25 bp, Homo sapien
tgaagggatgaaagaatgaatgagt

SEQ ID NO: 103302 - DNA, 25 bp, Homo sapien
tgaagggatgaaggaatgaatgagt

SEQ ID NO: 103303 - DNA, 25 bp, Homo sapien
tgaaggtgaacttggcatcagaaac

SEQ ID NO: 103304 - DNA, 25 bp, Homo sapien
tgaaggtgaactttgcatcagaaac

SEQ ID NO: 103305 - DNA, 25 bp, Homo sapien
tgaaggttcggattgtggcatcttg

SEQ ID NO: 103306 - DNA, 25 bp, Homo sapien
tgaaggttgagtaccgatactgggg

SEQ ID NO: 103307 - DNA, 25 bp, Homo sapien
tgaaggttgagtacggatactgggg

SEQ ID NO: 103308 - DNA, 25 bp, Homo sapien
tgaaggtttaggaaagaaccatctg

SEQ ID NO: 103309 - DNA, 25 bp, Homo sapien
tgaaggtttagggaagaaccatctg

SEQ ID NO: 103310 - DNA, 25 bp, Homo sapien
tgaaggtttccagagatcacatgtg

SEQ ID NO: 103311 - DNA, 25 bp, Homo sapien
tgaaggtttccagcgatcacatgtg

SEQ ID NO: 103312 - DNA, 25 bp, Homo sapien
tgaaggtttggattgtggcatcttg

SEQ ID NO: 103313 - DNA, 25 bp, Homo sapien
tgaagtaacagtcacaacagcattt

SEQ ID NO: 103314 - DNA, 25 bp, Homo sapien
tgaagtaacagttacaacagcattt

SEQ ID NO: 103315 - DNA, 25 bp, Homo sapien
tgaagtaacgccggagataaacttc

SEQ ID NO: 103316 - DNA, 25 bp, Homo sapien
tgaagtaacgcctgagataaacttc

SEQ ID NO: 103317 - DNA, 25 bp, Homo sapien
tgaagtaagcttggacagctgagtt

SEQ ID NO: 103318 - DNA, 25 bp, Homo sapien
tgaagtaagcttggccagctgagtt

SEQ ID NO: 103319 - DNA, 25 bp, Homo sapien
tgaagtagatgagcaaggtggattt

SEQ ID NO: 103320 - DNA, 25 bp, Homo sapien
tgaagtagccatactataccctagg

SEQ ID NO: 103321 - DNA, 25 bp, Homo sapien
tgaagtaggtgagcaaggtggattt

SEQ ID NO: 103322 - DNA, 25 bp, Homo sapien
tgaagtagtcatactataccctagg

SEQ ID NO: 103323 - DNA, 25 bp, Homo sapien
tgaagtcaacatgctccgaatttat

SEQ ID NO: 103324 - DNA, 25 bp, Homo sapien
tgaagtcaacatgctctgaatttat

SEQ ID NO: 103325 - DNA, 25 bp, Homo sapien
tgaagtcagttgcatcacaccctaa

SEQ ID NO: 103326 - DNA, 25 bp, Homo sapien
tgaagtcagttgcgtcacaccctaa

SEQ ID NO: 103327 - DNA, 25 bp, Homo sapien
tgaagtcataggaacacaaggcctc

SEQ ID NO: 103328 - DNA, 25 bp, Homo sapien
tgaagtcatgggaacacaaggcctc

SEQ ID NO: 103329 - DNA, 25 bp, Homo sapien
tgaagtccaaagtggtggccattac

SEQ ID NO: 103330 - DNA, 25 bp, Homo sapien
tgaagtccaaagtgttggccattac

SEQ ID NO: 103331 - DNA, 25 bp, Homo sapien
tgaagtccacatttttcttaaatcc

SEQ ID NO: 103332 - DNA, 25 bp, Homo sapien
tgaagtccatatttttcttaaatcc

SEQ ID NO: 103333 - DNA, 25 bp, Homo sapien
tgaagtcccggaagaaaaaatgaga

SEQ ID NO: 103334 - DNA, 25 bp, Homo sapien
tgaagtcctggaagaaaaaatgaga

SEQ ID NO: 103335 - DNA, 25 bp, Homo sapien
tgaagtgaagcgatactgaccataa

SEQ ID NO: 103336 - DNA, 25 bp, Homo sapien
tgaagtgaagctatactgaccataa

SEQ ID NO: 103337 - DNA, 25 bp, Homo sapien
tgaagtgagaactccaagtagaagc

SEQ ID NO: 103338 - DNA, 25 bp, Homo sapien
tgaagtgagaactccaggtagaagc

SEQ ID NO: 103339 - DNA, 25 bp, Homo sapien
tgaagtgagtttcagtgatatcttc

SEQ ID NO: 103340 - DNA, 25 bp, Homo sapien
tgaagtgattttcagtgatatcttc

SEQ ID NO: 103341 - DNA, 25 bp, Homo sapien
tgaagtgttaatcatttacacaagc

SEQ ID NO: 103342 - DNA, 25 bp, Homo sapien
tgaagtgttaatcgtttacacaagc

SEQ ID NO: 103343 - DNA, 25 bp, Homo sapien
tgaagtgttttacacatcctgaggt

SEQ ID NO: 103344 - DNA, 25 bp, Homo sapien
tgaagtgttttacatatcctgaggt

SEQ ID NO: 103345 - DNA, 25 bp, Homo sapien
tgaagttaccaatgttccactggtt

SEQ ID NO: 103346 - DNA, 25 bp, Homo sapien
tgaagttaccaatgtttcactggtt

SEQ ID NO: 103347 - DNA, 25 bp, Homo sapien
tgaagttacggctcttcttgcttct

SEQ ID NO: 103348 - DNA, 25 bp, Homo sapien
tgaagttatggctcttcttgcttct

SEQ ID NO: 103349 - DNA, 25 bp, Homo sapien
tgaagttcagttgctttgcagataa

SEQ ID NO: 103350 - DNA, 25 bp, Homo sapien
tgaagttcatttgctttgcagataa

SEQ ID NO: 103351 - DNA, 25 bp, Homo sapien
tgaagttcctccaattcagaaaggg

SEQ ID NO: 103352 - DNA, 25 bp, Homo sapien
tgaagttcctccagttcagaaaggg

SEQ ID NO: 103353 - DNA, 25 bp, Homo sapien
tgaagttcctgctgagacccttgca

SEQ ID NO: 103354 - DNA, 25 bp, Homo sapien
tgaagttcctgctgcgacccttgca

SEQ ID NO: 103355 - DNA, 25 bp, Homo sapien
tgaagttttaaataaggaacacaat

SEQ ID NO: 103356 - DNA, 25 bp, Homo sapien
tgaagttttaaatacggaacacaat

SEQ ID NO: 103357 - DNA, 25 bp, Homo sapien
tgaataaaaaagataatgcaggtac

SEQ ID NO: 103358 - DNA, 25 bp, Homo sapien
tgaataaaaaagcgaaacagcctta

SEQ ID NO: 103359 - DNA, 25 bp, Homo sapien
tgaataaaaaagctaaacagcctta

SEQ ID NO: 103360 - DNA, 25 bp, Homo sapien
tgaataaaaaaggtaatgcaggtac

SEQ ID NO: 103361 - DNA, 25 bp, Homo sapien
tgaataaacataagcagcagtcagg

SEQ ID NO: 103362 - DNA, 25 bp, Homo sapien
tgaataaacatcagcagcagtcagg

SEQ ID NO: 103363 - DNA, 25 bp, Homo sapien
tgaataaacctgaagaatattatgt

SEQ ID NO: 103364 - DNA, 25 bp, Homo sapien
tgaataaacctgaagagtattatgt

SEQ ID NO: 103365 - DNA, 25 bp, Homo sapien
tgaataacccatctgtggacactgg

SEQ ID NO: 103366 - DNA, 25 bp, Homo sapien
tgaataacgcatctgtggacactgg

SEQ ID NO: 103367 - DNA, 25 bp, Homo sapien
tgaataagttacatatacatggcga

SEQ ID NO: 103368 - DNA, 25 bp, Homo sapien
tgaataagttacgtatacatggcga

SEQ ID NO: 103369 - DNA, 25 bp, Homo sapien
tgaataatgaacggcagacttaaaa

SEQ ID NO: 103370 - DNA, 25 bp, Homo sapien
tgaataatgaatggcagacttaaaa

SEQ ID NO: 103371 - DNA, 25 bp, Homo sapien
tgaatacaatgcaaggccatgcatg

SEQ ID NO: 103372 - DNA, 25 bp, Homo sapien
tgaatacaatgcaaggtcatgcatg

SEQ ID NO: 103373 - DNA, 25 bp, Homo sapien
tgaatactttatcactacacaatgc

SEQ ID NO: 103374 - DNA, 25 bp, Homo sapien
tgaatactttatcattacacaatgc

SEQ ID NO: 103375 - DNA, 25 bp, Homo sapien
tgaatagaaggaatcaatttctggg

SEQ ID NO: 103376 - DNA, 25 bp, Homo sapien
tgaatagaatgaatcaatttctggg

SEQ ID NO: 103377 - DNA, 25 bp, Homo sapien
tgaatagcaaagatgtgcgaacaaa

SEQ ID NO: 103378 - DNA, 25 bp, Homo sapien
tgaatagcaaaggtgtgcgaacaaa

SEQ ID NO: 103379 - DNA, 25 bp, Homo sapien
tgaatagcagggaaccatagcctag

SEQ ID NO: 103380 - DNA, 25 bp, Homo sapien
tgaatagcaggggaccatagcctag

SEQ ID NO: 103381 - DNA, 25 bp, Homo sapien
tgaatagcccgaagtggcggaagat

SEQ ID NO: 103382 - DNA, 25 bp, Homo sapien
tgaatagccggaagtggcggaagat

SEQ ID NO: 103383 - DNA, 25 bp, Homo sapien
tgaataggaagggctctctgtgatc

SEQ ID NO: 103384 - DNA, 25 bp, Homo sapien
tgaataggaaggtctctctgtgatc

SEQ ID NO: 103385 - DNA, 25 bp, Homo sapien
tgaataggctatcagttgcccaata

SEQ ID NO: 103386 - DNA, 25 bp, Homo sapien
tgaataggctatccgttgcccaata

SEQ ID NO: 103387 - DNA, 25 bp, Homo sapien
tgaatagtcctaaaatagagggaaa

SEQ ID NO: 103388 - DNA, 25 bp, Homo sapien
tgaatagtcgtaaaatagagggaaa

SEQ ID NO: 103389 - DNA, 25 bp, Homo sapien
tgaatatatgttgaggtgttaagtt

SEQ ID NO: 103390 - DNA, 25 bp, Homo sapien
tgaatatatgttggggtgttaagtt

SEQ ID NO: 103391 - DNA, 25 bp, Homo sapien
tgaatatcacatccaaaacctagta

SEQ ID NO: 103392 - DNA, 25 bp, Homo sapien
tgaatatcagatccaaaacctagta

SEQ ID NO: 103393 - DNA, 25 bp, Homo sapien
tgaatatgaacttcctgatcctctt

SEQ ID NO: 103394 - DNA, 25 bp, Homo sapien
tgaatatgaactttctgatcctctt

SEQ ID NO: 103395 - DNA, 25 bp, Homo sapien
tgaatatggtcaattggcatcatga

SEQ ID NO: 103396 - DNA, 25 bp, Homo sapien
tgaatatgtgacctggagtctgcac

SEQ ID NO: 103397 - DNA, 25 bp, Homo sapien
tgaatatgtgacttggagtctgcac

SEQ ID NO: 103398 - DNA, 25 bp, Homo sapien
tgaatatgttcaattggcatcatga

SEQ ID NO: 103399 - DNA, 25 bp, Homo sapien
tgaatatgttgggccacgtgacaaa

SEQ ID NO: 103400 - DNA, 25 bp, Homo sapien
tgaatatgttgggctacgtgacaaa

SEQ ID NO: 103401 - DNA, 25 bp, Homo sapien
tgaatattgtgcatgacacctagaa

SEQ ID NO: 103402 - DNA, 25 bp, Homo sapien
tgaatattgtgcgtgacacctagaa

SEQ ID NO: 103403 - DNA, 25 bp, Homo sapien
tgaatatttaaagagttcttgtagg

SEQ ID NO: 103404 - DNA, 25 bp, Homo sapien
tgaatatttaaagggttcttgtagg

SEQ ID NO: 103405 - DNA, 25 bp, Homo sapien
tgaatatttacatattagtgctctt

SEQ ID NO: 103406 - DNA, 25 bp, Homo sapien
tgaatatttacatgttagtgctctt

SEQ ID NO: 103407 - DNA, 25 bp, Homo sapien
tgaatatttcacagtcgaattgttc

SEQ ID NO: 103408 - DNA, 25 bp, Homo sapien
tgaatatttcacagtctaattgttc

SEQ ID NO: 103409 - DNA, 25 bp, Homo sapien
tgaatatttgacatggaaagtctag

SEQ ID NO: 103410 - DNA, 25 bp, Homo sapien
tgaatatttgacatgggaagtctag

SEQ ID NO: 103411 - DNA, 25 bp, Homo sapien
tgaatcataggaacagacttgctgt

SEQ ID NO: 103412 - DNA, 25 bp, Homo sapien
tgaatcatagggtagttcttaatgg

SEQ ID NO: 103413 - DNA, 25 bp, Homo sapien
tgaatcatctttcgctcaaataaat

SEQ ID NO: 103414 - DNA, 25 bp, Homo sapien
tgaatcatcttttgctcaaataaat

SEQ ID NO: 103415 - DNA, 25 bp, Homo sapien
tgaatcatgggaacagacttgctgt

SEQ ID NO: 103416 - DNA, 25 bp, Homo sapien
tgaatcatggggtagttcttaatgg

SEQ ID NO: 103417 - DNA, 25 bp, Homo sapien
tgaatcatgtccagtaagagacaag

SEQ ID NO: 103418 - DNA, 25 bp, Homo sapien
tgaatcatgtccagtaggagacaag

SEQ ID NO: 103419 - DNA, 25 bp, Homo sapien
tgaatccaaaacaagactcaagcta

SEQ ID NO: 103420 - DNA, 25 bp, Homo sapien
tgaatccaaaactagactcaagcta

SEQ ID NO: 103421 - DNA, 25 bp, Homo sapien
tgaatccaagatcataaacccaagt

SEQ ID NO: 103422 - DNA, 25 bp, Homo sapien
tgaatccaagattataaacccaagt

SEQ ID NO: 103423 - DNA, 25 bp, Homo sapien
tgaatccacacaaagcaaagcattt

SEQ ID NO: 103424 - DNA, 25 bp, Homo sapien
tgaatccacacaaggcaaagcattt

SEQ ID NO: 103425 - DNA, 25 bp, Homo sapien
tgaatccagattctgaaacttttta

SEQ ID NO: 103426 - DNA, 25 bp, Homo sapien
tgaatccatattctgaaacttttta

SEQ ID NO: 103427 - DNA, 25 bp, Homo sapien
tgaatccgaataaagctgaataagc

SEQ ID NO: 103428 - DNA, 25 bp, Homo sapien
tgaatccgaatagagctgaataagc

SEQ ID NO: 103429 - DNA, 25 bp, Homo sapien
tgaatcctgtgttaccataaaggac

SEQ ID NO: 103430 - DNA, 25 bp, Homo sapien
tgaatcctgtgttaccgtaaaggac

SEQ ID NO: 103431 - DNA, 25 bp, Homo sapien
tgaatctaggcaatgatcatcagtg

SEQ ID NO: 103432 - DNA, 25 bp, Homo sapien
tgaatctaggcattgatcatcagtg

SEQ ID NO: 103433 - DNA, 25 bp, Homo sapien
tgaatctatttactccagaagcagt

SEQ ID NO: 103434 - DNA, 25 bp, Homo sapien
tgaatctatttacttcagaagcagt

SEQ ID NO: 103435 - DNA, 25 bp, Homo sapien
tgaatctcagctctgccacatacta

SEQ ID NO: 103436 - DNA, 25 bp, Homo sapien
tgaatctcagctttgccacatacta

SEQ ID NO: 103437 - DNA, 25 bp, Homo sapien
tgaatctcatgtaggaagaaattca

SEQ ID NO: 103438 - DNA, 25 bp, Homo sapien
tgaatctccaaacaatgatacattt

SEQ ID NO: 103439 - DNA, 25 bp, Homo sapien
tgaatctccaaacactgatacattt

SEQ ID NO: 103440 - DNA, 25 bp, Homo sapien
tgaatctccacacaataaaacattt

SEQ ID NO: 103441 - DNA, 25 bp, Homo sapien
tgaatctcctcttccttttcttata

SEQ ID NO: 103442 - DNA, 25 bp, Homo sapien
tgaatctcctcttctttttcttata

SEQ ID NO: 103443 - DNA, 25 bp, Homo sapien
tgaatctcgtgtaggaagaaattca

SEQ ID NO: 103444 - DNA, 25 bp, Homo sapien
tgaatctctacacaataaaacattt

SEQ ID NO: 103445 - DNA, 25 bp, Homo sapien
tgaatctcttcagtagctcatttac

SEQ ID NO: 103446 - DNA, 25 bp, Homo sapien
tgaatctcttcattagctcatttac

SEQ ID NO: 103447 - DNA, 25 bp, Homo sapien
tgaatctgagagtcacaaacccacc

SEQ ID NO: 103448 - DNA, 25 bp, Homo sapien
tgaatctgagagtcaccaacccacc

SEQ ID NO: 103449 - DNA, 25 bp, Homo sapien
tgaatcttactttaatttctccccc

SEQ ID NO: 103450 - DNA, 25 bp, Homo sapien
tgaatcttagtaaataaaggtcaat

SEQ ID NO: 103451 - DNA, 25 bp, Homo sapien
tgaatcttagtaagtaaaggtcaat

SEQ ID NO: 103452 - DNA, 25 bp, Homo sapien
tgaatcttatgactcttaacctctc

SEQ ID NO: 103453 - DNA, 25 bp, Homo sapien
tgaatcttatgagtcttaacctctc

SEQ ID NO: 103454 - DNA, 25 bp, Homo sapien
tgaatcttgaagtatgagtaagagt

SEQ ID NO: 103455 - DNA, 25 bp, Homo sapien
tgaatcttgaagtttgagtaagagt

SEQ ID NO: 103456 - DNA, 25 bp, Homo sapien
tgaatctttctttaatttctccccc

SEQ ID NO: 103457 - DNA, 25 bp, Homo sapien
tgaatcttttccctttttgctttta

SEQ ID NO: 103458 - DNA, 25 bp, Homo sapien
tgaatcttttctctttttgctttta

SEQ ID NO: 103459 - DNA, 25 bp, Homo sapien
tgaatgaactacggtgatggccaaa

SEQ ID NO: 103460 - DNA, 25 bp, Homo sapien
tgaatgaactagggtgatggccaaa

SEQ ID NO: 103461 - DNA, 25 bp, Homo sapien
tgaatgaattttcccgagggcagga

SEQ ID NO: 103462 - DNA, 25 bp, Homo sapien
tgaatgaattttcctgagggcagga

SEQ ID NO: 103463 - DNA, 25 bp, Homo sapien
tgaatgaccaggtacgctgtcaatg

SEQ ID NO: 103464 - DNA, 25 bp, Homo sapien
tgaatgaccaggtatgctgtcaatg

SEQ ID NO: 103465 - DNA, 25 bp, Homo sapien
tgaatgagaaagaatttttttgccc

SEQ ID NO: 103466 - DNA, 25 bp, Homo sapien
tgaatgagaaataatttttttgccc

SEQ ID NO: 103467 - DNA, 25 bp, Homo sapien
tgaatgagaagacggaatcagcagg

SEQ ID NO: 103468 - DNA, 25 bp, Homo sapien
tgaatgagaagacggactcagcagg

SEQ ID NO: 103469 - DNA, 25 bp, Homo sapien
tgaatgagcaaacataaaaaagaaa

SEQ ID NO: 103470 - DNA, 25 bp, Homo sapien
tgaatgagcaaagataaaaaagaaa

SEQ ID NO: 103471 - DNA, 25 bp, Homo sapien
tgaatgaggagacgaacaaggccta

SEQ ID NO: 103472 - DNA, 25 bp, Homo sapien
tgaatgaggagatgaacaaggccta

SEQ ID NO: 103473 - DNA, 25 bp, Homo sapien
tgaatgagttcaaggaaggccaaga

SEQ ID NO: 103474 - DNA, 25 bp, Homo sapien
tgaatgagttcaagtaaggccaaga

SEQ ID NO: 103475 - DNA, 25 bp, Homo sapien
tgaatgatgtgtgcttcacattgtg

SEQ ID NO: 103476 - DNA, 25 bp, Homo sapien
tgaatgatgtgtggttcacattgtg

SEQ ID NO: 103477 - DNA, 25 bp, Homo sapien
tgaatgattccggaaagttaacttg

SEQ ID NO: 103478 - DNA, 25 bp, Homo sapien
tgaatgattccgggaagttaacttg

SEQ ID NO: 103479 - DNA, 25 bp, Homo sapien
tgaatgatttctaagtaaacaacaa

SEQ ID NO: 103480 - DNA, 25 bp, Homo sapien
tgaatgatttctaggtaaacaacaa

SEQ ID NO: 103481 - DNA, 25 bp, Homo sapien
tgaatgctggcttagcctcttattt

SEQ ID NO: 103482 - DNA, 25 bp, Homo sapien
tgaatgctggcttagcttcttattt

SEQ ID NO: 103483 - DNA, 25 bp, Homo sapien
tgaatgcttttaacgacaccaaagt

SEQ ID NO: 103484 - DNA, 25 bp, Homo sapien
tgaatgcttttaatgacaccaaagt

SEQ ID NO: 103485 - DNA, 25 bp, Homo sapien
tgaatggaaaaaacaaactttgtta

SEQ ID NO: 103486 - DNA, 25 bp, Homo sapien
tgaatggaaaaaataaactttgtta

SEQ ID NO: 103487 - DNA, 25 bp, Homo sapien
tgaatggactacataacttgggtga

SEQ ID NO: 103488 - DNA, 25 bp, Homo sapien
tgaatggactatataacttgggtga

SEQ ID NO: 103489 - DNA, 25 bp, Homo sapien
tgaatggagtcatagagaagaaaga

SEQ ID NO: 103490 - DNA, 25 bp, Homo sapien
tgaatggagtcatagataagaaaga

SEQ ID NO: 103491 - DNA, 25 bp, Homo sapien
tgaatggagtccacggatgttgcta

SEQ ID NO: 103492 - DNA, 25 bp, Homo sapien
tgaatggagtccgcggatgttgcta

SEQ ID NO: 103493 - DNA, 25 bp, Homo sapien
tgaatggtcagaatcaatatcatgt

SEQ ID NO: 103494 - DNA, 25 bp, Homo sapien
tgaatggtcagaatgaatatcatgt

SEQ ID NO: 103495 - DNA, 25 bp, Homo sapien
tgaatgtcacaacggaaaaggtgga

SEQ ID NO: 103496 - DNA, 25 bp, Homo sapien
tgaatgtcacaagggaaaaggtgga

SEQ ID NO: 103497 - DNA, 25 bp, Homo sapien
tgaatgtcagagatagcagtacctt

SEQ ID NO: 103498 - DNA, 25 bp, Homo sapien
tgaatgtcagagatagtagtacctt

SEQ ID NO: 103499 - DNA, 25 bp, Homo sapien
tgaatgtccaaagtattcaatgtgt

SEQ ID NO: 103500 - DNA, 25 bp, Homo sapien
tgaatgtccgaagtattcaatgtgt

SEQ ID NO: 103501 - DNA, 25 bp, Homo sapien
tgaatgtgaatatgcaagtgagaga

SEQ ID NO: 103502 - DNA, 25 bp, Homo sapien
tgaatgtgactatgcaagtgagaga

SEQ ID NO: 103503 - DNA, 25 bp, Homo sapien
tgaatgtggtagcttctggaaactg

SEQ ID NO: 103504 - DNA, 25 bp, Homo sapien
tgaatgtgttagcttctggaaactg

SEQ ID NO: 103505 - DNA, 25 bp, Homo sapien
tgaatgttaaaaggtaagtgcttgg

SEQ ID NO: 103506 - DNA, 25 bp, Homo sapien
tgaatgttaaagggtaagtgcttgg

SEQ ID NO: 103507 - DNA, 25 bp, Homo sapien
tgaatgtttacaacacattttcaga

SEQ ID NO: 103508 - DNA, 25 bp, Homo sapien
tgaatgtttacgacacattttcaga

SEQ ID NO: 103509 - DNA, 25 bp, Homo sapien
tgaatgtttgcccaactttaagaat

SEQ ID NO: 103510 - DNA, 25 bp, Homo sapien
tgaatgtttgcccgactttaagaat

SEQ ID NO: 103511 - DNA, 25 bp, Homo sapien
tgaattaaatagcacacgtatgaag

SEQ ID NO: 103512 - DNA, 25 bp, Homo sapien
tgaattaaatagcacatgtatgaag

SEQ ID NO: 103513 - DNA, 25 bp, Homo sapien
tgaattaacttgctgatgtactgtt

SEQ ID NO: 103514 - DNA, 25 bp, Homo sapien
tgaattaacttgttgatgtactgtt

SEQ ID NO: 103515 - DNA, 25 bp, Homo sapien
tgaattaatagaaccatgactgaaa

SEQ ID NO: 103516 - DNA, 25 bp, Homo sapien
tgaattaatagatccatgactgaaa

SEQ ID NO: 103517 - DNA, 25 bp, Homo sapien
tgaattaccatatgtcccagcaatt

SEQ ID NO: 103518 - DNA, 25 bp, Homo sapien
tgaattaccgtatgtcccagcaatt

SEQ ID NO: 103519 - DNA, 25 bp, Homo sapien
tgaattagaaagtataagtgaagag

SEQ ID NO: 103520 - DNA, 25 bp, Homo sapien
tgaattagaaagtgtaagtgaagag

SEQ ID NO: 103521 - DNA, 25 bp, Homo sapien
tgaattaggagaacagtgtctaaga

SEQ ID NO: 103522 - DNA, 25 bp, Homo sapien
tgaattaggaggacagtgtctaaga

SEQ ID NO: 103523 - DNA, 25 bp, Homo sapien
tgaattatattggtctacatgtatg

SEQ ID NO: 103524 - DNA, 25 bp, Homo sapien
tgaattatctcaaccaaggagattg

SEQ ID NO: 103525 - DNA, 25 bp, Homo sapien
tgaattatctcgaccaaggagattg

SEQ ID NO: 103526 - DNA, 25 bp, Homo sapien
tgaattatgttggtctacatgtatg

SEQ ID NO: 103527 - DNA, 25 bp, Homo sapien
tgaattattacaggaaaaaaatagt

SEQ ID NO: 103528 - DNA, 25 bp, Homo sapien
tgaattattacgggaaaaaaatagt

SEQ ID NO: 103529 - DNA, 25 bp, Homo sapien
tgaattattgagagttgttcattgg

SEQ ID NO: 103530 - DNA, 25 bp, Homo sapien
tgaattattgagggttgttcattgg

SEQ ID NO: 103531 - DNA, 25 bp, Homo sapien
tgaattatttcaaaaactgcatttt

SEQ ID NO: 103532 - DNA, 25 bp, Homo sapien
tgaattatttcaacaactgcatttt

SEQ ID NO: 103533 - DNA, 25 bp, Homo sapien
tgaattcaaccacaatgaaggaatt

SEQ ID NO: 103534 - DNA, 25 bp, Homo sapien
tgaattcaaccacagtgaaggaatt

SEQ ID NO: 103535 - DNA, 25 bp, Homo sapien
tgaattccaacatgctcagagtgct

SEQ ID NO: 103536 - DNA, 25 bp, Homo sapien
tgaattccagcatgctcagagtgct

SEQ ID NO: 103537 - DNA, 25 bp, Homo sapien
tgaattctacaaacccttgttgtgg

SEQ ID NO: 103538 - DNA, 25 bp, Homo sapien
tgaattctacagacccttgttgtgg

SEQ ID NO: 103539 - DNA, 25 bp, Homo sapien
tgaattcttccaatatgttaaaagc

SEQ ID NO: 103540 - DNA, 25 bp, Homo sapien
tgaattcttcttcaggcaaatcagg

SEQ ID NO: 103541 - DNA, 25 bp, Homo sapien
tgaattcttgcaatatgttaaaagc

SEQ ID NO: 103542 - DNA, 25 bp, Homo sapien
tgaattctttttcaggcaaatcagg

SEQ ID NO: 103543 - DNA, 25 bp, Homo sapien
tgaattgaccattaccattaccatt

SEQ ID NO: 103544 - DNA, 25 bp, Homo sapien
tgaattgaccattaccgttaccatt

SEQ ID NO: 103545 - DNA, 25 bp, Homo sapien
tgaattgatttgaaggagtcagaca

SEQ ID NO: 103546 - DNA, 25 bp, Homo sapien
tgaattgatttgaaggcgtcagaca

SEQ ID NO: 103547 - DNA, 25 bp, Homo sapien
tgaattgcagtatttaacaagaata

SEQ ID NO: 103548 - DNA, 25 bp, Homo sapien
tgaattgcggtatttaacaagaata

SEQ ID NO: 103549 - DNA, 25 bp, Homo sapien
tgaattgcttctcggtctgtaaatc

SEQ ID NO: 103550 - DNA, 25 bp, Homo sapien
tgaattgcttcttggtctgtaaatc

SEQ ID NO: 103551 - DNA, 25 bp, Homo sapien
tgaattgtaagtacaagtgtcagcc

SEQ ID NO: 103552 - DNA, 25 bp, Homo sapien
tgaattgtaagtacgagtgtcagcc

SEQ ID NO: 103553 - DNA, 25 bp, Homo sapien
tgaattgtgcatcgtatggttggca

SEQ ID NO: 103554 - DNA, 25 bp, Homo sapien
tgaattgtgcattgtatggttggca

SEQ ID NO: 103555 - DNA, 25 bp, Homo sapien
tgaatttaatccatatgagcacggt

SEQ ID NO: 103556 - DNA, 25 bp, Homo sapien
tgaatttattccatatgagcacggt

SEQ ID NO: 103557 - DNA, 25 bp, Homo sapien
tgaatttattgcaacactgtgagtt

SEQ ID NO: 103558 - DNA, 25 bp, Homo sapien
tgaatttattgccacactgtgagtt

SEQ ID NO: 103559 - DNA, 25 bp, Homo sapien
tgaatttctcttcccgggtgcgatt

SEQ ID NO: 103560 - DNA, 25 bp, Homo sapien
tgaatttctcttcctgggtgcgatt

SEQ ID NO: 103561 - DNA, 25 bp, Homo sapien
tgaatttctttacttaatctcagaa

SEQ ID NO: 103562 - DNA, 25 bp, Homo sapien
tgaatttcttttcttaatctcagaa

SEQ ID NO: 103563 - DNA, 25 bp, Homo sapien
tgaatttgtccactttcactgatgt

SEQ ID NO: 103564 - DNA, 25 bp, Homo sapien
tgaatttgttcactttcactgatgt

SEQ ID NO: 103565 - DNA, 25 bp, Homo sapien
tgaattttacaaccagacatataat

SEQ ID NO: 103566 - DNA, 25 bp, Homo sapien
tgaattttagaaccagacatataat

SEQ ID NO: 103567 - DNA, 25 bp, Homo sapien
tgaattttatatatttctcacttac

SEQ ID NO: 103568 - DNA, 25 bp, Homo sapien
tgaattttatatatttgtcacttac

SEQ ID NO: 103569 - DNA, 25 bp, Homo sapien
tgaattttcaaacattatcaaaatg

SEQ ID NO: 103570 - DNA, 25 bp, Homo sapien
tgaattttcaaactttatcaaaatg

SEQ ID NO: 103571 - DNA, 25 bp, Homo sapien
tgaattttctcctttgtttcagtgg

SEQ ID NO: 103572 - DNA, 25 bp, Homo sapien
tgaattttctcttttgtttcagtgg

SEQ ID NO: 103573 - DNA, 25 bp, Homo sapien
tgaatttttctactgtggaattttt

SEQ ID NO: 103574 - DNA, 25 bp, Homo sapien
tgaatttttctcccgtaatgcataa

SEQ ID NO: 103575 - DNA, 25 bp, Homo sapien
tgaatttttctcctgtaatgcataa

SEQ ID NO: 103576 - DNA, 25 bp, Homo sapien
tgaatttttgtactgtggaattttt

SEQ ID NO: 103577 - DNA, 25 bp, Homo sapien
tgaatttttgtcaaatataggaaat

SEQ ID NO: 103578 - DNA, 25 bp, Homo sapien
tgaatttttgttaaatataggaaat

SEQ ID NO: 103579 - DNA, 25 bp, Homo sapien
tgacaaaaacttagccaatgtgaag

SEQ ID NO: 103580 - DNA, 25 bp, Homo sapien
tgacaaaaagtaaagcaagtgtgag

SEQ ID NO: 103581 - DNA, 25 bp, Homo sapien
tgacaaaaagtaaggcaagtgtgag

SEQ ID NO: 103582 - DNA, 25 bp, Homo sapien
tgacaaaaagtggcgacggtatgac

SEQ ID NO: 103583 - DNA, 25 bp, Homo sapien
tgacaaaaagtggcgatggtatgac

SEQ ID NO: 103584 - DNA, 25 bp, Homo sapien
tgacaaaaccttagccaatgtgaag

SEQ ID NO: 103585 - DNA, 25 bp, Homo sapien
tgacaaaacgcagaaggggtactct

SEQ ID NO: 103586 - DNA, 25 bp, Homo sapien
tgacaaaagaaattcatagtgacta

SEQ ID NO: 103587 - DNA, 25 bp, Homo sapien
tgacaaaagaatttcatagtgacta

SEQ ID NO: 103588 - DNA, 25 bp, Homo sapien
tgacaaaatgcagaaggggtactct

SEQ ID NO: 103589 - DNA, 25 bp, Homo sapien
tgacaaagaacaccattgtatgtgc

SEQ ID NO: 103590 - DNA, 25 bp, Homo sapien
tgacaaagaactccattgtatgtgc

SEQ ID NO: 103591 - DNA, 25 bp, Homo sapien
tgacaaagatcaatcactttctgca

SEQ ID NO: 103592 - DNA, 25 bp, Homo sapien
tgacaaaggtagcggtcagctgtgg

SEQ ID NO: 103593 - DNA, 25 bp, Homo sapien
tgacaaaggtagtggtcagctgtgg

SEQ ID NO: 103594 - DNA, 25 bp, Homo sapien
tgacaaaggtcaatcactttctgca

SEQ ID NO: 103595 - DNA, 25 bp, Homo sapien
tgacaaatatttaatgctgatacta

SEQ ID NO: 103596 - DNA, 25 bp, Homo sapien
tgacaaatcaaaattagtatttctt

SEQ ID NO: 103597 - DNA, 25 bp, Homo sapien
tgacaaatcatgaaaatatgagatt

SEQ ID NO: 103598 - DNA, 25 bp, Homo sapien
tgacaaatcatgagaatatgagatt

SEQ ID NO: 103599 - DNA, 25 bp, Homo sapien
tgacaaatccaaattagtatttctt

SEQ ID NO: 103600 - DNA, 25 bp, Homo sapien
tgacaaatctggtgagttctcaagg

SEQ ID NO: 103601 - DNA, 25 bp, Homo sapien
tgacaaatctggttagttctcaagg

SEQ ID NO: 103602 - DNA, 25 bp, Homo sapien
tgacaaatgtcctcatgcctaccta

SEQ ID NO: 103603 - DNA, 25 bp, Homo sapien
tgacaaatgtcctcgtgcctaccta

SEQ ID NO: 103604 - DNA, 25 bp, Homo sapien
tgacaaatgtttaatgctgatacta

SEQ ID NO: 103605 - DNA, 25 bp, Homo sapien
tgacaacaaaaatgaaatggttggt

SEQ ID NO: 103606 - DNA, 25 bp, Homo sapien
tgacaacaaataatttgatacgtaa

SEQ ID NO: 103607 - DNA, 25 bp, Homo sapien
tgacaacaaatagtttgatacgtaa

SEQ ID NO: 103608 - DNA, 25 bp, Homo sapien
tgacaacactcactcaatgggtcca

SEQ ID NO: 103609 - DNA, 25 bp, Homo sapien
tgacaacagaaatgaaatggttggt

SEQ ID NO: 103610 - DNA, 25 bp, Homo sapien
tgacaacattcactcaatgggtcca

SEQ ID NO: 103611 - DNA, 25 bp, Homo sapien
tgacaactctgtgtggctggctgcc

SEQ ID NO: 103612 - DNA, 25 bp, Homo sapien
tgacaactctgtgttgctggctgcc

SEQ ID NO: 103613 - DNA, 25 bp, Homo sapien
tgacaactgtaaatgtctttttacc

SEQ ID NO: 103614 - DNA, 25 bp, Homo sapien
tgacaactgtaattgtctttttacc

SEQ ID NO: 103615 - DNA, 25 bp, Homo sapien
tgacaagaaggaacaagatggttta

SEQ ID NO: 103616 - DNA, 25 bp, Homo sapien
tgacaagaccacaaactccctgtca

SEQ ID NO: 103617 - DNA, 25 bp, Homo sapien
tgacaagaccacagactccctgtca

SEQ ID NO: 103618 - DNA, 25 bp, Homo sapien
tgacaagagggaacaagatggttta

SEQ ID NO: 103619 - DNA, 25 bp, Homo sapien
tgacaaggataaacctatcataggt

SEQ ID NO: 103620 - DNA, 25 bp, Homo sapien
tgacaaggctaaacctatcataggt

SEQ ID NO: 103621 - DNA, 25 bp, Homo sapien
tgacaagggagcaaagatgggttcc

SEQ ID NO: 103622 - DNA, 25 bp, Homo sapien
tgacaagggagcgaagatgggttcc

SEQ ID NO: 103623 - DNA, 25 bp, Homo sapien
tgacaatactgacccagttgttaac

SEQ ID NO: 103624 - DNA, 25 bp, Homo sapien
tgacaatactgacgcagttgttaac

SEQ ID NO: 103625 - DNA, 25 bp, Homo sapien
tgacaatatgaagatttttaaggct

SEQ ID NO: 103626 - DNA, 25 bp, Homo sapien
tgacaatatgaggatttttaaggct

SEQ ID NO: 103627 - DNA, 25 bp, Homo sapien
tgacaatctaacgccactggtaagc

SEQ ID NO: 103628 - DNA, 25 bp, Homo sapien
tgacaatctaatgccactggtaagc

SEQ ID NO: 103629 - DNA, 25 bp, Homo sapien
tgacaatgaacagggtaagtataat

SEQ ID NO: 103630 - DNA, 25 bp, Homo sapien
tgacaatgaacatggtaagtataat

SEQ ID NO: 103631 - DNA, 25 bp, Homo sapien
tgacaattacaggcttatttttaga

SEQ ID NO: 103632 - DNA, 25 bp, Homo sapien
tgacaattacaggcttgtttttaga

SEQ ID NO: 103633 - DNA, 25 bp, Homo sapien
tgacaatttatcatatccatcatag

SEQ ID NO: 103634 - DNA, 25 bp, Homo sapien
tgacaatttattatatccatcatag

SEQ ID NO: 103635 - DNA, 25 bp, Homo sapien
tgacaatttggctgaacacaaaaca

SEQ ID NO: 103636 - DNA, 25 bp, Homo sapien
tgacaatttggctgaatacaaaaca

SEQ ID NO: 103637 - DNA, 25 bp, Homo sapien
tgacacaaatacatgtgcatatgtg

SEQ ID NO: 103638 - DNA, 25 bp, Homo sapien
tgacacaaatatatgtgcatatgtg

SEQ ID NO: 103639 - DNA, 25 bp, Homo sapien
tgacacaccaatgtggagttgaatt

SEQ ID NO: 103640 - DNA, 25 bp, Homo sapien
tgacacaccaatgtggggttgaatt

SEQ ID NO: 103641 - DNA, 25 bp, Homo sapien
tgacacagattctaaacccttcata

SEQ ID NO: 103642 - DNA, 25 bp, Homo sapien
tgacacagtttctaaacccttcata

SEQ ID NO: 103643 - DNA, 25 bp, Homo sapien
tgacacattacctacattacttata

SEQ ID NO: 103644 - DNA, 25 bp, Homo sapien
tgacacattacttacattacttata

SEQ ID NO: 103645 - DNA, 25 bp, Homo sapien
tgacaccaagaagtatgggaactcg

SEQ ID NO: 103646 - DNA, 25 bp, Homo sapien
tgacaccacggactagagtagctca

SEQ ID NO: 103647 - DNA, 25 bp, Homo sapien
tgacaccaggaagtatgggaactcg

SEQ ID NO: 103648 - DNA, 25 bp, Homo sapien
tgacaccatgcttctgagaagacag

SEQ ID NO: 103649 - DNA, 25 bp, Homo sapien
tgacaccatgcttttgagaagacag

SEQ ID NO: 103650 - DNA, 25 bp, Homo sapien
tgacaccatggactagagtagctca

SEQ ID NO: 103651 - DNA, 25 bp, Homo sapien
tgacaccgaaaatgagtgacaccga

SEQ ID NO: 103652 - DNA, 25 bp, Homo sapien
tgacaccgaaaattagtgacaccga

SEQ ID NO: 103653 - DNA, 25 bp, Homo sapien
tgacacctatatcatccagacaatt

SEQ ID NO: 103654 - DNA, 25 bp, Homo sapien
tgacacctatattatccagacaatt

SEQ ID NO: 103655 - DNA, 25 bp, Homo sapien
tgacacgcatgacgagtgagtgctc

SEQ ID NO: 103656 - DNA, 25 bp, Homo sapien
tgacacgcatgatgagtgagtgctc

SEQ ID NO: 103657 - DNA, 25 bp, Homo sapien
tgacactacgctctctgccatccca

SEQ ID NO: 103658 - DNA, 25 bp, Homo sapien
tgacactacgctctgtgccatccca

SEQ ID NO: 103659 - DNA, 25 bp, Homo sapien
tgacactcaagttttagcaaacaat

SEQ ID NO: 103660 - DNA, 25 bp, Homo sapien
tgacactcaggttttagcaaacaat

SEQ ID NO: 103661 - DNA, 25 bp, Homo sapien
tgacactcctgactgccgggaccgg

SEQ ID NO: 103662 - DNA, 25 bp, Homo sapien
tgacactcctgactgctgggaccgg

SEQ ID NO: 103663 - DNA, 25 bp, Homo sapien
tgacactcggtaaagcacagtaagg

SEQ ID NO: 103664 - DNA, 25 bp, Homo sapien
tgacactcggtgaagcacagtaagg

SEQ ID NO: 103665 - DNA, 25 bp, Homo sapien
tgacactctcaggacgctgcaagtt

SEQ ID NO: 103666 - DNA, 25 bp, Homo sapien
tgacactctcaggatgctgcaagtt

SEQ ID NO: 103667 - DNA, 25 bp, Homo sapien
tgacactgaaatcatatcttgctca

SEQ ID NO: 103668 - DNA, 25 bp, Homo sapien
tgacactgaaatgatatcttgctca

SEQ ID NO: 103669 - DNA, 25 bp, Homo sapien
tgacactgaaattggtaaagataca

SEQ ID NO: 103670 - DNA, 25 bp, Homo sapien
tgacactgaaattggtgaagataca

SEQ ID NO: 103671 - DNA, 25 bp, Homo sapien
tgacactgtttcgttccacacggta

SEQ ID NO: 103672 - DNA, 25 bp, Homo sapien
tgacactgtttggttccacacggta

SEQ ID NO: 103673 - DNA, 25 bp, Homo sapien
tgacacttactccatatggttgaat

SEQ ID NO: 103674 - DNA, 25 bp, Homo sapien
tgacacttactgcatatggttgaat

SEQ ID NO: 103675 - DNA, 25 bp, Homo sapien
tgacacttctgacaccagctgtgta

SEQ ID NO: 103676 - DNA, 25 bp, Homo sapien
tgacacttgttccggctctaatctg

SEQ ID NO: 103677 - DNA, 25 bp, Homo sapien
tgacacttgttctggctctaatctg

SEQ ID NO: 103678 - DNA, 25 bp, Homo sapien
tgacacttttgacaccagctgtgta

SEQ ID NO: 103679 - DNA, 25 bp, Homo sapien
tgacagaaaccataaataggaaaag

SEQ ID NO: 103680 - DNA, 25 bp, Homo sapien
tgacagaaaccatgaataggaaaag

SEQ ID NO: 103681 - DNA, 25 bp, Homo sapien
tgacagaagggatgtatatgtaatt

SEQ ID NO: 103682 - DNA, 25 bp, Homo sapien
tgacagaagggttgtatatgtaatt

SEQ ID NO: 103683 - DNA, 25 bp, Homo sapien
tgacagaatcgggtatgtgagactt

SEQ ID NO: 103684 - DNA, 25 bp, Homo sapien
tgacagaattgggtatgtgagactt

SEQ ID NO: 103685 - DNA, 25 bp, Homo sapien
tgacagacaatgtataaaccatttg

SEQ ID NO: 103686 - DNA, 25 bp, Homo sapien
tgacagacaatgtatagaccatttg

SEQ ID NO: 103687 - DNA, 25 bp, Homo sapien
tgacagacttccaaaacatcccctg

SEQ ID NO: 103688 - DNA, 25 bp, Homo sapien
tgacagacttccaaaagatcccctg

SEQ ID NO: 103689 - DNA, 25 bp, Homo sapien
tgacagacttggtcattaaggttat

SEQ ID NO: 103690 - DNA, 25 bp, Homo sapien
tgacagacttggtcgttaaggttat

SEQ ID NO: 103691 - DNA, 25 bp, Homo sapien
tgacagagctaatcacagggtgtca

SEQ ID NO: 103692 - DNA, 25 bp, Homo sapien
tgacagagttaatcacagggtgtca

SEQ ID NO: 103693 - DNA, 25 bp, Homo sapien
tgacagataatccactgctgtgttt

SEQ ID NO: 103694 - DNA, 25 bp, Homo sapien
tgacagataatccgctgctgtgttt

SEQ ID NO: 103695 - DNA, 25 bp, Homo sapien
tgacagatcattctctaacccttta

SEQ ID NO: 103696 - DNA, 25 bp, Homo sapien
tgacagatcgttctctaacccttta

SEQ ID NO: 103697 - DNA, 25 bp, Homo sapien
tgacagatcttaaagtggctgagca

SEQ ID NO: 103698 - DNA, 25 bp, Homo sapien
tgacagatcttcaagtggctgagca

SEQ ID NO: 103699 - DNA, 25 bp, Homo sapien
tgacagcaagctctaatcacacata

SEQ ID NO: 103700 - DNA, 25 bp, Homo sapien
tgacagcaatctctaatcacacata

SEQ ID NO: 103701 - DNA, 25 bp, Homo sapien
tgacagccagtgcggtggatttcat

SEQ ID NO: 103702 - DNA, 25 bp, Homo sapien
tgacagccagtgtggtggatttcat

SEQ ID NO: 103703 - DNA, 25 bp, Homo sapien
tgacagcccagacaggtcatggaaa

SEQ ID NO: 103704 - DNA, 25 bp, Homo sapien
tgacagcccagagaggtcatggaaa

SEQ ID NO: 103705 - DNA, 25 bp, Homo sapien
tgacagccctagtaagcgtggattc

SEQ ID NO: 103706 - DNA, 25 bp, Homo sapien
tgacagccctagtaagtgtggattc

SEQ ID NO: 103707 - DNA, 25 bp, Homo sapien
tgacagcttgcttactgactcatag

SEQ ID NO: 103708 - DNA, 25 bp, Homo sapien
tgacagcttgcttgctgactcatag

SEQ ID NO: 103709 - DNA, 25 bp, Homo sapien
tgacaggctgcatccctttttggag

SEQ ID NO: 103710 - DNA, 25 bp, Homo sapien
tgacaggctgcattcctttttggag

SEQ ID NO: 103711 - DNA, 25 bp, Homo sapien
tgacagtattagacagaccatcaag

SEQ ID NO: 103712 - DNA, 25 bp, Homo sapien
tgacagtattagatagaccatcaag

SEQ ID NO: 103713 - DNA, 25 bp, Homo sapien
tgacagtgacctagtaacatccaaa

SEQ ID NO: 103714 - DNA, 25 bp, Homo sapien
tgacagtgacctggtaacatccaaa

SEQ ID NO: 103715 - DNA, 25 bp, Homo sapien
tgacagtgttcgacgagaccaaaat

SEQ ID NO: 103716 - DNA, 25 bp, Homo sapien
tgacagtgttcgatgagaccaaaat

SEQ ID NO: 103717 - DNA, 25 bp, Homo sapien
tgacagttggcacagtggaaacaaa

SEQ ID NO: 103718 - DNA, 25 bp, Homo sapien
tgacagttggctcagtggaaacaaa

SEQ ID NO: 103719 - DNA, 25 bp, Homo sapien
tgacataatatatcactcataacag

SEQ ID NO: 103720 - DNA, 25 bp, Homo sapien
tgacataatctcattgcaatattgt

SEQ ID NO: 103721 - DNA, 25 bp, Homo sapien
tgacataatctccttgcaatattgt

SEQ ID NO: 103722 - DNA, 25 bp, Homo sapien
tgacataatgtatcactcataacag

SEQ ID NO: 103723 - DNA, 25 bp, Homo sapien
tgacatagaagaatgacgagagaaa

SEQ ID NO: 103724 - DNA, 25 bp, Homo sapien
tgacatagaagaatgatgagagaaa

SEQ ID NO: 103725 - DNA, 25 bp, Homo sapien
tgacatcaagacctaaggtaattta

SEQ ID NO: 103726 - DNA, 25 bp, Homo sapien
tgacatcaagagctaaggtaattta

SEQ ID NO: 103727 - DNA, 25 bp, Homo sapien
tgacatcaagccactaaaattactc

SEQ ID NO: 103728 - DNA, 25 bp, Homo sapien
tgacatcaagctactaaaattactc

SEQ ID NO: 103729 - DNA, 25 bp, Homo sapien
tgacatcactccctcctggttttct

SEQ ID NO: 103730 - DNA, 25 bp, Homo sapien
tgacatcactccttcctggttttct

SEQ ID NO: 103731 - DNA, 25 bp, Homo sapien
tgacatccttgcgaagtatttgtcc

SEQ ID NO: 103732 - DNA, 25 bp, Homo sapien
tgacatccttgtgaagtatttgtcc

SEQ ID NO: 103733 - DNA, 25 bp, Homo sapien
tgacatctatacacacaaagagtat

SEQ ID NO: 103734 - DNA, 25 bp, Homo sapien
tgacatctatatacacaaagagtat

SEQ ID NO: 103735 - DNA, 25 bp, Homo sapien
tgacatctattcattactataaagt

SEQ ID NO: 103736 - DNA, 25 bp, Homo sapien
tgacatctattcattattataaagt

SEQ ID NO: 103737 - DNA, 25 bp, Homo sapien
tgacatgcctggtgccgcacttgct

SEQ ID NO: 103738 - DNA, 25 bp, Homo sapien
tgacatgcctggtgcctcacttgct

SEQ ID NO: 103739 - DNA, 25 bp, Homo sapien
tgacatggataaatctcaaaatgat

SEQ ID NO: 103740 - DNA, 25 bp, Homo sapien
tgacatggcaaggacatcttggtca

SEQ ID NO: 103741 - DNA, 25 bp, Homo sapien
tgacatggcaaggatatcttggtca

SEQ ID NO: 103742 - DNA, 25 bp, Homo sapien
tgacatggtcttccttccggaacat

SEQ ID NO: 103743 - DNA, 25 bp, Homo sapien
tgacatggtcttctttccggaacat

SEQ ID NO: 103744 - DNA, 25 bp, Homo sapien
tgacatggttaaatctcaaaatgat

SEQ ID NO: 103745 - DNA, 25 bp, Homo sapien
tgacatgtccatcacacgatttatt

SEQ ID NO: 103746 - DNA, 25 bp, Homo sapien
tgacatgtccatcccacgatttatt

SEQ ID NO: 103747 - DNA, 25 bp, Homo sapien
tgacatgtggtcaccagctgttgga

SEQ ID NO: 103748 - DNA, 25 bp, Homo sapien
tgacatgtggtcacgagctgttgga

SEQ ID NO: 103749 - DNA, 25 bp, Homo sapien
tgacatgtttcattttagtaacctt

SEQ ID NO: 103750 - DNA, 25 bp, Homo sapien
tgacatgtttcattttggtaacctt

SEQ ID NO: 103751 - DNA, 25 bp, Homo sapien
tgacattaactgcccagtgatgtca

SEQ ID NO: 103752 - DNA, 25 bp, Homo sapien
tgacattaactgcccattgatgtca

SEQ ID NO: 103753 - DNA, 25 bp, Homo sapien
tgacattaatccattcatgaagaca

SEQ ID NO: 103754 - DNA, 25 bp, Homo sapien
tgacattagtccattcatgaagaca

SEQ ID NO: 103755 - DNA, 25 bp, Homo sapien
tgacattccaggaaaagcaaactgc

SEQ ID NO: 103756 - DNA, 25 bp, Homo sapien
tgacattccaggcaaagcaaactgc

SEQ ID NO: 103757 - DNA, 25 bp, Homo sapien
tgacatttgaagaaactaggctggc

SEQ ID NO: 103758 - DNA, 25 bp, Homo sapien
tgacattttaagaaactaggctggc

SEQ ID NO: 103759 - DNA, 25 bp, Homo sapien
tgacattttccactatgtactccaa

SEQ ID NO: 103760 - DNA, 25 bp, Homo sapien
tgacattttccattatgtactccaa

SEQ ID NO: 103761 - DNA, 25 bp, Homo sapien
tgaccaaaggcaaactttagaaatt

SEQ ID NO: 103762 - DNA, 25 bp, Homo sapien
tgaccaaaggcagactttagaaatt

SEQ ID NO: 103763 - DNA, 25 bp, Homo sapien
tgaccaacgctagacaaacatagct

SEQ ID NO: 103764 - DNA, 25 bp, Homo sapien
tgaccaacgctggacaaacatagct

SEQ ID NO: 103765 - DNA, 25 bp, Homo sapien
tgaccaagatgaacactttgaggag

SEQ ID NO: 103766 - DNA, 25 bp, Homo sapien
tgaccaaggtgaacactttgaggag

SEQ ID NO: 103767 - DNA, 25 bp, Homo sapien
tgaccacaacacgccatcttttcat

SEQ ID NO: 103768 - DNA, 25 bp, Homo sapien
tgaccacaacacgtcatcttttcat

SEQ ID NO: 103769 - DNA, 25 bp, Homo sapien
tgaccacaatgcagtctgttacgac

SEQ ID NO: 103770 - DNA, 25 bp, Homo sapien
tgaccacagcctggcacaggagtta

SEQ ID NO: 103771 - DNA, 25 bp, Homo sapien
tgaccacaggctggcacaggagtta

SEQ ID NO: 103772 - DNA, 25 bp, Homo sapien
tgaccacagtgcagtctgttacgac

SEQ ID NO: 103773 - DNA, 25 bp, Homo sapien
tgaccacatacttaaccataaagca

SEQ ID NO: 103774 - DNA, 25 bp, Homo sapien
tgaccacatgcttaaccataaagca

SEQ ID NO: 103775 - DNA, 25 bp, Homo sapien
tgaccaggctttccacattttctac

SEQ ID NO: 103776 - DNA, 25 bp, Homo sapien
tgaccaggctttccgcattttctac

SEQ ID NO: 103777 - DNA, 25 bp, Homo sapien
tgaccagttaagccagaggacgacc

SEQ ID NO: 103778 - DNA, 25 bp, Homo sapien
tgaccagttaagccagtggacgacc

SEQ ID NO: 103779 - DNA, 25 bp, Homo sapien
tgaccagttcttcctaagtctttca

SEQ ID NO: 103780 - DNA, 25 bp, Homo sapien
tgaccagttctttctaagtctttca

SEQ ID NO: 103781 - DNA, 25 bp, Homo sapien
tgaccatacatttaaaaacaaaatg

SEQ ID NO: 103782 - DNA, 25 bp, Homo sapien
tgaccatacgtttaaaaacaaaatg

SEQ ID NO: 103783 - DNA, 25 bp, Homo sapien
tgaccatcataccgtggtttgactt

SEQ ID NO: 103784 - DNA, 25 bp, Homo sapien
tgaccatcatactgtggtttgactt

SEQ ID NO: 103785 - DNA, 25 bp, Homo sapien
tgaccatctattgcacagattattg

SEQ ID NO: 103786 - DNA, 25 bp, Homo sapien
tgaccatctattgcacggattattg

SEQ ID NO: 103787 - DNA, 25 bp, Homo sapien
tgaccatgaagtgggttcacataac

SEQ ID NO: 103788 - DNA, 25 bp, Homo sapien
tgaccatgaggtgggttcacataac

SEQ ID NO: 103789 - DNA, 25 bp, Homo sapien
tgaccatggagtatacaagagtcaa

SEQ ID NO: 103790 - DNA, 25 bp, Homo sapien
tgaccatggagtatacgagagtcaa

SEQ ID NO: 103791 - DNA, 25 bp, Homo sapien
tgaccatggctctttgatatctttg

SEQ ID NO: 103792 - DNA, 25 bp, Homo sapien
tgaccatggttctttgatatctttg

SEQ ID NO: 103793 - DNA, 25 bp, Homo sapien
tgaccattaccattaccattaccct

SEQ ID NO: 103794 - DNA, 25 bp, Homo sapien
tgaccattaccgttaccattaccct

SEQ ID NO: 103795 - DNA, 25 bp, Homo sapien
tgaccattcgacacaggtgtggatt

SEQ ID NO: 103796 - DNA, 25 bp, Homo sapien
tgaccattcgacataggtgtggatt

SEQ ID NO: 103797 - DNA, 25 bp, Homo sapien
tgaccatttctggaaattcatagaa

SEQ ID NO: 103798 - DNA, 25 bp, Homo sapien
tgaccatttctgtaaattcatagaa

SEQ ID NO: 103799 - DNA, 25 bp, Homo sapien
tgacccaaaaggtagactggacact

SEQ ID NO: 103800 - DNA, 25 bp, Homo sapien
tgacccaagaggtagactggacact

SEQ ID NO: 103801 - DNA, 25 bp, Homo sapien
tgacccagagaccagaggcacaaac

SEQ ID NO: 103802 - DNA, 25 bp, Homo sapien
tgacccagcgaccagaggcacaaac

SEQ ID NO: 103803 - DNA, 25 bp, Homo sapien
tgacccatctcaacatgtttgtttc

SEQ ID NO: 103804 - DNA, 25 bp, Homo sapien
tgacccatctctacatgtttgtttc

SEQ ID NO: 103805 - DNA, 25 bp, Homo sapien
tgacccattgatagatcgaagccta

SEQ ID NO: 103806 - DNA, 25 bp, Homo sapien
tgacccattgatagattgaagccta

SEQ ID NO: 103807 - DNA, 25 bp, Homo sapien
tgaccctgacgcaaagattcatgtg

SEQ ID NO: 103808 - DNA, 25 bp, Homo sapien
tgaccctgatgcaaagattcatgtg

SEQ ID NO: 103809 - DNA, 25 bp, Homo sapien
tgaccctgcctctcttatattctta

SEQ ID NO: 103810 - DNA, 25 bp, Homo sapien
tgaccctgcctctgacccttttaga

SEQ ID NO: 103811 - DNA, 25 bp, Homo sapien
tgaccctgcctgtcttatattctta

SEQ ID NO: 103812 - DNA, 25 bp, Homo sapien
tgaccctgcttctgacccttttaga

SEQ ID NO: 103813 - DNA, 25 bp, Homo sapien
tgaccgccgatgccggtcttccaaa

SEQ ID NO: 103814 - DNA, 25 bp, Homo sapien
tgaccgccgatgctggtcttccaaa

SEQ ID NO: 103815 - DNA, 25 bp, Homo sapien
tgaccgcttgttcactttatgtgtc

SEQ ID NO: 103816 - DNA, 25 bp, Homo sapien
tgaccgcttgtttactttatgtgtc

SEQ ID NO: 103817 - DNA, 25 bp, Homo sapien
tgaccgtgcatccactcaccttatc

SEQ ID NO: 103818 - DNA, 25 bp, Homo sapien
tgaccgtgcatcgactcaccttatc

SEQ ID NO: 103819 - DNA, 25 bp, Homo sapien
tgacctaagttaacagacattcaca

SEQ ID NO: 103820 - DNA, 25 bp, Homo sapien
tgacctaagttaacaggcattcaca

SEQ ID NO: 103821 - DNA, 25 bp, Homo sapien
tgacctaatcatctattaaaggccc

SEQ ID NO: 103822 - DNA, 25 bp, Homo sapien
tgacctaatcatctcttaaaggccc

SEQ ID NO: 103823 - DNA, 25 bp, Homo sapien
tgacctacactggagtcctgaatcc

SEQ ID NO: 103824 - DNA, 25 bp, Homo sapien
tgacctacattggagtcctgaatcc

SEQ ID NO: 103825 - DNA, 25 bp, Homo sapien
tgacctactaactgcgtagctttag

SEQ ID NO: 103826 - DNA, 25 bp, Homo sapien
tgacctactaactgtgtagctttag

SEQ ID NO: 103827 - DNA, 25 bp, Homo sapien
tgacctatagcatgtccttgaggat

SEQ ID NO: 103828 - DNA, 25 bp, Homo sapien
tgacctatggcatgtccttgaggat

SEQ ID NO: 103829 - DNA, 25 bp, Homo sapien
tgacctcacattgtcctccttggtt

SEQ ID NO: 103830 - DNA, 25 bp, Homo sapien
tgacctcacattgttctccttggtt

SEQ ID NO: 103831 - DNA, 25 bp, Homo sapien
tgacctcatcacgcatttcttagag

SEQ ID NO: 103832 - DNA, 25 bp, Homo sapien
tgacctcatcatgcatttcttagag

SEQ ID NO: 103833 - DNA, 25 bp, Homo sapien
tgacctccataatcataagataata

SEQ ID NO: 103834 - DNA, 25 bp, Homo sapien
tgacctccataatcgtaagataata

SEQ ID NO: 103835 - DNA, 25 bp, Homo sapien
tgacctctgaggaactgaatgccag

SEQ ID NO: 103836 - DNA, 25 bp, Homo sapien
tgacctctgaggaattgaatgccag

SEQ ID NO: 103837 - DNA, 25 bp, Homo sapien
tgacctcttctattcacgcacttca

SEQ ID NO: 103838 - DNA, 25 bp, Homo sapien
tgacctcttctattcatgcacttca

SEQ ID NO: 103839 - DNA, 25 bp, Homo sapien
tgacctggaaagaacccactgctta

SEQ ID NO: 103840 - DNA, 25 bp, Homo sapien
tgacctggaaagaacctactgctta

SEQ ID NO: 103841 - DNA, 25 bp, Homo sapien
tgacctggaagcgctcatgcagcca

SEQ ID NO: 103842 - DNA, 25 bp, Homo sapien
tgacctggaagcgctcgtgcagcca

SEQ ID NO: 103843 - DNA, 25 bp, Homo sapien
tgaccttaagtgagttgctcacctt

SEQ ID NO: 103844 - DNA, 25 bp, Homo sapien
tgaccttaattgagttgctcacctt

SEQ ID NO: 103845 - DNA, 25 bp, Homo sapien
tgaccttcagctcccagttcctgag

SEQ ID NO: 103846 - DNA, 25 bp, Homo sapien
tgaccttcagcttccagttcctgag

SEQ ID NO: 103847 - DNA, 25 bp, Homo sapien
tgaccttcatgagaagctattacag

SEQ ID NO: 103848 - DNA, 25 bp, Homo sapien
tgaccttcatgataagctattacag

SEQ ID NO: 103849 - DNA, 25 bp, Homo sapien
tgaccttctaattcctttctttagc

SEQ ID NO: 103850 - DNA, 25 bp, Homo sapien
tgaccttctcattcctttctttagc

SEQ ID NO: 103851 - DNA, 25 bp, Homo sapien
tgaccttgagaaaataaatcttcat

SEQ ID NO: 103852 - DNA, 25 bp, Homo sapien
tgaccttgagaaattaaatcttcat

SEQ ID NO: 103853 - DNA, 25 bp, Homo sapien
tgaccttgagattgccagtgagttc

SEQ ID NO: 103854 - DNA, 25 bp, Homo sapien
tgaccttgcgattgccagtgagttc

SEQ ID NO: 103855 - DNA, 25 bp, Homo sapien
tgacctttggaaagtgatgtcttga

SEQ ID NO: 103856 - DNA, 25 bp, Homo sapien
tgacctttggaaagtggtgtcttga

SEQ ID NO: 103857 - DNA, 25 bp, Homo sapien
tgaccttttaatggatagattacac

SEQ ID NO: 103858 - DNA, 25 bp, Homo sapien
tgaccttttaatggatggattacac

SEQ ID NO: 103859 - DNA, 25 bp, Homo sapien
tgaccttttggaacacaaacccatt

SEQ ID NO: 103860 - DNA, 25 bp, Homo sapien
tgaccttttggaatacaaacccatt

SEQ ID NO: 103861 - DNA, 25 bp, Homo sapien
tgacgaatacttgggttactcccag

SEQ ID NO: 103862 - DNA, 25 bp, Homo sapien
tgacgaatacttggtttactcccag

SEQ ID NO: 103863 - DNA, 25 bp, Homo sapien
tgacgagctcactaagaagggtctg

SEQ ID NO: 103864 - DNA, 25 bp, Homo sapien
tgacgagctcattaagaagggtctg

SEQ ID NO: 103865 - DNA, 25 bp, Homo sapien
tgacgaggttctccacagctgcctg

SEQ ID NO: 103866 - DNA, 25 bp, Homo sapien
tgacgaggttctccacggctgcctg

SEQ ID NO: 103867 - DNA, 25 bp, Homo sapien
tgacgagtgaatggctcaattctca

SEQ ID NO: 103868 - DNA, 25 bp, Homo sapien
tgacgagtgcatggctcaattctca

SEQ ID NO: 103869 - DNA, 25 bp, Homo sapien
tgacgagttacagaaggtagaacct

SEQ ID NO: 103870 - DNA, 25 bp, Homo sapien
tgacgagttacggaaggtagaacct

SEQ ID NO: 103871 - DNA, 25 bp, Homo sapien
tgacgcctctgctttccttccagat

SEQ ID NO: 103872 - DNA, 25 bp, Homo sapien
tgacgcctgtgctttccttccagat

SEQ ID NO: 103873 - DNA, 25 bp, Homo sapien
tgacggcacaaatttccttgtcttg

SEQ ID NO: 103874 - DNA, 25 bp, Homo sapien
tgacggcaccaatttccttgtcttg

SEQ ID NO: 103875 - DNA, 25 bp, Homo sapien
tgacgggagtgaacaaataagagaa

SEQ ID NO: 103876 - DNA, 25 bp, Homo sapien
tgacgggagtgaacaagtaagagaa

SEQ ID NO: 103877 - DNA, 25 bp, Homo sapien
tgacggtagaaaaattataatgtct

SEQ ID NO: 103878 - DNA, 25 bp, Homo sapien
tgacggtaggaaaattataatgtct

SEQ ID NO: 103879 - DNA, 25 bp, Homo sapien
tgacggtccactctttacttggaat

SEQ ID NO: 103880 - DNA, 25 bp, Homo sapien
tgacggtccactgtttacttggaat

SEQ ID NO: 103881 - DNA, 25 bp, Homo sapien
tgacgtcactggctacaggctacag

SEQ ID NO: 103882 - DNA, 25 bp, Homo sapien
tgacgtcattggctacaggctacag

SEQ ID NO: 103883 - DNA, 25 bp, Homo sapien
tgacgtgatgacccatatgcaaatg

SEQ ID NO: 103884 - DNA, 25 bp, Homo sapien
tgacgtgatgacccctatgcaaatg

SEQ ID NO: 103885 - DNA, 25 bp, Homo sapien
tgacgtgtcattgtgggttcatcag

SEQ ID NO: 103886 - DNA, 25 bp, Homo sapien
tgacgtgtccttgtgggttcatcag

SEQ ID NO: 103887 - DNA, 25 bp, Homo sapien
tgacgtttgctcagtcttatttcat

SEQ ID NO: 103888 - DNA, 25 bp, Homo sapien
tgacgtttgctcggtcttatttcat

SEQ ID NO: 103889 - DNA, 25 bp, Homo sapien
tgactaaaaaaatgcacatccccta

SEQ ID NO: 103890 - DNA, 25 bp, Homo sapien
tgactaaaacaatgcacatccccta

SEQ ID NO: 103891 - DNA, 25 bp, Homo sapien
tgactaaaacaattgcatttaaatg

SEQ ID NO: 103892 - DNA, 25 bp, Homo sapien
tgactaaaacacttgcatttaaatg

SEQ ID NO: 103893 - DNA, 25 bp, Homo sapien
tgactaaactgggcatcttgagttt

SEQ ID NO: 103894 - DNA, 25 bp, Homo sapien
tgactaaactgggcattttgagttt

SEQ ID NO: 103895 - DNA, 25 bp, Homo sapien
tgactaaatgacagaacataaatga

SEQ ID NO: 103896 - DNA, 25 bp, Homo sapien
tgactaaatgagagaacataaatga

SEQ ID NO: 103897 - DNA, 25 bp, Homo sapien
tgactaagatgatacccaagttgca

SEQ ID NO: 103898 - DNA, 25 bp, Homo sapien
tgactaagatggtacccaagttgca

SEQ ID NO: 103899 - DNA, 25 bp, Homo sapien
tgactaatagccgtataaaggagtt

SEQ ID NO: 103900 - DNA, 25 bp, Homo sapien
tgactaatagccgtatgaaggagtt

SEQ ID NO: 103901 - DNA, 25 bp, Homo sapien
tgactacagaagatcactccctgcc

SEQ ID NO: 103902 - DNA, 25 bp, Homo sapien
tgactacataagatcactccctgcc

SEQ ID NO: 103903 - DNA, 25 bp, Homo sapien
tgactaccacatctataattcttgc

SEQ ID NO: 103904 - DNA, 25 bp, Homo sapien
tgactacctcatctataattcttgc

SEQ ID NO: 103905 - DNA, 25 bp, Homo sapien
tgactacgaacaaaaggagaacaga

SEQ ID NO: 103906 - DNA, 25 bp, Homo sapien
tgactacgaacgaaaggagaacaga

SEQ ID NO: 103907 - DNA, 25 bp, Homo sapien
tgactactaaaatcagccttttttc

SEQ ID NO: 103908 - DNA, 25 bp, Homo sapien
tgactactaaaatcaggcttttttc

SEQ ID NO: 103909 - DNA, 25 bp, Homo sapien
tgactactaatgcagctaaatgttt

SEQ ID NO: 103910 - DNA, 25 bp, Homo sapien
tgactactgatgcagctaaatgttt

SEQ ID NO: 103911 - DNA, 25 bp, Homo sapien
tgactactttgacgtttctcaaaca

SEQ ID NO: 103912 - DNA, 25 bp, Homo sapien
tgactactttgaggtttctcaaaca

SEQ ID NO: 103913 - DNA, 25 bp, Homo sapien
tgactatcagtaatttacacccccc

SEQ ID NO: 103914 - DNA, 25 bp, Homo sapien
tgactatcggtaatttacacccccc

SEQ ID NO: 103915 - DNA, 25 bp, Homo sapien
tgactatgggaagacttctgcattg

SEQ ID NO: 103916 - DNA, 25 bp, Homo sapien
tgactatgggaagccttctgcattg

SEQ ID NO: 103917 - DNA, 25 bp, Homo sapien
tgactcaaaagcgcactgtcacaat

SEQ ID NO: 103918 - DNA, 25 bp, Homo sapien
tgactcaaaggcgcactgtcacaat

SEQ ID NO: 103919 - DNA, 25 bp, Homo sapien
tgactcaaatgtcaatttcctctgg

SEQ ID NO: 103920 - DNA, 25 bp, Homo sapien
tgactcaaatgtcagtttcctctgg

SEQ ID NO: 103921 - DNA, 25 bp, Homo sapien
tgactcaataacatgaacaacattt

SEQ ID NO: 103922 - DNA, 25 bp, Homo sapien
tgactcaatcacatgaacaacattt

SEQ ID NO: 103923 - DNA, 25 bp, Homo sapien
tgactcatacagtgagaaagtgatt

SEQ ID NO: 103924 - DNA, 25 bp, Homo sapien
tgactcatatagtgagaaagtgatt

SEQ ID NO: 103925 - DNA, 25 bp, Homo sapien
tgactcatgatgtaaaattggaatg

SEQ ID NO: 103926 - DNA, 25 bp, Homo sapien
tgactcatgctgtaaaattggaatg

SEQ ID NO: 103927 - DNA, 25 bp, Homo sapien
tgactcattatgcctcgaatttttt

SEQ ID NO: 103928 - DNA, 25 bp, Homo sapien
tgactcattatgcttcgaatttttt

SEQ ID NO: 103929 - DNA, 25 bp, Homo sapien
tgactccaaatataagtctaaccaa

SEQ ID NO: 103930 - DNA, 25 bp, Homo sapien
tgactccaattataagtctaaccaa

SEQ ID NO: 103931 - DNA, 25 bp, Homo sapien
tgactcccaatctcattatctttcc

SEQ ID NO: 103932 - DNA, 25 bp, Homo sapien
tgactcccaatctcgttatctttcc

SEQ ID NO: 103933 - DNA, 25 bp, Homo sapien
tgactccgactgcagtgcggacaat

SEQ ID NO: 103934 - DNA, 25 bp, Homo sapien
tgactccgactgcggtgcggacaat

SEQ ID NO: 103935 - DNA, 25 bp, Homo sapien
tgactctatttggggtgttatcttt

SEQ ID NO: 103936 - DNA, 25 bp, Homo sapien
tgactctatttgggttgttatcttt

SEQ ID NO: 103937 - DNA, 25 bp, Homo sapien
tgactctcacgtacacacctatcag

SEQ ID NO: 103938 - DNA, 25 bp, Homo sapien
tgactctcatgtacacacctatcag

SEQ ID NO: 103939 - DNA, 25 bp, Homo sapien
tgactctcattgcgtgaattcaagt

SEQ ID NO: 103940 - DNA, 25 bp, Homo sapien
tgactctcattgtgtgaattcaagt

SEQ ID NO: 103941 - DNA, 25 bp, Homo sapien
tgactctctaaatctgtttgggatt

SEQ ID NO: 103942 - DNA, 25 bp, Homo sapien
tgactctctaaatttgtttgggatt

SEQ ID NO: 103943 - DNA, 25 bp, Homo sapien
tgactctgaagccagggccggcggg

SEQ ID NO: 103944 - DNA, 25 bp, Homo sapien
tgactctgaagccggggccggcggg

SEQ ID NO: 103945 - DNA, 25 bp, Homo sapien
tgactctgacaggtacttaaaacca

SEQ ID NO: 103946 - DNA, 25 bp, Homo sapien
tgactctgacaggtccttaaaacca

SEQ ID NO: 103947 - DNA, 25 bp, Homo sapien
tgactctgctcctcctcactgttgc

SEQ ID NO: 103948 - DNA, 25 bp, Homo sapien
tgactctgctccttctcactgttgc

SEQ ID NO: 103949 - DNA, 25 bp, Homo sapien
tgactcttagaaccataataatgct

SEQ ID NO: 103950 - DNA, 25 bp, Homo sapien
tgactcttagaaccgtaataatgct

SEQ ID NO: 103951 - DNA, 25 bp, Homo sapien
tgactcttccacattctatgggaca

SEQ ID NO: 103952 - DNA, 25 bp, Homo sapien
tgactcttctaaactaaattaacaa

SEQ ID NO: 103953 - DNA, 25 bp, Homo sapien
tgactcttctacattctatgggaca

SEQ ID NO: 103954 - DNA, 25 bp, Homo sapien
tgactcttctatactaaattaacaa

SEQ ID NO: 103955 - DNA, 25 bp, Homo sapien
tgactgaaatgaacctttctaaact

SEQ ID NO: 103956 - DNA, 25 bp, Homo sapien
tgactgaaatgaatctttctaaact

SEQ ID NO: 103957 - DNA, 25 bp, Homo sapien
tgactgaacggtactgtgaaacact

SEQ ID NO: 103958 - DNA, 25 bp, Homo sapien
tgactgaagagaatgttggaaaatc

SEQ ID NO: 103959 - DNA, 25 bp, Homo sapien
tgactgaagagattgttggaaaatc

SEQ ID NO: 103960 - DNA, 25 bp, Homo sapien
tgactgaatcatagggtagttctta

SEQ ID NO: 103961 - DNA, 25 bp, Homo sapien
tgactgaatcatggggtagttctta

SEQ ID NO: 103962 - DNA, 25 bp, Homo sapien
tgactgaatggtactgtgaaacact

SEQ ID NO: 103963 - DNA, 25 bp, Homo sapien
tgactgacatcattaaaaaattagc

SEQ ID NO: 103964 - DNA, 25 bp, Homo sapien
tgactgacatcattgaaaaattagc

SEQ ID NO: 103965 - DNA, 25 bp, Homo sapien
tgactgagaaatgatccttggacta

SEQ ID NO: 103966 - DNA, 25 bp, Homo sapien
tgactgagaaattatccttggacta

SEQ ID NO: 103967 - DNA, 25 bp, Homo sapien
tgactgagaccattcactttccttt

SEQ ID NO: 103968 - DNA, 25 bp, Homo sapien
tgactgagaccattcattttccttt

SEQ ID NO: 103969 - DNA, 25 bp, Homo sapien
tgactgagataataaatctatgccc

SEQ ID NO: 103970 - DNA, 25 bp, Homo sapien
tgactgagataatgaatctatgccc

SEQ ID NO: 103971 - DNA, 25 bp, Homo sapien
tgactgagatgtcaaaatcccatct

SEQ ID NO: 103972 - DNA, 25 bp, Homo sapien
tgactgagatgtcagaatcccatct

SEQ ID NO: 103973 - DNA, 25 bp, Homo sapien
tgactgagtctcgctccaaggctag

SEQ ID NO: 103974 - DNA, 25 bp, Homo sapien
tgactgagtcttgctccaaggctag

SEQ ID NO: 103975 - DNA, 25 bp, Homo sapien
tgactgcaaacatactaatggagag

SEQ ID NO: 103976 - DNA, 25 bp, Homo sapien
tgactgcaaacctactaatggagag

SEQ ID NO: 103977 - DNA, 25 bp, Homo sapien
tgactgcaaactccaccactaacta

SEQ ID NO: 103978 - DNA, 25 bp, Homo sapien
tgactgcaaactctaccactaacta

SEQ ID NO: 103979 - DNA, 25 bp, Homo sapien
tgactgcacagatcaaaagtgtcga

SEQ ID NO: 103980 - DNA, 25 bp, Homo sapien
tgactgcacagatcgaaagtgtcga

SEQ ID NO: 103981 - DNA, 25 bp, Homo sapien
tgactgcagtttacacttttctctg

SEQ ID NO: 103982 - DNA, 25 bp, Homo sapien
tgactgcagtttatacttttctctg

SEQ ID NO: 103983 - DNA, 25 bp, Homo sapien
tgactgctcacctttaccctacctg

SEQ ID NO: 103984 - DNA, 25 bp, Homo sapien
tgactgctcacttttaccctacctg

SEQ ID NO: 103985 - DNA, 25 bp, Homo sapien
tgactgctggtgcatatggtaagtg

SEQ ID NO: 103986 - DNA, 25 bp, Homo sapien
tgactgctggtgcgtatggtaagtg

SEQ ID NO: 103987 - DNA, 25 bp, Homo sapien
tgactgcttgcttcaactattaata

SEQ ID NO: 103988 - DNA, 25 bp, Homo sapien
tgactgcttgctttaactattaata

SEQ ID NO: 103989 - DNA, 25 bp, Homo sapien
tgactggaacgcttttggccgacat

SEQ ID NO: 103990 - DNA, 25 bp, Homo sapien
tgactggaacgtttttggccgacat

SEQ ID NO: 103991 - DNA, 25 bp, Homo sapien
tgactggcccagtacagccgatgga

SEQ ID NO: 103992 - DNA, 25 bp, Homo sapien
tgactggcccagtatagccgatgga

SEQ ID NO: 103993 - DNA, 25 bp, Homo sapien
tgactggtctgagattttcttgtga

SEQ ID NO: 103994 - DNA, 25 bp, Homo sapien
tgactggtgtgagattttcttgtga

SEQ ID NO: 103995 - DNA, 25 bp, Homo sapien
tgactgtatctggattatgtgatat

SEQ ID NO: 103996 - DNA, 25 bp, Homo sapien
tgactgtatctgtattatgtgatat

SEQ ID NO: 103997 - DNA, 25 bp, Homo sapien
tgactgtctgcccctccataaattg

SEQ ID NO: 103998 - DNA, 25 bp, Homo sapien
tgactgtctgcccctctataaattg

SEQ ID NO: 103999 - DNA, 25 bp, Homo sapien
tgactgtgctaaaactagagcctat

SEQ ID NO: 104000 - DNA, 25 bp, Homo sapien
tgactgtgctaacactagagcctat

SEQ ID NO: 104001 - DNA, 25 bp, Homo sapien
tgacttaaaaacctcacacatctca

SEQ ID NO: 104002 - DNA, 25 bp, Homo sapien
tgacttaaaaacctcatacatctca

SEQ ID NO: 104003 - DNA, 25 bp, Homo sapien
tgacttaaaatataccattcatcag

SEQ ID NO: 104004 - DNA, 25 bp, Homo sapien
tgacttaaaatgtaccattcatcag

SEQ ID NO: 104005 - DNA, 25 bp, Homo sapien
tgacttaaatgacacccttgttatt

SEQ ID NO: 104006 - DNA, 25 bp, Homo sapien
tgacttaaatgtcacccttgttatt

SEQ ID NO: 104007 - DNA, 25 bp, Homo sapien
tgacttaagtacacttgctttacag

SEQ ID NO: 104008 - DNA, 25 bp, Homo sapien
tgacttaagtacatttgctttacag

SEQ ID NO: 104009 - DNA, 25 bp, Homo sapien
tgacttacctaggtgattttattta

SEQ ID NO: 104010 - DNA, 25 bp, Homo sapien
tgacttacttaggtgattttattta

SEQ ID NO: 104011 - DNA, 25 bp, Homo sapien
tgacttataaaacatatagcaaaca

SEQ ID NO: 104012 - DNA, 25 bp, Homo sapien
tgacttataaaacgtatagcaaaca

SEQ ID NO: 104013 - DNA, 25 bp, Homo sapien
tgacttatcttaaacagcatctact

SEQ ID NO: 104014 - DNA, 25 bp, Homo sapien
tgacttatcttagacagcatctact

SEQ ID NO: 104015 - DNA, 25 bp, Homo sapien
tgacttcagatacagaaatctttgt

SEQ ID NO: 104016 - DNA, 25 bp, Homo sapien
tgacttcaggtacaaagcatcaatg

SEQ ID NO: 104017 - DNA, 25 bp, Homo sapien
tgacttcaggtacagaaatctttgt

SEQ ID NO: 104018 - DNA, 25 bp, Homo sapien
tgacttcaggtgcaaagcatcaatg

SEQ ID NO: 104019 - DNA, 25 bp, Homo sapien
tgacttcctcgaagccagtgtttct

SEQ ID NO: 104020 - DNA, 25 bp, Homo sapien
tgacttcctgaatattgcaaggtct

SEQ ID NO: 104021 - DNA, 25 bp, Homo sapien
tgacttcctgaatcttgcaaggtct

SEQ ID NO: 104022 - DNA, 25 bp, Homo sapien
tgacttcctggcagatgtatcctaa

SEQ ID NO: 104023 - DNA, 25 bp, Homo sapien
tgacttcctggcagatttatcctaa

SEQ ID NO: 104024 - DNA, 25 bp, Homo sapien
tgacttccttgaagccagtgtttct

SEQ ID NO: 104025 - DNA, 25 bp, Homo sapien
tgacttctcttagggagcacacttg

SEQ ID NO: 104026 - DNA, 25 bp, Homo sapien
tgacttctcttatggagcacacttg

SEQ ID NO: 104027 - DNA, 25 bp, Homo sapien
tgacttgaatacttctgagcatcta

SEQ ID NO: 104028 - DNA, 25 bp, Homo sapien
tgacttgagtacttctgagcatcta

SEQ ID NO: 104029 - DNA, 25 bp, Homo sapien
tgacttgagtggatataacctgtga

SEQ ID NO: 104030 - DNA, 25 bp, Homo sapien
tgacttgagtggatgtaacctgtga

SEQ ID NO: 104031 - DNA, 25 bp, Homo sapien
tgacttgccattggcagataaaaaa

SEQ ID NO: 104032 - DNA, 25 bp, Homo sapien
tgacttgccattggtagataaaaaa

SEQ ID NO: 104033 - DNA, 25 bp, Homo sapien
tgacttggaaagaactgattacctg

SEQ ID NO: 104034 - DNA, 25 bp, Homo sapien
tgacttggaaagaattgattacctg

SEQ ID NO: 104035 - DNA, 25 bp, Homo sapien
tgacttggatactattaaaagcatt

SEQ ID NO: 104036 - DNA, 25 bp, Homo sapien
tgacttggatactgttaaaagcatt

SEQ ID NO: 104037 - DNA, 25 bp, Homo sapien
tgacttggatggactacatcaccaa

SEQ ID NO: 104038 - DNA, 25 bp, Homo sapien
tgacttggatggcctacatcaccaa

SEQ ID NO: 104039 - DNA, 25 bp, Homo sapien
tgacttgttcttttacttttttaaa

SEQ ID NO: 104040 - DNA, 25 bp, Homo sapien
tgacttgttctttttcttttttaaa

SEQ ID NO: 104041 - DNA, 25 bp, Homo sapien
tgactttaactggtcgatctcaaaa

SEQ ID NO: 104042 - DNA, 25 bp, Homo sapien
tgactttaagatcgcataatgcatc

SEQ ID NO: 104043 - DNA, 25 bp, Homo sapien
tgactttaagattgcataatgcatc

SEQ ID NO: 104044 - DNA, 25 bp, Homo sapien
tgactttacctggtcgatctcaaaa

SEQ ID NO: 104045 - DNA, 25 bp, Homo sapien
tgactttatagaggcaaaagagtga

SEQ ID NO: 104046 - DNA, 25 bp, Homo sapien
tgactttatggaggcaaaagagtga

SEQ ID NO: 104047 - DNA, 25 bp, Homo sapien
tgactttcaaactagggtgaggcta

SEQ ID NO: 104048 - DNA, 25 bp, Homo sapien
tgactttcatactagggtgaggcta

SEQ ID NO: 104049 - DNA, 25 bp, Homo sapien
tgactttccaaaattcatctcaaat

SEQ ID NO: 104050 - DNA, 25 bp, Homo sapien
tgactttccaaaattcgtctcaaat

SEQ ID NO: 104051 - DNA, 25 bp, Homo sapien
tgactttccacccgtttttcccttc

SEQ ID NO: 104052 - DNA, 25 bp, Homo sapien
tgactttccacccttttttcccttc

SEQ ID NO: 104053 - DNA, 25 bp, Homo sapien
tgactttctagcagtagcatagtaa

SEQ ID NO: 104054 - DNA, 25 bp, Homo sapien
tgactttctagtagtagcatagtaa

SEQ ID NO: 104055 - DNA, 25 bp, Homo sapien
tgactttctcatggcggaaggcacg

SEQ ID NO: 104056 - DNA, 25 bp, Homo sapien
tgactttctcatggtggaaggcacg

SEQ ID NO: 104057 - DNA, 25 bp, Homo sapien
tgactttgaagacccattagtaata

SEQ ID NO: 104058 - DNA, 25 bp, Homo sapien
tgactttgaagactcattagtaata

SEQ ID NO: 104059 - DNA, 25 bp, Homo sapien
tgactttgctcacagtgggcttttt

SEQ ID NO: 104060 - DNA, 25 bp, Homo sapien
tgactttgggcaagtttactccgag

SEQ ID NO: 104061 - DNA, 25 bp, Homo sapien
tgactttgggcaggtttactccgag

SEQ ID NO: 104062 - DNA, 25 bp, Homo sapien
tgactttgggttccttattaatgtc

SEQ ID NO: 104063 - DNA, 25 bp, Homo sapien
tgactttggtcacagtgggcttttt

SEQ ID NO: 104064 - DNA, 25 bp, Homo sapien
tgactttgtgttccttattaatgtc

SEQ ID NO: 104065 - DNA, 25 bp, Homo sapien
tgacttttataactaacttactgac

SEQ ID NO: 104066 - DNA, 25 bp, Homo sapien
tgacttttataactaatttactgac

SEQ ID NO: 104067 - DNA, 25 bp, Homo sapien
tgacttttggcaggtcacatgtgct

SEQ ID NO: 104068 - DNA, 25 bp, Homo sapien
tgacttttggccggtcacatgtgct

SEQ ID NO: 104069 - DNA, 25 bp, Homo sapien
tgagaaaacgaaggcataaaaagag

SEQ ID NO: 104070 - DNA, 25 bp, Homo sapien
tgagaaaatgaaggcataaaaagag

SEQ ID NO: 104071 - DNA, 25 bp, Homo sapien
tgagaaaatggcaataaaaagaaga

SEQ ID NO: 104072 - DNA, 25 bp, Homo sapien
tgagaaaatggcgataaaaagaaga

SEQ ID NO: 104073 - DNA, 25 bp, Homo sapien
tgagaaaatgtaggccttttaattc

SEQ ID NO: 104074 - DNA, 25 bp, Homo sapien
tgagaaaatgtagggcttttaattc

SEQ ID NO: 104075 - DNA, 25 bp, Homo sapien
tgagaaacctaggccattatacagg

SEQ ID NO: 104076 - DNA, 25 bp, Homo sapien
tgagaaacttaggccattatacagg

SEQ ID NO: 104077 - DNA, 25 bp, Homo sapien
tgagaaagcctgtcaatcctgctgt

SEQ ID NO: 104078 - DNA, 25 bp, Homo sapien
tgagaaagcttgtcaatcctgctgt

SEQ ID NO: 104079 - DNA, 25 bp, Homo sapien
tgagaaaggaaactagcaggagatg

SEQ ID NO: 104080 - DNA, 25 bp, Homo sapien
tgagaaaggaaactggcaggagatg

SEQ ID NO: 104081 - DNA, 25 bp, Homo sapien
tgagaaagtcaggcttcagctcaga

SEQ ID NO: 104082 - DNA, 25 bp, Homo sapien
tgagaaagtcatgcttcagctcaga

SEQ ID NO: 104083 - DNA, 25 bp, Homo sapien
tgagaaagttcacataactgcaaag

SEQ ID NO: 104084 - DNA, 25 bp, Homo sapien
tgagaaagttcatataactgcaaag

SEQ ID NO: 104085 - DNA, 25 bp, Homo sapien
tgagaaataaatcggagctgcttgt

SEQ ID NO: 104086 - DNA, 25 bp, Homo sapien
tgagaaataccaaagtcctcaaagc

SEQ ID NO: 104087 - DNA, 25 bp, Homo sapien
tgagaaataccaaggtcctcaaagc

SEQ ID NO: 104088 - DNA, 25 bp, Homo sapien
tgagaaatagcaacaaagatttcta

SEQ ID NO: 104089 - DNA, 25 bp, Homo sapien
tgagaaatagcagcaaagatttcta

SEQ ID NO: 104090 - DNA, 25 bp, Homo sapien
tgagaaatcaatcggagctgcttgt

SEQ ID NO: 104091 - DNA, 25 bp, Homo sapien
tgagaaatctacgctgccgcttaca

SEQ ID NO: 104092 - DNA, 25 bp, Homo sapien
tgagaaatctactctgccgcttaca

SEQ ID NO: 104093 - DNA, 25 bp, Homo sapien
tgagaaatgaggtcaccaagtgatg

SEQ ID NO: 104094 - DNA, 25 bp, Homo sapien
tgagaaatgaggtcgccaagtgatg

SEQ ID NO: 104095 - DNA, 25 bp, Homo sapien
tgagaacatgtggtatttagcgtgt

SEQ ID NO: 104096 - DNA, 25 bp, Homo sapien
tgagaacatgtgttatttagcgtgt

SEQ ID NO: 104097 - DNA, 25 bp, Homo sapien
tgagaaccacaaactgagtggctca

SEQ ID NO: 104098 - DNA, 25 bp, Homo sapien
tgagaaccactggtttgtttgtttg

SEQ ID NO: 104099 - DNA, 25 bp, Homo sapien
tgagaaccataaactgagtggctca

SEQ ID NO: 104100 - DNA, 25 bp, Homo sapien
tgagaaccctaaagcttaatgaatt

SEQ ID NO: 104101 - DNA, 25 bp, Homo sapien
tgagaaccctacagcttaatgaatt

SEQ ID NO: 104102 - DNA, 25 bp, Homo sapien
tgagaaccgctggtttgtttgtttg

SEQ ID NO: 104103 - DNA, 25 bp, Homo sapien
tgagaacctctactctaggagaaaa

SEQ ID NO: 104104 - DNA, 25 bp, Homo sapien
tgagaacctctgctctaggagaaaa

SEQ ID NO: 104105 - DNA, 25 bp, Homo sapien
tgagaactccaagtagaagcaggca

SEQ ID NO: 104106 - DNA, 25 bp, Homo sapien
tgagaactccagaagagcctatcat

SEQ ID NO: 104107 - DNA, 25 bp, Homo sapien
tgagaactccaggtagaagcaggca

SEQ ID NO: 104108 - DNA, 25 bp, Homo sapien
tgagaactgaacctgctcttgctga

SEQ ID NO: 104109 - DNA, 25 bp, Homo sapien
tgagaactgaatctgctcttgctga

SEQ ID NO: 104110 - DNA, 25 bp, Homo sapien
tgagaactgccataaccagaaaaga

SEQ ID NO: 104111 - DNA, 25 bp, Homo sapien
tgagaactgccgtaaccagaaaaga

SEQ ID NO: 104112 - DNA, 25 bp, Homo sapien
tgagaacttcagaagagcctatcat

SEQ ID NO: 104113 - DNA, 25 bp, Homo sapien
tgagaagaaccttacagtagccaac

SEQ ID NO: 104114 - DNA, 25 bp, Homo sapien
tgagaagacacagcaggggatgcct

SEQ ID NO: 104115 - DNA, 25 bp, Homo sapien
tgagaagacccttacagtagccaac

SEQ ID NO: 104116 - DNA, 25 bp, Homo sapien
tgagaagacgcagcaggggatgcct

SEQ ID NO: 104117 - DNA, 25 bp, Homo sapien
tgagaagacggaatcagcaggtatt

SEQ ID NO: 104118 - DNA, 25 bp, Homo sapien
tgagaagacggactcagcaggtatt

SEQ ID NO: 104119 - DNA, 25 bp, Homo sapien
tgagaagagacgcattggtaattgt

SEQ ID NO: 104120 - DNA, 25 bp, Homo sapien
tgagaagagacgcgttggtaattgt

SEQ ID NO: 104121 - DNA, 25 bp, Homo sapien
tgagaagagaggcaggaagacttac

SEQ ID NO: 104122 - DNA, 25 bp, Homo sapien
tgagaagagaggcagggagacttac

SEQ ID NO: 104123 - DNA, 25 bp, Homo sapien
tgagaagagcccagaggatagcgac

SEQ ID NO: 104124 - DNA, 25 bp, Homo sapien
tgagaagagcccagagtatagcgac

SEQ ID NO: 104125 - DNA, 25 bp, Homo sapien
tgagaagcaaaaccacgtcttacat

SEQ ID NO: 104126 - DNA, 25 bp, Homo sapien
tgagaagcaaaatcacgtcttacat

SEQ ID NO: 104127 - DNA, 25 bp, Homo sapien
tgagaagcatgagaaaagctaggaa

SEQ ID NO: 104128 - DNA, 25 bp, Homo sapien
tgagaagcatgggaaaagctaggaa

SEQ ID NO: 104129 - DNA, 25 bp, Homo sapien
tgagaagcattcggctgattctccc

SEQ ID NO: 104130 - DNA, 25 bp, Homo sapien
tgagaagcatttggctgattctccc

SEQ ID NO: 104131 - DNA, 25 bp, Homo sapien
tgagaagtaagaaaatgacagagtt

SEQ ID NO: 104132 - DNA, 25 bp, Homo sapien
tgagaagtaagaagatgacagagtt

SEQ ID NO: 104133 - DNA, 25 bp, Homo sapien
tgagaagtgcaaggatcaaaggctc

SEQ ID NO: 104134 - DNA, 25 bp, Homo sapien
tgagaagtgcaagggtcaaaggctc

SEQ ID NO: 104135 - DNA, 25 bp, Homo sapien
tgagaagttctgcctgtggaggagt

SEQ ID NO: 104136 - DNA, 25 bp, Homo sapien
tgagaagttttgcctgtggaggagt

SEQ ID NO: 104137 - DNA, 25 bp, Homo sapien
tgagaataattatcacaaaaatgcc

SEQ ID NO: 104138 - DNA, 25 bp, Homo sapien
tgagaataattatgacaaaaatgcc

SEQ ID NO: 104139 - DNA, 25 bp, Homo sapien
tgagaatgaaaacagagataagcat

SEQ ID NO: 104140 - DNA, 25 bp, Homo sapien
tgagaatgaaagcagagataagcat

SEQ ID NO: 104141 - DNA, 25 bp, Homo sapien
tgagaatggatgtcgagtttatccc

SEQ ID NO: 104142 - DNA, 25 bp, Homo sapien
tgagaatggatgttgagtttatccc

SEQ ID NO: 104143 - DNA, 25 bp, Homo sapien
tgagacaaatttaagtattagttgg

SEQ ID NO: 104144 - DNA, 25 bp, Homo sapien
tgagacaaatttacgtattagttgg

SEQ ID NO: 104145 - DNA, 25 bp, Homo sapien
tgagacactcgagattcggggatgg

SEQ ID NO: 104146 - DNA, 25 bp, Homo sapien
tgagacactcgggattcggggatgg

SEQ ID NO: 104147 - DNA, 25 bp, Homo sapien
tgagacagaaagagagaatgggaat

SEQ ID NO: 104148 - DNA, 25 bp, Homo sapien
tgagacaggtgcatatctgattgcc

SEQ ID NO: 104149 - DNA, 25 bp, Homo sapien
tgagacaggtgcgtatctgattgcc

SEQ ID NO: 104150 - DNA, 25 bp, Homo sapien
tgagacagtaagagagaatgggaat

SEQ ID NO: 104151 - DNA, 25 bp, Homo sapien
tgagaccattcactttcctttaatt

SEQ ID NO: 104152 - DNA, 25 bp, Homo sapien
tgagaccattcattttcctttaatt

SEQ ID NO: 104153 - DNA, 25 bp, Homo sapien
tgagaccctttgtcaccctatgatc

SEQ ID NO: 104154 - DNA, 25 bp, Homo sapien
tgagaccctttttcaccctatgatc

SEQ ID NO: 104155 - DNA, 25 bp, Homo sapien
tgagaccgagtggtgccgcggctct

SEQ ID NO: 104156 - DNA, 25 bp, Homo sapien
tgagaccgagtggtgctgcggctct

SEQ ID NO: 104157 - DNA, 25 bp, Homo sapien
tgagacctctgtattataacttgaa

SEQ ID NO: 104158 - DNA, 25 bp, Homo sapien
tgagacctttgtattataacttgaa

SEQ ID NO: 104159 - DNA, 25 bp, Homo sapien
tgagacgatcattcagattgaggta

SEQ ID NO: 104160 - DNA, 25 bp, Homo sapien
tgagacgatcattcaggttgaggta

SEQ ID NO: 104161 - DNA, 25 bp, Homo sapien
tgagactagaatcaattaactccag

SEQ ID NO: 104162 - DNA, 25 bp, Homo sapien
tgagactagaatgaattaactccag

SEQ ID NO: 104163 - DNA, 25 bp, Homo sapien
tgagactagctgatacagttaagcc

SEQ ID NO: 104164 - DNA, 25 bp, Homo sapien
tgagactagctggtacagttaagcc

SEQ ID NO: 104165 - DNA, 25 bp, Homo sapien
tgagactctcagaactagtttattc

SEQ ID NO: 104166 - DNA, 25 bp, Homo sapien
tgagactctcagaactggtttattc

SEQ ID NO: 104167 - DNA, 25 bp, Homo sapien
tgagactgaaaataatcatcatctc

SEQ ID NO: 104168 - DNA, 25 bp, Homo sapien
tgagactgaaaatagtcatcatctc

SEQ ID NO: 104169 - DNA, 25 bp, Homo sapien
tgagactgaggccacaaagttaact

SEQ ID NO: 104170 - DNA, 25 bp, Homo sapien
tgagactgaggccagaaagttaact

SEQ ID NO: 104171 - DNA, 25 bp, Homo sapien
tgagactggttactcctccgtgcac

SEQ ID NO: 104172 - DNA, 25 bp, Homo sapien
tgagactggttattcctccgtgcac

SEQ ID NO: 104173 - DNA, 25 bp, Homo sapien
tgagacttaggcgagccaggcaata

SEQ ID NO: 104174 - DNA, 25 bp, Homo sapien
tgagactttggcgagccaggcaata

SEQ ID NO: 104175 - DNA, 25 bp, Homo sapien
tgagagaagacacactctttggata

SEQ ID NO: 104176 - DNA, 25 bp, Homo sapien
tgagagaagacacgctctttggata

SEQ ID NO: 104177 - DNA, 25 bp, Homo sapien
tgagagagcaaacgttcaatattct

SEQ ID NO: 104178 - DNA, 25 bp, Homo sapien
tgagagagcaaatgttcaatattct

SEQ ID NO: 104179 - DNA, 25 bp, Homo sapien
tgagagatcattaagcatcactctt

SEQ ID NO: 104180 - DNA, 25 bp, Homo sapien
tgagagattattaagcatcactctt

SEQ ID NO: 104181 - DNA, 25 bp, Homo sapien
tgagagcacccaaatgttatattgt

SEQ ID NO: 104182 - DNA, 25 bp, Homo sapien
tgagagcacccaagtgttatattgt

SEQ ID NO: 104183 - DNA, 25 bp, Homo sapien
tgagagcagattcattttcagacca

SEQ ID NO: 104184 - DNA, 25 bp, Homo sapien
tgagagcagattcgttttcagacca

SEQ ID NO: 104185 - DNA, 25 bp, Homo sapien
tgagagcccaataactgtgaataaa

SEQ ID NO: 104186 - DNA, 25 bp, Homo sapien
tgagagcccgataactgtgaataaa

SEQ ID NO: 104187 - DNA, 25 bp, Homo sapien
tgagagcccggagaagtatctccta

SEQ ID NO: 104188 - DNA, 25 bp, Homo sapien
tgagagcctggagaagtatctccta

SEQ ID NO: 104189 - DNA, 25 bp, Homo sapien
tgagagctacaggcatcctttcagc

SEQ ID NO: 104190 - DNA, 25 bp, Homo sapien
tgagagctagaggcatcctttcagc

SEQ ID NO: 104191 - DNA, 25 bp, Homo sapien
tgagagctgatgttatcaacaacgt

SEQ ID NO: 104192 - DNA, 25 bp, Homo sapien
tgagagctgatgttattaacaacgt

SEQ ID NO: 104193 - DNA, 25 bp, Homo sapien
tgagagctgcttcagaactgtgtgt

SEQ ID NO: 104194 - DNA, 25 bp, Homo sapien
tgagagctgcttgagaactgtgtgt

SEQ ID NO: 104195 - DNA, 25 bp, Homo sapien
tgagaggaaaagcagactactgcaa

SEQ ID NO: 104196 - DNA, 25 bp, Homo sapien
tgagaggaaaagcagagtactgcaa

SEQ ID NO: 104197 - DNA, 25 bp, Homo sapien
tgagaggccctctgaatactctatg

SEQ ID NO: 104198 - DNA, 25 bp, Homo sapien
tgagaggctctctgaatactctatg

SEQ ID NO: 104199 - DNA, 25 bp, Homo sapien
tgagagggcttacctgcttaggcac

SEQ ID NO: 104200 - DNA, 25 bp, Homo sapien
tgagagggcttacctggttaggcac

SEQ ID NO: 104201 - DNA, 25 bp, Homo sapien
tgagaggtcatccttgtttctggca

SEQ ID NO: 104202 - DNA, 25 bp, Homo sapien
tgagaggtcgtccttgtttctggca

SEQ ID NO: 104203 - DNA, 25 bp, Homo sapien
tgagaggtcttgaggatatctagaa

SEQ ID NO: 104204 - DNA, 25 bp, Homo sapien
tgagaggtcttgcggatatctagaa

SEQ ID NO: 104205 - DNA, 25 bp, Homo sapien
tgagagtaaagatactaaccagcca

SEQ ID NO: 104206 - DNA, 25 bp, Homo sapien
tgagagtaaagatgctaaccagcca

SEQ ID NO: 104207 - DNA, 25 bp, Homo sapien
tgagagtaagaaaaaagtaggaatt

SEQ ID NO: 104208 - DNA, 25 bp, Homo sapien
tgagagtaagaagaaagtaggaatt

SEQ ID NO: 104209 - DNA, 25 bp, Homo sapien
tgagagtggaagattattttggagt

SEQ ID NO: 104210 - DNA, 25 bp, Homo sapien
tgagagtgggagattattttggagt

SEQ ID NO: 104211 - DNA, 25 bp, Homo sapien
tgagagtgtgctccagtaaatttcc

SEQ ID NO: 104212 - DNA, 25 bp, Homo sapien
tgagagtgtgctccggtaaatttcc

SEQ ID NO: 104213 - DNA, 25 bp, Homo sapien
tgagagttattacagagctgtgaac

SEQ ID NO: 104214 - DNA, 25 bp, Homo sapien
tgagagttattacggagctgtgaac

SEQ ID NO: 104215 - DNA, 25 bp, Homo sapien
tgagataagccacgagtgcagtgcc

SEQ ID NO: 104216 - DNA, 25 bp, Homo sapien
tgagataagccatgagtgcagtgcc

SEQ ID NO: 104217 - DNA, 25 bp, Homo sapien
tgagataatcctcataaatccctaa

SEQ ID NO: 104218 - DNA, 25 bp, Homo sapien
tgagataatcctcgtaaatccctaa

SEQ ID NO: 104219 - DNA, 25 bp, Homo sapien
tgagatatacactgttttgcctttg

SEQ ID NO: 104220 - DNA, 25 bp, Homo sapien
tgagatatatataagatagcatcaa

SEQ ID NO: 104221 - DNA, 25 bp, Homo sapien
tgagatatatatacgatagcatcaa

SEQ ID NO: 104222 - DNA, 25 bp, Homo sapien
tgagatattcactgttttgcctttg

SEQ ID NO: 104223 - DNA, 25 bp, Homo sapien
tgagatcaaaaacataaaagaagca

SEQ ID NO: 104224 - DNA, 25 bp, Homo sapien
tgagatcaacgctttatttatcttc

SEQ ID NO: 104225 - DNA, 25 bp, Homo sapien
tgagatcaatgctttatttatcttc

SEQ ID NO: 104226 - DNA, 25 bp, Homo sapien
tgagatcacgcaattatcaataaca

SEQ ID NO: 104227 - DNA, 25 bp, Homo sapien
tgagatcagaaacataaaagaagca

SEQ ID NO: 104228 - DNA, 25 bp, Homo sapien
tgagatcagctcatggtgtaatatg

SEQ ID NO: 104229 - DNA, 25 bp, Homo sapien
tgagatcagctgatggtgtaatatg

SEQ ID NO: 104230 - DNA, 25 bp, Homo sapien
tgagatcatgcaattatcaataaca

SEQ ID NO: 104231 - DNA, 25 bp, Homo sapien
tgagatgagacaaaaatgtttactg

SEQ ID NO: 104232 - DNA, 25 bp, Homo sapien
tgagatgagaccaaaatgtttactg

SEQ ID NO: 104233 - DNA, 25 bp, Homo sapien
tgagatgcactcatatttttgcata

SEQ ID NO: 104234 - DNA, 25 bp, Homo sapien
tgagatgcactcatgtttttgcata

SEQ ID NO: 104235 - DNA, 25 bp, Homo sapien
tgagatgcatacacctacttccttt

SEQ ID NO: 104236 - DNA, 25 bp, Homo sapien
tgagatgcatactcctacttccttt

SEQ ID NO: 104237 - DNA, 25 bp, Homo sapien
tgagatgcgaactaaaagggctcac

SEQ ID NO: 104238 - DNA, 25 bp, Homo sapien
tgagatgcggactaaaagggctcac

SEQ ID NO: 104239 - DNA, 25 bp, Homo sapien
tgagatgctatcgatgttgctagtt

SEQ ID NO: 104240 - DNA, 25 bp, Homo sapien
tgagatgctattgatgttgctagtt

SEQ ID NO: 104241 - DNA, 25 bp, Homo sapien
tgagatggaaataatgccaaggctg

SEQ ID NO: 104242 - DNA, 25 bp, Homo sapien
tgagatggaaatcatgccaaggctg

SEQ ID NO: 104243 - DNA, 25 bp, Homo sapien
tgagatggaattccaaagccaattc

SEQ ID NO: 104244 - DNA, 25 bp, Homo sapien
tgagatggaattccgaagccaattc

SEQ ID NO: 104245 - DNA, 25 bp, Homo sapien
tgagatggatatacctaacagttga

SEQ ID NO: 104246 - DNA, 25 bp, Homo sapien
tgagatggatatgcctaacagttga

SEQ ID NO: 104247 - DNA, 25 bp, Homo sapien
tgagattaagaactggaataagaat

SEQ ID NO: 104248 - DNA, 25 bp, Homo sapien
tgagattaagaattggaataagaat

SEQ ID NO: 104249 - DNA, 25 bp, Homo sapien
tgagattaccgtgcaatcagttttg

SEQ ID NO: 104250 - DNA, 25 bp, Homo sapien
tgagattacgatatccattgacatt

SEQ ID NO: 104251 - DNA, 25 bp, Homo sapien
tgagattactgtgcaatcagttttg

SEQ ID NO: 104252 - DNA, 25 bp, Homo sapien
tgagattagctgcacggctgaggag

SEQ ID NO: 104253 - DNA, 25 bp, Homo sapien
tgagattagctgcatggctgaggag

SEQ ID NO: 104254 - DNA, 25 bp, Homo sapien
tgagattatgatatccattgacatt

SEQ ID NO: 104255 - DNA, 25 bp, Homo sapien
tgagattcatccactccggttgatc

SEQ ID NO: 104256 - DNA, 25 bp, Homo sapien
tgagattcatccactctggttgatc

SEQ ID NO: 104257 - DNA, 25 bp, Homo sapien
tgagattctcaggctcatcaggaag

SEQ ID NO: 104258 - DNA, 25 bp, Homo sapien
tgagattctcatgctcatcaggaag

SEQ ID NO: 104259 - DNA, 25 bp, Homo sapien
tgagattctgattgcggttcttttg

SEQ ID NO: 104260 - DNA, 25 bp, Homo sapien
tgagattctgattgtggttcttttg

SEQ ID NO: 104261 - DNA, 25 bp, Homo sapien
tgagattcttaaccgttctaatgcg

SEQ ID NO: 104262 - DNA, 25 bp, Homo sapien
tgagattcttaacctttctaatgcg

SEQ ID NO: 104263 - DNA, 25 bp, Homo sapien
tgagattgagtacaacagcaactaa

SEQ ID NO: 104264 - DNA, 25 bp, Homo sapien
tgagattgagtacaccagcaactaa

SEQ ID NO: 104265 - DNA, 25 bp, Homo sapien
tgagatttccttctgcgcctcagac

SEQ ID NO: 104266 - DNA, 25 bp, Homo sapien
tgagatttctttctgcgcctcagac

SEQ ID NO: 104267 - DNA, 25 bp, Homo sapien
tgagattttatatcatacatagcag

SEQ ID NO: 104268 - DNA, 25 bp, Homo sapien
tgagattttgtatcatacatagcag

SEQ ID NO: 104269 - DNA, 25 bp, Homo sapien
tgagcaaacataaaaaagaaatctc

SEQ ID NO: 104270 - DNA, 25 bp, Homo sapien
tgagcaaagataaaaaagaaatctc

SEQ ID NO: 104271 - DNA, 25 bp, Homo sapien
tgagcaaaggatcgagtggaaggag

SEQ ID NO: 104272 - DNA, 25 bp, Homo sapien
tgagcaaaggatggagtggaaggag

SEQ ID NO: 104273 - DNA, 25 bp, Homo sapien
tgagcaacagacatttctgcaacag

SEQ ID NO: 104274 - DNA, 25 bp, Homo sapien
tgagcaacagacttttctgcaacag

SEQ ID NO: 104275 - DNA, 25 bp, Homo sapien
tgagcaatactggtgctaagtatat

SEQ ID NO: 104276 - DNA, 25 bp, Homo sapien
tgagcaatagtggtgctaagtatat

SEQ ID NO: 104277 - DNA, 25 bp, Homo sapien
tgagcaatccactcggtgtccatcc

SEQ ID NO: 104278 - DNA, 25 bp, Homo sapien
tgagcaatccactgggtgtccatcc

SEQ ID NO: 104279 - DNA, 25 bp, Homo sapien
tgagcaatttctggcaggcatccag

SEQ ID NO: 104280 - DNA, 25 bp, Homo sapien
tgagcaatttcttgcaggcatccag

SEQ ID NO: 104281 - DNA, 25 bp, Homo sapien
tgagcacatttcattgcaagactgg

SEQ ID NO: 104282 - DNA, 25 bp, Homo sapien
tgagcacattttattgcaagactgg

SEQ ID NO: 104283 - DNA, 25 bp, Homo sapien
tgagcagaaagaggttgggtcttag

SEQ ID NO: 104284 - DNA, 25 bp, Homo sapien
tgagcagaaagagtttgggtcttag

SEQ ID NO: 104285 - DNA, 25 bp, Homo sapien
tgagcagaagagttaaagcttgtat

SEQ ID NO: 104286 - DNA, 25 bp, Homo sapien
tgagcagaattccggagttgagggt

SEQ ID NO: 104287 - DNA, 25 bp, Homo sapien
tgagcagaattctggagttgagggt

SEQ ID NO: 104288 - DNA, 25 bp, Homo sapien
tgagcagaggagttaaagcttgtat

SEQ ID NO: 104289 - DNA, 25 bp, Homo sapien
tgagcagcactccgccagtgacctt

SEQ ID NO: 104290 - DNA, 25 bp, Homo sapien
tgagcagcactctgccagtgacctt

SEQ ID NO: 104291 - DNA, 25 bp, Homo sapien
tgagcaggcaccagctgtgaccacc

SEQ ID NO: 104292 - DNA, 25 bp, Homo sapien
tgagcaggcaccggctgtgaccacc

SEQ ID NO: 104293 - DNA, 25 bp, Homo sapien
tgagcagtcaagagaaaaaatgtta

SEQ ID NO: 104294 - DNA, 25 bp, Homo sapien
tgagcagtcaagggaaaaaatgtta

SEQ ID NO: 104295 - DNA, 25 bp, Homo sapien
tgagcagtctaggattctgatgaat

SEQ ID NO: 104296 - DNA, 25 bp, Homo sapien
tgagcagtctagggttctgatgaat

SEQ ID NO: 104297 - DNA, 25 bp, Homo sapien
tgagcataggctgttagaagaagcc

SEQ ID NO: 104298 - DNA, 25 bp, Homo sapien
tgagcataggctgttataagaagcc

SEQ ID NO: 104299 - DNA, 25 bp, Homo sapien
tgagcatcaaaaaagatggactgtt

SEQ ID NO: 104300 - DNA, 25 bp, Homo sapien
tgagcatcagaaaagatggactgtt

SEQ ID NO: 104301 - DNA, 25 bp, Homo sapien
tgagcatctatactatgtcaggtgc

SEQ ID NO: 104302 - DNA, 25 bp, Homo sapien
tgagcatctatactgtgtcaggtgc

SEQ ID NO: 104303 - DNA, 25 bp, Homo sapien
tgagcatgccttatattccagcgag

SEQ ID NO: 104304 - DNA, 25 bp, Homo sapien
tgagcatgccttatgttccagcgag

SEQ ID NO: 104305 - DNA, 25 bp, Homo sapien
tgagcatggttctatgaaggatttg

SEQ ID NO: 104306 - DNA, 25 bp, Homo sapien
tgagcatggttttatgaaggatttg

SEQ ID NO: 104307 - DNA, 25 bp, Homo sapien
tgagcattatgaagtttaacatgta

SEQ ID NO: 104308 - DNA, 25 bp, Homo sapien
tgagcattgtgaagtttaacatgta

SEQ ID NO: 104309 - DNA, 25 bp, Homo sapien
tgagcatttaaccccttggtgatga

SEQ ID NO: 104310 - DNA, 25 bp, Homo sapien
tgagcatttaacccgttggtgatga

SEQ ID NO: 104311 - DNA, 25 bp, Homo sapien
tgagcattttagaatttgggtttag

SEQ ID NO: 104312 - DNA, 25 bp, Homo sapien
tgagcattttagagtttgggtttag

SEQ ID NO: 104313 - DNA, 25 bp, Homo sapien
tgagccacaaacgcctacaactaat

SEQ ID NO: 104314 - DNA, 25 bp, Homo sapien
tgagccacaaatgcctacaactaat

SEQ ID NO: 104315 - DNA, 25 bp, Homo sapien
tgagccactagaacaatggtgctgg

SEQ ID NO: 104316 - DNA, 25 bp, Homo sapien
tgagccactagaacgatggtgctgg

SEQ ID NO: 104317 - DNA, 25 bp, Homo sapien
tgagccagaagatttttaatgggag

SEQ ID NO: 104318 - DNA, 25 bp, Homo sapien
tgagccagaaggtttttaatgggag

SEQ ID NO: 104319 - DNA, 25 bp, Homo sapien
tgagccagagatcgacatgcaggat

SEQ ID NO: 104320 - DNA, 25 bp, Homo sapien
tgagccagagatcggcatgcaggat

SEQ ID NO: 104321 - DNA, 25 bp, Homo sapien
tgagccagctgtgatactatttatt

SEQ ID NO: 104322 - DNA, 25 bp, Homo sapien
tgagccagttgtgatactatttatt

SEQ ID NO: 104323 - DNA, 25 bp, Homo sapien
tgagccatattacctgagcccaatc

SEQ ID NO: 104324 - DNA, 25 bp, Homo sapien
tgagccatattccctgagcccaatc

SEQ ID NO: 104325 - DNA, 25 bp, Homo sapien
tgagccatgaagagtccttcctcag

SEQ ID NO: 104326 - DNA, 25 bp, Homo sapien
tgagccatgaagagtctttcctcag

SEQ ID NO: 104327 - DNA, 25 bp, Homo sapien
tgagcccagctgaacactctatatg

SEQ ID NO: 104328 - DNA, 25 bp, Homo sapien
tgagcccagttgaacactctatatg

SEQ ID NO: 104329 - DNA, 25 bp, Homo sapien
tgagcccatcagtgacaaagtacaa

SEQ ID NO: 104330 - DNA, 25 bp, Homo sapien
tgagcccatcagtgaccaagtacaa

SEQ ID NO: 104331 - DNA, 25 bp, Homo sapien
tgagcccatttccattagtatcttt

SEQ ID NO: 104332 - DNA, 25 bp, Homo sapien
tgagcccatttcgattagtatcttt

SEQ ID NO: 104333 - DNA, 25 bp, Homo sapien
tgagcccgtcaaaagcattcttatt

SEQ ID NO: 104334 - DNA, 25 bp, Homo sapien
tgagcccgtcaaaggcattcttatt

SEQ ID NO: 104335 - DNA, 25 bp, Homo sapien
tgagccctaaatgacatcatgtgtc

SEQ ID NO: 104336 - DNA, 25 bp, Homo sapien
tgagccctaaatgtcatcatgtgtc

SEQ ID NO: 104337 - DNA, 25 bp, Homo sapien
tgagcctataacctctgttgttttc

SEQ ID NO: 104338 - DNA, 25 bp, Homo sapien
tgagcctataagctctgttgttttc

SEQ ID NO: 104339 - DNA, 25 bp, Homo sapien
tgagcctctatattttcatttctaa

SEQ ID NO: 104340 - DNA, 25 bp, Homo sapien
tgagcctctatgttttcatttctaa

SEQ ID NO: 104341 - DNA, 25 bp, Homo sapien
tgagcctgacggtggcaaggtcaac

SEQ ID NO: 104342 - DNA, 25 bp, Homo sapien
tgagcctgacggtggctaggtcaac

SEQ ID NO: 104343 - DNA, 25 bp, Homo sapien
tgagcctgctcaaacatccagtaca

SEQ ID NO: 104344 - DNA, 25 bp, Homo sapien
tgagcctgttcaaacatccagtaca

SEQ ID NO: 104345 - DNA, 25 bp, Homo sapien
tgagccttatgctatgcgagccact

SEQ ID NO: 104346 - DNA, 25 bp, Homo sapien
tgagccttatgctatgggagccact

SEQ ID NO: 104347 - DNA, 25 bp, Homo sapien
tgagcgagtaatccttttaagggaa

SEQ ID NO: 104348 - DNA, 25 bp, Homo sapien
tgagcgagtaatctttttaagggaa

SEQ ID NO: 104349 - DNA, 25 bp, Homo sapien
tgagcgggacactgagttcttcccc

SEQ ID NO: 104350 - DNA, 25 bp, Homo sapien
tgagcgggacagtgagttcttcccc

SEQ ID NO: 104351 - DNA, 25 bp, Homo sapien
tgagcgtaacccactccacttccaa

SEQ ID NO: 104352 - DNA, 25 bp, Homo sapien
tgagcgtaacccgctccacttccaa

SEQ ID NO: 104353 - DNA, 25 bp, Homo sapien
tgagcgtactagaggctatggcatg

SEQ ID NO: 104354 - DNA, 25 bp, Homo sapien
tgagcgtagtagaggctatggcatg

SEQ ID NO: 104355 - DNA, 25 bp, Homo sapien
tgagcgtccactctgtgcctggctc

SEQ ID NO: 104356 - DNA, 25 bp, Homo sapien
tgagcgtctactctgtgcctggctc

SEQ ID NO: 104357 - DNA, 25 bp, Homo sapien
tgagctaaacaaagaagataagcgc

SEQ ID NO: 104358 - DNA, 25 bp, Homo sapien
tgagctaaacaaggaagataagcgc

SEQ ID NO: 104359 - DNA, 25 bp, Homo sapien
tgagctataataggccttaaaagac

SEQ ID NO: 104360 - DNA, 25 bp, Homo sapien
tgagctataatgtggtaaagattag

SEQ ID NO: 104361 - DNA, 25 bp, Homo sapien
tgagctataatgtggtcaagattag

SEQ ID NO: 104362 - DNA, 25 bp, Homo sapien
tgagctatactaggccttaaaagac

SEQ ID NO: 104363 - DNA, 25 bp, Homo sapien
tgagctatcattgtacaactgcact

SEQ ID NO: 104364 - DNA, 25 bp, Homo sapien
tgagctatcattgtacgactgcact

SEQ ID NO: 104365 - DNA, 25 bp, Homo sapien
tgagctatgtatcttctgctaattt

SEQ ID NO: 104366 - DNA, 25 bp, Homo sapien
tgagctatgtattttctgctaattt

SEQ ID NO: 104367 - DNA, 25 bp, Homo sapien
tgagctccaaaaattctttctccta

SEQ ID NO: 104368 - DNA, 25 bp, Homo sapien
tgagctccccatagatgaaatgctc

SEQ ID NO: 104369 - DNA, 25 bp, Homo sapien
tgagctccccatggatgaaatgctc

SEQ ID NO: 104370 - DNA, 25 bp, Homo sapien
tgagctccgaaaattctttctccta

SEQ ID NO: 104371 - DNA, 25 bp, Homo sapien
tgagctcttagttccaagaaccgta

SEQ ID NO: 104372 - DNA, 25 bp, Homo sapien
tgagctcttagtttcaagaaccgta

SEQ ID NO: 104373 - DNA, 25 bp, Homo sapien
tgagctgccaaggctacatcatttt

SEQ ID NO: 104374 - DNA, 25 bp, Homo sapien
tgagctgccaaggttacatcatttt

SEQ ID NO: 104375 - DNA, 25 bp, Homo sapien
tgagctgcccctcatcttcgcagaa

SEQ ID NO: 104376 - DNA, 25 bp, Homo sapien
tgagctgcccctcgtcttcgcagaa

SEQ ID NO: 104377 - DNA, 25 bp, Homo sapien
tgagctgctcagatgtcatacattt

SEQ ID NO: 104378 - DNA, 25 bp, Homo sapien
tgagctgctcagttgtcatacattt

SEQ ID NO: 104379 - DNA, 25 bp, Homo sapien
tgagctggaatccgacttttcttgc

SEQ ID NO: 104380 - DNA, 25 bp, Homo sapien
tgagctggaattcgacttttcttgc

SEQ ID NO: 104381 - DNA, 25 bp, Homo sapien
tgagctgtaaaacaaaagcatcagg

SEQ ID NO: 104382 - DNA, 25 bp, Homo sapien
tgagctgtaaagcaaaagcatcagg

SEQ ID NO: 104383 - DNA, 25 bp, Homo sapien
tgagctgtcacacgtgctgctagag

SEQ ID NO: 104384 - DNA, 25 bp, Homo sapien
tgagctgtcacatgtgctgctagag

SEQ ID NO: 104385 - DNA, 25 bp, Homo sapien
tgagctgtgtttgtaagtttcattg

SEQ ID NO: 104386 - DNA, 25 bp, Homo sapien
tgagctgtgtttttaagtttcattg

SEQ ID NO: 104387 - DNA, 25 bp, Homo sapien
tgagcttcctaacctatactggatc

SEQ ID NO: 104388 - DNA, 25 bp, Homo sapien
tgagcttcgtaacctatactggatc

SEQ ID NO: 104389 - DNA, 25 bp, Homo sapien
tgagcttctggtagcaacagtttca

SEQ ID NO: 104390 - DNA, 25 bp, Homo sapien
tgagcttctggttgcaacagtttca

SEQ ID NO: 104391 - DNA, 25 bp, Homo sapien
tgagcttcttcaacttgggcccccc

SEQ ID NO: 104392 - DNA, 25 bp, Homo sapien
tgagcttcttcatcttgggcccccc

SEQ ID NO: 104393 - DNA, 25 bp, Homo sapien
tgaggaaactcaaagaaatacaaga

SEQ ID NO: 104394 - DNA, 25 bp, Homo sapien
tgaggaaactcagagaaatacaaga

SEQ ID NO: 104395 - DNA, 25 bp, Homo sapien
tgaggaaccttcataatgctttctg

SEQ ID NO: 104396 - DNA, 25 bp, Homo sapien
tgaggaaccttcctaatgctttctg

SEQ ID NO: 104397 - DNA, 25 bp, Homo sapien
tgaggaactacctaccccattcaaa

SEQ ID NO: 104398 - DNA, 25 bp, Homo sapien
tgaggaactacctatcccattcaaa

SEQ ID NO: 104399 - DNA, 25 bp, Homo sapien
tgaggaagacggatgcatgactatg

SEQ ID NO: 104400 - DNA, 25 bp, Homo sapien
tgaggaagactatcttcttgccttg

SEQ ID NO: 104401 - DNA, 25 bp, Homo sapien
tgaggaagactattttcttgccttg

SEQ ID NO: 104402 - DNA, 25 bp, Homo sapien
tgaggaagatggatgcatgactatg

SEQ ID NO: 104403 - DNA, 25 bp, Homo sapien
tgaggaagcaggcaagaatatgtgg

SEQ ID NO: 104404 - DNA, 25 bp, Homo sapien
tgaggaagcaggcgagaatatgtgg

SEQ ID NO: 104405 - DNA, 25 bp, Homo sapien
tgaggaagtgaaactcagataaatt

SEQ ID NO: 104406 - DNA, 25 bp, Homo sapien
tgaggaagtgaaactcggataaatt

SEQ ID NO: 104407 - DNA, 25 bp, Homo sapien
tgaggacaagacatgttgacaaacc

SEQ ID NO: 104408 - DNA, 25 bp, Homo sapien
tgaggacaagatatgttgacaaacc

SEQ ID NO: 104409 - DNA, 25 bp, Homo sapien
tgaggacactgagactaagatgtga

SEQ ID NO: 104410 - DNA, 25 bp, Homo sapien
tgaggacactgatactaagatgtga

SEQ ID NO: 104411 - DNA, 25 bp, Homo sapien
tgaggacagaagtaagggaatgaga

SEQ ID NO: 104412 - DNA, 25 bp, Homo sapien
tgaggacaggagtaagggaatgaga

SEQ ID NO: 104413 - DNA, 25 bp, Homo sapien
tgaggacatgtcaaaatcacaattt

SEQ ID NO: 104414 - DNA, 25 bp, Homo sapien
tgaggacatgtcgaaatcacaattt

SEQ ID NO: 104415 - DNA, 25 bp, Homo sapien
tgaggacccacaggatccatcatcc

SEQ ID NO: 104416 - DNA, 25 bp, Homo sapien
tgaggacccacagggtccatcatcc

SEQ ID NO: 104417 - DNA, 25 bp, Homo sapien
tgaggactgcgtatcaacaaattta

SEQ ID NO: 104418 - DNA, 25 bp, Homo sapien
tgaggactgtaagtaacacaattgt

SEQ ID NO: 104419 - DNA, 25 bp, Homo sapien
tgaggactgtgtatcaacaaattta

SEQ ID NO: 104420 - DNA, 25 bp, Homo sapien
tgaggactttaagtaacacaattgt

SEQ ID NO: 104421 - DNA, 25 bp, Homo sapien
tgaggagaacaagacaaagtcctgc

SEQ ID NO: 104422 - DNA, 25 bp, Homo sapien
tgaggagaacaaggcaaagtcctgc

SEQ ID NO: 104423 - DNA, 25 bp, Homo sapien
tgaggagacgaacaaggcctatatt

SEQ ID NO: 104424 - DNA, 25 bp, Homo sapien
tgaggagatgaacaaggcctatatt

SEQ ID NO: 104425 - DNA, 25 bp, Homo sapien
tgaggagatgcactacattcaaaaa

SEQ ID NO: 104426 - DNA, 25 bp, Homo sapien
tgaggagatgcgctacattcaaaaa

SEQ ID NO: 104427 - DNA, 25 bp, Homo sapien
tgaggagccttttcgcagagtcttt

SEQ ID NO: 104428 - DNA, 25 bp, Homo sapien
tgaggagcctttttgcagagtcttt

SEQ ID NO: 104429 - DNA, 25 bp, Homo sapien
tgaggaggaaaacaagaatgatctt

SEQ ID NO: 104430 - DNA, 25 bp, Homo sapien
tgaggaggaaaacatgaatgatctt

SEQ ID NO: 104431 - DNA, 25 bp, Homo sapien
tgaggagtacaagagttactcaaaa

SEQ ID NO: 104432 - DNA, 25 bp, Homo sapien
tgaggagtagaagagttactcaaaa

SEQ ID NO: 104433 - DNA, 25 bp, Homo sapien
tgaggagtgcatagaccacaataga

SEQ ID NO: 104434 - DNA, 25 bp, Homo sapien
tgaggagtgcatagactacaataga

SEQ ID NO: 104435 - DNA, 25 bp, Homo sapien
tgaggagttcagttttggtcatgtt

SEQ ID NO: 104436 - DNA, 25 bp, Homo sapien
tgaggagttcagtttttgtcatgtt

SEQ ID NO: 104437 - DNA, 25 bp, Homo sapien
tgaggagtttgcagtcaaaaagcaa

SEQ ID NO: 104438 - DNA, 25 bp, Homo sapien
tgaggagtttgccgtcaaaaagcaa

SEQ ID NO: 104439 - DNA, 25 bp, Homo sapien
tgaggataaatcgtgaattggaagg

SEQ ID NO: 104440 - DNA, 25 bp, Homo sapien
tgaggataaatcgtgagttggaagg

SEQ ID NO: 104441 - DNA, 25 bp, Homo sapien
tgaggatacacttacaacgaactgt

SEQ ID NO: 104442 - DNA, 25 bp, Homo sapien
tgaggatacactttcaacgaactgt

SEQ ID NO: 104443 - DNA, 25 bp, Homo sapien
tgaggatcattaactgtccagaaat

SEQ ID NO: 104444 - DNA, 25 bp, Homo sapien
tgaggatcattcactgtccagaaat

SEQ ID NO: 104445 - DNA, 25 bp, Homo sapien
tgaggatgagagctgactgctgaac

SEQ ID NO: 104446 - DNA, 25 bp, Homo sapien
tgaggatgagagttgactgctgaac

SEQ ID NO: 104447 - DNA, 25 bp, Homo sapien
tgaggatgcaaaaatagaaaatgtc

SEQ ID NO: 104448 - DNA, 25 bp, Homo sapien
tgaggatgcctaatgggtaacaaaa

SEQ ID NO: 104449 - DNA, 25 bp, Homo sapien
tgaggatggaaaaatagaaaatgtc

SEQ ID NO: 104450 - DNA, 25 bp, Homo sapien
tgaggatggctaatgggtaacaaaa

SEQ ID NO: 104451 - DNA, 25 bp, Homo sapien
tgaggattcaaaaccaaaatgctat

SEQ ID NO: 104452 - DNA, 25 bp, Homo sapien
tgaggattcaaaactaaaatgctat

SEQ ID NO: 104453 - DNA, 25 bp, Homo sapien
tgaggatttaaacggtacagacagg

SEQ ID NO: 104454 - DNA, 25 bp, Homo sapien
tgaggatttaaactgtacagacagg

SEQ ID NO: 104455 - DNA, 25 bp, Homo sapien
tgaggcaactcacctctgactcaga

SEQ ID NO: 104456 - DNA, 25 bp, Homo sapien
tgaggcaactcatctctgactcaga

SEQ ID NO: 104457 - DNA, 25 bp, Homo sapien
tgaggcaaggaatgccactcataca

SEQ ID NO: 104458 - DNA, 25 bp, Homo sapien
tgaggcaaggaatgtcactcataca

SEQ ID NO: 104459 - DNA, 25 bp, Homo sapien
tgaggcactgaaaacctaaatttcc

SEQ ID NO: 104460 - DNA, 25 bp, Homo sapien
tgaggcactgaatacctaaatttcc

SEQ ID NO: 104461 - DNA, 25 bp, Homo sapien
tgaggcagaaaattcgcatttccaa

SEQ ID NO: 104462 - DNA, 25 bp, Homo sapien
tgaggcagaaaatttgcatttccaa

SEQ ID NO: 104463 - DNA, 25 bp, Homo sapien
tgaggcatcctacaagcattgtgac

SEQ ID NO: 104464 - DNA, 25 bp, Homo sapien
tgaggcatcctactagcattgtgac

SEQ ID NO: 104465 - DNA, 25 bp, Homo sapien
tgaggcattgctttcgcttcattac

SEQ ID NO: 104466 - DNA, 25 bp, Homo sapien
tgaggcattgcttttgcttcattac

SEQ ID NO: 104467 - DNA, 25 bp, Homo sapien
tgaggccaaagcccatggaaccaat

SEQ ID NO: 104468 - DNA, 25 bp, Homo sapien
tgaggccaagagaatttcctggcgg

SEQ ID NO: 104469 - DNA, 25 bp, Homo sapien
tgaggccaagaggatttcctggcgg

SEQ ID NO: 104470 - DNA, 25 bp, Homo sapien
tgaggccaaggcccatggaaccaat

SEQ ID NO: 104471 - DNA, 25 bp, Homo sapien
tgaggccacaaagttaactgtatgt

SEQ ID NO: 104472 - DNA, 25 bp, Homo sapien
tgaggccacataaagttagatcttc

SEQ ID NO: 104473 - DNA, 25 bp, Homo sapien
tgaggccacgtaaagttagatcttc

SEQ ID NO: 104474 - DNA, 25 bp, Homo sapien
tgaggccagaaagttaactgtatgt

SEQ ID NO: 104475 - DNA, 25 bp, Homo sapien
tgaggcctaattactttcaattaaa

SEQ ID NO: 104476 - DNA, 25 bp, Homo sapien
tgaggcctgattactttcaattaaa

SEQ ID NO: 104477 - DNA, 25 bp, Homo sapien
tgaggcctttccagcggtagagttc

SEQ ID NO: 104478 - DNA, 25 bp, Homo sapien
tgaggcctttccagtggtagagttc

SEQ ID NO: 104479 - DNA, 25 bp, Homo sapien
tgaggcctttttgctctctgcatcc

SEQ ID NO: 104480 - DNA, 25 bp, Homo sapien
tgaggcctttttgttctctgcatcc

SEQ ID NO: 104481 - DNA, 25 bp, Homo sapien
tgaggctagcaagcaaaacacctca

SEQ ID NO: 104482 - DNA, 25 bp, Homo sapien
tgaggctagcacgcaaaacacctca

SEQ ID NO: 104483 - DNA, 25 bp, Homo sapien
tgaggctccgattgtacttctaata

SEQ ID NO: 104484 - DNA, 25 bp, Homo sapien
tgaggctccgattgtatttctaata

SEQ ID NO: 104485 - DNA, 25 bp, Homo sapien
tgaggctgcaaacttctgcaatgta

SEQ ID NO: 104486 - DNA, 25 bp, Homo sapien
tgaggctgcaaatttctgcaatgta

SEQ ID NO: 104487 - DNA, 25 bp, Homo sapien
tgaggcttagagaactaaagtaact

SEQ ID NO: 104488 - DNA, 25 bp, Homo sapien
tgaggcttagagagctaaagtaact

SEQ ID NO: 104489 - DNA, 25 bp, Homo sapien
tgaggcttatcaagctccttctatg

SEQ ID NO: 104490 - DNA, 25 bp, Homo sapien
tgaggcttatcaagttccttctatg

SEQ ID NO: 104491 - DNA, 25 bp, Homo sapien
tgaggctttctcatcacggcttcta

SEQ ID NO: 104492 - DNA, 25 bp, Homo sapien
tgaggctttctcatcatggcttcta

SEQ ID NO: 104493 - DNA, 25 bp, Homo sapien
tgagggaaaatcagccatgaaaaat

SEQ ID NO: 104494 - DNA, 25 bp, Homo sapien
tgagggaaaattagccatgaaaaat

SEQ ID NO: 104495 - DNA, 25 bp, Homo sapien
tgagggaaagaactttgagagtgac

SEQ ID NO: 104496 - DNA, 25 bp, Homo sapien
tgagggaaataactttgagagtgac

SEQ ID NO: 104497 - DNA, 25 bp, Homo sapien
tgagggaacaatgaaccctacgacc

SEQ ID NO: 104498 - DNA, 25 bp, Homo sapien
tgagggaaccatgaaccctacgacc

SEQ ID NO: 104499 - DNA, 25 bp, Homo sapien
tgagggaaccgaggtatagaaaggt

SEQ ID NO: 104500 - DNA, 25 bp, Homo sapien
tgagggaactgaggtatagaaaggt

SEQ ID NO: 104501 - DNA, 25 bp, Homo sapien
tgagggaatatgaaaaagccacttg

SEQ ID NO: 104502 - DNA, 25 bp, Homo sapien
tgagggaatatgaaaaggccacttg

SEQ ID NO: 104503 - DNA, 25 bp, Homo sapien
tgagggaatgctcagtgtgactgag

SEQ ID NO: 104504 - DNA, 25 bp, Homo sapien
tgagggaatgcttagtgtgactgag

SEQ ID NO: 104505 - DNA, 25 bp, Homo sapien
tgagggacctaggctgtgctcctta

SEQ ID NO: 104506 - DNA, 25 bp, Homo sapien
tgagggacctagtctgtgctcctta

SEQ ID NO: 104507 - DNA, 25 bp, Homo sapien
tgagggacctgttgcgccactgcag

SEQ ID NO: 104508 - DNA, 25 bp, Homo sapien
tgagggacctgttgtgccactgcag

SEQ ID NO: 104509 - DNA, 25 bp, Homo sapien
tgagggagaatctgttcgatgcctc

SEQ ID NO: 104510 - DNA, 25 bp, Homo sapien
tgagggagaatctgtttgatgcctc

SEQ ID NO: 104511 - DNA, 25 bp, Homo sapien
tgagggagatggacaattcatcagg

SEQ ID NO: 104512 - DNA, 25 bp, Homo sapien
tgagggagatggacgattcatcagg

SEQ ID NO: 104513 - DNA, 25 bp, Homo sapien
tgagggatcgtacggtatgaaaccc

SEQ ID NO: 104514 - DNA, 25 bp, Homo sapien
tgagggatcgtatggtatgaaaccc

SEQ ID NO: 104515 - DNA, 25 bp, Homo sapien
tgagggatgaaaagaactaaaggac

SEQ ID NO: 104516 - DNA, 25 bp, Homo sapien
tgagggatgaaaagaattaaaggac

SEQ ID NO: 104517 - DNA, 25 bp, Homo sapien
tgagggcatcacaaacacagcctat

SEQ ID NO: 104518 - DNA, 25 bp, Homo sapien
tgagggcatcacaaacgcagcctat

SEQ ID NO: 104519 - DNA, 25 bp, Homo sapien
tgagggccgatctgaaccatggcag

SEQ ID NO: 104520 - DNA, 25 bp, Homo sapien
tgagggccgatgtgaaccatggcag

SEQ ID NO: 104521 - DNA, 25 bp, Homo sapien
tgaggggaatgttaaacacctcttg

SEQ ID NO: 104522 - DNA, 25 bp, Homo sapien
tgaggggaatgttaaagacctcttg

SEQ ID NO: 104523 - DNA, 25 bp, Homo sapien
tgaggggctcttccaccttcgcttc

SEQ ID NO: 104524 - DNA, 25 bp, Homo sapien
tgaggggcttttccaccttcgcttc

SEQ ID NO: 104525 - DNA, 25 bp, Homo sapien
tgaggggttagcacggaagaattga

SEQ ID NO: 104526 - DNA, 25 bp, Homo sapien
tgaggggtttgcacggaagaattga

SEQ ID NO: 104527 - DNA, 25 bp, Homo sapien
tgagggtacaaaattatgatgctac

SEQ ID NO: 104528 - DNA, 25 bp, Homo sapien
tgagggtagcacacatccagaaaca

SEQ ID NO: 104529 - DNA, 25 bp, Homo sapien
tgagggtagcacatatccagaaaca

SEQ ID NO: 104530 - DNA, 25 bp, Homo sapien
tgagggtataaaattatgatgctac

SEQ ID NO: 104531 - DNA, 25 bp, Homo sapien
tgagggtgaatagaaatgaagaact

SEQ ID NO: 104532 - DNA, 25 bp, Homo sapien
tgagggtgaatggaaatgaagaact

SEQ ID NO: 104533 - DNA, 25 bp, Homo sapien
tgaggtaacgctcataactgttagt

SEQ ID NO: 104534 - DNA, 25 bp, Homo sapien
tgaggtaatgctcataactgttagt

SEQ ID NO: 104535 - DNA, 25 bp, Homo sapien
tgaggtagctgacatcatggtgtct

SEQ ID NO: 104536 - DNA, 25 bp, Homo sapien
tgaggtagctgccatcatggtgtct

SEQ ID NO: 104537 - DNA, 25 bp, Homo sapien
tgaggtaggcctctttgtgtaataa

SEQ ID NO: 104538 - DNA, 25 bp, Homo sapien
tgaggtaggcctttttgtgtaataa

SEQ ID NO: 104539 - DNA, 25 bp, Homo sapien
tgaggtataagacaacagggcttgg

SEQ ID NO: 104540 - DNA, 25 bp, Homo sapien
tgaggtataaggcaacagggcttgg

SEQ ID NO: 104541 - DNA, 25 bp, Homo sapien
tgaggtatgcgttaaggtctttggc

SEQ ID NO: 104542 - DNA, 25 bp, Homo sapien
tgaggtatgtgttaaggtctttggc

SEQ ID NO: 104543 - DNA, 25 bp, Homo sapien
tgaggtatttgtccctcggaacaga

SEQ ID NO: 104544 - DNA, 25 bp, Homo sapien
tgaggtatttgtcccttggaacaga

SEQ ID NO: 104545 - DNA, 25 bp, Homo sapien
tgaggtcaaatgaactgtcagcact

SEQ ID NO: 104546 - DNA, 25 bp, Homo sapien
tgaggtcaactgaactgtcagcact

SEQ ID NO: 104547 - DNA, 25 bp, Homo sapien
tgaggtccaaattattatttccatc

SEQ ID NO: 104548 - DNA, 25 bp, Homo sapien
tgaggtccagattattatttccatc

SEQ ID NO: 104549 - DNA, 25 bp, Homo sapien
tgaggtccataagtagatcagagtt

SEQ ID NO: 104550 - DNA, 25 bp, Homo sapien
tgaggtccataattagatcagagtt

SEQ ID NO: 104551 - DNA, 25 bp, Homo sapien
tgaggtctcacaaaatgtcagattt

SEQ ID NO: 104552 - DNA, 25 bp, Homo sapien
tgaggtctcacgaaatgtcagattt

SEQ ID NO: 104553 - DNA, 25 bp, Homo sapien
tgaggtgaagttcgaaggatcactc

SEQ ID NO: 104554 - DNA, 25 bp, Homo sapien
tgaggtgaagtttgaaggatcactc

SEQ ID NO: 104555 - DNA, 25 bp, Homo sapien
tgaggtgactgataaagtttgaatt

SEQ ID NO: 104556 - DNA, 25 bp, Homo sapien
tgaggtgattgataaagtttgaatt

SEQ ID NO: 104557 - DNA, 25 bp, Homo sapien
tgaggtgtccagccatcaaaaccca

SEQ ID NO: 104558 - DNA, 25 bp, Homo sapien
tgaggtgttcagccatcaaaaccca

SEQ ID NO: 104559 - DNA, 25 bp, Homo sapien
tgaggttaaacagccagcaaggggc

SEQ ID NO: 104560 - DNA, 25 bp, Homo sapien
tgaggttaaacggccagcaaggggc

SEQ ID NO: 104561 - DNA, 25 bp, Homo sapien
tgaggttaaactctgttaatatgtt

SEQ ID NO: 104562 - DNA, 25 bp, Homo sapien
tgaggttaaactcttttaatatgtt

SEQ ID NO: 104563 - DNA, 25 bp, Homo sapien
tgaggttaaagaaaaactgtggcaa

SEQ ID NO: 104564 - DNA, 25 bp, Homo sapien
tgaggttaaagcaaaactgtggcaa

SEQ ID NO: 104565 - DNA, 25 bp, Homo sapien
tgaggttaacactgatgatcagtag

SEQ ID NO: 104566 - DNA, 25 bp, Homo sapien
tgaggttaacattgatgatcagtag

SEQ ID NO: 104567 - DNA, 25 bp, Homo sapien
tgaggttaagaacgagtaataagac

SEQ ID NO: 104568 - DNA, 25 bp, Homo sapien
tgaggttaagaatgagtaataagac

SEQ ID NO: 104569 - DNA, 25 bp, Homo sapien
tgaggttactgcacttgcattttgt

SEQ ID NO: 104570 - DNA, 25 bp, Homo sapien
tgaggttatggcttcccttacataa

SEQ ID NO: 104571 - DNA, 25 bp, Homo sapien
tgaggttatggctttccttacataa

SEQ ID NO: 104572 - DNA, 25 bp, Homo sapien
tgaggttattgcacttgcattttgt

SEQ ID NO: 104573 - DNA, 25 bp, Homo sapien
tgaggttccaatgcatgctaccatg

SEQ ID NO: 104574 - DNA, 25 bp, Homo sapien
tgaggttccgatgcatgctaccatg

SEQ ID NO: 104575 - DNA, 25 bp, Homo sapien
tgaggttctgcacctactgattcaa

SEQ ID NO: 104576 - DNA, 25 bp, Homo sapien
tgaggttctgcatctactgattcaa

SEQ ID NO: 104577 - DNA, 25 bp, Homo sapien
tgaggttgggagaggtaaagtgatc

SEQ ID NO: 104578 - DNA, 25 bp, Homo sapien
tgaggttgggagaggtgaagtgatc

SEQ ID NO: 104579 - DNA, 25 bp, Homo sapien
tgaggtttaagcactctgcttttag

SEQ ID NO: 104580 - DNA, 25 bp, Homo sapien
tgaggtttaggtcctctttcaaact

SEQ ID NO: 104581 - DNA, 25 bp, Homo sapien
tgaggtttgagcactctgcttttag

SEQ ID NO: 104582 - DNA, 25 bp, Homo sapien
tgaggtttgggtcctctttcaaact

SEQ ID NO: 104583 - DNA, 25 bp, Homo sapien
tgagtaaacatggcaaagaacagct

SEQ ID NO: 104584 - DNA, 25 bp, Homo sapien
tgagtaaactctatctagctcattc

SEQ ID NO: 104585 - DNA, 25 bp, Homo sapien
tgagtaaagtacattcttagggcac

SEQ ID NO: 104586 - DNA, 25 bp, Homo sapien
tgagtaaagtacgttcttagggcac

SEQ ID NO: 104587 - DNA, 25 bp, Homo sapien
tgagtaaatatggcaaagaacagct

SEQ ID NO: 104588 - DNA, 25 bp, Homo sapien
tgagtaaattctatctagctcattc

SEQ ID NO: 104589 - DNA, 25 bp, Homo sapien
tgagtaacacctgcattctctcacc

SEQ ID NO: 104590 - DNA, 25 bp, Homo sapien
tgagtaaccaaaaacaggtatgaac

SEQ ID NO: 104591 - DNA, 25 bp, Homo sapien
tgagtaaccaaaaccaggtatgaac

SEQ ID NO: 104592 - DNA, 25 bp, Homo sapien
tgagtaacccaccgtgtaccacttt

SEQ ID NO: 104593 - DNA, 25 bp, Homo sapien
tgagtaacctaccgtgtaccacttt

SEQ ID NO: 104594 - DNA, 25 bp, Homo sapien
tgagtaactcctgcattctctcacc

SEQ ID NO: 104595 - DNA, 25 bp, Homo sapien
tgagtaacttctatgtgccaggtac

SEQ ID NO: 104596 - DNA, 25 bp, Homo sapien
tgagtaacttctgtgtgccaggtac

SEQ ID NO: 104597 - DNA, 25 bp, Homo sapien
tgagtaagagatttttctggattat

SEQ ID NO: 104598 - DNA, 25 bp, Homo sapien
tgagtaaggagactgattggacttt

SEQ ID NO: 104599 - DNA, 25 bp, Homo sapien
tgagtaaggagattgattggacttt

SEQ ID NO: 104600 - DNA, 25 bp, Homo sapien
tgagtaaggcgacttgactttgaaa

SEQ ID NO: 104601 - DNA, 25 bp, Homo sapien
tgagtaagggatttttctggattat

SEQ ID NO: 104602 - DNA, 25 bp, Homo sapien
tgagtaaggtcacaggaaaagatgt

SEQ ID NO: 104603 - DNA, 25 bp, Homo sapien
tgagtaaggtcaccggaaaagatgt

SEQ ID NO: 104604 - DNA, 25 bp, Homo sapien
tgagtaaggtgacttgactttgaaa

SEQ ID NO: 104605 - DNA, 25 bp, Homo sapien
tgagtaatagtgacaagctaataaa

SEQ ID NO: 104606 - DNA, 25 bp, Homo sapien
tgagtaatagtggcaagctaataaa

SEQ ID NO: 104607 - DNA, 25 bp, Homo sapien
tgagtaattcttacgtggcagtcac

SEQ ID NO: 104608 - DNA, 25 bp, Homo sapien
tgagtaattcttatgtggcagtcac

SEQ ID NO: 104609 - DNA, 25 bp, Homo sapien
tgagtacatttccgggtcggctaat

SEQ ID NO: 104610 - DNA, 25 bp, Homo sapien
tgagtacatttctgggtcggctaat

SEQ ID NO: 104611 - DNA, 25 bp, Homo sapien
tgagtacctattgatatgtgtggtg

SEQ ID NO: 104612 - DNA, 25 bp, Homo sapien
tgagtacctgttgatatgtgtggtg

SEQ ID NO: 104613 - DNA, 25 bp, Homo sapien
tgagtagaacgtcacttgatccttg

SEQ ID NO: 104614 - DNA, 25 bp, Homo sapien
tgagtagaacgttacttgatccttg

SEQ ID NO: 104615 - DNA, 25 bp, Homo sapien
tgagtagaggtacaacatagcaaaa

SEQ ID NO: 104616 - DNA, 25 bp, Homo sapien
tgagtagaggtataacatagcaaaa

SEQ ID NO: 104617 - DNA, 25 bp, Homo sapien
tgagtaggagactggaaggaaggag

SEQ ID NO: 104618 - DNA, 25 bp, Homo sapien
tgagtaggagattggaaggaaggag

SEQ ID NO: 104619 - DNA, 25 bp, Homo sapien
tgagtagttcagcttgtgacatggt

SEQ ID NO: 104620 - DNA, 25 bp, Homo sapien
tgagtagttcagtttgtgacatggt

SEQ ID NO: 104621 - DNA, 25 bp, Homo sapien
tgagtatgaggctactgtttccatc

SEQ ID NO: 104622 - DNA, 25 bp, Homo sapien
tgagtatgaggctactttttccatc

SEQ ID NO: 104623 - DNA, 25 bp, Homo sapien
tgagtatggaatcaagaaatggatt

SEQ ID NO: 104624 - DNA, 25 bp, Homo sapien
tgagtatggtatcaagaaatggatt

SEQ ID NO: 104625 - DNA, 25 bp, Homo sapien
tgagtatgtcgactgatccaattga

SEQ ID NO: 104626 - DNA, 25 bp, Homo sapien
tgagtatgttgactgatccaattga

SEQ ID NO: 104627 - DNA, 25 bp, Homo sapien
tgagtattccggagacatggcctct

SEQ ID NO: 104628 - DNA, 25 bp, Homo sapien
tgagtattctggagacatggcctct

SEQ ID NO: 104629 - DNA, 25 bp, Homo sapien
tgagtattgctaacatacattaaac

SEQ ID NO: 104630 - DNA, 25 bp, Homo sapien
tgagtattggtaacatacattaaac

SEQ ID NO: 104631 - DNA, 25 bp, Homo sapien
tgagtcaagttatcggttgacatcc

SEQ ID NO: 104632 - DNA, 25 bp, Homo sapien
tgagtcaagttattggttgacatcc

SEQ ID NO: 104633 - DNA, 25 bp, Homo sapien
tgagtcactctgaccattgaagaca

SEQ ID NO: 104634 - DNA, 25 bp, Homo sapien
tgagtcactgtgaccattgaagaca

SEQ ID NO: 104635 - DNA, 25 bp, Homo sapien
tgagtcagagattgcttctaaactt

SEQ ID NO: 104636 - DNA, 25 bp, Homo sapien
tgagtcagagtcttgttctgttgcc

SEQ ID NO: 104637 - DNA, 25 bp, Homo sapien
tgagtcagagtctttttctgttgcc

SEQ ID NO: 104638 - DNA, 25 bp, Homo sapien
tgagtcagggattgcttctaaactt

SEQ ID NO: 104639 - DNA, 25 bp, Homo sapien
tgagtcatatcaagaaaggagaagc

SEQ ID NO: 104640 - DNA, 25 bp, Homo sapien
tgagtcatatcaagaagggagaagc

SEQ ID NO: 104641 - DNA, 25 bp, Homo sapien
tgagtcatccaatgccctataactg

SEQ ID NO: 104642 - DNA, 25 bp, Homo sapien
tgagtcatcgcaaaccaccatgaat

SEQ ID NO: 104643 - DNA, 25 bp, Homo sapien
tgagtcatcgccaaccaccatgaat

SEQ ID NO: 104644 - DNA, 25 bp, Homo sapien
tgagtcatctggtaaccgtgtgttt

SEQ ID NO: 104645 - DNA, 25 bp, Homo sapien
tgagtcatctggtaactgtgtgttt

SEQ ID NO: 104646 - DNA, 25 bp, Homo sapien
tgagtcatgcaatgccctataactg

SEQ ID NO: 104647 - DNA, 25 bp, Homo sapien
tgagtcatgtacagtataaaggatt

SEQ ID NO: 104648 - DNA, 25 bp, Homo sapien
tgagtcatgtatagtataaaggatt

SEQ ID NO: 104649 - DNA, 25 bp, Homo sapien
tgagtcattggctggaaagagacaa

SEQ ID NO: 104650 - DNA, 25 bp, Homo sapien
tgagtcattggctggagagagacaa

SEQ ID NO: 104651 - DNA, 25 bp, Homo sapien
tgagtcatttttaattctctgagcc

SEQ ID NO: 104652 - DNA, 25 bp, Homo sapien
tgagtcatttttatttctctgagcc

SEQ ID NO: 104653 - DNA, 25 bp, Homo sapien
tgagtccaactgaaaaaattgacag

SEQ ID NO: 104654 - DNA, 25 bp, Homo sapien
tgagtccacagtgagtaattaatac

SEQ ID NO: 104655 - DNA, 25 bp, Homo sapien
tgagtccagagtgagtaattaatac

SEQ ID NO: 104656 - DNA, 25 bp, Homo sapien
tgagtccagctgaaaaaattgacag

SEQ ID NO: 104657 - DNA, 25 bp, Homo sapien
tgagtccaggaggaagactgaggaa

SEQ ID NO: 104658 - DNA, 25 bp, Homo sapien
tgagtccaggaggaagtctgaggaa

SEQ ID NO: 104659 - DNA, 25 bp, Homo sapien
tgagtccttggccgccggacagggc

SEQ ID NO: 104660 - DNA, 25 bp, Homo sapien
tgagtccttggctgccggacagggc

SEQ ID NO: 104661 - DNA, 25 bp, Homo sapien
tgagtctatccttgtctctgtaatg

SEQ ID NO: 104662 - DNA, 25 bp, Homo sapien
tgagtctattcttgtctctgtaatg

SEQ ID NO: 104663 - DNA, 25 bp, Homo sapien
tgagtctcctgtttctgattgtagc

SEQ ID NO: 104664 - DNA, 25 bp, Homo sapien
tgagtctcctgtttttgattgtagc

SEQ ID NO: 104665 - DNA, 25 bp, Homo sapien
tgagtctctgctgctctgatgaagg

SEQ ID NO: 104666 - DNA, 25 bp, Homo sapien
tgagtctctgctgttctgatgaagg

SEQ ID NO: 104667 - DNA, 25 bp, Homo sapien
tgagtctgagaaagtcagttccttt

SEQ ID NO: 104668 - DNA, 25 bp, Homo sapien
tgagtctgcaagagccaagcattac

SEQ ID NO: 104669 - DNA, 25 bp, Homo sapien
tgagtctgcaagatccaagcattac

SEQ ID NO: 104670 - DNA, 25 bp, Homo sapien
tgagtctgggaaagtcagttccttt

SEQ ID NO: 104671 - DNA, 25 bp, Homo sapien
tgagtctggttatctctatttaaat

SEQ ID NO: 104672 - DNA, 25 bp, Homo sapien
tgagtctggttatttctatttaaat

SEQ ID NO: 104673 - DNA, 25 bp, Homo sapien
tgagtctgtgctttcataggccact

SEQ ID NO: 104674 - DNA, 25 bp, Homo sapien
tgagtctgtgctttgataggccact

SEQ ID NO: 104675 - DNA, 25 bp, Homo sapien
tgagtgaacgggtgaaaaacaacac

SEQ ID NO: 104676 - DNA, 25 bp, Homo sapien
tgagtgaagacataagatctattct

SEQ ID NO: 104677 - DNA, 25 bp, Homo sapien
tgagtgaagacgtaagatctattct

SEQ ID NO: 104678 - DNA, 25 bp, Homo sapien
tgagtgaatgggtgaaaaacaacac

SEQ ID NO: 104679 - DNA, 25 bp, Homo sapien
tgagtgacgtgtttctcctggtaac

SEQ ID NO: 104680 - DNA, 25 bp, Homo sapien
tgagtgacgtgtttttcctggtaac

SEQ ID NO: 104681 - DNA, 25 bp, Homo sapien
tgagtgagcaggcaccagctgtgac

SEQ ID NO: 104682 - DNA, 25 bp, Homo sapien
tgagtgagcaggcaccggctgtgac

SEQ ID NO: 104683 - DNA, 25 bp, Homo sapien
tgagtgagctataataggccttaaa

SEQ ID NO: 104684 - DNA, 25 bp, Homo sapien
tgagtgagctatactaggccttaaa

SEQ ID NO: 104685 - DNA, 25 bp, Homo sapien
tgagtgagggaacaatgaaccctac

SEQ ID NO: 104686 - DNA, 25 bp, Homo sapien
tgagtgagggaaccatgaaccctac

SEQ ID NO: 104687 - DNA, 25 bp, Homo sapien
tgagtgatccctgcagtattgtttc

SEQ ID NO: 104688 - DNA, 25 bp, Homo sapien
tgagtgatccctgcggtattgtttc

SEQ ID NO: 104689 - DNA, 25 bp, Homo sapien
tgagtgatgatactggcccccaagt

SEQ ID NO: 104690 - DNA, 25 bp, Homo sapien
tgagtgatggagtcggctctttcct

SEQ ID NO: 104691 - DNA, 25 bp, Homo sapien
tgagtgatggagttggctctttcct

SEQ ID NO: 104692 - DNA, 25 bp, Homo sapien
tgagtgatgttactggcccccaagt

SEQ ID NO: 104693 - DNA, 25 bp, Homo sapien
tgagtgattattatttatttgctaa

SEQ ID NO: 104694 - DNA, 25 bp, Homo sapien
tgagtgattattctttatttgctaa

SEQ ID NO: 104695 - DNA, 25 bp, Homo sapien
tgagtgcatagcaaacaacaacata

SEQ ID NO: 104696 - DNA, 25 bp, Homo sapien
tgagtgcatagcagacaacaacata

SEQ ID NO: 104697 - DNA, 25 bp, Homo sapien
tgagtgcctgaacaaaatggaattc

SEQ ID NO: 104698 - DNA, 25 bp, Homo sapien
tgagtgcctgaataaaatggaattc

SEQ ID NO: 104699 - DNA, 25 bp, Homo sapien
tgagtgctttccatttgctaattca

SEQ ID NO: 104700 - DNA, 25 bp, Homo sapien
tgagtgctttccgtttgctaattca

SEQ ID NO: 104701 - DNA, 25 bp, Homo sapien
tgagtggaatcctccaaaaatgaac

SEQ ID NO: 104702 - DNA, 25 bp, Homo sapien
tgagtggaatcctccagaaatgaac

SEQ ID NO: 104703 - DNA, 25 bp, Homo sapien
tgagtggagaagtagttacctttta

SEQ ID NO: 104704 - DNA, 25 bp, Homo sapien
tgagtggagaagtcgttacctttta

SEQ ID NO: 104705 - DNA, 25 bp, Homo sapien
tgagtggcaagctcaaatttaaact

SEQ ID NO: 104706 - DNA, 25 bp, Homo sapien
tgagtggcaagctctaatttaaact

SEQ ID NO: 104707 - DNA, 25 bp, Homo sapien
tgagtggcacatgacacagtgagac

SEQ ID NO: 104708 - DNA, 25 bp, Homo sapien
tgagtggcacattacacagtgagac

SEQ ID NO: 104709 - DNA, 25 bp, Homo sapien
tgagtggccagtgttattaactatg

SEQ ID NO: 104710 - DNA, 25 bp, Homo sapien
tgagtggccggtgttattaactatg

SEQ ID NO: 104711 - DNA, 25 bp, Homo sapien
tgagtggtgctaaaagaatctactg

SEQ ID NO: 104712 - DNA, 25 bp, Homo sapien
tgagtggtgttaaaagaatctactg

SEQ ID NO: 104713 - DNA, 25 bp, Homo sapien
tgagtgtcaaaaaccgatgatgaca

SEQ ID NO: 104714 - DNA, 25 bp, Homo sapien
tgagtgtcaaaacccgatgatgaca

SEQ ID NO: 104715 - DNA, 25 bp, Homo sapien
tgagtgtgcataatctcttccagat

SEQ ID NO: 104716 - DNA, 25 bp, Homo sapien
tgagtgtgcatattctcttccagat

SEQ ID NO: 104717 - DNA, 25 bp, Homo sapien
tgagtgttgctccagctctctgttt

SEQ ID NO: 104718 - DNA, 25 bp, Homo sapien
tgagtgttggtggatccaagtctat

SEQ ID NO: 104719 - DNA, 25 bp, Homo sapien
tgagtgttggttgatccaagtctat

SEQ ID NO: 104720 - DNA, 25 bp, Homo sapien
tgagtgtttctccagctctctgttt

SEQ ID NO: 104721 - DNA, 25 bp, Homo sapien
tgagttacaggtaaaaactgaaatg

SEQ ID NO: 104722 - DNA, 25 bp, Homo sapien
tgagttacaggtagaaactgaaatg

SEQ ID NO: 104723 - DNA, 25 bp, Homo sapien
tgagttactcaactgggagtcgcag

SEQ ID NO: 104724 - DNA, 25 bp, Homo sapien
tgagttactgaactgggagtcgcag

SEQ ID NO: 104725 - DNA, 25 bp, Homo sapien
tgagttagcagtcccagaatgttac

SEQ ID NO: 104726 - DNA, 25 bp, Homo sapien
tgagttagcagtctcagaatgttac

SEQ ID NO: 104727 - DNA, 25 bp, Homo sapien
tgagttaggcgagaacagtggtgta

SEQ ID NO: 104728 - DNA, 25 bp, Homo sapien
tgagttaggtgagaacagtggtgta

SEQ ID NO: 104729 - DNA, 25 bp, Homo sapien
tgagttatctttacgcaacagcatc

SEQ ID NO: 104730 - DNA, 25 bp, Homo sapien
tgagttatctttactcaacagcatc

SEQ ID NO: 104731 - DNA, 25 bp, Homo sapien
tgagttcaaacaccaacaagaaaac

SEQ ID NO: 104732 - DNA, 25 bp, Homo sapien
tgagttcaaacgccaacaagaaaac

SEQ ID NO: 104733 - DNA, 25 bp, Homo sapien
tgagttcaaatcatgactttgccaa

SEQ ID NO: 104734 - DNA, 25 bp, Homo sapien
tgagttcaaatcgtgactttgccaa

SEQ ID NO: 104735 - DNA, 25 bp, Homo sapien
tgagttcagcagatatttgactctg

SEQ ID NO: 104736 - DNA, 25 bp, Homo sapien
tgagttcagcaggtatttgactctg

SEQ ID NO: 104737 - DNA, 25 bp, Homo sapien
tgagttcaggcaaatcatctaagtc

SEQ ID NO: 104738 - DNA, 25 bp, Homo sapien
tgagttcaggcaagtcatctaagtc

SEQ ID NO: 104739 - DNA, 25 bp, Homo sapien
tgagttccaccaaatcaagaggtaa

SEQ ID NO: 104740 - DNA, 25 bp, Homo sapien
tgagttccaccaaatcgagaggtaa

SEQ ID NO: 104741 - DNA, 25 bp, Homo sapien
tgagttccgtgtatgttgtcagatg

SEQ ID NO: 104742 - DNA, 25 bp, Homo sapien
tgagttcctgacaggttactggcca

SEQ ID NO: 104743 - DNA, 25 bp, Homo sapien
tgagttcctgataggttactggcca

SEQ ID NO: 104744 - DNA, 25 bp, Homo sapien
tgagttccttgtatgttgtcagatg

SEQ ID NO: 104745 - DNA, 25 bp, Homo sapien
tgagttctacatgagcctctcatgc

SEQ ID NO: 104746 - DNA, 25 bp, Homo sapien
tgagttctatctaccttctttacat

SEQ ID NO: 104747 - DNA, 25 bp, Homo sapien
tgagttctctagccacctctcatac

SEQ ID NO: 104748 - DNA, 25 bp, Homo sapien
tgagttctctagcctcctctcatac

SEQ ID NO: 104749 - DNA, 25 bp, Homo sapien
tgagttctgaattggaagagcatca

SEQ ID NO: 104750 - DNA, 25 bp, Homo sapien
tgagttctgaatttgaagagcatca

SEQ ID NO: 104751 - DNA, 25 bp, Homo sapien
tgagttctgtctaccttctttacat

SEQ ID NO: 104752 - DNA, 25 bp, Homo sapien
tgagttcttcatgagcctctcatgc

SEQ ID NO: 104753 - DNA, 25 bp, Homo sapien
tgagtttaccaatcaacgtgtacac

SEQ ID NO: 104754 - DNA, 25 bp, Homo sapien
tgagtttaccaatcaatgtgtacac

SEQ ID NO: 104755 - DNA, 25 bp, Homo sapien
tgagtttacgaggtattttatcttt

SEQ ID NO: 104756 - DNA, 25 bp, Homo sapien
tgagtttatgaggtattttatcttt

SEQ ID NO: 104757 - DNA, 25 bp, Homo sapien
tgagtttcttaaataggtaggtatt

SEQ ID NO: 104758 - DNA, 25 bp, Homo sapien
tgagtttcttaaattggtaggtatt

SEQ ID NO: 104759 - DNA, 25 bp, Homo sapien
tgagtttgaaccatcttccagcctc

SEQ ID NO: 104760 - DNA, 25 bp, Homo sapien
tgagtttgagccatcttccagcctc

SEQ ID NO: 104761 - DNA, 25 bp, Homo sapien
tgagtttgggcaggacttgtttatt

SEQ ID NO: 104762 - DNA, 25 bp, Homo sapien
tgagtttgggcagtacttgtttatt

SEQ ID NO: 104763 - DNA, 25 bp, Homo sapien
tgagtttttggcccaaggatggagg

SEQ ID NO: 104764 - DNA, 25 bp, Homo sapien
tgagtttttggcccgaggatggagg

SEQ ID NO: 104765 - DNA, 25 bp, Homo sapien
tgataaaaactcaaacgagtagtaa

SEQ ID NO: 104766 - DNA, 25 bp, Homo sapien
tgataaaaactcaagcgagtagtaa

SEQ ID NO: 104767 - DNA, 25 bp, Homo sapien
tgataaaacccaacaaatcatcgat

SEQ ID NO: 104768 - DNA, 25 bp, Homo sapien
tgataaaacccagcaaatcatcgat

SEQ ID NO: 104769 - DNA, 25 bp, Homo sapien
tgataaacaatatgtttggcattct

SEQ ID NO: 104770 - DNA, 25 bp, Homo sapien
tgataaacagtatgtttggcattct

SEQ ID NO: 104771 - DNA, 25 bp, Homo sapien
tgataaatactgacaaatagcatta

SEQ ID NO: 104772 - DNA, 25 bp, Homo sapien
tgataaatattgacaaatagcatta

SEQ ID NO: 104773 - DNA, 25 bp, Homo sapien
tgataaatgagaaaacatgtcataa

SEQ ID NO: 104774 - DNA, 25 bp, Homo sapien
tgataaatgggaaaacatgtcataa

SEQ ID NO: 104775 - DNA, 25 bp, Homo sapien
tgataaccaaatacatctccagaca

SEQ ID NO: 104776 - DNA, 25 bp, Homo sapien
tgataaccaaatacgtctccagaca

SEQ ID NO: 104777 - DNA, 25 bp, Homo sapien
tgataaccaccatcatgcaaacatg

SEQ ID NO: 104778 - DNA, 25 bp, Homo sapien
tgataaccaccatcgtgcaaacatg

SEQ ID NO: 104779 - DNA, 25 bp, Homo sapien
tgataagaatgccaattaaatgcac

SEQ ID NO: 104780 - DNA, 25 bp, Homo sapien
tgataagaatgccgattaaatgcac

SEQ ID NO: 104781 - DNA, 25 bp, Homo sapien
tgataagcatatcagacatagtgga

SEQ ID NO: 104782 - DNA, 25 bp, Homo sapien
tgataagcgtatcagacatagtgga

SEQ ID NO: 104783 - DNA, 25 bp, Homo sapien
tgataagctaacaagaatcaacatt

SEQ ID NO: 104784 - DNA, 25 bp, Homo sapien
tgataagctaataagaatcaacatt

SEQ ID NO: 104785 - DNA, 25 bp, Homo sapien
tgataaggtcacccaaaaatgtcca

SEQ ID NO: 104786 - DNA, 25 bp, Homo sapien
tgataaggtcatccaaaaatgtcca

SEQ ID NO: 104787 - DNA, 25 bp, Homo sapien
tgataataaccataacatctacgaa

SEQ ID NO: 104788 - DNA, 25 bp, Homo sapien
tgataataaccataacgtctacgaa

SEQ ID NO: 104789 - DNA, 25 bp, Homo sapien
tgataatcattgccaggatttgatt

SEQ ID NO: 104790 - DNA, 25 bp, Homo sapien
tgataatcattgtcaggatttgatt

SEQ ID NO: 104791 - DNA, 25 bp, Homo sapien
tgataatccactctcattctccgag

SEQ ID NO: 104792 - DNA, 25 bp, Homo sapien
tgataatccactcttattctccgag

SEQ ID NO: 104793 - DNA, 25 bp, Homo sapien
tgataatgccccagtttggcttcct

SEQ ID NO: 104794 - DNA, 25 bp, Homo sapien
tgataatgccccggtttggcttcct

SEQ ID NO: 104795 - DNA, 25 bp, Homo sapien
tgataatgttcagacatccagttat

SEQ ID NO: 104796 - DNA, 25 bp, Homo sapien
tgataatgttcagatatccagttat

SEQ ID NO: 104797 - DNA, 25 bp, Homo sapien
tgataattctcagagaccaaagagc

SEQ ID NO: 104798 - DNA, 25 bp, Homo sapien
tgataattctcagagatcaaagagc

SEQ ID NO: 104799 - DNA, 25 bp, Homo sapien
tgatacaacatatgaacttgtaaag

SEQ ID NO: 104800 - DNA, 25 bp, Homo sapien
tgatacaacttatgaacttgtaaag

SEQ ID NO: 104801 - DNA, 25 bp, Homo sapien
tgatacaagaacatcaatgcagaat

SEQ ID NO: 104802 - DNA, 25 bp, Homo sapien
tgatacaagaacatcagtgcagaat

SEQ ID NO: 104803 - DNA, 25 bp, Homo sapien
tgatacagcaacataactcctgagt

SEQ ID NO: 104804 - DNA, 25 bp, Homo sapien
tgatacagcaacatgactcctgagt

SEQ ID NO: 104805 - DNA, 25 bp, Homo sapien
tgatacatagaatacaatgaaaatg

SEQ ID NO: 104806 - DNA, 25 bp, Homo sapien
tgatacatagactacaatgaaaatg

SEQ ID NO: 104807 - DNA, 25 bp, Homo sapien
tgataccaaaacccaaaagagacat

SEQ ID NO: 104808 - DNA, 25 bp, Homo sapien
tgataccaaaacccgaaagagacat

SEQ ID NO: 104809 - DNA, 25 bp, Homo sapien
tgatactctacacatgctctataaa

SEQ ID NO: 104810 - DNA, 25 bp, Homo sapien
tgatactctacacgtgctctataaa

SEQ ID NO: 104811 - DNA, 25 bp, Homo sapien
tgatactgagataaggataaacata

SEQ ID NO: 104812 - DNA, 25 bp, Homo sapien
tgatactgagatagggataaacata

SEQ ID NO: 104813 - DNA, 25 bp, Homo sapien
tgatacttttatgtaattctctgtt

SEQ ID NO: 104814 - DNA, 25 bp, Homo sapien
tgatacttttatttaattctctgtt

SEQ ID NO: 104815 - DNA, 25 bp, Homo sapien
tgatagaaacaaagtgcgaagttca

SEQ ID NO: 104816 - DNA, 25 bp, Homo sapien
tgatagaaacaaagtgtgaagttca

SEQ ID NO: 104817 - DNA, 25 bp, Homo sapien
tgatagaacatcatccttccattgg

SEQ ID NO: 104818 - DNA, 25 bp, Homo sapien
tgatagaacgtcatccttccattgg

SEQ ID NO: 104819 - DNA, 25 bp, Homo sapien
tgatagaagaaaaagacatatgggt

SEQ ID NO: 104820 - DNA, 25 bp, Homo sapien
tgatagaagcatttctacattaaac

SEQ ID NO: 104821 - DNA, 25 bp, Homo sapien
tgatagaagcatttctgcattaaac

SEQ ID NO: 104822 - DNA, 25 bp, Homo sapien
tgatagaaggaaaagacatatgggt

SEQ ID NO: 104823 - DNA, 25 bp, Homo sapien
tgatagagcagaaccctttttcaaa

SEQ ID NO: 104824 - DNA, 25 bp, Homo sapien
tgatagagcggaaccctttttcaaa

SEQ ID NO: 104825 - DNA, 25 bp, Homo sapien
tgatagatatcacaatactcacaat

SEQ ID NO: 104826 - DNA, 25 bp, Homo sapien
tgatagatatcagaatactcacaat

SEQ ID NO: 104827 - DNA, 25 bp, Homo sapien
tgatagatcctcacattcattccct

SEQ ID NO: 104828 - DNA, 25 bp, Homo sapien
tgatagatcctcagattcattccct

SEQ ID NO: 104829 - DNA, 25 bp, Homo sapien
tgatagatcgaagcctatagtgtct

SEQ ID NO: 104830 - DNA, 25 bp, Homo sapien
tgatagatcttattatcaggcatat

SEQ ID NO: 104831 - DNA, 25 bp, Homo sapien
tgatagatcttattatgaggcatat

SEQ ID NO: 104832 - DNA, 25 bp, Homo sapien
tgatagattgaagcctatagtgtct

SEQ ID NO: 104833 - DNA, 25 bp, Homo sapien
tgatagattgaggtaacgctcataa

SEQ ID NO: 104834 - DNA, 25 bp, Homo sapien
tgatagattgaggtaatgctcataa

SEQ ID NO: 104835 - DNA, 25 bp, Homo sapien
tgatagcatctcatctgcagcccca

SEQ ID NO: 104836 - DNA, 25 bp, Homo sapien
tgatagcatgtcatctgcagcccca

SEQ ID NO: 104837 - DNA, 25 bp, Homo sapien
tgatagctatggtaaaataaggaaa

SEQ ID NO: 104838 - DNA, 25 bp, Homo sapien
tgatagctatgttaaaataaggaaa

SEQ ID NO: 104839 - DNA, 25 bp, Homo sapien
tgatagctgcaatagaaagtaaagc

SEQ ID NO: 104840 - DNA, 25 bp, Homo sapien
tgatagctgcagtagaaagtaaagc

SEQ ID NO: 104841 - DNA, 25 bp, Homo sapien
tgataggaagaccgcactttgcaat

SEQ ID NO: 104842 - DNA, 25 bp, Homo sapien
tgataggaagactgcactttgcaat

SEQ ID NO: 104843 - DNA, 25 bp, Homo sapien
tgataggactttagccttttacctg

SEQ ID NO: 104844 - DNA, 25 bp, Homo sapien
tgataggattttagccttttacctg

SEQ ID NO: 104845 - DNA, 25 bp, Homo sapien
tgatataaagctagcattaattttc

SEQ ID NO: 104846 - DNA, 25 bp, Homo sapien
tgatataaagctaggattaattttc

SEQ ID NO: 104847 - DNA, 25 bp, Homo sapien
tgatatacactgaaattagggatcc

SEQ ID NO: 104848 - DNA, 25 bp, Homo sapien
tgatatacattgaaattagggatcc

SEQ ID NO: 104849 - DNA, 25 bp, Homo sapien
tgatatataggttgacttagctttg

SEQ ID NO: 104850 - DNA, 25 bp, Homo sapien
tgatatataggttggcttagctttg

SEQ ID NO: 104851 - DNA, 25 bp, Homo sapien
tgatatatgtatacgattgagcagg

SEQ ID NO: 104852 - DNA, 25 bp, Homo sapien
tgatatatgtatatgattgagcagg

SEQ ID NO: 104853 - DNA, 25 bp, Homo sapien
tgatatccagttctcaaatgaccat

SEQ ID NO: 104854 - DNA, 25 bp, Homo sapien
tgatatccagttttcaaatgaccat

SEQ ID NO: 104855 - DNA, 25 bp, Homo sapien
tgatatctatcaatggagaaggcgc

SEQ ID NO: 104856 - DNA, 25 bp, Homo sapien
tgatatctctcaatggagaaggcgc

SEQ ID NO: 104857 - DNA, 25 bp, Homo sapien
tgatatgaacaattaacatttcttg

SEQ ID NO: 104858 - DNA, 25 bp, Homo sapien
tgatatgaacagttaacatttcttg

SEQ ID NO: 104859 - DNA, 25 bp, Homo sapien
tgatatgacctcggtgtttattgtc

SEQ ID NO: 104860 - DNA, 25 bp, Homo sapien
tgatatgacttcggtgtttattgtc

SEQ ID NO: 104861 - DNA, 25 bp, Homo sapien
tgatattaaatgcagactctgttga

SEQ ID NO: 104862 - DNA, 25 bp, Homo sapien
tgatattaaatgtagactctgttga

SEQ ID NO: 104863 - DNA, 25 bp, Homo sapien
tgatattatcaacacgacagaagag

SEQ ID NO: 104864 - DNA, 25 bp, Homo sapien
tgatattatcaacatgacagaagag

SEQ ID NO: 104865 - DNA, 25 bp, Homo sapien
tgatattgctaaacttctggtattg

SEQ ID NO: 104866 - DNA, 25 bp, Homo sapien
tgatattgctaatcttctggtattg

SEQ ID NO: 104867 - DNA, 25 bp, Homo sapien
tgatattgttccataacctgttaaa

SEQ ID NO: 104868 - DNA, 25 bp, Homo sapien
tgatattgttctataacctgttaaa

SEQ ID NO: 104869 - DNA, 25 bp, Homo sapien
tgatatttataaagcagaaaaaatc

SEQ ID NO: 104870 - DNA, 25 bp, Homo sapien
tgatatttataaggcagaaaaaatc

SEQ ID NO: 104871 - DNA, 25 bp, Homo sapien
tgatatttcagttaaggttctcttg

SEQ ID NO: 104872 - DNA, 25 bp, Homo sapien
tgatatttcagttgaggttctcttg

SEQ ID NO: 104873 - DNA, 25 bp, Homo sapien
tgatatttgatgaggccgtgaaatg

SEQ ID NO: 104874 - DNA, 25 bp, Homo sapien
tgatatttgatgaggctgtgaaatg

SEQ ID NO: 104875 - DNA, 25 bp, Homo sapien
tgatattttgtgctcacgtcctatg

SEQ ID NO: 104876 - DNA, 25 bp, Homo sapien
tgatattttgtgctcatgtcctatg

SEQ ID NO: 104877 - DNA, 25 bp, Homo sapien
tgatcaaaactgcatgatcttctgc

SEQ ID NO: 104878 - DNA, 25 bp, Homo sapien
tgatcaaaactgcgtgatcttctgc

SEQ ID NO: 104879 - DNA, 25 bp, Homo sapien
tgatcaaatacaaacagatggaaag

SEQ ID NO: 104880 - DNA, 25 bp, Homo sapien
tgatcaaatacacacagatggaaag

SEQ ID NO: 104881 - DNA, 25 bp, Homo sapien
tgatcaaatattccatgagtgttcc

SEQ ID NO: 104882 - DNA, 25 bp, Homo sapien
tgatcaaatattccgtgagtgttcc

SEQ ID NO: 104883 - DNA, 25 bp, Homo sapien
tgatcaaattttgcgaagataagaa

SEQ ID NO: 104884 - DNA, 25 bp, Homo sapien
tgatcaaattttgtgaagataagaa

SEQ ID NO: 104885 - DNA, 25 bp, Homo sapien
tgatcaacgatacggcagaagtatg

SEQ ID NO: 104886 - DNA, 25 bp, Homo sapien
tgatcaacgatatggcagaagtatg

SEQ ID NO: 104887 - DNA, 25 bp, Homo sapien
tgatcaacgtaatagtaaaaattct

SEQ ID NO: 104888 - DNA, 25 bp, Homo sapien
tgatcaacgtaatggtaaaaattct

SEQ ID NO: 104889 - DNA, 25 bp, Homo sapien
tgatcaagtctgcttagaaaggaaa

SEQ ID NO: 104890 - DNA, 25 bp, Homo sapien
tgatcaagtctgtttagaaaggaaa

SEQ ID NO: 104891 - DNA, 25 bp, Homo sapien
tgatcaataggttaaatgtgattac

SEQ ID NO: 104892 - DNA, 25 bp, Homo sapien
tgatcaataggttcaatgtgattac

SEQ ID NO: 104893 - DNA, 25 bp, Homo sapien
tgatcacagtgatatatgagtagac

SEQ ID NO: 104894 - DNA, 25 bp, Homo sapien
tgatcacagtggtatatgagtagac

SEQ ID NO: 104895 - DNA, 25 bp, Homo sapien
tgatcacatgaaacactttatttat

SEQ ID NO: 104896 - DNA, 25 bp, Homo sapien
tgatcacatgaagcactttatttat

SEQ ID NO: 104897 - DNA, 25 bp, Homo sapien
tgatcaccaatggccactaaaatca

SEQ ID NO: 104898 - DNA, 25 bp, Homo sapien
tgatcaccaatggctactaaaatca

SEQ ID NO: 104899 - DNA, 25 bp, Homo sapien
tgatcaccttaaactgaaactcgat

SEQ ID NO: 104900 - DNA, 25 bp, Homo sapien
tgatcaccttaaattgaaactcgat

SEQ ID NO: 104901 - DNA, 25 bp, Homo sapien
tgatcacgtggtctgccagggctgc

SEQ ID NO: 104902 - DNA, 25 bp, Homo sapien
tgatcacgtggtttgccagggctgc

SEQ ID NO: 104903 - DNA, 25 bp, Homo sapien
tgatcaggctaaatcgccaggtcag

SEQ ID NO: 104904 - DNA, 25 bp, Homo sapien
tgatcaggttaaatcgccaggtcag

SEQ ID NO: 104905 - DNA, 25 bp, Homo sapien
tgatcatagcatcgtgattttgtta

SEQ ID NO: 104906 - DNA, 25 bp, Homo sapien
tgatcatagcatggtgattttgtta

SEQ ID NO: 104907 - DNA, 25 bp, Homo sapien
tgatcatcaatttaaatcagcctca

SEQ ID NO: 104908 - DNA, 25 bp, Homo sapien
tgatcatcattttaaatcagcctca

SEQ ID NO: 104909 - DNA, 25 bp, Homo sapien
tgatcatctaatccaattccttcag

SEQ ID NO: 104910 - DNA, 25 bp, Homo sapien
tgatcatctaatctaattccttcag

SEQ ID NO: 104911 - DNA, 25 bp, Homo sapien
tgatcatctggccaattctataggt

SEQ ID NO: 104912 - DNA, 25 bp, Homo sapien
tgatcatctggtcaattctataggt

SEQ ID NO: 104913 - DNA, 25 bp, Homo sapien
tgatcatgattcctgagaaatattg

SEQ ID NO: 104914 - DNA, 25 bp, Homo sapien
tgatcatgattcttgagaaatattg

SEQ ID NO: 104915 - DNA, 25 bp, Homo sapien
tgatcatggactacttcatgtctta

SEQ ID NO: 104916 - DNA, 25 bp, Homo sapien
tgatcatggactatttcatgtctta

SEQ ID NO: 104917 - DNA, 25 bp, Homo sapien
tgatcattatcctatcccatttctt

SEQ ID NO: 104918 - DNA, 25 bp, Homo sapien
tgatcattatcttatcccatttctt

SEQ ID NO: 104919 - DNA, 25 bp, Homo sapien
tgatcattgtcctttgattcatgga

SEQ ID NO: 104920 - DNA, 25 bp, Homo sapien
tgatcattgtcctttgtttcatgga

SEQ ID NO: 104921 - DNA, 25 bp, Homo sapien
tgatcattttgcaactcctaacaac

SEQ ID NO: 104922 - DNA, 25 bp, Homo sapien
tgatcattttgcagctcctaacaac

SEQ ID NO: 104923 - DNA, 25 bp, Homo sapien
tgatccaacaatcttcatttgggag

SEQ ID NO: 104924 - DNA, 25 bp, Homo sapien
tgatccaacaatcttcgtttgggag

SEQ ID NO: 104925 - DNA, 25 bp, Homo sapien
tgatccaagctgtagtccacagatc

SEQ ID NO: 104926 - DNA, 25 bp, Homo sapien
tgatccaagctgtcgtccacagatc

SEQ ID NO: 104927 - DNA, 25 bp, Homo sapien
tgatccatatactgtcacggcacct

SEQ ID NO: 104928 - DNA, 25 bp, Homo sapien
tgatccatctttatgaataagaaaa

SEQ ID NO: 104929 - DNA, 25 bp, Homo sapien
tgatccatgtactgtcacggcacct

SEQ ID NO: 104930 - DNA, 25 bp, Homo sapien
tgatccatgtttatgaataagaaaa

SEQ ID NO: 104931 - DNA, 25 bp, Homo sapien
tgatcccaaattcacacaggtagtg

SEQ ID NO: 104932 - DNA, 25 bp, Homo sapien
tgatcccaagttcacacaggtagtg

SEQ ID NO: 104933 - DNA, 25 bp, Homo sapien
tgatccgcctgcctggactatcact

SEQ ID NO: 104934 - DNA, 25 bp, Homo sapien
tgatccgcgtgcctggactatcact

SEQ ID NO: 104935 - DNA, 25 bp, Homo sapien
tgatcctacaagattataatgaagc

SEQ ID NO: 104936 - DNA, 25 bp, Homo sapien
tgatcctataagattataatgaagc

SEQ ID NO: 104937 - DNA, 25 bp, Homo sapien
tgatcctgaaggtcatggatgtttg

SEQ ID NO: 104938 - DNA, 25 bp, Homo sapien
tgatcctgatggtcatggatgtttg

SEQ ID NO: 104939 - DNA, 25 bp, Homo sapien
tgatcctgcggaagagctcccaatt

SEQ ID NO: 104940 - DNA, 25 bp, Homo sapien
tgatcctgcggatgagctcccaatt

SEQ ID NO: 104941 - DNA, 25 bp, Homo sapien
tgatcctgtgcacataatgggtcct

SEQ ID NO: 104942 - DNA, 25 bp, Homo sapien
tgatcctgtgcacatagtgggtcct

SEQ ID NO: 104943 - DNA, 25 bp, Homo sapien
tgatccttgcattcaggcacagtgc

SEQ ID NO: 104944 - DNA, 25 bp, Homo sapien
tgatccttgcattcagtcacagtgc

SEQ ID NO: 104945 - DNA, 25 bp, Homo sapien
tgatcgaggctgtcagaccatgaga

SEQ ID NO: 104946 - DNA, 25 bp, Homo sapien
tgatcgaggctgtcaggccatgaga

SEQ ID NO: 104947 - DNA, 25 bp, Homo sapien
tgatcgatgcggttgttctttcctc

SEQ ID NO: 104948 - DNA, 25 bp, Homo sapien
tgatcgatgtggttgttctttcctc

SEQ ID NO: 104949 - DNA, 25 bp, Homo sapien
tgatctaacgggacttaatttcctc

SEQ ID NO: 104950 - DNA, 25 bp, Homo sapien
tgatctaatgggacttaatttcctc

SEQ ID NO: 104951 - DNA, 25 bp, Homo sapien
tgatctaccaacagggtgagattac

SEQ ID NO: 104952 - DNA, 25 bp, Homo sapien
tgatctaccaatagggtgagattac

SEQ ID NO: 104953 - DNA, 25 bp, Homo sapien
tgatctgtgcaaaacttctaggagt

SEQ ID NO: 104954 - DNA, 25 bp, Homo sapien
tgatctgtgcaaagcttctaggagt

SEQ ID NO: 104955 - DNA, 25 bp, Homo sapien
tgatctgtttgacttgctgatgatt

SEQ ID NO: 104956 - DNA, 25 bp, Homo sapien
tgatctgtttgacttgttgatgatt

SEQ ID NO: 104957 - DNA, 25 bp, Homo sapien
tgatctttatgtgactcttttgata

SEQ ID NO: 104958 - DNA, 25 bp, Homo sapien
tgatctttgtgtgactcttttgata

SEQ ID NO: 104959 - DNA, 25 bp, Homo sapien
tgatgaaaaattatcttgatgctta

SEQ ID NO: 104960 - DNA, 25 bp, Homo sapien
tgatgaaacattatcttgatgctta

SEQ ID NO: 104961 - DNA, 25 bp, Homo sapien
tgatgaaaccaggaattgccatcac

SEQ ID NO: 104962 - DNA, 25 bp, Homo sapien
tgatgaaactaggaattgccatcac

SEQ ID NO: 104963 - DNA, 25 bp, Homo sapien
tgatgaaactgggtatctgcgttcg

SEQ ID NO: 104964 - DNA, 25 bp, Homo sapien
tgatgaaactggttatctgcgttcg

SEQ ID NO: 104965 - DNA, 25 bp, Homo sapien
tgatgaaatctccaaattttatctg

SEQ ID NO: 104966 - DNA, 25 bp, Homo sapien
tgatgaaatctccgaattttatctg

SEQ ID NO: 104967 - DNA, 25 bp, Homo sapien
tgatgaactcctgagtgattgcctc

SEQ ID NO: 104968 - DNA, 25 bp, Homo sapien
tgatgaactcctgattgattgcctc

SEQ ID NO: 104969 - DNA, 25 bp, Homo sapien
tgatgaataattcctaaaatacgca

SEQ ID NO: 104970 - DNA, 25 bp, Homo sapien
tgatgaataattcttaaaatacgca

SEQ ID NO: 104971 - DNA, 25 bp, Homo sapien
tgatgaatagactagctgcttccaa

SEQ ID NO: 104972 - DNA, 25 bp, Homo sapien
tgatgaatggactagctgcttccaa

SEQ ID NO: 104973 - DNA, 25 bp, Homo sapien
tgatgacaaaattcgaagatttaca

SEQ ID NO: 104974 - DNA, 25 bp, Homo sapien
tgatgacaaaatttgaagatttaca

SEQ ID NO: 104975 - DNA, 25 bp, Homo sapien
tgatgacaaattaacacctaaaact

SEQ ID NO: 104976 - DNA, 25 bp, Homo sapien
tgatgacaacgacgatgatgatgat

SEQ ID NO: 104977 - DNA, 25 bp, Homo sapien
tgatgacaacgatgatgatgatgat

SEQ ID NO: 104978 - DNA, 25 bp, Homo sapien
tgatgacaagttaacacctaaaact

SEQ ID NO: 104979 - DNA, 25 bp, Homo sapien
tgatgacacgtgcacaaggtggtcg

SEQ ID NO: 104980 - DNA, 25 bp, Homo sapien
tgatgacataatatatcactcataa

SEQ ID NO: 104981 - DNA, 25 bp, Homo sapien
tgatgacataatgtatcactcataa

SEQ ID NO: 104982 - DNA, 25 bp, Homo sapien
tgatgacatgtgcacaaggtggtcg

SEQ ID NO: 104983 - DNA, 25 bp, Homo sapien
tgatgacttaagtacacttgcttta

SEQ ID NO: 104984 - DNA, 25 bp, Homo sapien
tgatgacttaagtacatttgcttta

SEQ ID NO: 104985 - DNA, 25 bp, Homo sapien
tgatgacttgaacatttcccaagtt

SEQ ID NO: 104986 - DNA, 25 bp, Homo sapien
tgatgacttgaacgtttcccaagtt

SEQ ID NO: 104987 - DNA, 25 bp, Homo sapien
tgatgagaactgccataaccagaaa

SEQ ID NO: 104988 - DNA, 25 bp, Homo sapien
tgatgagaactgccgtaaccagaaa

SEQ ID NO: 104989 - DNA, 25 bp, Homo sapien
tgatgagaatacagagcaactggaa

SEQ ID NO: 104990 - DNA, 25 bp, Homo sapien
tgatgagaatacggagcaactggaa

SEQ ID NO: 104991 - DNA, 25 bp, Homo sapien
tgatgagactgatggcaaatgcacc

SEQ ID NO: 104992 - DNA, 25 bp, Homo sapien
tgatgagagccatattttaggaagt

SEQ ID NO: 104993 - DNA, 25 bp, Homo sapien
tgatgagagccttattttaggaagt

SEQ ID NO: 104994 - DNA, 25 bp, Homo sapien
tgatgagagtgatggcaaatgcacc

SEQ ID NO: 104995 - DNA, 25 bp, Homo sapien
tgatgaggagtacaagagttactca

SEQ ID NO: 104996 - DNA, 25 bp, Homo sapien
tgatgaggagtagaagagttactca

SEQ ID NO: 104997 - DNA, 25 bp, Homo sapien
tgatgaggggttagcacggaagaat

SEQ ID NO: 104998 - DNA, 25 bp, Homo sapien
tgatgaggggtttgcacggaagaat

SEQ ID NO: 104999 - DNA, 25 bp, Homo sapien
tgatgaggtggtagagttggatcct

SEQ ID NO: 105000 - DNA, 25 bp, Homo sapien
tgatgaggttaacactgatgatcag

SEQ ID NO: 105001 - DNA, 25 bp, Homo sapien
tgatgaggttaacattgatgatcag

SEQ ID NO: 105002 - DNA, 25 bp, Homo sapien
tgatgaggttgtagagttggatcct

SEQ ID NO: 105003 - DNA, 25 bp, Homo sapien
tgatgatacagaagcggaagcctga

SEQ ID NO: 105004 - DNA, 25 bp, Homo sapien
tgatgatacagaagtggaagcctga

SEQ ID NO: 105005 - DNA, 25 bp, Homo sapien
tgatgatagaaagccatcacaggct

SEQ ID NO: 105006 - DNA, 25 bp, Homo sapien
tgatgatagaaggccatcacaggct

SEQ ID NO: 105007 - DNA, 25 bp, Homo sapien
tgatgatcctggaaagaaaaaaaat

SEQ ID NO: 105008 - DNA, 25 bp, Homo sapien
tgatgatcctggagagaaaaaaaat

SEQ ID NO: 105009 - DNA, 25 bp, Homo sapien
tgatgatggccctgagttgtgaaga

SEQ ID NO: 105010 - DNA, 25 bp, Homo sapien
tgatgatgtccctgagttgtgaaga

SEQ ID NO: 105011 - DNA, 25 bp, Homo sapien
tgatgatgttccactaaggatgggt

SEQ ID NO: 105012 - DNA, 25 bp, Homo sapien
tgatgatgttccagtaaggatgggt

SEQ ID NO: 105013 - DNA, 25 bp, Homo sapien
tgatgatttccatgtctacaatgca

SEQ ID NO: 105014 - DNA, 25 bp, Homo sapien
tgatgatttccgtgtctacaatgca

SEQ ID NO: 105015 - DNA, 25 bp, Homo sapien
tgatgcagtcaggtgaaacttaaaa

SEQ ID NO: 105016 - DNA, 25 bp, Homo sapien
tgatgcagtcaggtgacacttaaaa

SEQ ID NO: 105017 - DNA, 25 bp, Homo sapien
tgatgcatcattaaatagagacata

SEQ ID NO: 105018 - DNA, 25 bp, Homo sapien
tgatgcatcattaagtagagacata

SEQ ID NO: 105019 - DNA, 25 bp, Homo sapien
tgatgcattgtttcatatgccaatt

SEQ ID NO: 105020 - DNA, 25 bp, Homo sapien
tgatgcattgtttcgtatgccaatt

SEQ ID NO: 105021 - DNA, 25 bp, Homo sapien
tgatgcatttctccataccaagaaa

SEQ ID NO: 105022 - DNA, 25 bp, Homo sapien
tgatgcatttctccgtaccaagaaa

SEQ ID NO: 105023 - DNA, 25 bp, Homo sapien
tgatgccaaattcaggaaattaaca

SEQ ID NO: 105024 - DNA, 25 bp, Homo sapien
tgatgccaaattcgggaaattaaca

SEQ ID NO: 105025 - DNA, 25 bp, Homo sapien
tgatgccataattccttagtttgga

SEQ ID NO: 105026 - DNA, 25 bp, Homo sapien
tgatgccataattgcttagtttgga

SEQ ID NO: 105027 - DNA, 25 bp, Homo sapien
tgatgccattagataactttagatg

SEQ ID NO: 105028 - DNA, 25 bp, Homo sapien
tgatgccattatataactttagatg

SEQ ID NO: 105029 - DNA, 25 bp, Homo sapien
tgatgcctttccattgctttctcct

SEQ ID NO: 105030 - DNA, 25 bp, Homo sapien
tgatgcctttctattgctttctcct

SEQ ID NO: 105031 - DNA, 25 bp, Homo sapien
tgatgctaagcttgcatgtaaatag

SEQ ID NO: 105032 - DNA, 25 bp, Homo sapien
tgatgctataacaaaagggtcttcc

SEQ ID NO: 105033 - DNA, 25 bp, Homo sapien
tgatgctataacaacagggtcttcc

SEQ ID NO: 105034 - DNA, 25 bp, Homo sapien
tgatgctatgcttgcatgtaaatag

SEQ ID NO: 105035 - DNA, 25 bp, Homo sapien
tgatgctcacacctataagcccagt

SEQ ID NO: 105036 - DNA, 25 bp, Homo sapien
tgatgctcacacttataagcccagt

SEQ ID NO: 105037 - DNA, 25 bp, Homo sapien
tgatgctcatcaaactgttatttat

SEQ ID NO: 105038 - DNA, 25 bp, Homo sapien
tgatgctcatcagactgttatttat

SEQ ID NO: 105039 - DNA, 25 bp, Homo sapien
tgatgctgaggatcgaaaacagaac

SEQ ID NO: 105040 - DNA, 25 bp, Homo sapien
tgatgctgaggattgaaaacagaac

SEQ ID NO: 105041 - DNA, 25 bp, Homo sapien
tgatgctttctgtacgtgcttcctt

SEQ ID NO: 105042 - DNA, 25 bp, Homo sapien
tgatgctttgtgtacgtgcttcctt

SEQ ID NO: 105043 - DNA, 25 bp, Homo sapien
tgatggaagagaattgtcccccact

SEQ ID NO: 105044 - DNA, 25 bp, Homo sapien
tgatggaagtgaattgtcccccact

SEQ ID NO: 105045 - DNA, 25 bp, Homo sapien
tgatggagtcggctctttcctggtg

SEQ ID NO: 105046 - DNA, 25 bp, Homo sapien
tgatggagtgaattgcagtatttaa

SEQ ID NO: 105047 - DNA, 25 bp, Homo sapien
tgatggagtgaattgcggtatttaa

SEQ ID NO: 105048 - DNA, 25 bp, Homo sapien
tgatggagttggctctttcctggtg

SEQ ID NO: 105049 - DNA, 25 bp, Homo sapien
tgatggatgaaaagatataggtatg

SEQ ID NO: 105050 - DNA, 25 bp, Homo sapien
tgatggatggaaagatataggtatg

SEQ ID NO: 105051 - DNA, 25 bp, Homo sapien
tgatggatgtgtcatgtctccctag

SEQ ID NO: 105052 - DNA, 25 bp, Homo sapien
tgatggatgtgttatgtctccctag

SEQ ID NO: 105053 - DNA, 25 bp, Homo sapien
tgatggcagaaaatttttttcacct

SEQ ID NO: 105054 - DNA, 25 bp, Homo sapien
tgatggcagaatatttttttcacct

SEQ ID NO: 105055 - DNA, 25 bp, Homo sapien
tgatggccatgtccagtttgccttc

SEQ ID NO: 105056 - DNA, 25 bp, Homo sapien
tgatggccatgtcgagtttgccttc

SEQ ID NO: 105057 - DNA, 25 bp, Homo sapien
tgatggctgtccaagtggttacggg

SEQ ID NO: 105058 - DNA, 25 bp, Homo sapien
tgatggctgtcgaagtggttacggg

SEQ ID NO: 105059 - DNA, 25 bp, Homo sapien
tgatggcttgaccgtggactttcca

SEQ ID NO: 105060 - DNA, 25 bp, Homo sapien
tgatggcttgatcgtggactttcca

SEQ ID NO: 105061 - DNA, 25 bp, Homo sapien
tgatgggacatggctgcctagaata

SEQ ID NO: 105062 - DNA, 25 bp, Homo sapien
tgatgggacttggctgcctagaata

SEQ ID NO: 105063 - DNA, 25 bp, Homo sapien
tgatggggaccacttcaggagcaaa

SEQ ID NO: 105064 - DNA, 25 bp, Homo sapien
tgatggggaccacttcgggagcaaa

SEQ ID NO: 105065 - DNA, 25 bp, Homo sapien
tgatgggtaaacctaacaagaatca

SEQ ID NO: 105066 - DNA, 25 bp, Homo sapien
tgatgggtaaacttaacaagaatca

SEQ ID NO: 105067 - DNA, 25 bp, Homo sapien
tgatggtatctcactcttgaaaatg

SEQ ID NO: 105068 - DNA, 25 bp, Homo sapien
tgatggtatctcattcttgaaaatg

SEQ ID NO: 105069 - DNA, 25 bp, Homo sapien
tgatggtgacaacaaaaatgaaatg

SEQ ID NO: 105070 - DNA, 25 bp, Homo sapien
tgatggtgacaacagaaatgaaatg

SEQ ID NO: 105071 - DNA, 25 bp, Homo sapien
tgatgtaaaattaacaatgatataa

SEQ ID NO: 105072 - DNA, 25 bp, Homo sapien
tgatgtaaaattgacaatgatataa

SEQ ID NO: 105073 - DNA, 25 bp, Homo sapien
tgatgtaaacgtacaaaattcaggg

SEQ ID NO: 105074 - DNA, 25 bp, Homo sapien
tgatgtaaatgtacaaaattcaggg

SEQ ID NO: 105075 - DNA, 25 bp, Homo sapien
tgatgtacaaaaagaaccagataaa

SEQ ID NO: 105076 - DNA, 25 bp, Homo sapien
tgatgtacaaaaagaatcagataaa

SEQ ID NO: 105077 - DNA, 25 bp, Homo sapien
tgatgtagaaattatggagttttta

SEQ ID NO: 105078 - DNA, 25 bp, Homo sapien
tgatgtagcaattatggagttttta

SEQ ID NO: 105079 - DNA, 25 bp, Homo sapien
tgatgtatggccgtgcaatgtgttt

SEQ ID NO: 105080 - DNA, 25 bp, Homo sapien
tgatgtatggctgtgcaatgtgttt

SEQ ID NO: 105081 - DNA, 25 bp, Homo sapien
tgatgtcaaatctaaaaatcccatg

SEQ ID NO: 105082 - DNA, 25 bp, Homo sapien
tgatgtcaagattaaaaaattacct

SEQ ID NO: 105083 - DNA, 25 bp, Homo sapien
tgatgtcaagtctaaaaatcccatg

SEQ ID NO: 105084 - DNA, 25 bp, Homo sapien
tgatgtcacctaatgtaaaaaaaag

SEQ ID NO: 105085 - DNA, 25 bp, Homo sapien
tgatgtcacctagtgtaaaaaaaag

SEQ ID NO: 105086 - DNA, 25 bp, Homo sapien
tgatgtcatgattaaaaaattacct

SEQ ID NO: 105087 - DNA, 25 bp, Homo sapien
tgatgtcatggaagtagagagtaga

SEQ ID NO: 105088 - DNA, 25 bp, Homo sapien
tgatgtcatggatgtagagagtaga

SEQ ID NO: 105089 - DNA, 25 bp, Homo sapien
tgatgtctgaatcgattggcagtaa

SEQ ID NO: 105090 - DNA, 25 bp, Homo sapien
tgatgtctgaattgattggcagtaa

SEQ ID NO: 105091 - DNA, 25 bp, Homo sapien
tgatgtgacgagtggctccctattg

SEQ ID NO: 105092 - DNA, 25 bp, Homo sapien
tgatgtgatgagtggctccctattg

SEQ ID NO: 105093 - DNA, 25 bp, Homo sapien
tgatgtgcctctaggtttgatcatt

SEQ ID NO: 105094 - DNA, 25 bp, Homo sapien
tgatgtgcctctagttttgatcatt

SEQ ID NO: 105095 - DNA, 25 bp, Homo sapien
tgatgtgctaatacatggtatcatt

SEQ ID NO: 105096 - DNA, 25 bp, Homo sapien
tgatgtgctaatgcatggtatcatt

SEQ ID NO: 105097 - DNA, 25 bp, Homo sapien
tgatgtggaaagaaccactggctcc

SEQ ID NO: 105098 - DNA, 25 bp, Homo sapien
tgatgtggatagaaccactggctcc

SEQ ID NO: 105099 - DNA, 25 bp, Homo sapien
tgatgtgtctacctgcactcactaa

SEQ ID NO: 105100 - DNA, 25 bp, Homo sapien
tgatgtgtctatctgcactcactaa

SEQ ID NO: 105101 - DNA, 25 bp, Homo sapien
tgatgtgtctgaaggctgcacatag

SEQ ID NO: 105102 - DNA, 25 bp, Homo sapien
tgatgtgtctgagggctgcacatag

SEQ ID NO: 105103 - DNA, 25 bp, Homo sapien
tgatgtgtgcttcacattgtggccg

SEQ ID NO: 105104 - DNA, 25 bp, Homo sapien
tgatgtgtggttcacattgtggccg

SEQ ID NO: 105105 - DNA, 25 bp, Homo sapien
tgatgtgtttgcacacttaaatggc

SEQ ID NO: 105106 - DNA, 25 bp, Homo sapien
tgatgtgtttgcactcttaaatggc

SEQ ID NO: 105107 - DNA, 25 bp, Homo sapien
tgatgttacccagagcccagaaaat

SEQ ID NO: 105108 - DNA, 25 bp, Homo sapien
tgatgttatccagagcccagaaaat

SEQ ID NO: 105109 - DNA, 25 bp, Homo sapien
tgatgttatgaactgcctttctaaa

SEQ ID NO: 105110 - DNA, 25 bp, Homo sapien
tgatgttatgaattgcctttctaaa

SEQ ID NO: 105111 - DNA, 25 bp, Homo sapien
tgatgttcccagctcatttggcttc

SEQ ID NO: 105112 - DNA, 25 bp, Homo sapien
tgatgttcccaggtcatttggcttc

SEQ ID NO: 105113 - DNA, 25 bp, Homo sapien
tgatgttgatgctcatgataatata

SEQ ID NO: 105114 - DNA, 25 bp, Homo sapien
tgatgttgatgctgatgataatata

SEQ ID NO: 105115 - DNA, 25 bp, Homo sapien
tgatgtttaagaataattttcaatt

SEQ ID NO: 105116 - DNA, 25 bp, Homo sapien
tgatgtttaagagtaattttcaatt

SEQ ID NO: 105117 - DNA, 25 bp, Homo sapien
tgatgtttcacaagactgctcttac

SEQ ID NO: 105118 - DNA, 25 bp, Homo sapien
tgatgtttcacacgactgctcttac

SEQ ID NO: 105119 - DNA, 25 bp, Homo sapien
tgatgtttctggtatagggaagagt

SEQ ID NO: 105120 - DNA, 25 bp, Homo sapien
tgatgtttctggtgtagggaagagt

SEQ ID NO: 105121 - DNA, 25 bp, Homo sapien
tgatgttttatatactgtcagcagc

SEQ ID NO: 105122 - DNA, 25 bp, Homo sapien
tgatgttttctatactgtcagcagc

SEQ ID NO: 105123 - DNA, 25 bp, Homo sapien
tgattaagattttgcttctcatctc

SEQ ID NO: 105124 - DNA, 25 bp, Homo sapien
tgattaagatttttcttctcatctc

SEQ ID NO: 105125 - DNA, 25 bp, Homo sapien
tgattaaggatcataagattgggag

SEQ ID NO: 105126 - DNA, 25 bp, Homo sapien
tgattaaggatcatgagattgggag

SEQ ID NO: 105127 - DNA, 25 bp, Homo sapien
tgattacaattcaacacgagatttg

SEQ ID NO: 105128 - DNA, 25 bp, Homo sapien
tgattacaattcgacacgagatttg

SEQ ID NO: 105129 - DNA, 25 bp, Homo sapien
tgattacattgtgcccacgcagatt

SEQ ID NO: 105130 - DNA, 25 bp, Homo sapien
tgattacattgtgtccacgcagatt

SEQ ID NO: 105131 - DNA, 25 bp, Homo sapien
tgattacctgtctgggatttcttga

SEQ ID NO: 105132 - DNA, 25 bp, Homo sapien
tgattacctgtcttggatttcttga

SEQ ID NO: 105133 - DNA, 25 bp, Homo sapien
tgattactttcttcttcggtgccaa

SEQ ID NO: 105134 - DNA, 25 bp, Homo sapien
tgattactttcttctttggtgccaa

SEQ ID NO: 105135 - DNA, 25 bp, Homo sapien
tgattagattcagataatttttgtc

SEQ ID NO: 105136 - DNA, 25 bp, Homo sapien
tgattagattcatataatttttgtc

SEQ ID NO: 105137 - DNA, 25 bp, Homo sapien
tgattagccaactatcaacatcggg

SEQ ID NO: 105138 - DNA, 25 bp, Homo sapien
tgattagccaactgtcaacatcggg

SEQ ID NO: 105139 - DNA, 25 bp, Homo sapien
tgattatagggaacaattaagaaga

SEQ ID NO: 105140 - DNA, 25 bp, Homo sapien
tgattatagggagcaattaagaaga

SEQ ID NO: 105141 - DNA, 25 bp, Homo sapien
tgattattaaagctcagttttttgc

SEQ ID NO: 105142 - DNA, 25 bp, Homo sapien
tgattattaaagcttagttttttgc

SEQ ID NO: 105143 - DNA, 25 bp, Homo sapien
tgattattatttatttgctaataat

SEQ ID NO: 105144 - DNA, 25 bp, Homo sapien
tgattattcaaaacttaatgtaggc

SEQ ID NO: 105145 - DNA, 25 bp, Homo sapien
tgattattcaaaatttaatgtaggc

SEQ ID NO: 105146 - DNA, 25 bp, Homo sapien
tgattattcacagtgaaatgctgac

SEQ ID NO: 105147 - DNA, 25 bp, Homo sapien
tgattattcacagttaaatgctgac

SEQ ID NO: 105148 - DNA, 25 bp, Homo sapien
tgattattcattaacttcatctttt

SEQ ID NO: 105149 - DNA, 25 bp, Homo sapien
tgattattcattagcttcatctttt

SEQ ID NO: 105150 - DNA, 25 bp, Homo sapien
tgattattctttatttgctaataat

SEQ ID NO: 105151 - DNA, 25 bp, Homo sapien
tgattcaaagacggttagaggattt

SEQ ID NO: 105152 - DNA, 25 bp, Homo sapien
tgattcaaagatggttagaggattt

SEQ ID NO: 105153 - DNA, 25 bp, Homo sapien
tgattcaacaatagctagaaagtgg

SEQ ID NO: 105154 - DNA, 25 bp, Homo sapien
tgattcaagaatagctagaaagtgg

SEQ ID NO: 105155 - DNA, 25 bp, Homo sapien
tgattcacagatttaatcccaggta

SEQ ID NO: 105156 - DNA, 25 bp, Homo sapien
tgattcacatatttaatcccaggta

SEQ ID NO: 105157 - DNA, 25 bp, Homo sapien
tgattcagcataatctgtttttcaa

SEQ ID NO: 105158 - DNA, 25 bp, Homo sapien
tgattcagcgtaatctgtttttcaa

SEQ ID NO: 105159 - DNA, 25 bp, Homo sapien
tgattcatcagcaacctaagagaca

SEQ ID NO: 105160 - DNA, 25 bp, Homo sapien
tgattcatcagcagcctaagagaca

SEQ ID NO: 105161 - DNA, 25 bp, Homo sapien
tgattccaaatgctctggaaagaaa

SEQ ID NO: 105162 - DNA, 25 bp, Homo sapien
tgattccaagtgctctggaaagaaa

SEQ ID NO: 105163 - DNA, 25 bp, Homo sapien
tgattcccagactacaatatggtat

SEQ ID NO: 105164 - DNA, 25 bp, Homo sapien
tgattcccagagtacaatatggtat

SEQ ID NO: 105165 - DNA, 25 bp, Homo sapien
tgattcccatcaatttctctataac

SEQ ID NO: 105166 - DNA, 25 bp, Homo sapien
tgattcccgtcaatttctctataac

SEQ ID NO: 105167 - DNA, 25 bp, Homo sapien
tgattccctgcaaaaccaaacttga

SEQ ID NO: 105168 - DNA, 25 bp, Homo sapien
tgattccctgccaaaccaaacttga

SEQ ID NO: 105169 - DNA, 25 bp, Homo sapien
tgattccggaaagttaacttgtatt

SEQ ID NO: 105170 - DNA, 25 bp, Homo sapien
tgattccgggaagttaacttgtatt

SEQ ID NO: 105171 - DNA, 25 bp, Homo sapien
tgattcctataagatttttgtgtcc

SEQ ID NO: 105172 - DNA, 25 bp, Homo sapien
tgattcctctaagatttttgtgtcc

SEQ ID NO: 105173 - DNA, 25 bp, Homo sapien
tgattcctgagagaggagaaccaaa

SEQ ID NO: 105174 - DNA, 25 bp, Homo sapien
tgattcctgagagcggagaaccaaa

SEQ ID NO: 105175 - DNA, 25 bp, Homo sapien
tgattcctgtgcataattttttatt

SEQ ID NO: 105176 - DNA, 25 bp, Homo sapien
tgattcctgtgcgtaattttttatt

SEQ ID NO: 105177 - DNA, 25 bp, Homo sapien
tgattcctttcgcttcctcctttgt

SEQ ID NO: 105178 - DNA, 25 bp, Homo sapien
tgattcctttctcttcctcctttgt

SEQ ID NO: 105179 - DNA, 25 bp, Homo sapien
tgattctaaatgacaggagcagcag

SEQ ID NO: 105180 - DNA, 25 bp, Homo sapien
tgattctaaattacaggagcagcag

SEQ ID NO: 105181 - DNA, 25 bp, Homo sapien
tgattctccttcacttttgctgtat

SEQ ID NO: 105182 - DNA, 25 bp, Homo sapien
tgattctctttcacttttgctgtat

SEQ ID NO: 105183 - DNA, 25 bp, Homo sapien
tgattctgctgatataaagtcaaac

SEQ ID NO: 105184 - DNA, 25 bp, Homo sapien
tgattctgctgatgtaaagtcaaac

SEQ ID NO: 105185 - DNA, 25 bp, Homo sapien
tgattctggaatgaaattaagtaac

SEQ ID NO: 105186 - DNA, 25 bp, Homo sapien
tgattctgggatgaaattaagtaac

SEQ ID NO: 105187 - DNA, 25 bp, Homo sapien
tgattcttcttctacggttccacta

SEQ ID NO: 105188 - DNA, 25 bp, Homo sapien
tgattcttcttctatggttccacta

SEQ ID NO: 105189 - DNA, 25 bp, Homo sapien
tgattctttcactgtgaaatttgat

SEQ ID NO: 105190 - DNA, 25 bp, Homo sapien
tgattctttcactgtggaatttgat

SEQ ID NO: 105191 - DNA, 25 bp, Homo sapien
tgattctttcttgcacccaagattt

SEQ ID NO: 105192 - DNA, 25 bp, Homo sapien
tgattctttctttcacccaagattt

SEQ ID NO: 105193 - DNA, 25 bp, Homo sapien
tgattgaaaggctattccattcata

SEQ ID NO: 105194 - DNA, 25 bp, Homo sapien
tgattgaaggagaatgagaacgaga

SEQ ID NO: 105195 - DNA, 25 bp, Homo sapien
tgattgaaggagcatgagaacgaga

SEQ ID NO: 105196 - DNA, 25 bp, Homo sapien
tgattgaaggattccatgagaaaaa

SEQ ID NO: 105197 - DNA, 25 bp, Homo sapien
tgattgaaggattctatgagaaaaa

SEQ ID NO: 105198 - DNA, 25 bp, Homo sapien
tgattgaagggctattccattcata

SEQ ID NO: 105199 - DNA, 25 bp, Homo sapien
tgattgacacttccttacaactgac

SEQ ID NO: 105200 - DNA, 25 bp, Homo sapien
tgattgacgcttccttacaactgac

SEQ ID NO: 105201 - DNA, 25 bp, Homo sapien
tgattgagagaaggctggatacact

SEQ ID NO: 105202 - DNA, 25 bp, Homo sapien
tgattgagagaatgctggatacact

SEQ ID NO: 105203 - DNA, 25 bp, Homo sapien
tgattgagtaaacatggcaaagaac

SEQ ID NO: 105204 - DNA, 25 bp, Homo sapien
tgattgagtaaatatggcaaagaac

SEQ ID NO: 105205 - DNA, 25 bp, Homo sapien
tgattgagtattcacctgtaagata

SEQ ID NO: 105206 - DNA, 25 bp, Homo sapien
tgattgagtattcatctgtaagata

SEQ ID NO: 105207 - DNA, 25 bp, Homo sapien
tgattgatgcacgccccttgttctc

SEQ ID NO: 105208 - DNA, 25 bp, Homo sapien
tgattgatgcatgccccttgttctc

SEQ ID NO: 105209 - DNA, 25 bp, Homo sapien
tgattgcatgagcagatccacgtcc

SEQ ID NO: 105210 - DNA, 25 bp, Homo sapien
tgattgcatgaggagatccacgtcc

SEQ ID NO: 105211 - DNA, 25 bp, Homo sapien
tgattgccaattctctcccctgaaa

SEQ ID NO: 105212 - DNA, 25 bp, Homo sapien
tgattgccaattctttcccctgaaa

SEQ ID NO: 105213 - DNA, 25 bp, Homo sapien
tgattgccactggtcaagcctggtc

SEQ ID NO: 105214 - DNA, 25 bp, Homo sapien
tgattgccagcaggtcagaaccctg

SEQ ID NO: 105215 - DNA, 25 bp, Homo sapien
tgattgccagcgggtcagaaccctg

SEQ ID NO: 105216 - DNA, 25 bp, Homo sapien
tgattgccattggtcaagcctggtc

SEQ ID NO: 105217 - DNA, 25 bp, Homo sapien
tgattgcctttacacacactgatgc

SEQ ID NO: 105218 - DNA, 25 bp, Homo sapien
tgattgcctttacatacactgatgc

SEQ ID NO: 105219 - DNA, 25 bp, Homo sapien
tgattgctaacagagaagtgtgagg

SEQ ID NO: 105220 - DNA, 25 bp, Homo sapien
tgattgctaacagagaggtgtgagg

SEQ ID NO: 105221 - DNA, 25 bp, Homo sapien
tgattgctatggattactcttcatc

SEQ ID NO: 105222 - DNA, 25 bp, Homo sapien
tgattgctatggattattcttcatc

SEQ ID NO: 105223 - DNA, 25 bp, Homo sapien
tgattgctgaaggctgcaatagctg

SEQ ID NO: 105224 - DNA, 25 bp, Homo sapien
tgattgctgaaggctggaatagctg

SEQ ID NO: 105225 - DNA, 25 bp, Homo sapien
tgattgcttgcctcataagacttcc

SEQ ID NO: 105226 - DNA, 25 bp, Homo sapien
tgattgcttgcctcgtaagacttcc

SEQ ID NO: 105227 - DNA, 25 bp, Homo sapien
tgattggagtcacaatgcatagctg

SEQ ID NO: 105228 - DNA, 25 bp, Homo sapien
tgattggagtcaccatgcatagctg

SEQ ID NO: 105229 - DNA, 25 bp, Homo sapien
tgattggccacggtaaggttcaggc

SEQ ID NO: 105230 - DNA, 25 bp, Homo sapien
tgattggctacggtaaggttcaggc

SEQ ID NO: 105231 - DNA, 25 bp, Homo sapien
tgattgggacgagcttttcaaccta

SEQ ID NO: 105232 - DNA, 25 bp, Homo sapien
tgattgggagggagccaccagcagc

SEQ ID NO: 105233 - DNA, 25 bp, Homo sapien
tgattgggagggagccgccagcagc

SEQ ID NO: 105234 - DNA, 25 bp, Homo sapien
tgattgggatgagcttttcaaccta

SEQ ID NO: 105235 - DNA, 25 bp, Homo sapien
tgattggtacaactttctattctgt

SEQ ID NO: 105236 - DNA, 25 bp, Homo sapien
tgattggtagaactttctattctgt

SEQ ID NO: 105237 - DNA, 25 bp, Homo sapien
tgattgtaaacattaatgccatcca

SEQ ID NO: 105238 - DNA, 25 bp, Homo sapien
tgattgtaaacgttaatgccatcca

SEQ ID NO: 105239 - DNA, 25 bp, Homo sapien
tgattgtcaagtggtcataatacta

SEQ ID NO: 105240 - DNA, 25 bp, Homo sapien
tgattgtcaagttgtcataatacta

SEQ ID NO: 105241 - DNA, 25 bp, Homo sapien
tgattgtcacaacttaggagatgcc

SEQ ID NO: 105242 - DNA, 25 bp, Homo sapien
tgattgtcacagcttaggagatgcc

SEQ ID NO: 105243 - DNA, 25 bp, Homo sapien
tgattgtcacctcctgaattaaagg

SEQ ID NO: 105244 - DNA, 25 bp, Homo sapien
tgattgtcatcttaccctggaagtc

SEQ ID NO: 105245 - DNA, 25 bp, Homo sapien
tgattgtcatcttaccttggaagtc

SEQ ID NO: 105246 - DNA, 25 bp, Homo sapien
tgattgtccagaattcagaccacaa

SEQ ID NO: 105247 - DNA, 25 bp, Homo sapien
tgattgtccaggcgaacttgtggga

SEQ ID NO: 105248 - DNA, 25 bp, Homo sapien
tgattgtccaggtgaacttgtggga

SEQ ID NO: 105249 - DNA, 25 bp, Homo sapien
tgattgtccggaattcagaccacaa

SEQ ID NO: 105250 - DNA, 25 bp, Homo sapien
tgattgtcgcctcctgaattaaagg

SEQ ID NO: 105251 - DNA, 25 bp, Homo sapien
tgattgtctgcctgctttttgttgt

SEQ ID NO: 105252 - DNA, 25 bp, Homo sapien
tgattgtctgcttgctttttgttgt

SEQ ID NO: 105253 - DNA, 25 bp, Homo sapien
tgattgtgaattttgagacctggtt

SEQ ID NO: 105254 - DNA, 25 bp, Homo sapien
tgattgtgatttttgagacctggtt

SEQ ID NO: 105255 - DNA, 25 bp, Homo sapien
tgattgttagtgcagatctgtggta

SEQ ID NO: 105256 - DNA, 25 bp, Homo sapien
tgattgttagtgcggatctgtggta

SEQ ID NO: 105257 - DNA, 25 bp, Homo sapien
tgattgttccgagggttttgtaaaa

SEQ ID NO: 105258 - DNA, 25 bp, Homo sapien
tgattgttctgagggttttgtaaaa

SEQ ID NO: 105259 - DNA, 25 bp, Homo sapien
tgattgttttatacgactttgagtt

SEQ ID NO: 105260 - DNA, 25 bp, Homo sapien
tgattgttttatatgactttgagtt

SEQ ID NO: 105261 - DNA, 25 bp, Homo sapien
tgatttacaatcgagaccactacag

SEQ ID NO: 105262 - DNA, 25 bp, Homo sapien
tgatttacaattgagaccactacag

SEQ ID NO: 105263 - DNA, 25 bp, Homo sapien
tgatttacaggcttttggcttgagc

SEQ ID NO: 105264 - DNA, 25 bp, Homo sapien
tgatttacaggtttttggcttgagc

SEQ ID NO: 105265 - DNA, 25 bp, Homo sapien
tgatttattaagatgtaaggattca

SEQ ID NO: 105266 - DNA, 25 bp, Homo sapien
tgatttattaagttgtaaggattca

SEQ ID NO: 105267 - DNA, 25 bp, Homo sapien
tgatttattgtatcactgctatcta

SEQ ID NO: 105268 - DNA, 25 bp, Homo sapien
tgatttattttatcactgctatcta

SEQ ID NO: 105269 - DNA, 25 bp, Homo sapien
tgatttcagttgggccagttagatg

SEQ ID NO: 105270 - DNA, 25 bp, Homo sapien
tgatttcatttgggccagttagatg

SEQ ID NO: 105271 - DNA, 25 bp, Homo sapien
tgatttccatgtctacaatgcagat

SEQ ID NO: 105272 - DNA, 25 bp, Homo sapien
tgatttccattctagttctacccat

SEQ ID NO: 105273 - DNA, 25 bp, Homo sapien
tgatttccattctggttctacccat

SEQ ID NO: 105274 - DNA, 25 bp, Homo sapien
tgatttccattgcatttagagaaca

SEQ ID NO: 105275 - DNA, 25 bp, Homo sapien
tgatttccattgcgtttagagaaca

SEQ ID NO: 105276 - DNA, 25 bp, Homo sapien
tgatttccgtgtctacaatgcagat

SEQ ID NO: 105277 - DNA, 25 bp, Homo sapien
tgatttctaaaactatgcaactccc

SEQ ID NO: 105278 - DNA, 25 bp, Homo sapien
tgatttctaaaattatgcaactccc

SEQ ID NO: 105279 - DNA, 25 bp, Homo sapien
tgatttctcgcactgagtctaacag

SEQ ID NO: 105280 - DNA, 25 bp, Homo sapien
tgatttctcttgcgtctgcagtcat

SEQ ID NO: 105281 - DNA, 25 bp, Homo sapien
tgatttctcttgtgtctgcagtcat

SEQ ID NO: 105282 - DNA, 25 bp, Homo sapien
tgatttctggcactgagtctaacag

SEQ ID NO: 105283 - DNA, 25 bp, Homo sapien
tgatttctttccacaatgtttgtag

SEQ ID NO: 105284 - DNA, 25 bp, Homo sapien
tgatttctttccgcaatgtttgtag

SEQ ID NO: 105285 - DNA, 25 bp, Homo sapien
tgatttgagagacaatcttggaaaa

SEQ ID NO: 105286 - DNA, 25 bp, Homo sapien
tgatttgagagagaatcttggaaaa

SEQ ID NO: 105287 - DNA, 25 bp, Homo sapien
tgatttgagtctaaaaacaaggcag

SEQ ID NO: 105288 - DNA, 25 bp, Homo sapien
tgatttgagtctaagaacaaggcag

SEQ ID NO: 105289 - DNA, 25 bp, Homo sapien
tgatttgagttccgtgtatgttgtc

SEQ ID NO: 105290 - DNA, 25 bp, Homo sapien
tgatttgagttccttgtatgttgtc

SEQ ID NO: 105291 - DNA, 25 bp, Homo sapien
tgatttgatttgatttttagacgga

SEQ ID NO: 105292 - DNA, 25 bp, Homo sapien
tgatttgattttatttttagacgga

SEQ ID NO: 105293 - DNA, 25 bp, Homo sapien
tgatttgctatatagatcaacctgt

SEQ ID NO: 105294 - DNA, 25 bp, Homo sapien
tgatttgctgtatagatcaacctgt

SEQ ID NO: 105295 - DNA, 25 bp, Homo sapien
tgatttggcaacagaaatatgcaaa

SEQ ID NO: 105296 - DNA, 25 bp, Homo sapien
tgatttggcaatagaaatatgcaaa

SEQ ID NO: 105297 - DNA, 25 bp, Homo sapien
tgatttggcgatgacaatggcttca

SEQ ID NO: 105298 - DNA, 25 bp, Homo sapien
tgatttgggcagagatttctgcagc

SEQ ID NO: 105299 - DNA, 25 bp, Homo sapien
tgatttggggagagatttctgcagc

SEQ ID NO: 105300 - DNA, 25 bp, Homo sapien
tgatttggtgatgacaatggcttca

SEQ ID NO: 105301 - DNA, 25 bp, Homo sapien
tgatttgtacaaactgctatacaaa

SEQ ID NO: 105302 - DNA, 25 bp, Homo sapien
tgatttgtcactatttgacctgtct

SEQ ID NO: 105303 - DNA, 25 bp, Homo sapien
tgatttgtcactttttgacctgtct

SEQ ID NO: 105304 - DNA, 25 bp, Homo sapien
tgatttgtgcaaactgctatacaaa

SEQ ID NO: 105305 - DNA, 25 bp, Homo sapien
tgatttgtgcatctgtaaaatggag

SEQ ID NO: 105306 - DNA, 25 bp, Homo sapien
tgatttgtgccactaagaaacaatc

SEQ ID NO: 105307 - DNA, 25 bp, Homo sapien
tgatttgtgtatctgtaaaatggag

SEQ ID NO: 105308 - DNA, 25 bp, Homo sapien
tgatttgtgtcactaagaaacaatc

SEQ ID NO: 105309 - DNA, 25 bp, Homo sapien
tgatttgttccatatagcagagcaa

SEQ ID NO: 105310 - DNA, 25 bp, Homo sapien
tgatttgttccgtatagcagagcaa

SEQ ID NO: 105311 - DNA, 25 bp, Homo sapien
tgatttgttgcctcttttctccaga

SEQ ID NO: 105312 - DNA, 25 bp, Homo sapien
tgatttgtttcctcttttctccaga

SEQ ID NO: 105313 - DNA, 25 bp, Homo sapien
tgattttaacagatcgaatgggagt

SEQ ID NO: 105314 - DNA, 25 bp, Homo sapien
tgattttaacagattgaatgggagt

SEQ ID NO: 105315 - DNA, 25 bp, Homo sapien
tgattttaatccgtcaggtttccat

SEQ ID NO: 105316 - DNA, 25 bp, Homo sapien
tgattttaatctgtcaggtttccat

SEQ ID NO: 105317 - DNA, 25 bp, Homo sapien
tgattttacgcaagaaaccataaag

SEQ ID NO: 105318 - DNA, 25 bp, Homo sapien
tgattttaggctatgcatttaaatc

SEQ ID NO: 105319 - DNA, 25 bp, Homo sapien
tgattttaggctattcatttaaatc

SEQ ID NO: 105320 - DNA, 25 bp, Homo sapien
tgattttatatatgccttcaagctt

SEQ ID NO: 105321 - DNA, 25 bp, Homo sapien
tgattttatatatggcttcaagctt

SEQ ID NO: 105322 - DNA, 25 bp, Homo sapien
tgattttatgcaagaaaccataaag

SEQ ID NO: 105323 - DNA, 25 bp, Homo sapien
tgattttcatggctttttatcattt

SEQ ID NO: 105324 - DNA, 25 bp, Homo sapien
tgattttcatggttttttatcattt

SEQ ID NO: 105325 - DNA, 25 bp, Homo sapien
tgattttgcatttcatttccctttt

SEQ ID NO: 105326 - DNA, 25 bp, Homo sapien
tgattttgtatttcatttccctttt

SEQ ID NO: 105327 - DNA, 25 bp, Homo sapien
tgattttgtcaaacttctgagctga

SEQ ID NO: 105328 - DNA, 25 bp, Homo sapien
tgattttgtcaaacttttgagctga

SEQ ID NO: 105329 - DNA, 25 bp, Homo sapien
tgatttttaacagcaagaaattaac

SEQ ID NO: 105330 - DNA, 25 bp, Homo sapien
tgatttttaacagtaagaaattaac

SEQ ID NO: 105331 - DNA, 25 bp, Homo sapien
tgatttttctctttggggaaacttg

SEQ ID NO: 105332 - DNA, 25 bp, Homo sapien
tgatttttgcaccaatgagggacac

SEQ ID NO: 105333 - DNA, 25 bp, Homo sapien
tgatttttgcacgaatgagggacac

SEQ ID NO: 105334 - DNA, 25 bp, Homo sapien
tgattttttgtaagactcatctcac

SEQ ID NO: 105335 - DNA, 25 bp, Homo sapien
tgattttttgtgagactcatctcac

SEQ ID NO: 105336 - DNA, 25 bp, Homo sapien
tgatttttttaacgtaagatttcgt

SEQ ID NO: 105337 - DNA, 25 bp, Homo sapien
tgatttttttaccgtaagatttcgt

SEQ ID NO: 105338 - DNA, 25 bp, Homo sapien
tgatttttttctttggggaaacttg

SEQ ID NO: 105339 - DNA, 25 bp, Homo sapien
tgcaaaaaaaccacaaagcacctcc

SEQ ID NO: 105340 - DNA, 25 bp, Homo sapien
tgcaaaaaaactacaaagcacctcc

SEQ ID NO: 105341 - DNA, 25 bp, Homo sapien
tgcaaaaaacaaggattttcccttt

SEQ ID NO: 105342 - DNA, 25 bp, Homo sapien
tgcaaaaacatctctcctggagtcc

SEQ ID NO: 105343 - DNA, 25 bp, Homo sapien
tgcaaaaacctctctcctggagtcc

SEQ ID NO: 105344 - DNA, 25 bp, Homo sapien
tgcaaaaagcaaggattttcccttt

SEQ ID NO: 105345 - DNA, 25 bp, Homo sapien
tgcaaaaataacgtcaatgcttttt

SEQ ID NO: 105346 - DNA, 25 bp, Homo sapien
tgcaaaaataatgtcaatgcttttt

SEQ ID NO: 105347 - DNA, 25 bp, Homo sapien
tgcaaaaatacatgagattatatgt

SEQ ID NO: 105348 - DNA, 25 bp, Homo sapien
tgcaaaaattcatgagattatatgt

SEQ ID NO: 105349 - DNA, 25 bp, Homo sapien
tgcaaaaccacctttactatgtaag

SEQ ID NO: 105350 - DNA, 25 bp, Homo sapien
tgcaaaaccacctttattatgtaag

SEQ ID NO: 105351 - DNA, 25 bp, Homo sapien
tgcaaaactatgagcgtccaggcag

SEQ ID NO: 105352 - DNA, 25 bp, Homo sapien
tgcaaaactatgagggtccaggcag

SEQ ID NO: 105353 - DNA, 25 bp, Homo sapien
tgcaaaagcaacaatatcaaagaat

SEQ ID NO: 105354 - DNA, 25 bp, Homo sapien
tgcaaaagcaacagtatcaaagaat

SEQ ID NO: 105355 - DNA, 25 bp, Homo sapien
tgcaaaaggcagactaactggagaa

SEQ ID NO: 105356 - DNA, 25 bp, Homo sapien
tgcaaaaggcagattaactggagaa

SEQ ID NO: 105357 - DNA, 25 bp, Homo sapien
tgcaaaaggtacaaaaaccaatgga

SEQ ID NO: 105358 - DNA, 25 bp, Homo sapien
tgcaaaaggtacgaaaaccaatgga

SEQ ID NO: 105359 - DNA, 25 bp, Homo sapien
tgcaaaagtcccacatgtcctcatt

SEQ ID NO: 105360 - DNA, 25 bp, Homo sapien
tgcaaaagtcccgcatgtcctcatt

SEQ ID NO: 105361 - DNA, 25 bp, Homo sapien
tgcaaaagtggcgctttctgctctg

SEQ ID NO: 105362 - DNA, 25 bp, Homo sapien
tgcaaaagtggcgttttctgctctg

SEQ ID NO: 105363 - DNA, 25 bp, Homo sapien
tgcaaaatacaccagaaagtcccag

SEQ ID NO: 105364 - DNA, 25 bp, Homo sapien
tgcaaaatacaccggaaagtcccag

SEQ ID NO: 105365 - DNA, 25 bp, Homo sapien
tgcaaaatgtgtaatccagcatcct

SEQ ID NO: 105366 - DNA, 25 bp, Homo sapien
tgcaaaatgtgtagtccagcatcct

SEQ ID NO: 105367 - DNA, 25 bp, Homo sapien
tgcaaacacaagcgcaataaagatg

SEQ ID NO: 105368 - DNA, 25 bp, Homo sapien
tgcaaacacaagtgcaataaagatg

SEQ ID NO: 105369 - DNA, 25 bp, Homo sapien
tgcaaacagagtacgactcccttat

SEQ ID NO: 105370 - DNA, 25 bp, Homo sapien
tgcaaacagagtatgactcccttat

SEQ ID NO: 105371 - DNA, 25 bp, Homo sapien
tgcaaactgacaggcttgaataaag

SEQ ID NO: 105372 - DNA, 25 bp, Homo sapien
tgcaaactgactggcttgaataaag

SEQ ID NO: 105373 - DNA, 25 bp, Homo sapien
tgcaaactgatatagccactctgga

SEQ ID NO: 105374 - DNA, 25 bp, Homo sapien
tgcaaactgattttgggcaaaattt

SEQ ID NO: 105375 - DNA, 25 bp, Homo sapien
tgcaaactggtatagccactctgga

SEQ ID NO: 105376 - DNA, 25 bp, Homo sapien
tgcaaactggttttgggcaaaattt

SEQ ID NO: 105377 - DNA, 25 bp, Homo sapien
tgcaaagagctgagcccgcaagttt

SEQ ID NO: 105378 - DNA, 25 bp, Homo sapien
tgcaaagagctgagccggcaagttt

SEQ ID NO: 105379 - DNA, 25 bp, Homo sapien
tgcaaagcgaactcaaaggaagagg

SEQ ID NO: 105380 - DNA, 25 bp, Homo sapien
tgcaaagcgaactcaagggaagagg

SEQ ID NO: 105381 - DNA, 25 bp, Homo sapien
tgcaaagctcacaactccaaaaatg

SEQ ID NO: 105382 - DNA, 25 bp, Homo sapien
tgcaaagctcagaactccaaaaatg

SEQ ID NO: 105383 - DNA, 25 bp, Homo sapien
tgcaaagcttcacctctagggaatc

SEQ ID NO: 105384 - DNA, 25 bp, Homo sapien
tgcaaagcttcgcctctagggaatc

SEQ ID NO: 105385 - DNA, 25 bp, Homo sapien
tgcaaaggaagatccacatctatat

SEQ ID NO: 105386 - DNA, 25 bp, Homo sapien
tgcaaaggacgatatttgggagtgg

SEQ ID NO: 105387 - DNA, 25 bp, Homo sapien
tgcaaaggacgatgtttgggagtgg

SEQ ID NO: 105388 - DNA, 25 bp, Homo sapien
tgcaaaggaggatccacatctatat

SEQ ID NO: 105389 - DNA, 25 bp, Homo sapien
tgcaaagtacccaattcactaccca

SEQ ID NO: 105390 - DNA, 25 bp, Homo sapien
tgcaaagtacccagttcactaccca

SEQ ID NO: 105391 - DNA, 25 bp, Homo sapien
tgcaaagtattaatcctgcgtgtgt

SEQ ID NO: 105392 - DNA, 25 bp, Homo sapien
tgcaaagtattgatcctgcgtgtgt

SEQ ID NO: 105393 - DNA, 25 bp, Homo sapien
tgcaaatacatcagtttacatgaga

SEQ ID NO: 105394 - DNA, 25 bp, Homo sapien
tgcaaatacatcattttacatgaga

SEQ ID NO: 105395 - DNA, 25 bp, Homo sapien
tgcaaatacctagtactgttggact

SEQ ID NO: 105396 - DNA, 25 bp, Homo sapien
tgcaaatagctagtactgttggact

SEQ ID NO: 105397 - DNA, 25 bp, Homo sapien
tgcaaatccttggttcacaataagt

SEQ ID NO: 105398 - DNA, 25 bp, Homo sapien
tgcaaatcgttggttcacaataagt

SEQ ID NO: 105399 - DNA, 25 bp, Homo sapien
tgcaaatggaaatggtaataaactc

SEQ ID NO: 105400 - DNA, 25 bp, Homo sapien
tgcaaatggcaatggtaataaactc

SEQ ID NO: 105401 - DNA, 25 bp, Homo sapien
tgcaaatgtcttaccacttgttcga

SEQ ID NO: 105402 - DNA, 25 bp, Homo sapien
tgcaaatgtcttcccacttgttcga

SEQ ID NO: 105403 - DNA, 25 bp, Homo sapien
tgcaaatttctaggagagtagggag

SEQ ID NO: 105404 - DNA, 25 bp, Homo sapien
tgcaaatttctaggagtgtagggag

SEQ ID NO: 105405 - DNA, 25 bp, Homo sapien
tgcaacaatctgacttgacaaccta

SEQ ID NO: 105406 - DNA, 25 bp, Homo sapien
tgcaacaatttgacttgacaaccta

SEQ ID NO: 105407 - DNA, 25 bp, Homo sapien
tgcaacagagaccgtgtggcctgcc

SEQ ID NO: 105408 - DNA, 25 bp, Homo sapien
tgcaacagagacggtgtggcctgcc

SEQ ID NO: 105409 - DNA, 25 bp, Homo sapien
tgcaacatcggtgcagtttggcaag

SEQ ID NO: 105410 - DNA, 25 bp, Homo sapien
tgcaacattggtgcagtttggcaag

SEQ ID NO: 105411 - DNA, 25 bp, Homo sapien
tgcaaccaacaatgtttttgtaaac

SEQ ID NO: 105412 - DNA, 25 bp, Homo sapien
tgcaaccaataatgtttttgtaaac

SEQ ID NO: 105413 - DNA, 25 bp, Homo sapien
tgcaaccatggaatacttgagtggg

SEQ ID NO: 105414 - DNA, 25 bp, Homo sapien
tgcaaccatggagtacttgagtggg

SEQ ID NO: 105415 - DNA, 25 bp, Homo sapien
tgcaacctccaaccgctggattcaa

SEQ ID NO: 105416 - DNA, 25 bp, Homo sapien
tgcaacctccaactgctggattcaa

SEQ ID NO: 105417 - DNA, 25 bp, Homo sapien
tgcaactaggaggcaacggcgaggg

SEQ ID NO: 105418 - DNA, 25 bp, Homo sapien
tgcaactaggaggcaatggcgaggg

SEQ ID NO: 105419 - DNA, 25 bp, Homo sapien
tgcaactcagtactttaacaagact

SEQ ID NO: 105420 - DNA, 25 bp, Homo sapien
tgcaactcagtgctttaacaagact

SEQ ID NO: 105421 - DNA, 25 bp, Homo sapien
tgcaactcgtgacttcatcatggct

SEQ ID NO: 105422 - DNA, 25 bp, Homo sapien
tgcaactctgcgatgttggaaaggc

SEQ ID NO: 105423 - DNA, 25 bp, Homo sapien
tgcaactctgcgctgttggaaaggc

SEQ ID NO: 105424 - DNA, 25 bp, Homo sapien
tgcaactcttgacttcatcatggct

SEQ ID NO: 105425 - DNA, 25 bp, Homo sapien
tgcaagaaggcacaatttaatcagg

SEQ ID NO: 105426 - DNA, 25 bp, Homo sapien
tgcaagaaggcataatttaatcagg

SEQ ID NO: 105427 - DNA, 25 bp, Homo sapien
tgcaagactgcaagaaatacctaag

SEQ ID NO: 105428 - DNA, 25 bp, Homo sapien
tgcaagactgcgagaaatacctaag

SEQ ID NO: 105429 - DNA, 25 bp, Homo sapien
tgcaagagaataggcctgagtcttg

SEQ ID NO: 105430 - DNA, 25 bp, Homo sapien
tgcaagagaataggtctgagtcttg

SEQ ID NO: 105431 - DNA, 25 bp, Homo sapien
tgcaagaggcaggcacagacgttag

SEQ ID NO: 105432 - DNA, 25 bp, Homo sapien
tgcaagaggcaggtacagacgttag

SEQ ID NO: 105433 - DNA, 25 bp, Homo sapien
tgcaagctcaataagaacagggact

SEQ ID NO: 105434 - DNA, 25 bp, Homo sapien
tgcaagctcaatgagaacagggact

SEQ ID NO: 105435 - DNA, 25 bp, Homo sapien
tgcaaggaatttgcccaacaaaggc

SEQ ID NO: 105436 - DNA, 25 bp, Homo sapien
tgcaaggaattttcccaacaaaggc

SEQ ID NO: 105437 - DNA, 25 bp, Homo sapien
tgcaaggaccaaagaaggaacctaa

SEQ ID NO: 105438 - DNA, 25 bp, Homo sapien
tgcaaggaccaaaggaggaacctaa

SEQ ID NO: 105439 - DNA, 25 bp, Homo sapien
tgcaagggatccattttcaggtagt

SEQ ID NO: 105440 - DNA, 25 bp, Homo sapien
tgcaaggggtccattttcaggtagt

SEQ ID NO: 105441 - DNA, 25 bp, Homo sapien
tgcaagggtaaaaaataaacaagtc

SEQ ID NO: 105442 - DNA, 25 bp, Homo sapien
tgcaagggtaagaaataaacaagtc

SEQ ID NO: 105443 - DNA, 25 bp, Homo sapien
tgcaaggtgctcgtgaagattaaat

SEQ ID NO: 105444 - DNA, 25 bp, Homo sapien
tgcaaggtgctcgtgaggattaaat

SEQ ID NO: 105445 - DNA, 25 bp, Homo sapien
tgcaagtgcatagaaacagaataga

SEQ ID NO: 105446 - DNA, 25 bp, Homo sapien
tgcaagtgcatagaaatagaataga

SEQ ID NO: 105447 - DNA, 25 bp, Homo sapien
tgcaagttttcagcttattggcaca

SEQ ID NO: 105448 - DNA, 25 bp, Homo sapien
tgcaagttttccgcttattggcaca

SEQ ID NO: 105449 - DNA, 25 bp, Homo sapien
tgcaataaacacgactactgatttg

SEQ ID NO: 105450 - DNA, 25 bp, Homo sapien
tgcaataaacacgattactgatttg

SEQ ID NO: 105451 - DNA, 25 bp, Homo sapien
tgcaatacgcttttcaaactttttg

SEQ ID NO: 105452 - DNA, 25 bp, Homo sapien
tgcaatacgcttttcatactttttg

SEQ ID NO: 105453 - DNA, 25 bp, Homo sapien
tgcaatagcataaaccagtacacat

SEQ ID NO: 105454 - DNA, 25 bp, Homo sapien
tgcaatagcatgaaccagtacacat

SEQ ID NO: 105455 - DNA, 25 bp, Homo sapien
tgcaatatacgcggaatgtcttaaa

SEQ ID NO: 105456 - DNA, 25 bp, Homo sapien
tgcaatatacgtggaatgtcttaaa

SEQ ID NO: 105457 - DNA, 25 bp, Homo sapien
tgcaatatatacctgtaatcatata

SEQ ID NO: 105458 - DNA, 25 bp, Homo sapien
tgcaatatatatctgtaatcatata

SEQ ID NO: 105459 - DNA, 25 bp, Homo sapien
tgcaatatgttcagtgccttgaaat

SEQ ID NO: 105460 - DNA, 25 bp, Homo sapien
tgcaatatgttcagtgtcttgaaat

SEQ ID NO: 105461 - DNA, 25 bp, Homo sapien
tgcaatctgtgcagaagaaagtaac

SEQ ID NO: 105462 - DNA, 25 bp, Homo sapien
tgcaatctgtgcaggagaaagtaac

SEQ ID NO: 105463 - DNA, 25 bp, Homo sapien
tgcaatgaagacattggactgagtg

SEQ ID NO: 105464 - DNA, 25 bp, Homo sapien
tgcaatgaagatattggactgagtg

SEQ ID NO: 105465 - DNA, 25 bp, Homo sapien
tgcaatgaatggactggccacaaaa

SEQ ID NO: 105466 - DNA, 25 bp, Homo sapien
tgcaatgaatgggctggccacaaaa

SEQ ID NO: 105467 - DNA, 25 bp, Homo sapien
tgcaatgatgtatcagaccattcat

SEQ ID NO: 105468 - DNA, 25 bp, Homo sapien
tgcaatgatgtatctgaccattcat

SEQ ID NO: 105469 - DNA, 25 bp, Homo sapien
tgcaatgattcaagagggagaggac

SEQ ID NO: 105470 - DNA, 25 bp, Homo sapien
tgcaatgattcaggagggagaggac

SEQ ID NO: 105471 - DNA, 25 bp, Homo sapien
tgcaatgcatgctctttaaatagaa

SEQ ID NO: 105472 - DNA, 25 bp, Homo sapien
tgcaatgcatgctttttaaatagaa

SEQ ID NO: 105473 - DNA, 25 bp, Homo sapien
tgcaatgtgttgtcattacaggact

SEQ ID NO: 105474 - DNA, 25 bp, Homo sapien
tgcaatgtgttgtcgttacaggact

SEQ ID NO: 105475 - DNA, 25 bp, Homo sapien
tgcaattccaacggctcagagcaaa

SEQ ID NO: 105476 - DNA, 25 bp, Homo sapien
tgcaattccaagggctcagagcaaa

SEQ ID NO: 105477 - DNA, 25 bp, Homo sapien
tgcaattccagctgaaatgggcaaa

SEQ ID NO: 105478 - DNA, 25 bp, Homo sapien
tgcaattctagctgaaatgggcaaa

SEQ ID NO: 105479 - DNA, 25 bp, Homo sapien
tgcaattctttactctaatccatta

SEQ ID NO: 105480 - DNA, 25 bp, Homo sapien
tgcaattctttgctctaatccatta

SEQ ID NO: 105481 - DNA, 25 bp, Homo sapien
tgcaattgttccatcagagaatttg

SEQ ID NO: 105482 - DNA, 25 bp, Homo sapien
tgcaattgttccgtcagagaatttg

SEQ ID NO: 105483 - DNA, 25 bp, Homo sapien
tgcaatttccttatttctctcagcc

SEQ ID NO: 105484 - DNA, 25 bp, Homo sapien
tgcaatttccttatttgtctcagcc

SEQ ID NO: 105485 - DNA, 25 bp, Homo sapien
tgcaattttgtggccatgtttccgt

SEQ ID NO: 105486 - DNA, 25 bp, Homo sapien
tgcaattttgtggctatgtttccgt

SEQ ID NO: 105487 - DNA, 25 bp, Homo sapien
tgcacaaaaggattcgatacactag

SEQ ID NO: 105488 - DNA, 25 bp, Homo sapien
tgcacaaaaggatttgatacactag

SEQ ID NO: 105489 - DNA, 25 bp, Homo sapien
tgcacaaagatactaataacaaaca

SEQ ID NO: 105490 - DNA, 25 bp, Homo sapien
tgcacaaagatgctaataacaaaca

SEQ ID NO: 105491 - DNA, 25 bp, Homo sapien
tgcacaagcaaggaaagagattcct

SEQ ID NO: 105492 - DNA, 25 bp, Homo sapien
tgcacaagtaaggaaagagattcct

SEQ ID NO: 105493 - DNA, 25 bp, Homo sapien
tgcacaatgaggagacacaatttaa

SEQ ID NO: 105494 - DNA, 25 bp, Homo sapien
tgcacaatgaggagacgcaatttaa

SEQ ID NO: 105495 - DNA, 25 bp, Homo sapien
tgcacaatggtatgaaaatgtttaa

SEQ ID NO: 105496 - DNA, 25 bp, Homo sapien
tgcacaatggtatgaatatgtttaa

SEQ ID NO: 105497 - DNA, 25 bp, Homo sapien
tgcacaccactatgccgtgctaatt

SEQ ID NO: 105498 - DNA, 25 bp, Homo sapien
tgcacaccactatgccttgctaatt

SEQ ID NO: 105499 - DNA, 25 bp, Homo sapien
tgcacactatattaccggaaagtga

SEQ ID NO: 105500 - DNA, 25 bp, Homo sapien
tgcacactgtattaccggaaagtga

SEQ ID NO: 105501 - DNA, 25 bp, Homo sapien
tgcacacttgtaaagacgagtgatg

SEQ ID NO: 105502 - DNA, 25 bp, Homo sapien
tgcacacttgtaaagatgagtgatg

SEQ ID NO: 105503 - DNA, 25 bp, Homo sapien
tgcacacttgttaccctaacactac

SEQ ID NO: 105504 - DNA, 25 bp, Homo sapien
tgcacacttgtttccctaacactac

SEQ ID NO: 105505 - DNA, 25 bp, Homo sapien
tgcacagcttaagggtcagcgtccc

SEQ ID NO: 105506 - DNA, 25 bp, Homo sapien
tgcacagcttaggggtcagcgtccc

SEQ ID NO: 105507 - DNA, 25 bp, Homo sapien
tgcacaggaaagtccctacccccca

SEQ ID NO: 105508 - DNA, 25 bp, Homo sapien
tgcacaggacaaactcaatcatgtc

SEQ ID NO: 105509 - DNA, 25 bp, Homo sapien
tgcacaggacaagctcaatcatgtc

SEQ ID NO: 105510 - DNA, 25 bp, Homo sapien
tgcacaggacagtccctacccccca

SEQ ID NO: 105511 - DNA, 25 bp, Homo sapien
tgcacaggggaaagccactccaggt

SEQ ID NO: 105512 - DNA, 25 bp, Homo sapien
tgcacaggggaaggccactccaggt

SEQ ID NO: 105513 - DNA, 25 bp, Homo sapien
tgcacagtatgttcaaaggccctgc

SEQ ID NO: 105514 - DNA, 25 bp, Homo sapien
tgcacagtcacactgctgtacttaa

SEQ ID NO: 105515 - DNA, 25 bp, Homo sapien
tgcacagtcacattgctgtacttaa

SEQ ID NO: 105516 - DNA, 25 bp, Homo sapien
tgcacagtcggcagtctgtgtctct

SEQ ID NO: 105517 - DNA, 25 bp, Homo sapien
tgcacagtgtgttcaaaggccctgc

SEQ ID NO: 105518 - DNA, 25 bp, Homo sapien
tgcacagttcgaggctcaaaaagag

SEQ ID NO: 105519 - DNA, 25 bp, Homo sapien
tgcacagttggcagtctgtgtctct

SEQ ID NO: 105520 - DNA, 25 bp, Homo sapien
tgcacagtttgaggctcaaaaagag

SEQ ID NO: 105521 - DNA, 25 bp, Homo sapien
tgcacataatgggtcctgagtattt

SEQ ID NO: 105522 - DNA, 25 bp, Homo sapien
tgcacatagtgggtcctgagtattt

SEQ ID NO: 105523 - DNA, 25 bp, Homo sapien
tgcacatatctctctgcggctaaag

SEQ ID NO: 105524 - DNA, 25 bp, Homo sapien
tgcacatatctctctgtggctaaag

SEQ ID NO: 105525 - DNA, 25 bp, Homo sapien
tgcacatgcattaaaaaaaagaatg

SEQ ID NO: 105526 - DNA, 25 bp, Homo sapien
tgcacatgcgttaaaaaaaagaatg

SEQ ID NO: 105527 - DNA, 25 bp, Homo sapien
tgcacatggcggtgatcaagccaga

SEQ ID NO: 105528 - DNA, 25 bp, Homo sapien
tgcacatggtggtgatcaagccaga

SEQ ID NO: 105529 - DNA, 25 bp, Homo sapien
tgcacatgtatacttactgacctgc

SEQ ID NO: 105530 - DNA, 25 bp, Homo sapien
tgcacatgtatacttattgacctgc

SEQ ID NO: 105531 - DNA, 25 bp, Homo sapien
tgcacattcataattgcaaaattca

SEQ ID NO: 105532 - DNA, 25 bp, Homo sapien
tgcacattcatcattgcaaaattca

SEQ ID NO: 105533 - DNA, 25 bp, Homo sapien
tgcacattgtattcaccttgggagc

SEQ ID NO: 105534 - DNA, 25 bp, Homo sapien
tgcacattgtattgaccttgggagc

SEQ ID NO: 105535 - DNA, 25 bp, Homo sapien
tgcacatttcactttttagaatcgt

SEQ ID NO: 105536 - DNA, 25 bp, Homo sapien
tgcacatttgcccgcaccttccatg

SEQ ID NO: 105537 - DNA, 25 bp, Homo sapien
tgcacatttgcctgcaccttccatg

SEQ ID NO: 105538 - DNA, 25 bp, Homo sapien
tgcacattttactttttagaatcgt

SEQ ID NO: 105539 - DNA, 25 bp, Homo sapien
tgcaccacttcattccagcttgagt

SEQ ID NO: 105540 - DNA, 25 bp, Homo sapien
tgcaccacttcattccggcttgagt

SEQ ID NO: 105541 - DNA, 25 bp, Homo sapien
tgcaccagataagctatgctaacaa

SEQ ID NO: 105542 - DNA, 25 bp, Homo sapien
tgcaccagataggctatgctaacaa

SEQ ID NO: 105543 - DNA, 25 bp, Homo sapien
tgcaccatcaaggattttaggacag

SEQ ID NO: 105544 - DNA, 25 bp, Homo sapien
tgcaccatcgaggattttaggacag

SEQ ID NO: 105545 - DNA, 25 bp, Homo sapien
tgcacccaaatacgcagtttcctgt

SEQ ID NO: 105546 - DNA, 25 bp, Homo sapien
tgcacccaaatatgcagtttcctgt

SEQ ID NO: 105547 - DNA, 25 bp, Homo sapien
tgcacccgatatcaaagaatccaaa

SEQ ID NO: 105548 - DNA, 25 bp, Homo sapien
tgcacccgatatcaaataatccaaa

SEQ ID NO: 105549 - DNA, 25 bp, Homo sapien
tgcacccgtttatacttggtgtccc

SEQ ID NO: 105550 - DNA, 25 bp, Homo sapien
tgcacccgtttttacttggtgtccc

SEQ ID NO: 105551 - DNA, 25 bp, Homo sapien
tgcacctctccggcaccaccaccag

SEQ ID NO: 105552 - DNA, 25 bp, Homo sapien
tgcacctctcctgcaccaccaccag

SEQ ID NO: 105553 - DNA, 25 bp, Homo sapien
tgcaccttctctgtcccatctcttt

SEQ ID NO: 105554 - DNA, 25 bp, Homo sapien
tgcaccttctctttcccatctcttt

SEQ ID NO: 105555 - DNA, 25 bp, Homo sapien
tgcacgaacagcatggatttcccct

SEQ ID NO: 105556 - DNA, 25 bp, Homo sapien
tgcacgaacaggatggatttcccct

SEQ ID NO: 105557 - DNA, 25 bp, Homo sapien
tgcacgggttgaccctacagaaaag

SEQ ID NO: 105558 - DNA, 25 bp, Homo sapien
tgcacgggttgaccttacagaaaag

SEQ ID NO: 105559 - DNA, 25 bp, Homo sapien
tgcactaaaggaatttactctcttc

SEQ ID NO: 105560 - DNA, 25 bp, Homo sapien
tgcactaaaggagtttactctcttc

SEQ ID NO: 105561 - DNA, 25 bp, Homo sapien
tgcactaactgaacacttgcagcat

SEQ ID NO: 105562 - DNA, 25 bp, Homo sapien
tgcactaactgagcacttgcagcat

SEQ ID NO: 105563 - DNA, 25 bp, Homo sapien
tgcactcactattcccacagaggct

SEQ ID NO: 105564 - DNA, 25 bp, Homo sapien
tgcactcactattcccgcagaggct

SEQ ID NO: 105565 - DNA, 25 bp, Homo sapien
tgcactccaacaaacagagccagac

SEQ ID NO: 105566 - DNA, 25 bp, Homo sapien
tgcactccatcaaacagagccagac

SEQ ID NO: 105567 - DNA, 25 bp, Homo sapien
tgcactcggaccgcttcacaggtgt

SEQ ID NO: 105568 - DNA, 25 bp, Homo sapien
tgcactcggactgcttcacaggtgt

SEQ ID NO: 105569 - DNA, 25 bp, Homo sapien
tgcactgcctaacaacacccctgct

SEQ ID NO: 105570 - DNA, 25 bp, Homo sapien
tgcactgcgtaacaacacccctgct

SEQ ID NO: 105571 - DNA, 25 bp, Homo sapien
tgcactggaatcagatgttcccaac

SEQ ID NO: 105572 - DNA, 25 bp, Homo sapien
tgcactggaatcaggtgttcccaac

SEQ ID NO: 105573 - DNA, 25 bp, Homo sapien
tgcacttccaaatcttgaacaattg

SEQ ID NO: 105574 - DNA, 25 bp, Homo sapien
tgcacttctaaatcttgaacaattg

SEQ ID NO: 105575 - DNA, 25 bp, Homo sapien
tgcacttgttatagaataataaacg

SEQ ID NO: 105576 - DNA, 25 bp, Homo sapien
tgcacttgttatataataataaacg

SEQ ID NO: 105577 - DNA, 25 bp, Homo sapien
tgcactttccacagatttttgctca

SEQ ID NO: 105578 - DNA, 25 bp, Homo sapien
tgcactttccacagctttttgctca

SEQ ID NO: 105579 - DNA, 25 bp, Homo sapien
tgcacttttagacccaacactcagg

SEQ ID NO: 105580 - DNA, 25 bp, Homo sapien
tgcacttttagatccaacactcagg

SEQ ID NO: 105581 - DNA, 25 bp, Homo sapien
tgcagaaaaagttctgaagtcttgt

SEQ ID NO: 105582 - DNA, 25 bp, Homo sapien
tgcagaaacgacacaaagattccca

SEQ ID NO: 105583 - DNA, 25 bp, Homo sapien
tgcagaaactacacaaagattccca

SEQ ID NO: 105584 - DNA, 25 bp, Homo sapien
tgcagaaactacagccttgttcttt

SEQ ID NO: 105585 - DNA, 25 bp, Homo sapien
tgcagaaactacggccttgttcttt

SEQ ID NO: 105586 - DNA, 25 bp, Homo sapien
tgcagaaagagttctgaagtcttgt

SEQ ID NO: 105587 - DNA, 25 bp, Homo sapien
tgcagaaatagtaaatttgacaaca

SEQ ID NO: 105588 - DNA, 25 bp, Homo sapien
tgcagaaatagtcaatttgacaaca

SEQ ID NO: 105589 - DNA, 25 bp, Homo sapien
tgcagaaccgttttctccttgatca

SEQ ID NO: 105590 - DNA, 25 bp, Homo sapien
tgcagaactgttttctccttgatca

SEQ ID NO: 105591 - DNA, 25 bp, Homo sapien
tgcagaagacaatggatatcggcag

SEQ ID NO: 105592 - DNA, 25 bp, Homo sapien
tgcagaaggcaatggatatcggcag

SEQ ID NO: 105593 - DNA, 25 bp, Homo sapien
tgcagacaaggaagctcagaggagg

SEQ ID NO: 105594 - DNA, 25 bp, Homo sapien
tgcagacaaggaagttcagaggagg

SEQ ID NO: 105595 - DNA, 25 bp, Homo sapien
tgcagacataaagaagaaggcatgg

SEQ ID NO: 105596 - DNA, 25 bp, Homo sapien
tgcagacataaagaagcaggcatgg

SEQ ID NO: 105597 - DNA, 25 bp, Homo sapien
tgcagacgtgtgtaggagcataaat

SEQ ID NO: 105598 - DNA, 25 bp, Homo sapien
tgcagacgtgtgtgggagcataaat

SEQ ID NO: 105599 - DNA, 25 bp, Homo sapien
tgcagactcctgagtaaatattatc

SEQ ID NO: 105600 - DNA, 25 bp, Homo sapien
tgcagactcctgggtaaatattatc

SEQ ID NO: 105601 - DNA, 25 bp, Homo sapien
tgcagagaaagggaccttaaaaaga

SEQ ID NO: 105602 - DNA, 25 bp, Homo sapien
tgcagagaaagggagcttaaaaaga

SEQ ID NO: 105603 - DNA, 25 bp, Homo sapien
tgcagaggcacaactgatggcaagc

SEQ ID NO: 105604 - DNA, 25 bp, Homo sapien
tgcagaggcacacctgatggcaagc

SEQ ID NO: 105605 - DNA, 25 bp, Homo sapien
tgcagagtacaaagcacatccttct

SEQ ID NO: 105606 - DNA, 25 bp, Homo sapien
tgcagagtacaaggcacatccttct

SEQ ID NO: 105607 - DNA, 25 bp, Homo sapien
tgcagatactgggttttccgtccaa

SEQ ID NO: 105608 - DNA, 25 bp, Homo sapien
tgcagatactgtgttttccgtccaa

SEQ ID NO: 105609 - DNA, 25 bp, Homo sapien
tgcagatgccgttaaaactaagttg

SEQ ID NO: 105610 - DNA, 25 bp, Homo sapien
tgcagatgctgttaaaactaagttg

SEQ ID NO: 105611 - DNA, 25 bp, Homo sapien
tgcagatgtggctcctaccaattga

SEQ ID NO: 105612 - DNA, 25 bp, Homo sapien
tgcagatgtggctcctgccaattga

SEQ ID NO: 105613 - DNA, 25 bp, Homo sapien
tgcagattaatccacttccatgcta

SEQ ID NO: 105614 - DNA, 25 bp, Homo sapien
tgcagattaatctacttccatgcta

SEQ ID NO: 105615 - DNA, 25 bp, Homo sapien
tgcagattaatgaacgtatttgaac

SEQ ID NO: 105616 - DNA, 25 bp, Homo sapien
tgcagattaatggacgtatttgaac

SEQ ID NO: 105617 - DNA, 25 bp, Homo sapien
tgcagattcgttttcacccttgagt

SEQ ID NO: 105618 - DNA, 25 bp, Homo sapien
tgcagatttgttttcacccttgagt

SEQ ID NO: 105619 - DNA, 25 bp, Homo sapien
tgcagcaacagaaacctattaagat

SEQ ID NO: 105620 - DNA, 25 bp, Homo sapien
tgcagcaacagaaatctattaagat

SEQ ID NO: 105621 - DNA, 25 bp, Homo sapien
tgcagcagagcattccctactctat

SEQ ID NO: 105622 - DNA, 25 bp, Homo sapien
tgcagcagagcattccttactctat

SEQ ID NO: 105623 - DNA, 25 bp, Homo sapien
tgcagcagatcattcagctctttcc

SEQ ID NO: 105624 - DNA, 25 bp, Homo sapien
tgcagcagatctttcagctctttcc

SEQ ID NO: 105625 - DNA, 25 bp, Homo sapien
tgcagcaggatggtatacagaatat

SEQ ID NO: 105626 - DNA, 25 bp, Homo sapien
tgcagcagggatgaaaacaaaatta

SEQ ID NO: 105627 - DNA, 25 bp, Homo sapien
tgcagcagggatgaaagcaaaatta

SEQ ID NO: 105628 - DNA, 25 bp, Homo sapien
tgcagcagggtggtatacagaatat

SEQ ID NO: 105629 - DNA, 25 bp, Homo sapien
tgcagcatagaagcatagaacgttt

SEQ ID NO: 105630 - DNA, 25 bp, Homo sapien
tgcagcatagaagcgtagaacgttt

SEQ ID NO: 105631 - DNA, 25 bp, Homo sapien
tgcagcatggccaccgtggaattca

SEQ ID NO: 105632 - DNA, 25 bp, Homo sapien
tgcagcatggccactgtggaattca

SEQ ID NO: 105633 - DNA, 25 bp, Homo sapien
tgcagcatttacatgtttaacaagc

SEQ ID NO: 105634 - DNA, 25 bp, Homo sapien
tgcagcatttacatttttaacaagc

SEQ ID NO: 105635 - DNA, 25 bp, Homo sapien
tgcagccaagacacccatgagagta

SEQ ID NO: 105636 - DNA, 25 bp, Homo sapien
tgcagccaagacgcccatgagagta

SEQ ID NO: 105637 - DNA, 25 bp, Homo sapien
tgcagccacattccaggaagtagat

SEQ ID NO: 105638 - DNA, 25 bp, Homo sapien
tgcagccatattccaggaagtagat

SEQ ID NO: 105639 - DNA, 25 bp, Homo sapien
tgcagcctaaatacttgaaagcaat

SEQ ID NO: 105640 - DNA, 25 bp, Homo sapien
tgcagcctagatacttgaaagcaat

SEQ ID NO: 105641 - DNA, 25 bp, Homo sapien
tgcagctaagtagtattagcgttgt

SEQ ID NO: 105642 - DNA, 25 bp, Homo sapien
tgcagctacggaaggcaatcaaggt

SEQ ID NO: 105643 - DNA, 25 bp, Homo sapien
tgcagctaggtagtattagcgttgt

SEQ ID NO: 105644 - DNA, 25 bp, Homo sapien
tgcagctatgattatggatattgag

SEQ ID NO: 105645 - DNA, 25 bp, Homo sapien
tgcagctatgattgtggatattgag

SEQ ID NO: 105646 - DNA, 25 bp, Homo sapien
tgcagctatggaaggcaatcaaggt

SEQ ID NO: 105647 - DNA, 25 bp, Homo sapien
tgcagctgaaattcaaacccaggtg

SEQ ID NO: 105648 - DNA, 25 bp, Homo sapien
tgcagctgaaattcgaacccaggtg

SEQ ID NO: 105649 - DNA, 25 bp, Homo sapien
tgcagcttaccaatgacggtcttct

SEQ ID NO: 105650 - DNA, 25 bp, Homo sapien
tgcagcttaccagtgacggtcttct

SEQ ID NO: 105651 - DNA, 25 bp, Homo sapien
tgcaggaaacgctgaggctttgaag

SEQ ID NO: 105652 - DNA, 25 bp, Homo sapien
tgcaggaaatgctgaggctttgaag

SEQ ID NO: 105653 - DNA, 25 bp, Homo sapien
tgcaggacctaaaatggtttttctg

SEQ ID NO: 105654 - DNA, 25 bp, Homo sapien
tgcaggacctaatatggtttttctg

SEQ ID NO: 105655 - DNA, 25 bp, Homo sapien
tgcaggaggccagctgccagtgcct

SEQ ID NO: 105656 - DNA, 25 bp, Homo sapien
tgcaggaggccggctgccagtgcct

SEQ ID NO: 105657 - DNA, 25 bp, Homo sapien
tgcaggattcagcaccaagagctct

SEQ ID NO: 105658 - DNA, 25 bp, Homo sapien
tgcaggattcatcaccaagagctct

SEQ ID NO: 105659 - DNA, 25 bp, Homo sapien
tgcaggcatgaaagaaaaggcctgg

SEQ ID NO: 105660 - DNA, 25 bp, Homo sapien
tgcaggcatgaaagcaaaggcctgg

SEQ ID NO: 105661 - DNA, 25 bp, Homo sapien
tgcaggccatgacaggctcatttca

SEQ ID NO: 105662 - DNA, 25 bp, Homo sapien
tgcaggccatgataggctcatttca

SEQ ID NO: 105663 - DNA, 25 bp, Homo sapien
tgcaggctcctgagaaaaaattcca

SEQ ID NO: 105664 - DNA, 25 bp, Homo sapien
tgcaggctcctgagaataaattcca

SEQ ID NO: 105665 - DNA, 25 bp, Homo sapien
tgcagggagttggtatgacactgtc

SEQ ID NO: 105666 - DNA, 25 bp, Homo sapien
tgcagggagtttgtatgacactgtc

SEQ ID NO: 105667 - DNA, 25 bp, Homo sapien
tgcaggtaaacgtgtgctagtcagt

SEQ ID NO: 105668 - DNA, 25 bp, Homo sapien
tgcaggtaatcgtgtgctagtcagt

SEQ ID NO: 105669 - DNA, 25 bp, Homo sapien
tgcaggtgattggcatcctgaattt

SEQ ID NO: 105670 - DNA, 25 bp, Homo sapien
tgcaggtgattggtatcctgaattt

SEQ ID NO: 105671 - DNA, 25 bp, Homo sapien
tgcaggtgccaataggcagccgata

SEQ ID NO: 105672 - DNA, 25 bp, Homo sapien
tgcaggtgccaatgggcagccgata

SEQ ID NO: 105673 - DNA, 25 bp, Homo sapien
tgcaggtggaccccgtgtcataaat

SEQ ID NO: 105674 - DNA, 25 bp, Homo sapien
tgcaggtggaccctgtgtcataaat

SEQ ID NO: 105675 - DNA, 25 bp, Homo sapien
tgcagtaaccacgatggcagctggc

SEQ ID NO: 105676 - DNA, 25 bp, Homo sapien
tgcagtaaccatgatggcagctggc

SEQ ID NO: 105677 - DNA, 25 bp, Homo sapien
tgcagtagcaaccactgcattgtat

SEQ ID NO: 105678 - DNA, 25 bp, Homo sapien
tgcagtagcaaccattgcattgtat

SEQ ID NO: 105679 - DNA, 25 bp, Homo sapien
tgcagtatatccaaagtttaattca

SEQ ID NO: 105680 - DNA, 25 bp, Homo sapien
tgcagtatatccgaagtttaattca

SEQ ID NO: 105681 - DNA, 25 bp, Homo sapien
tgcagtatcatttatcatgagaagt

SEQ ID NO: 105682 - DNA, 25 bp, Homo sapien
tgcagtatcatttatcctgagaagt

SEQ ID NO: 105683 - DNA, 25 bp, Homo sapien
tgcagtatcttcagttcttacagtg

SEQ ID NO: 105684 - DNA, 25 bp, Homo sapien
tgcagtatcttcatttcttacagtg

SEQ ID NO: 105685 - DNA, 25 bp, Homo sapien
tgcagtatgcacaaagggcaataaa

SEQ ID NO: 105686 - DNA, 25 bp, Homo sapien
tgcagtatgcacgaagggcaataaa

SEQ ID NO: 105687 - DNA, 25 bp, Homo sapien
tgcagtccacaaacacctttttgta

SEQ ID NO: 105688 - DNA, 25 bp, Homo sapien
tgcagtccacaatcacctttttgta

SEQ ID NO: 105689 - DNA, 25 bp, Homo sapien
tgcagtccagcagaccatctagggg

SEQ ID NO: 105690 - DNA, 25 bp, Homo sapien
tgcagtccagcggaccatctagggg

SEQ ID NO: 105691 - DNA, 25 bp, Homo sapien
tgcagtccatttatgcaaaataatc

SEQ ID NO: 105692 - DNA, 25 bp, Homo sapien
tgcagtccatttgtgcaaaataatc

SEQ ID NO: 105693 - DNA, 25 bp, Homo sapien
tgcagtcctagtcaagatggccaca

SEQ ID NO: 105694 - DNA, 25 bp, Homo sapien
tgcagtcctagtcgagatggccaca

SEQ ID NO: 105695 - DNA, 25 bp, Homo sapien
tgcagtctaatactcaaaatttccc

SEQ ID NO: 105696 - DNA, 25 bp, Homo sapien
tgcagtctaatattcaaaatttccc

SEQ ID NO: 105697 - DNA, 25 bp, Homo sapien
tgcagtctctgtctaatgatgcttc

SEQ ID NO: 105698 - DNA, 25 bp, Homo sapien
tgcagtctctgtctgatgatgcttc

SEQ ID NO: 105699 - DNA, 25 bp, Homo sapien
tgcagtgaaatataacagtatgact

SEQ ID NO: 105700 - DNA, 25 bp, Homo sapien
tgcagtgaattataacagtatgact

SEQ ID NO: 105701 - DNA, 25 bp, Homo sapien
tgcagtgccacatttcacaggtcaa

SEQ ID NO: 105702 - DNA, 25 bp, Homo sapien
tgcagtgccacgtttcacaggtcaa

SEQ ID NO: 105703 - DNA, 25 bp, Homo sapien
tgcagtgctttgatgaataataaac

SEQ ID NO: 105704 - DNA, 25 bp, Homo sapien
tgcagtgctttggtgaataataaac

SEQ ID NO: 105705 - DNA, 25 bp, Homo sapien
tgcagtggatgagaaataaatggaa

SEQ ID NO: 105706 - DNA, 25 bp, Homo sapien
tgcagtgggtgagaaataaatggaa

SEQ ID NO: 105707 - DNA, 25 bp, Homo sapien
tgcagtgtcatgaccttagcttctt

SEQ ID NO: 105708 - DNA, 25 bp, Homo sapien
tgcagtgtcatgcccttagcttctt

SEQ ID NO: 105709 - DNA, 25 bp, Homo sapien
tgcagtgtgtacaaattgtgggaag

SEQ ID NO: 105710 - DNA, 25 bp, Homo sapien
tgcagtgtgtacatattgtgggaag

SEQ ID NO: 105711 - DNA, 25 bp, Homo sapien
tgcagttcaggcagccctgtcattt

SEQ ID NO: 105712 - DNA, 25 bp, Homo sapien
tgcagttcaggtagccctgtcattt

SEQ ID NO: 105713 - DNA, 25 bp, Homo sapien
tgcagttcagtggaatgttagagag

SEQ ID NO: 105714 - DNA, 25 bp, Homo sapien
tgcagttcagtgtaatgttagagag

SEQ ID NO: 105715 - DNA, 25 bp, Homo sapien
tgcagttccactttgccccacaatg

SEQ ID NO: 105716 - DNA, 25 bp, Homo sapien
tgcagttccgctttgccccacaatg

SEQ ID NO: 105717 - DNA, 25 bp, Homo sapien
tgcagttggagaatacaaggtggat

SEQ ID NO: 105718 - DNA, 25 bp, Homo sapien
tgcagttggagaatgcaaggtggat

SEQ ID NO: 105719 - DNA, 25 bp, Homo sapien
tgcagttgtaacaaatgacataaag

SEQ ID NO: 105720 - DNA, 25 bp, Homo sapien
tgcagttgtaacgaatgacataaag

SEQ ID NO: 105721 - DNA, 25 bp, Homo sapien
tgcagttgtgatcatagctccctgt

SEQ ID NO: 105722 - DNA, 25 bp, Homo sapien
tgcagttgtgattatagctccctgt

SEQ ID NO: 105723 - DNA, 25 bp, Homo sapien
tgcagtttaatcaaaaatttactta

SEQ ID NO: 105724 - DNA, 25 bp, Homo sapien
tgcagtttaatcagaaatttactta

SEQ ID NO: 105725 - DNA, 25 bp, Homo sapien
tgcagtttataagacacctagttta

SEQ ID NO: 105726 - DNA, 25 bp, Homo sapien
tgcagtttataaggcacctagttta

SEQ ID NO: 105727 - DNA, 25 bp, Homo sapien
tgcagtttttagtgcgacctggcac

SEQ ID NO: 105728 - DNA, 25 bp, Homo sapien
tgcagtttttagtgtgacctggcac

SEQ ID NO: 105729 - DNA, 25 bp, Homo sapien
tgcagtttttcttacaccatctcag

SEQ ID NO: 105730 - DNA, 25 bp, Homo sapien
tgcagtttttcttataccatctcag

SEQ ID NO: 105731 - DNA, 25 bp, Homo sapien
tgcagtttttgttactattgtttat

SEQ ID NO: 105732 - DNA, 25 bp, Homo sapien
tgcagtttttgttcctattgtttat

SEQ ID NO: 105733 - DNA, 25 bp, Homo sapien
tgcataaaaagaacattcataataa

SEQ ID NO: 105734 - DNA, 25 bp, Homo sapien
tgcataaaaagagcattcataataa

SEQ ID NO: 105735 - DNA, 25 bp, Homo sapien
tgcataatccaatcacaaaagaaag

SEQ ID NO: 105736 - DNA, 25 bp, Homo sapien
tgcataatccagtcacaaaagaaag

SEQ ID NO: 105737 - DNA, 25 bp, Homo sapien
tgcataatttgataactaattctac

SEQ ID NO: 105738 - DNA, 25 bp, Homo sapien
tgcataatttgctaactaattctac

SEQ ID NO: 105739 - DNA, 25 bp, Homo sapien
tgcatacactttacccataatttcc

SEQ ID NO: 105740 - DNA, 25 bp, Homo sapien
tgcatacactttacccgtaatttcc

SEQ ID NO: 105741 - DNA, 25 bp, Homo sapien
tgcataccaattacaactctgcctc

SEQ ID NO: 105742 - DNA, 25 bp, Homo sapien
tgcataccacaaaaggaaaagaagg

SEQ ID NO: 105743 - DNA, 25 bp, Homo sapien
tgcataccataaaaggaaaagaagg

SEQ ID NO: 105744 - DNA, 25 bp, Homo sapien
tgcataccgattacaactctgcctc

SEQ ID NO: 105745 - DNA, 25 bp, Homo sapien
tgcatacgccgaagaggcattgtgg

SEQ ID NO: 105746 - DNA, 25 bp, Homo sapien
tgcatacgctgaagaggcattgtgg

SEQ ID NO: 105747 - DNA, 25 bp, Homo sapien
tgcatacttatatggccaatagcgt

SEQ ID NO: 105748 - DNA, 25 bp, Homo sapien
tgcatacttatttggccaatagcgt

SEQ ID NO: 105749 - DNA, 25 bp, Homo sapien
tgcatagaccacaatagattttaat

SEQ ID NO: 105750 - DNA, 25 bp, Homo sapien
tgcatagactacaatagattttaat

SEQ ID NO: 105751 - DNA, 25 bp, Homo sapien
tgcatagagccacgtccagcatcac

SEQ ID NO: 105752 - DNA, 25 bp, Homo sapien
tgcatagagccatgtccagcatcac

SEQ ID NO: 105753 - DNA, 25 bp, Homo sapien
tgcatagatgtgtctgcacaaggtc

SEQ ID NO: 105754 - DNA, 25 bp, Homo sapien
tgcatagatgtgtctgtacaaggtc

SEQ ID NO: 105755 - DNA, 25 bp, Homo sapien
tgcatagcaaacaacaacataaatg

SEQ ID NO: 105756 - DNA, 25 bp, Homo sapien
tgcatagcaacacgatttctgaaaa

SEQ ID NO: 105757 - DNA, 25 bp, Homo sapien
tgcatagcaacatgatttctgaaaa

SEQ ID NO: 105758 - DNA, 25 bp, Homo sapien
tgcatagcagacaacaacataaatg

SEQ ID NO: 105759 - DNA, 25 bp, Homo sapien
tgcatagctctacaatggagatttt

SEQ ID NO: 105760 - DNA, 25 bp, Homo sapien
tgcatagctctataatggagatttt

SEQ ID NO: 105761 - DNA, 25 bp, Homo sapien
tgcatagtatactcatttgagcaag

SEQ ID NO: 105762 - DNA, 25 bp, Homo sapien
tgcatagtgtactcatttgagcaag

SEQ ID NO: 105763 - DNA, 25 bp, Homo sapien
tgcatagtgtatcggtattgtgtta

SEQ ID NO: 105764 - DNA, 25 bp, Homo sapien
tgcatagtgtattggtattgtgtta

SEQ ID NO: 105765 - DNA, 25 bp, Homo sapien
tgcatatacatgcgggagaaactca

SEQ ID NO: 105766 - DNA, 25 bp, Homo sapien
tgcatatacatgtgggagaaactca

SEQ ID NO: 105767 - DNA, 25 bp, Homo sapien
tgcatatagttgcatcttgaagaaa

SEQ ID NO: 105768 - DNA, 25 bp, Homo sapien
tgcatatagttgcgtcttgaagaaa

SEQ ID NO: 105769 - DNA, 25 bp, Homo sapien
tgcatatgtttatcaaaatactccc

SEQ ID NO: 105770 - DNA, 25 bp, Homo sapien
tgcatatgtttatccaaatactccc

SEQ ID NO: 105771 - DNA, 25 bp, Homo sapien
tgcatattaaaagataagccagtac

SEQ ID NO: 105772 - DNA, 25 bp, Homo sapien
tgcatattaaaagataggccagtac

SEQ ID NO: 105773 - DNA, 25 bp, Homo sapien
tgcatcaacctatcgtcagtcaaac

SEQ ID NO: 105774 - DNA, 25 bp, Homo sapien
tgcatcaagctatcgtcagtcaaac

SEQ ID NO: 105775 - DNA, 25 bp, Homo sapien
tgcatcagaacagctggatccaagt

SEQ ID NO: 105776 - DNA, 25 bp, Homo sapien
tgcatcagaacaggtggatccaagt

SEQ ID NO: 105777 - DNA, 25 bp, Homo sapien
tgcatcagcaaataattattaagcc

SEQ ID NO: 105778 - DNA, 25 bp, Homo sapien
tgcatcagtaaataattattaagcc

SEQ ID NO: 105779 - DNA, 25 bp, Homo sapien
tgcatcagttgatctcttttcatgt

SEQ ID NO: 105780 - DNA, 25 bp, Homo sapien
tgcatcagttgatttcttttcatgt

SEQ ID NO: 105781 - DNA, 25 bp, Homo sapien
tgcatcataaacccaaattcctccc

SEQ ID NO: 105782 - DNA, 25 bp, Homo sapien
tgcatcatgaacccaaattcctccc

SEQ ID NO: 105783 - DNA, 25 bp, Homo sapien
tgcatcatgggacacacttctgaaa

SEQ ID NO: 105784 - DNA, 25 bp, Homo sapien
tgcatcatgggattaagaaaaaaaa

SEQ ID NO: 105785 - DNA, 25 bp, Homo sapien
tgcatcatggggcacacttctgaaa

SEQ ID NO: 105786 - DNA, 25 bp, Homo sapien
tgcatcatggggttaagaaaaaaaa

SEQ ID NO: 105787 - DNA, 25 bp, Homo sapien
tgcatcattaaatagagacataaga

SEQ ID NO: 105788 - DNA, 25 bp, Homo sapien
tgcatcattaagtagagacataaga

SEQ ID NO: 105789 - DNA, 25 bp, Homo sapien
tgcatcatttcctttgtattatctt

SEQ ID NO: 105790 - DNA, 25 bp, Homo sapien
tgcatcatttcttttgtattatctt

SEQ ID NO: 105791 - DNA, 25 bp, Homo sapien
tgcatctacttgttggcacaggtta

SEQ ID NO: 105792 - DNA, 25 bp, Homo sapien
tgcatctatttgttggcacaggtta

SEQ ID NO: 105793 - DNA, 25 bp, Homo sapien
tgcatctcaattatccaggcatggt

SEQ ID NO: 105794 - DNA, 25 bp, Homo sapien
tgcatctcaattttccaggcatggt

SEQ ID NO: 105795 - DNA, 25 bp, Homo sapien
tgcatctctaatttgggaaatgatc

SEQ ID NO: 105796 - DNA, 25 bp, Homo sapien
tgcatctctaattttggaaatgatc

SEQ ID NO: 105797 - DNA, 25 bp, Homo sapien
tgcatctctccctttcactgcttct

SEQ ID NO: 105798 - DNA, 25 bp, Homo sapien
tgcatctctccctttcgctgcttct

SEQ ID NO: 105799 - DNA, 25 bp, Homo sapien
tgcatctgtactatatctttatcac

SEQ ID NO: 105800 - DNA, 25 bp, Homo sapien
tgcatctgtactgtatctttatcac

SEQ ID NO: 105801 - DNA, 25 bp, Homo sapien
tgcatctgtgccggcagtttttgtt

SEQ ID NO: 105802 - DNA, 25 bp, Homo sapien
tgcatctgtgcctgcagtttttgtt

SEQ ID NO: 105803 - DNA, 25 bp, Homo sapien
tgcatcttacttcatgagaaatgca

SEQ ID NO: 105804 - DNA, 25 bp, Homo sapien
tgcatcttactttatgagaaatgca

SEQ ID NO: 105805 - DNA, 25 bp, Homo sapien
tgcatcttattccatggacatcagg

SEQ ID NO: 105806 - DNA, 25 bp, Homo sapien
tgcatcttattccgtggacatcagg

SEQ ID NO: 105807 - DNA, 25 bp, Homo sapien
tgcatcttttagactggtggttgtc

SEQ ID NO: 105808 - DNA, 25 bp, Homo sapien
tgcatcttttagattggtggttgtc

SEQ ID NO: 105809 - DNA, 25 bp, Homo sapien
tgcatgaagaggtgccataattatt

SEQ ID NO: 105810 - DNA, 25 bp, Homo sapien
tgcatgaagaggtgccgtaattatt

SEQ ID NO: 105811 - DNA, 25 bp, Homo sapien
tgcatgacagatcattctctaaccc

SEQ ID NO: 105812 - DNA, 25 bp, Homo sapien
tgcatgacagatcgttctctaaccc

SEQ ID NO: 105813 - DNA, 25 bp, Homo sapien
tgcatgagcagatccacgtcccata

SEQ ID NO: 105814 - DNA, 25 bp, Homo sapien
tgcatgaggagatccacgtcccata

SEQ ID NO: 105815 - DNA, 25 bp, Homo sapien
tgcatgaggttaagagcaatatttt

SEQ ID NO: 105816 - DNA, 25 bp, Homo sapien
tgcatgaggttgagagcaatatttt

SEQ ID NO: 105817 - DNA, 25 bp, Homo sapien
tgcatgattctttcttgcacccaag

SEQ ID NO: 105818 - DNA, 25 bp, Homo sapien
tgcatgattctttctttcacccaag

SEQ ID NO: 105819 - DNA, 25 bp, Homo sapien
tgcatgcacctgattagtggaacct

SEQ ID NO: 105820 - DNA, 25 bp, Homo sapien
tgcatgcatctgattagtggaacct

SEQ ID NO: 105821 - DNA, 25 bp, Homo sapien
tgcatgcccaaatcacagtatgcga

SEQ ID NO: 105822 - DNA, 25 bp, Homo sapien
tgcatgcccaaatcacggtatgcga

SEQ ID NO: 105823 - DNA, 25 bp, Homo sapien
tgcatgccctgaatctaaaatagaa

SEQ ID NO: 105824 - DNA, 25 bp, Homo sapien
tgcatgccctgcatctaaaatagaa

SEQ ID NO: 105825 - DNA, 25 bp, Homo sapien
tgcatgccggttacgtcctcactgt

SEQ ID NO: 105826 - DNA, 25 bp, Homo sapien
tgcatgccggttgcgtcctcactgt

SEQ ID NO: 105827 - DNA, 25 bp, Homo sapien
tgcatggcggagcttggttttccca

SEQ ID NO: 105828 - DNA, 25 bp, Homo sapien
tgcatggcggaggttggttttccca

SEQ ID NO: 105829 - DNA, 25 bp, Homo sapien
tgcatggtcattatccttttaccac

SEQ ID NO: 105830 - DNA, 25 bp, Homo sapien
tgcatggtcgttatccttttaccac

SEQ ID NO: 105831 - DNA, 25 bp, Homo sapien
tgcatgtacacaatatgttttcttt

SEQ ID NO: 105832 - DNA, 25 bp, Homo sapien
tgcatgtacacattatgttttcttt

SEQ ID NO: 105833 - DNA, 25 bp, Homo sapien
tgcatgtccgtcagagaggatacca

SEQ ID NO: 105834 - DNA, 25 bp, Homo sapien
tgcatgtctgtcagagaggatacca

SEQ ID NO: 105835 - DNA, 25 bp, Homo sapien
tgcatgtctttccccgtcgactgac

SEQ ID NO: 105836 - DNA, 25 bp, Homo sapien
tgcatgtctttccctgtcgactgac

SEQ ID NO: 105837 - DNA, 25 bp, Homo sapien
tgcatgtgctcatgggacactaagc

SEQ ID NO: 105838 - DNA, 25 bp, Homo sapien
tgcatgtgctcgtgggacactaagc

SEQ ID NO: 105839 - DNA, 25 bp, Homo sapien
tgcatgtttcaaatgtatgaatccc

SEQ ID NO: 105840 - DNA, 25 bp, Homo sapien
tgcatgtttcaaatttatgaatccc

SEQ ID NO: 105841 - DNA, 25 bp, Homo sapien
tgcatgtttctataagatggagagt

SEQ ID NO: 105842 - DNA, 25 bp, Homo sapien
tgcatgtttctctaagatggagagt

SEQ ID NO: 105843 - DNA, 25 bp, Homo sapien
tgcatgtttctgcgaagaactcaag

SEQ ID NO: 105844 - DNA, 25 bp, Homo sapien
tgcatgtttctgctaagaactcaag

SEQ ID NO: 105845 - DNA, 25 bp, Homo sapien
tgcattaaaaactaaaaaacagata

SEQ ID NO: 105846 - DNA, 25 bp, Homo sapien
tgcattaaaaagtaaaaaacagata

SEQ ID NO: 105847 - DNA, 25 bp, Homo sapien
tgcattaaagttactggtgctttaa

SEQ ID NO: 105848 - DNA, 25 bp, Homo sapien
tgcattaaagttattggtgctttaa

SEQ ID NO: 105849 - DNA, 25 bp, Homo sapien
tgcattacacctatgggtcttaaaa

SEQ ID NO: 105850 - DNA, 25 bp, Homo sapien
tgcattacatctatgggtcttaaaa

SEQ ID NO: 105851 - DNA, 25 bp, Homo sapien
tgcattatatcaatttttctacatg

SEQ ID NO: 105852 - DNA, 25 bp, Homo sapien
tgcattatatcagtttttctacatg

SEQ ID NO: 105853 - DNA, 25 bp, Homo sapien
tgcattatatgccaaatgaaagaga

SEQ ID NO: 105854 - DNA, 25 bp, Homo sapien
tgcattatttgccaaatgaaagaga

SEQ ID NO: 105855 - DNA, 25 bp, Homo sapien
tgcattcaatatagccatttatgaa

SEQ ID NO: 105856 - DNA, 25 bp, Homo sapien
tgcattcaatatcgccatttatgaa

SEQ ID NO: 105857 - DNA, 25 bp, Homo sapien
tgcattcagatacacatgaagattt

SEQ ID NO: 105858 - DNA, 25 bp, Homo sapien
tgcattcagatatacatgaagattt

SEQ ID NO: 105859 - DNA, 25 bp, Homo sapien
tgcattcaggcacagtgctctcctg

SEQ ID NO: 105860 - DNA, 25 bp, Homo sapien
tgcattcagtcacagtgctctcctg

SEQ ID NO: 105861 - DNA, 25 bp, Homo sapien
tgcattcatttacacttactgacaa

SEQ ID NO: 105862 - DNA, 25 bp, Homo sapien
tgcattcatttacagttactgacaa

SEQ ID NO: 105863 - DNA, 25 bp, Homo sapien
tgcattccattaaattcctcagagg

SEQ ID NO: 105864 - DNA, 25 bp, Homo sapien
tgcattccatttaattcctcagagg

SEQ ID NO: 105865 - DNA, 25 bp, Homo sapien
tgcattccgtttacaaagggaaaga

SEQ ID NO: 105866 - DNA, 25 bp, Homo sapien
tgcattccgtttaccaagggaaaga

SEQ ID NO: 105867 - DNA, 25 bp, Homo sapien
tgcattcgagtcaacacattcttct

SEQ ID NO: 105868 - DNA, 25 bp, Homo sapien
tgcattcgattcaacacattcttct

SEQ ID NO: 105869 - DNA, 25 bp, Homo sapien
tgcattctttactaagcggtctcaa

SEQ ID NO: 105870 - DNA, 25 bp, Homo sapien
tgcattctttagtaagcggtctcaa

SEQ ID NO: 105871 - DNA, 25 bp, Homo sapien
tgcattgcatcttctttgattgcct

SEQ ID NO: 105872 - DNA, 25 bp, Homo sapien
tgcattgcgtcttctttgattgcct

SEQ ID NO: 105873 - DNA, 25 bp, Homo sapien
tgcattgtttcatatgccaattgta

SEQ ID NO: 105874 - DNA, 25 bp, Homo sapien
tgcattgtttcgtatgccaattgta

SEQ ID NO: 105875 - DNA, 25 bp, Homo sapien
tgcatttatctatcaattattatag

SEQ ID NO: 105876 - DNA, 25 bp, Homo sapien
tgcatttatctgtcaattattatag

SEQ ID NO: 105877 - DNA, 25 bp, Homo sapien
tgcatttcaagcagcaaaatggaag

SEQ ID NO: 105878 - DNA, 25 bp, Homo sapien
tgcatttcaagtagcaaaatggaag

SEQ ID NO: 105879 - DNA, 25 bp, Homo sapien
tgcatttcactttaatgaatctcta

SEQ ID NO: 105880 - DNA, 25 bp, Homo sapien
tgcatttcagtttaatgaatctcta

SEQ ID NO: 105881 - DNA, 25 bp, Homo sapien
tgcatttccttcgtgtccaagctag

SEQ ID NO: 105882 - DNA, 25 bp, Homo sapien
tgcatttcctttgtgtccaagctag

SEQ ID NO: 105883 - DNA, 25 bp, Homo sapien
tgcatttgaacgatatacttcaact

SEQ ID NO: 105884 - DNA, 25 bp, Homo sapien
tgcatttgaactatatacttcaact

SEQ ID NO: 105885 - DNA, 25 bp, Homo sapien
tgcatttgcaaatccttggttcaca

SEQ ID NO: 105886 - DNA, 25 bp, Homo sapien
tgcatttgcaaatcgttggttcaca

SEQ ID NO: 105887 - DNA, 25 bp, Homo sapien
tgcatttgcttagatgtttgatagc

SEQ ID NO: 105888 - DNA, 25 bp, Homo sapien
tgcatttggacccacaggtaatagg

SEQ ID NO: 105889 - DNA, 25 bp, Homo sapien
tgcatttggacccgcaggtaatagg

SEQ ID NO: 105890 - DNA, 25 bp, Homo sapien
tgcatttgggccgcaaagtaacaac

SEQ ID NO: 105891 - DNA, 25 bp, Homo sapien
tgcatttgggcctcaaagtaacaac

SEQ ID NO: 105892 - DNA, 25 bp, Homo sapien
tgcatttgtttagatgtttgatagc

SEQ ID NO: 105893 - DNA, 25 bp, Homo sapien
tgcattttcaaaatcactacagctg

SEQ ID NO: 105894 - DNA, 25 bp, Homo sapien
tgcattttcaaattcactacagctg

SEQ ID NO: 105895 - DNA, 25 bp, Homo sapien
tgcattttccttacgttgctaatac

SEQ ID NO: 105896 - DNA, 25 bp, Homo sapien
tgcattttccttatgttgctaatac

SEQ ID NO: 105897 - DNA, 25 bp, Homo sapien
tgcattttgaccatcttttacacta

SEQ ID NO: 105898 - DNA, 25 bp, Homo sapien
tgcattttgactatcttttacacta

SEQ ID NO: 105899 - DNA, 25 bp, Homo sapien
tgcattttggacgtgccagcttcta

SEQ ID NO: 105900 - DNA, 25 bp, Homo sapien
tgcattttggatgtgccagcttcta

SEQ ID NO: 105901 - DNA, 25 bp, Homo sapien
tgcattttttaggatcagttgtcct

SEQ ID NO: 105902 - DNA, 25 bp, Homo sapien
tgcattttttaggatcggttgtcct

SEQ ID NO: 105903 - DNA, 25 bp, Homo sapien
tgccaaaaatttacatgctaaagaa

SEQ ID NO: 105904 - DNA, 25 bp, Homo sapien
tgccaaaaatttagatgctaaagaa

SEQ ID NO: 105905 - DNA, 25 bp, Homo sapien
tgccaaaacggaaagtcaagattct

SEQ ID NO: 105906 - DNA, 25 bp, Homo sapien
tgccaaaatggaaagtcaagattct

SEQ ID NO: 105907 - DNA, 25 bp, Homo sapien
tgccaaatcaccctttgcaaactaa

SEQ ID NO: 105908 - DNA, 25 bp, Homo sapien
tgccaaatcacccttttcaaactaa

SEQ ID NO: 105909 - DNA, 25 bp, Homo sapien
tgccaaatcattagctctctcttcc

SEQ ID NO: 105910 - DNA, 25 bp, Homo sapien
tgccaaatcgttagctctctcttcc

SEQ ID NO: 105911 - DNA, 25 bp, Homo sapien
tgccaaattgaatgatatattttca

SEQ ID NO: 105912 - DNA, 25 bp, Homo sapien
tgccaaattgaatgatgtattttca

SEQ ID NO: 105913 - DNA, 25 bp, Homo sapien
tgccaaatttgtctaatgggaatct

SEQ ID NO: 105914 - DNA, 25 bp, Homo sapien
tgccaaatttgtttaatgggaatct

SEQ ID NO: 105915 - DNA, 25 bp, Homo sapien
tgccaacatttgtactcctctctaa

SEQ ID NO: 105916 - DNA, 25 bp, Homo sapien
tgccaacatttttactcctctctaa

SEQ ID NO: 105917 - DNA, 25 bp, Homo sapien
tgccaacgaacctactattttgaca

SEQ ID NO: 105918 - DNA, 25 bp, Homo sapien
tgccaacgaacctactgttttgaca

SEQ ID NO: 105919 - DNA, 25 bp, Homo sapien
tgccaactgcgaaccgccagctctg

SEQ ID NO: 105920 - DNA, 25 bp, Homo sapien
tgccaactgcgagccgccagctctg

SEQ ID NO: 105921 - DNA, 25 bp, Homo sapien
tgccaagaatatcaggttttattgc

SEQ ID NO: 105922 - DNA, 25 bp, Homo sapien
tgccaagaatatcatgttttattgc

SEQ ID NO: 105923 - DNA, 25 bp, Homo sapien
tgccaagagtaggaaggctcatcat

SEQ ID NO: 105924 - DNA, 25 bp, Homo sapien
tgccaagagtaggatggctcatcat

SEQ ID NO: 105925 - DNA, 25 bp, Homo sapien
tgccaagcacaagtaaaataaggat

SEQ ID NO: 105926 - DNA, 25 bp, Homo sapien
tgccaagcataagtaaaataaggat

SEQ ID NO: 105927 - DNA, 25 bp, Homo sapien
tgccaaggctacatcattttgtggg

SEQ ID NO: 105928 - DNA, 25 bp, Homo sapien
tgccaaggttacatcattttgtggg

SEQ ID NO: 105929 - DNA, 25 bp, Homo sapien
tgccaagtggaataagccagacaca

SEQ ID NO: 105930 - DNA, 25 bp, Homo sapien
tgccaagtggagtaagccagacaca

SEQ ID NO: 105931 - DNA, 25 bp, Homo sapien
tgccaagttgagacaatggcttaac

SEQ ID NO: 105932 - DNA, 25 bp, Homo sapien
tgccaagttgaggcaatggcttaac

SEQ ID NO: 105933 - DNA, 25 bp, Homo sapien
tgccaatacgacatacttttcatat

SEQ ID NO: 105934 - DNA, 25 bp, Homo sapien
tgccaatactacatacttttcatat

SEQ ID NO: 105935 - DNA, 25 bp, Homo sapien
tgccaataggaaagtggaattcctg

SEQ ID NO: 105936 - DNA, 25 bp, Homo sapien
tgccaataggagagtggaattcctg

SEQ ID NO: 105937 - DNA, 25 bp, Homo sapien
tgccaataggtaagttcttactcaa

SEQ ID NO: 105938 - DNA, 25 bp, Homo sapien
tgccaatagttaagttcttactcaa

SEQ ID NO: 105939 - DNA, 25 bp, Homo sapien
tgccaatcaagaagaaaggaggagg

SEQ ID NO: 105940 - DNA, 25 bp, Homo sapien
tgccaatcaagaggaaaggaggagg

SEQ ID NO: 105941 - DNA, 25 bp, Homo sapien
tgccaatcatcagtagcacgcaccc

SEQ ID NO: 105942 - DNA, 25 bp, Homo sapien
tgccaatcatcggtagcacgcaccc

SEQ ID NO: 105943 - DNA, 25 bp, Homo sapien
tgccaatcatggaatgctcagggat

SEQ ID NO: 105944 - DNA, 25 bp, Homo sapien
tgccaatcatggaatggtcagggat

SEQ ID NO: 105945 - DNA, 25 bp, Homo sapien
tgccaatccagaaaacttgctaaaa

SEQ ID NO: 105946 - DNA, 25 bp, Homo sapien
tgccaatccagaaagcttgctaaaa

SEQ ID NO: 105947 - DNA, 25 bp, Homo sapien
tgccaatccatcatgtcaggcataa

SEQ ID NO: 105948 - DNA, 25 bp, Homo sapien
tgccaatctatcatgtcaggcataa

SEQ ID NO: 105949 - DNA, 25 bp, Homo sapien
tgccaattctcaagtatttcaaatc

SEQ ID NO: 105950 - DNA, 25 bp, Homo sapien
tgccaattctcaattatttcaaatc

SEQ ID NO: 105951 - DNA, 25 bp, Homo sapien
tgccaattttatgtaagagctgaaa

SEQ ID NO: 105952 - DNA, 25 bp, Homo sapien
tgccaattttatgttagagctgaaa

SEQ ID NO: 105953 - DNA, 25 bp, Homo sapien
tgccacaacaagaatgattagtgat

SEQ ID NO: 105954 - DNA, 25 bp, Homo sapien
tgccacaacatgactggaatgctca

SEQ ID NO: 105955 - DNA, 25 bp, Homo sapien
tgccacaacatggctggaatgctca

SEQ ID NO: 105956 - DNA, 25 bp, Homo sapien
tgccacaagaatgttaagttccatg

SEQ ID NO: 105957 - DNA, 25 bp, Homo sapien
tgccacaagcatgttaagttccatg

SEQ ID NO: 105958 - DNA, 25 bp, Homo sapien
tgccacaataagaatgattagtgat

SEQ ID NO: 105959 - DNA, 25 bp, Homo sapien
tgccacaatctacatgacagggatg

SEQ ID NO: 105960 - DNA, 25 bp, Homo sapien
tgccacaatctacgtgacagggatg

SEQ ID NO: 105961 - DNA, 25 bp, Homo sapien
tgccacaatgaatgagattgaggtt

SEQ ID NO: 105962 - DNA, 25 bp, Homo sapien
tgccacaatgaatgcgattgaggtt

SEQ ID NO: 105963 - DNA, 25 bp, Homo sapien
tgccacagaccgaatcagtggaagg

SEQ ID NO: 105964 - DNA, 25 bp, Homo sapien
tgccacagagcgaatcagtggaagg

SEQ ID NO: 105965 - DNA, 25 bp, Homo sapien
tgccacaggtctcaggataacagat

SEQ ID NO: 105966 - DNA, 25 bp, Homo sapien
tgccacaggtctcagggtaacagat

SEQ ID NO: 105967 - DNA, 25 bp, Homo sapien
tgccacatactaggagcttgctcta

SEQ ID NO: 105968 - DNA, 25 bp, Homo sapien
tgccacatactgggagcttgctcta

SEQ ID NO: 105969 - DNA, 25 bp, Homo sapien
tgccacattggatttaaaattgttt

SEQ ID NO: 105970 - DNA, 25 bp, Homo sapien
tgccacattggttttaaaattgttt

SEQ ID NO: 105971 - DNA, 25 bp, Homo sapien
tgccacctctctagttctctctctt

SEQ ID NO: 105972 - DNA, 25 bp, Homo sapien
tgccacctctcttgttctctctctt

SEQ ID NO: 105973 - DNA, 25 bp, Homo sapien
tgccacggtttacgttttcacacca

SEQ ID NO: 105974 - DNA, 25 bp, Homo sapien
tgccacggtttatgttttcacacca

SEQ ID NO: 105975 - DNA, 25 bp, Homo sapien
tgccactaatcattagggaaatgca

SEQ ID NO: 105976 - DNA, 25 bp, Homo sapien
tgccactaatcgttagggaaatgca

SEQ ID NO: 105977 - DNA, 25 bp, Homo sapien
tgccactaattcgagttttcattta

SEQ ID NO: 105978 - DNA, 25 bp, Homo sapien
tgccactaatttgagttttcattta

SEQ ID NO: 105979 - DNA, 25 bp, Homo sapien
tgccactatttatttttctgatagc

SEQ ID NO: 105980 - DNA, 25 bp, Homo sapien
tgccactatttctttttctgatagc

SEQ ID NO: 105981 - DNA, 25 bp, Homo sapien
tgccactgataaaccctatggtctt

SEQ ID NO: 105982 - DNA, 25 bp, Homo sapien
tgccactgataaatcctatggtctt

SEQ ID NO: 105983 - DNA, 25 bp, Homo sapien
tgccactttcatggactagtgcatt

SEQ ID NO: 105984 - DNA, 25 bp, Homo sapien
tgccactttctatgcgtatatggtc

SEQ ID NO: 105985 - DNA, 25 bp, Homo sapien
tgccactttctatgtgtatatggtc

SEQ ID NO: 105986 - DNA, 25 bp, Homo sapien
tgccacttttatggactagtgcatt

SEQ ID NO: 105987 - DNA, 25 bp, Homo sapien
tgccagaagggcttctccaggaatg

SEQ ID NO: 105988 - DNA, 25 bp, Homo sapien
tgccagaagggtttctccaggaatg

SEQ ID NO: 105989 - DNA, 25 bp, Homo sapien
tgccagacaaagagaagattcattt

SEQ ID NO: 105990 - DNA, 25 bp, Homo sapien
tgccagacaggactgaatggcaaag

SEQ ID NO: 105991 - DNA, 25 bp, Homo sapien
tgccagacaggacttaatggcaaag

SEQ ID NO: 105992 - DNA, 25 bp, Homo sapien
tgccagacatagagaagattcattt

SEQ ID NO: 105993 - DNA, 25 bp, Homo sapien
tgccagataaaagacatgaattatt

SEQ ID NO: 105994 - DNA, 25 bp, Homo sapien
tgccagataaaaggcatgaattatt

SEQ ID NO: 105995 - DNA, 25 bp, Homo sapien
tgccagatcactcacactgtttgca

SEQ ID NO: 105996 - DNA, 25 bp, Homo sapien
tgccagatcactcatactgtttgca

SEQ ID NO: 105997 - DNA, 25 bp, Homo sapien
tgccagatgatactcccaaaactta

SEQ ID NO: 105998 - DNA, 25 bp, Homo sapien
tgccagatgatactcctaaaactta

SEQ ID NO: 105999 - DNA, 25 bp, Homo sapien
tgccagatgggtcatctcatacagg

SEQ ID NO: 106000 - DNA, 25 bp, Homo sapien
tgccagatgtgtcatctcatacagg

SEQ ID NO: 106001 - DNA, 25 bp, Homo sapien
tgccagcgctactcggtgaccaaac

SEQ ID NO: 106002 - DNA, 25 bp, Homo sapien
tgccagcgctacttggtgaccaaac

SEQ ID NO: 106003 - DNA, 25 bp, Homo sapien
tgccaggacatggagaaacaataat

SEQ ID NO: 106004 - DNA, 25 bp, Homo sapien
tgccaggacctggagaaacaataat

SEQ ID NO: 106005 - DNA, 25 bp, Homo sapien
tgccaggctcttttcaacaactagt

SEQ ID NO: 106006 - DNA, 25 bp, Homo sapien
tgccaggctcttttcagcaactagt

SEQ ID NO: 106007 - DNA, 25 bp, Homo sapien
tgccaggtgcttcaccaagtgagta

SEQ ID NO: 106008 - DNA, 25 bp, Homo sapien
tgccaggtgcttcgccaagtgagta

SEQ ID NO: 106009 - DNA, 25 bp, Homo sapien
tgccaggttcatattcaaaataagt

SEQ ID NO: 106010 - DNA, 25 bp, Homo sapien
tgccaggttgatattcaaaataagt

SEQ ID NO: 106011 - DNA, 25 bp, Homo sapien
tgccagtatgttacgggcttcatca

SEQ ID NO: 106012 - DNA, 25 bp, Homo sapien
tgccagtatgttatgggcttcatca

SEQ ID NO: 106013 - DNA, 25 bp, Homo sapien
tgccagtcagccgagcccgtgaacc

SEQ ID NO: 106014 - DNA, 25 bp, Homo sapien
tgccagtcagctgagcccgtgaacc

SEQ ID NO: 106015 - DNA, 25 bp, Homo sapien
tgccagtccctcaggaggaactcaa

SEQ ID NO: 106016 - DNA, 25 bp, Homo sapien
tgccagtccctctggaggaactcaa

SEQ ID NO: 106017 - DNA, 25 bp, Homo sapien
tgccagtctgggtcggcccaaagca

SEQ ID NO: 106018 - DNA, 25 bp, Homo sapien
tgccagtctgggtctgcccaaagca

SEQ ID NO: 106019 - DNA, 25 bp, Homo sapien
tgccagtttgcccaccactttgcca

SEQ ID NO: 106020 - DNA, 25 bp, Homo sapien
tgccagtttgcccagcactttgcca

SEQ ID NO: 106021 - DNA, 25 bp, Homo sapien
tgccataatataaggaaaaatgatg

SEQ ID NO: 106022 - DNA, 25 bp, Homo sapien
tgccataatctaaggaaaaatgatg

SEQ ID NO: 106023 - DNA, 25 bp, Homo sapien
tgccatacaatttcaacggcagctt

SEQ ID NO: 106024 - DNA, 25 bp, Homo sapien
tgccatacaatttcaagggcagctt

SEQ ID NO: 106025 - DNA, 25 bp, Homo sapien
tgccatagatagacaatttgcctta

SEQ ID NO: 106026 - DNA, 25 bp, Homo sapien
tgccatagatagtaatgcctgtgat

SEQ ID NO: 106027 - DNA, 25 bp, Homo sapien
tgccatagatagtcaatttgcctta

SEQ ID NO: 106028 - DNA, 25 bp, Homo sapien
tgccatagatagtgatgcctgtgat

SEQ ID NO: 106029 - DNA, 25 bp, Homo sapien
tgccatcaggagataataaaaagtt

SEQ ID NO: 106030 - DNA, 25 bp, Homo sapien
tgccatcaggagttaataaaaagtt

SEQ ID NO: 106031 - DNA, 25 bp, Homo sapien
tgccatcccattctcttctgaccta

SEQ ID NO: 106032 - DNA, 25 bp, Homo sapien
tgccatcccattgtcttctgaccta

SEQ ID NO: 106033 - DNA, 25 bp, Homo sapien
tgccatctgaaaaactaaaacactt

SEQ ID NO: 106034 - DNA, 25 bp, Homo sapien
tgccatcttaaaaactaaaacactt

SEQ ID NO: 106035 - DNA, 25 bp, Homo sapien
tgccatgaaaaattctgagaagccc

SEQ ID NO: 106036 - DNA, 25 bp, Homo sapien
tgccatgaaaagttctgagaagccc

SEQ ID NO: 106037 - DNA, 25 bp, Homo sapien
tgccatgagaaagcctgtcaatcct

SEQ ID NO: 106038 - DNA, 25 bp, Homo sapien
tgccatgagaaagcttgtcaatcct

SEQ ID NO: 106039 - DNA, 25 bp, Homo sapien
tgccatgagtacattttcaggctcg

SEQ ID NO: 106040 - DNA, 25 bp, Homo sapien
tgccatgagtacgttttcaggctcg

SEQ ID NO: 106041 - DNA, 25 bp, Homo sapien
tgccatgtactcactgagattttgg

SEQ ID NO: 106042 - DNA, 25 bp, Homo sapien
tgccatgtactcactgtgattttgg

SEQ ID NO: 106043 - DNA, 25 bp, Homo sapien
tgccatgtcggacttcagaactatg

SEQ ID NO: 106044 - DNA, 25 bp, Homo sapien
tgccatgttggacttcagaactatg

SEQ ID NO: 106045 - DNA, 25 bp, Homo sapien
tgccattaaattgcacaaaatatca

SEQ ID NO: 106046 - DNA, 25 bp, Homo sapien
tgccattaaattgcacgaaatatca

SEQ ID NO: 106047 - DNA, 25 bp, Homo sapien
tgccattagataactttagatgctt

SEQ ID NO: 106048 - DNA, 25 bp, Homo sapien
tgccattatataactttagatgctt

SEQ ID NO: 106049 - DNA, 25 bp, Homo sapien
tgccattcaagaataaaaatgatta

SEQ ID NO: 106050 - DNA, 25 bp, Homo sapien
tgccattcaaggataaaaatgatta

SEQ ID NO: 106051 - DNA, 25 bp, Homo sapien
tgccattcagactgttgttttattt

SEQ ID NO: 106052 - DNA, 25 bp, Homo sapien
tgccattccacgtgattgctaaacc

SEQ ID NO: 106053 - DNA, 25 bp, Homo sapien
tgccattccacgtggttgctaaacc

SEQ ID NO: 106054 - DNA, 25 bp, Homo sapien
tgccattcggactgttgttttattt

SEQ ID NO: 106055 - DNA, 25 bp, Homo sapien
tgccattgactatgttggttaataa

SEQ ID NO: 106056 - DNA, 25 bp, Homo sapien
tgccattgcaaaatttactactgag

SEQ ID NO: 106057 - DNA, 25 bp, Homo sapien
tgccattgcaaagtttactactgag

SEQ ID NO: 106058 - DNA, 25 bp, Homo sapien
tgccattgcataataaggggtatca

SEQ ID NO: 106059 - DNA, 25 bp, Homo sapien
tgccattgcatagtaaggggtatca

SEQ ID NO: 106060 - DNA, 25 bp, Homo sapien
tgccattggcagataaaaaattagg

SEQ ID NO: 106061 - DNA, 25 bp, Homo sapien
tgccattggtagataaaaaattagg

SEQ ID NO: 106062 - DNA, 25 bp, Homo sapien
tgccattggtttgtacaagtgaaag

SEQ ID NO: 106063 - DNA, 25 bp, Homo sapien
tgccattgtaaagaagtagaattta

SEQ ID NO: 106064 - DNA, 25 bp, Homo sapien
tgccattgtaaagaggtagaattta

SEQ ID NO: 106065 - DNA, 25 bp, Homo sapien
tgccattgtctatgttggttaataa

SEQ ID NO: 106066 - DNA, 25 bp, Homo sapien
tgccattgttttacttgttgttatt

SEQ ID NO: 106067 - DNA, 25 bp, Homo sapien
tgccattgttttgcttgttgttatt

SEQ ID NO: 106068 - DNA, 25 bp, Homo sapien
tgccattgttttgtacaagtgaaag

SEQ ID NO: 106069 - DNA, 25 bp, Homo sapien
tgccatttccaagtctgggttaatc

SEQ ID NO: 106070 - DNA, 25 bp, Homo sapien
tgccatttccaagtttgggttaatc

SEQ ID NO: 106071 - DNA, 25 bp, Homo sapien
tgccatttgcttccccgtatatgtg

SEQ ID NO: 106072 - DNA, 25 bp, Homo sapien
tgccatttgtcctccaaacttctca

SEQ ID NO: 106073 - DNA, 25 bp, Homo sapien
tgccatttgtcttccaaacttctca

SEQ ID NO: 106074 - DNA, 25 bp, Homo sapien
tgccatttgtttccccgtatatgtg

SEQ ID NO: 106075 - DNA, 25 bp, Homo sapien
tgccattttcagacatttagagcta

SEQ ID NO: 106076 - DNA, 25 bp, Homo sapien
tgccattttcagacgtttagagcta

SEQ ID NO: 106077 - DNA, 25 bp, Homo sapien
tgcccaaaatgcagtcagtaggaga

SEQ ID NO: 106078 - DNA, 25 bp, Homo sapien
tgcccaaaatggagtcagtaggaga

SEQ ID NO: 106079 - DNA, 25 bp, Homo sapien
tgcccaaatcacagtatgcgatagt

SEQ ID NO: 106080 - DNA, 25 bp, Homo sapien
tgcccaaatcacggtatgcgatagt

SEQ ID NO: 106081 - DNA, 25 bp, Homo sapien
tgcccaagtgctcactagtccagag

SEQ ID NO: 106082 - DNA, 25 bp, Homo sapien
tgcccaagtgctcgctagtccagag

SEQ ID NO: 106083 - DNA, 25 bp, Homo sapien
tgcccaagttgctgtaggtatccat

SEQ ID NO: 106084 - DNA, 25 bp, Homo sapien
tgcccaagttgttgtaggtatccat

SEQ ID NO: 106085 - DNA, 25 bp, Homo sapien
tgcccactcttctgcccagaggcca

SEQ ID NO: 106086 - DNA, 25 bp, Homo sapien
tgcccacttttctgcccagaggcca

SEQ ID NO: 106087 - DNA, 25 bp, Homo sapien
tgcccagagattggatttaggtgat

SEQ ID NO: 106088 - DNA, 25 bp, Homo sapien
tgcccagagatttgatttaggtgat

SEQ ID NO: 106089 - DNA, 25 bp, Homo sapien
tgcccagagtttaccttggctttgt

SEQ ID NO: 106090 - DNA, 25 bp, Homo sapien
tgcccagagtttatcttggctttgt

SEQ ID NO: 106091 - DNA, 25 bp, Homo sapien
tgcccagatgctgaaagaacattta

SEQ ID NO: 106092 - DNA, 25 bp, Homo sapien
tgcccagatgctggaagaacattta

SEQ ID NO: 106093 - DNA, 25 bp, Homo sapien
tgcccaggtttaaagtttctcaggc

SEQ ID NO: 106094 - DNA, 25 bp, Homo sapien
tgcccaggtttagagtttctcaggc

SEQ ID NO: 106095 - DNA, 25 bp, Homo sapien
tgcccagtattgcttggttggagca

SEQ ID NO: 106096 - DNA, 25 bp, Homo sapien
tgcccagtattgtttggttggagca

SEQ ID NO: 106097 - DNA, 25 bp, Homo sapien
tgcccatacataaatctttgccgag

SEQ ID NO: 106098 - DNA, 25 bp, Homo sapien
tgcccatacataagtctttgccgag

SEQ ID NO: 106099 - DNA, 25 bp, Homo sapien
tgcccatcaaactaccaattacatt

SEQ ID NO: 106100 - DNA, 25 bp, Homo sapien
tgcccatcgaactaccaattacatt

SEQ ID NO: 106101 - DNA, 25 bp, Homo sapien
tgcccatcgcgtatatcaactcatc

SEQ ID NO: 106102 - DNA, 25 bp, Homo sapien
tgcccatcgcgtctatcaactcatc

SEQ ID NO: 106103 - DNA, 25 bp, Homo sapien
tgcccattaaactgtagtgggctct

SEQ ID NO: 106104 - DNA, 25 bp, Homo sapien
tgcccattatgaacaaggcactggc

SEQ ID NO: 106105 - DNA, 25 bp, Homo sapien
tgcccattatgagcaaggcactggc

SEQ ID NO: 106106 - DNA, 25 bp, Homo sapien
tgcccattcctggttcatgagagtc

SEQ ID NO: 106107 - DNA, 25 bp, Homo sapien
tgcccattcttggttcatgagagtc

SEQ ID NO: 106108 - DNA, 25 bp, Homo sapien
tgcccattgaactgtagtgggctct

SEQ ID NO: 106109 - DNA, 25 bp, Homo sapien
tgccccactgaatcttgtgtacctg

SEQ ID NO: 106110 - DNA, 25 bp, Homo sapien
tgccccactgaattttgtgtacctg

SEQ ID NO: 106111 - DNA, 25 bp, Homo sapien
tgccccagtgctcgtctggtctaag

SEQ ID NO: 106112 - DNA, 25 bp, Homo sapien
tgccccagtgcttgtctggtctaag

SEQ ID NO: 106113 - DNA, 25 bp, Homo sapien
tgccccctactagcgttactgtgtc

SEQ ID NO: 106114 - DNA, 25 bp, Homo sapien
tgccccctactagtgttactgtgtc

SEQ ID NO: 106115 - DNA, 25 bp, Homo sapien
tgcccctattcaaccttaagaagct

SEQ ID NO: 106116 - DNA, 25 bp, Homo sapien
tgcccctattcagccttaagaagct

SEQ ID NO: 106117 - DNA, 25 bp, Homo sapien
tgcccctcatcttcgcagaacaggt

SEQ ID NO: 106118 - DNA, 25 bp, Homo sapien
tgcccctccataaattgccttagga

SEQ ID NO: 106119 - DNA, 25 bp, Homo sapien
tgcccctcgtcttcgcagaacaggt

SEQ ID NO: 106120 - DNA, 25 bp, Homo sapien
tgcccctctataaattgccttagga

SEQ ID NO: 106121 - DNA, 25 bp, Homo sapien
tgcccctgtctgacatcggtgtctg

SEQ ID NO: 106122 - DNA, 25 bp, Homo sapien
tgcccctgtctggcatcggtgtctg

SEQ ID NO: 106123 - DNA, 25 bp, Homo sapien
tgccctagagtaggtatcatcagaa

SEQ ID NO: 106124 - DNA, 25 bp, Homo sapien
tgccctagcgtaggtatcatcagaa

SEQ ID NO: 106125 - DNA, 25 bp, Homo sapien
tgccctcaacttgaggcagtcagca

SEQ ID NO: 106126 - DNA, 25 bp, Homo sapien
tgccctcaatttgaggcagtcagca

SEQ ID NO: 106127 - DNA, 25 bp, Homo sapien
tgccctctatacaagcaactatgcc

SEQ ID NO: 106128 - DNA, 25 bp, Homo sapien
tgccctctatacatgcaactatgcc

SEQ ID NO: 106129 - DNA, 25 bp, Homo sapien
tgccctctggcctatagaacagcat

SEQ ID NO: 106130 - DNA, 25 bp, Homo sapien
tgccctctggcctgtagaacagcat

SEQ ID NO: 106131 - DNA, 25 bp, Homo sapien
tgccctgaatgtatcagcacatcta

SEQ ID NO: 106132 - DNA, 25 bp, Homo sapien
tgccctgaatgtttcagcacatcta

SEQ ID NO: 106133 - DNA, 25 bp, Homo sapien
tgccctggagtcactggtgtagggt

SEQ ID NO: 106134 - DNA, 25 bp, Homo sapien
tgccctggagtcattggtgtagggt

SEQ ID NO: 106135 - DNA, 25 bp, Homo sapien
tgccctggcatatttaacaacatca

SEQ ID NO: 106136 - DNA, 25 bp, Homo sapien
tgccctggcgtatttaacaacatca

SEQ ID NO: 106137 - DNA, 25 bp, Homo sapien
tgccctggcttagagtcccagctcc

SEQ ID NO: 106138 - DNA, 25 bp, Homo sapien
tgccctgggttagagtcccagctcc

SEQ ID NO: 106139 - DNA, 25 bp, Homo sapien
tgcccttcatacaaaaacgaaactg

SEQ ID NO: 106140 - DNA, 25 bp, Homo sapien
tgcccttcatacaaaaccgaaactg

SEQ ID NO: 106141 - DNA, 25 bp, Homo sapien
tgcccttccttagaatagaaggctg

SEQ ID NO: 106142 - DNA, 25 bp, Homo sapien
tgcccttccttagaatggaaggctg

SEQ ID NO: 106143 - DNA, 25 bp, Homo sapien
tgccctttttttttccttgtgtgtg

SEQ ID NO: 106144 - DNA, 25 bp, Homo sapien
tgcccttttttttttcttgtgtgtg

SEQ ID NO: 106145 - DNA, 25 bp, Homo sapien
tgccgacagacaattttaaatagct

SEQ ID NO: 106146 - DNA, 25 bp, Homo sapien
tgccgacagaccattttaaatagct

SEQ ID NO: 106147 - DNA, 25 bp, Homo sapien
tgccgaggtggtcattatcctgatt

SEQ ID NO: 106148 - DNA, 25 bp, Homo sapien
tgccgaggtggtctttatcctgatt

SEQ ID NO: 106149 - DNA, 25 bp, Homo sapien
tgccgctattgctattcattctgga

SEQ ID NO: 106150 - DNA, 25 bp, Homo sapien
tgccgctattgctgttcattctgga

SEQ ID NO: 106151 - DNA, 25 bp, Homo sapien
tgccggaatacatcaattcatcttc

SEQ ID NO: 106152 - DNA, 25 bp, Homo sapien
tgccggaatacatctattcatcttc

SEQ ID NO: 106153 - DNA, 25 bp, Homo sapien
tgccgtcaattacgaagtttcaata

SEQ ID NO: 106154 - DNA, 25 bp, Homo sapien
tgccgtcagttacgaagtttcaata

SEQ ID NO: 106155 - DNA, 25 bp, Homo sapien
tgccgttcccatcgacagcagccat

SEQ ID NO: 106156 - DNA, 25 bp, Homo sapien
tgccgttcctatcgacagcagccat

SEQ ID NO: 106157 - DNA, 25 bp, Homo sapien
tgcctaaaagtgcacgatttccatc

SEQ ID NO: 106158 - DNA, 25 bp, Homo sapien
tgcctaaaagtgcatgatttccatc

SEQ ID NO: 106159 - DNA, 25 bp, Homo sapien
tgcctaaaattgagaccgagaggaa

SEQ ID NO: 106160 - DNA, 25 bp, Homo sapien
tgcctaaaattgagactgagaggaa

SEQ ID NO: 106161 - DNA, 25 bp, Homo sapien
tgcctaaaccacttatctgggaatc

SEQ ID NO: 106162 - DNA, 25 bp, Homo sapien
tgcctaaatcacttatctgggaatc

SEQ ID NO: 106163 - DNA, 25 bp, Homo sapien
tgcctaaattattctgcatcttgca

SEQ ID NO: 106164 - DNA, 25 bp, Homo sapien
tgcctaaattattctgtatcttgca

SEQ ID NO: 106165 - DNA, 25 bp, Homo sapien
tgcctaaccgggtgccttcagtgtt

SEQ ID NO: 106166 - DNA, 25 bp, Homo sapien
tgcctaactgggtgccttcagtgtt

SEQ ID NO: 106167 - DNA, 25 bp, Homo sapien
tgcctaagccactatgaaatagttg

SEQ ID NO: 106168 - DNA, 25 bp, Homo sapien
tgcctaagcgactatgaaatagttg

SEQ ID NO: 106169 - DNA, 25 bp, Homo sapien
tgcctaatcgatcgaaagagggcat

SEQ ID NO: 106170 - DNA, 25 bp, Homo sapien
tgcctaatcgatggaaagagggcat

SEQ ID NO: 106171 - DNA, 25 bp, Homo sapien
tgcctacacaactgtatgggtcagc

SEQ ID NO: 106172 - DNA, 25 bp, Homo sapien
tgcctacagaactgtatgggtcagc

SEQ ID NO: 106173 - DNA, 25 bp, Homo sapien
tgcctacatactcgatatgttagat

SEQ ID NO: 106174 - DNA, 25 bp, Homo sapien
tgcctacatactctatatgttagat

SEQ ID NO: 106175 - DNA, 25 bp, Homo sapien
tgcctacatatttggcatgtctgct

SEQ ID NO: 106176 - DNA, 25 bp, Homo sapien
tgcctacatgataccatctcctctc

SEQ ID NO: 106177 - DNA, 25 bp, Homo sapien
tgcctacatgatactatctcctctc

SEQ ID NO: 106178 - DNA, 25 bp, Homo sapien
tgcctacatgtttggcatgtctgct

SEQ ID NO: 106179 - DNA, 25 bp, Homo sapien
tgcctacccgattctgatagtttca

SEQ ID NO: 106180 - DNA, 25 bp, Homo sapien
tgcctacctgattctgatagtttca

SEQ ID NO: 106181 - DNA, 25 bp, Homo sapien
tgcctactgctcaaactcagcgata

SEQ ID NO: 106182 - DNA, 25 bp, Homo sapien
tgcctactgttcaaactcagcgata

SEQ ID NO: 106183 - DNA, 25 bp, Homo sapien
tgcctacttgacccacattttcatg

SEQ ID NO: 106184 - DNA, 25 bp, Homo sapien
tgcctacttgatccacattttcatg

SEQ ID NO: 106185 - DNA, 25 bp, Homo sapien
tgcctagaagctcctccaaatgaag

SEQ ID NO: 106186 - DNA, 25 bp, Homo sapien
tgcctagaagctcttccaaatgaag

SEQ ID NO: 106187 - DNA, 25 bp, Homo sapien
tgcctagcaataagagataaacttc

SEQ ID NO: 106188 - DNA, 25 bp, Homo sapien
tgcctagcaataggagataaacttc

SEQ ID NO: 106189 - DNA, 25 bp, Homo sapien
tgcctagctaacacaggaaattacc

SEQ ID NO: 106190 - DNA, 25 bp, Homo sapien
tgcctagctgacacaggaaattacc

SEQ ID NO: 106191 - DNA, 25 bp, Homo sapien
tgcctaggaacactagcacctaact

SEQ ID NO: 106192 - DNA, 25 bp, Homo sapien
tgcctagggacactagcacctaact

SEQ ID NO: 106193 - DNA, 25 bp, Homo sapien
tgcctagtcctgcaaagttctgttc

SEQ ID NO: 106194 - DNA, 25 bp, Homo sapien
tgcctagtcctgcgaagttctgttc

SEQ ID NO: 106195 - DNA, 25 bp, Homo sapien
tgcctatcacgaggccctggtattt

SEQ ID NO: 106196 - DNA, 25 bp, Homo sapien
tgcctatcatgaggccctggtattt

SEQ ID NO: 106197 - DNA, 25 bp, Homo sapien
tgcctatctgtctaaaagcattagg

SEQ ID NO: 106198 - DNA, 25 bp, Homo sapien
tgcctatctgtctgaaagcattagg

SEQ ID NO: 106199 - DNA, 25 bp, Homo sapien
tgcctattgaaagcaaagatagcaa

SEQ ID NO: 106200 - DNA, 25 bp, Homo sapien
tgcctattggaagcaaagatagcaa

SEQ ID NO: 106201 - DNA, 25 bp, Homo sapien
tgcctattgtattaccgagagagta

SEQ ID NO: 106202 - DNA, 25 bp, Homo sapien
tgcctattttattaccgagagagta

SEQ ID NO: 106203 - DNA, 25 bp, Homo sapien
tgcctcaaactctgaatatgcaata

SEQ ID NO: 106204 - DNA, 25 bp, Homo sapien
tgcctcaaactctgtatatgcaata

SEQ ID NO: 106205 - DNA, 25 bp, Homo sapien
tgcctcaacagcccttgtttattcc

SEQ ID NO: 106206 - DNA, 25 bp, Homo sapien
tgcctcaacagtccttgtttattcc

SEQ ID NO: 106207 - DNA, 25 bp, Homo sapien
tgcctcaagcatgctgaacttggaa

SEQ ID NO: 106208 - DNA, 25 bp, Homo sapien
tgcctcaagcattctgaacttggaa

SEQ ID NO: 106209 - DNA, 25 bp, Homo sapien
tgcctcaaggaagatgtaagtaatt

SEQ ID NO: 106210 - DNA, 25 bp, Homo sapien
tgcctcaaggaggatgtaagtaatt

SEQ ID NO: 106211 - DNA, 25 bp, Homo sapien
tgcctcaagtacccaaaacagaccc

SEQ ID NO: 106212 - DNA, 25 bp, Homo sapien
tgcctcaagtacctaaaacagaccc

SEQ ID NO: 106213 - DNA, 25 bp, Homo sapien
tgcctcaattaaagtaatagcatct

SEQ ID NO: 106214 - DNA, 25 bp, Homo sapien
tgcctcaattacagtaatagcatct

SEQ ID NO: 106215 - DNA, 25 bp, Homo sapien
tgcctcactcaacttatttgtacct

SEQ ID NO: 106216 - DNA, 25 bp, Homo sapien
tgcctcactcatcttatttgtacct

SEQ ID NO: 106217 - DNA, 25 bp, Homo sapien
tgcctcactttactcctctgtaaag

SEQ ID NO: 106218 - DNA, 25 bp, Homo sapien
tgcctcactttattcctctgtaaag

SEQ ID NO: 106219 - DNA, 25 bp, Homo sapien
tgcctcagaatcgcttggagagctc

SEQ ID NO: 106220 - DNA, 25 bp, Homo sapien
tgcctcagaatctcttggagagctc

SEQ ID NO: 106221 - DNA, 25 bp, Homo sapien
tgcctcagctgcaataaaaaagtta

SEQ ID NO: 106222 - DNA, 25 bp, Homo sapien
tgcctcagctgcgataaaaaagtta

SEQ ID NO: 106223 - DNA, 25 bp, Homo sapien
tgcctcattcccttcaagctctctc

SEQ ID NO: 106224 - DNA, 25 bp, Homo sapien
tgcctcattccgttcaagctctctc

SEQ ID NO: 106225 - DNA, 25 bp, Homo sapien
tgcctccacggactatgaaggtgaa

SEQ ID NO: 106226 - DNA, 25 bp, Homo sapien
tgcctccagggactatgaaggtgaa

SEQ ID NO: 106227 - DNA, 25 bp, Homo sapien
tgcctctacgctctcttctttgagt

SEQ ID NO: 106228 - DNA, 25 bp, Homo sapien
tgcctctatgctctcttctttgagt

SEQ ID NO: 106229 - DNA, 25 bp, Homo sapien
tgcctctatttcttgtttattttct

SEQ ID NO: 106230 - DNA, 25 bp, Homo sapien
tgcctctattttttgtttattttct

SEQ ID NO: 106231 - DNA, 25 bp, Homo sapien
tgcctctcacttgttgttaccacaa

SEQ ID NO: 106232 - DNA, 25 bp, Homo sapien
tgcctctcgcttgttgttaccacaa

SEQ ID NO: 106233 - DNA, 25 bp, Homo sapien
tgcctctgactgaacctgtgcatag

SEQ ID NO: 106234 - DNA, 25 bp, Homo sapien
tgcctctgactgcacctgtgcatag

SEQ ID NO: 106235 - DNA, 25 bp, Homo sapien
tgcctctgatgcattaccatataga

SEQ ID NO: 106236 - DNA, 25 bp, Homo sapien
tgcctctgatgccttaccatataga

SEQ ID NO: 106237 - DNA, 25 bp, Homo sapien
tgcctctgatttaaaatcctgcttc

SEQ ID NO: 106238 - DNA, 25 bp, Homo sapien
tgcctctgatttagaatcctgcttc

SEQ ID NO: 106239 - DNA, 25 bp, Homo sapien
tgcctctgccgtctcttgctgtaac

SEQ ID NO: 106240 - DNA, 25 bp, Homo sapien
tgcctctgctgtctcttgctgtaac

SEQ ID NO: 106241 - DNA, 25 bp, Homo sapien
tgcctcttaatgcagtccagagagg

SEQ ID NO: 106242 - DNA, 25 bp, Homo sapien
tgcctcttgatgcagtccagagagg

SEQ ID NO: 106243 - DNA, 25 bp, Homo sapien
tgcctgaacaaaatggaattctgca

SEQ ID NO: 106244 - DNA, 25 bp, Homo sapien
tgcctgaacgagccatgtaaattaa

SEQ ID NO: 106245 - DNA, 25 bp, Homo sapien
tgcctgaacgagtcatgtaaattaa

SEQ ID NO: 106246 - DNA, 25 bp, Homo sapien
tgcctgaataaaatggaattctgca

SEQ ID NO: 106247 - DNA, 25 bp, Homo sapien
tgcctgacaaaggactcatctttca

SEQ ID NO: 106248 - DNA, 25 bp, Homo sapien
tgcctgaccaaggactcatctttca

SEQ ID NO: 106249 - DNA, 25 bp, Homo sapien
tgcctgactaaaacgtgaaaaacac

SEQ ID NO: 106250 - DNA, 25 bp, Homo sapien
tgcctgactatagtaaccatttcac

SEQ ID NO: 106251 - DNA, 25 bp, Homo sapien
tgcctgactatattaaccatttcac

SEQ ID NO: 106252 - DNA, 25 bp, Homo sapien
tgcctgacttaaacgtgaaaaacac

SEQ ID NO: 106253 - DNA, 25 bp, Homo sapien
tgcctgagatcacgcaattatcaat

SEQ ID NO: 106254 - DNA, 25 bp, Homo sapien
tgcctgagatcatgcaattatcaat

SEQ ID NO: 106255 - DNA, 25 bp, Homo sapien
tgcctgagattgagaagggaacaag

SEQ ID NO: 106256 - DNA, 25 bp, Homo sapien
tgcctgaggagacaaaaagaaagga

SEQ ID NO: 106257 - DNA, 25 bp, Homo sapien
tgcctgaggagataaaaagaaagga

SEQ ID NO: 106258 - DNA, 25 bp, Homo sapien
tgcctgaggctcacatgacctctgc

SEQ ID NO: 106259 - DNA, 25 bp, Homo sapien
tgcctgaggctcacgtgacctctgc

SEQ ID NO: 106260 - DNA, 25 bp, Homo sapien
tgcctgagtttgagaagggaacaag

SEQ ID NO: 106261 - DNA, 25 bp, Homo sapien
tgcctgccctggcttagagtcccag

SEQ ID NO: 106262 - DNA, 25 bp, Homo sapien
tgcctgccctgggttagagtcccag

SEQ ID NO: 106263 - DNA, 25 bp, Homo sapien
tgcctgctgcactttctcagtatgg

SEQ ID NO: 106264 - DNA, 25 bp, Homo sapien
tgcctgctgcagtttctcagtatgg

SEQ ID NO: 106265 - DNA, 25 bp, Homo sapien
tgcctggattgtgcctctgactccc

SEQ ID NO: 106266 - DNA, 25 bp, Homo sapien
tgcctggattgtgcttctgactccc

SEQ ID NO: 106267 - DNA, 25 bp, Homo sapien
tgcctggtgaagctacagtggaaga

SEQ ID NO: 106268 - DNA, 25 bp, Homo sapien
tgcctggtgccgcacttgctgggtt

SEQ ID NO: 106269 - DNA, 25 bp, Homo sapien
tgcctggtgcctcacttgctgggtt

SEQ ID NO: 106270 - DNA, 25 bp, Homo sapien
tgcctggtgcgaccttagctcattt

SEQ ID NO: 106271 - DNA, 25 bp, Homo sapien
tgcctggtggagctacagtggaaga

SEQ ID NO: 106272 - DNA, 25 bp, Homo sapien
tgcctggtgtgaccttagctcattt

SEQ ID NO: 106273 - DNA, 25 bp, Homo sapien
tgcctggttctaacaccaacgtttt

SEQ ID NO: 106274 - DNA, 25 bp, Homo sapien
tgcctggttctatcaccaacgtttt

SEQ ID NO: 106275 - DNA, 25 bp, Homo sapien
tgcctgtaaattcacggctatggta

SEQ ID NO: 106276 - DNA, 25 bp, Homo sapien
tgcctgtaaattcatggctatggta

SEQ ID NO: 106277 - DNA, 25 bp, Homo sapien
tgcctgtaatcccaactgaggacag

SEQ ID NO: 106278 - DNA, 25 bp, Homo sapien
tgcctgtaatcccagctgaggacag

SEQ ID NO: 106279 - DNA, 25 bp, Homo sapien
tgcctgtaccaagctggtccaatca

SEQ ID NO: 106280 - DNA, 25 bp, Homo sapien
tgcctgtaccaagttggtccaatca

SEQ ID NO: 106281 - DNA, 25 bp, Homo sapien
tgcctgtcaatgttttttcagacat

SEQ ID NO: 106282 - DNA, 25 bp, Homo sapien
tgcctgtcattgaaccaggagtcaa

SEQ ID NO: 106283 - DNA, 25 bp, Homo sapien
tgcctgtcattgttttttcagacat

SEQ ID NO: 106284 - DNA, 25 bp, Homo sapien
tgcctgtcgtcttcatcatcgtcat

SEQ ID NO: 106285 - DNA, 25 bp, Homo sapien
tgcctgtcgtcttcgtcatcgtcat

SEQ ID NO: 106286 - DNA, 25 bp, Homo sapien
tgcctgtcgttgaaccaggagtcaa

SEQ ID NO: 106287 - DNA, 25 bp, Homo sapien
tgcctgttacccatttgcaaagttg

SEQ ID NO: 106288 - DNA, 25 bp, Homo sapien
tgcctgttcttgtacgaaccaaatg

SEQ ID NO: 106289 - DNA, 25 bp, Homo sapien
tgcctgttcttgtatgaaccaaatg

SEQ ID NO: 106290 - DNA, 25 bp, Homo sapien
tgcctgtttagcccggaagttggtt

SEQ ID NO: 106291 - DNA, 25 bp, Homo sapien
tgcctgtttagcctggaagttggtt

SEQ ID NO: 106292 - DNA, 25 bp, Homo sapien
tgcctgtttcccatttgcaaagttg

SEQ ID NO: 106293 - DNA, 25 bp, Homo sapien
tgccttagaagacttttaaagttct

SEQ ID NO: 106294 - DNA, 25 bp, Homo sapien
tgccttaggagacttttaaagttct

SEQ ID NO: 106295 - DNA, 25 bp, Homo sapien
tgccttagtctcttctgcccttata

SEQ ID NO: 106296 - DNA, 25 bp, Homo sapien
tgccttagtcttttctgcccttata

SEQ ID NO: 106297 - DNA, 25 bp, Homo sapien
tgccttatattccagcgagggcaag

SEQ ID NO: 106298 - DNA, 25 bp, Homo sapien
tgccttatggcaatgtagaagaaat

SEQ ID NO: 106299 - DNA, 25 bp, Homo sapien
tgccttatgttccagcgagggcaag

SEQ ID NO: 106300 - DNA, 25 bp, Homo sapien
tgccttattgcaatgtagaagaaat

SEQ ID NO: 106301 - DNA, 25 bp, Homo sapien
tgccttcagatgctccaatttggga

SEQ ID NO: 106302 - DNA, 25 bp, Homo sapien
tgccttcagatgctccgatttggga

SEQ ID NO: 106303 - DNA, 25 bp, Homo sapien
tgccttccaccacacagtctgtagc

SEQ ID NO: 106304 - DNA, 25 bp, Homo sapien
tgccttccaccatacagtctgtagc

SEQ ID NO: 106305 - DNA, 25 bp, Homo sapien
tgccttctaatttgcgccaaaatct

SEQ ID NO: 106306 - DNA, 25 bp, Homo sapien
tgccttctaatttgggccaaaatct

SEQ ID NO: 106307 - DNA, 25 bp, Homo sapien
tgccttcttagtatcgtaactgttt

SEQ ID NO: 106308 - DNA, 25 bp, Homo sapien
tgccttcttagtgtcgtaactgttt

SEQ ID NO: 106309 - DNA, 25 bp, Homo sapien
tgccttcttattggtaaggagtggc

SEQ ID NO: 106310 - DNA, 25 bp, Homo sapien
tgccttcttgttggtaaggagtggc

SEQ ID NO: 106311 - DNA, 25 bp, Homo sapien
tgccttgacgcctcattgagtttga

SEQ ID NO: 106312 - DNA, 25 bp, Homo sapien
tgccttgacgcctcgttgagtttga

SEQ ID NO: 106313 - DNA, 25 bp, Homo sapien
tgccttgagatatgaggctgtaccg

SEQ ID NO: 106314 - DNA, 25 bp, Homo sapien
tgccttgaggaacggtgcactgtgg

SEQ ID NO: 106315 - DNA, 25 bp, Homo sapien
tgccttgaggaatggtgcactgtgg

SEQ ID NO: 106316 - DNA, 25 bp, Homo sapien
tgccttgatatatgaggctgtaccg

SEQ ID NO: 106317 - DNA, 25 bp, Homo sapien
tgccttgatgacactcgttttgtat

SEQ ID NO: 106318 - DNA, 25 bp, Homo sapien
tgccttgatgatactcgttttgtat

SEQ ID NO: 106319 - DNA, 25 bp, Homo sapien
tgccttgcctttcaatctttcactg

SEQ ID NO: 106320 - DNA, 25 bp, Homo sapien
tgccttgctagtctcaccctgggct

SEQ ID NO: 106321 - DNA, 25 bp, Homo sapien
tgccttgctagtgtcaccctgggct

SEQ ID NO: 106322 - DNA, 25 bp, Homo sapien
tgccttgcttttcaatctttcactg

SEQ ID NO: 106323 - DNA, 25 bp, Homo sapien
tgccttggcagctgaaacatggctc

SEQ ID NO: 106324 - DNA, 25 bp, Homo sapien
tgccttggcggctgaaacatggctc

SEQ ID NO: 106325 - DNA, 25 bp, Homo sapien
tgccttggcgtgagactgatgggag

SEQ ID NO: 106326 - DNA, 25 bp, Homo sapien
tgccttgggtcattggtcccattcc

SEQ ID NO: 106327 - DNA, 25 bp, Homo sapien
tgccttgggtcgttggtcccattcc

SEQ ID NO: 106328 - DNA, 25 bp, Homo sapien
tgccttggtatcctcatctgtaatg

SEQ ID NO: 106329 - DNA, 25 bp, Homo sapien
tgccttggtatgctcatctgtaatg

SEQ ID NO: 106330 - DNA, 25 bp, Homo sapien
tgccttggtgtagaaaactttttac

SEQ ID NO: 106331 - DNA, 25 bp, Homo sapien
tgccttggtgtagataactttttac

SEQ ID NO: 106332 - DNA, 25 bp, Homo sapien
tgccttggtgtgagactgatgggag

SEQ ID NO: 106333 - DNA, 25 bp, Homo sapien
tgcctttcaccttcttagtttctct

SEQ ID NO: 106334 - DNA, 25 bp, Homo sapien
tgcctttcagattgcaaaacccgca

SEQ ID NO: 106335 - DNA, 25 bp, Homo sapien
tgcctttccattgctttctccttct

SEQ ID NO: 106336 - DNA, 25 bp, Homo sapien
tgcctttcgccttcttagtttctct

SEQ ID NO: 106337 - DNA, 25 bp, Homo sapien
tgcctttctattgctttctccttct

SEQ ID NO: 106338 - DNA, 25 bp, Homo sapien
tgcctttctgattgcaaaacccgca

SEQ ID NO: 106339 - DNA, 25 bp, Homo sapien
tgcctttctgtagccagtcatccca

SEQ ID NO: 106340 - DNA, 25 bp, Homo sapien
tgcctttctgtatccagtcatccca

SEQ ID NO: 106341 - DNA, 25 bp, Homo sapien
tgcctttgcccaccacatgataaat

SEQ ID NO: 106342 - DNA, 25 bp, Homo sapien
tgcctttgcccgccacatgataaat

SEQ ID NO: 106343 - DNA, 25 bp, Homo sapien
tgcctttgctaagcacctcggtaga

SEQ ID NO: 106344 - DNA, 25 bp, Homo sapien
tgcctttgctaagtacctcggtaga

SEQ ID NO: 106345 - DNA, 25 bp, Homo sapien
tgccttttcagctgcttctggctat

SEQ ID NO: 106346 - DNA, 25 bp, Homo sapien
tgccttttcagcttcttctggctat

SEQ ID NO: 106347 - DNA, 25 bp, Homo sapien
tgcgacctcagccgtggacatcatc

SEQ ID NO: 106348 - DNA, 25 bp, Homo sapien
tgcgacctcagccttggacatcatc

SEQ ID NO: 106349 - DNA, 25 bp, Homo sapien
tgcgagctccctacaaactccccgg

SEQ ID NO: 106350 - DNA, 25 bp, Homo sapien
tgcgagctccctacgaactccccgg

SEQ ID NO: 106351 - DNA, 25 bp, Homo sapien
tgcgatgaaatttctgatttgtaaa

SEQ ID NO: 106352 - DNA, 25 bp, Homo sapien
tgcgatgaaatttgtgatttgtaaa

SEQ ID NO: 106353 - DNA, 25 bp, Homo sapien
tgcgatgaggagatagggagagaac

SEQ ID NO: 106354 - DNA, 25 bp, Homo sapien
tgcgatgaggagctagggagagaac

SEQ ID NO: 106355 - DNA, 25 bp, Homo sapien
tgcgatggcggcaaacagcagtggt

SEQ ID NO: 106356 - DNA, 25 bp, Homo sapien
tgcgatggtggcaaacagcagtggt

SEQ ID NO: 106357 - DNA, 25 bp, Homo sapien
tgcgccatctgctcctgacattaag

SEQ ID NO: 106358 - DNA, 25 bp, Homo sapien
tgcgccatctgttcctgacattaag

SEQ ID NO: 106359 - DNA, 25 bp, Homo sapien
tgcgctttctaatgtctgagtgaaa

SEQ ID NO: 106360 - DNA, 25 bp, Homo sapien
tgcgctttctactgtctgagtgaaa

SEQ ID NO: 106361 - DNA, 25 bp, Homo sapien
tgcggaaaacgctgccaagacaaca

SEQ ID NO: 106362 - DNA, 25 bp, Homo sapien
tgcggaaaatgctgccaagacaaca

SEQ ID NO: 106363 - DNA, 25 bp, Homo sapien
tgcggaacgcgttataaatgaatat

SEQ ID NO: 106364 - DNA, 25 bp, Homo sapien
tgcggaacgtgttataaatgaatat

SEQ ID NO: 106365 - DNA, 25 bp, Homo sapien
tgcggccaagatgaattttgaggaa

SEQ ID NO: 106366 - DNA, 25 bp, Homo sapien
tgcggccaagatgcattttgaggaa

SEQ ID NO: 106367 - DNA, 25 bp, Homo sapien
tgcggctaccgtgggataagaaaca

SEQ ID NO: 106368 - DNA, 25 bp, Homo sapien
tgcggctactgtgggataagaaaca

SEQ ID NO: 106369 - DNA, 25 bp, Homo sapien
tgcggcttcctccttcctgatgcca

SEQ ID NO: 106370 - DNA, 25 bp, Homo sapien
tgcggcttgctccttcctgatgcca

SEQ ID NO: 106371 - DNA, 25 bp, Homo sapien
tgcgggacagttaagaaaatggaag

SEQ ID NO: 106372 - DNA, 25 bp, Homo sapien
tgcgggacagttgagaaaatggaag

SEQ ID NO: 106373 - DNA, 25 bp, Homo sapien
tgcgtaaaattagttttattttgag

SEQ ID NO: 106374 - DNA, 25 bp, Homo sapien
tgcgtaaaattatttttattttgag

SEQ ID NO: 106375 - DNA, 25 bp, Homo sapien
tgcgtaaatcactcatcaattccac

SEQ ID NO: 106376 - DNA, 25 bp, Homo sapien
tgcgtaaatcactcattaattccac

SEQ ID NO: 106377 - DNA, 25 bp, Homo sapien
tgcgtacaagccgctgtgccgccca

SEQ ID NO: 106378 - DNA, 25 bp, Homo sapien
tgcgtacaagcctctgtgccgccca

SEQ ID NO: 106379 - DNA, 25 bp, Homo sapien
tgcgtagtcaacactttagtaatgt

SEQ ID NO: 106380 - DNA, 25 bp, Homo sapien
tgcgtagtcaacattttagtaatgt

SEQ ID NO: 106381 - DNA, 25 bp, Homo sapien
tgcgtatgccttaacttttcagaaa

SEQ ID NO: 106382 - DNA, 25 bp, Homo sapien
tgcgtatgccttagcttttcagaaa

SEQ ID NO: 106383 - DNA, 25 bp, Homo sapien
tgcgtatttgcattgcatcttcttt

SEQ ID NO: 106384 - DNA, 25 bp, Homo sapien
tgcgtatttgcattgcgtcttcttt

SEQ ID NO: 106385 - DNA, 25 bp, Homo sapien
tgcgtccacctcttctcttgttatc

SEQ ID NO: 106386 - DNA, 25 bp, Homo sapien
tgcgtccaccttttctcttgttatc

SEQ ID NO: 106387 - DNA, 25 bp, Homo sapien
tgcgtgcacaccgggctctgcaaat

SEQ ID NO: 106388 - DNA, 25 bp, Homo sapien
tgcgtgcacactgggctctgcaaat

SEQ ID NO: 106389 - DNA, 25 bp, Homo sapien
tgcgtgctcggatcttaccacatac

SEQ ID NO: 106390 - DNA, 25 bp, Homo sapien
tgcgtgctcggattttaccacatac

SEQ ID NO: 106391 - DNA, 25 bp, Homo sapien
tgcgttagaactagagacaaacata

SEQ ID NO: 106392 - DNA, 25 bp, Homo sapien
tgcgttagaactggagacaaacata

SEQ ID NO: 106393 - DNA, 25 bp, Homo sapien
tgcgtttagggaaaccacatttacc

SEQ ID NO: 106394 - DNA, 25 bp, Homo sapien
tgcgtttagggaaatcacatttacc

SEQ ID NO: 106395 - DNA, 25 bp, Homo sapien
tgcgttttcatcccacaaattcgaa

SEQ ID NO: 106396 - DNA, 25 bp, Homo sapien
tgcgttttcatcctacaaattcgaa

SEQ ID NO: 106397 - DNA, 25 bp, Homo sapien
tgctaaaagcccagacattttaatg

SEQ ID NO: 106398 - DNA, 25 bp, Homo sapien
tgctaaaagcccggacattttaatg

SEQ ID NO: 106399 - DNA, 25 bp, Homo sapien
tgctaaaagctctggtctcaaagcc

SEQ ID NO: 106400 - DNA, 25 bp, Homo sapien
tgctaaaagctctgttctcaaagcc

SEQ ID NO: 106401 - DNA, 25 bp, Homo sapien
tgctaaaatagaagcgtaagggaga

SEQ ID NO: 106402 - DNA, 25 bp, Homo sapien
tgctaaaatagaagtgtaagggaga

SEQ ID NO: 106403 - DNA, 25 bp, Homo sapien
tgctaaacatctgcgacggtttgga

SEQ ID NO: 106404 - DNA, 25 bp, Homo sapien
tgctaaacatctgctacggtttgga

SEQ ID NO: 106405 - DNA, 25 bp, Homo sapien
tgctaaagaacattcttggcaagag

SEQ ID NO: 106406 - DNA, 25 bp, Homo sapien
tgctaaagaacgttcttggcaagag

SEQ ID NO: 106407 - DNA, 25 bp, Homo sapien
tgctaaagatttcccaattttactg

SEQ ID NO: 106408 - DNA, 25 bp, Homo sapien
tgctaaagatttctcaattttactg

SEQ ID NO: 106409 - DNA, 25 bp, Homo sapien
tgctaaaggttggggcatgcatcct

SEQ ID NO: 106410 - DNA, 25 bp, Homo sapien
tgctaaaggttggggcttgcatcct

SEQ ID NO: 106411 - DNA, 25 bp, Homo sapien
tgctaaagttaaagcaatatgcaat

SEQ ID NO: 106412 - DNA, 25 bp, Homo sapien
tgctaaagttaaggcaatatgcaat

SEQ ID NO: 106413 - DNA, 25 bp, Homo sapien
tgctaaatacgagtggtgattccaa

SEQ ID NO: 106414 - DNA, 25 bp, Homo sapien
tgctaaataggagtggtgattccaa

SEQ ID NO: 106415 - DNA, 25 bp, Homo sapien
tgctaaatttcaggccttgtggcac

SEQ ID NO: 106416 - DNA, 25 bp, Homo sapien
tgctaaatttcgggccttgtggcac

SEQ ID NO: 106417 - DNA, 25 bp, Homo sapien
tgctaacaattctcattggttatct

SEQ ID NO: 106418 - DNA, 25 bp, Homo sapien
tgctaacaattcttattggttatct

SEQ ID NO: 106419 - DNA, 25 bp, Homo sapien
tgctaacagagaagtgtgaggagaa

SEQ ID NO: 106420 - DNA, 25 bp, Homo sapien
tgctaacagagaggtgtgaggagaa

SEQ ID NO: 106421 - DNA, 25 bp, Homo sapien
tgctaagcaaaaacaactgtcccta

SEQ ID NO: 106422 - DNA, 25 bp, Homo sapien
tgctaagcaaaagcaactgtcccta

SEQ ID NO: 106423 - DNA, 25 bp, Homo sapien
tgctaagcgtcaataaacagcatcc

SEQ ID NO: 106424 - DNA, 25 bp, Homo sapien
tgctaagcgtcagtaaacagcatcc

SEQ ID NO: 106425 - DNA, 25 bp, Homo sapien
tgctaaggaattaatgcaggcactg

SEQ ID NO: 106426 - DNA, 25 bp, Homo sapien
tgctaaggaattactgcaggcactg

SEQ ID NO: 106427 - DNA, 25 bp, Homo sapien
tgctaagtagtactccattttatga

SEQ ID NO: 106428 - DNA, 25 bp, Homo sapien
tgctaagtagtattccattttatga

SEQ ID NO: 106429 - DNA, 25 bp, Homo sapien
tgctaagtcagagtttcagctgtaa

SEQ ID NO: 106430 - DNA, 25 bp, Homo sapien
tgctaagtcagtgtttcagctgtaa

SEQ ID NO: 106431 - DNA, 25 bp, Homo sapien
tgctaagtcatttctttgccatcag

SEQ ID NO: 106432 - DNA, 25 bp, Homo sapien
tgctaagtcctttctttgccatcag

SEQ ID NO: 106433 - DNA, 25 bp, Homo sapien
tgctaatagaaggacaattctactc

SEQ ID NO: 106434 - DNA, 25 bp, Homo sapien
tgctaatagaaggacagttctactc

SEQ ID NO: 106435 - DNA, 25 bp, Homo sapien
tgctaatagtagcggcctacaaatc

SEQ ID NO: 106436 - DNA, 25 bp, Homo sapien
tgctaatagtagtggcctacaaatc

SEQ ID NO: 106437 - DNA, 25 bp, Homo sapien
tgctaatctttttgatcctccaatt

SEQ ID NO: 106438 - DNA, 25 bp, Homo sapien
tgctaatcttttttatcctccaatt

SEQ ID NO: 106439 - DNA, 25 bp, Homo sapien
tgctaattcattataaggttattac

SEQ ID NO: 106440 - DNA, 25 bp, Homo sapien
tgctaattcgttataaggttattac

SEQ ID NO: 106441 - DNA, 25 bp, Homo sapien
tgctaatttgtaagtcctgcaagat

SEQ ID NO: 106442 - DNA, 25 bp, Homo sapien
tgctaatttgtaagtcgtgcaagat

SEQ ID NO: 106443 - DNA, 25 bp, Homo sapien
tgctaattttggctgcactttgaag

SEQ ID NO: 106444 - DNA, 25 bp, Homo sapien
tgctaattttggctgcgctttgaag

SEQ ID NO: 106445 - DNA, 25 bp, Homo sapien
tgctacaaactaatgactaatgata

SEQ ID NO: 106446 - DNA, 25 bp, Homo sapien
tgctacaaactgatgactaatgata

SEQ ID NO: 106447 - DNA, 25 bp, Homo sapien
tgctacaagagtacttaacacatgc

SEQ ID NO: 106448 - DNA, 25 bp, Homo sapien
tgctacaagagtacttgacacatgc

SEQ ID NO: 106449 - DNA, 25 bp, Homo sapien
tgctacaagccaagaacacctgagg

SEQ ID NO: 106450 - DNA, 25 bp, Homo sapien
tgctacaagccaggaacacctgagg

SEQ ID NO: 106451 - DNA, 25 bp, Homo sapien
tgctacagccactgcacacccaggc

SEQ ID NO: 106452 - DNA, 25 bp, Homo sapien
tgctacagcgactgcacacccaggc

SEQ ID NO: 106453 - DNA, 25 bp, Homo sapien
tgctacaggcatctagtgagtagag

SEQ ID NO: 106454 - DNA, 25 bp, Homo sapien
tgctacagggatctagtgagtagag

SEQ ID NO: 106455 - DNA, 25 bp, Homo sapien
tgctacatgctaaaatgtgaatgat

SEQ ID NO: 106456 - DNA, 25 bp, Homo sapien
tgctacatgctataatgtgaatgat

SEQ ID NO: 106457 - DNA, 25 bp, Homo sapien
tgctaccagtgcatcgctaaggctt

SEQ ID NO: 106458 - DNA, 25 bp, Homo sapien
tgctaccagtgcattgctaaggctt

SEQ ID NO: 106459 - DNA, 25 bp, Homo sapien
tgctacccatcagcagtgagttcca

SEQ ID NO: 106460 - DNA, 25 bp, Homo sapien
tgctacccatcagctgtgagttcca

SEQ ID NO: 106461 - DNA, 25 bp, Homo sapien
tgctacctcttgcctaaatgtgttc

SEQ ID NO: 106462 - DNA, 25 bp, Homo sapien
tgctacctcttgcttaaatgtgttc

SEQ ID NO: 106463 - DNA, 25 bp, Homo sapien
tgctaccttccaaggctgccagagc

SEQ ID NO: 106464 - DNA, 25 bp, Homo sapien
tgctacctttcaaggctgccagagc

SEQ ID NO: 106465 - DNA, 25 bp, Homo sapien
tgctactactctaacgtttcgtatt

SEQ ID NO: 106466 - DNA, 25 bp, Homo sapien
tgctactactctaatgtttcgtatt

SEQ ID NO: 106467 - DNA, 25 bp, Homo sapien
tgctactcacaaccaggatgtcagg

SEQ ID NO: 106468 - DNA, 25 bp, Homo sapien
tgctactcacaatcaggatgtcagg

SEQ ID NO: 106469 - DNA, 25 bp, Homo sapien
tgctactcctatagaacataaaccc

SEQ ID NO: 106470 - DNA, 25 bp, Homo sapien
tgctactcctatagaatataaaccc

SEQ ID NO: 106471 - DNA, 25 bp, Homo sapien
tgctactctgcaccatggtatattt

SEQ ID NO: 106472 - DNA, 25 bp, Homo sapien
tgctactctgcaccgtggtatattt

SEQ ID NO: 106473 - DNA, 25 bp, Homo sapien
tgctactgactttcatacaatggct

SEQ ID NO: 106474 - DNA, 25 bp, Homo sapien
tgctactgacttttatacaatggct

SEQ ID NO: 106475 - DNA, 25 bp, Homo sapien
tgctactgatattctcttccatagc

SEQ ID NO: 106476 - DNA, 25 bp, Homo sapien
tgctactgatattgtcttccatagc

SEQ ID NO: 106477 - DNA, 25 bp, Homo sapien
tgctacttacagcaagcgacaagtc

SEQ ID NO: 106478 - DNA, 25 bp, Homo sapien
tgctacttacagcaagtgacaagtc

SEQ ID NO: 106479 - DNA, 25 bp, Homo sapien
tgctacttacgatgtgaaagcagct

SEQ ID NO: 106480 - DNA, 25 bp, Homo sapien
tgctacttatgatgtgaaagcagct

SEQ ID NO: 106481 - DNA, 25 bp, Homo sapien
tgctactttctcaccttgtgtttct

SEQ ID NO: 106482 - DNA, 25 bp, Homo sapien
tgctactttcttaccttgtgtttct

SEQ ID NO: 106483 - DNA, 25 bp, Homo sapien
tgctactttggtgacatttgttatg

SEQ ID NO: 106484 - DNA, 25 bp, Homo sapien
tgctactttggtgatatttgttatg

SEQ ID NO: 106485 - DNA, 25 bp, Homo sapien
tgctacttttagcgatggcaacttg

SEQ ID NO: 106486 - DNA, 25 bp, Homo sapien
tgctacttttagtgatggcaacttg

SEQ ID NO: 106487 - DNA, 25 bp, Homo sapien
tgctagaaatacctgcacgtcattt

SEQ ID NO: 106488 - DNA, 25 bp, Homo sapien
tgctagaaatacctgcccgtcattt

SEQ ID NO: 106489 - DNA, 25 bp, Homo sapien
tgctagaaatccaatacttggcttg

SEQ ID NO: 106490 - DNA, 25 bp, Homo sapien
tgctagaactccaatacttggcttg

SEQ ID NO: 106491 - DNA, 25 bp, Homo sapien
tgctagcagggatcagtgagggatg

SEQ ID NO: 106492 - DNA, 25 bp, Homo sapien
tgctagcagggctcagtgagggatg

SEQ ID NO: 106493 - DNA, 25 bp, Homo sapien
tgctaggccctgaagaggcaaagac

SEQ ID NO: 106494 - DNA, 25 bp, Homo sapien
tgctaggccctggagaggcaaagac

SEQ ID NO: 106495 - DNA, 25 bp, Homo sapien
tgctagggatacagtggattaatgc

SEQ ID NO: 106496 - DNA, 25 bp, Homo sapien
tgctagggatatagtggattaatgc

SEQ ID NO: 106497 - DNA, 25 bp, Homo sapien
tgctaggtagtaatttctagcactc

SEQ ID NO: 106498 - DNA, 25 bp, Homo sapien
tgctaggtcagcgatcagcaccaaa

SEQ ID NO: 106499 - DNA, 25 bp, Homo sapien
tgctaggtcagtgatcagcaccaaa

SEQ ID NO: 106500 - DNA, 25 bp, Homo sapien
tgctaggtgccctggaggaatacaa

SEQ ID NO: 106501 - DNA, 25 bp, Homo sapien
tgctaggtggtaatttctagcactc

SEQ ID NO: 106502 - DNA, 25 bp, Homo sapien
tgctaggtgtcctggaggaatacaa

SEQ ID NO: 106503 - DNA, 25 bp, Homo sapien
tgctagtttctcatactacttgtct

SEQ ID NO: 106504 - DNA, 25 bp, Homo sapien
tgctagtttcttatactacttgtct

SEQ ID NO: 106505 - DNA, 25 bp, Homo sapien
tgctataacaaaagggtcttccatc

SEQ ID NO: 106506 - DNA, 25 bp, Homo sapien
tgctataacaacagggtcttccatc

SEQ ID NO: 106507 - DNA, 25 bp, Homo sapien
tgctataacttcgtagtcctggatg

SEQ ID NO: 106508 - DNA, 25 bp, Homo sapien
tgctataactttgtagtcctggatg

SEQ ID NO: 106509 - DNA, 25 bp, Homo sapien
tgctatacaaaatccatcttttcag

SEQ ID NO: 106510 - DNA, 25 bp, Homo sapien
tgctatacaaaatgcatcttttcag

SEQ ID NO: 106511 - DNA, 25 bp, Homo sapien
tgctatagtgtacgtctacatacta

SEQ ID NO: 106512 - DNA, 25 bp, Homo sapien
tgctatagtgtaggtctacatacta

SEQ ID NO: 106513 - DNA, 25 bp, Homo sapien
tgctatatgcaagaatggcaattat

SEQ ID NO: 106514 - DNA, 25 bp, Homo sapien
tgctatatgcaggaatggcaattat

SEQ ID NO: 106515 - DNA, 25 bp, Homo sapien
tgctatattatttttcttctgatgg

SEQ ID NO: 106516 - DNA, 25 bp, Homo sapien
tgctatattctttttcttctgatgg

SEQ ID NO: 106517 - DNA, 25 bp, Homo sapien
tgctatcaacaacgtattatgccaa

SEQ ID NO: 106518 - DNA, 25 bp, Homo sapien
tgctatcagcaacgtattatgccaa

SEQ ID NO: 106519 - DNA, 25 bp, Homo sapien
tgctatccactgaattgttaccatc

SEQ ID NO: 106520 - DNA, 25 bp, Homo sapien
tgctatccacttccaatcttaccaa

SEQ ID NO: 106521 - DNA, 25 bp, Homo sapien
tgctatccacttctaatcttaccaa

SEQ ID NO: 106522 - DNA, 25 bp, Homo sapien
tgctatccattgaattgttaccatc

SEQ ID NO: 106523 - DNA, 25 bp, Homo sapien
tgctatctgttacgtgatgccatcc

SEQ ID NO: 106524 - DNA, 25 bp, Homo sapien
tgctatctgttatgtgatgccatcc

SEQ ID NO: 106525 - DNA, 25 bp, Homo sapien
tgctatgagagcaccaaattatcta

SEQ ID NO: 106526 - DNA, 25 bp, Homo sapien
tgctatgagagcgccaaattatcta

SEQ ID NO: 106527 - DNA, 25 bp, Homo sapien
tgctatgatcattatcctatcccat

SEQ ID NO: 106528 - DNA, 25 bp, Homo sapien
tgctatgatcattatcttatcccat

SEQ ID NO: 106529 - DNA, 25 bp, Homo sapien
tgctatgccattgtattcacttcca

SEQ ID NO: 106530 - DNA, 25 bp, Homo sapien
tgctatgctattgtattcacttcca

SEQ ID NO: 106531 - DNA, 25 bp, Homo sapien
tgctatggaacccagttttttcttt

SEQ ID NO: 106532 - DNA, 25 bp, Homo sapien
tgctatggaacccatttttttcttt

SEQ ID NO: 106533 - DNA, 25 bp, Homo sapien
tgctatggattactcttcatcaaat

SEQ ID NO: 106534 - DNA, 25 bp, Homo sapien
tgctatggattattcttcatcaaat

SEQ ID NO: 106535 - DNA, 25 bp, Homo sapien
tgctatgtccactagaagaagtatt

SEQ ID NO: 106536 - DNA, 25 bp, Homo sapien
tgctatgtccactggaagaagtatt

SEQ ID NO: 106537 - DNA, 25 bp, Homo sapien
tgctattaatgatagcaattcacgc

SEQ ID NO: 106538 - DNA, 25 bp, Homo sapien
tgctattaatgatagcgattcacgc

SEQ ID NO: 106539 - DNA, 25 bp, Homo sapien
tgctattacggtaatgctagcttca

SEQ ID NO: 106540 - DNA, 25 bp, Homo sapien
tgctattagattacaacacgtgggc

SEQ ID NO: 106541 - DNA, 25 bp, Homo sapien
tgctattagattccaacacgtgggc

SEQ ID NO: 106542 - DNA, 25 bp, Homo sapien
tgctattagggtaatgctagcttca

SEQ ID NO: 106543 - DNA, 25 bp, Homo sapien
tgctattattttacggtatctgcag

SEQ ID NO: 106544 - DNA, 25 bp, Homo sapien
tgctattattttatggtatctgcag

SEQ ID NO: 106545 - DNA, 25 bp, Homo sapien
tgctattctcttggtgcctctgtca

SEQ ID NO: 106546 - DNA, 25 bp, Homo sapien
tgctattctcttggtgtctctgtca

SEQ ID NO: 106547 - DNA, 25 bp, Homo sapien
tgctattggctttccctcgctagca

SEQ ID NO: 106548 - DNA, 25 bp, Homo sapien
tgctattgtctttccctcgctagca

SEQ ID NO: 106549 - DNA, 25 bp, Homo sapien
tgctatttggagtcagtttctccca

SEQ ID NO: 106550 - DNA, 25 bp, Homo sapien
tgctatttggagttagtttctccca

SEQ ID NO: 106551 - DNA, 25 bp, Homo sapien
tgctatttgggcgcctcaatccatc

SEQ ID NO: 106552 - DNA, 25 bp, Homo sapien
tgctatttgggctcctcaatccatc

SEQ ID NO: 106553 - DNA, 25 bp, Homo sapien
tgctcaaacatattcataaagcaga

SEQ ID NO: 106554 - DNA, 25 bp, Homo sapien
tgctcaaacatgttcataaagcaga

SEQ ID NO: 106555 - DNA, 25 bp, Homo sapien
tgctcaactcgagtgcctttactgg

SEQ ID NO: 106556 - DNA, 25 bp, Homo sapien
tgctcaacttgagtgcctttactgg

SEQ ID NO: 106557 - DNA, 25 bp, Homo sapien
tgctcaagaaaaatgaaattacatc

SEQ ID NO: 106558 - DNA, 25 bp, Homo sapien
tgctcaagataatctacttttccta

SEQ ID NO: 106559 - DNA, 25 bp, Homo sapien
tgctcaagcatttaaagaaaaacat

SEQ ID NO: 106560 - DNA, 25 bp, Homo sapien
tgctcaagctcaaggacgggacaaa

SEQ ID NO: 106561 - DNA, 25 bp, Homo sapien
tgctcaagctcaaggatgggacaaa

SEQ ID NO: 106562 - DNA, 25 bp, Homo sapien
tgctcaaggaaaatgaaattacatc

SEQ ID NO: 106563 - DNA, 25 bp, Homo sapien
tgctcaaggacagcaaaaatgaggg

SEQ ID NO: 106564 - DNA, 25 bp, Homo sapien
tgctcaaggacagcgaaaatgaggg

SEQ ID NO: 106565 - DNA, 25 bp, Homo sapien
tgctcaaggatttaaagaaaaacat

SEQ ID NO: 106566 - DNA, 25 bp, Homo sapien
tgctcaaggtaatctacttttccta

SEQ ID NO: 106567 - DNA, 25 bp, Homo sapien
tgctcaattgacgtctcaggatagc

SEQ ID NO: 106568 - DNA, 25 bp, Homo sapien
tgctcaattgatgtctcaggatagc

SEQ ID NO: 106569 - DNA, 25 bp, Homo sapien
tgctcacacctataagcccagtgac

SEQ ID NO: 106570 - DNA, 25 bp, Homo sapien
tgctcacacttataagcccagtgac

SEQ ID NO: 106571 - DNA, 25 bp, Homo sapien
tgctcacagaccgcagtgaaagaaa

SEQ ID NO: 106572 - DNA, 25 bp, Homo sapien
tgctcacagacctcagtgaaagaaa

SEQ ID NO: 106573 - DNA, 25 bp, Homo sapien
tgctcacagattgtggagtccaatt

SEQ ID NO: 106574 - DNA, 25 bp, Homo sapien
tgctcacagattttggagtccaatt

SEQ ID NO: 106575 - DNA, 25 bp, Homo sapien
tgctcaccactcgaaaaacaaactc

SEQ ID NO: 106576 - DNA, 25 bp, Homo sapien
tgctcaccacttgaaaaacaaactc

SEQ ID NO: 106577 - DNA, 25 bp, Homo sapien
tgctcacttatattataaactattg

SEQ ID NO: 106578 - DNA, 25 bp, Homo sapien
tgctcacttatgttataaactattg

SEQ ID NO: 106579 - DNA, 25 bp, Homo sapien
tgctcagaccagaaactctgaattt

SEQ ID NO: 106580 - DNA, 25 bp, Homo sapien
tgctcagatcagaaactctgaattt

SEQ ID NO: 106581 - DNA, 25 bp, Homo sapien
tgctcagatgtccccctggtagtaa

SEQ ID NO: 106582 - DNA, 25 bp, Homo sapien
tgctcagatgttcccctggtagtaa

SEQ ID NO: 106583 - DNA, 25 bp, Homo sapien
tgctcagcttctacgtaccacgctc

SEQ ID NO: 106584 - DNA, 25 bp, Homo sapien
tgctcagcttctatgtaccacgctc

SEQ ID NO: 106585 - DNA, 25 bp, Homo sapien
tgctcatagaggatgaagacagggt

SEQ ID NO: 106586 - DNA, 25 bp, Homo sapien
tgctcatagaggatgacgacagggt

SEQ ID NO: 106587 - DNA, 25 bp, Homo sapien
tgctcatagtactggaggcaagaaa

SEQ ID NO: 106588 - DNA, 25 bp, Homo sapien
tgctcatagtagtggaggcaagaaa

SEQ ID NO: 106589 - DNA, 25 bp, Homo sapien
tgctcatcactgaaaagtagactcc

SEQ ID NO: 106590 - DNA, 25 bp, Homo sapien
tgctcatcgctgaaaagtagactcc

SEQ ID NO: 106591 - DNA, 25 bp, Homo sapien
tgctcatggtaagcagacacctacc

SEQ ID NO: 106592 - DNA, 25 bp, Homo sapien
tgctcatggtaagcggacacctacc

SEQ ID NO: 106593 - DNA, 25 bp, Homo sapien
tgctcatggttgtactggagagcaa

SEQ ID NO: 106594 - DNA, 25 bp, Homo sapien
tgctcatggttgttctggagagcaa

SEQ ID NO: 106595 - DNA, 25 bp, Homo sapien
tgctcattttacatataaaggaaag

SEQ ID NO: 106596 - DNA, 25 bp, Homo sapien
tgctcattttacgtataaaggaaag

SEQ ID NO: 106597 - DNA, 25 bp, Homo sapien
tgctccaacacaatacaaagagctg

SEQ ID NO: 106598 - DNA, 25 bp, Homo sapien
tgctccaacacaatacgaagagctg

SEQ ID NO: 106599 - DNA, 25 bp, Homo sapien
tgctccaacgtggtcttctcatgtc

SEQ ID NO: 106600 - DNA, 25 bp, Homo sapien
tgctccaacttggtcttctcatgtc

SEQ ID NO: 106601 - DNA, 25 bp, Homo sapien
tgctccacaatgaacgtgtccttct

SEQ ID NO: 106602 - DNA, 25 bp, Homo sapien
tgctccacaatgaatgtgtccttct

SEQ ID NO: 106603 - DNA, 25 bp, Homo sapien
tgctccacacaatttctcagtgatc

SEQ ID NO: 106604 - DNA, 25 bp, Homo sapien
tgctccaccagctcatgttgcctct

SEQ ID NO: 106605 - DNA, 25 bp, Homo sapien
tgctccaccagttcatgttgcctct

SEQ ID NO: 106606 - DNA, 25 bp, Homo sapien
tgctccacgcaatttctcagtgatc

SEQ ID NO: 106607 - DNA, 25 bp, Homo sapien
tgctccatatttttgccagtatgta

SEQ ID NO: 106608 - DNA, 25 bp, Homo sapien
tgctccatattttttccagtatgta

SEQ ID NO: 106609 - DNA, 25 bp, Homo sapien
tgctccatccacaggttcctgtcct

SEQ ID NO: 106610 - DNA, 25 bp, Homo sapien
tgctccatccataggttcctgtcct

SEQ ID NO: 106611 - DNA, 25 bp, Homo sapien
tgctccatgaaactcggaggaaatc

SEQ ID NO: 106612 - DNA, 25 bp, Homo sapien
tgctccatgaacctcggaggaaatc

SEQ ID NO: 106613 - DNA, 25 bp, Homo sapien
tgctcccatctgcgcactttgagct

SEQ ID NO: 106614 - DNA, 25 bp, Homo sapien
tgctcccatctgggcactttgagct

SEQ ID NO: 106615 - DNA, 25 bp, Homo sapien
tgctccgatgttcgtccatgctgac

SEQ ID NO: 106616 - DNA, 25 bp, Homo sapien
tgctccgatgtttgtccatgctgac

SEQ ID NO: 106617 - DNA, 25 bp, Homo sapien
tgctcctcaagtcggcattccttct

SEQ ID NO: 106618 - DNA, 25 bp, Homo sapien
tgctcctcaagttggcattccttct

SEQ ID NO: 106619 - DNA, 25 bp, Homo sapien
tgctcctcacaagcttaaaatccct

SEQ ID NO: 106620 - DNA, 25 bp, Homo sapien
tgctcctcataagcttaaaatccct

SEQ ID NO: 106621 - DNA, 25 bp, Homo sapien
tgctccttataacaaaatgaccaaa

SEQ ID NO: 106622 - DNA, 25 bp, Homo sapien
tgctccttataataaaatgaccaaa

SEQ ID NO: 106623 - DNA, 25 bp, Homo sapien
tgctccttcctcgggctgcctaccc

SEQ ID NO: 106624 - DNA, 25 bp, Homo sapien
tgctccttcctgattccttaaatga

SEQ ID NO: 106625 - DNA, 25 bp, Homo sapien
tgctccttcttgattccttaaatga

SEQ ID NO: 106626 - DNA, 25 bp, Homo sapien
tgctcctttcgcgagggcattagct

SEQ ID NO: 106627 - DNA, 25 bp, Homo sapien
tgctcctttctcgggctgcctaccc

SEQ ID NO: 106628 - DNA, 25 bp, Homo sapien
tgctccttttgcgagggcattagct

SEQ ID NO: 106629 - DNA, 25 bp, Homo sapien
tgctcgctcgctctctctcaaacaa

SEQ ID NO: 106630 - DNA, 25 bp, Homo sapien
tgctcgctggctctctctcaaacaa

SEQ ID NO: 106631 - DNA, 25 bp, Homo sapien
tgctcggatcttaccacatacttgt

SEQ ID NO: 106632 - DNA, 25 bp, Homo sapien
tgctcggattttaccacatacttgt

SEQ ID NO: 106633 - DNA, 25 bp, Homo sapien
tgctcggtctacatctgatcctaag

SEQ ID NO: 106634 - DNA, 25 bp, Homo sapien
tgctcggtctacatgtgatcctaag

SEQ ID NO: 106635 - DNA, 25 bp, Homo sapien
tgctcgtccactagccctcgctcat

SEQ ID NO: 106636 - DNA, 25 bp, Homo sapien
tgctcgtcgactagccctcgctcat

SEQ ID NO: 106637 - DNA, 25 bp, Homo sapien
tgctcgtctctggttttgagtgtgt

SEQ ID NO: 106638 - DNA, 25 bp, Homo sapien
tgctcgtctctgtttttgagtgtgt

SEQ ID NO: 106639 - DNA, 25 bp, Homo sapien
tgctcgtgaagattaaatgcattaa

SEQ ID NO: 106640 - DNA, 25 bp, Homo sapien
tgctcgtgaggattaaatgcattaa

SEQ ID NO: 106641 - DNA, 25 bp, Homo sapien
tgctcgtggagacgctggtggtttg

SEQ ID NO: 106642 - DNA, 25 bp, Homo sapien
tgctcgtggagatgctggtggtttg

SEQ ID NO: 106643 - DNA, 25 bp, Homo sapien
tgctctacattcttttcaatccaag

SEQ ID NO: 106644 - DNA, 25 bp, Homo sapien
tgctctacgttcttttcaatccaag

SEQ ID NO: 106645 - DNA, 25 bp, Homo sapien
tgctctaggacataaccaataagca

SEQ ID NO: 106646 - DNA, 25 bp, Homo sapien
tgctctagggcataaccaataagca

SEQ ID NO: 106647 - DNA, 25 bp, Homo sapien
tgctctatccacaatgacctacttt

SEQ ID NO: 106648 - DNA, 25 bp, Homo sapien
tgctctatccactatgacctacttt

SEQ ID NO: 106649 - DNA, 25 bp, Homo sapien
tgctctcactcttaatacaatcgcc

SEQ ID NO: 106650 - DNA, 25 bp, Homo sapien
tgctctcactcttcatacaatcgcc

SEQ ID NO: 106651 - DNA, 25 bp, Homo sapien
tgctctcactttatggacttgccct

SEQ ID NO: 106652 - DNA, 25 bp, Homo sapien
tgctctcagtttatggacttgccct

SEQ ID NO: 106653 - DNA, 25 bp, Homo sapien
tgctctcctaatcatctgcccagga

SEQ ID NO: 106654 - DNA, 25 bp, Homo sapien
tgctctcctaatcgtctgcccagga

SEQ ID NO: 106655 - DNA, 25 bp, Homo sapien
tgctctctatcaatacctggagaat

SEQ ID NO: 106656 - DNA, 25 bp, Homo sapien
tgctctctggtccatgatattgata

SEQ ID NO: 106657 - DNA, 25 bp, Homo sapien
tgctctctggtccctgatattgata

SEQ ID NO: 106658 - DNA, 25 bp, Homo sapien
tgctctctgtcaatacctggagaat

SEQ ID NO: 106659 - DNA, 25 bp, Homo sapien
tgctctgacgccctagggacatgtc

SEQ ID NO: 106660 - DNA, 25 bp, Homo sapien
tgctctgatgccctagggacatgtc

SEQ ID NO: 106661 - DNA, 25 bp, Homo sapien
tgctctggctttcgcaacatcccat

SEQ ID NO: 106662 - DNA, 25 bp, Homo sapien
tgctctggcttttgcaacatcccat

SEQ ID NO: 106663 - DNA, 25 bp, Homo sapien
tgctctgggtccctcagtatcagag

SEQ ID NO: 106664 - DNA, 25 bp, Homo sapien
tgctctgggtccctgagtatcagag

SEQ ID NO: 106665 - DNA, 25 bp, Homo sapien
tgctctggttatcaggacagagaaa

SEQ ID NO: 106666 - DNA, 25 bp, Homo sapien
tgctctggttatcgggacagagaaa

SEQ ID NO: 106667 - DNA, 25 bp, Homo sapien
tgctctgtctatcggtctcacttcc

SEQ ID NO: 106668 - DNA, 25 bp, Homo sapien
tgctctgtctatgggtctcacttcc

SEQ ID NO: 106669 - DNA, 25 bp, Homo sapien
tgctcttaaacctaaatctaagaaa

SEQ ID NO: 106670 - DNA, 25 bp, Homo sapien
tgctcttaaagcccttatttctcag

SEQ ID NO: 106671 - DNA, 25 bp, Homo sapien
tgctcttaaagctcttatttctcag

SEQ ID NO: 106672 - DNA, 25 bp, Homo sapien
tgctcttaagcctaaatctaagaaa

SEQ ID NO: 106673 - DNA, 25 bp, Homo sapien
tgctcttcaaattcagaactcacaa

SEQ ID NO: 106674 - DNA, 25 bp, Homo sapien
tgctcttccaattcagaactcacaa

SEQ ID NO: 106675 - DNA, 25 bp, Homo sapien
tgctcttccactgatctctcaagaa

SEQ ID NO: 106676 - DNA, 25 bp, Homo sapien
tgctcttcctctgatctctcaagaa

SEQ ID NO: 106677 - DNA, 25 bp, Homo sapien
tgctcttctcttggggcctcccgcc

SEQ ID NO: 106678 - DNA, 25 bp, Homo sapien
tgctcttctctttgggcctcccgcc

SEQ ID NO: 106679 - DNA, 25 bp, Homo sapien
tgctcttgcctcactcgacctccaa

SEQ ID NO: 106680 - DNA, 25 bp, Homo sapien
tgctcttgcctcattcgacctccaa

SEQ ID NO: 106681 - DNA, 25 bp, Homo sapien
tgctcttggattcaccaagcactca

SEQ ID NO: 106682 - DNA, 25 bp, Homo sapien
tgctcttggattcgccaagcactca

SEQ ID NO: 106683 - DNA, 25 bp, Homo sapien
tgctctttcggaaaggtgtgctgat

SEQ ID NO: 106684 - DNA, 25 bp, Homo sapien
tgctctttggttacatgaactgact

SEQ ID NO: 106685 - DNA, 25 bp, Homo sapien
tgctctttggttacattaactgact

SEQ ID NO: 106686 - DNA, 25 bp, Homo sapien
tgctcttttctttcgtgatacttat

SEQ ID NO: 106687 - DNA, 25 bp, Homo sapien
tgctcttttcttttgtgatacttat

SEQ ID NO: 106688 - DNA, 25 bp, Homo sapien
tgctcttttggaaaggtgtgctgat

SEQ ID NO: 106689 - DNA, 25 bp, Homo sapien
tgctgaaaaacttcagaaactgtct

SEQ ID NO: 106690 - DNA, 25 bp, Homo sapien
tgctgaaaaatataaaaagtgttgt

SEQ ID NO: 106691 - DNA, 25 bp, Homo sapien
tgctgaaaaatctaaaaagtgttgt

SEQ ID NO: 106692 - DNA, 25 bp, Homo sapien
tgctgaaaatcttcagaaactgtct

SEQ ID NO: 106693 - DNA, 25 bp, Homo sapien
tgctgaaagagacagtgctatctgg

SEQ ID NO: 106694 - DNA, 25 bp, Homo sapien
tgctgaaagagacggtgctatctgg

SEQ ID NO: 106695 - DNA, 25 bp, Homo sapien
tgctgaaatagcaatacgtatctgt

SEQ ID NO: 106696 - DNA, 25 bp, Homo sapien
tgctgaaatagcaatatgtatctgt

SEQ ID NO: 106697 - DNA, 25 bp, Homo sapien
tgctgaacaatctccatgcactgtc

SEQ ID NO: 106698 - DNA, 25 bp, Homo sapien
tgctgaacagccacagaaataacta

SEQ ID NO: 106699 - DNA, 25 bp, Homo sapien
tgctgaacagccgcagaaataacta

SEQ ID NO: 106700 - DNA, 25 bp, Homo sapien
tgctgaacagtctccatgcactgtc

SEQ ID NO: 106701 - DNA, 25 bp, Homo sapien
tgctgaaggctgcaatagctgtgtc

SEQ ID NO: 106702 - DNA, 25 bp, Homo sapien
tgctgaaggctggaatagctgtgtc

SEQ ID NO: 106703 - DNA, 25 bp, Homo sapien
tgctgaatgtgtcagtctctctgaa

SEQ ID NO: 106704 - DNA, 25 bp, Homo sapien
tgctgaatgtgtcagtttctctgaa

SEQ ID NO: 106705 - DNA, 25 bp, Homo sapien
tgctgacagaggctcctctctactc

SEQ ID NO: 106706 - DNA, 25 bp, Homo sapien
tgctgacagaggcttctctctactc

SEQ ID NO: 106707 - DNA, 25 bp, Homo sapien
tgctgacataaaagctgcaggtatt

SEQ ID NO: 106708 - DNA, 25 bp, Homo sapien
tgctgacataagagctgcaggtatt

SEQ ID NO: 106709 - DNA, 25 bp, Homo sapien
tgctgacatcaagccactaaaatta

SEQ ID NO: 106710 - DNA, 25 bp, Homo sapien
tgctgacatcaagctactaaaatta

SEQ ID NO: 106711 - DNA, 25 bp, Homo sapien
tgctgaccaagaacaggttaaacct

SEQ ID NO: 106712 - DNA, 25 bp, Homo sapien
tgctgaccaaggacaggttaaacct

SEQ ID NO: 106713 - DNA, 25 bp, Homo sapien
tgctgaccatgctcctcgcaacagg

SEQ ID NO: 106714 - DNA, 25 bp, Homo sapien
tgctgaccatgttcctcgcaacagg

SEQ ID NO: 106715 - DNA, 25 bp, Homo sapien
tgctgactctaaccaattgaatgtg

SEQ ID NO: 106716 - DNA, 25 bp, Homo sapien
tgctgactttaaccaattgaatgtg

SEQ ID NO: 106717 - DNA, 25 bp, Homo sapien
tgctgagaagatgaatatatacaaa

SEQ ID NO: 106718 - DNA, 25 bp, Homo sapien
tgctgagaagatgaatgtatacaaa

SEQ ID NO: 106719 - DNA, 25 bp, Homo sapien
tgctgagaggtcatccttgtttctg

SEQ ID NO: 106720 - DNA, 25 bp, Homo sapien
tgctgagaggtcgtccttgtttctg

SEQ ID NO: 106721 - DNA, 25 bp, Homo sapien
tgctgagatgattcgatttgcattt

SEQ ID NO: 106722 - DNA, 25 bp, Homo sapien
tgctgagatgatttgatttgcattt

SEQ ID NO: 106723 - DNA, 25 bp, Homo sapien
tgctgagctctttatttctatacac

SEQ ID NO: 106724 - DNA, 25 bp, Homo sapien
tgctgagctctttgtttctatacac

SEQ ID NO: 106725 - DNA, 25 bp, Homo sapien
tgctgaggaaaaagtgcacgcaaag

SEQ ID NO: 106726 - DNA, 25 bp, Homo sapien
tgctgaggagaacaagacaaagtcc

SEQ ID NO: 106727 - DNA, 25 bp, Homo sapien
tgctgaggagaacaaggcaaagtcc

SEQ ID NO: 106728 - DNA, 25 bp, Homo sapien
tgctgagggaaaagtgcacgcaaag

SEQ ID NO: 106729 - DNA, 25 bp, Homo sapien
tgctgagtaacacctgcattctctc

SEQ ID NO: 106730 - DNA, 25 bp, Homo sapien
tgctgagtaactcctgcattctctc

SEQ ID NO: 106731 - DNA, 25 bp, Homo sapien
tgctgagtatgtcgactgatccaat

SEQ ID NO: 106732 - DNA, 25 bp, Homo sapien
tgctgagtatgttgactgatccaat

SEQ ID NO: 106733 - DNA, 25 bp, Homo sapien
tgctgagtgatgatactggccccca

SEQ ID NO: 106734 - DNA, 25 bp, Homo sapien
tgctgagtgatgttactggccccca

SEQ ID NO: 106735 - DNA, 25 bp, Homo sapien
tgctgataacttctatatctaaaaa

SEQ ID NO: 106736 - DNA, 25 bp, Homo sapien
tgctgataacttctgtatctaaaaa

SEQ ID NO: 106737 - DNA, 25 bp, Homo sapien
tgctgatacctgacaaaagagattc

SEQ ID NO: 106738 - DNA, 25 bp, Homo sapien
tgctgatacctgacgaaagagattc

SEQ ID NO: 106739 - DNA, 25 bp, Homo sapien
tgctgatctgatacagaaaactttt

SEQ ID NO: 106740 - DNA, 25 bp, Homo sapien
tgctgatctgatagagaaaactttt

SEQ ID NO: 106741 - DNA, 25 bp, Homo sapien
tgctgatggctgtccaagtggttac

SEQ ID NO: 106742 - DNA, 25 bp, Homo sapien
tgctgatggctgtcgaagtggttac

SEQ ID NO: 106743 - DNA, 25 bp, Homo sapien
tgctgcaaaaacatctctcctggag

SEQ ID NO: 106744 - DNA, 25 bp, Homo sapien
tgctgcaaaaacctctctcctggag

SEQ ID NO: 106745 - DNA, 25 bp, Homo sapien
tgctgcagcggtgtgtgtgtctgca

SEQ ID NO: 106746 - DNA, 25 bp, Homo sapien
tgctgcagtggtgtgtgtgtctgca

SEQ ID NO: 106747 - DNA, 25 bp, Homo sapien
tgctgcatagctcttttactcagat

SEQ ID NO: 106748 - DNA, 25 bp, Homo sapien
tgctgcatagcttttttactcagat

SEQ ID NO: 106749 - DNA, 25 bp, Homo sapien
tgctgcatataacaagcctgtcatt

SEQ ID NO: 106750 - DNA, 25 bp, Homo sapien
tgctgcatgtaacaagcctgtcatt

SEQ ID NO: 106751 - DNA, 25 bp, Homo sapien
tgctgcatttgtctataaatttaga

SEQ ID NO: 106752 - DNA, 25 bp, Homo sapien
tgctgcatttgtttataaatttaga

SEQ ID NO: 106753 - DNA, 25 bp, Homo sapien
tgctgccatcaagaatttaaaagac

SEQ ID NO: 106754 - DNA, 25 bp, Homo sapien
tgctgccatcatgaatttaaaagac

SEQ ID NO: 106755 - DNA, 25 bp, Homo sapien
tgctgccatttgtcctccaaacttc

SEQ ID NO: 106756 - DNA, 25 bp, Homo sapien
tgctgccatttgtcttccaaacttc

SEQ ID NO: 106757 - DNA, 25 bp, Homo sapien
tgctgcccagccaggtgtccttgtt

SEQ ID NO: 106758 - DNA, 25 bp, Homo sapien
tgctgcccagcgaggtgtccttgtt

SEQ ID NO: 106759 - DNA, 25 bp, Homo sapien
tgctgcctattgaaagcaaagatag

SEQ ID NO: 106760 - DNA, 25 bp, Homo sapien
tgctgcctattggaagcaaagatag

SEQ ID NO: 106761 - DNA, 25 bp, Homo sapien
tgctgccttatgaacaagtaagagg

SEQ ID NO: 106762 - DNA, 25 bp, Homo sapien
tgctgccttatggacaagtaagagg

SEQ ID NO: 106763 - DNA, 25 bp, Homo sapien
tgctgctatttcagaatttctgtag

SEQ ID NO: 106764 - DNA, 25 bp, Homo sapien
tgctgctatttcggaatttctgtag

SEQ ID NO: 106765 - DNA, 25 bp, Homo sapien
tgctgctcaatgacacctgcagaca

SEQ ID NO: 106766 - DNA, 25 bp, Homo sapien
tgctgctcaatgatacctgcagaca

SEQ ID NO: 106767 - DNA, 25 bp, Homo sapien
tgctggaagttttataagaaatcag

SEQ ID NO: 106768 - DNA, 25 bp, Homo sapien
tgctggaagttttgtaagaaatcag

SEQ ID NO: 106769 - DNA, 25 bp, Homo sapien
tgctggatctgctttactagcacat

SEQ ID NO: 106770 - DNA, 25 bp, Homo sapien
tgctggatctgttttactagcacat

SEQ ID NO: 106771 - DNA, 25 bp, Homo sapien
tgctggattccgcagtgccaaacca

SEQ ID NO: 106772 - DNA, 25 bp, Homo sapien
tgctggattccgcggtgccaaacca

SEQ ID NO: 106773 - DNA, 25 bp, Homo sapien
tgctggcagcactgtgcggaaggct

SEQ ID NO: 106774 - DNA, 25 bp, Homo sapien
tgctggcagcactgtgtggaaggct

SEQ ID NO: 106775 - DNA, 25 bp, Homo sapien
tgctggctgcagttaacacaggaaa

SEQ ID NO: 106776 - DNA, 25 bp, Homo sapien
tgctggctgcagtttacacaggaaa

SEQ ID NO: 106777 - DNA, 25 bp, Homo sapien
tgctggctgctgggcgttctcctgg

SEQ ID NO: 106778 - DNA, 25 bp, Homo sapien
tgctggctgctgggtgttctcctgg

SEQ ID NO: 106779 - DNA, 25 bp, Homo sapien
tgctggcttagcctcttatttagga

SEQ ID NO: 106780 - DNA, 25 bp, Homo sapien
tgctggcttagcttcttatttagga

SEQ ID NO: 106781 - DNA, 25 bp, Homo sapien
tgctggcttgactactgtaactttg

SEQ ID NO: 106782 - DNA, 25 bp, Homo sapien
tgctggcttgactattgtaactttg

SEQ ID NO: 106783 - DNA, 25 bp, Homo sapien
tgctggcttttccatttgtcatcca

SEQ ID NO: 106784 - DNA, 25 bp, Homo sapien
tgctggcttttccgtttgtcatcca

SEQ ID NO: 106785 - DNA, 25 bp, Homo sapien
tgctgggggaatagcattacctgaa

SEQ ID NO: 106786 - DNA, 25 bp, Homo sapien
tgctgggggaatcgcattacctgaa

SEQ ID NO: 106787 - DNA, 25 bp, Homo sapien
tgctgggtattacgaaagcttcaaa

SEQ ID NO: 106788 - DNA, 25 bp, Homo sapien
tgctgggtattatgaaagcttcaaa

SEQ ID NO: 106789 - DNA, 25 bp, Homo sapien
tgctgggtggtatgaaactgacaag

SEQ ID NO: 106790 - DNA, 25 bp, Homo sapien
tgctgggttccatttacaaagacaa

SEQ ID NO: 106791 - DNA, 25 bp, Homo sapien
tgctgggttccatttagaaagacaa

SEQ ID NO: 106792 - DNA, 25 bp, Homo sapien
tgctgggttgtatgaaactgacaag

SEQ ID NO: 106793 - DNA, 25 bp, Homo sapien
tgctggtaggcctataacaagattc

SEQ ID NO: 106794 - DNA, 25 bp, Homo sapien
tgctggtaggcctgtaacaagattc

SEQ ID NO: 106795 - DNA, 25 bp, Homo sapien
tgctggtatgtcaatattttagatg

SEQ ID NO: 106796 - DNA, 25 bp, Homo sapien
tgctggtatgtcgatattttagatg

SEQ ID NO: 106797 - DNA, 25 bp, Homo sapien
tgctggtgcatatggtaagtgtggt

SEQ ID NO: 106798 - DNA, 25 bp, Homo sapien
tgctggtgcgtatggtaagtgtggt

SEQ ID NO: 106799 - DNA, 25 bp, Homo sapien
tgctggtgctttaaagtgaggcttc

SEQ ID NO: 106800 - DNA, 25 bp, Homo sapien
tgctggtgctttcaagtgaggcttc

SEQ ID NO: 106801 - DNA, 25 bp, Homo sapien
tgctggtgggattgaacagaaagaa

SEQ ID NO: 106802 - DNA, 25 bp, Homo sapien
tgctggtgggattggacagaaagaa

SEQ ID NO: 106803 - DNA, 25 bp, Homo sapien
tgctggttcccgaagccgatgggct

SEQ ID NO: 106804 - DNA, 25 bp, Homo sapien
tgctggttcccgaagctgatgggct

SEQ ID NO: 106805 - DNA, 25 bp, Homo sapien
tgctggttctgcctgaaatgtgagc

SEQ ID NO: 106806 - DNA, 25 bp, Homo sapien
tgctggttctgcttgaaatgtgagc

SEQ ID NO: 106807 - DNA, 25 bp, Homo sapien
tgctgtaaaaagcgagttaagaagg

SEQ ID NO: 106808 - DNA, 25 bp, Homo sapien
tgctgtaaaaagtgagttaagaagg

SEQ ID NO: 106809 - DNA, 25 bp, Homo sapien
tgctgtaaattcctttcagggtcat

SEQ ID NO: 106810 - DNA, 25 bp, Homo sapien
tgctgtaaatttctttcagggtcat

SEQ ID NO: 106811 - DNA, 25 bp, Homo sapien
tgctgtaacaaagtttcgctaatta

SEQ ID NO: 106812 - DNA, 25 bp, Homo sapien
tgctgtaacaaagttttgctaatta

SEQ ID NO: 106813 - DNA, 25 bp, Homo sapien
tgctgtaaggagtagaattaacaga

SEQ ID NO: 106814 - DNA, 25 bp, Homo sapien
tgctgtaaggagtagagttaacaga

SEQ ID NO: 106815 - DNA, 25 bp, Homo sapien
tgctgtaagttgtctcattatgatt

SEQ ID NO: 106816 - DNA, 25 bp, Homo sapien
tgctgtaagttgtctcgttatgatt

SEQ ID NO: 106817 - DNA, 25 bp, Homo sapien
tgctgtaatatcacacactgggtga

SEQ ID NO: 106818 - DNA, 25 bp, Homo sapien
tgctgtaatgtcacacactgggtga

SEQ ID NO: 106819 - DNA, 25 bp, Homo sapien
tgctgtaggtgcactgatacagaag

SEQ ID NO: 106820 - DNA, 25 bp, Homo sapien
tgctgtaggtgcattgatacagaag

SEQ ID NO: 106821 - DNA, 25 bp, Homo sapien
tgctgtagtggacatacctggtttt

SEQ ID NO: 106822 - DNA, 25 bp, Homo sapien
tgctgtagtggatatacctggtttt

SEQ ID NO: 106823 - DNA, 25 bp, Homo sapien
tgctgtagtggcattacccttcttt

SEQ ID NO: 106824 - DNA, 25 bp, Homo sapien
tgctgtagtggcgttacccttcttt

SEQ ID NO: 106825 - DNA, 25 bp, Homo sapien
tgctgtcaaatgctttagggctgtc

SEQ ID NO: 106826 - DNA, 25 bp, Homo sapien
tgctgtcaaatgttttagggctgtc

SEQ ID NO: 106827 - DNA, 25 bp, Homo sapien
tgctgtcacactacaagctgcaaaa

SEQ ID NO: 106828 - DNA, 25 bp, Homo sapien
tgctgtcacacttcaagctgcaaaa

SEQ ID NO: 106829 - DNA, 25 bp, Homo sapien
tgctgtcactgacttccatttgaaa

SEQ ID NO: 106830 - DNA, 25 bp, Homo sapien
tgctgtcactgtgcgggttatccat

SEQ ID NO: 106831 - DNA, 25 bp, Homo sapien
tgctgtcactgtgtgggttatccat

SEQ ID NO: 106832 - DNA, 25 bp, Homo sapien
tgctgtcatgaaaagtagtataaat

SEQ ID NO: 106833 - DNA, 25 bp, Homo sapien
tgctgtcattaaaagtagtataaat

SEQ ID NO: 106834 - DNA, 25 bp, Homo sapien
tgctgtcattgaaccgccagtgaca

SEQ ID NO: 106835 - DNA, 25 bp, Homo sapien
tgctgtcattgacttccatttgaaa

SEQ ID NO: 106836 - DNA, 25 bp, Homo sapien
tgctgtcattggaccgccagtgaca

SEQ ID NO: 106837 - DNA, 25 bp, Homo sapien
tgctgtctatctcaatgatataccc

SEQ ID NO: 106838 - DNA, 25 bp, Homo sapien
tgctgtctatctcagtgatataccc

SEQ ID NO: 106839 - DNA, 25 bp, Homo sapien
tgctgtgaactgccatctcttcttc

SEQ ID NO: 106840 - DNA, 25 bp, Homo sapien
tgctgtgagctgccatctcttcttc

SEQ ID NO: 106841 - DNA, 25 bp, Homo sapien
tgctgtgattgactggtcatgtctg

SEQ ID NO: 106842 - DNA, 25 bp, Homo sapien
tgctgtgattgattggtcatgtctg

SEQ ID NO: 106843 - DNA, 25 bp, Homo sapien
tgctgtgcagcagttatccctttat

SEQ ID NO: 106844 - DNA, 25 bp, Homo sapien
tgctgtgcagcggttatccctttat

SEQ ID NO: 106845 - DNA, 25 bp, Homo sapien
tgctgtgcccatcaaactaccaatt

SEQ ID NO: 106846 - DNA, 25 bp, Homo sapien
tgctgtgcccatcgaactaccaatt

SEQ ID NO: 106847 - DNA, 25 bp, Homo sapien
tgctgtgcttcttgttgggcttaat

SEQ ID NO: 106848 - DNA, 25 bp, Homo sapien
tgctgtgcttctttttgggcttaat

SEQ ID NO: 106849 - DNA, 25 bp, Homo sapien
tgctgtgggacaaatcacaagactg

SEQ ID NO: 106850 - DNA, 25 bp, Homo sapien
tgctgtgggacagatcacaagactg

SEQ ID NO: 106851 - DNA, 25 bp, Homo sapien
tgctgtgggatgtcactttttaata

SEQ ID NO: 106852 - DNA, 25 bp, Homo sapien
tgctgtgggttgtcactttttaata

SEQ ID NO: 106853 - DNA, 25 bp, Homo sapien
tgctgtgtaaggcctgttcctcttt

SEQ ID NO: 106854 - DNA, 25 bp, Homo sapien
tgctgtgtaagtcctgttcctcttt

SEQ ID NO: 106855 - DNA, 25 bp, Homo sapien
tgctgtgtagaactgataatatgga

SEQ ID NO: 106856 - DNA, 25 bp, Homo sapien
tgctgtgtagaattgataatatgga

SEQ ID NO: 106857 - DNA, 25 bp, Homo sapien
tgctgtgttcttctcgagtagactg

SEQ ID NO: 106858 - DNA, 25 bp, Homo sapien
tgctgtgtttttagttagctctcca

SEQ ID NO: 106859 - DNA, 25 bp, Homo sapien
tgctgtgtttttctcgagtagactg

SEQ ID NO: 106860 - DNA, 25 bp, Homo sapien
tgctgtgtttttggttagctctcca

SEQ ID NO: 106861 - DNA, 25 bp, Homo sapien
tgctgttatttaggtcatatttatt

SEQ ID NO: 106862 - DNA, 25 bp, Homo sapien
tgctgttatttaggtcgtatttatt

SEQ ID NO: 106863 - DNA, 25 bp, Homo sapien
tgctgttcatgactcaatttcggtt

SEQ ID NO: 106864 - DNA, 25 bp, Homo sapien
tgctgttcctctaccatttttatgg

SEQ ID NO: 106865 - DNA, 25 bp, Homo sapien
tgctgttcctctacgatttttatgg

SEQ ID NO: 106866 - DNA, 25 bp, Homo sapien
tgctgttcgtgactcaatttcggtt

SEQ ID NO: 106867 - DNA, 25 bp, Homo sapien
tgctgttgtttgtcctctcagtaca

SEQ ID NO: 106868 - DNA, 25 bp, Homo sapien
tgctgttgtttgtcttctcagtaca

SEQ ID NO: 106869 - DNA, 25 bp, Homo sapien
tgctgttgttttctgtctatcctgc

SEQ ID NO: 106870 - DNA, 25 bp, Homo sapien
tgctgttgttttctgtttatcctgc

SEQ ID NO: 106871 - DNA, 25 bp, Homo sapien
tgctgttgtttttgatattaaaagc

SEQ ID NO: 106872 - DNA, 25 bp, Homo sapien
tgctgttgtttttgatgttaaaagc

SEQ ID NO: 106873 - DNA, 25 bp, Homo sapien
tgctgtttcatttatagagcagaga

SEQ ID NO: 106874 - DNA, 25 bp, Homo sapien
tgctgtttcctttatagagcagaga

SEQ ID NO: 106875 - DNA, 25 bp, Homo sapien
tgctgtttctcaatgattctcacaa

SEQ ID NO: 106876 - DNA, 25 bp, Homo sapien
tgctgtttctcattgattctcacaa

SEQ ID NO: 106877 - DNA, 25 bp, Homo sapien
tgctgtttgatttatatgaaagtgg

SEQ ID NO: 106878 - DNA, 25 bp, Homo sapien
tgctgtttgggtggttcaaccaagg

SEQ ID NO: 106879 - DNA, 25 bp, Homo sapien
tgctgtttgggttgttcaaccaagg

SEQ ID NO: 106880 - DNA, 25 bp, Homo sapien
tgctgtttgttttatatgaaagtgg

SEQ ID NO: 106881 - DNA, 25 bp, Homo sapien
tgctgttttaacctactgaggtctt

SEQ ID NO: 106882 - DNA, 25 bp, Homo sapien
tgctgttttaagctactgaggtctt

SEQ ID NO: 106883 - DNA, 25 bp, Homo sapien
tgcttaaaacccacgaattgggcag

SEQ ID NO: 106884 - DNA, 25 bp, Homo sapien
tgcttaaaacccacgatttgggcag

SEQ ID NO: 106885 - DNA, 25 bp, Homo sapien
tgcttaaacccaatagaagcctgaa

SEQ ID NO: 106886 - DNA, 25 bp, Homo sapien
tgcttaaacccattagaagcctgaa

SEQ ID NO: 106887 - DNA, 25 bp, Homo sapien
tgcttaaaggagtcaaaacattgat

SEQ ID NO: 106888 - DNA, 25 bp, Homo sapien
tgcttaaaggagttaaaacattgat

SEQ ID NO: 106889 - DNA, 25 bp, Homo sapien
tgcttaaatgccttgcctttcaatc

SEQ ID NO: 106890 - DNA, 25 bp, Homo sapien
tgcttaaatgccttgcttttcaatc

SEQ ID NO: 106891 - DNA, 25 bp, Homo sapien
tgcttaacatacaccctggaaagag

SEQ ID NO: 106892 - DNA, 25 bp, Homo sapien
tgcttaaccggagttctcaccattc

SEQ ID NO: 106893 - DNA, 25 bp, Homo sapien
tgcttaaccggcgttctcaccattc

SEQ ID NO: 106894 - DNA, 25 bp, Homo sapien
tgcttaacgtacaccctggaaagag

SEQ ID NO: 106895 - DNA, 25 bp, Homo sapien
tgcttaagaacattcctcttggttt

SEQ ID NO: 106896 - DNA, 25 bp, Homo sapien
tgcttaagattaaagactaggagtg

SEQ ID NO: 106897 - DNA, 25 bp, Homo sapien
tgcttaagattaaagattaggagtg

SEQ ID NO: 106898 - DNA, 25 bp, Homo sapien
tgcttaaggccataagtccgaaacc

SEQ ID NO: 106899 - DNA, 25 bp, Homo sapien
tgcttaaggccgtaagtccgaaacc

SEQ ID NO: 106900 - DNA, 25 bp, Homo sapien
tgcttaagtacattcctcttggttt

SEQ ID NO: 106901 - DNA, 25 bp, Homo sapien
tgcttaatccgtttgggctactaca

SEQ ID NO: 106902 - DNA, 25 bp, Homo sapien
tgcttaatctgtttgggctactaca

SEQ ID NO: 106903 - DNA, 25 bp, Homo sapien
tgcttacaacagtaaaagtcctgac

SEQ ID NO: 106904 - DNA, 25 bp, Homo sapien
tgcttacaatagtaaaagtcctgac

SEQ ID NO: 106905 - DNA, 25 bp, Homo sapien
tgcttaccgcacgattattttgagg

SEQ ID NO: 106906 - DNA, 25 bp, Homo sapien
tgcttaccgcatgattattttgagg

SEQ ID NO: 106907 - DNA, 25 bp, Homo sapien
tgcttacctctcctttacatcatta

SEQ ID NO: 106908 - DNA, 25 bp, Homo sapien
tgcttacctctgctttacatcatta

SEQ ID NO: 106909 - DNA, 25 bp, Homo sapien
tgcttactatgctcatgcagctaaa

SEQ ID NO: 106910 - DNA, 25 bp, Homo sapien
tgcttactatgttcatgcagctaaa

SEQ ID NO: 106911 - DNA, 25 bp, Homo sapien
tgcttagaaacctgagaactgcagg

SEQ ID NO: 106912 - DNA, 25 bp, Homo sapien
tgcttagaagcgtaaggtttatcca

SEQ ID NO: 106913 - DNA, 25 bp, Homo sapien
tgcttagaagcttaaggtttatcca

SEQ ID NO: 106914 - DNA, 25 bp, Homo sapien
tgcttagaatcctgagaactgcagg

SEQ ID NO: 106915 - DNA, 25 bp, Homo sapien
tgcttaggagaaaaggcaaatttat

SEQ ID NO: 106916 - DNA, 25 bp, Homo sapien
tgcttaggagaaagggcaaatttat

SEQ ID NO: 106917 - DNA, 25 bp, Homo sapien
tgcttaggatggtcttgcttgccaa

SEQ ID NO: 106918 - DNA, 25 bp, Homo sapien
tgcttaggatggttttgcttgccaa

SEQ ID NO: 106919 - DNA, 25 bp, Homo sapien
tgcttagggatttacgaggattatc

SEQ ID NO: 106920 - DNA, 25 bp, Homo sapien
tgcttagggatttatgaggattatc

SEQ ID NO: 106921 - DNA, 25 bp, Homo sapien
tgcttagtatcgttgtctcctatgg

SEQ ID NO: 106922 - DNA, 25 bp, Homo sapien
tgcttagtatctttgtctcctatgg

SEQ ID NO: 106923 - DNA, 25 bp, Homo sapien
tgcttagtcatcattagtgcatttc

SEQ ID NO: 106924 - DNA, 25 bp, Homo sapien
tgcttagtcctcattagtgcatttc

SEQ ID NO: 106925 - DNA, 25 bp, Homo sapien
tgcttagttttaactccacagaatt

SEQ ID NO: 106926 - DNA, 25 bp, Homo sapien
tgcttagttttatctccacagaatt

SEQ ID NO: 106927 - DNA, 25 bp, Homo sapien
tgcttataagagcacagtatttcgt

SEQ ID NO: 106928 - DNA, 25 bp, Homo sapien
tgcttataagagcatagtatttcgt

SEQ ID NO: 106929 - DNA, 25 bp, Homo sapien
tgcttatatacaagtaggcatgtcg

SEQ ID NO: 106930 - DNA, 25 bp, Homo sapien
tgcttatatacatgtaggcatgtcg

SEQ ID NO: 106931 - DNA, 25 bp, Homo sapien
tgcttatatcccaatggccagaaat

SEQ ID NO: 106932 - DNA, 25 bp, Homo sapien
tgcttatatcccattggccagaaat

SEQ ID NO: 106933 - DNA, 25 bp, Homo sapien
tgcttatccagcaacggatgatgtg

SEQ ID NO: 106934 - DNA, 25 bp, Homo sapien
tgcttatccagcaagggatgatgtg

SEQ ID NO: 106935 - DNA, 25 bp, Homo sapien
tgcttatctactgacactgttttca

SEQ ID NO: 106936 - DNA, 25 bp, Homo sapien
tgcttatctactgatactgttttca

SEQ ID NO: 106937 - DNA, 25 bp, Homo sapien
tgcttatgcatcactcatctaaaag

SEQ ID NO: 106938 - DNA, 25 bp, Homo sapien
tgcttatgcatcattcatctaaaag

SEQ ID NO: 106939 - DNA, 25 bp, Homo sapien
tgcttatgtgtcttcgtctttaaca

SEQ ID NO: 106940 - DNA, 25 bp, Homo sapien
tgcttatgtgtctttgtctttaaca

SEQ ID NO: 106941 - DNA, 25 bp, Homo sapien
tgcttattggtgcacggtagtatga

SEQ ID NO: 106942 - DNA, 25 bp, Homo sapien
tgcttattggtgtacggtagtatga

SEQ ID NO: 106943 - DNA, 25 bp, Homo sapien
tgcttatttgaatgttctctccctt

SEQ ID NO: 106944 - DNA, 25 bp, Homo sapien
tgcttatttgagtgttctctccctt

SEQ ID NO: 106945 - DNA, 25 bp, Homo sapien
tgcttcacaataacatcggtatgac

SEQ ID NO: 106946 - DNA, 25 bp, Homo sapien
tgcttcacaataacattggtatgac

SEQ ID NO: 106947 - DNA, 25 bp, Homo sapien
tgcttcacactagttattggactat

SEQ ID NO: 106948 - DNA, 25 bp, Homo sapien
tgcttcacactatttattggactat

SEQ ID NO: 106949 - DNA, 25 bp, Homo sapien
tgcttcaccatcaattaatgttgtg

SEQ ID NO: 106950 - DNA, 25 bp, Homo sapien
tgcttcaccgtcaattaatgttgtg

SEQ ID NO: 106951 - DNA, 25 bp, Homo sapien
tgcttcaccttccgagaaatgctcg

SEQ ID NO: 106952 - DNA, 25 bp, Homo sapien
tgcttcaccttctgagaaatgctcg

SEQ ID NO: 106953 - DNA, 25 bp, Homo sapien
tgcttcactccaatttctacctcca

SEQ ID NO: 106954 - DNA, 25 bp, Homo sapien
tgcttcactccagtttctacctcca

SEQ ID NO: 106955 - DNA, 25 bp, Homo sapien
tgcttcaggcattaatcgaaagttt

SEQ ID NO: 106956 - DNA, 25 bp, Homo sapien
tgcttcaggcattaattgaaagttt

SEQ ID NO: 106957 - DNA, 25 bp, Homo sapien
tgcttcatgtggcactgttatgcta

SEQ ID NO: 106958 - DNA, 25 bp, Homo sapien
tgcttcatgtggcacttttatgcta

SEQ ID NO: 106959 - DNA, 25 bp, Homo sapien
tgcttccaatatctctagtacatga

SEQ ID NO: 106960 - DNA, 25 bp, Homo sapien
tgcttccaatatttctagtacatga

SEQ ID NO: 106961 - DNA, 25 bp, Homo sapien
tgcttccataatgcaggaagaaacc

SEQ ID NO: 106962 - DNA, 25 bp, Homo sapien
tgcttccataattcaggaagaaacc

SEQ ID NO: 106963 - DNA, 25 bp, Homo sapien
tgcttccatccatcaacccatttgc

SEQ ID NO: 106964 - DNA, 25 bp, Homo sapien
tgcttccatccgtcaacccatttgc

SEQ ID NO: 106965 - DNA, 25 bp, Homo sapien
tgcttccctttttcgtcagattaat

SEQ ID NO: 106966 - DNA, 25 bp, Homo sapien
tgcttccctttttcttcagattaat

SEQ ID NO: 106967 - DNA, 25 bp, Homo sapien
tgcttccgaaaggattcttacttga

SEQ ID NO: 106968 - DNA, 25 bp, Homo sapien
tgcttccgcaaggattcttacttga

SEQ ID NO: 106969 - DNA, 25 bp, Homo sapien
tgcttcctaaatatgctctgtaaaa

SEQ ID NO: 106970 - DNA, 25 bp, Homo sapien
tgcttcctaaatgtgctctgtaaaa

SEQ ID NO: 106971 - DNA, 25 bp, Homo sapien
tgcttcctggaggctggtattgtcc

SEQ ID NO: 106972 - DNA, 25 bp, Homo sapien
tgcttcctggagtctggtattgtcc

SEQ ID NO: 106973 - DNA, 25 bp, Homo sapien
tgcttcgagtttgactttgaaatgt

SEQ ID NO: 106974 - DNA, 25 bp, Homo sapien
tgcttcgagttttactttgaaatgt

SEQ ID NO: 106975 - DNA, 25 bp, Homo sapien
tgcttctatcacaacctgcagaggg

SEQ ID NO: 106976 - DNA, 25 bp, Homo sapien
tgcttctatcacgacctgcagaggg

SEQ ID NO: 106977 - DNA, 25 bp, Homo sapien
tgcttctattttgagccttttttga

SEQ ID NO: 106978 - DNA, 25 bp, Homo sapien
tgcttctattttgagcgttttttga

SEQ ID NO: 106979 - DNA, 25 bp, Homo sapien
tgcttctcatgaaagactccaacaa

SEQ ID NO: 106980 - DNA, 25 bp, Homo sapien
tgcttctcatgaaagattccaacaa

SEQ ID NO: 106981 - DNA, 25 bp, Homo sapien
tgcttctccctgaaaaaaagcaaga

SEQ ID NO: 106982 - DNA, 25 bp, Homo sapien
tgcttctccctgcaaaaaagcaaga

SEQ ID NO: 106983 - DNA, 25 bp, Homo sapien
tgcttctgagccataacatcctttc

SEQ ID NO: 106984 - DNA, 25 bp, Homo sapien
tgcttctgagccataatatcctttc

SEQ ID NO: 106985 - DNA, 25 bp, Homo sapien
tgcttctgagttagacacacttggt

SEQ ID NO: 106986 - DNA, 25 bp, Homo sapien
tgcttctgcttaagaacattcctct

SEQ ID NO: 106987 - DNA, 25 bp, Homo sapien
tgcttctgcttaagtacattcctct

SEQ ID NO: 106988 - DNA, 25 bp, Homo sapien
tgcttctgcttgacaaacatgcttt

SEQ ID NO: 106989 - DNA, 25 bp, Homo sapien
tgcttctgcttgaccaacatgcttt

SEQ ID NO: 106990 - DNA, 25 bp, Homo sapien
tgcttctgggttagacacacttggt

SEQ ID NO: 106991 - DNA, 25 bp, Homo sapien
tgcttctgtacagcattatttatca

SEQ ID NO: 106992 - DNA, 25 bp, Homo sapien
tgcttctgtacagcgttatttatca

SEQ ID NO: 106993 - DNA, 25 bp, Homo sapien
tgcttctgttttcccacctgccatt

SEQ ID NO: 106994 - DNA, 25 bp, Homo sapien
tgcttctgtttttccacctgccatt

SEQ ID NO: 106995 - DNA, 25 bp, Homo sapien
tgcttcttactgatcatgtgaccac

SEQ ID NO: 106996 - DNA, 25 bp, Homo sapien
tgcttcttattgatcatgtgaccac

SEQ ID NO: 106997 - DNA, 25 bp, Homo sapien
tgcttcttcatagcatggtaagaag

SEQ ID NO: 106998 - DNA, 25 bp, Homo sapien
tgcttcttcatatcatggtaagaag

SEQ ID NO: 106999 - DNA, 25 bp, Homo sapien
tgcttcttcctagccaatctcctgt

SEQ ID NO: 107000 - DNA, 25 bp, Homo sapien
tgcttcttcctagtcaatctcctgt

SEQ ID NO: 107001 - DNA, 25 bp, Homo sapien
tgcttcttgttgggcttaatgtttg

SEQ ID NO: 107002 - DNA, 25 bp, Homo sapien
tgcttctttggtattatcagagctt

SEQ ID NO: 107003 - DNA, 25 bp, Homo sapien
tgcttctttggtgttatcagagctt

SEQ ID NO: 107004 - DNA, 25 bp, Homo sapien
tgcttctttttgggcttaatgtttg

SEQ ID NO: 107005 - DNA, 25 bp, Homo sapien
tgcttgaaggcaaggatgatgccta

SEQ ID NO: 107006 - DNA, 25 bp, Homo sapien
tgcttgaaggcagggatgatgccta

SEQ ID NO: 107007 - DNA, 25 bp, Homo sapien
tgcttgaattcttcaaaataagtac

SEQ ID NO: 107008 - DNA, 25 bp, Homo sapien
tgcttgaattctttaaaataagtac

SEQ ID NO: 107009 - DNA, 25 bp, Homo sapien
tgcttgacaacatgctttcccaggg

SEQ ID NO: 107010 - DNA, 25 bp, Homo sapien
tgcttgacaacgtgctttcccaggg

SEQ ID NO: 107011 - DNA, 25 bp, Homo sapien
tgcttgacctatgttttttgcattt

SEQ ID NO: 107012 - DNA, 25 bp, Homo sapien
tgcttgacttatgttttttgcattt

SEQ ID NO: 107013 - DNA, 25 bp, Homo sapien
tgcttgatattcatgaacatttcac

SEQ ID NO: 107014 - DNA, 25 bp, Homo sapien
tgcttgatattcgtgaacatttcac

SEQ ID NO: 107015 - DNA, 25 bp, Homo sapien
tgcttgcatagagccacgtccagca

SEQ ID NO: 107016 - DNA, 25 bp, Homo sapien
tgcttgcatagagccatgtccagca

SEQ ID NO: 107017 - DNA, 25 bp, Homo sapien
tgcttgccagatagcatctagtctt

SEQ ID NO: 107018 - DNA, 25 bp, Homo sapien
tgcttgccatatagcatctagtctt

SEQ ID NO: 107019 - DNA, 25 bp, Homo sapien
tgcttgctacaattcaacaccattc

SEQ ID NO: 107020 - DNA, 25 bp, Homo sapien
tgcttgctacagttcaacaccattc

SEQ ID NO: 107021 - DNA, 25 bp, Homo sapien
tgcttgctgttacgtccaaggcatc

SEQ ID NO: 107022 - DNA, 25 bp, Homo sapien
tgcttgctgttatgtccaaggcatc

SEQ ID NO: 107023 - DNA, 25 bp, Homo sapien
tgcttgcttaggattttcatattga

SEQ ID NO: 107024 - DNA, 25 bp, Homo sapien
tgcttgcttcaactattaatagtga

SEQ ID NO: 107025 - DNA, 25 bp, Homo sapien
tgcttgcttgggattttcatattga

SEQ ID NO: 107026 - DNA, 25 bp, Homo sapien
tgcttgctttaactattaatagtga

SEQ ID NO: 107027 - DNA, 25 bp, Homo sapien
tgcttggaaacactataggaacagg

SEQ ID NO: 107028 - DNA, 25 bp, Homo sapien
tgcttggaaacagtataggaacagg

SEQ ID NO: 107029 - DNA, 25 bp, Homo sapien
tgcttggagatgatgatgaccttga

SEQ ID NO: 107030 - DNA, 25 bp, Homo sapien
tgcttggagatggtgatgaccttga

SEQ ID NO: 107031 - DNA, 25 bp, Homo sapien
tgcttggtacatttcatttggcata

SEQ ID NO: 107032 - DNA, 25 bp, Homo sapien
tgcttggtgtcctccttccctgtcc

SEQ ID NO: 107033 - DNA, 25 bp, Homo sapien
tgcttggtgtcctctttccctgtcc

SEQ ID NO: 107034 - DNA, 25 bp, Homo sapien
tgcttggttcatttcatttggcata

SEQ ID NO: 107035 - DNA, 25 bp, Homo sapien
tgcttgtcaattctgcctttaattt

SEQ ID NO: 107036 - DNA, 25 bp, Homo sapien
tgcttgtcagttctgcctttaattt

SEQ ID NO: 107037 - DNA, 25 bp, Homo sapien
tgcttgttgcaataagataaccaat

SEQ ID NO: 107038 - DNA, 25 bp, Homo sapien
tgcttgttgcaatcagataaccaat

SEQ ID NO: 107039 - DNA, 25 bp, Homo sapien
tgcttgttgcttagacaatgcctag

SEQ ID NO: 107040 - DNA, 25 bp, Homo sapien
tgcttgttgcttagaccatgcctag

SEQ ID NO: 107041 - DNA, 25 bp, Homo sapien
tgcttgtttcttaaatgggttgctt

SEQ ID NO: 107042 - DNA, 25 bp, Homo sapien
tgcttgtttcttaattgggttgctt

SEQ ID NO: 107043 - DNA, 25 bp, Homo sapien
tgctttaaaaaaagaaagacggcga

SEQ ID NO: 107044 - DNA, 25 bp, Homo sapien
tgctttaaaaaaggaaagacggcga

SEQ ID NO: 107045 - DNA, 25 bp, Homo sapien
tgctttaagttataatatccctaag

SEQ ID NO: 107046 - DNA, 25 bp, Homo sapien
tgctttaagttataatttccctaag

SEQ ID NO: 107047 - DNA, 25 bp, Homo sapien
tgctttaagttcagctctcaaaatc

SEQ ID NO: 107048 - DNA, 25 bp, Homo sapien
tgctttaagttcggctctcaaaatc

SEQ ID NO: 107049 - DNA, 25 bp, Homo sapien
tgctttacagtaaagagtgtccatc

SEQ ID NO: 107050 - DNA, 25 bp, Homo sapien
tgctttacagtagagagtgtccatc

SEQ ID NO: 107051 - DNA, 25 bp, Homo sapien
tgctttacctgattctcaaatgaca

SEQ ID NO: 107052 - DNA, 25 bp, Homo sapien
tgctttacctgcttctcaaatgaca

SEQ ID NO: 107053 - DNA, 25 bp, Homo sapien
tgctttactctaatacatagctgta

SEQ ID NO: 107054 - DNA, 25 bp, Homo sapien
tgctttactctaatacgtagctgta

SEQ ID NO: 107055 - DNA, 25 bp, Homo sapien
tgctttagaattcatttggctccct

SEQ ID NO: 107056 - DNA, 25 bp, Homo sapien
tgctttagaattcgtttggctccct

SEQ ID NO: 107057 - DNA, 25 bp, Homo sapien
tgctttagctcaacgtgggatgaat

SEQ ID NO: 107058 - DNA, 25 bp, Homo sapien
tgctttagctcaacgttggatgaat

SEQ ID NO: 107059 - DNA, 25 bp, Homo sapien
tgctttatctccaatgtcactttta

SEQ ID NO: 107060 - DNA, 25 bp, Homo sapien
tgctttatctcccatgtcactttta

SEQ ID NO: 107061 - DNA, 25 bp, Homo sapien
tgctttatctcttgcgagtacgatt

SEQ ID NO: 107062 - DNA, 25 bp, Homo sapien
tgctttatctcttgggagtacgatt

SEQ ID NO: 107063 - DNA, 25 bp, Homo sapien
tgctttattcaaacgactggttggg

SEQ ID NO: 107064 - DNA, 25 bp, Homo sapien
tgctttattcaaatgactggttggg

SEQ ID NO: 107065 - DNA, 25 bp, Homo sapien
tgctttcaaagtaaaacactgatat

SEQ ID NO: 107066 - DNA, 25 bp, Homo sapien
tgctttcaaagtaatacactgatat

SEQ ID NO: 107067 - DNA, 25 bp, Homo sapien
tgctttcagagctgcatttacctcc

SEQ ID NO: 107068 - DNA, 25 bp, Homo sapien
tgctttcagagcttcatttacctcc

SEQ ID NO: 107069 - DNA, 25 bp, Homo sapien
tgctttcagttactttggataaata

SEQ ID NO: 107070 - DNA, 25 bp, Homo sapien
tgctttcagttattttggataaata

SEQ ID NO: 107071 - DNA, 25 bp, Homo sapien
tgctttccctgcacaatccaggtcc

SEQ ID NO: 107072 - DNA, 25 bp, Homo sapien
tgctttccctgcacgatccaggtcc

SEQ ID NO: 107073 - DNA, 25 bp, Homo sapien
tgctttcctgaaatcaatcagaagc

SEQ ID NO: 107074 - DNA, 25 bp, Homo sapien
tgctttcctgaagtcaatcagaagc

SEQ ID NO: 107075 - DNA, 25 bp, Homo sapien
tgctttcctgtaccagacacctctg

SEQ ID NO: 107076 - DNA, 25 bp, Homo sapien
tgctttcctttaccagacacctctg

SEQ ID NO: 107077 - DNA, 25 bp, Homo sapien
tgctttctatgtacctgctgaggac

SEQ ID NO: 107078 - DNA, 25 bp, Homo sapien
tgctttctcacagtaaatcaagtcc

SEQ ID NO: 107079 - DNA, 25 bp, Homo sapien
tgctttctcacggtaaatcaagtcc

SEQ ID NO: 107080 - DNA, 25 bp, Homo sapien
tgctttctccaatatgaaaggtgtg

SEQ ID NO: 107081 - DNA, 25 bp, Homo sapien
tgctttctccaatctgaaaggtgtg

SEQ ID NO: 107082 - DNA, 25 bp, Homo sapien
tgctttctgctctatctttaggttt

SEQ ID NO: 107083 - DNA, 25 bp, Homo sapien
tgctttctggtctatctttaggttt

SEQ ID NO: 107084 - DNA, 25 bp, Homo sapien
tgctttctgtgtacctgctgaggac

SEQ ID NO: 107085 - DNA, 25 bp, Homo sapien
tgctttctttctacgccctgaagat

SEQ ID NO: 107086 - DNA, 25 bp, Homo sapien
tgctttctttctatgccctgaagat

SEQ ID NO: 107087 - DNA, 25 bp, Homo sapien
tgctttgaaattatttatccctctt

SEQ ID NO: 107088 - DNA, 25 bp, Homo sapien
tgctttgaagttatttatccctctt

SEQ ID NO: 107089 - DNA, 25 bp, Homo sapien
tgctttgactaacagaatatcataa

SEQ ID NO: 107090 - DNA, 25 bp, Homo sapien
tgctttgactaatagaatatcataa

SEQ ID NO: 107091 - DNA, 25 bp, Homo sapien
tgctttgatcgatgcggttgttctt

SEQ ID NO: 107092 - DNA, 25 bp, Homo sapien
tgctttgatcgatgtggttgttctt

SEQ ID NO: 107093 - DNA, 25 bp, Homo sapien
tgctttgctctctctgcctttaaca

SEQ ID NO: 107094 - DNA, 25 bp, Homo sapien
tgctttgctgtctctgcctttaaca

SEQ ID NO: 107095 - DNA, 25 bp, Homo sapien
tgctttgctttttctactagcatag

SEQ ID NO: 107096 - DNA, 25 bp, Homo sapien
tgctttgctttttgtactagcatag

SEQ ID NO: 107097 - DNA, 25 bp, Homo sapien
tgctttggaaataaggtgtacactg

SEQ ID NO: 107098 - DNA, 25 bp, Homo sapien
tgctttggaaatagggtgtacactg

SEQ ID NO: 107099 - DNA, 25 bp, Homo sapien
tgctttggagtggcgaggttaaagt

SEQ ID NO: 107100 - DNA, 25 bp, Homo sapien
tgctttggagtggtgaggttaaagt

SEQ ID NO: 107101 - DNA, 25 bp, Homo sapien
tgctttggatatttggattccagtc

SEQ ID NO: 107102 - DNA, 25 bp, Homo sapien
tgctttggatatttgggttccagtc

SEQ ID NO: 107103 - DNA, 25 bp, Homo sapien
tgctttgtctttggacattttcacc

SEQ ID NO: 107104 - DNA, 25 bp, Homo sapien
tgctttgtctttggacgttttcacc

SEQ ID NO: 107105 - DNA, 25 bp, Homo sapien
tgctttgtggctacaaactgaagaa

SEQ ID NO: 107106 - DNA, 25 bp, Homo sapien
tgctttgtggctgcaaactgaagaa

SEQ ID NO: 107107 - DNA, 25 bp, Homo sapien
tgctttgtgttttcagttgttattt

SEQ ID NO: 107108 - DNA, 25 bp, Homo sapien
tgctttgtgtttttagttgttattt

SEQ ID NO: 107109 - DNA, 25 bp, Homo sapien
tgcttttatttttaagaagatcaaa

SEQ ID NO: 107110 - DNA, 25 bp, Homo sapien
tgcttttatttttgagaagatcaaa

SEQ ID NO: 107111 - DNA, 25 bp, Homo sapien
tgcttttcagtttaatagctgagaa

SEQ ID NO: 107112 - DNA, 25 bp, Homo sapien
tgcttttcagtttaatggctgagaa

SEQ ID NO: 107113 - DNA, 25 bp, Homo sapien
tgcttttcctagagcccgtgagccg

SEQ ID NO: 107114 - DNA, 25 bp, Homo sapien
tgcttttcctagagcctgtgagccg

SEQ ID NO: 107115 - DNA, 25 bp, Homo sapien
tgcttttccttaatttcctcactgc

SEQ ID NO: 107116 - DNA, 25 bp, Homo sapien
tgcttttccttaattttctcactgc

SEQ ID NO: 107117 - DNA, 25 bp, Homo sapien
tgcttttctgttacatctatctgta

SEQ ID NO: 107118 - DNA, 25 bp, Homo sapien
tgcttttctgttgcatctatctgta

SEQ ID NO: 107119 - DNA, 25 bp, Homo sapien
tgctttttaaactttggaaaatata

SEQ ID NO: 107120 - DNA, 25 bp, Homo sapien
tgctttttaaagtttggaaaatata

SEQ ID NO: 107121 - DNA, 25 bp, Homo sapien
tgctttttatcctcttgttcttcca

SEQ ID NO: 107122 - DNA, 25 bp, Homo sapien
tgctttttatcctctttttcttcca

SEQ ID NO: 107123 - DNA, 25 bp, Homo sapien
tgctttttatgccttgacctttgta

SEQ ID NO: 107124 - DNA, 25 bp, Homo sapien
tgctttttatgcgttgacctttgta

SEQ ID NO: 107125 - DNA, 25 bp, Homo sapien
tgctttttctactagcatagagagc

SEQ ID NO: 107126 - DNA, 25 bp, Homo sapien
tgctttttgtactagcatagagagc

SEQ ID NO: 107127 - DNA, 25 bp, Homo sapien
tggaaaaaagtgagtgagctataat

SEQ ID NO: 107128 - DNA, 25 bp, Homo sapien
tggaaaaaagttagtgagctataat

SEQ ID NO: 107129 - DNA, 25 bp, Homo sapien
tggaaaaagcagactcgcagcacaa

SEQ ID NO: 107130 - DNA, 25 bp, Homo sapien
tggaaaaagcaggctcgcagcacaa

SEQ ID NO: 107131 - DNA, 25 bp, Homo sapien
tggaaaaagggcctgacaaatgatg

SEQ ID NO: 107132 - DNA, 25 bp, Homo sapien
tggaaaaagggcttgacaaatgatg

SEQ ID NO: 107133 - DNA, 25 bp, Homo sapien
tggaaaactagccattaattttaga

SEQ ID NO: 107134 - DNA, 25 bp, Homo sapien
tggaaaactagccattgattttaga

SEQ ID NO: 107135 - DNA, 25 bp, Homo sapien
tggaaaactcaaaacatccacgggt

SEQ ID NO: 107136 - DNA, 25 bp, Homo sapien
tggaaaactcaaagcatccacgggt

SEQ ID NO: 107137 - DNA, 25 bp, Homo sapien
tggaaaagcgttgggccagccgttc

SEQ ID NO: 107138 - DNA, 25 bp, Homo sapien
tggaaaaggcctgccagtagagcaa

SEQ ID NO: 107139 - DNA, 25 bp, Homo sapien
tggaaaaggcctgtcagtagagcaa

SEQ ID NO: 107140 - DNA, 25 bp, Homo sapien
tggaaaagtacaaaagaaaagagag

SEQ ID NO: 107141 - DNA, 25 bp, Homo sapien
tggaaaagtacaaaaggaaagagag

SEQ ID NO: 107142 - DNA, 25 bp, Homo sapien
tggaaaagtgttgggccagccgttc

SEQ ID NO: 107143 - DNA, 25 bp, Homo sapien
tggaaaatatgccgtgactagtcac

SEQ ID NO: 107144 - DNA, 25 bp, Homo sapien
tggaaaatatgctgtgactagtcac

SEQ ID NO: 107145 - DNA, 25 bp, Homo sapien
tggaaaatgaaagcaagatgtcctt

SEQ ID NO: 107146 - DNA, 25 bp, Homo sapien
tggaaaatgataccctacatacaaa

SEQ ID NO: 107147 - DNA, 25 bp, Homo sapien
tggaaaatgatactctacatacaaa

SEQ ID NO: 107148 - DNA, 25 bp, Homo sapien
tggaaaatgatcgtttaaatttagt

SEQ ID NO: 107149 - DNA, 25 bp, Homo sapien
tggaaaatgattgtttaaatttagt

SEQ ID NO: 107150 - DNA, 25 bp, Homo sapien
tggaaaatgcaactggcatactgaa

SEQ ID NO: 107151 - DNA, 25 bp, Homo sapien
tggaaaatgcctaggagtgaacagg

SEQ ID NO: 107152 - DNA, 25 bp, Homo sapien
tggaaaatgcctatgagtgaacagg

SEQ ID NO: 107153 - DNA, 25 bp, Homo sapien
tggaaaatggaagcaagatgtcctt

SEQ ID NO: 107154 - DNA, 25 bp, Homo sapien
tggaaaatgtaactggcatactgaa

SEQ ID NO: 107155 - DNA, 25 bp, Homo sapien
tggaaaatgtcaaatccaaaggaat

SEQ ID NO: 107156 - DNA, 25 bp, Homo sapien
tggaaaatgtcacatccaaaggaat

SEQ ID NO: 107157 - DNA, 25 bp, Homo sapien
tggaaacactataggaacaggtcca

SEQ ID NO: 107158 - DNA, 25 bp, Homo sapien
tggaaacagtataggaacaggtcca

SEQ ID NO: 107159 - DNA, 25 bp, Homo sapien
tggaaacagtcctcaatacccaata

SEQ ID NO: 107160 - DNA, 25 bp, Homo sapien
tggaaacagtcctgaatacccaata

SEQ ID NO: 107161 - DNA, 25 bp, Homo sapien
tggaaaccactataatagctctaag

SEQ ID NO: 107162 - DNA, 25 bp, Homo sapien
tggaaaccactctaatagctctaag

SEQ ID NO: 107163 - DNA, 25 bp, Homo sapien
tggaaaccatgacatacactaaaga

SEQ ID NO: 107164 - DNA, 25 bp, Homo sapien
tggaaaccctttacagaagagcctt

SEQ ID NO: 107165 - DNA, 25 bp, Homo sapien
tggaaaccctttagagaagagcctt

SEQ ID NO: 107166 - DNA, 25 bp, Homo sapien
tggaaaccgtgacatacactaaaga

SEQ ID NO: 107167 - DNA, 25 bp, Homo sapien
tggaaacgattactagttagtattg

SEQ ID NO: 107168 - DNA, 25 bp, Homo sapien
tggaaacggttactagttagtattg

SEQ ID NO: 107169 - DNA, 25 bp, Homo sapien
tggaaactaatatctttgaacatct

SEQ ID NO: 107170 - DNA, 25 bp, Homo sapien
tggaaactacagaaaattggactcc

SEQ ID NO: 107171 - DNA, 25 bp, Homo sapien
tggaaactacagagaattggactcc

SEQ ID NO: 107172 - DNA, 25 bp, Homo sapien
tggaaactagtatctttgaacatct

SEQ ID NO: 107173 - DNA, 25 bp, Homo sapien
tggaaactcttccctttggagcagc

SEQ ID NO: 107174 - DNA, 25 bp, Homo sapien
tggaaactcttcgctttggagcagc

SEQ ID NO: 107175 - DNA, 25 bp, Homo sapien
tggaaactttttctgcgcagctcat

SEQ ID NO: 107176 - DNA, 25 bp, Homo sapien
tggaaactttttctgctcagctcat

SEQ ID NO: 107177 - DNA, 25 bp, Homo sapien
tggaaagaactgattacctgaagga

SEQ ID NO: 107178 - DNA, 25 bp, Homo sapien
tggaaagaattgattacctgaagga

SEQ ID NO: 107179 - DNA, 25 bp, Homo sapien
tggaaagacatcagaaataccaaga

SEQ ID NO: 107180 - DNA, 25 bp, Homo sapien
tggaaagacatcggaaataccaaga

SEQ ID NO: 107181 - DNA, 25 bp, Homo sapien
tggaaagacattccatgaacaagga

SEQ ID NO: 107182 - DNA, 25 bp, Homo sapien
tggaaagacatttcatgaacaagga

SEQ ID NO: 107183 - DNA, 25 bp, Homo sapien
tggaaagactagacttgctgagtct

SEQ ID NO: 107184 - DNA, 25 bp, Homo sapien
tggaaagactaggcttgctgagtct

SEQ ID NO: 107185 - DNA, 25 bp, Homo sapien
tggaaagatatatatgcatctttgt

SEQ ID NO: 107186 - DNA, 25 bp, Homo sapien
tggaaagatatgtatgcatctttgt

SEQ ID NO: 107187 - DNA, 25 bp, Homo sapien
tggaaagcagtaatggaaataaaga

SEQ ID NO: 107188 - DNA, 25 bp, Homo sapien
tggaaagcagtaattgaaataaaga

SEQ ID NO: 107189 - DNA, 25 bp, Homo sapien
tggaaagccagatgggagtgactgg

SEQ ID NO: 107190 - DNA, 25 bp, Homo sapien
tggaaagccaggtgggagtgactgg

SEQ ID NO: 107191 - DNA, 25 bp, Homo sapien
tggaaagctctatagaaagtaaaat

SEQ ID NO: 107192 - DNA, 25 bp, Homo sapien
tggaaagctctatagagagtaaaat

SEQ ID NO: 107193 - DNA, 25 bp, Homo sapien
tggaaagtgatgtcttgactggaaa

SEQ ID NO: 107194 - DNA, 25 bp, Homo sapien
tggaaagtggtgtcttgactggaaa

SEQ ID NO: 107195 - DNA, 25 bp, Homo sapien
tggaaataacggccagcataggtga

SEQ ID NO: 107196 - DNA, 25 bp, Homo sapien
tggaaataaggtgtacactgtttag

SEQ ID NO: 107197 - DNA, 25 bp, Homo sapien
tggaaataatggccagcataggtga

SEQ ID NO: 107198 - DNA, 25 bp, Homo sapien
tggaaatacagaattctatccaacc

SEQ ID NO: 107199 - DNA, 25 bp, Homo sapien
tggaaatactgaattctatccaacc

SEQ ID NO: 107200 - DNA, 25 bp, Homo sapien
tggaaatagattcttggagacacag

SEQ ID NO: 107201 - DNA, 25 bp, Homo sapien
tggaaatagcaaacaaacaacaatg

SEQ ID NO: 107202 - DNA, 25 bp, Homo sapien
tggaaatagggtgtacactgtttag

SEQ ID NO: 107203 - DNA, 25 bp, Homo sapien
tggaaataggttcttggagacacag

SEQ ID NO: 107204 - DNA, 25 bp, Homo sapien
tggaaatataggaaaacaactaagg

SEQ ID NO: 107205 - DNA, 25 bp, Homo sapien
tggaaatataggaagacaactaagg

SEQ ID NO: 107206 - DNA, 25 bp, Homo sapien
tggaaatatcaaacaaacaacaatg

SEQ ID NO: 107207 - DNA, 25 bp, Homo sapien
tggaaatcactgcagttttctccat

SEQ ID NO: 107208 - DNA, 25 bp, Homo sapien
tggaaatcactgccgttttctccat

SEQ ID NO: 107209 - DNA, 25 bp, Homo sapien
tggaaatctacatgccactgtcaca

SEQ ID NO: 107210 - DNA, 25 bp, Homo sapien
tggaaatctacctgccactgtcaca

SEQ ID NO: 107211 - DNA, 25 bp, Homo sapien
tggaaatctatcctatggtctactt

SEQ ID NO: 107212 - DNA, 25 bp, Homo sapien
tggaaatctatgctatggtctactt

SEQ ID NO: 107213 - DNA, 25 bp, Homo sapien
tggaaatctgtacctgcattatact

SEQ ID NO: 107214 - DNA, 25 bp, Homo sapien
tggaaatctgtacttgcattatact

SEQ ID NO: 107215 - DNA, 25 bp, Homo sapien
tggaaatgagtaggtactgctaaaa

SEQ ID NO: 107216 - DNA, 25 bp, Homo sapien
tggaaatgagtgggtactgctaaaa

SEQ ID NO: 107217 - DNA, 25 bp, Homo sapien
tggaaatggaatagaatagaaggct

SEQ ID NO: 107218 - DNA, 25 bp, Homo sapien
tggaaatgggatagaatagaaggct

SEQ ID NO: 107219 - DNA, 25 bp, Homo sapien
tggaaatgtgccaagtcacacctga

SEQ ID NO: 107220 - DNA, 25 bp, Homo sapien
tggaaatgtgccgagtcacacctga

SEQ ID NO: 107221 - DNA, 25 bp, Homo sapien
tggaaatgttcgctgtctgcactgt

SEQ ID NO: 107222 - DNA, 25 bp, Homo sapien
tggaaatgttcgttgtctgcactgt

SEQ ID NO: 107223 - DNA, 25 bp, Homo sapien
tggaaattacgggtagaaattgaga

SEQ ID NO: 107224 - DNA, 25 bp, Homo sapien
tggaaattatgggtagaaattgaga

SEQ ID NO: 107225 - DNA, 25 bp, Homo sapien
tggaaattatgttttactcattttt

SEQ ID NO: 107226 - DNA, 25 bp, Homo sapien
tggaaattgtgttttactcattttt

SEQ ID NO: 107227 - DNA, 25 bp, Homo sapien
tggaaattttgctgtgagaatgtca

SEQ ID NO: 107228 - DNA, 25 bp, Homo sapien
tggaaattttggtgtgagaatgtca

SEQ ID NO: 107229 - DNA, 25 bp, Homo sapien
tggaacaagcagatgatgttgtgag

SEQ ID NO: 107230 - DNA, 25 bp, Homo sapien
tggaacaagcagctgatgttgtgag

SEQ ID NO: 107231 - DNA, 25 bp, Homo sapien
tggaacaatgttcaagattaaatac

SEQ ID NO: 107232 - DNA, 25 bp, Homo sapien
tggaacaatgtttaagattaaatac

SEQ ID NO: 107233 - DNA, 25 bp, Homo sapien
tggaacacaatctaactgttgctta

SEQ ID NO: 107234 - DNA, 25 bp, Homo sapien
tggaacacgatctaactgttgctta

SEQ ID NO: 107235 - DNA, 25 bp, Homo sapien
tggaacactttggaacactgtggaa

SEQ ID NO: 107236 - DNA, 25 bp, Homo sapien
tggaacactttggaactctgtggaa

SEQ ID NO: 107237 - DNA, 25 bp, Homo sapien
tggaacatcagatgaaacaatgtgt

SEQ ID NO: 107238 - DNA, 25 bp, Homo sapien
tggaacatcggatgaaacaatgtgt

SEQ ID NO: 107239 - DNA, 25 bp, Homo sapien
tggaaccacacaaaaagcttagcaa

SEQ ID NO: 107240 - DNA, 25 bp, Homo sapien
tggaaccacacgaaaagcttagcaa

SEQ ID NO: 107241 - DNA, 25 bp, Homo sapien
tggaaccatttttgagtgtgacttc

SEQ ID NO: 107242 - DNA, 25 bp, Homo sapien
tggaaccattttttagtgtgacttc

SEQ ID NO: 107243 - DNA, 25 bp, Homo sapien
tggaacccatgctgtggtatcaatt

SEQ ID NO: 107244 - DNA, 25 bp, Homo sapien
tggaacccgtgctgtggtatcaatt

SEQ ID NO: 107245 - DNA, 25 bp, Homo sapien
tggaacccttgcacagtgttagtgg

SEQ ID NO: 107246 - DNA, 25 bp, Homo sapien
tggaacccttgcatagtgttagtgg

SEQ ID NO: 107247 - DNA, 25 bp, Homo sapien
tggaacctaagataactcaataatc

SEQ ID NO: 107248 - DNA, 25 bp, Homo sapien
tggaacctaagatgactcaataatc

SEQ ID NO: 107249 - DNA, 25 bp, Homo sapien
tggaactgataatttgaacaagaca

SEQ ID NO: 107250 - DNA, 25 bp, Homo sapien
tggaactgatattttgaacaagaca

SEQ ID NO: 107251 - DNA, 25 bp, Homo sapien
tggaactgggcatccgtttctccat

SEQ ID NO: 107252 - DNA, 25 bp, Homo sapien
tggaactgggcatctgtttctccat

SEQ ID NO: 107253 - DNA, 25 bp, Homo sapien
tggaactgtgtcctgctatgcctga

SEQ ID NO: 107254 - DNA, 25 bp, Homo sapien
tggaactgtgtcttgctatgcctga

SEQ ID NO: 107255 - DNA, 25 bp, Homo sapien
tggaacttgttcttattagactctc

SEQ ID NO: 107256 - DNA, 25 bp, Homo sapien
tggaactttttcttattagactctc

SEQ ID NO: 107257 - DNA, 25 bp, Homo sapien
tggaagaaatctattattaagtaca

SEQ ID NO: 107258 - DNA, 25 bp, Homo sapien
tggaagaactgtagaggcagcaaag

SEQ ID NO: 107259 - DNA, 25 bp, Homo sapien
tggaagaactgtagcggcagcaaag

SEQ ID NO: 107260 - DNA, 25 bp, Homo sapien
tggaagaagagcagcctacacttag

SEQ ID NO: 107261 - DNA, 25 bp, Homo sapien
tggaagaagagcggcctacacttag

SEQ ID NO: 107262 - DNA, 25 bp, Homo sapien
tggaagaagtctattattaagtaca

SEQ ID NO: 107263 - DNA, 25 bp, Homo sapien
tggaagacaatctgacactttctta

SEQ ID NO: 107264 - DNA, 25 bp, Homo sapien
tggaagacaatttgacactttctta

SEQ ID NO: 107265 - DNA, 25 bp, Homo sapien
tggaagacactgaaatgaatttttc

SEQ ID NO: 107266 - DNA, 25 bp, Homo sapien
tggaagacgctgaaatgaatttttc

SEQ ID NO: 107267 - DNA, 25 bp, Homo sapien
tggaagacggctacgtaacggaaac

SEQ ID NO: 107268 - DNA, 25 bp, Homo sapien
tggaagacggctacgtgacggaaac

SEQ ID NO: 107269 - DNA, 25 bp, Homo sapien
tggaagagagccgttttctacctac

SEQ ID NO: 107270 - DNA, 25 bp, Homo sapien
tggaagagagctgttttctacctac

SEQ ID NO: 107271 - DNA, 25 bp, Homo sapien
tggaagaggaaacgatgctgaagac

SEQ ID NO: 107272 - DNA, 25 bp, Homo sapien
tggaagaggaaatgatgctgaagac

SEQ ID NO: 107273 - DNA, 25 bp, Homo sapien
tggaagaggtacaaaaaaacagtct

SEQ ID NO: 107274 - DNA, 25 bp, Homo sapien
tggaagaggtagaaaaaaacagtct

SEQ ID NO: 107275 - DNA, 25 bp, Homo sapien
tggaagagtccatcgaatgctaagc

SEQ ID NO: 107276 - DNA, 25 bp, Homo sapien
tggaagagtccatctaatgctaagc

SEQ ID NO: 107277 - DNA, 25 bp, Homo sapien
tggaagatacccactgaaatttgag

SEQ ID NO: 107278 - DNA, 25 bp, Homo sapien
tggaagatacccactggaatttgag

SEQ ID NO: 107279 - DNA, 25 bp, Homo sapien
tggaagcacttgggaacagctgggc

SEQ ID NO: 107280 - DNA, 25 bp, Homo sapien
tggaagcacttgtgaacagctgggc

SEQ ID NO: 107281 - DNA, 25 bp, Homo sapien
tggaagcagggaacctaggactgat

SEQ ID NO: 107282 - DNA, 25 bp, Homo sapien
tggaagcagggaagctaggactgat

SEQ ID NO: 107283 - DNA, 25 bp, Homo sapien
tggaagcgacttcgaaattattata

SEQ ID NO: 107284 - DNA, 25 bp, Homo sapien
tggaagcgactttgaaattattata

SEQ ID NO: 107285 - DNA, 25 bp, Homo sapien
tggaaggaagccaatcacagggtct

SEQ ID NO: 107286 - DNA, 25 bp, Homo sapien
tggaaggaagccgatcacagggtct

SEQ ID NO: 107287 - DNA, 25 bp, Homo sapien
tggaaggccagacaagccagcataa

SEQ ID NO: 107288 - DNA, 25 bp, Homo sapien
tggaaggccagagaagccagcataa

SEQ ID NO: 107289 - DNA, 25 bp, Homo sapien
tggaaggccatttgacataacaaaa

SEQ ID NO: 107290 - DNA, 25 bp, Homo sapien
tggaaggccatttggcataacaaaa

SEQ ID NO: 107291 - DNA, 25 bp, Homo sapien
tggaaggctctgcaactagatctgt

SEQ ID NO: 107292 - DNA, 25 bp, Homo sapien
tggaaggctctgcagctagatctgt

SEQ ID NO: 107293 - DNA, 25 bp, Homo sapien
tggaaggtgagtagacacagagaaa

SEQ ID NO: 107294 - DNA, 25 bp, Homo sapien
tggaaggtgagtagacgcagagaaa

SEQ ID NO: 107295 - DNA, 25 bp, Homo sapien
tggaaggtgtgaactttgaaaattt

SEQ ID NO: 107296 - DNA, 25 bp, Homo sapien
tggaaggtgtgatctttgaaaattt

SEQ ID NO: 107297 - DNA, 25 bp, Homo sapien
tggaagtaataacaaaccagaaaca

SEQ ID NO: 107298 - DNA, 25 bp, Homo sapien
tggaagtaataagaaaccagaaaca

SEQ ID NO: 107299 - DNA, 25 bp, Homo sapien
tggaagtacagacctaccaagtgct

SEQ ID NO: 107300 - DNA, 25 bp, Homo sapien
tggaagtacagatctaccaagtgct

SEQ ID NO: 107301 - DNA, 25 bp, Homo sapien
tggaagtaccataaaaataaataga

SEQ ID NO: 107302 - DNA, 25 bp, Homo sapien
tggaagtacgataaaaataaataga

SEQ ID NO: 107303 - DNA, 25 bp, Homo sapien
tggaagtcacagaatgtcatttcta

SEQ ID NO: 107304 - DNA, 25 bp, Homo sapien
tggaagtcacataatgtcatttcta

SEQ ID NO: 107305 - DNA, 25 bp, Homo sapien
tggaagtccgtacttgccattttct

SEQ ID NO: 107306 - DNA, 25 bp, Homo sapien
tggaagtccgtacttggcattttct

SEQ ID NO: 107307 - DNA, 25 bp, Homo sapien
tggaagttgctatcttattgccata

SEQ ID NO: 107308 - DNA, 25 bp, Homo sapien
tggaagttggtatcttattgccata

SEQ ID NO: 107309 - DNA, 25 bp, Homo sapien
tggaagttttccctacctaacactt

SEQ ID NO: 107310 - DNA, 25 bp, Homo sapien
tggaagttttctctacctaacactt

SEQ ID NO: 107311 - DNA, 25 bp, Homo sapien
tggaataatgcaagaggtagtatgg

SEQ ID NO: 107312 - DNA, 25 bp, Homo sapien
tggaataatgcaggaggtagtatgg

SEQ ID NO: 107313 - DNA, 25 bp, Homo sapien
tggaatacaaaaatagttcatcata

SEQ ID NO: 107314 - DNA, 25 bp, Homo sapien
tggaatacaaaaatggttcatcata

SEQ ID NO: 107315 - DNA, 25 bp, Homo sapien
tggaatacaataaaatgcttgcact

SEQ ID NO: 107316 - DNA, 25 bp, Homo sapien
tggaatacaatagaatgcttgcact

SEQ ID NO: 107317 - DNA, 25 bp, Homo sapien
tggaatcaaatcctgtcgttgtagg

SEQ ID NO: 107318 - DNA, 25 bp, Homo sapien
tggaatcaaatcctgttgttgtagg

SEQ ID NO: 107319 - DNA, 25 bp, Homo sapien
tggaatcagatgttcccaacctgag

SEQ ID NO: 107320 - DNA, 25 bp, Homo sapien
tggaatcagggacgtttcctggagg

SEQ ID NO: 107321 - DNA, 25 bp, Homo sapien
tggaatcagggacttttcctggagg

SEQ ID NO: 107322 - DNA, 25 bp, Homo sapien
tggaatcaggtgttcccaacctgag

SEQ ID NO: 107323 - DNA, 25 bp, Homo sapien
tggaatcctcatgccactgaagcaa

SEQ ID NO: 107324 - DNA, 25 bp, Homo sapien
tggaatcctcatgctactgaagcaa

SEQ ID NO: 107325 - DNA, 25 bp, Homo sapien
tggaatcctccaaaaatgaacacag

SEQ ID NO: 107326 - DNA, 25 bp, Homo sapien
tggaatcctccagaaatgaacacag

SEQ ID NO: 107327 - DNA, 25 bp, Homo sapien
tggaatctgaacccaacaggatcag

SEQ ID NO: 107328 - DNA, 25 bp, Homo sapien
tggaatctgaactcaacaggatcag

SEQ ID NO: 107329 - DNA, 25 bp, Homo sapien
tggaatgaaaccatactctgtttgt

SEQ ID NO: 107330 - DNA, 25 bp, Homo sapien
tggaatgaaactatactctgtttgt

SEQ ID NO: 107331 - DNA, 25 bp, Homo sapien
tggaatgaattttacaaccagacat

SEQ ID NO: 107332 - DNA, 25 bp, Homo sapien
tggaatgaattttagaaccagacat

SEQ ID NO: 107333 - DNA, 25 bp, Homo sapien
tggaatgacaagatatactcatttg

SEQ ID NO: 107334 - DNA, 25 bp, Homo sapien
tggaatgacaagatattctcatttg

SEQ ID NO: 107335 - DNA, 25 bp, Homo sapien
tggaatgattgagtaaaagtgattt

SEQ ID NO: 107336 - DNA, 25 bp, Homo sapien
tggaatgattgcgtaaaagtgattt

SEQ ID NO: 107337 - DNA, 25 bp, Homo sapien
tggaatggaacaaaattaagaaggc

SEQ ID NO: 107338 - DNA, 25 bp, Homo sapien
tggaatggaacagaattaagaaggc

SEQ ID NO: 107339 - DNA, 25 bp, Homo sapien
tggaatggcatatgcaagcaactgt

SEQ ID NO: 107340 - DNA, 25 bp, Homo sapien
tggaatggtatatgcaagcaactgt

SEQ ID NO: 107341 - DNA, 25 bp, Homo sapien
tggaatgtaaattgcatctcgacaa

SEQ ID NO: 107342 - DNA, 25 bp, Homo sapien
tggaatgtaaattgtatctcgacaa

SEQ ID NO: 107343 - DNA, 25 bp, Homo sapien
tggaatgtcaaagataaagtgcaac

SEQ ID NO: 107344 - DNA, 25 bp, Homo sapien
tggaatgtcaaaggtaaagtgcaac

SEQ ID NO: 107345 - DNA, 25 bp, Homo sapien
tggaattataacagacatgtgctca

SEQ ID NO: 107346 - DNA, 25 bp, Homo sapien
tggaattataatagacatgtgctca

SEQ ID NO: 107347 - DNA, 25 bp, Homo sapien
tggaattccaaagccaattcagcat

SEQ ID NO: 107348 - DNA, 25 bp, Homo sapien
tggaattccgaagccaattcagcat

SEQ ID NO: 107349 - DNA, 25 bp, Homo sapien
tggaattcttgacctggttaaggga

SEQ ID NO: 107350 - DNA, 25 bp, Homo sapien
tggaattcttgacttggttaaggga

SEQ ID NO: 107351 - DNA, 25 bp, Homo sapien
tggaattgacactgttgcttctgtc

SEQ ID NO: 107352 - DNA, 25 bp, Homo sapien
tggaattgacagtgttgcttctgtc

SEQ ID NO: 107353 - DNA, 25 bp, Homo sapien
tggaatttctcttattgcaaaattc

SEQ ID NO: 107354 - DNA, 25 bp, Homo sapien
tggaatttctcttatttcaaaattc

SEQ ID NO: 107355 - DNA, 25 bp, Homo sapien
tggaattttaaaaactgcctggtac

SEQ ID NO: 107356 - DNA, 25 bp, Homo sapien
tggaattttaaacactgcctggtac

SEQ ID NO: 107357 - DNA, 25 bp, Homo sapien
tggaattttcatactggcatggaaa

SEQ ID NO: 107358 - DNA, 25 bp, Homo sapien
tggaattttcatcctggcatggaaa

SEQ ID NO: 107359 - DNA, 25 bp, Homo sapien
tggacaaaagacgataatgtttatt

SEQ ID NO: 107360 - DNA, 25 bp, Homo sapien
tggacaaaagatgataatgtttatt

SEQ ID NO: 107361 - DNA, 25 bp, Homo sapien
tggacaaacaagtaagaagtttccc

SEQ ID NO: 107362 - DNA, 25 bp, Homo sapien
tggacaaacaagtcagaagtttccc

SEQ ID NO: 107363 - DNA, 25 bp, Homo sapien
tggacaaagacatggagttaggaat

SEQ ID NO: 107364 - DNA, 25 bp, Homo sapien
tggacaaagacttggagttaggaat

SEQ ID NO: 107365 - DNA, 25 bp, Homo sapien
tggacaaccttgataagaccccact

SEQ ID NO: 107366 - DNA, 25 bp, Homo sapien
tggacaaccttggtaagaccccact

SEQ ID NO: 107367 - DNA, 25 bp, Homo sapien
tggacaacgtgcaacataggactct

SEQ ID NO: 107368 - DNA, 25 bp, Homo sapien
tggacaacgtgcaatataggactct

SEQ ID NO: 107369 - DNA, 25 bp, Homo sapien
tggacaagaatacaatacagtactt

SEQ ID NO: 107370 - DNA, 25 bp, Homo sapien
tggacaagaatacgatacagtactt

SEQ ID NO: 107371 - DNA, 25 bp, Homo sapien
tggacaatgatttctaagcacctgt

SEQ ID NO: 107372 - DNA, 25 bp, Homo sapien
tggacaatgatttgtaagcacctgt

SEQ ID NO: 107373 - DNA, 25 bp, Homo sapien
tggacacaacagaagaaataatcag

SEQ ID NO: 107374 - DNA, 25 bp, Homo sapien
tggacacaatagaagaaataatcag

SEQ ID NO: 107375 - DNA, 25 bp, Homo sapien
tggacacagagcggcgctgccacca

SEQ ID NO: 107376 - DNA, 25 bp, Homo sapien
tggacacagagcggtgctgccacca

SEQ ID NO: 107377 - DNA, 25 bp, Homo sapien
tggacacccaaatacgctggcttga

SEQ ID NO: 107378 - DNA, 25 bp, Homo sapien
tggacacccaaatatgctggcttga

SEQ ID NO: 107379 - DNA, 25 bp, Homo sapien
tggacagcagaacgttaatcgacac

SEQ ID NO: 107380 - DNA, 25 bp, Homo sapien
tggacagcagaatgttaatcgacac

SEQ ID NO: 107381 - DNA, 25 bp, Homo sapien
tggacaggagactttccatacaaga

SEQ ID NO: 107382 - DNA, 25 bp, Homo sapien
tggacaggagagtttccatacaaga

SEQ ID NO: 107383 - DNA, 25 bp, Homo sapien
tggacatcatctacatctggattcc

SEQ ID NO: 107384 - DNA, 25 bp, Homo sapien
tggacatcatctgcatctggattcc

SEQ ID NO: 107385 - DNA, 25 bp, Homo sapien
tggacatttcccgttaggaaccacg

SEQ ID NO: 107386 - DNA, 25 bp, Homo sapien
tggacatttccctttaggaaccacg

SEQ ID NO: 107387 - DNA, 25 bp, Homo sapien
tggaccaagagtacaaagttctcca

SEQ ID NO: 107388 - DNA, 25 bp, Homo sapien
tggaccaagagtaccaagttctcca

SEQ ID NO: 107389 - DNA, 25 bp, Homo sapien
tggaccagaaagacgcatggagagt

SEQ ID NO: 107390 - DNA, 25 bp, Homo sapien
tggaccagaaagatgcatggagagt

SEQ ID NO: 107391 - DNA, 25 bp, Homo sapien
tggaccatattcatcttcatcttta

SEQ ID NO: 107392 - DNA, 25 bp, Homo sapien
tggaccatattcttcttcatcttta

SEQ ID NO: 107393 - DNA, 25 bp, Homo sapien
tggacccaagtatgggaacaataga

SEQ ID NO: 107394 - DNA, 25 bp, Homo sapien
tggacccaagtatggggacaataga

SEQ ID NO: 107395 - DNA, 25 bp, Homo sapien
tggacccagatttcgtgccaagaat

SEQ ID NO: 107396 - DNA, 25 bp, Homo sapien
tggacccagattttgtgccaagaat

SEQ ID NO: 107397 - DNA, 25 bp, Homo sapien
tggaccctgttgccgctctcttgct

SEQ ID NO: 107398 - DNA, 25 bp, Homo sapien
tggaccctgttgcctctctcttgct

SEQ ID NO: 107399 - DNA, 25 bp, Homo sapien
tggacctctcacacgttgctggtgc

SEQ ID NO: 107400 - DNA, 25 bp, Homo sapien
tggacctctcacatgttgctggtgc

SEQ ID NO: 107401 - DNA, 25 bp, Homo sapien
tggacctgtgactacagaacatttt

SEQ ID NO: 107402 - DNA, 25 bp, Homo sapien
tggacctgtgactatagaacatttt

SEQ ID NO: 107403 - DNA, 25 bp, Homo sapien
tggaccttgatgtgactcctggttc

SEQ ID NO: 107404 - DNA, 25 bp, Homo sapien
tggaccttggtgtgactcctggttc

SEQ ID NO: 107405 - DNA, 25 bp, Homo sapien
tggacggaaaccgtctccgaaattc

SEQ ID NO: 107406 - DNA, 25 bp, Homo sapien
tggacggaagccgtctccgaaattc

SEQ ID NO: 107407 - DNA, 25 bp, Homo sapien
tggacggactcttaagatgcagtgg

SEQ ID NO: 107408 - DNA, 25 bp, Homo sapien
tggacggactcttaagctgcagtgg

SEQ ID NO: 107409 - DNA, 25 bp, Homo sapien
tggactatacgaatgcattttgaaa

SEQ ID NO: 107410 - DNA, 25 bp, Homo sapien
tggactatatgaatgcattttgaaa

SEQ ID NO: 107411 - DNA, 25 bp, Homo sapien
tggactcctttcttattataccaca

SEQ ID NO: 107412 - DNA, 25 bp, Homo sapien
tggactcctttcttgttataccaca

SEQ ID NO: 107413 - DNA, 25 bp, Homo sapien
tggactctaaaaaaacggaatttga

SEQ ID NO: 107414 - DNA, 25 bp, Homo sapien
tggactctgaaaaaacggaatttga

SEQ ID NO: 107415 - DNA, 25 bp, Homo sapien
tggactgacgctgatttccaagatt

SEQ ID NO: 107416 - DNA, 25 bp, Homo sapien
tggactgatgctgatttccaagatt

SEQ ID NO: 107417 - DNA, 25 bp, Homo sapien
tggactgcaccagataagctatgct

SEQ ID NO: 107418 - DNA, 25 bp, Homo sapien
tggactgcaccagataggctatgct

SEQ ID NO: 107419 - DNA, 25 bp, Homo sapien
tggactgctgttcccccagatagca

SEQ ID NO: 107420 - DNA, 25 bp, Homo sapien
tggactgctgtttccccagatagca

SEQ ID NO: 107421 - DNA, 25 bp, Homo sapien
tggactggatgaaactgaaggtcac

SEQ ID NO: 107422 - DNA, 25 bp, Homo sapien
tggactggatgaaattgaaggtcac

SEQ ID NO: 107423 - DNA, 25 bp, Homo sapien
tggactggccttagctggccgaatc

SEQ ID NO: 107424 - DNA, 25 bp, Homo sapien
tggactggccttggctggccgaatc

SEQ ID NO: 107425 - DNA, 25 bp, Homo sapien
tggactgtacttcctcactccttgc

SEQ ID NO: 107426 - DNA, 25 bp, Homo sapien
tggactgtagcactagacttgtgaa

SEQ ID NO: 107427 - DNA, 25 bp, Homo sapien
tggactgtagcactagtcttgtgaa

SEQ ID NO: 107428 - DNA, 25 bp, Homo sapien
tggactgtatttcctcactccttgc

SEQ ID NO: 107429 - DNA, 25 bp, Homo sapien
tggactgttagccgatttaacagct

SEQ ID NO: 107430 - DNA, 25 bp, Homo sapien
tggactgttagctgatttaacagct

SEQ ID NO: 107431 - DNA, 25 bp, Homo sapien
tggacttaaaattgacccttgagcg

SEQ ID NO: 107432 - DNA, 25 bp, Homo sapien
tggacttaaaattgacgcttgagcg

SEQ ID NO: 107433 - DNA, 25 bp, Homo sapien
tggacttacagcgcaatcgacttaa

SEQ ID NO: 107434 - DNA, 25 bp, Homo sapien
tggacttatagcgcaatcgacttaa

SEQ ID NO: 107435 - DNA, 25 bp, Homo sapien
tggacttcaattatgcaactagtga

SEQ ID NO: 107436 - DNA, 25 bp, Homo sapien
tggacttcagttatgcaactagtga

SEQ ID NO: 107437 - DNA, 25 bp, Homo sapien
tggacttgcacgagacctgtatcct

SEQ ID NO: 107438 - DNA, 25 bp, Homo sapien
tggacttgcacgggacctgtatcct

SEQ ID NO: 107439 - DNA, 25 bp, Homo sapien
tggactttacacaataagacctaag

SEQ ID NO: 107440 - DNA, 25 bp, Homo sapien
tggactttacacagtaagacctaag

SEQ ID NO: 107441 - DNA, 25 bp, Homo sapien
tggactttattttctttatcccgca

SEQ ID NO: 107442 - DNA, 25 bp, Homo sapien
tggactttattttttttatcccgca

SEQ ID NO: 107443 - DNA, 25 bp, Homo sapien
tggacttttcccgagaggcttagaa

SEQ ID NO: 107444 - DNA, 25 bp, Homo sapien
tggacttttcctgagaggcttagaa

SEQ ID NO: 107445 - DNA, 25 bp, Homo sapien
tggactttttaccttaatgtatgaa

SEQ ID NO: 107446 - DNA, 25 bp, Homo sapien
tggactttttagcttaatgtatgaa

SEQ ID NO: 107447 - DNA, 25 bp, Homo sapien
tggagaaattacctaatcagcctgc

SEQ ID NO: 107448 - DNA, 25 bp, Homo sapien
tggagaaattacttaatcagcctgc

SEQ ID NO: 107449 - DNA, 25 bp, Homo sapien
tggagaacataaacctaagtgaaaa

SEQ ID NO: 107450 - DNA, 25 bp, Homo sapien
tggagaacataatcctaagtgaaaa

SEQ ID NO: 107451 - DNA, 25 bp, Homo sapien
tggagaactctttggccttggtcag

SEQ ID NO: 107452 - DNA, 25 bp, Homo sapien
tggagaactgtttggccttggtcag

SEQ ID NO: 107453 - DNA, 25 bp, Homo sapien
tggagaagaaatgagactgagagat

SEQ ID NO: 107454 - DNA, 25 bp, Homo sapien
tggagaaggaatgagactgagagat

SEQ ID NO: 107455 - DNA, 25 bp, Homo sapien
tggagaagtagttaccttttacctt

SEQ ID NO: 107456 - DNA, 25 bp, Homo sapien
tggagaagtcgttaccttttacctt

SEQ ID NO: 107457 - DNA, 25 bp, Homo sapien
tggagaatacaaggtggatggtctg

SEQ ID NO: 107458 - DNA, 25 bp, Homo sapien
tggagaatgcaaggtggatggtctg

SEQ ID NO: 107459 - DNA, 25 bp, Homo sapien
tggagaattgcctttggtgcctctt

SEQ ID NO: 107460 - DNA, 25 bp, Homo sapien
tggagaattgcttttggtgcctctt

SEQ ID NO: 107461 - DNA, 25 bp, Homo sapien
tggagacaaatacaggaacccagtt

SEQ ID NO: 107462 - DNA, 25 bp, Homo sapien
tggagacaaatataggaacccagtt

SEQ ID NO: 107463 - DNA, 25 bp, Homo sapien
tggagactcagaagcaagcgcagcg

SEQ ID NO: 107464 - DNA, 25 bp, Homo sapien
tggagactgagaagcaagcgcagcg

SEQ ID NO: 107465 - DNA, 25 bp, Homo sapien
tggagagaagacagatctaattccc

SEQ ID NO: 107466 - DNA, 25 bp, Homo sapien
tggagagaagacggatctaattccc

SEQ ID NO: 107467 - DNA, 25 bp, Homo sapien
tggagagaatttttatgggcagagc

SEQ ID NO: 107468 - DNA, 25 bp, Homo sapien
tggagagacgtccgcaaacaggttt

SEQ ID NO: 107469 - DNA, 25 bp, Homo sapien
tggagagacgtctgcaaacaggttt

SEQ ID NO: 107470 - DNA, 25 bp, Homo sapien
tggagagactttttatgggcagagc

SEQ ID NO: 107471 - DNA, 25 bp, Homo sapien
tggagagagaaaaattatgtttcaa

SEQ ID NO: 107472 - DNA, 25 bp, Homo sapien
tggagagagaaatattatgtttcaa

SEQ ID NO: 107473 - DNA, 25 bp, Homo sapien
tggagagatgtccgcaaacaggttt

SEQ ID NO: 107474 - DNA, 25 bp, Homo sapien
tggagagctggaatggcatatgcaa

SEQ ID NO: 107475 - DNA, 25 bp, Homo sapien
tggagagctggaatggtatatgcaa

SEQ ID NO: 107476 - DNA, 25 bp, Homo sapien
tggagaggtgacgaggaatactctg

SEQ ID NO: 107477 - DNA, 25 bp, Homo sapien
tggagaggtgatgaggaatactctg

SEQ ID NO: 107478 - DNA, 25 bp, Homo sapien
tggagagtccgcagtgaccaattgg

SEQ ID NO: 107479 - DNA, 25 bp, Homo sapien
tggagagtctgcagtgaccaattgg

SEQ ID NO: 107480 - DNA, 25 bp, Homo sapien
tggagatagagcctttcaagaaatg

SEQ ID NO: 107481 - DNA, 25 bp, Homo sapien
tggagatagaggctttcaagaaatg

SEQ ID NO: 107482 - DNA, 25 bp, Homo sapien
tggagatctggtctttatcagacca

SEQ ID NO: 107483 - DNA, 25 bp, Homo sapien
tggagatcttgtctttatcagacca

SEQ ID NO: 107484 - DNA, 25 bp, Homo sapien
tggagatgatgatgaccttgaggct

SEQ ID NO: 107485 - DNA, 25 bp, Homo sapien
tggagatgctttaaaggaatttatg

SEQ ID NO: 107486 - DNA, 25 bp, Homo sapien
tggagatgctttaaagtaatttatg

SEQ ID NO: 107487 - DNA, 25 bp, Homo sapien
tggagatggtgatgaccttgaggct

SEQ ID NO: 107488 - DNA, 25 bp, Homo sapien
tggagattaaaatagtacctacctc

SEQ ID NO: 107489 - DNA, 25 bp, Homo sapien
tggagattaaaatcgtacctacctc

SEQ ID NO: 107490 - DNA, 25 bp, Homo sapien
tggagattacagcgcattctttcta

SEQ ID NO: 107491 - DNA, 25 bp, Homo sapien
tggagattacagtgcattctttcta

SEQ ID NO: 107492 - DNA, 25 bp, Homo sapien
tggagattgtggcatttgggcctgg

SEQ ID NO: 107493 - DNA, 25 bp, Homo sapien
tggagattgtggcgtttgggcctgg

SEQ ID NO: 107494 - DNA, 25 bp, Homo sapien
tggagatttagaaactgtaggatta

SEQ ID NO: 107495 - DNA, 25 bp, Homo sapien
tggagatttagaaagtgtaggatta

SEQ ID NO: 107496 - DNA, 25 bp, Homo sapien
tggagatttgtgagtaacagggcat

SEQ ID NO: 107497 - DNA, 25 bp, Homo sapien
tggagatttttgagtaacagggcat

SEQ ID NO: 107498 - DNA, 25 bp, Homo sapien
tggagcaaatgagactcagattaag

SEQ ID NO: 107499 - DNA, 25 bp, Homo sapien
tggagcaaccaagcatcctaatccc

SEQ ID NO: 107500 - DNA, 25 bp, Homo sapien
tggagcaactgagactcagattaag

SEQ ID NO: 107501 - DNA, 25 bp, Homo sapien
tggagcaagcaagcatcctaatccc

SEQ ID NO: 107502 - DNA, 25 bp, Homo sapien
tggagcagttgtcggtatggttata

SEQ ID NO: 107503 - DNA, 25 bp, Homo sapien
tggagcagttgttggtatggttata

SEQ ID NO: 107504 - DNA, 25 bp, Homo sapien
tggagcagtttgtgggatagttagt

SEQ ID NO: 107505 - DNA, 25 bp, Homo sapien
tggagcagtttgtggggtagttagt

SEQ ID NO: 107506 - DNA, 25 bp, Homo sapien
tggagcatgaagctgcacaggcatc

SEQ ID NO: 107507 - DNA, 25 bp, Homo sapien
tggagcatgaagttgcacaggcatc

SEQ ID NO: 107508 - DNA, 25 bp, Homo sapien
tggagcatggtatcaactgttcaga

SEQ ID NO: 107509 - DNA, 25 bp, Homo sapien
tggagcatggtatcaagtgttcaga

SEQ ID NO: 107510 - DNA, 25 bp, Homo sapien
tggagcccataggaggaagttccca

SEQ ID NO: 107511 - DNA, 25 bp, Homo sapien
tggagcccatagtaggaagttccca

SEQ ID NO: 107512 - DNA, 25 bp, Homo sapien
tggagcccatccatcagtactttcc

SEQ ID NO: 107513 - DNA, 25 bp, Homo sapien
tggagcccatctatcagtactttcc

SEQ ID NO: 107514 - DNA, 25 bp, Homo sapien
tggagccctgtcatccttaaagatc

SEQ ID NO: 107515 - DNA, 25 bp, Homo sapien
tggagccctgtcgtccttaaagatc

SEQ ID NO: 107516 - DNA, 25 bp, Homo sapien
tggagcctcgtgagtgctggctggt

SEQ ID NO: 107517 - DNA, 25 bp, Homo sapien
tggagccttgtgagtgctggctggt

SEQ ID NO: 107518 - DNA, 25 bp, Homo sapien
tggagctaaaaaatgaagcctagtg

SEQ ID NO: 107519 - DNA, 25 bp, Homo sapien
tggagctaaaacatgaagcctagtg

SEQ ID NO: 107520 - DNA, 25 bp, Homo sapien
tggagctacacaccgtcaaattaag

SEQ ID NO: 107521 - DNA, 25 bp, Homo sapien
tggagctacacactgtcaaattaag

SEQ ID NO: 107522 - DNA, 25 bp, Homo sapien
tggagctcatttgtctgacggtttt

SEQ ID NO: 107523 - DNA, 25 bp, Homo sapien
tggagctcatttttctgacggtttt

SEQ ID NO: 107524 - DNA, 25 bp, Homo sapien
tggagctgagtaataccctcattac

SEQ ID NO: 107525 - DNA, 25 bp, Homo sapien
tggagctgcgttcaagggatgcact

SEQ ID NO: 107526 - DNA, 25 bp, Homo sapien
tggagctgcgttcgagggatgcact

SEQ ID NO: 107527 - DNA, 25 bp, Homo sapien
tggagctgctgcataagaaacgaaa

SEQ ID NO: 107528 - DNA, 25 bp, Homo sapien
tggagctgctgcattagaaacgaaa

SEQ ID NO: 107529 - DNA, 25 bp, Homo sapien
tggagctgggtaataccctcattac

SEQ ID NO: 107530 - DNA, 25 bp, Homo sapien
tggagcttcctcatctcccatttcg

SEQ ID NO: 107531 - DNA, 25 bp, Homo sapien
tggagcttcctcgtctcccatttcg

SEQ ID NO: 107532 - DNA, 25 bp, Homo sapien
tggaggaaaaatcatctttccaaat

SEQ ID NO: 107533 - DNA, 25 bp, Homo sapien
tggaggaaaaatcgtctttccaaat

SEQ ID NO: 107534 - DNA, 25 bp, Homo sapien
tggaggaggtcagactttgtcctat

SEQ ID NO: 107535 - DNA, 25 bp, Homo sapien
tggaggaggtcagtctttgtcctat

SEQ ID NO: 107536 - DNA, 25 bp, Homo sapien
tggaggcaagaaatctgagctcaag

SEQ ID NO: 107537 - DNA, 25 bp, Homo sapien
tggaggcaagaagtctgagctcaag

SEQ ID NO: 107538 - DNA, 25 bp, Homo sapien
tggaggcacgcatatgcggtagttc

SEQ ID NO: 107539 - DNA, 25 bp, Homo sapien
tggaggcacgcatgtgcggtagttc

SEQ ID NO: 107540 - DNA, 25 bp, Homo sapien
tggaggcgacacagcccaagaggcc

SEQ ID NO: 107541 - DNA, 25 bp, Homo sapien
tggaggcggcacagcccaagaggcc

SEQ ID NO: 107542 - DNA, 25 bp, Homo sapien
tggaggctgaaaatacaagatcagg

SEQ ID NO: 107543 - DNA, 25 bp, Homo sapien
tggaggctgaaagtacaagatcagg

SEQ ID NO: 107544 - DNA, 25 bp, Homo sapien
tggaggctgcatctgctcttctgtc

SEQ ID NO: 107545 - DNA, 25 bp, Homo sapien
tggaggctgtatctgctcttctgtc

SEQ ID NO: 107546 - DNA, 25 bp, Homo sapien
tggagggccagttgaaaaatgtagt

SEQ ID NO: 107547 - DNA, 25 bp, Homo sapien
tggagggccagttgaataatgtagt

SEQ ID NO: 107548 - DNA, 25 bp, Homo sapien
tggagggtatctaatagaagcatct

SEQ ID NO: 107549 - DNA, 25 bp, Homo sapien
tggagggtatctgatagaagcatct

SEQ ID NO: 107550 - DNA, 25 bp, Homo sapien
tggagggtcgtgaatagcagtgccc

SEQ ID NO: 107551 - DNA, 25 bp, Homo sapien
tggagggtgtaaacagtacctgaca

SEQ ID NO: 107552 - DNA, 25 bp, Homo sapien
tggagggtgtaaatagtacctgaca

SEQ ID NO: 107553 - DNA, 25 bp, Homo sapien
tggagggttgtgaatagcagtgccc

SEQ ID NO: 107554 - DNA, 25 bp, Homo sapien
tggaggtcaatactcaaaacttaaa

SEQ ID NO: 107555 - DNA, 25 bp, Homo sapien
tggaggtcaatactgaaaacttaaa

SEQ ID NO: 107556 - DNA, 25 bp, Homo sapien
tggaggtcagacgccaagtagaaaa

SEQ ID NO: 107557 - DNA, 25 bp, Homo sapien
tggaggtcagacgtcaagtagaaaa

SEQ ID NO: 107558 - DNA, 25 bp, Homo sapien
tggaggtcttctctggaattatatc

SEQ ID NO: 107559 - DNA, 25 bp, Homo sapien
tggaggtcttctttggaattatatc

SEQ ID NO: 107560 - DNA, 25 bp, Homo sapien
tggaggtctttatgctactcattcc

SEQ ID NO: 107561 - DNA, 25 bp, Homo sapien
tggaggtctttatgcttctcattcc

SEQ ID NO: 107562 - DNA, 25 bp, Homo sapien
tggagtaaacgatttttgcaggata

SEQ ID NO: 107563 - DNA, 25 bp, Homo sapien
tggagtaaatgatttttgcaggata

SEQ ID NO: 107564 - DNA, 25 bp, Homo sapien
tggagtacagcctgggtatccctgc

SEQ ID NO: 107565 - DNA, 25 bp, Homo sapien
tggagtacctgaatcatacaattac

SEQ ID NO: 107566 - DNA, 25 bp, Homo sapien
tggagtacctgcatcatacaattac

SEQ ID NO: 107567 - DNA, 25 bp, Homo sapien
tggagtacgaaaaaaaactcctgca

SEQ ID NO: 107568 - DNA, 25 bp, Homo sapien
tggagtacgaaaacaaactcctgca

SEQ ID NO: 107569 - DNA, 25 bp, Homo sapien
tggagtacggcctgggtatccctgc

SEQ ID NO: 107570 - DNA, 25 bp, Homo sapien
tggagtagacacactaacacataaa

SEQ ID NO: 107571 - DNA, 25 bp, Homo sapien
tggagtagacaccctaacacataaa

SEQ ID NO: 107572 - DNA, 25 bp, Homo sapien
tggagtagcacactcaaatgaggaa

SEQ ID NO: 107573 - DNA, 25 bp, Homo sapien
tggagtagcacacttaaatgaggaa

SEQ ID NO: 107574 - DNA, 25 bp, Homo sapien
tggagtatttctatagagaggatcc

SEQ ID NO: 107575 - DNA, 25 bp, Homo sapien
tggagtatttctttagagaggatcc

SEQ ID NO: 107576 - DNA, 25 bp, Homo sapien
tggagtcaacccccagttccaccat

SEQ ID NO: 107577 - DNA, 25 bp, Homo sapien
tggagtcaacccctagttccaccat

SEQ ID NO: 107578 - DNA, 25 bp, Homo sapien
tggagtcacaattctgctaacagta

SEQ ID NO: 107579 - DNA, 25 bp, Homo sapien
tggagtcacaattttgctaacagta

SEQ ID NO: 107580 - DNA, 25 bp, Homo sapien
tggagtcatagagaagaaagatttg

SEQ ID NO: 107581 - DNA, 25 bp, Homo sapien
tggagtcatagataagaaagatttg

SEQ ID NO: 107582 - DNA, 25 bp, Homo sapien
tggagtccacggatgttgctaaata

SEQ ID NO: 107583 - DNA, 25 bp, Homo sapien
tggagtcccagcgcggcaggaaaat

SEQ ID NO: 107584 - DNA, 25 bp, Homo sapien
tggagtcccagtgcggcaggaaaat

SEQ ID NO: 107585 - DNA, 25 bp, Homo sapien
tggagtccgcggatgttgctaaata

SEQ ID NO: 107586 - DNA, 25 bp, Homo sapien
tggagtgactcctcacatcgcattt

SEQ ID NO: 107587 - DNA, 25 bp, Homo sapien
tggagtgacttggacaaggtggtca

SEQ ID NO: 107588 - DNA, 25 bp, Homo sapien
tggagtgacttggataaggtggtca

SEQ ID NO: 107589 - DNA, 25 bp, Homo sapien
tggagtgattcctcacatcgcattt

SEQ ID NO: 107590 - DNA, 25 bp, Homo sapien
tggagtggcgaggttaaagtgatct

SEQ ID NO: 107591 - DNA, 25 bp, Homo sapien
tggagtggtgaggttaaagtgatct

SEQ ID NO: 107592 - DNA, 25 bp, Homo sapien
tggagtgtcggcatgaaatatggta

SEQ ID NO: 107593 - DNA, 25 bp, Homo sapien
tggagtgttggcatgaaatatggta

SEQ ID NO: 107594 - DNA, 25 bp, Homo sapien
tggagttaatttgccgcagttataa

SEQ ID NO: 107595 - DNA, 25 bp, Homo sapien
tggagttaatttgctgcagttataa

SEQ ID NO: 107596 - DNA, 25 bp, Homo sapien
tggagttcttgcatttaagcctgtt

SEQ ID NO: 107597 - DNA, 25 bp, Homo sapien
tggagttcttgcgtttaagcctgtt

SEQ ID NO: 107598 - DNA, 25 bp, Homo sapien
tggagttgaagaaagggagtttccc

SEQ ID NO: 107599 - DNA, 25 bp, Homo sapien
tggagttgaagatagggagtttccc

SEQ ID NO: 107600 - DNA, 25 bp, Homo sapien
tggagttgatttcaaccggactaag

SEQ ID NO: 107601 - DNA, 25 bp, Homo sapien
tggagttgatttcaactggactaag

SEQ ID NO: 107602 - DNA, 25 bp, Homo sapien
tggagttgcacatgctattcattat

SEQ ID NO: 107603 - DNA, 25 bp, Homo sapien
tggagttgcacctgctattcattat

SEQ ID NO: 107604 - DNA, 25 bp, Homo sapien
tggagtttctgcaaagccattaaaa

SEQ ID NO: 107605 - DNA, 25 bp, Homo sapien
tggagtttctgcaatgccattaaaa

SEQ ID NO: 107606 - DNA, 25 bp, Homo sapien
tggataaagctatgcactgtgtttg

SEQ ID NO: 107607 - DNA, 25 bp, Homo sapien
tggataaagctatgtactgtgtttg

SEQ ID NO: 107608 - DNA, 25 bp, Homo sapien
tggataactcaaaccgccaaatttc

SEQ ID NO: 107609 - DNA, 25 bp, Homo sapien
tggataactcaaactgccaaatttc

SEQ ID NO: 107610 - DNA, 25 bp, Homo sapien
tggataagaattgaacaaccaaata

SEQ ID NO: 107611 - DNA, 25 bp, Homo sapien
tggataagaattgaccaaccaaata

SEQ ID NO: 107612 - DNA, 25 bp, Homo sapien
tggatactattaaaagcatttagtt

SEQ ID NO: 107613 - DNA, 25 bp, Homo sapien
tggatactcaaactgttcttaggaa

SEQ ID NO: 107614 - DNA, 25 bp, Homo sapien
tggatactcaaacttttcttaggaa

SEQ ID NO: 107615 - DNA, 25 bp, Homo sapien
tggatactgttaaaagcatttagtt

SEQ ID NO: 107616 - DNA, 25 bp, Homo sapien
tggatacttgcagccagctctaaag

SEQ ID NO: 107617 - DNA, 25 bp, Homo sapien
tggatactttcagccagctctaaag

SEQ ID NO: 107618 - DNA, 25 bp, Homo sapien
tggatactttttccagttgattctc

SEQ ID NO: 107619 - DNA, 25 bp, Homo sapien
tggatacttttttcagttgattctc

SEQ ID NO: 107620 - DNA, 25 bp, Homo sapien
tggatagacatgacagttttacaat

SEQ ID NO: 107621 - DNA, 25 bp, Homo sapien
tggatagacatgacggttttacaat

SEQ ID NO: 107622 - DNA, 25 bp, Homo sapien
tggatatcgtgaattgtctgtttga

SEQ ID NO: 107623 - DNA, 25 bp, Homo sapien
tggatatcttgaattgtctgtttga

SEQ ID NO: 107624 - DNA, 25 bp, Homo sapien
tggatatgacaaatatttaatgctg

SEQ ID NO: 107625 - DNA, 25 bp, Homo sapien
tggatatgacaaatgtttaatgctg

SEQ ID NO: 107626 - DNA, 25 bp, Homo sapien
tggatatgatggttatcttgatttt

SEQ ID NO: 107627 - DNA, 25 bp, Homo sapien
tggatatgatgtttatcttgatttt

SEQ ID NO: 107628 - DNA, 25 bp, Homo sapien
tggatatgcaccttgtgtggcaaaa

SEQ ID NO: 107629 - DNA, 25 bp, Homo sapien
tggatatgcctcacagttgcattgg

SEQ ID NO: 107630 - DNA, 25 bp, Homo sapien
tggatatgcctcgcagttgcattgg

SEQ ID NO: 107631 - DNA, 25 bp, Homo sapien
tggatatgtaccttgtgtggcaaaa

SEQ ID NO: 107632 - DNA, 25 bp, Homo sapien
tggatatttggcatgatatattgaa

SEQ ID NO: 107633 - DNA, 25 bp, Homo sapien
tggatattttgcatgatatattgaa

SEQ ID NO: 107634 - DNA, 25 bp, Homo sapien
tggatcaatgagacaaaaagaaaat

SEQ ID NO: 107635 - DNA, 25 bp, Homo sapien
tggatcaatgaggcaaaaagaaaat

SEQ ID NO: 107636 - DNA, 25 bp, Homo sapien
tggatcaccaagagtcaactataga

SEQ ID NO: 107637 - DNA, 25 bp, Homo sapien
tggatcaccaagagtcgactataga

SEQ ID NO: 107638 - DNA, 25 bp, Homo sapien
tggatcacgctcatttgttcaaagc

SEQ ID NO: 107639 - DNA, 25 bp, Homo sapien
tggatcacgctcattttttcaaagc

SEQ ID NO: 107640 - DNA, 25 bp, Homo sapien
tggatcatactactatatttccctg

SEQ ID NO: 107641 - DNA, 25 bp, Homo sapien
tggatcatactactgtatttccctg

SEQ ID NO: 107642 - DNA, 25 bp, Homo sapien
tggatcatcgcaataactgtctaac

SEQ ID NO: 107643 - DNA, 25 bp, Homo sapien
tggatcattgcaataactgtctaac

SEQ ID NO: 107644 - DNA, 25 bp, Homo sapien
tggatccaagagtcagcgagatggt

SEQ ID NO: 107645 - DNA, 25 bp, Homo sapien
tggatccaagagtcagtgagatggt

SEQ ID NO: 107646 - DNA, 25 bp, Homo sapien
tggatcgggcagccattgtgcactt

SEQ ID NO: 107647 - DNA, 25 bp, Homo sapien
tggatcgggcagccgttgtgcactt

SEQ ID NO: 107648 - DNA, 25 bp, Homo sapien
tggatctacttagcattttgcctac

SEQ ID NO: 107649 - DNA, 25 bp, Homo sapien
tggatctacttagtattttgcctac

SEQ ID NO: 107650 - DNA, 25 bp, Homo sapien
tggatctctgtcactaaggaatgtt

SEQ ID NO: 107651 - DNA, 25 bp, Homo sapien
tggatctctgtcattaaggaatgtt

SEQ ID NO: 107652 - DNA, 25 bp, Homo sapien
tggatctgagtacctttagtagcac

SEQ ID NO: 107653 - DNA, 25 bp, Homo sapien
tggatctgagtatctttagtagcac

SEQ ID NO: 107654 - DNA, 25 bp, Homo sapien
tggatctgattatacgttctgtact

SEQ ID NO: 107655 - DNA, 25 bp, Homo sapien
tggatctgattatatgttctgtact

SEQ ID NO: 107656 - DNA, 25 bp, Homo sapien
tggatctgctttactagcacatttc

SEQ ID NO: 107657 - DNA, 25 bp, Homo sapien
tggatctggagtgactcctcacatc

SEQ ID NO: 107658 - DNA, 25 bp, Homo sapien
tggatctggagtgattcctcacatc

SEQ ID NO: 107659 - DNA, 25 bp, Homo sapien
tggatctgttttactagcacatttc

SEQ ID NO: 107660 - DNA, 25 bp, Homo sapien
tggatctttatccaccttctcctca

SEQ ID NO: 107661 - DNA, 25 bp, Homo sapien
tggatctttattcaccttctcctca

SEQ ID NO: 107662 - DNA, 25 bp, Homo sapien
tggatgaaaacaaagtgtggattgg

SEQ ID NO: 107663 - DNA, 25 bp, Homo sapien
tggatgaaaacaaggtgtggattgg

SEQ ID NO: 107664 - DNA, 25 bp, Homo sapien
tggatgaaagattgcagtaaccgtg

SEQ ID NO: 107665 - DNA, 25 bp, Homo sapien
tggatgaaaggccagagttggtcct

SEQ ID NO: 107666 - DNA, 25 bp, Homo sapien
tggatgaaaggtcagagttggtcct

SEQ ID NO: 107667 - DNA, 25 bp, Homo sapien
tggatgaacagaaaatgtgatatat

SEQ ID NO: 107668 - DNA, 25 bp, Homo sapien
tggatgaatagaaaatgtgatatat

SEQ ID NO: 107669 - DNA, 25 bp, Homo sapien
tggatgaatgattgcagtaaccgtg

SEQ ID NO: 107670 - DNA, 25 bp, Homo sapien
tggatgacagcatactaagacattc

SEQ ID NO: 107671 - DNA, 25 bp, Homo sapien
tggatgacagcgtactaagacattc

SEQ ID NO: 107672 - DNA, 25 bp, Homo sapien
tggatgaggaactagaagattggga

SEQ ID NO: 107673 - DNA, 25 bp, Homo sapien
tggatgaggaacttgaagattggga

SEQ ID NO: 107674 - DNA, 25 bp, Homo sapien
tggatgatcgaggacagctaactag

SEQ ID NO: 107675 - DNA, 25 bp, Homo sapien
tggatgatcgatgacagctaactag

SEQ ID NO: 107676 - DNA, 25 bp, Homo sapien
tggatgcagatgacagagtgtgtct

SEQ ID NO: 107677 - DNA, 25 bp, Homo sapien
tggatgcagatgagagagtgtgtct

SEQ ID NO: 107678 - DNA, 25 bp, Homo sapien
tggatgcatcaacctatcgtcagtc

SEQ ID NO: 107679 - DNA, 25 bp, Homo sapien
tggatgcatcaagctatcgtcagtc

SEQ ID NO: 107680 - DNA, 25 bp, Homo sapien
tggatgcccctgtctgacatcggtg

SEQ ID NO: 107681 - DNA, 25 bp, Homo sapien
tggatgcccctgtctggcatcggtg

SEQ ID NO: 107682 - DNA, 25 bp, Homo sapien
tggatggacagaaggatgctgcctc

SEQ ID NO: 107683 - DNA, 25 bp, Homo sapien
tggatggatagaaggatgctgcctc

SEQ ID NO: 107684 - DNA, 25 bp, Homo sapien
tggatggcatcatttggttaaactg

SEQ ID NO: 107685 - DNA, 25 bp, Homo sapien
tggatggcatcgtttggttaaactg

SEQ ID NO: 107686 - DNA, 25 bp, Homo sapien
tggatgtacaagcatctgagtacct

SEQ ID NO: 107687 - DNA, 25 bp, Homo sapien
tggatgtacaagtatctgagtacct

SEQ ID NO: 107688 - DNA, 25 bp, Homo sapien
tggatgtagaacctgtggatgcaga

SEQ ID NO: 107689 - DNA, 25 bp, Homo sapien
tggatgtagaagctgtggatgcaga

SEQ ID NO: 107690 - DNA, 25 bp, Homo sapien
tggatgtatttatacggcaccctct

SEQ ID NO: 107691 - DNA, 25 bp, Homo sapien
tggatgtatttatatggcaccctct

SEQ ID NO: 107692 - DNA, 25 bp, Homo sapien
tggatgtctaaccattccttgttga

SEQ ID NO: 107693 - DNA, 25 bp, Homo sapien
tggatgtctaactattccttgttga

SEQ ID NO: 107694 - DNA, 25 bp, Homo sapien
tggatgtgcttcttttggcaagggg

SEQ ID NO: 107695 - DNA, 25 bp, Homo sapien
tggatgtgtcatgtctccctaggaa

SEQ ID NO: 107696 - DNA, 25 bp, Homo sapien
tggatgtgttatgtctccctaggaa

SEQ ID NO: 107697 - DNA, 25 bp, Homo sapien
tggatgtgtttcttttggcaagggg

SEQ ID NO: 107698 - DNA, 25 bp, Homo sapien
tggatgttcaacgttgcaatactgt

SEQ ID NO: 107699 - DNA, 25 bp, Homo sapien
tggatgttcaatgttgcaatactgt

SEQ ID NO: 107700 - DNA, 25 bp, Homo sapien
tggatgttttcaaatagtcgcattt

SEQ ID NO: 107701 - DNA, 25 bp, Homo sapien
tggatgttttcaagtagtcgcattt

SEQ ID NO: 107702 - DNA, 25 bp, Homo sapien
tggattaagtcacactttccattgt

SEQ ID NO: 107703 - DNA, 25 bp, Homo sapien
tggattaagtcacattttccattgt

SEQ ID NO: 107704 - DNA, 25 bp, Homo sapien
tggattaatcccatgtgtttgagct

SEQ ID NO: 107705 - DNA, 25 bp, Homo sapien
tggattaatcccttgtgtttgagct

SEQ ID NO: 107706 - DNA, 25 bp, Homo sapien
tggattacatacttcgaagtgactt

SEQ ID NO: 107707 - DNA, 25 bp, Homo sapien
tggattacatatttcgaagtgactt

SEQ ID NO: 107708 - DNA, 25 bp, Homo sapien
tggattacctatacaggctgacatt

SEQ ID NO: 107709 - DNA, 25 bp, Homo sapien
tggattacctatgcaggctgacatt

SEQ ID NO: 107710 - DNA, 25 bp, Homo sapien
tggattagagtaggccttaagtcca

SEQ ID NO: 107711 - DNA, 25 bp, Homo sapien
tggattagcgtaggccttaagtcca

SEQ ID NO: 107712 - DNA, 25 bp, Homo sapien
tggattatcaggattatcacaattg

SEQ ID NO: 107713 - DNA, 25 bp, Homo sapien
tggattatcaggtttatcacaattg

SEQ ID NO: 107714 - DNA, 25 bp, Homo sapien
tggattatggccatacccttcattt

SEQ ID NO: 107715 - DNA, 25 bp, Homo sapien
tggattatggccatactcttcattt

SEQ ID NO: 107716 - DNA, 25 bp, Homo sapien
tggattatgttatcttcttttacaa

SEQ ID NO: 107717 - DNA, 25 bp, Homo sapien
tggattatgttattttcttttacaa

SEQ ID NO: 107718 - DNA, 25 bp, Homo sapien
tggattattatgggaaaagctgttg

SEQ ID NO: 107719 - DNA, 25 bp, Homo sapien
tggattattatggggaaagctgttg

SEQ ID NO: 107720 - DNA, 25 bp, Homo sapien
tggattccaataaaacaaatcacct

SEQ ID NO: 107721 - DNA, 25 bp, Homo sapien
tggattccagtaaaacaaatcacct

SEQ ID NO: 107722 - DNA, 25 bp, Homo sapien
tggattctccacagcgttcatcatc

SEQ ID NO: 107723 - DNA, 25 bp, Homo sapien
tggattctccacagtgttcatcatc

SEQ ID NO: 107724 - DNA, 25 bp, Homo sapien
tggattcttgcaaaagatagtaatt

SEQ ID NO: 107725 - DNA, 25 bp, Homo sapien
tggattcttgcacaagatagtaatt

SEQ ID NO: 107726 - DNA, 25 bp, Homo sapien
tggattgaaagaaaaggctgggaaa

SEQ ID NO: 107727 - DNA, 25 bp, Homo sapien
tggattgaaagaaatggctgggaaa

SEQ ID NO: 107728 - DNA, 25 bp, Homo sapien
tggattgaccacctaatctcatcat

SEQ ID NO: 107729 - DNA, 25 bp, Homo sapien
tggattgaccacgtaatctcatcat

SEQ ID NO: 107730 - DNA, 25 bp, Homo sapien
tggattgactgtggtcagagcctgt

SEQ ID NO: 107731 - DNA, 25 bp, Homo sapien
tggattgactgttgtcagagcctgt

SEQ ID NO: 107732 - DNA, 25 bp, Homo sapien
tggattgcaccagcgggcttcttag

SEQ ID NO: 107733 - DNA, 25 bp, Homo sapien
tggattgcaccatcgggcttcttag

SEQ ID NO: 107734 - DNA, 25 bp, Homo sapien
tggattggaagtactctgcatcttg

SEQ ID NO: 107735 - DNA, 25 bp, Homo sapien
tggattggaagtgctctgcatcttg

SEQ ID NO: 107736 - DNA, 25 bp, Homo sapien
tggattgtgggaccagagcattcag

SEQ ID NO: 107737 - DNA, 25 bp, Homo sapien
tggattgtgggaccggagcattcag

SEQ ID NO: 107738 - DNA, 25 bp, Homo sapien
tggatttaatgtaagtcttgggatc

SEQ ID NO: 107739 - DNA, 25 bp, Homo sapien
tggatttagtaactgcaggtaagca

SEQ ID NO: 107740 - DNA, 25 bp, Homo sapien
tggatttagtaattgcaggtaagca

SEQ ID NO: 107741 - DNA, 25 bp, Homo sapien
tggatttagtgtaagtcttgggatc

SEQ ID NO: 107742 - DNA, 25 bp, Homo sapien
tggatttcaaagactgtataaaaaa

SEQ ID NO: 107743 - DNA, 25 bp, Homo sapien
tggatttcaaagattgtataaaaaa

SEQ ID NO: 107744 - DNA, 25 bp, Homo sapien
tggatttgtgaaagatggctatagg

SEQ ID NO: 107745 - DNA, 25 bp, Homo sapien
tggatttgtgaacgatggctatagg

SEQ ID NO: 107746 - DNA, 25 bp, Homo sapien
tggatttttccataatcgccattct

SEQ ID NO: 107747 - DNA, 25 bp, Homo sapien
tggattttttcataatcgccattct

SEQ ID NO: 107748 - DNA, 25 bp, Homo sapien
tggcaaaagctcaactctactaaaa

SEQ ID NO: 107749 - DNA, 25 bp, Homo sapien
tggcaaaagctcacctctactaaaa

SEQ ID NO: 107750 - DNA, 25 bp, Homo sapien
tggcaaaattaaacgtatattaaat

SEQ ID NO: 107751 - DNA, 25 bp, Homo sapien
tggcaaaattaaaggtatattaaat

SEQ ID NO: 107752 - DNA, 25 bp, Homo sapien
tggcaaaattacatatgagcttccc

SEQ ID NO: 107753 - DNA, 25 bp, Homo sapien
tggcaaaattatatatgagcttccc

SEQ ID NO: 107754 - DNA, 25 bp, Homo sapien
tggcaaaccatgtgttgttattatt

SEQ ID NO: 107755 - DNA, 25 bp, Homo sapien
tggcaaactatgtgttgttattatt

SEQ ID NO: 107756 - DNA, 25 bp, Homo sapien
tggcaaagaagatcacaataattca

SEQ ID NO: 107757 - DNA, 25 bp, Homo sapien
tggcaaagaggatcacaataattca

SEQ ID NO: 107758 - DNA, 25 bp, Homo sapien
tggcaaagcaagacaccctagtaaa

SEQ ID NO: 107759 - DNA, 25 bp, Homo sapien
tggcaaagcaaggcaccctagtaaa

SEQ ID NO: 107760 - DNA, 25 bp, Homo sapien
tggcaaagcacctatttgaatcttt

SEQ ID NO: 107761 - DNA, 25 bp, Homo sapien
tggcaaagcacctgtttgaatcttt

SEQ ID NO: 107762 - DNA, 25 bp, Homo sapien
tggcaaatactgagggcagggcctt

SEQ ID NO: 107763 - DNA, 25 bp, Homo sapien
tggcaaatactgcgtttcatcccag

SEQ ID NO: 107764 - DNA, 25 bp, Homo sapien
tggcaaatactgtgtttcatcccag

SEQ ID NO: 107765 - DNA, 25 bp, Homo sapien
tggcaaatacttagggcagggcctt

SEQ ID NO: 107766 - DNA, 25 bp, Homo sapien
tggcaaattagctgggtttataatt

SEQ ID NO: 107767 - DNA, 25 bp, Homo sapien
tggcaaattagttgggtttataatt

SEQ ID NO: 107768 - DNA, 25 bp, Homo sapien
tggcaacacggcaggactgtggtcc

SEQ ID NO: 107769 - DNA, 25 bp, Homo sapien
tggcaacactgagcttttgtctcta

SEQ ID NO: 107770 - DNA, 25 bp, Homo sapien
tggcaacactgcaggactgtggtcc

SEQ ID NO: 107771 - DNA, 25 bp, Homo sapien
tggcaacagattgtgaacatgccag

SEQ ID NO: 107772 - DNA, 25 bp, Homo sapien
tggcaacaggttgtgaacatgccag

SEQ ID NO: 107773 - DNA, 25 bp, Homo sapien
tggcaacatggttaagcatcagcat

SEQ ID NO: 107774 - DNA, 25 bp, Homo sapien
tggcaacatggttaaggatcagcat

SEQ ID NO: 107775 - DNA, 25 bp, Homo sapien
tggcaacattgagcttttgtctcta

SEQ ID NO: 107776 - DNA, 25 bp, Homo sapien
tggcaaccaaagaaggagcttttac

SEQ ID NO: 107777 - DNA, 25 bp, Homo sapien
tggcaaccaaagagggagcttttac

SEQ ID NO: 107778 - DNA, 25 bp, Homo sapien
tggcaactaatatcaccatgagact

SEQ ID NO: 107779 - DNA, 25 bp, Homo sapien
tggcaactaatgtcaccatgagact

SEQ ID NO: 107780 - DNA, 25 bp, Homo sapien
tggcaagaacgttacaaatgaaatc

SEQ ID NO: 107781 - DNA, 25 bp, Homo sapien
tggcaagaatgttacaaatgaaatc

SEQ ID NO: 107782 - DNA, 25 bp, Homo sapien
tggcaagagaggaaggccgatggga

SEQ ID NO: 107783 - DNA, 25 bp, Homo sapien
tggcaagagaggaaggtcgatggga

SEQ ID NO: 107784 - DNA, 25 bp, Homo sapien
tggcaagccttgacgggagagccaa

SEQ ID NO: 107785 - DNA, 25 bp, Homo sapien
tggcaagccttgatgggagagccaa

SEQ ID NO: 107786 - DNA, 25 bp, Homo sapien
tggcaaggacatcttggtcatcaag

SEQ ID NO: 107787 - DNA, 25 bp, Homo sapien
tggcaaggatatcttggtcatcaag

SEQ ID NO: 107788 - DNA, 25 bp, Homo sapien
tggcaagtcgatatagccctatcta

SEQ ID NO: 107789 - DNA, 25 bp, Homo sapien
tggcaagtggatatagccctatcta

SEQ ID NO: 107790 - DNA, 25 bp, Homo sapien
tggcaagtttttatcaggccttcct

SEQ ID NO: 107791 - DNA, 25 bp, Homo sapien
tggcaagtttttattaggccttcct

SEQ ID NO: 107792 - DNA, 25 bp, Homo sapien
tggcaataaaggtactgagcataag

SEQ ID NO: 107793 - DNA, 25 bp, Homo sapien
tggcaataaaggttctgagcataag

SEQ ID NO: 107794 - DNA, 25 bp, Homo sapien
tggcaatactcatcatatcagtgat

SEQ ID NO: 107795 - DNA, 25 bp, Homo sapien
tggcaatactcatcgtatcagtgat

SEQ ID NO: 107796 - DNA, 25 bp, Homo sapien
tggcaataggggtgccagtgaacaa

SEQ ID NO: 107797 - DNA, 25 bp, Homo sapien
tggcaataggggtgccggtgaacaa

SEQ ID NO: 107798 - DNA, 25 bp, Homo sapien
tggcaattcctaataaagcaacata

SEQ ID NO: 107799 - DNA, 25 bp, Homo sapien
tggcaattcctattaaagcaacata

SEQ ID NO: 107800 - DNA, 25 bp, Homo sapien
tggcacaaaacagatctagaataag

SEQ ID NO: 107801 - DNA, 25 bp, Homo sapien
tggcacaaaactgatctagaataag

SEQ ID NO: 107802 - DNA, 25 bp, Homo sapien
tggcacaaggttcgagaggccaaag

SEQ ID NO: 107803 - DNA, 25 bp, Homo sapien
tggcacaaggtttgagaggccaaag

SEQ ID NO: 107804 - DNA, 25 bp, Homo sapien
tggcacatctgaaatttacataaga

SEQ ID NO: 107805 - DNA, 25 bp, Homo sapien
tggcacatctgaactttacataaga

SEQ ID NO: 107806 - DNA, 25 bp, Homo sapien
tggcacatgacacagtgagacacca

SEQ ID NO: 107807 - DNA, 25 bp, Homo sapien
tggcacattacacagtgagacacca

SEQ ID NO: 107808 - DNA, 25 bp, Homo sapien
tggcaccagcaggtccatttggatc

SEQ ID NO: 107809 - DNA, 25 bp, Homo sapien
tggcaccagcaggtccctttggatc

SEQ ID NO: 107810 - DNA, 25 bp, Homo sapien
tggcaccccattgctgctttctttc

SEQ ID NO: 107811 - DNA, 25 bp, Homo sapien
tggcaccccgagtcctgccattact

SEQ ID NO: 107812 - DNA, 25 bp, Homo sapien
tggcaccccgagtcttgccattact

SEQ ID NO: 107813 - DNA, 25 bp, Homo sapien
tggcaccctattgctgctttctttc

SEQ ID NO: 107814 - DNA, 25 bp, Homo sapien
tggcacctccaacagttttgctcca

SEQ ID NO: 107815 - DNA, 25 bp, Homo sapien
tggcacctccaatagttttgctcca

SEQ ID NO: 107816 - DNA, 25 bp, Homo sapien
tggcacgcagagattaagaagtgac

SEQ ID NO: 107817 - DNA, 25 bp, Homo sapien
tggcacgcagagattaggaagtgac

SEQ ID NO: 107818 - DNA, 25 bp, Homo sapien
tggcacgttaaagaaagaaagatgg

SEQ ID NO: 107819 - DNA, 25 bp, Homo sapien
tggcacgttaaagagagaaagatgg

SEQ ID NO: 107820 - DNA, 25 bp, Homo sapien
tggcacgttacattataaccactca

SEQ ID NO: 107821 - DNA, 25 bp, Homo sapien
tggcacgttacgttataaccactca

SEQ ID NO: 107822 - DNA, 25 bp, Homo sapien
tggcactatcatctactacccattc

SEQ ID NO: 107823 - DNA, 25 bp, Homo sapien
tggcactatcatttactacccattc

SEQ ID NO: 107824 - DNA, 25 bp, Homo sapien
tggcactatccatagcaggcttctt

SEQ ID NO: 107825 - DNA, 25 bp, Homo sapien
tggcactatccatcgcaggcttctt

SEQ ID NO: 107826 - DNA, 25 bp, Homo sapien
tggcactatgtgttaattgcttagt

SEQ ID NO: 107827 - DNA, 25 bp, Homo sapien
tggcactatgtgtttattgcttagt

SEQ ID NO: 107828 - DNA, 25 bp, Homo sapien
tggcactcagtctggtgggtattac

SEQ ID NO: 107829 - DNA, 25 bp, Homo sapien
tggcactcagtgtggtgggtattac

SEQ ID NO: 107830 - DNA, 25 bp, Homo sapien
tggcactgtattttaacgtaaaaca

SEQ ID NO: 107831 - DNA, 25 bp, Homo sapien
tggcactgtattttaatgtaaaaca

SEQ ID NO: 107832 - DNA, 25 bp, Homo sapien
tggcacttacttcagtgtctgagct

SEQ ID NO: 107833 - DNA, 25 bp, Homo sapien
tggcacttactttagtgtctgagct

SEQ ID NO: 107834 - DNA, 25 bp, Homo sapien
tggcacttcagcgactattcaatat

SEQ ID NO: 107835 - DNA, 25 bp, Homo sapien
tggcacttgctgttcctccagcctg

SEQ ID NO: 107836 - DNA, 25 bp, Homo sapien
tggcacttgttgttcctccagcctg

SEQ ID NO: 107837 - DNA, 25 bp, Homo sapien
tggcactttagcgactattcaatat

SEQ ID NO: 107838 - DNA, 25 bp, Homo sapien
tggcagaatggatctttaaaaggca

SEQ ID NO: 107839 - DNA, 25 bp, Homo sapien
tggcagaatgggtctttaaaaggca

SEQ ID NO: 107840 - DNA, 25 bp, Homo sapien
tggcagagacaacagaaaaaactag

SEQ ID NO: 107841 - DNA, 25 bp, Homo sapien
tggcagagataaacaattaaattca

SEQ ID NO: 107842 - DNA, 25 bp, Homo sapien
tggcagagataacagaaaaaactag

SEQ ID NO: 107843 - DNA, 25 bp, Homo sapien
tggcagagataagcaattaaattca

SEQ ID NO: 107844 - DNA, 25 bp, Homo sapien
tggcagcatgccgtgagagtcactc

SEQ ID NO: 107845 - DNA, 25 bp, Homo sapien
tggcagcatgctgtgagagtcactc

SEQ ID NO: 107846 - DNA, 25 bp, Homo sapien
tggcagctaagtacctatttttcat

SEQ ID NO: 107847 - DNA, 25 bp, Homo sapien
tggcagctaggtacctatttttcat

SEQ ID NO: 107848 - DNA, 25 bp, Homo sapien
tggcaggaaatagcctatcaccctg

SEQ ID NO: 107849 - DNA, 25 bp, Homo sapien
tggcaggaaatagcgtatcaccctg

SEQ ID NO: 107850 - DNA, 25 bp, Homo sapien
tggcaggatgctattggctttccct

SEQ ID NO: 107851 - DNA, 25 bp, Homo sapien
tggcaggatgctattgtctttccct

SEQ ID NO: 107852 - DNA, 25 bp, Homo sapien
tggcaggatttacaggtaaaggata

SEQ ID NO: 107853 - DNA, 25 bp, Homo sapien
tggcaggatttagaggtaaaggata

SEQ ID NO: 107854 - DNA, 25 bp, Homo sapien
tggcagtccagcactctctaacaga

SEQ ID NO: 107855 - DNA, 25 bp, Homo sapien
tggcagtccagcattctctaacaga

SEQ ID NO: 107856 - DNA, 25 bp, Homo sapien
tggcagtctcgttctctataaaaca

SEQ ID NO: 107857 - DNA, 25 bp, Homo sapien
tggcagtcttgttctctataaaaca

SEQ ID NO: 107858 - DNA, 25 bp, Homo sapien
tggcagttacggatgtatgaaatat

SEQ ID NO: 107859 - DNA, 25 bp, Homo sapien
tggcagttatggatgtatgaaatat

SEQ ID NO: 107860 - DNA, 25 bp, Homo sapien
tggcataacttgcggtccagtaatg

SEQ ID NO: 107861 - DNA, 25 bp, Homo sapien
tggcataagagtctcagtctggata

SEQ ID NO: 107862 - DNA, 25 bp, Homo sapien
tggcataagagtttcagtctggata

SEQ ID NO: 107863 - DNA, 25 bp, Homo sapien
tggcataatttgcggtccagtaatg

SEQ ID NO: 107864 - DNA, 25 bp, Homo sapien
tggcatacacatacgagttgaaagg

SEQ ID NO: 107865 - DNA, 25 bp, Homo sapien
tggcatacgcatacgagttgaaagg

SEQ ID NO: 107866 - DNA, 25 bp, Homo sapien
tggcatagttcacgtgtaattacaa

SEQ ID NO: 107867 - DNA, 25 bp, Homo sapien
tggcatagttcacttgtaattacaa

SEQ ID NO: 107868 - DNA, 25 bp, Homo sapien
tggcatatagtaagcaatgaaaagt

SEQ ID NO: 107869 - DNA, 25 bp, Homo sapien
tggcatatagtaagcactgaaaagt

SEQ ID NO: 107870 - DNA, 25 bp, Homo sapien
tggcatatgaaccatttacttctaa

SEQ ID NO: 107871 - DNA, 25 bp, Homo sapien
tggcatatgaaccgtttacttctaa

SEQ ID NO: 107872 - DNA, 25 bp, Homo sapien
tggcatcagttttcagcgatcagga

SEQ ID NO: 107873 - DNA, 25 bp, Homo sapien
tggcatcagttttcagggatcagga

SEQ ID NO: 107874 - DNA, 25 bp, Homo sapien
tggcatctccaatagtaatcatgtc

SEQ ID NO: 107875 - DNA, 25 bp, Homo sapien
tggcatctccagtagtaatcatgtc

SEQ ID NO: 107876 - DNA, 25 bp, Homo sapien
tggcatggagcaaagcagagaactc

SEQ ID NO: 107877 - DNA, 25 bp, Homo sapien
tggcatggagcatagcagagaactc

SEQ ID NO: 107878 - DNA, 25 bp, Homo sapien
tggcatgggcaaatttaatgtaaga

SEQ ID NO: 107879 - DNA, 25 bp, Homo sapien
tggcatgggcaaatttgatgtaaga

SEQ ID NO: 107880 - DNA, 25 bp, Homo sapien
tggcatgtatcgtggcaatctttat

SEQ ID NO: 107881 - DNA, 25 bp, Homo sapien
tggcatgtcgaaaactgagaaaggc

SEQ ID NO: 107882 - DNA, 25 bp, Homo sapien
tggcatgtcgaaagctgagaaaggc

SEQ ID NO: 107883 - DNA, 25 bp, Homo sapien
tggcatgtctcgtggcaatctttat

SEQ ID NO: 107884 - DNA, 25 bp, Homo sapien
tggcatgttataatttaattggcag

SEQ ID NO: 107885 - DNA, 25 bp, Homo sapien
tggcatgttataatttcattggcag

SEQ ID NO: 107886 - DNA, 25 bp, Homo sapien
tggcattactaacgtctcctttctg

SEQ ID NO: 107887 - DNA, 25 bp, Homo sapien
tggcattactaatgtctcctttctg

SEQ ID NO: 107888 - DNA, 25 bp, Homo sapien
tggcattagtgaaattgcttcctga

SEQ ID NO: 107889 - DNA, 25 bp, Homo sapien
tggcattagtgacattgcttcctga

SEQ ID NO: 107890 - DNA, 25 bp, Homo sapien
tggcattcatttccctttcttgctt

SEQ ID NO: 107891 - DNA, 25 bp, Homo sapien
tggcattccaggctagctctgttac

SEQ ID NO: 107892 - DNA, 25 bp, Homo sapien
tggcattccaggttagctctgttac

SEQ ID NO: 107893 - DNA, 25 bp, Homo sapien
tggcattcgtttccctttcttgctt

SEQ ID NO: 107894 - DNA, 25 bp, Homo sapien
tggcattgatcaaacactttactat

SEQ ID NO: 107895 - DNA, 25 bp, Homo sapien
tggcattgttcaaacactttactat

SEQ ID NO: 107896 - DNA, 25 bp, Homo sapien
tggcatttacctacttcaaaacatg

SEQ ID NO: 107897 - DNA, 25 bp, Homo sapien
tggcatttacctgcttcaaaacatg

SEQ ID NO: 107898 - DNA, 25 bp, Homo sapien
tggcatttgatgatctagtcactct

SEQ ID NO: 107899 - DNA, 25 bp, Homo sapien
tggcatttgatggtctagtcactct

SEQ ID NO: 107900 - DNA, 25 bp, Homo sapien
tggcatttgcttcaaacagcctgca

SEQ ID NO: 107901 - DNA, 25 bp, Homo sapien
tggcatttgtttcaaacagcctgca

SEQ ID NO: 107902 - DNA, 25 bp, Homo sapien
tggccaaaatatggaccaaaactca

SEQ ID NO: 107903 - DNA, 25 bp, Homo sapien
tggccaaaatatgggccaaaactca

SEQ ID NO: 107904 - DNA, 25 bp, Homo sapien
tggccaactcaacgatacaaaaaca

SEQ ID NO: 107905 - DNA, 25 bp, Homo sapien
tggccaactcatcgatacaaaaaca

SEQ ID NO: 107906 - DNA, 25 bp, Homo sapien
tggccaaggacgtcgtagttggagg

SEQ ID NO: 107907 - DNA, 25 bp, Homo sapien
tggccaaggacttcgtagttggagg

SEQ ID NO: 107908 - DNA, 25 bp, Homo sapien
tggccaccatcatccatacagagag

SEQ ID NO: 107909 - DNA, 25 bp, Homo sapien
tggccaccatcattcatacagagag

SEQ ID NO: 107910 - DNA, 25 bp, Homo sapien
tggccactttttgcccaccttaatg

SEQ ID NO: 107911 - DNA, 25 bp, Homo sapien
tggccactttttgccccccttaatg

SEQ ID NO: 107912 - DNA, 25 bp, Homo sapien
tggccagaaagtaacccgaggactt

SEQ ID NO: 107913 - DNA, 25 bp, Homo sapien
tggccagaaagtaacctgaggactt

SEQ ID NO: 107914 - DNA, 25 bp, Homo sapien
tggccagcaagggaagtgttatacg

SEQ ID NO: 107915 - DNA, 25 bp, Homo sapien
tggccagcaagggcagtgttatacg

SEQ ID NO: 107916 - DNA, 25 bp, Homo sapien
tggccagtgaatgaagcgtgagaat

SEQ ID NO: 107917 - DNA, 25 bp, Homo sapien
tggccagtgaatgaagtgtgagaat

SEQ ID NO: 107918 - DNA, 25 bp, Homo sapien
tggccagttacatttctcatcaatc

SEQ ID NO: 107919 - DNA, 25 bp, Homo sapien
tggccagttgcatttctcatcaatc

SEQ ID NO: 107920 - DNA, 25 bp, Homo sapien
tggccatacccttcatttttgtaat

SEQ ID NO: 107921 - DNA, 25 bp, Homo sapien
tggccatactcttcatttttgtaat

SEQ ID NO: 107922 - DNA, 25 bp, Homo sapien
tggccatcacaggtaaattcttaca

SEQ ID NO: 107923 - DNA, 25 bp, Homo sapien
tggccatcacaggtaagttcttaca

SEQ ID NO: 107924 - DNA, 25 bp, Homo sapien
tggccatcactcgggaaaatccatt

SEQ ID NO: 107925 - DNA, 25 bp, Homo sapien
tggccatcattcgggaaaatccatt

SEQ ID NO: 107926 - DNA, 25 bp, Homo sapien
tggccatccagaactaatgcccaag

SEQ ID NO: 107927 - DNA, 25 bp, Homo sapien
tggccatccggaactaatgcccaag

SEQ ID NO: 107928 - DNA, 25 bp, Homo sapien
tggccatgcatcaataacataatac

SEQ ID NO: 107929 - DNA, 25 bp, Homo sapien
tggccatgcgtcaataacataatac

SEQ ID NO: 107930 - DNA, 25 bp, Homo sapien
tggccatggagataaatttgcaatc

SEQ ID NO: 107931 - DNA, 25 bp, Homo sapien
tggccatggagatacatttgcaatc

SEQ ID NO: 107932 - DNA, 25 bp, Homo sapien
tggccattacgttattgtccagttt

SEQ ID NO: 107933 - DNA, 25 bp, Homo sapien
tggccattatggtattgtccagttt

SEQ ID NO: 107934 - DNA, 25 bp, Homo sapien
tggccattatgttattgtccagttt

SEQ ID NO: 107935 - DNA, 25 bp, Homo sapien
tggcccaacaaaggttcagaaatgt

SEQ ID NO: 107936 - DNA, 25 bp, Homo sapien
tggcccaacaaagtttcagaaatgt

SEQ ID NO: 107937 - DNA, 25 bp, Homo sapien
tggcccagatttcgtttctggtgct

SEQ ID NO: 107938 - DNA, 25 bp, Homo sapien
tggcccagattttgtttctggtgct

SEQ ID NO: 107939 - DNA, 25 bp, Homo sapien
tggccctaatcagtgcattctaata

SEQ ID NO: 107940 - DNA, 25 bp, Homo sapien
tggccctaatcagtgccttctaata

SEQ ID NO: 107941 - DNA, 25 bp, Homo sapien
tggccctcgttaattttatcagata

SEQ ID NO: 107942 - DNA, 25 bp, Homo sapien
tggccctctttaattttatcagata

SEQ ID NO: 107943 - DNA, 25 bp, Homo sapien
tggccgccttggtcaccgcacagga

SEQ ID NO: 107944 - DNA, 25 bp, Homo sapien
tggccgccttggtcactgcacagga

SEQ ID NO: 107945 - DNA, 25 bp, Homo sapien
tggccgtccatggtggcagtcagcg

SEQ ID NO: 107946 - DNA, 25 bp, Homo sapien
tggccgtccgtggtggcagtcagcg

SEQ ID NO: 107947 - DNA, 25 bp, Homo sapien
tggcctaagaaaatgcagttaaaat

SEQ ID NO: 107948 - DNA, 25 bp, Homo sapien
tggcctaaggaaatgcagttaaaat

SEQ ID NO: 107949 - DNA, 25 bp, Homo sapien
tggcctaggcaagcacagaatgccc

SEQ ID NO: 107950 - DNA, 25 bp, Homo sapien
tggcctaggcaagcacggaatgccc

SEQ ID NO: 107951 - DNA, 25 bp, Homo sapien
tggcctatccaccacattccatatt

SEQ ID NO: 107952 - DNA, 25 bp, Homo sapien
tggcctatccaccatattccatatt

SEQ ID NO: 107953 - DNA, 25 bp, Homo sapien
tggcctcaccctggacgctgggcct

SEQ ID NO: 107954 - DNA, 25 bp, Homo sapien
tggcctcagcaactccattcacttc

SEQ ID NO: 107955 - DNA, 25 bp, Homo sapien
tggcctcagcagctccattcacttc

SEQ ID NO: 107956 - DNA, 25 bp, Homo sapien
tggcctcatcctggacgctgggcct

SEQ ID NO: 107957 - DNA, 25 bp, Homo sapien
tggcctccatctcgattgccatctc

SEQ ID NO: 107958 - DNA, 25 bp, Homo sapien
tggcctccatcttgattgccatctc

SEQ ID NO: 107959 - DNA, 25 bp, Homo sapien
tggcctctacctttccaagtgtatg

SEQ ID NO: 107960 - DNA, 25 bp, Homo sapien
tggcctctaccttttcaagtgtatg

SEQ ID NO: 107961 - DNA, 25 bp, Homo sapien
tggcctgcacccatgggatggaaac

SEQ ID NO: 107962 - DNA, 25 bp, Homo sapien
tggcctgcacctatgggatggaaac

SEQ ID NO: 107963 - DNA, 25 bp, Homo sapien
tggcctgctcccaacgtacctgttg

SEQ ID NO: 107964 - DNA, 25 bp, Homo sapien
tggcctgctcccaatgtacctgttg

SEQ ID NO: 107965 - DNA, 25 bp, Homo sapien
tggcctggattgacaagcgcaatgc

SEQ ID NO: 107966 - DNA, 25 bp, Homo sapien
tggcctgggttgacaagcgcaatgc

SEQ ID NO: 107967 - DNA, 25 bp, Homo sapien
tggcctgtagattgggtgtgcaggt

SEQ ID NO: 107968 - DNA, 25 bp, Homo sapien
tggcctgtatattgggtgtgcaggt

SEQ ID NO: 107969 - DNA, 25 bp, Homo sapien
tggccttcatctctgcagagtcagt

SEQ ID NO: 107970 - DNA, 25 bp, Homo sapien
tggccttcatctctgccgagtcagt

SEQ ID NO: 107971 - DNA, 25 bp, Homo sapien
tggccttggttgaattggatcagac

SEQ ID NO: 107972 - DNA, 25 bp, Homo sapien
tggccttggttgacttggatcagac

SEQ ID NO: 107973 - DNA, 25 bp, Homo sapien
tggcctttacttatgcagtatagga

SEQ ID NO: 107974 - DNA, 25 bp, Homo sapien
tggcctttagttatgcagtatagga

SEQ ID NO: 107975 - DNA, 25 bp, Homo sapien
tggcgagctatcatactgcattgtt

SEQ ID NO: 107976 - DNA, 25 bp, Homo sapien
tggcgagctatcatgctgcattgtt

SEQ ID NO: 107977 - DNA, 25 bp, Homo sapien
tggcgagctggtgtagagttgacct

SEQ ID NO: 107978 - DNA, 25 bp, Homo sapien
tggcgagctggtgtggagttgacct

SEQ ID NO: 107979 - DNA, 25 bp, Homo sapien
tggcgataaacccaagaggaagggg

SEQ ID NO: 107980 - DNA, 25 bp, Homo sapien
tggcgataaacccgagaggaagggg

SEQ ID NO: 107981 - DNA, 25 bp, Homo sapien
tggcggagcttggttttcccaccag

SEQ ID NO: 107982 - DNA, 25 bp, Homo sapien
tggcggaggttggttttcccaccag

SEQ ID NO: 107983 - DNA, 25 bp, Homo sapien
tggcgtaacatacatactattgatt

SEQ ID NO: 107984 - DNA, 25 bp, Homo sapien
tggcgtaacatatatactattgatt

SEQ ID NO: 107985 - DNA, 25 bp, Homo sapien
tggcgtgaaccctggcattttcatg

SEQ ID NO: 107986 - DNA, 25 bp, Homo sapien
tggcgtgaaccctggcgttttcatg

SEQ ID NO: 107987 - DNA, 25 bp, Homo sapien
tggcgtgacttcatcttgactaatt

SEQ ID NO: 107988 - DNA, 25 bp, Homo sapien
tggcgtgagttcatcttgactaatt

SEQ ID NO: 107989 - DNA, 25 bp, Homo sapien
tggctaagcataaagctgttatcag

SEQ ID NO: 107990 - DNA, 25 bp, Homo sapien
tggctaagcattaagctgttatcag

SEQ ID NO: 107991 - DNA, 25 bp, Homo sapien
tggctacaaggaaagaagagctatc

SEQ ID NO: 107992 - DNA, 25 bp, Homo sapien
tggctacaaggaacgaagagctatc

SEQ ID NO: 107993 - DNA, 25 bp, Homo sapien
tggctactcttccaacgcaccatga

SEQ ID NO: 107994 - DNA, 25 bp, Homo sapien
tggctactctttcaacgcaccatga

SEQ ID NO: 107995 - DNA, 25 bp, Homo sapien
tggctagaatttacaataatatgtt

SEQ ID NO: 107996 - DNA, 25 bp, Homo sapien
tggctagaatttccaataatatgtt

SEQ ID NO: 107997 - DNA, 25 bp, Homo sapien
tggctagagtaagtgtaaacaggtc

SEQ ID NO: 107998 - DNA, 25 bp, Homo sapien
tggctagagtaagtgtgaacaggtc

SEQ ID NO: 107999 - DNA, 25 bp, Homo sapien
tggctagcagcatttccctttgcct

SEQ ID NO: 108000 - DNA, 25 bp, Homo sapien
tggctagcggcatttccctttgcct

SEQ ID NO: 108001 - DNA, 25 bp, Homo sapien
tggctagctgctgaaaccagtttca

SEQ ID NO: 108002 - DNA, 25 bp, Homo sapien
tggctagcttctgaaaccagtttca

SEQ ID NO: 108003 - DNA, 25 bp, Homo sapien
tggctaggaaaatgaatatttactt

SEQ ID NO: 108004 - DNA, 25 bp, Homo sapien
tggctaggaaagtgaatatttactt

SEQ ID NO: 108005 - DNA, 25 bp, Homo sapien
tggctagtgtccttgaaggttggta

SEQ ID NO: 108006 - DNA, 25 bp, Homo sapien
tggctagtgtccttgagggttggta

SEQ ID NO: 108007 - DNA, 25 bp, Homo sapien
tggctatgctacagaagacaagaag

SEQ ID NO: 108008 - DNA, 25 bp, Homo sapien
tggctatgctatagaagacaagaag

SEQ ID NO: 108009 - DNA, 25 bp, Homo sapien
tggctatgtagacccggttcgcagt

SEQ ID NO: 108010 - DNA, 25 bp, Homo sapien
tggctatgtagagccggttcgcagt

SEQ ID NO: 108011 - DNA, 25 bp, Homo sapien
tggctatttatcctgcttacaagaa

SEQ ID NO: 108012 - DNA, 25 bp, Homo sapien
tggctatttatgctgcttacaagaa

SEQ ID NO: 108013 - DNA, 25 bp, Homo sapien
tggctcagagcttgccaggtagtga

SEQ ID NO: 108014 - DNA, 25 bp, Homo sapien
tggctcagagcttgtcaggtagtga

SEQ ID NO: 108015 - DNA, 25 bp, Homo sapien
tggctcagcatgccttaacagaata

SEQ ID NO: 108016 - DNA, 25 bp, Homo sapien
tggctcagcgtgccttaacagaata

SEQ ID NO: 108017 - DNA, 25 bp, Homo sapien
tggctcagttacgcactttaaatcc

SEQ ID NO: 108018 - DNA, 25 bp, Homo sapien
tggctcagttactcactttaaatcc

SEQ ID NO: 108019 - DNA, 25 bp, Homo sapien
tggctcatgactcatactaggggat

SEQ ID NO: 108020 - DNA, 25 bp, Homo sapien
tggctcatggctcatactaggggat

SEQ ID NO: 108021 - DNA, 25 bp, Homo sapien
tggctccaggctgccatacactgag

SEQ ID NO: 108022 - DNA, 25 bp, Homo sapien
tggctccaggctgtcatacactgag

SEQ ID NO: 108023 - DNA, 25 bp, Homo sapien
tggctccatccgccatatttaaagc

SEQ ID NO: 108024 - DNA, 25 bp, Homo sapien
tggctccatcctccatatttaaagc

SEQ ID NO: 108025 - DNA, 25 bp, Homo sapien
tggctccgacctgcaccgtgctctc

SEQ ID NO: 108026 - DNA, 25 bp, Homo sapien
tggctccgacctgcactgtgctctc

SEQ ID NO: 108027 - DNA, 25 bp, Homo sapien
tggctcctaccaattgaggtcattt

SEQ ID NO: 108028 - DNA, 25 bp, Homo sapien
tggctcctgccaattgaggtcattt

SEQ ID NO: 108029 - DNA, 25 bp, Homo sapien
tggctctaccttgtatcgttctatg

SEQ ID NO: 108030 - DNA, 25 bp, Homo sapien
tggctctaccttgtattgttctatg

SEQ ID NO: 108031 - DNA, 25 bp, Homo sapien
tggctctcagttcagagattcagct

SEQ ID NO: 108032 - DNA, 25 bp, Homo sapien
tggctctccagtgtatgtaatgctg

SEQ ID NO: 108033 - DNA, 25 bp, Homo sapien
tggctctccagtgtgtgtaatgctg

SEQ ID NO: 108034 - DNA, 25 bp, Homo sapien
tggctctccgtaattatctcttcaa

SEQ ID NO: 108035 - DNA, 25 bp, Homo sapien
tggctctccgtagttatctcttcaa

SEQ ID NO: 108036 - DNA, 25 bp, Homo sapien
tggctctcctacctccttttccttc

SEQ ID NO: 108037 - DNA, 25 bp, Homo sapien
tggctctcggttcagagattcagct

SEQ ID NO: 108038 - DNA, 25 bp, Homo sapien
tggctctcttacctccttttccttc

SEQ ID NO: 108039 - DNA, 25 bp, Homo sapien
tggctctgagaatatcttcatgcca

SEQ ID NO: 108040 - DNA, 25 bp, Homo sapien
tggctctgagattatcttcatgcca

SEQ ID NO: 108041 - DNA, 25 bp, Homo sapien
tggctctgccgtttctactatattt

SEQ ID NO: 108042 - DNA, 25 bp, Homo sapien
tggctctgtcgtttctactatattt

SEQ ID NO: 108043 - DNA, 25 bp, Homo sapien
tggctcttaaaagcgtccacctgta

SEQ ID NO: 108044 - DNA, 25 bp, Homo sapien
tggctcttaaaagcttccacctgta

SEQ ID NO: 108045 - DNA, 25 bp, Homo sapien
tggctcttcttagatgagacccaat

SEQ ID NO: 108046 - DNA, 25 bp, Homo sapien
tggctcttcttcgatgagacccaat

SEQ ID NO: 108047 - DNA, 25 bp, Homo sapien
tggctcttggccgtagaagagcatg

SEQ ID NO: 108048 - DNA, 25 bp, Homo sapien
tggctcttggctgtagaagagcatg

SEQ ID NO: 108049 - DNA, 25 bp, Homo sapien
tggctgaacacaaaacactggatac

SEQ ID NO: 108050 - DNA, 25 bp, Homo sapien
tggctgaactcttagagaggcaggc

SEQ ID NO: 108051 - DNA, 25 bp, Homo sapien
tggctgaactcttggagaggcaggc

SEQ ID NO: 108052 - DNA, 25 bp, Homo sapien
tggctgaatacaaaacactggatac

SEQ ID NO: 108053 - DNA, 25 bp, Homo sapien
tggctgacgtggtgcccatcaggac

SEQ ID NO: 108054 - DNA, 25 bp, Homo sapien
tggctgacgtgttgcccatcaggac

SEQ ID NO: 108055 - DNA, 25 bp, Homo sapien
tggctgagattacgatatccattga

SEQ ID NO: 108056 - DNA, 25 bp, Homo sapien
tggctgagattatgatatccattga

SEQ ID NO: 108057 - DNA, 25 bp, Homo sapien
tggctgagccttggtaatcaagtca

SEQ ID NO: 108058 - DNA, 25 bp, Homo sapien
tggctgagtcttggtaatcaagtca

SEQ ID NO: 108059 - DNA, 25 bp, Homo sapien
tggctgatgaaaaattatcttgatg

SEQ ID NO: 108060 - DNA, 25 bp, Homo sapien
tggctgatgaaacattatcttgatg

SEQ ID NO: 108061 - DNA, 25 bp, Homo sapien
tggctgatgaatagactagctgctt

SEQ ID NO: 108062 - DNA, 25 bp, Homo sapien
tggctgatgaatggactagctgctt

SEQ ID NO: 108063 - DNA, 25 bp, Homo sapien
tggctgcaacagagaccgtgtggcc

SEQ ID NO: 108064 - DNA, 25 bp, Homo sapien
tggctgcaacagagacggtgtggcc

SEQ ID NO: 108065 - DNA, 25 bp, Homo sapien
tggctgcaacctcaaaaaaagcaaa

SEQ ID NO: 108066 - DNA, 25 bp, Homo sapien
tggctgcaataagctattaaagatg

SEQ ID NO: 108067 - DNA, 25 bp, Homo sapien
tggctgcaatatgctattaaagatg

SEQ ID NO: 108068 - DNA, 25 bp, Homo sapien
tggctgcagttaacacaggaaaacc

SEQ ID NO: 108069 - DNA, 25 bp, Homo sapien
tggctgcagtttacacaggaaaacc

SEQ ID NO: 108070 - DNA, 25 bp, Homo sapien
tggctgcatcctcaaaaaaagcaaa

SEQ ID NO: 108071 - DNA, 25 bp, Homo sapien
tggctgcatctacttgttggcacag

SEQ ID NO: 108072 - DNA, 25 bp, Homo sapien
tggctgcatctatttgttggcacag

SEQ ID NO: 108073 - DNA, 25 bp, Homo sapien
tggctgccacttgcttataaataga

SEQ ID NO: 108074 - DNA, 25 bp, Homo sapien
tggctgccagttgcttataaataga

SEQ ID NO: 108075 - DNA, 25 bp, Homo sapien
tggctgctgcaatattaagttcctt

SEQ ID NO: 108076 - DNA, 25 bp, Homo sapien
tggctgctgcagtattaagttcctt

SEQ ID NO: 108077 - DNA, 25 bp, Homo sapien
tggctgctgggcgttctcctggatg

SEQ ID NO: 108078 - DNA, 25 bp, Homo sapien
tggctgctgggtgttctcctggatg

SEQ ID NO: 108079 - DNA, 25 bp, Homo sapien
tggctggcctcacttaggattgcag

SEQ ID NO: 108080 - DNA, 25 bp, Homo sapien
tggctggcctcagttaggattgcag

SEQ ID NO: 108081 - DNA, 25 bp, Homo sapien
tggctgggcaaataaacggtttggt

SEQ ID NO: 108082 - DNA, 25 bp, Homo sapien
tggctgggcaaataaatggtttggt

SEQ ID NO: 108083 - DNA, 25 bp, Homo sapien
tggctgggtcactgggttgttattg

SEQ ID NO: 108084 - DNA, 25 bp, Homo sapien
tggctgggtcactgtgttgttattg

SEQ ID NO: 108085 - DNA, 25 bp, Homo sapien
tggctgtacgctgaaatgatctagc

SEQ ID NO: 108086 - DNA, 25 bp, Homo sapien
tggctgtatgctgaaatgatctagc

SEQ ID NO: 108087 - DNA, 25 bp, Homo sapien
tggctgtccaagtggttacggggtc

SEQ ID NO: 108088 - DNA, 25 bp, Homo sapien
tggctgtccataattggtaaacatg

SEQ ID NO: 108089 - DNA, 25 bp, Homo sapien
tggctgtccgtaattggtaaacatg

SEQ ID NO: 108090 - DNA, 25 bp, Homo sapien
tggctgtccttccacggatacctga

SEQ ID NO: 108091 - DNA, 25 bp, Homo sapien
tggctgtccttccatggatacctga

SEQ ID NO: 108092 - DNA, 25 bp, Homo sapien
tggctgtcgaagtggttacggggtc

SEQ ID NO: 108093 - DNA, 25 bp, Homo sapien
tggctgtctaatgtttaggactgtg

SEQ ID NO: 108094 - DNA, 25 bp, Homo sapien
tggctgtctgatgtttaggactgtg

SEQ ID NO: 108095 - DNA, 25 bp, Homo sapien
tggctgtgggaaacatgccatgccc

SEQ ID NO: 108096 - DNA, 25 bp, Homo sapien
tggctgtgggaaacgtgccatgccc

SEQ ID NO: 108097 - DNA, 25 bp, Homo sapien
tggctgtgtcctcacagagtgaaag

SEQ ID NO: 108098 - DNA, 25 bp, Homo sapien
tggctgtgtccttacagagtgaaag

SEQ ID NO: 108099 - DNA, 25 bp, Homo sapien
tggctgtgtgatctgctttggccaa

SEQ ID NO: 108100 - DNA, 25 bp, Homo sapien
tggctgtgtgatttgctttggccaa

SEQ ID NO: 108101 - DNA, 25 bp, Homo sapien
tggctgttaaaaaaattcacattca

SEQ ID NO: 108102 - DNA, 25 bp, Homo sapien
tggctgttaaaaaatttcacattca

SEQ ID NO: 108103 - DNA, 25 bp, Homo sapien
tggctgttcgtaggaatggaaggag

SEQ ID NO: 108104 - DNA, 25 bp, Homo sapien
tggctgtttgatttggcgatgacaa

SEQ ID NO: 108105 - DNA, 25 bp, Homo sapien
tggctgtttgatttggtgatgacaa

SEQ ID NO: 108106 - DNA, 25 bp, Homo sapien
tggctgtttgtaggaatggaaggag

SEQ ID NO: 108107 - DNA, 25 bp, Homo sapien
tggcttaaagtatgcaaatcaacca

SEQ ID NO: 108108 - DNA, 25 bp, Homo sapien
tggcttaacgaacctcatatactgt

SEQ ID NO: 108109 - DNA, 25 bp, Homo sapien
tggcttaacgtatgcaaatcaacca

SEQ ID NO: 108110 - DNA, 25 bp, Homo sapien
tggcttaactgagtatcctaaggtg

SEQ ID NO: 108111 - DNA, 25 bp, Homo sapien
tggcttaactgattatcctaaggtg

SEQ ID NO: 108112 - DNA, 25 bp, Homo sapien
tggcttaatgaacctcatatactgt

SEQ ID NO: 108113 - DNA, 25 bp, Homo sapien
tggcttacatgattgtgaggtctag

SEQ ID NO: 108114 - DNA, 25 bp, Homo sapien
tggcttacgtgattgtgaggtctag

SEQ ID NO: 108115 - DNA, 25 bp, Homo sapien
tggcttagcctcttatttaggagct

SEQ ID NO: 108116 - DNA, 25 bp, Homo sapien
tggcttagcttcttatttaggagct

SEQ ID NO: 108117 - DNA, 25 bp, Homo sapien
tggcttaggttctagtggtacatgg

SEQ ID NO: 108118 - DNA, 25 bp, Homo sapien
tggcttaggttctggtggtacatgg

SEQ ID NO: 108119 - DNA, 25 bp, Homo sapien
tggcttatttcaccactgtactgaa

SEQ ID NO: 108120 - DNA, 25 bp, Homo sapien
tggcttatttcatcactgtactgaa

SEQ ID NO: 108121 - DNA, 25 bp, Homo sapien
tggcttatttcctcatctgttttgg

SEQ ID NO: 108122 - DNA, 25 bp, Homo sapien
tggcttatttcctcttctgttttgg

SEQ ID NO: 108123 - DNA, 25 bp, Homo sapien
tggcttcaagacacatttaagagat

SEQ ID NO: 108124 - DNA, 25 bp, Homo sapien
tggcttcaagacagatttaagagat

SEQ ID NO: 108125 - DNA, 25 bp, Homo sapien
tggcttcactgataaacagactcac

SEQ ID NO: 108126 - DNA, 25 bp, Homo sapien
tggcttcactgataaatagactcac

SEQ ID NO: 108127 - DNA, 25 bp, Homo sapien
tggcttccttagcacgagagcagac

SEQ ID NO: 108128 - DNA, 25 bp, Homo sapien
tggcttccttagcatgagagcagac

SEQ ID NO: 108129 - DNA, 25 bp, Homo sapien
tggcttctacctatagtatattatc

SEQ ID NO: 108130 - DNA, 25 bp, Homo sapien
tggcttctacctgtagtatattatc

SEQ ID NO: 108131 - DNA, 25 bp, Homo sapien
tggcttctgatatagcataatacca

SEQ ID NO: 108132 - DNA, 25 bp, Homo sapien
tggcttctgatatggcataatacca

SEQ ID NO: 108133 - DNA, 25 bp, Homo sapien
tggcttctttactgggcttcgcagc

SEQ ID NO: 108134 - DNA, 25 bp, Homo sapien
tggcttctttactgtgcttcgcagc

SEQ ID NO: 108135 - DNA, 25 bp, Homo sapien
tggcttctttttcgtagtataataa

SEQ ID NO: 108136 - DNA, 25 bp, Homo sapien
tggcttctttttcttagtataataa

SEQ ID NO: 108137 - DNA, 25 bp, Homo sapien
tggcttgaacagagaggttgaagaa

SEQ ID NO: 108138 - DNA, 25 bp, Homo sapien
tggcttgaattagatggtgatatct

SEQ ID NO: 108139 - DNA, 25 bp, Homo sapien
tggcttgaattggatggtgatatct

SEQ ID NO: 108140 - DNA, 25 bp, Homo sapien
tggcttgactttaactgggcttttt

SEQ ID NO: 108141 - DNA, 25 bp, Homo sapien
tggcttgactttaattgggcttttt

SEQ ID NO: 108142 - DNA, 25 bp, Homo sapien
tggcttgagcagagaggttgaagaa

SEQ ID NO: 108143 - DNA, 25 bp, Homo sapien
tggcttggatcttttgaatatttaa

SEQ ID NO: 108144 - DNA, 25 bp, Homo sapien
tggcttggctcttttgaatatttaa

SEQ ID NO: 108145 - DNA, 25 bp, Homo sapien
tggcttgtagctagggcactgaaga

SEQ ID NO: 108146 - DNA, 25 bp, Homo sapien
tggcttgtagctggggcactgaaga

SEQ ID NO: 108147 - DNA, 25 bp, Homo sapien
tggctttcattacacagtagctctt

SEQ ID NO: 108148 - DNA, 25 bp, Homo sapien
tggctttcattgcacagtagctctt

SEQ ID NO: 108149 - DNA, 25 bp, Homo sapien
tggctttccgatagcatgggaaatg

SEQ ID NO: 108150 - DNA, 25 bp, Homo sapien
tggctttctgataacagtgataaga

SEQ ID NO: 108151 - DNA, 25 bp, Homo sapien
tggctttctgatagcagtgataaga

SEQ ID NO: 108152 - DNA, 25 bp, Homo sapien
tggctttctgatagcatgggaaatg

SEQ ID NO: 108153 - DNA, 25 bp, Homo sapien
tggctttggtctagcgtcctataga

SEQ ID NO: 108154 - DNA, 25 bp, Homo sapien
tggctttggtctagtgtcctataga

SEQ ID NO: 108155 - DNA, 25 bp, Homo sapien
tggctttgtatacttccacggtgtt

SEQ ID NO: 108156 - DNA, 25 bp, Homo sapien
tggctttgtgtacttccacggtgtt

SEQ ID NO: 108157 - DNA, 25 bp, Homo sapien
tggctttgttctatcacccgtatct

SEQ ID NO: 108158 - DNA, 25 bp, Homo sapien
tggctttgttctatcatccgtatct

SEQ ID NO: 108159 - DNA, 25 bp, Homo sapien
tggcttttcttggactctcaagtag

SEQ ID NO: 108160 - DNA, 25 bp, Homo sapien
tggcttttcttggactgtcaagtag

SEQ ID NO: 108161 - DNA, 25 bp, Homo sapien
tgggaaaaataacagaaccaataac

SEQ ID NO: 108162 - DNA, 25 bp, Homo sapien
tgggaaaaataacggaaccaataac

SEQ ID NO: 108163 - DNA, 25 bp, Homo sapien
tgggaaaactcccaattgcataaga

SEQ ID NO: 108164 - DNA, 25 bp, Homo sapien
tgggaaaactcctaattgcataaga

SEQ ID NO: 108165 - DNA, 25 bp, Homo sapien
tgggaaacatgccatgccctctgaa

SEQ ID NO: 108166 - DNA, 25 bp, Homo sapien
tgggaaaccttccatcccttgctct

SEQ ID NO: 108167 - DNA, 25 bp, Homo sapien
tgggaaacgtgccatgccctctgaa

SEQ ID NO: 108168 - DNA, 25 bp, Homo sapien
tgggaaacgttccatcccttgctct

SEQ ID NO: 108169 - DNA, 25 bp, Homo sapien
tgggaaagacatattcagcatctgg

SEQ ID NO: 108170 - DNA, 25 bp, Homo sapien
tgggaaagatatattcagcatctgg

SEQ ID NO: 108171 - DNA, 25 bp, Homo sapien
tgggaaatggagaagtgttaatctt

SEQ ID NO: 108172 - DNA, 25 bp, Homo sapien
tgggaaatggagtagtgttaatctt

SEQ ID NO: 108173 - DNA, 25 bp, Homo sapien
tgggaaattgtagcgccttctaaaa

SEQ ID NO: 108174 - DNA, 25 bp, Homo sapien
tgggaaattgtagtgccttctaaaa

SEQ ID NO: 108175 - DNA, 25 bp, Homo sapien
tgggaacaactctttggcagggctg

SEQ ID NO: 108176 - DNA, 25 bp, Homo sapien
tgggaacaattctttggcagggctg

SEQ ID NO: 108177 - DNA, 25 bp, Homo sapien
tgggaaccaaacactcctggcacca

SEQ ID NO: 108178 - DNA, 25 bp, Homo sapien
tgggaaccaaagactcctggcacca

SEQ ID NO: 108179 - DNA, 25 bp, Homo sapien
tgggaactaaatggtaaaataagaa

SEQ ID NO: 108180 - DNA, 25 bp, Homo sapien
tgggaactaaattgtaaaataagaa

SEQ ID NO: 108181 - DNA, 25 bp, Homo sapien
tgggaagaaaacgtctgtattgaaa

SEQ ID NO: 108182 - DNA, 25 bp, Homo sapien
tgggaagaaaatgtctgtattgaaa

SEQ ID NO: 108183 - DNA, 25 bp, Homo sapien
tgggaagaaagatttggtttctaaa

SEQ ID NO: 108184 - DNA, 25 bp, Homo sapien
tgggaagaaaggtttggtttctaaa

SEQ ID NO: 108185 - DNA, 25 bp, Homo sapien
tgggaagaatgacgccttctatatt

SEQ ID NO: 108186 - DNA, 25 bp, Homo sapien
tgggaagaatgatgccttctatatt

SEQ ID NO: 108187 - DNA, 25 bp, Homo sapien
tgggaagacaagtaggactgaaatc

SEQ ID NO: 108188 - DNA, 25 bp, Homo sapien
tgggaagacaagtcggactgaaatc

SEQ ID NO: 108189 - DNA, 25 bp, Homo sapien
tgggaagacccatcgcatcatcatt

SEQ ID NO: 108190 - DNA, 25 bp, Homo sapien
tgggaagacccatggcatcatcatt

SEQ ID NO: 108191 - DNA, 25 bp, Homo sapien
tgggaagactcatgtgagttcagag

SEQ ID NO: 108192 - DNA, 25 bp, Homo sapien
tgggaagactcatttgagttcagag

SEQ ID NO: 108193 - DNA, 25 bp, Homo sapien
tgggaagagtctcacttgttaatta

SEQ ID NO: 108194 - DNA, 25 bp, Homo sapien
tgggaagatgacaataagtaacaat

SEQ ID NO: 108195 - DNA, 25 bp, Homo sapien
tgggaagatgacagtaagtaacaat

SEQ ID NO: 108196 - DNA, 25 bp, Homo sapien
tgggaagattctcacttgttaatta

SEQ ID NO: 108197 - DNA, 25 bp, Homo sapien
tgggaagccattgctgcattttaaa

SEQ ID NO: 108198 - DNA, 25 bp, Homo sapien
tgggaagccattggtgcattttaaa

SEQ ID NO: 108199 - DNA, 25 bp, Homo sapien
tgggaagctcgtcccattttagttg

SEQ ID NO: 108200 - DNA, 25 bp, Homo sapien
tgggaagcttgtcccattttagttg

SEQ ID NO: 108201 - DNA, 25 bp, Homo sapien
tgggaaggtcagttaagagaagact

SEQ ID NO: 108202 - DNA, 25 bp, Homo sapien
tgggaaggtcagttgagagaagact

SEQ ID NO: 108203 - DNA, 25 bp, Homo sapien
tgggaagtcaaatgcctctttgaat

SEQ ID NO: 108204 - DNA, 25 bp, Homo sapien
tgggaagtcaggccagcagtctgaa

SEQ ID NO: 108205 - DNA, 25 bp, Homo sapien
tgggaagtcaggccggcagtctgaa

SEQ ID NO: 108206 - DNA, 25 bp, Homo sapien
tgggaagtcgaatgcctctttgaat

SEQ ID NO: 108207 - DNA, 25 bp, Homo sapien
tgggaagtgggcattatggtcttta

SEQ ID NO: 108208 - DNA, 25 bp, Homo sapien
tgggaagtgggcgttatggtcttta

SEQ ID NO: 108209 - DNA, 25 bp, Homo sapien
tgggaataacaatgcccatcatcca

SEQ ID NO: 108210 - DNA, 25 bp, Homo sapien
tgggaataagctcgatgtgaaggct

SEQ ID NO: 108211 - DNA, 25 bp, Homo sapien
tgggaataagctggatgtgaaggct

SEQ ID NO: 108212 - DNA, 25 bp, Homo sapien
tgggaataatgtgatgaaaacaagg

SEQ ID NO: 108213 - DNA, 25 bp, Homo sapien
tgggaatagaagtcacaacatatcc

SEQ ID NO: 108214 - DNA, 25 bp, Homo sapien
tgggaatagaagtcgcaacatatcc

SEQ ID NO: 108215 - DNA, 25 bp, Homo sapien
tgggaatagcaatgcccatcatcca

SEQ ID NO: 108216 - DNA, 25 bp, Homo sapien
tgggaatattgtgatgaaaacaagg

SEQ ID NO: 108217 - DNA, 25 bp, Homo sapien
tgggaatctttccaacaaaaaggtg

SEQ ID NO: 108218 - DNA, 25 bp, Homo sapien
tgggaatctttctaacaaaaaggtg

SEQ ID NO: 108219 - DNA, 25 bp, Homo sapien
tgggaatgcagacaactagcatgcc

SEQ ID NO: 108220 - DNA, 25 bp, Homo sapien
tgggaatgtaacaatgttggactct

SEQ ID NO: 108221 - DNA, 25 bp, Homo sapien
tgggaatgtaaccatgttggactct

SEQ ID NO: 108222 - DNA, 25 bp, Homo sapien
tgggaatgtagacaactagcatgcc

SEQ ID NO: 108223 - DNA, 25 bp, Homo sapien
tgggaattgggtaaacagttcttag

SEQ ID NO: 108224 - DNA, 25 bp, Homo sapien
tgggaattgggtatacagttcttag

SEQ ID NO: 108225 - DNA, 25 bp, Homo sapien
tgggaatttttatttgagacagatg

SEQ ID NO: 108226 - DNA, 25 bp, Homo sapien
tgggaatttttgtttgagacagatg

SEQ ID NO: 108227 - DNA, 25 bp, Homo sapien
tgggacactgacagccagacttata

SEQ ID NO: 108228 - DNA, 25 bp, Homo sapien
tgggacactgacggccagacttata

SEQ ID NO: 108229 - DNA, 25 bp, Homo sapien
tgggacatattggattaactaacat

SEQ ID NO: 108230 - DNA, 25 bp, Homo sapien
tgggacatattggcttaactaacat

SEQ ID NO: 108231 - DNA, 25 bp, Homo sapien
tgggacatctgctcactttgggact

SEQ ID NO: 108232 - DNA, 25 bp, Homo sapien
tgggacatctgctcgctttgggact

SEQ ID NO: 108233 - DNA, 25 bp, Homo sapien
tgggaccaagtagatctagctttgt

SEQ ID NO: 108234 - DNA, 25 bp, Homo sapien
tgggaccaagtaggtctagctttgt

SEQ ID NO: 108235 - DNA, 25 bp, Homo sapien
tgggacctactgagtcataatctgc

SEQ ID NO: 108236 - DNA, 25 bp, Homo sapien
tgggacctactgagtcgtaatctgc

SEQ ID NO: 108237 - DNA, 25 bp, Homo sapien
tgggacgaaagaagcttgtgaaata

SEQ ID NO: 108238 - DNA, 25 bp, Homo sapien
tgggacgaatgaagcttgtgaaata

SEQ ID NO: 108239 - DNA, 25 bp, Homo sapien
tgggacgcagtatgaccaggaccca

SEQ ID NO: 108240 - DNA, 25 bp, Homo sapien
tgggacgcggtatgaccaggaccca

SEQ ID NO: 108241 - DNA, 25 bp, Homo sapien
tgggactgagacatgaatggactgt

SEQ ID NO: 108242 - DNA, 25 bp, Homo sapien
tgggactgagacatgagtggactgt

SEQ ID NO: 108243 - DNA, 25 bp, Homo sapien
tgggactggccaccgaactgggaag

SEQ ID NO: 108244 - DNA, 25 bp, Homo sapien
tgggactggccactgaactgggaag

SEQ ID NO: 108245 - DNA, 25 bp, Homo sapien
tgggagaacagttactatgatgaac

SEQ ID NO: 108246 - DNA, 25 bp, Homo sapien
tgggagaacggttactatgatgaac

SEQ ID NO: 108247 - DNA, 25 bp, Homo sapien
tgggagaagcacaacagatgagcag

SEQ ID NO: 108248 - DNA, 25 bp, Homo sapien
tgggagaagcacaatagatgagcag

SEQ ID NO: 108249 - DNA, 25 bp, Homo sapien
tgggagacgtgcatcagtagtaaga

SEQ ID NO: 108250 - DNA, 25 bp, Homo sapien
tgggagacgtgcatcattagtaaga

SEQ ID NO: 108251 - DNA, 25 bp, Homo sapien
tgggagactaggtgctggatgtgct

SEQ ID NO: 108252 - DNA, 25 bp, Homo sapien
tgggagactaggtgttggatgtgct

SEQ ID NO: 108253 - DNA, 25 bp, Homo sapien
tgggagactgcagttggaggatgac

SEQ ID NO: 108254 - DNA, 25 bp, Homo sapien
tgggagactgcggttggaggatgac

SEQ ID NO: 108255 - DNA, 25 bp, Homo sapien
tgggagagaaggacaacaagtagtg

SEQ ID NO: 108256 - DNA, 25 bp, Homo sapien
tgggagagaaggacaagaagtagtg

SEQ ID NO: 108257 - DNA, 25 bp, Homo sapien
tgggagatacttcagagggagaagc

SEQ ID NO: 108258 - DNA, 25 bp, Homo sapien
tgggagatatttcagagggagaagc

SEQ ID NO: 108259 - DNA, 25 bp, Homo sapien
tgggagcaagaacacttgtcatcac

SEQ ID NO: 108260 - DNA, 25 bp, Homo sapien
tgggagcaagaacatttgtcatcac

SEQ ID NO: 108261 - DNA, 25 bp, Homo sapien
tgggagctccaactcttccctttat

SEQ ID NO: 108262 - DNA, 25 bp, Homo sapien
tgggagctccaattcttccctttat

SEQ ID NO: 108263 - DNA, 25 bp, Homo sapien
tgggagctctttggaaacagattat

SEQ ID NO: 108264 - DNA, 25 bp, Homo sapien
tgggagctgtgcccagatccgagcc

SEQ ID NO: 108265 - DNA, 25 bp, Homo sapien
tgggagctgtgcccaggtccgagcc

SEQ ID NO: 108266 - DNA, 25 bp, Homo sapien
tgggagctttttggaaacagattat

SEQ ID NO: 108267 - DNA, 25 bp, Homo sapien
tgggaggaaagagagtaatgacgga

SEQ ID NO: 108268 - DNA, 25 bp, Homo sapien
tgggaggaaagatagtaatgacgga

SEQ ID NO: 108269 - DNA, 25 bp, Homo sapien
tgggaggaaatgacaggtgacctca

SEQ ID NO: 108270 - DNA, 25 bp, Homo sapien
tgggaggaaatggcaggtgacctca

SEQ ID NO: 108271 - DNA, 25 bp, Homo sapien
tgggaggcaatggagtaaagaggag

SEQ ID NO: 108272 - DNA, 25 bp, Homo sapien
tgggaggcaatggagtgaagaggag

SEQ ID NO: 108273 - DNA, 25 bp, Homo sapien
tgggaggccgagatgggtctatcaa

SEQ ID NO: 108274 - DNA, 25 bp, Homo sapien
tgggaggccgagatggttctatcaa

SEQ ID NO: 108275 - DNA, 25 bp, Homo sapien
tgggagggagccaccagcagcatcc

SEQ ID NO: 108276 - DNA, 25 bp, Homo sapien
tgggagggagccgccagcagcatcc

SEQ ID NO: 108277 - DNA, 25 bp, Homo sapien
tgggagggtatcttgcatttgtctt

SEQ ID NO: 108278 - DNA, 25 bp, Homo sapien
tgggagggtattttgcatttgtctt

SEQ ID NO: 108279 - DNA, 25 bp, Homo sapien
tgggaggtaatgcaagaaaacagca

SEQ ID NO: 108280 - DNA, 25 bp, Homo sapien
tgggaggtagtgcaagaaaacagca

SEQ ID NO: 108281 - DNA, 25 bp, Homo sapien
tgggaggtccatggatgctatgtgt

SEQ ID NO: 108282 - DNA, 25 bp, Homo sapien
tgggaggtccatggttgctatgtgt

SEQ ID NO: 108283 - DNA, 25 bp, Homo sapien
tgggaggtgaaaacttgtctaggtt

SEQ ID NO: 108284 - DNA, 25 bp, Homo sapien
tgggaggtgaaaacttttctaggtt

SEQ ID NO: 108285 - DNA, 25 bp, Homo sapien
tgggagtcaactgtgcacaacgtgc

SEQ ID NO: 108286 - DNA, 25 bp, Homo sapien
tgggagtcaactgtgcgcaacgtgc

SEQ ID NO: 108287 - DNA, 25 bp, Homo sapien
tgggagtcagtgtatccattttatg

SEQ ID NO: 108288 - DNA, 25 bp, Homo sapien
tgggagtcagtgtatctattttatg

SEQ ID NO: 108289 - DNA, 25 bp, Homo sapien
tgggagtgccgcgaatcagtgtagg

SEQ ID NO: 108290 - DNA, 25 bp, Homo sapien
tgggagtgctgcgaatcagtgtagg

SEQ ID NO: 108291 - DNA, 25 bp, Homo sapien
tgggagtttctactgctctgatagc

SEQ ID NO: 108292 - DNA, 25 bp, Homo sapien
tgggagtttctcctgctctgatagc

SEQ ID NO: 108293 - DNA, 25 bp, Homo sapien
tgggatacactgtgcttcctagatc

SEQ ID NO: 108294 - DNA, 25 bp, Homo sapien
tgggatacgctgtgcttcctagatc

SEQ ID NO: 108295 - DNA, 25 bp, Homo sapien
tgggatactcaactacttcacattt

SEQ ID NO: 108296 - DNA, 25 bp, Homo sapien
tgggatactcaactgcttcacattt

SEQ ID NO: 108297 - DNA, 25 bp, Homo sapien
tgggatactcagtactttgaagagg

SEQ ID NO: 108298 - DNA, 25 bp, Homo sapien
tgggatactcagtcctttgaagagg

SEQ ID NO: 108299 - DNA, 25 bp, Homo sapien
tgggatatgtagcctgtgggatcct

SEQ ID NO: 108300 - DNA, 25 bp, Homo sapien
tgggatatgtagtctgtgggatcct

SEQ ID NO: 108301 - DNA, 25 bp, Homo sapien
tgggatatttttcctcttcactctc

SEQ ID NO: 108302 - DNA, 25 bp, Homo sapien
tgggatattttttctcttcactctc

SEQ ID NO: 108303 - DNA, 25 bp, Homo sapien
tgggatcatatagtgtgtaaccttt

SEQ ID NO: 108304 - DNA, 25 bp, Homo sapien
tgggatcatatagtttgtaaccttt

SEQ ID NO: 108305 - DNA, 25 bp, Homo sapien
tgggatccaaggaccgtacattcag

SEQ ID NO: 108306 - DNA, 25 bp, Homo sapien
tgggatccagggaccgtacattcag

SEQ ID NO: 108307 - DNA, 25 bp, Homo sapien
tgggatcctggctcagttaatgaga

SEQ ID NO: 108308 - DNA, 25 bp, Homo sapien
tgggatcctggcttagttaatgaga

SEQ ID NO: 108309 - DNA, 25 bp, Homo sapien
tgggatgagaaggagttggtgacta

SEQ ID NO: 108310 - DNA, 25 bp, Homo sapien
tgggatgagtaggagttggtgacta

SEQ ID NO: 108311 - DNA, 25 bp, Homo sapien
tgggatgcattttctaaacaacctt

SEQ ID NO: 108312 - DNA, 25 bp, Homo sapien
tgggatgcgttttctaaacaacctt

SEQ ID NO: 108313 - DNA, 25 bp, Homo sapien
tgggatgttacttgaaagagtttca

SEQ ID NO: 108314 - DNA, 25 bp, Homo sapien
tgggatgttacttggaagagtttca

SEQ ID NO: 108315 - DNA, 25 bp, Homo sapien
tgggattaggttctcctgatcatct

SEQ ID NO: 108316 - DNA, 25 bp, Homo sapien
tgggattatgttctcctgatcatct

SEQ ID NO: 108317 - DNA, 25 bp, Homo sapien
tgggattgaacagaaagaagctcag

SEQ ID NO: 108318 - DNA, 25 bp, Homo sapien
tgggattgactgcatttgtgtgtta

SEQ ID NO: 108319 - DNA, 25 bp, Homo sapien
tgggattgattgcatttgtgtgtta

SEQ ID NO: 108320 - DNA, 25 bp, Homo sapien
tgggattggacagaaagaagctcag

SEQ ID NO: 108321 - DNA, 25 bp, Homo sapien
tgggattgtttattatagcagcatc

SEQ ID NO: 108322 - DNA, 25 bp, Homo sapien
tgggattgtttgttatagcagcatc

SEQ ID NO: 108323 - DNA, 25 bp, Homo sapien
tgggatttaaatcaaaccagtagga

SEQ ID NO: 108324 - DNA, 25 bp, Homo sapien
tgggatttccgacattcattccacc

SEQ ID NO: 108325 - DNA, 25 bp, Homo sapien
tgggatttctgacattcattccacc

SEQ ID NO: 108326 - DNA, 25 bp, Homo sapien
tgggatttggtagacagataactca

SEQ ID NO: 108327 - DNA, 25 bp, Homo sapien
tgggatttggtagatagataactca

SEQ ID NO: 108328 - DNA, 25 bp, Homo sapien
tgggattttaatcaaaccagtagga

SEQ ID NO: 108329 - DNA, 25 bp, Homo sapien
tgggcaaaggaaaaccaaatgaaga

SEQ ID NO: 108330 - DNA, 25 bp, Homo sapien
tgggcaaaggaaaagcaaatgaaga

SEQ ID NO: 108331 - DNA, 25 bp, Homo sapien
tgggcaaataaacggtttggtttac

SEQ ID NO: 108332 - DNA, 25 bp, Homo sapien
tgggcaaataaatggtttggtttac

SEQ ID NO: 108333 - DNA, 25 bp, Homo sapien
tgggcaaatacgacaacggctgagg

SEQ ID NO: 108334 - DNA, 25 bp, Homo sapien
tgggcaaatacgacaatggctgagg

SEQ ID NO: 108335 - DNA, 25 bp, Homo sapien
tgggcaaatagcctaccctttctca

SEQ ID NO: 108336 - DNA, 25 bp, Homo sapien
tgggcaaatagcttaccctttctca

SEQ ID NO: 108337 - DNA, 25 bp, Homo sapien
tgggcaaatctgcagataactttgt

SEQ ID NO: 108338 - DNA, 25 bp, Homo sapien
tgggcaaatctgtagataactttgt

SEQ ID NO: 108339 - DNA, 25 bp, Homo sapien
tgggcacaaataccacatattacac

SEQ ID NO: 108340 - DNA, 25 bp, Homo sapien
tgggcacaaatcccacatattacac

SEQ ID NO: 108341 - DNA, 25 bp, Homo sapien
tgggcagaaacttaatgactaaaac

SEQ ID NO: 108342 - DNA, 25 bp, Homo sapien
tgggcagaaccttaatgactaaaac

SEQ ID NO: 108343 - DNA, 25 bp, Homo sapien
tgggcagcctataaaagctggtgtt

SEQ ID NO: 108344 - DNA, 25 bp, Homo sapien
tgggcagcgtataaaagctggtgtt

SEQ ID NO: 108345 - DNA, 25 bp, Homo sapien
tgggcaggactcctctttaagcaga

SEQ ID NO: 108346 - DNA, 25 bp, Homo sapien
tgggcaggactcttctttaagcaga

SEQ ID NO: 108347 - DNA, 25 bp, Homo sapien
tgggcagtagtcatattaaaagtgt

SEQ ID NO: 108348 - DNA, 25 bp, Homo sapien
tgggcagtagtcgtattaaaagtgt

SEQ ID NO: 108349 - DNA, 25 bp, Homo sapien
tgggcagtctcattttctagaacat

SEQ ID NO: 108350 - DNA, 25 bp, Homo sapien
tgggcagtctctttttctagaacat

SEQ ID NO: 108351 - DNA, 25 bp, Homo sapien
tgggcagttcagctgacattcaaac

SEQ ID NO: 108352 - DNA, 25 bp, Homo sapien
tgggcagttcagctgagattcaaac

SEQ ID NO: 108353 - DNA, 25 bp, Homo sapien
tgggcagtttggattaaagaatcgc

SEQ ID NO: 108354 - DNA, 25 bp, Homo sapien
tgggcagtttggattagagaatcgc

SEQ ID NO: 108355 - DNA, 25 bp, Homo sapien
tgggcataagacattgggagaaaga

SEQ ID NO: 108356 - DNA, 25 bp, Homo sapien
tgggcataagaccttgggagaaaga

SEQ ID NO: 108357 - DNA, 25 bp, Homo sapien
tgggcatagctaccgtgaagggcag

SEQ ID NO: 108358 - DNA, 25 bp, Homo sapien
tgggcatagctactgtgaagggcag

SEQ ID NO: 108359 - DNA, 25 bp, Homo sapien
tgggcatatgctttattatgtatgc

SEQ ID NO: 108360 - DNA, 25 bp, Homo sapien
tgggcatatgctttgttatgtatgc

SEQ ID NO: 108361 - DNA, 25 bp, Homo sapien
tgggcatcactgcgaattatttaga

SEQ ID NO: 108362 - DNA, 25 bp, Homo sapien
tgggcatcactgtgaattatttaga

SEQ ID NO: 108363 - DNA, 25 bp, Homo sapien
tgggcatccaccgggagcttttctc

SEQ ID NO: 108364 - DNA, 25 bp, Homo sapien
tgggcatccactgggagcttttctc

SEQ ID NO: 108365 - DNA, 25 bp, Homo sapien
tgggcattgattaccgataaaagtt

SEQ ID NO: 108366 - DNA, 25 bp, Homo sapien
tgggcattgattaccggtaaaagtt

SEQ ID NO: 108367 - DNA, 25 bp, Homo sapien
tgggcattggggaagtaccctcgga

SEQ ID NO: 108368 - DNA, 25 bp, Homo sapien
tgggcattggggaagtcccctcgga

SEQ ID NO: 108369 - DNA, 25 bp, Homo sapien
tgggccaaagttcatcaggtagtaa

SEQ ID NO: 108370 - DNA, 25 bp, Homo sapien
tgggccaaggtctaatttttcacac

SEQ ID NO: 108371 - DNA, 25 bp, Homo sapien
tgggccaaggtctagtttttcacac

SEQ ID NO: 108372 - DNA, 25 bp, Homo sapien
tgggccaaggttcatcaggtagtaa

SEQ ID NO: 108373 - DNA, 25 bp, Homo sapien
tgggccactcggccttccatgtctg

SEQ ID NO: 108374 - DNA, 25 bp, Homo sapien
tgggccactcgggcttccatgtctg

SEQ ID NO: 108375 - DNA, 25 bp, Homo sapien
tgggccagaagaaagttctagatat

SEQ ID NO: 108376 - DNA, 25 bp, Homo sapien
tgggccagaaggaagttctagatat

SEQ ID NO: 108377 - DNA, 25 bp, Homo sapien
tgggccagatgatccgtcacaacca

SEQ ID NO: 108378 - DNA, 25 bp, Homo sapien
tgggccagatgatctgtcacaacca

SEQ ID NO: 108379 - DNA, 25 bp, Homo sapien
tgggccagtctctccacccagaatg

SEQ ID NO: 108380 - DNA, 25 bp, Homo sapien
tgggccagtctgtccacccagaatg

SEQ ID NO: 108381 - DNA, 25 bp, Homo sapien
tgggccagtttccgattccttttcc

SEQ ID NO: 108382 - DNA, 25 bp, Homo sapien
tgggccagtttctgattccttttcc

SEQ ID NO: 108383 - DNA, 25 bp, Homo sapien
tgggcccagaaggctctaagtggca

SEQ ID NO: 108384 - DNA, 25 bp, Homo sapien
tgggcccagaaggttctaagtggca

SEQ ID NO: 108385 - DNA, 25 bp, Homo sapien
tgggccccggcaccaaatgccagga

SEQ ID NO: 108386 - DNA, 25 bp, Homo sapien
tgggccccggcaccgaatgccagga

SEQ ID NO: 108387 - DNA, 25 bp, Homo sapien
tgggcctaatcctcgttattggcac

SEQ ID NO: 108388 - DNA, 25 bp, Homo sapien
tgggcctaatccttgttattggcac

SEQ ID NO: 108389 - DNA, 25 bp, Homo sapien
tgggcctggactatacaatccagtt

SEQ ID NO: 108390 - DNA, 25 bp, Homo sapien
tgggcctggactatacgatccagtt

SEQ ID NO: 108391 - DNA, 25 bp, Homo sapien
tgggccttccataaaagtttgttga

SEQ ID NO: 108392 - DNA, 25 bp, Homo sapien
tgggccttccatagaagtttgttga

SEQ ID NO: 108393 - DNA, 25 bp, Homo sapien
tgggcgagactcatggattctttga

SEQ ID NO: 108394 - DNA, 25 bp, Homo sapien
tgggcgagtctcatggattctttga

SEQ ID NO: 108395 - DNA, 25 bp, Homo sapien
tgggcgccagccaagacttgcagcg

SEQ ID NO: 108396 - DNA, 25 bp, Homo sapien
tgggcgccggccaagacttgcagcg

SEQ ID NO: 108397 - DNA, 25 bp, Homo sapien
tgggcgtctgccacacacttgcact

SEQ ID NO: 108398 - DNA, 25 bp, Homo sapien
tgggcgtctgcctcacacttgcact

SEQ ID NO: 108399 - DNA, 25 bp, Homo sapien
tgggctaattctatgaagtcagtca

SEQ ID NO: 108400 - DNA, 25 bp, Homo sapien
tgggctaattctatgaggtcagtca

SEQ ID NO: 108401 - DNA, 25 bp, Homo sapien
tgggctatctctccgtttacttagg

SEQ ID NO: 108402 - DNA, 25 bp, Homo sapien
tgggctatctcttcgtttacttagg

SEQ ID NO: 108403 - DNA, 25 bp, Homo sapien
tgggctcaaaagtcaagccagtgcc

SEQ ID NO: 108404 - DNA, 25 bp, Homo sapien
tgggctcaaaagtcaatccagtgcc

SEQ ID NO: 108405 - DNA, 25 bp, Homo sapien
tgggctccagcgaggttctaaacca

SEQ ID NO: 108406 - DNA, 25 bp, Homo sapien
tgggctccagcgagtttctaaacca

SEQ ID NO: 108407 - DNA, 25 bp, Homo sapien
tgggctccccaggcaaaaagaaggc

SEQ ID NO: 108408 - DNA, 25 bp, Homo sapien
tgggctccccaggcaacaagaaggc

SEQ ID NO: 108409 - DNA, 25 bp, Homo sapien
tgggctccggcatcctattttcctg

SEQ ID NO: 108410 - DNA, 25 bp, Homo sapien
tgggctccggcatcctgttttcctg

SEQ ID NO: 108411 - DNA, 25 bp, Homo sapien
tgggctctttcatgaccgaggctcc

SEQ ID NO: 108412 - DNA, 25 bp, Homo sapien
tgggctctttcatgactgaggctcc

SEQ ID NO: 108413 - DNA, 25 bp, Homo sapien
tgggcttccaagcattctgattttc

SEQ ID NO: 108414 - DNA, 25 bp, Homo sapien
tgggcttccaagtattctgattttc

SEQ ID NO: 108415 - DNA, 25 bp, Homo sapien
tgggctttccaggtctgccttcttt

SEQ ID NO: 108416 - DNA, 25 bp, Homo sapien
tgggctttccatgtctgccttcttt

SEQ ID NO: 108417 - DNA, 25 bp, Homo sapien
tgggctttcgcaaaaggtactcgct

SEQ ID NO: 108418 - DNA, 25 bp, Homo sapien
tgggctttcgcaaaagttactcgct

SEQ ID NO: 108419 - DNA, 25 bp, Homo sapien
tgggctttggagtacaaacgatccc

SEQ ID NO: 108420 - DNA, 25 bp, Homo sapien
tgggctttggagtagaaacgatccc

SEQ ID NO: 108421 - DNA, 25 bp, Homo sapien
tggggaaaacagttgcataaagcag

SEQ ID NO: 108422 - DNA, 25 bp, Homo sapien
tggggaaaacagttgcgtaaagcag

SEQ ID NO: 108423 - DNA, 25 bp, Homo sapien
tggggaaaataagcacgtcctgtgt

SEQ ID NO: 108424 - DNA, 25 bp, Homo sapien
tggggaaaataagcgcgtcctgtgt

SEQ ID NO: 108425 - DNA, 25 bp, Homo sapien
tggggaactccaactcagtagccaa

SEQ ID NO: 108426 - DNA, 25 bp, Homo sapien
tggggaactccaactcggtagccaa

SEQ ID NO: 108427 - DNA, 25 bp, Homo sapien
tggggaatctggacttatttcttcc

SEQ ID NO: 108428 - DNA, 25 bp, Homo sapien
tggggaatttggacttatttcttcc

SEQ ID NO: 108429 - DNA, 25 bp, Homo sapien
tggggacaaaaatgcactctgagag

SEQ ID NO: 108430 - DNA, 25 bp, Homo sapien
tggggacacaagattatagatgtaa

SEQ ID NO: 108431 - DNA, 25 bp, Homo sapien
tggggacacaatattatagatgtaa

SEQ ID NO: 108432 - DNA, 25 bp, Homo sapien
tggggacagaaatgcactctgagag

SEQ ID NO: 108433 - DNA, 25 bp, Homo sapien
tggggacatgcggaacactgaaaac

SEQ ID NO: 108434 - DNA, 25 bp, Homo sapien
tggggacatgcgtaacactgaaaac

SEQ ID NO: 108435 - DNA, 25 bp, Homo sapien
tggggaccacttcaggagcaaaggc

SEQ ID NO: 108436 - DNA, 25 bp, Homo sapien
tggggaccacttcgggagcaaaggc

SEQ ID NO: 108437 - DNA, 25 bp, Homo sapien
tggggactcaattaatggaacatat

SEQ ID NO: 108438 - DNA, 25 bp, Homo sapien
tggggactcgagcccagaagatcag

SEQ ID NO: 108439 - DNA, 25 bp, Homo sapien
tggggactcgagcctagaagatcag

SEQ ID NO: 108440 - DNA, 25 bp, Homo sapien
tggggactgaattaatggaacatat

SEQ ID NO: 108441 - DNA, 25 bp, Homo sapien
tggggagatgcaattcagcccataa

SEQ ID NO: 108442 - DNA, 25 bp, Homo sapien
tggggagatgcatttcagcccataa

SEQ ID NO: 108443 - DNA, 25 bp, Homo sapien
tggggagcaatcatgcatctttgca

SEQ ID NO: 108444 - DNA, 25 bp, Homo sapien
tggggagcaatcatgcgtctttgca

SEQ ID NO: 108445 - DNA, 25 bp, Homo sapien
tggggagccaacgggcagtatgaca

SEQ ID NO: 108446 - DNA, 25 bp, Homo sapien
tggggagccaatgggcagtatgaca

SEQ ID NO: 108447 - DNA, 25 bp, Homo sapien
tggggagtggcatcctgacagcttt

SEQ ID NO: 108448 - DNA, 25 bp, Homo sapien
tggggagtggcatcttgacagcttt

SEQ ID NO: 108449 - DNA, 25 bp, Homo sapien
tggggataaagaataagccaagtcc

SEQ ID NO: 108450 - DNA, 25 bp, Homo sapien
tggggatacagaaatggagaagccc

SEQ ID NO: 108451 - DNA, 25 bp, Homo sapien
tggggatacagaataagccaagtcc

SEQ ID NO: 108452 - DNA, 25 bp, Homo sapien
tggggatagagaaatggagaagccc

SEQ ID NO: 108453 - DNA, 25 bp, Homo sapien
tggggatcagaaaaatatttgaaga

SEQ ID NO: 108454 - DNA, 25 bp, Homo sapien
tggggatcagaaaagtatttgaaga

SEQ ID NO: 108455 - DNA, 25 bp, Homo sapien
tggggatcctggcttcagtacgttg

SEQ ID NO: 108456 - DNA, 25 bp, Homo sapien
tggggatcctgggttcagtacgttg

SEQ ID NO: 108457 - DNA, 25 bp, Homo sapien
tggggatgacaatgcttcctgtctc

SEQ ID NO: 108458 - DNA, 25 bp, Homo sapien
tggggatgacagtgcttcctgtctc

SEQ ID NO: 108459 - DNA, 25 bp, Homo sapien
tggggattagctctctcaggacatt

SEQ ID NO: 108460 - DNA, 25 bp, Homo sapien
tggggattatctctctcaggacatt

SEQ ID NO: 108461 - DNA, 25 bp, Homo sapien
tggggcaatagactcaacctcttaa

SEQ ID NO: 108462 - DNA, 25 bp, Homo sapien
tggggcaatagattcaacctcttaa

SEQ ID NO: 108463 - DNA, 25 bp, Homo sapien
tggggcagatgatttacggccagct

SEQ ID NO: 108464 - DNA, 25 bp, Homo sapien
tggggcagatgatttatggccagct

SEQ ID NO: 108465 - DNA, 25 bp, Homo sapien
tggggcagtccaggtgtggagctct

SEQ ID NO: 108466 - DNA, 25 bp, Homo sapien
tggggcagtccatgtgtggagctct

SEQ ID NO: 108467 - DNA, 25 bp, Homo sapien
tggggcatcgtgaatctccctagtg

SEQ ID NO: 108468 - DNA, 25 bp, Homo sapien
tggggcatcgtgactctccctagtg

SEQ ID NO: 108469 - DNA, 25 bp, Homo sapien
tggggcattggaaagtaattaggtc

SEQ ID NO: 108470 - DNA, 25 bp, Homo sapien
tggggcattgggaagtaattaggtc

SEQ ID NO: 108471 - DNA, 25 bp, Homo sapien
tggggccaagaatttctagttctaa

SEQ ID NO: 108472 - DNA, 25 bp, Homo sapien
tggggccaagactttctagttctaa

SEQ ID NO: 108473 - DNA, 25 bp, Homo sapien
tggggcccagaaacatgtaataggc

SEQ ID NO: 108474 - DNA, 25 bp, Homo sapien
tggggcccagaaacatttaataggc

SEQ ID NO: 108475 - DNA, 25 bp, Homo sapien
tggggcctggacattgcattgttta

SEQ ID NO: 108476 - DNA, 25 bp, Homo sapien
tggggcctggacattgtattgttta

SEQ ID NO: 108477 - DNA, 25 bp, Homo sapien
tggggctcaataaggtaatggttca

SEQ ID NO: 108478 - DNA, 25 bp, Homo sapien
tggggctcaataatgtaatggttca

SEQ ID NO: 108479 - DNA, 25 bp, Homo sapien
tggggctcttttctaagtgcatgtg

SEQ ID NO: 108480 - DNA, 25 bp, Homo sapien
tggggctcttttgtaagtgcatgtg

SEQ ID NO: 108481 - DNA, 25 bp, Homo sapien
tggggcttctcacatgcagtccaga

SEQ ID NO: 108482 - DNA, 25 bp, Homo sapien
tggggcttctcagcttcgtcggtgc

SEQ ID NO: 108483 - DNA, 25 bp, Homo sapien
tggggcttctcagctttgtcggtgc

SEQ ID NO: 108484 - DNA, 25 bp, Homo sapien
tggggcttttcacatgcagtccaga

SEQ ID NO: 108485 - DNA, 25 bp, Homo sapien
tgggggaatagcattacctgaaaca

SEQ ID NO: 108486 - DNA, 25 bp, Homo sapien
tgggggaatcgcattacctgaaaca

SEQ ID NO: 108487 - DNA, 25 bp, Homo sapien
tgggggacaagaatatgccttccca

SEQ ID NO: 108488 - DNA, 25 bp, Homo sapien
tgggggacaagaatattccttccca

SEQ ID NO: 108489 - DNA, 25 bp, Homo sapien
tggggggtcctgtgtaactctacat

SEQ ID NO: 108490 - DNA, 25 bp, Homo sapien
tggggggtcctgtgtacctctacat

SEQ ID NO: 108491 - DNA, 25 bp, Homo sapien
tgggggtacaggcagccatcaatat

SEQ ID NO: 108492 - DNA, 25 bp, Homo sapien
tgggggtacaggtagccatcaatat

SEQ ID NO: 108493 - DNA, 25 bp, Homo sapien
tgggggtggcttaatgacatagcag

SEQ ID NO: 108494 - DNA, 25 bp, Homo sapien
tgggggtggtttaatgacatagcag

SEQ ID NO: 108495 - DNA, 25 bp, Homo sapien
tggggtaccttcatcggactcatca

SEQ ID NO: 108496 - DNA, 25 bp, Homo sapien
tggggtacctttatcggactcatca

SEQ ID NO: 108497 - DNA, 25 bp, Homo sapien
tggggtactactatacaactgaggc

SEQ ID NO: 108498 - DNA, 25 bp, Homo sapien
tggggtactgctatacaactgaggc

SEQ ID NO: 108499 - DNA, 25 bp, Homo sapien
tggggtggatgcgaacatgaaaagc

SEQ ID NO: 108500 - DNA, 25 bp, Homo sapien
tggggtggatgtgaacatgaaaagc

SEQ ID NO: 108501 - DNA, 25 bp, Homo sapien
tggggtggttgcccagctcattagc

SEQ ID NO: 108502 - DNA, 25 bp, Homo sapien
tggggtggttggccagctcattagc

SEQ ID NO: 108503 - DNA, 25 bp, Homo sapien
tggggttcgctgaattattcttgtt

SEQ ID NO: 108504 - DNA, 25 bp, Homo sapien
tggggttcgctgagttattcttgtt

SEQ ID NO: 108505 - DNA, 25 bp, Homo sapien
tggggttctttcgttctgaaacagc

SEQ ID NO: 108506 - DNA, 25 bp, Homo sapien
tggggttctttggttctgaaacagc

SEQ ID NO: 108507 - DNA, 25 bp, Homo sapien
tggggtttaataaggtttcaaagtc

SEQ ID NO: 108508 - DNA, 25 bp, Homo sapien
tggggtttgataaggtttcaaagtc

SEQ ID NO: 108509 - DNA, 25 bp, Homo sapien
tgggtaactaggggtcatgtcttga

SEQ ID NO: 108510 - DNA, 25 bp, Homo sapien
tgggtaactaggggtcgtgtcttga

SEQ ID NO: 108511 - DNA, 25 bp, Homo sapien
tgggtaaggatgagaaagctgtaaa

SEQ ID NO: 108512 - DNA, 25 bp, Homo sapien
tgggtaaggctgagaaagctgtaaa

SEQ ID NO: 108513 - DNA, 25 bp, Homo sapien
tgggtagaagtataacttgaaagag

SEQ ID NO: 108514 - DNA, 25 bp, Homo sapien
tgggtagaagtattacttgaaagag

SEQ ID NO: 108515 - DNA, 25 bp, Homo sapien
tgggtagtcaacgcactttgttaaa

SEQ ID NO: 108516 - DNA, 25 bp, Homo sapien
tgggtagtcaatgcactttgttaaa

SEQ ID NO: 108517 - DNA, 25 bp, Homo sapien
tgggtatcatcaggtctctcctttg

SEQ ID NO: 108518 - DNA, 25 bp, Homo sapien
tgggtatcatcagttctctcctttg

SEQ ID NO: 108519 - DNA, 25 bp, Homo sapien
tgggtatgttcacgatatcactgat

SEQ ID NO: 108520 - DNA, 25 bp, Homo sapien
tgggtatgttcatgatatcactgat

SEQ ID NO: 108521 - DNA, 25 bp, Homo sapien
tgggtattacgaaagcttcaaaagc

SEQ ID NO: 108522 - DNA, 25 bp, Homo sapien
tgggtattatgaaagcttcaaaagc

SEQ ID NO: 108523 - DNA, 25 bp, Homo sapien
tgggtcaacgtccttctccacaaca

SEQ ID NO: 108524 - DNA, 25 bp, Homo sapien
tgggtcaatgtccttctccacaaca

SEQ ID NO: 108525 - DNA, 25 bp, Homo sapien
tgggtcagctttctctcccattctg

SEQ ID NO: 108526 - DNA, 25 bp, Homo sapien
tgggtcagctttgtctcccattctg

SEQ ID NO: 108527 - DNA, 25 bp, Homo sapien
tgggtcaggctgcatgaatcacttt

SEQ ID NO: 108528 - DNA, 25 bp, Homo sapien
tgggtcaggctgcgtgaatcacttt

SEQ ID NO: 108529 - DNA, 25 bp, Homo sapien
tgggtcatctgccttttctctcctg

SEQ ID NO: 108530 - DNA, 25 bp, Homo sapien
tgggtcatctgcgttttctctcctg

SEQ ID NO: 108531 - DNA, 25 bp, Homo sapien
tgggtcatggtgttttagtctttga

SEQ ID NO: 108532 - DNA, 25 bp, Homo sapien
tgggtcatggttttttagtctttga

SEQ ID NO: 108533 - DNA, 25 bp, Homo sapien
tgggtccctcagtatcagagtcaac

SEQ ID NO: 108534 - DNA, 25 bp, Homo sapien
tgggtccctgagtatcagagtcaac

SEQ ID NO: 108535 - DNA, 25 bp, Homo sapien
tgggtcctgaatacactcacttatg

SEQ ID NO: 108536 - DNA, 25 bp, Homo sapien
tgggtcctgaatactctcacttatg

SEQ ID NO: 108537 - DNA, 25 bp, Homo sapien
tgggtctaaattctcctgaaatcct

SEQ ID NO: 108538 - DNA, 25 bp, Homo sapien
tgggtctaaattcttctgaaatcct

SEQ ID NO: 108539 - DNA, 25 bp, Homo sapien
tgggtctctcactcactgccttgaa

SEQ ID NO: 108540 - DNA, 25 bp, Homo sapien
tgggtctctcattcactgccttgaa

SEQ ID NO: 108541 - DNA, 25 bp, Homo sapien
tgggtctggagcatccatgtggctg

SEQ ID NO: 108542 - DNA, 25 bp, Homo sapien
tgggtctggagcgtccatgtggctg

SEQ ID NO: 108543 - DNA, 25 bp, Homo sapien
tgggtctttcgcgaagcccaatctt

SEQ ID NO: 108544 - DNA, 25 bp, Homo sapien
tgggtcttttgcgaagcccaatctt

SEQ ID NO: 108545 - DNA, 25 bp, Homo sapien
tgggtgaaaaggacgctatgtgctg

SEQ ID NO: 108546 - DNA, 25 bp, Homo sapien
tgggtgaaaaggatgctatgtgctg

SEQ ID NO: 108547 - DNA, 25 bp, Homo sapien
tgggtgaaagccatgtgctcttcct

SEQ ID NO: 108548 - DNA, 25 bp, Homo sapien
tgggtgaaagccgtgtgctcttcct

SEQ ID NO: 108549 - DNA, 25 bp, Homo sapien
tgggtgaacccgaacttcaaagtgt

SEQ ID NO: 108550 - DNA, 25 bp, Homo sapien
tgggtgaacccggacttcaaagtgt

SEQ ID NO: 108551 - DNA, 25 bp, Homo sapien
tgggtgagcaatttctggcaggcat

SEQ ID NO: 108552 - DNA, 25 bp, Homo sapien
tgggtgagcaatttcttgcaggcat

SEQ ID NO: 108553 - DNA, 25 bp, Homo sapien
tgggtgagtagatgccctgccctgc

SEQ ID NO: 108554 - DNA, 25 bp, Homo sapien
tgggtgagtcgatgccctgccctgc

SEQ ID NO: 108555 - DNA, 25 bp, Homo sapien
tgggtgatagagcagaacccttttt

SEQ ID NO: 108556 - DNA, 25 bp, Homo sapien
tgggtgatagagcggaacccttttt

SEQ ID NO: 108557 - DNA, 25 bp, Homo sapien
tgggtgatcctgaaggtcatggatg

SEQ ID NO: 108558 - DNA, 25 bp, Homo sapien
tgggtgatcctgatggtcatggatg

SEQ ID NO: 108559 - DNA, 25 bp, Homo sapien
tgggtgccagatacatacaaagcca

SEQ ID NO: 108560 - DNA, 25 bp, Homo sapien
tgggtgccagatacgtacaaagcca

SEQ ID NO: 108561 - DNA, 25 bp, Homo sapien
tgggtggtggcaacacagacttgtt

SEQ ID NO: 108562 - DNA, 25 bp, Homo sapien
tgggtggtggctacacagacttgtt

SEQ ID NO: 108563 - DNA, 25 bp, Homo sapien
tgggtgtcagccccacagaggagaa

SEQ ID NO: 108564 - DNA, 25 bp, Homo sapien
tgggtgtcagccctacagaggagaa

SEQ ID NO: 108565 - DNA, 25 bp, Homo sapien
tgggtgtccaaactggtggtgttag

SEQ ID NO: 108566 - DNA, 25 bp, Homo sapien
tgggtgtccgaactggtggtgttag

SEQ ID NO: 108567 - DNA, 25 bp, Homo sapien
tgggtgtctacttatgctaggtgtc

SEQ ID NO: 108568 - DNA, 25 bp, Homo sapien
tgggtgtctacttttgctaggtgtc

SEQ ID NO: 108569 - DNA, 25 bp, Homo sapien
tgggtgtgccctgtgagctggtctg

SEQ ID NO: 108570 - DNA, 25 bp, Homo sapien
tgggtgtgccctgtgatctggtctg

SEQ ID NO: 108571 - DNA, 25 bp, Homo sapien
tgggtgtttccatatatccaaactc

SEQ ID NO: 108572 - DNA, 25 bp, Homo sapien
tgggtgtttccatgtatccaaactc

SEQ ID NO: 108573 - DNA, 25 bp, Homo sapien
tgggttaaatgtcaggcccattatt

SEQ ID NO: 108574 - DNA, 25 bp, Homo sapien
tgggttaaatgtcaggtccattatt

SEQ ID NO: 108575 - DNA, 25 bp, Homo sapien
tgggttaccaacaagagcaaaagag

SEQ ID NO: 108576 - DNA, 25 bp, Homo sapien
tgggttaccaacaggagcaaaagag

SEQ ID NO: 108577 - DNA, 25 bp, Homo sapien
tgggttaggagaacaggcaaaatct

SEQ ID NO: 108578 - DNA, 25 bp, Homo sapien
tgggttaggagaccaggcaaaatct

SEQ ID NO: 108579 - DNA, 25 bp, Homo sapien
tgggttatgaaaagacatcctaact

SEQ ID NO: 108580 - DNA, 25 bp, Homo sapien
tgggttatgaaaatacatcctaact

SEQ ID NO: 108581 - DNA, 25 bp, Homo sapien
tgggttatggctagctgctgaaacc

SEQ ID NO: 108582 - DNA, 25 bp, Homo sapien
tgggttatggctagcttctgaaacc

SEQ ID NO: 108583 - DNA, 25 bp, Homo sapien
tgggttcatgacagtggctagaggt

SEQ ID NO: 108584 - DNA, 25 bp, Homo sapien
tgggttcatgaccgtggctagaggt

SEQ ID NO: 108585 - DNA, 25 bp, Homo sapien
tgggttccatttacaaagacaaaga

SEQ ID NO: 108586 - DNA, 25 bp, Homo sapien
tgggttccatttagaaagacaaaga

SEQ ID NO: 108587 - DNA, 25 bp, Homo sapien
tgggttccttataaaacgacaaatt

SEQ ID NO: 108588 - DNA, 25 bp, Homo sapien
tgggttccttataaaatgacaaatt

SEQ ID NO: 108589 - DNA, 25 bp, Homo sapien
tgggttctgagacatactggtttca

SEQ ID NO: 108590 - DNA, 25 bp, Homo sapien
tgggttctgagacgtactggtttca

SEQ ID NO: 108591 - DNA, 25 bp, Homo sapien
tgggttgttcttatttcttgcttgt

SEQ ID NO: 108592 - DNA, 25 bp, Homo sapien
tgggttgttcttatttgttgcttgt

SEQ ID NO: 108593 - DNA, 25 bp, Homo sapien
tgggtttagagacagctgattttca

SEQ ID NO: 108594 - DNA, 25 bp, Homo sapien
tgggtttagagatagctgattttca

SEQ ID NO: 108595 - DNA, 25 bp, Homo sapien
tgggtttcaagactaggaccaagaa

SEQ ID NO: 108596 - DNA, 25 bp, Homo sapien
tgggtttcaagattaggaccaagaa

SEQ ID NO: 108597 - DNA, 25 bp, Homo sapien
tgggtttcactaatatctgattttc

SEQ ID NO: 108598 - DNA, 25 bp, Homo sapien
tgggtttcactaatatttgattttc

SEQ ID NO: 108599 - DNA, 25 bp, Homo sapien
tgggtttcagttaacggcaacttta

SEQ ID NO: 108600 - DNA, 25 bp, Homo sapien
tgggtttcagttaatggcaacttta

SEQ ID NO: 108601 - DNA, 25 bp, Homo sapien
tgggtttccatgcaccaataaaatt

SEQ ID NO: 108602 - DNA, 25 bp, Homo sapien
tgggtttccatgtaccaataaaatt

SEQ ID NO: 108603 - DNA, 25 bp, Homo sapien
tgggtttggtcacacgagttatagc

SEQ ID NO: 108604 - DNA, 25 bp, Homo sapien
tgggtttggtcacatgagttatagc

SEQ ID NO: 108605 - DNA, 25 bp, Homo sapien
tgggttttctgggagttcaaagtac

SEQ ID NO: 108606 - DNA, 25 bp, Homo sapien
tgggttttgctcaatgtagtcactt

SEQ ID NO: 108607 - DNA, 25 bp, Homo sapien
tgggttttgctcagtgtagtcactt

SEQ ID NO: 108608 - DNA, 25 bp, Homo sapien
tgggttttttgggagttcaaagtac

SEQ ID NO: 108609 - DNA, 25 bp, Homo sapien
tggtaaaaaaaaagaatgtctcata

SEQ ID NO: 108610 - DNA, 25 bp, Homo sapien
tggtaaaaaaaatgaatgtctcata

SEQ ID NO: 108611 - DNA, 25 bp, Homo sapien
tggtaaaacgagattatgtacaggt

SEQ ID NO: 108612 - DNA, 25 bp, Homo sapien
tggtaaaatgagattatgtacaggt

SEQ ID NO: 108613 - DNA, 25 bp, Homo sapien
tggtaaacatacaactgaggtgatg

SEQ ID NO: 108614 - DNA, 25 bp, Homo sapien
tggtaaacatacagctgaggtgatg

SEQ ID NO: 108615 - DNA, 25 bp, Homo sapien
tggtaaacctacaaaaacttgcaaa

SEQ ID NO: 108616 - DNA, 25 bp, Homo sapien
tggtaaacctataaaaacttgcaaa

SEQ ID NO: 108617 - DNA, 25 bp, Homo sapien
tggtaaagaaaggacatgcgagtga

SEQ ID NO: 108618 - DNA, 25 bp, Homo sapien
tggtaaagaaagggcatgcgagtga

SEQ ID NO: 108619 - DNA, 25 bp, Homo sapien
tggtaacaacaatagagaccttaac

SEQ ID NO: 108620 - DNA, 25 bp, Homo sapien
tggtaacagcaatagagaccttaac

SEQ ID NO: 108621 - DNA, 25 bp, Homo sapien
tggtaacagcttccttctggaccgg

SEQ ID NO: 108622 - DNA, 25 bp, Homo sapien
tggtaacagcttctttctggaccgg

SEQ ID NO: 108623 - DNA, 25 bp, Homo sapien
tggtaactacatcgtctgaaaggaa

SEQ ID NO: 108624 - DNA, 25 bp, Homo sapien
tggtaactacattgtctgaaaggaa

SEQ ID NO: 108625 - DNA, 25 bp, Homo sapien
tggtaagacatgcctacttctcctt

SEQ ID NO: 108626 - DNA, 25 bp, Homo sapien
tggtaagacgtgcctacttctcctt

SEQ ID NO: 108627 - DNA, 25 bp, Homo sapien
tggtaagattcagaaaaaaatgaag

SEQ ID NO: 108628 - DNA, 25 bp, Homo sapien
tggtaagattcaggaaaaaatgaag

SEQ ID NO: 108629 - DNA, 25 bp, Homo sapien
tggtaagtcttgagagaaatgagca

SEQ ID NO: 108630 - DNA, 25 bp, Homo sapien
tggtaagttttgagagaaatgagca

SEQ ID NO: 108631 - DNA, 25 bp, Homo sapien
tggtaatatgcataattttggaaca

SEQ ID NO: 108632 - DNA, 25 bp, Homo sapien
tggtaatatgcgtaattttggaaca

SEQ ID NO: 108633 - DNA, 25 bp, Homo sapien
tggtaatgaagaccactgcagtgtg

SEQ ID NO: 108634 - DNA, 25 bp, Homo sapien
tggtaatgaggaccactgcagtgtg

SEQ ID NO: 108635 - DNA, 25 bp, Homo sapien
tggtaattaaagtcatgagagtgga

SEQ ID NO: 108636 - DNA, 25 bp, Homo sapien
tggtaattaaagtgatgagagtgga

SEQ ID NO: 108637 - DNA, 25 bp, Homo sapien
tggtaattcaatgcataacatattt

SEQ ID NO: 108638 - DNA, 25 bp, Homo sapien
tggtaattcaatgcgtaacatattt

SEQ ID NO: 108639 - DNA, 25 bp, Homo sapien
tggtacaacgtgaagtcagtctggc

SEQ ID NO: 108640 - DNA, 25 bp, Homo sapien
tggtacaagcctaattggaaaaaag

SEQ ID NO: 108641 - DNA, 25 bp, Homo sapien
tggtacaagtctaattggaaaaaag

SEQ ID NO: 108642 - DNA, 25 bp, Homo sapien
tggtacaatacaaacacataaatca

SEQ ID NO: 108643 - DNA, 25 bp, Homo sapien
tggtacaatacagacacataaatca

SEQ ID NO: 108644 - DNA, 25 bp, Homo sapien
tggtacaatgtgaagtcagtctggc

SEQ ID NO: 108645 - DNA, 25 bp, Homo sapien
tggtacacatagtagattcatagta

SEQ ID NO: 108646 - DNA, 25 bp, Homo sapien
tggtacacatagtggattcatagta

SEQ ID NO: 108647 - DNA, 25 bp, Homo sapien
tggtacagatgataagaaacatttg

SEQ ID NO: 108648 - DNA, 25 bp, Homo sapien
tggtacagatgataaggaacatttg

SEQ ID NO: 108649 - DNA, 25 bp, Homo sapien
tggtacagctatcattagaaaccag

SEQ ID NO: 108650 - DNA, 25 bp, Homo sapien
tggtacagttatcattagaaaccag

SEQ ID NO: 108651 - DNA, 25 bp, Homo sapien
tggtacatatttaacagaggagttc

SEQ ID NO: 108652 - DNA, 25 bp, Homo sapien
tggtacatatttagcagaggagttc

SEQ ID NO: 108653 - DNA, 25 bp, Homo sapien
tggtacatgctcaaacattcatcca

SEQ ID NO: 108654 - DNA, 25 bp, Homo sapien
tggtacatgctcaagcattcatcca

SEQ ID NO: 108655 - DNA, 25 bp, Homo sapien
tggtaccccagcgggttcaacaggt

SEQ ID NO: 108656 - DNA, 25 bp, Homo sapien
tggtaccccagtgggttcaacaggt

SEQ ID NO: 108657 - DNA, 25 bp, Homo sapien
tggtactaccaaggctttgactgga

SEQ ID NO: 108658 - DNA, 25 bp, Homo sapien
tggtactatcaaggctttgactgga

SEQ ID NO: 108659 - DNA, 25 bp, Homo sapien
tggtactccaaatcaccttatagac

SEQ ID NO: 108660 - DNA, 25 bp, Homo sapien
tggtactcgaaatcaccttatagac

SEQ ID NO: 108661 - DNA, 25 bp, Homo sapien
tggtactctgctctttgtactctag

SEQ ID NO: 108662 - DNA, 25 bp, Homo sapien
tggtactctgctttttgtactctag

SEQ ID NO: 108663 - DNA, 25 bp, Homo sapien
tggtactgatgataaaaaaaaaaaa

SEQ ID NO: 108664 - DNA, 25 bp, Homo sapien
tggtactgatgttaaaaaaaaaaaa

SEQ ID NO: 108665 - DNA, 25 bp, Homo sapien
tggtacttcctagagacggccggag

SEQ ID NO: 108666 - DNA, 25 bp, Homo sapien
tggtacttcctagagatggccggag

SEQ ID NO: 108667 - DNA, 25 bp, Homo sapien
tggtacttgcatccaagaggtccag

SEQ ID NO: 108668 - DNA, 25 bp, Homo sapien
tggtacttgcatcctagaggtccag

SEQ ID NO: 108669 - DNA, 25 bp, Homo sapien
tggtagattacactgatagatttta

SEQ ID NO: 108670 - DNA, 25 bp, Homo sapien
tggtagattacattgatagatttta

SEQ ID NO: 108671 - DNA, 25 bp, Homo sapien
tggtaggaaagttgccatgactcca

SEQ ID NO: 108672 - DNA, 25 bp, Homo sapien
tggtaggaaagttgccgtgactcca

SEQ ID NO: 108673 - DNA, 25 bp, Homo sapien
tggtagtagactggaattcctttta

SEQ ID NO: 108674 - DNA, 25 bp, Homo sapien
tggtagtagcctggaattcctttta

SEQ ID NO: 108675 - DNA, 25 bp, Homo sapien
tggtagtatttgcttttgtaataaa

SEQ ID NO: 108676 - DNA, 25 bp, Homo sapien
tggtagtatttgtttttgtaataaa

SEQ ID NO: 108677 - DNA, 25 bp, Homo sapien
tggtagtcaaatctcaccatcagga

SEQ ID NO: 108678 - DNA, 25 bp, Homo sapien
tggtagtcacatctcaccatcagga

SEQ ID NO: 108679 - DNA, 25 bp, Homo sapien
tggtagttcctatgaaacagagaat

SEQ ID NO: 108680 - DNA, 25 bp, Homo sapien
tggtagttcctatgaagcagagaat

SEQ ID NO: 108681 - DNA, 25 bp, Homo sapien
tggtataaattttcttcaaaagaac

SEQ ID NO: 108682 - DNA, 25 bp, Homo sapien
tggtataatttttcttcaaaagaac

SEQ ID NO: 108683 - DNA, 25 bp, Homo sapien
tggtatagaagtatctgaattttat

SEQ ID NO: 108684 - DNA, 25 bp, Homo sapien
tggtatagaagtatttgaattttat

SEQ ID NO: 108685 - DNA, 25 bp, Homo sapien
tggtatagcgccaacattcgaagta

SEQ ID NO: 108686 - DNA, 25 bp, Homo sapien
tggtatagtgccaacattcgaagta

SEQ ID NO: 108687 - DNA, 25 bp, Homo sapien
tggtatatgtttgcaatgagcatgc

SEQ ID NO: 108688 - DNA, 25 bp, Homo sapien
tggtatatgtttggaatgagcatgc

SEQ ID NO: 108689 - DNA, 25 bp, Homo sapien
tggtatcaactgttcagatagctct

SEQ ID NO: 108690 - DNA, 25 bp, Homo sapien
tggtatcaagtgttcagatagctct

SEQ ID NO: 108691 - DNA, 25 bp, Homo sapien
tggtatcaataaagagatgaaggca

SEQ ID NO: 108692 - DNA, 25 bp, Homo sapien
tggtatcagtaaagagatgaaggca

SEQ ID NO: 108693 - DNA, 25 bp, Homo sapien
tggtatctcgttgttgtaatttgca

SEQ ID NO: 108694 - DNA, 25 bp, Homo sapien
tggtatcttgttgttgtaatttgca

SEQ ID NO: 108695 - DNA, 25 bp, Homo sapien
tggtatgaaaatgtttaacactact

SEQ ID NO: 108696 - DNA, 25 bp, Homo sapien
tggtatgaatatgtttaacactact

SEQ ID NO: 108697 - DNA, 25 bp, Homo sapien
tggtatgacctctgtttacctctcc

SEQ ID NO: 108698 - DNA, 25 bp, Homo sapien
tggtatgagctctgtttacctctcc

SEQ ID NO: 108699 - DNA, 25 bp, Homo sapien
tggtatgagtatggaatcaagaaat

SEQ ID NO: 108700 - DNA, 25 bp, Homo sapien
tggtatgagtatggtatcaagaaat

SEQ ID NO: 108701 - DNA, 25 bp, Homo sapien
tggtatgcccatcaattcaagcatt

SEQ ID NO: 108702 - DNA, 25 bp, Homo sapien
tggtatgcccatcagttcaagcatt

SEQ ID NO: 108703 - DNA, 25 bp, Homo sapien
tggtatggccgtagactagagctct

SEQ ID NO: 108704 - DNA, 25 bp, Homo sapien
tggtatggctgtagactagagctct

SEQ ID NO: 108705 - DNA, 25 bp, Homo sapien
tggtatgggtcctagcactgaggaa

SEQ ID NO: 108706 - DNA, 25 bp, Homo sapien
tggtatgggtcttagcactgaggaa

SEQ ID NO: 108707 - DNA, 25 bp, Homo sapien
tggtatggtctcacttacaatggaa

SEQ ID NO: 108708 - DNA, 25 bp, Homo sapien
tggtatggtctcacttgcaatggaa

SEQ ID NO: 108709 - DNA, 25 bp, Homo sapien
tggtatgtcaatattttagatgcca

SEQ ID NO: 108710 - DNA, 25 bp, Homo sapien
tggtatgtcgatattttagatgcca

SEQ ID NO: 108711 - DNA, 25 bp, Homo sapien
tggtatgtttgcagtgacaaaagtt

SEQ ID NO: 108712 - DNA, 25 bp, Homo sapien
tggtatgtttgtagtgacaaaagtt

SEQ ID NO: 108713 - DNA, 25 bp, Homo sapien
tggtatgttttatacgtatcctagt

SEQ ID NO: 108714 - DNA, 25 bp, Homo sapien
tggtatgttttatatgtatcctagt

SEQ ID NO: 108715 - DNA, 25 bp, Homo sapien
tggtattaggtacaaaaccataatg

SEQ ID NO: 108716 - DNA, 25 bp, Homo sapien
tggtattaggtacaaatccataatg

SEQ ID NO: 108717 - DNA, 25 bp, Homo sapien
tggtattgtcaggacttggattcta

SEQ ID NO: 108718 - DNA, 25 bp, Homo sapien
tggtattgtcaggatttggattcta

SEQ ID NO: 108719 - DNA, 25 bp, Homo sapien
tggtatttcgttcattcttagaatt

SEQ ID NO: 108720 - DNA, 25 bp, Homo sapien
tggtatttctttcattcttagaatt

SEQ ID NO: 108721 - DNA, 25 bp, Homo sapien
tggtcaaacccagagaagaggggat

SEQ ID NO: 108722 - DNA, 25 bp, Homo sapien
tggtcaaactccttccttttggtga

SEQ ID NO: 108723 - DNA, 25 bp, Homo sapien
tggtcaaactctttccttttggtga

SEQ ID NO: 108724 - DNA, 25 bp, Homo sapien
tggtcaaactgccacctcagggcaa

SEQ ID NO: 108725 - DNA, 25 bp, Homo sapien
tggtcaaactgccgcctcagggcaa

SEQ ID NO: 108726 - DNA, 25 bp, Homo sapien
tggtcaaatccaactggaacccagg

SEQ ID NO: 108727 - DNA, 25 bp, Homo sapien
tggtcaaatccaattggaacccagg

SEQ ID NO: 108728 - DNA, 25 bp, Homo sapien
tggtcaaatccagagaagaggggat

SEQ ID NO: 108729 - DNA, 25 bp, Homo sapien
tggtcaacatgcagatgactagaaa

SEQ ID NO: 108730 - DNA, 25 bp, Homo sapien
tggtcaacgtgcagatgactagaaa

SEQ ID NO: 108731 - DNA, 25 bp, Homo sapien
tggtcaagaactagaggacttctag

SEQ ID NO: 108732 - DNA, 25 bp, Homo sapien
tggtcaaggactagaggacttctag

SEQ ID NO: 108733 - DNA, 25 bp, Homo sapien
tggtcaagggaaatgatcactcttc

SEQ ID NO: 108734 - DNA, 25 bp, Homo sapien
tggtcaagggaactgatcactcttc

SEQ ID NO: 108735 - DNA, 25 bp, Homo sapien
tggtcaagtcctgtctcctataacg

SEQ ID NO: 108736 - DNA, 25 bp, Homo sapien
tggtcaagtcctttctcctataacg

SEQ ID NO: 108737 - DNA, 25 bp, Homo sapien
tggtcaagttccagtgagggccctc

SEQ ID NO: 108738 - DNA, 25 bp, Homo sapien
tggtcaagttccggtgagggccctc

SEQ ID NO: 108739 - DNA, 25 bp, Homo sapien
tggtcaatatgcatagcaagtcaac

SEQ ID NO: 108740 - DNA, 25 bp, Homo sapien
tggtcaatatgcgtagcaagtcaac

SEQ ID NO: 108741 - DNA, 25 bp, Homo sapien
tggtcacacgttcctcaactgatcc

SEQ ID NO: 108742 - DNA, 25 bp, Homo sapien
tggtcacacttccggacagcaaatg

SEQ ID NO: 108743 - DNA, 25 bp, Homo sapien
tggtcacacttctggacagcaaatg

SEQ ID NO: 108744 - DNA, 25 bp, Homo sapien
tggtcacatgatcaatcctggtctt

SEQ ID NO: 108745 - DNA, 25 bp, Homo sapien
tggtcacatgatcagtcctggtctt

SEQ ID NO: 108746 - DNA, 25 bp, Homo sapien
tggtcacatgttcctcaactgatcc

SEQ ID NO: 108747 - DNA, 25 bp, Homo sapien
tggtcaccaggaataagttgtgtaa

SEQ ID NO: 108748 - DNA, 25 bp, Homo sapien
tggtcaccaggagtaagttgtgtaa

SEQ ID NO: 108749 - DNA, 25 bp, Homo sapien
tggtcacccaggaaggatggataaa

SEQ ID NO: 108750 - DNA, 25 bp, Homo sapien
tggtcacccgggaaggatggataaa

SEQ ID NO: 108751 - DNA, 25 bp, Homo sapien
tggtcagaaacctaatttttgtgct

SEQ ID NO: 108752 - DNA, 25 bp, Homo sapien
tggtcagaaacctagtttttgtgct

SEQ ID NO: 108753 - DNA, 25 bp, Homo sapien
tggtcagatctacgtaaacggaatc

SEQ ID NO: 108754 - DNA, 25 bp, Homo sapien
tggtcagatctatgtaaacggaatc

SEQ ID NO: 108755 - DNA, 25 bp, Homo sapien
tggtcagctcagaatggaaaacgca

SEQ ID NO: 108756 - DNA, 25 bp, Homo sapien
tggtcagctcagagtggaaaacgca

SEQ ID NO: 108757 - DNA, 25 bp, Homo sapien
tggtcagttgttacatatttgtgta

SEQ ID NO: 108758 - DNA, 25 bp, Homo sapien
tggtcagttgttatatatttgtgta

SEQ ID NO: 108759 - DNA, 25 bp, Homo sapien
tggtcatagaggtggacaatcataa

SEQ ID NO: 108760 - DNA, 25 bp, Homo sapien
tggtcatagaggtggagaatcataa

SEQ ID NO: 108761 - DNA, 25 bp, Homo sapien
tggtcatgccttaaccatgggtaac

SEQ ID NO: 108762 - DNA, 25 bp, Homo sapien
tggtcatgccttaaccgtgggtaac

SEQ ID NO: 108763 - DNA, 25 bp, Homo sapien
tggtcatgtatttatggatttgttt

SEQ ID NO: 108764 - DNA, 25 bp, Homo sapien
tggtcatgtatttgtggatttgttt

SEQ ID NO: 108765 - DNA, 25 bp, Homo sapien
tggtcattctcctcactcgaaaaag

SEQ ID NO: 108766 - DNA, 25 bp, Homo sapien
tggtcattttcctcactcgaaaaag

SEQ ID NO: 108767 - DNA, 25 bp, Homo sapien
tggtcattttgggttcatttgttga

SEQ ID NO: 108768 - DNA, 25 bp, Homo sapien
tggtcattttgtgttcatttgttga

SEQ ID NO: 108769 - DNA, 25 bp, Homo sapien
tggtccacctcatatcagatgaaca

SEQ ID NO: 108770 - DNA, 25 bp, Homo sapien
tggtccacctcatgtcagatgaaca

SEQ ID NO: 108771 - DNA, 25 bp, Homo sapien
tggtccagccaatcagggataaatc

SEQ ID NO: 108772 - DNA, 25 bp, Homo sapien
tggtccagctaatcagggataaatc

SEQ ID NO: 108773 - DNA, 25 bp, Homo sapien
tggtccataagttttaactaacaga

SEQ ID NO: 108774 - DNA, 25 bp, Homo sapien
tggtccatatgttttaactaacaga

SEQ ID NO: 108775 - DNA, 25 bp, Homo sapien
tggtcccattcttcctctagtgcgc

SEQ ID NO: 108776 - DNA, 25 bp, Homo sapien
tggtcccattcttcctgtagtgcgc

SEQ ID NO: 108777 - DNA, 25 bp, Homo sapien
tggtccggaatggcggaagtaaatc

SEQ ID NO: 108778 - DNA, 25 bp, Homo sapien
tggtccggaatggtggaagtaaatc

SEQ ID NO: 108779 - DNA, 25 bp, Homo sapien
tggtcctccatgatctccacatcct

SEQ ID NO: 108780 - DNA, 25 bp, Homo sapien
tggtcctccgtgatctccacatcct

SEQ ID NO: 108781 - DNA, 25 bp, Homo sapien
tggtcctgcacaagttggatttgaa

SEQ ID NO: 108782 - DNA, 25 bp, Homo sapien
tggtcctggaaatgtcagactcaaa

SEQ ID NO: 108783 - DNA, 25 bp, Homo sapien
tggtcctgggaatgtcagactcaaa

SEQ ID NO: 108784 - DNA, 25 bp, Homo sapien
tggtcctgggcattttctcgttggt

SEQ ID NO: 108785 - DNA, 25 bp, Homo sapien
tggtcctgggcattttttcgttggt

SEQ ID NO: 108786 - DNA, 25 bp, Homo sapien
tggtcctgtacaagttggatttgaa

SEQ ID NO: 108787 - DNA, 25 bp, Homo sapien
tggtcctttgacctaggattatctt

SEQ ID NO: 108788 - DNA, 25 bp, Homo sapien
tggtcctttgatctaggattatctt

SEQ ID NO: 108789 - DNA, 25 bp, Homo sapien
tggtctaaactgcaagtgacttata

SEQ ID NO: 108790 - DNA, 25 bp, Homo sapien
tggtctaaacttcaagtgacttata

SEQ ID NO: 108791 - DNA, 25 bp, Homo sapien
tggtctcaaagccataattgatatt

SEQ ID NO: 108792 - DNA, 25 bp, Homo sapien
tggtctcaaagccgtaattgatatt

SEQ ID NO: 108793 - DNA, 25 bp, Homo sapien
tggtctcactaactgatatgtcaat

SEQ ID NO: 108794 - DNA, 25 bp, Homo sapien
tggtctcactaattgatatgtcaat

SEQ ID NO: 108795 - DNA, 25 bp, Homo sapien
tggtctccatacatcatcttcactg

SEQ ID NO: 108796 - DNA, 25 bp, Homo sapien
tggtctccatacctcatcttcactg

SEQ ID NO: 108797 - DNA, 25 bp, Homo sapien
tggtctgacagcttccgtggtccct

SEQ ID NO: 108798 - DNA, 25 bp, Homo sapien
tggtctgacaggttccgtggtccct

SEQ ID NO: 108799 - DNA, 25 bp, Homo sapien
tggtctgtaatgactgacttctttc

SEQ ID NO: 108800 - DNA, 25 bp, Homo sapien
tggtctgtagtgactgacttctttc

SEQ ID NO: 108801 - DNA, 25 bp, Homo sapien
tggtcttatctaaaggaaagtactg

SEQ ID NO: 108802 - DNA, 25 bp, Homo sapien
tggtcttatctaaagggaagtactg

SEQ ID NO: 108803 - DNA, 25 bp, Homo sapien
tggtcttccttccggaacataatct

SEQ ID NO: 108804 - DNA, 25 bp, Homo sapien
tggtcttctttccggaacataatct

SEQ ID NO: 108805 - DNA, 25 bp, Homo sapien
tggtctttaaagcgatttcctgcca

SEQ ID NO: 108806 - DNA, 25 bp, Homo sapien
tggtctttaaagtgatttcctgcca

SEQ ID NO: 108807 - DNA, 25 bp, Homo sapien
tggtctttccggaggtactttagaa

SEQ ID NO: 108808 - DNA, 25 bp, Homo sapien
tggtctttccttggctaacttcttc

SEQ ID NO: 108809 - DNA, 25 bp, Homo sapien
tggtctttccttggttaacttcttc

SEQ ID NO: 108810 - DNA, 25 bp, Homo sapien
tggtctttctggaggtactttagaa

SEQ ID NO: 108811 - DNA, 25 bp, Homo sapien
tggtctttttttccacaagaacatg

SEQ ID NO: 108812 - DNA, 25 bp, Homo sapien
tggtcttttttttcacaagaacatg

SEQ ID NO: 108813 - DNA, 25 bp, Homo sapien
tggtgaaatgactatgggttctgtc

SEQ ID NO: 108814 - DNA, 25 bp, Homo sapien
tggtgaaatgactctgggttctgtc

SEQ ID NO: 108815 - DNA, 25 bp, Homo sapien
tggtgaaatgttacaaaatatagac

SEQ ID NO: 108816 - DNA, 25 bp, Homo sapien
tggtgaaatgttagaaaatatagac

SEQ ID NO: 108817 - DNA, 25 bp, Homo sapien
tggtgaagtcataggaacacaaggc

SEQ ID NO: 108818 - DNA, 25 bp, Homo sapien
tggtgaagtcatgggaacacaaggc

SEQ ID NO: 108819 - DNA, 25 bp, Homo sapien
tggtgacagcttgcttactgactca

SEQ ID NO: 108820 - DNA, 25 bp, Homo sapien
tggtgacagcttgcttgctgactca

SEQ ID NO: 108821 - DNA, 25 bp, Homo sapien
tggtgacagtgcaatcaaaaattat

SEQ ID NO: 108822 - DNA, 25 bp, Homo sapien
tggtgacagtgcgatcaaaaattat

SEQ ID NO: 108823 - DNA, 25 bp, Homo sapien
tggtgaccttaagtgagttgctcac

SEQ ID NO: 108824 - DNA, 25 bp, Homo sapien
tggtgaccttaattgagttgctcac

SEQ ID NO: 108825 - DNA, 25 bp, Homo sapien
tggtgacgagtgaatggctcaattc

SEQ ID NO: 108826 - DNA, 25 bp, Homo sapien
tggtgacgagtgcatggctcaattc

SEQ ID NO: 108827 - DNA, 25 bp, Homo sapien
tggtgacggcacaaatttccttgtc

SEQ ID NO: 108828 - DNA, 25 bp, Homo sapien
tggtgacggcaccaatttccttgtc

SEQ ID NO: 108829 - DNA, 25 bp, Homo sapien
tggtgacgtgtcattgtgggttcat

SEQ ID NO: 108830 - DNA, 25 bp, Homo sapien
tggtgacgtgtccttgtgggttcat

SEQ ID NO: 108831 - DNA, 25 bp, Homo sapien
tggtgactcttctaaactaaattaa

SEQ ID NO: 108832 - DNA, 25 bp, Homo sapien
tggtgactcttctatactaaattaa

SEQ ID NO: 108833 - DNA, 25 bp, Homo sapien
tggtgagcatcatcactaaggccat

SEQ ID NO: 108834 - DNA, 25 bp, Homo sapien
tggtgagcgtcatcactaaggccat

SEQ ID NO: 108835 - DNA, 25 bp, Homo sapien
tggtgagctagtttgtataaagtat

SEQ ID NO: 108836 - DNA, 25 bp, Homo sapien
tggtgagcttgtttgtataaagtat

SEQ ID NO: 108837 - DNA, 25 bp, Homo sapien
tggtgaggaagcactaacacttgtt

SEQ ID NO: 108838 - DNA, 25 bp, Homo sapien
tggtgaggaagcagtaacacttgtt

SEQ ID NO: 108839 - DNA, 25 bp, Homo sapien
tggtgaggtatgcgttaaggtcttt

SEQ ID NO: 108840 - DNA, 25 bp, Homo sapien
tggtgaggtatgtgttaaggtcttt

SEQ ID NO: 108841 - DNA, 25 bp, Homo sapien
tggtgataccgtttgacctaagtgt

SEQ ID NO: 108842 - DNA, 25 bp, Homo sapien
tggtgatactgtttgacctaagtgt

SEQ ID NO: 108843 - DNA, 25 bp, Homo sapien
tggtgatcctacaagattataatga

SEQ ID NO: 108844 - DNA, 25 bp, Homo sapien
tggtgatcctataagattataatga

SEQ ID NO: 108845 - DNA, 25 bp, Homo sapien
tggtgatggggttgccagacaccta

SEQ ID NO: 108846 - DNA, 25 bp, Homo sapien
tggtgatggggttgcctgacaccta

SEQ ID NO: 108847 - DNA, 25 bp, Homo sapien
tggtgattatgtcatgaaatctttg

SEQ ID NO: 108848 - DNA, 25 bp, Homo sapien
tggtgattatgtcatgcaatctttg

SEQ ID NO: 108849 - DNA, 25 bp, Homo sapien
tggtgatttccttttgagttcttgg

SEQ ID NO: 108850 - DNA, 25 bp, Homo sapien
tggtgatttccttttgtgttcttgg

SEQ ID NO: 108851 - DNA, 25 bp, Homo sapien
tggtgatttgctatatagatcaacc

SEQ ID NO: 108852 - DNA, 25 bp, Homo sapien
tggtgatttgctgtatagatcaacc

SEQ ID NO: 108853 - DNA, 25 bp, Homo sapien
tggtgcaaattattttattgtctct

SEQ ID NO: 108854 - DNA, 25 bp, Homo sapien
tggtgcaagttattttattgtctct

SEQ ID NO: 108855 - DNA, 25 bp, Homo sapien
tggtgcaatatcttatacaaagctc

SEQ ID NO: 108856 - DNA, 25 bp, Homo sapien
tggtgcaatgtcttatacaaagctc

SEQ ID NO: 108857 - DNA, 25 bp, Homo sapien
tggtgcattactggaggtcccagct

SEQ ID NO: 108858 - DNA, 25 bp, Homo sapien
tggtgcattacttgaggtcccagct

SEQ ID NO: 108859 - DNA, 25 bp, Homo sapien
tggtgccaggaaccaaaccaaggcc

SEQ ID NO: 108860 - DNA, 25 bp, Homo sapien
tggtgccaggatccaaaccaaggcc

SEQ ID NO: 108861 - DNA, 25 bp, Homo sapien
tggtgccctagcttgtcagccaaac

SEQ ID NO: 108862 - DNA, 25 bp, Homo sapien
tggtgccctagtttgtcagccaaac

SEQ ID NO: 108863 - DNA, 25 bp, Homo sapien
tggtgccgttcccatcgacagcagc

SEQ ID NO: 108864 - DNA, 25 bp, Homo sapien
tggtgccgttcctatcgacagcagc

SEQ ID NO: 108865 - DNA, 25 bp, Homo sapien
tggtgcctacatactcgatatgtta

SEQ ID NO: 108866 - DNA, 25 bp, Homo sapien
tggtgcctacatactctatatgtta

SEQ ID NO: 108867 - DNA, 25 bp, Homo sapien
tggtgcgtgcagtacatttttttag

SEQ ID NO: 108868 - DNA, 25 bp, Homo sapien
tggtgcgtggagtacatttttttag

SEQ ID NO: 108869 - DNA, 25 bp, Homo sapien
tggtgctccactctagtatatgttt

SEQ ID NO: 108870 - DNA, 25 bp, Homo sapien
tggtgctccgctctagtatatgttt

SEQ ID NO: 108871 - DNA, 25 bp, Homo sapien
tggtgcttatgcatggagagagatg

SEQ ID NO: 108872 - DNA, 25 bp, Homo sapien
tggtgcttatgcttggagagagatg

SEQ ID NO: 108873 - DNA, 25 bp, Homo sapien
tggtgcttgctgcagaaagttataa

SEQ ID NO: 108874 - DNA, 25 bp, Homo sapien
tggtgcttgctgcggaaagttataa

SEQ ID NO: 108875 - DNA, 25 bp, Homo sapien
tggtgctttaaagtgaggcttctct

SEQ ID NO: 108876 - DNA, 25 bp, Homo sapien
tggtgctttcaagtgaggcttctct

SEQ ID NO: 108877 - DNA, 25 bp, Homo sapien
tggtggaactgaaccatctttgtaa

SEQ ID NO: 108878 - DNA, 25 bp, Homo sapien
tggtggaattgaaccatctttgtaa

SEQ ID NO: 108879 - DNA, 25 bp, Homo sapien
tggtggacattaacggaatcacaca

SEQ ID NO: 108880 - DNA, 25 bp, Homo sapien
tggtggacattaatggaatcacaca

SEQ ID NO: 108881 - DNA, 25 bp, Homo sapien
tggtggacccactgtaatcacaagg

SEQ ID NO: 108882 - DNA, 25 bp, Homo sapien
tggtggacccattgtaatcacaagg

SEQ ID NO: 108883 - DNA, 25 bp, Homo sapien
tggtggagcccatccatcagtactt

SEQ ID NO: 108884 - DNA, 25 bp, Homo sapien
tggtggagcccatctatcagtactt

SEQ ID NO: 108885 - DNA, 25 bp, Homo sapien
tggtggattagctaaatctgccaac

SEQ ID NO: 108886 - DNA, 25 bp, Homo sapien
tggtggattccactgttccttccac

SEQ ID NO: 108887 - DNA, 25 bp, Homo sapien
tggtggatttcactgttccttccac

SEQ ID NO: 108888 - DNA, 25 bp, Homo sapien
tggtggatttgctaaatctgccaac

SEQ ID NO: 108889 - DNA, 25 bp, Homo sapien
tggtggcaactctggctcccctgag

SEQ ID NO: 108890 - DNA, 25 bp, Homo sapien
tggtggcaattctggctcccctgag

SEQ ID NO: 108891 - DNA, 25 bp, Homo sapien
tggtggcagagggaaaaatggctgc

SEQ ID NO: 108892 - DNA, 25 bp, Homo sapien
tggtggcagagggagaaatggctgc

SEQ ID NO: 108893 - DNA, 25 bp, Homo sapien
tggtggcatctggtaagggtcatcc

SEQ ID NO: 108894 - DNA, 25 bp, Homo sapien
tggtggcatctggtgagggtcatcc

SEQ ID NO: 108895 - DNA, 25 bp, Homo sapien
tggtggccactctaggactgcaagg

SEQ ID NO: 108896 - DNA, 25 bp, Homo sapien
tggtggccactctatgactgcaagg

SEQ ID NO: 108897 - DNA, 25 bp, Homo sapien
tggtggcccaaaaggcgtcatcagc

SEQ ID NO: 108898 - DNA, 25 bp, Homo sapien
tggtggcccaaaatgcgtcatcagc

SEQ ID NO: 108899 - DNA, 25 bp, Homo sapien
tggtggctgtctaatgtttaggact

SEQ ID NO: 108900 - DNA, 25 bp, Homo sapien
tggtggctgtctgatgtttaggact

SEQ ID NO: 108901 - DNA, 25 bp, Homo sapien
tggtgggaaaaataacagaaccaat

SEQ ID NO: 108902 - DNA, 25 bp, Homo sapien
tggtgggaaaaataacggaaccaat

SEQ ID NO: 108903 - DNA, 25 bp, Homo sapien
tggtgggacgaaagaagcttgtgaa

SEQ ID NO: 108904 - DNA, 25 bp, Homo sapien
tggtgggacgaatgaagcttgtgaa

SEQ ID NO: 108905 - DNA, 25 bp, Homo sapien
tggtgggatgagaaggagttggtga

SEQ ID NO: 108906 - DNA, 25 bp, Homo sapien
tggtgggatgagtaggagttggtga

SEQ ID NO: 108907 - DNA, 25 bp, Homo sapien
tggtgggattgaacagaaagaagct

SEQ ID NO: 108908 - DNA, 25 bp, Homo sapien
tggtgggattggacagaaagaagct

SEQ ID NO: 108909 - DNA, 25 bp, Homo sapien
tggtggtaagagagctgacataaca

SEQ ID NO: 108910 - DNA, 25 bp, Homo sapien
tggtggtatgagagctgacataaca

SEQ ID NO: 108911 - DNA, 25 bp, Homo sapien
tggtggtgacaagataaaataagga

SEQ ID NO: 108912 - DNA, 25 bp, Homo sapien
tggtggtgacaaggtaaaataagga

SEQ ID NO: 108913 - DNA, 25 bp, Homo sapien
tggtggtgccggactccagttcttg

SEQ ID NO: 108914 - DNA, 25 bp, Homo sapien
tggtggtgctggactccagttcttg

SEQ ID NO: 108915 - DNA, 25 bp, Homo sapien
tggtggtggaacccgttctcactcc

SEQ ID NO: 108916 - DNA, 25 bp, Homo sapien
tggtggtggaacctgttctcactcc

SEQ ID NO: 108917 - DNA, 25 bp, Homo sapien
tggtggtgtgaacagtatgaataaa

SEQ ID NO: 108918 - DNA, 25 bp, Homo sapien
tggtggtgtgaacagtctgaataaa

SEQ ID NO: 108919 - DNA, 25 bp, Homo sapien
tggtggtgttttaaacttctaaatt

SEQ ID NO: 108920 - DNA, 25 bp, Homo sapien
tggtggtgttttaaccttctaaatt

SEQ ID NO: 108921 - DNA, 25 bp, Homo sapien
tggtggttacggtgaaagactcctt

SEQ ID NO: 108922 - DNA, 25 bp, Homo sapien
tggtggttgcggtgaaagactcctt

SEQ ID NO: 108923 - DNA, 25 bp, Homo sapien
tggtgtaaacataactgccattttt

SEQ ID NO: 108924 - DNA, 25 bp, Homo sapien
tggtgtaaacataattgccattttt

SEQ ID NO: 108925 - DNA, 25 bp, Homo sapien
tggtgtacagaatattttaccacct

SEQ ID NO: 108926 - DNA, 25 bp, Homo sapien
tggtgtacagattattttaccacct

SEQ ID NO: 108927 - DNA, 25 bp, Homo sapien
tggtgtaccacagggagcctggaca

SEQ ID NO: 108928 - DNA, 25 bp, Homo sapien
tggtgtaccacggggagcctggaca

SEQ ID NO: 108929 - DNA, 25 bp, Homo sapien
tggtgtactcacaatcacttaattg

SEQ ID NO: 108930 - DNA, 25 bp, Homo sapien
tggtgtactcacattcacttaattg

SEQ ID NO: 108931 - DNA, 25 bp, Homo sapien
tggtgtatcgattcctattgacttt

SEQ ID NO: 108932 - DNA, 25 bp, Homo sapien
tggtgtatcgattcttattgacttt

SEQ ID NO: 108933 - DNA, 25 bp, Homo sapien
tggtgtatctctccgttgtgaagtt

SEQ ID NO: 108934 - DNA, 25 bp, Homo sapien
tggtgtatttctccgttgtgaagtt

SEQ ID NO: 108935 - DNA, 25 bp, Homo sapien
tggtgtcctactgtgaagattttgc

SEQ ID NO: 108936 - DNA, 25 bp, Homo sapien
tggtgtcctactgtgacgattttgc

SEQ ID NO: 108937 - DNA, 25 bp, Homo sapien
tggtgtcctgttgtaactttagtga

SEQ ID NO: 108938 - DNA, 25 bp, Homo sapien
tggtgtcctgttttaactttagtga

SEQ ID NO: 108939 - DNA, 25 bp, Homo sapien
tggtgtgaacagtatgaataaaagg

SEQ ID NO: 108940 - DNA, 25 bp, Homo sapien
tggtgtgaacagtctgaataaaagg

SEQ ID NO: 108941 - DNA, 25 bp, Homo sapien
tggtgtgctcacttggccagaagca

SEQ ID NO: 108942 - DNA, 25 bp, Homo sapien
tggtgtgctcatttggccagaagca

SEQ ID NO: 108943 - DNA, 25 bp, Homo sapien
tggtgttctataaatattcattccc

SEQ ID NO: 108944 - DNA, 25 bp, Homo sapien
tggtgttctctctctactgcacttt

SEQ ID NO: 108945 - DNA, 25 bp, Homo sapien
tggtgttctgtaaatattcattccc

SEQ ID NO: 108946 - DNA, 25 bp, Homo sapien
tggtgttctgtctctactgcacttt

SEQ ID NO: 108947 - DNA, 25 bp, Homo sapien
tggtgttgataggcaaataaataac

SEQ ID NO: 108948 - DNA, 25 bp, Homo sapien
tggtgttgataggtaaataaataac

SEQ ID NO: 108949 - DNA, 25 bp, Homo sapien
tggtgttgctagaagtattatatct

SEQ ID NO: 108950 - DNA, 25 bp, Homo sapien
tggtgttgctagcagtattatatct

SEQ ID NO: 108951 - DNA, 25 bp, Homo sapien
tggtgtttaatcctgggttagcaaa

SEQ ID NO: 108952 - DNA, 25 bp, Homo sapien
tggtgtttaatcctggtttagcaaa

SEQ ID NO: 108953 - DNA, 25 bp, Homo sapien
tggtgtttctactctttagcataca

SEQ ID NO: 108954 - DNA, 25 bp, Homo sapien
tggtgtttctactttttagcataca

SEQ ID NO: 108955 - DNA, 25 bp, Homo sapien
tggtgtttctttgagacagagtctc

SEQ ID NO: 108956 - DNA, 25 bp, Homo sapien
tggtgttttaaacttctaaatttgt

SEQ ID NO: 108957 - DNA, 25 bp, Homo sapien
tggtgttttaaccttctaaatttgt

SEQ ID NO: 108958 - DNA, 25 bp, Homo sapien
tggtgtttttttgagacagagtctc

SEQ ID NO: 108959 - DNA, 25 bp, Homo sapien
tggttaaaatgggtagactcttcat

SEQ ID NO: 108960 - DNA, 25 bp, Homo sapien
tggttaaaatgtgtagactcttcat

SEQ ID NO: 108961 - DNA, 25 bp, Homo sapien
tggttaaaggtgaagatgtggttga

SEQ ID NO: 108962 - DNA, 25 bp, Homo sapien
tggttaaatgaaaccttctagctgt

SEQ ID NO: 108963 - DNA, 25 bp, Homo sapien
tggttaaatgaaatcttctagctgt

SEQ ID NO: 108964 - DNA, 25 bp, Homo sapien
tggttaaatgtgaagatgtggttga

SEQ ID NO: 108965 - DNA, 25 bp, Homo sapien
tggttaactaactacatgctaagag

SEQ ID NO: 108966 - DNA, 25 bp, Homo sapien
tggttaactaattacatgctaagag

SEQ ID NO: 108967 - DNA, 25 bp, Homo sapien
tggttaacttatgcaagtaacaatc

SEQ ID NO: 108968 - DNA, 25 bp, Homo sapien
tggttaacttatgcgagtaacaatc

SEQ ID NO: 108969 - DNA, 25 bp, Homo sapien
tggttaagagaaaggtatctccaga

SEQ ID NO: 108970 - DNA, 25 bp, Homo sapien
tggttaagagacaggtatctccaga

SEQ ID NO: 108971 - DNA, 25 bp, Homo sapien
tggttaagcatgtggtcaattttag

SEQ ID NO: 108972 - DNA, 25 bp, Homo sapien
tggttaagccagaggcccagtgaag

SEQ ID NO: 108973 - DNA, 25 bp, Homo sapien
tggttaagccagaggctcagtgaag

SEQ ID NO: 108974 - DNA, 25 bp, Homo sapien
tggttaagctcctgtgttccaaaaa

SEQ ID NO: 108975 - DNA, 25 bp, Homo sapien
tggttaagtatgtggtcaattttag

SEQ ID NO: 108976 - DNA, 25 bp, Homo sapien
tggttaagttcctgtgttccaaaaa

SEQ ID NO: 108977 - DNA, 25 bp, Homo sapien
tggttaatgcaacacagactgctca

SEQ ID NO: 108978 - DNA, 25 bp, Homo sapien
tggttaatgcaatacagactgctca

SEQ ID NO: 108979 - DNA, 25 bp, Homo sapien
tggttaattaaaaggagaatcaaac

SEQ ID NO: 108980 - DNA, 25 bp, Homo sapien
tggttaattaaaaggataatcaaac

SEQ ID NO: 108981 - DNA, 25 bp, Homo sapien
tggttacagcatgtatgctttcaaa

SEQ ID NO: 108982 - DNA, 25 bp, Homo sapien
tggttacagcatttatgctttcaaa

SEQ ID NO: 108983 - DNA, 25 bp, Homo sapien
tggttaccaagctaaagtttttgtt

SEQ ID NO: 108984 - DNA, 25 bp, Homo sapien
tggttaccaagctacagtttttgtt

SEQ ID NO: 108985 - DNA, 25 bp, Homo sapien
tggttacctacatatcagtttttcc

SEQ ID NO: 108986 - DNA, 25 bp, Homo sapien
tggttacctacgtatcagtttttcc

SEQ ID NO: 108987 - DNA, 25 bp, Homo sapien
tggttagagcacagcatgaaggaag

SEQ ID NO: 108988 - DNA, 25 bp, Homo sapien
tggttagagcacaggatgaaggaag

SEQ ID NO: 108989 - DNA, 25 bp, Homo sapien
tggttagtatggattggtgtatttc

SEQ ID NO: 108990 - DNA, 25 bp, Homo sapien
tggttagtatgggttggtgtatttc

SEQ ID NO: 108991 - DNA, 25 bp, Homo sapien
tggttagtcttcttgttctaagttt

SEQ ID NO: 108992 - DNA, 25 bp, Homo sapien
tggttagtgttcttgttctaagttt

SEQ ID NO: 108993 - DNA, 25 bp, Homo sapien
tggttagttaattacaccctgttgc

SEQ ID NO: 108994 - DNA, 25 bp, Homo sapien
tggttagttaattacatcctgttgc

SEQ ID NO: 108995 - DNA, 25 bp, Homo sapien
tggttataagcaatgcatgaaggct

SEQ ID NO: 108996 - DNA, 25 bp, Homo sapien
tggttataggcaatgcatgaaggct

SEQ ID NO: 108997 - DNA, 25 bp, Homo sapien
tggttatcaggacagagaaatatct

SEQ ID NO: 108998 - DNA, 25 bp, Homo sapien
tggttatcgggacagagaaatatct

SEQ ID NO: 108999 - DNA, 25 bp, Homo sapien
tggttatgatcagcatgtacccgcc

SEQ ID NO: 109000 - DNA, 25 bp, Homo sapien
tggttatgatccgcatgtacccgcc

SEQ ID NO: 109001 - DNA, 25 bp, Homo sapien
tggttatggagaactcagtcatgag

SEQ ID NO: 109002 - DNA, 25 bp, Homo sapien
tggttatggagaattcagtcatgag

SEQ ID NO: 109003 - DNA, 25 bp, Homo sapien
tggttatggtaagtcttgagagaaa

SEQ ID NO: 109004 - DNA, 25 bp, Homo sapien
tggttatggtaagttttgagagaaa

SEQ ID NO: 109005 - DNA, 25 bp, Homo sapien
tggttatgtcacagccagtgggttc

SEQ ID NO: 109006 - DNA, 25 bp, Homo sapien
tggttatgtcatagccagtgggttc

SEQ ID NO: 109007 - DNA, 25 bp, Homo sapien
tggttatttttaatagagctcaaca

SEQ ID NO: 109008 - DNA, 25 bp, Homo sapien
tggttatttttagtagagctcaaca

SEQ ID NO: 109009 - DNA, 25 bp, Homo sapien
tggttcaaatatcacaggcagaaga

SEQ ID NO: 109010 - DNA, 25 bp, Homo sapien
tggttcaaatatcacatgcagaaga

SEQ ID NO: 109011 - DNA, 25 bp, Homo sapien
tggttcacccaaaattgaactgcct

SEQ ID NO: 109012 - DNA, 25 bp, Homo sapien
tggttcacgcaaaattgaactgcct

SEQ ID NO: 109013 - DNA, 25 bp, Homo sapien
tggttcagcacagaaagaaagactt

SEQ ID NO: 109014 - DNA, 25 bp, Homo sapien
tggttcagcacagcaagaaagactt

SEQ ID NO: 109015 - DNA, 25 bp, Homo sapien
tggttcagttgatataatacaattc

SEQ ID NO: 109016 - DNA, 25 bp, Homo sapien
tggttcagttggtataatacaattc

SEQ ID NO: 109017 - DNA, 25 bp, Homo sapien
tggttcatagttttggtattgtatc

SEQ ID NO: 109018 - DNA, 25 bp, Homo sapien
tggttcattgttttggtattgtatc

SEQ ID NO: 109019 - DNA, 25 bp, Homo sapien
tggttccaattacgcctaattattt

SEQ ID NO: 109020 - DNA, 25 bp, Homo sapien
tggttccaattactcctaattattt

SEQ ID NO: 109021 - DNA, 25 bp, Homo sapien
tggttccacaagaggctcagggaca

SEQ ID NO: 109022 - DNA, 25 bp, Homo sapien
tggttccacgagaggctcagggaca

SEQ ID NO: 109023 - DNA, 25 bp, Homo sapien
tggttccagaaactccacagaagtt

SEQ ID NO: 109024 - DNA, 25 bp, Homo sapien
tggttccagagaacactgaactgaa

SEQ ID NO: 109025 - DNA, 25 bp, Homo sapien
tggttccaggaactccacagaagtt

SEQ ID NO: 109026 - DNA, 25 bp, Homo sapien
tggttccatagaacactgaactgaa

SEQ ID NO: 109027 - DNA, 25 bp, Homo sapien
tggttccatatcaagatatttggca

SEQ ID NO: 109028 - DNA, 25 bp, Homo sapien
tggttccatatcgagatatttggca

SEQ ID NO: 109029 - DNA, 25 bp, Homo sapien
tggttcccgaagccgatgggctctg

SEQ ID NO: 109030 - DNA, 25 bp, Homo sapien
tggttcccgaagctgatgggctctg

SEQ ID NO: 109031 - DNA, 25 bp, Homo sapien
tggttcgggctaacaaattggtttt

SEQ ID NO: 109032 - DNA, 25 bp, Homo sapien
tggttcgggctgacaaattggtttt

SEQ ID NO: 109033 - DNA, 25 bp, Homo sapien
tggttcgtggccaaattagatcaca

SEQ ID NO: 109034 - DNA, 25 bp, Homo sapien
tggttcgtggcctaattagatcaca

SEQ ID NO: 109035 - DNA, 25 bp, Homo sapien
tggttctaacaccaacgttttaaat

SEQ ID NO: 109036 - DNA, 25 bp, Homo sapien
tggttctaagccaacctatgacctc

SEQ ID NO: 109037 - DNA, 25 bp, Homo sapien
tggttctaggccaacctatgacctc

SEQ ID NO: 109038 - DNA, 25 bp, Homo sapien
tggttctatcaccaacgttttaaat

SEQ ID NO: 109039 - DNA, 25 bp, Homo sapien
tggttctctatgtctgcactgcata

SEQ ID NO: 109040 - DNA, 25 bp, Homo sapien
tggttctctgtgtctgcactgcata

SEQ ID NO: 109041 - DNA, 25 bp, Homo sapien
tggttctgcctgaaatgtgagcaca

SEQ ID NO: 109042 - DNA, 25 bp, Homo sapien
tggttctgcttgaaatgtgagcaca

SEQ ID NO: 109043 - DNA, 25 bp, Homo sapien
tggttcttcacccagacataatccc

SEQ ID NO: 109044 - DNA, 25 bp, Homo sapien
tggttcttcataaagattgcatagg

SEQ ID NO: 109045 - DNA, 25 bp, Homo sapien
tggttcttcatagagattgcatagg

SEQ ID NO: 109046 - DNA, 25 bp, Homo sapien
tggttcttcgcccagacataatccc

SEQ ID NO: 109047 - DNA, 25 bp, Homo sapien
tggttctttctctgggctcaagaag

SEQ ID NO: 109048 - DNA, 25 bp, Homo sapien
tggttctttctctgtgctcaagaag

SEQ ID NO: 109049 - DNA, 25 bp, Homo sapien
tggttgaattcccggaaatatgtag

SEQ ID NO: 109050 - DNA, 25 bp, Homo sapien
tggttgaattcctggaaatatgtag

SEQ ID NO: 109051 - DNA, 25 bp, Homo sapien
tggttgacatccacctgatcaccac

SEQ ID NO: 109052 - DNA, 25 bp, Homo sapien
tggttgacatcctcctgatcaccac

SEQ ID NO: 109053 - DNA, 25 bp, Homo sapien
tggttgaccaacatcatcagatcct

SEQ ID NO: 109054 - DNA, 25 bp, Homo sapien
tggttgactaacatcatcagatcct

SEQ ID NO: 109055 - DNA, 25 bp, Homo sapien
tggttgagattgtctcatagagaac

SEQ ID NO: 109056 - DNA, 25 bp, Homo sapien
tggttgagattttctcatagagaac

SEQ ID NO: 109057 - DNA, 25 bp, Homo sapien
tggttgagtgaaaccatgaataaaa

SEQ ID NO: 109058 - DNA, 25 bp, Homo sapien
tggttgagtgaaactatgaataaaa

SEQ ID NO: 109059 - DNA, 25 bp, Homo sapien
tggttgatcctaaattgaccagtta

SEQ ID NO: 109060 - DNA, 25 bp, Homo sapien
tggttgattctaaattgaccagtta

SEQ ID NO: 109061 - DNA, 25 bp, Homo sapien
tggttgctcctaatttgagtggaca

SEQ ID NO: 109062 - DNA, 25 bp, Homo sapien
tggttgctcctgatttgagtggaca

SEQ ID NO: 109063 - DNA, 25 bp, Homo sapien
tggttgctctcacctgtggtcctag

SEQ ID NO: 109064 - DNA, 25 bp, Homo sapien
tggttgctctcatctgtggtcctag

SEQ ID NO: 109065 - DNA, 25 bp, Homo sapien
tggttggagtacagcagaaccacaa

SEQ ID NO: 109066 - DNA, 25 bp, Homo sapien
tggttggagtactgcagaaccacaa

SEQ ID NO: 109067 - DNA, 25 bp, Homo sapien
tggttggatttgacttcttcttatg

SEQ ID NO: 109068 - DNA, 25 bp, Homo sapien
tggttggatttgatttcttcttatg

SEQ ID NO: 109069 - DNA, 25 bp, Homo sapien
tggttgtgaccatgcccgagactgc

SEQ ID NO: 109070 - DNA, 25 bp, Homo sapien
tggttgtgcacaataaataattgaa

SEQ ID NO: 109071 - DNA, 25 bp, Homo sapien
tggttgtgcacaataagtaattgaa

SEQ ID NO: 109072 - DNA, 25 bp, Homo sapien
tggttgtgcttgaatgatagaggat

SEQ ID NO: 109073 - DNA, 25 bp, Homo sapien
tggttgtggttgaatgatagaggat

SEQ ID NO: 109074 - DNA, 25 bp, Homo sapien
tggttgtgtccatgcccgagactgc

SEQ ID NO: 109075 - DNA, 25 bp, Homo sapien
tggttgttctcaaatggaataaata

SEQ ID NO: 109076 - DNA, 25 bp, Homo sapien
tggttgttctcgaatggaataaata

SEQ ID NO: 109077 - DNA, 25 bp, Homo sapien
tggtttacatgcagatgttttcaat

SEQ ID NO: 109078 - DNA, 25 bp, Homo sapien
tggtttacattggtagcttaatcaa

SEQ ID NO: 109079 - DNA, 25 bp, Homo sapien
tggtttacatttgtagcttaatcaa

SEQ ID NO: 109080 - DNA, 25 bp, Homo sapien
tggtttacgtgcagatgttttcaat

SEQ ID NO: 109081 - DNA, 25 bp, Homo sapien
tggtttagtccacgaactccgaaca

SEQ ID NO: 109082 - DNA, 25 bp, Homo sapien
tggtttagtccatgaactccgaaca

SEQ ID NO: 109083 - DNA, 25 bp, Homo sapien
tggtttatggagacctggctaagga

SEQ ID NO: 109084 - DNA, 25 bp, Homo sapien
tggtttatggagccctggctaagga

SEQ ID NO: 109085 - DNA, 25 bp, Homo sapien
tggtttattgtgaatactacataag

SEQ ID NO: 109086 - DNA, 25 bp, Homo sapien
tggtttattgtgaatattacataag

SEQ ID NO: 109087 - DNA, 25 bp, Homo sapien
tggtttccagattcacatgcacatg

SEQ ID NO: 109088 - DNA, 25 bp, Homo sapien
tggtttccagggctgtaatattata

SEQ ID NO: 109089 - DNA, 25 bp, Homo sapien
tggtttccagggttgtaatattata

SEQ ID NO: 109090 - DNA, 25 bp, Homo sapien
tggtttccggattcacatgcacatg

SEQ ID NO: 109091 - DNA, 25 bp, Homo sapien
tggtttcgagttagagagaagagag

SEQ ID NO: 109092 - DNA, 25 bp, Homo sapien
tggtttcgagttcgagagaagagag

SEQ ID NO: 109093 - DNA, 25 bp, Homo sapien
tggtttctatcacttagcaccatgc

SEQ ID NO: 109094 - DNA, 25 bp, Homo sapien
tggtttctcaggcctaatgatttac

SEQ ID NO: 109095 - DNA, 25 bp, Homo sapien
tggtttctcaggcttaatgatttac

SEQ ID NO: 109096 - DNA, 25 bp, Homo sapien
tggtttctgtagaagctgggctgat

SEQ ID NO: 109097 - DNA, 25 bp, Homo sapien
tggtttctgtaggagctgggctgat

SEQ ID NO: 109098 - DNA, 25 bp, Homo sapien
tggtttctgtcacttagcaccatgc

SEQ ID NO: 109099 - DNA, 25 bp, Homo sapien
tggtttgactgcacatcacaccaga

SEQ ID NO: 109100 - DNA, 25 bp, Homo sapien
tggtttgactgcacattacaccaga

SEQ ID NO: 109101 - DNA, 25 bp, Homo sapien
tggtttgctttatggatgagcttag

SEQ ID NO: 109102 - DNA, 25 bp, Homo sapien
tggtttgctttgtggatgagcttag

SEQ ID NO: 109103 - DNA, 25 bp, Homo sapien
tggtttggatgaaaggccagagttg

SEQ ID NO: 109104 - DNA, 25 bp, Homo sapien
tggtttggatgaaaggtcagagttg

SEQ ID NO: 109105 - DNA, 25 bp, Homo sapien
tggtttgttggatcagcggccaagc

SEQ ID NO: 109106 - DNA, 25 bp, Homo sapien
tggtttgttggatcagtggccaagc

SEQ ID NO: 109107 - DNA, 25 bp, Homo sapien
tggtttgtttagaaagcagtgggtt

SEQ ID NO: 109108 - DNA, 25 bp, Homo sapien
tggtttgtttaggaagcagtgggtt

SEQ ID NO: 109109 - DNA, 25 bp, Homo sapien
tggttttaaacacgttatgtgtgct

SEQ ID NO: 109110 - DNA, 25 bp, Homo sapien
tggttttaaacatgttatgtgtgct

SEQ ID NO: 109111 - DNA, 25 bp, Homo sapien
tggttttatacattgaaggagacat

SEQ ID NO: 109112 - DNA, 25 bp, Homo sapien
tggttttatgcattgaaggagacat

SEQ ID NO: 109113 - DNA, 25 bp, Homo sapien
tggttttcaggacagtgtcctattt

SEQ ID NO: 109114 - DNA, 25 bp, Homo sapien
tggttttcctttatcagccttttaa

SEQ ID NO: 109115 - DNA, 25 bp, Homo sapien
tggttttcctttattagccttttaa

SEQ ID NO: 109116 - DNA, 25 bp, Homo sapien
tggttttcgggacagtgtcctattt

SEQ ID NO: 109117 - DNA, 25 bp, Homo sapien
tggttttgacaatcatagtatcttt

SEQ ID NO: 109118 - DNA, 25 bp, Homo sapien
tggttttgactagccatgactgact

SEQ ID NO: 109119 - DNA, 25 bp, Homo sapien
tggttttgactggccatgactgact

SEQ ID NO: 109120 - DNA, 25 bp, Homo sapien
tggttttgcattgtaaattaaagtc

SEQ ID NO: 109121 - DNA, 25 bp, Homo sapien
tggttttgcattttaaattaaagtc

SEQ ID NO: 109122 - DNA, 25 bp, Homo sapien
tggttttgctgacactgctgcccac

SEQ ID NO: 109123 - DNA, 25 bp, Homo sapien
tggttttgctgacgctgctgcccac

SEQ ID NO: 109124 - DNA, 25 bp, Homo sapien
tggttttggcaatcatagtatcttt

SEQ ID NO: 109125 - DNA, 25 bp, Homo sapien
tggttttgtactccaacatgctcta

SEQ ID NO: 109126 - DNA, 25 bp, Homo sapien
tggttttgtactcccacatgctcta

SEQ ID NO: 109127 - DNA, 25 bp, Homo sapien
tggtttttgacatctgaaaagccct

SEQ ID NO: 109128 - DNA, 25 bp, Homo sapien
tggtttttgacgtctgaaaagccct

SEQ ID NO: 109129 - DNA, 25 bp, Homo sapien
tggtttttgtagagacaaggtcttc

SEQ ID NO: 109130 - DNA, 25 bp, Homo sapien
tggtttttgtagagacgaggtcttc

SEQ ID NO: 109131 - DNA, 25 bp, Homo sapien
tggttttttggatgcgaatggaatg

SEQ ID NO: 109132 - DNA, 25 bp, Homo sapien
tggttttttggatgtgaatggaatg

SEQ ID NO: 109133 - DNA, 25 bp, Homo sapien
tgtaaaaacctcagatctccttcac

SEQ ID NO: 109134 - DNA, 25 bp, Homo sapien
tgtaaaaacctcaggtctccttcac

SEQ ID NO: 109135 - DNA, 25 bp, Homo sapien
tgtaaaaatatgtccgtaagttaaa

SEQ ID NO: 109136 - DNA, 25 bp, Homo sapien
tgtaaaaatatgtctgtaagttaaa

SEQ ID NO: 109137 - DNA, 25 bp, Homo sapien
tgtaaaacacaatcgaagctatcaa

SEQ ID NO: 109138 - DNA, 25 bp, Homo sapien
tgtaaaacacagtcgaagctatcaa

SEQ ID NO: 109139 - DNA, 25 bp, Homo sapien
tgtaaaacatctccataatttttga

SEQ ID NO: 109140 - DNA, 25 bp, Homo sapien
tgtaaaacgtctccataatttttga

SEQ ID NO: 109141 - DNA, 25 bp, Homo sapien
tgtaaaactcccatttcgacattct

SEQ ID NO: 109142 - DNA, 25 bp, Homo sapien
tgtaaaactcccgtttcgacattct

SEQ ID NO: 109143 - DNA, 25 bp, Homo sapien
tgtaaaactgactcaacgttcccaa

SEQ ID NO: 109144 - DNA, 25 bp, Homo sapien
tgtaaaactgactcaatgttcccaa

SEQ ID NO: 109145 - DNA, 25 bp, Homo sapien
tgtaaaagatgctagaggagcatag

SEQ ID NO: 109146 - DNA, 25 bp, Homo sapien
tgtaaaagatgttagaggagcatag

SEQ ID NO: 109147 - DNA, 25 bp, Homo sapien
tgtaaaagtcaaaaatttaccatcc

SEQ ID NO: 109148 - DNA, 25 bp, Homo sapien
tgtaaaagtcaaaagtttaccatcc

SEQ ID NO: 109149 - DNA, 25 bp, Homo sapien
tgtaaaataccaggctgctctccct

SEQ ID NO: 109150 - DNA, 25 bp, Homo sapien
tgtaaaatgccaggctgctctccct

SEQ ID NO: 109151 - DNA, 25 bp, Homo sapien
tgtaaaatggaggcacaatggtgag

SEQ ID NO: 109152 - DNA, 25 bp, Homo sapien
tgtaaaatggaggcacgatggtgag

SEQ ID NO: 109153 - DNA, 25 bp, Homo sapien
tgtaaacactatatgcctgtgtctc

SEQ ID NO: 109154 - DNA, 25 bp, Homo sapien
tgtaaacactctcaatttcccagat

SEQ ID NO: 109155 - DNA, 25 bp, Homo sapien
tgtaaacactctccatttcccagat

SEQ ID NO: 109156 - DNA, 25 bp, Homo sapien
tgtaaacagtatatgcctgtgtctc

SEQ ID NO: 109157 - DNA, 25 bp, Homo sapien
tgtaaacataactgccattttttgc

SEQ ID NO: 109158 - DNA, 25 bp, Homo sapien
tgtaaacataattgccattttttgc

SEQ ID NO: 109159 - DNA, 25 bp, Homo sapien
tgtaaacatatgccctgcagtaaac

SEQ ID NO: 109160 - DNA, 25 bp, Homo sapien
tgtaaacatatgtcctgcagtaaac

SEQ ID NO: 109161 - DNA, 25 bp, Homo sapien
tgtaaacatttctgccattacatta

SEQ ID NO: 109162 - DNA, 25 bp, Homo sapien
tgtaaacatttctgtcattacatta

SEQ ID NO: 109163 - DNA, 25 bp, Homo sapien
tgtaaacgtggccccaatgcaaggg

SEQ ID NO: 109164 - DNA, 25 bp, Homo sapien
tgtaaacgtggccccagtgcaaggg

SEQ ID NO: 109165 - DNA, 25 bp, Homo sapien
tgtaaactggtacatctattccaga

SEQ ID NO: 109166 - DNA, 25 bp, Homo sapien
tgtaaactggtgcatctattccaga

SEQ ID NO: 109167 - DNA, 25 bp, Homo sapien
tgtaaacttagccggaaagcccaca

SEQ ID NO: 109168 - DNA, 25 bp, Homo sapien
tgtaaacttagctggaaagcccaca

SEQ ID NO: 109169 - DNA, 25 bp, Homo sapien
tgtaaagaaactggagcaaaaaacc

SEQ ID NO: 109170 - DNA, 25 bp, Homo sapien
tgtaaagaaactggagtaaaaaacc

SEQ ID NO: 109171 - DNA, 25 bp, Homo sapien
tgtaaagacgagtgatgttatcgtt

SEQ ID NO: 109172 - DNA, 25 bp, Homo sapien
tgtaaagatgagtgatgttatcgtt

SEQ ID NO: 109173 - DNA, 25 bp, Homo sapien
tgtaaagcagaagtattaatttgac

SEQ ID NO: 109174 - DNA, 25 bp, Homo sapien
tgtaaagcagaattattaatttgac

SEQ ID NO: 109175 - DNA, 25 bp, Homo sapien
tgtaaagccttgaacaagaaagcaa

SEQ ID NO: 109176 - DNA, 25 bp, Homo sapien
tgtaaagccttgaagaagaaagcaa

SEQ ID NO: 109177 - DNA, 25 bp, Homo sapien
tgtaaaggaccacagagtaaacatt

SEQ ID NO: 109178 - DNA, 25 bp, Homo sapien
tgtaaaggaccacggagtaaacatt

SEQ ID NO: 109179 - DNA, 25 bp, Homo sapien
tgtaaagttgatcattttaaacacc

SEQ ID NO: 109180 - DNA, 25 bp, Homo sapien
tgtaaagttgatcgttttaaacacc

SEQ ID NO: 109181 - DNA, 25 bp, Homo sapien
tgtaaatataggattaaagtgcaag

SEQ ID NO: 109182 - DNA, 25 bp, Homo sapien
tgtaaatatctcagtgctattttta

SEQ ID NO: 109183 - DNA, 25 bp, Homo sapien
tgtaaatatgggattaaagtgcaag

SEQ ID NO: 109184 - DNA, 25 bp, Homo sapien
tgtaaatatttcagtgctattttta

SEQ ID NO: 109185 - DNA, 25 bp, Homo sapien
tgtaaatcattcaaatccttactat

SEQ ID NO: 109186 - DNA, 25 bp, Homo sapien
tgtaaatcattcgaatccttactat

SEQ ID NO: 109187 - DNA, 25 bp, Homo sapien
tgtaaatcgatcgctttctttctga

SEQ ID NO: 109188 - DNA, 25 bp, Homo sapien
tgtaaatcgattgctttctttctga

SEQ ID NO: 109189 - DNA, 25 bp, Homo sapien
tgtaaatctgctggcgggattaaag

SEQ ID NO: 109190 - DNA, 25 bp, Homo sapien
tgtaaatctgctggtgggattaaag

SEQ ID NO: 109191 - DNA, 25 bp, Homo sapien
tgtaaatgagtttcagaagagttgt

SEQ ID NO: 109192 - DNA, 25 bp, Homo sapien
tgtaaatgagtttcggaagagttgt

SEQ ID NO: 109193 - DNA, 25 bp, Homo sapien
tgtaaattcctttcagggtcatgcc

SEQ ID NO: 109194 - DNA, 25 bp, Homo sapien
tgtaaatttctttcagggtcatgcc

SEQ ID NO: 109195 - DNA, 25 bp, Homo sapien
tgtaacaaagtttcgctaattaagt

SEQ ID NO: 109196 - DNA, 25 bp, Homo sapien
tgtaacaaagttttgctaattaagt

SEQ ID NO: 109197 - DNA, 25 bp, Homo sapien
tgtaacaagcctacctactgatgct

SEQ ID NO: 109198 - DNA, 25 bp, Homo sapien
tgtaacaagccttcctactgatgct

SEQ ID NO: 109199 - DNA, 25 bp, Homo sapien
tgtaacaaggatgatgtaattttgt

SEQ ID NO: 109200 - DNA, 25 bp, Homo sapien
tgtaacaaggattatgtaattttgt

SEQ ID NO: 109201 - DNA, 25 bp, Homo sapien
tgtaacaatcaggtgtaaattctga

SEQ ID NO: 109202 - DNA, 25 bp, Homo sapien
tgtaacaatcaggtgtgaattctga

SEQ ID NO: 109203 - DNA, 25 bp, Homo sapien
tgtaacagacactgaggattgttcc

SEQ ID NO: 109204 - DNA, 25 bp, Homo sapien
tgtaacagacactgagtattgttcc

SEQ ID NO: 109205 - DNA, 25 bp, Homo sapien
tgtaacagcaagctctgctttccct

SEQ ID NO: 109206 - DNA, 25 bp, Homo sapien
tgtaacagcacatagcacatccgcc

SEQ ID NO: 109207 - DNA, 25 bp, Homo sapien
tgtaacagcgagctctgctttccct

SEQ ID NO: 109208 - DNA, 25 bp, Homo sapien
tgtaacaggacatagcacatccgcc

SEQ ID NO: 109209 - DNA, 25 bp, Homo sapien
tgtaacattgctaaaagtcctatgc

SEQ ID NO: 109210 - DNA, 25 bp, Homo sapien
tgtaacattgctcaaagtcctatgc

SEQ ID NO: 109211 - DNA, 25 bp, Homo sapien
tgtaaccataataggctcattggtc

SEQ ID NO: 109212 - DNA, 25 bp, Homo sapien
tgtaaccataatagtctcattggtc

SEQ ID NO: 109213 - DNA, 25 bp, Homo sapien
tgtaaccatctaagaactgtaaatc

SEQ ID NO: 109214 - DNA, 25 bp, Homo sapien
tgtaaccatctaagaattgtaaatc

SEQ ID NO: 109215 - DNA, 25 bp, Homo sapien
tgtaactatcaagcacgttcatgag

SEQ ID NO: 109216 - DNA, 25 bp, Homo sapien
tgtaactatcaagcactttcatgag

SEQ ID NO: 109217 - DNA, 25 bp, Homo sapien
tgtaactcattggactctagtctca

SEQ ID NO: 109218 - DNA, 25 bp, Homo sapien
tgtaactcattggagtctagtctca

SEQ ID NO: 109219 - DNA, 25 bp, Homo sapien
tgtaactctggatgactgatatggg

SEQ ID NO: 109220 - DNA, 25 bp, Homo sapien
tgtaactctggatgtctgatatggg

SEQ ID NO: 109221 - DNA, 25 bp, Homo sapien
tgtaacttccttcaaagactgcagt

SEQ ID NO: 109222 - DNA, 25 bp, Homo sapien
tgtaacttccttccaagactgcagt

SEQ ID NO: 109223 - DNA, 25 bp, Homo sapien
tgtaagaaaaccaggtgggaaagtg

SEQ ID NO: 109224 - DNA, 25 bp, Homo sapien
tgtaagaaagccaggtgggaaagtg

SEQ ID NO: 109225 - DNA, 25 bp, Homo sapien
tgtaagaatgtacgggcattgaagc

SEQ ID NO: 109226 - DNA, 25 bp, Homo sapien
tgtaagaatgtactggcattgaagc

SEQ ID NO: 109227 - DNA, 25 bp, Homo sapien
tgtaagacgagtacctcttcagagt

SEQ ID NO: 109228 - DNA, 25 bp, Homo sapien
tgtaagactagtacctcttcagagt

SEQ ID NO: 109229 - DNA, 25 bp, Homo sapien
tgtaagagaggctttcatgtagtac

SEQ ID NO: 109230 - DNA, 25 bp, Homo sapien
tgtaagagatgctttcatgtagtac

SEQ ID NO: 109231 - DNA, 25 bp, Homo sapien
tgtaagatttaatatgctgttactg

SEQ ID NO: 109232 - DNA, 25 bp, Homo sapien
tgtaagatttaatatgttgttactg

SEQ ID NO: 109233 - DNA, 25 bp, Homo sapien
tgtaagcaaaattccacgctcattc

SEQ ID NO: 109234 - DNA, 25 bp, Homo sapien
tgtaagcaagctgtaaaccctctga

SEQ ID NO: 109235 - DNA, 25 bp, Homo sapien
tgtaagcaagctgtaagccctctga

SEQ ID NO: 109236 - DNA, 25 bp, Homo sapien
tgtaagcagaaaagaggatctactg

SEQ ID NO: 109237 - DNA, 25 bp, Homo sapien
tgtaagcagaaatgaggatctactg

SEQ ID NO: 109238 - DNA, 25 bp, Homo sapien
tgtaagcagaattccacgctcattc

SEQ ID NO: 109239 - DNA, 25 bp, Homo sapien
tgtaagcagattatcatcatcagaa

SEQ ID NO: 109240 - DNA, 25 bp, Homo sapien
tgtaagcagattgtcatcatcagaa

SEQ ID NO: 109241 - DNA, 25 bp, Homo sapien
tgtaagctattattatatggtcatc

SEQ ID NO: 109242 - DNA, 25 bp, Homo sapien
tgtaagctctacaaaggcaggtggc

SEQ ID NO: 109243 - DNA, 25 bp, Homo sapien
tgtaagctctataaaggcaggtggc

SEQ ID NO: 109244 - DNA, 25 bp, Homo sapien
tgtaagctcttattatatggtcatc

SEQ ID NO: 109245 - DNA, 25 bp, Homo sapien
tgtaaggacacagagagaaggcatc

SEQ ID NO: 109246 - DNA, 25 bp, Homo sapien
tgtaaggacacagcgagaaggcatc

SEQ ID NO: 109247 - DNA, 25 bp, Homo sapien
tgtaaggagacagacttgccctact

SEQ ID NO: 109248 - DNA, 25 bp, Homo sapien
tgtaaggagacagatttgccctact

SEQ ID NO: 109249 - DNA, 25 bp, Homo sapien
tgtaaggcagagcagtgagtgaatg

SEQ ID NO: 109250 - DNA, 25 bp, Homo sapien
tgtaaggcagagctgtgagtgaatg

SEQ ID NO: 109251 - DNA, 25 bp, Homo sapien
tgtaaggcgaaataccacctggtcc

SEQ ID NO: 109252 - DNA, 25 bp, Homo sapien
tgtaaggcgaaataccgcctggtcc

SEQ ID NO: 109253 - DNA, 25 bp, Homo sapien
tgtaaggttgcaacagaagattgaa

SEQ ID NO: 109254 - DNA, 25 bp, Homo sapien
tgtaaggttgcaatagaagattgaa

SEQ ID NO: 109255 - DNA, 25 bp, Homo sapien
tgtaagtacaagtgtcagccatcct

SEQ ID NO: 109256 - DNA, 25 bp, Homo sapien
tgtaagtacgagtgtcagccatcct

SEQ ID NO: 109257 - DNA, 25 bp, Homo sapien
tgtaagtccacacgctcaggtttgc

SEQ ID NO: 109258 - DNA, 25 bp, Homo sapien
tgtaagtccacatgctcaggtttgc

SEQ ID NO: 109259 - DNA, 25 bp, Homo sapien
tgtaagtcctgcaagatcatgagga

SEQ ID NO: 109260 - DNA, 25 bp, Homo sapien
tgtaagtcgtgcaagatcatgagga

SEQ ID NO: 109261 - DNA, 25 bp, Homo sapien
tgtaagttggtgcttggtagagttg

SEQ ID NO: 109262 - DNA, 25 bp, Homo sapien
tgtaagttggtgtttggtagagttg

SEQ ID NO: 109263 - DNA, 25 bp, Homo sapien
tgtaagtttgacgtgaagtgggctt

SEQ ID NO: 109264 - DNA, 25 bp, Homo sapien
tgtaagtttgaggtgaagtgggctt

SEQ ID NO: 109265 - DNA, 25 bp, Homo sapien
tgtaataacgtcactaaagctgtaa

SEQ ID NO: 109266 - DNA, 25 bp, Homo sapien
tgtaataacttgcctggtatggtac

SEQ ID NO: 109267 - DNA, 25 bp, Homo sapien
tgtaataaggtcactaaagctgtaa

SEQ ID NO: 109268 - DNA, 25 bp, Homo sapien
tgtaataagttgcctggtatggtac

SEQ ID NO: 109269 - DNA, 25 bp, Homo sapien
tgtaatacttccaatatcatattca

SEQ ID NO: 109270 - DNA, 25 bp, Homo sapien
tgtaatacttccgatatcatattca

SEQ ID NO: 109271 - DNA, 25 bp, Homo sapien
tgtaatagatgctaataaacatttg

SEQ ID NO: 109272 - DNA, 25 bp, Homo sapien
tgtaatagatgctcataaacatttg

SEQ ID NO: 109273 - DNA, 25 bp, Homo sapien
tgtaatagcaaaatgtccttcactt

SEQ ID NO: 109274 - DNA, 25 bp, Homo sapien
tgtaatagcgaaatgtccttcactt

SEQ ID NO: 109275 - DNA, 25 bp, Homo sapien
tgtaatattcaaatgcccaactgct

SEQ ID NO: 109276 - DNA, 25 bp, Homo sapien
tgtaatattcaagtgcccaactgct

SEQ ID NO: 109277 - DNA, 25 bp, Homo sapien
tgtaatcacagaaaaacgcacttag

SEQ ID NO: 109278 - DNA, 25 bp, Homo sapien
tgtaatcacagggtccctataagag

SEQ ID NO: 109279 - DNA, 25 bp, Homo sapien
tgtaatcacagggttcctataagag

SEQ ID NO: 109280 - DNA, 25 bp, Homo sapien
tgtaatcatagaaaaacgcacttag

SEQ ID NO: 109281 - DNA, 25 bp, Homo sapien
tgtaatccataagacaatgtcacca

SEQ ID NO: 109282 - DNA, 25 bp, Homo sapien
tgtaatccataagacagtgtcacca

SEQ ID NO: 109283 - DNA, 25 bp, Homo sapien
tgtaatcccacgtaagtttcgaaaa

SEQ ID NO: 109284 - DNA, 25 bp, Homo sapien
tgtaatcccgcgtaagtttcgaaaa

SEQ ID NO: 109285 - DNA, 25 bp, Homo sapien
tgtaatctctgaccccatagcatcc

SEQ ID NO: 109286 - DNA, 25 bp, Homo sapien
tgtaatctctgaccccgtagcatcc

SEQ ID NO: 109287 - DNA, 25 bp, Homo sapien
tgtaatgaaaacaattctggtactg

SEQ ID NO: 109288 - DNA, 25 bp, Homo sapien
tgtaatgaaaataattctggtactg

SEQ ID NO: 109289 - DNA, 25 bp, Homo sapien
tgtaatgaactatgaaaacattttt

SEQ ID NO: 109290 - DNA, 25 bp, Homo sapien
tgtaatgaactatggaaacattttt

SEQ ID NO: 109291 - DNA, 25 bp, Homo sapien
tgtaatgcatgacccaaagtgtttt

SEQ ID NO: 109292 - DNA, 25 bp, Homo sapien
tgtaatgcatgtcccaaagtgtttt

SEQ ID NO: 109293 - DNA, 25 bp, Homo sapien
tgtaatgcatttatcacaaacctca

SEQ ID NO: 109294 - DNA, 25 bp, Homo sapien
tgtaatgccgaatttacgaacagct

SEQ ID NO: 109295 - DNA, 25 bp, Homo sapien
tgtaatgccgaatttatgaacagct

SEQ ID NO: 109296 - DNA, 25 bp, Homo sapien
tgtaatgcgtttatcacaaacctca

SEQ ID NO: 109297 - DNA, 25 bp, Homo sapien
tgtaatggtaatgtgctgtatgtac

SEQ ID NO: 109298 - DNA, 25 bp, Homo sapien
tgtaatggtcatgtgctgtatgtac

SEQ ID NO: 109299 - DNA, 25 bp, Homo sapien
tgtaattaaccagatactgagcctt

SEQ ID NO: 109300 - DNA, 25 bp, Homo sapien
tgtaattaaccagatattgagcctt

SEQ ID NO: 109301 - DNA, 25 bp, Homo sapien
tgtaatttcagcagaaaaatctaac

SEQ ID NO: 109302 - DNA, 25 bp, Homo sapien
tgtaatttcagtagaaaaatctaac

SEQ ID NO: 109303 - DNA, 25 bp, Homo sapien
tgtaatttgcacacgtggagggagg

SEQ ID NO: 109304 - DNA, 25 bp, Homo sapien
tgtaatttgcacatgtggagggagg

SEQ ID NO: 109305 - DNA, 25 bp, Homo sapien
tgtaattttaaacaatcaaacatgg

SEQ ID NO: 109306 - DNA, 25 bp, Homo sapien
tgtaattttaaacgatcaaacatgg

SEQ ID NO: 109307 - DNA, 25 bp, Homo sapien
tgtacaaaaagaaccagataaatga

SEQ ID NO: 109308 - DNA, 25 bp, Homo sapien
tgtacaaaaagaatcagataaatga

SEQ ID NO: 109309 - DNA, 25 bp, Homo sapien
tgtacaaaacaatagaaaagtgggc

SEQ ID NO: 109310 - DNA, 25 bp, Homo sapien
tgtacaaaagaatagaaaagtgggc

SEQ ID NO: 109311 - DNA, 25 bp, Homo sapien
tgtacaacagcaatgacccaaacct

SEQ ID NO: 109312 - DNA, 25 bp, Homo sapien
tgtacaacagcactgacccaaacct

SEQ ID NO: 109313 - DNA, 25 bp, Homo sapien
tgtacaactttgagacctgggccac

SEQ ID NO: 109314 - DNA, 25 bp, Homo sapien
tgtacaactttgagacttgggccac

SEQ ID NO: 109315 - DNA, 25 bp, Homo sapien
tgtacaagatattcagttcctcagc

SEQ ID NO: 109316 - DNA, 25 bp, Homo sapien
tgtacaagatattcggttcctcagc

SEQ ID NO: 109317 - DNA, 25 bp, Homo sapien
tgtacaagtcaacggaatataatac

SEQ ID NO: 109318 - DNA, 25 bp, Homo sapien
tgtacaagtcaatggaatataatac

SEQ ID NO: 109319 - DNA, 25 bp, Homo sapien
tgtacaagtcacctatgaaactgtt

SEQ ID NO: 109320 - DNA, 25 bp, Homo sapien
tgtacaagtcatctatgaaactgtt

SEQ ID NO: 109321 - DNA, 25 bp, Homo sapien
tgtacacacaggatagacagttata

SEQ ID NO: 109322 - DNA, 25 bp, Homo sapien
tgtacacacaggatggacagttata

SEQ ID NO: 109323 - DNA, 25 bp, Homo sapien
tgtacacaggtactgaaacatcaca

SEQ ID NO: 109324 - DNA, 25 bp, Homo sapien
tgtacacaggtattgaaacatcaca

SEQ ID NO: 109325 - DNA, 25 bp, Homo sapien
tgtacactgcagcattgttgactgt

SEQ ID NO: 109326 - DNA, 25 bp, Homo sapien
tgtacactgtagcattgttgactgt

SEQ ID NO: 109327 - DNA, 25 bp, Homo sapien
tgtacagaaaacagtaagaaatcaa

SEQ ID NO: 109328 - DNA, 25 bp, Homo sapien
tgtacagaaaatagtaagaaatcaa

SEQ ID NO: 109329 - DNA, 25 bp, Homo sapien
tgtacagaaagctaattaaaagttt

SEQ ID NO: 109330 - DNA, 25 bp, Homo sapien
tgtacagaacgacgcagttgaagga

SEQ ID NO: 109331 - DNA, 25 bp, Homo sapien
tgtacagaacgatgcagttgaagga

SEQ ID NO: 109332 - DNA, 25 bp, Homo sapien
tgtacagaatattttaccacctagg

SEQ ID NO: 109333 - DNA, 25 bp, Homo sapien
tgtacagaatgctaattaaaagttt

SEQ ID NO: 109334 - DNA, 25 bp, Homo sapien
tgtacagatgattttgcttgtcctt

SEQ ID NO: 109335 - DNA, 25 bp, Homo sapien
tgtacagatgattttggttgtcctt

SEQ ID NO: 109336 - DNA, 25 bp, Homo sapien
tgtacagattattttaccacctagg

SEQ ID NO: 109337 - DNA, 25 bp, Homo sapien
tgtacagcattatttatcaacaagt

SEQ ID NO: 109338 - DNA, 25 bp, Homo sapien
tgtacagcgttatttatcaacaagt

SEQ ID NO: 109339 - DNA, 25 bp, Homo sapien
tgtacagttgagtagtgttaagtcc

SEQ ID NO: 109340 - DNA, 25 bp, Homo sapien
tgtacagtttaatgggttatgttat

SEQ ID NO: 109341 - DNA, 25 bp, Homo sapien
tgtacagtttagtagtgttaagtcc

SEQ ID NO: 109342 - DNA, 25 bp, Homo sapien
tgtacagtttagtgggttatgttat

SEQ ID NO: 109343 - DNA, 25 bp, Homo sapien
tgtacatcacattgccagatgacat

SEQ ID NO: 109344 - DNA, 25 bp, Homo sapien
tgtacatccctgattgattataact

SEQ ID NO: 109345 - DNA, 25 bp, Homo sapien
tgtacatccctgattgtttataact

SEQ ID NO: 109346 - DNA, 25 bp, Homo sapien
tgtacatcctcattcagaagcagtc

SEQ ID NO: 109347 - DNA, 25 bp, Homo sapien
tgtacatcctcattgagaagcagtc

SEQ ID NO: 109348 - DNA, 25 bp, Homo sapien
tgtacatcctctgcacgttcattag

SEQ ID NO: 109349 - DNA, 25 bp, Homo sapien
tgtacatcctctgcactttcattag

SEQ ID NO: 109350 - DNA, 25 bp, Homo sapien
tgtacatctcattgccagatgacat

SEQ ID NO: 109351 - DNA, 25 bp, Homo sapien
tgtacattaattcaacaagcacata

SEQ ID NO: 109352 - DNA, 25 bp, Homo sapien
tgtacattaattcagcaagcacata

SEQ ID NO: 109353 - DNA, 25 bp, Homo sapien
tgtaccaagctggtccaatcagagt

SEQ ID NO: 109354 - DNA, 25 bp, Homo sapien
tgtaccaagttggtccaatcagagt

SEQ ID NO: 109355 - DNA, 25 bp, Homo sapien
tgtaccaatagctctatataatagt

SEQ ID NO: 109356 - DNA, 25 bp, Homo sapien
tgtaccaatagctgtatataatagt

SEQ ID NO: 109357 - DNA, 25 bp, Homo sapien
tgtaccacagggagcctggacatac

SEQ ID NO: 109358 - DNA, 25 bp, Homo sapien
tgtaccacatggaaatttgtgcccc

SEQ ID NO: 109359 - DNA, 25 bp, Homo sapien
tgtaccacatggaagtttgtgcccc

SEQ ID NO: 109360 - DNA, 25 bp, Homo sapien
tgtaccacggggagcctggacatac

SEQ ID NO: 109361 - DNA, 25 bp, Homo sapien
tgtacctaattacatcattgcaatt

SEQ ID NO: 109362 - DNA, 25 bp, Homo sapien
tgtacctaattatatcattgcaatt

SEQ ID NO: 109363 - DNA, 25 bp, Homo sapien
tgtacctactgcaaatggcttctcc

SEQ ID NO: 109364 - DNA, 25 bp, Homo sapien
tgtacctactgcatatggcttctcc

SEQ ID NO: 109365 - DNA, 25 bp, Homo sapien
tgtacctccactataccatgcctct

SEQ ID NO: 109366 - DNA, 25 bp, Homo sapien
tgtacctccgctataccatgcctct

SEQ ID NO: 109367 - DNA, 25 bp, Homo sapien
tgtacctgaagtgaaagattaatgt

SEQ ID NO: 109368 - DNA, 25 bp, Homo sapien
tgtacctgaagtgaaatattaatgt

SEQ ID NO: 109369 - DNA, 25 bp, Homo sapien
tgtacctgagcagtgctgaaaacac

SEQ ID NO: 109370 - DNA, 25 bp, Homo sapien
tgtacctgggcagtgctgaaaacac

SEQ ID NO: 109371 - DNA, 25 bp, Homo sapien
tgtaccttagttgttacatcttcaa

SEQ ID NO: 109372 - DNA, 25 bp, Homo sapien
tgtaccttagtttttacatcttcaa

SEQ ID NO: 109373 - DNA, 25 bp, Homo sapien
tgtacctttcaatttcaacaaatat

SEQ ID NO: 109374 - DNA, 25 bp, Homo sapien
tgtacctttcattttcaacaaatat

SEQ ID NO: 109375 - DNA, 25 bp, Homo sapien
tgtaccttttaaatcaaaactcagg

SEQ ID NO: 109376 - DNA, 25 bp, Homo sapien
tgtaccttttacatcaaaactcagg

SEQ ID NO: 109377 - DNA, 25 bp, Homo sapien
tgtacgacaaagactactccaataa

SEQ ID NO: 109378 - DNA, 25 bp, Homo sapien
tgtacgacaaaggctactccaataa

SEQ ID NO: 109379 - DNA, 25 bp, Homo sapien
tgtacgcacgagataaaacctggcc

SEQ ID NO: 109380 - DNA, 25 bp, Homo sapien
tgtacgcatgagataaaacctggcc

SEQ ID NO: 109381 - DNA, 25 bp, Homo sapien
tgtacgctaggaattttctcatgga

SEQ ID NO: 109382 - DNA, 25 bp, Homo sapien
tgtacgctaggcattttctcatgga

SEQ ID NO: 109383 - DNA, 25 bp, Homo sapien
tgtacggcaagcatttgttagaagt

SEQ ID NO: 109384 - DNA, 25 bp, Homo sapien
tgtacggcgagcatttgttagaagt

SEQ ID NO: 109385 - DNA, 25 bp, Homo sapien
tgtacggtagacactgatgtgttat

SEQ ID NO: 109386 - DNA, 25 bp, Homo sapien
tgtacggtagacattgatgtgttat

SEQ ID NO: 109387 - DNA, 25 bp, Homo sapien
tgtacggtgttcatcaattcctatg

SEQ ID NO: 109388 - DNA, 25 bp, Homo sapien
tgtacggtgttcgtcaattcctatg

SEQ ID NO: 109389 - DNA, 25 bp, Homo sapien
tgtacggttgcactgctgactaagt

SEQ ID NO: 109390 - DNA, 25 bp, Homo sapien
tgtacggttgcattgctgactaagt

SEQ ID NO: 109391 - DNA, 25 bp, Homo sapien
tgtacgtgactatatcttgtataga

SEQ ID NO: 109392 - DNA, 25 bp, Homo sapien
tgtacgtgactgtatcttgtataga

SEQ ID NO: 109393 - DNA, 25 bp, Homo sapien
tgtacgttcaaattcctcaattatt

SEQ ID NO: 109394 - DNA, 25 bp, Homo sapien
tgtacgttcaagttcctcaattatt

SEQ ID NO: 109395 - DNA, 25 bp, Homo sapien
tgtactaattaccaccaaagaatgt

SEQ ID NO: 109396 - DNA, 25 bp, Homo sapien
tgtactaattaccatcaaagaatgt

SEQ ID NO: 109397 - DNA, 25 bp, Homo sapien
tgtactacaacaagattccactcct

SEQ ID NO: 109398 - DNA, 25 bp, Homo sapien
tgtactacgacaagattccactcct

SEQ ID NO: 109399 - DNA, 25 bp, Homo sapien
tgtactaggtactacggaggagaca

SEQ ID NO: 109400 - DNA, 25 bp, Homo sapien
tgtactaggtactatggaggagaca

SEQ ID NO: 109401 - DNA, 25 bp, Homo sapien
tgtactatggcagcaaatcctgcaa

SEQ ID NO: 109402 - DNA, 25 bp, Homo sapien
tgtactatggcggcaaatcctgcaa

SEQ ID NO: 109403 - DNA, 25 bp, Homo sapien
tgtactcactgagattttgggcagg

SEQ ID NO: 109404 - DNA, 25 bp, Homo sapien
tgtactcactgtgattttgggcagg

SEQ ID NO: 109405 - DNA, 25 bp, Homo sapien
tgtactctcacgacacattgtatgt

SEQ ID NO: 109406 - DNA, 25 bp, Homo sapien
tgtactctcacgacgcattgtatgt

SEQ ID NO: 109407 - DNA, 25 bp, Homo sapien
tgtactctccacgccataatttgta

SEQ ID NO: 109408 - DNA, 25 bp, Homo sapien
tgtactctccacggcataatttgta

SEQ ID NO: 109409 - DNA, 25 bp, Homo sapien
tgtactgaacgatgcaggctatctt

SEQ ID NO: 109410 - DNA, 25 bp, Homo sapien
tgtactgaatgatgcaggctatctt

SEQ ID NO: 109411 - DNA, 25 bp, Homo sapien
tgtactggaattcacacgcttactg

SEQ ID NO: 109412 - DNA, 25 bp, Homo sapien
tgtactggaattcacatgcttactg

SEQ ID NO: 109413 - DNA, 25 bp, Homo sapien
tgtactggatctaatcttatttatg

SEQ ID NO: 109414 - DNA, 25 bp, Homo sapien
tgtactggatctcatcttatttatg

SEQ ID NO: 109415 - DNA, 25 bp, Homo sapien
tgtactgtcaccaccagataacaac

SEQ ID NO: 109416 - DNA, 25 bp, Homo sapien
tgtactgtcaccactagataacaac

SEQ ID NO: 109417 - DNA, 25 bp, Homo sapien
tgtactgtgttcaatctttggttac

SEQ ID NO: 109418 - DNA, 25 bp, Homo sapien
tgtactgtgttcagtctttggttac

SEQ ID NO: 109419 - DNA, 25 bp, Homo sapien
tgtactgttaacgagcagtaatctt

SEQ ID NO: 109420 - DNA, 25 bp, Homo sapien
tgtactgttaatgagcagtaatctt

SEQ ID NO: 109421 - DNA, 25 bp, Homo sapien
tgtacttacatgaatttgattaagt

SEQ ID NO: 109422 - DNA, 25 bp, Homo sapien
tgtacttatatgaatttgattaagt

SEQ ID NO: 109423 - DNA, 25 bp, Homo sapien
tgtacttcctgaacgtagccctgct

SEQ ID NO: 109424 - DNA, 25 bp, Homo sapien
tgtacttcctgaatgtagccctgct

SEQ ID NO: 109425 - DNA, 25 bp, Homo sapien
tgtacttcctgtcagtcaggcagag

SEQ ID NO: 109426 - DNA, 25 bp, Homo sapien
tgtacttcctgttagtcaggcagag

SEQ ID NO: 109427 - DNA, 25 bp, Homo sapien
tgtacttgcagttgctagggcaaaa

SEQ ID NO: 109428 - DNA, 25 bp, Homo sapien
tgtacttggagttgctagggcaaaa

SEQ ID NO: 109429 - DNA, 25 bp, Homo sapien
tgtactttaaaactgccacaggcag

SEQ ID NO: 109430 - DNA, 25 bp, Homo sapien
tgtactttaaaattgccacaggcag

SEQ ID NO: 109431 - DNA, 25 bp, Homo sapien
tgtactttaaaccactgaaatgtac

SEQ ID NO: 109432 - DNA, 25 bp, Homo sapien
tgtactttaaactactgaaatgtac

SEQ ID NO: 109433 - DNA, 25 bp, Homo sapien
tgtactttaagtttgattgaccagt

SEQ ID NO: 109434 - DNA, 25 bp, Homo sapien
tgtactttgagtttgattgaccagt

SEQ ID NO: 109435 - DNA, 25 bp, Homo sapien
tgtacttttcttttggtggccacaa

SEQ ID NO: 109436 - DNA, 25 bp, Homo sapien
tgtactttttttttggtggccacaa

SEQ ID NO: 109437 - DNA, 25 bp, Homo sapien
tgtagaaaaatatacggttggaagg

SEQ ID NO: 109438 - DNA, 25 bp, Homo sapien
tgtagaaaaatatatggttggaagg

SEQ ID NO: 109439 - DNA, 25 bp, Homo sapien
tgtagaaaagccatattttatgaag

SEQ ID NO: 109440 - DNA, 25 bp, Homo sapien
tgtagaaacacctagatttgcaggg

SEQ ID NO: 109441 - DNA, 25 bp, Homo sapien
tgtagaaaccacagagtgacaggtg

SEQ ID NO: 109442 - DNA, 25 bp, Homo sapien
tgtagaaaccacggagtgacaggtg

SEQ ID NO: 109443 - DNA, 25 bp, Homo sapien
tgtagaaaggccatattttatgaag

SEQ ID NO: 109444 - DNA, 25 bp, Homo sapien
tgtagaaatacctagatttgcaggg

SEQ ID NO: 109445 - DNA, 25 bp, Homo sapien
tgtagaaatgtaccaggtaatcatc

SEQ ID NO: 109446 - DNA, 25 bp, Homo sapien
tgtagaaatgtacgaggtaatcatc

SEQ ID NO: 109447 - DNA, 25 bp, Homo sapien
tgtagaagagccaggtaatagccat

SEQ ID NO: 109448 - DNA, 25 bp, Homo sapien
tgtagaagaggaaaatatgatctca

SEQ ID NO: 109449 - DNA, 25 bp, Homo sapien
tgtagaagaggacaatatgatctca

SEQ ID NO: 109450 - DNA, 25 bp, Homo sapien
tgtagaagatccaggtaatagccat

SEQ ID NO: 109451 - DNA, 25 bp, Homo sapien
tgtagaaggggtttgagttgagcca

SEQ ID NO: 109452 - DNA, 25 bp, Homo sapien
tgtagaaggggtttgatttgagcca

SEQ ID NO: 109453 - DNA, 25 bp, Homo sapien
tgtagacagcactgaaatacagatc

SEQ ID NO: 109454 - DNA, 25 bp, Homo sapien
tgtagacagcactgaagtacagatc

SEQ ID NO: 109455 - DNA, 25 bp, Homo sapien
tgtagacataacatgcttattttgt

SEQ ID NO: 109456 - DNA, 25 bp, Homo sapien
tgtagacataatatgcttattttgt

SEQ ID NO: 109457 - DNA, 25 bp, Homo sapien
tgtagactcataagcccaggtttga

SEQ ID NO: 109458 - DNA, 25 bp, Homo sapien
tgtagactcataagcctaggtttga

SEQ ID NO: 109459 - DNA, 25 bp, Homo sapien
tgtagagaagaaataaaagctgaga

SEQ ID NO: 109460 - DNA, 25 bp, Homo sapien
tgtagagacaaggtcttcctatgtt

SEQ ID NO: 109461 - DNA, 25 bp, Homo sapien
tgtagagacgaaataaaagctgaga

SEQ ID NO: 109462 - DNA, 25 bp, Homo sapien
tgtagagacgaggtcttcctatgtt

SEQ ID NO: 109463 - DNA, 25 bp, Homo sapien
tgtagagatattctaaaacagactg

SEQ ID NO: 109464 - DNA, 25 bp, Homo sapien
tgtagagatattctaacacagactg

SEQ ID NO: 109465 - DNA, 25 bp, Homo sapien
tgtagagatatttggttaattccta

SEQ ID NO: 109466 - DNA, 25 bp, Homo sapien
tgtagagatctttggttaattccta

SEQ ID NO: 109467 - DNA, 25 bp, Homo sapien
tgtagagattctatcaattgccaag

SEQ ID NO: 109468 - DNA, 25 bp, Homo sapien
tgtagagattctatcagttgccaag

SEQ ID NO: 109469 - DNA, 25 bp, Homo sapien
tgtagagccagtaaaacattacaat

SEQ ID NO: 109470 - DNA, 25 bp, Homo sapien
tgtagagccagtgaaacattacaat

SEQ ID NO: 109471 - DNA, 25 bp, Homo sapien
tgtagaggcctactcctcacagcac

SEQ ID NO: 109472 - DNA, 25 bp, Homo sapien
tgtagaggccttctcctcacagcac

SEQ ID NO: 109473 - DNA, 25 bp, Homo sapien
tgtagaggtttaaaaatatactagg

SEQ ID NO: 109474 - DNA, 25 bp, Homo sapien
tgtagaggtttagaaatatactagg

SEQ ID NO: 109475 - DNA, 25 bp, Homo sapien
tgtagagtcagcctagtatatgagc

SEQ ID NO: 109476 - DNA, 25 bp, Homo sapien
tgtagagtcagcctcgtatatgagc

SEQ ID NO: 109477 - DNA, 25 bp, Homo sapien
tgtagagtgaaaattgagcaaatct

SEQ ID NO: 109478 - DNA, 25 bp, Homo sapien
tgtagagtgaaagttgagcaaatct

SEQ ID NO: 109479 - DNA, 25 bp, Homo sapien
tgtagatagccttacgtttcttttt

SEQ ID NO: 109480 - DNA, 25 bp, Homo sapien
tgtagatagccttatgtttcttttt

SEQ ID NO: 109481 - DNA, 25 bp, Homo sapien
tgtagatcattcttcagaggtcagg

SEQ ID NO: 109482 - DNA, 25 bp, Homo sapien
tgtagatcatttttcagaggtcagg

SEQ ID NO: 109483 - DNA, 25 bp, Homo sapien
tgtagatgttcatcaggcattgaag

SEQ ID NO: 109484 - DNA, 25 bp, Homo sapien
tgtagatgttcgtcaggcattgaag

SEQ ID NO: 109485 - DNA, 25 bp, Homo sapien
tgtagatttagaattaaatgatatg

SEQ ID NO: 109486 - DNA, 25 bp, Homo sapien
tgtagattttgaattaaatgatatg

SEQ ID NO: 109487 - DNA, 25 bp, Homo sapien
tgtagcactagacttgtgaatttga

SEQ ID NO: 109488 - DNA, 25 bp, Homo sapien
tgtagcactagtcttgtgaatttga

SEQ ID NO: 109489 - DNA, 25 bp, Homo sapien
tgtagcattttttaaagtctgttac

SEQ ID NO: 109490 - DNA, 25 bp, Homo sapien
tgtagcatttttttaagtctgttac

SEQ ID NO: 109491 - DNA, 25 bp, Homo sapien
tgtagccaaagacccgcgagctcct

SEQ ID NO: 109492 - DNA, 25 bp, Homo sapien
tgtagccaaaggcccgcgagctcct

SEQ ID NO: 109493 - DNA, 25 bp, Homo sapien
tgtagccacattacacctttgcatt

SEQ ID NO: 109494 - DNA, 25 bp, Homo sapien
tgtagccacattacgcctttgcatt

SEQ ID NO: 109495 - DNA, 25 bp, Homo sapien
tgtagccagtgttgcgtgtcttagc

SEQ ID NO: 109496 - DNA, 25 bp, Homo sapien
tgtagccagtgtttcgtgtcttagc

SEQ ID NO: 109497 - DNA, 25 bp, Homo sapien
tgtagcccaaactcaagaatgagaa

SEQ ID NO: 109498 - DNA, 25 bp, Homo sapien
tgtagcccaaactgaagaatgagaa

SEQ ID NO: 109499 - DNA, 25 bp, Homo sapien
tgtagcctatgtgaagccatgaagg

SEQ ID NO: 109500 - DNA, 25 bp, Homo sapien
tgtagcctatgtgaagtcatgaagg

SEQ ID NO: 109501 - DNA, 25 bp, Homo sapien
tgtagcctctatcctgaccttaggc

SEQ ID NO: 109502 - DNA, 25 bp, Homo sapien
tgtagcctctatgctgaccttaggc

SEQ ID NO: 109503 - DNA, 25 bp, Homo sapien
tgtagcgcttcccgctttgttctct

SEQ ID NO: 109504 - DNA, 25 bp, Homo sapien
tgtagcgcttcctgctttgttctct

SEQ ID NO: 109505 - DNA, 25 bp, Homo sapien
tgtagctaatactctacggactgaa

SEQ ID NO: 109506 - DNA, 25 bp, Homo sapien
tgtagctaatactctatggactgaa

SEQ ID NO: 109507 - DNA, 25 bp, Homo sapien
tgtagctccatctttaatgatcaca

SEQ ID NO: 109508 - DNA, 25 bp, Homo sapien
tgtagctcccaatctgcctgggaag

SEQ ID NO: 109509 - DNA, 25 bp, Homo sapien
tgtagctcccaatctgtctgggaag

SEQ ID NO: 109510 - DNA, 25 bp, Homo sapien
tgtagctccttctttaatgatcaca

SEQ ID NO: 109511 - DNA, 25 bp, Homo sapien
tgtagctgataatgatgatcctaag

SEQ ID NO: 109512 - DNA, 25 bp, Homo sapien
tgtagctgataattatgatcctaag

SEQ ID NO: 109513 - DNA, 25 bp, Homo sapien
tgtagctgcctacagaattagagaa

SEQ ID NO: 109514 - DNA, 25 bp, Homo sapien
tgtagctgcctacagagttagagaa

SEQ ID NO: 109515 - DNA, 25 bp, Homo sapien
tgtagctgctgactttaaattgaag

SEQ ID NO: 109516 - DNA, 25 bp, Homo sapien
tgtagctgctgattttaaattgaag

SEQ ID NO: 109517 - DNA, 25 bp, Homo sapien
tgtagcttaaagaatataaaatcat

SEQ ID NO: 109518 - DNA, 25 bp, Homo sapien
tgtagcttaaagactataaaatcat

SEQ ID NO: 109519 - DNA, 25 bp, Homo sapien
tgtagcttgaaatctcttatgatga

SEQ ID NO: 109520 - DNA, 25 bp, Homo sapien
tgtagctttaaatctcttatgatga

SEQ ID NO: 109521 - DNA, 25 bp, Homo sapien
tgtagctttttttgtgcgagcctct

SEQ ID NO: 109522 - DNA, 25 bp, Homo sapien
tgtagctttttttgtgtgagcctct

SEQ ID NO: 109523 - DNA, 25 bp, Homo sapien
tgtaggaaaagcaactccattacat

SEQ ID NO: 109524 - DNA, 25 bp, Homo sapien
tgtaggaaaagcaagtccattacat

SEQ ID NO: 109525 - DNA, 25 bp, Homo sapien
tgtaggaatcttctcgctgaggtta

SEQ ID NO: 109526 - DNA, 25 bp, Homo sapien
tgtaggaatcttcttgctgaggtta

SEQ ID NO: 109527 - DNA, 25 bp, Homo sapien
tgtaggaggaacgagctggaaataa

SEQ ID NO: 109528 - DNA, 25 bp, Homo sapien
tgtaggaggaatgagctggaaataa

SEQ ID NO: 109529 - DNA, 25 bp, Homo sapien
tgtaggatggccaaacgcagcagac

SEQ ID NO: 109530 - DNA, 25 bp, Homo sapien
tgtaggatggccaaactcagcagac

SEQ ID NO: 109531 - DNA, 25 bp, Homo sapien
tgtaggcaatttagatgatgaaatt

SEQ ID NO: 109532 - DNA, 25 bp, Homo sapien
tgtaggcaatttggatgatgaaatt

SEQ ID NO: 109533 - DNA, 25 bp, Homo sapien
tgtaggcatgatcttgtggtctgaa

SEQ ID NO: 109534 - DNA, 25 bp, Homo sapien
tgtaggcatgatgttgtggtctgaa

SEQ ID NO: 109535 - DNA, 25 bp, Homo sapien
tgtaggcatttttatacttttgaaa

SEQ ID NO: 109536 - DNA, 25 bp, Homo sapien
tgtaggcatttttgtacttttgaaa

SEQ ID NO: 109537 - DNA, 25 bp, Homo sapien
tgtaggctaagcctctgtttggtat

SEQ ID NO: 109538 - DNA, 25 bp, Homo sapien
tgtaggctaagcttctgtttggtat

SEQ ID NO: 109539 - DNA, 25 bp, Homo sapien
tgtagggaatttgtggattggtctt

SEQ ID NO: 109540 - DNA, 25 bp, Homo sapien
tgtagggaatttgtgggttggtctt

SEQ ID NO: 109541 - DNA, 25 bp, Homo sapien
tgtagggtggccaacttgtcccagt

SEQ ID NO: 109542 - DNA, 25 bp, Homo sapien
tgtagggtggccaatttgtcccagt

SEQ ID NO: 109543 - DNA, 25 bp, Homo sapien
tgtaggtagttaagagaaagtcagg

SEQ ID NO: 109544 - DNA, 25 bp, Homo sapien
tgtaggtagttaagggaaagtcagg

SEQ ID NO: 109545 - DNA, 25 bp, Homo sapien
tgtaggtataactactgctaaatac

SEQ ID NO: 109546 - DNA, 25 bp, Homo sapien
tgtaggtataattactgctaaatac

SEQ ID NO: 109547 - DNA, 25 bp, Homo sapien
tgtaggtgcagacgtttagcaagct

SEQ ID NO: 109548 - DNA, 25 bp, Homo sapien
tgtaggtgctttaggcattccctgg

SEQ ID NO: 109549 - DNA, 25 bp, Homo sapien
tgtaggtgctttaggccttccctgg

SEQ ID NO: 109550 - DNA, 25 bp, Homo sapien
tgtaggtgtagacgtttagcaagct

SEQ ID NO: 109551 - DNA, 25 bp, Homo sapien
tgtaggttgattgacagaaataaga

SEQ ID NO: 109552 - DNA, 25 bp, Homo sapien
tgtaggttgattgatagaaataaga

SEQ ID NO: 109553 - DNA, 25 bp, Homo sapien
tgtaggttgcattcggttaattata

SEQ ID NO: 109554 - DNA, 25 bp, Homo sapien
tgtaggttgcatttggttaattata

SEQ ID NO: 109555 - DNA, 25 bp, Homo sapien
tgtagtcaactggagaagacagaca

SEQ ID NO: 109556 - DNA, 25 bp, Homo sapien
tgtagtcaattggagaagacagaca

SEQ ID NO: 109557 - DNA, 25 bp, Homo sapien
tgtagtcactgagccgcagcaggcg

SEQ ID NO: 109558 - DNA, 25 bp, Homo sapien
tgtagtcactgagctgcagcaggcg

SEQ ID NO: 109559 - DNA, 25 bp, Homo sapien
tgtagtctctaccctgaccatgtgc

SEQ ID NO: 109560 - DNA, 25 bp, Homo sapien
tgtagtctctaccttgaccatgtgc

SEQ ID NO: 109561 - DNA, 25 bp, Homo sapien
tgtagtcttgaagtcagttggaatg

SEQ ID NO: 109562 - DNA, 25 bp, Homo sapien
tgtagtcttgaattcagttggaatg

SEQ ID NO: 109563 - DNA, 25 bp, Homo sapien
tgtagtgacaaagcgaaagaaaagg

SEQ ID NO: 109564 - DNA, 25 bp, Homo sapien
tgtagtgacaaagtgaaagaaaagg

SEQ ID NO: 109565 - DNA, 25 bp, Homo sapien
tgtagtgattcaagcacacatgtgg

SEQ ID NO: 109566 - DNA, 25 bp, Homo sapien
tgtagtgattcaaggacacatgtgg

SEQ ID NO: 109567 - DNA, 25 bp, Homo sapien
tgtagtggacatacctggtttttct

SEQ ID NO: 109568 - DNA, 25 bp, Homo sapien
tgtagtggatatacctggtttttct

SEQ ID NO: 109569 - DNA, 25 bp, Homo sapien
tgtagtggcattacccttctttttg

SEQ ID NO: 109570 - DNA, 25 bp, Homo sapien
tgtagtggcgttacccttctttttg

SEQ ID NO: 109571 - DNA, 25 bp, Homo sapien
tgtagtggtatctcgttgttgtaat

SEQ ID NO: 109572 - DNA, 25 bp, Homo sapien
tgtagtggtatcttgttgttgtaat

SEQ ID NO: 109573 - DNA, 25 bp, Homo sapien
tgtagttcctgttacttaggaggcc

SEQ ID NO: 109574 - DNA, 25 bp, Homo sapien
tgtagttcttgttacttaggaggcc

SEQ ID NO: 109575 - DNA, 25 bp, Homo sapien
tgtagttgagagacgagctatgggc

SEQ ID NO: 109576 - DNA, 25 bp, Homo sapien
tgtagttgagagatgagctatgggc

SEQ ID NO: 109577 - DNA, 25 bp, Homo sapien
tgtagttggcttactcaaagcagag

SEQ ID NO: 109578 - DNA, 25 bp, Homo sapien
tgtagttggcttattcaaagcagag

SEQ ID NO: 109579 - DNA, 25 bp, Homo sapien
tgtataaaaacttacagagctagca

SEQ ID NO: 109580 - DNA, 25 bp, Homo sapien
tgtataaaaacttatagagctagca

SEQ ID NO: 109581 - DNA, 25 bp, Homo sapien
tgtataaccctttggacgcaaatgt

SEQ ID NO: 109582 - DNA, 25 bp, Homo sapien
tgtataaccctttggatgcaaatgt

SEQ ID NO: 109583 - DNA, 25 bp, Homo sapien
tgtataactcaaatctttgatcttc

SEQ ID NO: 109584 - DNA, 25 bp, Homo sapien
tgtataactcaagtctttgatcttc

SEQ ID NO: 109585 - DNA, 25 bp, Homo sapien
tgtataattaaccagaagtccagta

SEQ ID NO: 109586 - DNA, 25 bp, Homo sapien
tgtataattaactagaagtccagta

SEQ ID NO: 109587 - DNA, 25 bp, Homo sapien
tgtatacatccacactcgttttctg

SEQ ID NO: 109588 - DNA, 25 bp, Homo sapien
tgtatacatccgcactcgttttctg

SEQ ID NO: 109589 - DNA, 25 bp, Homo sapien
tgtatagaatgagaagggaaggggt

SEQ ID NO: 109590 - DNA, 25 bp, Homo sapien
tgtatagaatgagaggggaaggggt

SEQ ID NO: 109591 - DNA, 25 bp, Homo sapien
tgtatagcagtgcagttaatttgtg

SEQ ID NO: 109592 - DNA, 25 bp, Homo sapien
tgtatagcagtgctgttaatttgtg

SEQ ID NO: 109593 - DNA, 25 bp, Homo sapien
tgtatagccagcaggatgaatttaa

SEQ ID NO: 109594 - DNA, 25 bp, Homo sapien
tgtatagccagtaggatgaatttaa

SEQ ID NO: 109595 - DNA, 25 bp, Homo sapien
tgtatagctgagggaactgaggtcc

SEQ ID NO: 109596 - DNA, 25 bp, Homo sapien
tgtatagctgagggaattgaggtcc

SEQ ID NO: 109597 - DNA, 25 bp, Homo sapien
tgtatagctttgccaccagtatcta

SEQ ID NO: 109598 - DNA, 25 bp, Homo sapien
tgtatagctttgtcaccagtatcta

SEQ ID NO: 109599 - DNA, 25 bp, Homo sapien
tgtatagtctattcaggtatctaaa

SEQ ID NO: 109600 - DNA, 25 bp, Homo sapien
tgtatagtctattcagttatctaaa

SEQ ID NO: 109601 - DNA, 25 bp, Homo sapien
tgtatagtttcaattctcacatgaa

SEQ ID NO: 109602 - DNA, 25 bp, Homo sapien
tgtatagtttctattctcacatgaa

SEQ ID NO: 109603 - DNA, 25 bp, Homo sapien
tgtatatcatctttgccgtgatttg

SEQ ID NO: 109604 - DNA, 25 bp, Homo sapien
tgtatatcatctttgctgtgatttg

SEQ ID NO: 109605 - DNA, 25 bp, Homo sapien
tgtatatctgttcatattctgtctg

SEQ ID NO: 109606 - DNA, 25 bp, Homo sapien
tgtatatctgttcgtattctgtctg

SEQ ID NO: 109607 - DNA, 25 bp, Homo sapien
tgtatatcttccacatgatagttat

SEQ ID NO: 109608 - DNA, 25 bp, Homo sapien
tgtatatcttccacgtgatagttat

SEQ ID NO: 109609 - DNA, 25 bp, Homo sapien
tgtatatgatggagtaggtagatga

SEQ ID NO: 109610 - DNA, 25 bp, Homo sapien
tgtatatgatggtgtaggtagatga

SEQ ID NO: 109611 - DNA, 25 bp, Homo sapien
tgtatatggtacaggctattgttcc

SEQ ID NO: 109612 - DNA, 25 bp, Homo sapien
tgtatatggtataggctattgttcc

SEQ ID NO: 109613 - DNA, 25 bp, Homo sapien
tgtatatgtctacgcattcttgtaa

SEQ ID NO: 109614 - DNA, 25 bp, Homo sapien
tgtatatgtctatgcattcttgtaa

SEQ ID NO: 109615 - DNA, 25 bp, Homo sapien
tgtatattttctcatgatgaattct

SEQ ID NO: 109616 - DNA, 25 bp, Homo sapien
tgtatattttctcttgatgaattct

SEQ ID NO: 109617 - DNA, 25 bp, Homo sapien
tgtatcaccctgaattgctattttt

SEQ ID NO: 109618 - DNA, 25 bp, Homo sapien
tgtatcactctgaattgctattttt

SEQ ID NO: 109619 - DNA, 25 bp, Homo sapien
tgtatcagaagcgttttgtgtaaat

SEQ ID NO: 109620 - DNA, 25 bp, Homo sapien
tgtatcagaagtgttttgtgtaaat

SEQ ID NO: 109621 - DNA, 25 bp, Homo sapien
tgtatcagctcatcatctgcagtta

SEQ ID NO: 109622 - DNA, 25 bp, Homo sapien
tgtatcagctcgtcatctgcagtta

SEQ ID NO: 109623 - DNA, 25 bp, Homo sapien
tgtatcattaaaaaaatgtcactgg

SEQ ID NO: 109624 - DNA, 25 bp, Homo sapien
tgtatcattgaaaaaatgtcactgg

SEQ ID NO: 109625 - DNA, 25 bp, Homo sapien
tgtatcattgttgcatttgattgtc

SEQ ID NO: 109626 - DNA, 25 bp, Homo sapien
tgtatcatttttgcatttgattgtc

SEQ ID NO: 109627 - DNA, 25 bp, Homo sapien
tgtatccagtataagctaaacatta

SEQ ID NO: 109628 - DNA, 25 bp, Homo sapien
tgtatccagtatatgctaaacatta

SEQ ID NO: 109629 - DNA, 25 bp, Homo sapien
tgtatccagtctgataggtgtgaag

SEQ ID NO: 109630 - DNA, 25 bp, Homo sapien
tgtatccatcttgtatattttcaaa

SEQ ID NO: 109631 - DNA, 25 bp, Homo sapien
tgtatccatcttgtatcttttcaaa

SEQ ID NO: 109632 - DNA, 25 bp, Homo sapien
tgtatccattctgataggtgtgaag

SEQ ID NO: 109633 - DNA, 25 bp, Homo sapien
tgtatcgattcctattgactttatt

SEQ ID NO: 109634 - DNA, 25 bp, Homo sapien
tgtatcgattcttattgactttatt

SEQ ID NO: 109635 - DNA, 25 bp, Homo sapien
tgtatctaaacttcaaagtaccata

SEQ ID NO: 109636 - DNA, 25 bp, Homo sapien
tgtatctaaccttcaaagtaccata

SEQ ID NO: 109637 - DNA, 25 bp, Homo sapien
tgtatctggattatgtgatataaga

SEQ ID NO: 109638 - DNA, 25 bp, Homo sapien
tgtatctggttattaaaagttactc

SEQ ID NO: 109639 - DNA, 25 bp, Homo sapien
tgtatctgtaatcccttgtatcaca

SEQ ID NO: 109640 - DNA, 25 bp, Homo sapien
tgtatctgtaatcctttgtatcaca

SEQ ID NO: 109641 - DNA, 25 bp, Homo sapien
tgtatctgtattatgtgatataaga

SEQ ID NO: 109642 - DNA, 25 bp, Homo sapien
tgtatctgtttattaaaagttactc

SEQ ID NO: 109643 - DNA, 25 bp, Homo sapien
tgtatcttcagtagaaaacatatat

SEQ ID NO: 109644 - DNA, 25 bp, Homo sapien
tgtatcttgagtagaaaacatatat

SEQ ID NO: 109645 - DNA, 25 bp, Homo sapien
tgtatcttgctgaaaattgacacag

SEQ ID NO: 109646 - DNA, 25 bp, Homo sapien
tgtatcttgctgaagattgacacag

SEQ ID NO: 109647 - DNA, 25 bp, Homo sapien
tgtatcttgtaaattgagacagctc

SEQ ID NO: 109648 - DNA, 25 bp, Homo sapien
tgtatcttgtaagttgagacagctc

SEQ ID NO: 109649 - DNA, 25 bp, Homo sapien
tgtatctttagtagaagtgctgcca

SEQ ID NO: 109650 - DNA, 25 bp, Homo sapien
tgtatctttagtaggagtgctgcca

SEQ ID NO: 109651 - DNA, 25 bp, Homo sapien
tgtatctttcttgctttgtagacaa

SEQ ID NO: 109652 - DNA, 25 bp, Homo sapien
tgtatcttttttgctttgtagacaa

SEQ ID NO: 109653 - DNA, 25 bp, Homo sapien
tgtatgaaacgcccctgctctgtgc

SEQ ID NO: 109654 - DNA, 25 bp, Homo sapien
tgtatgaaatagaactccaaggcat

SEQ ID NO: 109655 - DNA, 25 bp, Homo sapien
tgtatgaaatagcactccaaggcat

SEQ ID NO: 109656 - DNA, 25 bp, Homo sapien
tgtatgaaatgcccctgctctgtgc

SEQ ID NO: 109657 - DNA, 25 bp, Homo sapien
tgtatgaaattctgaaggaagggct

SEQ ID NO: 109658 - DNA, 25 bp, Homo sapien
tgtatgaacgctattgtgcccttgc

SEQ ID NO: 109659 - DNA, 25 bp, Homo sapien
tgtatgaacttcatggtcttcagaa

SEQ ID NO: 109660 - DNA, 25 bp, Homo sapien
tgtatgaacttcattgtcttcagaa

SEQ ID NO: 109661 - DNA, 25 bp, Homo sapien
tgtatgaagaaattaatgttgtttt

SEQ ID NO: 109662 - DNA, 25 bp, Homo sapien
tgtatgaagaagttaatgttgtttt

SEQ ID NO: 109663 - DNA, 25 bp, Homo sapien
tgtatgaagttctgaaggaagggct

SEQ ID NO: 109664 - DNA, 25 bp, Homo sapien
tgtatgaatgctattgtgcccttgc

SEQ ID NO: 109665 - DNA, 25 bp, Homo sapien
tgtatgcagaaatagtaaatttgac

SEQ ID NO: 109666 - DNA, 25 bp, Homo sapien
tgtatgcagaaatagtcaatttgac

SEQ ID NO: 109667 - DNA, 25 bp, Homo sapien
tgtatggaagaagagcagcctacac

SEQ ID NO: 109668 - DNA, 25 bp, Homo sapien
tgtatggaagaagagcggcctacac

SEQ ID NO: 109669 - DNA, 25 bp, Homo sapien
tgtatggatatttggcatgatatat

SEQ ID NO: 109670 - DNA, 25 bp, Homo sapien
tgtatggatattttgcatgatatat

SEQ ID NO: 109671 - DNA, 25 bp, Homo sapien
tgtatggattgcaccagcgggcttc

SEQ ID NO: 109672 - DNA, 25 bp, Homo sapien
tgtatggattgcaccatcgggcttc

SEQ ID NO: 109673 - DNA, 25 bp, Homo sapien
tgtatggatttaatgtaagtcttgg

SEQ ID NO: 109674 - DNA, 25 bp, Homo sapien
tgtatggatttagtgtaagtcttgg

SEQ ID NO: 109675 - DNA, 25 bp, Homo sapien
tgtatggccgtgcaatgtgtttgca

SEQ ID NO: 109676 - DNA, 25 bp, Homo sapien
tgtatggctgtgcaatgtgtttgca

SEQ ID NO: 109677 - DNA, 25 bp, Homo sapien
tgtatgggcagcctataaaagctgg

SEQ ID NO: 109678 - DNA, 25 bp, Homo sapien
tgtatgggcagcgtataaaagctgg

SEQ ID NO: 109679 - DNA, 25 bp, Homo sapien
tgtatgtccagaagatataaaacta

SEQ ID NO: 109680 - DNA, 25 bp, Homo sapien
tgtatgtccagaggatataaaacta

SEQ ID NO: 109681 - DNA, 25 bp, Homo sapien
tgtatgtgaaacttttgaaacagta

SEQ ID NO: 109682 - DNA, 25 bp, Homo sapien
tgtatgtgaaatttttgaaacagta

SEQ ID NO: 109683 - DNA, 25 bp, Homo sapien
tgtatgtgcaacctaaaaatctgaa

SEQ ID NO: 109684 - DNA, 25 bp, Homo sapien
tgtatgtgtaacctaaaaatctgaa

SEQ ID NO: 109685 - DNA, 25 bp, Homo sapien
tgtatgttttcattcgctttgttga

SEQ ID NO: 109686 - DNA, 25 bp, Homo sapien
tgtatgttttcatttgctttgttga

SEQ ID NO: 109687 - DNA, 25 bp, Homo sapien
tgtattaaaacacctcacgcctcag

SEQ ID NO: 109688 - DNA, 25 bp, Homo sapien
tgtattaaaacacttcacgcctcag

SEQ ID NO: 109689 - DNA, 25 bp, Homo sapien
tgtattaaaatcacaagaaaagcaa

SEQ ID NO: 109690 - DNA, 25 bp, Homo sapien
tgtattaaagtcacaagaaaagcaa

SEQ ID NO: 109691 - DNA, 25 bp, Homo sapien
tgtattaagagctgaccgtataaac

SEQ ID NO: 109692 - DNA, 25 bp, Homo sapien
tgtattaagagctgactgtataaac

SEQ ID NO: 109693 - DNA, 25 bp, Homo sapien
tgtattaagcgtccagtcagataat

SEQ ID NO: 109694 - DNA, 25 bp, Homo sapien
tgtattaagtgtccagtcagataat

SEQ ID NO: 109695 - DNA, 25 bp, Homo sapien
tgtattaatggcactaatttttgta

SEQ ID NO: 109696 - DNA, 25 bp, Homo sapien
tgtattaatggtactaatttttgta

SEQ ID NO: 109697 - DNA, 25 bp, Homo sapien
tgtattacatttgctcagcatcttg

SEQ ID NO: 109698 - DNA, 25 bp, Homo sapien
tgtattacatttgctcggcatcttg

SEQ ID NO: 109699 - DNA, 25 bp, Homo sapien
tgtattactcacaatttttgccatg

SEQ ID NO: 109700 - DNA, 25 bp, Homo sapien
tgtattactcacagtttttgccatg

SEQ ID NO: 109701 - DNA, 25 bp, Homo sapien
tgtattactcttgcagttgtttact

SEQ ID NO: 109702 - DNA, 25 bp, Homo sapien
tgtattactcttgtagttgtttact

SEQ ID NO: 109703 - DNA, 25 bp, Homo sapien
tgtattagtagctacggtgaacagt

SEQ ID NO: 109704 - DNA, 25 bp, Homo sapien
tgtattagtagctatggtgaacagt

SEQ ID NO: 109705 - DNA, 25 bp, Homo sapien
tgtattatggtgcacgcacatagcc

SEQ ID NO: 109706 - DNA, 25 bp, Homo sapien
tgtattatggtgcacgtacatagcc

SEQ ID NO: 109707 - DNA, 25 bp, Homo sapien
tgtattattgcataaggtagtgtac

SEQ ID NO: 109708 - DNA, 25 bp, Homo sapien
tgtattattgcgtaaggtagtgtac

SEQ ID NO: 109709 - DNA, 25 bp, Homo sapien
tgtattcaattctcttatacttgat

SEQ ID NO: 109710 - DNA, 25 bp, Homo sapien
tgtattcaattttcttatacttgat

SEQ ID NO: 109711 - DNA, 25 bp, Homo sapien
tgtattcataaatcatagcatcaca

SEQ ID NO: 109712 - DNA, 25 bp, Homo sapien
tgtattcataaatcattgcatcaca

SEQ ID NO: 109713 - DNA, 25 bp, Homo sapien
tgtattcattgaatggctattactg

SEQ ID NO: 109714 - DNA, 25 bp, Homo sapien
tgtattcattgagtggctattactg

SEQ ID NO: 109715 - DNA, 25 bp, Homo sapien
tgtattcccttgcagatcctgagct

SEQ ID NO: 109716 - DNA, 25 bp, Homo sapien
tgtattcctttgcagatcctgagct

SEQ ID NO: 109717 - DNA, 25 bp, Homo sapien
tgtattctctgaagtatgaatgtct

SEQ ID NO: 109718 - DNA, 25 bp, Homo sapien
tgtattctctgaggtatgaatgtct

SEQ ID NO: 109719 - DNA, 25 bp, Homo sapien
tgtattctgcaaatatttcaaaatc

SEQ ID NO: 109720 - DNA, 25 bp, Homo sapien
tgtattctgtaaatatttcaaaatc

SEQ ID NO: 109721 - DNA, 25 bp, Homo sapien
tgtattcttcacgcatcttaatata

SEQ ID NO: 109722 - DNA, 25 bp, Homo sapien
tgtattcttcatgcatcttaatata

SEQ ID NO: 109723 - DNA, 25 bp, Homo sapien
tgtattgcaatttcctggctttagt

SEQ ID NO: 109724 - DNA, 25 bp, Homo sapien
tgtattgcagggagttggtatgaca

SEQ ID NO: 109725 - DNA, 25 bp, Homo sapien
tgtattgcagggagtttgtatgaca

SEQ ID NO: 109726 - DNA, 25 bp, Homo sapien
tgtattgccatttcctggctttagt

SEQ ID NO: 109727 - DNA, 25 bp, Homo sapien
tgtattgctagccctgccaactgaa

SEQ ID NO: 109728 - DNA, 25 bp, Homo sapien
tgtattgctagccctggcaactgaa

SEQ ID NO: 109729 - DNA, 25 bp, Homo sapien
tgtattgctcatagtactggaggca

SEQ ID NO: 109730 - DNA, 25 bp, Homo sapien
tgtattgctcatagtagtggaggca

SEQ ID NO: 109731 - DNA, 25 bp, Homo sapien
tgtattgtgtcaggagcagctctaa

SEQ ID NO: 109732 - DNA, 25 bp, Homo sapien
tgtattgtgtcgggagcagctctaa

SEQ ID NO: 109733 - DNA, 25 bp, Homo sapien
tgtattgttcttagaatgtatgtct

SEQ ID NO: 109734 - DNA, 25 bp, Homo sapien
tgtattgttttaaacccggtaagag

SEQ ID NO: 109735 - DNA, 25 bp, Homo sapien
tgtattgttttaaacctggtaagag

SEQ ID NO: 109736 - DNA, 25 bp, Homo sapien
tgtattgtttttagaatgtatgtct

SEQ ID NO: 109737 - DNA, 25 bp, Homo sapien
tgtatttaaccaatatttagagggg

SEQ ID NO: 109738 - DNA, 25 bp, Homo sapien
tgtatttaaccattatttagagggg

SEQ ID NO: 109739 - DNA, 25 bp, Homo sapien
tgtatttacctggacaattcttcca

SEQ ID NO: 109740 - DNA, 25 bp, Homo sapien
tgtatttacctggacagttcttcca

SEQ ID NO: 109741 - DNA, 25 bp, Homo sapien
tgtatttatagtcctgcaattatca

SEQ ID NO: 109742 - DNA, 25 bp, Homo sapien
tgtatttatagtcttgcaattatca

SEQ ID NO: 109743 - DNA, 25 bp, Homo sapien
tgtatttccagtgcagtgttctatc

SEQ ID NO: 109744 - DNA, 25 bp, Homo sapien
tgtatttccggtgcagtgttctatc

SEQ ID NO: 109745 - DNA, 25 bp, Homo sapien
tgtatttgcattaagcattttataa

SEQ ID NO: 109746 - DNA, 25 bp, Homo sapien
tgtatttgcattaagcgttttataa

SEQ ID NO: 109747 - DNA, 25 bp, Homo sapien
tgtatttgcttgaatggtgaagtca

SEQ ID NO: 109748 - DNA, 25 bp, Homo sapien
tgtatttgtttgaatggtgaagtca

SEQ ID NO: 109749 - DNA, 25 bp, Homo sapien
tgtattttacacacatagcctgtta

SEQ ID NO: 109750 - DNA, 25 bp, Homo sapien
tgtattttacacatatagcctgtta

SEQ ID NO: 109751 - DNA, 25 bp, Homo sapien
tgtattttcaccgcaattttctaaa

SEQ ID NO: 109752 - DNA, 25 bp, Homo sapien
tgtattttcactgcaattttctaaa

SEQ ID NO: 109753 - DNA, 25 bp, Homo sapien
tgtattttggtagacaaatgcagta

SEQ ID NO: 109754 - DNA, 25 bp, Homo sapien
tgtattttggtagacatatgcagta

SEQ ID NO: 109755 - DNA, 25 bp, Homo sapien
tgtcaaaacggccatactaccaaga

SEQ ID NO: 109756 - DNA, 25 bp, Homo sapien
tgtcaaaagggccatactaccaaga

SEQ ID NO: 109757 - DNA, 25 bp, Homo sapien
tgtcaaagataaagtgcaacacatt

SEQ ID NO: 109758 - DNA, 25 bp, Homo sapien
tgtcaaagattagatcaagcacttc

SEQ ID NO: 109759 - DNA, 25 bp, Homo sapien
tgtcaaagcgcagggtcacaggaga

SEQ ID NO: 109760 - DNA, 25 bp, Homo sapien
tgtcaaagctcagggtcacaggaga

SEQ ID NO: 109761 - DNA, 25 bp, Homo sapien
tgtcaaaggtaaagtgcaacacatt

SEQ ID NO: 109762 - DNA, 25 bp, Homo sapien
tgtcaaaggttagatcaagcacttc

SEQ ID NO: 109763 - DNA, 25 bp, Homo sapien
tgtcaaatcagctgtgacattagac

SEQ ID NO: 109764 - DNA, 25 bp, Homo sapien
tgtcaaatcagctgtggcattagac

SEQ ID NO: 109765 - DNA, 25 bp, Homo sapien
tgtcaaatgctttagggctgtccca

SEQ ID NO: 109766 - DNA, 25 bp, Homo sapien
tgtcaaatgttttagggctgtccca

SEQ ID NO: 109767 - DNA, 25 bp, Homo sapien
tgtcaacattatgatcaaaggtgaa

SEQ ID NO: 109768 - DNA, 25 bp, Homo sapien
tgtcaacattatgctcaaaggtgaa

SEQ ID NO: 109769 - DNA, 25 bp, Homo sapien
tgtcaaccaggagaatgagttggaa

SEQ ID NO: 109770 - DNA, 25 bp, Homo sapien
tgtcaacccggagaatgagttggaa

SEQ ID NO: 109771 - DNA, 25 bp, Homo sapien
tgtcaactgtgtcaccctttaccaa

SEQ ID NO: 109772 - DNA, 25 bp, Homo sapien
tgtcaactgtgtcgccctttaccaa

SEQ ID NO: 109773 - DNA, 25 bp, Homo sapien
tgtcaagaaatgacaattgactttg

SEQ ID NO: 109774 - DNA, 25 bp, Homo sapien
tgtcaagaaatgataattgactttg

SEQ ID NO: 109775 - DNA, 25 bp, Homo sapien
tgtcaagtggtcataatactaagcc

SEQ ID NO: 109776 - DNA, 25 bp, Homo sapien
tgtcaagttgtcataatactaagcc

SEQ ID NO: 109777 - DNA, 25 bp, Homo sapien
tgtcaatactactactctgaatttg

SEQ ID NO: 109778 - DNA, 25 bp, Homo sapien
tgtcaatactactactttgaatttg

SEQ ID NO: 109779 - DNA, 25 bp, Homo sapien
tgtcaatagcaaatgtttcaattgc

SEQ ID NO: 109780 - DNA, 25 bp, Homo sapien
tgtcaatagcaagtgtttcaattgc

SEQ ID NO: 109781 - DNA, 25 bp, Homo sapien
tgtcaataggagcgactcacgcgct

SEQ ID NO: 109782 - DNA, 25 bp, Homo sapien
tgtcaataggagcgtctcacgcgct

SEQ ID NO: 109783 - DNA, 25 bp, Homo sapien
tgtcaatccaccagaatttagggct

SEQ ID NO: 109784 - DNA, 25 bp, Homo sapien
tgtcaatccaccggaatttagggct

SEQ ID NO: 109785 - DNA, 25 bp, Homo sapien
tgtcaattccacgaaaaaaatatgc

SEQ ID NO: 109786 - DNA, 25 bp, Homo sapien
tgtcaattccatgaaaaaaatatgc

SEQ ID NO: 109787 - DNA, 25 bp, Homo sapien
tgtcaatttccatttttctactatg

SEQ ID NO: 109788 - DNA, 25 bp, Homo sapien
tgtcaatttccgtttttctactatg

SEQ ID NO: 109789 - DNA, 25 bp, Homo sapien
tgtcacaaaaccacagacacatttc

SEQ ID NO: 109790 - DNA, 25 bp, Homo sapien
tgtcacaaaaccacggacacatttc

SEQ ID NO: 109791 - DNA, 25 bp, Homo sapien
tgtcacaacggaaaaggtggaaaac

SEQ ID NO: 109792 - DNA, 25 bp, Homo sapien
tgtcacaagggaaaaggtggaaaac

SEQ ID NO: 109793 - DNA, 25 bp, Homo sapien
tgtcacactacaagctgcaaaagtt

SEQ ID NO: 109794 - DNA, 25 bp, Homo sapien
tgtcacacttcaagctgcaaaagtt

SEQ ID NO: 109795 - DNA, 25 bp, Homo sapien
tgtcacatatttccattttgtactg

SEQ ID NO: 109796 - DNA, 25 bp, Homo sapien
tgtcacatattttcattttgtactg

SEQ ID NO: 109797 - DNA, 25 bp, Homo sapien
tgtcacatgaccatcccagttttct

SEQ ID NO: 109798 - DNA, 25 bp, Homo sapien
tgtcacatgaccgtcccagttttct

SEQ ID NO: 109799 - DNA, 25 bp, Homo sapien
tgtcaccatcaatgcagtcgaggtg

SEQ ID NO: 109800 - DNA, 25 bp, Homo sapien
tgtcaccatcagtgcagtcgaggtg

SEQ ID NO: 109801 - DNA, 25 bp, Homo sapien
tgtcaccatgccagcctaaggtttg

SEQ ID NO: 109802 - DNA, 25 bp, Homo sapien
tgtcaccatgccaggctaaggtttg

SEQ ID NO: 109803 - DNA, 25 bp, Homo sapien
tgtcaccattttaaaaccataagag

SEQ ID NO: 109804 - DNA, 25 bp, Homo sapien
tgtcaccattttacaaccataagag

SEQ ID NO: 109805 - DNA, 25 bp, Homo sapien
tgtcacccaatggcagttgaaatta

SEQ ID NO: 109806 - DNA, 25 bp, Homo sapien
tgtcacccagtggcagttgaaatta

SEQ ID NO: 109807 - DNA, 25 bp, Homo sapien
tgtcaccggtttacagatgaggcca

SEQ ID NO: 109808 - DNA, 25 bp, Homo sapien
tgtcaccgttttacagatgaggcca

SEQ ID NO: 109809 - DNA, 25 bp, Homo sapien
tgtcacctaatgtaaaaaaaaggga

SEQ ID NO: 109810 - DNA, 25 bp, Homo sapien
tgtcacctagtcagaagttcatatc

SEQ ID NO: 109811 - DNA, 25 bp, Homo sapien
tgtcacctagtgtaaaaaaaaggga

SEQ ID NO: 109812 - DNA, 25 bp, Homo sapien
tgtcacctattcagaagttcatatc

SEQ ID NO: 109813 - DNA, 25 bp, Homo sapien
tgtcactactggccagaacaagcaa

SEQ ID NO: 109814 - DNA, 25 bp, Homo sapien
tgtcactataagaagttgcttttat

SEQ ID NO: 109815 - DNA, 25 bp, Homo sapien
tgtcactataagaggttgcttttat

SEQ ID NO: 109816 - DNA, 25 bp, Homo sapien
tgtcactattggccagaacaagcaa

SEQ ID NO: 109817 - DNA, 25 bp, Homo sapien
tgtcactgcagcaataaggaagtaa

SEQ ID NO: 109818 - DNA, 25 bp, Homo sapien
tgtcactgcagcaatagggaagtaa

SEQ ID NO: 109819 - DNA, 25 bp, Homo sapien
tgtcactgtagaactctaacatggg

SEQ ID NO: 109820 - DNA, 25 bp, Homo sapien
tgtcactgtagaagtctaacatggg

SEQ ID NO: 109821 - DNA, 25 bp, Homo sapien
tgtcacttaatgacaatgatacatt

SEQ ID NO: 109822 - DNA, 25 bp, Homo sapien
tgtcacttaatgacgatgatacatt

SEQ ID NO: 109823 - DNA, 25 bp, Homo sapien
tgtcacttgattagatgccctctgt

SEQ ID NO: 109824 - DNA, 25 bp, Homo sapien
tgtcacttgattcgatgccctctgt

SEQ ID NO: 109825 - DNA, 25 bp, Homo sapien
tgtcagaaaggttattagagatagt

SEQ ID NO: 109826 - DNA, 25 bp, Homo sapien
tgtcagaaaggttattggagatagt

SEQ ID NO: 109827 - DNA, 25 bp, Homo sapien
tgtcagaattccatgtgggcctgtg

SEQ ID NO: 109828 - DNA, 25 bp, Homo sapien
tgtcagaattccctgtgggcctgtg

SEQ ID NO: 109829 - DNA, 25 bp, Homo sapien
tgtcagacacagtcagatccgttag

SEQ ID NO: 109830 - DNA, 25 bp, Homo sapien
tgtcagacacagtcaggtccgttag

SEQ ID NO: 109831 - DNA, 25 bp, Homo sapien
tgtcagagatagcagtaccttgcat

SEQ ID NO: 109832 - DNA, 25 bp, Homo sapien
tgtcagagatagtagtaccttgcat

SEQ ID NO: 109833 - DNA, 25 bp, Homo sapien
tgtcagcagagccagctcatcaact

SEQ ID NO: 109834 - DNA, 25 bp, Homo sapien
tgtcagcagggccagctcatcaact

SEQ ID NO: 109835 - DNA, 25 bp, Homo sapien
tgtcagccaatcatccaagcctgtg

SEQ ID NO: 109836 - DNA, 25 bp, Homo sapien
tgtcagccaatcatcccagcctgtg

SEQ ID NO: 109837 - DNA, 25 bp, Homo sapien
tgtcagcctactattgccaggtagc

SEQ ID NO: 109838 - DNA, 25 bp, Homo sapien
tgtcagcctactgttgccaggtagc

SEQ ID NO: 109839 - DNA, 25 bp, Homo sapien
tgtcagctgtagacctctctgaata

SEQ ID NO: 109840 - DNA, 25 bp, Homo sapien
tgtcagctgtagatctctctgaata

SEQ ID NO: 109841 - DNA, 25 bp, Homo sapien
tgtcagcttcatatgccggaaatta

SEQ ID NO: 109842 - DNA, 25 bp, Homo sapien
tgtcagcttcatatgctggaaatta

SEQ ID NO: 109843 - DNA, 25 bp, Homo sapien
tgtcagcttggcagaaaatgtaatg

SEQ ID NO: 109844 - DNA, 25 bp, Homo sapien
tgtcagcttggcaggaaatgtaatg

SEQ ID NO: 109845 - DNA, 25 bp, Homo sapien
tgtcaggacttggattctagccata

SEQ ID NO: 109846 - DNA, 25 bp, Homo sapien
tgtcaggatttggattctagccata

SEQ ID NO: 109847 - DNA, 25 bp, Homo sapien
tgtcaggcactaatgctcagtattg

SEQ ID NO: 109848 - DNA, 25 bp, Homo sapien
tgtcaggcagtaatgctcagtattg

SEQ ID NO: 109849 - DNA, 25 bp, Homo sapien
tgtcaggcatttcacagctttgtgt

SEQ ID NO: 109850 - DNA, 25 bp, Homo sapien
tgtcaggcatttcgcagctttgtgt

SEQ ID NO: 109851 - DNA, 25 bp, Homo sapien
tgtcagggctccaacttcatatttc

SEQ ID NO: 109852 - DNA, 25 bp, Homo sapien
tgtcagggctccgacttcatatttc

SEQ ID NO: 109853 - DNA, 25 bp, Homo sapien
tgtcaggtcagccgaaggatgaagg

SEQ ID NO: 109854 - DNA, 25 bp, Homo sapien
tgtcaggtcagctgaaggatgaagg

SEQ ID NO: 109855 - DNA, 25 bp, Homo sapien
tgtcaggtgagtgaaatgataggct

SEQ ID NO: 109856 - DNA, 25 bp, Homo sapien
tgtcaggtgagtggaatgataggct

SEQ ID NO: 109857 - DNA, 25 bp, Homo sapien
tgtcagtagcacataagatcccatc

SEQ ID NO: 109858 - DNA, 25 bp, Homo sapien
tgtcagtagcacgtaagatcccatc

SEQ ID NO: 109859 - DNA, 25 bp, Homo sapien
tgtcagtctcgtttggacatggtaa

SEQ ID NO: 109860 - DNA, 25 bp, Homo sapien
tgtcagtcttgtttggacatggtaa

SEQ ID NO: 109861 - DNA, 25 bp, Homo sapien
tgtcagtggttctcgcactcccaaa

SEQ ID NO: 109862 - DNA, 25 bp, Homo sapien
tgtcagtggttcttgcactcccaaa

SEQ ID NO: 109863 - DNA, 25 bp, Homo sapien
tgtcataagatatgaacagcaaatg

SEQ ID NO: 109864 - DNA, 25 bp, Homo sapien
tgtcataagatatgaatagcaaatg

SEQ ID NO: 109865 - DNA, 25 bp, Homo sapien
tgtcataatgtggtcctgatacact

SEQ ID NO: 109866 - DNA, 25 bp, Homo sapien
tgtcataatttggtcctgatacact

SEQ ID NO: 109867 - DNA, 25 bp, Homo sapien
tgtcatacttttatacatgaaatgg

SEQ ID NO: 109868 - DNA, 25 bp, Homo sapien
tgtcatacttttatacgtgaaatgg

SEQ ID NO: 109869 - DNA, 25 bp, Homo sapien
tgtcatataccaatgtcattcttta

SEQ ID NO: 109870 - DNA, 25 bp, Homo sapien
tgtcatataccagtgtcattcttta

SEQ ID NO: 109871 - DNA, 25 bp, Homo sapien
tgtcatattccaactttgtgtttct

SEQ ID NO: 109872 - DNA, 25 bp, Homo sapien
tgtcatattccaattttgtgtttct

SEQ ID NO: 109873 - DNA, 25 bp, Homo sapien
tgtcatcagtagattgctgaaaaat

SEQ ID NO: 109874 - DNA, 25 bp, Homo sapien
tgtcatcagtagattgttgaaaaat

SEQ ID NO: 109875 - DNA, 25 bp, Homo sapien
tgtcatccaatcataacaggacttt

SEQ ID NO: 109876 - DNA, 25 bp, Homo sapien
tgtcatccagtcataacaggacttt

SEQ ID NO: 109877 - DNA, 25 bp, Homo sapien
tgtcatccctttaacaccattacca

SEQ ID NO: 109878 - DNA, 25 bp, Homo sapien
tgtcatccctttaacatcattacca

SEQ ID NO: 109879 - DNA, 25 bp, Homo sapien
tgtcatcctgggaatcaaaatcaga

SEQ ID NO: 109880 - DNA, 25 bp, Homo sapien
tgtcatcctgggagtcaaaatcaga

SEQ ID NO: 109881 - DNA, 25 bp, Homo sapien
tgtcatcgttgaatttccaacatct

SEQ ID NO: 109882 - DNA, 25 bp, Homo sapien
tgtcatcgttgaatttgcaacatct

SEQ ID NO: 109883 - DNA, 25 bp, Homo sapien
tgtcatctgggaagtcaaatgcctc

SEQ ID NO: 109884 - DNA, 25 bp, Homo sapien
tgtcatctgggaagtcgaatgcctc

SEQ ID NO: 109885 - DNA, 25 bp, Homo sapien
tgtcatcttaccctggaagtctcca

SEQ ID NO: 109886 - DNA, 25 bp, Homo sapien
tgtcatcttaccttggaagtctcca

SEQ ID NO: 109887 - DNA, 25 bp, Homo sapien
tgtcatgacacttggtctgtaatag

SEQ ID NO: 109888 - DNA, 25 bp, Homo sapien
tgtcatgacccttggtctgtaatag

SEQ ID NO: 109889 - DNA, 25 bp, Homo sapien
tgtcatgagaaaccctgatagaagg

SEQ ID NO: 109890 - DNA, 25 bp, Homo sapien
tgtcatgagaaaccttgatagaagg

SEQ ID NO: 109891 - DNA, 25 bp, Homo sapien
tgtcatgcaccgagttgatggtctt

SEQ ID NO: 109892 - DNA, 25 bp, Homo sapien
tgtcatgcacctagttgatggtctt

SEQ ID NO: 109893 - DNA, 25 bp, Homo sapien
tgtcatgccaccttgctccctggct

SEQ ID NO: 109894 - DNA, 25 bp, Homo sapien
tgtcatgccgccttgctccctggct

SEQ ID NO: 109895 - DNA, 25 bp, Homo sapien
tgtcatggaagtagagagtagaata

SEQ ID NO: 109896 - DNA, 25 bp, Homo sapien
tgtcatggagctagtgcagtagaca

SEQ ID NO: 109897 - DNA, 25 bp, Homo sapien
tgtcatggagctagtggagtagaca

SEQ ID NO: 109898 - DNA, 25 bp, Homo sapien
tgtcatggatgcgtgtacagggttg

SEQ ID NO: 109899 - DNA, 25 bp, Homo sapien
tgtcatggatgcttgtacagggttg

SEQ ID NO: 109900 - DNA, 25 bp, Homo sapien
tgtcatggatgtagagagtagaata

SEQ ID NO: 109901 - DNA, 25 bp, Homo sapien
tgtcatgtcacgaaaacatctagga

SEQ ID NO: 109902 - DNA, 25 bp, Homo sapien
tgtcatgtcgcgaaaacatctagga

SEQ ID NO: 109903 - DNA, 25 bp, Homo sapien
tgtcatgttaaacattctgtagtta

SEQ ID NO: 109904 - DNA, 25 bp, Homo sapien
tgtcatgttaaacattgtgtagtta

SEQ ID NO: 109905 - DNA, 25 bp, Homo sapien
tgtcattaaaaacgatgccagaagt

SEQ ID NO: 109906 - DNA, 25 bp, Homo sapien
tgtcattaaaaatgatgccagaagt

SEQ ID NO: 109907 - DNA, 25 bp, Homo sapien
tgtcattactttcaaccccatctgt

SEQ ID NO: 109908 - DNA, 25 bp, Homo sapien
tgtcattactttcgaccccatctgt

SEQ ID NO: 109909 - DNA, 25 bp, Homo sapien
tgtcattctcgtacgcctctctaga

SEQ ID NO: 109910 - DNA, 25 bp, Homo sapien
tgtcattctcgtgcgcctctctaga

SEQ ID NO: 109911 - DNA, 25 bp, Homo sapien
tgtcattgcaacagtaaattcaaag

SEQ ID NO: 109912 - DNA, 25 bp, Homo sapien
tgtcattgcaatagtaaattcaaag

SEQ ID NO: 109913 - DNA, 25 bp, Homo sapien
tgtcattgcccaacgtcacactagg

SEQ ID NO: 109914 - DNA, 25 bp, Homo sapien
tgtcattgcccaatgtcacactagg

SEQ ID NO: 109915 - DNA, 25 bp, Homo sapien
tgtcatttccatgttttctatttaa

SEQ ID NO: 109916 - DNA, 25 bp, Homo sapien
tgtcatttccattttttctatttaa

SEQ ID NO: 109917 - DNA, 25 bp, Homo sapien
tgtcatttcgggatgagaagttgta

SEQ ID NO: 109918 - DNA, 25 bp, Homo sapien
tgtcattttgggatgagaagttgta

SEQ ID NO: 109919 - DNA, 25 bp, Homo sapien
tgtccaaaacaaacaaatattgcat

SEQ ID NO: 109920 - DNA, 25 bp, Homo sapien
tgtccaaaacaaccaaatattgcat

SEQ ID NO: 109921 - DNA, 25 bp, Homo sapien
tgtccaaaacaataaaagtagtaac

SEQ ID NO: 109922 - DNA, 25 bp, Homo sapien
tgtccaaaacaataaaggtagtaac

SEQ ID NO: 109923 - DNA, 25 bp, Homo sapien
tgtccaacacgctatgaaggaccaa

SEQ ID NO: 109924 - DNA, 25 bp, Homo sapien
tgtccaacagcacatagttaatatg

SEQ ID NO: 109925 - DNA, 25 bp, Homo sapien
tgtccaacagcacgtagttaatatg

SEQ ID NO: 109926 - DNA, 25 bp, Homo sapien
tgtccaacatgcattctctcattgt

SEQ ID NO: 109927 - DNA, 25 bp, Homo sapien
tgtccaacgcgctatgaaggaccaa

SEQ ID NO: 109928 - DNA, 25 bp, Homo sapien
tgtccaacgtgcattctctcattgt

SEQ ID NO: 109929 - DNA, 25 bp, Homo sapien
tgtccaagattaaacctttctacgc

SEQ ID NO: 109930 - DNA, 25 bp, Homo sapien
tgtccaagattcaacctttctacgc

SEQ ID NO: 109931 - DNA, 25 bp, Homo sapien
tgtccaaggattgccatttattcaa

SEQ ID NO: 109932 - DNA, 25 bp, Homo sapien
tgtccaagggttgccatttattcaa

SEQ ID NO: 109933 - DNA, 25 bp, Homo sapien
tgtccaatacggtatccaccagcca

SEQ ID NO: 109934 - DNA, 25 bp, Homo sapien
tgtccaatacggtgtccaccagcca

SEQ ID NO: 109935 - DNA, 25 bp, Homo sapien
tgtccaatatttatcacgtcttggt

SEQ ID NO: 109936 - DNA, 25 bp, Homo sapien
tgtccaatatttatcatgtcttggt

SEQ ID NO: 109937 - DNA, 25 bp, Homo sapien
tgtccaattgcatcagcaaataatt

SEQ ID NO: 109938 - DNA, 25 bp, Homo sapien
tgtccaattgcatcagtaaataatt

SEQ ID NO: 109939 - DNA, 25 bp, Homo sapien
tgtccacatcaaagacgccatcttc

SEQ ID NO: 109940 - DNA, 25 bp, Homo sapien
tgtccacatcaaggacgccatcttc

SEQ ID NO: 109941 - DNA, 25 bp, Homo sapien
tgtccacatcctgatccccggacct

SEQ ID NO: 109942 - DNA, 25 bp, Homo sapien
tgtccacattctgatccccggacct

SEQ ID NO: 109943 - DNA, 25 bp, Homo sapien
tgtccactttgtgcgccagaattga

SEQ ID NO: 109944 - DNA, 25 bp, Homo sapien
tgtccactttgtgtgccagaattga

SEQ ID NO: 109945 - DNA, 25 bp, Homo sapien
tgtccagaagatataaaactattcc

SEQ ID NO: 109946 - DNA, 25 bp, Homo sapien
tgtccagacttggctaaagaaaaga

SEQ ID NO: 109947 - DNA, 25 bp, Homo sapien
tgtccagaggatataaaactattcc

SEQ ID NO: 109948 - DNA, 25 bp, Homo sapien
tgtccagatttggctaaagaaaaga

SEQ ID NO: 109949 - DNA, 25 bp, Homo sapien
tgtccagctgctatcatcacacact

SEQ ID NO: 109950 - DNA, 25 bp, Homo sapien
tgtccagctgctgtcatcacacact

SEQ ID NO: 109951 - DNA, 25 bp, Homo sapien
tgtccaggacctcaataacacctaa

SEQ ID NO: 109952 - DNA, 25 bp, Homo sapien
tgtccaggacctcattaacacctaa

SEQ ID NO: 109953 - DNA, 25 bp, Homo sapien
tgtccaggagtgccctgtatataag

SEQ ID NO: 109954 - DNA, 25 bp, Homo sapien
tgtccaggagtgctctgtatataag

SEQ ID NO: 109955 - DNA, 25 bp, Homo sapien
tgtccaggcgaacttgtgggaactg

SEQ ID NO: 109956 - DNA, 25 bp, Homo sapien
tgtccaggtgaacttgtgggaactg

SEQ ID NO: 109957 - DNA, 25 bp, Homo sapien
tgtccagtaagagacaaggactgcg

SEQ ID NO: 109958 - DNA, 25 bp, Homo sapien
tgtccagtaggagacaaggactgcg

SEQ ID NO: 109959 - DNA, 25 bp, Homo sapien
tgtccataacatgaattaatactgc

SEQ ID NO: 109960 - DNA, 25 bp, Homo sapien
tgtccataatatgaattaatactgc

SEQ ID NO: 109961 - DNA, 25 bp, Homo sapien
tgtccatagaaagacgatagagata

SEQ ID NO: 109962 - DNA, 25 bp, Homo sapien
tgtccatagaaagatgatagagata

SEQ ID NO: 109963 - DNA, 25 bp, Homo sapien
tgtccatatttccatgtattatact

SEQ ID NO: 109964 - DNA, 25 bp, Homo sapien
tgtccatattttcatgtattatact

SEQ ID NO: 109965 - DNA, 25 bp, Homo sapien
tgtccatgtgacatttgtgggtcag

SEQ ID NO: 109966 - DNA, 25 bp, Homo sapien
tgtccatgtgacttttgtgggtcag

SEQ ID NO: 109967 - DNA, 25 bp, Homo sapien
tgtccattactaaaacaaagcagaa

SEQ ID NO: 109968 - DNA, 25 bp, Homo sapien
tgtccattactcaaacaaagcagaa

SEQ ID NO: 109969 - DNA, 25 bp, Homo sapien
tgtccattataattccatatgttgt

SEQ ID NO: 109970 - DNA, 25 bp, Homo sapien
tgtccattataattccgtatgttgt

SEQ ID NO: 109971 - DNA, 25 bp, Homo sapien
tgtccattctcagggctcaaatgcc

SEQ ID NO: 109972 - DNA, 25 bp, Homo sapien
tgtccattctcagtgctcaaatgcc

SEQ ID NO: 109973 - DNA, 25 bp, Homo sapien
tgtcccaaaccaccagagtgccaca

SEQ ID NO: 109974 - DNA, 25 bp, Homo sapien
tgtcccaaaccagcagagtgccaca

SEQ ID NO: 109975 - DNA, 25 bp, Homo sapien
tgtcccaggcttgtgaaatcctagt

SEQ ID NO: 109976 - DNA, 25 bp, Homo sapien
tgtcccaggcttgtgatatcctagt

SEQ ID NO: 109977 - DNA, 25 bp, Homo sapien
tgtcccatgatgaaaccctagcttg

SEQ ID NO: 109978 - DNA, 25 bp, Homo sapien
tgtcccatgttgaaaccctagcttg

SEQ ID NO: 109979 - DNA, 25 bp, Homo sapien
tgtcccctgaaattcgtatgttgaa

SEQ ID NO: 109980 - DNA, 25 bp, Homo sapien
tgtcccctgaaatttgtatgttgaa

SEQ ID NO: 109981 - DNA, 25 bp, Homo sapien
tgtccccttgccagcgaaaacttgg

SEQ ID NO: 109982 - DNA, 25 bp, Homo sapien
tgtccccttgccagtgaaaacttgg

SEQ ID NO: 109983 - DNA, 25 bp, Homo sapien
tgtcccgtgaaaaagtagaatttat

SEQ ID NO: 109984 - DNA, 25 bp, Homo sapien
tgtcccgtgaaaaattagaatttat

SEQ ID NO: 109985 - DNA, 25 bp, Homo sapien
tgtccctaacaaaaattgcctggca

SEQ ID NO: 109986 - DNA, 25 bp, Homo sapien
tgtccctaacacaaattgcctggca

SEQ ID NO: 109987 - DNA, 25 bp, Homo sapien
tgtccctaggcatgaagccattgca

SEQ ID NO: 109988 - DNA, 25 bp, Homo sapien
tgtccctaggcgtgaagccattgca

SEQ ID NO: 109989 - DNA, 25 bp, Homo sapien
tgtccctatgcaatgagaaagcagg

SEQ ID NO: 109990 - DNA, 25 bp, Homo sapien
tgtccctatgcgatgagaaagcagg

SEQ ID NO: 109991 - DNA, 25 bp, Homo sapien
tgtccctgggataaatcgcacttgg

SEQ ID NO: 109992 - DNA, 25 bp, Homo sapien
tgtccctgggataaattgcacttgg

SEQ ID NO: 109993 - DNA, 25 bp, Homo sapien
tgtcctactgtgaagattttgcctt

SEQ ID NO: 109994 - DNA, 25 bp, Homo sapien
tgtcctactgtgacgattttgcctt

SEQ ID NO: 109995 - DNA, 25 bp, Homo sapien
tgtcctattaaaacaattttggcaa

SEQ ID NO: 109996 - DNA, 25 bp, Homo sapien
tgtcctattaaaagaattttggcaa

SEQ ID NO: 109997 - DNA, 25 bp, Homo sapien
tgtcctcaatatccaattcacggcc

SEQ ID NO: 109998 - DNA, 25 bp, Homo sapien
tgtcctcagatatccgtcctcttta

SEQ ID NO: 109999 - DNA, 25 bp, Homo sapien
tgtcctcagatatctgtcctcttta

SEQ ID NO: 110000 - DNA, 25 bp, Homo sapien
tgtcctcagtatccaattcacggcc

SEQ ID NO: 110001 - DNA, 25 bp, Homo sapien
tgtcctcatgagatcaaagtataaa

SEQ ID NO: 110002 - DNA, 25 bp, Homo sapien
tgtcctcatgagttcaaagtataaa

SEQ ID NO: 110003 - DNA, 25 bp, Homo sapien
tgtcctctatggagttgtgtcacct

SEQ ID NO: 110004 - DNA, 25 bp, Homo sapien
tgtcctctattttgtggcacataat

SEQ ID NO: 110005 - DNA, 25 bp, Homo sapien
tgtcctctattttgtgtcacataat

SEQ ID NO: 110006 - DNA, 25 bp, Homo sapien
tgtcctctccactatgtttctaaaa

SEQ ID NO: 110007 - DNA, 25 bp, Homo sapien
tgtcctctccactgtgtttctaaaa

SEQ ID NO: 110008 - DNA, 25 bp, Homo sapien
tgtcctctgtggagttgtgtcacct

SEQ ID NO: 110009 - DNA, 25 bp, Homo sapien
tgtcctgaaaactcactctcaatac

SEQ ID NO: 110010 - DNA, 25 bp, Homo sapien
tgtcctgacaactcactctcaatac

SEQ ID NO: 110011 - DNA, 25 bp, Homo sapien
tgtcctgccgattgagtatattcat

SEQ ID NO: 110012 - DNA, 25 bp, Homo sapien
tgtcctgccttattggagattctag

SEQ ID NO: 110013 - DNA, 25 bp, Homo sapien
tgtcctgccttatttgagattctag

SEQ ID NO: 110014 - DNA, 25 bp, Homo sapien
tgtcctgctataacttcgtagtcct

SEQ ID NO: 110015 - DNA, 25 bp, Homo sapien
tgtcctgctataactttgtagtcct

SEQ ID NO: 110016 - DNA, 25 bp, Homo sapien
tgtcctgctataagaagatggaaga

SEQ ID NO: 110017 - DNA, 25 bp, Homo sapien
tgtcctgctataataagatggaaga

SEQ ID NO: 110018 - DNA, 25 bp, Homo sapien
tgtcctgctgattgagtatattcat

SEQ ID NO: 110019 - DNA, 25 bp, Homo sapien
tgtcctgttgtaactttagtgaaaa

SEQ ID NO: 110020 - DNA, 25 bp, Homo sapien
tgtcctgttttaactttagtgaaaa

SEQ ID NO: 110021 - DNA, 25 bp, Homo sapien
tgtccttcccggtgtctcaggcttc

SEQ ID NO: 110022 - DNA, 25 bp, Homo sapien
tgtccttcctggtgtctcaggcttc

SEQ ID NO: 110023 - DNA, 25 bp, Homo sapien
tgtccttgaagacctcctggaatgg

SEQ ID NO: 110024 - DNA, 25 bp, Homo sapien
tgtccttgaaggttggtactctgct

SEQ ID NO: 110025 - DNA, 25 bp, Homo sapien
tgtccttgagggttggtactctgct

SEQ ID NO: 110026 - DNA, 25 bp, Homo sapien
tgtccttgcagacctcctggaatgg

SEQ ID NO: 110027 - DNA, 25 bp, Homo sapien
tgtccttgcagagctcctggaatgg

SEQ ID NO: 110028 - DNA, 25 bp, Homo sapien
tgtcctttatttcggcagatgttac

SEQ ID NO: 110029 - DNA, 25 bp, Homo sapien
tgtcctttattttggcagatgttac

SEQ ID NO: 110030 - DNA, 25 bp, Homo sapien
tgtcctttgattcatggaggtactt

SEQ ID NO: 110031 - DNA, 25 bp, Homo sapien
tgtcctttgtttcatggaggtactt

SEQ ID NO: 110032 - DNA, 25 bp, Homo sapien
tgtccttttaaaatctgatctgcaa

SEQ ID NO: 110033 - DNA, 25 bp, Homo sapien
tgtccttttaaagtctgatctgcaa

SEQ ID NO: 110034 - DNA, 25 bp, Homo sapien
tgtccttttgacatacttttattat

SEQ ID NO: 110035 - DNA, 25 bp, Homo sapien
tgtcctttttacatacttttattat

SEQ ID NO: 110036 - DNA, 25 bp, Homo sapien
tgtcgctggacaacgaaacactgca

SEQ ID NO: 110037 - DNA, 25 bp, Homo sapien
tgtcgctggacaatgaaacactgca

SEQ ID NO: 110038 - DNA, 25 bp, Homo sapien
tgtctaaaggcctccaaatcttcaa

SEQ ID NO: 110039 - DNA, 25 bp, Homo sapien
tgtctaaaggcctccacatcttcaa

SEQ ID NO: 110040 - DNA, 25 bp, Homo sapien
tgtctaacacacggcagctgcttac

SEQ ID NO: 110041 - DNA, 25 bp, Homo sapien
tgtctaacacatggcagctgcttac

SEQ ID NO: 110042 - DNA, 25 bp, Homo sapien
tgtctaaccatggctgcttttaagg

SEQ ID NO: 110043 - DNA, 25 bp, Homo sapien
tgtctaaccatggctgtttttaagg

SEQ ID NO: 110044 - DNA, 25 bp, Homo sapien
tgtctaataaagaggaatagctaca

SEQ ID NO: 110045 - DNA, 25 bp, Homo sapien
tgtctaataaagaggagtagctaca

SEQ ID NO: 110046 - DNA, 25 bp, Homo sapien
tgtctaataaagggtcaaggtggag

SEQ ID NO: 110047 - DNA, 25 bp, Homo sapien
tgtctaataaatggtcaaggtggag

SEQ ID NO: 110048 - DNA, 25 bp, Homo sapien
tgtctacactgacaatctgttgttt

SEQ ID NO: 110049 - DNA, 25 bp, Homo sapien
tgtctacatcaacaatcatttgctt

SEQ ID NO: 110050 - DNA, 25 bp, Homo sapien
tgtctacattaacaatcatttgctt

SEQ ID NO: 110051 - DNA, 25 bp, Homo sapien
tgtctacattgacaatctgttgttt

SEQ ID NO: 110052 - DNA, 25 bp, Homo sapien
tgtctactacatcactgcagctgca

SEQ ID NO: 110053 - DNA, 25 bp, Homo sapien
tgtctactacatcgctgcagctgca

SEQ ID NO: 110054 - DNA, 25 bp, Homo sapien
tgtctactatgtaacagataattac

SEQ ID NO: 110055 - DNA, 25 bp, Homo sapien
tgtctactatgtatcagataattac

SEQ ID NO: 110056 - DNA, 25 bp, Homo sapien
tgtctagattggaacccctgcacat

SEQ ID NO: 110057 - DNA, 25 bp, Homo sapien
tgtctagattgggacccctgcacat

SEQ ID NO: 110058 - DNA, 25 bp, Homo sapien
tgtctaggccgcccaaattgctggg

SEQ ID NO: 110059 - DNA, 25 bp, Homo sapien
tgtctaggctgcccaaattgctggg

SEQ ID NO: 110060 - DNA, 25 bp, Homo sapien
tgtctaggttaaacaactcaagtat

SEQ ID NO: 110061 - DNA, 25 bp, Homo sapien
tgtctaggttaagcaactcaagtat

SEQ ID NO: 110062 - DNA, 25 bp, Homo sapien
tgtctagtgaatgagctgagaggtg

SEQ ID NO: 110063 - DNA, 25 bp, Homo sapien
tgtctagtgaatgggctgagaggtg

SEQ ID NO: 110064 - DNA, 25 bp, Homo sapien
tgtctatgctcaacaaatggaagaa

SEQ ID NO: 110065 - DNA, 25 bp, Homo sapien
tgtctatgctcaataaatggaagaa

SEQ ID NO: 110066 - DNA, 25 bp, Homo sapien
tgtctcaagaaataagctgcaaata

SEQ ID NO: 110067 - DNA, 25 bp, Homo sapien
tgtctcaagaaatatgctgcaaata

SEQ ID NO: 110068 - DNA, 25 bp, Homo sapien
tgtctcacagtatagacgctggagc

SEQ ID NO: 110069 - DNA, 25 bp, Homo sapien
tgtctcacagtatagatgctggagc

SEQ ID NO: 110070 - DNA, 25 bp, Homo sapien
tgtctcagaatatactgatgaatgc

SEQ ID NO: 110071 - DNA, 25 bp, Homo sapien
tgtctcagaatatattgatgaatgc

SEQ ID NO: 110072 - DNA, 25 bp, Homo sapien
tgtctcagtcttcatctactttctc

SEQ ID NO: 110073 - DNA, 25 bp, Homo sapien
tgtctcagtcttcgtctactttctc

SEQ ID NO: 110074 - DNA, 25 bp, Homo sapien
tgtctcatacttcttacctttccca

SEQ ID NO: 110075 - DNA, 25 bp, Homo sapien
tgtctcatatttcttacctttccca

SEQ ID NO: 110076 - DNA, 25 bp, Homo sapien
tgtctcatgaatatcacatccaaaa

SEQ ID NO: 110077 - DNA, 25 bp, Homo sapien
tgtctcatgaatatcagatccaaaa

SEQ ID NO: 110078 - DNA, 25 bp, Homo sapien
tgtctcattaaactttggtcagtta

SEQ ID NO: 110079 - DNA, 25 bp, Homo sapien
tgtctcattaaacttttgtcagtta

SEQ ID NO: 110080 - DNA, 25 bp, Homo sapien
tgtctcattttatactcctactaac

SEQ ID NO: 110081 - DNA, 25 bp, Homo sapien
tgtctcattttatactgctactaac

SEQ ID NO: 110082 - DNA, 25 bp, Homo sapien
tgtctccaaggcatatcattgacct

SEQ ID NO: 110083 - DNA, 25 bp, Homo sapien
tgtctccaaggcatgtcattgacct

SEQ ID NO: 110084 - DNA, 25 bp, Homo sapien
tgtctccacaccacagctgtagcct

SEQ ID NO: 110085 - DNA, 25 bp, Homo sapien
tgtctccacacctcagctgtagcct

SEQ ID NO: 110086 - DNA, 25 bp, Homo sapien
tgtctccatttgtgcacgactgttc

SEQ ID NO: 110087 - DNA, 25 bp, Homo sapien
tgtctccatttgtgtacgactgttc

SEQ ID NO: 110088 - DNA, 25 bp, Homo sapien
tgtctccctaggaagtgtaaaagcc

SEQ ID NO: 110089 - DNA, 25 bp, Homo sapien
tgtctccctaggatgtgtaaaagcc

SEQ ID NO: 110090 - DNA, 25 bp, Homo sapien
tgtctccctcaaagcaaggccatta

SEQ ID NO: 110091 - DNA, 25 bp, Homo sapien
tgtctccctcagagcaaggccatta

SEQ ID NO: 110092 - DNA, 25 bp, Homo sapien
tgtctctaattgtcccggttatagc

SEQ ID NO: 110093 - DNA, 25 bp, Homo sapien
tgtctctagtaagccaattcctctc

SEQ ID NO: 110094 - DNA, 25 bp, Homo sapien
tgtctctagtaagccagttcctctc

SEQ ID NO: 110095 - DNA, 25 bp, Homo sapien
tgtctctagttgtcccggttatagc

SEQ ID NO: 110096 - DNA, 25 bp, Homo sapien
tgtctctcacacatataatttttta

SEQ ID NO: 110097 - DNA, 25 bp, Homo sapien
tgtctctcacacgtataatttttta

SEQ ID NO: 110098 - DNA, 25 bp, Homo sapien
tgtctctctctgtatgtttgaatat

SEQ ID NO: 110099 - DNA, 25 bp, Homo sapien
tgtctctctctgtgtgtttgaatat

SEQ ID NO: 110100 - DNA, 25 bp, Homo sapien
tgtctctgtttttatcaggaaagaa

SEQ ID NO: 110101 - DNA, 25 bp, Homo sapien
tgtctctgtttttatcgggaaagaa

SEQ ID NO: 110102 - DNA, 25 bp, Homo sapien
tgtctcttagtttttgctgctgctt

SEQ ID NO: 110103 - DNA, 25 bp, Homo sapien
tgtctcttagtttttggtgctgctt

SEQ ID NO: 110104 - DNA, 25 bp, Homo sapien
tgtctcttcaatctgttggttgttt

SEQ ID NO: 110105 - DNA, 25 bp, Homo sapien
tgtctcttcccatacctcttatcca

SEQ ID NO: 110106 - DNA, 25 bp, Homo sapien
tgtctcttcctcttttctgatttcc

SEQ ID NO: 110107 - DNA, 25 bp, Homo sapien
tgtctcttctcatacctcttatcca

SEQ ID NO: 110108 - DNA, 25 bp, Homo sapien
tgtctcttgaatctgttggttgttt

SEQ ID NO: 110109 - DNA, 25 bp, Homo sapien
tgtctcttgcacccagttcacacag

SEQ ID NO: 110110 - DNA, 25 bp, Homo sapien
tgtctcttgcactcagttcacacag

SEQ ID NO: 110111 - DNA, 25 bp, Homo sapien
tgtctcttgctcttttctgatttcc

SEQ ID NO: 110112 - DNA, 25 bp, Homo sapien
tgtctcttgttcatgttgcaatttg

SEQ ID NO: 110113 - DNA, 25 bp, Homo sapien
tgtctcttgttcattttgcaatttg

SEQ ID NO: 110114 - DNA, 25 bp, Homo sapien
tgtctctttctgaaacatgtatctg

SEQ ID NO: 110115 - DNA, 25 bp, Homo sapien
tgtctctttctggaacatgtatctg

SEQ ID NO: 110116 - DNA, 25 bp, Homo sapien
tgtctcttttttttgaacaactacc

SEQ ID NO: 110117 - DNA, 25 bp, Homo sapien
tgtctcttttttttgagcaactacc

SEQ ID NO: 110118 - DNA, 25 bp, Homo sapien
tgtctgaaaagaaactaagcacgtg

SEQ ID NO: 110119 - DNA, 25 bp, Homo sapien
tgtctgaaaagatactaagcacgtg

SEQ ID NO: 110120 - DNA, 25 bp, Homo sapien
tgtctgaatcgattggcagtaaatg

SEQ ID NO: 110121 - DNA, 25 bp, Homo sapien
tgtctgaattgattggcagtaaatg

SEQ ID NO: 110122 - DNA, 25 bp, Homo sapien
tgtctgagaactccagaagagccta

SEQ ID NO: 110123 - DNA, 25 bp, Homo sapien
tgtctgagaacttcagaagagccta

SEQ ID NO: 110124 - DNA, 25 bp, Homo sapien
tgtctgagactcagaacctcaacag

SEQ ID NO: 110125 - DNA, 25 bp, Homo sapien
tgtctgagattcagaacctcaacag

SEQ ID NO: 110126 - DNA, 25 bp, Homo sapien
tgtctgagtgattattatttatttg

SEQ ID NO: 110127 - DNA, 25 bp, Homo sapien
tgtctgagtgattattctttatttg

SEQ ID NO: 110128 - DNA, 25 bp, Homo sapien
tgtctgatgaatgtactttagaatt

SEQ ID NO: 110129 - DNA, 25 bp, Homo sapien
tgtctgatgaatgtcctttagaatt

SEQ ID NO: 110130 - DNA, 25 bp, Homo sapien
tgtctgatgttccttgcagccctca

SEQ ID NO: 110131 - DNA, 25 bp, Homo sapien
tgtctgatgtttcttgcagccctca

SEQ ID NO: 110132 - DNA, 25 bp, Homo sapien
tgtctgatttttgtgctgtaaagtg

SEQ ID NO: 110133 - DNA, 25 bp, Homo sapien
tgtctgatttttgttctgtaaagtg

SEQ ID NO: 110134 - DNA, 25 bp, Homo sapien
tgtctgcaaatagacataagaatct

SEQ ID NO: 110135 - DNA, 25 bp, Homo sapien
tgtctgcacatagacataagaatct

SEQ ID NO: 110136 - DNA, 25 bp, Homo sapien
tgtctgccatcaggagataataaaa

SEQ ID NO: 110137 - DNA, 25 bp, Homo sapien
tgtctgccatcaggagttaataaaa

SEQ ID NO: 110138 - DNA, 25 bp, Homo sapien
tgtctgcccctccataaattgcctt

SEQ ID NO: 110139 - DNA, 25 bp, Homo sapien
tgtctgcccctctataaattgcctt

SEQ ID NO: 110140 - DNA, 25 bp, Homo sapien
tgtctgcctgaacgagccatgtaaa

SEQ ID NO: 110141 - DNA, 25 bp, Homo sapien
tgtctgcctgaacgagtcatgtaaa

SEQ ID NO: 110142 - DNA, 25 bp, Homo sapien
tgtctgctaacaaaatgtcggtgac

SEQ ID NO: 110143 - DNA, 25 bp, Homo sapien
tgtctgctaatacattcttcagccc

SEQ ID NO: 110144 - DNA, 25 bp, Homo sapien
tgtctgctaatatattcttcagccc

SEQ ID NO: 110145 - DNA, 25 bp, Homo sapien
tgtctgctaccaaaatgtcggtgac

SEQ ID NO: 110146 - DNA, 25 bp, Homo sapien
tgtctggcacagaacaagcactcgg

SEQ ID NO: 110147 - DNA, 25 bp, Homo sapien
tgtctggcacagcacaagcactcgg

SEQ ID NO: 110148 - DNA, 25 bp, Homo sapien
tgtctggtaaatgctgaccatttgt

SEQ ID NO: 110149 - DNA, 25 bp, Homo sapien
tgtctggtaaatgttgaccatttgt

SEQ ID NO: 110150 - DNA, 25 bp, Homo sapien
tgtctggtgagctagtttgtataaa

SEQ ID NO: 110151 - DNA, 25 bp, Homo sapien
tgtctggtgagcttgtttgtataaa

SEQ ID NO: 110152 - DNA, 25 bp, Homo sapien
tgtctggtgatcattatttgcctga

SEQ ID NO: 110153 - DNA, 25 bp, Homo sapien
tgtctggtgatgattatttgcctga

SEQ ID NO: 110154 - DNA, 25 bp, Homo sapien
tgtctggtttctatcacttagcacc

SEQ ID NO: 110155 - DNA, 25 bp, Homo sapien
tgtctggtttctgtcacttagcacc

SEQ ID NO: 110156 - DNA, 25 bp, Homo sapien
tgtctggttttgacaatcatagtat

SEQ ID NO: 110157 - DNA, 25 bp, Homo sapien
tgtctggttttggcaatcatagtat

SEQ ID NO: 110158 - DNA, 25 bp, Homo sapien
tgtctgtacaacccttttgaatgga

SEQ ID NO: 110159 - DNA, 25 bp, Homo sapien
tgtctgtagcagaatattttaattg

SEQ ID NO: 110160 - DNA, 25 bp, Homo sapien
tgtctgtagcagagtattttaattg

SEQ ID NO: 110161 - DNA, 25 bp, Homo sapien
tgtctgtataacccttttgaatgga

SEQ ID NO: 110162 - DNA, 25 bp, Homo sapien
tgtctgtatgttaactactttgtca

SEQ ID NO: 110163 - DNA, 25 bp, Homo sapien
tgtctgtattttaactactttgtca

SEQ ID NO: 110164 - DNA, 25 bp, Homo sapien
tgtctgtcacgaacccagtcagcct

SEQ ID NO: 110165 - DNA, 25 bp, Homo sapien
tgtctgtcatgaacccagtcagcct

SEQ ID NO: 110166 - DNA, 25 bp, Homo sapien
tgtctgtccaacacgctatgaagga

SEQ ID NO: 110167 - DNA, 25 bp, Homo sapien
tgtctgtccaacgcgctatgaagga

SEQ ID NO: 110168 - DNA, 25 bp, Homo sapien
tgtctgtgagaagaagcctgaaggg

SEQ ID NO: 110169 - DNA, 25 bp, Homo sapien
tgtctgtgagaagaaggctgaaggg

SEQ ID NO: 110170 - DNA, 25 bp, Homo sapien
tgtcttaaacttttgatatgaggcc

SEQ ID NO: 110171 - DNA, 25 bp, Homo sapien
tgtcttaatcttttgatatgaggcc

SEQ ID NO: 110172 - DNA, 25 bp, Homo sapien
tgtcttaattatcgtagctatatag

SEQ ID NO: 110173 - DNA, 25 bp, Homo sapien
tgtcttaattattgtagctatatag

SEQ ID NO: 110174 - DNA, 25 bp, Homo sapien
tgtcttagtgacgatttttcttgtg

SEQ ID NO: 110175 - DNA, 25 bp, Homo sapien
tgtcttagtgatgatttttcttgtg

SEQ ID NO: 110176 - DNA, 25 bp, Homo sapien
tgtcttatatggcatgcttctgtga

SEQ ID NO: 110177 - DNA, 25 bp, Homo sapien
tgtcttatggtgaaagcagatgaaa

SEQ ID NO: 110178 - DNA, 25 bp, Homo sapien
tgtcttatggtgaaaggagatgaaa

SEQ ID NO: 110179 - DNA, 25 bp, Homo sapien
tgtcttatgtggcatgcttctgtga

SEQ ID NO: 110180 - DNA, 25 bp, Homo sapien
tgtcttattatccaattgttttgat

SEQ ID NO: 110181 - DNA, 25 bp, Homo sapien
tgtcttattatccagttgttttgat

SEQ ID NO: 110182 - DNA, 25 bp, Homo sapien
tgtcttcaaaacatctgcattaagt

SEQ ID NO: 110183 - DNA, 25 bp, Homo sapien
tgtcttcaaaacgtctgcattaagt

SEQ ID NO: 110184 - DNA, 25 bp, Homo sapien
tgtcttccaaatcttgagtgacttc

SEQ ID NO: 110185 - DNA, 25 bp, Homo sapien
tgtcttccacatcttgagtgacttc

SEQ ID NO: 110186 - DNA, 25 bp, Homo sapien
tgtcttccatttgcattttaaatag

SEQ ID NO: 110187 - DNA, 25 bp, Homo sapien
tgtcttccgtttgcattttaaatag

SEQ ID NO: 110188 - DNA, 25 bp, Homo sapien
tgtcttcctaatctgaaaaatcttt

SEQ ID NO: 110189 - DNA, 25 bp, Homo sapien
tgtcttcctaatctgagaaatcttt

SEQ ID NO: 110190 - DNA, 25 bp, Homo sapien
tgtcttcgctgtgcagataaggaac

SEQ ID NO: 110191 - DNA, 25 bp, Homo sapien
tgtcttcgttgtgcagataaggaac

SEQ ID NO: 110192 - DNA, 25 bp, Homo sapien
tgtcttctacaatattctatgtcat

SEQ ID NO: 110193 - DNA, 25 bp, Homo sapien
tgtcttctacaatattttatgtcat

SEQ ID NO: 110194 - DNA, 25 bp, Homo sapien
tgtcttctaccacctgtatcatttt

SEQ ID NO: 110195 - DNA, 25 bp, Homo sapien
tgtcttctaccgcctgtatcatttt

SEQ ID NO: 110196 - DNA, 25 bp, Homo sapien
tgtcttctagcacatggggcagtga

SEQ ID NO: 110197 - DNA, 25 bp, Homo sapien
tgtcttctagcgcatggggcagtga

SEQ ID NO: 110198 - DNA, 25 bp, Homo sapien
tgtcttctctggaaatgtgtctgta

SEQ ID NO: 110199 - DNA, 25 bp, Homo sapien
tgtcttctttggaaatgtgtctgta

SEQ ID NO: 110200 - DNA, 25 bp, Homo sapien
tgtcttggccccagattttgttaac

SEQ ID NO: 110201 - DNA, 25 bp, Homo sapien
tgtcttggctccagattttgttaac

SEQ ID NO: 110202 - DNA, 25 bp, Homo sapien
tgtcttgtgtggataagttttcaat

SEQ ID NO: 110203 - DNA, 25 bp, Homo sapien
tgtcttgtgtggataatttttcaat

SEQ ID NO: 110204 - DNA, 25 bp, Homo sapien
tgtctttaactcaagtatagtaata

SEQ ID NO: 110205 - DNA, 25 bp, Homo sapien
tgtctttaactcaggtatagtaata

SEQ ID NO: 110206 - DNA, 25 bp, Homo sapien
tgtctttaccttcatcctgcaatta

SEQ ID NO: 110207 - DNA, 25 bp, Homo sapien
tgtctttacctttatcctgcaatta

SEQ ID NO: 110208 - DNA, 25 bp, Homo sapien
tgtctttagctttcaaagtagatct

SEQ ID NO: 110209 - DNA, 25 bp, Homo sapien
tgtctttagctttgaaagtagatct

SEQ ID NO: 110210 - DNA, 25 bp, Homo sapien
tgtctttcacaattgcctagaaacc

SEQ ID NO: 110211 - DNA, 25 bp, Homo sapien
tgtctttcataattgcctagaaacc

SEQ ID NO: 110212 - DNA, 25 bp, Homo sapien
tgtctttccagaaggcttcccaagg

SEQ ID NO: 110213 - DNA, 25 bp, Homo sapien
tgtctttccagaagtcttcccaagg

SEQ ID NO: 110214 - DNA, 25 bp, Homo sapien
tgtctttcgtccagccaggcttatg

SEQ ID NO: 110215 - DNA, 25 bp, Homo sapien
tgtctttcgtctagccaggcttatg

SEQ ID NO: 110216 - DNA, 25 bp, Homo sapien
tgtctttgaaacaacagagatacca

SEQ ID NO: 110217 - DNA, 25 bp, Homo sapien
tgtctttgaaacaatagagatacca

SEQ ID NO: 110218 - DNA, 25 bp, Homo sapien
tgtctttggacattttcacctttaa

SEQ ID NO: 110219 - DNA, 25 bp, Homo sapien
tgtctttggacgttttcacctttaa

SEQ ID NO: 110220 - DNA, 25 bp, Homo sapien
tgtcttttgctggttaatgagatga

SEQ ID NO: 110221 - DNA, 25 bp, Homo sapien
tgtcttttgcttgttaatgagatga

SEQ ID NO: 110222 - DNA, 25 bp, Homo sapien
tgtgaaaaaatagatggaaggagat

SEQ ID NO: 110223 - DNA, 25 bp, Homo sapien
tgtgaaaaattgtgcgaaattaata

SEQ ID NO: 110224 - DNA, 25 bp, Homo sapien
tgtgaaaaattgtgtgaaattaata

SEQ ID NO: 110225 - DNA, 25 bp, Homo sapien
tgtgaaaagactacagtggcttagc

SEQ ID NO: 110226 - DNA, 25 bp, Homo sapien
tgtgaaaagactagagtggcttagc

SEQ ID NO: 110227 - DNA, 25 bp, Homo sapien
tgtgaaaagatagatggaaggagat

SEQ ID NO: 110228 - DNA, 25 bp, Homo sapien
tgtgaaaaggtgggaagacttgcaa

SEQ ID NO: 110229 - DNA, 25 bp, Homo sapien
tgtgaaaagttgggaagacttgcaa

SEQ ID NO: 110230 - DNA, 25 bp, Homo sapien
tgtgaaacatattaccatcatattg

SEQ ID NO: 110231 - DNA, 25 bp, Homo sapien
tgtgaaacatattatcatcatattg

SEQ ID NO: 110232 - DNA, 25 bp, Homo sapien
tgtgaaaggtagcatcatcaaaaca

SEQ ID NO: 110233 - DNA, 25 bp, Homo sapien
tgtgaaaggtagcgtcatcaaaaca

SEQ ID NO: 110234 - DNA, 25 bp, Homo sapien
tgtgaaagtctttcgattgtttcca

SEQ ID NO: 110235 - DNA, 25 bp, Homo sapien
tgtgaaagtcttttgattgtttcca

SEQ ID NO: 110236 - DNA, 25 bp, Homo sapien
tgtgaaagttgtatgaaattatatg

SEQ ID NO: 110237 - DNA, 25 bp, Homo sapien
tgtgaaagttgtatgagattatatg

SEQ ID NO: 110238 - DNA, 25 bp, Homo sapien
tgtgaaataagactgagcttttgtc

SEQ ID NO: 110239 - DNA, 25 bp, Homo sapien
tgtgaaataggactgagcttttgtc

SEQ ID NO: 110240 - DNA, 25 bp, Homo sapien
tgtgaaatatggcagtttgcatgat

SEQ ID NO: 110241 - DNA, 25 bp, Homo sapien
tgtgaaatatggcggtttgcatgat

SEQ ID NO: 110242 - DNA, 25 bp, Homo sapien
tgtgaaatctcaacctaggagcagg

SEQ ID NO: 110243 - DNA, 25 bp, Homo sapien
tgtgaaatctcaacgtaggagcagg

SEQ ID NO: 110244 - DNA, 25 bp, Homo sapien
tgtgaaatgacccaaaagataagag

SEQ ID NO: 110245 - DNA, 25 bp, Homo sapien
tgtgaaatgaccgaaaagataagag

SEQ ID NO: 110246 - DNA, 25 bp, Homo sapien
tgtgaaatttgaccactaatgcaat

SEQ ID NO: 110247 - DNA, 25 bp, Homo sapien
tgtgaaatttgatcactaatgcaat

SEQ ID NO: 110248 - DNA, 25 bp, Homo sapien
tgtgaacaaaattaaccctgtgtgt

SEQ ID NO: 110249 - DNA, 25 bp, Homo sapien
tgtgaacaaaattaactctgtgtgt

SEQ ID NO: 110250 - DNA, 25 bp, Homo sapien
tgtgaacagcatcagcaacgagttg

SEQ ID NO: 110251 - DNA, 25 bp, Homo sapien
tgtgaacagcatcggcaacgagttg

SEQ ID NO: 110252 - DNA, 25 bp, Homo sapien
tgtgaacatcatcaaacagattttt

SEQ ID NO: 110253 - DNA, 25 bp, Homo sapien
tgtgaacatcattaaacagattttt

SEQ ID NO: 110254 - DNA, 25 bp, Homo sapien
tgtgaacattttatcttaaatggta

SEQ ID NO: 110255 - DNA, 25 bp, Homo sapien
tgtgaacattttgtcttaaatggta

SEQ ID NO: 110256 - DNA, 25 bp, Homo sapien
tgtgaactgaccttcccattcctga

SEQ ID NO: 110257 - DNA, 25 bp, Homo sapien
tgtgaactgacctttccattcctga

SEQ ID NO: 110258 - DNA, 25 bp, Homo sapien
tgtgaagaagctcagacaatctgtg

SEQ ID NO: 110259 - DNA, 25 bp, Homo sapien
tgtgaagaagctctgacaatctgtg

SEQ ID NO: 110260 - DNA, 25 bp, Homo sapien
tgtgaagaattcagtgcagatattc

SEQ ID NO: 110261 - DNA, 25 bp, Homo sapien
tgtgaagaattcagtgtagatattc

SEQ ID NO: 110262 - DNA, 25 bp, Homo sapien
tgtgaagccatactatcaataggag

SEQ ID NO: 110263 - DNA, 25 bp, Homo sapien
tgtgaagccatactgtcaataggag

SEQ ID NO: 110264 - DNA, 25 bp, Homo sapien
tgtgaaggacagcatcacaggttat

SEQ ID NO: 110265 - DNA, 25 bp, Homo sapien
tgtgaaggacagtatcacaggttat

SEQ ID NO: 110266 - DNA, 25 bp, Homo sapien
tgtgaaggttgagtaccgatactgg

SEQ ID NO: 110267 - DNA, 25 bp, Homo sapien
tgtgaaggttgagtacggatactgg

SEQ ID NO: 110268 - DNA, 25 bp, Homo sapien
tgtgaatactacataagtgagtacg

SEQ ID NO: 110269 - DNA, 25 bp, Homo sapien
tgtgaataggaagggctctctgtga

SEQ ID NO: 110270 - DNA, 25 bp, Homo sapien
tgtgaataggaaggtctctctgtga

SEQ ID NO: 110271 - DNA, 25 bp, Homo sapien
tgtgaatattacataagtgagtacg

SEQ ID NO: 110272 - DNA, 25 bp, Homo sapien
tgtgaatgaagaaacatttaagatt

SEQ ID NO: 110273 - DNA, 25 bp, Homo sapien
tgtgaatgaagagacatttaagatt

SEQ ID NO: 110274 - DNA, 25 bp, Homo sapien
tgtgaatgacaatagcacagagatg

SEQ ID NO: 110275 - DNA, 25 bp, Homo sapien
tgtgaatgagaacttccaaattaac

SEQ ID NO: 110276 - DNA, 25 bp, Homo sapien
tgtgaatgagaatagcacagagatg

SEQ ID NO: 110277 - DNA, 25 bp, Homo sapien
tgtgaatgagaatttccaaattaac

SEQ ID NO: 110278 - DNA, 25 bp, Homo sapien
tgtgaatgcatagaaattaatcaga

SEQ ID NO: 110279 - DNA, 25 bp, Homo sapien
tgtgaatgcgtagaaattaatcaga

SEQ ID NO: 110280 - DNA, 25 bp, Homo sapien
tgtgaatgctttatagttagttgag

SEQ ID NO: 110281 - DNA, 25 bp, Homo sapien
tgtgaatgctttctagttagttgag

SEQ ID NO: 110282 - DNA, 25 bp, Homo sapien
tgtgaattccgatttgaggatttat

SEQ ID NO: 110283 - DNA, 25 bp, Homo sapien
tgtgaattctacaaacccttgttgt

SEQ ID NO: 110284 - DNA, 25 bp, Homo sapien
tgtgaattctacagacccttgttgt

SEQ ID NO: 110285 - DNA, 25 bp, Homo sapien
tgtgaattctgatttgaggatttat

SEQ ID NO: 110286 - DNA, 25 bp, Homo sapien
tgtgacaaaagaaaagaattgataa

SEQ ID NO: 110287 - DNA, 25 bp, Homo sapien
tgtgacaaaggaaaagaattgataa

SEQ ID NO: 110288 - DNA, 25 bp, Homo sapien
tgtgacactcaagttttagcaaaca

SEQ ID NO: 110289 - DNA, 25 bp, Homo sapien
tgtgacactcaggttttagcaaaca

SEQ ID NO: 110290 - DNA, 25 bp, Homo sapien
tgtgacagcaagctctaatcacaca

SEQ ID NO: 110291 - DNA, 25 bp, Homo sapien
tgtgacagcaatctctaatcacaca

SEQ ID NO: 110292 - DNA, 25 bp, Homo sapien
tgtgacattttacggactgctaagc

SEQ ID NO: 110293 - DNA, 25 bp, Homo sapien
tgtgacattttatggactgctaagc

SEQ ID NO: 110294 - DNA, 25 bp, Homo sapien
tgtgaccaacgctagacaaacatag

SEQ ID NO: 110295 - DNA, 25 bp, Homo sapien
tgtgaccaacgctggacaaacatag

SEQ ID NO: 110296 - DNA, 25 bp, Homo sapien
tgtgaccatacatttaaaaacaaaa

SEQ ID NO: 110297 - DNA, 25 bp, Homo sapien
tgtgaccatacgtttaaaaacaaaa

SEQ ID NO: 110298 - DNA, 25 bp, Homo sapien
tgtgaccatcataccgtggtttgac

SEQ ID NO: 110299 - DNA, 25 bp, Homo sapien
tgtgaccatcatactgtggtttgac

SEQ ID NO: 110300 - DNA, 25 bp, Homo sapien
tgtgaccattttcctgggccagggg

SEQ ID NO: 110301 - DNA, 25 bp, Homo sapien
tgtgaccatttttctgggccagggg

SEQ ID NO: 110302 - DNA, 25 bp, Homo sapien
tgtgaccttgcctcgtcagtgttct

SEQ ID NO: 110303 - DNA, 25 bp, Homo sapien
tgtgaccttgccttgtcagtgttct

SEQ ID NO: 110304 - DNA, 25 bp, Homo sapien
tgtgactaagatgatacccaagttg

SEQ ID NO: 110305 - DNA, 25 bp, Homo sapien
tgtgactaagatggtacccaagttg

SEQ ID NO: 110306 - DNA, 25 bp, Homo sapien
tgtgactacagaacatttttcgtga

SEQ ID NO: 110307 - DNA, 25 bp, Homo sapien
tgtgactatagaacatttttcgtga

SEQ ID NO: 110308 - DNA, 25 bp, Homo sapien
tgtgactcaataacatgaacaacat

SEQ ID NO: 110309 - DNA, 25 bp, Homo sapien
tgtgactcaatcacatgaacaacat

SEQ ID NO: 110310 - DNA, 25 bp, Homo sapien
tgtgactcatttgcatatcggagac

SEQ ID NO: 110311 - DNA, 25 bp, Homo sapien
tgtgactccaagctagttccctcat

SEQ ID NO: 110312 - DNA, 25 bp, Homo sapien
tgtgactccgagctagttccctcat

SEQ ID NO: 110313 - DNA, 25 bp, Homo sapien
tgtgactcgtttgcatatcggagac

SEQ ID NO: 110314 - DNA, 25 bp, Homo sapien
tgtgactgttccataagttatgtat

SEQ ID NO: 110315 - DNA, 25 bp, Homo sapien
tgtgactgttccgtaagttatgtat

SEQ ID NO: 110316 - DNA, 25 bp, Homo sapien
tgtgacttataaataatgctttatg

SEQ ID NO: 110317 - DNA, 25 bp, Homo sapien
tgtgacttatagataatgctttatg

SEQ ID NO: 110318 - DNA, 25 bp, Homo sapien
tgtgacttatcttaaacagcatcta

SEQ ID NO: 110319 - DNA, 25 bp, Homo sapien
tgtgacttatcttagacagcatcta

SEQ ID NO: 110320 - DNA, 25 bp, Homo sapien
tgtgacttcagccaaatcacttgta

SEQ ID NO: 110321 - DNA, 25 bp, Homo sapien
tgtgacttcggccaaatcacttgta

SEQ ID NO: 110322 - DNA, 25 bp, Homo sapien
tgtgacttctcttagggagcacact

SEQ ID NO: 110323 - DNA, 25 bp, Homo sapien
tgtgacttctcttatggagcacact

SEQ ID NO: 110324 - DNA, 25 bp, Homo sapien
tgtgacttgttatttttctttttta

SEQ ID NO: 110325 - DNA, 25 bp, Homo sapien
tgtgacttgttcttttactttttta

SEQ ID NO: 110326 - DNA, 25 bp, Homo sapien
tgtgacttgttctttttctttttta

SEQ ID NO: 110327 - DNA, 25 bp, Homo sapien
tgtgactttcgctgattcaagttag

SEQ ID NO: 110328 - DNA, 25 bp, Homo sapien
tgtgacttttgcaatgtgttgattc

SEQ ID NO: 110329 - DNA, 25 bp, Homo sapien
tgtgacttttgccatgtgttgattc

SEQ ID NO: 110330 - DNA, 25 bp, Homo sapien
tgtgacttttgctgattcaagttag

SEQ ID NO: 110331 - DNA, 25 bp, Homo sapien
tgtgagaagaagcctgaagggtgag

SEQ ID NO: 110332 - DNA, 25 bp, Homo sapien
tgtgagaagaaggctgaagggtgag

SEQ ID NO: 110333 - DNA, 25 bp, Homo sapien
tgtgagagctgcttcagaactgtgt

SEQ ID NO: 110334 - DNA, 25 bp, Homo sapien
tgtgagagctgcttgagaactgtgt

SEQ ID NO: 110335 - DNA, 25 bp, Homo sapien
tgtgagaggaaacctggcatgagct

SEQ ID NO: 110336 - DNA, 25 bp, Homo sapien
tgtgagaggaaagctggcatgagct

SEQ ID NO: 110337 - DNA, 25 bp, Homo sapien
tgtgagataagtctgcaaactgaat

SEQ ID NO: 110338 - DNA, 25 bp, Homo sapien
tgtgagatcagtctgcaaactgaat

SEQ ID NO: 110339 - DNA, 25 bp, Homo sapien
tgtgagcaaaggatcgagtggaagg

SEQ ID NO: 110340 - DNA, 25 bp, Homo sapien
tgtgagcaaaggatggagtggaagg

SEQ ID NO: 110341 - DNA, 25 bp, Homo sapien
tgtgagcatggtcatggatcctaag

SEQ ID NO: 110342 - DNA, 25 bp, Homo sapien
tgtgagcatggttatggatcctaag

SEQ ID NO: 110343 - DNA, 25 bp, Homo sapien
tgtgagcatggttctatgaaggatt

SEQ ID NO: 110344 - DNA, 25 bp, Homo sapien
tgtgagcatggttttatgaaggatt

SEQ ID NO: 110345 - DNA, 25 bp, Homo sapien
tgtgagccagaagatttttaatggg

SEQ ID NO: 110346 - DNA, 25 bp, Homo sapien
tgtgagccagaaggtttttaatggg

SEQ ID NO: 110347 - DNA, 25 bp, Homo sapien
tgtgagcgtctcactttccttttcc

SEQ ID NO: 110348 - DNA, 25 bp, Homo sapien
tgtgagcgtctcgctttccttttcc

SEQ ID NO: 110349 - DNA, 25 bp, Homo sapien
tgtgagctacgactctggaaaatct

SEQ ID NO: 110350 - DNA, 25 bp, Homo sapien
tgtgagctatgactctggaaaatct

SEQ ID NO: 110351 - DNA, 25 bp, Homo sapien
tgtgaggaaaggatgcatttggtat

SEQ ID NO: 110352 - DNA, 25 bp, Homo sapien
tgtgaggaagggatgcatttggtat

SEQ ID NO: 110353 - DNA, 25 bp, Homo sapien
tgtgaggacaacaatttgttttttt

SEQ ID NO: 110354 - DNA, 25 bp, Homo sapien
tgtgaggacaataatttgttttttt

SEQ ID NO: 110355 - DNA, 25 bp, Homo sapien
tgtgaggacataacaggaaaaggcc

SEQ ID NO: 110356 - DNA, 25 bp, Homo sapien
tgtgaggacataccaggaaaaggcc

SEQ ID NO: 110357 - DNA, 25 bp, Homo sapien
tgtgaggataagcaagaaaaaagtg

SEQ ID NO: 110358 - DNA, 25 bp, Homo sapien
tgtgaggatcattaactgtccagaa

SEQ ID NO: 110359 - DNA, 25 bp, Homo sapien
tgtgaggatcattcactgtccagaa

SEQ ID NO: 110360 - DNA, 25 bp, Homo sapien
tgtgaggatgagcaagaaaaaagtg

SEQ ID NO: 110361 - DNA, 25 bp, Homo sapien
tgtgaggattggaatagaatatggg

SEQ ID NO: 110362 - DNA, 25 bp, Homo sapien
tgtgaggattggcatagaatatggg

SEQ ID NO: 110363 - DNA, 25 bp, Homo sapien
tgtgaggcactgccaagtcgcattg

SEQ ID NO: 110364 - DNA, 25 bp, Homo sapien
tgtgaggcattgccaagtcgcattg

SEQ ID NO: 110365 - DNA, 25 bp, Homo sapien
tgtgagggacctaggctgtgctcct

SEQ ID NO: 110366 - DNA, 25 bp, Homo sapien
tgtgagggacctagtctgtgctcct

SEQ ID NO: 110367 - DNA, 25 bp, Homo sapien
tgtgagggactaaaaaaacctgagt

SEQ ID NO: 110368 - DNA, 25 bp, Homo sapien
tgtgagggattaaaaaaacctgagt

SEQ ID NO: 110369 - DNA, 25 bp, Homo sapien
tgtgaggtagctgacatcatggtgt

SEQ ID NO: 110370 - DNA, 25 bp, Homo sapien
tgtgaggtagctgccatcatggtgt

SEQ ID NO: 110371 - DNA, 25 bp, Homo sapien
tgtgaggtccaaattattatttcca

SEQ ID NO: 110372 - DNA, 25 bp, Homo sapien
tgtgaggtccagattattatttcca

SEQ ID NO: 110373 - DNA, 25 bp, Homo sapien
tgtgagtaatcaaacagttgataaa

SEQ ID NO: 110374 - DNA, 25 bp, Homo sapien
tgtgagtaatcagacagttgataaa

SEQ ID NO: 110375 - DNA, 25 bp, Homo sapien
tgtgagtacaaataaaatcacagag

SEQ ID NO: 110376 - DNA, 25 bp, Homo sapien
tgtgagtagaacgtcacttgatcct

SEQ ID NO: 110377 - DNA, 25 bp, Homo sapien
tgtgagtagaacgttacttgatcct

SEQ ID NO: 110378 - DNA, 25 bp, Homo sapien
tgtgagtagaggtacaacatagcaa

SEQ ID NO: 110379 - DNA, 25 bp, Homo sapien
tgtgagtagaggtataacatagcaa

SEQ ID NO: 110380 - DNA, 25 bp, Homo sapien
tgtgagtagttacagcagtgaaaca

SEQ ID NO: 110381 - DNA, 25 bp, Homo sapien
tgtgagtagttatagcagtgaaaca

SEQ ID NO: 110382 - DNA, 25 bp, Homo sapien
tgtgagtataaataaaatcacagag

SEQ ID NO: 110383 - DNA, 25 bp, Homo sapien
tgtgagtattccggagacatggcct

SEQ ID NO: 110384 - DNA, 25 bp, Homo sapien
tgtgagtattctggagacatggcct

SEQ ID NO: 110385 - DNA, 25 bp, Homo sapien
tgtgagttctctagccacctctcat

SEQ ID NO: 110386 - DNA, 25 bp, Homo sapien
tgtgagttctctagcctcctctcat

SEQ ID NO: 110387 - DNA, 25 bp, Homo sapien
tgtgagtttccatttaatagttttc

SEQ ID NO: 110388 - DNA, 25 bp, Homo sapien
tgtgagttttcatttaatagttttc

SEQ ID NO: 110389 - DNA, 25 bp, Homo sapien
tgtgataaaaacagtcatagaatgg

SEQ ID NO: 110390 - DNA, 25 bp, Homo sapien
tgtgataaaaacagtcgtagaatgg

SEQ ID NO: 110391 - DNA, 25 bp, Homo sapien
tgtgataaccaaatacatctccaga

SEQ ID NO: 110392 - DNA, 25 bp, Homo sapien
tgtgataaccaaatacgtctccaga

SEQ ID NO: 110393 - DNA, 25 bp, Homo sapien
tgtgataccacacgggactcattat

SEQ ID NO: 110394 - DNA, 25 bp, Homo sapien
tgtgataccgcacgggactcattat

SEQ ID NO: 110395 - DNA, 25 bp, Homo sapien
tgtgatagagtagtgaagaatttaa

SEQ ID NO: 110396 - DNA, 25 bp, Homo sapien
tgtgatagatatcacaatactcaca

SEQ ID NO: 110397 - DNA, 25 bp, Homo sapien
tgtgatagatatcagaatactcaca

SEQ ID NO: 110398 - DNA, 25 bp, Homo sapien
tgtgatagattagtgaagaatttaa

SEQ ID NO: 110399 - DNA, 25 bp, Homo sapien
tgtgatatgtttgttatgtatatgt

SEQ ID NO: 110400 - DNA, 25 bp, Homo sapien
tgtgatatttttgttatgtatatgt

SEQ ID NO: 110401 - DNA, 25 bp, Homo sapien
tgtgatcaaataatcctcacgtata

SEQ ID NO: 110402 - DNA, 25 bp, Homo sapien
tgtgatcaaatagtcctcacgtata

SEQ ID NO: 110403 - DNA, 25 bp, Homo sapien
tgtgatcagcactaacaccacatac

SEQ ID NO: 110404 - DNA, 25 bp, Homo sapien
tgtgatcagcactaacgccacatac

SEQ ID NO: 110405 - DNA, 25 bp, Homo sapien
tgtgatctctaccactattttggag

SEQ ID NO: 110406 - DNA, 25 bp, Homo sapien
tgtgatctctactactattttggag

SEQ ID NO: 110407 - DNA, 25 bp, Homo sapien
tgtgatgacaccacttgatcaaacc

SEQ ID NO: 110408 - DNA, 25 bp, Homo sapien
tgtgatgacaccgcttgatcaaacc

SEQ ID NO: 110409 - DNA, 25 bp, Homo sapien
tgtgatgaccgggaaatttaagagc

SEQ ID NO: 110410 - DNA, 25 bp, Homo sapien
tgtgatgacgagaggagaaggaagt

SEQ ID NO: 110411 - DNA, 25 bp, Homo sapien
tgtgatgactgggaaatttaagagc

SEQ ID NO: 110412 - DNA, 25 bp, Homo sapien
tgtgatgatgagaggagaaggaagt

SEQ ID NO: 110413 - DNA, 25 bp, Homo sapien
tgtgatgctcttcaaattcagaact

SEQ ID NO: 110414 - DNA, 25 bp, Homo sapien
tgtgatgctcttccaattcagaact

SEQ ID NO: 110415 - DNA, 25 bp, Homo sapien
tgtgatggcaaaattctccttcagt

SEQ ID NO: 110416 - DNA, 25 bp, Homo sapien
tgtgatggccaaattctccttcagt

SEQ ID NO: 110417 - DNA, 25 bp, Homo sapien
tgtgatgggttacgttaattgtttt

SEQ ID NO: 110418 - DNA, 25 bp, Homo sapien
tgtgatgggttatgttaattgtttt

SEQ ID NO: 110419 - DNA, 25 bp, Homo sapien
tgtgatgttccaatgaaaacagaca

SEQ ID NO: 110420 - DNA, 25 bp, Homo sapien
tgtgatgttccagtgaaaacagaca

SEQ ID NO: 110421 - DNA, 25 bp, Homo sapien
tgtgatgtttgatatggacgtgaag

SEQ ID NO: 110422 - DNA, 25 bp, Homo sapien
tgtgatgtttggtatggacgtgaag

SEQ ID NO: 110423 - DNA, 25 bp, Homo sapien
tgtgattagctgtaattagctgaaa

SEQ ID NO: 110424 - DNA, 25 bp, Homo sapien
tgtgattagttgtaattagctgaaa

SEQ ID NO: 110425 - DNA, 25 bp, Homo sapien
tgtgattattaaagctcagtttttt

SEQ ID NO: 110426 - DNA, 25 bp, Homo sapien
tgtgattattaaagcttagtttttt

SEQ ID NO: 110427 - DNA, 25 bp, Homo sapien
tgtgattcacagatttaatcccagg

SEQ ID NO: 110428 - DNA, 25 bp, Homo sapien
tgtgattcacatatttaatcccagg

SEQ ID NO: 110429 - DNA, 25 bp, Homo sapien
tgtgattctaaatgacaggagcagc

SEQ ID NO: 110430 - DNA, 25 bp, Homo sapien
tgtgattctaaattacaggagcagc

SEQ ID NO: 110431 - DNA, 25 bp, Homo sapien
tgtgattgactggtcatgtctgacg

SEQ ID NO: 110432 - DNA, 25 bp, Homo sapien
tgtgattgattggtcatgtctgacg

SEQ ID NO: 110433 - DNA, 25 bp, Homo sapien
tgtgattgccactggtcaagcctgg

SEQ ID NO: 110434 - DNA, 25 bp, Homo sapien
tgtgattgccattggtcaagcctgg

SEQ ID NO: 110435 - DNA, 25 bp, Homo sapien
tgtgattgttacagcgggtggtgtg

SEQ ID NO: 110436 - DNA, 25 bp, Homo sapien
tgtgattgttactgcgggtggtgtg

SEQ ID NO: 110437 - DNA, 25 bp, Homo sapien
tgtgcaaaacttctaggagtaccaa

SEQ ID NO: 110438 - DNA, 25 bp, Homo sapien
tgtgcaaagaagtaactgcgagggg

SEQ ID NO: 110439 - DNA, 25 bp, Homo sapien
tgtgcaaagatcaggacggaagcaa

SEQ ID NO: 110440 - DNA, 25 bp, Homo sapien
tgtgcaaagatcaggatggaagcaa

SEQ ID NO: 110441 - DNA, 25 bp, Homo sapien
tgtgcaaagcttctaggagtaccaa

SEQ ID NO: 110442 - DNA, 25 bp, Homo sapien
tgtgcaaaggagtaactgcgagggg

SEQ ID NO: 110443 - DNA, 25 bp, Homo sapien
tgtgcaacactgggttttgctttaa

SEQ ID NO: 110444 - DNA, 25 bp, Homo sapien
tgtgcaacattgggttttgctttaa

SEQ ID NO: 110445 - DNA, 25 bp, Homo sapien
tgtgcaactatatctgcagaggaaa

SEQ ID NO: 110446 - DNA, 25 bp, Homo sapien
tgtgcaactcagtactttaacaaga

SEQ ID NO: 110447 - DNA, 25 bp, Homo sapien
tgtgcaactcagtgctttaacaaga

SEQ ID NO: 110448 - DNA, 25 bp, Homo sapien
tgtgcaactgtatctgcagaggaaa

SEQ ID NO: 110449 - DNA, 25 bp, Homo sapien
tgtgcaaggaccaaagaaggaacct

SEQ ID NO: 110450 - DNA, 25 bp, Homo sapien
tgtgcaaggaccaaaggaggaacct

SEQ ID NO: 110451 - DNA, 25 bp, Homo sapien
tgtgcaaggatcgtctttatttact

SEQ ID NO: 110452 - DNA, 25 bp, Homo sapien
tgtgcaaggatcttctttatttact

SEQ ID NO: 110453 - DNA, 25 bp, Homo sapien
tgtgcacaataaataattgaattat

SEQ ID NO: 110454 - DNA, 25 bp, Homo sapien
tgtgcacaataagtaattgaattat

SEQ ID NO: 110455 - DNA, 25 bp, Homo sapien
tgtgcacatgcccatctgtggcatt

SEQ ID NO: 110456 - DNA, 25 bp, Homo sapien
tgtgcacatgctcatctgtggcatt

SEQ ID NO: 110457 - DNA, 25 bp, Homo sapien
tgtgcacattactccagaactgtta

SEQ ID NO: 110458 - DNA, 25 bp, Homo sapien
tgtgcacattattccagaactgtta

SEQ ID NO: 110459 - DNA, 25 bp, Homo sapien
tgtgcaccaaagtatcatcctagtt

SEQ ID NO: 110460 - DNA, 25 bp, Homo sapien
tgtgcaccaaagtgtcatcctagtt

SEQ ID NO: 110461 - DNA, 25 bp, Homo sapien
tgtgcacttaacccatctgtagaaa

SEQ ID NO: 110462 - DNA, 25 bp, Homo sapien
tgtgcacttgacccatctgtagaaa

SEQ ID NO: 110463 - DNA, 25 bp, Homo sapien
tgtgcagaaaatcgtaagtagctga

SEQ ID NO: 110464 - DNA, 25 bp, Homo sapien
tgtgcagaaaattgtaagtagctga

SEQ ID NO: 110465 - DNA, 25 bp, Homo sapien
tgtgcagcagttatccctttatgtg

SEQ ID NO: 110466 - DNA, 25 bp, Homo sapien
tgtgcagcggttatccctttatgtg

SEQ ID NO: 110467 - DNA, 25 bp, Homo sapien
tgtgcaggaggccagctgccagtgc

SEQ ID NO: 110468 - DNA, 25 bp, Homo sapien
tgtgcaggaggccggctgccagtgc

SEQ ID NO: 110469 - DNA, 25 bp, Homo sapien
tgtgcagtcctctctcattgtcctt

SEQ ID NO: 110470 - DNA, 25 bp, Homo sapien
tgtgcagtcctctgtcattgtcctt

SEQ ID NO: 110471 - DNA, 25 bp, Homo sapien
tgtgcataatctcttccagatcctg

SEQ ID NO: 110472 - DNA, 25 bp, Homo sapien
tgtgcatacatgaattttgtttatc

SEQ ID NO: 110473 - DNA, 25 bp, Homo sapien
tgtgcatacatgagttttgtttatc

SEQ ID NO: 110474 - DNA, 25 bp, Homo sapien
tgtgcatagtcaacctgatgaccat

SEQ ID NO: 110475 - DNA, 25 bp, Homo sapien
tgtgcatagtcagcctgatgaccat

SEQ ID NO: 110476 - DNA, 25 bp, Homo sapien
tgtgcatattctcttccagatcctg

SEQ ID NO: 110477 - DNA, 25 bp, Homo sapien
tgtgcatgtatcatctgtttacatg

SEQ ID NO: 110478 - DNA, 25 bp, Homo sapien
tgtgcatgtatgatctgtttacatg

SEQ ID NO: 110479 - DNA, 25 bp, Homo sapien
tgtgcatgtccatcctccatattta

SEQ ID NO: 110480 - DNA, 25 bp, Homo sapien
tgtgcatgtccgtcctccatattta

SEQ ID NO: 110481 - DNA, 25 bp, Homo sapien
tgtgccaactccgcaagaattgaaa

SEQ ID NO: 110482 - DNA, 25 bp, Homo sapien
tgtgccaactcctcaagaattgaaa

SEQ ID NO: 110483 - DNA, 25 bp, Homo sapien
tgtgccaatcctctaagtcctccgc

SEQ ID NO: 110484 - DNA, 25 bp, Homo sapien
tgtgccaattctctaagtcctccgc

SEQ ID NO: 110485 - DNA, 25 bp, Homo sapien
tgtgccacaagaatgttaagttcca

SEQ ID NO: 110486 - DNA, 25 bp, Homo sapien
tgtgccacaagcatgttaagttcca

SEQ ID NO: 110487 - DNA, 25 bp, Homo sapien
tgtgccacattggatttaaaattgt

SEQ ID NO: 110488 - DNA, 25 bp, Homo sapien
tgtgccacattggttttaaaattgt

SEQ ID NO: 110489 - DNA, 25 bp, Homo sapien
tgtgccagccaccatgccaaacact

SEQ ID NO: 110490 - DNA, 25 bp, Homo sapien
tgtgccagccaccgtgccaaacact

SEQ ID NO: 110491 - DNA, 25 bp, Homo sapien
tgtgccatatccaatcgtgttctat

SEQ ID NO: 110492 - DNA, 25 bp, Homo sapien
tgtgccatatccagtcgtgttctat

SEQ ID NO: 110493 - DNA, 25 bp, Homo sapien
tgtgccattcaccgaatataaagca

SEQ ID NO: 110494 - DNA, 25 bp, Homo sapien
tgtgccattcactgaatataaagca

SEQ ID NO: 110495 - DNA, 25 bp, Homo sapien
tgtgcccaaaatgcagtcagtagga

SEQ ID NO: 110496 - DNA, 25 bp, Homo sapien
tgtgcccaaaatggagtcagtagga

SEQ ID NO: 110497 - DNA, 25 bp, Homo sapien
tgtgcccacagtaactccctgcctt

SEQ ID NO: 110498 - DNA, 25 bp, Homo sapien
tgtgcccaccgtaactccctgcctt

SEQ ID NO: 110499 - DNA, 25 bp, Homo sapien
tgtgccctgtgagctggtctgggca

SEQ ID NO: 110500 - DNA, 25 bp, Homo sapien
tgtgccctgtgatctggtctgggca

SEQ ID NO: 110501 - DNA, 25 bp, Homo sapien
tgtgcccttctcacctgaatctgac

SEQ ID NO: 110502 - DNA, 25 bp, Homo sapien
tgtgcccttctcatctgaatctgac

SEQ ID NO: 110503 - DNA, 25 bp, Homo sapien
tgtgcccttctgcgttttgctttgt

SEQ ID NO: 110504 - DNA, 25 bp, Homo sapien
tgtgcccttctgtgttttgctttgt

SEQ ID NO: 110505 - DNA, 25 bp, Homo sapien
tgtgccgtgcctatttgtctatacc

SEQ ID NO: 110506 - DNA, 25 bp, Homo sapien
tgtgccgtgcctgtttgtctatacc

SEQ ID NO: 110507 - DNA, 25 bp, Homo sapien
tgtgcctccatattttagcagagac

SEQ ID NO: 110508 - DNA, 25 bp, Homo sapien
tgtgcctccgtattttagcagagac

SEQ ID NO: 110509 - DNA, 25 bp, Homo sapien
tgtgcctctaggtttgatcattgat

SEQ ID NO: 110510 - DNA, 25 bp, Homo sapien
tgtgcctctagttttgatcattgat

SEQ ID NO: 110511 - DNA, 25 bp, Homo sapien
tgtgccttaatctctgtatctcctg

SEQ ID NO: 110512 - DNA, 25 bp, Homo sapien
tgtgccttaatctttgtatctcctg

SEQ ID NO: 110513 - DNA, 25 bp, Homo sapien
tgtgccttgtcaacatattagtctg

SEQ ID NO: 110514 - DNA, 25 bp, Homo sapien
tgtgccttttcaacatattagtctg

SEQ ID NO: 110515 - DNA, 25 bp, Homo sapien
tgtgcgaacaaaacaaattaggaaa

SEQ ID NO: 110516 - DNA, 25 bp, Homo sapien
tgtgcgaacaaaccaaattaggaaa

SEQ ID NO: 110517 - DNA, 25 bp, Homo sapien
tgtgcgctttttccaagtgtgctgt

SEQ ID NO: 110518 - DNA, 25 bp, Homo sapien
tgtgcgctttttgcaagtgtgctgt

SEQ ID NO: 110519 - DNA, 25 bp, Homo sapien
tgtgcgttaacacgtaatttagtac

SEQ ID NO: 110520 - DNA, 25 bp, Homo sapien
tgtgcgttaacatgtaatttagtac

SEQ ID NO: 110521 - DNA, 25 bp, Homo sapien
tgtgctaaaactagagcctatttct

SEQ ID NO: 110522 - DNA, 25 bp, Homo sapien
tgtgctaaagttaaagcaatatgca

SEQ ID NO: 110523 - DNA, 25 bp, Homo sapien
tgtgctaaagttaaggcaatatgca

SEQ ID NO: 110524 - DNA, 25 bp, Homo sapien
tgtgctaaatgttgccagatgaaaa

SEQ ID NO: 110525 - DNA, 25 bp, Homo sapien
tgtgctaacactagagcctatttct

SEQ ID NO: 110526 - DNA, 25 bp, Homo sapien
tgtgctaacgatctctgtctccttg

SEQ ID NO: 110527 - DNA, 25 bp, Homo sapien
tgtgctaagcagtgaagtcctcatg

SEQ ID NO: 110528 - DNA, 25 bp, Homo sapien
tgtgctaagtagtgaagtcctcatg

SEQ ID NO: 110529 - DNA, 25 bp, Homo sapien
tgtgctaagtgttgccagatgaaaa

SEQ ID NO: 110530 - DNA, 25 bp, Homo sapien
tgtgctaatacatggtatcattcta

SEQ ID NO: 110531 - DNA, 25 bp, Homo sapien
tgtgctaatgatctctgtctccttg

SEQ ID NO: 110532 - DNA, 25 bp, Homo sapien
tgtgctaatgcatggtatcattcta

SEQ ID NO: 110533 - DNA, 25 bp, Homo sapien
tgtgctaggccctgaagaggcaaag

SEQ ID NO: 110534 - DNA, 25 bp, Homo sapien
tgtgctaggccctggagaggcaaag

SEQ ID NO: 110535 - DNA, 25 bp, Homo sapien
tgtgctaggtgccctggaggaatac

SEQ ID NO: 110536 - DNA, 25 bp, Homo sapien
tgtgctaggtgtcctggaggaatac

SEQ ID NO: 110537 - DNA, 25 bp, Homo sapien
tgtgctagtttctcatactacttgt

SEQ ID NO: 110538 - DNA, 25 bp, Homo sapien
tgtgctagtttcttatactacttgt

SEQ ID NO: 110539 - DNA, 25 bp, Homo sapien
tgtgctatagtgtacgtctacatac

SEQ ID NO: 110540 - DNA, 25 bp, Homo sapien
tgtgctatagtgtaggtctacatac

SEQ ID NO: 110541 - DNA, 25 bp, Homo sapien
tgtgctcaaagcaacaacctgcctg

SEQ ID NO: 110542 - DNA, 25 bp, Homo sapien
tgtgctcaaagcaacagcctgcctg

SEQ ID NO: 110543 - DNA, 25 bp, Homo sapien
tgtgctcaatatttactgttgatgc

SEQ ID NO: 110544 - DNA, 25 bp, Homo sapien
tgtgctcacgtcctatgtatcatgc

SEQ ID NO: 110545 - DNA, 25 bp, Homo sapien
tgtgctcacttggccagaagcaaac

SEQ ID NO: 110546 - DNA, 25 bp, Homo sapien
tgtgctcagtatttactgttgatgc

SEQ ID NO: 110547 - DNA, 25 bp, Homo sapien
tgtgctcatgtcctatgtatcatgc

SEQ ID NO: 110548 - DNA, 25 bp, Homo sapien
tgtgctcatttggccagaagcaaac

SEQ ID NO: 110549 - DNA, 25 bp, Homo sapien
tgtgctccagtaaatttcctgcata

SEQ ID NO: 110550 - DNA, 25 bp, Homo sapien
tgtgctccggtaaatttcctgcata

SEQ ID NO: 110551 - DNA, 25 bp, Homo sapien
tgtgctcgtggagacgctggtggtt

SEQ ID NO: 110552 - DNA, 25 bp, Homo sapien
tgtgctcgtggagatgctggtggtt

SEQ ID NO: 110553 - DNA, 25 bp, Homo sapien
tgtgctctactcccaggagtcctta

SEQ ID NO: 110554 - DNA, 25 bp, Homo sapien
tgtgctctactcgcaggagtcctta

SEQ ID NO: 110555 - DNA, 25 bp, Homo sapien
tgtgctctcaatttcaatacatctt

SEQ ID NO: 110556 - DNA, 25 bp, Homo sapien
tgtgctctcgatttcaatacatctt

SEQ ID NO: 110557 - DNA, 25 bp, Homo sapien
tgtgctgaaaagatgggacaaatgt

SEQ ID NO: 110558 - DNA, 25 bp, Homo sapien
tgtgctgaacagccacagaaataac

SEQ ID NO: 110559 - DNA, 25 bp, Homo sapien
tgtgctgaacagccgcagaaataac

SEQ ID NO: 110560 - DNA, 25 bp, Homo sapien
tgtgctgaagagatgggacaaatgt

SEQ ID NO: 110561 - DNA, 25 bp, Homo sapien
tgtgctgagtgatgatactggcccc

SEQ ID NO: 110562 - DNA, 25 bp, Homo sapien
tgtgctgagtgatgttactggcccc

SEQ ID NO: 110563 - DNA, 25 bp, Homo sapien
tgtgctgatcgttgtagtgtgagga

SEQ ID NO: 110564 - DNA, 25 bp, Homo sapien
tgtgctgattgttgtagtgtgagga

SEQ ID NO: 110565 - DNA, 25 bp, Homo sapien
tgtgctgccattcagactgttgttt

SEQ ID NO: 110566 - DNA, 25 bp, Homo sapien
tgtgctgccattcggactgttgttt

SEQ ID NO: 110567 - DNA, 25 bp, Homo sapien
tgtgctgtaggtatatctgtacttt

SEQ ID NO: 110568 - DNA, 25 bp, Homo sapien
tgtgctgtatgtatatctgtacttt

SEQ ID NO: 110569 - DNA, 25 bp, Homo sapien
tgtgctgttatcagatgtgcagtgt

SEQ ID NO: 110570 - DNA, 25 bp, Homo sapien
tgtgctgttttcagatgtgcagtgt

SEQ ID NO: 110571 - DNA, 25 bp, Homo sapien
tgtgcttaaatgatgcgggctcatg

SEQ ID NO: 110572 - DNA, 25 bp, Homo sapien
tgtgcttaaatggtgcgggctcatg

SEQ ID NO: 110573 - DNA, 25 bp, Homo sapien
tgtgcttataacgattgccagtttc

SEQ ID NO: 110574 - DNA, 25 bp, Homo sapien
tgtgcttataatgattgccagtttc

SEQ ID NO: 110575 - DNA, 25 bp, Homo sapien
tgtgcttatactatgactgaatgta

SEQ ID NO: 110576 - DNA, 25 bp, Homo sapien
tgtgcttatactgtgactgaatgta

SEQ ID NO: 110577 - DNA, 25 bp, Homo sapien
tgtgcttcaccacatcttgacaaca

SEQ ID NO: 110578 - DNA, 25 bp, Homo sapien
tgtgcttcaccatatcttgacaaca

SEQ ID NO: 110579 - DNA, 25 bp, Homo sapien
tgtgcttcctgaactccctgcagca

SEQ ID NO: 110580 - DNA, 25 bp, Homo sapien
tgtgcttcgttattaatttcattct

SEQ ID NO: 110581 - DNA, 25 bp, Homo sapien
tgtgcttcttgaactccctgcagca

SEQ ID NO: 110582 - DNA, 25 bp, Homo sapien
tgtgcttctttattaatttcattct

SEQ ID NO: 110583 - DNA, 25 bp, Homo sapien
tgtgctttcataggccactctagtg

SEQ ID NO: 110584 - DNA, 25 bp, Homo sapien
tgtgctttctcacagtaaatcaagt

SEQ ID NO: 110585 - DNA, 25 bp, Homo sapien
tgtgctttctcacggtaaatcaagt

SEQ ID NO: 110586 - DNA, 25 bp, Homo sapien
tgtgctttctgggtgcattacactt

SEQ ID NO: 110587 - DNA, 25 bp, Homo sapien
tgtgctttctgggtgctttacactt

SEQ ID NO: 110588 - DNA, 25 bp, Homo sapien
tgtgctttgataggccactctagtg

SEQ ID NO: 110589 - DNA, 25 bp, Homo sapien
tgtgctttgatcgatgcggttgttc

SEQ ID NO: 110590 - DNA, 25 bp, Homo sapien
tgtgctttgatcgatgtggttgttc

SEQ ID NO: 110591 - DNA, 25 bp, Homo sapien
tgtgctttgtttcatgtgctgtgca

SEQ ID NO: 110592 - DNA, 25 bp, Homo sapien
tgtgctttgtttcgtgtgctgtgca

SEQ ID NO: 110593 - DNA, 25 bp, Homo sapien
tgtggaaaacagagattgtatctta

SEQ ID NO: 110594 - DNA, 25 bp, Homo sapien
tgtggaaaacagggattgtatctta

SEQ ID NO: 110595 - DNA, 25 bp, Homo sapien
tgtggaatgagaaaggacttgtttg

SEQ ID NO: 110596 - DNA, 25 bp, Homo sapien
tgtggaatgagagaggacttgtttg

SEQ ID NO: 110597 - DNA, 25 bp, Homo sapien
tgtggaattttaaaaactgcctggt

SEQ ID NO: 110598 - DNA, 25 bp, Homo sapien
tgtggaattttaaacactgcctggt

SEQ ID NO: 110599 - DNA, 25 bp, Homo sapien
tgtggacacagagaggcgtgaaagt

SEQ ID NO: 110600 - DNA, 25 bp, Homo sapien
tgtggacacagagaggtgtgaaagt

SEQ ID NO: 110601 - DNA, 25 bp, Homo sapien
tgtggacagctcatcaataacacat

SEQ ID NO: 110602 - DNA, 25 bp, Homo sapien
tgtggacagctcgtcaataacacat

SEQ ID NO: 110603 - DNA, 25 bp, Homo sapien
tgtggacctgttattttccatcact

SEQ ID NO: 110604 - DNA, 25 bp, Homo sapien
tgtggaccttttattttccatcact

SEQ ID NO: 110605 - DNA, 25 bp, Homo sapien
tgtggagaaaataaaacgttagggt

SEQ ID NO: 110606 - DNA, 25 bp, Homo sapien
tgtggagaaaataaaatgttagggt

SEQ ID NO: 110607 - DNA, 25 bp, Homo sapien
tgtggagaggtgacgaggaatactc

SEQ ID NO: 110608 - DNA, 25 bp, Homo sapien
tgtggagaggtgatgaggaatactc

SEQ ID NO: 110609 - DNA, 25 bp, Homo sapien
tgtggagccgttttcctgtagcgcc

SEQ ID NO: 110610 - DNA, 25 bp, Homo sapien
tgtggagctgttttcctgtagcgcc

SEQ ID NO: 110611 - DNA, 25 bp, Homo sapien
tgtggataagttttcaatttggtgt

SEQ ID NO: 110612 - DNA, 25 bp, Homo sapien
tgtggataatttttcaatttggtgt

SEQ ID NO: 110613 - DNA, 25 bp, Homo sapien
tgtggatcaatttgaacatactgga

SEQ ID NO: 110614 - DNA, 25 bp, Homo sapien
tgtggatcatgcgtgtcatattgat

SEQ ID NO: 110615 - DNA, 25 bp, Homo sapien
tgtggatcatgcttgtcatattgat

SEQ ID NO: 110616 - DNA, 25 bp, Homo sapien
tgtggatccatttgaacatactgga

SEQ ID NO: 110617 - DNA, 25 bp, Homo sapien
tgtggatcgaacagtacggcaatgt

SEQ ID NO: 110618 - DNA, 25 bp, Homo sapien
tgtggatcgaacagtatggcaatgt

SEQ ID NO: 110619 - DNA, 25 bp, Homo sapien
tgtggatctgtacatttccttaggg

SEQ ID NO: 110620 - DNA, 25 bp, Homo sapien
tgtggatctgtacgtttccttaggg

SEQ ID NO: 110621 - DNA, 25 bp, Homo sapien
tgtggatgtagaacctgtggatgca

SEQ ID NO: 110622 - DNA, 25 bp, Homo sapien
tgtggatgtagaagctgtggatgca

SEQ ID NO: 110623 - DNA, 25 bp, Homo sapien
tgtggatgttcaacgttgcaatact

SEQ ID NO: 110624 - DNA, 25 bp, Homo sapien
tgtggatgttcaatgttgcaatact

SEQ ID NO: 110625 - DNA, 25 bp, Homo sapien
tgtggattattatgggaaaagctgt

SEQ ID NO: 110626 - DNA, 25 bp, Homo sapien
tgtggattattatggggaaagctgt

SEQ ID NO: 110627 - DNA, 25 bp, Homo sapien
tgtggattgaccacctaatctcatc

SEQ ID NO: 110628 - DNA, 25 bp, Homo sapien
tgtggattgaccacgtaatctcatc

SEQ ID NO: 110629 - DNA, 25 bp, Homo sapien
tgtggcaaagaagatcacaataatt

SEQ ID NO: 110630 - DNA, 25 bp, Homo sapien
tgtggcaaagaggatcacaataatt

SEQ ID NO: 110631 - DNA, 25 bp, Homo sapien
tgtggcaacaaatggtggaaactca

SEQ ID NO: 110632 - DNA, 25 bp, Homo sapien
tgtggcaaggatgggactctgctct

SEQ ID NO: 110633 - DNA, 25 bp, Homo sapien
tgtggcaaggattggactctgctct

SEQ ID NO: 110634 - DNA, 25 bp, Homo sapien
tgtggcaataaatggtggaaactca

SEQ ID NO: 110635 - DNA, 25 bp, Homo sapien
tgtggcaccccgagtcctgccatta

SEQ ID NO: 110636 - DNA, 25 bp, Homo sapien
tgtggcaccccgagtcttgccatta

SEQ ID NO: 110637 - DNA, 25 bp, Homo sapien
tgtggcactatcatctactacccat

SEQ ID NO: 110638 - DNA, 25 bp, Homo sapien
tgtggcactatcatttactacccat

SEQ ID NO: 110639 - DNA, 25 bp, Homo sapien
tgtggcactcattaatagagtctgc

SEQ ID NO: 110640 - DNA, 25 bp, Homo sapien
tgtggcactcatttatagagtctgc

SEQ ID NO: 110641 - DNA, 25 bp, Homo sapien
tgtggcagtgacatgttgaagaaac

SEQ ID NO: 110642 - DNA, 25 bp, Homo sapien
tgtggcagtgacttgttgaagaaac

SEQ ID NO: 110643 - DNA, 25 bp, Homo sapien
tgtggcatgcgttatatttctacca

SEQ ID NO: 110644 - DNA, 25 bp, Homo sapien
tgtggcatgtgttatatttctacca

SEQ ID NO: 110645 - DNA, 25 bp, Homo sapien
tgtggccaaccaaaatctccatatg

SEQ ID NO: 110646 - DNA, 25 bp, Homo sapien
tgtggccaaccgaaatctccatatg

SEQ ID NO: 110647 - DNA, 25 bp, Homo sapien
tgtggccggtttctgtaatccggga

SEQ ID NO: 110648 - DNA, 25 bp, Homo sapien
tgtggccggtttttgtaatccggga

SEQ ID NO: 110649 - DNA, 25 bp, Homo sapien
tgtggcctttacttatgcagtatag

SEQ ID NO: 110650 - DNA, 25 bp, Homo sapien
tgtggcctttagttatgcagtatag

SEQ ID NO: 110651 - DNA, 25 bp, Homo sapien
tgtggctagagttactggaaaacaa

SEQ ID NO: 110652 - DNA, 25 bp, Homo sapien
tgtggctagtgttactggaaaacaa

SEQ ID NO: 110653 - DNA, 25 bp, Homo sapien
tgtggctatttactgaacaggaatg

SEQ ID NO: 110654 - DNA, 25 bp, Homo sapien
tgtggctatttattgaacaggaatg

SEQ ID NO: 110655 - DNA, 25 bp, Homo sapien
tgtggctcatctatagtgctgcttt

SEQ ID NO: 110656 - DNA, 25 bp, Homo sapien
tgtggctcatctgtagtgctgcttt

SEQ ID NO: 110657 - DNA, 25 bp, Homo sapien
tgtggctccaaaaaagactccttcc

SEQ ID NO: 110658 - DNA, 25 bp, Homo sapien
tgtggctcgaaaaaagactccttcc

SEQ ID NO: 110659 - DNA, 25 bp, Homo sapien
tgtggctgaccatccaaaggaaagc

SEQ ID NO: 110660 - DNA, 25 bp, Homo sapien
tgtggctgagcatccaaaggaaagc

SEQ ID NO: 110661 - DNA, 25 bp, Homo sapien
tgtggctgatgaatagactagctgc

SEQ ID NO: 110662 - DNA, 25 bp, Homo sapien
tgtggctgatgaatggactagctgc

SEQ ID NO: 110663 - DNA, 25 bp, Homo sapien
tgtggctgcagcaccgccactcagg

SEQ ID NO: 110664 - DNA, 25 bp, Homo sapien
tgtggctgcggcaccgccactcagg

SEQ ID NO: 110665 - DNA, 25 bp, Homo sapien
tgtggcttcaaacgtaaatgtccct

SEQ ID NO: 110666 - DNA, 25 bp, Homo sapien
tgtggcttcaaatgtaaatgtccct

SEQ ID NO: 110667 - DNA, 25 bp, Homo sapien
tgtggcttctccaggctcaaaaaaa

SEQ ID NO: 110668 - DNA, 25 bp, Homo sapien
tgtggcttctccgggctcaaaaaaa

SEQ ID NO: 110669 - DNA, 25 bp, Homo sapien
tgtgggaaaactcccaattgcataa

SEQ ID NO: 110670 - DNA, 25 bp, Homo sapien
tgtgggaaaactcctaattgcataa

SEQ ID NO: 110671 - DNA, 25 bp, Homo sapien
tgtgggagaacagttactatgatga

SEQ ID NO: 110672 - DNA, 25 bp, Homo sapien
tgtgggagaacggttactatgatga

SEQ ID NO: 110673 - DNA, 25 bp, Homo sapien
tgtgggagagcatcctagccagggg

SEQ ID NO: 110674 - DNA, 25 bp, Homo sapien
tgtgggagagcgtcctagccagggg

SEQ ID NO: 110675 - DNA, 25 bp, Homo sapien
tgtgggaggtccatggatgctatgt

SEQ ID NO: 110676 - DNA, 25 bp, Homo sapien
tgtgggaggtccatggttgctatgt

SEQ ID NO: 110677 - DNA, 25 bp, Homo sapien
tgtgggcactaatccctttagatct

SEQ ID NO: 110678 - DNA, 25 bp, Homo sapien
tgtgggcactactccctttagatct

SEQ ID NO: 110679 - DNA, 25 bp, Homo sapien
tgtgggcatttgagttttcaatgcc

SEQ ID NO: 110680 - DNA, 25 bp, Homo sapien
tgtgggcatttgcgttttcaatgcc

SEQ ID NO: 110681 - DNA, 25 bp, Homo sapien
tgtgggcccttaatacttatggaat

SEQ ID NO: 110682 - DNA, 25 bp, Homo sapien
tgtgggcccttactacttatggaat

SEQ ID NO: 110683 - DNA, 25 bp, Homo sapien
tgtgggcctttcatatattgtctat

SEQ ID NO: 110684 - DNA, 25 bp, Homo sapien
tgtgggcctttcgtatattgtctat

SEQ ID NO: 110685 - DNA, 25 bp, Homo sapien
tgtgggcgatctctacaagtagaag

SEQ ID NO: 110686 - DNA, 25 bp, Homo sapien
tgtgggcgatctgtacaagtagaag

SEQ ID NO: 110687 - DNA, 25 bp, Homo sapien
tgtggggtgtcctttttctagatgg

SEQ ID NO: 110688 - DNA, 25 bp, Homo sapien
tgtggggtgtcttttttctagatgg

SEQ ID NO: 110689 - DNA, 25 bp, Homo sapien
tgtgggtaacagtacctgctatact

SEQ ID NO: 110690 - DNA, 25 bp, Homo sapien
tgtgggtaatagtacctgctatact

SEQ ID NO: 110691 - DNA, 25 bp, Homo sapien
tgtgggtgcttgctctcttcaggtg

SEQ ID NO: 110692 - DNA, 25 bp, Homo sapien
tgtgggtggagaccgcataatcaag

SEQ ID NO: 110693 - DNA, 25 bp, Homo sapien
tgtgggtggagaccgcgtaatcaag

SEQ ID NO: 110694 - DNA, 25 bp, Homo sapien
tgtgggtgtttgctctcttcaggtg

SEQ ID NO: 110695 - DNA, 25 bp, Homo sapien
tgtggtaacggaatgtctgtgtttt

SEQ ID NO: 110696 - DNA, 25 bp, Homo sapien
tgtggtaatggaatgtctgtgtttt

SEQ ID NO: 110697 - DNA, 25 bp, Homo sapien
tgtggtcaaaaaccacgagctacac

SEQ ID NO: 110698 - DNA, 25 bp, Homo sapien
tgtggtcacacttccggacagcaaa

SEQ ID NO: 110699 - DNA, 25 bp, Homo sapien
tgtggtcacacttctggacagcaaa

SEQ ID NO: 110700 - DNA, 25 bp, Homo sapien
tgtggtcaccagctgttggatgcat

SEQ ID NO: 110701 - DNA, 25 bp, Homo sapien
tgtggtcacgagctgttggatgcat

SEQ ID NO: 110702 - DNA, 25 bp, Homo sapien
tgtggtcagaaaccacgagctacac

SEQ ID NO: 110703 - DNA, 25 bp, Homo sapien
tgtggtctgtaatgactgacttctt

SEQ ID NO: 110704 - DNA, 25 bp, Homo sapien
tgtggtctgtagtgactgacttctt

SEQ ID NO: 110705 - DNA, 25 bp, Homo sapien
tgtggtcttcagtaagttgtatgtt

SEQ ID NO: 110706 - DNA, 25 bp, Homo sapien
tgtggtctttagtaagttgtatgtt

SEQ ID NO: 110707 - DNA, 25 bp, Homo sapien
tgtggtgaagttcaaatgagctaat

SEQ ID NO: 110708 - DNA, 25 bp, Homo sapien
tgtggtgaggttcaaatgagctaat

SEQ ID NO: 110709 - DNA, 25 bp, Homo sapien
tgtggtgccttggtatcctcatctg

SEQ ID NO: 110710 - DNA, 25 bp, Homo sapien
tgtggtgccttggtatgctcatctg

SEQ ID NO: 110711 - DNA, 25 bp, Homo sapien
tgtggtggccactctaggactgcaa

SEQ ID NO: 110712 - DNA, 25 bp, Homo sapien
tgtggtggccactctatgactgcaa

SEQ ID NO: 110713 - DNA, 25 bp, Homo sapien
tgtggttatggtaagtcttgagaga

SEQ ID NO: 110714 - DNA, 25 bp, Homo sapien
tgtggttatggtaagttttgagaga

SEQ ID NO: 110715 - DNA, 25 bp, Homo sapien
tgtggttccatatcaagatatttgg

SEQ ID NO: 110716 - DNA, 25 bp, Homo sapien
tgtggttccatatcgagatatttgg

SEQ ID NO: 110717 - DNA, 25 bp, Homo sapien
tgtggttcttcacccagacataatc

SEQ ID NO: 110718 - DNA, 25 bp, Homo sapien
tgtggttcttcataaagattgcata

SEQ ID NO: 110719 - DNA, 25 bp, Homo sapien
tgtggttcttcatagagattgcata

SEQ ID NO: 110720 - DNA, 25 bp, Homo sapien
tgtggttcttcgcccagacataatc

SEQ ID NO: 110721 - DNA, 25 bp, Homo sapien
tgtggttgaaaacgtgttaataaag

SEQ ID NO: 110722 - DNA, 25 bp, Homo sapien
tgtggttgaaaatgtgttaataaag

SEQ ID NO: 110723 - DNA, 25 bp, Homo sapien
tgtggtttaagcttttcactaaatt

SEQ ID NO: 110724 - DNA, 25 bp, Homo sapien
tgtggtttacgcttttcactaaatt

SEQ ID NO: 110725 - DNA, 25 bp, Homo sapien
tgtggtttccagtttagcagtgggc

SEQ ID NO: 110726 - DNA, 25 bp, Homo sapien
tgtggtttctagtttagcagtgggc

SEQ ID NO: 110727 - DNA, 25 bp, Homo sapien
tgtggtttgctttatggatgagctt

SEQ ID NO: 110728 - DNA, 25 bp, Homo sapien
tgtggtttgctttgtggatgagctt

SEQ ID NO: 110729 - DNA, 25 bp, Homo sapien
tgtggtttgtttagaaagcagtggg

SEQ ID NO: 110730 - DNA, 25 bp, Homo sapien
tgtggtttgtttaggaagcagtggg

SEQ ID NO: 110731 - DNA, 25 bp, Homo sapien
tgtgtaaaagacagtattttcaaca

SEQ ID NO: 110732 - DNA, 25 bp, Homo sapien
tgtgtaaaagacattattttcaaca

SEQ ID NO: 110733 - DNA, 25 bp, Homo sapien
tgtgtaaatcattcaaatccttact

SEQ ID NO: 110734 - DNA, 25 bp, Homo sapien
tgtgtaaatcattcgaatccttact

SEQ ID NO: 110735 - DNA, 25 bp, Homo sapien
tgtgtaacttttcgggttggcattt

SEQ ID NO: 110736 - DNA, 25 bp, Homo sapien
tgtgtaactttttgggttggcattt

SEQ ID NO: 110737 - DNA, 25 bp, Homo sapien
tgtgtaagcagattatcatcatcag

SEQ ID NO: 110738 - DNA, 25 bp, Homo sapien
tgtgtaagcagattgtcatcatcag

SEQ ID NO: 110739 - DNA, 25 bp, Homo sapien
tgtgtaaggcctgttcctctttccc

SEQ ID NO: 110740 - DNA, 25 bp, Homo sapien
tgtgtaagtcctgttcctctttccc

SEQ ID NO: 110741 - DNA, 25 bp, Homo sapien
tgtgtaatagcacccctagcatatc

SEQ ID NO: 110742 - DNA, 25 bp, Homo sapien
tgtgtaatagcatccctagcatatc

SEQ ID NO: 110743 - DNA, 25 bp, Homo sapien
tgtgtaatcgattgtgaagaagagg

SEQ ID NO: 110744 - DNA, 25 bp, Homo sapien
tgtgtaatctattgtgaagaagagg

SEQ ID NO: 110745 - DNA, 25 bp, Homo sapien
tgtgtaatggtaatgtgctgtatgt

SEQ ID NO: 110746 - DNA, 25 bp, Homo sapien
tgtgtaatggtcatgtgctgtatgt

SEQ ID NO: 110747 - DNA, 25 bp, Homo sapien
tgtgtacattttcatagcttatctt

SEQ ID NO: 110748 - DNA, 25 bp, Homo sapien
tgtgtacattttgatagcttatctt

SEQ ID NO: 110749 - DNA, 25 bp, Homo sapien
tgtgtacgtgactatatcttgtata

SEQ ID NO: 110750 - DNA, 25 bp, Homo sapien
tgtgtacgtgactgtatcttgtata

SEQ ID NO: 110751 - DNA, 25 bp, Homo sapien
tgtgtactcatacacttgacaacat

SEQ ID NO: 110752 - DNA, 25 bp, Homo sapien
tgtgtactcatagacttgacaacat

SEQ ID NO: 110753 - DNA, 25 bp, Homo sapien
tgtgtactcgtttcctggattgaag

SEQ ID NO: 110754 - DNA, 25 bp, Homo sapien
tgtgtacttgtttcctggattgaag

SEQ ID NO: 110755 - DNA, 25 bp, Homo sapien
tgtgtagaactgataatatggactt

SEQ ID NO: 110756 - DNA, 25 bp, Homo sapien
tgtgtagaagtctccttggtttttt

SEQ ID NO: 110757 - DNA, 25 bp, Homo sapien
tgtgtagaattgataatatggactt

SEQ ID NO: 110758 - DNA, 25 bp, Homo sapien
tgtgtagaatttatagactcctcag

SEQ ID NO: 110759 - DNA, 25 bp, Homo sapien
tgtgtagaatttgtagactcctcag

SEQ ID NO: 110760 - DNA, 25 bp, Homo sapien
tgtgtagacgtctccttggtttttt

SEQ ID NO: 110761 - DNA, 25 bp, Homo sapien
tgtgtagagctattatcctcatctt

SEQ ID NO: 110762 - DNA, 25 bp, Homo sapien
tgtgtagatctattatcctcatctt

SEQ ID NO: 110763 - DNA, 25 bp, Homo sapien
tgtgtagcgcttcccgctttgttct

SEQ ID NO: 110764 - DNA, 25 bp, Homo sapien
tgtgtagcgcttcctgctttgttct

SEQ ID NO: 110765 - DNA, 25 bp, Homo sapien
tgtgtagttttaataagtcttaact

SEQ ID NO: 110766 - DNA, 25 bp, Homo sapien
tgtgtagttttagtaagtcttaact

SEQ ID NO: 110767 - DNA, 25 bp, Homo sapien
tgtgtatacatccacactcgttttc

SEQ ID NO: 110768 - DNA, 25 bp, Homo sapien
tgtgtatacatccgcactcgttttc

SEQ ID NO: 110769 - DNA, 25 bp, Homo sapien
tgtgtatagccagcaggatgaattt

SEQ ID NO: 110770 - DNA, 25 bp, Homo sapien
tgtgtatagccagtaggatgaattt

SEQ ID NO: 110771 - DNA, 25 bp, Homo sapien
tgtgtatccaccagtagtcacttcc

SEQ ID NO: 110772 - DNA, 25 bp, Homo sapien
tgtgtatccaccggtagtcacttcc

SEQ ID NO: 110773 - DNA, 25 bp, Homo sapien
tgtgtatctgtaatcccttgtatca

SEQ ID NO: 110774 - DNA, 25 bp, Homo sapien
tgtgtatctgtaatcctttgtatca

SEQ ID NO: 110775 - DNA, 25 bp, Homo sapien
tgtgtatgattttaactgtgggctt

SEQ ID NO: 110776 - DNA, 25 bp, Homo sapien
tgtgtatgcaatcaaacaaccagat

SEQ ID NO: 110777 - DNA, 25 bp, Homo sapien
tgtgtatgcaattaaacaaccagat

SEQ ID NO: 110778 - DNA, 25 bp, Homo sapien
tgtgtatgtttttaactgtgggctt

SEQ ID NO: 110779 - DNA, 25 bp, Homo sapien
tgtgtattattgcataaggtagtgt

SEQ ID NO: 110780 - DNA, 25 bp, Homo sapien
tgtgtattattgcgtaaggtagtgt

SEQ ID NO: 110781 - DNA, 25 bp, Homo sapien
tgtgtattgcactaaatggactgat

SEQ ID NO: 110782 - DNA, 25 bp, Homo sapien
tgtgtattgtactaaatggactgat

SEQ ID NO: 110783 - DNA, 25 bp, Homo sapien
tgtgtatttaaacgtttccattatt

SEQ ID NO: 110784 - DNA, 25 bp, Homo sapien
tgtgtatttaaatgtttccattatt

SEQ ID NO: 110785 - DNA, 25 bp, Homo sapien
tgtgtcaaaatcacacttaaactga

SEQ ID NO: 110786 - DNA, 25 bp, Homo sapien
tgtgtcaaaatcgcacttaaactga

SEQ ID NO: 110787 - DNA, 25 bp, Homo sapien
tgtgtcaaagtagaatgagagatgg

SEQ ID NO: 110788 - DNA, 25 bp, Homo sapien
tgtgtcaaagtagaattagagatgg

SEQ ID NO: 110789 - DNA, 25 bp, Homo sapien
tgtgtcaatattagttcaccaactg

SEQ ID NO: 110790 - DNA, 25 bp, Homo sapien
tgtgtcaatatttgttcaccaactg

SEQ ID NO: 110791 - DNA, 25 bp, Homo sapien
tgtgtcaatccaccagaatttaggg

SEQ ID NO: 110792 - DNA, 25 bp, Homo sapien
tgtgtcaatccaccggaatttaggg

SEQ ID NO: 110793 - DNA, 25 bp, Homo sapien
tgtgtcaggaaaagcctatttattc

SEQ ID NO: 110794 - DNA, 25 bp, Homo sapien
tgtgtcaggaaaggcctatttattc

SEQ ID NO: 110795 - DNA, 25 bp, Homo sapien
tgtgtcagggctccaacttcatatt

SEQ ID NO: 110796 - DNA, 25 bp, Homo sapien
tgtgtcagggctccgacttcatatt

SEQ ID NO: 110797 - DNA, 25 bp, Homo sapien
tgtgtcaggtcagccgaaggatgaa

SEQ ID NO: 110798 - DNA, 25 bp, Homo sapien
tgtgtcaggtcagctgaaggatgaa

SEQ ID NO: 110799 - DNA, 25 bp, Homo sapien
tgtgtcatccaatcataacaggact

SEQ ID NO: 110800 - DNA, 25 bp, Homo sapien
tgtgtcatccagtcataacaggact

SEQ ID NO: 110801 - DNA, 25 bp, Homo sapien
tgtgtcatgtctgtgtccagatgtc

SEQ ID NO: 110802 - DNA, 25 bp, Homo sapien
tgtgtcatgtctttgtccagatgtc

SEQ ID NO: 110803 - DNA, 25 bp, Homo sapien
tgtgtccaaggacttgggttcagat

SEQ ID NO: 110804 - DNA, 25 bp, Homo sapien
tgtgtccaaggtcttgggttcagat

SEQ ID NO: 110805 - DNA, 25 bp, Homo sapien
tgtgtccatttactatgttgttggc

SEQ ID NO: 110806 - DNA, 25 bp, Homo sapien
tgtgtccatttagtatgttgttggc

SEQ ID NO: 110807 - DNA, 25 bp, Homo sapien
tgtgtcccgtgaaaaagtagaattt

SEQ ID NO: 110808 - DNA, 25 bp, Homo sapien
tgtgtcccgtgaaaaattagaattt

SEQ ID NO: 110809 - DNA, 25 bp, Homo sapien
tgtgtccggcataggactgtgacaa

SEQ ID NO: 110810 - DNA, 25 bp, Homo sapien
tgtgtccggcataggattgtgacaa

SEQ ID NO: 110811 - DNA, 25 bp, Homo sapien
tgtgtccttttgacatacttttatt

SEQ ID NO: 110812 - DNA, 25 bp, Homo sapien
tgtgtcctttttacatacttttatt

SEQ ID NO: 110813 - DNA, 25 bp, Homo sapien
tgtgtctacctgcactcactaattt

SEQ ID NO: 110814 - DNA, 25 bp, Homo sapien
tgtgtctatcctggagtttccctgg

SEQ ID NO: 110815 - DNA, 25 bp, Homo sapien
tgtgtctatctgcactcactaattt

SEQ ID NO: 110816 - DNA, 25 bp, Homo sapien
tgtgtctattctggagtttccctgg

SEQ ID NO: 110817 - DNA, 25 bp, Homo sapien
tgtgtctcagtcgaatggccaaatc

SEQ ID NO: 110818 - DNA, 25 bp, Homo sapien
tgtgtctcagttgaatggccaaatc

SEQ ID NO: 110819 - DNA, 25 bp, Homo sapien
tgtgtctgaaggctgcacataggtt

SEQ ID NO: 110820 - DNA, 25 bp, Homo sapien
tgtgtctgagctatgagaaatcccg

SEQ ID NO: 110821 - DNA, 25 bp, Homo sapien
tgtgtctgagctgtgagaaatcccg

SEQ ID NO: 110822 - DNA, 25 bp, Homo sapien
tgtgtctgagggctgcacataggtt

SEQ ID NO: 110823 - DNA, 25 bp, Homo sapien
tgtgtctgcaaatataaagttacag

SEQ ID NO: 110824 - DNA, 25 bp, Homo sapien
tgtgtctgcacaaggtcttttaggg

SEQ ID NO: 110825 - DNA, 25 bp, Homo sapien
tgtgtctggaaatataaagttacag

SEQ ID NO: 110826 - DNA, 25 bp, Homo sapien
tgtgtctgggtattttgttctttta

SEQ ID NO: 110827 - DNA, 25 bp, Homo sapien
tgtgtctgggtatttttttctttta

SEQ ID NO: 110828 - DNA, 25 bp, Homo sapien
tgtgtctggtccgctacagtgagaa

SEQ ID NO: 110829 - DNA, 25 bp, Homo sapien
tgtgtctggtcctctacagtgagaa

SEQ ID NO: 110830 - DNA, 25 bp, Homo sapien
tgtgtctgtacaaggtcttttaggg

SEQ ID NO: 110831 - DNA, 25 bp, Homo sapien
tgtgtctgtcacgaacccagtcagc

SEQ ID NO: 110832 - DNA, 25 bp, Homo sapien
tgtgtctgtcatgaacccagtcagc

SEQ ID NO: 110833 - DNA, 25 bp, Homo sapien
tgtgtctgtccaacacgctatgaag

SEQ ID NO: 110834 - DNA, 25 bp, Homo sapien
tgtgtctgtccaacgcgctatgaag

SEQ ID NO: 110835 - DNA, 25 bp, Homo sapien
tgtgtcttacaacttttagccattc

SEQ ID NO: 110836 - DNA, 25 bp, Homo sapien
tgtgtcttataacttttagccattc

SEQ ID NO: 110837 - DNA, 25 bp, Homo sapien
tgtgtcttcgtctttaacatcaaag

SEQ ID NO: 110838 - DNA, 25 bp, Homo sapien
tgtgtcttgctgccttcagtcttgc

SEQ ID NO: 110839 - DNA, 25 bp, Homo sapien
tgtgtcttgctggcttcagtcttgc

SEQ ID NO: 110840 - DNA, 25 bp, Homo sapien
tgtgtctttgtctttaacatcaaag

SEQ ID NO: 110841 - DNA, 25 bp, Homo sapien
tgtgtgaaacatattaccatcatat

SEQ ID NO: 110842 - DNA, 25 bp, Homo sapien
tgtgtgaaacatattatcatcatat

SEQ ID NO: 110843 - DNA, 25 bp, Homo sapien
tgtgtgaaatgacccaaaagataag

SEQ ID NO: 110844 - DNA, 25 bp, Homo sapien
tgtgtgaaatgaccgaaaagataag

SEQ ID NO: 110845 - DNA, 25 bp, Homo sapien
tgtgtgactgttccataagttatgt

SEQ ID NO: 110846 - DNA, 25 bp, Homo sapien
tgtgtgactgttccgtaagttatgt

SEQ ID NO: 110847 - DNA, 25 bp, Homo sapien
tgtgtgacttatcttaaacagcatc

SEQ ID NO: 110848 - DNA, 25 bp, Homo sapien
tgtgtgacttatcttagacagcatc

SEQ ID NO: 110849 - DNA, 25 bp, Homo sapien
tgtgtgagagctgcttcagaactgt

SEQ ID NO: 110850 - DNA, 25 bp, Homo sapien
tgtgtgagagctgcttgagaactgt

SEQ ID NO: 110851 - DNA, 25 bp, Homo sapien
tgtgtgagtctgagaaagtcagttc

SEQ ID NO: 110852 - DNA, 25 bp, Homo sapien
tgtgtgagtctgggaaagtcagttc

SEQ ID NO: 110853 - DNA, 25 bp, Homo sapien
tgtgtgatctgctttggccaacaaa

SEQ ID NO: 110854 - DNA, 25 bp, Homo sapien
tgtgtgattaaagtgggctcacctg

SEQ ID NO: 110855 - DNA, 25 bp, Homo sapien
tgtgtgattgaagtgggctcacctg

SEQ ID NO: 110856 - DNA, 25 bp, Homo sapien
tgtgtgatttgctttggccaacaaa

SEQ ID NO: 110857 - DNA, 25 bp, Homo sapien
tgtgtgcccactttcctttgtttaa

SEQ ID NO: 110858 - DNA, 25 bp, Homo sapien
tgtgtgcccgctttcctttgtttaa

SEQ ID NO: 110859 - DNA, 25 bp, Homo sapien
tgtgtgccctacgcaaatgaaaagg

SEQ ID NO: 110860 - DNA, 25 bp, Homo sapien
tgtgtgccctatgcaaatgaaaagg

SEQ ID NO: 110861 - DNA, 25 bp, Homo sapien
tgtgtgcctccatattttagcagag

SEQ ID NO: 110862 - DNA, 25 bp, Homo sapien
tgtgtgcctccgtattttagcagag

SEQ ID NO: 110863 - DNA, 25 bp, Homo sapien
tgtgtgctccctgactggcaatcct

SEQ ID NO: 110864 - DNA, 25 bp, Homo sapien
tgtgtgctctctgactggcaatcct

SEQ ID NO: 110865 - DNA, 25 bp, Homo sapien
tgtgtgctgaaaagatgggacaaat

SEQ ID NO: 110866 - DNA, 25 bp, Homo sapien
tgtgtgctgaagagatgggacaaat

SEQ ID NO: 110867 - DNA, 25 bp, Homo sapien
tgtgtggatcatgcgtgtcatattg

SEQ ID NO: 110868 - DNA, 25 bp, Homo sapien
tgtgtggatcatgcttgtcatattg

SEQ ID NO: 110869 - DNA, 25 bp, Homo sapien
tgtgtggcaatatgattagttacaa

SEQ ID NO: 110870 - DNA, 25 bp, Homo sapien
tgtgtggcgatatgattagttacaa

SEQ ID NO: 110871 - DNA, 25 bp, Homo sapien
tgtgtgggcactaatccctttagat

SEQ ID NO: 110872 - DNA, 25 bp, Homo sapien
tgtgtgggcactactccctttagat

SEQ ID NO: 110873 - DNA, 25 bp, Homo sapien
tgtgtgggttttctgggagttcaaa

SEQ ID NO: 110874 - DNA, 25 bp, Homo sapien
tgtgtgggttttttgggagttcaaa

SEQ ID NO: 110875 - DNA, 25 bp, Homo sapien
tgtgtggtacaacgtgaagtcagtc

SEQ ID NO: 110876 - DNA, 25 bp, Homo sapien
tgtgtggtacaatgtgaagtcagtc

SEQ ID NO: 110877 - DNA, 25 bp, Homo sapien
tgtgtgtacggcaagcatttgttag

SEQ ID NO: 110878 - DNA, 25 bp, Homo sapien
tgtgtgtacggcgagcatttgttag

SEQ ID NO: 110879 - DNA, 25 bp, Homo sapien
tgtgtgtagaagaggaaaatatgat

SEQ ID NO: 110880 - DNA, 25 bp, Homo sapien
tgtgtgtagaagaggacaatatgat

SEQ ID NO: 110881 - DNA, 25 bp, Homo sapien
tgtgtgtatgctttgaactgcaatt

SEQ ID NO: 110882 - DNA, 25 bp, Homo sapien
tgtgtgtattctttgaactgcaatt

SEQ ID NO: 110883 - DNA, 25 bp, Homo sapien
tgtgtgtcaggtcagccgaaggatg

SEQ ID NO: 110884 - DNA, 25 bp, Homo sapien
tgtgtgtcaggtcagctgaaggatg

SEQ ID NO: 110885 - DNA, 25 bp, Homo sapien
tgtgtgtcatccaatcataacagga

SEQ ID NO: 110886 - DNA, 25 bp, Homo sapien
tgtgtgtcatccagtcataacagga

SEQ ID NO: 110887 - DNA, 25 bp, Homo sapien
tgtgtgtcttctctggaaatgtgtc

SEQ ID NO: 110888 - DNA, 25 bp, Homo sapien
tgtgtgtcttctttggaaatgtgtc

SEQ ID NO: 110889 - DNA, 25 bp, Homo sapien
tgtgtgtgaatgaagaaacatttaa

SEQ ID NO: 110890 - DNA, 25 bp, Homo sapien
tgtgtgtgaatgaagagacatttaa

SEQ ID NO: 110891 - DNA, 25 bp, Homo sapien
tgtgtgtgagaggaaacctggcatg

SEQ ID NO: 110892 - DNA, 25 bp, Homo sapien
tgtgtgtgagaggaaagctggcatg

SEQ ID NO: 110893 - DNA, 25 bp, Homo sapien
tgtgtgtgctgaaaagatgggacaa

SEQ ID NO: 110894 - DNA, 25 bp, Homo sapien
tgtgtgtgctgaagagatgggacaa

SEQ ID NO: 110895 - DNA, 25 bp, Homo sapien
tgtgtgttaggcaaggcaacctcaa

SEQ ID NO: 110896 - DNA, 25 bp, Homo sapien
tgtgtgttaggcgaggcaacctcaa

SEQ ID NO: 110897 - DNA, 25 bp, Homo sapien
tgtgtgtttagaaggagccttttct

SEQ ID NO: 110898 - DNA, 25 bp, Homo sapien
tgtgtgtttagtaggagccttttct

SEQ ID NO: 110899 - DNA, 25 bp, Homo sapien
tgtgtgtttcctggaaatgccaggg

SEQ ID NO: 110900 - DNA, 25 bp, Homo sapien
tgtgtgttttctggaaatgccaggg

SEQ ID NO: 110901 - DNA, 25 bp, Homo sapien
tgtgttaccataaaggacaactgat

SEQ ID NO: 110902 - DNA, 25 bp, Homo sapien
tgtgttaccgtaaaggacaactgat

SEQ ID NO: 110903 - DNA, 25 bp, Homo sapien
tgtgttagtttcaaaaatcttaatg

SEQ ID NO: 110904 - DNA, 25 bp, Homo sapien
tgtgttagtttcaaaagtcttaatg

SEQ ID NO: 110905 - DNA, 25 bp, Homo sapien
tgtgttatctgaacaagcaaaacct

SEQ ID NO: 110906 - DNA, 25 bp, Homo sapien
tgtgttatctgagcaagcaaaacct

SEQ ID NO: 110907 - DNA, 25 bp, Homo sapien
tgtgttatttccatcatttttctcc

SEQ ID NO: 110908 - DNA, 25 bp, Homo sapien
tgtgttatttcgatcatttttctcc

SEQ ID NO: 110909 - DNA, 25 bp, Homo sapien
tgtgttcaaagcagcgctattcata

SEQ ID NO: 110910 - DNA, 25 bp, Homo sapien
tgtgttcaaagcagtgctattcata

SEQ ID NO: 110911 - DNA, 25 bp, Homo sapien
tgtgttcaatacagatgcagccatc

SEQ ID NO: 110912 - DNA, 25 bp, Homo sapien
tgtgttcaatctttggttactctgt

SEQ ID NO: 110913 - DNA, 25 bp, Homo sapien
tgtgttcagctttcctcctgcttgg

SEQ ID NO: 110914 - DNA, 25 bp, Homo sapien
tgtgttcagctttccttctgcttgg

SEQ ID NO: 110915 - DNA, 25 bp, Homo sapien
tgtgttcagtacagatgcagccatc

SEQ ID NO: 110916 - DNA, 25 bp, Homo sapien
tgtgttcagtctttggttactctgt

SEQ ID NO: 110917 - DNA, 25 bp, Homo sapien
tgtgttcatatcataaacattatcc

SEQ ID NO: 110918 - DNA, 25 bp, Homo sapien
tgtgttcatatcgtaaacattatcc

SEQ ID NO: 110919 - DNA, 25 bp, Homo sapien
tgtgttcgactttatatctgccttt

SEQ ID NO: 110920 - DNA, 25 bp, Homo sapien
tgtgttcgccatctaccgcagcggg

SEQ ID NO: 110921 - DNA, 25 bp, Homo sapien
tgtgttcggcatctaccgcagcggg

SEQ ID NO: 110922 - DNA, 25 bp, Homo sapien
tgtgttcggctttatatctgccttt

SEQ ID NO: 110923 - DNA, 25 bp, Homo sapien
tgtgttgaatgtgttcaagaaacag

SEQ ID NO: 110924 - DNA, 25 bp, Homo sapien
tgtgttgagtgtgttcaagaaacag

SEQ ID NO: 110925 - DNA, 25 bp, Homo sapien
tgtgttgcttaaataccacttccag

SEQ ID NO: 110926 - DNA, 25 bp, Homo sapien
tgtgttgcttaaattccacttccag

SEQ ID NO: 110927 - DNA, 25 bp, Homo sapien
tgtgttggcaagtcgatatagccct

SEQ ID NO: 110928 - DNA, 25 bp, Homo sapien
tgtgttggcaagtggatatagccct

SEQ ID NO: 110929 - DNA, 25 bp, Homo sapien
tgtgttggggtctagcatgtattgt

SEQ ID NO: 110930 - DNA, 25 bp, Homo sapien
tgtgttgggttctagcatgtattgt

SEQ ID NO: 110931 - DNA, 25 bp, Homo sapien
tgtgttggtgatcatacaaagctgg

SEQ ID NO: 110932 - DNA, 25 bp, Homo sapien
tgtgttggtgattatacaaagctgg

SEQ ID NO: 110933 - DNA, 25 bp, Homo sapien
tgtgttgtgcactagatagatatgc

SEQ ID NO: 110934 - DNA, 25 bp, Homo sapien
tgtgttgtgcattagatagatatgc

SEQ ID NO: 110935 - DNA, 25 bp, Homo sapien
tgtgttgttctggctgtcaataatc

SEQ ID NO: 110936 - DNA, 25 bp, Homo sapien
tgtgttgttcttgctgtcaataatc

SEQ ID NO: 110937 - DNA, 25 bp, Homo sapien
tgtgtttaacttgaattgctctgca

SEQ ID NO: 110938 - DNA, 25 bp, Homo sapien
tgtgtttacgcatttaccttcaggt

SEQ ID NO: 110939 - DNA, 25 bp, Homo sapien
tgtgtttataccatcttttcctgga

SEQ ID NO: 110940 - DNA, 25 bp, Homo sapien
tgtgtttatacgatcttttcctgga

SEQ ID NO: 110941 - DNA, 25 bp, Homo sapien
tgtgtttatactatcaccatcatca

SEQ ID NO: 110942 - DNA, 25 bp, Homo sapien
tgtgtttatactattaccatcatca

SEQ ID NO: 110943 - DNA, 25 bp, Homo sapien
tgtgtttataggccttcagtgtcag

SEQ ID NO: 110944 - DNA, 25 bp, Homo sapien
tgtgtttatagggcttcagtgtcag

SEQ ID NO: 110945 - DNA, 25 bp, Homo sapien
tgtgtttatcttgaattgctctgca

SEQ ID NO: 110946 - DNA, 25 bp, Homo sapien
tgtgtttatgcatttaccttcaggt

SEQ ID NO: 110947 - DNA, 25 bp, Homo sapien
tgtgtttccactaactccatgcaaa

SEQ ID NO: 110948 - DNA, 25 bp, Homo sapien
tgtgtttccctaattgctagtgagg

SEQ ID NO: 110949 - DNA, 25 bp, Homo sapien
tgtgtttccgctaactccatgcaaa

SEQ ID NO: 110950 - DNA, 25 bp, Homo sapien
tgtgtttctctaattgctagtgagg

SEQ ID NO: 110951 - DNA, 25 bp, Homo sapien
tgtgtttctctctatatatatgcac

SEQ ID NO: 110952 - DNA, 25 bp, Homo sapien
tgtgtttctctctctatatatgcac

SEQ ID NO: 110953 - DNA, 25 bp, Homo sapien
tgtgtttgcacacttaaatggctac

SEQ ID NO: 110954 - DNA, 25 bp, Homo sapien
tgtgtttgcactcttaaatggctac

SEQ ID NO: 110955 - DNA, 25 bp, Homo sapien
tgtgtttgcttttccttgtctgtgt

SEQ ID NO: 110956 - DNA, 25 bp, Homo sapien
tgtgtttggcttcaataattccatt

SEQ ID NO: 110957 - DNA, 25 bp, Homo sapien
tgtgtttggctttaataattccatt

SEQ ID NO: 110958 - DNA, 25 bp, Homo sapien
tgtgtttgtacatgtatcttgttgt

SEQ ID NO: 110959 - DNA, 25 bp, Homo sapien
tgtgtttgtacgtgtatcttgttgt

SEQ ID NO: 110960 - DNA, 25 bp, Homo sapien
tgtgtttgtgagaatcctcttttac

SEQ ID NO: 110961 - DNA, 25 bp, Homo sapien
tgtgtttgtgagagtcctcttttac

SEQ ID NO: 110962 - DNA, 25 bp, Homo sapien
tgtgtttgtgcaaatcctaggtgct

SEQ ID NO: 110963 - DNA, 25 bp, Homo sapien
tgtgtttgtgcaaatcttaggtgct

SEQ ID NO: 110964 - DNA, 25 bp, Homo sapien
tgtgtttgtttttccttgtctgtgt

SEQ ID NO: 110965 - DNA, 25 bp, Homo sapien
tgtgttttaacacggatattttgca

SEQ ID NO: 110966 - DNA, 25 bp, Homo sapien
tgtgttttaacatggatattttgca

SEQ ID NO: 110967 - DNA, 25 bp, Homo sapien
tgtgttttaggcgataacatttcat

SEQ ID NO: 110968 - DNA, 25 bp, Homo sapien
tgtgttttaggtgataacatttcat

SEQ ID NO: 110969 - DNA, 25 bp, Homo sapien
tgtgttttcaagaaagtaatttacc

SEQ ID NO: 110970 - DNA, 25 bp, Homo sapien
tgtgttttcaagacagtaatttacc

SEQ ID NO: 110971 - DNA, 25 bp, Homo sapien
tgtgttttcagttgttattttcttg

SEQ ID NO: 110972 - DNA, 25 bp, Homo sapien
tgtgttttggtgattgtatgtgtca

SEQ ID NO: 110973 - DNA, 25 bp, Homo sapien
tgtgttttgttgattgtatgtgtca

SEQ ID NO: 110974 - DNA, 25 bp, Homo sapien
tgtgtttttagttagctctccatag

SEQ ID NO: 110975 - DNA, 25 bp, Homo sapien
tgtgtttttagttgttattttcttg

SEQ ID NO: 110976 - DNA, 25 bp, Homo sapien
tgtgtttttggttagctctccatag

SEQ ID NO: 110977 - DNA, 25 bp, Homo sapien
tgttaaaaagaaatgatgtcaaagg

SEQ ID NO: 110978 - DNA, 25 bp, Homo sapien
tgttaaaacccatagaatatacaac

SEQ ID NO: 110979 - DNA, 25 bp, Homo sapien
tgttaaaacccatagactatacaac

SEQ ID NO: 110980 - DNA, 25 bp, Homo sapien
tgttaaaacgctgcaatgaagaata

SEQ ID NO: 110981 - DNA, 25 bp, Homo sapien
tgttaaaagtcaaccgtttactggc

SEQ ID NO: 110982 - DNA, 25 bp, Homo sapien
tgttaaaagtcagccgtttactggc

SEQ ID NO: 110983 - DNA, 25 bp, Homo sapien
tgttaaaatatacctacaaatgcaa

SEQ ID NO: 110984 - DNA, 25 bp, Homo sapien
tgttaaaatgaaatgatgtcaaagg

SEQ ID NO: 110985 - DNA, 25 bp, Homo sapien
tgttaaaatgctgcaatgaagaata

SEQ ID NO: 110986 - DNA, 25 bp, Homo sapien
tgttaaaatgtacctacaaatgcaa

SEQ ID NO: 110987 - DNA, 25 bp, Homo sapien
tgttaaacattctgtagttaacacc

SEQ ID NO: 110988 - DNA, 25 bp, Homo sapien
tgttaaacattgtgtagttaacacc

SEQ ID NO: 110989 - DNA, 25 bp, Homo sapien
tgttaaacttacctgataggattcc

SEQ ID NO: 110990 - DNA, 25 bp, Homo sapien
tgttaaacttatctgataggattcc

SEQ ID NO: 110991 - DNA, 25 bp, Homo sapien
tgttaaagcacacattgctgggcct

SEQ ID NO: 110992 - DNA, 25 bp, Homo sapien
tgttaaagcacagattgctgggcct

SEQ ID NO: 110993 - DNA, 25 bp, Homo sapien
tgttaaagggacatcgaaatctcga

SEQ ID NO: 110994 - DNA, 25 bp, Homo sapien
tgttaaagggacatcggaatctcga

SEQ ID NO: 110995 - DNA, 25 bp, Homo sapien
tgttaaagtcttttagcccatctta

SEQ ID NO: 110996 - DNA, 25 bp, Homo sapien
tgttaaagtcttttagtccatctta

SEQ ID NO: 110997 - DNA, 25 bp, Homo sapien
tgttaaagttctacacctcattata

SEQ ID NO: 110998 - DNA, 25 bp, Homo sapien
tgttaaagttctatacctcattata

SEQ ID NO: 110999 - DNA, 25 bp, Homo sapien
tgttaaatacctaagcatctcaaaa

SEQ ID NO: 111000 - DNA, 25 bp, Homo sapien
tgttaaatacctaggcatctcaaaa

SEQ ID NO: 111001 - DNA, 25 bp, Homo sapien
tgttaaatactgactcacaggagag

SEQ ID NO: 111002 - DNA, 25 bp, Homo sapien
tgttaaatactgagtcacaggagag

SEQ ID NO: 111003 - DNA, 25 bp, Homo sapien
tgttaaatatcctgataagttcaca

SEQ ID NO: 111004 - DNA, 25 bp, Homo sapien
tgttaaatatcctgttaagttcaca

SEQ ID NO: 111005 - DNA, 25 bp, Homo sapien
tgttaaatgtccagtaccaggtttg

SEQ ID NO: 111006 - DNA, 25 bp, Homo sapien
tgttaaatgtccggtaccaggtttg

SEQ ID NO: 111007 - DNA, 25 bp, Homo sapien
tgttaacacgtgtgaggagattgta

SEQ ID NO: 111008 - DNA, 25 bp, Homo sapien
tgttaacagagtcctaactgagctg

SEQ ID NO: 111009 - DNA, 25 bp, Homo sapien
tgttaacagagttctaactgagctg

SEQ ID NO: 111010 - DNA, 25 bp, Homo sapien
tgttaacatcaagcttctaggatag

SEQ ID NO: 111011 - DNA, 25 bp, Homo sapien
tgttaacatcaagcttgtaggatag

SEQ ID NO: 111012 - DNA, 25 bp, Homo sapien
tgttaacatgtgtgaggagattgta

SEQ ID NO: 111013 - DNA, 25 bp, Homo sapien
tgttaaccaatctctgactattcac

SEQ ID NO: 111014 - DNA, 25 bp, Homo sapien
tgttaaccaatttctgactattcac

SEQ ID NO: 111015 - DNA, 25 bp, Homo sapien
tgttaaccctactaccacattcttc

SEQ ID NO: 111016 - DNA, 25 bp, Homo sapien
tgttaaccttactaccacattcttc

SEQ ID NO: 111017 - DNA, 25 bp, Homo sapien
tgttaactctcctgtgttcatctgt

SEQ ID NO: 111018 - DNA, 25 bp, Homo sapien
tgttaactctcttgtgttcatctgt

SEQ ID NO: 111019 - DNA, 25 bp, Homo sapien
tgttaacttagcctcttcctctatg

SEQ ID NO: 111020 - DNA, 25 bp, Homo sapien
tgttaacttagcttcttcctctatg

SEQ ID NO: 111021 - DNA, 25 bp, Homo sapien
tgttaagatgagccaggtttctttc

SEQ ID NO: 111022 - DNA, 25 bp, Homo sapien
tgttaagatgaggcaggtttctttc

SEQ ID NO: 111023 - DNA, 25 bp, Homo sapien
tgttaagctgatgataaaagaagtt

SEQ ID NO: 111024 - DNA, 25 bp, Homo sapien
tgttaagctgatggtaaaagaagtt

SEQ ID NO: 111025 - DNA, 25 bp, Homo sapien
tgttaagttattgcacatgagataa

SEQ ID NO: 111026 - DNA, 25 bp, Homo sapien
tgttaagttattgcacgtgagataa

SEQ ID NO: 111027 - DNA, 25 bp, Homo sapien
tgttaataaagatggtgctaccttc

SEQ ID NO: 111028 - DNA, 25 bp, Homo sapien
tgttaataaagattgtgctaccttc

SEQ ID NO: 111029 - DNA, 25 bp, Homo sapien
tgttaatagttgtggacaagtttta

SEQ ID NO: 111030 - DNA, 25 bp, Homo sapien
tgttaatagttgtggagaagtttta

SEQ ID NO: 111031 - DNA, 25 bp, Homo sapien
tgttaatcatttacacaagcatgga

SEQ ID NO: 111032 - DNA, 25 bp, Homo sapien
tgttaatcgtttacacaagcatgga

SEQ ID NO: 111033 - DNA, 25 bp, Homo sapien
tgttaatgaatatactgcttgtccc

SEQ ID NO: 111034 - DNA, 25 bp, Homo sapien
tgttaatggatatactgcttgtccc

SEQ ID NO: 111035 - DNA, 25 bp, Homo sapien
tgttaatgtggccgtctccaatcac

SEQ ID NO: 111036 - DNA, 25 bp, Homo sapien
tgttaatgtggctgtctccaatcac

SEQ ID NO: 111037 - DNA, 25 bp, Homo sapien
tgttaattacggacgcaaacaaggc

SEQ ID NO: 111038 - DNA, 25 bp, Homo sapien
tgttaattacggatgcaaacaaggc

SEQ ID NO: 111039 - DNA, 25 bp, Homo sapien
tgttaattccatgattttgacaagt

SEQ ID NO: 111040 - DNA, 25 bp, Homo sapien
tgttaattccatggttttgacaagt

SEQ ID NO: 111041 - DNA, 25 bp, Homo sapien
tgttacaaagttagccagatctcaa

SEQ ID NO: 111042 - DNA, 25 bp, Homo sapien
tgttacaaagttagtcagatctcaa

SEQ ID NO: 111043 - DNA, 25 bp, Homo sapien
tgttacatatattcatagactgagg

SEQ ID NO: 111044 - DNA, 25 bp, Homo sapien
tgttacatgtattcatagactgagg

SEQ ID NO: 111045 - DNA, 25 bp, Homo sapien
tgttacattttaagagtgacaagca

SEQ ID NO: 111046 - DNA, 25 bp, Homo sapien
tgttacattttacgagtgacaagca

SEQ ID NO: 111047 - DNA, 25 bp, Homo sapien
tgttaccaatctgatgaggaaagca

SEQ ID NO: 111048 - DNA, 25 bp, Homo sapien
tgttaccaatcttatgaggaaagca

SEQ ID NO: 111049 - DNA, 25 bp, Homo sapien
tgttaccacgcctcgacagcccctg

SEQ ID NO: 111050 - DNA, 25 bp, Homo sapien
tgttaccagaagaaagttatgtaga

SEQ ID NO: 111051 - DNA, 25 bp, Homo sapien
tgttaccagaaggaagttatgtaga

SEQ ID NO: 111052 - DNA, 25 bp, Homo sapien
tgttaccagatcttcgcatgttttt

SEQ ID NO: 111053 - DNA, 25 bp, Homo sapien
tgttaccagatctttgcatgttttt

SEQ ID NO: 111054 - DNA, 25 bp, Homo sapien
tgttaccagcactagcggatgtgaa

SEQ ID NO: 111055 - DNA, 25 bp, Homo sapien
tgttaccagcattagcggatgtgaa

SEQ ID NO: 111056 - DNA, 25 bp, Homo sapien
tgttaccatgcctcgacagcccctg

SEQ ID NO: 111057 - DNA, 25 bp, Homo sapien
tgttacccaagacggttattccaga

SEQ ID NO: 111058 - DNA, 25 bp, Homo sapien
tgttacccaagatggttattccaga

SEQ ID NO: 111059 - DNA, 25 bp, Homo sapien
tgttacgtacctatgcttcttttaa

SEQ ID NO: 111060 - DNA, 25 bp, Homo sapien
tgttacgtacctgtgcttcttttaa

SEQ ID NO: 111061 - DNA, 25 bp, Homo sapien
tgttactccaaattgctggcttcag

SEQ ID NO: 111062 - DNA, 25 bp, Homo sapien
tgttactctaaattgctggcttcag

SEQ ID NO: 111063 - DNA, 25 bp, Homo sapien
tgttactgacatgatgccccttcac

SEQ ID NO: 111064 - DNA, 25 bp, Homo sapien
tgttactgacattatgccccttcac

SEQ ID NO: 111065 - DNA, 25 bp, Homo sapien
tgttactggttgcgtgttaactggt

SEQ ID NO: 111066 - DNA, 25 bp, Homo sapien
tgttactggttgtgtgttaactggt

SEQ ID NO: 111067 - DNA, 25 bp, Homo sapien
tgttactgtccccgtaaaggtaatg

SEQ ID NO: 111068 - DNA, 25 bp, Homo sapien
tgttactgtccctgtaaaggtaatg

SEQ ID NO: 111069 - DNA, 25 bp, Homo sapien
tgttagaacccatggttgccacgag

SEQ ID NO: 111070 - DNA, 25 bp, Homo sapien
tgttagaactcatggttgccacgag

SEQ ID NO: 111071 - DNA, 25 bp, Homo sapien
tgttagacatactgttcggatctgc

SEQ ID NO: 111072 - DNA, 25 bp, Homo sapien
tgttagacatactgtttggatctgc

SEQ ID NO: 111073 - DNA, 25 bp, Homo sapien
tgttagaccattctggcagcaatgt

SEQ ID NO: 111074 - DNA, 25 bp, Homo sapien
tgttagaccgttctggcagcaatgt

SEQ ID NO: 111075 - DNA, 25 bp, Homo sapien
tgttagagccttgatcaactgctag

SEQ ID NO: 111076 - DNA, 25 bp, Homo sapien
tgttagaggcttgatcaactgctag

SEQ ID NO: 111077 - DNA, 25 bp, Homo sapien
tgttagattctaaatttactacttc

SEQ ID NO: 111078 - DNA, 25 bp, Homo sapien
tgttagattgtaaatttactacttc

SEQ ID NO: 111079 - DNA, 25 bp, Homo sapien
tgttagcataatggacttgtgacca

SEQ ID NO: 111080 - DNA, 25 bp, Homo sapien
tgttagcataatggccttgtgacca

SEQ ID NO: 111081 - DNA, 25 bp, Homo sapien
tgttagccgaatgccctcaagagct

SEQ ID NO: 111082 - DNA, 25 bp, Homo sapien
tgttagccgaatgtcctcaagagct

SEQ ID NO: 111083 - DNA, 25 bp, Homo sapien
tgttaggaagaataaatacgttaat

SEQ ID NO: 111084 - DNA, 25 bp, Homo sapien
tgttaggatgaataaatacgttaat

SEQ ID NO: 111085 - DNA, 25 bp, Homo sapien
tgttaggcaaggcaacctcaattat

SEQ ID NO: 111086 - DNA, 25 bp, Homo sapien
tgttaggcgaggcaacctcaattat

SEQ ID NO: 111087 - DNA, 25 bp, Homo sapien
tgttaggctgcttctttgcctttct

SEQ ID NO: 111088 - DNA, 25 bp, Homo sapien
tgttaggcttcttctttgcctttct

SEQ ID NO: 111089 - DNA, 25 bp, Homo sapien
tgttaggtgaacaaatacttttcat

SEQ ID NO: 111090 - DNA, 25 bp, Homo sapien
tgttaggtgaacaactacttttcat

SEQ ID NO: 111091 - DNA, 25 bp, Homo sapien
tgttaggttgcactgtcctccttgg

SEQ ID NO: 111092 - DNA, 25 bp, Homo sapien
tgttaggttgcagtgtcctccttgg

SEQ ID NO: 111093 - DNA, 25 bp, Homo sapien
tgttaggtttgctctattctttatt

SEQ ID NO: 111094 - DNA, 25 bp, Homo sapien
tgttaggtttgctttattctttatt

SEQ ID NO: 111095 - DNA, 25 bp, Homo sapien
tgttagtcgttctggcacttaaaat

SEQ ID NO: 111096 - DNA, 25 bp, Homo sapien
tgttagtctttctggcacttaaaat

SEQ ID NO: 111097 - DNA, 25 bp, Homo sapien
tgttagtgcagatctgtggtactgc

SEQ ID NO: 111098 - DNA, 25 bp, Homo sapien
tgttagtgcatctcatggatacaat

SEQ ID NO: 111099 - DNA, 25 bp, Homo sapien
tgttagtgcatttcatggatacaat

SEQ ID NO: 111100 - DNA, 25 bp, Homo sapien
tgttagtgccatcccgtaagctatc

SEQ ID NO: 111101 - DNA, 25 bp, Homo sapien
tgttagtgcggatctgtggtactgc

SEQ ID NO: 111102 - DNA, 25 bp, Homo sapien
tgttagtgtcatcccgtaagctatc

SEQ ID NO: 111103 - DNA, 25 bp, Homo sapien
tgttagtttcaaaaatcttaatgta

SEQ ID NO: 111104 - DNA, 25 bp, Homo sapien
tgttagtttcaaaagtcttaatgta

SEQ ID NO: 111105 - DNA, 25 bp, Homo sapien
tgttagtttccattttcttctgttc

SEQ ID NO: 111106 - DNA, 25 bp, Homo sapien
tgttagtttccgttttcttctgttc

SEQ ID NO: 111107 - DNA, 25 bp, Homo sapien
tgttataagcttgttcagaattatt

SEQ ID NO: 111108 - DNA, 25 bp, Homo sapien
tgttataagcttgttctgaattatt

SEQ ID NO: 111109 - DNA, 25 bp, Homo sapien
tgttataatttaattggcagcatta

SEQ ID NO: 111110 - DNA, 25 bp, Homo sapien
tgttataatttcattggcagcatta

SEQ ID NO: 111111 - DNA, 25 bp, Homo sapien
tgttatacccttacgcaatttaata

SEQ ID NO: 111112 - DNA, 25 bp, Homo sapien
tgttatacccttaggcaatttaata

SEQ ID NO: 111113 - DNA, 25 bp, Homo sapien
tgttatatccaatgcgtatgtgcaa

SEQ ID NO: 111114 - DNA, 25 bp, Homo sapien
tgttatatccaatgtgtatgtgcaa

SEQ ID NO: 111115 - DNA, 25 bp, Homo sapien
tgttatctgaggatgaaaaaatgac

SEQ ID NO: 111116 - DNA, 25 bp, Homo sapien
tgttatctgaggttgaaaaaatgac

SEQ ID NO: 111117 - DNA, 25 bp, Homo sapien
tgttatgaatgtatgcaactcttgt

SEQ ID NO: 111118 - DNA, 25 bp, Homo sapien
tgttatgaatgtatgctactcttgt

SEQ ID NO: 111119 - DNA, 25 bp, Homo sapien
tgttatgacaggacacaaaggaggt

SEQ ID NO: 111120 - DNA, 25 bp, Homo sapien
tgttatgacagggcacaaaggaggt

SEQ ID NO: 111121 - DNA, 25 bp, Homo sapien
tgttatgggcatagaccctgcctag

SEQ ID NO: 111122 - DNA, 25 bp, Homo sapien
tgttatgggcatagactctgcctag

SEQ ID NO: 111123 - DNA, 25 bp, Homo sapien
tgttatgtcttcaagctcacccatc

SEQ ID NO: 111124 - DNA, 25 bp, Homo sapien
tgttatgtcttcaggctcacccatc

SEQ ID NO: 111125 - DNA, 25 bp, Homo sapien
tgttattatgatccatctttatgaa

SEQ ID NO: 111126 - DNA, 25 bp, Homo sapien
tgttattatgatccatgtttatgaa

SEQ ID NO: 111127 - DNA, 25 bp, Homo sapien
tgttattcatgcaattcctgacaat

SEQ ID NO: 111128 - DNA, 25 bp, Homo sapien
tgttattcatgcagttcctgacaat

SEQ ID NO: 111129 - DNA, 25 bp, Homo sapien
tgttattcttagagattatgtcagg

SEQ ID NO: 111130 - DNA, 25 bp, Homo sapien
tgttattcttagcgattatgtcagg

SEQ ID NO: 111131 - DNA, 25 bp, Homo sapien
tgttatttaggtcatatttatttca

SEQ ID NO: 111132 - DNA, 25 bp, Homo sapien
tgttatttaggtcgtatttatttca

SEQ ID NO: 111133 - DNA, 25 bp, Homo sapien
tgttatttccatcatttttctcctt

SEQ ID NO: 111134 - DNA, 25 bp, Homo sapien
tgttatttcgatcatttttctcctt

SEQ ID NO: 111135 - DNA, 25 bp, Homo sapien
tgttatttcgctgagaatgatagtt

SEQ ID NO: 111136 - DNA, 25 bp, Homo sapien
tgttatttgaattattccagtccat

SEQ ID NO: 111137 - DNA, 25 bp, Homo sapien
tgttatttgaattattgcagtccat

SEQ ID NO: 111138 - DNA, 25 bp, Homo sapien
tgttattttaaatggaagaacttgg

SEQ ID NO: 111139 - DNA, 25 bp, Homo sapien
tgttattttaagtggaagaacttgg

SEQ ID NO: 111140 - DNA, 25 bp, Homo sapien
tgttattttagcataagctcatttg

SEQ ID NO: 111141 - DNA, 25 bp, Homo sapien
tgttattttagcgtaagctcatttg

SEQ ID NO: 111142 - DNA, 25 bp, Homo sapien
tgttattttatagacgatgagttga

SEQ ID NO: 111143 - DNA, 25 bp, Homo sapien
tgttattttatagacgctgagttga

SEQ ID NO: 111144 - DNA, 25 bp, Homo sapien
tgttattttcttccgacctcatatc

SEQ ID NO: 111145 - DNA, 25 bp, Homo sapien
tgttattttcttctgacctcatatc

SEQ ID NO: 111146 - DNA, 25 bp, Homo sapien
tgttattttgctgagaatgatagtt

SEQ ID NO: 111147 - DNA, 25 bp, Homo sapien
tgttcaaagcagcgctattcatatt

SEQ ID NO: 111148 - DNA, 25 bp, Homo sapien
tgttcaaagcagtgctattcatatt

SEQ ID NO: 111149 - DNA, 25 bp, Homo sapien
tgttcaacgaataaatagatggatc

SEQ ID NO: 111150 - DNA, 25 bp, Homo sapien
tgttcaacgaataaatggatggatc

SEQ ID NO: 111151 - DNA, 25 bp, Homo sapien
tgttcaatacaaacttattgagcaa

SEQ ID NO: 111152 - DNA, 25 bp, Homo sapien
tgttcaatacaaatttattgagcaa

SEQ ID NO: 111153 - DNA, 25 bp, Homo sapien
tgttcaatatacgtttgttgattaa

SEQ ID NO: 111154 - DNA, 25 bp, Homo sapien
tgttcaatatatgtttgttgattaa

SEQ ID NO: 111155 - DNA, 25 bp, Homo sapien
tgttcacatagaagacaatttagga

SEQ ID NO: 111156 - DNA, 25 bp, Homo sapien
tgttcacatagaagacgatttagga

SEQ ID NO: 111157 - DNA, 25 bp, Homo sapien
tgttcacatctgctctctgaatcag

SEQ ID NO: 111158 - DNA, 25 bp, Homo sapien
tgttcacatttgctctctgaatcag

SEQ ID NO: 111159 - DNA, 25 bp, Homo sapien
tgttcaccataacagtgttgggctt

SEQ ID NO: 111160 - DNA, 25 bp, Homo sapien
tgttcaccataacattgttgggctt

SEQ ID NO: 111161 - DNA, 25 bp, Homo sapien
tgttcacctgaatggcatggctttc

SEQ ID NO: 111162 - DNA, 25 bp, Homo sapien
tgttcacctgaatggcgtggctttc

SEQ ID NO: 111163 - DNA, 25 bp, Homo sapien
tgttcactttcatatcaaatatatc

SEQ ID NO: 111164 - DNA, 25 bp, Homo sapien
tgttcactttcatgtcaaatatatc

SEQ ID NO: 111165 - DNA, 25 bp, Homo sapien
tgttcagaaacctctcacatgcatg

SEQ ID NO: 111166 - DNA, 25 bp, Homo sapien
tgttcagaaccctctcacatgcatg

SEQ ID NO: 111167 - DNA, 25 bp, Homo sapien
tgttcagcatgaagtttttggaatt

SEQ ID NO: 111168 - DNA, 25 bp, Homo sapien
tgttcagccaggaactaagaaagaa

SEQ ID NO: 111169 - DNA, 25 bp, Homo sapien
tgttcagccaggatctaagaaagaa

SEQ ID NO: 111170 - DNA, 25 bp, Homo sapien
tgttcagcgtgaagtttttggaatt

SEQ ID NO: 111171 - DNA, 25 bp, Homo sapien
tgttcagctttcctcctgcttgggt

SEQ ID NO: 111172 - DNA, 25 bp, Homo sapien
tgttcagctttccttctgcttgggt

SEQ ID NO: 111173 - DNA, 25 bp, Homo sapien
tgttcagtcgtctaataattttatt

SEQ ID NO: 111174 - DNA, 25 bp, Homo sapien
tgttcagtctcacccattagagctc

SEQ ID NO: 111175 - DNA, 25 bp, Homo sapien
tgttcagtcttctaataattttatt

SEQ ID NO: 111176 - DNA, 25 bp, Homo sapien
tgttcagtgatggctgagtgctggc

SEQ ID NO: 111177 - DNA, 25 bp, Homo sapien
tgttcagtgatgtctgagtgctggc

SEQ ID NO: 111178 - DNA, 25 bp, Homo sapien
tgttcagtgttttatccccagatcc

SEQ ID NO: 111179 - DNA, 25 bp, Homo sapien
tgttcagtgttttgtccccagatcc

SEQ ID NO: 111180 - DNA, 25 bp, Homo sapien
tgttcagttaatgtgacttttgttt

SEQ ID NO: 111181 - DNA, 25 bp, Homo sapien
tgttcagttaatgtgatttttgttt

SEQ ID NO: 111182 - DNA, 25 bp, Homo sapien
tgttcagtttcacccattagagctc

SEQ ID NO: 111183 - DNA, 25 bp, Homo sapien
tgttcataatttccggtatggttta

SEQ ID NO: 111184 - DNA, 25 bp, Homo sapien
tgttcataatttcctgtatggttta

SEQ ID NO: 111185 - DNA, 25 bp, Homo sapien
tgttcatatatctgcttcccattct

SEQ ID NO: 111186 - DNA, 25 bp, Homo sapien
tgttcatatgtctgcttcccattct

SEQ ID NO: 111187 - DNA, 25 bp, Homo sapien
tgttcatcagcatattctgtaaaga

SEQ ID NO: 111188 - DNA, 25 bp, Homo sapien
tgttcatcagcgtattctgtaaaga

SEQ ID NO: 111189 - DNA, 25 bp, Homo sapien
tgttcatctctctatccatcactat

SEQ ID NO: 111190 - DNA, 25 bp, Homo sapien
tgttcatctctctctccatcactat

SEQ ID NO: 111191 - DNA, 25 bp, Homo sapien
tgttcatgctgcaattttctttatt

SEQ ID NO: 111192 - DNA, 25 bp, Homo sapien
tgttcatgctgcgattttctttatt

SEQ ID NO: 111193 - DNA, 25 bp, Homo sapien
tgttcattacatgttactatgagag

SEQ ID NO: 111194 - DNA, 25 bp, Homo sapien
tgttcattcttaccctcagtgcaca

SEQ ID NO: 111195 - DNA, 25 bp, Homo sapien
tgttcattcttactctcagtgcaca

SEQ ID NO: 111196 - DNA, 25 bp, Homo sapien
tgttcatttcatgttactatgagag

SEQ ID NO: 111197 - DNA, 25 bp, Homo sapien
tgttccaaacagaagattatttgct

SEQ ID NO: 111198 - DNA, 25 bp, Homo sapien
tgttccaaacagaatattatttgct

SEQ ID NO: 111199 - DNA, 25 bp, Homo sapien
tgttccaggatcccagcgccttctt

SEQ ID NO: 111200 - DNA, 25 bp, Homo sapien
tgttccaggatcccagtgccttctt

SEQ ID NO: 111201 - DNA, 25 bp, Homo sapien
tgttccatttcccttctctactttg

SEQ ID NO: 111202 - DNA, 25 bp, Homo sapien
tgttccatttcctttctctactttg

SEQ ID NO: 111203 - DNA, 25 bp, Homo sapien
tgttcccagctcatttggcttctgg

SEQ ID NO: 111204 - DNA, 25 bp, Homo sapien
tgttcccaggtcatttggcttctgg

SEQ ID NO: 111205 - DNA, 25 bp, Homo sapien
tgttcccttcaatggattccaggct

SEQ ID NO: 111206 - DNA, 25 bp, Homo sapien
tgttcccttcaatgtattccaggct

SEQ ID NO: 111207 - DNA, 25 bp, Homo sapien
tgttcctcaatcttggtgctattgt

SEQ ID NO: 111208 - DNA, 25 bp, Homo sapien
tgttcctcagtcttggtgctattgt

SEQ ID NO: 111209 - DNA, 25 bp, Homo sapien
tgttcctctaccatttttatggccc

SEQ ID NO: 111210 - DNA, 25 bp, Homo sapien
tgttcctctacgatttttatggccc

SEQ ID NO: 111211 - DNA, 25 bp, Homo sapien
tgttcctctcatacgcaaaatatat

SEQ ID NO: 111212 - DNA, 25 bp, Homo sapien
tgttcctctcatacgcgaaatatat

SEQ ID NO: 111213 - DNA, 25 bp, Homo sapien
tgttcctgcttcatgccactagctc

SEQ ID NO: 111214 - DNA, 25 bp, Homo sapien
tgttcctgcttcgtgccactagctc

SEQ ID NO: 111215 - DNA, 25 bp, Homo sapien
tgttcgagacttacatgctcatgac

SEQ ID NO: 111216 - DNA, 25 bp, Homo sapien
tgttcgagatttacatgctcatgac

SEQ ID NO: 111217 - DNA, 25 bp, Homo sapien
tgttcgtaatgctagacacatcgcc

SEQ ID NO: 111218 - DNA, 25 bp, Homo sapien
tgttcgtaatgctggacacatcgcc

SEQ ID NO: 111219 - DNA, 25 bp, Homo sapien
tgttctaacagcgaattttgagtga

SEQ ID NO: 111220 - DNA, 25 bp, Homo sapien
tgttctaacagtgaattttgagtga

SEQ ID NO: 111221 - DNA, 25 bp, Homo sapien
tgttctaggatacaacaagaaggat

SEQ ID NO: 111222 - DNA, 25 bp, Homo sapien
tgttctaggataccacaagaaggat

SEQ ID NO: 111223 - DNA, 25 bp, Homo sapien
tgttctatactcacacaaatttatt

SEQ ID NO: 111224 - DNA, 25 bp, Homo sapien
tgttctatacttacacaaatttatt

SEQ ID NO: 111225 - DNA, 25 bp, Homo sapien
tgttctcacaggcatcacagatagg

SEQ ID NO: 111226 - DNA, 25 bp, Homo sapien
tgttctcacaggcatctcagatagg

SEQ ID NO: 111227 - DNA, 25 bp, Homo sapien
tgttctcacgtcttctaagagattc

SEQ ID NO: 111228 - DNA, 25 bp, Homo sapien
tgttctcagaacgttaccacacttt

SEQ ID NO: 111229 - DNA, 25 bp, Homo sapien
tgttctcagaatgttaccacacttt

SEQ ID NO: 111230 - DNA, 25 bp, Homo sapien
tgttctcagcaaaaagcagcaatat

SEQ ID NO: 111231 - DNA, 25 bp, Homo sapien
tgttctcagcacaaagcagcaatat

SEQ ID NO: 111232 - DNA, 25 bp, Homo sapien
tgttctcagtggtccacgtgctaca

SEQ ID NO: 111233 - DNA, 25 bp, Homo sapien
tgttctcagtggtccatgtgctaca

SEQ ID NO: 111234 - DNA, 25 bp, Homo sapien
tgttctcagtttgggagagaatatg

SEQ ID NO: 111235 - DNA, 25 bp, Homo sapien
tgttctcagttttggagagaatatg

SEQ ID NO: 111236 - DNA, 25 bp, Homo sapien
tgttctcatgtcttctaagagattc

SEQ ID NO: 111237 - DNA, 25 bp, Homo sapien
tgttctcatttgccttacgggtgtc

SEQ ID NO: 111238 - DNA, 25 bp, Homo sapien
tgttctcatttgctttacgggtgtc

SEQ ID NO: 111239 - DNA, 25 bp, Homo sapien
tgttctccagaggacactgctctgt

SEQ ID NO: 111240 - DNA, 25 bp, Homo sapien
tgttctccagaggccactgctctgt

SEQ ID NO: 111241 - DNA, 25 bp, Homo sapien
tgttctccatggtctcaaggcctct

SEQ ID NO: 111242 - DNA, 25 bp, Homo sapien
tgttctccatggtctcgaggcctct

SEQ ID NO: 111243 - DNA, 25 bp, Homo sapien
tgttctcccatagaaataaaatata

SEQ ID NO: 111244 - DNA, 25 bp, Homo sapien
tgttctcccgtagaaataaaatata

SEQ ID NO: 111245 - DNA, 25 bp, Homo sapien
tgttctccttccatggttcttcact

SEQ ID NO: 111246 - DNA, 25 bp, Homo sapien
tgttctccttctatggttcttcact

SEQ ID NO: 111247 - DNA, 25 bp, Homo sapien
tgttctctactcgccttcataaata

SEQ ID NO: 111248 - DNA, 25 bp, Homo sapien
tgttctctacttgccttcataaata

SEQ ID NO: 111249 - DNA, 25 bp, Homo sapien
tgttctctcactgccactaatttag

SEQ ID NO: 111250 - DNA, 25 bp, Homo sapien
tgttctctcactgctactaatttag

SEQ ID NO: 111251 - DNA, 25 bp, Homo sapien
tgttctctggcaatgtgaatattcc

SEQ ID NO: 111252 - DNA, 25 bp, Homo sapien
tgttctctggctatgtgaatattcc

SEQ ID NO: 111253 - DNA, 25 bp, Homo sapien
tgttctcttggcaagttcatagtca

SEQ ID NO: 111254 - DNA, 25 bp, Homo sapien
tgttctcttggccagttcatagtca

SEQ ID NO: 111255 - DNA, 25 bp, Homo sapien
tgttctctttccatctgggtctagg

SEQ ID NO: 111256 - DNA, 25 bp, Homo sapien
tgttctctttccgtctgggtctagg

SEQ ID NO: 111257 - DNA, 25 bp, Homo sapien
tgttctgagtggtgctaaaagaatc

SEQ ID NO: 111258 - DNA, 25 bp, Homo sapien
tgttctgagtggtgttaaaagaatc

SEQ ID NO: 111259 - DNA, 25 bp, Homo sapien
tgttctgagttgaaattcagttaga

SEQ ID NO: 111260 - DNA, 25 bp, Homo sapien
tgttctgagttgaatttcagttaga

SEQ ID NO: 111261 - DNA, 25 bp, Homo sapien
tgttctgcagcctaaatacttgaaa

SEQ ID NO: 111262 - DNA, 25 bp, Homo sapien
tgttctgcagcctagatacttgaaa

SEQ ID NO: 111263 - DNA, 25 bp, Homo sapien
tgttctgctcttaatttttacatat

SEQ ID NO: 111264 - DNA, 25 bp, Homo sapien
tgttctgctcttattttttacatat

SEQ ID NO: 111265 - DNA, 25 bp, Homo sapien
tgttctgggaatcgctccatatcaa

SEQ ID NO: 111266 - DNA, 25 bp, Homo sapien
tgttctgggaattgctccatatcaa

SEQ ID NO: 111267 - DNA, 25 bp, Homo sapien
tgttctgtccctacagtgatttatg

SEQ ID NO: 111268 - DNA, 25 bp, Homo sapien
tgttctgttcctacagtgatttatg

SEQ ID NO: 111269 - DNA, 25 bp, Homo sapien
tgttcttacagcgatgttaccaagc

SEQ ID NO: 111270 - DNA, 25 bp, Homo sapien
tgttcttacagtgatgttaccaagc

SEQ ID NO: 111271 - DNA, 25 bp, Homo sapien
tgttcttagacaaggtgtgaagagg

SEQ ID NO: 111272 - DNA, 25 bp, Homo sapien
tgttcttagacaatgtgtgaagagg

SEQ ID NO: 111273 - DNA, 25 bp, Homo sapien
tgttcttatcgcaccttattgacaa

SEQ ID NO: 111274 - DNA, 25 bp, Homo sapien
tgttcttattgcaccttattgacaa

SEQ ID NO: 111275 - DNA, 25 bp, Homo sapien
tgttcttatttcttgcttgtgttgg

SEQ ID NO: 111276 - DNA, 25 bp, Homo sapien
tgttcttatttgttgcttgtgttgg

SEQ ID NO: 111277 - DNA, 25 bp, Homo sapien
tgttcttcaggcataataggtgcag

SEQ ID NO: 111278 - DNA, 25 bp, Homo sapien
tgttcttcaggcctaataggtgcag

SEQ ID NO: 111279 - DNA, 25 bp, Homo sapien
tgttcttccctacacctgcttttgg

SEQ ID NO: 111280 - DNA, 25 bp, Homo sapien
tgttcttctctacacctgcttttgg

SEQ ID NO: 111281 - DNA, 25 bp, Homo sapien
tgttcttctgcagaaccgttttctc

SEQ ID NO: 111282 - DNA, 25 bp, Homo sapien
tgttcttctgcagaactgttttctc

SEQ ID NO: 111283 - DNA, 25 bp, Homo sapien
tgttcttgactggtttagttacctg

SEQ ID NO: 111284 - DNA, 25 bp, Homo sapien
tgttcttgtctggtttagttacctg

SEQ ID NO: 111285 - DNA, 25 bp, Homo sapien
tgttctttacagagcctcattatat

SEQ ID NO: 111286 - DNA, 25 bp, Homo sapien
tgttctttacagagtctcattatat

SEQ ID NO: 111287 - DNA, 25 bp, Homo sapien
tgttctttactgttgattttttata

SEQ ID NO: 111288 - DNA, 25 bp, Homo sapien
tgttctttctcccagtctgaggtgc

SEQ ID NO: 111289 - DNA, 25 bp, Homo sapien
tgttctttgctgttgattttttata

SEQ ID NO: 111290 - DNA, 25 bp, Homo sapien
tgttcttttgttatttcgctgagaa

SEQ ID NO: 111291 - DNA, 25 bp, Homo sapien
tgttcttttgttattttgctgagaa

SEQ ID NO: 111292 - DNA, 25 bp, Homo sapien
tgttctttttcccagtctgaggtgc

SEQ ID NO: 111293 - DNA, 25 bp, Homo sapien
tgttgaaaggaagacgagacacata

SEQ ID NO: 111294 - DNA, 25 bp, Homo sapien
tgttgaaaggaagatgagacacata

SEQ ID NO: 111295 - DNA, 25 bp, Homo sapien
tgttgaaagtggaaccgttagtcca

SEQ ID NO: 111296 - DNA, 25 bp, Homo sapien
tgttgaaagtggatccgttagtcca

SEQ ID NO: 111297 - DNA, 25 bp, Homo sapien
tgttgaaatgacaaccaaggcttta

SEQ ID NO: 111298 - DNA, 25 bp, Homo sapien
tgttgaaatgacgaccaaggcttta

SEQ ID NO: 111299 - DNA, 25 bp, Homo sapien
tgttgaaatttggccttcaatatta

SEQ ID NO: 111300 - DNA, 25 bp, Homo sapien
tgttgaaatttggtcttcaatatta

SEQ ID NO: 111301 - DNA, 25 bp, Homo sapien
tgttgaacttttgcgttccttcttg

SEQ ID NO: 111302 - DNA, 25 bp, Homo sapien
tgttgaacttttgtgttccttcttg

SEQ ID NO: 111303 - DNA, 25 bp, Homo sapien
tgttgaagaagaagaacaagtcgga

SEQ ID NO: 111304 - DNA, 25 bp, Homo sapien
tgttgaagaagaagaagaagtcgga

SEQ ID NO: 111305 - DNA, 25 bp, Homo sapien
tgttgaagaccttgccatgttaagt

SEQ ID NO: 111306 - DNA, 25 bp, Homo sapien
tgttgaagaccttgccgtgttaagt

SEQ ID NO: 111307 - DNA, 25 bp, Homo sapien
tgttgaaggaataactacttgttca

SEQ ID NO: 111308 - DNA, 25 bp, Homo sapien
tgttgaaggaataattacttgttca

SEQ ID NO: 111309 - DNA, 25 bp, Homo sapien
tgttgaaggacatcagtcaatcttt

SEQ ID NO: 111310 - DNA, 25 bp, Homo sapien
tgttgaaggacgtcagtcaatcttt

SEQ ID NO: 111311 - DNA, 25 bp, Homo sapien
tgttgaataaaacaccaagtggaga

SEQ ID NO: 111312 - DNA, 25 bp, Homo sapien
tgttgaataaaacgccaagtggaga

SEQ ID NO: 111313 - DNA, 25 bp, Homo sapien
tgttgaatacttgaagggaacaatc

SEQ ID NO: 111314 - DNA, 25 bp, Homo sapien
tgttgaatagttgaagggaacaatc

SEQ ID NO: 111315 - DNA, 25 bp, Homo sapien
tgttgaatccagaagtagcagctgt

SEQ ID NO: 111316 - DNA, 25 bp, Homo sapien
tgttgaatctatcagtagtcccttt

SEQ ID NO: 111317 - DNA, 25 bp, Homo sapien
tgttgaatgtatcagtagtcccttt

SEQ ID NO: 111318 - DNA, 25 bp, Homo sapien
tgttgaattcagaagtagcagctgt

SEQ ID NO: 111319 - DNA, 25 bp, Homo sapien
tgttgacaaatcaaaattagtattt

SEQ ID NO: 111320 - DNA, 25 bp, Homo sapien
tgttgacaaatccaaattagtattt

SEQ ID NO: 111321 - DNA, 25 bp, Homo sapien
tgttgacaacgatgctgaacaatag

SEQ ID NO: 111322 - DNA, 25 bp, Homo sapien
tgttgacaaggatgctgaacaatag

SEQ ID NO: 111323 - DNA, 25 bp, Homo sapien
tgttgacagagctgtcgtcctcatt

SEQ ID NO: 111324 - DNA, 25 bp, Homo sapien
tgttgacaggctgcatccctttttg

SEQ ID NO: 111325 - DNA, 25 bp, Homo sapien
tgttgacaggctgcattcctttttg

SEQ ID NO: 111326 - DNA, 25 bp, Homo sapien
tgttgacagtgctgtcgtcctcatt

SEQ ID NO: 111327 - DNA, 25 bp, Homo sapien
tgttgaccacacattttcactctgc

SEQ ID NO: 111328 - DNA, 25 bp, Homo sapien
tgttgacctcacattttcactctgc

SEQ ID NO: 111329 - DNA, 25 bp, Homo sapien
tgttgagcatagcagagatgaagcc

SEQ ID NO: 111330 - DNA, 25 bp, Homo sapien
tgttgagcgtagcagagatgaagcc

SEQ ID NO: 111331 - DNA, 25 bp, Homo sapien
tgttgaggcttccacaacagagaaa

SEQ ID NO: 111332 - DNA, 25 bp, Homo sapien
tgttgaggtttccacaacagagaaa

SEQ ID NO: 111333 - DNA, 25 bp, Homo sapien
tgttgagtaaataagtatcttgttg

SEQ ID NO: 111334 - DNA, 25 bp, Homo sapien
tgttgagtaaatatgtatcttgttg

SEQ ID NO: 111335 - DNA, 25 bp, Homo sapien
tgttgagtctctgctgctacttgaa

SEQ ID NO: 111336 - DNA, 25 bp, Homo sapien
tgttgagtttctgctgctacttgaa

SEQ ID NO: 111337 - DNA, 25 bp, Homo sapien
tgttgatattgggtaagtttctggg

SEQ ID NO: 111338 - DNA, 25 bp, Homo sapien
tgttgatattgggtgagtttctggg

SEQ ID NO: 111339 - DNA, 25 bp, Homo sapien
tgttgatctgagaacataactcttt

SEQ ID NO: 111340 - DNA, 25 bp, Homo sapien
tgttgatctgataacataactcttt

SEQ ID NO: 111341 - DNA, 25 bp, Homo sapien
tgttgatgagactgatggcaaatgc

SEQ ID NO: 111342 - DNA, 25 bp, Homo sapien
tgttgatgagagtgatggcaaatgc

SEQ ID NO: 111343 - DNA, 25 bp, Homo sapien
tgttgatgctaagcttgcatgtaaa

SEQ ID NO: 111344 - DNA, 25 bp, Homo sapien
tgttgatgctatgcttgcatgtaaa

SEQ ID NO: 111345 - DNA, 25 bp, Homo sapien
tgttgatggcttgaccgtggacttt

SEQ ID NO: 111346 - DNA, 25 bp, Homo sapien
tgttgatggcttgatcgtggacttt

SEQ ID NO: 111347 - DNA, 25 bp, Homo sapien
tgttgattcactaaacaaatgcctc

SEQ ID NO: 111348 - DNA, 25 bp, Homo sapien
tgttgattcactgaacaaatgcctc

SEQ ID NO: 111349 - DNA, 25 bp, Homo sapien
tgttgatttcaatctccatacaaat

SEQ ID NO: 111350 - DNA, 25 bp, Homo sapien
tgttgatttcaatctctatacaaat

SEQ ID NO: 111351 - DNA, 25 bp, Homo sapien
tgttgcaaaaatacatgagattata

SEQ ID NO: 111352 - DNA, 25 bp, Homo sapien
tgttgcaaaaattcatgagattata

SEQ ID NO: 111353 - DNA, 25 bp, Homo sapien
tgttgcaacaatgaataactgaatg

SEQ ID NO: 111354 - DNA, 25 bp, Homo sapien
tgttgcaataatgaataactgaatg

SEQ ID NO: 111355 - DNA, 25 bp, Homo sapien
tgttgcagaggcaccaatggttgca

SEQ ID NO: 111356 - DNA, 25 bp, Homo sapien
tgttgcagaggcagcaatggttgca

SEQ ID NO: 111357 - DNA, 25 bp, Homo sapien
tgttgcatttatctatcaattatta

SEQ ID NO: 111358 - DNA, 25 bp, Homo sapien
tgttgcatttatctgtcaattatta

SEQ ID NO: 111359 - DNA, 25 bp, Homo sapien
tgttgccactgagtttctatttcaa

SEQ ID NO: 111360 - DNA, 25 bp, Homo sapien
tgttgccattgagtttctatttcaa

SEQ ID NO: 111361 - DNA, 25 bp, Homo sapien
tgttgccctctggcctatagaacag

SEQ ID NO: 111362 - DNA, 25 bp, Homo sapien
tgttgccctctggcctgtagaacag

SEQ ID NO: 111363 - DNA, 25 bp, Homo sapien
tgttgcctacacaactgtatgggtc

SEQ ID NO: 111364 - DNA, 25 bp, Homo sapien
tgttgcctacagaactgtatgggtc

SEQ ID NO: 111365 - DNA, 25 bp, Homo sapien
tgttgcctataactgtaagacataa

SEQ ID NO: 111366 - DNA, 25 bp, Homo sapien
tgttgcctattgatttcaagtctgg

SEQ ID NO: 111367 - DNA, 25 bp, Homo sapien
tgttgcctccacggactatgaaggt

SEQ ID NO: 111368 - DNA, 25 bp, Homo sapien
tgttgcctccagggactatgaaggt

SEQ ID NO: 111369 - DNA, 25 bp, Homo sapien
tgttgcctgtaactgtaagacataa

SEQ ID NO: 111370 - DNA, 25 bp, Homo sapien
tgttgcctgttgatttcaagtctgg

SEQ ID NO: 111371 - DNA, 25 bp, Homo sapien
tgttgccttcttattggtaaggagt

SEQ ID NO: 111372 - DNA, 25 bp, Homo sapien
tgttgccttcttgttggtaaggagt

SEQ ID NO: 111373 - DNA, 25 bp, Homo sapien
tgttgctaaggaattaatgcaggca

SEQ ID NO: 111374 - DNA, 25 bp, Homo sapien
tgttgctaaggaattactgcaggca

SEQ ID NO: 111375 - DNA, 25 bp, Homo sapien
tgttgctagaagtattatatctttt

SEQ ID NO: 111376 - DNA, 25 bp, Homo sapien
tgttgctagcagtattatatctttt

SEQ ID NO: 111377 - DNA, 25 bp, Homo sapien
tgttgctaggcacctgtatctcttt

SEQ ID NO: 111378 - DNA, 25 bp, Homo sapien
tgttgctaggcatctgtatctcttt

SEQ ID NO: 111379 - DNA, 25 bp, Homo sapien
tgttgctatgacagaggtattaaaa

SEQ ID NO: 111380 - DNA, 25 bp, Homo sapien
tgttgctatgagagaggtattaaaa

SEQ ID NO: 111381 - DNA, 25 bp, Homo sapien
tgttgctcaaagttgaagagatcag

SEQ ID NO: 111382 - DNA, 25 bp, Homo sapien
tgttgctcaactgcactctctgacc

SEQ ID NO: 111383 - DNA, 25 bp, Homo sapien
tgttgctcgaagttgaagagatcag

SEQ ID NO: 111384 - DNA, 25 bp, Homo sapien
tgttgctcgactgcactctctgacc

SEQ ID NO: 111385 - DNA, 25 bp, Homo sapien
tgttgcttaaataccacttccagaa

SEQ ID NO: 111386 - DNA, 25 bp, Homo sapien
tgttgcttaaattccacttccagaa

SEQ ID NO: 111387 - DNA, 25 bp, Homo sapien
tgttgcttacaacagtaaaagtcct

SEQ ID NO: 111388 - DNA, 25 bp, Homo sapien
tgttgcttacaatagtaaaagtcct

SEQ ID NO: 111389 - DNA, 25 bp, Homo sapien
tgttgcttagacaatgcctagtcca

SEQ ID NO: 111390 - DNA, 25 bp, Homo sapien
tgttgcttagaccatgcctagtcca

SEQ ID NO: 111391 - DNA, 25 bp, Homo sapien
tgttgcttctgccttccacttccca

SEQ ID NO: 111392 - DNA, 25 bp, Homo sapien
tgttgcttctgccttctacttccca

SEQ ID NO: 111393 - DNA, 25 bp, Homo sapien
tgttggaccagcacagggcttcttt

SEQ ID NO: 111394 - DNA, 25 bp, Homo sapien
tgttggaccagcgcagggcttcttt

SEQ ID NO: 111395 - DNA, 25 bp, Homo sapien
tgttggactgtacttcctcactcct

SEQ ID NO: 111396 - DNA, 25 bp, Homo sapien
tgttggactgtatttcctcactcct

SEQ ID NO: 111397 - DNA, 25 bp, Homo sapien
tgttggagaactctttggccttggt

SEQ ID NO: 111398 - DNA, 25 bp, Homo sapien
tgttggagaactgtttggccttggt

SEQ ID NO: 111399 - DNA, 25 bp, Homo sapien
tgttggagagaaaggttacagacaa

SEQ ID NO: 111400 - DNA, 25 bp, Homo sapien
tgttggagcgaaaggttacagacaa

SEQ ID NO: 111401 - DNA, 25 bp, Homo sapien
tgttggatcagcggccaagcagggt

SEQ ID NO: 111402 - DNA, 25 bp, Homo sapien
tgttggatcagtggccaagcagggt

SEQ ID NO: 111403 - DNA, 25 bp, Homo sapien
tgttggattgactcaaactctttta

SEQ ID NO: 111404 - DNA, 25 bp, Homo sapien
tgttggattgacttaaactctttta

SEQ ID NO: 111405 - DNA, 25 bp, Homo sapien
tgttggcaaaggcacggggaaataa

SEQ ID NO: 111406 - DNA, 25 bp, Homo sapien
tgttggcaacggcacggggaaataa

SEQ ID NO: 111407 - DNA, 25 bp, Homo sapien
tgttggcacgttacattataaccac

SEQ ID NO: 111408 - DNA, 25 bp, Homo sapien
tgttggcacgttacgttataaccac

SEQ ID NO: 111409 - DNA, 25 bp, Homo sapien
tgttggccaagtccgagctgtgtcc

SEQ ID NO: 111410 - DNA, 25 bp, Homo sapien
tgttggccaagtctgagctgtgtcc

SEQ ID NO: 111411 - DNA, 25 bp, Homo sapien
tgttggccgtagcgttaagtgtcag

SEQ ID NO: 111412 - DNA, 25 bp, Homo sapien
tgttggccgtagctttaagtgtcag

SEQ ID NO: 111413 - DNA, 25 bp, Homo sapien
tgttggcctgtagattgggtgtgca

SEQ ID NO: 111414 - DNA, 25 bp, Homo sapien
tgttggcctgtatattgggtgtgca

SEQ ID NO: 111415 - DNA, 25 bp, Homo sapien
tgttggctacaccctctggctctgc

SEQ ID NO: 111416 - DNA, 25 bp, Homo sapien
tgttggctccaccctctggctctgc

SEQ ID NO: 111417 - DNA, 25 bp, Homo sapien
tgttgggactgcaataaaacatgac

SEQ ID NO: 111418 - DNA, 25 bp, Homo sapien
tgttgggactgccataaaacatgac

SEQ ID NO: 111419 - DNA, 25 bp, Homo sapien
tgttgggccacgtgacaaacatgga

SEQ ID NO: 111420 - DNA, 25 bp, Homo sapien
tgttgggctacgtgacaaacatgga

SEQ ID NO: 111421 - DNA, 25 bp, Homo sapien
tgttggtcacgcccaagacaaaact

SEQ ID NO: 111422 - DNA, 25 bp, Homo sapien
tgttggtcatgcccaagacaaaact

SEQ ID NO: 111423 - DNA, 25 bp, Homo sapien
tgttggttccacaagaggctcaggg

SEQ ID NO: 111424 - DNA, 25 bp, Homo sapien
tgttggttccacgagaggctcaggg

SEQ ID NO: 111425 - DNA, 25 bp, Homo sapien
tgttggtttcaatgtttgatttaga

SEQ ID NO: 111426 - DNA, 25 bp, Homo sapien
tgttggtttcagtgtttgatttaga

SEQ ID NO: 111427 - DNA, 25 bp, Homo sapien
tgttgtacaaatggtagttcttatt

SEQ ID NO: 111428 - DNA, 25 bp, Homo sapien
tgttgtacacatggtagttcttatt

SEQ ID NO: 111429 - DNA, 25 bp, Homo sapien
tgttgtacagtgcaacagtttcata

SEQ ID NO: 111430 - DNA, 25 bp, Homo sapien
tgttgtacagtgcagcagtttcata

SEQ ID NO: 111431 - DNA, 25 bp, Homo sapien
tgttgtagcttgaaatctcttatga

SEQ ID NO: 111432 - DNA, 25 bp, Homo sapien
tgttgtagctttaaatctcttatga

SEQ ID NO: 111433 - DNA, 25 bp, Homo sapien
tgttgtatcatttctatttttgaga

SEQ ID NO: 111434 - DNA, 25 bp, Homo sapien
tgttgtatcgtttctatttttgaga

SEQ ID NO: 111435 - DNA, 25 bp, Homo sapien
tgttgtatggatatttggcatgata

SEQ ID NO: 111436 - DNA, 25 bp, Homo sapien
tgttgtatggatattttgcatgata

SEQ ID NO: 111437 - DNA, 25 bp, Homo sapien
tgttgtcaccaccatttcaagaggg

SEQ ID NO: 111438 - DNA, 25 bp, Homo sapien
tgttgtcaccaccgtttcaagaggg

SEQ ID NO: 111439 - DNA, 25 bp, Homo sapien
tgttgtcagtctcgtttggacatgg

SEQ ID NO: 111440 - DNA, 25 bp, Homo sapien
tgttgtcagtcttgtttggacatgg

SEQ ID NO: 111441 - DNA, 25 bp, Homo sapien
tgttgtcatagaggcaaatgagatg

SEQ ID NO: 111442 - DNA, 25 bp, Homo sapien
tgttgtcatagagtcaaatgagatg

SEQ ID NO: 111443 - DNA, 25 bp, Homo sapien
tgttgtcatattatctctaggcagt

SEQ ID NO: 111444 - DNA, 25 bp, Homo sapien
tgttgtcatattatttctaggcagt

SEQ ID NO: 111445 - DNA, 25 bp, Homo sapien
tgttgtcccatgatgaaaccctagc

SEQ ID NO: 111446 - DNA, 25 bp, Homo sapien
tgttgtcccatgttgaaaccctagc

SEQ ID NO: 111447 - DNA, 25 bp, Homo sapien
tgttgtctaagctaatcataaaaat

SEQ ID NO: 111448 - DNA, 25 bp, Homo sapien
tgttgtctgagctaatcataaaaat

SEQ ID NO: 111449 - DNA, 25 bp, Homo sapien
tgttgtgactatagttaaatgaaat

SEQ ID NO: 111450 - DNA, 25 bp, Homo sapien
tgttgtgattatagttaaatgaaat

SEQ ID NO: 111451 - DNA, 25 bp, Homo sapien
tgttgtgattgtacgagtcaatact

SEQ ID NO: 111452 - DNA, 25 bp, Homo sapien
tgttgtgattgtgcgagtcaatact

SEQ ID NO: 111453 - DNA, 25 bp, Homo sapien
tgttgtggcgagactgaaatccaaa

SEQ ID NO: 111454 - DNA, 25 bp, Homo sapien
tgttgtggtgagactgaaatccaaa

SEQ ID NO: 111455 - DNA, 25 bp, Homo sapien
tgttgttattgaggcctgtataaca

SEQ ID NO: 111456 - DNA, 25 bp, Homo sapien
tgttgttattgaggtctgtataaca

SEQ ID NO: 111457 - DNA, 25 bp, Homo sapien
tgttgttctggctgtcaataatcaa

SEQ ID NO: 111458 - DNA, 25 bp, Homo sapien
tgttgttcttgctgtcaataatcaa

SEQ ID NO: 111459 - DNA, 25 bp, Homo sapien
tgttgttgacacggggaaaatttca

SEQ ID NO: 111460 - DNA, 25 bp, Homo sapien
tgttgttgatacggggaaaatttca

SEQ ID NO: 111461 - DNA, 25 bp, Homo sapien
tgttgttgcctataactgtaagaca

SEQ ID NO: 111462 - DNA, 25 bp, Homo sapien
tgttgttgcctgtaactgtaagaca

SEQ ID NO: 111463 - DNA, 25 bp, Homo sapien
tgttgttgtaaaggtgtgggcaatg

SEQ ID NO: 111464 - DNA, 25 bp, Homo sapien
tgttgttgtaaatgtgtgggcaatg

SEQ ID NO: 111465 - DNA, 25 bp, Homo sapien
tgttgttgttcctgtcatgaatgga

SEQ ID NO: 111466 - DNA, 25 bp, Homo sapien
tgttgttgttcctgtcgtgaatgga

SEQ ID NO: 111467 - DNA, 25 bp, Homo sapien
tgttgtttaaagaagcaaataccaa

SEQ ID NO: 111468 - DNA, 25 bp, Homo sapien
tgttgtttaaagtagcaaataccaa

SEQ ID NO: 111469 - DNA, 25 bp, Homo sapien
tgttgtttactgatatcctgcctcc

SEQ ID NO: 111470 - DNA, 25 bp, Homo sapien
tgttgtttattgatatcctgcctcc

SEQ ID NO: 111471 - DNA, 25 bp, Homo sapien
tgttgtttcacttatagaacacaga

SEQ ID NO: 111472 - DNA, 25 bp, Homo sapien
tgttgtttcgcttatagaacacaga

SEQ ID NO: 111473 - DNA, 25 bp, Homo sapien
tgttgtttctgatgactctcataat

SEQ ID NO: 111474 - DNA, 25 bp, Homo sapien
tgttgtttctgatggctctcataat

SEQ ID NO: 111475 - DNA, 25 bp, Homo sapien
tgttgtttgtcctctcagtacagaa

SEQ ID NO: 111476 - DNA, 25 bp, Homo sapien
tgttgtttgtcttctcagtacagaa

SEQ ID NO: 111477 - DNA, 25 bp, Homo sapien
tgttgttttctgtctatcctgctag

SEQ ID NO: 111478 - DNA, 25 bp, Homo sapien
tgttgttttctgtttatcctgctag

SEQ ID NO: 111479 - DNA, 25 bp, Homo sapien
tgtttaaaaacaaagccttgaagtg

SEQ ID NO: 111480 - DNA, 25 bp, Homo sapien
tgtttaaaagccaaatatccaggtt

SEQ ID NO: 111481 - DNA, 25 bp, Homo sapien
tgtttaaaagccagatatccaggtt

SEQ ID NO: 111482 - DNA, 25 bp, Homo sapien
tgtttaaaatcaaagccttgaagtg

SEQ ID NO: 111483 - DNA, 25 bp, Homo sapien
tgtttaaagaagcaaataccaagtg

SEQ ID NO: 111484 - DNA, 25 bp, Homo sapien
tgtttaaagccactagtattagtac

SEQ ID NO: 111485 - DNA, 25 bp, Homo sapien
tgtttaaagccattagtattagtac

SEQ ID NO: 111486 - DNA, 25 bp, Homo sapien
tgtttaaagtagcaaataccaagtg

SEQ ID NO: 111487 - DNA, 25 bp, Homo sapien
tgtttaaattgtcgtaatctgagtg

SEQ ID NO: 111488 - DNA, 25 bp, Homo sapien
tgtttaaattgttgtaatctgagtg

SEQ ID NO: 111489 - DNA, 25 bp, Homo sapien
tgtttaaccatacctaaaaatgcca

SEQ ID NO: 111490 - DNA, 25 bp, Homo sapien
tgtttaaccgtacctaaaaatgcca

SEQ ID NO: 111491 - DNA, 25 bp, Homo sapien
tgtttaagaaaagtttgcctatgta

SEQ ID NO: 111492 - DNA, 25 bp, Homo sapien
tgtttaagaaatgtttgcctatgta

SEQ ID NO: 111493 - DNA, 25 bp, Homo sapien
tgtttaagggtcactttgtaaatta

SEQ ID NO: 111494 - DNA, 25 bp, Homo sapien
tgtttaagggtcattttgtaaatta

SEQ ID NO: 111495 - DNA, 25 bp, Homo sapien
tgtttaatcctgggttagcaaaaat

SEQ ID NO: 111496 - DNA, 25 bp, Homo sapien
tgtttaatcctggtttagcaaaaat

SEQ ID NO: 111497 - DNA, 25 bp, Homo sapien
tgtttaatttctacctactcctgtt

SEQ ID NO: 111498 - DNA, 25 bp, Homo sapien
tgtttaatttctacctcctcctgtt

SEQ ID NO: 111499 - DNA, 25 bp, Homo sapien
tgtttagaaattttggattatatgc

SEQ ID NO: 111500 - DNA, 25 bp, Homo sapien
tgtttagaagttttggattatatgc

SEQ ID NO: 111501 - DNA, 25 bp, Homo sapien
tgtttagcccggaagttggttttaa

SEQ ID NO: 111502 - DNA, 25 bp, Homo sapien
tgtttagcctggaagttggttttaa

SEQ ID NO: 111503 - DNA, 25 bp, Homo sapien
tgtttaggagatcactataggcaaa

SEQ ID NO: 111504 - DNA, 25 bp, Homo sapien
tgtttaggagatgactataggcaaa

SEQ ID NO: 111505 - DNA, 25 bp, Homo sapien
tgtttaggtgcaactttgcttttct

SEQ ID NO: 111506 - DNA, 25 bp, Homo sapien
tgtttaggttcaactttgcttttct

SEQ ID NO: 111507 - DNA, 25 bp, Homo sapien
tgtttaggttgcgctaaaatttaca

SEQ ID NO: 111508 - DNA, 25 bp, Homo sapien
tgtttaggttgtgctaaaatttaca

SEQ ID NO: 111509 - DNA, 25 bp, Homo sapien
tgtttataagacgcctacaataaag

SEQ ID NO: 111510 - DNA, 25 bp, Homo sapien
tgtttataagatgcctacaataaag

SEQ ID NO: 111511 - DNA, 25 bp, Homo sapien
tgtttatactatcaccatcatcagt

SEQ ID NO: 111512 - DNA, 25 bp, Homo sapien
tgtttatactattaccatcatcagt

SEQ ID NO: 111513 - DNA, 25 bp, Homo sapien
tgtttatagagcacatccacagtat

SEQ ID NO: 111514 - DNA, 25 bp, Homo sapien
tgtttatagagtacatccacagtat

SEQ ID NO: 111515 - DNA, 25 bp, Homo sapien
tgtttatcgtggtataacaggcact

SEQ ID NO: 111516 - DNA, 25 bp, Homo sapien
tgtttatcgtggtgtaacaggcact

SEQ ID NO: 111517 - DNA, 25 bp, Homo sapien
tgtttattaggccagaggatcaagg

SEQ ID NO: 111518 - DNA, 25 bp, Homo sapien
tgtttattaggtcagaggatcaagg

SEQ ID NO: 111519 - DNA, 25 bp, Homo sapien
tgtttattatataccagatgtgatg

SEQ ID NO: 111520 - DNA, 25 bp, Homo sapien
tgtttattgtataccagatgtgatg

SEQ ID NO: 111521 - DNA, 25 bp, Homo sapien
tgtttattgtccatctcctctgcca

SEQ ID NO: 111522 - DNA, 25 bp, Homo sapien
tgtttattgtccgtctcctctgcca

SEQ ID NO: 111523 - DNA, 25 bp, Homo sapien
tgtttattgtctgtacaacccagca

SEQ ID NO: 111524 - DNA, 25 bp, Homo sapien
tgtttattgtctgtaccacccagca

SEQ ID NO: 111525 - DNA, 25 bp, Homo sapien
tgtttatttgtaggcattattgtag

SEQ ID NO: 111526 - DNA, 25 bp, Homo sapien
tgtttatttgtgggcattattgtag

SEQ ID NO: 111527 - DNA, 25 bp, Homo sapien
tgtttcaaagtacatgtaacattta

SEQ ID NO: 111528 - DNA, 25 bp, Homo sapien
tgtttcaaagtatatgtaacattta

SEQ ID NO: 111529 - DNA, 25 bp, Homo sapien
tgtttcaaattcccagaagacctta

SEQ ID NO: 111530 - DNA, 25 bp, Homo sapien
tgtttcaaatttccagaagacctta

SEQ ID NO: 111531 - DNA, 25 bp, Homo sapien
tgtttcaaggttaataccctgatag

SEQ ID NO: 111532 - DNA, 25 bp, Homo sapien
tgtttcaaggttagtaccctgatag

SEQ ID NO: 111533 - DNA, 25 bp, Homo sapien
tgtttcaatcgctaaaaccaagtac

SEQ ID NO: 111534 - DNA, 25 bp, Homo sapien
tgtttcaatgaacttgacctttagt

SEQ ID NO: 111535 - DNA, 25 bp, Homo sapien
tgtttcaatgaagttgacctttagt

SEQ ID NO: 111536 - DNA, 25 bp, Homo sapien
tgtttcaattgctaaaaccaagtac

SEQ ID NO: 111537 - DNA, 25 bp, Homo sapien
tgtttcacgtgtacataggcatacc

SEQ ID NO: 111538 - DNA, 25 bp, Homo sapien
tgtttcacgtgtacattggcatacc

SEQ ID NO: 111539 - DNA, 25 bp, Homo sapien
tgtttcacttcgacctggaggccag

SEQ ID NO: 111540 - DNA, 25 bp, Homo sapien
tgtttcacttcgacttggaggccag

SEQ ID NO: 111541 - DNA, 25 bp, Homo sapien
tgtttcagaaagaataggttcccac

SEQ ID NO: 111542 - DNA, 25 bp, Homo sapien
tgtttcagagagaataggttcccac

SEQ ID NO: 111543 - DNA, 25 bp, Homo sapien
tgtttcagcctcaaatttaacttct

SEQ ID NO: 111544 - DNA, 25 bp, Homo sapien
tgtttcagcctctaatttaacttct

SEQ ID NO: 111545 - DNA, 25 bp, Homo sapien
tgtttcaggaaagttctcaccacca

SEQ ID NO: 111546 - DNA, 25 bp, Homo sapien
tgtttcaggctacataattctttgt

SEQ ID NO: 111547 - DNA, 25 bp, Homo sapien
tgtttcaggctacctaattctttgt

SEQ ID NO: 111548 - DNA, 25 bp, Homo sapien
tgtttcagtaaagttctcaccacca

SEQ ID NO: 111549 - DNA, 25 bp, Homo sapien
tgtttcagtggactatataatgtag

SEQ ID NO: 111550 - DNA, 25 bp, Homo sapien
tgtttcagtggactgtataatgtag

SEQ ID NO: 111551 - DNA, 25 bp, Homo sapien
tgtttcagttagcattttcagcttc

SEQ ID NO: 111552 - DNA, 25 bp, Homo sapien
tgtttcagttagtattttcagcttc

SEQ ID NO: 111553 - DNA, 25 bp, Homo sapien
tgtttcataaacttatttgaatctg

SEQ ID NO: 111554 - DNA, 25 bp, Homo sapien
tgtttcatctagtgtggaaattaag

SEQ ID NO: 111555 - DNA, 25 bp, Homo sapien
tgtttcatgaacttatttgaatctg

SEQ ID NO: 111556 - DNA, 25 bp, Homo sapien
tgtttcatgcgtcttcctcctccta

SEQ ID NO: 111557 - DNA, 25 bp, Homo sapien
tgtttcatgcgttttcctcctccta

SEQ ID NO: 111558 - DNA, 25 bp, Homo sapien
tgtttcatttagtgtggaaattaag

SEQ ID NO: 111559 - DNA, 25 bp, Homo sapien
tgtttcattttagtaaccttgaact

SEQ ID NO: 111560 - DNA, 25 bp, Homo sapien
tgtttcattttggtaaccttgaact

SEQ ID NO: 111561 - DNA, 25 bp, Homo sapien
tgtttccaagccctttagatgaaga

SEQ ID NO: 111562 - DNA, 25 bp, Homo sapien
tgtttccaattctccagcataatca

SEQ ID NO: 111563 - DNA, 25 bp, Homo sapien
tgtttccagttctccagcataatca

SEQ ID NO: 111564 - DNA, 25 bp, Homo sapien
tgtttccatatatccaaactcatca

SEQ ID NO: 111565 - DNA, 25 bp, Homo sapien
tgtttccatgccctttagatgaaga

SEQ ID NO: 111566 - DNA, 25 bp, Homo sapien
tgtttccatgtatccaaactcatca

SEQ ID NO: 111567 - DNA, 25 bp, Homo sapien
tgtttccatttatatgaaattcaat

SEQ ID NO: 111568 - DNA, 25 bp, Homo sapien
tgtttccatttatgtgaaattcaat

SEQ ID NO: 111569 - DNA, 25 bp, Homo sapien
tgtttccctcgagcccttggatatt

SEQ ID NO: 111570 - DNA, 25 bp, Homo sapien
tgtttccctcgggcccttggatatt

SEQ ID NO: 111571 - DNA, 25 bp, Homo sapien
tgtttcctcggatacagaaataagt

SEQ ID NO: 111572 - DNA, 25 bp, Homo sapien
tgtttcctctaacttgctttgtctc

SEQ ID NO: 111573 - DNA, 25 bp, Homo sapien
tgtttcctctaacttgttttgtctc

SEQ ID NO: 111574 - DNA, 25 bp, Homo sapien
tgtttccttgctcatctcagatctg

SEQ ID NO: 111575 - DNA, 25 bp, Homo sapien
tgtttccttgctcgtctcagatctg

SEQ ID NO: 111576 - DNA, 25 bp, Homo sapien
tgtttccttggatacagaaataagt

SEQ ID NO: 111577 - DNA, 25 bp, Homo sapien
tgtttcgggcattacacttattatc

SEQ ID NO: 111578 - DNA, 25 bp, Homo sapien
tgtttcgggcattatacttattatc

SEQ ID NO: 111579 - DNA, 25 bp, Homo sapien
tgtttctaaaaattcattacttgca

SEQ ID NO: 111580 - DNA, 25 bp, Homo sapien
tgtttctaagaattcattacttgca

SEQ ID NO: 111581 - DNA, 25 bp, Homo sapien
tgtttctactgctcctgtttttttt

SEQ ID NO: 111582 - DNA, 25 bp, Homo sapien
tgtttctactgcttctgtttttttt

SEQ ID NO: 111583 - DNA, 25 bp, Homo sapien
tgtttctcctagacatcatggttac

SEQ ID NO: 111584 - DNA, 25 bp, Homo sapien
tgtttctcctaggcatcatggttac

SEQ ID NO: 111585 - DNA, 25 bp, Homo sapien
tgtttctcctttgtatcacagcatc

SEQ ID NO: 111586 - DNA, 25 bp, Homo sapien
tgtttctcctttttatcacagcatc

SEQ ID NO: 111587 - DNA, 25 bp, Homo sapien
tgtttctgaagaaaatggagctcaa

SEQ ID NO: 111588 - DNA, 25 bp, Homo sapien
tgtttctgatgactctcataatggc

SEQ ID NO: 111589 - DNA, 25 bp, Homo sapien
tgtttctgatggctctcataatggc

SEQ ID NO: 111590 - DNA, 25 bp, Homo sapien
tgtttctgcgaagaactcaagaact

SEQ ID NO: 111591 - DNA, 25 bp, Homo sapien
tgtttctgctaagaactcaagaact

SEQ ID NO: 111592 - DNA, 25 bp, Homo sapien
tgtttctgctctgctccagaggaca

SEQ ID NO: 111593 - DNA, 25 bp, Homo sapien
tgtttctggagaaaatggagctcaa

SEQ ID NO: 111594 - DNA, 25 bp, Homo sapien
tgtttctggctctgccgtttctact

SEQ ID NO: 111595 - DNA, 25 bp, Homo sapien
tgtttctggctctgtcgtttctact

SEQ ID NO: 111596 - DNA, 25 bp, Homo sapien
tgtttctgtaaaactgcactgatag

SEQ ID NO: 111597 - DNA, 25 bp, Homo sapien
tgtttctgtaaaattgcactgatag

SEQ ID NO: 111598 - DNA, 25 bp, Homo sapien
tgtttctgttctgctccagaggaca

SEQ ID NO: 111599 - DNA, 25 bp, Homo sapien
tgtttcttcctgaatatttttgatc

SEQ ID NO: 111600 - DNA, 25 bp, Homo sapien
tgtttcttgctgaatatttttgatc

SEQ ID NO: 111601 - DNA, 25 bp, Homo sapien
tgtttcttgtgaaataagactgagc

SEQ ID NO: 111602 - DNA, 25 bp, Homo sapien
tgtttcttgtgaaataggactgagc

SEQ ID NO: 111603 - DNA, 25 bp, Homo sapien
tgtttctttctttgatggtagagaa

SEQ ID NO: 111604 - DNA, 25 bp, Homo sapien
tgtttctttctttggtggtagagaa

SEQ ID NO: 111605 - DNA, 25 bp, Homo sapien
tgtttgaagcccaccacggcattac

SEQ ID NO: 111606 - DNA, 25 bp, Homo sapien
tgtttgaagtccaccacggcattac

SEQ ID NO: 111607 - DNA, 25 bp, Homo sapien
tgtttgaatagcaaagatgtgcgaa

SEQ ID NO: 111608 - DNA, 25 bp, Homo sapien
tgtttgaatagcaaaggtgtgcgaa

SEQ ID NO: 111609 - DNA, 25 bp, Homo sapien
tgtttgaatgtggatcaaaataagg

SEQ ID NO: 111610 - DNA, 25 bp, Homo sapien
tgtttgaatgtgggtcaaaataagg

SEQ ID NO: 111611 - DNA, 25 bp, Homo sapien
tgtttgacagacaatcattcagacc

SEQ ID NO: 111612 - DNA, 25 bp, Homo sapien
tgtttgacagacagtcattcagacc

SEQ ID NO: 111613 - DNA, 25 bp, Homo sapien
tgtttgaccttcatgagaagctatt

SEQ ID NO: 111614 - DNA, 25 bp, Homo sapien
tgtttgaccttcatgataagctatt

SEQ ID NO: 111615 - DNA, 25 bp, Homo sapien
tgtttgactagttctcattcaatat

SEQ ID NO: 111616 - DNA, 25 bp, Homo sapien
tgtttgactggttctcattcaatat

SEQ ID NO: 111617 - DNA, 25 bp, Homo sapien
tgtttgaggttactgcacttgcatt

SEQ ID NO: 111618 - DNA, 25 bp, Homo sapien
tgtttgaggttattgcacttgcatt

SEQ ID NO: 111619 - DNA, 25 bp, Homo sapien
tgtttgagtacctgatgtaccagca

SEQ ID NO: 111620 - DNA, 25 bp, Homo sapien
tgtttgagtacctgttgtaccagca

SEQ ID NO: 111621 - DNA, 25 bp, Homo sapien
tgtttgataagcatatcagacatag

SEQ ID NO: 111622 - DNA, 25 bp, Homo sapien
tgtttgataagcgtatcagacatag

SEQ ID NO: 111623 - DNA, 25 bp, Homo sapien
tgtttgatttggcgatgacaatggc

SEQ ID NO: 111624 - DNA, 25 bp, Homo sapien
tgtttgatttggtgatgacaatggc

SEQ ID NO: 111625 - DNA, 25 bp, Homo sapien
tgtttgcacacttaaatggctactc

SEQ ID NO: 111626 - DNA, 25 bp, Homo sapien
tgtttgcactcttaaatggctactc

SEQ ID NO: 111627 - DNA, 25 bp, Homo sapien
tgtttgcagcaacatggataaacct

SEQ ID NO: 111628 - DNA, 25 bp, Homo sapien
tgtttgcagcaacgtggataaacct

SEQ ID NO: 111629 - DNA, 25 bp, Homo sapien
tgtttgccaagcgagacagattcaa

SEQ ID NO: 111630 - DNA, 25 bp, Homo sapien
tgtttgccaagtgagacagattcaa

SEQ ID NO: 111631 - DNA, 25 bp, Homo sapien
tgtttgcccaactttaagaattcag

SEQ ID NO: 111632 - DNA, 25 bp, Homo sapien
tgtttgcccgactttaagaattcag

SEQ ID NO: 111633 - DNA, 25 bp, Homo sapien
tgtttgcctctaacatacgtgcatc

SEQ ID NO: 111634 - DNA, 25 bp, Homo sapien
tgtttgcctctaacgtacgtgcatc

SEQ ID NO: 111635 - DNA, 25 bp, Homo sapien
tgtttgcctgagatcacgcaattat

SEQ ID NO: 111636 - DNA, 25 bp, Homo sapien
tgtttgcctgagatcatgcaattat

SEQ ID NO: 111637 - DNA, 25 bp, Homo sapien
tgtttgcctttctgtagccagtcat

SEQ ID NO: 111638 - DNA, 25 bp, Homo sapien
tgtttgcctttctgtatccagtcat

SEQ ID NO: 111639 - DNA, 25 bp, Homo sapien
tgtttgctgtgggacaaatcacaag

SEQ ID NO: 111640 - DNA, 25 bp, Homo sapien
tgtttgctgtgggacagatcacaag

SEQ ID NO: 111641 - DNA, 25 bp, Homo sapien
tgtttgcttttcatttgtcagtgaa

SEQ ID NO: 111642 - DNA, 25 bp, Homo sapien
tgtttgctttttatttgtcagtgaa

SEQ ID NO: 111643 - DNA, 25 bp, Homo sapien
tgtttggaaaaagcagactcgcagc

SEQ ID NO: 111644 - DNA, 25 bp, Homo sapien
tgtttggaaaaagcaggctcgcagc

SEQ ID NO: 111645 - DNA, 25 bp, Homo sapien
tgtttggacgaccatgaaaatttga

SEQ ID NO: 111646 - DNA, 25 bp, Homo sapien
tgtttggagcccataggaggaagtt

SEQ ID NO: 111647 - DNA, 25 bp, Homo sapien
tgtttggagcccatagtaggaagtt

SEQ ID NO: 111648 - DNA, 25 bp, Homo sapien
tgtttggatgaccatgaaaatttga

SEQ ID NO: 111649 - DNA, 25 bp, Homo sapien
tgtttggccgtccatggtggcagtc

SEQ ID NO: 111650 - DNA, 25 bp, Homo sapien
tgtttggccgtccgtggtggcagtc

SEQ ID NO: 111651 - DNA, 25 bp, Homo sapien
tgtttgggatacactgtgcttccta

SEQ ID NO: 111652 - DNA, 25 bp, Homo sapien
tgtttgggatacgctgtgcttccta

SEQ ID NO: 111653 - DNA, 25 bp, Homo sapien
tgtttggtgcacccatatttgttct

SEQ ID NO: 111654 - DNA, 25 bp, Homo sapien
tgtttggtgcactcatatttgttct

SEQ ID NO: 111655 - DNA, 25 bp, Homo sapien
tgtttggtgtatctctccgttgtga

SEQ ID NO: 111656 - DNA, 25 bp, Homo sapien
tgtttggtgtatttctccgttgtga

SEQ ID NO: 111657 - DNA, 25 bp, Homo sapien
tgtttgtacatgtatcttgttgttt

SEQ ID NO: 111658 - DNA, 25 bp, Homo sapien
tgtttgtacgtgtatcttgttgttt

SEQ ID NO: 111659 - DNA, 25 bp, Homo sapien
tgtttgtcctctcagtacagaatgt

SEQ ID NO: 111660 - DNA, 25 bp, Homo sapien
tgtttgtcttctcagtacagaatgt

SEQ ID NO: 111661 - DNA, 25 bp, Homo sapien
tgtttgtgagaatcctcttttacat

SEQ ID NO: 111662 - DNA, 25 bp, Homo sapien
tgtttgtgagagtcctcttttacat

SEQ ID NO: 111663 - DNA, 25 bp, Homo sapien
tgtttgtgcaaatcctaggtgctca

SEQ ID NO: 111664 - DNA, 25 bp, Homo sapien
tgtttgtgcaaatcttaggtgctca

SEQ ID NO: 111665 - DNA, 25 bp, Homo sapien
tgtttgtggagatggatggatcctt

SEQ ID NO: 111666 - DNA, 25 bp, Homo sapien
tgtttgtggcgatggatggatcctt

SEQ ID NO: 111667 - DNA, 25 bp, Homo sapien
tgtttgttcctcacctaacattcca

SEQ ID NO: 111668 - DNA, 25 bp, Homo sapien
tgtttgttcgtcacctaacattcca

SEQ ID NO: 111669 - DNA, 25 bp, Homo sapien
tgtttgtttgttccaatttcattta

SEQ ID NO: 111670 - DNA, 25 bp, Homo sapien
tgtttgtttgttctaatttcattta

SEQ ID NO: 111671 - DNA, 25 bp, Homo sapien
tgttttaaacccggtaagagaggat

SEQ ID NO: 111672 - DNA, 25 bp, Homo sapien
tgttttaaacctggtaagagaggat

SEQ ID NO: 111673 - DNA, 25 bp, Homo sapien
tgttttaactacatgggattttggg

SEQ ID NO: 111674 - DNA, 25 bp, Homo sapien
tgttttaactacgtgggattttggg

SEQ ID NO: 111675 - DNA, 25 bp, Homo sapien
tgttttacacatcctgaggttgtca

SEQ ID NO: 111676 - DNA, 25 bp, Homo sapien
tgttttacatatcctgaggttgtca

SEQ ID NO: 111677 - DNA, 25 bp, Homo sapien
tgttttaccttttagcatgaaagaa

SEQ ID NO: 111678 - DNA, 25 bp, Homo sapien
tgttttaccttttagcgtgaaagaa

SEQ ID NO: 111679 - DNA, 25 bp, Homo sapien
tgttttactcctcgcttaacatctt

SEQ ID NO: 111680 - DNA, 25 bp, Homo sapien
tgttttactccttgcttaacatctt

SEQ ID NO: 111681 - DNA, 25 bp, Homo sapien
tgttttagcacctgatttagtcact

SEQ ID NO: 111682 - DNA, 25 bp, Homo sapien
tgttttagcatataccatcaggcaa

SEQ ID NO: 111683 - DNA, 25 bp, Homo sapien
tgttttagcatatatcatcaggcaa

SEQ ID NO: 111684 - DNA, 25 bp, Homo sapien
tgttttagcattattatgtattatc

SEQ ID NO: 111685 - DNA, 25 bp, Homo sapien
tgttttagcattcttatgtattatc

SEQ ID NO: 111686 - DNA, 25 bp, Homo sapien
tgttttagtacctgatttagtcact

SEQ ID NO: 111687 - DNA, 25 bp, Homo sapien
tgttttatacgactttgagttttat

SEQ ID NO: 111688 - DNA, 25 bp, Homo sapien
tgttttatatgactttgagttttat

SEQ ID NO: 111689 - DNA, 25 bp, Homo sapien
tgttttatcatcctgtttctgctaa

SEQ ID NO: 111690 - DNA, 25 bp, Homo sapien
tgttttatcccaagccattgtgctg

SEQ ID NO: 111691 - DNA, 25 bp, Homo sapien
tgttttatcccaggccattgtgctg

SEQ ID NO: 111692 - DNA, 25 bp, Homo sapien
tgttttatgaatggaaactagtgaa

SEQ ID NO: 111693 - DNA, 25 bp, Homo sapien
tgttttattaatggaaactagtgaa

SEQ ID NO: 111694 - DNA, 25 bp, Homo sapien
tgttttattataagccataggtaca

SEQ ID NO: 111695 - DNA, 25 bp, Homo sapien
tgttttattataagtcataggtaca

SEQ ID NO: 111696 - DNA, 25 bp, Homo sapien
tgttttattatcctgtttctgctaa

SEQ ID NO: 111697 - DNA, 25 bp, Homo sapien
tgttttattcgtccagaaagactaa

SEQ ID NO: 111698 - DNA, 25 bp, Homo sapien
tgttttattgacatatactccttct

SEQ ID NO: 111699 - DNA, 25 bp, Homo sapien
tgttttattgacatctactccttct

SEQ ID NO: 111700 - DNA, 25 bp, Homo sapien
tgttttatttgtccagaaagactaa

SEQ ID NO: 111701 - DNA, 25 bp, Homo sapien
tgttttcaaatagtcgcatttttag

SEQ ID NO: 111702 - DNA, 25 bp, Homo sapien
tgttttcaagaaagtaatttaccaa

SEQ ID NO: 111703 - DNA, 25 bp, Homo sapien
tgttttcaagacagtaatttaccaa

SEQ ID NO: 111704 - DNA, 25 bp, Homo sapien
tgttttcaagtagtcgcatttttag

SEQ ID NO: 111705 - DNA, 25 bp, Homo sapien
tgttttcacatcggtcactttaaaa

SEQ ID NO: 111706 - DNA, 25 bp, Homo sapien
tgttttcacattggtcactttaaaa

SEQ ID NO: 111707 - DNA, 25 bp, Homo sapien
tgttttcacgctcttatgtcctctc

SEQ ID NO: 111708 - DNA, 25 bp, Homo sapien
tgttttcatagtaaccattgcattt

SEQ ID NO: 111709 - DNA, 25 bp, Homo sapien
tgttttcatagtaaccgttgcattt

SEQ ID NO: 111710 - DNA, 25 bp, Homo sapien
tgttttcatgactgcaatgactgct

SEQ ID NO: 111711 - DNA, 25 bp, Homo sapien
tgttttcatgactggaatgactgct

SEQ ID NO: 111712 - DNA, 25 bp, Homo sapien
tgttttcatgctcttatgtcctctc

SEQ ID NO: 111713 - DNA, 25 bp, Homo sapien
tgttttccaatagaaatcattcact

SEQ ID NO: 111714 - DNA, 25 bp, Homo sapien
tgttttccacaacggtatttggcta

SEQ ID NO: 111715 - DNA, 25 bp, Homo sapien
tgttttccacaatggtatttggcta

SEQ ID NO: 111716 - DNA, 25 bp, Homo sapien
tgttttccacagcggctatgctgtt

SEQ ID NO: 111717 - DNA, 25 bp, Homo sapien
tgttttccacagtggctatgctgtt

SEQ ID NO: 111718 - DNA, 25 bp, Homo sapien
tgttttccagtagaaatcattcact

SEQ ID NO: 111719 - DNA, 25 bp, Homo sapien
tgttttcccattcgtattgcttatc

SEQ ID NO: 111720 - DNA, 25 bp, Homo sapien
tgttttcccatttgtattgcttatc

SEQ ID NO: 111721 - DNA, 25 bp, Homo sapien
tgttttccgctaggttgctttggga

SEQ ID NO: 111722 - DNA, 25 bp, Homo sapien
tgttttcctatcttgggagaagaga

SEQ ID NO: 111723 - DNA, 25 bp, Homo sapien
tgttttcctccgtgttctctaacct

SEQ ID NO: 111724 - DNA, 25 bp, Homo sapien
tgttttcctccttgttctctaacct

SEQ ID NO: 111725 - DNA, 25 bp, Homo sapien
tgttttcctctaggttgctttggga

SEQ ID NO: 111726 - DNA, 25 bp, Homo sapien
tgttttcctctcttgggagaagaga

SEQ ID NO: 111727 - DNA, 25 bp, Homo sapien
tgttttcgtgcaccgctgacatgca

SEQ ID NO: 111728 - DNA, 25 bp, Homo sapien
tgttttcgtgcactgctgacatgca

SEQ ID NO: 111729 - DNA, 25 bp, Homo sapien
tgttttctacaactcccgagtccac

SEQ ID NO: 111730 - DNA, 25 bp, Homo sapien
tgttttctacacctcccgagtccac

SEQ ID NO: 111731 - DNA, 25 bp, Homo sapien
tgttttctcaacgattcaacctaac

SEQ ID NO: 111732 - DNA, 25 bp, Homo sapien
tgttttctcaatgattcaacctaac

SEQ ID NO: 111733 - DNA, 25 bp, Homo sapien
tgttttctcagaggttattaatacc

SEQ ID NO: 111734 - DNA, 25 bp, Homo sapien
tgttttctcagaggttgttaatacc

SEQ ID NO: 111735 - DNA, 25 bp, Homo sapien
tgttttctgtagcacaatgcatctt

SEQ ID NO: 111736 - DNA, 25 bp, Homo sapien
tgttttctgtagcataatgcatctt

SEQ ID NO: 111737 - DNA, 25 bp, Homo sapien
tgttttcttaacatttgtgtattca

SEQ ID NO: 111738 - DNA, 25 bp, Homo sapien
tgttttcttaatatttgtgtattca

SEQ ID NO: 111739 - DNA, 25 bp, Homo sapien
tgttttcttattgacgctcaaaaat

SEQ ID NO: 111740 - DNA, 25 bp, Homo sapien
tgttttcttattgaggctcaaaaat

SEQ ID NO: 111741 - DNA, 25 bp, Homo sapien
tgttttcttcaggtgtaagtagttt

SEQ ID NO: 111742 - DNA, 25 bp, Homo sapien
tgttttcttgggatagcaaggacaa

SEQ ID NO: 111743 - DNA, 25 bp, Homo sapien
tgttttcttggtcagggttgttgtc

SEQ ID NO: 111744 - DNA, 25 bp, Homo sapien
tgttttcttggtccgggttgttgtc

SEQ ID NO: 111745 - DNA, 25 bp, Homo sapien
tgttttctttaggtgtaagtagttt

SEQ ID NO: 111746 - DNA, 25 bp, Homo sapien
tgttttctttggatagcaaggacaa

SEQ ID NO: 111747 - DNA, 25 bp, Homo sapien
tgttttgaatgcatttcggccatga

SEQ ID NO: 111748 - DNA, 25 bp, Homo sapien
tgttttgaatgcattttggccatga

SEQ ID NO: 111749 - DNA, 25 bp, Homo sapien
tgttttgacttaaaatataccattc

SEQ ID NO: 111750 - DNA, 25 bp, Homo sapien
tgttttgacttaaaatgtaccattc

SEQ ID NO: 111751 - DNA, 25 bp, Homo sapien
tgttttgatccagaatctctaacca

SEQ ID NO: 111752 - DNA, 25 bp, Homo sapien
tgttttgatgcagaatctctaacca

SEQ ID NO: 111753 - DNA, 25 bp, Homo sapien
tgttttgattttttgtaagactcat

SEQ ID NO: 111754 - DNA, 25 bp, Homo sapien
tgttttgattttttgtgagactcat

SEQ ID NO: 111755 - DNA, 25 bp, Homo sapien
tgttttgcccagagttaggacaatt

SEQ ID NO: 111756 - DNA, 25 bp, Homo sapien
tgttttgcctatcacgaggccctgg

SEQ ID NO: 111757 - DNA, 25 bp, Homo sapien
tgttttgcctatcatgaggccctgg

SEQ ID NO: 111758 - DNA, 25 bp, Homo sapien
tgttttgcgcagagttaggacaatt

SEQ ID NO: 111759 - DNA, 25 bp, Homo sapien
tgttttggaatacgactcttgggct

SEQ ID NO: 111760 - DNA, 25 bp, Homo sapien
tgttttggactttatacaggaaata

SEQ ID NO: 111761 - DNA, 25 bp, Homo sapien
tgttttggactttatagaggaaata

SEQ ID NO: 111762 - DNA, 25 bp, Homo sapien
tgttttgggatacgactcttgggct

SEQ ID NO: 111763 - DNA, 25 bp, Homo sapien
tgttttggttaacgtactcttatat

SEQ ID NO: 111764 - DNA, 25 bp, Homo sapien
tgttttggttaatgtactcttatat

SEQ ID NO: 111765 - DNA, 25 bp, Homo sapien
tgttttgtaatgcatgacccaaagt

SEQ ID NO: 111766 - DNA, 25 bp, Homo sapien
tgttttgtaatgcatgtcccaaagt

SEQ ID NO: 111767 - DNA, 25 bp, Homo sapien
tgttttgtcagtcttacgatttcta

SEQ ID NO: 111768 - DNA, 25 bp, Homo sapien
tgttttgtcagtcttatgatttcta

SEQ ID NO: 111769 - DNA, 25 bp, Homo sapien
tgttttgtctacactgacaatctgt

SEQ ID NO: 111770 - DNA, 25 bp, Homo sapien
tgttttgtctacattgacaatctgt

SEQ ID NO: 111771 - DNA, 25 bp, Homo sapien
tgttttgtctgcgaaaatctataac

SEQ ID NO: 111772 - DNA, 25 bp, Homo sapien
tgttttgtctgtgaaaatctataac

SEQ ID NO: 111773 - DNA, 25 bp, Homo sapien
tgtttttacactaattcacaaatat

SEQ ID NO: 111774 - DNA, 25 bp, Homo sapien
tgtttttacatgaatgaaggcccat

SEQ ID NO: 111775 - DNA, 25 bp, Homo sapien
tgtttttacgctaattcacaaatat

SEQ ID NO: 111776 - DNA, 25 bp, Homo sapien
tgtttttacgtgaatgaaggcccat

SEQ ID NO: 111777 - DNA, 25 bp, Homo sapien
tgtttttacttacttattgaacttt

SEQ ID NO: 111778 - DNA, 25 bp, Homo sapien
tgtttttacttatttattgaacttt

SEQ ID NO: 111779 - DNA, 25 bp, Homo sapien
tgtttttagcaacacggctagtaaa

SEQ ID NO: 111780 - DNA, 25 bp, Homo sapien
tgtttttagcaacatggctagtaaa

SEQ ID NO: 111781 - DNA, 25 bp, Homo sapien
tgtttttatgcttttgatccttccc

SEQ ID NO: 111782 - DNA, 25 bp, Homo sapien
tgtttttatgcttttggtccttccc

SEQ ID NO: 111783 - DNA, 25 bp, Homo sapien
tgtttttcacgtgccactgtttcca

SEQ ID NO: 111784 - DNA, 25 bp, Homo sapien
tgtttttcacgtgtcactgtttcca

SEQ ID NO: 111785 - DNA, 25 bp, Homo sapien
tgtttttcacttacagtacggtagt

SEQ ID NO: 111786 - DNA, 25 bp, Homo sapien
tgtttttcactttcagtacggtagt

SEQ ID NO: 111787 - DNA, 25 bp, Homo sapien
tgtttttccctctttatttgtaaac

SEQ ID NO: 111788 - DNA, 25 bp, Homo sapien
tgtttttctcctgaatgaaaccacc

SEQ ID NO: 111789 - DNA, 25 bp, Homo sapien
tgtttttctcctgagtgaaaccacc

SEQ ID NO: 111790 - DNA, 25 bp, Homo sapien
tgtttttctctctttatttgtaaac

SEQ ID NO: 111791 - DNA, 25 bp, Homo sapien
tgtttttgaactgggtggtggtagg

SEQ ID NO: 111792 - DNA, 25 bp, Homo sapien
tgtttttgacctgggtggtggtagg

SEQ ID NO: 111793 - DNA, 25 bp, Homo sapien
tgtttttgcatagcttgtcccattt

SEQ ID NO: 111794 - DNA, 25 bp, Homo sapien
tgtttttgcatatggcttccaaaag

SEQ ID NO: 111795 - DNA, 25 bp, Homo sapien
tgtttttgcgtagcttgtcccattt

SEQ ID NO: 111796 - DNA, 25 bp, Homo sapien
tgtttttgcgtatggcttccaaaag

SEQ ID NO: 111797 - DNA, 25 bp, Homo sapien
tgtttttgtctttatcgtttgttag

SEQ ID NO: 111798 - DNA, 25 bp, Homo sapien
tgtttttgtctttatcttttgttag

SEQ ID NO: 111799 - DNA, 25 bp, Homo sapien
tgtttttgtttccctggttttctac

SEQ ID NO: 111800 - DNA, 25 bp, Homo sapien
tgtttttgtttccctgtttttctac

SEQ ID NO: 111801 - DNA, 25 bp, Homo sapien
tgttttttagtcacttgttaaaaag

SEQ ID NO: 111802 - DNA, 25 bp, Homo sapien
tgttttttagtcagggtgaatggag

SEQ ID NO: 111803 - DNA, 25 bp, Homo sapien
tgttttttagtcgcttgttaaaaag

SEQ ID NO: 111804 - DNA, 25 bp, Homo sapien
tgttttttagtgagggtgaatggag

SEQ ID NO: 111805 - DNA, 25 bp, Homo sapien
tgttttttatttccctcctatgttg

SEQ ID NO: 111806 - DNA, 25 bp, Homo sapien
tgttttttattttcctcctatgttg

SEQ ID NO: 111807 - DNA, 25 bp, Homo sapien
tgttttttctgcaataatgtaataa

SEQ ID NO: 111808 - DNA, 25 bp, Homo sapien
tgttttttctgcaatagtgtaataa

SEQ ID NO: 111809 - DNA, 25 bp, Homo sapien
tgttttttgactaccgtccagagtt

SEQ ID NO: 111810 - DNA, 25 bp, Homo sapien
tgttttttgactactgtccagagtt

SEQ ID NO: 111811 - DNA, 25 bp, Homo sapien
tgtttttttccctacagaatgattg

SEQ ID NO: 111812 - DNA, 25 bp, Homo sapien
tgtttttttcccttcagaatgattg

SEQ ID NO: 111813 - DNA, 25 bp, Homo sapien
tgtttttttctgaatacgttcaatg

SEQ ID NO: 111814 - DNA, 25 bp, Homo sapien
tgtttttttctgaatatgttcaatg

SEQ ID NO: 111815 - DNA, 25 bp, Homo sapien
tgtttttttctgcagtgattcagca

SEQ ID NO: 111816 - DNA, 25 bp, Homo sapien
tgtttttttctgcggtgattcagca

SEQ ID NO: 111817 - DNA, 25 bp, Homo sapien
tgtttttttgtctcatggttacatt

SEQ ID NO: 111818 - DNA, 25 bp, Homo sapien
tgtttttttgtctcgtggttacatt

SEQ ID NO: 111819 - DNA, 25 bp, Homo sapien
tgttttttttgcggcacacagaaga

SEQ ID NO: 111820 - DNA, 25 bp, Homo sapien
tgttttttttgctgcacacagaaga

SEQ ID NO: 111821 - DNA, 25 bp, Homo sapien
ttaaaaaaaaatatgtaccacatca

SEQ ID NO: 111822 - DNA, 25 bp, Homo sapien
ttaaaaaaacatatgtaccacatca

SEQ ID NO: 111823 - DNA, 25 bp, Homo sapien
ttaaaaaaatactcattggaaacag

SEQ ID NO: 111824 - DNA, 25 bp, Homo sapien
ttaaaaaaatactcgttggaaacag

SEQ ID NO: 111825 - DNA, 25 bp, Homo sapien
ttaaaaaatttcctcattgggtgtt

SEQ ID NO: 111826 - DNA, 25 bp, Homo sapien
ttaaaaaatttcttcattgggtgtt

SEQ ID NO: 111827 - DNA, 25 bp, Homo sapien
ttaaaaacaacacaggacgaagaga

SEQ ID NO: 111828 - DNA, 25 bp, Homo sapien
ttaaaaacaacacatgacgaagaga

SEQ ID NO: 111829 - DNA, 25 bp, Homo sapien
ttaaaaacctcacacatctcagtgc

SEQ ID NO: 111830 - DNA, 25 bp, Homo sapien
ttaaaaacctcatacatctcagtgc

SEQ ID NO: 111831 - DNA, 25 bp, Homo sapien
ttaaaaactgaacaaaggattgttt

SEQ ID NO: 111832 - DNA, 25 bp, Homo sapien
ttaaaaactgaacaaatgattgttt

SEQ ID NO: 111833 - DNA, 25 bp, Homo sapien
ttaaaaaggaatgcatatacactat

SEQ ID NO: 111834 - DNA, 25 bp, Homo sapien
ttaaaaaggaatgcatgtacactat

SEQ ID NO: 111835 - DNA, 25 bp, Homo sapien
ttaaaaatacccaaattgttcaaac

SEQ ID NO: 111836 - DNA, 25 bp, Homo sapien
ttaaaaatacccagattgttcaaac

SEQ ID NO: 111837 - DNA, 25 bp, Homo sapien
ttaaaaatacgaccactttggtagg

SEQ ID NO: 111838 - DNA, 25 bp, Homo sapien
ttaaaaatatgaccactttggtagg

SEQ ID NO: 111839 - DNA, 25 bp, Homo sapien
ttaaaaatcacccaattgtgaaaaa

SEQ ID NO: 111840 - DNA, 25 bp, Homo sapien
ttaaaaatgattagcagagtctatt

SEQ ID NO: 111841 - DNA, 25 bp, Homo sapien
ttaaaaatgattatcagagtctatt

SEQ ID NO: 111842 - DNA, 25 bp, Homo sapien
ttaaaaattacccaattgtgaaaaa

SEQ ID NO: 111843 - DNA, 25 bp, Homo sapien
ttaaaacaagccatgtgttagtctc

SEQ ID NO: 111844 - DNA, 25 bp, Homo sapien
ttaaaacaatccatgtgttagtctc

SEQ ID NO: 111845 - DNA, 25 bp, Homo sapien
ttaaaacacagtatgcatgaagaca

SEQ ID NO: 111846 - DNA, 25 bp, Homo sapien
ttaaaacacctcacgcctcaggttg

SEQ ID NO: 111847 - DNA, 25 bp, Homo sapien
ttaaaacactgatgagaccttagat

SEQ ID NO: 111848 - DNA, 25 bp, Homo sapien
ttaaaacacttcacgcctcaggttg

SEQ ID NO: 111849 - DNA, 25 bp, Homo sapien
ttaaaacagagaccttgtttatgtg

SEQ ID NO: 111850 - DNA, 25 bp, Homo sapien
ttaaaacagaggccttgtttatgtg

SEQ ID NO: 111851 - DNA, 25 bp, Homo sapien
ttaaaacatagtatgcatgaagaca

SEQ ID NO: 111852 - DNA, 25 bp, Homo sapien
ttaaaacattgatgagaccttagat

SEQ ID NO: 111853 - DNA, 25 bp, Homo sapien
ttaaaacatttcctgcaaagatatt

SEQ ID NO: 111854 - DNA, 25 bp, Homo sapien
ttaaaacatttcctgcgaagatatt

SEQ ID NO: 111855 - DNA, 25 bp, Homo sapien
ttaaaaccttgcctaacgcaaggca

SEQ ID NO: 111856 - DNA, 25 bp, Homo sapien
ttaaaaccttgcctaatgcaaggca

SEQ ID NO: 111857 - DNA, 25 bp, Homo sapien
ttaaaacttcttgcgccaaactggc

SEQ ID NO: 111858 - DNA, 25 bp, Homo sapien
ttaaaacttcttgctccaaactggc

SEQ ID NO: 111859 - DNA, 25 bp, Homo sapien
ttaaaactttcattaaacatggtga

SEQ ID NO: 111860 - DNA, 25 bp, Homo sapien
ttaaaactttcgttaaacatggtga

SEQ ID NO: 111861 - DNA, 25 bp, Homo sapien
ttaaaagaaaatctatcccatgctc

SEQ ID NO: 111862 - DNA, 25 bp, Homo sapien
ttaaaagaaaatctattccatgctc

SEQ ID NO: 111863 - DNA, 25 bp, Homo sapien
ttaaaagaatacacagctatacagg

SEQ ID NO: 111864 - DNA, 25 bp, Homo sapien
ttaaaagaatatacagctatacagg

SEQ ID NO: 111865 - DNA, 25 bp, Homo sapien
ttaaaagaccattcatatgcaaatc

SEQ ID NO: 111866 - DNA, 25 bp, Homo sapien
ttaaaagatcattcatatgcaaatc

SEQ ID NO: 111867 - DNA, 25 bp, Homo sapien
ttaaaagcgtccacctgtaaatgcc

SEQ ID NO: 111868 - DNA, 25 bp, Homo sapien
ttaaaagctgaagtagtaattcaac

SEQ ID NO: 111869 - DNA, 25 bp, Homo sapien
ttaaaagctgaagttgtaattcaac

SEQ ID NO: 111870 - DNA, 25 bp, Homo sapien
ttaaaagcttccacctgtaaatgcc

SEQ ID NO: 111871 - DNA, 25 bp, Homo sapien
ttaaaaggagaatcaaacattttga

SEQ ID NO: 111872 - DNA, 25 bp, Homo sapien
ttaaaaggataatcaaacattttga

SEQ ID NO: 111873 - DNA, 25 bp, Homo sapien
ttaaaagtatccttgcagttttcct

SEQ ID NO: 111874 - DNA, 25 bp, Homo sapien
ttaaaagtatctttgcagttttcct

SEQ ID NO: 111875 - DNA, 25 bp, Homo sapien
ttaaaagtcatttccacttaaaaaa

SEQ ID NO: 111876 - DNA, 25 bp, Homo sapien
ttaaaagtcatttccagttaaaaaa

SEQ ID NO: 111877 - DNA, 25 bp, Homo sapien
ttaaaagttattccaaaattgtata

SEQ ID NO: 111878 - DNA, 25 bp, Homo sapien
ttaaaagttattccgaaattgtata

SEQ ID NO: 111879 - DNA, 25 bp, Homo sapien
ttaaaagttccacgtacactactat

SEQ ID NO: 111880 - DNA, 25 bp, Homo sapien
ttaaaagttccatgtacactactat

SEQ ID NO: 111881 - DNA, 25 bp, Homo sapien
ttaaaataaccagtccctattgctt

SEQ ID NO: 111882 - DNA, 25 bp, Homo sapien
ttaaaatagcagtcaaaaaaatcaa

SEQ ID NO: 111883 - DNA, 25 bp, Homo sapien
ttaaaatagcagtccaaaaaatcaa

SEQ ID NO: 111884 - DNA, 25 bp, Homo sapien
ttaaaatagccagtccctattgctt

SEQ ID NO: 111885 - DNA, 25 bp, Homo sapien
ttaaaatcaacagatagaaattgtc

SEQ ID NO: 111886 - DNA, 25 bp, Homo sapien
ttaaaatcaacggatagaaattgtc

SEQ ID NO: 111887 - DNA, 25 bp, Homo sapien
ttaaaatgagcattttcttttgcca

SEQ ID NO: 111888 - DNA, 25 bp, Homo sapien
ttaaaatgagcattttgttttgcca

SEQ ID NO: 111889 - DNA, 25 bp, Homo sapien
ttaaaatgccaactgacttgtgttt

SEQ ID NO: 111890 - DNA, 25 bp, Homo sapien
ttaaaatgccagctgacttgtgttt

SEQ ID NO: 111891 - DNA, 25 bp, Homo sapien
ttaaaatggagaccgcctgaacttg

SEQ ID NO: 111892 - DNA, 25 bp, Homo sapien
ttaaaatggagactgcctgaacttg

SEQ ID NO: 111893 - DNA, 25 bp, Homo sapien
ttaaaatgggtagactcttcattca

SEQ ID NO: 111894 - DNA, 25 bp, Homo sapien
ttaaaatggtcaataataggagagt

SEQ ID NO: 111895 - DNA, 25 bp, Homo sapien
ttaaaatggtcgataataggagagt

SEQ ID NO: 111896 - DNA, 25 bp, Homo sapien
ttaaaatggtggtgtgcgtccaaga

SEQ ID NO: 111897 - DNA, 25 bp, Homo sapien
ttaaaatggtggtgtgtgtccaaga

SEQ ID NO: 111898 - DNA, 25 bp, Homo sapien
ttaaaatgtcacacaacttgttgtt

SEQ ID NO: 111899 - DNA, 25 bp, Homo sapien
ttaaaatgtcacacaatttgttgtt

SEQ ID NO: 111900 - DNA, 25 bp, Homo sapien
ttaaaatgtcttccatttgcatttt

SEQ ID NO: 111901 - DNA, 25 bp, Homo sapien
ttaaaatgtcttccgtttgcatttt

SEQ ID NO: 111902 - DNA, 25 bp, Homo sapien
ttaaaatgtgacacaagtgaaggaa

SEQ ID NO: 111903 - DNA, 25 bp, Homo sapien
ttaaaatgtgatacaagtgaaggaa

SEQ ID NO: 111904 - DNA, 25 bp, Homo sapien
ttaaaatgtgcctacgtccttccaa

SEQ ID NO: 111905 - DNA, 25 bp, Homo sapien
ttaaaatgtgcctatgtccttccaa

SEQ ID NO: 111906 - DNA, 25 bp, Homo sapien
ttaaaatgtgtagactcttcattca

SEQ ID NO: 111907 - DNA, 25 bp, Homo sapien
ttaaaatgtgtcatagagctgaatg

SEQ ID NO: 111908 - DNA, 25 bp, Homo sapien
ttaaaatgtgtcgtagagctgaatg

SEQ ID NO: 111909 - DNA, 25 bp, Homo sapien
ttaaaattagaaccacattgtttgc

SEQ ID NO: 111910 - DNA, 25 bp, Homo sapien
ttaaaattagaactacattgtttgc

SEQ ID NO: 111911 - DNA, 25 bp, Homo sapien
ttaaaattctgctgctaaaacagtt

SEQ ID NO: 111912 - DNA, 25 bp, Homo sapien
ttaaaattctgcttctaaaacagtt

SEQ ID NO: 111913 - DNA, 25 bp, Homo sapien
ttaaaattgacccttgagcgattag

SEQ ID NO: 111914 - DNA, 25 bp, Homo sapien
ttaaaattgacgcttgagcgattag

SEQ ID NO: 111915 - DNA, 25 bp, Homo sapien
ttaaaattgctcatgctggcttccc

SEQ ID NO: 111916 - DNA, 25 bp, Homo sapien
ttaaaatttagccgagaacttctag

SEQ ID NO: 111917 - DNA, 25 bp, Homo sapien
ttaaaatttagctgagaacttctag

SEQ ID NO: 111918 - DNA, 25 bp, Homo sapien
ttaaaatttctcatgctggcttccc

SEQ ID NO: 111919 - DNA, 25 bp, Homo sapien
ttaaacaacagtctctaattttttt

SEQ ID NO: 111920 - DNA, 25 bp, Homo sapien
ttaaacaacagtctctgattttttt

SEQ ID NO: 111921 - DNA, 25 bp, Homo sapien
ttaaacaactggtttaggaaaagct

SEQ ID NO: 111922 - DNA, 25 bp, Homo sapien
ttaaacaactggtttatgaaaagct

SEQ ID NO: 111923 - DNA, 25 bp, Homo sapien
ttaaacaagcacgtacaaaggagaa

SEQ ID NO: 111924 - DNA, 25 bp, Homo sapien
ttaaacaagcatgtacaaaggagaa

SEQ ID NO: 111925 - DNA, 25 bp, Homo sapien
ttaaacaataagactttacttagtg

SEQ ID NO: 111926 - DNA, 25 bp, Homo sapien
ttaaacaataagcctttacttagtg

SEQ ID NO: 111927 - DNA, 25 bp, Homo sapien
ttaaacacaaggataatgaatcagg

SEQ ID NO: 111928 - DNA, 25 bp, Homo sapien
ttaaacacaagtataatgaatcagg

SEQ ID NO: 111929 - DNA, 25 bp, Homo sapien
ttaaacacacccagtgctcaaatca

SEQ ID NO: 111930 - DNA, 25 bp, Homo sapien
ttaaacacacctagtgctcaaatca

SEQ ID NO: 111931 - DNA, 25 bp, Homo sapien
ttaaacagaggaaactctaatattc

SEQ ID NO: 111932 - DNA, 25 bp, Homo sapien
ttaaacagaggaagctctaatattc

SEQ ID NO: 111933 - DNA, 25 bp, Homo sapien
ttaaacagtgaccggaagagcttgt

SEQ ID NO: 111934 - DNA, 25 bp, Homo sapien
ttaaacagtgactggaagagcttgt

SEQ ID NO: 111935 - DNA, 25 bp, Homo sapien
ttaaacatactacacattcaattct

SEQ ID NO: 111936 - DNA, 25 bp, Homo sapien
ttaaacatactgcacattcaattct

SEQ ID NO: 111937 - DNA, 25 bp, Homo sapien
ttaaacatcatcaatataatttgct

SEQ ID NO: 111938 - DNA, 25 bp, Homo sapien
ttaaacatcatcgatataatttgct

SEQ ID NO: 111939 - DNA, 25 bp, Homo sapien
ttaaacatcctatgaagcacaggac

SEQ ID NO: 111940 - DNA, 25 bp, Homo sapien
ttaaacatgctatgaagcacaggac

SEQ ID NO: 111941 - DNA, 25 bp, Homo sapien
ttaaacattctgtagttaacaccac

SEQ ID NO: 111942 - DNA, 25 bp, Homo sapien
ttaaacattgtctctgctgggtgtg

SEQ ID NO: 111943 - DNA, 25 bp, Homo sapien
ttaaacattgtctttgctgggtgtg

SEQ ID NO: 111944 - DNA, 25 bp, Homo sapien
ttaaacattgtgtagttaacaccac

SEQ ID NO: 111945 - DNA, 25 bp, Homo sapien
ttaaacatttgtgggagatattgaa

SEQ ID NO: 111946 - DNA, 25 bp, Homo sapien
ttaaacatttgttggagatattgaa

SEQ ID NO: 111947 - DNA, 25 bp, Homo sapien
ttaaacccaatagaagcctgaagtc

SEQ ID NO: 111948 - DNA, 25 bp, Homo sapien
ttaaacccattagaagcctgaagtc

SEQ ID NO: 111949 - DNA, 25 bp, Homo sapien
ttaaacccttcaagtcgttccattg

SEQ ID NO: 111950 - DNA, 25 bp, Homo sapien
ttaaacccttcacgtcgttccattg

SEQ ID NO: 111951 - DNA, 25 bp, Homo sapien
ttaaaccgggtaatctacttctaag

SEQ ID NO: 111952 - DNA, 25 bp, Homo sapien
ttaaaccgggtaatctgcttctaag

SEQ ID NO: 111953 - DNA, 25 bp, Homo sapien
ttaaaccttagaatgtgaacgccta

SEQ ID NO: 111954 - DNA, 25 bp, Homo sapien
ttaaaccttagagtgtgaacgccta

SEQ ID NO: 111955 - DNA, 25 bp, Homo sapien
ttaaacgcctagatacaataagttt

SEQ ID NO: 111956 - DNA, 25 bp, Homo sapien
ttaaacgcctaggtacaataagttt

SEQ ID NO: 111957 - DNA, 25 bp, Homo sapien
ttaaactaacctttaaaagcacagg

SEQ ID NO: 111958 - DNA, 25 bp, Homo sapien
ttaaactaatctttaaaagcacagg

SEQ ID NO: 111959 - DNA, 25 bp, Homo sapien
ttaaactacaccatgatgcttattt

SEQ ID NO: 111960 - DNA, 25 bp, Homo sapien
ttaaactataccatgatgcttattt

SEQ ID NO: 111961 - DNA, 25 bp, Homo sapien
ttaaactcagaatttataactcaca

SEQ ID NO: 111962 - DNA, 25 bp, Homo sapien
ttaaactcggaatttataactcaca

SEQ ID NO: 111963 - DNA, 25 bp, Homo sapien
ttaaactcttaattctttcctctga

SEQ ID NO: 111964 - DNA, 25 bp, Homo sapien
ttaaactcttacttctttcctctga

SEQ ID NO: 111965 - DNA, 25 bp, Homo sapien
ttaaactgaaaacattctgcacagc

SEQ ID NO: 111966 - DNA, 25 bp, Homo sapien
ttaaactgaaaatattctgcacagc

SEQ ID NO: 111967 - DNA, 25 bp, Homo sapien
ttaaacttacctgataggattccaa

SEQ ID NO: 111968 - DNA, 25 bp, Homo sapien
ttaaacttatctgataggattccaa

SEQ ID NO: 111969 - DNA, 25 bp, Homo sapien
ttaaactttggtcagttatgtccta

SEQ ID NO: 111970 - DNA, 25 bp, Homo sapien
ttaaacttttgtcagttatgtccta

SEQ ID NO: 111971 - DNA, 25 bp, Homo sapien
ttaaagaaaacatacaaggagtgtt

SEQ ID NO: 111972 - DNA, 25 bp, Homo sapien
ttaaagaaattgaaaataaacactc

SEQ ID NO: 111973 - DNA, 25 bp, Homo sapien
ttaaagaaattggaaataaacactc

SEQ ID NO: 111974 - DNA, 25 bp, Homo sapien
ttaaagaacacatacaaggagtgtt

SEQ ID NO: 111975 - DNA, 25 bp, Homo sapien
ttaaagaaccacgcagaagtgctca

SEQ ID NO: 111976 - DNA, 25 bp, Homo sapien
ttaaagaaccatgcagaagtgctca

SEQ ID NO: 111977 - DNA, 25 bp, Homo sapien
ttaaagaatctgctgactgattcac

SEQ ID NO: 111978 - DNA, 25 bp, Homo sapien
ttaaagaatctggtgactgattcac

SEQ ID NO: 111979 - DNA, 25 bp, Homo sapien
ttaaagaattgacgaaggaaaatta

SEQ ID NO: 111980 - DNA, 25 bp, Homo sapien
ttaaagaattgatgaaggaaaatta

SEQ ID NO: 111981 - DNA, 25 bp, Homo sapien
ttaaagaccctttctgctccaagat

SEQ ID NO: 111982 - DNA, 25 bp, Homo sapien
ttaaagactctttctgctccaagat

SEQ ID NO: 111983 - DNA, 25 bp, Homo sapien
ttaaagagagcagcattagccagac

SEQ ID NO: 111984 - DNA, 25 bp, Homo sapien
ttaaagagagcagcgttagccagac

SEQ ID NO: 111985 - DNA, 25 bp, Homo sapien
ttaaagatatacattttcatagctg

SEQ ID NO: 111986 - DNA, 25 bp, Homo sapien
ttaaagatgggctgctcgaaccttg

SEQ ID NO: 111987 - DNA, 25 bp, Homo sapien
ttaaagatgggctgcttgaaccttg

SEQ ID NO: 111988 - DNA, 25 bp, Homo sapien
ttaaagatgtacattttcatagctg

SEQ ID NO: 111989 - DNA, 25 bp, Homo sapien
ttaaagcacattatcacagatgtac

SEQ ID NO: 111990 - DNA, 25 bp, Homo sapien
ttaaagcacgttatcacagatgtac

SEQ ID NO: 111991 - DNA, 25 bp, Homo sapien
ttaaagccactagtattagtacaat

SEQ ID NO: 111992 - DNA, 25 bp, Homo sapien
ttaaagccattagtattagtacaat

SEQ ID NO: 111993 - DNA, 25 bp, Homo sapien
ttaaagctcaagcgctcttcaatca

SEQ ID NO: 111994 - DNA, 25 bp, Homo sapien
ttaaagctcaagggctcttcaatca

SEQ ID NO: 111995 - DNA, 25 bp, Homo sapien
ttaaaggcttgaccctgggaagcag

SEQ ID NO: 111996 - DNA, 25 bp, Homo sapien
ttaaaggcttgatcctgggaagcag

SEQ ID NO: 111997 - DNA, 25 bp, Homo sapien
ttaaagggacccgcagtcatgttca

SEQ ID NO: 111998 - DNA, 25 bp, Homo sapien
ttaaagggacctgcagtcatgttca

SEQ ID NO: 111999 - DNA, 25 bp, Homo sapien
ttaaaggttgagttttccttagtgc

SEQ ID NO: 112000 - DNA, 25 bp, Homo sapien
ttaaaggttgatttttccttagtgc

SEQ ID NO: 112001 - DNA, 25 bp, Homo sapien
ttaaagtcttttagcccatcttaaa

SEQ ID NO: 112002 - DNA, 25 bp, Homo sapien
ttaaagtcttttagtccatcttaaa

SEQ ID NO: 112003 - DNA, 25 bp, Homo sapien
ttaaagtgacttgtctgcttagcaa

SEQ ID NO: 112004 - DNA, 25 bp, Homo sapien
ttaaagtgacttgtttgcttagcaa

SEQ ID NO: 112005 - DNA, 25 bp, Homo sapien
ttaaagtgttactattcggcctttt

SEQ ID NO: 112006 - DNA, 25 bp, Homo sapien
ttaaagtgttactatttggcctttt

SEQ ID NO: 112007 - DNA, 25 bp, Homo sapien
ttaaagttactggtgctttaagact

SEQ ID NO: 112008 - DNA, 25 bp, Homo sapien
ttaaagttattggtgctttaagact

SEQ ID NO: 112009 - DNA, 25 bp, Homo sapien
ttaaataaagaaacaacgtaaaaca

SEQ ID NO: 112010 - DNA, 25 bp, Homo sapien
ttaaataaagaaccaacgtaaaaca

SEQ ID NO: 112011 - DNA, 25 bp, Homo sapien
ttaaataaagagccgctatgttcta

SEQ ID NO: 112012 - DNA, 25 bp, Homo sapien
ttaaataaagagtcgctatgttcta

SEQ ID NO: 112013 - DNA, 25 bp, Homo sapien
ttaaatacactctaggcaattataa

SEQ ID NO: 112014 - DNA, 25 bp, Homo sapien
ttaaatacattgcctaagacttagt

SEQ ID NO: 112015 - DNA, 25 bp, Homo sapien
ttaaatacattgcgtaagacttagt

SEQ ID NO: 112016 - DNA, 25 bp, Homo sapien
ttaaatacgagtctgtgaaattcaa

SEQ ID NO: 112017 - DNA, 25 bp, Homo sapien
ttaaatacgagtttgtgaaattcaa

SEQ ID NO: 112018 - DNA, 25 bp, Homo sapien
ttaaatactctctaggcaattataa

SEQ ID NO: 112019 - DNA, 25 bp, Homo sapien
ttaaatagaacaaacagggacaggt

SEQ ID NO: 112020 - DNA, 25 bp, Homo sapien
ttaaatagaacaagcagggacaggt

SEQ ID NO: 112021 - DNA, 25 bp, Homo sapien
ttaaatagcacacgtatgaagtgtg

SEQ ID NO: 112022 - DNA, 25 bp, Homo sapien
ttaaatagcacatgtatgaagtgtg

SEQ ID NO: 112023 - DNA, 25 bp, Homo sapien
ttaaatatcctgataagttcacagt

SEQ ID NO: 112024 - DNA, 25 bp, Homo sapien
ttaaatatcctgttaagttcacagt

SEQ ID NO: 112025 - DNA, 25 bp, Homo sapien
ttaaatatggatcgttaatacctca

SEQ ID NO: 112026 - DNA, 25 bp, Homo sapien
ttaaatatggatctttaatacctca

SEQ ID NO: 112027 - DNA, 25 bp, Homo sapien
ttaaatatgtgcaccttattgtatg

SEQ ID NO: 112028 - DNA, 25 bp, Homo sapien
ttaaatatgtgcgccttattgtatg

SEQ ID NO: 112029 - DNA, 25 bp, Homo sapien
ttaaatatgttatgatgatgtttga

SEQ ID NO: 112030 - DNA, 25 bp, Homo sapien
ttaaatatgttccggaccccaagaa

SEQ ID NO: 112031 - DNA, 25 bp, Homo sapien
ttaaatatgttctggaccccaagaa

SEQ ID NO: 112032 - DNA, 25 bp, Homo sapien
ttaaatatgttgtgatgatgtttga

SEQ ID NO: 112033 - DNA, 25 bp, Homo sapien
ttaaatatttcacgtaaaccataga

SEQ ID NO: 112034 - DNA, 25 bp, Homo sapien
ttaaatatttcatgtaaaccataga

SEQ ID NO: 112035 - DNA, 25 bp, Homo sapien
ttaaatcacaatacaacattccctt

SEQ ID NO: 112036 - DNA, 25 bp, Homo sapien
ttaaatcacaatacgacattccctt

SEQ ID NO: 112037 - DNA, 25 bp, Homo sapien
ttaaatcacataagctcctcctcta

SEQ ID NO: 112038 - DNA, 25 bp, Homo sapien
ttaaatcacatatgctcctcctcta

SEQ ID NO: 112039 - DNA, 25 bp, Homo sapien
ttaaatctgaattcctgcaaccctc

SEQ ID NO: 112040 - DNA, 25 bp, Homo sapien
ttaaatcttaattcctgcaaccctc

SEQ ID NO: 112041 - DNA, 25 bp, Homo sapien
ttaaatgaatcttttccctttttgc

SEQ ID NO: 112042 - DNA, 25 bp, Homo sapien
ttaaatgaatcttttctctttttgc

SEQ ID NO: 112043 - DNA, 25 bp, Homo sapien
ttaaatgaggatctgattccaaaac

SEQ ID NO: 112044 - DNA, 25 bp, Homo sapien
ttaaatgagtatctgattccaaaac

SEQ ID NO: 112045 - DNA, 25 bp, Homo sapien
ttaaatgatatataggatttgcttc

SEQ ID NO: 112046 - DNA, 25 bp, Homo sapien
ttaaatgatgtataggatttgcttc

SEQ ID NO: 112047 - DNA, 25 bp, Homo sapien
ttaaatgccacaacaagaatgatta

SEQ ID NO: 112048 - DNA, 25 bp, Homo sapien
ttaaatgccacaataagaatgatta

SEQ ID NO: 112049 - DNA, 25 bp, Homo sapien
ttaaatgctaaaatgatgtgtaaaa

SEQ ID NO: 112050 - DNA, 25 bp, Homo sapien
ttaaatgctaaagtgatgtgtaaaa

SEQ ID NO: 112051 - DNA, 25 bp, Homo sapien
ttaaatgtcaggcccattatttatt

SEQ ID NO: 112052 - DNA, 25 bp, Homo sapien
ttaaatgtcaggtccattatttatt

SEQ ID NO: 112053 - DNA, 25 bp, Homo sapien
ttaaatgtcagtgtgggaacatgca

SEQ ID NO: 112054 - DNA, 25 bp, Homo sapien
ttaaatgtcagtgtggtaacatgca

SEQ ID NO: 112055 - DNA, 25 bp, Homo sapien
ttaaatgtgctacagattcttcatt

SEQ ID NO: 112056 - DNA, 25 bp, Homo sapien
ttaaatgtgctccagattcttcatt

SEQ ID NO: 112057 - DNA, 25 bp, Homo sapien
ttaaatgttcataccaaaaaaataa

SEQ ID NO: 112058 - DNA, 25 bp, Homo sapien
ttaaatgttcataccacaaaaataa

SEQ ID NO: 112059 - DNA, 25 bp, Homo sapien
ttaaattacctcagcaggttcagta

SEQ ID NO: 112060 - DNA, 25 bp, Homo sapien
ttaaattacctcagcatgttcagta

SEQ ID NO: 112061 - DNA, 25 bp, Homo sapien
ttaaattatctgtttatatcatcca

SEQ ID NO: 112062 - DNA, 25 bp, Homo sapien
ttaaattatttgtttatatcatcca

SEQ ID NO: 112063 - DNA, 25 bp, Homo sapien
ttaaattcagtcagagcggaaaaaa

SEQ ID NO: 112064 - DNA, 25 bp, Homo sapien
ttaaattcagtcggagcggaaaaaa

SEQ ID NO: 112065 - DNA, 25 bp, Homo sapien
ttaaattcctgccagctgtgagcct

SEQ ID NO: 112066 - DNA, 25 bp, Homo sapien
ttaaattcctgcgagctgtgagcct

SEQ ID NO: 112067 - DNA, 25 bp, Homo sapien
ttaaattctttctgttcctcaagac

SEQ ID NO: 112068 - DNA, 25 bp, Homo sapien
ttaaattctttttgttcctcaagac

SEQ ID NO: 112069 - DNA, 25 bp, Homo sapien
ttaaattgcatgttcttggaggagg

SEQ ID NO: 112070 - DNA, 25 bp, Homo sapien
ttaaattgcttgttcttggaggagg

SEQ ID NO: 112071 - DNA, 25 bp, Homo sapien
ttaaattgtcgtaatctgagtgagt

SEQ ID NO: 112072 - DNA, 25 bp, Homo sapien
ttaaattgttgtaatctgagtgagt

SEQ ID NO: 112073 - DNA, 25 bp, Homo sapien
ttaaatttcagtcttggcttcaact

SEQ ID NO: 112074 - DNA, 25 bp, Homo sapien
ttaaatttcctctgtagcttgtaaa

SEQ ID NO: 112075 - DNA, 25 bp, Homo sapien
ttaaatttcctttgtagcttgtaaa

SEQ ID NO: 112076 - DNA, 25 bp, Homo sapien
ttaaatttctgcttgtttttctctt

SEQ ID NO: 112077 - DNA, 25 bp, Homo sapien
ttaaatttctgtttgtttttctctt

SEQ ID NO: 112078 - DNA, 25 bp, Homo sapien
ttaaattttagtcttggcttcaact

SEQ ID NO: 112079 - DNA, 25 bp, Homo sapien
ttaaattttgtatatggtaaacctt

SEQ ID NO: 112080 - DNA, 25 bp, Homo sapien
ttaaattttgtatgtggtaaacctt

SEQ ID NO: 112081 - DNA, 25 bp, Homo sapien
ttaacaaacagcctaaactctttca

SEQ ID NO: 112082 - DNA, 25 bp, Homo sapien
ttaacaaacagcgtaaactctttca

SEQ ID NO: 112083 - DNA, 25 bp, Homo sapien
ttaacaaacataattccctctcacc

SEQ ID NO: 112084 - DNA, 25 bp, Homo sapien
ttaacaaacatcattccctctcacc

SEQ ID NO: 112085 - DNA, 25 bp, Homo sapien
ttaacaaattccatgattgtcagtt

SEQ ID NO: 112086 - DNA, 25 bp, Homo sapien
ttaacaaattccgtgattgtcagtt

SEQ ID NO: 112087 - DNA, 25 bp, Homo sapien
ttaacaacaatactggaagctgcaa

SEQ ID NO: 112088 - DNA, 25 bp, Homo sapien
ttaacaacaatcctggaagctgcaa

SEQ ID NO: 112089 - DNA, 25 bp, Homo sapien
ttaacaagtcaatttggtgattttg

SEQ ID NO: 112090 - DNA, 25 bp, Homo sapien
ttaacaagtcagtttggtgattttg

SEQ ID NO: 112091 - DNA, 25 bp, Homo sapien
ttaacaatacatacgaaatttttgg

SEQ ID NO: 112092 - DNA, 25 bp, Homo sapien
ttaacaatacatatgaaatttttgg

SEQ ID NO: 112093 - DNA, 25 bp, Homo sapien
ttaacaatggagtctgccagatcaa

SEQ ID NO: 112094 - DNA, 25 bp, Homo sapien
ttaacaatggagtctgtcagatcaa

SEQ ID NO: 112095 - DNA, 25 bp, Homo sapien
ttaacaatttcaattatgcaagtgc

SEQ ID NO: 112096 - DNA, 25 bp, Homo sapien
ttaacaatttcacttatgcaagtgc

SEQ ID NO: 112097 - DNA, 25 bp, Homo sapien
ttaacacgtcaaaataacatgaatt

SEQ ID NO: 112098 - DNA, 25 bp, Homo sapien
ttaacacgtcagaataacatgaatt

SEQ ID NO: 112099 - DNA, 25 bp, Homo sapien
ttaacagaacaacatggatttaaac

SEQ ID NO: 112100 - DNA, 25 bp, Homo sapien
ttaacagaattgtaatcatgcagaa

SEQ ID NO: 112101 - DNA, 25 bp, Homo sapien
ttaacagaattttaatcatgcagaa

SEQ ID NO: 112102 - DNA, 25 bp, Homo sapien
ttaacagagcaacatggatttaaac

SEQ ID NO: 112103 - DNA, 25 bp, Homo sapien
ttaacagatcgaatgggagttctta

SEQ ID NO: 112104 - DNA, 25 bp, Homo sapien
ttaacagattgaatgggagttctta

SEQ ID NO: 112105 - DNA, 25 bp, Homo sapien
ttaacagcaaagaacaatgtctcca

SEQ ID NO: 112106 - DNA, 25 bp, Homo sapien
ttaacagcaaagagcaatgtctcca

SEQ ID NO: 112107 - DNA, 25 bp, Homo sapien
ttaacaggagcttcaggtttgttgg

SEQ ID NO: 112108 - DNA, 25 bp, Homo sapien
ttaacaggcgcttcaggtttgttgg

SEQ ID NO: 112109 - DNA, 25 bp, Homo sapien
ttaacagtgtttcaataaacatagg

SEQ ID NO: 112110 - DNA, 25 bp, Homo sapien
ttaacagtgtttcgataaacatagg

SEQ ID NO: 112111 - DNA, 25 bp, Homo sapien
ttaacatacagtaagcaatcaatca

SEQ ID NO: 112112 - DNA, 25 bp, Homo sapien
ttaacatacggtaagcaatcaatca

SEQ ID NO: 112113 - DNA, 25 bp, Homo sapien
ttaacatcaagcttctaggatagtt

SEQ ID NO: 112114 - DNA, 25 bp, Homo sapien
ttaacatcaagcttgtaggatagtt

SEQ ID NO: 112115 - DNA, 25 bp, Homo sapien
ttaacatccaaacaaacttgcagtc

SEQ ID NO: 112116 - DNA, 25 bp, Homo sapien
ttaacatccaagcaaacttgcagtc

SEQ ID NO: 112117 - DNA, 25 bp, Homo sapien
ttaacatcccttgctttcagttgtc

SEQ ID NO: 112118 - DNA, 25 bp, Homo sapien
ttaacatccctttctttcagttgtc

SEQ ID NO: 112119 - DNA, 25 bp, Homo sapien
ttaacatgctgtatggtgcttagca

SEQ ID NO: 112120 - DNA, 25 bp, Homo sapien
ttaacatggtgtatggtgcttagca

SEQ ID NO: 112121 - DNA, 25 bp, Homo sapien
ttaacattccaaacatgaatcagtt

SEQ ID NO: 112122 - DNA, 25 bp, Homo sapien
ttaacattctaaacatgaatcagtt

SEQ ID NO: 112123 - DNA, 25 bp, Homo sapien
ttaacattgctgtcatgaaaagtag

SEQ ID NO: 112124 - DNA, 25 bp, Homo sapien
ttaacattgctgtcattaaaagtag

SEQ ID NO: 112125 - DNA, 25 bp, Homo sapien
ttaaccaaaagagttgttgtttgcc

SEQ ID NO: 112126 - DNA, 25 bp, Homo sapien
ttaaccaaaagggttgttgtttgcc

SEQ ID NO: 112127 - DNA, 25 bp, Homo sapien
ttaaccaatctctgactattcacac

SEQ ID NO: 112128 - DNA, 25 bp, Homo sapien
ttaaccaatttctgactattcacac

SEQ ID NO: 112129 - DNA, 25 bp, Homo sapien
ttaaccagacatggtactatacacc

SEQ ID NO: 112130 - DNA, 25 bp, Homo sapien
ttaaccaggcatggtactatacacc

SEQ ID NO: 112131 - DNA, 25 bp, Homo sapien
ttaaccatgatgcagatcccctgaa

SEQ ID NO: 112132 - DNA, 25 bp, Homo sapien
ttaaccatgatgctgatcccctgaa

SEQ ID NO: 112133 - DNA, 25 bp, Homo sapien
ttaacccattctcaggctgttatga

SEQ ID NO: 112134 - DNA, 25 bp, Homo sapien
ttaacccattctcatgctgttatga

SEQ ID NO: 112135 - DNA, 25 bp, Homo sapien
ttaaccctggagtcgagtttcacaa

SEQ ID NO: 112136 - DNA, 25 bp, Homo sapien
ttaaccctggagttgagtttcacaa

SEQ ID NO: 112137 - DNA, 25 bp, Homo sapien
ttaaccggagttctcaccattcaaa

SEQ ID NO: 112138 - DNA, 25 bp, Homo sapien
ttaaccggcgttctcaccattcaaa

SEQ ID NO: 112139 - DNA, 25 bp, Homo sapien
ttaacctcagactacatattacaga

SEQ ID NO: 112140 - DNA, 25 bp, Homo sapien
ttaacctcagactagatattacaga

SEQ ID NO: 112141 - DNA, 25 bp, Homo sapien
ttaaccttactaagcctttttaacc

SEQ ID NO: 112142 - DNA, 25 bp, Homo sapien
ttaaccttcctaagcctttttaacc

SEQ ID NO: 112143 - DNA, 25 bp, Homo sapien
ttaacctttgtcagtcatcaccttt

SEQ ID NO: 112144 - DNA, 25 bp, Homo sapien
ttaacctttgtcagtcgtcaccttt

SEQ ID NO: 112145 - DNA, 25 bp, Homo sapien
ttaacgataattcatctggtagatt

SEQ ID NO: 112146 - DNA, 25 bp, Homo sapien
ttaacgataattcgtctggtagatt

SEQ ID NO: 112147 - DNA, 25 bp, Homo sapien
ttaactaactacatgctaagagttc

SEQ ID NO: 112148 - DNA, 25 bp, Homo sapien
ttaactaattacatgctaagagttc

SEQ ID NO: 112149 - DNA, 25 bp, Homo sapien
ttaactacatgcgcttggacaattt

SEQ ID NO: 112150 - DNA, 25 bp, Homo sapien
ttaactacatgggattttgggaaga

SEQ ID NO: 112151 - DNA, 25 bp, Homo sapien
ttaactacgtgcgcttggacaattt

SEQ ID NO: 112152 - DNA, 25 bp, Homo sapien
ttaactacgtgggattttgggaaga

SEQ ID NO: 112153 - DNA, 25 bp, Homo sapien
ttaactatttctatttagccaacca

SEQ ID NO: 112154 - DNA, 25 bp, Homo sapien
ttaactatttctgtttagccaacca

SEQ ID NO: 112155 - DNA, 25 bp, Homo sapien
ttaactcaagtatagtaatagatga

SEQ ID NO: 112156 - DNA, 25 bp, Homo sapien
ttaactcactacagcttcaagtcca

SEQ ID NO: 112157 - DNA, 25 bp, Homo sapien
ttaactcaggtatagtaatagatga

SEQ ID NO: 112158 - DNA, 25 bp, Homo sapien
ttaactcatcccaggctgaagggtg

SEQ ID NO: 112159 - DNA, 25 bp, Homo sapien
ttaactcatgccaggctgaagggtg

SEQ ID NO: 112160 - DNA, 25 bp, Homo sapien
ttaactcattacagcttcaagtcca

SEQ ID NO: 112161 - DNA, 25 bp, Homo sapien
ttaactccaccccagactgcttttc

SEQ ID NO: 112162 - DNA, 25 bp, Homo sapien
ttaactccacccgagactgcttttc

SEQ ID NO: 112163 - DNA, 25 bp, Homo sapien
ttaactcccagcataatctctgcaa

SEQ ID NO: 112164 - DNA, 25 bp, Homo sapien
ttaactcctagcataatctctgcaa

SEQ ID NO: 112165 - DNA, 25 bp, Homo sapien
ttaactcctttcggatgtcacactg

SEQ ID NO: 112166 - DNA, 25 bp, Homo sapien
ttaactccttttggatgtcacactg

SEQ ID NO: 112167 - DNA, 25 bp, Homo sapien
ttaactctcctgtgttcatctgtgc

SEQ ID NO: 112168 - DNA, 25 bp, Homo sapien
ttaactctccttgcttatctttcca

SEQ ID NO: 112169 - DNA, 25 bp, Homo sapien
ttaactctcttgtgttcatctgtgc

SEQ ID NO: 112170 - DNA, 25 bp, Homo sapien
ttaactctgagtgtgaacgaaaagt

SEQ ID NO: 112171 - DNA, 25 bp, Homo sapien
ttaactctgagtttgaacgaaaagt

SEQ ID NO: 112172 - DNA, 25 bp, Homo sapien
ttaactcttcttgcttatctttcca

SEQ ID NO: 112173 - DNA, 25 bp, Homo sapien
ttaactgaagttcagttgctttgca

SEQ ID NO: 112174 - DNA, 25 bp, Homo sapien
ttaactgaagttcatttgctttgca

SEQ ID NO: 112175 - DNA, 25 bp, Homo sapien
ttaactgagagatcattaagcatca

SEQ ID NO: 112176 - DNA, 25 bp, Homo sapien
ttaactgagagattattaagcatca

SEQ ID NO: 112177 - DNA, 25 bp, Homo sapien
ttaactgagtatcctaaggtgttat

SEQ ID NO: 112178 - DNA, 25 bp, Homo sapien
ttaactgattatcctaaggtgttat

SEQ ID NO: 112179 - DNA, 25 bp, Homo sapien
ttaactgcccagtgatgtcacactg

SEQ ID NO: 112180 - DNA, 25 bp, Homo sapien
ttaactgcccattgatgtcacactg

SEQ ID NO: 112181 - DNA, 25 bp, Homo sapien
ttaactgctgggaatttgagaagtc

SEQ ID NO: 112182 - DNA, 25 bp, Homo sapien
ttaactgctgggcatttgagaagtc

SEQ ID NO: 112183 - DNA, 25 bp, Homo sapien
ttaactgtagatcattcttcagagg

SEQ ID NO: 112184 - DNA, 25 bp, Homo sapien
ttaactgtagatcatttttcagagg

SEQ ID NO: 112185 - DNA, 25 bp, Homo sapien
ttaactgtggatgttgtcatcagtg

SEQ ID NO: 112186 - DNA, 25 bp, Homo sapien
ttaactgttgatgttgtcatcagtg

SEQ ID NO: 112187 - DNA, 25 bp, Homo sapien
ttaacttaccgctaatctcaatgtc

SEQ ID NO: 112188 - DNA, 25 bp, Homo sapien
ttaacttactgctaatctcaatgtc

SEQ ID NO: 112189 - DNA, 25 bp, Homo sapien
ttaacttatgcaagtaacaatccag

SEQ ID NO: 112190 - DNA, 25 bp, Homo sapien
ttaacttatgcgagtaacaatccag

SEQ ID NO: 112191 - DNA, 25 bp, Homo sapien
ttaacttctgaatcacttctttctg

SEQ ID NO: 112192 - DNA, 25 bp, Homo sapien
ttaacttctgaatcgcttctttctg

SEQ ID NO: 112193 - DNA, 25 bp, Homo sapien
ttaacttgaacacgactcattttgt

SEQ ID NO: 112194 - DNA, 25 bp, Homo sapien
ttaacttgaacatgactcattttgt

SEQ ID NO: 112195 - DNA, 25 bp, Homo sapien
ttaacttgctgatgtactgttgaat

SEQ ID NO: 112196 - DNA, 25 bp, Homo sapien
ttaacttgttgatgtactgttgaat

SEQ ID NO: 112197 - DNA, 25 bp, Homo sapien
ttaactttctgaaatcagattgtgt

SEQ ID NO: 112198 - DNA, 25 bp, Homo sapien
ttaactttctgatatcagattgtgt

SEQ ID NO: 112199 - DNA, 25 bp, Homo sapien
ttaagaaaagcaacataagcaacaa

SEQ ID NO: 112200 - DNA, 25 bp, Homo sapien
ttaagaaaagcaacgtaagcaacaa

SEQ ID NO: 112201 - DNA, 25 bp, Homo sapien
ttaagaaaagtttgcctatgtaaag

SEQ ID NO: 112202 - DNA, 25 bp, Homo sapien
ttaagaaacagcagtatcatgaaaa

SEQ ID NO: 112203 - DNA, 25 bp, Homo sapien
ttaagaaacaggagtatcatgaaaa

SEQ ID NO: 112204 - DNA, 25 bp, Homo sapien
ttaagaaagcgatctcaggaagcac

SEQ ID NO: 112205 - DNA, 25 bp, Homo sapien
ttaagaaagtacaaatgtcttcctg

SEQ ID NO: 112206 - DNA, 25 bp, Homo sapien
ttaagaaagtacaattgtcttcctg

SEQ ID NO: 112207 - DNA, 25 bp, Homo sapien
ttaagaaagtgatctcaggaagcac

SEQ ID NO: 112208 - DNA, 25 bp, Homo sapien
ttaagaaatataccaaaggccaccc

SEQ ID NO: 112209 - DNA, 25 bp, Homo sapien
ttaagaaatataccgaaggccaccc

SEQ ID NO: 112210 - DNA, 25 bp, Homo sapien
ttaagaaatgtttgcctatgtaaag

SEQ ID NO: 112211 - DNA, 25 bp, Homo sapien
ttaagaataatacataccacatgct

SEQ ID NO: 112212 - DNA, 25 bp, Homo sapien
ttaagaataatacgtaccacatgct

SEQ ID NO: 112213 - DNA, 25 bp, Homo sapien
ttaagacatatagcacaagtgatac

SEQ ID NO: 112214 - DNA, 25 bp, Homo sapien
ttaagacatatagcacgagtgatac

SEQ ID NO: 112215 - DNA, 25 bp, Homo sapien
ttaagacatctgcatgattttcctt

SEQ ID NO: 112216 - DNA, 25 bp, Homo sapien
ttaagacatctgcatgtttttcctt

SEQ ID NO: 112217 - DNA, 25 bp, Homo sapien
ttaagacattgggtctgcatattga

SEQ ID NO: 112218 - DNA, 25 bp, Homo sapien
ttaagacattgggtttgcatattga

SEQ ID NO: 112219 - DNA, 25 bp, Homo sapien
ttaagaccatcatcatctctcaacc

SEQ ID NO: 112220 - DNA, 25 bp, Homo sapien
ttaagaccatcgtcatctctcaacc

SEQ ID NO: 112221 - DNA, 25 bp, Homo sapien
ttaagagaagtatgcaagaattcag

SEQ ID NO: 112222 - DNA, 25 bp, Homo sapien
ttaagagaagtttgcaagaattcag

SEQ ID NO: 112223 - DNA, 25 bp, Homo sapien
ttaagagacgtcaacatggaaggta

SEQ ID NO: 112224 - DNA, 25 bp, Homo sapien
ttaagagacgtcaatatggaaggta

SEQ ID NO: 112225 - DNA, 25 bp, Homo sapien
ttaagagatcaaccttgaagtgaca

SEQ ID NO: 112226 - DNA, 25 bp, Homo sapien
ttaagagatcaacctttaagtgaca

SEQ ID NO: 112227 - DNA, 25 bp, Homo sapien
ttaagagcggtagtggcatgtccct

SEQ ID NO: 112228 - DNA, 25 bp, Homo sapien
ttaagagcggtcgtggcatgtccct

SEQ ID NO: 112229 - DNA, 25 bp, Homo sapien
ttaagagctgaccgtataaacgatg

SEQ ID NO: 112230 - DNA, 25 bp, Homo sapien
ttaagagctgactgtataaacgatg

SEQ ID NO: 112231 - DNA, 25 bp, Homo sapien
ttaagagcttaacatgctgtatggt

SEQ ID NO: 112232 - DNA, 25 bp, Homo sapien
ttaagagcttaacatggtgtatggt

SEQ ID NO: 112233 - DNA, 25 bp, Homo sapien
ttaagaggagagagaccatacaact

SEQ ID NO: 112234 - DNA, 25 bp, Homo sapien
ttaagaggagagagactatacaact

SEQ ID NO: 112235 - DNA, 25 bp, Homo sapien
ttaagagtattgactccttcatgca

SEQ ID NO: 112236 - DNA, 25 bp, Homo sapien
ttaagagtattgtctccttcatgca

SEQ ID NO: 112237 - DNA, 25 bp, Homo sapien
ttaagagtgaaaaggcaattcatag

SEQ ID NO: 112238 - DNA, 25 bp, Homo sapien
ttaagagtgaaaaggcgattcatag

SEQ ID NO: 112239 - DNA, 25 bp, Homo sapien
ttaagagttgtacggcttggattgt

SEQ ID NO: 112240 - DNA, 25 bp, Homo sapien
ttaagagttgtgcggcttggattgt

SEQ ID NO: 112241 - DNA, 25 bp, Homo sapien
ttaagatcgctaaatgtcttagatt

SEQ ID NO: 112242 - DNA, 25 bp, Homo sapien
ttaagatcgcttaatgtcttagatt

SEQ ID NO: 112243 - DNA, 25 bp, Homo sapien
ttaagatgatagttaagatttgatg

SEQ ID NO: 112244 - DNA, 25 bp, Homo sapien
ttaagatgatatttaagatttgatg

SEQ ID NO: 112245 - DNA, 25 bp, Homo sapien
ttaagattaaagactaggagtggcc

SEQ ID NO: 112246 - DNA, 25 bp, Homo sapien
ttaagattaaagattaggagtggcc

SEQ ID NO: 112247 - DNA, 25 bp, Homo sapien
ttaagattcagaaatgtacagatag

SEQ ID NO: 112248 - DNA, 25 bp, Homo sapien
ttaagattcagagatgtacagatag

SEQ ID NO: 112249 - DNA, 25 bp, Homo sapien
ttaagcaaagtatccagctaatttt

SEQ ID NO: 112250 - DNA, 25 bp, Homo sapien
ttaagcaaagtattcagctaatttt

SEQ ID NO: 112251 - DNA, 25 bp, Homo sapien
ttaagcaaatgaacatctttacctt

SEQ ID NO: 112252 - DNA, 25 bp, Homo sapien
ttaagcaaatgaatatctttacctt

SEQ ID NO: 112253 - DNA, 25 bp, Homo sapien
ttaagccactcagtctgctgtcttg

SEQ ID NO: 112254 - DNA, 25 bp, Homo sapien
ttaagccactcagtcttctgtcttg

SEQ ID NO: 112255 - DNA, 25 bp, Homo sapien
ttaagctaaaacatactaacacatg

SEQ ID NO: 112256 - DNA, 25 bp, Homo sapien
ttaagctaaaacttactaacacatg

SEQ ID NO: 112257 - DNA, 25 bp, Homo sapien
ttaagctactgtatttaaaattggc

SEQ ID NO: 112258 - DNA, 25 bp, Homo sapien
ttaagctactgtattttaaattggc

SEQ ID NO: 112259 - DNA, 25 bp, Homo sapien
ttaagctagttctctccagtacagg

SEQ ID NO: 112260 - DNA, 25 bp, Homo sapien
ttaagctagttctttccagtacagg

SEQ ID NO: 112261 - DNA, 25 bp, Homo sapien
ttaagctcatagacatgtttaaaat

SEQ ID NO: 112262 - DNA, 25 bp, Homo sapien
ttaagctcataggcatgtttaaaat

SEQ ID NO: 112263 - DNA, 25 bp, Homo sapien
ttaagctgaatatgttggaaaacat

SEQ ID NO: 112264 - DNA, 25 bp, Homo sapien
ttaagctgatgataaaagaagtttc

SEQ ID NO: 112265 - DNA, 25 bp, Homo sapien
ttaagctgatggtaaaagaagtttc

SEQ ID NO: 112266 - DNA, 25 bp, Homo sapien
ttaagctgcatccgagagattctgg

SEQ ID NO: 112267 - DNA, 25 bp, Homo sapien
ttaagctgcatctgagagattctgg

SEQ ID NO: 112268 - DNA, 25 bp, Homo sapien
ttaagctggaaagtttgtgtcaatt

SEQ ID NO: 112269 - DNA, 25 bp, Homo sapien
ttaagctggaaagtttttgtcaatt

SEQ ID NO: 112270 - DNA, 25 bp, Homo sapien
ttaagctggatatgttggaaaacat

SEQ ID NO: 112271 - DNA, 25 bp, Homo sapien
ttaagcttattaaactccatgacac

SEQ ID NO: 112272 - DNA, 25 bp, Homo sapien
ttaagcttattaaattccatgacac

SEQ ID NO: 112273 - DNA, 25 bp, Homo sapien
ttaaggaaagaagctggttaataaa

SEQ ID NO: 112274 - DNA, 25 bp, Homo sapien
ttaaggaaataagctggttaataaa

SEQ ID NO: 112275 - DNA, 25 bp, Homo sapien
ttaaggaatggccgatgcccagtca

SEQ ID NO: 112276 - DNA, 25 bp, Homo sapien
ttaaggaatggctgatgcccagtca

SEQ ID NO: 112277 - DNA, 25 bp, Homo sapien
ttaaggacaatattagacatctgct

SEQ ID NO: 112278 - DNA, 25 bp, Homo sapien
ttaaggacaatattggacatctgct

SEQ ID NO: 112279 - DNA, 25 bp, Homo sapien
ttaaggaccggcgttgctttctgac

SEQ ID NO: 112280 - DNA, 25 bp, Homo sapien
ttaaggaccggtgttgctttctgac

SEQ ID NO: 112281 - DNA, 25 bp, Homo sapien
ttaaggagataaggactggggtgtg

SEQ ID NO: 112282 - DNA, 25 bp, Homo sapien
ttaaggagataatgactggggtgtg

SEQ ID NO: 112283 - DNA, 25 bp, Homo sapien
ttaaggatcatttttgagtattacg

SEQ ID NO: 112284 - DNA, 25 bp, Homo sapien
ttaaggatcgtttttgagtattacg

SEQ ID NO: 112285 - DNA, 25 bp, Homo sapien
ttaaggcattcttaaatcacaaaca

SEQ ID NO: 112286 - DNA, 25 bp, Homo sapien
ttaaggcattcttacatcacaaaca

SEQ ID NO: 112287 - DNA, 25 bp, Homo sapien
ttaaggccataagtccgaaaccagc

SEQ ID NO: 112288 - DNA, 25 bp, Homo sapien
ttaaggccgtaagtccgaaaccagc

SEQ ID NO: 112289 - DNA, 25 bp, Homo sapien
ttaaggctaatacctataataacat

SEQ ID NO: 112290 - DNA, 25 bp, Homo sapien
ttaaggctaatacgtataataacat

SEQ ID NO: 112291 - DNA, 25 bp, Homo sapien
ttaaggctctggcagctgtggtgtt

SEQ ID NO: 112292 - DNA, 25 bp, Homo sapien
ttaaggctctggcatctgtggtgtt

SEQ ID NO: 112293 - DNA, 25 bp, Homo sapien
ttaaggcttcaacatatgaaattgg

SEQ ID NO: 112294 - DNA, 25 bp, Homo sapien
ttaaggcttgaacatatgaaattgg

SEQ ID NO: 112295 - DNA, 25 bp, Homo sapien
ttaaggcttttagtatccatgaagg

SEQ ID NO: 112296 - DNA, 25 bp, Homo sapien
ttaaggctttttgtatccatgaagg

SEQ ID NO: 112297 - DNA, 25 bp, Homo sapien
ttaagggaacattgtttgtaggctg

SEQ ID NO: 112298 - DNA, 25 bp, Homo sapien
ttaagggaatattgtttgtaggctg

SEQ ID NO: 112299 - DNA, 25 bp, Homo sapien
ttaaggggaagaaatagcattattg

SEQ ID NO: 112300 - DNA, 25 bp, Homo sapien
ttaaggggaagaagtagcattattg

SEQ ID NO: 112301 - DNA, 25 bp, Homo sapien
ttaaggtccaggtcccattttctct

SEQ ID NO: 112302 - DNA, 25 bp, Homo sapien
ttaaggtccaggtccccttttctct

SEQ ID NO: 112303 - DNA, 25 bp, Homo sapien
ttaaggtcccatcatcttttaatcc

SEQ ID NO: 112304 - DNA, 25 bp, Homo sapien
ttaaggtccgatcatcttttaatcc

SEQ ID NO: 112305 - DNA, 25 bp, Homo sapien
ttaaggtgaaagtgacttgactttg

SEQ ID NO: 112306 - DNA, 25 bp, Homo sapien
ttaaggtgaaattgacttgactttg

SEQ ID NO: 112307 - DNA, 25 bp, Homo sapien
ttaaggttacgtacagcagtcagga

SEQ ID NO: 112308 - DNA, 25 bp, Homo sapien
ttaaggttaggtacagcagtcagga

SEQ ID NO: 112309 - DNA, 25 bp, Homo sapien
ttaaggttctcaatcggtgtacagt

SEQ ID NO: 112310 - DNA, 25 bp, Homo sapien
ttaaggttttcaatcggtgtacagt

SEQ ID NO: 112311 - DNA, 25 bp, Homo sapien
ttaagtaattcaatggaaacatacc

SEQ ID NO: 112312 - DNA, 25 bp, Homo sapien
ttaagtaattcagtggaaacatacc

SEQ ID NO: 112313 - DNA, 25 bp, Homo sapien
ttaagtactgggatagactgataat

SEQ ID NO: 112314 - DNA, 25 bp, Homo sapien
ttaagtactggggtagactgataat

SEQ ID NO: 112315 - DNA, 25 bp, Homo sapien
ttaagtagcattcccagagtgacag

SEQ ID NO: 112316 - DNA, 25 bp, Homo sapien
ttaagtagcatttccagagtgacag

SEQ ID NO: 112317 - DNA, 25 bp, Homo sapien
ttaagtatgtgcagattcaagcaat

SEQ ID NO: 112318 - DNA, 25 bp, Homo sapien
ttaagtatgtgtagattcaagcaat

SEQ ID NO: 112319 - DNA, 25 bp, Homo sapien
ttaagtattgtattagtttcctctt

SEQ ID NO: 112320 - DNA, 25 bp, Homo sapien
ttaagtattgtattcgtttcctctt

SEQ ID NO: 112321 - DNA, 25 bp, Homo sapien
ttaagtctaagtagaagcgacgtag

SEQ ID NO: 112322 - DNA, 25 bp, Homo sapien
ttaagtctatgtagaagcgacgtag

SEQ ID NO: 112323 - DNA, 25 bp, Homo sapien
ttaagtgaaatatctcttcatgact

SEQ ID NO: 112324 - DNA, 25 bp, Homo sapien
ttaagtgaaatgtctcttcatgact

SEQ ID NO: 112325 - DNA, 25 bp, Homo sapien
ttaagtgaacaagcgagattttaat

SEQ ID NO: 112326 - DNA, 25 bp, Homo sapien
ttaagtgaacaagtgagattttaat

SEQ ID NO: 112327 - DNA, 25 bp, Homo sapien
ttaagtgaatgacgctaaagggtaa

SEQ ID NO: 112328 - DNA, 25 bp, Homo sapien
ttaagtgaatgatgctaaagggtaa

SEQ ID NO: 112329 - DNA, 25 bp, Homo sapien
ttaagtgagatgacgtaaatagttt

SEQ ID NO: 112330 - DNA, 25 bp, Homo sapien
ttaagtgagatgatgtaaatagttt

SEQ ID NO: 112331 - DNA, 25 bp, Homo sapien
ttaagtgatttgttccatatagcag

SEQ ID NO: 112332 - DNA, 25 bp, Homo sapien
ttaagtgatttgttccgtatagcag

SEQ ID NO: 112333 - DNA, 25 bp, Homo sapien
ttaagtggcaatgttccatgcaata

SEQ ID NO: 112334 - DNA, 25 bp, Homo sapien
ttaagtggtaatgttccatgcaata

SEQ ID NO: 112335 - DNA, 25 bp, Homo sapien
ttaagttaagtggtattacctggac

SEQ ID NO: 112336 - DNA, 25 bp, Homo sapien
ttaagttaggtggtattacctggac

SEQ ID NO: 112337 - DNA, 25 bp, Homo sapien
ttaagttataatatccctaagctga

SEQ ID NO: 112338 - DNA, 25 bp, Homo sapien
ttaagttataatttccctaagctga

SEQ ID NO: 112339 - DNA, 25 bp, Homo sapien
ttaagttcagctctcaaaatcattt

SEQ ID NO: 112340 - DNA, 25 bp, Homo sapien
ttaagttcggctctcaaaatcattt

SEQ ID NO: 112341 - DNA, 25 bp, Homo sapien
ttaataaaaatgtcaacaatattat

SEQ ID NO: 112342 - DNA, 25 bp, Homo sapien
ttaataaaaatgtcaagaatattat

SEQ ID NO: 112343 - DNA, 25 bp, Homo sapien
ttaataaaagttgccaaccaacacc

SEQ ID NO: 112344 - DNA, 25 bp, Homo sapien
ttaataaaagttgccatccaacacc

SEQ ID NO: 112345 - DNA, 25 bp, Homo sapien
ttaataaactcatcatcgcatttgc

SEQ ID NO: 112346 - DNA, 25 bp, Homo sapien
ttaataaactcatcattgcatttgc

SEQ ID NO: 112347 - DNA, 25 bp, Homo sapien
ttaataaagcccaattgagagagaa

SEQ ID NO: 112348 - DNA, 25 bp, Homo sapien
ttaataaagcccgattgagagagaa

SEQ ID NO: 112349 - DNA, 25 bp, Homo sapien
ttaataaatcttgacgaaaactttc

SEQ ID NO: 112350 - DNA, 25 bp, Homo sapien
ttaataaatcttgatgaaaactttc

SEQ ID NO: 112351 - DNA, 25 bp, Homo sapien
ttaataaatttcctatcatttacac

SEQ ID NO: 112352 - DNA, 25 bp, Homo sapien
ttaataaatttcttatcatttacac

SEQ ID NO: 112353 - DNA, 25 bp, Homo sapien
ttaataacaaaacacacatgacttt

SEQ ID NO: 112354 - DNA, 25 bp, Homo sapien
ttaataacaaaatacacatgacttt

SEQ ID NO: 112355 - DNA, 25 bp, Homo sapien
ttaataagtggatgtcctcatttat

SEQ ID NO: 112356 - DNA, 25 bp, Homo sapien
ttaataagtgggtgtcctcatttat

SEQ ID NO: 112357 - DNA, 25 bp, Homo sapien
ttaataataccgtgttagatgcaaa

SEQ ID NO: 112358 - DNA, 25 bp, Homo sapien
ttaataataccgttttagatgcaaa

SEQ ID NO: 112359 - DNA, 25 bp, Homo sapien
ttaataatcaatactttggctgctt

SEQ ID NO: 112360 - DNA, 25 bp, Homo sapien
ttaataatcaatcctttggctgctt

SEQ ID NO: 112361 - DNA, 25 bp, Homo sapien
ttaataatggctacttgatccacag

SEQ ID NO: 112362 - DNA, 25 bp, Homo sapien
ttaataattgctacttgatccacag

SEQ ID NO: 112363 - DNA, 25 bp, Homo sapien
ttaatacaggttatttcccatggag

SEQ ID NO: 112364 - DNA, 25 bp, Homo sapien
ttaatacaggttattttccatggag

SEQ ID NO: 112365 - DNA, 25 bp, Homo sapien
ttaatacctaatataatgtctgata

SEQ ID NO: 112366 - DNA, 25 bp, Homo sapien
ttaatacctaatgtaatgtctgata

SEQ ID NO: 112367 - DNA, 25 bp, Homo sapien
ttaataccttttgaaacgtaaacaa

SEQ ID NO: 112368 - DNA, 25 bp, Homo sapien
ttaataccttttgaaatgtaaacaa

SEQ ID NO: 112369 - DNA, 25 bp, Homo sapien
ttaatactcagatttcatatacgta

SEQ ID NO: 112370 - DNA, 25 bp, Homo sapien
ttaatactccaaagcccgcttatga

SEQ ID NO: 112371 - DNA, 25 bp, Homo sapien
ttaatactccaaaggccgcttatga

SEQ ID NO: 112372 - DNA, 25 bp, Homo sapien
ttaatactcggatttcatatacgta

SEQ ID NO: 112373 - DNA, 25 bp, Homo sapien
ttaatagaaccatgactgaaaaagt

SEQ ID NO: 112374 - DNA, 25 bp, Homo sapien
ttaatagagcctacataaattagag

SEQ ID NO: 112375 - DNA, 25 bp, Homo sapien
ttaatagagcctacctaaattagag

SEQ ID NO: 112376 - DNA, 25 bp, Homo sapien
ttaatagatccatgactgaaaaagt

SEQ ID NO: 112377 - DNA, 25 bp, Homo sapien
ttaatagcaggttaagatgaaacat

SEQ ID NO: 112378 - DNA, 25 bp, Homo sapien
ttaatagcgggttaagatgaaacat

SEQ ID NO: 112379 - DNA, 25 bp, Homo sapien
ttaatagttgtggacaagttttatt

SEQ ID NO: 112380 - DNA, 25 bp, Homo sapien
ttaatagttgtggagaagttttatt

SEQ ID NO: 112381 - DNA, 25 bp, Homo sapien
ttaatatatgactgctgactttgcc

SEQ ID NO: 112382 - DNA, 25 bp, Homo sapien
ttaatatatgagtgctgactttgcc

SEQ ID NO: 112383 - DNA, 25 bp, Homo sapien
ttaatatcatcctcattattatcat

SEQ ID NO: 112384 - DNA, 25 bp, Homo sapien
ttaatatcatcctcgttattatcat

SEQ ID NO: 112385 - DNA, 25 bp, Homo sapien
ttaatatcgttatccatgactgctt

SEQ ID NO: 112386 - DNA, 25 bp, Homo sapien
ttaatatcgttatctatgactgctt

SEQ ID NO: 112387 - DNA, 25 bp, Homo sapien
ttaatatgctgttactgtaagctta

SEQ ID NO: 112388 - DNA, 25 bp, Homo sapien
ttaatatgttgttactgtaagctta

SEQ ID NO: 112389 - DNA, 25 bp, Homo sapien
ttaatattcaatatccagatcaacc

SEQ ID NO: 112390 - DNA, 25 bp, Homo sapien
ttaatattgaatatccagatcaacc

SEQ ID NO: 112391 - DNA, 25 bp, Homo sapien
ttaatattgaggcctttttatctga

SEQ ID NO: 112392 - DNA, 25 bp, Homo sapien
ttaatattgagggctttttatctga

SEQ ID NO: 112393 - DNA, 25 bp, Homo sapien
ttaatcaaaccaacaagcatttatt

SEQ ID NO: 112394 - DNA, 25 bp, Homo sapien
ttaatcaaatcaacaagcatttatt

SEQ ID NO: 112395 - DNA, 25 bp, Homo sapien
ttaatcacaactagtttcagaaaca

SEQ ID NO: 112396 - DNA, 25 bp, Homo sapien
ttaatcacaaggaacaatcagacta

SEQ ID NO: 112397 - DNA, 25 bp, Homo sapien
ttaatcacacggaacaatcagacta

SEQ ID NO: 112398 - DNA, 25 bp, Homo sapien
ttaatcacgactagtttcagaaaca

SEQ ID NO: 112399 - DNA, 25 bp, Homo sapien
ttaatcagtgtctaatctgatgtta

SEQ ID NO: 112400 - DNA, 25 bp, Homo sapien
ttaatcagtgtctagtctgatgtta

SEQ ID NO: 112401 - DNA, 25 bp, Homo sapien
ttaatccatattgtttggcatcaat

SEQ ID NO: 112402 - DNA, 25 bp, Homo sapien
ttaatccatattgttttgcatcaat

SEQ ID NO: 112403 - DNA, 25 bp, Homo sapien
ttaatcccatgtgtttgagctctga

SEQ ID NO: 112404 - DNA, 25 bp, Homo sapien
ttaatcccgactctactcttttcct

SEQ ID NO: 112405 - DNA, 25 bp, Homo sapien
ttaatcccgactgtactcttttcct

SEQ ID NO: 112406 - DNA, 25 bp, Homo sapien
ttaatcccttgtgtttgagctctga

SEQ ID NO: 112407 - DNA, 25 bp, Homo sapien
ttaatctccagatcctgttaagcca

SEQ ID NO: 112408 - DNA, 25 bp, Homo sapien
ttaatctccagattctgttaagcca

SEQ ID NO: 112409 - DNA, 25 bp, Homo sapien
ttaatctgaatgacagttgccctaa

SEQ ID NO: 112410 - DNA, 25 bp, Homo sapien
ttaatctgaatgagagttgccctaa

SEQ ID NO: 112411 - DNA, 25 bp, Homo sapien
ttaatctgcagacgtggactgaggg

SEQ ID NO: 112412 - DNA, 25 bp, Homo sapien
ttaatctgcagatgtggactgaggg

SEQ ID NO: 112413 - DNA, 25 bp, Homo sapien
ttaatctgtatttgcttgaatggtg

SEQ ID NO: 112414 - DNA, 25 bp, Homo sapien
ttaatctgtatttgtttgaatggtg

SEQ ID NO: 112415 - DNA, 25 bp, Homo sapien
ttaatctgtggatcaatttgaacat

SEQ ID NO: 112416 - DNA, 25 bp, Homo sapien
ttaatctgtggatccatttgaacat

SEQ ID NO: 112417 - DNA, 25 bp, Homo sapien
ttaatcttatccatgaccttttttg

SEQ ID NO: 112418 - DNA, 25 bp, Homo sapien
ttaatcttatccgtgaccttttttg

SEQ ID NO: 112419 - DNA, 25 bp, Homo sapien
ttaatgaaaatcagtagaccatgtt

SEQ ID NO: 112420 - DNA, 25 bp, Homo sapien
ttaatgaaaatcggtagaccatgtt

SEQ ID NO: 112421 - DNA, 25 bp, Homo sapien
ttaatgaacaggtaaaaaaaaatgc

SEQ ID NO: 112422 - DNA, 25 bp, Homo sapien
ttaatgaacaggttaaaaaaaatgc

SEQ ID NO: 112423 - DNA, 25 bp, Homo sapien
ttaatgacaatgatacattctgaga

SEQ ID NO: 112424 - DNA, 25 bp, Homo sapien
ttaatgacgatgatacattctgaga

SEQ ID NO: 112425 - DNA, 25 bp, Homo sapien
ttaatgactttatagaggcaaaaga

SEQ ID NO: 112426 - DNA, 25 bp, Homo sapien
ttaatgactttatggaggcaaaaga

SEQ ID NO: 112427 - DNA, 25 bp, Homo sapien
ttaatgagtggccagtgttattaac

SEQ ID NO: 112428 - DNA, 25 bp, Homo sapien
ttaatgagtggccggtgttattaac

SEQ ID NO: 112429 - DNA, 25 bp, Homo sapien
ttaatgatagcaattcacgctagag

SEQ ID NO: 112430 - DNA, 25 bp, Homo sapien
ttaatgatagcgattcacgctagag

SEQ ID NO: 112431 - DNA, 25 bp, Homo sapien
ttaatgatccatatactgtcacggc

SEQ ID NO: 112432 - DNA, 25 bp, Homo sapien
ttaatgatccatgtactgtcacggc

SEQ ID NO: 112433 - DNA, 25 bp, Homo sapien
ttaatgcaaaagaatatcgagggta

SEQ ID NO: 112434 - DNA, 25 bp, Homo sapien
ttaatgcaaaagagtatcgagggta

SEQ ID NO: 112435 - DNA, 25 bp, Homo sapien
ttaatgcaactccatcaaaatccca

SEQ ID NO: 112436 - DNA, 25 bp, Homo sapien
ttaatgcaatgggtttccttctggc

SEQ ID NO: 112437 - DNA, 25 bp, Homo sapien
ttaatgcacaagcaaggaaagagat

SEQ ID NO: 112438 - DNA, 25 bp, Homo sapien
ttaatgcacaagtaaggaaagagat

SEQ ID NO: 112439 - DNA, 25 bp, Homo sapien
ttaatgcacctccatcaaaatccca

SEQ ID NO: 112440 - DNA, 25 bp, Homo sapien
ttaatgcagtgggtttccttctggc

SEQ ID NO: 112441 - DNA, 25 bp, Homo sapien
ttaatgccttttgagtaaacaaaat

SEQ ID NO: 112442 - DNA, 25 bp, Homo sapien
ttaatgccttttgattaaacaaaat

SEQ ID NO: 112443 - DNA, 25 bp, Homo sapien
ttaatgcttcctatctctcacacag

SEQ ID NO: 112444 - DNA, 25 bp, Homo sapien
ttaatgcttcctatgtctcacacag

SEQ ID NO: 112445 - DNA, 25 bp, Homo sapien
ttaatggatagattacacagagcaa

SEQ ID NO: 112446 - DNA, 25 bp, Homo sapien
ttaatggatggattacacagagcaa

SEQ ID NO: 112447 - DNA, 25 bp, Homo sapien
ttaatggcttggatcttttgaatat

SEQ ID NO: 112448 - DNA, 25 bp, Homo sapien
ttaatggcttggctcttttgaatat

SEQ ID NO: 112449 - DNA, 25 bp, Homo sapien
ttaatggttacagcatgtatgcttt

SEQ ID NO: 112450 - DNA, 25 bp, Homo sapien
ttaatggttacagcatttatgcttt

SEQ ID NO: 112451 - DNA, 25 bp, Homo sapien
ttaatggttcatagttttggtattg

SEQ ID NO: 112452 - DNA, 25 bp, Homo sapien
ttaatggttcattgttttggtattg

SEQ ID NO: 112453 - DNA, 25 bp, Homo sapien
ttaatgtaaactaccaaatcaacag

SEQ ID NO: 112454 - DNA, 25 bp, Homo sapien
ttaatgtaatcccacgtaagtttcg

SEQ ID NO: 112455 - DNA, 25 bp, Homo sapien
ttaatgtaatcccgcgtaagtttcg

SEQ ID NO: 112456 - DNA, 25 bp, Homo sapien
ttaatgtaatctaccaaatcaacag

SEQ ID NO: 112457 - DNA, 25 bp, Homo sapien
ttaatgtagaaaagccatattttat

SEQ ID NO: 112458 - DNA, 25 bp, Homo sapien
ttaatgtagaaaggccatattttat

SEQ ID NO: 112459 - DNA, 25 bp, Homo sapien
ttaatgtaggcaatttgatgagttt

SEQ ID NO: 112460 - DNA, 25 bp, Homo sapien
ttaatgtatgcaatttgatgagttt

SEQ ID NO: 112461 - DNA, 25 bp, Homo sapien
ttaatgtgggtgcttgctctcttca

SEQ ID NO: 112462 - DNA, 25 bp, Homo sapien
ttaatgtgggtgtttgctctcttca

SEQ ID NO: 112463 - DNA, 25 bp, Homo sapien
ttaatgtgtcaatattagttcacca

SEQ ID NO: 112464 - DNA, 25 bp, Homo sapien
ttaatgtgtcaatatttgttcacca

SEQ ID NO: 112465 - DNA, 25 bp, Homo sapien
ttaatgttcgagtgtttctgcttcc

SEQ ID NO: 112466 - DNA, 25 bp, Homo sapien
ttaatgttgaaaaagatgaacctct

SEQ ID NO: 112467 - DNA, 25 bp, Homo sapien
ttaatgttggaaaagatgaacctct

SEQ ID NO: 112468 - DNA, 25 bp, Homo sapien
ttaatgtttcttcctgaatattttt

SEQ ID NO: 112469 - DNA, 25 bp, Homo sapien
ttaatgtttcttgctgaatattttt

SEQ ID NO: 112470 - DNA, 25 bp, Homo sapien
ttaatgtttgagtgtttctgcttcc

SEQ ID NO: 112471 - DNA, 25 bp, Homo sapien
ttaatgttttgggataaatatggca

SEQ ID NO: 112472 - DNA, 25 bp, Homo sapien
ttaatgttttgtgataaatatggca

SEQ ID NO: 112473 - DNA, 25 bp, Homo sapien
ttaattacaactcctggcccactaa

SEQ ID NO: 112474 - DNA, 25 bp, Homo sapien
ttaattacaccctgttgcctccgaa

SEQ ID NO: 112475 - DNA, 25 bp, Homo sapien
ttaattacacttctataaaactgtt

SEQ ID NO: 112476 - DNA, 25 bp, Homo sapien
ttaattacatcctgttgcctccgaa

SEQ ID NO: 112477 - DNA, 25 bp, Homo sapien
ttaattacattggactacttctatc

SEQ ID NO: 112478 - DNA, 25 bp, Homo sapien
ttaattacattggactgcttctatc

SEQ ID NO: 112479 - DNA, 25 bp, Homo sapien
ttaattacgactcctggcccactaa

SEQ ID NO: 112480 - DNA, 25 bp, Homo sapien
ttaattacgcttctataaaactgtt

SEQ ID NO: 112481 - DNA, 25 bp, Homo sapien
ttaattagagcgaccaagaaaggaa

SEQ ID NO: 112482 - DNA, 25 bp, Homo sapien
ttaattagtcataccttcccataat

SEQ ID NO: 112483 - DNA, 25 bp, Homo sapien
ttaattagtcatactttcccataat

SEQ ID NO: 112484 - DNA, 25 bp, Homo sapien
ttaattagtgcgaccaagaaaggaa

SEQ ID NO: 112485 - DNA, 25 bp, Homo sapien
ttaattagttgaaactctcttgaat

SEQ ID NO: 112486 - DNA, 25 bp, Homo sapien
ttaattagttgaacctctcttgaat

SEQ ID NO: 112487 - DNA, 25 bp, Homo sapien
ttaattatcgtagctatatagtaaa

SEQ ID NO: 112488 - DNA, 25 bp, Homo sapien
ttaattattgtagctatatagtaaa

SEQ ID NO: 112489 - DNA, 25 bp, Homo sapien
ttaattcaacaagcacatattgaac

SEQ ID NO: 112490 - DNA, 25 bp, Homo sapien
ttaattcacagtcgaaataggatcc

SEQ ID NO: 112491 - DNA, 25 bp, Homo sapien
ttaattcacagttgaaataggatcc

SEQ ID NO: 112492 - DNA, 25 bp, Homo sapien
ttaattcagaggcgctgacacatgc

SEQ ID NO: 112493 - DNA, 25 bp, Homo sapien
ttaattcagaggtgctgacacatgc

SEQ ID NO: 112494 - DNA, 25 bp, Homo sapien
ttaattcagcaagcacatattgaac

SEQ ID NO: 112495 - DNA, 25 bp, Homo sapien
ttaattcatgttccaaaggtgactt

SEQ ID NO: 112496 - DNA, 25 bp, Homo sapien
ttaattcatgttgcaaaggtgactt

SEQ ID NO: 112497 - DNA, 25 bp, Homo sapien
ttaattccatgattttgacaagtgc

SEQ ID NO: 112498 - DNA, 25 bp, Homo sapien
ttaattccatggttttgacaagtgc

SEQ ID NO: 112499 - DNA, 25 bp, Homo sapien
ttaattcccacatgaactctatgca

SEQ ID NO: 112500 - DNA, 25 bp, Homo sapien
ttaattcccacgtgaactctatgca

SEQ ID NO: 112501 - DNA, 25 bp, Homo sapien
ttaattctagtcattatccatcaag

SEQ ID NO: 112502 - DNA, 25 bp, Homo sapien
ttaattctagtcgttatccatcaag

SEQ ID NO: 112503 - DNA, 25 bp, Homo sapien
ttaattcttatctgttcaatgtgac

SEQ ID NO: 112504 - DNA, 25 bp, Homo sapien
ttaattcttatctgtttaatgtgac

SEQ ID NO: 112505 - DNA, 25 bp, Homo sapien
ttaattgaaatcagaaaaaaacaga

SEQ ID NO: 112506 - DNA, 25 bp, Homo sapien
ttaattgaaatcagaagaaaacaga

SEQ ID NO: 112507 - DNA, 25 bp, Homo sapien
ttaattgcagctgaacttaaaccca

SEQ ID NO: 112508 - DNA, 25 bp, Homo sapien
ttaattgcagcttaacttaaaccca

SEQ ID NO: 112509 - DNA, 25 bp, Homo sapien
ttaattgcctaactgggtatgatgc

SEQ ID NO: 112510 - DNA, 25 bp, Homo sapien
ttaattgcctaattgggtatgatgc

SEQ ID NO: 112511 - DNA, 25 bp, Homo sapien
ttaattgtaggtataactactgcta

SEQ ID NO: 112512 - DNA, 25 bp, Homo sapien
ttaattgtaggtataattactgcta

SEQ ID NO: 112513 - DNA, 25 bp, Homo sapien
ttaattgtccacttggagtgtttgc

SEQ ID NO: 112514 - DNA, 25 bp, Homo sapien
ttaattgtctacttggagtgtttgc

SEQ ID NO: 112515 - DNA, 25 bp, Homo sapien
ttaattgtctccctcaaagcaaggc

SEQ ID NO: 112516 - DNA, 25 bp, Homo sapien
ttaattgtctccctcagagcaaggc

SEQ ID NO: 112517 - DNA, 25 bp, Homo sapien
ttaatttactccagttcctccaaat

SEQ ID NO: 112518 - DNA, 25 bp, Homo sapien
ttaatttactccggttcctccaaat

SEQ ID NO: 112519 - DNA, 25 bp, Homo sapien
ttaatttacttgtagcacagacatg

SEQ ID NO: 112520 - DNA, 25 bp, Homo sapien
ttaatttacttgtggcacagacatg

SEQ ID NO: 112521 - DNA, 25 bp, Homo sapien
ttaatttccagaatctctttgatcg

SEQ ID NO: 112522 - DNA, 25 bp, Homo sapien
ttaatttccagagtctctttgatcg

SEQ ID NO: 112523 - DNA, 25 bp, Homo sapien
ttaatttctacctactcctgttaca

SEQ ID NO: 112524 - DNA, 25 bp, Homo sapien
ttaatttctacctcctcctgttaca

SEQ ID NO: 112525 - DNA, 25 bp, Homo sapien
ttaatttcttttccctgatgacata

SEQ ID NO: 112526 - DNA, 25 bp, Homo sapien
ttaatttcttttccgtgatgacata

SEQ ID NO: 112527 - DNA, 25 bp, Homo sapien
ttaatttgaaccacacacagtctaa

SEQ ID NO: 112528 - DNA, 25 bp, Homo sapien
ttaatttgaaccacgcacagtctaa

SEQ ID NO: 112529 - DNA, 25 bp, Homo sapien
ttaatttgatggcttgagcagggaa

SEQ ID NO: 112530 - DNA, 25 bp, Homo sapien
ttaatttgccgcagttataagtttc

SEQ ID NO: 112531 - DNA, 25 bp, Homo sapien
ttaatttgcgtccctaatagctaat

SEQ ID NO: 112532 - DNA, 25 bp, Homo sapien
ttaatttgctgcagttataagtttc

SEQ ID NO: 112533 - DNA, 25 bp, Homo sapien
ttaatttggtggcttgagcagggaa

SEQ ID NO: 112534 - DNA, 25 bp, Homo sapien
ttaatttgtgtccctaatagctaat

SEQ ID NO: 112535 - DNA, 25 bp, Homo sapien
ttaatttgtgtttccctaattgcta

SEQ ID NO: 112536 - DNA, 25 bp, Homo sapien
ttaatttgtgtttctctaattgcta

SEQ ID NO: 112537 - DNA, 25 bp, Homo sapien
ttaattttatctgcagcatcctttg

SEQ ID NO: 112538 - DNA, 25 bp, Homo sapien
ttaattttcacatcacagtaataag

SEQ ID NO: 112539 - DNA, 25 bp, Homo sapien
ttaattttcacctttaatcaacagc

SEQ ID NO: 112540 - DNA, 25 bp, Homo sapien
ttaattttcacctttagtcaacagc

SEQ ID NO: 112541 - DNA, 25 bp, Homo sapien
ttaattttcacgtcacagtaataag

SEQ ID NO: 112542 - DNA, 25 bp, Homo sapien
ttaattttccacttgtgcaaatcat

SEQ ID NO: 112543 - DNA, 25 bp, Homo sapien
ttaattttctacttgtgcaaatcat

SEQ ID NO: 112544 - DNA, 25 bp, Homo sapien
ttaattttctgcgcttagaatgctc

SEQ ID NO: 112545 - DNA, 25 bp, Homo sapien
ttaattttctgctcttagaatgctc

SEQ ID NO: 112546 - DNA, 25 bp, Homo sapien
ttaattttgtactctactggctgtt

SEQ ID NO: 112547 - DNA, 25 bp, Homo sapien
ttaattttgtactctattggctgtt

SEQ ID NO: 112548 - DNA, 25 bp, Homo sapien
ttaattttgtctgcagcatcctttg

SEQ ID NO: 112549 - DNA, 25 bp, Homo sapien
ttaattttttaacaagtgccgtgat

SEQ ID NO: 112550 - DNA, 25 bp, Homo sapien
ttaattttttaataagtgccgtgat

SEQ ID NO: 112551 - DNA, 25 bp, Homo sapien
ttacaaaattataggcctgatttct

SEQ ID NO: 112552 - DNA, 25 bp, Homo sapien
ttacaaaattatagtcctgatttct

SEQ ID NO: 112553 - DNA, 25 bp, Homo sapien
ttacaaacagtagatatgacacagt

SEQ ID NO: 112554 - DNA, 25 bp, Homo sapien
ttacaaacagtggatatgacacagt

SEQ ID NO: 112555 - DNA, 25 bp, Homo sapien
ttacaaagatgcgtcttttcctgct

SEQ ID NO: 112556 - DNA, 25 bp, Homo sapien
ttacaaagatgtgtcttttcctgct

SEQ ID NO: 112557 - DNA, 25 bp, Homo sapien
ttacaaagttagccagatctcaata

SEQ ID NO: 112558 - DNA, 25 bp, Homo sapien
ttacaaagttagtcagatctcaata

SEQ ID NO: 112559 - DNA, 25 bp, Homo sapien
ttacaaatgagggaaccgaggtata

SEQ ID NO: 112560 - DNA, 25 bp, Homo sapien
ttacaaatgagggaactgaggtata

SEQ ID NO: 112561 - DNA, 25 bp, Homo sapien
ttacaaatgctaccagtgtggatta

SEQ ID NO: 112562 - DNA, 25 bp, Homo sapien
ttacaaatgttaccagtgtggatta

SEQ ID NO: 112563 - DNA, 25 bp, Homo sapien
ttacaacaatgggaagttaagaaga

SEQ ID NO: 112564 - DNA, 25 bp, Homo sapien
ttacaacaatgggaggttaagaaga

SEQ ID NO: 112565 - DNA, 25 bp, Homo sapien
ttacaacatacactaaatgtaactg

SEQ ID NO: 112566 - DNA, 25 bp, Homo sapien
ttacaacatacgctaaatgtaactg

SEQ ID NO: 112567 - DNA, 25 bp, Homo sapien
ttacaaccatagtcaacgtaagaaa

SEQ ID NO: 112568 - DNA, 25 bp, Homo sapien
ttacaaccatagtcaatgtaagaaa

SEQ ID NO: 112569 - DNA, 25 bp, Homo sapien
ttacaaccgctatgagggcagagaa

SEQ ID NO: 112570 - DNA, 25 bp, Homo sapien
ttacaacctctatgagggcagagaa

SEQ ID NO: 112571 - DNA, 25 bp, Homo sapien
ttacaactaccaagcgaggcagaga

SEQ ID NO: 112572 - DNA, 25 bp, Homo sapien
ttacaactaccaagtgaggcagaga

SEQ ID NO: 112573 - DNA, 25 bp, Homo sapien
ttacaactatatacgtttatggcct

SEQ ID NO: 112574 - DNA, 25 bp, Homo sapien
ttacaactatatatgtttatggcct

SEQ ID NO: 112575 - DNA, 25 bp, Homo sapien
ttacaagaactactgtattttctgc

SEQ ID NO: 112576 - DNA, 25 bp, Homo sapien
ttacaagaactattgtattttctgc

SEQ ID NO: 112577 - DNA, 25 bp, Homo sapien
ttacaagacctgagccatagaatat

SEQ ID NO: 112578 - DNA, 25 bp, Homo sapien
ttacaagagctgagccatagaatat

SEQ ID NO: 112579 - DNA, 25 bp, Homo sapien
ttacaagcacgaagcacaaagttca

SEQ ID NO: 112580 - DNA, 25 bp, Homo sapien
ttacaagcacgtttcaaaaaccacc

SEQ ID NO: 112581 - DNA, 25 bp, Homo sapien
ttacaagcatgaagcacaaagttca

SEQ ID NO: 112582 - DNA, 25 bp, Homo sapien
ttacaagcatgtgcatgagtctgtg

SEQ ID NO: 112583 - DNA, 25 bp, Homo sapien
ttacaagcatgtgcgtgagtctgtg

SEQ ID NO: 112584 - DNA, 25 bp, Homo sapien
ttacaagcatgtttcaaaaaccacc

SEQ ID NO: 112585 - DNA, 25 bp, Homo sapien
ttacaaggtagctaaaattaagcac

SEQ ID NO: 112586 - DNA, 25 bp, Homo sapien
ttacaaggtagctataattaagcac

SEQ ID NO: 112587 - DNA, 25 bp, Homo sapien
ttacaaggtgctacgagaacatgta

SEQ ID NO: 112588 - DNA, 25 bp, Homo sapien
ttacaaggtgctatgagaacatgta

SEQ ID NO: 112589 - DNA, 25 bp, Homo sapien
ttacaagtcatgccacagaaataaa

SEQ ID NO: 112590 - DNA, 25 bp, Homo sapien
ttacaagtcgtgccacagaaataaa

SEQ ID NO: 112591 - DNA, 25 bp, Homo sapien
ttacaatatcagcccattaagcatc

SEQ ID NO: 112592 - DNA, 25 bp, Homo sapien
ttacaatatcagctcattaagcatc

SEQ ID NO: 112593 - DNA, 25 bp, Homo sapien
ttacaatgagttcatgcatcaacta

SEQ ID NO: 112594 - DNA, 25 bp, Homo sapien
ttacaatgagttcgtgcatcaacta

SEQ ID NO: 112595 - DNA, 25 bp, Homo sapien
ttacaattattaattcacaaaaggg

SEQ ID NO: 112596 - DNA, 25 bp, Homo sapien
ttacaattattactaggtgcttctt

SEQ ID NO: 112597 - DNA, 25 bp, Homo sapien
ttacaattgttaattcacaaaaggg

SEQ ID NO: 112598 - DNA, 25 bp, Homo sapien
ttacaatttttactaggtgcttctt

SEQ ID NO: 112599 - DNA, 25 bp, Homo sapien
ttacacataactcatagggttttca

SEQ ID NO: 112600 - DNA, 25 bp, Homo sapien
ttacacataactcgtagggttttca

SEQ ID NO: 112601 - DNA, 25 bp, Homo sapien
ttacaccacttcttggattgcatgc

SEQ ID NO: 112602 - DNA, 25 bp, Homo sapien
ttacaccagtcattcaaaaatacat

SEQ ID NO: 112603 - DNA, 25 bp, Homo sapien
ttacaccagtcgttcaaaaatacat

SEQ ID NO: 112604 - DNA, 25 bp, Homo sapien
ttacaccatacatataaatccataa

SEQ ID NO: 112605 - DNA, 25 bp, Homo sapien
ttacaccatacatatacatccataa

SEQ ID NO: 112606 - DNA, 25 bp, Homo sapien
ttacaccatttcttggattgcatgc

SEQ ID NO: 112607 - DNA, 25 bp, Homo sapien
ttacacccatctgtggaaaattgcc

SEQ ID NO: 112608 - DNA, 25 bp, Homo sapien
ttacacccgtctgtggaaaattgcc

SEQ ID NO: 112609 - DNA, 25 bp, Homo sapien
ttacacccttgaacctggtttcttc

SEQ ID NO: 112610 - DNA, 25 bp, Homo sapien
ttacacccttgagcctggtttcttc

SEQ ID NO: 112611 - DNA, 25 bp, Homo sapien
ttacacctgtatctttcttgctttg

SEQ ID NO: 112612 - DNA, 25 bp, Homo sapien
ttacacctgtatcttttttgctttg

SEQ ID NO: 112613 - DNA, 25 bp, Homo sapien
ttacactatactgtctcccgtgagg

SEQ ID NO: 112614 - DNA, 25 bp, Homo sapien
ttacactatgctgtctcccgtgagg

SEQ ID NO: 112615 - DNA, 25 bp, Homo sapien
ttacactctctcacatattcacacg

SEQ ID NO: 112616 - DNA, 25 bp, Homo sapien
ttacactctttcacatattcacacg

SEQ ID NO: 112617 - DNA, 25 bp, Homo sapien
ttacactgcacactcgtgaaacagt

SEQ ID NO: 112618 - DNA, 25 bp, Homo sapien
ttacactgcacacttgtgaaacagt

SEQ ID NO: 112619 - DNA, 25 bp, Homo sapien
ttacactgcgtaacagcaaaccact

SEQ ID NO: 112620 - DNA, 25 bp, Homo sapien
ttacactgcgtaacagtaaaccact

SEQ ID NO: 112621 - DNA, 25 bp, Homo sapien
ttacactttaatgccctcaaatatg

SEQ ID NO: 112622 - DNA, 25 bp, Homo sapien
ttacacttttatgccctcaaatatg

SEQ ID NO: 112623 - DNA, 25 bp, Homo sapien
ttacactttttaaatgaagtttcac

SEQ ID NO: 112624 - DNA, 25 bp, Homo sapien
ttacacttttttaatgaagtttcac

SEQ ID NO: 112625 - DNA, 25 bp, Homo sapien
ttacagacagcagaaactgtatctt

SEQ ID NO: 112626 - DNA, 25 bp, Homo sapien
ttacagacagcggaaactgtatctt

SEQ ID NO: 112627 - DNA, 25 bp, Homo sapien
ttacagagaccaacagcaaaataaa

SEQ ID NO: 112628 - DNA, 25 bp, Homo sapien
ttacagagcctcattatattgctcg

SEQ ID NO: 112629 - DNA, 25 bp, Homo sapien
ttacagaggccaacagcaaaataaa

SEQ ID NO: 112630 - DNA, 25 bp, Homo sapien
ttacagagtctcattatattgctcg

SEQ ID NO: 112631 - DNA, 25 bp, Homo sapien
ttacagagttcacagtattcatatt

SEQ ID NO: 112632 - DNA, 25 bp, Homo sapien
ttacagagttcacggtattcatatt

SEQ ID NO: 112633 - DNA, 25 bp, Homo sapien
ttacagattcaaagggtatgttgtt

SEQ ID NO: 112634 - DNA, 25 bp, Homo sapien
ttacagattcaaggggtatgttgtt

SEQ ID NO: 112635 - DNA, 25 bp, Homo sapien
ttacagcaacattgccttccagtgt

SEQ ID NO: 112636 - DNA, 25 bp, Homo sapien
ttacagcaacattgtcttccagtgt

SEQ ID NO: 112637 - DNA, 25 bp, Homo sapien
ttacagccaatatgaacacacaggt

SEQ ID NO: 112638 - DNA, 25 bp, Homo sapien
ttacagccattggagcaaatgaaaa

SEQ ID NO: 112639 - DNA, 25 bp, Homo sapien
ttacagccatttgagcaaatgaaaa

SEQ ID NO: 112640 - DNA, 25 bp, Homo sapien
ttacagccgatatgaacacacaggt

SEQ ID NO: 112641 - DNA, 25 bp, Homo sapien
ttacagctcagatgtcactttctca

SEQ ID NO: 112642 - DNA, 25 bp, Homo sapien
ttacagctcagatgtcgctttctca

SEQ ID NO: 112643 - DNA, 25 bp, Homo sapien
ttacagctcttggaaaaaaggtctg

SEQ ID NO: 112644 - DNA, 25 bp, Homo sapien
ttacagctcttggacaaaaggtctg

SEQ ID NO: 112645 - DNA, 25 bp, Homo sapien
ttacaggcgtgacccactgtgccta

SEQ ID NO: 112646 - DNA, 25 bp, Homo sapien
ttacaggcgtgacctactgtgccta

SEQ ID NO: 112647 - DNA, 25 bp, Homo sapien
ttacagggtcagagtagataattgc

SEQ ID NO: 112648 - DNA, 25 bp, Homo sapien
ttacagggtgagagtagataattgc

SEQ ID NO: 112649 - DNA, 25 bp, Homo sapien
ttacaggtaaaaactgaaatggaag

SEQ ID NO: 112650 - DNA, 25 bp, Homo sapien
ttacaggtagaaactgaaatggaag

SEQ ID NO: 112651 - DNA, 25 bp, Homo sapien
ttacagtaaagagtgtccatcctcc

SEQ ID NO: 112652 - DNA, 25 bp, Homo sapien
ttacagtagagagtgtccatcctcc

SEQ ID NO: 112653 - DNA, 25 bp, Homo sapien
ttacagtcagggactcatatctcat

SEQ ID NO: 112654 - DNA, 25 bp, Homo sapien
ttacagtcagggattcatatctcat

SEQ ID NO: 112655 - DNA, 25 bp, Homo sapien
ttacagtcagtctcctagaacatac

SEQ ID NO: 112656 - DNA, 25 bp, Homo sapien
ttacagtcagtctcctggaacatac

SEQ ID NO: 112657 - DNA, 25 bp, Homo sapien
ttacagtctagtcgggttagataga

SEQ ID NO: 112658 - DNA, 25 bp, Homo sapien
ttacagtctagttgggttagataga

SEQ ID NO: 112659 - DNA, 25 bp, Homo sapien
ttacagtctgcagagaaaaatgctg

SEQ ID NO: 112660 - DNA, 25 bp, Homo sapien
ttacagtcttcagagaaaaatgctg

SEQ ID NO: 112661 - DNA, 25 bp, Homo sapien
ttacagtgtgtgacagggagagaaa

SEQ ID NO: 112662 - DNA, 25 bp, Homo sapien
ttacagtgtgttacagggagagaaa

SEQ ID NO: 112663 - DNA, 25 bp, Homo sapien
ttacagtttagtcagagtcaagagc

SEQ ID NO: 112664 - DNA, 25 bp, Homo sapien
ttacagtttagttagagtcaagagc

SEQ ID NO: 112665 - DNA, 25 bp, Homo sapien
ttacatatagtatgaagaagaaaac

SEQ ID NO: 112666 - DNA, 25 bp, Homo sapien
ttacatatagtattaagaagaaaac

SEQ ID NO: 112667 - DNA, 25 bp, Homo sapien
ttacatatatagcacacaatcatgt

SEQ ID NO: 112668 - DNA, 25 bp, Homo sapien
ttacatatatatcacacaatcatgt

SEQ ID NO: 112669 - DNA, 25 bp, Homo sapien
ttacatcatttcaccgtcttctcat

SEQ ID NO: 112670 - DNA, 25 bp, Homo sapien
ttacatcatttcactgtcttctcat

SEQ ID NO: 112671 - DNA, 25 bp, Homo sapien
ttacatcattttcttcctagtaact

SEQ ID NO: 112672 - DNA, 25 bp, Homo sapien
ttacatcatttttttcctagtaact

SEQ ID NO: 112673 - DNA, 25 bp, Homo sapien
ttacatcgatttttgtatgctgaac

SEQ ID NO: 112674 - DNA, 25 bp, Homo sapien
ttacatcgatttttgtgtgctgaac

SEQ ID NO: 112675 - DNA, 25 bp, Homo sapien
ttacatcgcagaaaatgttaatgag

SEQ ID NO: 112676 - DNA, 25 bp, Homo sapien
ttacatcgcagcaaatgttaatgag

SEQ ID NO: 112677 - DNA, 25 bp, Homo sapien
ttacatctactggccgtaagtcggg

SEQ ID NO: 112678 - DNA, 25 bp, Homo sapien
ttacatctactggctgtaagtcggg

SEQ ID NO: 112679 - DNA, 25 bp, Homo sapien
ttacatgacaaaagacaagaagaga

SEQ ID NO: 112680 - DNA, 25 bp, Homo sapien
ttacatgacaaaagaccagaagaga

SEQ ID NO: 112681 - DNA, 25 bp, Homo sapien
ttacatgccttcttaaaacacaggg

SEQ ID NO: 112682 - DNA, 25 bp, Homo sapien
ttacatgctttcttaaaacacaggg

SEQ ID NO: 112683 - DNA, 25 bp, Homo sapien
ttacatggggcctacgcctcagctc

SEQ ID NO: 112684 - DNA, 25 bp, Homo sapien
ttacatggggcctatgcctcagctc

SEQ ID NO: 112685 - DNA, 25 bp, Homo sapien
ttacatgtcgtctgggctgctttca

SEQ ID NO: 112686 - DNA, 25 bp, Homo sapien
ttacatgtctcaaataataccatat

SEQ ID NO: 112687 - DNA, 25 bp, Homo sapien
ttacatgtctcagataataccatat

SEQ ID NO: 112688 - DNA, 25 bp, Homo sapien
ttacatgttgtctgggctgctttca

SEQ ID NO: 112689 - DNA, 25 bp, Homo sapien
ttacatgtttagaaattttggatta

SEQ ID NO: 112690 - DNA, 25 bp, Homo sapien
ttacatgtttagaagttttggatta

SEQ ID NO: 112691 - DNA, 25 bp, Homo sapien
ttacattaatacagcttctcacata

SEQ ID NO: 112692 - DNA, 25 bp, Homo sapien
ttacattacgcaaatgaaaacagca

SEQ ID NO: 112693 - DNA, 25 bp, Homo sapien
ttacattaggcaaatgaaaacagca

SEQ ID NO: 112694 - DNA, 25 bp, Homo sapien
ttacattattacagcttctcacata

SEQ ID NO: 112695 - DNA, 25 bp, Homo sapien
ttacattcaatgaatattttctcca

SEQ ID NO: 112696 - DNA, 25 bp, Homo sapien
ttacattcagtgaatattttctcca

SEQ ID NO: 112697 - DNA, 25 bp, Homo sapien
ttacattcatcatacaaaagaatca

SEQ ID NO: 112698 - DNA, 25 bp, Homo sapien
ttacattcatcatataaaagaatca

SEQ ID NO: 112699 - DNA, 25 bp, Homo sapien
ttacattccaaggcataaacttgtt

SEQ ID NO: 112700 - DNA, 25 bp, Homo sapien
ttacattccaaggcatgaacttgtt

SEQ ID NO: 112701 - DNA, 25 bp, Homo sapien
ttacattgaaatctataacccattt

SEQ ID NO: 112702 - DNA, 25 bp, Homo sapien
ttacattgaaatctgtaacccattt

SEQ ID NO: 112703 - DNA, 25 bp, Homo sapien
ttacattggactacttctatcatgg

SEQ ID NO: 112704 - DNA, 25 bp, Homo sapien
ttacattggactgcttctatcatgg

SEQ ID NO: 112705 - DNA, 25 bp, Homo sapien
ttacattgtgccttgtcaacatatt

SEQ ID NO: 112706 - DNA, 25 bp, Homo sapien
ttacattgtgccttttcaacatatt

SEQ ID NO: 112707 - DNA, 25 bp, Homo sapien
ttacatttgcagtgtgccccatgtc

SEQ ID NO: 112708 - DNA, 25 bp, Homo sapien
ttacatttgctcagcatcttgcctg

SEQ ID NO: 112709 - DNA, 25 bp, Homo sapien
ttacatttgctcggcatcttgcctg

SEQ ID NO: 112710 - DNA, 25 bp, Homo sapien
ttacattttcagtgtgccccatgtc

SEQ ID NO: 112711 - DNA, 25 bp, Homo sapien
ttacattttctattccttttggagt

SEQ ID NO: 112712 - DNA, 25 bp, Homo sapien
ttacattttctatttcttttggagt

SEQ ID NO: 112713 - DNA, 25 bp, Homo sapien
ttaccaaacttcaccatgatagcac

SEQ ID NO: 112714 - DNA, 25 bp, Homo sapien
ttaccaaacttcactatgatagcac

SEQ ID NO: 112715 - DNA, 25 bp, Homo sapien
ttaccaaataattaagaacaccagc

SEQ ID NO: 112716 - DNA, 25 bp, Homo sapien
ttaccaaataattaaggacaccagc

SEQ ID NO: 112717 - DNA, 25 bp, Homo sapien
ttaccaacaagagcaaaagagaaag

SEQ ID NO: 112718 - DNA, 25 bp, Homo sapien
ttaccaacaggagcaaaagagaaag

SEQ ID NO: 112719 - DNA, 25 bp, Homo sapien
ttaccaagctaaagtttttgttcat

SEQ ID NO: 112720 - DNA, 25 bp, Homo sapien
ttaccaagctacagtttttgttcat

SEQ ID NO: 112721 - DNA, 25 bp, Homo sapien
ttaccaagctcaatgaataaatgat

SEQ ID NO: 112722 - DNA, 25 bp, Homo sapien
ttaccaagctcgatgaataaatgat

SEQ ID NO: 112723 - DNA, 25 bp, Homo sapien
ttaccaaggaagactcagtgttgtc

SEQ ID NO: 112724 - DNA, 25 bp, Homo sapien
ttaccaaggaagtctcagtgttgtc

SEQ ID NO: 112725 - DNA, 25 bp, Homo sapien
ttaccaagtacaataatgtcggagt

SEQ ID NO: 112726 - DNA, 25 bp, Homo sapien
ttaccaagtacaattatgtcggagt

SEQ ID NO: 112727 - DNA, 25 bp, Homo sapien
ttaccaatcaacgtgtacacttaat

SEQ ID NO: 112728 - DNA, 25 bp, Homo sapien
ttaccaatcaatgtgtacacttaat

SEQ ID NO: 112729 - DNA, 25 bp, Homo sapien
ttaccaatgttccactggttgacct

SEQ ID NO: 112730 - DNA, 25 bp, Homo sapien
ttaccaatgtttcactggttgacct

SEQ ID NO: 112731 - DNA, 25 bp, Homo sapien
ttaccaattctgctgaacgggataa

SEQ ID NO: 112732 - DNA, 25 bp, Homo sapien
ttaccaattctgttgaacgggataa

SEQ ID NO: 112733 - DNA, 25 bp, Homo sapien
ttaccaatttttttatgtgtcagcc

SEQ ID NO: 112734 - DNA, 25 bp, Homo sapien
ttaccaatttttttgtgtgtcagcc

SEQ ID NO: 112735 - DNA, 25 bp, Homo sapien
ttaccacataggcatgactggcaca

SEQ ID NO: 112736 - DNA, 25 bp, Homo sapien
ttaccacataggcgtgactggcaca

SEQ ID NO: 112737 - DNA, 25 bp, Homo sapien
ttaccacttcacaactacagagtaa

SEQ ID NO: 112738 - DNA, 25 bp, Homo sapien
ttaccacttcacaactgcagagtaa

SEQ ID NO: 112739 - DNA, 25 bp, Homo sapien
ttaccagaaaaactgttgctattaa

SEQ ID NO: 112740 - DNA, 25 bp, Homo sapien
ttaccagaaaacctgttgctattaa

SEQ ID NO: 112741 - DNA, 25 bp, Homo sapien
ttaccagaaggtagagattcagttg

SEQ ID NO: 112742 - DNA, 25 bp, Homo sapien
ttaccagaaggtagaggttcagttg

SEQ ID NO: 112743 - DNA, 25 bp, Homo sapien
ttaccagaagttatgtaccaaatca

SEQ ID NO: 112744 - DNA, 25 bp, Homo sapien
ttaccagaatttatgtaccaaatca

SEQ ID NO: 112745 - DNA, 25 bp, Homo sapien
ttaccagatcttcgcatgtttttca

SEQ ID NO: 112746 - DNA, 25 bp, Homo sapien
ttaccagatctttgcatgtttttca

SEQ ID NO: 112747 - DNA, 25 bp, Homo sapien
ttaccagcactagcggatgtgaaaa

SEQ ID NO: 112748 - DNA, 25 bp, Homo sapien
ttaccagcattagcggatgtgaaaa

SEQ ID NO: 112749 - DNA, 25 bp, Homo sapien
ttaccagtcagctacaattcagagt

SEQ ID NO: 112750 - DNA, 25 bp, Homo sapien
ttaccagtcagctgcaattcagagt

SEQ ID NO: 112751 - DNA, 25 bp, Homo sapien
ttaccatcctgccattcagaggagg

SEQ ID NO: 112752 - DNA, 25 bp, Homo sapien
ttaccatcctgccgttcagaggagg

SEQ ID NO: 112753 - DNA, 25 bp, Homo sapien
ttaccatgccgtttattcatccatt

SEQ ID NO: 112754 - DNA, 25 bp, Homo sapien
ttaccatgctgtttattcatccatt

SEQ ID NO: 112755 - DNA, 25 bp, Homo sapien
ttaccattcacttcctgccatcatt

SEQ ID NO: 112756 - DNA, 25 bp, Homo sapien
ttaccattcactttctgccatcatt

SEQ ID NO: 112757 - DNA, 25 bp, Homo sapien
ttaccattctgtagcagaacctata

SEQ ID NO: 112758 - DNA, 25 bp, Homo sapien
ttaccattttgtagcagaacctata

SEQ ID NO: 112759 - DNA, 25 bp, Homo sapien
ttacccataatatcattttttgcag

SEQ ID NO: 112760 - DNA, 25 bp, Homo sapien
ttacccataatattattttttgcag

SEQ ID NO: 112761 - DNA, 25 bp, Homo sapien
ttacccatgacttaatcatccaggg

SEQ ID NO: 112762 - DNA, 25 bp, Homo sapien
ttacccatgacttattcatccaggg

SEQ ID NO: 112763 - DNA, 25 bp, Homo sapien
ttaccccggaatatgctgtgttatt

SEQ ID NO: 112764 - DNA, 25 bp, Homo sapien
ttaccccgggatatgctgtgttatt

SEQ ID NO: 112765 - DNA, 25 bp, Homo sapien
ttaccccgtggcgtgctatgttgtc

SEQ ID NO: 112766 - DNA, 25 bp, Homo sapien
ttaccccgtggtgtgctatgttgtc

SEQ ID NO: 112767 - DNA, 25 bp, Homo sapien
ttaccctccaactgcccggctactt

SEQ ID NO: 112768 - DNA, 25 bp, Homo sapien
ttaccctccaactgcctggctactt

SEQ ID NO: 112769 - DNA, 25 bp, Homo sapien
ttaccctgaattgaccatcacataa

SEQ ID NO: 112770 - DNA, 25 bp, Homo sapien
ttaccctgaattgaccgtcacataa

SEQ ID NO: 112771 - DNA, 25 bp, Homo sapien
ttaccctgcatcattttgcatagtt

SEQ ID NO: 112772 - DNA, 25 bp, Homo sapien
ttaccctgcgtcattttgcatagtt

SEQ ID NO: 112773 - DNA, 25 bp, Homo sapien
ttaccgtggctttggtacatgctcc

SEQ ID NO: 112774 - DNA, 25 bp, Homo sapien
ttaccgtggcttttgtacatgctcc

SEQ ID NO: 112775 - DNA, 25 bp, Homo sapien
ttaccgttgaattgctttatttaaa

SEQ ID NO: 112776 - DNA, 25 bp, Homo sapien
ttaccgttggattgctttatttaaa

SEQ ID NO: 112777 - DNA, 25 bp, Homo sapien
ttacctaaatctccagcttgccagc

SEQ ID NO: 112778 - DNA, 25 bp, Homo sapien
ttacctaaatctccagtttgccagc

SEQ ID NO: 112779 - DNA, 25 bp, Homo sapien
ttacctacatatcagtttttcctcc

SEQ ID NO: 112780 - DNA, 25 bp, Homo sapien
ttacctacgtatcagtttttcctcc

SEQ ID NO: 112781 - DNA, 25 bp, Homo sapien
ttacctagctgcccatgtctgagcc

SEQ ID NO: 112782 - DNA, 25 bp, Homo sapien
ttacctagctgcccttgtctgagcc

SEQ ID NO: 112783 - DNA, 25 bp, Homo sapien
ttacctatacaggctgacattttca

SEQ ID NO: 112784 - DNA, 25 bp, Homo sapien
ttacctatgcaggctgacattttca

SEQ ID NO: 112785 - DNA, 25 bp, Homo sapien
ttacctattttgcctgatgagattt

SEQ ID NO: 112786 - DNA, 25 bp, Homo sapien
ttacctattttgcttgatgagattt

SEQ ID NO: 112787 - DNA, 25 bp, Homo sapien
ttacctcacttgccgcttattttag

SEQ ID NO: 112788 - DNA, 25 bp, Homo sapien
ttacctcagcaggttcagtacttag

SEQ ID NO: 112789 - DNA, 25 bp, Homo sapien
ttacctcagcatgttcagtacttag

SEQ ID NO: 112790 - DNA, 25 bp, Homo sapien
ttacctcagttgccgcttattttag

SEQ ID NO: 112791 - DNA, 25 bp, Homo sapien
ttacctcatttggctataaagttgt

SEQ ID NO: 112792 - DNA, 25 bp, Homo sapien
ttacctcatttgtctataaagttgt

SEQ ID NO: 112793 - DNA, 25 bp, Homo sapien
ttacctctcagacatcaggcagatg

SEQ ID NO: 112794 - DNA, 25 bp, Homo sapien
ttacctctcagatatcaggcagatg

SEQ ID NO: 112795 - DNA, 25 bp, Homo sapien
ttacctgagccaactccccagcctc

SEQ ID NO: 112796 - DNA, 25 bp, Homo sapien
ttacctgagccatctccccagcctc

SEQ ID NO: 112797 - DNA, 25 bp, Homo sapien
ttacctggggatgtaaagactatgg

SEQ ID NO: 112798 - DNA, 25 bp, Homo sapien
ttacctgggtatgtaaagactatgg

SEQ ID NO: 112799 - DNA, 25 bp, Homo sapien
ttacctgtatcttttgcagtgttta

SEQ ID NO: 112800 - DNA, 25 bp, Homo sapien
ttacctgtatcttttgtagtgttta

SEQ ID NO: 112801 - DNA, 25 bp, Homo sapien
ttacctgtcagcaccgcacactgca

SEQ ID NO: 112802 - DNA, 25 bp, Homo sapien
ttacctgtcagcacggcacactgca

SEQ ID NO: 112803 - DNA, 25 bp, Homo sapien
ttaccttatcactgccttgaattcc

SEQ ID NO: 112804 - DNA, 25 bp, Homo sapien
ttaccttatcattgccttgaattcc

SEQ ID NO: 112805 - DNA, 25 bp, Homo sapien
ttaccttcttcatctatgcacactc

SEQ ID NO: 112806 - DNA, 25 bp, Homo sapien
ttaccttcttcttctatgcacactc

SEQ ID NO: 112807 - DNA, 25 bp, Homo sapien
ttaccttgacatttttatagctaaa

SEQ ID NO: 112808 - DNA, 25 bp, Homo sapien
ttaccttgacatttttgtagctaaa

SEQ ID NO: 112809 - DNA, 25 bp, Homo sapien
ttaccttgcattgtagcagttttgc

SEQ ID NO: 112810 - DNA, 25 bp, Homo sapien
ttaccttgcattgtagtagttttgc

SEQ ID NO: 112811 - DNA, 25 bp, Homo sapien
ttaccttggaccctgacacagtagc

SEQ ID NO: 112812 - DNA, 25 bp, Homo sapien
ttaccttggactctgacacagtagc

SEQ ID NO: 112813 - DNA, 25 bp, Homo sapien
ttaccttttagcatgaaagaaaagt

SEQ ID NO: 112814 - DNA, 25 bp, Homo sapien
ttaccttttagcgtgaaagaaaagt

SEQ ID NO: 112815 - DNA, 25 bp, Homo sapien
ttacctttttatgtggctaacttca

SEQ ID NO: 112816 - DNA, 25 bp, Homo sapien
ttacctttttatgtggttaacttca

SEQ ID NO: 112817 - DNA, 25 bp, Homo sapien
ttacgaattatatattgcaagttat

SEQ ID NO: 112818 - DNA, 25 bp, Homo sapien
ttacgaattgtatattgcaagttat

SEQ ID NO: 112819 - DNA, 25 bp, Homo sapien
ttacgatatttggaaaaccataaag

SEQ ID NO: 112820 - DNA, 25 bp, Homo sapien
ttacgatatttggaaagccataaag

SEQ ID NO: 112821 - DNA, 25 bp, Homo sapien
ttacgcctgggataccttttattct

SEQ ID NO: 112822 - DNA, 25 bp, Homo sapien
ttacgccttggataccttttattct

SEQ ID NO: 112823 - DNA, 25 bp, Homo sapien
ttacggctccaaagccaagggggac

SEQ ID NO: 112824 - DNA, 25 bp, Homo sapien
ttacggcttcaaagccaagggggac

SEQ ID NO: 112825 - DNA, 25 bp, Homo sapien
ttacggtatagtgtaccgtggactc

SEQ ID NO: 112826 - DNA, 25 bp, Homo sapien
ttacggtatagtttaccgtggactc

SEQ ID NO: 112827 - DNA, 25 bp, Homo sapien
ttacggtgctgccaaaaactatcac

SEQ ID NO: 112828 - DNA, 25 bp, Homo sapien
ttacggtgctgtcaaaaactatcac

SEQ ID NO: 112829 - DNA, 25 bp, Homo sapien
ttacgtagagattagtgctgattat

SEQ ID NO: 112830 - DNA, 25 bp, Homo sapien
ttacgtagggattagtgctgattat

SEQ ID NO: 112831 - DNA, 25 bp, Homo sapien
ttacgtcttagtcaacacttaatat

SEQ ID NO: 112832 - DNA, 25 bp, Homo sapien
ttacgtcttagtgaacacttaatat

SEQ ID NO: 112833 - DNA, 25 bp, Homo sapien
ttacgtgttcatcccagtgtccttt

SEQ ID NO: 112834 - DNA, 25 bp, Homo sapien
ttacgtgttgatcccagtgtccttt

SEQ ID NO: 112835 - DNA, 25 bp, Homo sapien
ttacgttaaacacctaatcttgtgc

SEQ ID NO: 112836 - DNA, 25 bp, Homo sapien
ttacgttaatcacctaatcttgtgc

SEQ ID NO: 112837 - DNA, 25 bp, Homo sapien
ttactaaaaacaggttacaaatagg

SEQ ID NO: 112838 - DNA, 25 bp, Homo sapien
ttactaaaaacgggttacaaatagg

SEQ ID NO: 112839 - DNA, 25 bp, Homo sapien
ttactaaaccattactgtagattaa

SEQ ID NO: 112840 - DNA, 25 bp, Homo sapien
ttactaaaccattattgtagattaa

SEQ ID NO: 112841 - DNA, 25 bp, Homo sapien
ttactaaagaagagtcaggtaaata

SEQ ID NO: 112842 - DNA, 25 bp, Homo sapien
ttactaaagaagagtcgggtaaata

SEQ ID NO: 112843 - DNA, 25 bp, Homo sapien
ttactaaaggcactgtctgacaaaa

SEQ ID NO: 112844 - DNA, 25 bp, Homo sapien
ttactaaaggcactgtttgacaaaa

SEQ ID NO: 112845 - DNA, 25 bp, Homo sapien
ttactaaaggcataaactatctaaa

SEQ ID NO: 112846 - DNA, 25 bp, Homo sapien
ttactaaaggcatagactatctaaa

SEQ ID NO: 112847 - DNA, 25 bp, Homo sapien
ttactaaatttgattgttcctggac

SEQ ID NO: 112848 - DNA, 25 bp, Homo sapien
ttactaaatttgtttgttcctggac

SEQ ID NO: 112849 - DNA, 25 bp, Homo sapien
ttactaaccattcaatccctttact

SEQ ID NO: 112850 - DNA, 25 bp, Homo sapien
ttactaactattcaatccctttact

SEQ ID NO: 112851 - DNA, 25 bp, Homo sapien
ttactaatgcaaagtggccagtcaa

SEQ ID NO: 112852 - DNA, 25 bp, Homo sapien
ttactaatggaaagtggccagtcaa

SEQ ID NO: 112853 - DNA, 25 bp, Homo sapien
ttactaattatacgaagtcctttga

SEQ ID NO: 112854 - DNA, 25 bp, Homo sapien
ttactaattatatgaagtcctttga

SEQ ID NO: 112855 - DNA, 25 bp, Homo sapien
ttactaattcaaagctgtagttttt

SEQ ID NO: 112856 - DNA, 25 bp, Homo sapien
ttactaattcaaagttgtagttttt

SEQ ID NO: 112857 - DNA, 25 bp, Homo sapien
ttactaattttcacaatagtttgtt

SEQ ID NO: 112858 - DNA, 25 bp, Homo sapien
ttactaatttttacaatagtttgtt

SEQ ID NO: 112859 - DNA, 25 bp, Homo sapien
ttactacaatgtaaatgactggcct

SEQ ID NO: 112860 - DNA, 25 bp, Homo sapien
ttactacagtgtaaatgactggcct

SEQ ID NO: 112861 - DNA, 25 bp, Homo sapien
ttactacattgagatacaccagtct

SEQ ID NO: 112862 - DNA, 25 bp, Homo sapien
ttactacattgcgatacaccagtct

SEQ ID NO: 112863 - DNA, 25 bp, Homo sapien
ttactacctgtgtgaccttggagaa

SEQ ID NO: 112864 - DNA, 25 bp, Homo sapien
ttactacctgtgtgtccttggagaa

SEQ ID NO: 112865 - DNA, 25 bp, Homo sapien
ttactagaagctacctttttcctag

SEQ ID NO: 112866 - DNA, 25 bp, Homo sapien
ttactagaagctacttttttcctag

SEQ ID NO: 112867 - DNA, 25 bp, Homo sapien
ttactagaattatgctcatattaca

SEQ ID NO: 112868 - DNA, 25 bp, Homo sapien
ttactagaattatgctgatattaca

SEQ ID NO: 112869 - DNA, 25 bp, Homo sapien
ttactagatccatctaattctacta

SEQ ID NO: 112870 - DNA, 25 bp, Homo sapien
ttactagattcatctaattctacta

SEQ ID NO: 112871 - DNA, 25 bp, Homo sapien
ttactagcattacgcattttgatgc

SEQ ID NO: 112872 - DNA, 25 bp, Homo sapien
ttactagcattatgcattttgatgc

SEQ ID NO: 112873 - DNA, 25 bp, Homo sapien
ttactagttgtccggagcttcctag

SEQ ID NO: 112874 - DNA, 25 bp, Homo sapien
ttactagttgtctggagcttcctag

SEQ ID NO: 112875 - DNA, 25 bp, Homo sapien
ttactataggcatcagaaatgtgag

SEQ ID NO: 112876 - DNA, 25 bp, Homo sapien
ttactataggcattagaaatgtgag

SEQ ID NO: 112877 - DNA, 25 bp, Homo sapien
ttactatcatgcgaacagcagcatg

SEQ ID NO: 112878 - DNA, 25 bp, Homo sapien
ttactatcgtgcgaacagcagcatg

SEQ ID NO: 112879 - DNA, 25 bp, Homo sapien
ttactatgctcatgcagctaaaagc

SEQ ID NO: 112880 - DNA, 25 bp, Homo sapien
ttactatgtaaggttactcaagggt

SEQ ID NO: 112881 - DNA, 25 bp, Homo sapien
ttactatgtaatgttactcaagggt

SEQ ID NO: 112882 - DNA, 25 bp, Homo sapien
ttactatgttcatgcagctaaaagc

SEQ ID NO: 112883 - DNA, 25 bp, Homo sapien
ttactattagaacaggcttacaaga

SEQ ID NO: 112884 - DNA, 25 bp, Homo sapien
ttactattagaaccggcttacaaga

SEQ ID NO: 112885 - DNA, 25 bp, Homo sapien
ttactattcggccttttacagaaaa

SEQ ID NO: 112886 - DNA, 25 bp, Homo sapien
ttactatttggccttttacagaaaa

SEQ ID NO: 112887 - DNA, 25 bp, Homo sapien
ttactcaagttgatataggtttaag

SEQ ID NO: 112888 - DNA, 25 bp, Homo sapien
ttactcaagttgatgtaggtttaag

SEQ ID NO: 112889 - DNA, 25 bp, Homo sapien
ttactcacaatttttgccatggtct

SEQ ID NO: 112890 - DNA, 25 bp, Homo sapien
ttactcacagtttttgccatggtct

SEQ ID NO: 112891 - DNA, 25 bp, Homo sapien
ttactcaggttcccgataatgtttg

SEQ ID NO: 112892 - DNA, 25 bp, Homo sapien
ttactcaggttcctgataatgtttg

SEQ ID NO: 112893 - DNA, 25 bp, Homo sapien
ttactcatgaagacagatgggaagt

SEQ ID NO: 112894 - DNA, 25 bp, Homo sapien
ttactcatgaagccagatgggaagt

SEQ ID NO: 112895 - DNA, 25 bp, Homo sapien
ttactccaactcaccttgtccacag

SEQ ID NO: 112896 - DNA, 25 bp, Homo sapien
ttactccaactcgccttgtccacag

SEQ ID NO: 112897 - DNA, 25 bp, Homo sapien
ttactccacacttcaaggtcaaatg

SEQ ID NO: 112898 - DNA, 25 bp, Homo sapien
ttactccatacttcaaggtcaaatg

SEQ ID NO: 112899 - DNA, 25 bp, Homo sapien
ttactcctcgcttaacatctttatg

SEQ ID NO: 112900 - DNA, 25 bp, Homo sapien
ttactccttgcttaacatctttatg

SEQ ID NO: 112901 - DNA, 25 bp, Homo sapien
ttactctaatacatagctgtaacac

SEQ ID NO: 112902 - DNA, 25 bp, Homo sapien
ttactctaatacgtagctgtaacac

SEQ ID NO: 112903 - DNA, 25 bp, Homo sapien
ttactctcaattttgtctcccgcag

SEQ ID NO: 112904 - DNA, 25 bp, Homo sapien
ttactctcacttttgtctcccgcag

SEQ ID NO: 112905 - DNA, 25 bp, Homo sapien
ttactctgtatactttacttgcctt

SEQ ID NO: 112906 - DNA, 25 bp, Homo sapien
ttactctgtatactttccttgcctt

SEQ ID NO: 112907 - DNA, 25 bp, Homo sapien
ttactcttcctcgagtcagtgcagg

SEQ ID NO: 112908 - DNA, 25 bp, Homo sapien
ttactcttccttgagtcagtgcagg

SEQ ID NO: 112909 - DNA, 25 bp, Homo sapien
ttactcttgcagttgtttacttgtt

SEQ ID NO: 112910 - DNA, 25 bp, Homo sapien
ttactcttgtagttgtttacttgtt

SEQ ID NO: 112911 - DNA, 25 bp, Homo sapien
ttactgaagctgttcttagcctctt

SEQ ID NO: 112912 - DNA, 25 bp, Homo sapien
ttactgaagctgtttttagcctctt

SEQ ID NO: 112913 - DNA, 25 bp, Homo sapien
ttactgaaggaacggaatttgatca

SEQ ID NO: 112914 - DNA, 25 bp, Homo sapien
ttactgaaggaatggaatttgatca

SEQ ID NO: 112915 - DNA, 25 bp, Homo sapien
ttactgatcatttataaaaggtgtt

SEQ ID NO: 112916 - DNA, 25 bp, Homo sapien
ttactgatcgtttataaaaggtgtt

SEQ ID NO: 112917 - DNA, 25 bp, Homo sapien
ttactgattcccatcaatttctcta

SEQ ID NO: 112918 - DNA, 25 bp, Homo sapien
ttactgattcccgtcaatttctcta

SEQ ID NO: 112919 - DNA, 25 bp, Homo sapien
ttactgcaaagcattcaagagctgg

SEQ ID NO: 112920 - DNA, 25 bp, Homo sapien
ttactgcaaagcgttcaagagctgg

SEQ ID NO: 112921 - DNA, 25 bp, Homo sapien
ttactgcacttagctacacattaag

SEQ ID NO: 112922 - DNA, 25 bp, Homo sapien
ttactgcacttagttacacattaag

SEQ ID NO: 112923 - DNA, 25 bp, Homo sapien
ttactgcctctacgctctcttcttt

SEQ ID NO: 112924 - DNA, 25 bp, Homo sapien
ttactgcctctatgctctcttcttt

SEQ ID NO: 112925 - DNA, 25 bp, Homo sapien
ttactggaacaaattagcacataaa

SEQ ID NO: 112926 - DNA, 25 bp, Homo sapien
ttactggaataaattagcacataaa

SEQ ID NO: 112927 - DNA, 25 bp, Homo sapien
ttactggcttgaaggttgatgaaaa

SEQ ID NO: 112928 - DNA, 25 bp, Homo sapien
ttactggcttgaagtttgatgaaaa

SEQ ID NO: 112929 - DNA, 25 bp, Homo sapien
ttactgggactgtgaaaaagaaaca

SEQ ID NO: 112930 - DNA, 25 bp, Homo sapien
ttactgggatttccgacattcattc

SEQ ID NO: 112931 - DNA, 25 bp, Homo sapien
ttactgggatttctgacattcattc

SEQ ID NO: 112932 - DNA, 25 bp, Homo sapien
ttactggggctgtgaaaaagaaaca

SEQ ID NO: 112933 - DNA, 25 bp, Homo sapien
ttactggttttcaggacagtgtcct

SEQ ID NO: 112934 - DNA, 25 bp, Homo sapien
ttactggttttcgggacagtgtcct

SEQ ID NO: 112935 - DNA, 25 bp, Homo sapien
ttactgtaacagagcttgatttcgt

SEQ ID NO: 112936 - DNA, 25 bp, Homo sapien
ttactgtaatagagcttgatttcgt

SEQ ID NO: 112937 - DNA, 25 bp, Homo sapien
ttactgtcaccggtttacagatgag

SEQ ID NO: 112938 - DNA, 25 bp, Homo sapien
ttactgtcaccgttttacagatgag

SEQ ID NO: 112939 - DNA, 25 bp, Homo sapien
ttactgtgtctctttcagctttaac

SEQ ID NO: 112940 - DNA, 25 bp, Homo sapien
ttactgtgtctttttcagctttaac

SEQ ID NO: 112941 - DNA, 25 bp, Homo sapien
ttacttaacagaacaacatggattt

SEQ ID NO: 112942 - DNA, 25 bp, Homo sapien
ttacttaacagagcaacatggattt

SEQ ID NO: 112943 - DNA, 25 bp, Homo sapien
ttacttatgctaccttacttctcta

SEQ ID NO: 112944 - DNA, 25 bp, Homo sapien
ttacttatgctatcttacttctcta

SEQ ID NO: 112945 - DNA, 25 bp, Homo sapien
ttacttcactgagttgatataaaaa

SEQ ID NO: 112946 - DNA, 25 bp, Homo sapien
ttacttcattgagttgatataaaaa

SEQ ID NO: 112947 - DNA, 25 bp, Homo sapien
ttacttctgtaacaaattgccagaa

SEQ ID NO: 112948 - DNA, 25 bp, Homo sapien
ttacttctgtaaccaattgccagaa

SEQ ID NO: 112949 - DNA, 25 bp, Homo sapien
ttacttctgtcttcttaaaaaatcc

SEQ ID NO: 112950 - DNA, 25 bp, Homo sapien
ttacttctgtcttcttgaaaaatcc

SEQ ID NO: 112951 - DNA, 25 bp, Homo sapien
ttacttgtaatagcaaaatgtcctt

SEQ ID NO: 112952 - DNA, 25 bp, Homo sapien
ttacttgtaatagcgaaatgtcctt

SEQ ID NO: 112953 - DNA, 25 bp, Homo sapien
ttacttgtaattgcaagtgcaaaaa

SEQ ID NO: 112954 - DNA, 25 bp, Homo sapien
ttacttgtaatttcaagtgcaaaaa

SEQ ID NO: 112955 - DNA, 25 bp, Homo sapien
ttacttgtagcacagacatgctcca

SEQ ID NO: 112956 - DNA, 25 bp, Homo sapien
ttacttgtggcacagacatgctcca

SEQ ID NO: 112957 - DNA, 25 bp, Homo sapien
ttacttgtttttacactaattcaca

SEQ ID NO: 112958 - DNA, 25 bp, Homo sapien
ttacttgtttttacgctaattcaca

SEQ ID NO: 112959 - DNA, 25 bp, Homo sapien
ttactttactcaccattgtatacat

SEQ ID NO: 112960 - DNA, 25 bp, Homo sapien
ttactttattcaccattgtatacat

SEQ ID NO: 112961 - DNA, 25 bp, Homo sapien
ttactttcactggacttattttgct

SEQ ID NO: 112962 - DNA, 25 bp, Homo sapien
ttactttcactgggcttattttgct

SEQ ID NO: 112963 - DNA, 25 bp, Homo sapien
ttactttcactttgcattttttgaa

SEQ ID NO: 112964 - DNA, 25 bp, Homo sapien
ttactttcattttgcattttttgaa

SEQ ID NO: 112965 - DNA, 25 bp, Homo sapien
ttactttccatttgagatacagctc

SEQ ID NO: 112966 - DNA, 25 bp, Homo sapien
ttactttccatttgagttacagctc

SEQ ID NO: 112967 - DNA, 25 bp, Homo sapien
ttactttctccaaaatatacagtct

SEQ ID NO: 112968 - DNA, 25 bp, Homo sapien
ttactttctccagaatatacagtct

SEQ ID NO: 112969 - DNA, 25 bp, Homo sapien
ttactttcttcttcggtgccaatta

SEQ ID NO: 112970 - DNA, 25 bp, Homo sapien
ttactttcttctttggtgccaatta

SEQ ID NO: 112971 - DNA, 25 bp, Homo sapien
ttactttgggacactgttctttcca

SEQ ID NO: 112972 - DNA, 25 bp, Homo sapien
ttactttgggacattgttctttcca

SEQ ID NO: 112973 - DNA, 25 bp, Homo sapien
ttactttgtccagtatcttcttttt

SEQ ID NO: 112974 - DNA, 25 bp, Homo sapien
ttactttgtccagtatgttcttttt

SEQ ID NO: 112975 - DNA, 25 bp, Homo sapien
ttactttgtcttagcccacaggatg

SEQ ID NO: 112976 - DNA, 25 bp, Homo sapien
ttactttgttttagcccacaggatg

SEQ ID NO: 112977 - DNA, 25 bp, Homo sapien
ttacttttcctgaacaaacacctct

SEQ ID NO: 112978 - DNA, 25 bp, Homo sapien
ttacttttcctgagcaaacacctct

SEQ ID NO: 112979 - DNA, 25 bp, Homo sapien
ttacttttcctgtacatctctgctt

SEQ ID NO: 112980 - DNA, 25 bp, Homo sapien
ttacttttcgtcatgctggatttgg

SEQ ID NO: 112981 - DNA, 25 bp, Homo sapien
ttacttttcttgtacatctctgctt

SEQ ID NO: 112982 - DNA, 25 bp, Homo sapien
ttacttttgctatccactgaattgt

SEQ ID NO: 112983 - DNA, 25 bp, Homo sapien
ttacttttgctatccattgaattgt

SEQ ID NO: 112984 - DNA, 25 bp, Homo sapien
ttacttttggtcatgctggatttgg

SEQ ID NO: 112985 - DNA, 25 bp, Homo sapien
ttagaaaactcaactatcacccagc

SEQ ID NO: 112986 - DNA, 25 bp, Homo sapien
ttagaaaactgtacactttccacat

SEQ ID NO: 112987 - DNA, 25 bp, Homo sapien
ttagaaaactgtacgctttccacat

SEQ ID NO: 112988 - DNA, 25 bp, Homo sapien
ttagaaaattcaactatcacccagc

SEQ ID NO: 112989 - DNA, 25 bp, Homo sapien
ttagaaagacagcatcactaaaaga

SEQ ID NO: 112990 - DNA, 25 bp, Homo sapien
ttagaaagacaggatcactaaaaga

SEQ ID NO: 112991 - DNA, 25 bp, Homo sapien
ttagaaagagcaactgaatatgttg

SEQ ID NO: 112992 - DNA, 25 bp, Homo sapien
ttagaaagagcaattgaatatgttg

SEQ ID NO: 112993 - DNA, 25 bp, Homo sapien
ttagaaagatcaccatgcatgcact

SEQ ID NO: 112994 - DNA, 25 bp, Homo sapien
ttagaaagatcatcatgcatgcact

SEQ ID NO: 112995 - DNA, 25 bp, Homo sapien
ttagaaatcagagaagacttttcct

SEQ ID NO: 112996 - DNA, 25 bp, Homo sapien
ttagaaatcagagaagccttttcct

SEQ ID NO: 112997 - DNA, 25 bp, Homo sapien
ttagaaatgcctgacgaaggagttc

SEQ ID NO: 112998 - DNA, 25 bp, Homo sapien
ttagaaatgcctgatgaaggagttc

SEQ ID NO: 112999 - DNA, 25 bp, Homo sapien
ttagaacaaaaactccaaaagtgaa

SEQ ID NO: 113000 - DNA, 25 bp, Homo sapien
ttagaacaaaaacttcaaaagtgaa

SEQ ID NO: 113001 - DNA, 25 bp, Homo sapien
ttagaacactgtgaaacgctgccaa

SEQ ID NO: 113002 - DNA, 25 bp, Homo sapien
ttagaacactgtgaaatgctgccaa

SEQ ID NO: 113003 - DNA, 25 bp, Homo sapien
ttagaaccaaagtgctaagttaatg

SEQ ID NO: 113004 - DNA, 25 bp, Homo sapien
ttagaaccataataatgcttcgcca

SEQ ID NO: 113005 - DNA, 25 bp, Homo sapien
ttagaaccgaagtgctaagttaatg

SEQ ID NO: 113006 - DNA, 25 bp, Homo sapien
ttagaaccgtaataatgcttcgcca

SEQ ID NO: 113007 - DNA, 25 bp, Homo sapien
ttagaacctccagatgtcttctgag

SEQ ID NO: 113008 - DNA, 25 bp, Homo sapien
ttagaacctgcagatgtcttctgag

SEQ ID NO: 113009 - DNA, 25 bp, Homo sapien
ttagaactgtctgtatgttaactac

SEQ ID NO: 113010 - DNA, 25 bp, Homo sapien
ttagaactgtctgtattttaactac

SEQ ID NO: 113011 - DNA, 25 bp, Homo sapien
ttagaacttcaacttttgaatctgt

SEQ ID NO: 113012 - DNA, 25 bp, Homo sapien
ttagaacttcaatttttgaatctgt

SEQ ID NO: 113013 - DNA, 25 bp, Homo sapien
ttagaacttttgcataaattcactg

SEQ ID NO: 113014 - DNA, 25 bp, Homo sapien
ttagaacttttgtataaattcactg

SEQ ID NO: 113015 - DNA, 25 bp, Homo sapien
ttagaagaaactttatcacagtttt

SEQ ID NO: 113016 - DNA, 25 bp, Homo sapien
ttagaagaacctttatcacagtttt

SEQ ID NO: 113017 - DNA, 25 bp, Homo sapien
ttagaagaatatcatcttgaagagt

SEQ ID NO: 113018 - DNA, 25 bp, Homo sapien
ttagaagaatatcgtcttgaagagt

SEQ ID NO: 113019 - DNA, 25 bp, Homo sapien
ttagaagactgacattgcattacca

SEQ ID NO: 113020 - DNA, 25 bp, Homo sapien
ttagaagactgatattgcattacca

SEQ ID NO: 113021 - DNA, 25 bp, Homo sapien
ttagaagagaaaagtctgcctttga

SEQ ID NO: 113022 - DNA, 25 bp, Homo sapien
ttagaagagaaatgtctgcctttga

SEQ ID NO: 113023 - DNA, 25 bp, Homo sapien
ttagaagaggagattctgacacaga

SEQ ID NO: 113024 - DNA, 25 bp, Homo sapien
ttagaagaggagtttctgacacaga

SEQ ID NO: 113025 - DNA, 25 bp, Homo sapien
ttagaagataaccgctatgacacac

SEQ ID NO: 113026 - DNA, 25 bp, Homo sapien
ttagaagataactagcagtgttcct

SEQ ID NO: 113027 - DNA, 25 bp, Homo sapien
ttagaagataactgctatgacacac

SEQ ID NO: 113028 - DNA, 25 bp, Homo sapien
ttagaagataactggcagtgttcct

SEQ ID NO: 113029 - DNA, 25 bp, Homo sapien
ttagaagcgtaaggtttatccatag

SEQ ID NO: 113030 - DNA, 25 bp, Homo sapien
ttagaagcttaaggtttatccatag

SEQ ID NO: 113031 - DNA, 25 bp, Homo sapien
ttagaagggttaatgttttgtatta

SEQ ID NO: 113032 - DNA, 25 bp, Homo sapien
ttagaagggttattgttttgtatta

SEQ ID NO: 113033 - DNA, 25 bp, Homo sapien
ttagaagtggtccatgtataacaaa

SEQ ID NO: 113034 - DNA, 25 bp, Homo sapien
ttagaagttgtccatgtataacaaa

SEQ ID NO: 113035 - DNA, 25 bp, Homo sapien
ttagaagtttacatttcatattgga

SEQ ID NO: 113036 - DNA, 25 bp, Homo sapien
ttagaagtttacttttcatattgga

SEQ ID NO: 113037 - DNA, 25 bp, Homo sapien
ttagaatatagccaaacatgacaag

SEQ ID NO: 113038 - DNA, 25 bp, Homo sapien
ttagaatatggccaaacatgacaag

SEQ ID NO: 113039 - DNA, 25 bp, Homo sapien
ttagaatctagcagccgaactgtgc

SEQ ID NO: 113040 - DNA, 25 bp, Homo sapien
ttagaatctagcagcctaactgtgc

SEQ ID NO: 113041 - DNA, 25 bp, Homo sapien
ttagaatgcagatcactccaatcat

SEQ ID NO: 113042 - DNA, 25 bp, Homo sapien
ttagaatgtagatcactccaatcat

SEQ ID NO: 113043 - DNA, 25 bp, Homo sapien
ttagaattactacaatctataacgt

SEQ ID NO: 113044 - DNA, 25 bp, Homo sapien
ttagaattactataatctataacgt

SEQ ID NO: 113045 - DNA, 25 bp, Homo sapien
ttagaattagtctacaccagaactt

SEQ ID NO: 113046 - DNA, 25 bp, Homo sapien
ttagaattatgatttgagctttttc

SEQ ID NO: 113047 - DNA, 25 bp, Homo sapien
ttagaattggtctacaccagaactt

SEQ ID NO: 113048 - DNA, 25 bp, Homo sapien
ttagaattgtgatttgagctttttc

SEQ ID NO: 113049 - DNA, 25 bp, Homo sapien
ttagaattttgcataggcatctact

SEQ ID NO: 113050 - DNA, 25 bp, Homo sapien
ttagaattttgcattggcatctact

SEQ ID NO: 113051 - DNA, 25 bp, Homo sapien
ttagaccacccctagccagaaaaaa

SEQ ID NO: 113052 - DNA, 25 bp, Homo sapien
ttagaccacccctagctagaaaaaa

SEQ ID NO: 113053 - DNA, 25 bp, Homo sapien
ttagacctcatcacttttccccaac

SEQ ID NO: 113054 - DNA, 25 bp, Homo sapien
ttagacctcatcagttttccccaac

SEQ ID NO: 113055 - DNA, 25 bp, Homo sapien
ttagacctgcgttctacctaactga

SEQ ID NO: 113056 - DNA, 25 bp, Homo sapien
ttagacctgtgttctacctaactga

SEQ ID NO: 113057 - DNA, 25 bp, Homo sapien
ttagactccacagcttcgctccctg

SEQ ID NO: 113058 - DNA, 25 bp, Homo sapien
ttagactccgcagcttcgctccctg

SEQ ID NO: 113059 - DNA, 25 bp, Homo sapien
ttagacttgctattttttttccctt

SEQ ID NO: 113060 - DNA, 25 bp, Homo sapien
ttagacttgctcttttttttccctt

SEQ ID NO: 113061 - DNA, 25 bp, Homo sapien
ttagagaatatgggtgctagacatt

SEQ ID NO: 113062 - DNA, 25 bp, Homo sapien
ttagagaatatgggtgttagacatt

SEQ ID NO: 113063 - DNA, 25 bp, Homo sapien
ttagagacttcaacccaggattttc

SEQ ID NO: 113064 - DNA, 25 bp, Homo sapien
ttagagacttcaactcaggattttc

SEQ ID NO: 113065 - DNA, 25 bp, Homo sapien
ttagagatgagattagcaaacaaaa

SEQ ID NO: 113066 - DNA, 25 bp, Homo sapien
ttagagatgagattaggaaacaaaa

SEQ ID NO: 113067 - DNA, 25 bp, Homo sapien
ttagagcaataaacattcttcaaac

SEQ ID NO: 113068 - DNA, 25 bp, Homo sapien
ttagagcaataaagattcttcaaac

SEQ ID NO: 113069 - DNA, 25 bp, Homo sapien
ttagagcagatcaaacaacaccact

SEQ ID NO: 113070 - DNA, 25 bp, Homo sapien
ttagagcagatcaagcaacaccact

SEQ ID NO: 113071 - DNA, 25 bp, Homo sapien
ttagagctttatcacttgatgaggt

SEQ ID NO: 113072 - DNA, 25 bp, Homo sapien
ttagagctttatcgcttgatgaggt

SEQ ID NO: 113073 - DNA, 25 bp, Homo sapien
ttagaggtctagcagaaagtggaat

SEQ ID NO: 113074 - DNA, 25 bp, Homo sapien
ttagaggtttagcagaaagtggaat

SEQ ID NO: 113075 - DNA, 25 bp, Homo sapien
ttagagtcccgatcagctagttttc

SEQ ID NO: 113076 - DNA, 25 bp, Homo sapien
ttagagtcccgattagctagttttc

SEQ ID NO: 113077 - DNA, 25 bp, Homo sapien
ttagagtgacggaagtgagcattga

SEQ ID NO: 113078 - DNA, 25 bp, Homo sapien
ttagagtgatggaagtgagcattga

SEQ ID NO: 113079 - DNA, 25 bp, Homo sapien
ttagatagtcgttatggcctcacaa

SEQ ID NO: 113080 - DNA, 25 bp, Homo sapien
ttagatagtggttatggcctcacaa

SEQ ID NO: 113081 - DNA, 25 bp, Homo sapien
ttagatatcctctaagagaactttc

SEQ ID NO: 113082 - DNA, 25 bp, Homo sapien
ttagatatcctctaagggaactttc

SEQ ID NO: 113083 - DNA, 25 bp, Homo sapien
ttagatcataccctgtttgtcctat

SEQ ID NO: 113084 - DNA, 25 bp, Homo sapien
ttagatcataccgtgtttgtcctat

SEQ ID NO: 113085 - DNA, 25 bp, Homo sapien
ttagatcatctccaagttctgaaat

SEQ ID NO: 113086 - DNA, 25 bp, Homo sapien
ttagatcatctccatgttctgaaat

SEQ ID NO: 113087 - DNA, 25 bp, Homo sapien
ttagatccaacaatatttgctatac

SEQ ID NO: 113088 - DNA, 25 bp, Homo sapien
ttagatccatcaatatttgctatac

SEQ ID NO: 113089 - DNA, 25 bp, Homo sapien
ttagatccgtagcttcttaacatta

SEQ ID NO: 113090 - DNA, 25 bp, Homo sapien
ttagatccttagcttcttaacatta

SEQ ID NO: 113091 - DNA, 25 bp, Homo sapien
ttagatctcaacatacaaatattaa

SEQ ID NO: 113092 - DNA, 25 bp, Homo sapien
ttagatctcaacatacgaatattaa

SEQ ID NO: 113093 - DNA, 25 bp, Homo sapien
ttagatgaaaaacctggcatgcact

SEQ ID NO: 113094 - DNA, 25 bp, Homo sapien
ttagatgaaaaatctggcatgcact

SEQ ID NO: 113095 - DNA, 25 bp, Homo sapien
ttagatgacgtgtgatcagagagtg

SEQ ID NO: 113096 - DNA, 25 bp, Homo sapien
ttagatgagctaccagagatgacca

SEQ ID NO: 113097 - DNA, 25 bp, Homo sapien
ttagatgagtatagtgtgaaggtta

SEQ ID NO: 113098 - DNA, 25 bp, Homo sapien
ttagatgagtatcgtgtgaaggtta

SEQ ID NO: 113099 - DNA, 25 bp, Homo sapien
ttagatgagttaccagagatgacca

SEQ ID NO: 113100 - DNA, 25 bp, Homo sapien
ttagatgatgtgtgatcagagagtg

SEQ ID NO: 113101 - DNA, 25 bp, Homo sapien
ttagatgcaaatgacagcttgttat

SEQ ID NO: 113102 - DNA, 25 bp, Homo sapien
ttagatgcaaatggcagcttgttat

SEQ ID NO: 113103 - DNA, 25 bp, Homo sapien
ttagattcagataatttttgtcttt

SEQ ID NO: 113104 - DNA, 25 bp, Homo sapien
ttagattcatataatttttgtcttt

SEQ ID NO: 113105 - DNA, 25 bp, Homo sapien
ttagattgactaaaagcatggtgca

SEQ ID NO: 113106 - DNA, 25 bp, Homo sapien
ttagattgattaaaagcatggtgca

SEQ ID NO: 113107 - DNA, 25 bp, Homo sapien
ttagattgcagtgattaaattgaag

SEQ ID NO: 113108 - DNA, 25 bp, Homo sapien
ttagattgcagtgattgaattgaag

SEQ ID NO: 113109 - DNA, 25 bp, Homo sapien
ttagattggtgtaagcctttgacta

SEQ ID NO: 113110 - DNA, 25 bp, Homo sapien
ttagattgttgtaagcctttgacta

SEQ ID NO: 113111 - DNA, 25 bp, Homo sapien
ttagatttattacctggatgatttt

SEQ ID NO: 113112 - DNA, 25 bp, Homo sapien
ttagatttattatctggatgatttt

SEQ ID NO: 113113 - DNA, 25 bp, Homo sapien
ttagatttccgcttcaggatgaaaa

SEQ ID NO: 113114 - DNA, 25 bp, Homo sapien
ttagatttctgcttcaggatgaaaa

SEQ ID NO: 113115 - DNA, 25 bp, Homo sapien
ttagattttggctctgttctcaact

SEQ ID NO: 113116 - DNA, 25 bp, Homo sapien
ttagattttggctgtgttctcaact

SEQ ID NO: 113117 - DNA, 25 bp, Homo sapien
ttagcaaaatatgagataagtgtca

SEQ ID NO: 113118 - DNA, 25 bp, Homo sapien
ttagcaaaatattagataagtgtca

SEQ ID NO: 113119 - DNA, 25 bp, Homo sapien
ttagcaaacccaagtgatcatttag

SEQ ID NO: 113120 - DNA, 25 bp, Homo sapien
ttagcaaacccacgtgatcatttag

SEQ ID NO: 113121 - DNA, 25 bp, Homo sapien
ttagcaaagacagaacaagggtatt

SEQ ID NO: 113122 - DNA, 25 bp, Homo sapien
ttagcaaaggcagaacaagggtatt

SEQ ID NO: 113123 - DNA, 25 bp, Homo sapien
ttagcaactaaataactgcacaggc

SEQ ID NO: 113124 - DNA, 25 bp, Homo sapien
ttagcaactaaatagctgcacaggc

SEQ ID NO: 113125 - DNA, 25 bp, Homo sapien
ttagcaactctacaatcctgcccac

SEQ ID NO: 113126 - DNA, 25 bp, Homo sapien
ttagcaactctacagtcctgcccac

SEQ ID NO: 113127 - DNA, 25 bp, Homo sapien
ttagcaatatttatgactgcctggt

SEQ ID NO: 113128 - DNA, 25 bp, Homo sapien
ttagcaatatttctgactgcctggt

SEQ ID NO: 113129 - DNA, 25 bp, Homo sapien
ttagcaatccaaacagaaaagggag

SEQ ID NO: 113130 - DNA, 25 bp, Homo sapien
ttagcaatccaaagagaaaagggag

SEQ ID NO: 113131 - DNA, 25 bp, Homo sapien
ttagcaatctgcagtttcacccctc

SEQ ID NO: 113132 - DNA, 25 bp, Homo sapien
ttagcaatctgctactgatatagtt

SEQ ID NO: 113133 - DNA, 25 bp, Homo sapien
ttagcaatctgtagtttcacccctc

SEQ ID NO: 113134 - DNA, 25 bp, Homo sapien
ttagcaatctgttactgatatagtt

SEQ ID NO: 113135 - DNA, 25 bp, Homo sapien
ttagcaatgactcatgatgtaaaat

SEQ ID NO: 113136 - DNA, 25 bp, Homo sapien
ttagcaatgactcatgctgtaaaat

SEQ ID NO: 113137 - DNA, 25 bp, Homo sapien
ttagcaatgcacattaaagttcaaa

SEQ ID NO: 113138 - DNA, 25 bp, Homo sapien
ttagcaatgcatattaaagttcaaa

SEQ ID NO: 113139 - DNA, 25 bp, Homo sapien
ttagcaatttaatgagtgatttctg

SEQ ID NO: 113140 - DNA, 25 bp, Homo sapien
ttagcaatttaatgcgtgatttctg

SEQ ID NO: 113141 - DNA, 25 bp, Homo sapien
ttagcacaatggttagaaggttaag

SEQ ID NO: 113142 - DNA, 25 bp, Homo sapien
ttagcacaatggttaggaggttaag

SEQ ID NO: 113143 - DNA, 25 bp, Homo sapien
ttagcacacaaaaacattaagaaag

SEQ ID NO: 113144 - DNA, 25 bp, Homo sapien
ttagcacacaagaacattaagaaag

SEQ ID NO: 113145 - DNA, 25 bp, Homo sapien
ttagcaccaatcttgtacatattta

SEQ ID NO: 113146 - DNA, 25 bp, Homo sapien
ttagcaccgatcttgtacatattta

SEQ ID NO: 113147 - DNA, 25 bp, Homo sapien
ttagcacctttcaactatgatattg

SEQ ID NO: 113148 - DNA, 25 bp, Homo sapien
ttagcacctttcaactctgatattg

SEQ ID NO: 113149 - DNA, 25 bp, Homo sapien
ttagcactaggatgcaagttgcagg

SEQ ID NO: 113150 - DNA, 25 bp, Homo sapien
ttagcactaggatgtaagttgcagg

SEQ ID NO: 113151 - DNA, 25 bp, Homo sapien
ttagcactgagggtcctcttgtcgt

SEQ ID NO: 113152 - DNA, 25 bp, Homo sapien
ttagcactgggggtcctcttgtcgt

SEQ ID NO: 113153 - DNA, 25 bp, Homo sapien
ttagcacttctaaaatcattgttgc

SEQ ID NO: 113154 - DNA, 25 bp, Homo sapien
ttagcacttttaaaatcattgttgc

SEQ ID NO: 113155 - DNA, 25 bp, Homo sapien
ttagcagtcccagaatgttactgga

SEQ ID NO: 113156 - DNA, 25 bp, Homo sapien
ttagcagtctcagaatgttactgga

SEQ ID NO: 113157 - DNA, 25 bp, Homo sapien
ttagcataactgacagaaatgcaga

SEQ ID NO: 113158 - DNA, 25 bp, Homo sapien
ttagcataactggcagaaatgcaga

SEQ ID NO: 113159 - DNA, 25 bp, Homo sapien
ttagcataatggacttgtgaccaga

SEQ ID NO: 113160 - DNA, 25 bp, Homo sapien
ttagcataatggccttgtgaccaga

SEQ ID NO: 113161 - DNA, 25 bp, Homo sapien
ttagcatacgctttttaaactgggg

SEQ ID NO: 113162 - DNA, 25 bp, Homo sapien
ttagcatatgactgtctctattata

SEQ ID NO: 113163 - DNA, 25 bp, Homo sapien
ttagcatatgattgtctctattata

SEQ ID NO: 113164 - DNA, 25 bp, Homo sapien
ttagcatatgctttttaaactgggg

SEQ ID NO: 113165 - DNA, 25 bp, Homo sapien
ttagcattattatgtattatctgtt

SEQ ID NO: 113166 - DNA, 25 bp, Homo sapien
ttagcattcttatgtattatctgtt

SEQ ID NO: 113167 - DNA, 25 bp, Homo sapien
ttagccatgaaagagaatatactca

SEQ ID NO: 113168 - DNA, 25 bp, Homo sapien
ttagccatgtaagagaatatactca

SEQ ID NO: 113169 - DNA, 25 bp, Homo sapien
ttagccattggaaaaacagaaatta

SEQ ID NO: 113170 - DNA, 25 bp, Homo sapien
ttagccattggaaaaatagaaatta

SEQ ID NO: 113171 - DNA, 25 bp, Homo sapien
ttagccgaatgccctcaagagcttc

SEQ ID NO: 113172 - DNA, 25 bp, Homo sapien
ttagccgaatgtcctcaagagcttc

SEQ ID NO: 113173 - DNA, 25 bp, Homo sapien
ttagccgttttcatcaatgatctta

SEQ ID NO: 113174 - DNA, 25 bp, Homo sapien
ttagccgttttcatgaatgatctta

SEQ ID NO: 113175 - DNA, 25 bp, Homo sapien
ttagcctcaacatcctcatctgcaa

SEQ ID NO: 113176 - DNA, 25 bp, Homo sapien
ttagcctcaacatcttcatctgcaa

SEQ ID NO: 113177 - DNA, 25 bp, Homo sapien
ttagccttccactgagatactgact

SEQ ID NO: 113178 - DNA, 25 bp, Homo sapien
ttagccttccattgagatactgact

SEQ ID NO: 113179 - DNA, 25 bp, Homo sapien
ttagcctttttgcgttctgaagtat

SEQ ID NO: 113180 - DNA, 25 bp, Homo sapien
ttagcctttttgggttctgaagtat

SEQ ID NO: 113181 - DNA, 25 bp, Homo sapien
ttagctaaagcctattctatgaact

SEQ ID NO: 113182 - DNA, 25 bp, Homo sapien
ttagctaaatcctattctatgaact

SEQ ID NO: 113183 - DNA, 25 bp, Homo sapien
ttagctacccaatgacaaggttaag

SEQ ID NO: 113184 - DNA, 25 bp, Homo sapien
ttagctactcaatgacaaggttaag

SEQ ID NO: 113185 - DNA, 25 bp, Homo sapien
ttagctagaaagaacaataatgacc

SEQ ID NO: 113186 - DNA, 25 bp, Homo sapien
ttagctagaaagaataataatgacc

SEQ ID NO: 113187 - DNA, 25 bp, Homo sapien
ttagctattaactctcaattactag

SEQ ID NO: 113188 - DNA, 25 bp, Homo sapien
ttagctattaactttcaattactag

SEQ ID NO: 113189 - DNA, 25 bp, Homo sapien
ttagctcaacgtgggatgaatgcca

SEQ ID NO: 113190 - DNA, 25 bp, Homo sapien
ttagctcaacgttggatgaatgcca

SEQ ID NO: 113191 - DNA, 25 bp, Homo sapien
ttagctccacttatctggaatacag

SEQ ID NO: 113192 - DNA, 25 bp, Homo sapien
ttagctccacttgtctggaatacag

SEQ ID NO: 113193 - DNA, 25 bp, Homo sapien
ttagctcccattttgaagagagaac

SEQ ID NO: 113194 - DNA, 25 bp, Homo sapien
ttagctcccatttttaagagagaac

SEQ ID NO: 113195 - DNA, 25 bp, Homo sapien
ttagctctggtccctctcgatgctg

SEQ ID NO: 113196 - DNA, 25 bp, Homo sapien
ttagctctgtcctgcctaggcgact

SEQ ID NO: 113197 - DNA, 25 bp, Homo sapien
ttagctctgtcttgcctaggcgact

SEQ ID NO: 113198 - DNA, 25 bp, Homo sapien
ttagctcttgtccctctcgatgctg

SEQ ID NO: 113199 - DNA, 25 bp, Homo sapien
ttagctgatttaaactcaatgtaac

SEQ ID NO: 113200 - DNA, 25 bp, Homo sapien
ttagctgatttagactcaatgtaac

SEQ ID NO: 113201 - DNA, 25 bp, Homo sapien
ttagctgcttggaaagtcagtcaca

SEQ ID NO: 113202 - DNA, 25 bp, Homo sapien
ttagctgcttgggaagtcagtcaca

SEQ ID NO: 113203 - DNA, 25 bp, Homo sapien
ttagctgggctgatctgaatacaat

SEQ ID NO: 113204 - DNA, 25 bp, Homo sapien
ttagctgggctggtctgaatacaat

SEQ ID NO: 113205 - DNA, 25 bp, Homo sapien
ttagctgtagccacacattccagaa

SEQ ID NO: 113206 - DNA, 25 bp, Homo sapien
ttagctgtagccgcacattccagaa

SEQ ID NO: 113207 - DNA, 25 bp, Homo sapien
ttagcttacaaccgctatgagggca

SEQ ID NO: 113208 - DNA, 25 bp, Homo sapien
ttagcttacaacctctatgagggca

SEQ ID NO: 113209 - DNA, 25 bp, Homo sapien
ttagcttacaagcaacttaaatatg

SEQ ID NO: 113210 - DNA, 25 bp, Homo sapien
ttagcttactagcaacttaaatatg

SEQ ID NO: 113211 - DNA, 25 bp, Homo sapien
ttagcttatgtccttggaaatggaa

SEQ ID NO: 113212 - DNA, 25 bp, Homo sapien
ttagcttatgtctttggaaatggaa

SEQ ID NO: 113213 - DNA, 25 bp, Homo sapien
ttagcttcaaaaccttacatgaatt

SEQ ID NO: 113214 - DNA, 25 bp, Homo sapien
ttagcttcaaaactttacatgaatt

SEQ ID NO: 113215 - DNA, 25 bp, Homo sapien
ttagcttcaatgtattcattactgg

SEQ ID NO: 113216 - DNA, 25 bp, Homo sapien
ttagcttcactgtattcattactgg

SEQ ID NO: 113217 - DNA, 25 bp, Homo sapien
ttagcttcataatgcaatgttttat

SEQ ID NO: 113218 - DNA, 25 bp, Homo sapien
ttagcttcgtaatgcaatgttttat

SEQ ID NO: 113219 - DNA, 25 bp, Homo sapien
ttagctttcaaagtagatcttgcct

SEQ ID NO: 113220 - DNA, 25 bp, Homo sapien
ttagctttcttacctgaaaatctga

SEQ ID NO: 113221 - DNA, 25 bp, Homo sapien
ttagctttcttatctgaaaatctga

SEQ ID NO: 113222 - DNA, 25 bp, Homo sapien
ttagctttgaaagtagatcttgcct

SEQ ID NO: 113223 - DNA, 25 bp, Homo sapien
ttaggaaaagccattcacatcaagg

SEQ ID NO: 113224 - DNA, 25 bp, Homo sapien
ttaggaaaagccgttcacatcaagg

SEQ ID NO: 113225 - DNA, 25 bp, Homo sapien
ttaggaaactgcatagattaatgca

SEQ ID NO: 113226 - DNA, 25 bp, Homo sapien
ttaggaaactggatagattaatgca

SEQ ID NO: 113227 - DNA, 25 bp, Homo sapien
ttaggaaggttgtcaaaatgagacg

SEQ ID NO: 113228 - DNA, 25 bp, Homo sapien
ttaggaagtttgtcaaaatgagacg

SEQ ID NO: 113229 - DNA, 25 bp, Homo sapien
ttaggaataattcagacgatcttaa

SEQ ID NO: 113230 - DNA, 25 bp, Homo sapien
ttaggaataattcagatgatcttaa

SEQ ID NO: 113231 - DNA, 25 bp, Homo sapien
ttaggacctggcctcgatactaaat

SEQ ID NO: 113232 - DNA, 25 bp, Homo sapien
ttaggacctggccttgatactaaat

SEQ ID NO: 113233 - DNA, 25 bp, Homo sapien
ttaggactacagtttcttgatgtat

SEQ ID NO: 113234 - DNA, 25 bp, Homo sapien
ttaggactatagtttcttgatgtat

SEQ ID NO: 113235 - DNA, 25 bp, Homo sapien
ttaggactcatttatctatttatat

SEQ ID NO: 113236 - DNA, 25 bp, Homo sapien
ttaggactcatttgtctatttatat

SEQ ID NO: 113237 - DNA, 25 bp, Homo sapien
ttaggagaacaggcaaaatctatgg

SEQ ID NO: 113238 - DNA, 25 bp, Homo sapien
ttaggagaccaggcaaaatctatgg

SEQ ID NO: 113239 - DNA, 25 bp, Homo sapien
ttaggagatcactataggcaaagct

SEQ ID NO: 113240 - DNA, 25 bp, Homo sapien
ttaggagatgactataggcaaagct

SEQ ID NO: 113241 - DNA, 25 bp, Homo sapien
ttaggagtatattccggtaacaaag

SEQ ID NO: 113242 - DNA, 25 bp, Homo sapien
ttaggagtatattctggtaacaaag

SEQ ID NO: 113243 - DNA, 25 bp, Homo sapien
ttaggagtcagaaatagcaggtggg

SEQ ID NO: 113244 - DNA, 25 bp, Homo sapien
ttaggagtctgaaatagcaggtggg

SEQ ID NO: 113245 - DNA, 25 bp, Homo sapien
ttaggatcaattgacccttgagtga

SEQ ID NO: 113246 - DNA, 25 bp, Homo sapien
ttaggatcagttgacccttgagtga

SEQ ID NO: 113247 - DNA, 25 bp, Homo sapien
ttaggatcagttgtccttgtgcctg

SEQ ID NO: 113248 - DNA, 25 bp, Homo sapien
ttaggatcggttgtccttgtgcctg

SEQ ID NO: 113249 - DNA, 25 bp, Homo sapien
ttaggatctctacagaaagtggtgc

SEQ ID NO: 113250 - DNA, 25 bp, Homo sapien
ttaggatctctatagaaagtggtgc

SEQ ID NO: 113251 - DNA, 25 bp, Homo sapien
ttaggatgcctgcagttgtcaaggc

SEQ ID NO: 113252 - DNA, 25 bp, Homo sapien
ttaggatgcctgcggttgtcaaggc

SEQ ID NO: 113253 - DNA, 25 bp, Homo sapien
ttaggatttcaatgtatgaattttg

SEQ ID NO: 113254 - DNA, 25 bp, Homo sapien
ttaggatttcagtgtatgaattttg

SEQ ID NO: 113255 - DNA, 25 bp, Homo sapien
ttaggcaaatgcacctctcgaatcc

SEQ ID NO: 113256 - DNA, 25 bp, Homo sapien
ttaggcaaatgcatctctcgaatcc

SEQ ID NO: 113257 - DNA, 25 bp, Homo sapien
ttaggcaataacactacttgctaat

SEQ ID NO: 113258 - DNA, 25 bp, Homo sapien
ttaggcaataatactacttgctaat

SEQ ID NO: 113259 - DNA, 25 bp, Homo sapien
ttaggcacccaagagaaaatcttgc

SEQ ID NO: 113260 - DNA, 25 bp, Homo sapien
ttaggcacccaggagaaaatcttgc

SEQ ID NO: 113261 - DNA, 25 bp, Homo sapien
ttaggcaggctatcccaagaaaaag

SEQ ID NO: 113262 - DNA, 25 bp, Homo sapien
ttaggcaggttatcccaagaaaaag

SEQ ID NO: 113263 - DNA, 25 bp, Homo sapien
ttaggcattaggactttaaaaaata

SEQ ID NO: 113264 - DNA, 25 bp, Homo sapien
ttaggcattgggactttaaaaaata

SEQ ID NO: 113265 - DNA, 25 bp, Homo sapien
ttaggcccatatcctaatttaggtc

SEQ ID NO: 113266 - DNA, 25 bp, Homo sapien
ttaggcccgtatcctaatttaggtc

SEQ ID NO: 113267 - DNA, 25 bp, Homo sapien
ttaggctaaatctactattgaggtt

SEQ ID NO: 113268 - DNA, 25 bp, Homo sapien
ttaggctaaatctactgttgaggtt

SEQ ID NO: 113269 - DNA, 25 bp, Homo sapien
ttaggctatttacataaaactttag

SEQ ID NO: 113270 - DNA, 25 bp, Homo sapien
ttaggctatttacgtaaaactttag

SEQ ID NO: 113271 - DNA, 25 bp, Homo sapien
ttaggctctaatgaaacctcagcag

SEQ ID NO: 113272 - DNA, 25 bp, Homo sapien
ttaggctctgatgaaacctcagcag

SEQ ID NO: 113273 - DNA, 25 bp, Homo sapien
ttagggagaaaggccatatacacac

SEQ ID NO: 113274 - DNA, 25 bp, Homo sapien
ttagggagaaaggtcatatacacac

SEQ ID NO: 113275 - DNA, 25 bp, Homo sapien
ttagggcaagcaccatctctgtttc

SEQ ID NO: 113276 - DNA, 25 bp, Homo sapien
ttagggcaggcaccatctctgtttc

SEQ ID NO: 113277 - DNA, 25 bp, Homo sapien
ttagggcatgctgatgagctgagat

SEQ ID NO: 113278 - DNA, 25 bp, Homo sapien
ttagggcatgctgttgagctgagat

SEQ ID NO: 113279 - DNA, 25 bp, Homo sapien
ttagggctccatttacctctcgtat

SEQ ID NO: 113280 - DNA, 25 bp, Homo sapien
ttagggctccatttacttctcgtat

SEQ ID NO: 113281 - DNA, 25 bp, Homo sapien
ttaggggcaaactgattgcatccga

SEQ ID NO: 113282 - DNA, 25 bp, Homo sapien
ttaggggcaaattgattgcatccga

SEQ ID NO: 113283 - DNA, 25 bp, Homo sapien
ttagggtagcacatggcacacagca

SEQ ID NO: 113284 - DNA, 25 bp, Homo sapien
ttagggtagcacgtggcacacagca

SEQ ID NO: 113285 - DNA, 25 bp, Homo sapien
ttagggttaaggttttatcatattg

SEQ ID NO: 113286 - DNA, 25 bp, Homo sapien
ttagggttaaggttttgtcatattg

SEQ ID NO: 113287 - DNA, 25 bp, Homo sapien
ttaggtacaaaaccataatgactga

SEQ ID NO: 113288 - DNA, 25 bp, Homo sapien
ttaggtacaaatccataatgactga

SEQ ID NO: 113289 - DNA, 25 bp, Homo sapien
ttaggtaggaaacctgccgggcacc

SEQ ID NO: 113290 - DNA, 25 bp, Homo sapien
ttaggtaggaaatctgccgggcacc

SEQ ID NO: 113291 - DNA, 25 bp, Homo sapien
ttaggtatacggcacaggctttatg

SEQ ID NO: 113292 - DNA, 25 bp, Homo sapien
ttaggtatatggcacaggctttatg

SEQ ID NO: 113293 - DNA, 25 bp, Homo sapien
ttaggtattcactgcagtctcctca

SEQ ID NO: 113294 - DNA, 25 bp, Homo sapien
ttaggtattcattgcagtctcctca

SEQ ID NO: 113295 - DNA, 25 bp, Homo sapien
ttaggtctacaaacactgaatgagc

SEQ ID NO: 113296 - DNA, 25 bp, Homo sapien
ttaggtctacaagcactgaatgagc

SEQ ID NO: 113297 - DNA, 25 bp, Homo sapien
ttaggtgaacaaatacttttcatag

SEQ ID NO: 113298 - DNA, 25 bp, Homo sapien
ttaggtgaacaactacttttcatag

SEQ ID NO: 113299 - DNA, 25 bp, Homo sapien
ttaggtgacttttcggagaagatta

SEQ ID NO: 113300 - DNA, 25 bp, Homo sapien
ttaggtgactttttggagaagatta

SEQ ID NO: 113301 - DNA, 25 bp, Homo sapien
ttaggttaacaacaatactggaagc

SEQ ID NO: 113302 - DNA, 25 bp, Homo sapien
ttaggttaacaacaatcctggaagc

SEQ ID NO: 113303 - DNA, 25 bp, Homo sapien
ttaggttcaggaagtagatgagaaa

SEQ ID NO: 113304 - DNA, 25 bp, Homo sapien
ttaggttcgggaagtagatgagaaa

SEQ ID NO: 113305 - DNA, 25 bp, Homo sapien
ttaggttgaactgatgatgtggttt

SEQ ID NO: 113306 - DNA, 25 bp, Homo sapien
ttaggttgaactgatgctgtggttt

SEQ ID NO: 113307 - DNA, 25 bp, Homo sapien
ttaggttgcaagacttttctgtgta

SEQ ID NO: 113308 - DNA, 25 bp, Homo sapien
ttaggttgcaagccttttctgtgta

SEQ ID NO: 113309 - DNA, 25 bp, Homo sapien
ttaggttgcgctaaaatttacatta

SEQ ID NO: 113310 - DNA, 25 bp, Homo sapien
ttaggttgtgctaaaatttacatta

SEQ ID NO: 113311 - DNA, 25 bp, Homo sapien
ttaggtttctgaatccataatggca

SEQ ID NO: 113312 - DNA, 25 bp, Homo sapien
ttaggtttctgaattcataatggca

SEQ ID NO: 113313 - DNA, 25 bp, Homo sapien
ttaggtttgctctattctttattat

SEQ ID NO: 113314 - DNA, 25 bp, Homo sapien
ttaggtttgctttattctttattat

SEQ ID NO: 113315 - DNA, 25 bp, Homo sapien
ttaggtttttgttacagcagtgccc

SEQ ID NO: 113316 - DNA, 25 bp, Homo sapien
ttaggtttttgttagagcagtgccc

SEQ ID NO: 113317 - DNA, 25 bp, Homo sapien
ttagtaaaaaaaatagtgtgtcaaa

SEQ ID NO: 113318 - DNA, 25 bp, Homo sapien
ttagtaaaacaaatagtgtgtcaaa

SEQ ID NO: 113319 - DNA, 25 bp, Homo sapien
ttagtaaagttagaggaaatttcag

SEQ ID NO: 113320 - DNA, 25 bp, Homo sapien
ttagtaaagttagaggcaatttcag

SEQ ID NO: 113321 - DNA, 25 bp, Homo sapien
ttagtaaatagaaaatccgtggaca

SEQ ID NO: 113322 - DNA, 25 bp, Homo sapien
ttagtaaatagagaatccgtggaca

SEQ ID NO: 113323 - DNA, 25 bp, Homo sapien
ttagtacaaattttattggcttttc

SEQ ID NO: 113324 - DNA, 25 bp, Homo sapien
ttagtacaacttttattggcttttc

SEQ ID NO: 113325 - DNA, 25 bp, Homo sapien
ttagtagcaagaaggttactggtgc

SEQ ID NO: 113326 - DNA, 25 bp, Homo sapien
ttagtagcaaggaggttactggtgc

SEQ ID NO: 113327 - DNA, 25 bp, Homo sapien
ttagtatcatccgaatgtcccaggt

SEQ ID NO: 113328 - DNA, 25 bp, Homo sapien
ttagtatcatctgaatgtcccaggt

SEQ ID NO: 113329 - DNA, 25 bp, Homo sapien
ttagtatctattcaagcctttttta

SEQ ID NO: 113330 - DNA, 25 bp, Homo sapien
ttagtatctattcaaggctttttta

SEQ ID NO: 113331 - DNA, 25 bp, Homo sapien
ttagtatgccttcaaattttttctt

SEQ ID NO: 113332 - DNA, 25 bp, Homo sapien
ttagtatgccttctaattttttctt

SEQ ID NO: 113333 - DNA, 25 bp, Homo sapien
ttagtatggattggtgtatttctag

SEQ ID NO: 113334 - DNA, 25 bp, Homo sapien
ttagtatgggttggtgtatttctag

SEQ ID NO: 113335 - DNA, 25 bp, Homo sapien
ttagtatttatctggttccctcatt

SEQ ID NO: 113336 - DNA, 25 bp, Homo sapien
ttagtatttctctggttccctcatt

SEQ ID NO: 113337 - DNA, 25 bp, Homo sapien
ttagtatttgtaagtggtgtaagat

SEQ ID NO: 113338 - DNA, 25 bp, Homo sapien
ttagtatttgtgagtggtgtaagat

SEQ ID NO: 113339 - DNA, 25 bp, Homo sapien
ttagtcaattgaatgaaggctttgt

SEQ ID NO: 113340 - DNA, 25 bp, Homo sapien
ttagtcaattgaatgatggctttgt

SEQ ID NO: 113341 - DNA, 25 bp, Homo sapien
ttagtcatgatatagggaattgaaa

SEQ ID NO: 113342 - DNA, 25 bp, Homo sapien
ttagtcatgatatatggaattgaaa

SEQ ID NO: 113343 - DNA, 25 bp, Homo sapien
ttagtcatgtgggagacaggagaag

SEQ ID NO: 113344 - DNA, 25 bp, Homo sapien
ttagtcatgtgggagataggagaag

SEQ ID NO: 113345 - DNA, 25 bp, Homo sapien
ttagtccacacaggtagccaacaaa

SEQ ID NO: 113346 - DNA, 25 bp, Homo sapien
ttagtccacgaactccgaacactga

SEQ ID NO: 113347 - DNA, 25 bp, Homo sapien
ttagtccagacaggtagccaacaaa

SEQ ID NO: 113348 - DNA, 25 bp, Homo sapien
ttagtccatgaactccgaacactga

SEQ ID NO: 113349 - DNA, 25 bp, Homo sapien
ttagtcccagcatataacaattact

SEQ ID NO: 113350 - DNA, 25 bp, Homo sapien
ttagtcccagcgtataacaattact

SEQ ID NO: 113351 - DNA, 25 bp, Homo sapien
ttagtcgcccacagtggtcacatga

SEQ ID NO: 113352 - DNA, 25 bp, Homo sapien
ttagtcgcccacggtggtcacatga

SEQ ID NO: 113353 - DNA, 25 bp, Homo sapien
ttagtctccaaagattagaaaactt

SEQ ID NO: 113354 - DNA, 25 bp, Homo sapien
ttagtctccatggctgattcactac

SEQ ID NO: 113355 - DNA, 25 bp, Homo sapien
ttagtctccgaagattagaaaactt

SEQ ID NO: 113356 - DNA, 25 bp, Homo sapien
ttagtctccgtggctgattcactac

SEQ ID NO: 113357 - DNA, 25 bp, Homo sapien
ttagtgaaaaaagaagaatttggga

SEQ ID NO: 113358 - DNA, 25 bp, Homo sapien
ttagtgaaaaaagaagtatttggga

SEQ ID NO: 113359 - DNA, 25 bp, Homo sapien
ttagtgaaggaatgagggaacaatg

SEQ ID NO: 113360 - DNA, 25 bp, Homo sapien
ttagtgaaggaatgcgggaacaatg

SEQ ID NO: 113361 - DNA, 25 bp, Homo sapien
ttagtgagtcaaattcgaccattta

SEQ ID NO: 113362 - DNA, 25 bp, Homo sapien
ttagtgagttaaattcgaccattta

SEQ ID NO: 113363 - DNA, 25 bp, Homo sapien
ttagtgcatctcatggatacaatct

SEQ ID NO: 113364 - DNA, 25 bp, Homo sapien
ttagtgcattctatgtatggcccaa

SEQ ID NO: 113365 - DNA, 25 bp, Homo sapien
ttagtgcattctgtgtatggcccaa

SEQ ID NO: 113366 - DNA, 25 bp, Homo sapien
ttagtgcatttcatggatacaatct

SEQ ID NO: 113367 - DNA, 25 bp, Homo sapien
ttagtgctggttctgcctgaaatgt

SEQ ID NO: 113368 - DNA, 25 bp, Homo sapien
ttagtgctggttctgcttgaaatgt

SEQ ID NO: 113369 - DNA, 25 bp, Homo sapien
ttagtgcttcaatctaaagaggaca

SEQ ID NO: 113370 - DNA, 25 bp, Homo sapien
ttagtgcttgctgttacgtccaagg

SEQ ID NO: 113371 - DNA, 25 bp, Homo sapien
ttagtgcttgctgttatgtccaagg

SEQ ID NO: 113372 - DNA, 25 bp, Homo sapien
ttagtgctttaatctaaagaggaca

SEQ ID NO: 113373 - DNA, 25 bp, Homo sapien
ttagtggagcagttgtcggtatggt

SEQ ID NO: 113374 - DNA, 25 bp, Homo sapien
ttagtggagcagttgttggtatggt

SEQ ID NO: 113375 - DNA, 25 bp, Homo sapien
ttagtgggtcaaaacaatacaactt

SEQ ID NO: 113376 - DNA, 25 bp, Homo sapien
ttagtgggttaaaacaatacaactt

SEQ ID NO: 113377 - DNA, 25 bp, Homo sapien
ttagtgtatttcgcagtgtcacaga

SEQ ID NO: 113378 - DNA, 25 bp, Homo sapien
ttagtgtattttgcagtgtcacaga

SEQ ID NO: 113379 - DNA, 25 bp, Homo sapien
ttagtgtcctcatctttgagtctgc

SEQ ID NO: 113380 - DNA, 25 bp, Homo sapien
ttagtgtcttcatctttgagtctgc

SEQ ID NO: 113381 - DNA, 25 bp, Homo sapien
ttagtgttctttactgttgattttt

SEQ ID NO: 113382 - DNA, 25 bp, Homo sapien
ttagtgttctttgctgttgattttt

SEQ ID NO: 113383 - DNA, 25 bp, Homo sapien
ttagttaactttttccttgcatact

SEQ ID NO: 113384 - DNA, 25 bp, Homo sapien
ttagttaacttttttcttgcatact

SEQ ID NO: 113385 - DNA, 25 bp, Homo sapien
ttagttaattacaccctgttgcctc

SEQ ID NO: 113386 - DNA, 25 bp, Homo sapien
ttagttaattacatcctgttgcctc

SEQ ID NO: 113387 - DNA, 25 bp, Homo sapien
ttagttaccagtaagactgctttta

SEQ ID NO: 113388 - DNA, 25 bp, Homo sapien
ttagttaccggtaagactgctttta

SEQ ID NO: 113389 - DNA, 25 bp, Homo sapien
ttagttatgcaatgctaccacacat

SEQ ID NO: 113390 - DNA, 25 bp, Homo sapien
ttagttatgtaatgctaccacacat

SEQ ID NO: 113391 - DNA, 25 bp, Homo sapien
ttagttcaagcaagaggtgagagct

SEQ ID NO: 113392 - DNA, 25 bp, Homo sapien
ttagttcaagcaagagttgagagct

SEQ ID NO: 113393 - DNA, 25 bp, Homo sapien
ttagttcaccaaacctagaaccaaa

SEQ ID NO: 113394 - DNA, 25 bp, Homo sapien
ttagttcagagtcgctctttgacca

SEQ ID NO: 113395 - DNA, 25 bp, Homo sapien
ttagttcagagttgctctttgacca

SEQ ID NO: 113396 - DNA, 25 bp, Homo sapien
ttagttcatcaaacctagaaccaaa

SEQ ID NO: 113397 - DNA, 25 bp, Homo sapien
ttagttcttcgacctctctgactag

SEQ ID NO: 113398 - DNA, 25 bp, Homo sapien
ttagttcttcgacgcagagcttttc

SEQ ID NO: 113399 - DNA, 25 bp, Homo sapien
ttagttctttgacctctctgactag

SEQ ID NO: 113400 - DNA, 25 bp, Homo sapien
ttagttctttgacgcagagcttttc

SEQ ID NO: 113401 - DNA, 25 bp, Homo sapien
ttagttgaaactctcttgaatatca

SEQ ID NO: 113402 - DNA, 25 bp, Homo sapien
ttagttgaacctctcttgaatatca

SEQ ID NO: 113403 - DNA, 25 bp, Homo sapien
ttagttgagtcctccgaatgaaaag

SEQ ID NO: 113404 - DNA, 25 bp, Homo sapien
ttagttgagtcctctgaatgaaaag

SEQ ID NO: 113405 - DNA, 25 bp, Homo sapien
ttagttgcaatgacggtgtaatttt

SEQ ID NO: 113406 - DNA, 25 bp, Homo sapien
ttagttgcaatgactgtgtaatttt

SEQ ID NO: 113407 - DNA, 25 bp, Homo sapien
ttagttgccttggcagctgaaacat

SEQ ID NO: 113408 - DNA, 25 bp, Homo sapien
ttagttgccttggcggctgaaacat

SEQ ID NO: 113409 - DNA, 25 bp, Homo sapien
ttagttgcttagattgggtcgtgtt

SEQ ID NO: 113410 - DNA, 25 bp, Homo sapien
ttagttgcttaggttgggtcgtgtt

SEQ ID NO: 113411 - DNA, 25 bp, Homo sapien
ttagttgtaggctcatatgtaaaag

SEQ ID NO: 113412 - DNA, 25 bp, Homo sapien
ttagttgtaggctcatgtgtaaaag

SEQ ID NO: 113413 - DNA, 25 bp, Homo sapien
ttagttgtatcattaaaaaaatgtc

SEQ ID NO: 113414 - DNA, 25 bp, Homo sapien
ttagttgtatcattgaaaaaatgtc

SEQ ID NO: 113415 - DNA, 25 bp, Homo sapien
ttagtttaaccatgtatctgactgg

SEQ ID NO: 113416 - DNA, 25 bp, Homo sapien
ttagtttaaccgtgtatctgactgg

SEQ ID NO: 113417 - DNA, 25 bp, Homo sapien
ttagtttaccgttgaattgctttat

SEQ ID NO: 113418 - DNA, 25 bp, Homo sapien
ttagtttaccgttggattgctttat

SEQ ID NO: 113419 - DNA, 25 bp, Homo sapien
ttagtttcaaaaatcttaatgtaga

SEQ ID NO: 113420 - DNA, 25 bp, Homo sapien
ttagtttcaaaagtcttaatgtaga

SEQ ID NO: 113421 - DNA, 25 bp, Homo sapien
ttagtttccattctattcaatgttc

SEQ ID NO: 113422 - DNA, 25 bp, Homo sapien
ttagtttccgttctattcaatgttc

SEQ ID NO: 113423 - DNA, 25 bp, Homo sapien
ttagtttccttactgggagagacca

SEQ ID NO: 113424 - DNA, 25 bp, Homo sapien
ttagtttccttattgggagagacca

SEQ ID NO: 113425 - DNA, 25 bp, Homo sapien
ttagtttctttgtgtccatccacag

SEQ ID NO: 113426 - DNA, 25 bp, Homo sapien
ttagtttctttgtgtctatccacag

SEQ ID NO: 113427 - DNA, 25 bp, Homo sapien
ttagtttgcaccattgttcctgttg

SEQ ID NO: 113428 - DNA, 25 bp, Homo sapien
ttagtttgcaccgttgttcctgttg

SEQ ID NO: 113429 - DNA, 25 bp, Homo sapien
ttagttttggtgctccactctagta

SEQ ID NO: 113430 - DNA, 25 bp, Homo sapien
ttagttttggtgctccgctctagta

SEQ ID NO: 113431 - DNA, 25 bp, Homo sapien
ttagttttgtagcataactagaagt

SEQ ID NO: 113432 - DNA, 25 bp, Homo sapien
ttagttttgtagcgtaactagaagt

SEQ ID NO: 113433 - DNA, 25 bp, Homo sapien
ttagtttttagcagtgtcaaaaatg

SEQ ID NO: 113434 - DNA, 25 bp, Homo sapien
ttagtttttagtagtgtcaaaaatg

SEQ ID NO: 113435 - DNA, 25 bp, Homo sapien
ttagttttttcattttctacagctt

SEQ ID NO: 113436 - DNA, 25 bp, Homo sapien
ttagttttttcgttttctacagctt

SEQ ID NO: 113437 - DNA, 25 bp, Homo sapien
ttataaaaatgccctggagaaattg

SEQ ID NO: 113438 - DNA, 25 bp, Homo sapien
ttataaaaatgctctggagaaattg

SEQ ID NO: 113439 - DNA, 25 bp, Homo sapien
ttataaaacatatagcaaacatgtg

SEQ ID NO: 113440 - DNA, 25 bp, Homo sapien
ttataaaacgtatagcaaacatgtg

SEQ ID NO: 113441 - DNA, 25 bp, Homo sapien
ttataaaaggtcaaaaagctaaata

SEQ ID NO: 113442 - DNA, 25 bp, Homo sapien
ttataaaaggtcacaaagctaaata

SEQ ID NO: 113443 - DNA, 25 bp, Homo sapien
ttataaaatgcagctactgagagag

SEQ ID NO: 113444 - DNA, 25 bp, Homo sapien
ttataaaatgcagctattgagagag

SEQ ID NO: 113445 - DNA, 25 bp, Homo sapien
ttataaacaacattgaaataagaat

SEQ ID NO: 113446 - DNA, 25 bp, Homo sapien
ttataaaccatcttttgaaaaggat

SEQ ID NO: 113447 - DNA, 25 bp, Homo sapien
ttataaaccattttttgaaaaggat

SEQ ID NO: 113448 - DNA, 25 bp, Homo sapien
ttataaacccagatgacatcttagc

SEQ ID NO: 113449 - DNA, 25 bp, Homo sapien
ttataaacccagatgatatcttagc

SEQ ID NO: 113450 - DNA, 25 bp, Homo sapien
ttataaactacattgaaataagaat

SEQ ID NO: 113451 - DNA, 25 bp, Homo sapien
ttataaagagacacgtaggctaaga

SEQ ID NO: 113452 - DNA, 25 bp, Homo sapien
ttataaagagacgcgtaggctaaga

SEQ ID NO: 113453 - DNA, 25 bp, Homo sapien
ttataaagcactaagagataacaat

SEQ ID NO: 113454 - DNA, 25 bp, Homo sapien
ttataaagcactgagagataacaat

SEQ ID NO: 113455 - DNA, 25 bp, Homo sapien
ttataaagccagacctcatgaaaag

SEQ ID NO: 113456 - DNA, 25 bp, Homo sapien
ttataaagccagccctcatgaaaag

SEQ ID NO: 113457 - DNA, 25 bp, Homo sapien
ttataaatgtcagttactatcatta

SEQ ID NO: 113458 - DNA, 25 bp, Homo sapien
ttataaatgtcagttattatcatta

SEQ ID NO: 113459 - DNA, 25 bp, Homo sapien
ttataacacaactatgtaatataat

SEQ ID NO: 113460 - DNA, 25 bp, Homo sapien
ttataacacaattatgtaatataat

SEQ ID NO: 113461 - DNA, 25 bp, Homo sapien
ttataacatcaaacactaggagaat

SEQ ID NO: 113462 - DNA, 25 bp, Homo sapien
ttataacatcaaacgctaggagaat

SEQ ID NO: 113463 - DNA, 25 bp, Homo sapien
ttataaccagtgacccttctaagca

SEQ ID NO: 113464 - DNA, 25 bp, Homo sapien
ttataaccagtggcccttctaagca

SEQ ID NO: 113465 - DNA, 25 bp, Homo sapien
ttataaccgctgcaccttacaaacc

SEQ ID NO: 113466 - DNA, 25 bp, Homo sapien
ttataacctctgcaccttacaaacc

SEQ ID NO: 113467 - DNA, 25 bp, Homo sapien
ttataactcgtaatgaatgttaagc

SEQ ID NO: 113468 - DNA, 25 bp, Homo sapien
ttataacttgtaatgaatgttaagc

SEQ ID NO: 113469 - DNA, 25 bp, Homo sapien
ttataagaaagaccatatgcaagct

SEQ ID NO: 113470 - DNA, 25 bp, Homo sapien
ttataagaaagaccgtatgcaagct

SEQ ID NO: 113471 - DNA, 25 bp, Homo sapien
ttataagaagagaaaatccatagac

SEQ ID NO: 113472 - DNA, 25 bp, Homo sapien
ttataagaagagaagatccatagac

SEQ ID NO: 113473 - DNA, 25 bp, Homo sapien
ttataagacttagcgtggcaacaaa

SEQ ID NO: 113474 - DNA, 25 bp, Homo sapien
ttataagacttagtgtggcaacaaa

SEQ ID NO: 113475 - DNA, 25 bp, Homo sapien
ttataagagcacagtatttcgtagc

SEQ ID NO: 113476 - DNA, 25 bp, Homo sapien
ttataagagcatagtatttcgtagc

SEQ ID NO: 113477 - DNA, 25 bp, Homo sapien
ttataagattaattacaactcctgg

SEQ ID NO: 113478 - DNA, 25 bp, Homo sapien
ttataagattaattacgactcctgg

SEQ ID NO: 113479 - DNA, 25 bp, Homo sapien
ttataagcttgttcagaattattat

SEQ ID NO: 113480 - DNA, 25 bp, Homo sapien
ttataagcttgttctgaattattat

SEQ ID NO: 113481 - DNA, 25 bp, Homo sapien
ttataagtgctgtaatgaaaagaaa

SEQ ID NO: 113482 - DNA, 25 bp, Homo sapien
ttataagtgctgtattgaaaagaaa

SEQ ID NO: 113483 - DNA, 25 bp, Homo sapien
ttataagttccaggccgcctgtttt

SEQ ID NO: 113484 - DNA, 25 bp, Homo sapien
ttataagttccaggcctcctgtttt

SEQ ID NO: 113485 - DNA, 25 bp, Homo sapien
ttataatcataacaagacattgcat

SEQ ID NO: 113486 - DNA, 25 bp, Homo sapien
ttataatcataacaagccattgcat

SEQ ID NO: 113487 - DNA, 25 bp, Homo sapien
ttataatgcatgaatgtaaggtatg

SEQ ID NO: 113488 - DNA, 25 bp, Homo sapien
ttataatgcatgattgtaaggtatg

SEQ ID NO: 113489 - DNA, 25 bp, Homo sapien
ttataatgtgcaaccagattaagct

SEQ ID NO: 113490 - DNA, 25 bp, Homo sapien
ttataatgtgcgaccagattaagct

SEQ ID NO: 113491 - DNA, 25 bp, Homo sapien
ttataatgtttacagccatctccat

SEQ ID NO: 113492 - DNA, 25 bp, Homo sapien
ttataatgtttacggccatctccat

SEQ ID NO: 113493 - DNA, 25 bp, Homo sapien
ttataattcagctctaacactgtct

SEQ ID NO: 113494 - DNA, 25 bp, Homo sapien
ttataattcggctctaacactgtct

SEQ ID NO: 113495 - DNA, 25 bp, Homo sapien
ttatacaccttgttctgtatcttgc

SEQ ID NO: 113496 - DNA, 25 bp, Homo sapien
ttatacacgttgttctgtatcttgc

SEQ ID NO: 113497 - DNA, 25 bp, Homo sapien
ttatacagactacataattgaagag

SEQ ID NO: 113498 - DNA, 25 bp, Homo sapien
ttatacagactacgtaattgaagag

SEQ ID NO: 113499 - DNA, 25 bp, Homo sapien
ttatacccttacgcaatttaatagg

SEQ ID NO: 113500 - DNA, 25 bp, Homo sapien
ttatacccttaggcaatttaatagg

SEQ ID NO: 113501 - DNA, 25 bp, Homo sapien
ttatacctactgacctggcgtctca

SEQ ID NO: 113502 - DNA, 25 bp, Homo sapien
ttatacctactgccctggcgtctca

SEQ ID NO: 113503 - DNA, 25 bp, Homo sapien
ttatacctatcatatagcacagcat

SEQ ID NO: 113504 - DNA, 25 bp, Homo sapien
ttatacctatcgataaatatgtgtg

SEQ ID NO: 113505 - DNA, 25 bp, Homo sapien
ttatacctatcgataagtatgtgtg

SEQ ID NO: 113506 - DNA, 25 bp, Homo sapien
ttatacctgtcatatagcacagcat

SEQ ID NO: 113507 - DNA, 25 bp, Homo sapien
ttatacgcaaaaactggtaacacaa

SEQ ID NO: 113508 - DNA, 25 bp, Homo sapien
ttatacgcaaaaattggtaacacaa

SEQ ID NO: 113509 - DNA, 25 bp, Homo sapien
ttatactactgcacacctgtgaagc

SEQ ID NO: 113510 - DNA, 25 bp, Homo sapien
ttatactactgtacacctgtgaagc

SEQ ID NO: 113511 - DNA, 25 bp, Homo sapien
ttatactcttgcggttttgtgaatc

SEQ ID NO: 113512 - DNA, 25 bp, Homo sapien
ttatactcttgtggttttgtgaatc

SEQ ID NO: 113513 - DNA, 25 bp, Homo sapien
ttatactgtacaaccagcaagtaga

SEQ ID NO: 113514 - DNA, 25 bp, Homo sapien
ttatactgtacatccagcaagtaga

SEQ ID NO: 113515 - DNA, 25 bp, Homo sapien
ttatagaacaaaatttaagaaaact

SEQ ID NO: 113516 - DNA, 25 bp, Homo sapien
ttatagaaccaaatttaagaaaact

SEQ ID NO: 113517 - DNA, 25 bp, Homo sapien
ttatagaagcagcttattgaaatga

SEQ ID NO: 113518 - DNA, 25 bp, Homo sapien
ttatagaagcaggttattgaaatga

SEQ ID NO: 113519 - DNA, 25 bp, Homo sapien
ttatagaaggtagggcactacagaa

SEQ ID NO: 113520 - DNA, 25 bp, Homo sapien
ttatagaaggtagggcgctacagaa

SEQ ID NO: 113521 - DNA, 25 bp, Homo sapien
ttatagacagaattgtatcctctct

SEQ ID NO: 113522 - DNA, 25 bp, Homo sapien
ttatagacagaattgtgtcctctct

SEQ ID NO: 113523 - DNA, 25 bp, Homo sapien
ttatagacatttcaatagttgccca

SEQ ID NO: 113524 - DNA, 25 bp, Homo sapien
ttatagacatttcagtagttgccca

SEQ ID NO: 113525 - DNA, 25 bp, Homo sapien
ttatagaccattgaaagatccctgt

SEQ ID NO: 113526 - DNA, 25 bp, Homo sapien
ttatagaccatttaaagatccctgt

SEQ ID NO: 113527 - DNA, 25 bp, Homo sapien
ttatagacgatgagttgaaagccca

SEQ ID NO: 113528 - DNA, 25 bp, Homo sapien
ttatagacgctgagttgaaagccca

SEQ ID NO: 113529 - DNA, 25 bp, Homo sapien
ttatagagaaaacactgtattggtt

SEQ ID NO: 113530 - DNA, 25 bp, Homo sapien
ttatagagaaaacgctgtattggtt

SEQ ID NO: 113531 - DNA, 25 bp, Homo sapien
ttatagataataacttcctagtcta

SEQ ID NO: 113532 - DNA, 25 bp, Homo sapien
ttatagataataatttcctagtcta

SEQ ID NO: 113533 - DNA, 25 bp, Homo sapien
ttatagatctgatcatgaattctct

SEQ ID NO: 113534 - DNA, 25 bp, Homo sapien
ttatagatctgatcgtgaattctct

SEQ ID NO: 113535 - DNA, 25 bp, Homo sapien
ttatagatttggaatcctgttatgt

SEQ ID NO: 113536 - DNA, 25 bp, Homo sapien
ttatagatttggagtcctgttatgt

SEQ ID NO: 113537 - DNA, 25 bp, Homo sapien
ttatagcaaatatacggctttagaa

SEQ ID NO: 113538 - DNA, 25 bp, Homo sapien
ttatagcaaatatagggctttagaa

SEQ ID NO: 113539 - DNA, 25 bp, Homo sapien
ttatagcacaactgaaatattttac

SEQ ID NO: 113540 - DNA, 25 bp, Homo sapien
ttatagcacaactgaagtattttac

SEQ ID NO: 113541 - DNA, 25 bp, Homo sapien
ttatagcacagactagtttttcagt

SEQ ID NO: 113542 - DNA, 25 bp, Homo sapien
ttatagcacagactggtttttcagt

SEQ ID NO: 113543 - DNA, 25 bp, Homo sapien
ttatagcagcaatagaaaatggaca

SEQ ID NO: 113544 - DNA, 25 bp, Homo sapien
ttatagcagcagtagaaaatggaca

SEQ ID NO: 113545 - DNA, 25 bp, Homo sapien
ttatagcattgtctgacgtgattct

SEQ ID NO: 113546 - DNA, 25 bp, Homo sapien
ttatagcattgtctgatgtgattct

SEQ ID NO: 113547 - DNA, 25 bp, Homo sapien
ttatagccagtttgtgttggataaa

SEQ ID NO: 113548 - DNA, 25 bp, Homo sapien
ttatagccggtttgtgttggataaa

SEQ ID NO: 113549 - DNA, 25 bp, Homo sapien
ttatagctatacattgagacaacca

SEQ ID NO: 113550 - DNA, 25 bp, Homo sapien
ttatagctatatattgagacaacca

SEQ ID NO: 113551 - DNA, 25 bp, Homo sapien
ttataggagacatcacaggaggaaa

SEQ ID NO: 113552 - DNA, 25 bp, Homo sapien
ttataggagacatctcaggaggaaa

SEQ ID NO: 113553 - DNA, 25 bp, Homo sapien
ttataggcacttagcgaatggagag

SEQ ID NO: 113554 - DNA, 25 bp, Homo sapien
ttataggcacttagtgaatggagag

SEQ ID NO: 113555 - DNA, 25 bp, Homo sapien
ttataggcttaggctcaaaatacta

SEQ ID NO: 113556 - DNA, 25 bp, Homo sapien
ttataggcttaggttcaaaatacta

SEQ ID NO: 113557 - DNA, 25 bp, Homo sapien
ttatagggcaactttgcttccccta

SEQ ID NO: 113558 - DNA, 25 bp, Homo sapien
ttatagggcaactttggttccccta

SEQ ID NO: 113559 - DNA, 25 bp, Homo sapien
ttataggttcttactttattgcact

SEQ ID NO: 113560 - DNA, 25 bp, Homo sapien
ttataggttcttattttattgcact

SEQ ID NO: 113561 - DNA, 25 bp, Homo sapien
ttatagtatgcaaccttatatccat

SEQ ID NO: 113562 - DNA, 25 bp, Homo sapien
ttatagtatgcagccttatatccat

SEQ ID NO: 113563 - DNA, 25 bp, Homo sapien
ttatagtcactaagcatctactatg

SEQ ID NO: 113564 - DNA, 25 bp, Homo sapien
ttatagtcagtaagcatctactatg

SEQ ID NO: 113565 - DNA, 25 bp, Homo sapien
ttatagtcctgcaattatcagcaga

SEQ ID NO: 113566 - DNA, 25 bp, Homo sapien
ttatagtcctgttcattcagtccta

SEQ ID NO: 113567 - DNA, 25 bp, Homo sapien
ttatagtcctgttcgttcagtccta

SEQ ID NO: 113568 - DNA, 25 bp, Homo sapien
ttatagtcttgcaattatcagcaga

SEQ ID NO: 113569 - DNA, 25 bp, Homo sapien
ttatagtggaccatcaacttatgat

SEQ ID NO: 113570 - DNA, 25 bp, Homo sapien
ttatagtggaccgtcaacttatgat

SEQ ID NO: 113571 - DNA, 25 bp, Homo sapien
ttatagtgttagctcctataggatt

SEQ ID NO: 113572 - DNA, 25 bp, Homo sapien
ttatagtgttagcttctataggatt

SEQ ID NO: 113573 - DNA, 25 bp, Homo sapien
ttatagttccttaatagttttttac

SEQ ID NO: 113574 - DNA, 25 bp, Homo sapien
ttatagttccttaatatttttttac

SEQ ID NO: 113575 - DNA, 25 bp, Homo sapien
ttatagttgtcatcagtagggaacc

SEQ ID NO: 113576 - DNA, 25 bp, Homo sapien
ttatagttgtcgtcagtagggaacc

SEQ ID NO: 113577 - DNA, 25 bp, Homo sapien
ttatagtttcagcctttagaattag

SEQ ID NO: 113578 - DNA, 25 bp, Homo sapien
ttatagtttcaggctttagaattag

SEQ ID NO: 113579 - DNA, 25 bp, Homo sapien
ttatagtttcgcctactcttctttc

SEQ ID NO: 113580 - DNA, 25 bp, Homo sapien
ttatagtttcgtctactcttctttc

SEQ ID NO: 113581 - DNA, 25 bp, Homo sapien
ttatataaatgagaacacactgagc

SEQ ID NO: 113582 - DNA, 25 bp, Homo sapien
ttatataaatgcgaacacactgagc

SEQ ID NO: 113583 - DNA, 25 bp, Homo sapien
ttatataaggaaattgaacatctga

SEQ ID NO: 113584 - DNA, 25 bp, Homo sapien
ttatataaggaacttgaacatctga

SEQ ID NO: 113585 - DNA, 25 bp, Homo sapien
ttatatacaatttaaaaagccttca

SEQ ID NO: 113586 - DNA, 25 bp, Homo sapien
ttatatacaattttaaaagccttca

SEQ ID NO: 113587 - DNA, 25 bp, Homo sapien
ttatatacgtaacaaaatatgttca

SEQ ID NO: 113588 - DNA, 25 bp, Homo sapien
ttatatacgtaacaaagtatgttca

SEQ ID NO: 113589 - DNA, 25 bp, Homo sapien
ttatatactcaacgttcaacaagaa

SEQ ID NO: 113590 - DNA, 25 bp, Homo sapien
ttatatactcaatgttcaacaagaa

SEQ ID NO: 113591 - DNA, 25 bp, Homo sapien
ttatatacttagacatctttgaatt

SEQ ID NO: 113592 - DNA, 25 bp, Homo sapien
ttatatacttagacatgtttgaatt

SEQ ID NO: 113593 - DNA, 25 bp, Homo sapien
ttatatagaatcttgccctgtcttc

SEQ ID NO: 113594 - DNA, 25 bp, Homo sapien
ttatatagaatcttgctctgtcttc

SEQ ID NO: 113595 - DNA, 25 bp, Homo sapien
ttatatagagcaatcatgaatcatc

SEQ ID NO: 113596 - DNA, 25 bp, Homo sapien
ttatatagcgcaatcatgaatcatc

SEQ ID NO: 113597 - DNA, 25 bp, Homo sapien
ttatataggcacaccactcatccac

SEQ ID NO: 113598 - DNA, 25 bp, Homo sapien
ttatataggcataccactcatccac

SEQ ID NO: 113599 - DNA, 25 bp, Homo sapien
ttatatatggacaactgatttgcaa

SEQ ID NO: 113600 - DNA, 25 bp, Homo sapien
ttatatatggacagctgatttgcaa

SEQ ID NO: 113601 - DNA, 25 bp, Homo sapien
ttatatatttaaagctgtgtgccag

SEQ ID NO: 113602 - DNA, 25 bp, Homo sapien
ttatatatttaaagttgtgtgccag

SEQ ID NO: 113603 - DNA, 25 bp, Homo sapien
ttatatcagtgaagttaatcgtgcc

SEQ ID NO: 113604 - DNA, 25 bp, Homo sapien
ttatatcagtgaagttcatcgtgcc

SEQ ID NO: 113605 - DNA, 25 bp, Homo sapien
ttatatcatctgtgttcctacatat

SEQ ID NO: 113606 - DNA, 25 bp, Homo sapien
ttatatcatctgtgtttctacatat

SEQ ID NO: 113607 - DNA, 25 bp, Homo sapien
ttatatccaatgcgtatgtgcaatg

SEQ ID NO: 113608 - DNA, 25 bp, Homo sapien
ttatatccaatgtgtatgtgcaatg

SEQ ID NO: 113609 - DNA, 25 bp, Homo sapien
ttatatctcacaatgttcacaggat

SEQ ID NO: 113610 - DNA, 25 bp, Homo sapien
ttatatctcacagtgttcacaggat

SEQ ID NO: 113611 - DNA, 25 bp, Homo sapien
ttatatctggctacattttatccat

SEQ ID NO: 113612 - DNA, 25 bp, Homo sapien
ttatatctgtctacattttatccat

SEQ ID NO: 113613 - DNA, 25 bp, Homo sapien
ttatatgaatcgataatcttccaga

SEQ ID NO: 113614 - DNA, 25 bp, Homo sapien
ttatatgaatcggtaatcttccaga

SEQ ID NO: 113615 - DNA, 25 bp, Homo sapien
ttatatgctaatggctctccactcc

SEQ ID NO: 113616 - DNA, 25 bp, Homo sapien
ttatatgctaattgctctccactcc

SEQ ID NO: 113617 - DNA, 25 bp, Homo sapien
ttatatgctgtgtaaggcctgttcc

SEQ ID NO: 113618 - DNA, 25 bp, Homo sapien
ttatatgctgtgtaagtcctgttcc

SEQ ID NO: 113619 - DNA, 25 bp, Homo sapien
ttatatggcaaaagattataagtac

SEQ ID NO: 113620 - DNA, 25 bp, Homo sapien
ttatatggcaaaggattataagtac

SEQ ID NO: 113621 - DNA, 25 bp, Homo sapien
ttatatggttccagagaacactgaa

SEQ ID NO: 113622 - DNA, 25 bp, Homo sapien
ttatatggttccatagaacactgaa

SEQ ID NO: 113623 - DNA, 25 bp, Homo sapien
ttatatgtcttaaacttttgatatg

SEQ ID NO: 113624 - DNA, 25 bp, Homo sapien
ttatatgtcttaatcttttgatatg

SEQ ID NO: 113625 - DNA, 25 bp, Homo sapien
ttatatgttacagtcaaatcctctg

SEQ ID NO: 113626 - DNA, 25 bp, Homo sapien
ttatatgttactgtcaaatcctctg

SEQ ID NO: 113627 - DNA, 25 bp, Homo sapien
ttatattagacacaagtacttaggc

SEQ ID NO: 113628 - DNA, 25 bp, Homo sapien
ttatattagacgcaagtacttaggc

SEQ ID NO: 113629 - DNA, 25 bp, Homo sapien
ttatattggatatcgtgaattgtct

SEQ ID NO: 113630 - DNA, 25 bp, Homo sapien
ttatattggatatcttgaattgtct

SEQ ID NO: 113631 - DNA, 25 bp, Homo sapien
ttatatttagaattatgatttgagc

SEQ ID NO: 113632 - DNA, 25 bp, Homo sapien
ttatatttagaattgtgatttgagc

SEQ ID NO: 113633 - DNA, 25 bp, Homo sapien
ttatatttccataaacagcagaaag

SEQ ID NO: 113634 - DNA, 25 bp, Homo sapien
ttatatttccataagcagcagaaag

SEQ ID NO: 113635 - DNA, 25 bp, Homo sapien
ttatatttcccattatctgatgact

SEQ ID NO: 113636 - DNA, 25 bp, Homo sapien
ttatatttctcattatctgatgact

SEQ ID NO: 113637 - DNA, 25 bp, Homo sapien
ttatcaaaacctaatcacctcccaa

SEQ ID NO: 113638 - DNA, 25 bp, Homo sapien
ttatcaaaacctcatcacctcccaa

SEQ ID NO: 113639 - DNA, 25 bp, Homo sapien
ttatcaaaattccaaaatataaagg

SEQ ID NO: 113640 - DNA, 25 bp, Homo sapien
ttatcaaaattccgaaatataaagg

SEQ ID NO: 113641 - DNA, 25 bp, Homo sapien
ttatcaaagctgtatgaagtaagac

SEQ ID NO: 113642 - DNA, 25 bp, Homo sapien
ttatcaaagctttatgaagtaagac

SEQ ID NO: 113643 - DNA, 25 bp, Homo sapien
ttatcaaagtcatacgtgtagagaa

SEQ ID NO: 113644 - DNA, 25 bp, Homo sapien
ttatcaaagtcatatgtgtagagaa

SEQ ID NO: 113645 - DNA, 25 bp, Homo sapien
ttatcaacaatgataccactctgac

SEQ ID NO: 113646 - DNA, 25 bp, Homo sapien
ttatcaacacgacagaagagaaagt

SEQ ID NO: 113647 - DNA, 25 bp, Homo sapien
ttatcaacatgacagaagagaaagt

SEQ ID NO: 113648 - DNA, 25 bp, Homo sapien
ttatcaaccatgaaaataaagtggg

SEQ ID NO: 113649 - DNA, 25 bp, Homo sapien
ttatcaaccatgaatataaagtggg

SEQ ID NO: 113650 - DNA, 25 bp, Homo sapien
ttatcaactatgataccactctgac

SEQ ID NO: 113651 - DNA, 25 bp, Homo sapien
ttatcaagcgtcaaaaattaagata

SEQ ID NO: 113652 - DNA, 25 bp, Homo sapien
ttatcaagctccttctatgagtcag

SEQ ID NO: 113653 - DNA, 25 bp, Homo sapien
ttatcaagggccatttctgtgtaag

SEQ ID NO: 113654 - DNA, 25 bp, Homo sapien
ttatcaagggctatttctgtgtaag

SEQ ID NO: 113655 - DNA, 25 bp, Homo sapien
ttatcaagtgtcaaaaattaagata

SEQ ID NO: 113656 - DNA, 25 bp, Homo sapien
ttatcaagttccttctatgagtcag

SEQ ID NO: 113657 - DNA, 25 bp, Homo sapien
ttatcacgagtcctacgggaaacca

SEQ ID NO: 113658 - DNA, 25 bp, Homo sapien
ttatcacgagtcctgcgggaaacca

SEQ ID NO: 113659 - DNA, 25 bp, Homo sapien
ttatcactcaaagtctcatagatag

SEQ ID NO: 113660 - DNA, 25 bp, Homo sapien
ttatcactcaaggtctcatagatag

SEQ ID NO: 113661 - DNA, 25 bp, Homo sapien
ttatcagcatttacaagctcagtgt

SEQ ID NO: 113662 - DNA, 25 bp, Homo sapien
ttatcagcatttacgagctcagtgt

SEQ ID NO: 113663 - DNA, 25 bp, Homo sapien
ttatcaggattatcacaattgcctc

SEQ ID NO: 113664 - DNA, 25 bp, Homo sapien
ttatcaggtttatcacaattgcctc

SEQ ID NO: 113665 - DNA, 25 bp, Homo sapien
ttatcagttcagctgcttcaaacat

SEQ ID NO: 113666 - DNA, 25 bp, Homo sapien
ttatcagttcagttgcttcaaacat

SEQ ID NO: 113667 - DNA, 25 bp, Homo sapien
ttatcataaatgctagaagactgga

SEQ ID NO: 113668 - DNA, 25 bp, Homo sapien
ttatcataaccagttccaccaaaaa

SEQ ID NO: 113669 - DNA, 25 bp, Homo sapien
ttatcataatcagttccaccaaaaa

SEQ ID NO: 113670 - DNA, 25 bp, Homo sapien
ttatcataatttttgagttacagct

SEQ ID NO: 113671 - DNA, 25 bp, Homo sapien
ttatcataattttttagttacagct

SEQ ID NO: 113672 - DNA, 25 bp, Homo sapien
ttatcatacatgctagaagactgga

SEQ ID NO: 113673 - DNA, 25 bp, Homo sapien
ttatcatattatacgtaggagcaat

SEQ ID NO: 113674 - DNA, 25 bp, Homo sapien
ttatcatattatatgtaggagcaat

SEQ ID NO: 113675 - DNA, 25 bp, Homo sapien
ttatcatccgagccataactggaat

SEQ ID NO: 113676 - DNA, 25 bp, Homo sapien
ttatcatcggagccataactggaat

SEQ ID NO: 113677 - DNA, 25 bp, Homo sapien
ttatcatgccagctaaaattggcca

SEQ ID NO: 113678 - DNA, 25 bp, Homo sapien
ttatcatgcgtgacccctgaagtct

SEQ ID NO: 113679 - DNA, 25 bp, Homo sapien
ttatcatgcgtgatccctgaagtct

SEQ ID NO: 113680 - DNA, 25 bp, Homo sapien
ttatcatgctagctaaaattggcca

SEQ ID NO: 113681 - DNA, 25 bp, Homo sapien
ttatcatgctcccattgtgaacttc

SEQ ID NO: 113682 - DNA, 25 bp, Homo sapien
ttatcatgctcccgttgtgaacttc

SEQ ID NO: 113683 - DNA, 25 bp, Homo sapien
ttatcattgcctggccatgtatctt

SEQ ID NO: 113684 - DNA, 25 bp, Homo sapien
ttatcattgcctggccttgtatctt

SEQ ID NO: 113685 - DNA, 25 bp, Homo sapien
ttatcatttctttctcatcttagat

SEQ ID NO: 113686 - DNA, 25 bp, Homo sapien
ttatcatttctttctcgtcttagat

SEQ ID NO: 113687 - DNA, 25 bp, Homo sapien
ttatcatttgaaaccagaaaactgt

SEQ ID NO: 113688 - DNA, 25 bp, Homo sapien
ttatcatttgaaactagaaaactgt

SEQ ID NO: 113689 - DNA, 25 bp, Homo sapien
ttatcatttgtgcattcactgaagt

SEQ ID NO: 113690 - DNA, 25 bp, Homo sapien
ttatcatttgtgcgttcactgaagt

SEQ ID NO: 113691 - DNA, 25 bp, Homo sapien
ttatccaaaggacgtgttaggctaa

SEQ ID NO: 113692 - DNA, 25 bp, Homo sapien
ttatccaaaggaggtgttaggctaa

SEQ ID NO: 113693 - DNA, 25 bp, Homo sapien
ttatccagcaacggatgatgtgctt

SEQ ID NO: 113694 - DNA, 25 bp, Homo sapien
ttatccagcaagggatgatgtgctt

SEQ ID NO: 113695 - DNA, 25 bp, Homo sapien
ttatcccaagtcctctgactcgtcc

SEQ ID NO: 113696 - DNA, 25 bp, Homo sapien
ttatcccaagtcttctgactcgtcc

SEQ ID NO: 113697 - DNA, 25 bp, Homo sapien
ttatcccagacatgcaaggagattc

SEQ ID NO: 113698 - DNA, 25 bp, Homo sapien
ttatcccagacattcaaggagattc

SEQ ID NO: 113699 - DNA, 25 bp, Homo sapien
ttatcctatgtcatatggcccaacg

SEQ ID NO: 113700 - DNA, 25 bp, Homo sapien
ttatcctatgtcgtatggcccaacg

SEQ ID NO: 113701 - DNA, 25 bp, Homo sapien
ttatcctcaacattactgccatacc

SEQ ID NO: 113702 - DNA, 25 bp, Homo sapien
ttatcctcaacgttactgccatacc

SEQ ID NO: 113703 - DNA, 25 bp, Homo sapien
ttatcctgagatatacactgttttg

SEQ ID NO: 113704 - DNA, 25 bp, Homo sapien
ttatcctgagatattcactgttttg

SEQ ID NO: 113705 - DNA, 25 bp, Homo sapien
ttatcgaggcccaggctcatatgtc

SEQ ID NO: 113706 - DNA, 25 bp, Homo sapien
ttatcgaggcccgggctcatatgtc

SEQ ID NO: 113707 - DNA, 25 bp, Homo sapien
ttatcgttttcagaacatctctgtc

SEQ ID NO: 113708 - DNA, 25 bp, Homo sapien
ttatcgttttcggaacatctctgtc

SEQ ID NO: 113709 - DNA, 25 bp, Homo sapien
ttatctaaaacagatgaagattaag

SEQ ID NO: 113710 - DNA, 25 bp, Homo sapien
ttatctaaaacggatgaagattaag

SEQ ID NO: 113711 - DNA, 25 bp, Homo sapien
ttatctaagcatttggcttgtttga

SEQ ID NO: 113712 - DNA, 25 bp, Homo sapien
ttatctaagcatttggtttgtttga

SEQ ID NO: 113713 - DNA, 25 bp, Homo sapien
ttatctactgacactgttttcacac

SEQ ID NO: 113714 - DNA, 25 bp, Homo sapien
ttatctactgatactgttttcacac

SEQ ID NO: 113715 - DNA, 25 bp, Homo sapien
ttatctatggccaactcatgcacaa

SEQ ID NO: 113716 - DNA, 25 bp, Homo sapien
ttatctatggccagctcatgcacaa

SEQ ID NO: 113717 - DNA, 25 bp, Homo sapien
ttatctcaagtgaacctggagaagc

SEQ ID NO: 113718 - DNA, 25 bp, Homo sapien
ttatctcaagtgaatctggagaagc

SEQ ID NO: 113719 - DNA, 25 bp, Homo sapien
ttatctcaggagcaagccagggaag

SEQ ID NO: 113720 - DNA, 25 bp, Homo sapien
ttatctcaggagcaagtcagggaag

SEQ ID NO: 113721 - DNA, 25 bp, Homo sapien
ttatctccaatgtcacttttaacaa

SEQ ID NO: 113722 - DNA, 25 bp, Homo sapien
ttatctcccatgtcacttttaacaa

SEQ ID NO: 113723 - DNA, 25 bp, Homo sapien
ttatctcctgcatagagagacgata

SEQ ID NO: 113724 - DNA, 25 bp, Homo sapien
ttatctcctgcgtagagagacgata

SEQ ID NO: 113725 - DNA, 25 bp, Homo sapien
ttatctctggctctctcaattttga

SEQ ID NO: 113726 - DNA, 25 bp, Homo sapien
ttatctctggctctcttaattttga

SEQ ID NO: 113727 - DNA, 25 bp, Homo sapien
ttatctgaacaagcaaaacctaaga

SEQ ID NO: 113728 - DNA, 25 bp, Homo sapien
ttatctgagcaagcaaaacctaaga

SEQ ID NO: 113729 - DNA, 25 bp, Homo sapien
ttatctgatactaatatagccattc

SEQ ID NO: 113730 - DNA, 25 bp, Homo sapien
ttatctgatactagtatagccattc

SEQ ID NO: 113731 - DNA, 25 bp, Homo sapien
ttatctgatctatacgtaaccaatc

SEQ ID NO: 113732 - DNA, 25 bp, Homo sapien
ttatctgatctgtacgtaaccaatc

SEQ ID NO: 113733 - DNA, 25 bp, Homo sapien
ttatctgcctactgctcaaactcag

SEQ ID NO: 113734 - DNA, 25 bp, Homo sapien
ttatctgcctactgttcaaactcag

SEQ ID NO: 113735 - DNA, 25 bp, Homo sapien
ttatctggacgtagcaatgagaaac

SEQ ID NO: 113736 - DNA, 25 bp, Homo sapien
ttatctggatgtagcaatgagaaac

SEQ ID NO: 113737 - DNA, 25 bp, Homo sapien
ttatctggcataataaactatttgg

SEQ ID NO: 113738 - DNA, 25 bp, Homo sapien
ttatctggcataataagctatttgg

SEQ ID NO: 113739 - DNA, 25 bp, Homo sapien
ttatctgtgacaggtatacccttac

SEQ ID NO: 113740 - DNA, 25 bp, Homo sapien
ttatctgtggcaggtatacccttac

SEQ ID NO: 113741 - DNA, 25 bp, Homo sapien
ttatctgttcaatgtgactagtaga

SEQ ID NO: 113742 - DNA, 25 bp, Homo sapien
ttatctgttgctatgacagaggtat

SEQ ID NO: 113743 - DNA, 25 bp, Homo sapien
ttatctgttgctatgagagaggtat

SEQ ID NO: 113744 - DNA, 25 bp, Homo sapien
ttatctgtttaatgtgactagtaga

SEQ ID NO: 113745 - DNA, 25 bp, Homo sapien
ttatcttaaacagcatctactttgt

SEQ ID NO: 113746 - DNA, 25 bp, Homo sapien
ttatcttacagtttcagagacagaa

SEQ ID NO: 113747 - DNA, 25 bp, Homo sapien
ttatcttagacagcatctactttgt

SEQ ID NO: 113748 - DNA, 25 bp, Homo sapien
ttatcttatagtttcagagacagaa

SEQ ID NO: 113749 - DNA, 25 bp, Homo sapien
ttatcttattgctccagcactcggt

SEQ ID NO: 113750 - DNA, 25 bp, Homo sapien
ttatcttattgttccagcactcggt

SEQ ID NO: 113751 - DNA, 25 bp, Homo sapien
ttatcttctctgacaacaaggaaat

SEQ ID NO: 113752 - DNA, 25 bp, Homo sapien
ttatcttctctgactacaaggaaat

SEQ ID NO: 113753 - DNA, 25 bp, Homo sapien
ttatcttgaaagtaacaaacttgct

SEQ ID NO: 113754 - DNA, 25 bp, Homo sapien
ttatcttgaaagtagcaaacttgct

SEQ ID NO: 113755 - DNA, 25 bp, Homo sapien
ttatcttgcatgaacttttgtaact

SEQ ID NO: 113756 - DNA, 25 bp, Homo sapien
ttatcttgcatggacttttgtaact

SEQ ID NO: 113757 - DNA, 25 bp, Homo sapien
ttatctttacagaacttcagtattt

SEQ ID NO: 113758 - DNA, 25 bp, Homo sapien
ttatctttacagagcttcagtattt

SEQ ID NO: 113759 - DNA, 25 bp, Homo sapien
ttatctttatgcagtatcccttcag

SEQ ID NO: 113760 - DNA, 25 bp, Homo sapien
ttatctttctacgcctctgtttgct

SEQ ID NO: 113761 - DNA, 25 bp, Homo sapien
ttatctttctatgcctctgtttgct

SEQ ID NO: 113762 - DNA, 25 bp, Homo sapien
ttatctttgtgcagtatcccttcag

SEQ ID NO: 113763 - DNA, 25 bp, Homo sapien
ttatgaaaacctgtgattacataat

SEQ ID NO: 113764 - DNA, 25 bp, Homo sapien
ttatgaaagaccccattcaatatcc

SEQ ID NO: 113765 - DNA, 25 bp, Homo sapien
ttatgaaagaccccgttcaatatcc

SEQ ID NO: 113766 - DNA, 25 bp, Homo sapien
ttatgaaagcctgtgattacataat

SEQ ID NO: 113767 - DNA, 25 bp, Homo sapien
ttatgaaatctgtggagcttgacaa

SEQ ID NO: 113768 - DNA, 25 bp, Homo sapien
ttatgaaatttgtggagcttgacaa

SEQ ID NO: 113769 - DNA, 25 bp, Homo sapien
ttatgaacagctatatactcacaaa

SEQ ID NO: 113770 - DNA, 25 bp, Homo sapien
ttatgaacagctatttactcacaaa

SEQ ID NO: 113771 - DNA, 25 bp, Homo sapien
ttatgaagcaagtctcacaattcaa

SEQ ID NO: 113772 - DNA, 25 bp, Homo sapien
ttatgaagcaagtctcgcaattcaa

SEQ ID NO: 113773 - DNA, 25 bp, Homo sapien
ttatgaaggagaatgaaggagttag

SEQ ID NO: 113774 - DNA, 25 bp, Homo sapien
ttatgaaggagaatgagggagttag

SEQ ID NO: 113775 - DNA, 25 bp, Homo sapien
ttatgaataatatcgccggctgttt

SEQ ID NO: 113776 - DNA, 25 bp, Homo sapien
ttatgaataatatcgctggctgttt

SEQ ID NO: 113777 - DNA, 25 bp, Homo sapien
ttatgaatcttactttaatttctcc

SEQ ID NO: 113778 - DNA, 25 bp, Homo sapien
ttatgaatctttctttaatttctcc

SEQ ID NO: 113779 - DNA, 25 bp, Homo sapien
ttatgaatgtatgcaactcttgtcc

SEQ ID NO: 113780 - DNA, 25 bp, Homo sapien
ttatgaatgtatgctactcttgtcc

SEQ ID NO: 113781 - DNA, 25 bp, Homo sapien
ttatgaatttgtccactttcactga

SEQ ID NO: 113782 - DNA, 25 bp, Homo sapien
ttatgaatttgttcactttcactga

SEQ ID NO: 113783 - DNA, 25 bp, Homo sapien
ttatgactctcacgtacacacctat

SEQ ID NO: 113784 - DNA, 25 bp, Homo sapien
ttatgactctcatgtacacacctat

SEQ ID NO: 113785 - DNA, 25 bp, Homo sapien
ttatgactgggatatcatgaggttt

SEQ ID NO: 113786 - DNA, 25 bp, Homo sapien
ttatgactgggatgtcatgaggttt

SEQ ID NO: 113787 - DNA, 25 bp, Homo sapien
ttatgagaataattatcacaaaaat

SEQ ID NO: 113788 - DNA, 25 bp, Homo sapien
ttatgagaataattatgacaaaaat

SEQ ID NO: 113789 - DNA, 25 bp, Homo sapien
ttatgagaattagtggtcactgttg

SEQ ID NO: 113790 - DNA, 25 bp, Homo sapien
ttatgagagttagtggtcactgttg

SEQ ID NO: 113791 - DNA, 25 bp, Homo sapien
ttatgagcgagtaatccttttaagg

SEQ ID NO: 113792 - DNA, 25 bp, Homo sapien
ttatgagcgagtaatctttttaagg

SEQ ID NO: 113793 - DNA, 25 bp, Homo sapien
ttatgagctgtaaaacaaaagcatc

SEQ ID NO: 113794 - DNA, 25 bp, Homo sapien
ttatgagctgtaaagcaaaagcatc

SEQ ID NO: 113795 - DNA, 25 bp, Homo sapien
ttatgaggggctcttccaccttcgc

SEQ ID NO: 113796 - DNA, 25 bp, Homo sapien
ttatgaggggcttttccaccttcgc

SEQ ID NO: 113797 - DNA, 25 bp, Homo sapien
ttatgatactctacacatgctctat

SEQ ID NO: 113798 - DNA, 25 bp, Homo sapien
ttatgatactctacacgtgctctat

SEQ ID NO: 113799 - DNA, 25 bp, Homo sapien
ttatgatcagcatgtacccgccaat

SEQ ID NO: 113800 - DNA, 25 bp, Homo sapien
ttatgatccgcatgtacccgccaat

SEQ ID NO: 113801 - DNA, 25 bp, Homo sapien
ttatgatgacaaaattcgaagattt

SEQ ID NO: 113802 - DNA, 25 bp, Homo sapien
ttatgatgacaaaatttgaagattt

SEQ ID NO: 113803 - DNA, 25 bp, Homo sapien
ttatgatgaggaaagtttgaagcca

SEQ ID NO: 113804 - DNA, 25 bp, Homo sapien
ttatgatggggaaagtttgaagcca

SEQ ID NO: 113805 - DNA, 25 bp, Homo sapien
ttatgattatgccaggttacaccag

SEQ ID NO: 113806 - DNA, 25 bp, Homo sapien
ttatgattgtgccaggttacaccag

SEQ ID NO: 113807 - DNA, 25 bp, Homo sapien
ttatgcaggtaaacgtgtgctagtc

SEQ ID NO: 113808 - DNA, 25 bp, Homo sapien
ttatgcaggtaatcgtgtgctagtc

SEQ ID NO: 113809 - DNA, 25 bp, Homo sapien
ttatgcaggtatagaagtctgatgc

SEQ ID NO: 113810 - DNA, 25 bp, Homo sapien
ttatgcaggtataggagtctgatgc

SEQ ID NO: 113811 - DNA, 25 bp, Homo sapien
ttatgcatccttaactcaacattat

SEQ ID NO: 113812 - DNA, 25 bp, Homo sapien
ttatgcatccttagctcaacattat

SEQ ID NO: 113813 - DNA, 25 bp, Homo sapien
ttatgcatgaaaacaccttcacaaa

SEQ ID NO: 113814 - DNA, 25 bp, Homo sapien
ttatgcatgaaaataccttcacaaa

SEQ ID NO: 113815 - DNA, 25 bp, Homo sapien
ttatgcattttgaccatcttttaca

SEQ ID NO: 113816 - DNA, 25 bp, Homo sapien
ttatgcattttgactatcttttaca

SEQ ID NO: 113817 - DNA, 25 bp, Homo sapien
ttatgccaaatgaaacaaatcaaga

SEQ ID NO: 113818 - DNA, 25 bp, Homo sapien
ttatgccaagtgaaacaaatcaaga

SEQ ID NO: 113819 - DNA, 25 bp, Homo sapien
ttatgccaatgtgtgcccaacgttt

SEQ ID NO: 113820 - DNA, 25 bp, Homo sapien
ttatgccactccataaatttgttct

SEQ ID NO: 113821 - DNA, 25 bp, Homo sapien
ttatgccactctataaatttgttct

SEQ ID NO: 113822 - DNA, 25 bp, Homo sapien
ttatgccagtgtgtgcccaacgttt

SEQ ID NO: 113823 - DNA, 25 bp, Homo sapien
ttatgcccactcttctgcccagagg

SEQ ID NO: 113824 - DNA, 25 bp, Homo sapien
ttatgcccacttttctgcccagagg

SEQ ID NO: 113825 - DNA, 25 bp, Homo sapien
ttatgcctcaattaaagtaatagca

SEQ ID NO: 113826 - DNA, 25 bp, Homo sapien
ttatgcctcaattacagtaatagca

SEQ ID NO: 113827 - DNA, 25 bp, Homo sapien
ttatgcctgtcattgaaccaggagt

SEQ ID NO: 113828 - DNA, 25 bp, Homo sapien
ttatgcctgtcgttgaaccaggagt

SEQ ID NO: 113829 - DNA, 25 bp, Homo sapien
ttatgctaccttacttctctatcct

SEQ ID NO: 113830 - DNA, 25 bp, Homo sapien
ttatgctatcttacttctctatcct

SEQ ID NO: 113831 - DNA, 25 bp, Homo sapien
ttatgctcaactcgagtgcctttac

SEQ ID NO: 113832 - DNA, 25 bp, Homo sapien
ttatgctcaacttgagtgcctttac

SEQ ID NO: 113833 - DNA, 25 bp, Homo sapien
ttatgctcgcatttcagtctcacat

SEQ ID NO: 113834 - DNA, 25 bp, Homo sapien
ttatgctctcatttcagtctcacat

SEQ ID NO: 113835 - DNA, 25 bp, Homo sapien
ttatgctctgatccgaaattttaat

SEQ ID NO: 113836 - DNA, 25 bp, Homo sapien
ttatgctctgatctgaaattttaat

SEQ ID NO: 113837 - DNA, 25 bp, Homo sapien
ttatgctgagtcagaccgatgccag

SEQ ID NO: 113838 - DNA, 25 bp, Homo sapien
ttatgctgggtcagaccgatgccag

SEQ ID NO: 113839 - DNA, 25 bp, Homo sapien
ttatgcttccaaatgcagcacgtaa

SEQ ID NO: 113840 - DNA, 25 bp, Homo sapien
ttatgcttgaattcttcaaaataag

SEQ ID NO: 113841 - DNA, 25 bp, Homo sapien
ttatgcttgaattctttaaaataag

SEQ ID NO: 113842 - DNA, 25 bp, Homo sapien
ttatgctttcaaatgcagcacgtaa

SEQ ID NO: 113843 - DNA, 25 bp, Homo sapien
ttatgcttttgatccttcccatata

SEQ ID NO: 113844 - DNA, 25 bp, Homo sapien
ttatgcttttggtccttcccatata

SEQ ID NO: 113845 - DNA, 25 bp, Homo sapien
ttatggaaaatgatcgtttaaattt

SEQ ID NO: 113846 - DNA, 25 bp, Homo sapien
ttatggaaaatgattgtttaaattt

SEQ ID NO: 113847 - DNA, 25 bp, Homo sapien
ttatggaaaccatgacatacactaa

SEQ ID NO: 113848 - DNA, 25 bp, Homo sapien
ttatggaaaccgtgacatacactaa

SEQ ID NO: 113849 - DNA, 25 bp, Homo sapien
ttatggaaatgttctgtatttgcac

SEQ ID NO: 113850 - DNA, 25 bp, Homo sapien
ttatggaaatgttttgtatttgcac

SEQ ID NO: 113851 - DNA, 25 bp, Homo sapien
ttatggaaattctagcactcttaag

SEQ ID NO: 113852 - DNA, 25 bp, Homo sapien
ttatggaaattgtagcactcttaag

SEQ ID NO: 113853 - DNA, 25 bp, Homo sapien
ttatggaactcataatttttaaaag

SEQ ID NO: 113854 - DNA, 25 bp, Homo sapien
ttatggaagtcataatttttaaaag

SEQ ID NO: 113855 - DNA, 25 bp, Homo sapien
ttatggcaccccattgctgctttct

SEQ ID NO: 113856 - DNA, 25 bp, Homo sapien
ttatggcaccctattgctgctttct

SEQ ID NO: 113857 - DNA, 25 bp, Homo sapien
ttatggcagagtgcgtgatggaggg

SEQ ID NO: 113858 - DNA, 25 bp, Homo sapien
ttatggcagagtgtgtgatggaggg

SEQ ID NO: 113859 - DNA, 25 bp, Homo sapien
ttatggcatatgtaaaacaggaaag

SEQ ID NO: 113860 - DNA, 25 bp, Homo sapien
ttatggcatatgtacaacaggaaag

SEQ ID NO: 113861 - DNA, 25 bp, Homo sapien
ttatggccatacccttcatttttgt

SEQ ID NO: 113862 - DNA, 25 bp, Homo sapien
ttatggccatactcttcatttttgt

SEQ ID NO: 113863 - DNA, 25 bp, Homo sapien
ttatggccattgcagtcttttcctt

SEQ ID NO: 113864 - DNA, 25 bp, Homo sapien
ttatggccattgcagtgttttcctt

SEQ ID NO: 113865 - DNA, 25 bp, Homo sapien
ttatggccttcagaaaaattgcagc

SEQ ID NO: 113866 - DNA, 25 bp, Homo sapien
ttatggccttcagacaaattgcagc

SEQ ID NO: 113867 - DNA, 25 bp, Homo sapien
ttatggcggtggactatgacttata

SEQ ID NO: 113868 - DNA, 25 bp, Homo sapien
ttatggcggtggattatgacttata

SEQ ID NO: 113869 - DNA, 25 bp, Homo sapien
ttatggctaatcatttgtctccagc

SEQ ID NO: 113870 - DNA, 25 bp, Homo sapien
ttatggctagctgctgaaaccagtt

SEQ ID NO: 113871 - DNA, 25 bp, Homo sapien
ttatggctagcttctgaaaccagtt

SEQ ID NO: 113872 - DNA, 25 bp, Homo sapien
ttatggctagtcatttgtctccagc

SEQ ID NO: 113873 - DNA, 25 bp, Homo sapien
ttatggcttttgacaacatcagcca

SEQ ID NO: 113874 - DNA, 25 bp, Homo sapien
ttatggcttttggcaacatcagcca

SEQ ID NO: 113875 - DNA, 25 bp, Homo sapien
ttatgggacatagtatatatttctg

SEQ ID NO: 113876 - DNA, 25 bp, Homo sapien
ttatgggacatagtatgtatttctg

SEQ ID NO: 113877 - DNA, 25 bp, Homo sapien
ttatgggcatagaccctgcctagca

SEQ ID NO: 113878 - DNA, 25 bp, Homo sapien
ttatgggcatagactctgcctagca

SEQ ID NO: 113879 - DNA, 25 bp, Homo sapien
ttatggtaagagagacttttctaac

SEQ ID NO: 113880 - DNA, 25 bp, Homo sapien
ttatggtaagagatacttttctaac

SEQ ID NO: 113881 - DNA, 25 bp, Homo sapien
ttatggtaagatacagagaatttag

SEQ ID NO: 113882 - DNA, 25 bp, Homo sapien
ttatggtaagatagagagaatttag

SEQ ID NO: 113883 - DNA, 25 bp, Homo sapien
ttatggtgaaagcagatgaaacctg

SEQ ID NO: 113884 - DNA, 25 bp, Homo sapien
ttatggtgaaaggagatgaaacctg

SEQ ID NO: 113885 - DNA, 25 bp, Homo sapien
ttatggtgcacgcacatagccacca

SEQ ID NO: 113886 - DNA, 25 bp, Homo sapien
ttatggtgcacgtacatagccacca

SEQ ID NO: 113887 - DNA, 25 bp, Homo sapien
ttatggttaagcatgtggtcaattt

SEQ ID NO: 113888 - DNA, 25 bp, Homo sapien
ttatggttaagtatgtggtcaattt

SEQ ID NO: 113889 - DNA, 25 bp, Homo sapien
ttatggttcgatacatttcagtaaa

SEQ ID NO: 113890 - DNA, 25 bp, Homo sapien
ttatggtttgatacatttcagtaaa

SEQ ID NO: 113891 - DNA, 25 bp, Homo sapien
ttatggttttaatttgcgtccctaa

SEQ ID NO: 113892 - DNA, 25 bp, Homo sapien
ttatggttttaatttgtgtccctaa

SEQ ID NO: 113893 - DNA, 25 bp, Homo sapien
ttatgtaaggctcaccatgtcaact

SEQ ID NO: 113894 - DNA, 25 bp, Homo sapien
ttatgtaaggctcaccgtgtcaact

SEQ ID NO: 113895 - DNA, 25 bp, Homo sapien
ttatgtacgttcaaattcctcaatt

SEQ ID NO: 113896 - DNA, 25 bp, Homo sapien
ttatgtacgttcaagttcctcaatt

SEQ ID NO: 113897 - DNA, 25 bp, Homo sapien
ttatgtagaagtgaagcgtaaaatc

SEQ ID NO: 113898 - DNA, 25 bp, Homo sapien
ttatgtagaagtgaagtgtaaaatc

SEQ ID NO: 113899 - DNA, 25 bp, Homo sapien
ttatgtagctgataatgatgatcct

SEQ ID NO: 113900 - DNA, 25 bp, Homo sapien
ttatgtagctgataattatgatcct

SEQ ID NO: 113901 - DNA, 25 bp, Homo sapien
ttatgtagtggtaattcagtgaggt

SEQ ID NO: 113902 - DNA, 25 bp, Homo sapien
ttatgtagtggtatttcagtgaggt

SEQ ID NO: 113903 - DNA, 25 bp, Homo sapien
ttatgtcaaagattagatcaagcac

SEQ ID NO: 113904 - DNA, 25 bp, Homo sapien
ttatgtcaaagcgcagggtcacagg

SEQ ID NO: 113905 - DNA, 25 bp, Homo sapien
ttatgtcaaagctcagggtcacagg

SEQ ID NO: 113906 - DNA, 25 bp, Homo sapien
ttatgtcaaaggttagatcaagcac

SEQ ID NO: 113907 - DNA, 25 bp, Homo sapien
ttatgtcacagccagtgggttcctt

SEQ ID NO: 113908 - DNA, 25 bp, Homo sapien
ttatgtcacatttctctcactgtta

SEQ ID NO: 113909 - DNA, 25 bp, Homo sapien
ttatgtcagatttctctcactgtta

SEQ ID NO: 113910 - DNA, 25 bp, Homo sapien
ttatgtcagcctatttaactgtgcc

SEQ ID NO: 113911 - DNA, 25 bp, Homo sapien
ttatgtcagtggctgaagtgtggtt

SEQ ID NO: 113912 - DNA, 25 bp, Homo sapien
ttatgtcagtggctgaggtgtggtt

SEQ ID NO: 113913 - DNA, 25 bp, Homo sapien
ttatgtcatagccagtgggttcctt

SEQ ID NO: 113914 - DNA, 25 bp, Homo sapien
ttatgtcatcctatttaactgtgcc

SEQ ID NO: 113915 - DNA, 25 bp, Homo sapien
ttatgtcctgccgattgagtatatt

SEQ ID NO: 113916 - DNA, 25 bp, Homo sapien
ttatgtcctgctgattgagtatatt

SEQ ID NO: 113917 - DNA, 25 bp, Homo sapien
ttatgtctccctaggaagtgtaaaa

SEQ ID NO: 113918 - DNA, 25 bp, Homo sapien
ttatgtctccctaggatgtgtaaaa

SEQ ID NO: 113919 - DNA, 25 bp, Homo sapien
ttatgtctcttcctcttttctgatt

SEQ ID NO: 113920 - DNA, 25 bp, Homo sapien
ttatgtctcttgctcttttctgatt

SEQ ID NO: 113921 - DNA, 25 bp, Homo sapien
ttatgtcttcaagctcacccatctt

SEQ ID NO: 113922 - DNA, 25 bp, Homo sapien
ttatgtcttcaggctcacccatctt

SEQ ID NO: 113923 - DNA, 25 bp, Homo sapien
ttatgtgacctatgagacagcatag

SEQ ID NO: 113924 - DNA, 25 bp, Homo sapien
ttatgtgacttatgagacagcatag

SEQ ID NO: 113925 - DNA, 25 bp, Homo sapien
ttatgtgcacggtagcagtgtgtaa

SEQ ID NO: 113926 - DNA, 25 bp, Homo sapien
ttatgtgcatggtagcagtgtgtaa

SEQ ID NO: 113927 - DNA, 25 bp, Homo sapien
ttatgtgctgtaggtatatctgtac

SEQ ID NO: 113928 - DNA, 25 bp, Homo sapien
ttatgtgctgtatgtatatctgtac

SEQ ID NO: 113929 - DNA, 25 bp, Homo sapien
ttatgtggctaacttcaataagcta

SEQ ID NO: 113930 - DNA, 25 bp, Homo sapien
ttatgtggttaacttcaataagcta

SEQ ID NO: 113931 - DNA, 25 bp, Homo sapien
ttatgtgtcttacaacttttagcca

SEQ ID NO: 113932 - DNA, 25 bp, Homo sapien
ttatgtgtcttataacttttagcca

SEQ ID NO: 113933 - DNA, 25 bp, Homo sapien
ttatgtgttttcaagaaagtaattt

SEQ ID NO: 113934 - DNA, 25 bp, Homo sapien
ttatgtgttttcaagacagtaattt

SEQ ID NO: 113935 - DNA, 25 bp, Homo sapien
ttatgttaaatactgactcacagga

SEQ ID NO: 113936 - DNA, 25 bp, Homo sapien
ttatgttaaatactgagtcacagga

SEQ ID NO: 113937 - DNA, 25 bp, Homo sapien
ttatgttagaccattctggcagcaa

SEQ ID NO: 113938 - DNA, 25 bp, Homo sapien
ttatgttagaccgttctggcagcaa

SEQ ID NO: 113939 - DNA, 25 bp, Homo sapien
ttatgttatcttcttttacaaaatg

SEQ ID NO: 113940 - DNA, 25 bp, Homo sapien
ttatgttattttcttttacaaaatg

SEQ ID NO: 113941 - DNA, 25 bp, Homo sapien
ttatgttccgacccaaaggacaaat

SEQ ID NO: 113942 - DNA, 25 bp, Homo sapien
ttatgttctgacccaaaggacaaat

SEQ ID NO: 113943 - DNA, 25 bp, Homo sapien
ttatgttctgttccactgcggctaa

SEQ ID NO: 113944 - DNA, 25 bp, Homo sapien
ttatgttctgttctactgcggctaa

SEQ ID NO: 113945 - DNA, 25 bp, Homo sapien
ttatgttgtttactgatatcctgcc

SEQ ID NO: 113946 - DNA, 25 bp, Homo sapien
ttatgttgtttattgatatcctgcc

SEQ ID NO: 113947 - DNA, 25 bp, Homo sapien
ttatgttttagtttccattctattc

SEQ ID NO: 113948 - DNA, 25 bp, Homo sapien
ttatgttttagtttccgttctattc

SEQ ID NO: 113949 - DNA, 25 bp, Homo sapien
ttatgttttctttgaccttacttac

SEQ ID NO: 113950 - DNA, 25 bp, Homo sapien
ttatgttttctttgcccttacttac

SEQ ID NO: 113951 - DNA, 25 bp, Homo sapien
ttattaaaacaacgttaggctccac

SEQ ID NO: 113952 - DNA, 25 bp, Homo sapien
ttattaaaacaactttaggctccac

SEQ ID NO: 113953 - DNA, 25 bp, Homo sapien
ttattaaaatgtgacacaagtgaag

SEQ ID NO: 113954 - DNA, 25 bp, Homo sapien
ttattaaaatgtgatacaagtgaag

SEQ ID NO: 113955 - DNA, 25 bp, Homo sapien
ttattaaacattacgatgcagtttt

SEQ ID NO: 113956 - DNA, 25 bp, Homo sapien
ttattaaacattatgatgcagtttt

SEQ ID NO: 113957 - DNA, 25 bp, Homo sapien
ttattaactacatgcgcttggacaa

SEQ ID NO: 113958 - DNA, 25 bp, Homo sapien
ttattaactacgtgcgcttggacaa

SEQ ID NO: 113959 - DNA, 25 bp, Homo sapien
ttattaagatgtaaggattcaggag

SEQ ID NO: 113960 - DNA, 25 bp, Homo sapien
ttattaagccatgttagcaatgaaa

SEQ ID NO: 113961 - DNA, 25 bp, Homo sapien
ttattaagtcatgttagcaatgaaa

SEQ ID NO: 113962 - DNA, 25 bp, Homo sapien
ttattaagttgtaaggattcaggag

SEQ ID NO: 113963 - DNA, 25 bp, Homo sapien
ttattaccacaaacctccagtgggc

SEQ ID NO: 113964 - DNA, 25 bp, Homo sapien
ttattaccattctgtagcagaacct

SEQ ID NO: 113965 - DNA, 25 bp, Homo sapien
ttattaccattttgtagcagaacct

SEQ ID NO: 113966 - DNA, 25 bp, Homo sapien
ttattaccgcaaacctccagtgggc

SEQ ID NO: 113967 - DNA, 25 bp, Homo sapien
ttattacttctgcatttactcattg

SEQ ID NO: 113968 - DNA, 25 bp, Homo sapien
ttattacttctgcctttactcattg

SEQ ID NO: 113969 - DNA, 25 bp, Homo sapien
ttattacttttcctgtacatctctg

SEQ ID NO: 113970 - DNA, 25 bp, Homo sapien
ttattacttttcttgtacatctctg

SEQ ID NO: 113971 - DNA, 25 bp, Homo sapien
ttattagaatatagccaaacatgac

SEQ ID NO: 113972 - DNA, 25 bp, Homo sapien
ttattagaatatggccaaacatgac

SEQ ID NO: 113973 - DNA, 25 bp, Homo sapien
ttattagaggtctagcagaaagtgg

SEQ ID NO: 113974 - DNA, 25 bp, Homo sapien
ttattagaggtttagcagaaagtgg

SEQ ID NO: 113975 - DNA, 25 bp, Homo sapien
ttattagatccgtagcttcttaaca

SEQ ID NO: 113976 - DNA, 25 bp, Homo sapien
ttattagatccttagcttcttaaca

SEQ ID NO: 113977 - DNA, 25 bp, Homo sapien
ttattaggccagaggatcaaggtta

SEQ ID NO: 113978 - DNA, 25 bp, Homo sapien
ttattagggatttaggtcagtcaat

SEQ ID NO: 113979 - DNA, 25 bp, Homo sapien
ttattagggttttaggtcagtcaat

SEQ ID NO: 113980 - DNA, 25 bp, Homo sapien
ttattaggtcagaggatcaaggtta

SEQ ID NO: 113981 - DNA, 25 bp, Homo sapien
ttattagtgatcagcacttatgagt

SEQ ID NO: 113982 - DNA, 25 bp, Homo sapien
ttattagtgatcggcacttatgagt

SEQ ID NO: 113983 - DNA, 25 bp, Homo sapien
ttattataagacttagcgtggcaac

SEQ ID NO: 113984 - DNA, 25 bp, Homo sapien
ttattataagacttagtgtggcaac

SEQ ID NO: 113985 - DNA, 25 bp, Homo sapien
ttattatccttccaaaaatagacac

SEQ ID NO: 113986 - DNA, 25 bp, Homo sapien
ttattatcgttccaaaaatagacac

SEQ ID NO: 113987 - DNA, 25 bp, Homo sapien
ttattatcttacagtttcagagaca

SEQ ID NO: 113988 - DNA, 25 bp, Homo sapien
ttattatcttatagtttcagagaca

SEQ ID NO: 113989 - DNA, 25 bp, Homo sapien
ttattatgaagctaaaacctgggtc

SEQ ID NO: 113990 - DNA, 25 bp, Homo sapien
ttattatgaggctaaaacctgggtc

SEQ ID NO: 113991 - DNA, 25 bp, Homo sapien
ttattatgatccatctttatgaata

SEQ ID NO: 113992 - DNA, 25 bp, Homo sapien
ttattatgatccatgtttatgaata

SEQ ID NO: 113993 - DNA, 25 bp, Homo sapien
ttattcaaacgactggttggggtgc

SEQ ID NO: 113994 - DNA, 25 bp, Homo sapien
ttattcaaagccaacctgcacatta

SEQ ID NO: 113995 - DNA, 25 bp, Homo sapien
ttattcaaagccaatctgcacatta

SEQ ID NO: 113996 - DNA, 25 bp, Homo sapien
ttattcaaatcagtgagttcaaaaa

SEQ ID NO: 113997 - DNA, 25 bp, Homo sapien
ttattcaaatctgtgagttcaaaaa

SEQ ID NO: 113998 - DNA, 25 bp, Homo sapien
ttattcaaatgactggttggggtgc

SEQ ID NO: 113999 - DNA, 25 bp, Homo sapien
ttattcacaatacccaatatatgaa

SEQ ID NO: 114000 - DNA, 25 bp, Homo sapien
ttattcacaatgtgagactcgcttt

SEQ ID NO: 114001 - DNA, 25 bp, Homo sapien
ttattcacaatttgagactcgcttt

SEQ ID NO: 114002 - DNA, 25 bp, Homo sapien
ttattcacagtacccaatatatgaa

SEQ ID NO: 114003 - DNA, 25 bp, Homo sapien
ttattcacagtgaaatgctgacagg

SEQ ID NO: 114004 - DNA, 25 bp, Homo sapien
ttattcacagttaaatgctgacagg

SEQ ID NO: 114005 - DNA, 25 bp, Homo sapien
ttattcacatgtaatctcgtaatta

SEQ ID NO: 114006 - DNA, 25 bp, Homo sapien
ttattcacgtgtaatctcgtaatta

SEQ ID NO: 114007 - DNA, 25 bp, Homo sapien
ttattcatgcaattcctgacaatgt

SEQ ID NO: 114008 - DNA, 25 bp, Homo sapien
ttattcatgcagttcctgacaatgt

SEQ ID NO: 114009 - DNA, 25 bp, Homo sapien
ttattccagaagcactcataatggg

SEQ ID NO: 114010 - DNA, 25 bp, Homo sapien
ttattccagaagtactcataatggg

SEQ ID NO: 114011 - DNA, 25 bp, Homo sapien
ttattccagcccatgatgttggaga

SEQ ID NO: 114012 - DNA, 25 bp, Homo sapien
ttattccagcccgtgatgttggaga

SEQ ID NO: 114013 - DNA, 25 bp, Homo sapien
ttattccatgcaagaccatacaagt

SEQ ID NO: 114014 - DNA, 25 bp, Homo sapien
ttattccatgcacgaccatacaagt

SEQ ID NO: 114015 - DNA, 25 bp, Homo sapien
ttattcccattgttggtttaggcag

SEQ ID NO: 114016 - DNA, 25 bp, Homo sapien
ttattcccgttgttggtttaggcag

SEQ ID NO: 114017 - DNA, 25 bp, Homo sapien
ttattccctatactcttcctctctc

SEQ ID NO: 114018 - DNA, 25 bp, Homo sapien
ttattccctatagtcttcctctctc

SEQ ID NO: 114019 - DNA, 25 bp, Homo sapien
ttattcctacgtgtttcttttatgt

SEQ ID NO: 114020 - DNA, 25 bp, Homo sapien
ttattcctatggctccaaaggtctt

SEQ ID NO: 114021 - DNA, 25 bp, Homo sapien
ttattcctatggcttcaaaggtctt

SEQ ID NO: 114022 - DNA, 25 bp, Homo sapien
ttattcctatgtgtttcttttatgt

SEQ ID NO: 114023 - DNA, 25 bp, Homo sapien
ttattcctcagctatgacattctaa

SEQ ID NO: 114024 - DNA, 25 bp, Homo sapien
ttattcctcagctgtgacattctaa

SEQ ID NO: 114025 - DNA, 25 bp, Homo sapien
ttattctagtcatgattgcagctga

SEQ ID NO: 114026 - DNA, 25 bp, Homo sapien
ttattctagtcgtgattgcagctga

SEQ ID NO: 114027 - DNA, 25 bp, Homo sapien
ttattctcaccacaacaatttttcc

SEQ ID NO: 114028 - DNA, 25 bp, Homo sapien
ttattctcaccacagcaatttttcc

SEQ ID NO: 114029 - DNA, 25 bp, Homo sapien
ttattctgcttaatgggtcgcttgt

SEQ ID NO: 114030 - DNA, 25 bp, Homo sapien
ttattctgtttaatgggtcgcttgt

SEQ ID NO: 114031 - DNA, 25 bp, Homo sapien
ttattgaacatgcactgaatttaca

SEQ ID NO: 114032 - DNA, 25 bp, Homo sapien
ttattgaacatgcgctgaatttaca

SEQ ID NO: 114033 - DNA, 25 bp, Homo sapien
ttattgaattaatagaaccatgact

SEQ ID NO: 114034 - DNA, 25 bp, Homo sapien
ttattgaattaatagatccatgact

SEQ ID NO: 114035 - DNA, 25 bp, Homo sapien
ttattgagagttgttcattggaaaa

SEQ ID NO: 114036 - DNA, 25 bp, Homo sapien
ttattgaggcctgtataacattcta

SEQ ID NO: 114037 - DNA, 25 bp, Homo sapien
ttattgagggttgttcattggaaaa

SEQ ID NO: 114038 - DNA, 25 bp, Homo sapien
ttattgaggtcaaatgaactgtcag

SEQ ID NO: 114039 - DNA, 25 bp, Homo sapien
ttattgaggtcaactgaactgtcag

SEQ ID NO: 114040 - DNA, 25 bp, Homo sapien
ttattgaggtctgtataacattcta

SEQ ID NO: 114041 - DNA, 25 bp, Homo sapien
ttattgagtacctattgatatgtgt

SEQ ID NO: 114042 - DNA, 25 bp, Homo sapien
ttattgagtacctgttgatatgtgt

SEQ ID NO: 114043 - DNA, 25 bp, Homo sapien
ttattgatacagggcaaagaatcgg

SEQ ID NO: 114044 - DNA, 25 bp, Homo sapien
ttattgatagagggcaaagaatcgg

SEQ ID NO: 114045 - DNA, 25 bp, Homo sapien
ttattgattccacaccacttactga

SEQ ID NO: 114046 - DNA, 25 bp, Homo sapien
ttattgatttcacaccacttactga

SEQ ID NO: 114047 - DNA, 25 bp, Homo sapien
ttattgctaaaagcccagacatttt

SEQ ID NO: 114048 - DNA, 25 bp, Homo sapien
ttattgctaaaagcccggacatttt

SEQ ID NO: 114049 - DNA, 25 bp, Homo sapien
ttattgctttttcatgggaatgtag

SEQ ID NO: 114050 - DNA, 25 bp, Homo sapien
ttattgctttttcgtgggaatgtag

SEQ ID NO: 114051 - DNA, 25 bp, Homo sapien
ttattggaaatgtagtccttgtcct

SEQ ID NO: 114052 - DNA, 25 bp, Homo sapien
ttattggagatgtagtccttgtcct

SEQ ID NO: 114053 - DNA, 25 bp, Homo sapien
ttattggagttcttgcatttaagcc

SEQ ID NO: 114054 - DNA, 25 bp, Homo sapien
ttattggagttcttgcgtttaagcc

SEQ ID NO: 114055 - DNA, 25 bp, Homo sapien
ttattgggatgaccccttgaataag

SEQ ID NO: 114056 - DNA, 25 bp, Homo sapien
ttattgggatgcccccttgaataag

SEQ ID NO: 114057 - DNA, 25 bp, Homo sapien
ttattggtagtaagccagacactga

SEQ ID NO: 114058 - DNA, 25 bp, Homo sapien
ttattggtgcacggtagtatgaaat

SEQ ID NO: 114059 - DNA, 25 bp, Homo sapien
ttattggtgtacggtagtatgaaat

SEQ ID NO: 114060 - DNA, 25 bp, Homo sapien
ttattggttgtaagccagacactga

SEQ ID NO: 114061 - DNA, 25 bp, Homo sapien
ttattgtatccagtctgataggtgt

SEQ ID NO: 114062 - DNA, 25 bp, Homo sapien
ttattgtatccattctgataggtgt

SEQ ID NO: 114063 - DNA, 25 bp, Homo sapien
ttattgtattgcaatttcctggctt

SEQ ID NO: 114064 - DNA, 25 bp, Homo sapien
ttattgtattgccatttcctggctt

SEQ ID NO: 114065 - DNA, 25 bp, Homo sapien
ttattgtccatctcctctgccattc

SEQ ID NO: 114066 - DNA, 25 bp, Homo sapien
ttattgtccgtctcctctgccattc

SEQ ID NO: 114067 - DNA, 25 bp, Homo sapien
ttattgtctcttcccatacctctta

SEQ ID NO: 114068 - DNA, 25 bp, Homo sapien
ttattgtctcttctcatacctctta

SEQ ID NO: 114069 - DNA, 25 bp, Homo sapien
ttattgtctgtacaacccagcacat

SEQ ID NO: 114070 - DNA, 25 bp, Homo sapien
ttattgtctgtaccacccagcacat

SEQ ID NO: 114071 - DNA, 25 bp, Homo sapien
ttattgtgaatactacataagtgag

SEQ ID NO: 114072 - DNA, 25 bp, Homo sapien
ttattgtgaatattacataagtgag

SEQ ID NO: 114073 - DNA, 25 bp, Homo sapien
ttattgtgagcagtaggtcttgaaa

SEQ ID NO: 114074 - DNA, 25 bp, Homo sapien
ttattgtgagcggtaggtcttgaaa

SEQ ID NO: 114075 - DNA, 25 bp, Homo sapien
ttattgtgcaagactgccctgtgcc

SEQ ID NO: 114076 - DNA, 25 bp, Homo sapien
ttattgtgtaagactgccctgtgcc

SEQ ID NO: 114077 - DNA, 25 bp, Homo sapien
ttattgttggagagaaaggttacag

SEQ ID NO: 114078 - DNA, 25 bp, Homo sapien
ttattgttggagcgaaaggttacag

SEQ ID NO: 114079 - DNA, 25 bp, Homo sapien
ttatttaaccttactaagccttttt

SEQ ID NO: 114080 - DNA, 25 bp, Homo sapien
ttatttaaccttcctaagccttttt

SEQ ID NO: 114081 - DNA, 25 bp, Homo sapien
ttatttaagcctcagttcctatatc

SEQ ID NO: 114082 - DNA, 25 bp, Homo sapien
ttatttaagccttagttcctatatc

SEQ ID NO: 114083 - DNA, 25 bp, Homo sapien
ttatttacaagcgattagtttgctg

SEQ ID NO: 114084 - DNA, 25 bp, Homo sapien
ttatttacaagtgattagtttgctg

SEQ ID NO: 114085 - DNA, 25 bp, Homo sapien
ttatttacacaccgatggatttggc

SEQ ID NO: 114086 - DNA, 25 bp, Homo sapien
ttatttacacaccgttggatttggc

SEQ ID NO: 114087 - DNA, 25 bp, Homo sapien
ttatttaccaaataccacatataca

SEQ ID NO: 114088 - DNA, 25 bp, Homo sapien
ttatttaccaaatatcacatataca

SEQ ID NO: 114089 - DNA, 25 bp, Homo sapien
ttatttagaaaactcaactatcacc

SEQ ID NO: 114090 - DNA, 25 bp, Homo sapien
ttatttagaaaattcaactatcacc

SEQ ID NO: 114091 - DNA, 25 bp, Homo sapien
ttatttataagccatataattttgc

SEQ ID NO: 114092 - DNA, 25 bp, Homo sapien
ttatttataagtcatataattttgc

SEQ ID NO: 114093 - DNA, 25 bp, Homo sapien
ttatttatccgacatttttcttttt

SEQ ID NO: 114094 - DNA, 25 bp, Homo sapien
ttatttatctgacatttttcttttt

SEQ ID NO: 114095 - DNA, 25 bp, Homo sapien
ttatttattctcgtggatggtctaa

SEQ ID NO: 114096 - DNA, 25 bp, Homo sapien
ttatttattcttgtggatggtctaa

SEQ ID NO: 114097 - DNA, 25 bp, Homo sapien
ttatttattttcctgtatcagtgtg

SEQ ID NO: 114098 - DNA, 25 bp, Homo sapien
ttatttattttggcaattattggag

SEQ ID NO: 114099 - DNA, 25 bp, Homo sapien
ttatttattttggtaattattggag

SEQ ID NO: 114100 - DNA, 25 bp, Homo sapien
ttatttatttttctgtatcagtgtg

SEQ ID NO: 114101 - DNA, 25 bp, Homo sapien
ttatttcaaaaactgcattttcctt

SEQ ID NO: 114102 - DNA, 25 bp, Homo sapien
ttatttcaacaactgcattttcctt

SEQ ID NO: 114103 - DNA, 25 bp, Homo sapien
ttatttcaagtataagagagatgta

SEQ ID NO: 114104 - DNA, 25 bp, Homo sapien
ttatttcaagtatgagagagatgta

SEQ ID NO: 114105 - DNA, 25 bp, Homo sapien
ttatttcacactgtatacaagattc

SEQ ID NO: 114106 - DNA, 25 bp, Homo sapien
ttatttcaccactgtactgaatctc

SEQ ID NO: 114107 - DNA, 25 bp, Homo sapien
ttatttcactgatgctttatccccg

SEQ ID NO: 114108 - DNA, 25 bp, Homo sapien
ttatttcagatacattgtgaagaaa

SEQ ID NO: 114109 - DNA, 25 bp, Homo sapien
ttatttcagatagattgtgaagaaa

SEQ ID NO: 114110 - DNA, 25 bp, Homo sapien
ttatttcatactgtatacaagattc

SEQ ID NO: 114111 - DNA, 25 bp, Homo sapien
ttatttcatcactgtactgaatctc

SEQ ID NO: 114112 - DNA, 25 bp, Homo sapien
ttatttcatcagtccctgttagctc

SEQ ID NO: 114113 - DNA, 25 bp, Homo sapien
ttatttcatcagttcctgttagctc

SEQ ID NO: 114114 - DNA, 25 bp, Homo sapien
ttatttcatgctgacgaacgtttga

SEQ ID NO: 114115 - DNA, 25 bp, Homo sapien
ttatttcatgctgatgaacgtttga

SEQ ID NO: 114116 - DNA, 25 bp, Homo sapien
ttatttcattgatgctttatccccg

SEQ ID NO: 114117 - DNA, 25 bp, Homo sapien
ttatttccaaacttcacgatcgggt

SEQ ID NO: 114118 - DNA, 25 bp, Homo sapien
ttatttccaaacttcatgatcgggt

SEQ ID NO: 114119 - DNA, 25 bp, Homo sapien
ttatttccatcattccattgtgtca

SEQ ID NO: 114120 - DNA, 25 bp, Homo sapien
ttatttccatctttccattgtgtca

SEQ ID NO: 114121 - DNA, 25 bp, Homo sapien
ttatttccatttaccaagttttagg

SEQ ID NO: 114122 - DNA, 25 bp, Homo sapien
ttatttccatttatcaagttttagg

SEQ ID NO: 114123 - DNA, 25 bp, Homo sapien
ttatttcccaatcttatagacaatg

SEQ ID NO: 114124 - DNA, 25 bp, Homo sapien
ttatttcccaatgttatagacaatg

SEQ ID NO: 114125 - DNA, 25 bp, Homo sapien
ttatttgaatgttctctcccttttt

SEQ ID NO: 114126 - DNA, 25 bp, Homo sapien
ttatttgaattattccagtccatag

SEQ ID NO: 114127 - DNA, 25 bp, Homo sapien
ttatttgaattattgcagtccatag

SEQ ID NO: 114128 - DNA, 25 bp, Homo sapien
ttatttgactttctagcagtagcat

SEQ ID NO: 114129 - DNA, 25 bp, Homo sapien
ttatttgactttctagtagtagcat

SEQ ID NO: 114130 - DNA, 25 bp, Homo sapien
ttatttgagtgttctctcccttttt

SEQ ID NO: 114131 - DNA, 25 bp, Homo sapien
ttatttgatccatgtgttacttaga

SEQ ID NO: 114132 - DNA, 25 bp, Homo sapien
ttatttgattcatgtgttacttaga

SEQ ID NO: 114133 - DNA, 25 bp, Homo sapien
ttatttgattgtattgtcttagatg

SEQ ID NO: 114134 - DNA, 25 bp, Homo sapien
ttatttgattgtgttgtcttagatg

SEQ ID NO: 114135 - DNA, 25 bp, Homo sapien
ttatttgctgtaaattcctttcagg

SEQ ID NO: 114136 - DNA, 25 bp, Homo sapien
ttatttgctgtaaatttctttcagg

SEQ ID NO: 114137 - DNA, 25 bp, Homo sapien
ttatttggatcaaccctcagaacac

SEQ ID NO: 114138 - DNA, 25 bp, Homo sapien
ttatttggatcaactctcagaacac

SEQ ID NO: 114139 - DNA, 25 bp, Homo sapien
ttatttgtaatcaagagtggccgct

SEQ ID NO: 114140 - DNA, 25 bp, Homo sapien
ttatttgtacactgggcctttgctc

SEQ ID NO: 114141 - DNA, 25 bp, Homo sapien
ttatttgtagaactgaggtaataat

SEQ ID NO: 114142 - DNA, 25 bp, Homo sapien
ttatttgtagaattgaggtaataat

SEQ ID NO: 114143 - DNA, 25 bp, Homo sapien
ttatttgtagactgggcctttgctc

SEQ ID NO: 114144 - DNA, 25 bp, Homo sapien
ttatttgtagtcaagagtggccgct

SEQ ID NO: 114145 - DNA, 25 bp, Homo sapien
ttatttgtcaagtattaaaggcccc

SEQ ID NO: 114146 - DNA, 25 bp, Homo sapien
ttatttgttaagtattaaaggcccc

SEQ ID NO: 114147 - DNA, 25 bp, Homo sapien
ttatttgttcattaaggtgattatt

SEQ ID NO: 114148 - DNA, 25 bp, Homo sapien
ttatttgttcattagggtgattatt

SEQ ID NO: 114149 - DNA, 25 bp, Homo sapien
ttattttaagtatgtgcagattcaa

SEQ ID NO: 114150 - DNA, 25 bp, Homo sapien
ttattttaagtatgtgtagattcaa

SEQ ID NO: 114151 - DNA, 25 bp, Homo sapien
ttattttacagagtagccttgtgtt

SEQ ID NO: 114152 - DNA, 25 bp, Homo sapien
ttattttacagagtaggcttgtgtt

SEQ ID NO: 114153 - DNA, 25 bp, Homo sapien
ttattttacggtatctgcaggtttt

SEQ ID NO: 114154 - DNA, 25 bp, Homo sapien
ttattttagcagtacgaaacagact

SEQ ID NO: 114155 - DNA, 25 bp, Homo sapien
ttattttagcagtatgaaacagact

SEQ ID NO: 114156 - DNA, 25 bp, Homo sapien
ttattttatgagcgcatgatatctg

SEQ ID NO: 114157 - DNA, 25 bp, Homo sapien
ttattttatgagtgcatgatatctg

SEQ ID NO: 114158 - DNA, 25 bp, Homo sapien
ttattttatggtatctgcaggtttt

SEQ ID NO: 114159 - DNA, 25 bp, Homo sapien
ttattttattggccatctctctgac

SEQ ID NO: 114160 - DNA, 25 bp, Homo sapien
ttattttattggccgtctctctgac

SEQ ID NO: 114161 - DNA, 25 bp, Homo sapien
ttattttcatctacaaatggaacaa

SEQ ID NO: 114162 - DNA, 25 bp, Homo sapien
ttattttcatctacgaatggaacaa

SEQ ID NO: 114163 - DNA, 25 bp, Homo sapien
ttattttccacataaatccatcaaa

SEQ ID NO: 114164 - DNA, 25 bp, Homo sapien
ttattttccacgtaaatccatcaaa

SEQ ID NO: 114165 - DNA, 25 bp, Homo sapien
ttattttccattcccattcttattt

SEQ ID NO: 114166 - DNA, 25 bp, Homo sapien
ttattttccgttcccattcttattt

SEQ ID NO: 114167 - DNA, 25 bp, Homo sapien
ttattttccttctattgaattgttt

SEQ ID NO: 114168 - DNA, 25 bp, Homo sapien
ttattttcttccgacctcatatctc

SEQ ID NO: 114169 - DNA, 25 bp, Homo sapien
ttattttcttctgacctcatatctc

SEQ ID NO: 114170 - DNA, 25 bp, Homo sapien
ttattttctttctattgaattgttt

SEQ ID NO: 114171 - DNA, 25 bp, Homo sapien
ttattttgacgaatctccaaaggtg

SEQ ID NO: 114172 - DNA, 25 bp, Homo sapien
ttattttgactttcccattgcagtg

SEQ ID NO: 114173 - DNA, 25 bp, Homo sapien
ttattttgactttcccgttgcagtg

SEQ ID NO: 114174 - DNA, 25 bp, Homo sapien
ttattttgatacagattacaattac

SEQ ID NO: 114175 - DNA, 25 bp, Homo sapien
ttattttgatagagattacaattac

SEQ ID NO: 114176 - DNA, 25 bp, Homo sapien
ttattttgatgaatctccaaaggtg

SEQ ID NO: 114177 - DNA, 25 bp, Homo sapien
ttattttggcaattattggagagat

SEQ ID NO: 114178 - DNA, 25 bp, Homo sapien
ttattttggctcatgcttctacaaa

SEQ ID NO: 114179 - DNA, 25 bp, Homo sapien
ttattttggcttatgcttctacaaa

SEQ ID NO: 114180 - DNA, 25 bp, Homo sapien
ttattttggtaattattggagagat

SEQ ID NO: 114181 - DNA, 25 bp, Homo sapien
ttatttttaatagagctcaacatta

SEQ ID NO: 114182 - DNA, 25 bp, Homo sapien
ttatttttagtagagctcaacatta

SEQ ID NO: 114183 - DNA, 25 bp, Homo sapien
ttatttttctgtttatttaaggctg

SEQ ID NO: 114184 - DNA, 25 bp, Homo sapien
ttatttttctgtttgtttaaggctg

SEQ ID NO: 114185 - DNA, 25 bp, Homo sapien
ttatttttgccaacatttaagggag

SEQ ID NO: 114186 - DNA, 25 bp, Homo sapien
ttatttttgccaacgtttaagggag

SEQ ID NO: 114187 - DNA, 25 bp, Homo sapien
ttatttttgcctcagtttatattag

SEQ ID NO: 114188 - DNA, 25 bp, Homo sapien
ttatttttgcctcattttatattag

SEQ ID NO: 114189 - DNA, 25 bp, Homo sapien
ttatttttgctgaaggaatttttat

SEQ ID NO: 114190 - DNA, 25 bp, Homo sapien
ttatttttgctggaggaatttttat

SEQ ID NO: 114191 - DNA, 25 bp, Homo sapien
ttattttttggcattcatttccctt

SEQ ID NO: 114192 - DNA, 25 bp, Homo sapien
ttattttttggcattcgtttccctt

SEQ ID NO: 114193 - DNA, 25 bp, Homo sapien
ttatttttttaaggcaagtatttta

SEQ ID NO: 114194 - DNA, 25 bp, Homo sapien
ttatttttttaatgcaagtatttta

SEQ ID NO: 114195 - DNA, 25 bp, Homo sapien
ttatttttttgcagagatggcttca

SEQ ID NO: 114196 - DNA, 25 bp, Homo sapien
ttatttttttgccgagatggcttca

SEQ ID NO: 114197 - DNA, 25 bp, Homo sapien
ttcaaaaaacggtcagctgatcgaa

SEQ ID NO: 114198 - DNA, 25 bp, Homo sapien
ttcaaaaaatggtcagctgatcgaa

SEQ ID NO: 114199 - DNA, 25 bp, Homo sapien
ttcaaaaacatattaaccaggtgca

SEQ ID NO: 114200 - DNA, 25 bp, Homo sapien
ttcaaaaacatattaagcaggtgca

SEQ ID NO: 114201 - DNA, 25 bp, Homo sapien
ttcaaaaagaagcagtagatgatta

SEQ ID NO: 114202 - DNA, 25 bp, Homo sapien
ttcaaaaagaagtagtagatgatta

SEQ ID NO: 114203 - DNA, 25 bp, Homo sapien
ttcaaaaataaacatatatgccatg

SEQ ID NO: 114204 - DNA, 25 bp, Homo sapien
ttcaaaaataaacgtatatgccatg

SEQ ID NO: 114205 - DNA, 25 bp, Homo sapien
ttcaaaaatcagtcgggtgcagtga

SEQ ID NO: 114206 - DNA, 25 bp, Homo sapien
ttcaaaaatgtgtctgcaaatataa

SEQ ID NO: 114207 - DNA, 25 bp, Homo sapien
ttcaaaaatgtgtctggaaatataa

SEQ ID NO: 114208 - DNA, 25 bp, Homo sapien
ttcaaaaattagtcgggtgcagtga

SEQ ID NO: 114209 - DNA, 25 bp, Homo sapien
ttcaaaacaataaacgcatctcttt

SEQ ID NO: 114210 - DNA, 25 bp, Homo sapien
ttcaaaacaataaatgcatctcttt

SEQ ID NO: 114211 - DNA, 25 bp, Homo sapien
ttcaaaacatctgcattaagttatt

SEQ ID NO: 114212 - DNA, 25 bp, Homo sapien
ttcaaaaccaaaatgctattcctaa

SEQ ID NO: 114213 - DNA, 25 bp, Homo sapien
ttcaaaacctatttcaaaacctaca

SEQ ID NO: 114214 - DNA, 25 bp, Homo sapien
ttcaaaacgtctgcattaagttatt

SEQ ID NO: 114215 - DNA, 25 bp, Homo sapien
ttcaaaactaaaatgctattcctaa

SEQ ID NO: 114216 - DNA, 25 bp, Homo sapien
ttcaaaacttatttcaaaacctaca

SEQ ID NO: 114217 - DNA, 25 bp, Homo sapien
ttcaaaaggatacgcactggctttt

SEQ ID NO: 114218 - DNA, 25 bp, Homo sapien
ttcaaaaggatatgcactggctttt

SEQ ID NO: 114219 - DNA, 25 bp, Homo sapien
ttcaaaagtgctaagaatataaata

SEQ ID NO: 114220 - DNA, 25 bp, Homo sapien
ttcaaaagtgctaggaatataaata

SEQ ID NO: 114221 - DNA, 25 bp, Homo sapien
ttcaaaatatgtcaaagaaatacac

SEQ ID NO: 114222 - DNA, 25 bp, Homo sapien
ttcaaaatatgtcaaataaatacac

SEQ ID NO: 114223 - DNA, 25 bp, Homo sapien
ttcaaaatgattgttacagccaatg

SEQ ID NO: 114224 - DNA, 25 bp, Homo sapien
ttcaaaatgattgttatagccaatg

SEQ ID NO: 114225 - DNA, 25 bp, Homo sapien
ttcaaaatgccctttgcaatgatct

SEQ ID NO: 114226 - DNA, 25 bp, Homo sapien
ttcaaaatgtcctttgcaatgatct

SEQ ID NO: 114227 - DNA, 25 bp, Homo sapien
ttcaaaattatctgcacgatggaaa

SEQ ID NO: 114228 - DNA, 25 bp, Homo sapien
ttcaaaattatctgcatgatggaaa

SEQ ID NO: 114229 - DNA, 25 bp, Homo sapien
ttcaaaattttcaagatggctttga

SEQ ID NO: 114230 - DNA, 25 bp, Homo sapien
ttcaaaattttgaagatggctttga

SEQ ID NO: 114231 - DNA, 25 bp, Homo sapien
ttcaaacaatattccacttttacct

SEQ ID NO: 114232 - DNA, 25 bp, Homo sapien
ttcaaacaatattcgacttttacct

SEQ ID NO: 114233 - DNA, 25 bp, Homo sapien
ttcaaacactgacattggtgctaga

SEQ ID NO: 114234 - DNA, 25 bp, Homo sapien
ttcaaacactgacgttggtgctaga

SEQ ID NO: 114235 - DNA, 25 bp, Homo sapien
ttcaaacagagaatcagaatcacca

SEQ ID NO: 114236 - DNA, 25 bp, Homo sapien
ttcaaacagggaatcagaatcacca

SEQ ID NO: 114237 - DNA, 25 bp, Homo sapien
ttcaaaccaaaagcttaatcttcaa

SEQ ID NO: 114238 - DNA, 25 bp, Homo sapien
ttcaaaccaatatcacaaatggatg

SEQ ID NO: 114239 - DNA, 25 bp, Homo sapien
ttcaaaccagtatcacaaatggatg

SEQ ID NO: 114240 - DNA, 25 bp, Homo sapien
ttcaaaccgaaagcttaatcttcaa

SEQ ID NO: 114241 - DNA, 25 bp, Homo sapien
ttcaaacgatactataaggcactag

SEQ ID NO: 114242 - DNA, 25 bp, Homo sapien
ttcaaacgatactgtaaggcactag

SEQ ID NO: 114243 - DNA, 25 bp, Homo sapien
ttcaaacgccttcgtggtgcttcca

SEQ ID NO: 114244 - DNA, 25 bp, Homo sapien
ttcaaacgccttcttggtgcttcca

SEQ ID NO: 114245 - DNA, 25 bp, Homo sapien
ttcaaacgtattctcacctacagaa

SEQ ID NO: 114246 - DNA, 25 bp, Homo sapien
ttcaaacgtattctcatctacagaa

SEQ ID NO: 114247 - DNA, 25 bp, Homo sapien
ttcaaagaattagccattgatacaa

SEQ ID NO: 114248 - DNA, 25 bp, Homo sapien
ttcaaagaattagtcattgatacaa

SEQ ID NO: 114249 - DNA, 25 bp, Homo sapien
ttcaaagatatacgcatgagatgtt

SEQ ID NO: 114250 - DNA, 25 bp, Homo sapien
ttcaaagatggcatagctgatagat

SEQ ID NO: 114251 - DNA, 25 bp, Homo sapien
ttcaaagatggcgtagctgatagat

SEQ ID NO: 114252 - DNA, 25 bp, Homo sapien
ttcaaagatgtacgcatgagatgtt

SEQ ID NO: 114253 - DNA, 25 bp, Homo sapien
ttcaaagcacggatttcaagcaagc

SEQ ID NO: 114254 - DNA, 25 bp, Homo sapien
ttcaaagcatggatttcaagcaagc

SEQ ID NO: 114255 - DNA, 25 bp, Homo sapien
ttcaaagccagctcatagacagtat

SEQ ID NO: 114256 - DNA, 25 bp, Homo sapien
ttcaaagccagctcgtagacagtat

SEQ ID NO: 114257 - DNA, 25 bp, Homo sapien
ttcaaaggagcagcaccatcctctt

SEQ ID NO: 114258 - DNA, 25 bp, Homo sapien
ttcaaaggagcggcaccatcctctt

SEQ ID NO: 114259 - DNA, 25 bp, Homo sapien
ttcaaaggccagggcgatccaagct

SEQ ID NO: 114260 - DNA, 25 bp, Homo sapien
ttcaaaggccagggtgatccaagct

SEQ ID NO: 114261 - DNA, 25 bp, Homo sapien
ttcaaagtacatgtaacatttatca

SEQ ID NO: 114262 - DNA, 25 bp, Homo sapien
ttcaaagtatatgtaacatttatca

SEQ ID NO: 114263 - DNA, 25 bp, Homo sapien
ttcaaataaaaagtgatgtagatag

SEQ ID NO: 114264 - DNA, 25 bp, Homo sapien
ttcaaataaaatataatctgtgtat

SEQ ID NO: 114265 - DNA, 25 bp, Homo sapien
ttcaaataaaatatgatctgtgtat

SEQ ID NO: 114266 - DNA, 25 bp, Homo sapien
ttcaaataactgggatcgtgcatca

SEQ ID NO: 114267 - DNA, 25 bp, Homo sapien
ttcaaataactgggattgtgcatca

SEQ ID NO: 114268 - DNA, 25 bp, Homo sapien
ttcaaataatgccaggaaatgcatt

SEQ ID NO: 114269 - DNA, 25 bp, Homo sapien
ttcaaataatgtcaggaaatgcatt

SEQ ID NO: 114270 - DNA, 25 bp, Homo sapien
ttcaaatacaaagtgatgtagatag

SEQ ID NO: 114271 - DNA, 25 bp, Homo sapien
ttcaaatacaaatcgacaatccaga

SEQ ID NO: 114272 - DNA, 25 bp, Homo sapien
ttcaaatacaaattgacaatccaga

SEQ ID NO: 114273 - DNA, 25 bp, Homo sapien
ttcaaatacagagaggccctctctg

SEQ ID NO: 114274 - DNA, 25 bp, Homo sapien
ttcaaatacgttgtcatctcccctt

SEQ ID NO: 114275 - DNA, 25 bp, Homo sapien
ttcaaatagagagaggccctctctg

SEQ ID NO: 114276 - DNA, 25 bp, Homo sapien
ttcaaatatattaaacacagcaatt

SEQ ID NO: 114277 - DNA, 25 bp, Homo sapien
ttcaaatatattaaccacagcaatt

SEQ ID NO: 114278 - DNA, 25 bp, Homo sapien
ttcaaatatgttgtcatctcccctt

SEQ ID NO: 114279 - DNA, 25 bp, Homo sapien
ttcaaatattgaataacacatgaca

SEQ ID NO: 114280 - DNA, 25 bp, Homo sapien
ttcaaatattgactaacacatgaca

SEQ ID NO: 114281 - DNA, 25 bp, Homo sapien
ttcaaatatttaaaaaaatctcagc

SEQ ID NO: 114282 - DNA, 25 bp, Homo sapien
ttcaaatattttaaaaaatctcagc

SEQ ID NO: 114283 - DNA, 25 bp, Homo sapien
ttcaaatcagtgagttcaaaaaaat

SEQ ID NO: 114284 - DNA, 25 bp, Homo sapien
ttcaaatcatgactttgccaattac

SEQ ID NO: 114285 - DNA, 25 bp, Homo sapien
ttcaaatccacattccacttaatat

SEQ ID NO: 114286 - DNA, 25 bp, Homo sapien
ttcaaatccactttccacttaatat

SEQ ID NO: 114287 - DNA, 25 bp, Homo sapien
ttcaaatcgtgactttgccaattac

SEQ ID NO: 114288 - DNA, 25 bp, Homo sapien
ttcaaatctgtgagttcaaaaaaat

SEQ ID NO: 114289 - DNA, 25 bp, Homo sapien
ttcaaatcttaaggcagcattttct

SEQ ID NO: 114290 - DNA, 25 bp, Homo sapien
ttcaaatcttaagtcagcattttct

SEQ ID NO: 114291 - DNA, 25 bp, Homo sapien
ttcaaatgcaccttccagaatgtag

SEQ ID NO: 114292 - DNA, 25 bp, Homo sapien
ttcaaatgcactttccagaatgtag

SEQ ID NO: 114293 - DNA, 25 bp, Homo sapien
ttcaaatggcatgcccacttagtaa

SEQ ID NO: 114294 - DNA, 25 bp, Homo sapien
ttcaaatggcatgccctcttagtaa

SEQ ID NO: 114295 - DNA, 25 bp, Homo sapien
ttcaaattcccagaagaccttacta

SEQ ID NO: 114296 - DNA, 25 bp, Homo sapien
ttcaaatttccagaagaccttacta

SEQ ID NO: 114297 - DNA, 25 bp, Homo sapien
ttcaaatttgctgatactttcttcc

SEQ ID NO: 114298 - DNA, 25 bp, Homo sapien
ttcaaatttgctgatattttcttcc

SEQ ID NO: 114299 - DNA, 25 bp, Homo sapien
ttcaacaaaatggcaccgagagaac

SEQ ID NO: 114300 - DNA, 25 bp, Homo sapien
ttcaacaaaatggcactgagagaac

SEQ ID NO: 114301 - DNA, 25 bp, Homo sapien
ttcaacaaatcaaacggtttattcc

SEQ ID NO: 114302 - DNA, 25 bp, Homo sapien
ttcaacaaatcaaatggtttattcc

SEQ ID NO: 114303 - DNA, 25 bp, Homo sapien
ttcaacaacagtttattcaaaagtt

SEQ ID NO: 114304 - DNA, 25 bp, Homo sapien
ttcaacaacagtttgttcaaaagtt

SEQ ID NO: 114305 - DNA, 25 bp, Homo sapien
ttcaacaacggctaaaaacatataa

SEQ ID NO: 114306 - DNA, 25 bp, Homo sapien
ttcaacaactaaagtaggtgatcct

SEQ ID NO: 114307 - DNA, 25 bp, Homo sapien
ttcaacaactaaggtaggtgatcct

SEQ ID NO: 114308 - DNA, 25 bp, Homo sapien
ttcaacaagggctaaaaacatataa

SEQ ID NO: 114309 - DNA, 25 bp, Homo sapien
ttcaacaataccagtagcaagtcag

SEQ ID NO: 114310 - DNA, 25 bp, Homo sapien
ttcaacaataccagtatcaagtcag

SEQ ID NO: 114311 - DNA, 25 bp, Homo sapien
ttcaacaataggatttactagaatt

SEQ ID NO: 114312 - DNA, 25 bp, Homo sapien
ttcaacaataggatttcctagaatt

SEQ ID NO: 114313 - DNA, 25 bp, Homo sapien
ttcaacaatgttacataaaaggaat

SEQ ID NO: 114314 - DNA, 25 bp, Homo sapien
ttcaacaatgttacgtaaaaggaat

SEQ ID NO: 114315 - DNA, 25 bp, Homo sapien
ttcaacaatttttaaatcagggttt

SEQ ID NO: 114316 - DNA, 25 bp, Homo sapien
ttcaacaattttttaatcagggttt

SEQ ID NO: 114317 - DNA, 25 bp, Homo sapien
ttcaacacatgcactgcacacatgc

SEQ ID NO: 114318 - DNA, 25 bp, Homo sapien
ttcaacacatgcgctgcacacatgc

SEQ ID NO: 114319 - DNA, 25 bp, Homo sapien
ttcaacataaaaccttgaagcaaac

SEQ ID NO: 114320 - DNA, 25 bp, Homo sapien
ttcaacatataaccttgaagcaaac

SEQ ID NO: 114321 - DNA, 25 bp, Homo sapien
ttcaacccatgcctatggaatttca

SEQ ID NO: 114322 - DNA, 25 bp, Homo sapien
ttcaacccatgcttatggaatttca

SEQ ID NO: 114323 - DNA, 25 bp, Homo sapien
ttcaaccttcgctttctggccttga

SEQ ID NO: 114324 - DNA, 25 bp, Homo sapien
ttcaaccttggctttctggccttga

SEQ ID NO: 114325 - DNA, 25 bp, Homo sapien
ttcaacgaataaatagatggatctt

SEQ ID NO: 114326 - DNA, 25 bp, Homo sapien
ttcaacgaataaatggatggatctt

SEQ ID NO: 114327 - DNA, 25 bp, Homo sapien
ttcaacgacttaaaatcatctgcat

SEQ ID NO: 114328 - DNA, 25 bp, Homo sapien
ttcaacgacttacaatcatctgcat

SEQ ID NO: 114329 - DNA, 25 bp, Homo sapien
ttcaacggagtttgagacaaaagct

SEQ ID NO: 114330 - DNA, 25 bp, Homo sapien
ttcaacggagtttgggacaaaagct

SEQ ID NO: 114331 - DNA, 25 bp, Homo sapien
ttcaactaatccctaacctttctat

SEQ ID NO: 114332 - DNA, 25 bp, Homo sapien
ttcaactaatgaaggccagaagcca

SEQ ID NO: 114333 - DNA, 25 bp, Homo sapien
ttcaactaatggaggccagaagcca

SEQ ID NO: 114334 - DNA, 25 bp, Homo sapien
ttcaactagtccctaacctttctat

SEQ ID NO: 114335 - DNA, 25 bp, Homo sapien
ttcaagaaaggagtaaacggtcctt

SEQ ID NO: 114336 - DNA, 25 bp, Homo sapien
ttcaagaaaggagtaagcggtcctt

SEQ ID NO: 114337 - DNA, 25 bp, Homo sapien
ttcaagaatcctcatacaaattgtc

SEQ ID NO: 114338 - DNA, 25 bp, Homo sapien
ttcaagaatcctcgtacaaattgtc

SEQ ID NO: 114339 - DNA, 25 bp, Homo sapien
ttcaagacacatttaagagataaga

SEQ ID NO: 114340 - DNA, 25 bp, Homo sapien
ttcaagacagatttaagagataaga

SEQ ID NO: 114341 - DNA, 25 bp, Homo sapien
ttcaagactctcttctcttttatag

SEQ ID NO: 114342 - DNA, 25 bp, Homo sapien
ttcaagactctcttctgttttatag

SEQ ID NO: 114343 - DNA, 25 bp, Homo sapien
ttcaagaggaacgcataaataggtc

SEQ ID NO: 114344 - DNA, 25 bp, Homo sapien
ttcaagaggaatgcataaataggtc

SEQ ID NO: 114345 - DNA, 25 bp, Homo sapien
ttcaagagttcacacaagtattaag

SEQ ID NO: 114346 - DNA, 25 bp, Homo sapien
ttcaagagttcacgcaagtattaag

SEQ ID NO: 114347 - DNA, 25 bp, Homo sapien
ttcaagattaggcatctgcatttgg

SEQ ID NO: 114348 - DNA, 25 bp, Homo sapien
ttcaagattaggcttctgcatttgg

SEQ ID NO: 114349 - DNA, 25 bp, Homo sapien
ttcaagcaagaggtgagagctggtt

SEQ ID NO: 114350 - DNA, 25 bp, Homo sapien
ttcaagcaagagttgagagctggtt

SEQ ID NO: 114351 - DNA, 25 bp, Homo sapien
ttcaagcacttcaaacttcataaac

SEQ ID NO: 114352 - DNA, 25 bp, Homo sapien
ttcaagcactttaaacttcataaac

SEQ ID NO: 114353 - DNA, 25 bp, Homo sapien
ttcaagcccttacgaacaaaagatg

SEQ ID NO: 114354 - DNA, 25 bp, Homo sapien
ttcaagcccttactaacaaaagatg

SEQ ID NO: 114355 - DNA, 25 bp, Homo sapien
ttcaagctcttcaggaccaagcctg

SEQ ID NO: 114356 - DNA, 25 bp, Homo sapien
ttcaagctcttcgggaccaagcctg

SEQ ID NO: 114357 - DNA, 25 bp, Homo sapien
ttcaagcttttgctatgaggcaata

SEQ ID NO: 114358 - DNA, 25 bp, Homo sapien
ttcaagcttttgctattaggcaata

SEQ ID NO: 114359 - DNA, 25 bp, Homo sapien
ttcaagtaaggtcactccagaaagt

SEQ ID NO: 114360 - DNA, 25 bp, Homo sapien
ttcaagtaaggtgactccagaaagt

SEQ ID NO: 114361 - DNA, 25 bp, Homo sapien
ttcaagtagtcgataattggacctg

SEQ ID NO: 114362 - DNA, 25 bp, Homo sapien
ttcaagtagtcggtaattggacctg

SEQ ID NO: 114363 - DNA, 25 bp, Homo sapien
ttcaagtcaacattatttattcact

SEQ ID NO: 114364 - DNA, 25 bp, Homo sapien
ttcaagtcaacattgtttattcact

SEQ ID NO: 114365 - DNA, 25 bp, Homo sapien
ttcaagtgggaataacaatgcccat

SEQ ID NO: 114366 - DNA, 25 bp, Homo sapien
ttcaagtgggaatagcaatgcccat

SEQ ID NO: 114367 - DNA, 25 bp, Homo sapien
ttcaagtttccatttgtattctggt

SEQ ID NO: 114368 - DNA, 25 bp, Homo sapien
ttcaagtttccgtttgtattctggt

SEQ ID NO: 114369 - DNA, 25 bp, Homo sapien
ttcaatacaaacttattgagcaatg

SEQ ID NO: 114370 - DNA, 25 bp, Homo sapien
ttcaatacaaatttattgagcaatg

SEQ ID NO: 114371 - DNA, 25 bp, Homo sapien
ttcaatacaggactgaaggacaaac

SEQ ID NO: 114372 - DNA, 25 bp, Homo sapien
ttcaatacagggctgaaggacaaac

SEQ ID NO: 114373 - DNA, 25 bp, Homo sapien
ttcaatagaaaagccaatcctttaa

SEQ ID NO: 114374 - DNA, 25 bp, Homo sapien
ttcaatagaaaagtcaatcctttaa

SEQ ID NO: 114375 - DNA, 25 bp, Homo sapien
ttcaatagctaatttttactcactt

SEQ ID NO: 114376 - DNA, 25 bp, Homo sapien
ttcaatagctattttttactcactt

SEQ ID NO: 114377 - DNA, 25 bp, Homo sapien
ttcaatatacgtttgttgattaaga

SEQ ID NO: 114378 - DNA, 25 bp, Homo sapien
ttcaatatatgtttgttgattaaga

SEQ ID NO: 114379 - DNA, 25 bp, Homo sapien
ttcaatatcattgttcatcattcaa

SEQ ID NO: 114380 - DNA, 25 bp, Homo sapien
ttcaatatcgttgttcatcattcaa

SEQ ID NO: 114381 - DNA, 25 bp, Homo sapien
ttcaatcagggcacgatctgtctcc

SEQ ID NO: 114382 - DNA, 25 bp, Homo sapien
ttcaatcagggcaggatctgtctcc

SEQ ID NO: 114383 - DNA, 25 bp, Homo sapien
ttcaatccagcaatcccactactag

SEQ ID NO: 114384 - DNA, 25 bp, Homo sapien
ttcaatccggcaatcccactactag

SEQ ID NO: 114385 - DNA, 25 bp, Homo sapien
ttcaatctccatacaaatgagaact

SEQ ID NO: 114386 - DNA, 25 bp, Homo sapien
ttcaatctctatacaaatgagaact

SEQ ID NO: 114387 - DNA, 25 bp, Homo sapien
ttcaatgaaattcagaagatgtaag

SEQ ID NO: 114388 - DNA, 25 bp, Homo sapien
ttcaatgaaattcggaagatgtaag

SEQ ID NO: 114389 - DNA, 25 bp, Homo sapien
ttcaatgaacttgacctttagtgca

SEQ ID NO: 114390 - DNA, 25 bp, Homo sapien
ttcaatgaagttgacctttagtgca

SEQ ID NO: 114391 - DNA, 25 bp, Homo sapien
ttcaatgagtgttggtggatccaag

SEQ ID NO: 114392 - DNA, 25 bp, Homo sapien
ttcaatgagtgttggttgatccaag

SEQ ID NO: 114393 - DNA, 25 bp, Homo sapien
ttcaatgcactgtattggatttcta

SEQ ID NO: 114394 - DNA, 25 bp, Homo sapien
ttcaatgcataacatattttcaaat

SEQ ID NO: 114395 - DNA, 25 bp, Homo sapien
ttcaatgcgctgtattggatttcta

SEQ ID NO: 114396 - DNA, 25 bp, Homo sapien
ttcaatgcgtaacatattttcaaat

SEQ ID NO: 114397 - DNA, 25 bp, Homo sapien
ttcaatggatgtcaactttttctgc

SEQ ID NO: 114398 - DNA, 25 bp, Homo sapien
ttcaatggatgttaactttttctgc

SEQ ID NO: 114399 - DNA, 25 bp, Homo sapien
ttcaatgtccatattcctacccaca

SEQ ID NO: 114400 - DNA, 25 bp, Homo sapien
ttcaatgttcatattcctacccaca

SEQ ID NO: 114401 - DNA, 25 bp, Homo sapien
ttcaattacttattgtgcacaacca

SEQ ID NO: 114402 - DNA, 25 bp, Homo sapien
ttcaattataacccaacctactaat

SEQ ID NO: 114403 - DNA, 25 bp, Homo sapien
ttcaattataactcaacctactaat

SEQ ID NO: 114404 - DNA, 25 bp, Homo sapien
ttcaattatgaaatctgtggagctt

SEQ ID NO: 114405 - DNA, 25 bp, Homo sapien
ttcaattatgaaatttgtggagctt

SEQ ID NO: 114406 - DNA, 25 bp, Homo sapien
ttcaattatttattgtgcacaacca

SEQ ID NO: 114407 - DNA, 25 bp, Homo sapien
ttcaattcatgcttcgttgaatcca

SEQ ID NO: 114408 - DNA, 25 bp, Homo sapien
ttcaattcatgcttggttgaatcca

SEQ ID NO: 114409 - DNA, 25 bp, Homo sapien
ttcaattctttcgggtaaatactca

SEQ ID NO: 114410 - DNA, 25 bp, Homo sapien
ttcaattcttttgggtaaatactca

SEQ ID NO: 114411 - DNA, 25 bp, Homo sapien
ttcaatttccgtacttccaccagag

SEQ ID NO: 114412 - DNA, 25 bp, Homo sapien
ttcaatttctgtacttccaccagag

SEQ ID NO: 114413 - DNA, 25 bp, Homo sapien
ttcaattttttaaagacatgttcaa

SEQ ID NO: 114414 - DNA, 25 bp, Homo sapien
ttcaattttttaaggacatgttcaa

SEQ ID NO: 114415 - DNA, 25 bp, Homo sapien
ttcacaaactagagcaatttgagat

SEQ ID NO: 114416 - DNA, 25 bp, Homo sapien
ttcacaaactagagcactttgagat

SEQ ID NO: 114417 - DNA, 25 bp, Homo sapien
ttcacaaataacataaacaagttag

SEQ ID NO: 114418 - DNA, 25 bp, Homo sapien
ttcacaaataagataaacaagttag

SEQ ID NO: 114419 - DNA, 25 bp, Homo sapien
ttcacaaattgggtcgctgaaaaca

SEQ ID NO: 114420 - DNA, 25 bp, Homo sapien
ttcacaaattgggtggctgaaaaca

SEQ ID NO: 114421 - DNA, 25 bp, Homo sapien
ttcacaactacagagtaacctagat

SEQ ID NO: 114422 - DNA, 25 bp, Homo sapien
ttcacaactactagggtggctgtaa

SEQ ID NO: 114423 - DNA, 25 bp, Homo sapien
ttcacaactgcagagtaacctagat

SEQ ID NO: 114424 - DNA, 25 bp, Homo sapien
ttcacaactgctagggtggctgtaa

SEQ ID NO: 114425 - DNA, 25 bp, Homo sapien
ttcacaacttacatcggttttcaga

SEQ ID NO: 114426 - DNA, 25 bp, Homo sapien
ttcacaacttacattggttttcaga

SEQ ID NO: 114427 - DNA, 25 bp, Homo sapien
ttcacaagtgaagttgctgtcaggt

SEQ ID NO: 114428 - DNA, 25 bp, Homo sapien
ttcacaagtgaagttggtgtcaggt

SEQ ID NO: 114429 - DNA, 25 bp, Homo sapien
ttcacaatgtcatagaatgctaaat

SEQ ID NO: 114430 - DNA, 25 bp, Homo sapien
ttcacaatgtcgtagaatgctaaat

SEQ ID NO: 114431 - DNA, 25 bp, Homo sapien
ttcacaatgtgagactcgctttgct

SEQ ID NO: 114432 - DNA, 25 bp, Homo sapien
ttcacaatttgagactcgctttgct

SEQ ID NO: 114433 - DNA, 25 bp, Homo sapien
ttcacacaaatctaaattttattac

SEQ ID NO: 114434 - DNA, 25 bp, Homo sapien
ttcacacaacttcctccggaaacac

SEQ ID NO: 114435 - DNA, 25 bp, Homo sapien
ttcacacaacttcctctggaaacac

SEQ ID NO: 114436 - DNA, 25 bp, Homo sapien
ttcacacaagtctaaattttattac

SEQ ID NO: 114437 - DNA, 25 bp, Homo sapien
ttcacacattgacggacattcaggt

SEQ ID NO: 114438 - DNA, 25 bp, Homo sapien
ttcacacattgatggacattcaggt

SEQ ID NO: 114439 - DNA, 25 bp, Homo sapien
ttcacaccataaaatgatacattct

SEQ ID NO: 114440 - DNA, 25 bp, Homo sapien
ttcacaccataagatgatacattct

SEQ ID NO: 114441 - DNA, 25 bp, Homo sapien
ttcacactagacgtgcctccaccct

SEQ ID NO: 114442 - DNA, 25 bp, Homo sapien
ttcacactagatgtgcctccaccct

SEQ ID NO: 114443 - DNA, 25 bp, Homo sapien
ttcacactagttattggactatctg

SEQ ID NO: 114444 - DNA, 25 bp, Homo sapien
ttcacactatttattggactatctg

SEQ ID NO: 114445 - DNA, 25 bp, Homo sapien
ttcacactcccacgtccattcagca

SEQ ID NO: 114446 - DNA, 25 bp, Homo sapien
ttcacactcccacttccattcagca

SEQ ID NO: 114447 - DNA, 25 bp, Homo sapien
ttcacagaagaacaaccacagatgc

SEQ ID NO: 114448 - DNA, 25 bp, Homo sapien
ttcacagaagaacaactacagatgc

SEQ ID NO: 114449 - DNA, 25 bp, Homo sapien
ttcacagccttagaaatgagatgtt

SEQ ID NO: 114450 - DNA, 25 bp, Homo sapien
ttcacagctaattgactagtgacta

SEQ ID NO: 114451 - DNA, 25 bp, Homo sapien
ttcacagctaatttactagtgacta

SEQ ID NO: 114452 - DNA, 25 bp, Homo sapien
ttcacagctttagaaatgagatgtt

SEQ ID NO: 114453 - DNA, 25 bp, Homo sapien
ttcacaggtaaatgaaaggaaatca

SEQ ID NO: 114454 - DNA, 25 bp, Homo sapien
ttcacaggtgaatgaaaggaaatca

SEQ ID NO: 114455 - DNA, 25 bp, Homo sapien
ttcacagtcgaattgttcataatag

SEQ ID NO: 114456 - DNA, 25 bp, Homo sapien
ttcacagtctaattgttcataatag

SEQ ID NO: 114457 - DNA, 25 bp, Homo sapien
ttcacagtttttatctatctgaagt

SEQ ID NO: 114458 - DNA, 25 bp, Homo sapien
ttcacagtttttgtctatctgaagt

SEQ ID NO: 114459 - DNA, 25 bp, Homo sapien
ttcacataaaagcacacgagaccat

SEQ ID NO: 114460 - DNA, 25 bp, Homo sapien
ttcacataaaagtacacgagaccat

SEQ ID NO: 114461 - DNA, 25 bp, Homo sapien
ttcacataatgtaccattccatttt

SEQ ID NO: 114462 - DNA, 25 bp, Homo sapien
ttcacataatgtactattccatttt

SEQ ID NO: 114463 - DNA, 25 bp, Homo sapien
ttcacatacatgccataagtccctg

SEQ ID NO: 114464 - DNA, 25 bp, Homo sapien
ttcacatacgtgccataagtccctg

SEQ ID NO: 114465 - DNA, 25 bp, Homo sapien
ttcacattcatcacagtaatgacaa

SEQ ID NO: 114466 - DNA, 25 bp, Homo sapien
ttcacattcatcacggtaatgacaa

SEQ ID NO: 114467 - DNA, 25 bp, Homo sapien
ttcacattgctttccactcatcaaa

SEQ ID NO: 114468 - DNA, 25 bp, Homo sapien
ttcacattgttttccactcatcaaa

SEQ ID NO: 114469 - DNA, 25 bp, Homo sapien
ttcacatttccctggcttgatttct

SEQ ID NO: 114470 - DNA, 25 bp, Homo sapien
ttcacatttccgacaaagttcttcc

SEQ ID NO: 114471 - DNA, 25 bp, Homo sapien
ttcacatttccggcaaagttcttcc

SEQ ID NO: 114472 - DNA, 25 bp, Homo sapien
ttcacatttccgtggcttgatttct

SEQ ID NO: 114473 - DNA, 25 bp, Homo sapien
ttcacatttcctcatagtttcacca

SEQ ID NO: 114474 - DNA, 25 bp, Homo sapien
ttcacatttccttatagtttcacca

SEQ ID NO: 114475 - DNA, 25 bp, Homo sapien
ttcacatttttcacatttgattttg

SEQ ID NO: 114476 - DNA, 25 bp, Homo sapien
ttcacatttttcagatttgattttg

SEQ ID NO: 114477 - DNA, 25 bp, Homo sapien
ttcaccaaatcctaacagcagaact

SEQ ID NO: 114478 - DNA, 25 bp, Homo sapien
ttcaccaaatcctagcagcagaact

SEQ ID NO: 114479 - DNA, 25 bp, Homo sapien
ttcaccaacacgtttgccctgtatg

SEQ ID NO: 114480 - DNA, 25 bp, Homo sapien
ttcaccaacccgtttgccctgtatg

SEQ ID NO: 114481 - DNA, 25 bp, Homo sapien
ttcaccagccagacatcgtcacctc

SEQ ID NO: 114482 - DNA, 25 bp, Homo sapien
ttcaccagctagacatcgtcacctc

SEQ ID NO: 114483 - DNA, 25 bp, Homo sapien
ttcaccagtaatatctaaactatgc

SEQ ID NO: 114484 - DNA, 25 bp, Homo sapien
ttcaccagtaatatttaaactatgc

SEQ ID NO: 114485 - DNA, 25 bp, Homo sapien
ttcaccataacagtgttgggcttcc

SEQ ID NO: 114486 - DNA, 25 bp, Homo sapien
ttcaccataacattgttgggcttcc

SEQ ID NO: 114487 - DNA, 25 bp, Homo sapien
ttcaccataagcgtgcatgcagtta

SEQ ID NO: 114488 - DNA, 25 bp, Homo sapien
ttcaccataggcgtgcatgcagtta

SEQ ID NO: 114489 - DNA, 25 bp, Homo sapien
ttcaccatccctagacatcctgaca

SEQ ID NO: 114490 - DNA, 25 bp, Homo sapien
ttcaccatccctagacgtcctgaca

SEQ ID NO: 114491 - DNA, 25 bp, Homo sapien
ttcaccattatagcttgattatttg

SEQ ID NO: 114492 - DNA, 25 bp, Homo sapien
ttcaccattataggttgattatttg

SEQ ID NO: 114493 - DNA, 25 bp, Homo sapien
ttcaccctaaccttttattcaagcc

SEQ ID NO: 114494 - DNA, 25 bp, Homo sapien
ttcaccctaacgttttattcaagcc

SEQ ID NO: 114495 - DNA, 25 bp, Homo sapien
ttcaccctgtgttagacagcccagg

SEQ ID NO: 114496 - DNA, 25 bp, Homo sapien
ttcaccctgtgtttgacagcccagg

SEQ ID NO: 114497 - DNA, 25 bp, Homo sapien
ttcaccgtggacccttcatgttaat

SEQ ID NO: 114498 - DNA, 25 bp, Homo sapien
ttcaccgtggacctttcatgttaat

SEQ ID NO: 114499 - DNA, 25 bp, Homo sapien
ttcacctaataaacctgtcctactc

SEQ ID NO: 114500 - DNA, 25 bp, Homo sapien
ttcacctaataagcctgtcctactc

SEQ ID NO: 114501 - DNA, 25 bp, Homo sapien
ttcacctaattctcgtcaggccagt

SEQ ID NO: 114502 - DNA, 25 bp, Homo sapien
ttcacctaattcttgtcaggccagt

SEQ ID NO: 114503 - DNA, 25 bp, Homo sapien
ttcacctcttcatcattcagaattt

SEQ ID NO: 114504 - DNA, 25 bp, Homo sapien
ttcacctcttcttcattcagaattt

SEQ ID NO: 114505 - DNA, 25 bp, Homo sapien
ttcacctgaatggcatggctttcca

SEQ ID NO: 114506 - DNA, 25 bp, Homo sapien
ttcacctgaatggcgtggctttcca

SEQ ID NO: 114507 - DNA, 25 bp, Homo sapien
ttcacctgccttgctagctgcattt

SEQ ID NO: 114508 - DNA, 25 bp, Homo sapien
ttcacctgccttgttagctgcattt

SEQ ID NO: 114509 - DNA, 25 bp, Homo sapien
ttcacctgctggataattgtaacat

SEQ ID NO: 114510 - DNA, 25 bp, Homo sapien
ttcacctgctggctaattgtaacat

SEQ ID NO: 114511 - DNA, 25 bp, Homo sapien
ttcacctgggttatctcattcgatc

SEQ ID NO: 114512 - DNA, 25 bp, Homo sapien
ttcacctgtcgataacatttgcatt

SEQ ID NO: 114513 - DNA, 25 bp, Homo sapien
ttcacctgtcgatagcatttgcatt

SEQ ID NO: 114514 - DNA, 25 bp, Homo sapien
ttcacctgtgttatctcattcgatc

SEQ ID NO: 114515 - DNA, 25 bp, Homo sapien
ttcaccttgactatatggcattatg

SEQ ID NO: 114516 - DNA, 25 bp, Homo sapien
ttcaccttgtctatatggcattatg

SEQ ID NO: 114517 - DNA, 25 bp, Homo sapien
ttcacctttcttcgtgtacctgctg

SEQ ID NO: 114518 - DNA, 25 bp, Homo sapien
ttcacctttctttgtgtacctgctg

SEQ ID NO: 114519 - DNA, 25 bp, Homo sapien
ttcacgcctcactgccccacttctc

SEQ ID NO: 114520 - DNA, 25 bp, Homo sapien
ttcacgcctcattgccccacttctc

SEQ ID NO: 114521 - DNA, 25 bp, Homo sapien
ttcacgctaaaactgagattctttc

SEQ ID NO: 114522 - DNA, 25 bp, Homo sapien
ttcacgctaaaattgagattctttc

SEQ ID NO: 114523 - DNA, 25 bp, Homo sapien
ttcacgctgattattcatcctacgt

SEQ ID NO: 114524 - DNA, 25 bp, Homo sapien
ttcacgctgattattcttcctacgt

SEQ ID NO: 114525 - DNA, 25 bp, Homo sapien
ttcacggaggacaccaccctgaaag

SEQ ID NO: 114526 - DNA, 25 bp, Homo sapien
ttcacggaggacaccatcctgaaag

SEQ ID NO: 114527 - DNA, 25 bp, Homo sapien
ttcacgtctgtgctcctggttaggt

SEQ ID NO: 114528 - DNA, 25 bp, Homo sapien
ttcacgtctgtgttcctggttaggt

SEQ ID NO: 114529 - DNA, 25 bp, Homo sapien
ttcacgtgatcaagcatcatagtcc

SEQ ID NO: 114530 - DNA, 25 bp, Homo sapien
ttcacgtgatcaagtatcatagtcc

SEQ ID NO: 114531 - DNA, 25 bp, Homo sapien
ttcacgtgccactgtttccaaatat

SEQ ID NO: 114532 - DNA, 25 bp, Homo sapien
ttcacgtgtacataggcatacccac

SEQ ID NO: 114533 - DNA, 25 bp, Homo sapien
ttcacgtgtacattggcatacccac

SEQ ID NO: 114534 - DNA, 25 bp, Homo sapien
ttcacgtgtcactgtttccaaatat

SEQ ID NO: 114535 - DNA, 25 bp, Homo sapien
ttcactaaaaccttcaatgaagaaa

SEQ ID NO: 114536 - DNA, 25 bp, Homo sapien
ttcactaaaaccttcattgaagaaa

SEQ ID NO: 114537 - DNA, 25 bp, Homo sapien
ttcactaatatctgattttcccttt

SEQ ID NO: 114538 - DNA, 25 bp, Homo sapien
ttcactaatatttgattttcccttt

SEQ ID NO: 114539 - DNA, 25 bp, Homo sapien
ttcactaatcgagttgggctatttc

SEQ ID NO: 114540 - DNA, 25 bp, Homo sapien
ttcactaattgagttgggctatttc

SEQ ID NO: 114541 - DNA, 25 bp, Homo sapien
ttcactacaaaagattgaagcaaaa

SEQ ID NO: 114542 - DNA, 25 bp, Homo sapien
ttcactacaaaggattgaagcaaaa

SEQ ID NO: 114543 - DNA, 25 bp, Homo sapien
ttcactaggtctgcagtagaggctg

SEQ ID NO: 114544 - DNA, 25 bp, Homo sapien
ttcactaggtctgcggtagaggctg

SEQ ID NO: 114545 - DNA, 25 bp, Homo sapien
ttcactcacactcttctgtccaatt

SEQ ID NO: 114546 - DNA, 25 bp, Homo sapien
ttcactcacgctcttctgtccaatt

SEQ ID NO: 114547 - DNA, 25 bp, Homo sapien
ttcactcactccgaaacatgctgga

SEQ ID NO: 114548 - DNA, 25 bp, Homo sapien
ttcactcactctgaaacatgctgga

SEQ ID NO: 114549 - DNA, 25 bp, Homo sapien
ttcactcagataatcatagtgcccc

SEQ ID NO: 114550 - DNA, 25 bp, Homo sapien
ttcactcagatagtcatagtgcccc

SEQ ID NO: 114551 - DNA, 25 bp, Homo sapien
ttcactcatttttaatattttttcc

SEQ ID NO: 114552 - DNA, 25 bp, Homo sapien
ttcactcatttttaatgttttttcc

SEQ ID NO: 114553 - DNA, 25 bp, Homo sapien
ttcactctaccaaaaaaaggcaaaa

SEQ ID NO: 114554 - DNA, 25 bp, Homo sapien
ttcactctaccaacaaaaggcaaaa

SEQ ID NO: 114555 - DNA, 25 bp, Homo sapien
ttcactcttgaataactaataggag

SEQ ID NO: 114556 - DNA, 25 bp, Homo sapien
ttcactcttgaatcactaataggag

SEQ ID NO: 114557 - DNA, 25 bp, Homo sapien
ttcactgataaacagactcacctgt

SEQ ID NO: 114558 - DNA, 25 bp, Homo sapien
ttcactgataaatagactcacctgt

SEQ ID NO: 114559 - DNA, 25 bp, Homo sapien
ttcactgcatactactgatctttaa

SEQ ID NO: 114560 - DNA, 25 bp, Homo sapien
ttcactgcatactattgatctttaa

SEQ ID NO: 114561 - DNA, 25 bp, Homo sapien
ttcactgccttcattgctatccgac

SEQ ID NO: 114562 - DNA, 25 bp, Homo sapien
ttcactgccttcgttgctatccgac

SEQ ID NO: 114563 - DNA, 25 bp, Homo sapien
ttcactgcgtgcacaccgggctctg

SEQ ID NO: 114564 - DNA, 25 bp, Homo sapien
ttcactgcgtgcacactgggctctg

SEQ ID NO: 114565 - DNA, 25 bp, Homo sapien
ttcactggacttattttgctatagt

SEQ ID NO: 114566 - DNA, 25 bp, Homo sapien
ttcactggatgaattttgggtttta

SEQ ID NO: 114567 - DNA, 25 bp, Homo sapien
ttcactgggcttattttgctatagt

SEQ ID NO: 114568 - DNA, 25 bp, Homo sapien
ttcactggttgaattttgggtttta

SEQ ID NO: 114569 - DNA, 25 bp, Homo sapien
ttcactgtaatgcatttatcacaaa

SEQ ID NO: 114570 - DNA, 25 bp, Homo sapien
ttcactgtaatgcgtttatcacaaa

SEQ ID NO: 114571 - DNA, 25 bp, Homo sapien
ttcactgtgaaatttgatgatactt

SEQ ID NO: 114572 - DNA, 25 bp, Homo sapien
ttcactgtgaacacgtttcttgtgt

SEQ ID NO: 114573 - DNA, 25 bp, Homo sapien
ttcactgtgaacatgtttcttgtgt

SEQ ID NO: 114574 - DNA, 25 bp, Homo sapien
ttcactgtggaatttgatgatactt

SEQ ID NO: 114575 - DNA, 25 bp, Homo sapien
ttcacttaacaacgtcttttgcaga

SEQ ID NO: 114576 - DNA, 25 bp, Homo sapien
ttcacttaacaatgtcttttgcaga

SEQ ID NO: 114577 - DNA, 25 bp, Homo sapien
ttcacttaactcctttcggatgtca

SEQ ID NO: 114578 - DNA, 25 bp, Homo sapien
ttcacttaactccttttggatgtca

SEQ ID NO: 114579 - DNA, 25 bp, Homo sapien
ttcacttacacaaaaaatttcgcag

SEQ ID NO: 114580 - DNA, 25 bp, Homo sapien
ttcacttacacagaaaatttcgcag

SEQ ID NO: 114581 - DNA, 25 bp, Homo sapien
ttcacttcaccaacacgtttgccct

SEQ ID NO: 114582 - DNA, 25 bp, Homo sapien
ttcacttcaccaacccgtttgccct

SEQ ID NO: 114583 - DNA, 25 bp, Homo sapien
ttcacttgtcttcaatttagaaagc

SEQ ID NO: 114584 - DNA, 25 bp, Homo sapien
ttcacttgtcttccatttagaaagc

SEQ ID NO: 114585 - DNA, 25 bp, Homo sapien
ttcactttcatatcaaatatatcac

SEQ ID NO: 114586 - DNA, 25 bp, Homo sapien
ttcactttcatgtcaaatatatcac

SEQ ID NO: 114587 - DNA, 25 bp, Homo sapien
ttcactttccggtcttgttatattt

SEQ ID NO: 114588 - DNA, 25 bp, Homo sapien
ttcactttctggtcttgttatattt

SEQ ID NO: 114589 - DNA, 25 bp, Homo sapien
ttcactttcttaacagtgttttttg

SEQ ID NO: 114590 - DNA, 25 bp, Homo sapien
ttcactttcttaacggtgttttttg

SEQ ID NO: 114591 - DNA, 25 bp, Homo sapien
ttcacttttaaggagtttctgtatt

SEQ ID NO: 114592 - DNA, 25 bp, Homo sapien
ttcacttttaagtagtttctgtatt

SEQ ID NO: 114593 - DNA, 25 bp, Homo sapien
ttcacttttgcagaataatttcgca

SEQ ID NO: 114594 - DNA, 25 bp, Homo sapien
ttcacttttgcggaataatttcgca

SEQ ID NO: 114595 - DNA, 25 bp, Homo sapien
ttcagaaaaaaacctgaggagagaa

SEQ ID NO: 114596 - DNA, 25 bp, Homo sapien
ttcagaaaaaaatctgaggagagaa

SEQ ID NO: 114597 - DNA, 25 bp, Homo sapien
ttcagaaaatctgggataaataatt

SEQ ID NO: 114598 - DNA, 25 bp, Homo sapien
ttcagaaaatcttggataaataatt

SEQ ID NO: 114599 - DNA, 25 bp, Homo sapien
ttcagaaacacagcgagtggccctg

SEQ ID NO: 114600 - DNA, 25 bp, Homo sapien
ttcagaaacacagtgagtggccctg

SEQ ID NO: 114601 - DNA, 25 bp, Homo sapien
ttcagaaagacagaacagagaaaat

SEQ ID NO: 114602 - DNA, 25 bp, Homo sapien
ttcagaaagacggaacagagaaaat

SEQ ID NO: 114603 - DNA, 25 bp, Homo sapien
ttcagaaagcagtaccttttccata

SEQ ID NO: 114604 - DNA, 25 bp, Homo sapien
ttcagaaagcattaccttttccata

SEQ ID NO: 114605 - DNA, 25 bp, Homo sapien
ttcagaaagcttctttcagtttggc

SEQ ID NO: 114606 - DNA, 25 bp, Homo sapien
ttcagaaagcttgtttcagtttggc

SEQ ID NO: 114607 - DNA, 25 bp, Homo sapien
ttcagaaaggacccaatgtctcttt

SEQ ID NO: 114608 - DNA, 25 bp, Homo sapien
ttcagaaaggatccaatgtctcttt

SEQ ID NO: 114609 - DNA, 25 bp, Homo sapien
ttcagaagaaaactttccagcaagt

SEQ ID NO: 114610 - DNA, 25 bp, Homo sapien
ttcagaagaaacctttccagcaagt

SEQ ID NO: 114611 - DNA, 25 bp, Homo sapien
ttcagaagatctcgtttaaacttcc

SEQ ID NO: 114612 - DNA, 25 bp, Homo sapien
ttcagaagattcttgcactcaacca

SEQ ID NO: 114613 - DNA, 25 bp, Homo sapien
ttcagaagattcttgccctcaacca

SEQ ID NO: 114614 - DNA, 25 bp, Homo sapien
ttcagaagctacggtacatttctat

SEQ ID NO: 114615 - DNA, 25 bp, Homo sapien
ttcagaagctacggtatatttctat

SEQ ID NO: 114616 - DNA, 25 bp, Homo sapien
ttcagaaggtctcgtttaaacttcc

SEQ ID NO: 114617 - DNA, 25 bp, Homo sapien
ttcagaatgggccaagcttaggtaa

SEQ ID NO: 114618 - DNA, 25 bp, Homo sapien
ttcagaatgggtcaagcttaggtaa

SEQ ID NO: 114619 - DNA, 25 bp, Homo sapien
ttcagaattaagcatagtagatatg

SEQ ID NO: 114620 - DNA, 25 bp, Homo sapien
ttcagaattaagcgtagtagatatg

SEQ ID NO: 114621 - DNA, 25 bp, Homo sapien
ttcagaattacggtgttgttagaag

SEQ ID NO: 114622 - DNA, 25 bp, Homo sapien
ttcagaattacggttttgttagaag

SEQ ID NO: 114623 - DNA, 25 bp, Homo sapien
ttcagacaaactgatgcacaaaacc

SEQ ID NO: 114624 - DNA, 25 bp, Homo sapien
ttcagacaaactgatggacaaaacc

SEQ ID NO: 114625 - DNA, 25 bp, Homo sapien
ttcagacataaacaacataagcaca

SEQ ID NO: 114626 - DNA, 25 bp, Homo sapien
ttcagacataaacgacataagcaca

SEQ ID NO: 114627 - DNA, 25 bp, Homo sapien
ttcagagaacgatttcttaagcact

SEQ ID NO: 114628 - DNA, 25 bp, Homo sapien
ttcagagaatgatttcttaagcact

SEQ ID NO: 114629 - DNA, 25 bp, Homo sapien
ttcagagacaacaaggcctatagta

SEQ ID NO: 114630 - DNA, 25 bp, Homo sapien
ttcagagacaactaggcctatagta

SEQ ID NO: 114631 - DNA, 25 bp, Homo sapien
ttcagagagcgtctaccctcaagtt

SEQ ID NO: 114632 - DNA, 25 bp, Homo sapien
ttcagagagtgtctaccctcaagtt

SEQ ID NO: 114633 - DNA, 25 bp, Homo sapien
ttcagagcattagatacaaagaggc

SEQ ID NO: 114634 - DNA, 25 bp, Homo sapien
ttcagagcattagatagaaagaggc

SEQ ID NO: 114635 - DNA, 25 bp, Homo sapien
ttcagagctgcatttacctcccatt

SEQ ID NO: 114636 - DNA, 25 bp, Homo sapien
ttcagagcttcatttacctcccatt

SEQ ID NO: 114637 - DNA, 25 bp, Homo sapien
ttcagaggaggtatcaaaaagtctg

SEQ ID NO: 114638 - DNA, 25 bp, Homo sapien
ttcagaggatgtatcaaaaagtctg

SEQ ID NO: 114639 - DNA, 25 bp, Homo sapien
ttcagaggcgctgacacatgctcac

SEQ ID NO: 114640 - DNA, 25 bp, Homo sapien
ttcagaggctattacgaacagcact

SEQ ID NO: 114641 - DNA, 25 bp, Homo sapien
ttcagaggctattatgaacagcact

SEQ ID NO: 114642 - DNA, 25 bp, Homo sapien
ttcagaggtgctgacacatgctcac

SEQ ID NO: 114643 - DNA, 25 bp, Homo sapien
ttcagagtcgctctttgaccatcta

SEQ ID NO: 114644 - DNA, 25 bp, Homo sapien
ttcagagttgctctttgaccatcta

SEQ ID NO: 114645 - DNA, 25 bp, Homo sapien
ttcagataaaacatttggaaagtga

SEQ ID NO: 114646 - DNA, 25 bp, Homo sapien
ttcagataaaacattttgaaagtga

SEQ ID NO: 114647 - DNA, 25 bp, Homo sapien
ttcagatacacatgaagatttccat

SEQ ID NO: 114648 - DNA, 25 bp, Homo sapien
ttcagatagctcttggtctccaatg

SEQ ID NO: 114649 - DNA, 25 bp, Homo sapien
ttcagatagctgttggtctccaatg

SEQ ID NO: 114650 - DNA, 25 bp, Homo sapien
ttcagatagttgcagagaggtggag

SEQ ID NO: 114651 - DNA, 25 bp, Homo sapien
ttcagatagttgtagagaggtggag

SEQ ID NO: 114652 - DNA, 25 bp, Homo sapien
ttcagatatacatgaagatttccat

SEQ ID NO: 114653 - DNA, 25 bp, Homo sapien
ttcagatctccacgtcctactaaga

SEQ ID NO: 114654 - DNA, 25 bp, Homo sapien
ttcagatctccatgtcctactaaga

SEQ ID NO: 114655 - DNA, 25 bp, Homo sapien
ttcagatgaaacgaatcactctaac

SEQ ID NO: 114656 - DNA, 25 bp, Homo sapien
ttcagatgaaacgagtcactctaac

SEQ ID NO: 114657 - DNA, 25 bp, Homo sapien
ttcagatgctccaatttgggaagct

SEQ ID NO: 114658 - DNA, 25 bp, Homo sapien
ttcagatgctccgatttgggaagct

SEQ ID NO: 114659 - DNA, 25 bp, Homo sapien
ttcagatggctatgcaataggttcc

SEQ ID NO: 114660 - DNA, 25 bp, Homo sapien
ttcagatggctatgtaataggttcc

SEQ ID NO: 114661 - DNA, 25 bp, Homo sapien
ttcagatggtcaacaacttcatatt

SEQ ID NO: 114662 - DNA, 25 bp, Homo sapien
ttcagatggtcagcaacttcatatt

SEQ ID NO: 114663 - DNA, 25 bp, Homo sapien
ttcagattacattaatacagcttct

SEQ ID NO: 114664 - DNA, 25 bp, Homo sapien
ttcagattacattattacagcttct

SEQ ID NO: 114665 - DNA, 25 bp, Homo sapien
ttcagattcgctccttgttcttcag

SEQ ID NO: 114666 - DNA, 25 bp, Homo sapien
ttcagattgtcagaaaagtagcttt

SEQ ID NO: 114667 - DNA, 25 bp, Homo sapien
ttcagattgtcagataagtagcttt

SEQ ID NO: 114668 - DNA, 25 bp, Homo sapien
ttcagatttccccagttgctcaaaa

SEQ ID NO: 114669 - DNA, 25 bp, Homo sapien
ttcagatttgctccttgttcttcag

SEQ ID NO: 114670 - DNA, 25 bp, Homo sapien
ttcagattttcccagttgctcaaaa

SEQ ID NO: 114671 - DNA, 25 bp, Homo sapien
ttcagattttgctattcagtattta

SEQ ID NO: 114672 - DNA, 25 bp, Homo sapien
ttcagattttgctatttagtattta

SEQ ID NO: 114673 - DNA, 25 bp, Homo sapien
ttcagcaaaaggcatgatcttgctg

SEQ ID NO: 114674 - DNA, 25 bp, Homo sapien
ttcagcaaaaggcatggtcttgctg

SEQ ID NO: 114675 - DNA, 25 bp, Homo sapien
ttcagcaaagcattccctgaccaca

SEQ ID NO: 114676 - DNA, 25 bp, Homo sapien
ttcagcaaagcattccttgaccaca

SEQ ID NO: 114677 - DNA, 25 bp, Homo sapien
ttcagcactcaatcagctctctccc

SEQ ID NO: 114678 - DNA, 25 bp, Homo sapien
ttcagcactgaatcagctctctccc

SEQ ID NO: 114679 - DNA, 25 bp, Homo sapien
ttcagcagccctggaaagttattat

SEQ ID NO: 114680 - DNA, 25 bp, Homo sapien
ttcagcagtcctggaaagttattat

SEQ ID NO: 114681 - DNA, 25 bp, Homo sapien
ttcagcagtttatgtgcgaggtatt

SEQ ID NO: 114682 - DNA, 25 bp, Homo sapien
ttcagcagtttatgtgtgaggtatt

SEQ ID NO: 114683 - DNA, 25 bp, Homo sapien
ttcagcattattcaagcagctaatt

SEQ ID NO: 114684 - DNA, 25 bp, Homo sapien
ttcagcattgttcaagcagctaatt

SEQ ID NO: 114685 - DNA, 25 bp, Homo sapien
ttcagccacaccgggaatgatgctt

SEQ ID NO: 114686 - DNA, 25 bp, Homo sapien
ttcagccacatttatttactgtctg

SEQ ID NO: 114687 - DNA, 25 bp, Homo sapien
ttcagccacgccgggaatgatgctt

SEQ ID NO: 114688 - DNA, 25 bp, Homo sapien
ttcagccacgtttatttactgtctg

SEQ ID NO: 114689 - DNA, 25 bp, Homo sapien
ttcagccagaaagatcatgatgagg

SEQ ID NO: 114690 - DNA, 25 bp, Homo sapien
ttcagccaggaactaagaaagaaga

SEQ ID NO: 114691 - DNA, 25 bp, Homo sapien
ttcagccaggaagatcatgatgagg

SEQ ID NO: 114692 - DNA, 25 bp, Homo sapien
ttcagccaggatctaagaaagaaga

SEQ ID NO: 114693 - DNA, 25 bp, Homo sapien
ttcagccattacaaagttaggaaaa

SEQ ID NO: 114694 - DNA, 25 bp, Homo sapien
ttcagccattacaaggttaggaaaa

SEQ ID NO: 114695 - DNA, 25 bp, Homo sapien
ttcagcccagatgcggagtcacaga

SEQ ID NO: 114696 - DNA, 25 bp, Homo sapien
ttcagcccagatgtggagtcacaga

SEQ ID NO: 114697 - DNA, 25 bp, Homo sapien
ttcagccctgatgaatgattttgaa

SEQ ID NO: 114698 - DNA, 25 bp, Homo sapien
ttcagccctgatgcatgattttgaa

SEQ ID NO: 114699 - DNA, 25 bp, Homo sapien
ttcagcctcaaatttaacttctggg

SEQ ID NO: 114700 - DNA, 25 bp, Homo sapien
ttcagcctctaatttaacttctggg

SEQ ID NO: 114701 - DNA, 25 bp, Homo sapien
ttcagcctctcagcgatctctcgtc

SEQ ID NO: 114702 - DNA, 25 bp, Homo sapien
ttcagcctctcagtgatctctcgtc

SEQ ID NO: 114703 - DNA, 25 bp, Homo sapien
ttcagcctggcctatcttatctctc

SEQ ID NO: 114704 - DNA, 25 bp, Homo sapien
ttcagccttgcctatcttatctctc

SEQ ID NO: 114705 - DNA, 25 bp, Homo sapien
ttcagcgaaaacttctaaggatgga

SEQ ID NO: 114706 - DNA, 25 bp, Homo sapien
ttcagcgaaaacttgtaaggatgga

SEQ ID NO: 114707 - DNA, 25 bp, Homo sapien
ttcagctacccattatcaattacct

SEQ ID NO: 114708 - DNA, 25 bp, Homo sapien
ttcagctacccattattaattacct

SEQ ID NO: 114709 - DNA, 25 bp, Homo sapien
ttcagctatttgtttacattccact

SEQ ID NO: 114710 - DNA, 25 bp, Homo sapien
ttcagctatttgtttagattccact

SEQ ID NO: 114711 - DNA, 25 bp, Homo sapien
ttcagctctttcattactgtctttt

SEQ ID NO: 114712 - DNA, 25 bp, Homo sapien
ttcagctctttcgttactgtctttt

SEQ ID NO: 114713 - DNA, 25 bp, Homo sapien
ttcagctgaatgcagccctatcagt

SEQ ID NO: 114714 - DNA, 25 bp, Homo sapien
ttcagctgaatgtagccctatcagt

SEQ ID NO: 114715 - DNA, 25 bp, Homo sapien
ttcagctgactggtgcatgggaagg

SEQ ID NO: 114716 - DNA, 25 bp, Homo sapien
ttcagctgactggtgcctgggaagg

SEQ ID NO: 114717 - DNA, 25 bp, Homo sapien
ttcagctgatccacagtatcttcca

SEQ ID NO: 114718 - DNA, 25 bp, Homo sapien
ttcagctgatccgcagtatcttcca

SEQ ID NO: 114719 - DNA, 25 bp, Homo sapien
ttcagctgggacagttgtcactatt

SEQ ID NO: 114720 - DNA, 25 bp, Homo sapien
ttcagctgggacggttgtcactatt

SEQ ID NO: 114721 - DNA, 25 bp, Homo sapien
ttcagctgtgtcacatgccttagtt

SEQ ID NO: 114722 - DNA, 25 bp, Homo sapien
ttcagctgtgtcatatgccttagtt

SEQ ID NO: 114723 - DNA, 25 bp, Homo sapien
ttcagctgttagtatgatatgctga

SEQ ID NO: 114724 - DNA, 25 bp, Homo sapien
ttcagctgttagtgtgatatgctga

SEQ ID NO: 114725 - DNA, 25 bp, Homo sapien
ttcagctttcctcctgcttgggtag

SEQ ID NO: 114726 - DNA, 25 bp, Homo sapien
ttcagctttccttctgcttgggtag

SEQ ID NO: 114727 - DNA, 25 bp, Homo sapien
ttcaggaaaaatatagccctgagga

SEQ ID NO: 114728 - DNA, 25 bp, Homo sapien
ttcaggaaaaatatggccctgagga

SEQ ID NO: 114729 - DNA, 25 bp, Homo sapien
ttcaggaaaatttagtcgttaccaa

SEQ ID NO: 114730 - DNA, 25 bp, Homo sapien
ttcaggaaagtttagtcgttaccaa

SEQ ID NO: 114731 - DNA, 25 bp, Homo sapien
ttcaggaatgaagctgagtcccaag

SEQ ID NO: 114732 - DNA, 25 bp, Homo sapien
ttcaggaatgaggctgagtcccaag

SEQ ID NO: 114733 - DNA, 25 bp, Homo sapien
ttcaggaatgggaataatgtgatga

SEQ ID NO: 114734 - DNA, 25 bp, Homo sapien
ttcaggaatgggaatattgtgatga

SEQ ID NO: 114735 - DNA, 25 bp, Homo sapien
ttcaggacaagcaagacagcaagag

SEQ ID NO: 114736 - DNA, 25 bp, Homo sapien
ttcaggacgagcaagacagcaagag

SEQ ID NO: 114737 - DNA, 25 bp, Homo sapien
ttcaggactgaaacgttatgtaact

SEQ ID NO: 114738 - DNA, 25 bp, Homo sapien
ttcaggactgaaatgttatgtaact

SEQ ID NO: 114739 - DNA, 25 bp, Homo sapien
ttcaggagcctgctgggtgattcac

SEQ ID NO: 114740 - DNA, 25 bp, Homo sapien
ttcaggagcctgttgggtgattcac

SEQ ID NO: 114741 - DNA, 25 bp, Homo sapien
ttcaggataatgtgaaatatggcct

SEQ ID NO: 114742 - DNA, 25 bp, Homo sapien
ttcaggataatgtgaactatggcct

SEQ ID NO: 114743 - DNA, 25 bp, Homo sapien
ttcaggattcacagttcagctaatt

SEQ ID NO: 114744 - DNA, 25 bp, Homo sapien
ttcaggattcatagttcagctaatt

SEQ ID NO: 114745 - DNA, 25 bp, Homo sapien
ttcaggattccctggtatttttaaa

SEQ ID NO: 114746 - DNA, 25 bp, Homo sapien
ttcaggattccttggtatttttaaa

SEQ ID NO: 114747 - DNA, 25 bp, Homo sapien
ttcaggcaaagaaagtaggttaacc

SEQ ID NO: 114748 - DNA, 25 bp, Homo sapien
ttcaggcaaagaagaaggagttttc

SEQ ID NO: 114749 - DNA, 25 bp, Homo sapien
ttcaggcaaatcatctaagtccccg

SEQ ID NO: 114750 - DNA, 25 bp, Homo sapien
ttcaggcaactttacttagcttgtc

SEQ ID NO: 114751 - DNA, 25 bp, Homo sapien
ttcaggcaagcacattacatgagtt

SEQ ID NO: 114752 - DNA, 25 bp, Homo sapien
ttcaggcaagcatattacatgagtt

SEQ ID NO: 114753 - DNA, 25 bp, Homo sapien
ttcaggcaaggaagaaggagttttc

SEQ ID NO: 114754 - DNA, 25 bp, Homo sapien
ttcaggcaagtcatctaagtccccg

SEQ ID NO: 114755 - DNA, 25 bp, Homo sapien
ttcaggcacaaacatcccgaggggt

SEQ ID NO: 114756 - DNA, 25 bp, Homo sapien
ttcaggcacaaacatcgcgaggggt

SEQ ID NO: 114757 - DNA, 25 bp, Homo sapien
ttcaggcagagaaagtaggttaacc

SEQ ID NO: 114758 - DNA, 25 bp, Homo sapien
ttcaggcagcgaaaaagttctaaaa

SEQ ID NO: 114759 - DNA, 25 bp, Homo sapien
ttcaggcagctttacttagcttgtc

SEQ ID NO: 114760 - DNA, 25 bp, Homo sapien
ttcaggcagtgaaaaagttctaaaa

SEQ ID NO: 114761 - DNA, 25 bp, Homo sapien
ttcaggcatagaataagaggcttga

SEQ ID NO: 114762 - DNA, 25 bp, Homo sapien
ttcaggcatagactaagaggcttga

SEQ ID NO: 114763 - DNA, 25 bp, Homo sapien
ttcaggcattaatcgaaagtttgaa

SEQ ID NO: 114764 - DNA, 25 bp, Homo sapien
ttcaggcattaattgaaagtttgaa

SEQ ID NO: 114765 - DNA, 25 bp, Homo sapien
ttcaggccacaatgctaggaggaag

SEQ ID NO: 114766 - DNA, 25 bp, Homo sapien
ttcaggccacagtgctaggaggaag

SEQ ID NO: 114767 - DNA, 25 bp, Homo sapien
ttcaggcgtaaaattacctgcaatt

SEQ ID NO: 114768 - DNA, 25 bp, Homo sapien
ttcaggcgtaaaattatctgcaatt

SEQ ID NO: 114769 - DNA, 25 bp, Homo sapien
ttcaggctccttaagtctcatattc

SEQ ID NO: 114770 - DNA, 25 bp, Homo sapien
ttcaggctcgttaagtctcatattc

SEQ ID NO: 114771 - DNA, 25 bp, Homo sapien
ttcagggaaagtccacagtgcaaag

SEQ ID NO: 114772 - DNA, 25 bp, Homo sapien
ttcagggaaagtccgcagtgcaaag

SEQ ID NO: 114773 - DNA, 25 bp, Homo sapien
ttcagggatccacgtagaagttgca

SEQ ID NO: 114774 - DNA, 25 bp, Homo sapien
ttcagggatccatgtagaagttgca

SEQ ID NO: 114775 - DNA, 25 bp, Homo sapien
ttcagggcattttgataaataaagg

SEQ ID NO: 114776 - DNA, 25 bp, Homo sapien
ttcagggcattttggtaaataaagg

SEQ ID NO: 114777 - DNA, 25 bp, Homo sapien
ttcaggtataaaacacctagagaat

SEQ ID NO: 114778 - DNA, 25 bp, Homo sapien
ttcaggtataaaacgcctagagaat

SEQ ID NO: 114779 - DNA, 25 bp, Homo sapien
ttcaggtataaaggcaggcgagaca

SEQ ID NO: 114780 - DNA, 25 bp, Homo sapien
ttcaggtataaagtcaggcgagaca

SEQ ID NO: 114781 - DNA, 25 bp, Homo sapien
ttcaggtgtgaaccagtgcagtgcc

SEQ ID NO: 114782 - DNA, 25 bp, Homo sapien
ttcaggtgtgacccagtgcagtgcc

SEQ ID NO: 114783 - DNA, 25 bp, Homo sapien
ttcaggttatgtcagtttatttgga

SEQ ID NO: 114784 - DNA, 25 bp, Homo sapien
ttcaggttatgtgagtttatttgga

SEQ ID NO: 114785 - DNA, 25 bp, Homo sapien
ttcagtaagattttcaaggcagaat

SEQ ID NO: 114786 - DNA, 25 bp, Homo sapien
ttcagtaagattttcagggcagaat

SEQ ID NO: 114787 - DNA, 25 bp, Homo sapien
ttcagtagcagacacaattatatcc

SEQ ID NO: 114788 - DNA, 25 bp, Homo sapien
ttcagtagcagacgcaattatatcc

SEQ ID NO: 114789 - DNA, 25 bp, Homo sapien
ttcagtatagacaaccatccaattt

SEQ ID NO: 114790 - DNA, 25 bp, Homo sapien
ttcagtatagacagccatccaattt

SEQ ID NO: 114791 - DNA, 25 bp, Homo sapien
ttcagtattaaaataggctggaaat

SEQ ID NO: 114792 - DNA, 25 bp, Homo sapien
ttcagtattaacataggctggaaat

SEQ ID NO: 114793 - DNA, 25 bp, Homo sapien
ttcagtattttgacaagaatttagt

SEQ ID NO: 114794 - DNA, 25 bp, Homo sapien
ttcagtattttggcaagaatttagt

SEQ ID NO: 114795 - DNA, 25 bp, Homo sapien
ttcagtcacatcccaattaatttac

SEQ ID NO: 114796 - DNA, 25 bp, Homo sapien
ttcagtcacgtcccaattaatttac

SEQ ID NO: 114797 - DNA, 25 bp, Homo sapien
ttcagtcagaaactggttccccgcc

SEQ ID NO: 114798 - DNA, 25 bp, Homo sapien
ttcagtcagaagctggttccccgcc

SEQ ID NO: 114799 - DNA, 25 bp, Homo sapien
ttcagtcatgtatttccacagatgg

SEQ ID NO: 114800 - DNA, 25 bp, Homo sapien
ttcagtcatgtctttccacagatgg

SEQ ID NO: 114801 - DNA, 25 bp, Homo sapien
ttcagtcgaggccagtttggacaaa

SEQ ID NO: 114802 - DNA, 25 bp, Homo sapien
ttcagtcgatgccagtttggacaaa

SEQ ID NO: 114803 - DNA, 25 bp, Homo sapien
ttcagtgatacaagaatcttagagt

SEQ ID NO: 114804 - DNA, 25 bp, Homo sapien
ttcagtgatacgagaatcttagagt

SEQ ID NO: 114805 - DNA, 25 bp, Homo sapien
ttcagtggactatataatgtagttg

SEQ ID NO: 114806 - DNA, 25 bp, Homo sapien
ttcagtggactgtataatgtagttg

SEQ ID NO: 114807 - DNA, 25 bp, Homo sapien
ttcagtgtccaacctctttgctcat

SEQ ID NO: 114808 - DNA, 25 bp, Homo sapien
ttcagtgtccaatctctttgctcat

SEQ ID NO: 114809 - DNA, 25 bp, Homo sapien
ttcagttaacggcaactttagagac

SEQ ID NO: 114810 - DNA, 25 bp, Homo sapien
ttcagttaagtttgttcatcttttg

SEQ ID NO: 114811 - DNA, 25 bp, Homo sapien
ttcagttaatggcaactttagagac

SEQ ID NO: 114812 - DNA, 25 bp, Homo sapien
ttcagttaatgtgacttttgttttt

SEQ ID NO: 114813 - DNA, 25 bp, Homo sapien
ttcagttaatgtgatttttgttttt

SEQ ID NO: 114814 - DNA, 25 bp, Homo sapien
ttcagttacattaacggctcaaagt

SEQ ID NO: 114815 - DNA, 25 bp, Homo sapien
ttcagttacattgacggctcaaagt

SEQ ID NO: 114816 - DNA, 25 bp, Homo sapien
ttcagttacgtttgttcatcttttg

SEQ ID NO: 114817 - DNA, 25 bp, Homo sapien
ttcagttactttggataaatatcca

SEQ ID NO: 114818 - DNA, 25 bp, Homo sapien
ttcagttattttggataaatatcca

SEQ ID NO: 114819 - DNA, 25 bp, Homo sapien
ttcagttcatcaattgaattttaca

SEQ ID NO: 114820 - DNA, 25 bp, Homo sapien
ttcagttcatcatttgaattttaca

SEQ ID NO: 114821 - DNA, 25 bp, Homo sapien
ttcagttcctgcttttgaacaaatg

SEQ ID NO: 114822 - DNA, 25 bp, Homo sapien
ttcagttcctgtttttgaacaaatg

SEQ ID NO: 114823 - DNA, 25 bp, Homo sapien
ttcagttgacttctcaattttctat

SEQ ID NO: 114824 - DNA, 25 bp, Homo sapien
ttcagttgatataatacaattctct

SEQ ID NO: 114825 - DNA, 25 bp, Homo sapien
ttcagttgcaggagattaacgtaga

SEQ ID NO: 114826 - DNA, 25 bp, Homo sapien
ttcagttgccttctcaattttctat

SEQ ID NO: 114827 - DNA, 25 bp, Homo sapien
ttcagttgcgtttctgtgatttgca

SEQ ID NO: 114828 - DNA, 25 bp, Homo sapien
ttcagttgcgtttttgtgatttgca

SEQ ID NO: 114829 - DNA, 25 bp, Homo sapien
ttcagttggctgggataaaaactca

SEQ ID NO: 114830 - DNA, 25 bp, Homo sapien
ttcagttggtataatacaattctct

SEQ ID NO: 114831 - DNA, 25 bp, Homo sapien
ttcagttggttgggataaaaactca

SEQ ID NO: 114832 - DNA, 25 bp, Homo sapien
ttcagttgtaggagattaacgtaga

SEQ ID NO: 114833 - DNA, 25 bp, Homo sapien
ttcagttgtgatagctccttgattt

SEQ ID NO: 114834 - DNA, 25 bp, Homo sapien
ttcagttgtgatatctccttgattt

SEQ ID NO: 114835 - DNA, 25 bp, Homo sapien
ttcagtttaatagctgagaaataag

SEQ ID NO: 114836 - DNA, 25 bp, Homo sapien
ttcagtttaatggctgagaaataag

SEQ ID NO: 114837 - DNA, 25 bp, Homo sapien
ttcagtttgcaaaaccttcaatcat

SEQ ID NO: 114838 - DNA, 25 bp, Homo sapien
ttcagtttgcaaaagcttcaatcat

SEQ ID NO: 114839 - DNA, 25 bp, Homo sapien
ttcagttttctccttctgccacatc

SEQ ID NO: 114840 - DNA, 25 bp, Homo sapien
ttcagttttgtccttctgccacatc

SEQ ID NO: 114841 - DNA, 25 bp, Homo sapien
ttcataaatcatagcatcacattgt

SEQ ID NO: 114842 - DNA, 25 bp, Homo sapien
ttcataaatcattgcatcacattgt

SEQ ID NO: 114843 - DNA, 25 bp, Homo sapien
ttcataagggaaacataacttgcaa

SEQ ID NO: 114844 - DNA, 25 bp, Homo sapien
ttcataagggaaccataacttgcaa

SEQ ID NO: 114845 - DNA, 25 bp, Homo sapien
ttcataataaataaaacgactgttg

SEQ ID NO: 114846 - DNA, 25 bp, Homo sapien
ttcataataaataaaatgactgttg

SEQ ID NO: 114847 - DNA, 25 bp, Homo sapien
ttcataatttccggtatggtttaag

SEQ ID NO: 114848 - DNA, 25 bp, Homo sapien
ttcataatttcctgtatggtttaag

SEQ ID NO: 114849 - DNA, 25 bp, Homo sapien
ttcatacaaaaacgaaactgctatg

SEQ ID NO: 114850 - DNA, 25 bp, Homo sapien
ttcatacaaaaccgaaactgctatg

SEQ ID NO: 114851 - DNA, 25 bp, Homo sapien
ttcatacaaccacagcagtcctaaa

SEQ ID NO: 114852 - DNA, 25 bp, Homo sapien
ttcatacaaccagagcagtcctaaa

SEQ ID NO: 114853 - DNA, 25 bp, Homo sapien
ttcatacaaggcattgaacacagaa

SEQ ID NO: 114854 - DNA, 25 bp, Homo sapien
ttcatacaaggccttgaacacagaa

SEQ ID NO: 114855 - DNA, 25 bp, Homo sapien
ttcatacacctcataaaaacttcag

SEQ ID NO: 114856 - DNA, 25 bp, Homo sapien
ttcatacacctcgtaaaaacttcag

SEQ ID NO: 114857 - DNA, 25 bp, Homo sapien
ttcatacccattagcggtcactttc

SEQ ID NO: 114858 - DNA, 25 bp, Homo sapien
ttcatacccgttagcggtcactttc

SEQ ID NO: 114859 - DNA, 25 bp, Homo sapien
ttcatactggatcataaaggccaac

SEQ ID NO: 114860 - DNA, 25 bp, Homo sapien
ttcatactggattataaaggccaac

SEQ ID NO: 114861 - DNA, 25 bp, Homo sapien
ttcatactttcacagaactgtaact

SEQ ID NO: 114862 - DNA, 25 bp, Homo sapien
ttcatactttcatagaactgtaact

SEQ ID NO: 114863 - DNA, 25 bp, Homo sapien
ttcatactttttggtttcctggctt

SEQ ID NO: 114864 - DNA, 25 bp, Homo sapien
ttcatacttttttgtttcctggctt

SEQ ID NO: 114865 - DNA, 25 bp, Homo sapien
ttcatagaatagaacaggacagaat

SEQ ID NO: 114866 - DNA, 25 bp, Homo sapien
ttcatagacatcctggcagctaagt

SEQ ID NO: 114867 - DNA, 25 bp, Homo sapien
ttcatagacatcttggcagctaagt

SEQ ID NO: 114868 - DNA, 25 bp, Homo sapien
ttcatagactagaacaggacagaat

SEQ ID NO: 114869 - DNA, 25 bp, Homo sapien
ttcatagccacgatgtacctccttc

SEQ ID NO: 114870 - DNA, 25 bp, Homo sapien
ttcatagccacgttgtacctccttc

SEQ ID NO: 114871 - DNA, 25 bp, Homo sapien
ttcatagtaaccattgcattttttg

SEQ ID NO: 114872 - DNA, 25 bp, Homo sapien
ttcatagtaaccgttgcattttttg

SEQ ID NO: 114873 - DNA, 25 bp, Homo sapien
ttcatagtctcaaatgttcatgaga

SEQ ID NO: 114874 - DNA, 25 bp, Homo sapien
ttcatagtctcacatgttcatgaga

SEQ ID NO: 114875 - DNA, 25 bp, Homo sapien
ttcatagtgcgagttcagatattcc

SEQ ID NO: 114876 - DNA, 25 bp, Homo sapien
ttcatagtgggagttcagatattcc

SEQ ID NO: 114877 - DNA, 25 bp, Homo sapien
ttcatataatgaattgcagttccca

SEQ ID NO: 114878 - DNA, 25 bp, Homo sapien
ttcatataatggattgcagttccca

SEQ ID NO: 114879 - DNA, 25 bp, Homo sapien
ttcatatatttttcaaactacctcc

SEQ ID NO: 114880 - DNA, 25 bp, Homo sapien
ttcatatatttttgaaactacctcc

SEQ ID NO: 114881 - DNA, 25 bp, Homo sapien
ttcatatcataaacattatccacct

SEQ ID NO: 114882 - DNA, 25 bp, Homo sapien
ttcatatcgtaaacattatccacct

SEQ ID NO: 114883 - DNA, 25 bp, Homo sapien
ttcatatgcctattatttcactcct

SEQ ID NO: 114884 - DNA, 25 bp, Homo sapien
ttcatatgtactcattgcaacaaat

SEQ ID NO: 114885 - DNA, 25 bp, Homo sapien
ttcatatgtactcgttgcaacaaat

SEQ ID NO: 114886 - DNA, 25 bp, Homo sapien
ttcatatgtctattatttcactcct

SEQ ID NO: 114887 - DNA, 25 bp, Homo sapien
ttcatattctgctataaattaaaca

SEQ ID NO: 114888 - DNA, 25 bp, Homo sapien
ttcatattctgctgtaaattaaaca

SEQ ID NO: 114889 - DNA, 25 bp, Homo sapien
ttcatatttcttaaactagcctgac

SEQ ID NO: 114890 - DNA, 25 bp, Homo sapien
ttcatattttttaaactagcctgac

SEQ ID NO: 114891 - DNA, 25 bp, Homo sapien
ttcatattttttgtatgcttccttt

SEQ ID NO: 114892 - DNA, 25 bp, Homo sapien
ttcatattttttgtgtgcttccttt

SEQ ID NO: 114893 - DNA, 25 bp, Homo sapien
ttcatcaattaggtttttttgttta

SEQ ID NO: 114894 - DNA, 25 bp, Homo sapien
ttcatcaattagttttttttgttta

SEQ ID NO: 114895 - DNA, 25 bp, Homo sapien
ttcatcacaaacaccctagttcaat

SEQ ID NO: 114896 - DNA, 25 bp, Homo sapien
ttcatcacaaacgccctagttcaat

SEQ ID NO: 114897 - DNA, 25 bp, Homo sapien
ttcatcacctacagctccgtggagc

SEQ ID NO: 114898 - DNA, 25 bp, Homo sapien
ttcatcacctatagctccgtggagc

SEQ ID NO: 114899 - DNA, 25 bp, Homo sapien
ttcatcactcccgattgctctcaga

SEQ ID NO: 114900 - DNA, 25 bp, Homo sapien
ttcatcactcctgattgctctcaga

SEQ ID NO: 114901 - DNA, 25 bp, Homo sapien
ttcatcactctgacgttggtgcgct

SEQ ID NO: 114902 - DNA, 25 bp, Homo sapien
ttcatcactctgatgttggtgcgct

SEQ ID NO: 114903 - DNA, 25 bp, Homo sapien
ttcatcagaaatacttgtctattgt

SEQ ID NO: 114904 - DNA, 25 bp, Homo sapien
ttcatcagagcagtcagtagaacat

SEQ ID NO: 114905 - DNA, 25 bp, Homo sapien
ttcatcagccaaaaagaaagaatct

SEQ ID NO: 114906 - DNA, 25 bp, Homo sapien
ttcatcagccataaagaaagaatct

SEQ ID NO: 114907 - DNA, 25 bp, Homo sapien
ttcatcaggaatacttgtctattgt

SEQ ID NO: 114908 - DNA, 25 bp, Homo sapien
ttcatcagggcagtcagtagaacat

SEQ ID NO: 114909 - DNA, 25 bp, Homo sapien
ttcatcagtaattacaacatggaaa

SEQ ID NO: 114910 - DNA, 25 bp, Homo sapien
ttcatcagtaattccaacatggaaa

SEQ ID NO: 114911 - DNA, 25 bp, Homo sapien
ttcatcagtccctgttagctctatg

SEQ ID NO: 114912 - DNA, 25 bp, Homo sapien
ttcatcagttcctgttagctctatg

SEQ ID NO: 114913 - DNA, 25 bp, Homo sapien
ttcatcatcattaggtgtcacccgg

SEQ ID NO: 114914 - DNA, 25 bp, Homo sapien
ttcatcatcggaaaatatccaggag

SEQ ID NO: 114915 - DNA, 25 bp, Homo sapien
ttcatcatcggacaatatccaggag

SEQ ID NO: 114916 - DNA, 25 bp, Homo sapien
ttcatcatcgttaggtgtcacccgg

SEQ ID NO: 114917 - DNA, 25 bp, Homo sapien
ttcatcatctgatctcatcattctt

SEQ ID NO: 114918 - DNA, 25 bp, Homo sapien
ttcatcatctggtctcatcattctt

SEQ ID NO: 114919 - DNA, 25 bp, Homo sapien
ttcatcattaattctgcactaactt

SEQ ID NO: 114920 - DNA, 25 bp, Homo sapien
ttcatcattaattttgcactaactt

SEQ ID NO: 114921 - DNA, 25 bp, Homo sapien
ttcatcattaccaaattccaggcat

SEQ ID NO: 114922 - DNA, 25 bp, Homo sapien
ttcatcattgccaaattccaggcat

SEQ ID NO: 114923 - DNA, 25 bp, Homo sapien
ttcatcattttaatcaattaattgg

SEQ ID NO: 114924 - DNA, 25 bp, Homo sapien
ttcatcattttactcaattaattgg

SEQ ID NO: 114925 - DNA, 25 bp, Homo sapien
ttcatccaccaagtagtggcatcaa

SEQ ID NO: 114926 - DNA, 25 bp, Homo sapien
ttcatccaccaggtagtggcatcaa

SEQ ID NO: 114927 - DNA, 25 bp, Homo sapien
ttcatccactccggttgatcagaat

SEQ ID NO: 114928 - DNA, 25 bp, Homo sapien
ttcatccactctggttgatcagaat

SEQ ID NO: 114929 - DNA, 25 bp, Homo sapien
ttcatccagataaaaactaccttga

SEQ ID NO: 114930 - DNA, 25 bp, Homo sapien
ttcatccagctaaaaactaccttga

SEQ ID NO: 114931 - DNA, 25 bp, Homo sapien
ttcatccgagtcttgaaggaagagt

SEQ ID NO: 114932 - DNA, 25 bp, Homo sapien
ttcatccgagtcttgagggaagagt

SEQ ID NO: 114933 - DNA, 25 bp, Homo sapien
ttcatcctgacaacatgttcaacaa

SEQ ID NO: 114934 - DNA, 25 bp, Homo sapien
ttcatcctgacaacgtgttcaacaa

SEQ ID NO: 114935 - DNA, 25 bp, Homo sapien
ttcatcgccatatccaggctcctgg

SEQ ID NO: 114936 - DNA, 25 bp, Homo sapien
ttcatcgccatgtccaggctcctgg

SEQ ID NO: 114937 - DNA, 25 bp, Homo sapien
ttcatctacaaatggaacaatctgt

SEQ ID NO: 114938 - DNA, 25 bp, Homo sapien
ttcatctacgaatggaacaatctgt

SEQ ID NO: 114939 - DNA, 25 bp, Homo sapien
ttcatctataaaacaggttctttga

SEQ ID NO: 114940 - DNA, 25 bp, Homo sapien
ttcatctataaaagaggttctttga

SEQ ID NO: 114941 - DNA, 25 bp, Homo sapien
ttcatctcagaatatgtctggtcac

SEQ ID NO: 114942 - DNA, 25 bp, Homo sapien
ttcatctcagagtatgtctggtcac

SEQ ID NO: 114943 - DNA, 25 bp, Homo sapien
ttcatctccaagaataagtctcatt

SEQ ID NO: 114944 - DNA, 25 bp, Homo sapien
ttcatctccaataataagtctcatt

SEQ ID NO: 114945 - DNA, 25 bp, Homo sapien
ttcatctctctatccatcactatat

SEQ ID NO: 114946 - DNA, 25 bp, Homo sapien
ttcatctctctctccatcactatat

SEQ ID NO: 114947 - DNA, 25 bp, Homo sapien
ttcatctctgtaagcctgttttgct

SEQ ID NO: 114948 - DNA, 25 bp, Homo sapien
ttcatctctgtaagtctgttttgct

SEQ ID NO: 114949 - DNA, 25 bp, Homo sapien
ttcatctctgttgctcaactgcact

SEQ ID NO: 114950 - DNA, 25 bp, Homo sapien
ttcatctctgttgctcgactgcact

SEQ ID NO: 114951 - DNA, 25 bp, Homo sapien
ttcatctgaattatcccctactggt

SEQ ID NO: 114952 - DNA, 25 bp, Homo sapien
ttcatctgcagcaagcatctgttat

SEQ ID NO: 114953 - DNA, 25 bp, Homo sapien
ttcatctgcagcgagcatctgttat

SEQ ID NO: 114954 - DNA, 25 bp, Homo sapien
ttcatctgcctgctccttaaataaa

SEQ ID NO: 114955 - DNA, 25 bp, Homo sapien
ttcatctggattatcccctactggt

SEQ ID NO: 114956 - DNA, 25 bp, Homo sapien
ttcatctgtctgctccttaaataaa

SEQ ID NO: 114957 - DNA, 25 bp, Homo sapien
ttcatgaatcatctttcgctcaaat

SEQ ID NO: 114958 - DNA, 25 bp, Homo sapien
ttcatgaatcatcttttgctcaaat

SEQ ID NO: 114959 - DNA, 25 bp, Homo sapien
ttcatgacaccacggactagagtag

SEQ ID NO: 114960 - DNA, 25 bp, Homo sapien
ttcatgacaccatggactagagtag

SEQ ID NO: 114961 - DNA, 25 bp, Homo sapien
ttcatgaccgaggctccatcatgag

SEQ ID NO: 114962 - DNA, 25 bp, Homo sapien
ttcatgactgaggctccatcatgag

SEQ ID NO: 114963 - DNA, 25 bp, Homo sapien
ttcatgagctacaaaaggttgcaaa

SEQ ID NO: 114964 - DNA, 25 bp, Homo sapien
ttcatgagctacagaaggttgcaaa

SEQ ID NO: 114965 - DNA, 25 bp, Homo sapien
ttcatgaggcgttaagaaggagagg

SEQ ID NO: 114966 - DNA, 25 bp, Homo sapien
ttcatgagggaaaaaaacagaccaa

SEQ ID NO: 114967 - DNA, 25 bp, Homo sapien
ttcatgagggaaagaaacagaccaa

SEQ ID NO: 114968 - DNA, 25 bp, Homo sapien
ttcatgaggtgttaagaaggagagg

SEQ ID NO: 114969 - DNA, 25 bp, Homo sapien
ttcatgattaaattcagctctggtg

SEQ ID NO: 114970 - DNA, 25 bp, Homo sapien
ttcatgattaaatttagctctggtg

SEQ ID NO: 114971 - DNA, 25 bp, Homo sapien
ttcatgatttcaacaatacttatac

SEQ ID NO: 114972 - DNA, 25 bp, Homo sapien
ttcatgatttccacaatacttatac

SEQ ID NO: 114973 - DNA, 25 bp, Homo sapien
ttcatgcagtaatttcacccttggg

SEQ ID NO: 114974 - DNA, 25 bp, Homo sapien
ttcatgcagtactttcacccttggg

SEQ ID NO: 114975 - DNA, 25 bp, Homo sapien
ttcatgcagtctaaagataaaatga

SEQ ID NO: 114976 - DNA, 25 bp, Homo sapien
ttcatgcagtctaaggataaaatga

SEQ ID NO: 114977 - DNA, 25 bp, Homo sapien
ttcatgcatatccacatcaggcagt

SEQ ID NO: 114978 - DNA, 25 bp, Homo sapien
ttcatgcatgtccacatcaggcagt

SEQ ID NO: 114979 - DNA, 25 bp, Homo sapien
ttcatgccaagttgaagaagcagac

SEQ ID NO: 114980 - DNA, 25 bp, Homo sapien
ttcatgccaagttgcagaagcagac

SEQ ID NO: 114981 - DNA, 25 bp, Homo sapien
ttcatgcgtcttcctcctcctatgt

SEQ ID NO: 114982 - DNA, 25 bp, Homo sapien
ttcatgcgttttcctcctcctatgt

SEQ ID NO: 114983 - DNA, 25 bp, Homo sapien
ttcatgctagattccaacttgttcg

SEQ ID NO: 114984 - DNA, 25 bp, Homo sapien
ttcatgctggattccaacttgttcg

SEQ ID NO: 114985 - DNA, 25 bp, Homo sapien
ttcatggagatttgtgagtaacagg

SEQ ID NO: 114986 - DNA, 25 bp, Homo sapien
ttcatggagatttttgagtaacagg

SEQ ID NO: 114987 - DNA, 25 bp, Homo sapien
ttcatggattccaataaaacaaatc

SEQ ID NO: 114988 - DNA, 25 bp, Homo sapien
ttcatggattccagtaaaacaaatc

SEQ ID NO: 114989 - DNA, 25 bp, Homo sapien
ttcatggattttaaatgtaaatgac

SEQ ID NO: 114990 - DNA, 25 bp, Homo sapien
ttcatggattttaagtgtaaatgac

SEQ ID NO: 114991 - DNA, 25 bp, Homo sapien
ttcatgggatgcattttctaaacaa

SEQ ID NO: 114992 - DNA, 25 bp, Homo sapien
ttcatgggatgcgttttctaaacaa

SEQ ID NO: 114993 - DNA, 25 bp, Homo sapien
ttcatgggtcccacatgcaaattca

SEQ ID NO: 114994 - DNA, 25 bp, Homo sapien
ttcatgggtcccacgtgcaaattca

SEQ ID NO: 114995 - DNA, 25 bp, Homo sapien
ttcatggtgtcatatagaaggggca

SEQ ID NO: 114996 - DNA, 25 bp, Homo sapien
ttcatggtgtcgtatagaaggggca

SEQ ID NO: 114997 - DNA, 25 bp, Homo sapien
ttcatgtattgtcaatagcagtgag

SEQ ID NO: 114998 - DNA, 25 bp, Homo sapien
ttcatgtattgtcagtagcagtgag

SEQ ID NO: 114999 - DNA, 25 bp, Homo sapien
ttcatgtcccgagccaataataact

SEQ ID NO: 115000 - DNA, 25 bp, Homo sapien
ttcatgtcctgagccaataataact

SEQ ID NO: 115001 - DNA, 25 bp, Homo sapien
ttcatgtctgctaatacattcttca

SEQ ID NO: 115002 - DNA, 25 bp, Homo sapien
ttcatgtctgctaatatattcttca

SEQ ID NO: 115003 - DNA, 25 bp, Homo sapien
ttcatgtggcactgttatgctatgc

SEQ ID NO: 115004 - DNA, 25 bp, Homo sapien
ttcatgtggcacttttatgctatgc

SEQ ID NO: 115005 - DNA, 25 bp, Homo sapien
ttcatgtgtagaatttatagactcc

SEQ ID NO: 115006 - DNA, 25 bp, Homo sapien
ttcatgtgtagaatttgtagactcc

SEQ ID NO: 115007 - DNA, 25 bp, Homo sapien
ttcatgttcttataatggagtggaa

SEQ ID NO: 115008 - DNA, 25 bp, Homo sapien
ttcatgttcttgactggtttagtta

SEQ ID NO: 115009 - DNA, 25 bp, Homo sapien
ttcatgttcttgtctggtttagtta

SEQ ID NO: 115010 - DNA, 25 bp, Homo sapien
ttcatgttcttttaatggagtggaa

SEQ ID NO: 115011 - DNA, 25 bp, Homo sapien
ttcatgttgtgattgtacgagtcaa

SEQ ID NO: 115012 - DNA, 25 bp, Homo sapien
ttcatgttgtgattgtgcgagtcaa

SEQ ID NO: 115013 - DNA, 25 bp, Homo sapien
ttcattaaaatttagccgagaactt

SEQ ID NO: 115014 - DNA, 25 bp, Homo sapien
ttcattaaaatttagctgagaactt

SEQ ID NO: 115015 - DNA, 25 bp, Homo sapien
ttcattaaggatgtctaacaccaaa

SEQ ID NO: 115016 - DNA, 25 bp, Homo sapien
ttcattaaggatttctaacaccaaa

SEQ ID NO: 115017 - DNA, 25 bp, Homo sapien
ttcattagggctgtctgtaatgtct

SEQ ID NO: 115018 - DNA, 25 bp, Homo sapien
ttcattagggctgtttgtaatgtct

SEQ ID NO: 115019 - DNA, 25 bp, Homo sapien
ttcattcaataatgcctgtttttga

SEQ ID NO: 115020 - DNA, 25 bp, Homo sapien
ttcattcaatattgcctgtttttga

SEQ ID NO: 115021 - DNA, 25 bp, Homo sapien
ttcattcacacattgacggacattc

SEQ ID NO: 115022 - DNA, 25 bp, Homo sapien
ttcattcacacattgatggacattc

SEQ ID NO: 115023 - DNA, 25 bp, Homo sapien
ttcattcacttaacaacgtcttttg

SEQ ID NO: 115024 - DNA, 25 bp, Homo sapien
ttcattcacttaacaatgtcttttg

SEQ ID NO: 115025 - DNA, 25 bp, Homo sapien
ttcattcagaagaggcactgagggt

SEQ ID NO: 115026 - DNA, 25 bp, Homo sapien
ttcattcagaagagtcactgagggt

SEQ ID NO: 115027 - DNA, 25 bp, Homo sapien
ttcattcattccaggaacttctact

SEQ ID NO: 115028 - DNA, 25 bp, Homo sapien
ttcattcattccaggagcttctact

SEQ ID NO: 115029 - DNA, 25 bp, Homo sapien
ttcattccaggaacttctactgagc

SEQ ID NO: 115030 - DNA, 25 bp, Homo sapien
ttcattccaggagcttctactgagc

SEQ ID NO: 115031 - DNA, 25 bp, Homo sapien
ttcattccatgtatccatcttaatt

SEQ ID NO: 115032 - DNA, 25 bp, Homo sapien
ttcattccatgtatccctcttaatt

SEQ ID NO: 115033 - DNA, 25 bp, Homo sapien
ttcattcctatcaacagcacacaaa

SEQ ID NO: 115034 - DNA, 25 bp, Homo sapien
ttcattcctatcaacatcacacaaa

SEQ ID NO: 115035 - DNA, 25 bp, Homo sapien
ttcattctctcagaaaacactgttg

SEQ ID NO: 115036 - DNA, 25 bp, Homo sapien
ttcattctctcagagaacactgttg

SEQ ID NO: 115037 - DNA, 25 bp, Homo sapien
ttcattcttaccctcagtgcacaga

SEQ ID NO: 115038 - DNA, 25 bp, Homo sapien
ttcattcttactctcagtgcacaga

SEQ ID NO: 115039 - DNA, 25 bp, Homo sapien
ttcattgaatggctattactgagca

SEQ ID NO: 115040 - DNA, 25 bp, Homo sapien
ttcattgagcaaatcatcaaactcc

SEQ ID NO: 115041 - DNA, 25 bp, Homo sapien
ttcattgagcaagtcatcaaactcc

SEQ ID NO: 115042 - DNA, 25 bp, Homo sapien
ttcattgagtggctattactgagca

SEQ ID NO: 115043 - DNA, 25 bp, Homo sapien
ttcattgtagagatatttggttaat

SEQ ID NO: 115044 - DNA, 25 bp, Homo sapien
ttcattgtagagatctttggttaat

SEQ ID NO: 115045 - DNA, 25 bp, Homo sapien
ttcattgtaggaagcggaagtattt

SEQ ID NO: 115046 - DNA, 25 bp, Homo sapien
ttcattgtaggaagtggaagtattt

SEQ ID NO: 115047 - DNA, 25 bp, Homo sapien
ttcattgtgggaattttaagcattt

SEQ ID NO: 115048 - DNA, 25 bp, Homo sapien
ttcattgtgggagttttaagcattt

SEQ ID NO: 115049 - DNA, 25 bp, Homo sapien
ttcattgtgtcatcttcattgaaaa

SEQ ID NO: 115050 - DNA, 25 bp, Homo sapien
ttcattgtgtcgtcttcattgaaaa

SEQ ID NO: 115051 - DNA, 25 bp, Homo sapien
ttcattgttattctccagtgcattg

SEQ ID NO: 115052 - DNA, 25 bp, Homo sapien
ttcattgttcttctccagtgcattg

SEQ ID NO: 115053 - DNA, 25 bp, Homo sapien
ttcattgttgctcttgatggtttta

SEQ ID NO: 115054 - DNA, 25 bp, Homo sapien
ttcattgttgcttttgatggtttta

SEQ ID NO: 115055 - DNA, 25 bp, Homo sapien
ttcatttaaataaatatctgcaatc

SEQ ID NO: 115056 - DNA, 25 bp, Homo sapien
ttcatttaaatagatatctgcaatc

SEQ ID NO: 115057 - DNA, 25 bp, Homo sapien
ttcatttaattgaatcaccggtttc

SEQ ID NO: 115058 - DNA, 25 bp, Homo sapien
ttcatttacgttgaatgcaatgtgc

SEQ ID NO: 115059 - DNA, 25 bp, Homo sapien
ttcatttagctcagtgagtcccagg

SEQ ID NO: 115060 - DNA, 25 bp, Homo sapien
ttcatttagctcagtgcgtcccagg

SEQ ID NO: 115061 - DNA, 25 bp, Homo sapien
ttcatttatgttgaatgcaatgtgc

SEQ ID NO: 115062 - DNA, 25 bp, Homo sapien
ttcatttatttgaatcaccggtttc

SEQ ID NO: 115063 - DNA, 25 bp, Homo sapien
ttcatttccttttacatctcttaca

SEQ ID NO: 115064 - DNA, 25 bp, Homo sapien
ttcatttctttttacatctcttaca

SEQ ID NO: 115065 - DNA, 25 bp, Homo sapien
ttcatttgtaaaccgtacgccttga

SEQ ID NO: 115066 - DNA, 25 bp, Homo sapien
ttcatttgtaaaccgtgcgccttga

SEQ ID NO: 115067 - DNA, 25 bp, Homo sapien
ttcatttgtctcaaggaatttttaa

SEQ ID NO: 115068 - DNA, 25 bp, Homo sapien
ttcatttgtctcgaggaatttttaa

SEQ ID NO: 115069 - DNA, 25 bp, Homo sapien
ttcatttgtttctgagaccaggaaa

SEQ ID NO: 115070 - DNA, 25 bp, Homo sapien
ttcatttgtttcttagaccaggaaa

SEQ ID NO: 115071 - DNA, 25 bp, Homo sapien
ttcattttacttatgtaaggaattg

SEQ ID NO: 115072 - DNA, 25 bp, Homo sapien
ttcattttacttctgtaaggaattg

SEQ ID NO: 115073 - DNA, 25 bp, Homo sapien
ttcattttatgtgagcaaatgggag

SEQ ID NO: 115074 - DNA, 25 bp, Homo sapien
ttcattttgtgagttttcttagttt

SEQ ID NO: 115075 - DNA, 25 bp, Homo sapien
ttcattttttgagttttcttagttt

SEQ ID NO: 115076 - DNA, 25 bp, Homo sapien
ttcattttttgtgagcaaatgggag

SEQ ID NO: 115077 - DNA, 25 bp, Homo sapien
ttcatttttttccctcaaagctgca

SEQ ID NO: 115078 - DNA, 25 bp, Homo sapien
ttcattttttttcctcaaagctgca

SEQ ID NO: 115079 - DNA, 25 bp, Homo sapien
ttccaaaaaggttagaagagatcag

SEQ ID NO: 115080 - DNA, 25 bp, Homo sapien
ttccaaaaaggtttgaagagatcag

SEQ ID NO: 115081 - DNA, 25 bp, Homo sapien
ttccaaaaagttcaagcctatcatc

SEQ ID NO: 115082 - DNA, 25 bp, Homo sapien
ttccaaaaagttcaagtctatcatc

SEQ ID NO: 115083 - DNA, 25 bp, Homo sapien
ttccaaaaatcagcttactggtaac

SEQ ID NO: 115084 - DNA, 25 bp, Homo sapien
ttccaaaaatcggcttactggtaac

SEQ ID NO: 115085 - DNA, 25 bp, Homo sapien
ttccaaaaggtcatatcatactgca

SEQ ID NO: 115086 - DNA, 25 bp, Homo sapien
ttccaaaaggtcgtatcatactgca

SEQ ID NO: 115087 - DNA, 25 bp, Homo sapien
ttccaaaatagctgcctaaaatgaa

SEQ ID NO: 115088 - DNA, 25 bp, Homo sapien
ttccaaaataggtgcctaaaatgaa

SEQ ID NO: 115089 - DNA, 25 bp, Homo sapien
ttccaaaattcatctcaaattaagg

SEQ ID NO: 115090 - DNA, 25 bp, Homo sapien
ttccaaaattcgtctcaaattaagg

SEQ ID NO: 115091 - DNA, 25 bp, Homo sapien
ttccaaacagaagattatttgctgg

SEQ ID NO: 115092 - DNA, 25 bp, Homo sapien
ttccaaacagaatattatttgctgg

SEQ ID NO: 115093 - DNA, 25 bp, Homo sapien
ttccaaacagagactagcaggtgca

SEQ ID NO: 115094 - DNA, 25 bp, Homo sapien
ttccaaaccaaagcaaggattaaaa

SEQ ID NO: 115095 - DNA, 25 bp, Homo sapien
ttccaaaccaaggcaaggattaaaa

SEQ ID NO: 115096 - DNA, 25 bp, Homo sapien
ttccaaaccgagactagcaggtgca

SEQ ID NO: 115097 - DNA, 25 bp, Homo sapien
ttccaaacttcacgatcgggtagta

SEQ ID NO: 115098 - DNA, 25 bp, Homo sapien
ttccaaacttcatgatcgggtagta

SEQ ID NO: 115099 - DNA, 25 bp, Homo sapien
ttccaaagacgatttattgaaaaga

SEQ ID NO: 115100 - DNA, 25 bp, Homo sapien
ttccaaagatgatttattgaaaaga

SEQ ID NO: 115101 - DNA, 25 bp, Homo sapien
ttccaaaggcactaatagcctcaac

SEQ ID NO: 115102 - DNA, 25 bp, Homo sapien
ttccaaaggcactagtagcctcaac

SEQ ID NO: 115103 - DNA, 25 bp, Homo sapien
ttccaaaggcaggtggttctaaaga

SEQ ID NO: 115104 - DNA, 25 bp, Homo sapien
ttccaaaggcagttggttctaaaga

SEQ ID NO: 115105 - DNA, 25 bp, Homo sapien
ttccaaataaaatggaaaaacctgg

SEQ ID NO: 115106 - DNA, 25 bp, Homo sapien
ttccaaataaaatggagaaacctgg

SEQ ID NO: 115107 - DNA, 25 bp, Homo sapien
ttccaaatggaccaaggaaaacaaa

SEQ ID NO: 115108 - DNA, 25 bp, Homo sapien
ttccaaatggaccagggaaaacaaa

SEQ ID NO: 115109 - DNA, 25 bp, Homo sapien
ttccaaatggctcacggttggagtc

SEQ ID NO: 115110 - DNA, 25 bp, Homo sapien
ttccaaatggctcatggttggagtc

SEQ ID NO: 115111 - DNA, 25 bp, Homo sapien
ttccaacaaacccattcataggtat

SEQ ID NO: 115112 - DNA, 25 bp, Homo sapien
ttccaacaaacccgttcataggtat

SEQ ID NO: 115113 - DNA, 25 bp, Homo sapien
ttccaacaaatagattaggaggatg

SEQ ID NO: 115114 - DNA, 25 bp, Homo sapien
ttccaacaagcatactttccagaga

SEQ ID NO: 115115 - DNA, 25 bp, Homo sapien
ttccaacaagcatattttccagaga

SEQ ID NO: 115116 - DNA, 25 bp, Homo sapien
ttccaacaagtagattaggaggatg

SEQ ID NO: 115117 - DNA, 25 bp, Homo sapien
ttccaacacgaacacaatgtatttg

SEQ ID NO: 115118 - DNA, 25 bp, Homo sapien
ttccaacacgagcacaatgtatttg

SEQ ID NO: 115119 - DNA, 25 bp, Homo sapien
ttccaacactgctttggttcacata

SEQ ID NO: 115120 - DNA, 25 bp, Homo sapien
ttccaacactgctttgtttcacata

SEQ ID NO: 115121 - DNA, 25 bp, Homo sapien
ttccaacagaacttcgtttacaaaa

SEQ ID NO: 115122 - DNA, 25 bp, Homo sapien
ttccaacagaatttcgtttacaaaa

SEQ ID NO: 115123 - DNA, 25 bp, Homo sapien
ttccaacatttaaagtatctgtcag

SEQ ID NO: 115124 - DNA, 25 bp, Homo sapien
ttccaacatttaaggtatctgtcag

SEQ ID NO: 115125 - DNA, 25 bp, Homo sapien
ttccaactaatatcatgaaactgat

SEQ ID NO: 115126 - DNA, 25 bp, Homo sapien
ttccaactaatatcgtgaaactgat

SEQ ID NO: 115127 - DNA, 25 bp, Homo sapien
ttccaactgacctactgatttccat

SEQ ID NO: 115128 - DNA, 25 bp, Homo sapien
ttccaactgacctcctgatttccat

SEQ ID NO: 115129 - DNA, 25 bp, Homo sapien
ttccaagaattactggactgtgcat

SEQ ID NO: 115130 - DNA, 25 bp, Homo sapien
ttccaagaattactgggctgtgcat

SEQ ID NO: 115131 - DNA, 25 bp, Homo sapien
ttccaagccatttaaccatgtccca

SEQ ID NO: 115132 - DNA, 25 bp, Homo sapien
ttccaagccatttaacgatgtccca

SEQ ID NO: 115133 - DNA, 25 bp, Homo sapien
ttccaagcgcggtcggctgtgtcag

SEQ ID NO: 115134 - DNA, 25 bp, Homo sapien
ttccaagcgcggttggctgtgtcag

SEQ ID NO: 115135 - DNA, 25 bp, Homo sapien
ttccaagctaagaccatgtgcgccc

SEQ ID NO: 115136 - DNA, 25 bp, Homo sapien
ttccaagctaagtccatgtgcgccc

SEQ ID NO: 115137 - DNA, 25 bp, Homo sapien
ttccaagctatttgcaactgtaaac

SEQ ID NO: 115138 - DNA, 25 bp, Homo sapien
ttccaagctctttgcaactgtaaac

SEQ ID NO: 115139 - DNA, 25 bp, Homo sapien
ttccaaggactctgggtcagcagct

SEQ ID NO: 115140 - DNA, 25 bp, Homo sapien
ttccaaggactctgtgtcagcagct

SEQ ID NO: 115141 - DNA, 25 bp, Homo sapien
ttccaaggagacagtggatggctgg

SEQ ID NO: 115142 - DNA, 25 bp, Homo sapien
ttccaaggagagagtggatggctgg

SEQ ID NO: 115143 - DNA, 25 bp, Homo sapien
ttccaaggttccgtgcaccaaatca

SEQ ID NO: 115144 - DNA, 25 bp, Homo sapien
ttccaaggttctgtgcaccaaatca

SEQ ID NO: 115145 - DNA, 25 bp, Homo sapien
ttccaagtcctatcttcttttcact

SEQ ID NO: 115146 - DNA, 25 bp, Homo sapien
ttccaagtcctgtcttcttttcact

SEQ ID NO: 115147 - DNA, 25 bp, Homo sapien
ttccaagtggagtagacagcaggaa

SEQ ID NO: 115148 - DNA, 25 bp, Homo sapien
ttccaagtggagtagatagcaggaa

SEQ ID NO: 115149 - DNA, 25 bp, Homo sapien
ttccaagtggcatatggactagttg

SEQ ID NO: 115150 - DNA, 25 bp, Homo sapien
ttccaagttgcatatggactagttg

SEQ ID NO: 115151 - DNA, 25 bp, Homo sapien
ttccaatatctctagtacatgatat

SEQ ID NO: 115152 - DNA, 25 bp, Homo sapien
ttccaatatttctagtacatgatat

SEQ ID NO: 115153 - DNA, 25 bp, Homo sapien
ttccaatcctccaggttctcataac

SEQ ID NO: 115154 - DNA, 25 bp, Homo sapien
ttccaatcctctaggttctcataac

SEQ ID NO: 115155 - DNA, 25 bp, Homo sapien
ttccaatgacatcaacttttattaa

SEQ ID NO: 115156 - DNA, 25 bp, Homo sapien
ttccaatgacatctacttttattaa

SEQ ID NO: 115157 - DNA, 25 bp, Homo sapien
ttccaatggccatacatttactaaa

SEQ ID NO: 115158 - DNA, 25 bp, Homo sapien
ttccaatggccttacatttactaaa

SEQ ID NO: 115159 - DNA, 25 bp, Homo sapien
ttccaatttcaacatttaggactct

SEQ ID NO: 115160 - DNA, 25 bp, Homo sapien
ttccaatttcaagatttaggactct

SEQ ID NO: 115161 - DNA, 25 bp, Homo sapien
ttccaatttgattggccacggtaag

SEQ ID NO: 115162 - DNA, 25 bp, Homo sapien
ttccaatttgattggctacggtaag

SEQ ID NO: 115163 - DNA, 25 bp, Homo sapien
ttccacaaaagctaggagtaataat

SEQ ID NO: 115164 - DNA, 25 bp, Homo sapien
ttccacaaaagctgggagtaataat

SEQ ID NO: 115165 - DNA, 25 bp, Homo sapien
ttccacaacggtatttggctacact

SEQ ID NO: 115166 - DNA, 25 bp, Homo sapien
ttccacaatggtatttggctacact

SEQ ID NO: 115167 - DNA, 25 bp, Homo sapien
ttccacagatttttgctcatgctgc

SEQ ID NO: 115168 - DNA, 25 bp, Homo sapien
ttccacagctttttgctcatgctgc

SEQ ID NO: 115169 - DNA, 25 bp, Homo sapien
ttccacatattacgtcatttaactc

SEQ ID NO: 115170 - DNA, 25 bp, Homo sapien
ttccacatattatgtcatttaactc

SEQ ID NO: 115171 - DNA, 25 bp, Homo sapien
ttccacatattcgatttgctaattc

SEQ ID NO: 115172 - DNA, 25 bp, Homo sapien
ttccacatatttgatttgctaattc

SEQ ID NO: 115173 - DNA, 25 bp, Homo sapien
ttccacatctcctttctgcacatgt

SEQ ID NO: 115174 - DNA, 25 bp, Homo sapien
ttccacatctcttttctgcacatgt

SEQ ID NO: 115175 - DNA, 25 bp, Homo sapien
ttccacattctgcacaccagtccaa

SEQ ID NO: 115176 - DNA, 25 bp, Homo sapien
ttccacattcttcacaccagtccaa

SEQ ID NO: 115177 - DNA, 25 bp, Homo sapien
ttccacatttttagaatcacttaac

SEQ ID NO: 115178 - DNA, 25 bp, Homo sapien
ttccacattttttgaatcacttaac

SEQ ID NO: 115179 - DNA, 25 bp, Homo sapien
ttccaccaaatcaagaggtaaacca

SEQ ID NO: 115180 - DNA, 25 bp, Homo sapien
ttccaccaaatcgagaggtaaacca

SEQ ID NO: 115181 - DNA, 25 bp, Homo sapien
ttccaccaatagcgtgtgaatggaa

SEQ ID NO: 115182 - DNA, 25 bp, Homo sapien
ttccaccaatagcttgtgaatggaa

SEQ ID NO: 115183 - DNA, 25 bp, Homo sapien
ttccaccacacagtctgtagcttct

SEQ ID NO: 115184 - DNA, 25 bp, Homo sapien
ttccaccatacagtctgtagcttct

SEQ ID NO: 115185 - DNA, 25 bp, Homo sapien
ttccacccaccaaggagaagcagtt

SEQ ID NO: 115186 - DNA, 25 bp, Homo sapien
ttccacccgccaaggagaagcagtt

SEQ ID NO: 115187 - DNA, 25 bp, Homo sapien
ttccactcaacaaggctgacttggc

SEQ ID NO: 115188 - DNA, 25 bp, Homo sapien
ttccactcaccaaggctgacttggc

SEQ ID NO: 115189 - DNA, 25 bp, Homo sapien
ttccactgctcaatccatacagtga

SEQ ID NO: 115190 - DNA, 25 bp, Homo sapien
ttccactgctcaatccgtacagtga

SEQ ID NO: 115191 - DNA, 25 bp, Homo sapien
ttccacttacattttatatctgaag

SEQ ID NO: 115192 - DNA, 25 bp, Homo sapien
ttccacttccgacggactacagctc

SEQ ID NO: 115193 - DNA, 25 bp, Homo sapien
ttccacttccgatggactacagctc

SEQ ID NO: 115194 - DNA, 25 bp, Homo sapien
ttccacttgcattttatatctgaag

SEQ ID NO: 115195 - DNA, 25 bp, Homo sapien
ttccactttgtcacatgccagatac

SEQ ID NO: 115196 - DNA, 25 bp, Homo sapien
ttccactttgtcacttgccagatac

SEQ ID NO: 115197 - DNA, 25 bp, Homo sapien
ttccagaagaaattacttgaaagtt

SEQ ID NO: 115198 - DNA, 25 bp, Homo sapien
ttccagaagaagttacttgaaagtt

SEQ ID NO: 115199 - DNA, 25 bp, Homo sapien
ttccagaagcactcataatgggctt

SEQ ID NO: 115200 - DNA, 25 bp, Homo sapien
ttccagaagtactcataatgggctt

SEQ ID NO: 115201 - DNA, 25 bp, Homo sapien
ttccagactgtgacgaactgggcaa

SEQ ID NO: 115202 - DNA, 25 bp, Homo sapien
ttccagactgtgatgaactgggcaa

SEQ ID NO: 115203 - DNA, 25 bp, Homo sapien
ttccagagaatataagaaggatcac

SEQ ID NO: 115204 - DNA, 25 bp, Homo sapien
ttccagagactataagaaggatcac

SEQ ID NO: 115205 - DNA, 25 bp, Homo sapien
ttccagagcaaagcaaagagaggga

SEQ ID NO: 115206 - DNA, 25 bp, Homo sapien
ttccagagcaaaggaaagagaggga

SEQ ID NO: 115207 - DNA, 25 bp, Homo sapien
ttccagagcaggtaatgtcagacct

SEQ ID NO: 115208 - DNA, 25 bp, Homo sapien
ttccagagtaggtaatgtcagacct

SEQ ID NO: 115209 - DNA, 25 bp, Homo sapien
ttccagattggcttgaacagagagg

SEQ ID NO: 115210 - DNA, 25 bp, Homo sapien
ttccagattggcttgagcagagagg

SEQ ID NO: 115211 - DNA, 25 bp, Homo sapien
ttccagatttttggaattctgtatt

SEQ ID NO: 115212 - DNA, 25 bp, Homo sapien
ttccagattttttgaattctgtatt

SEQ ID NO: 115213 - DNA, 25 bp, Homo sapien
ttccagccattatcattatccatta

SEQ ID NO: 115214 - DNA, 25 bp, Homo sapien
ttccagccattgtcattatccatta

SEQ ID NO: 115215 - DNA, 25 bp, Homo sapien
ttccagcccatgctgaggttcgagg

SEQ ID NO: 115216 - DNA, 25 bp, Homo sapien
ttccagcccgtgctgaggttcgagg

SEQ ID NO: 115217 - DNA, 25 bp, Homo sapien
ttccagcctttctattgaagttttc

SEQ ID NO: 115218 - DNA, 25 bp, Homo sapien
ttccagcctttttattgaagttttc

SEQ ID NO: 115219 - DNA, 25 bp, Homo sapien
ttccagctcagagcacccaactaag

SEQ ID NO: 115220 - DNA, 25 bp, Homo sapien
ttccagctcagagtacccaactaag

SEQ ID NO: 115221 - DNA, 25 bp, Homo sapien
ttccagctctacaactcactaccta

SEQ ID NO: 115222 - DNA, 25 bp, Homo sapien
ttccagctttacaactcactaccta

SEQ ID NO: 115223 - DNA, 25 bp, Homo sapien
ttccaggaagcagactgtggactta

SEQ ID NO: 115224 - DNA, 25 bp, Homo sapien
ttccaggaagcagattgtggactta

SEQ ID NO: 115225 - DNA, 25 bp, Homo sapien
ttccaggaccacaatttgcttgctg

SEQ ID NO: 115226 - DNA, 25 bp, Homo sapien
ttccaggaccacgatttgcttgctg

SEQ ID NO: 115227 - DNA, 25 bp, Homo sapien
ttccaggatcccagcgccttcttcc

SEQ ID NO: 115228 - DNA, 25 bp, Homo sapien
ttccaggatcccagtgccttcttcc

SEQ ID NO: 115229 - DNA, 25 bp, Homo sapien
ttccaggcacatcctaactcaggat

SEQ ID NO: 115230 - DNA, 25 bp, Homo sapien
ttccaggcacattctaactcaggat

SEQ ID NO: 115231 - DNA, 25 bp, Homo sapien
ttccaggcttgtagaagtagcttcc

SEQ ID NO: 115232 - DNA, 25 bp, Homo sapien
ttccaggcttgtagaattagcttcc

SEQ ID NO: 115233 - DNA, 25 bp, Homo sapien
ttccagggcttgcattttttagtta

SEQ ID NO: 115234 - DNA, 25 bp, Homo sapien
ttccagggtttgcattttttagtta

SEQ ID NO: 115235 - DNA, 25 bp, Homo sapien
ttccaggtccatgttttcagaggcc

SEQ ID NO: 115236 - DNA, 25 bp, Homo sapien
ttccaggtccattttttcagaggcc

SEQ ID NO: 115237 - DNA, 25 bp, Homo sapien
ttccagtggcaggtcacttgcaaat

SEQ ID NO: 115238 - DNA, 25 bp, Homo sapien
ttccagtggcaggtcatttgcaaat

SEQ ID NO: 115239 - DNA, 25 bp, Homo sapien
ttccagtgtactaccaccaacaatt

SEQ ID NO: 115240 - DNA, 25 bp, Homo sapien
ttccagtgtactactaccaacaatt

SEQ ID NO: 115241 - DNA, 25 bp, Homo sapien
ttccataaacagcagaaagccattg

SEQ ID NO: 115242 - DNA, 25 bp, Homo sapien
ttccataagcagcagaaagccattg

SEQ ID NO: 115243 - DNA, 25 bp, Homo sapien
ttccataatgcaggaagaaaccttc

SEQ ID NO: 115244 - DNA, 25 bp, Homo sapien
ttccataattcaggaagaaaccttc

SEQ ID NO: 115245 - DNA, 25 bp, Homo sapien
ttccataccacactctcttcactat

SEQ ID NO: 115246 - DNA, 25 bp, Homo sapien
ttccataccacagtctcttcactat

SEQ ID NO: 115247 - DNA, 25 bp, Homo sapien
ttccatagtcgtcatgagctaacac

SEQ ID NO: 115248 - DNA, 25 bp, Homo sapien
ttccatagttgtcatgagctaacac

SEQ ID NO: 115249 - DNA, 25 bp, Homo sapien
ttccatcagtgtagcctaatctact

SEQ ID NO: 115250 - DNA, 25 bp, Homo sapien
ttccatcagtgtcgcctaatctact

SEQ ID NO: 115251 - DNA, 25 bp, Homo sapien
ttccatcatccaccagaagaatgtg

SEQ ID NO: 115252 - DNA, 25 bp, Homo sapien
ttccatcatccaccaggagaatgtg

SEQ ID NO: 115253 - DNA, 25 bp, Homo sapien
ttccatcatggtatgacctctgttt

SEQ ID NO: 115254 - DNA, 25 bp, Homo sapien
ttccatcatggtatgagctctgttt

SEQ ID NO: 115255 - DNA, 25 bp, Homo sapien
ttccatccatcaacccatttgctga

SEQ ID NO: 115256 - DNA, 25 bp, Homo sapien
ttccatccgtcaacccatttgctga

SEQ ID NO: 115257 - DNA, 25 bp, Homo sapien
ttccatccttaaagacagaatagga

SEQ ID NO: 115258 - DNA, 25 bp, Homo sapien
ttccatccttaaatacagaatagga

SEQ ID NO: 115259 - DNA, 25 bp, Homo sapien
ttccatctcaattgtacagacaacc

SEQ ID NO: 115260 - DNA, 25 bp, Homo sapien
ttccatctgaattgtacagacaacc

SEQ ID NO: 115261 - DNA, 25 bp, Homo sapien
ttccatgaacacgatatttttgtaa

SEQ ID NO: 115262 - DNA, 25 bp, Homo sapien
ttccatgaacactatatttttgtaa

SEQ ID NO: 115263 - DNA, 25 bp, Homo sapien
ttccatgagaccttcagagatccat

SEQ ID NO: 115264 - DNA, 25 bp, Homo sapien
ttccatgaggccttcagagatccat

SEQ ID NO: 115265 - DNA, 25 bp, Homo sapien
ttccatgcaagaccatacaagtgag

SEQ ID NO: 115266 - DNA, 25 bp, Homo sapien
ttccatgcacgaccatacaagtgag

SEQ ID NO: 115267 - DNA, 25 bp, Homo sapien
ttccatggtcttggttcattttcac

SEQ ID NO: 115268 - DNA, 25 bp, Homo sapien
ttccatggtctttgttcattttcac

SEQ ID NO: 115269 - DNA, 25 bp, Homo sapien
ttccatggttttacgcaaatgtctg

SEQ ID NO: 115270 - DNA, 25 bp, Homo sapien
ttccatggttttatgcaaatgtctg

SEQ ID NO: 115271 - DNA, 25 bp, Homo sapien
ttccatgtatccatcttaattctgc

SEQ ID NO: 115272 - DNA, 25 bp, Homo sapien
ttccatgtatccctcttaattctgc

SEQ ID NO: 115273 - DNA, 25 bp, Homo sapien
ttccatgtcctctctgggcgtgcca

SEQ ID NO: 115274 - DNA, 25 bp, Homo sapien
ttccatgtcgtctctgggcgtgcca

SEQ ID NO: 115275 - DNA, 25 bp, Homo sapien
ttccatgttaaccctactaccacat

SEQ ID NO: 115276 - DNA, 25 bp, Homo sapien
ttccatgttaaccttactaccacat

SEQ ID NO: 115277 - DNA, 25 bp, Homo sapien
ttccatgttcctataaaaatggggt

SEQ ID NO: 115278 - DNA, 25 bp, Homo sapien
ttccatgttgctataaaaatggggt

SEQ ID NO: 115279 - DNA, 25 bp, Homo sapien
ttccattaattgcgtctcttttcta

SEQ ID NO: 115280 - DNA, 25 bp, Homo sapien
ttccattaattgtgtctcttttcta

SEQ ID NO: 115281 - DNA, 25 bp, Homo sapien
ttccattagatgacgtgtgatcaga

SEQ ID NO: 115282 - DNA, 25 bp, Homo sapien
ttccattagatgatgtgtgatcaga

SEQ ID NO: 115283 - DNA, 25 bp, Homo sapien
ttccattattcccattgttggttta

SEQ ID NO: 115284 - DNA, 25 bp, Homo sapien
ttccattattcccgttgttggttta

SEQ ID NO: 115285 - DNA, 25 bp, Homo sapien
ttccattcctgttacacttgggagt

SEQ ID NO: 115286 - DNA, 25 bp, Homo sapien
ttccattctgcacttggtggccaca

SEQ ID NO: 115287 - DNA, 25 bp, Homo sapien
ttccattctgcatttggtggccaca

SEQ ID NO: 115288 - DNA, 25 bp, Homo sapien
ttccattcttgttacacttgggagt

SEQ ID NO: 115289 - DNA, 25 bp, Homo sapien
ttccattgaatccaggaatatatct

SEQ ID NO: 115290 - DNA, 25 bp, Homo sapien
ttccattgacagcagtgattgaaag

SEQ ID NO: 115291 - DNA, 25 bp, Homo sapien
ttccattgacagcggtgattgaaag

SEQ ID NO: 115292 - DNA, 25 bp, Homo sapien
ttccattgattccaggaatatatct

SEQ ID NO: 115293 - DNA, 25 bp, Homo sapien
ttccattgcagttccccgtaaatag

SEQ ID NO: 115294 - DNA, 25 bp, Homo sapien
ttccattgcagttccctgtaaatag

SEQ ID NO: 115295 - DNA, 25 bp, Homo sapien
ttccattgcatttagagaacatcca

SEQ ID NO: 115296 - DNA, 25 bp, Homo sapien
ttccattgcgtttagagaacatcca

SEQ ID NO: 115297 - DNA, 25 bp, Homo sapien
ttccatttcttttatacatcatagg

SEQ ID NO: 115298 - DNA, 25 bp, Homo sapien
ttccatttcttttgtacatcatagg

SEQ ID NO: 115299 - DNA, 25 bp, Homo sapien
ttccatttgagatacagctctggat

SEQ ID NO: 115300 - DNA, 25 bp, Homo sapien
ttccatttgagttacagctctggat

SEQ ID NO: 115301 - DNA, 25 bp, Homo sapien
ttccatttgctctgccattcaaaac

SEQ ID NO: 115302 - DNA, 25 bp, Homo sapien
ttccatttgttctgccattcaaaac

SEQ ID NO: 115303 - DNA, 25 bp, Homo sapien
ttccattttgaatcggtgctacttt

SEQ ID NO: 115304 - DNA, 25 bp, Homo sapien
ttccattttgaattggtgctacttt

SEQ ID NO: 115305 - DNA, 25 bp, Homo sapien
ttcccaaatatagcacattcgcaac

SEQ ID NO: 115306 - DNA, 25 bp, Homo sapien
ttcccaaatatagtacattcgcaac

SEQ ID NO: 115307 - DNA, 25 bp, Homo sapien
ttcccaacaagtctggctacgagtc

SEQ ID NO: 115308 - DNA, 25 bp, Homo sapien
ttcccaacaagtttggctacgagtc

SEQ ID NO: 115309 - DNA, 25 bp, Homo sapien
ttcccaagtccaaatcagtttctta

SEQ ID NO: 115310 - DNA, 25 bp, Homo sapien
ttcccaagtccgaatcagtttctta

SEQ ID NO: 115311 - DNA, 25 bp, Homo sapien
ttcccaatcttatagacaatgagca

SEQ ID NO: 115312 - DNA, 25 bp, Homo sapien
ttcccaatgttatagacaatgagca

SEQ ID NO: 115313 - DNA, 25 bp, Homo sapien
ttcccaatttgcgtttttatttgct

SEQ ID NO: 115314 - DNA, 25 bp, Homo sapien
ttcccaatttgtgtttttatttgct

SEQ ID NO: 115315 - DNA, 25 bp, Homo sapien
ttcccacgaaacaatgacttctctt

SEQ ID NO: 115316 - DNA, 25 bp, Homo sapien
ttcccacgaaacgatgacttctctt

SEQ ID NO: 115317 - DNA, 25 bp, Homo sapien
ttcccactaaccaaagattatttaa

SEQ ID NO: 115318 - DNA, 25 bp, Homo sapien
ttcccactaaccgaagattatttaa

SEQ ID NO: 115319 - DNA, 25 bp, Homo sapien
ttcccacttctcacttctgcctctg

SEQ ID NO: 115320 - DNA, 25 bp, Homo sapien
ttcccacttctcgcttctgcctctg

SEQ ID NO: 115321 - DNA, 25 bp, Homo sapien
ttcccagcctcctgatctatgagaa

SEQ ID NO: 115322 - DNA, 25 bp, Homo sapien
ttcccagcctcctgatttatgagaa

SEQ ID NO: 115323 - DNA, 25 bp, Homo sapien
ttcccaggagccactgcaaatgatg

SEQ ID NO: 115324 - DNA, 25 bp, Homo sapien
ttcccaggagccattgcaaatgatg

SEQ ID NO: 115325 - DNA, 25 bp, Homo sapien
ttcccaggattcatttccatctttt

SEQ ID NO: 115326 - DNA, 25 bp, Homo sapien
ttcccaggattcgtttccatctttt

SEQ ID NO: 115327 - DNA, 25 bp, Homo sapien
ttcccaggctactcccagccaatga

SEQ ID NO: 115328 - DNA, 25 bp, Homo sapien
ttcccaggctactcccggccaatga

SEQ ID NO: 115329 - DNA, 25 bp, Homo sapien
ttcccaggtgaacgaaccctagctc

SEQ ID NO: 115330 - DNA, 25 bp, Homo sapien
ttcccaggtgaactaaccctagctc

SEQ ID NO: 115331 - DNA, 25 bp, Homo sapien
ttcccagtgatcacactatttcacc

SEQ ID NO: 115332 - DNA, 25 bp, Homo sapien
ttcccagtgatcatactatttcacc

SEQ ID NO: 115333 - DNA, 25 bp, Homo sapien
ttcccatatacatacttttttctgt

SEQ ID NO: 115334 - DNA, 25 bp, Homo sapien
ttcccatatacatatttttttctgt

SEQ ID NO: 115335 - DNA, 25 bp, Homo sapien
ttcccatgacccaaatttaccatcc

SEQ ID NO: 115336 - DNA, 25 bp, Homo sapien
ttcccatgacccagatttaccatcc

SEQ ID NO: 115337 - DNA, 25 bp, Homo sapien
ttcccatgtgatttgagtgtgcatg

SEQ ID NO: 115338 - DNA, 25 bp, Homo sapien
ttcccatgttataattccctgtctt

SEQ ID NO: 115339 - DNA, 25 bp, Homo sapien
ttcccatgttatacttccctgtctt

SEQ ID NO: 115340 - DNA, 25 bp, Homo sapien
ttcccatgttatttgagtgtgcatg

SEQ ID NO: 115341 - DNA, 25 bp, Homo sapien
ttcccattagatcctgacctgcctc

SEQ ID NO: 115342 - DNA, 25 bp, Homo sapien
ttcccattagatcttgacctgcctc

SEQ ID NO: 115343 - DNA, 25 bp, Homo sapien
ttcccattctccacatggtagtggc

SEQ ID NO: 115344 - DNA, 25 bp, Homo sapien
ttcccattctccacgtggtagtggc

SEQ ID NO: 115345 - DNA, 25 bp, Homo sapien
ttccccacagggctaggatgattaa

SEQ ID NO: 115346 - DNA, 25 bp, Homo sapien
ttccccacagggttaggatgattaa

SEQ ID NO: 115347 - DNA, 25 bp, Homo sapien
ttccccaccagcgtgtttttctctg

SEQ ID NO: 115348 - DNA, 25 bp, Homo sapien
ttccccaccagtgtgtttttctctg

SEQ ID NO: 115349 - DNA, 25 bp, Homo sapien
ttccccaggtcatttgggttttccc

SEQ ID NO: 115350 - DNA, 25 bp, Homo sapien
ttccccaggtcgtttgggttttccc

SEQ ID NO: 115351 - DNA, 25 bp, Homo sapien
ttccccagtcatctgccgtcactca

SEQ ID NO: 115352 - DNA, 25 bp, Homo sapien
ttccccagtcatctgctgtcactca

SEQ ID NO: 115353 - DNA, 25 bp, Homo sapien
ttccccatattgcgatggtagtaga

SEQ ID NO: 115354 - DNA, 25 bp, Homo sapien
ttccccatattgtgatggtagtaga

SEQ ID NO: 115355 - DNA, 25 bp, Homo sapien
ttcccccagagagttacaatggtga

SEQ ID NO: 115356 - DNA, 25 bp, Homo sapien
ttcccccagagagttataatggtga

SEQ ID NO: 115357 - DNA, 25 bp, Homo sapien
ttcccccagtccatgctgcaaccac

SEQ ID NO: 115358 - DNA, 25 bp, Homo sapien
ttcccccagtccttgctgcaaccac

SEQ ID NO: 115359 - DNA, 25 bp, Homo sapien
ttccccgaggcatcagttactatca

SEQ ID NO: 115360 - DNA, 25 bp, Homo sapien
ttccccgaggcatcggttactatca

SEQ ID NO: 115361 - DNA, 25 bp, Homo sapien
ttcccctcttcctaacaaagcatcc

SEQ ID NO: 115362 - DNA, 25 bp, Homo sapien
ttcccctcttcctatcaaagcatcc

SEQ ID NO: 115363 - DNA, 25 bp, Homo sapien
ttcccctgattaacgagaacactct

SEQ ID NO: 115364 - DNA, 25 bp, Homo sapien
ttcccctgattaaggagaacactct

SEQ ID NO: 115365 - DNA, 25 bp, Homo sapien
ttccctaacattaagcatttttgct

SEQ ID NO: 115366 - DNA, 25 bp, Homo sapien
ttccctaacgttaagcatttttgct

SEQ ID NO: 115367 - DNA, 25 bp, Homo sapien
ttccctaactgactacaattagggg

SEQ ID NO: 115368 - DNA, 25 bp, Homo sapien
ttccctaactgactaccattagggg

SEQ ID NO: 115369 - DNA, 25 bp, Homo sapien
ttccctacttgcagcggccatagca

SEQ ID NO: 115370 - DNA, 25 bp, Homo sapien
ttccctacttgcagtggccatagca

SEQ ID NO: 115371 - DNA, 25 bp, Homo sapien
ttccctatactcttcctctctcccc

SEQ ID NO: 115372 - DNA, 25 bp, Homo sapien
ttccctatagtcttcctctctcccc

SEQ ID NO: 115373 - DNA, 25 bp, Homo sapien
ttccctatggcctatggacttactg

SEQ ID NO: 115374 - DNA, 25 bp, Homo sapien
ttccctatggcctgtggacttactg

SEQ ID NO: 115375 - DNA, 25 bp, Homo sapien
ttccctcagaacattgcacacgtgt

SEQ ID NO: 115376 - DNA, 25 bp, Homo sapien
ttccctcaggtttgctctaaataca

SEQ ID NO: 115377 - DNA, 25 bp, Homo sapien
ttccctcaggtttgctgtaaataca

SEQ ID NO: 115378 - DNA, 25 bp, Homo sapien
ttccctcataacattgcacacgtgt

SEQ ID NO: 115379 - DNA, 25 bp, Homo sapien
ttccctgcaaaaccaaacttgatga

SEQ ID NO: 115380 - DNA, 25 bp, Homo sapien
ttccctgccaaaccaaacttgatga

SEQ ID NO: 115381 - DNA, 25 bp, Homo sapien
ttccctggatttcaatttggtaggc

SEQ ID NO: 115382 - DNA, 25 bp, Homo sapien
ttccctgggattagtctccaggcat

SEQ ID NO: 115383 - DNA, 25 bp, Homo sapien
ttccctgggattcgtctccaggcat

SEQ ID NO: 115384 - DNA, 25 bp, Homo sapien
ttccctgggtttcaatttggtaggc

SEQ ID NO: 115385 - DNA, 25 bp, Homo sapien
ttccctgtaatcacagaaaaacgca

SEQ ID NO: 115386 - DNA, 25 bp, Homo sapien
ttccctgtaatcatagaaaaacgca

SEQ ID NO: 115387 - DNA, 25 bp, Homo sapien
ttccctgtatttcttggtttcagta

SEQ ID NO: 115388 - DNA, 25 bp, Homo sapien
ttccctgtatttgttggtttcagta

SEQ ID NO: 115389 - DNA, 25 bp, Homo sapien
ttccctgtgtcataagtaagctcat

SEQ ID NO: 115390 - DNA, 25 bp, Homo sapien
ttccctgtttcataagtaagctcat

SEQ ID NO: 115391 - DNA, 25 bp, Homo sapien
ttcccttacaagctgaatgtcccta

SEQ ID NO: 115392 - DNA, 25 bp, Homo sapien
ttcccttaccagctgaatgtcccta

SEQ ID NO: 115393 - DNA, 25 bp, Homo sapien
ttcccttcaatggattccaggctgc

SEQ ID NO: 115394 - DNA, 25 bp, Homo sapien
ttcccttcaatgtattccaggctgc

SEQ ID NO: 115395 - DNA, 25 bp, Homo sapien
ttcccttctaagcaccctggtgatt

SEQ ID NO: 115396 - DNA, 25 bp, Homo sapien
ttcccttctaaggaccctggtgatt

SEQ ID NO: 115397 - DNA, 25 bp, Homo sapien
ttccctttccaccttcactgacttg

SEQ ID NO: 115398 - DNA, 25 bp, Homo sapien
ttccctttccactttcactgacttg

SEQ ID NO: 115399 - DNA, 25 bp, Homo sapien
ttccgatcacttacctgtttgttct

SEQ ID NO: 115400 - DNA, 25 bp, Homo sapien
ttccgatcacttatctgtttgttct

SEQ ID NO: 115401 - DNA, 25 bp, Homo sapien
ttccgcctctagcactcttttgcct

SEQ ID NO: 115402 - DNA, 25 bp, Homo sapien
ttccgcctctagcgctcttttgcct

SEQ ID NO: 115403 - DNA, 25 bp, Homo sapien
ttccgctcatttccagtgatccact

SEQ ID NO: 115404 - DNA, 25 bp, Homo sapien
ttccgctcattttcagtgatccact

SEQ ID NO: 115405 - DNA, 25 bp, Homo sapien
ttccgctcctgtctcaacagaatca

SEQ ID NO: 115406 - DNA, 25 bp, Homo sapien
ttccgctcctgtgtcaacagaatca

SEQ ID NO: 115407 - DNA, 25 bp, Homo sapien
ttccgcttgaaaatagccaaaaagt

SEQ ID NO: 115408 - DNA, 25 bp, Homo sapien
ttccgcttgaaaataggcaaaaagt

SEQ ID NO: 115409 - DNA, 25 bp, Homo sapien
ttccgcttggccaatttaaagagaa

SEQ ID NO: 115410 - DNA, 25 bp, Homo sapien
ttccgcttggctaatttaaagagaa

SEQ ID NO: 115411 - DNA, 25 bp, Homo sapien
ttccggagggagagaaccgctaaaa

SEQ ID NO: 115412 - DNA, 25 bp, Homo sapien
ttccggagggagagaatcgctaaaa

SEQ ID NO: 115413 - DNA, 25 bp, Homo sapien
ttccggaggtagacaggccactagg

SEQ ID NO: 115414 - DNA, 25 bp, Homo sapien
ttccggaggtagacgggccactagg

SEQ ID NO: 115415 - DNA, 25 bp, Homo sapien
ttccggatatcagcaccaactaaac

SEQ ID NO: 115416 - DNA, 25 bp, Homo sapien
ttccggatatcagctccaactaaac

SEQ ID NO: 115417 - DNA, 25 bp, Homo sapien
ttccgtaacgcaagtagagtacact

SEQ ID NO: 115418 - DNA, 25 bp, Homo sapien
ttccgtaacgcaggtagagtacact

SEQ ID NO: 115419 - DNA, 25 bp, Homo sapien
ttccgtcactccgaaaacatgaagt

SEQ ID NO: 115420 - DNA, 25 bp, Homo sapien
ttccgtcactctgaaaacatgaagt

SEQ ID NO: 115421 - DNA, 25 bp, Homo sapien
ttccgtctctgccatcatgacagaa

SEQ ID NO: 115422 - DNA, 25 bp, Homo sapien
ttccgtctctgccttcatgacagaa

SEQ ID NO: 115423 - DNA, 25 bp, Homo sapien
ttccgtgccctcctgtttttgatct

SEQ ID NO: 115424 - DNA, 25 bp, Homo sapien
ttccgtgccttcctgtttttgatct

SEQ ID NO: 115425 - DNA, 25 bp, Homo sapien
ttcctaaacacactctaccatctta

SEQ ID NO: 115426 - DNA, 25 bp, Homo sapien
ttcctaaacacattctaccatctta

SEQ ID NO: 115427 - DNA, 25 bp, Homo sapien
ttcctaaatatgctctgtaaaacac

SEQ ID NO: 115428 - DNA, 25 bp, Homo sapien
ttcctaaatcatgatcccagtgctg

SEQ ID NO: 115429 - DNA, 25 bp, Homo sapien
ttcctaaatgtgctctgtaaaacac

SEQ ID NO: 115430 - DNA, 25 bp, Homo sapien
ttcctaaattatgatcccagtgctg

SEQ ID NO: 115431 - DNA, 25 bp, Homo sapien
ttcctaacaataaaccacattctag

SEQ ID NO: 115432 - DNA, 25 bp, Homo sapien
ttcctaacactaaaccacattctag

SEQ ID NO: 115433 - DNA, 25 bp, Homo sapien
ttcctaacctctaaggcatttcaga

SEQ ID NO: 115434 - DNA, 25 bp, Homo sapien
ttcctaacctctgaggcatttcaga

SEQ ID NO: 115435 - DNA, 25 bp, Homo sapien
ttcctaagacatttcaacatgtgat

SEQ ID NO: 115436 - DNA, 25 bp, Homo sapien
ttcctaagatatttcaacatgtgat

SEQ ID NO: 115437 - DNA, 25 bp, Homo sapien
ttcctaaggctgccataaaaaatca

SEQ ID NO: 115438 - DNA, 25 bp, Homo sapien
ttcctaaggctgccgtaaaaaatca

SEQ ID NO: 115439 - DNA, 25 bp, Homo sapien
ttcctaaggtttccgactcagatcc

SEQ ID NO: 115440 - DNA, 25 bp, Homo sapien
ttcctaaggtttctgactcagatcc

SEQ ID NO: 115441 - DNA, 25 bp, Homo sapien
ttcctaatctgaaaaatctttttat

SEQ ID NO: 115442 - DNA, 25 bp, Homo sapien
ttcctaatctgagaaatctttttat

SEQ ID NO: 115443 - DNA, 25 bp, Homo sapien
ttcctaattggcataccttttattt

SEQ ID NO: 115444 - DNA, 25 bp, Homo sapien
ttcctaattggcatactttttattt

SEQ ID NO: 115445 - DNA, 25 bp, Homo sapien
ttcctaatttatattgcacttacaa

SEQ ID NO: 115446 - DNA, 25 bp, Homo sapien
ttcctaatttatgttgcacttacaa

SEQ ID NO: 115447 - DNA, 25 bp, Homo sapien
ttcctacaagccagtataataacac

SEQ ID NO: 115448 - DNA, 25 bp, Homo sapien
ttcctacaaggtctggtgacttaat

SEQ ID NO: 115449 - DNA, 25 bp, Homo sapien
ttcctacactacagtttggttccaa

SEQ ID NO: 115450 - DNA, 25 bp, Homo sapien
ttcctacactatagtttggttccaa

SEQ ID NO: 115451 - DNA, 25 bp, Homo sapien
ttcctacaggccagtataataacac

SEQ ID NO: 115452 - DNA, 25 bp, Homo sapien
ttcctacagggtctggtgacttaat

SEQ ID NO: 115453 - DNA, 25 bp, Homo sapien
ttcctaccactatggtccagatcct

SEQ ID NO: 115454 - DNA, 25 bp, Homo sapien
ttcctaccgctatggtccagatcct

SEQ ID NO: 115455 - DNA, 25 bp, Homo sapien
ttcctacctttcaaaataggagcca

SEQ ID NO: 115456 - DNA, 25 bp, Homo sapien
ttcctacctttcaatataggagcca

SEQ ID NO: 115457 - DNA, 25 bp, Homo sapien
ttcctactagctataagagtgttct

SEQ ID NO: 115458 - DNA, 25 bp, Homo sapien
ttcctactagctgtaagagtgttct

SEQ ID NO: 115459 - DNA, 25 bp, Homo sapien
ttcctactgtttgatttgtcctttt

SEQ ID NO: 115460 - DNA, 25 bp, Homo sapien
ttcctactgttttatttgtcctttt

SEQ ID NO: 115461 - DNA, 25 bp, Homo sapien
ttcctacttaacgttacgccctctc

SEQ ID NO: 115462 - DNA, 25 bp, Homo sapien
ttcctacttaacgttatgccctctc

SEQ ID NO: 115463 - DNA, 25 bp, Homo sapien
ttcctagaaaggatatatgaatgca

SEQ ID NO: 115464 - DNA, 25 bp, Homo sapien
ttcctagaaagggtatatgaatgca

SEQ ID NO: 115465 - DNA, 25 bp, Homo sapien
ttcctagaccactctgaccttgccc

SEQ ID NO: 115466 - DNA, 25 bp, Homo sapien
ttcctagaccactttgaccttgccc

SEQ ID NO: 115467 - DNA, 25 bp, Homo sapien
ttcctagagctgttgtaaggcttaa

SEQ ID NO: 115468 - DNA, 25 bp, Homo sapien
ttcctagatctgttgtaaggcttaa

SEQ ID NO: 115469 - DNA, 25 bp, Homo sapien
ttcctagcacagcatttcttcattc

SEQ ID NO: 115470 - DNA, 25 bp, Homo sapien
ttcctagcacagcgtttcttcattc

SEQ ID NO: 115471 - DNA, 25 bp, Homo sapien
ttcctagtctgctagttgatatctg

SEQ ID NO: 115472 - DNA, 25 bp, Homo sapien
ttcctagtgtgctagttgatatctg

SEQ ID NO: 115473 - DNA, 25 bp, Homo sapien
ttcctatacctaccactacttgagg

SEQ ID NO: 115474 - DNA, 25 bp, Homo sapien
ttcctatacttaccactacttgagg

SEQ ID NO: 115475 - DNA, 25 bp, Homo sapien
ttcctatcaacagcacacaaacctt

SEQ ID NO: 115476 - DNA, 25 bp, Homo sapien
ttcctatcaacatcacacaaacctt

SEQ ID NO: 115477 - DNA, 25 bp, Homo sapien
ttcctatccttctgtggacagtgaa

SEQ ID NO: 115478 - DNA, 25 bp, Homo sapien
ttcctatccttttgtggacagtgaa

SEQ ID NO: 115479 - DNA, 25 bp, Homo sapien
ttcctatcttgactttatgttttta

SEQ ID NO: 115480 - DNA, 25 bp, Homo sapien
ttcctatcttgattttatgttttta

SEQ ID NO: 115481 - DNA, 25 bp, Homo sapien
ttcctatgataccgtatcttctgga

SEQ ID NO: 115482 - DNA, 25 bp, Homo sapien
ttcctatgatactgtatcttctgga

SEQ ID NO: 115483 - DNA, 25 bp, Homo sapien
ttcctcaaacagttcctgctaatgc

SEQ ID NO: 115484 - DNA, 25 bp, Homo sapien
ttcctcaaacatttcctgctaatgc

SEQ ID NO: 115485 - DNA, 25 bp, Homo sapien
ttcctcaaatccattaaatttttcc

SEQ ID NO: 115486 - DNA, 25 bp, Homo sapien
ttcctcaaatccgttaaatttttcc

SEQ ID NO: 115487 - DNA, 25 bp, Homo sapien
ttcctcaagggatcaaatcaaacct

SEQ ID NO: 115488 - DNA, 25 bp, Homo sapien
ttcctcaatggatcaaatcaaacct

SEQ ID NO: 115489 - DNA, 25 bp, Homo sapien
ttcctcacaaaatggcacatcccgc

SEQ ID NO: 115490 - DNA, 25 bp, Homo sapien
ttcctcacaaaatggctcatcccgc

SEQ ID NO: 115491 - DNA, 25 bp, Homo sapien
ttcctcactaatatctataagggca

SEQ ID NO: 115492 - DNA, 25 bp, Homo sapien
ttcctcactaatctctataagggca

SEQ ID NO: 115493 - DNA, 25 bp, Homo sapien
ttcctcactactctcaaaaatcaga

SEQ ID NO: 115494 - DNA, 25 bp, Homo sapien
ttcctcactactctcagaaatcaga

SEQ ID NO: 115495 - DNA, 25 bp, Homo sapien
ttcctcagccttctggacccgtctg

SEQ ID NO: 115496 - DNA, 25 bp, Homo sapien
ttcctcaggcttctggacccgtctg

SEQ ID NO: 115497 - DNA, 25 bp, Homo sapien
ttcctcatcagtaaagcggattcac

SEQ ID NO: 115498 - DNA, 25 bp, Homo sapien
ttcctcatcagtaaagtggattcac

SEQ ID NO: 115499 - DNA, 25 bp, Homo sapien
ttcctcatgatacaatggcatgccc

SEQ ID NO: 115500 - DNA, 25 bp, Homo sapien
ttcctcatgatagaatggcatgccc

SEQ ID NO: 115501 - DNA, 25 bp, Homo sapien
ttcctcatgcactctgttgttagtg

SEQ ID NO: 115502 - DNA, 25 bp, Homo sapien
ttcctcatgcattctgttgttagtg

SEQ ID NO: 115503 - DNA, 25 bp, Homo sapien
ttcctcatgttcagttgatagctgc

SEQ ID NO: 115504 - DNA, 25 bp, Homo sapien
ttcctcatgttcatttgatagctgc

SEQ ID NO: 115505 - DNA, 25 bp, Homo sapien
ttcctccaaaataccgagtgaggtc

SEQ ID NO: 115506 - DNA, 25 bp, Homo sapien
ttcctccaaaatactgagtgaggtc

SEQ ID NO: 115507 - DNA, 25 bp, Homo sapien
ttcctccaaatgactccataagata

SEQ ID NO: 115508 - DNA, 25 bp, Homo sapien
ttcctccacatgactccataagata

SEQ ID NO: 115509 - DNA, 25 bp, Homo sapien
ttcctccacgcgtaaatacaaaaac

SEQ ID NO: 115510 - DNA, 25 bp, Homo sapien
ttcctccagatccctgatacaaaag

SEQ ID NO: 115511 - DNA, 25 bp, Homo sapien
ttcctccagatctctgatacaaaag

SEQ ID NO: 115512 - DNA, 25 bp, Homo sapien
ttcctccatgcgtaaatacaaaaac

SEQ ID NO: 115513 - DNA, 25 bp, Homo sapien
ttcctccttctttcattcgtttttg

SEQ ID NO: 115514 - DNA, 25 bp, Homo sapien
ttcctccttctttcgttcgtttttg

SEQ ID NO: 115515 - DNA, 25 bp, Homo sapien
ttcctccttgactctggatttaaag

SEQ ID NO: 115516 - DNA, 25 bp, Homo sapien
ttcctccttgactttggatttaaag

SEQ ID NO: 115517 - DNA, 25 bp, Homo sapien
ttcctcgtgccatcttcaggagaaa

SEQ ID NO: 115518 - DNA, 25 bp, Homo sapien
ttcctcgtgtcatcttcaggagaaa

SEQ ID NO: 115519 - DNA, 25 bp, Homo sapien
ttcctctcatacgcaaaatatattc

SEQ ID NO: 115520 - DNA, 25 bp, Homo sapien
ttcctctcatacgcgaaatatattc

SEQ ID NO: 115521 - DNA, 25 bp, Homo sapien
ttcctctccgtcatcagcctatttt

SEQ ID NO: 115522 - DNA, 25 bp, Homo sapien
ttcctctccgtcattagcctatttt

SEQ ID NO: 115523 - DNA, 25 bp, Homo sapien
ttcctctcgttctaatggcaaagta

SEQ ID NO: 115524 - DNA, 25 bp, Homo sapien
ttcctctctgacattcaaccacatg

SEQ ID NO: 115525 - DNA, 25 bp, Homo sapien
ttcctctctgacgttcaaccacatg

SEQ ID NO: 115526 - DNA, 25 bp, Homo sapien
ttcctctctttctaatggcaaagta

SEQ ID NO: 115527 - DNA, 25 bp, Homo sapien
ttcctctgacaaacgtctctcagca

SEQ ID NO: 115528 - DNA, 25 bp, Homo sapien
ttcctctgacaaatgtctctcagca

SEQ ID NO: 115529 - DNA, 25 bp, Homo sapien
ttcctctgcatcactcttaaccctt

SEQ ID NO: 115530 - DNA, 25 bp, Homo sapien
ttcctctgcatcattcttaaccctt

SEQ ID NO: 115531 - DNA, 25 bp, Homo sapien
ttcctcttcattgtcaaaactacct

SEQ ID NO: 115532 - DNA, 25 bp, Homo sapien
ttcctcttcattttcaaaactacct

SEQ ID NO: 115533 - DNA, 25 bp, Homo sapien
ttcctcttccacagtccaacaagat

SEQ ID NO: 115534 - DNA, 25 bp, Homo sapien
ttcctcttccacggtccaacaagat

SEQ ID NO: 115535 - DNA, 25 bp, Homo sapien
ttcctcttctcaaaagtacctggca

SEQ ID NO: 115536 - DNA, 25 bp, Homo sapien
ttcctcttctccaaagtacctggca

SEQ ID NO: 115537 - DNA, 25 bp, Homo sapien
ttcctcttgcctctctctgactctc

SEQ ID NO: 115538 - DNA, 25 bp, Homo sapien
ttcctcttgcctctgtctgactctc

SEQ ID NO: 115539 - DNA, 25 bp, Homo sapien
ttcctcttggtcctccagacacgcc

SEQ ID NO: 115540 - DNA, 25 bp, Homo sapien
ttcctcttggttctccagacacgcc

SEQ ID NO: 115541 - DNA, 25 bp, Homo sapien
ttcctctttaatttatctgactttc

SEQ ID NO: 115542 - DNA, 25 bp, Homo sapien
ttcctctttgatttatctgactttc

SEQ ID NO: 115543 - DNA, 25 bp, Homo sapien
ttcctctttgcacattgtctcatat

SEQ ID NO: 115544 - DNA, 25 bp, Homo sapien
ttcctctttgcagattgtctcatat

SEQ ID NO: 115545 - DNA, 25 bp, Homo sapien
ttcctctttgctctgttatttattt

SEQ ID NO: 115546 - DNA, 25 bp, Homo sapien
ttcctctttgctgtgttatttattt

SEQ ID NO: 115547 - DNA, 25 bp, Homo sapien
ttcctgaactatacatggtaggata

SEQ ID NO: 115548 - DNA, 25 bp, Homo sapien
ttcctgaactatacgtggtaggata

SEQ ID NO: 115549 - DNA, 25 bp, Homo sapien
ttcctgaatattgcaaggtctggag

SEQ ID NO: 115550 - DNA, 25 bp, Homo sapien
ttcctgaatcttgcaaggtctggag

SEQ ID NO: 115551 - DNA, 25 bp, Homo sapien
ttcctgaattacttttaatactgca

SEQ ID NO: 115552 - DNA, 25 bp, Homo sapien
ttcctgaattatttttaatactgca

SEQ ID NO: 115553 - DNA, 25 bp, Homo sapien
ttcctgacattgagcttcactgtgt

SEQ ID NO: 115554 - DNA, 25 bp, Homo sapien
ttcctgacccaacggaatctactta

SEQ ID NO: 115555 - DNA, 25 bp, Homo sapien
ttcctgacccaatggaatctactta

SEQ ID NO: 115556 - DNA, 25 bp, Homo sapien
ttcctgacgttgagcttcactgtgt

SEQ ID NO: 115557 - DNA, 25 bp, Homo sapien
ttcctgactttgctcacagtgggct

SEQ ID NO: 115558 - DNA, 25 bp, Homo sapien
ttcctgactttggtcacagtgggct

SEQ ID NO: 115559 - DNA, 25 bp, Homo sapien
ttcctgagcgagtactgggtagcct

SEQ ID NO: 115560 - DNA, 25 bp, Homo sapien
ttcctgagcgattactgggtagcct

SEQ ID NO: 115561 - DNA, 25 bp, Homo sapien
ttcctgaggccacattcttacagca

SEQ ID NO: 115562 - DNA, 25 bp, Homo sapien
ttcctgaggccgcattcttacagca

SEQ ID NO: 115563 - DNA, 25 bp, Homo sapien
ttcctgaggctctcttagaatactg

SEQ ID NO: 115564 - DNA, 25 bp, Homo sapien
ttcctgaggctgtcttagaatactg

SEQ ID NO: 115565 - DNA, 25 bp, Homo sapien
ttcctgagtcacagagtacaaacag

SEQ ID NO: 115566 - DNA, 25 bp, Homo sapien
ttcctgagtcatagagtacaaacag

SEQ ID NO: 115567 - DNA, 25 bp, Homo sapien
ttcctgagtttgaaccatcttccag

SEQ ID NO: 115568 - DNA, 25 bp, Homo sapien
ttcctgagtttgagccatcttccag

SEQ ID NO: 115569 - DNA, 25 bp, Homo sapien
ttcctgcaattctaacatttgatct

SEQ ID NO: 115570 - DNA, 25 bp, Homo sapien
ttcctgcagttctaacatttgatct

SEQ ID NO: 115571 - DNA, 25 bp, Homo sapien
ttcctgccatctttttggaatttta

SEQ ID NO: 115572 - DNA, 25 bp, Homo sapien
ttcctgccgtctttttggaatttta

SEQ ID NO: 115573 - DNA, 25 bp, Homo sapien
ttcctgcctccttatttgactgtta

SEQ ID NO: 115574 - DNA, 25 bp, Homo sapien
ttcctgcctgcttatttgactgtta

SEQ ID NO: 115575 - DNA, 25 bp, Homo sapien
ttcctgctccaggaagtatatcaga

SEQ ID NO: 115576 - DNA, 25 bp, Homo sapien
ttcctgctccaggaggtatatcaga

SEQ ID NO: 115577 - DNA, 25 bp, Homo sapien
ttcctgctccgatgttcgtccatgc

SEQ ID NO: 115578 - DNA, 25 bp, Homo sapien
ttcctgctccgatgtttgtccatgc

SEQ ID NO: 115579 - DNA, 25 bp, Homo sapien
ttcctgctgagacccttgcaatatt

SEQ ID NO: 115580 - DNA, 25 bp, Homo sapien
ttcctgctgcgacccttgcaatatt

SEQ ID NO: 115581 - DNA, 25 bp, Homo sapien
ttcctgcttttcatgcatcttggtg

SEQ ID NO: 115582 - DNA, 25 bp, Homo sapien
ttcctgcttttcgtgcatcttggtg

SEQ ID NO: 115583 - DNA, 25 bp, Homo sapien
ttcctggacttcccactcttgttag

SEQ ID NO: 115584 - DNA, 25 bp, Homo sapien
ttcctggacttcccgctcttgttag

SEQ ID NO: 115585 - DNA, 25 bp, Homo sapien
ttcctggagccacctctgggccaga

SEQ ID NO: 115586 - DNA, 25 bp, Homo sapien
ttcctggaggcacctctgggccaga

SEQ ID NO: 115587 - DNA, 25 bp, Homo sapien
ttcctggaggctggtattgtcccta

SEQ ID NO: 115588 - DNA, 25 bp, Homo sapien
ttcctggagtctggtattgtcccta

SEQ ID NO: 115589 - DNA, 25 bp, Homo sapien
ttcctggatggtaccgatgcttgtt

SEQ ID NO: 115590 - DNA, 25 bp, Homo sapien
ttcctggatggtactgatgcttgtt

SEQ ID NO: 115591 - DNA, 25 bp, Homo sapien
ttcctggatgtctaaccattccttg

SEQ ID NO: 115592 - DNA, 25 bp, Homo sapien
ttcctggatgtctaactattccttg

SEQ ID NO: 115593 - DNA, 25 bp, Homo sapien
ttcctggcagatgtatcctaaagaa

SEQ ID NO: 115594 - DNA, 25 bp, Homo sapien
ttcctggcagatttatcctaaagaa

SEQ ID NO: 115595 - DNA, 25 bp, Homo sapien
ttcctgggaataagctcgatgtgaa

SEQ ID NO: 115596 - DNA, 25 bp, Homo sapien
ttcctgggaataagctggatgtgaa

SEQ ID NO: 115597 - DNA, 25 bp, Homo sapien
ttcctgggtgagtagatgccctgcc

SEQ ID NO: 115598 - DNA, 25 bp, Homo sapien
ttcctgggtgagtcgatgccctgcc

SEQ ID NO: 115599 - DNA, 25 bp, Homo sapien
ttcctggtctttcaaagccatctct

SEQ ID NO: 115600 - DNA, 25 bp, Homo sapien
ttcctggtctttccggaggtacttt

SEQ ID NO: 115601 - DNA, 25 bp, Homo sapien
ttcctggtctttcgaagccatctct

SEQ ID NO: 115602 - DNA, 25 bp, Homo sapien
ttcctggtctttctggaggtacttt

SEQ ID NO: 115603 - DNA, 25 bp, Homo sapien
ttcctggtgatcacattcccaactg

SEQ ID NO: 115604 - DNA, 25 bp, Homo sapien
ttcctggtgatcatattcccaactg

SEQ ID NO: 115605 - DNA, 25 bp, Homo sapien
ttcctggtggaacacgatccaactc

SEQ ID NO: 115606 - DNA, 25 bp, Homo sapien
ttcctggtggaacatgatccaactc

SEQ ID NO: 115607 - DNA, 25 bp, Homo sapien
ttcctgtcatgaatggagtcttatt

SEQ ID NO: 115608 - DNA, 25 bp, Homo sapien
ttcctgtcctggttcatctttgagt

SEQ ID NO: 115609 - DNA, 25 bp, Homo sapien
ttcctgtcctggtttatctttgagt

SEQ ID NO: 115610 - DNA, 25 bp, Homo sapien
ttcctgtcgtgaatggagtcttatt

SEQ ID NO: 115611 - DNA, 25 bp, Homo sapien
ttcctgtgcataattttttattgtg

SEQ ID NO: 115612 - DNA, 25 bp, Homo sapien
ttcctgtgccaaatttttatgtgat

SEQ ID NO: 115613 - DNA, 25 bp, Homo sapien
ttcctgtgcgtaattttttattgtg

SEQ ID NO: 115614 - DNA, 25 bp, Homo sapien
ttcctgtgctaaatttttatgtgat

SEQ ID NO: 115615 - DNA, 25 bp, Homo sapien
ttcctgttagagccttgatcaactg

SEQ ID NO: 115616 - DNA, 25 bp, Homo sapien
ttcctgttagaggcttgatcaactg

SEQ ID NO: 115617 - DNA, 25 bp, Homo sapien
ttcctgttatagccagtttgtgttg

SEQ ID NO: 115618 - DNA, 25 bp, Homo sapien
ttcctgttatagccggtttgtgttg

SEQ ID NO: 115619 - DNA, 25 bp, Homo sapien
ttcctgttcttccctacacctgctt

SEQ ID NO: 115620 - DNA, 25 bp, Homo sapien
ttcctgttcttctctacacctgctt

SEQ ID NO: 115621 - DNA, 25 bp, Homo sapien
ttccttaaggtcccatcatctttta

SEQ ID NO: 115622 - DNA, 25 bp, Homo sapien
ttccttaaggtccgatcatctttta

SEQ ID NO: 115623 - DNA, 25 bp, Homo sapien
ttccttaggcccatatcctaattta

SEQ ID NO: 115624 - DNA, 25 bp, Homo sapien
ttccttaggcccgtatcctaattta

SEQ ID NO: 115625 - DNA, 25 bp, Homo sapien
ttccttataaaacgacaaattcagc

SEQ ID NO: 115626 - DNA, 25 bp, Homo sapien
ttccttataaaatgacaaattcagc

SEQ ID NO: 115627 - DNA, 25 bp, Homo sapien
ttccttattatacaagagaggccct

SEQ ID NO: 115628 - DNA, 25 bp, Homo sapien
ttccttattccctatactcttcctc

SEQ ID NO: 115629 - DNA, 25 bp, Homo sapien
ttccttattccctatagtcttcctc

SEQ ID NO: 115630 - DNA, 25 bp, Homo sapien
ttccttattctacaagagaggccct

SEQ ID NO: 115631 - DNA, 25 bp, Homo sapien
ttccttcaagtaaggtcactccaga

SEQ ID NO: 115632 - DNA, 25 bp, Homo sapien
ttccttcaagtaaggtgactccaga

SEQ ID NO: 115633 - DNA, 25 bp, Homo sapien
ttccttcaagtcttggagcatgctt

SEQ ID NO: 115634 - DNA, 25 bp, Homo sapien
ttccttcaagtctttgagcatgctt

SEQ ID NO: 115635 - DNA, 25 bp, Homo sapien
ttccttcatgcctgactactgcaga

SEQ ID NO: 115636 - DNA, 25 bp, Homo sapien
ttccttcatgcctgtctactgcaga

SEQ ID NO: 115637 - DNA, 25 bp, Homo sapien
ttccttcctacatatttgacctgtt

SEQ ID NO: 115638 - DNA, 25 bp, Homo sapien
ttccttcctacgtatttgacctgtt

SEQ ID NO: 115639 - DNA, 25 bp, Homo sapien
ttccttcgtcctacagtcccaagga

SEQ ID NO: 115640 - DNA, 25 bp, Homo sapien
ttccttcgtcctgcagtcccaagga

SEQ ID NO: 115641 - DNA, 25 bp, Homo sapien
ttccttctcaccacagagaactggg

SEQ ID NO: 115642 - DNA, 25 bp, Homo sapien
ttccttctcactacagagaactggg

SEQ ID NO: 115643 - DNA, 25 bp, Homo sapien
ttccttctcctcctctttattcagt

SEQ ID NO: 115644 - DNA, 25 bp, Homo sapien
ttccttctcttcctctttattcagt

SEQ ID NO: 115645 - DNA, 25 bp, Homo sapien
ttccttctgtgttactgattgggag

SEQ ID NO: 115646 - DNA, 25 bp, Homo sapien
ttccttctgtgttcctgattgggag

SEQ ID NO: 115647 - DNA, 25 bp, Homo sapien
ttccttgacgtcactggctacaggc

SEQ ID NO: 115648 - DNA, 25 bp, Homo sapien
ttccttgacgtcattggctacaggc

SEQ ID NO: 115649 - DNA, 25 bp, Homo sapien
ttccttgagcacagtaaggagagta

SEQ ID NO: 115650 - DNA, 25 bp, Homo sapien
ttccttgagcacggtaaggagagta

SEQ ID NO: 115651 - DNA, 25 bp, Homo sapien
ttccttgagtgactgacctctctta

SEQ ID NO: 115652 - DNA, 25 bp, Homo sapien
ttccttgagtgattgacctctctta

SEQ ID NO: 115653 - DNA, 25 bp, Homo sapien
ttccttgcactgggcagcctgatgg

SEQ ID NO: 115654 - DNA, 25 bp, Homo sapien
ttccttgcctgactaaaacgtgaaa

SEQ ID NO: 115655 - DNA, 25 bp, Homo sapien
ttccttgcctgacttaaacgtgaaa

SEQ ID NO: 115656 - DNA, 25 bp, Homo sapien
ttccttgcgctgggcagcctgatgg

SEQ ID NO: 115657 - DNA, 25 bp, Homo sapien
ttccttgctcacttatattataaac

SEQ ID NO: 115658 - DNA, 25 bp, Homo sapien
ttccttgctcacttatgttataaac

SEQ ID NO: 115659 - DNA, 25 bp, Homo sapien
ttccttgctgaatactgtttttttt

SEQ ID NO: 115660 - DNA, 25 bp, Homo sapien
ttccttgctgaatactttttttttt

SEQ ID NO: 115661 - DNA, 25 bp, Homo sapien
ttccttggctaacttcttcgagtgt

SEQ ID NO: 115662 - DNA, 25 bp, Homo sapien
ttccttggttaacttcttcgagtgt

SEQ ID NO: 115663 - DNA, 25 bp, Homo sapien
ttcctttacttattccatattttgt

SEQ ID NO: 115664 - DNA, 25 bp, Homo sapien
ttcctttagggcaagcaccatctct

SEQ ID NO: 115665 - DNA, 25 bp, Homo sapien
ttcctttagggcaggcaccatctct

SEQ ID NO: 115666 - DNA, 25 bp, Homo sapien
ttcctttatttattccatattttgt

SEQ ID NO: 115667 - DNA, 25 bp, Homo sapien
ttcctttcacctgcgcagtcacacc

SEQ ID NO: 115668 - DNA, 25 bp, Homo sapien
ttcctttcacctgggcagtcacacc

SEQ ID NO: 115669 - DNA, 25 bp, Homo sapien
ttcctttcattcaccagttttgaaa

SEQ ID NO: 115670 - DNA, 25 bp, Homo sapien
ttcctttcattcgccagttttgaaa

SEQ ID NO: 115671 - DNA, 25 bp, Homo sapien
ttcctttccatagtcgtcatgagct

SEQ ID NO: 115672 - DNA, 25 bp, Homo sapien
ttcctttccatagttgtcatgagct

SEQ ID NO: 115673 - DNA, 25 bp, Homo sapien
ttcctttccttaacgtaccaaaagt

SEQ ID NO: 115674 - DNA, 25 bp, Homo sapien
ttcctttcgcttcctcctttgtgtg

SEQ ID NO: 115675 - DNA, 25 bp, Homo sapien
ttcctttctcagccgtcttctacct

SEQ ID NO: 115676 - DNA, 25 bp, Homo sapien
ttcctttctcagtcgtcttctacct

SEQ ID NO: 115677 - DNA, 25 bp, Homo sapien
ttcctttctcttcctcctttgtgtg

SEQ ID NO: 115678 - DNA, 25 bp, Homo sapien
ttcctttctgatctgatcttgtgct

SEQ ID NO: 115679 - DNA, 25 bp, Homo sapien
ttcctttctgatcttatcttgtgct

SEQ ID NO: 115680 - DNA, 25 bp, Homo sapien
ttcctttcttcattttgtgagtttt

SEQ ID NO: 115681 - DNA, 25 bp, Homo sapien
ttcctttcttcattttttgagtttt

SEQ ID NO: 115682 - DNA, 25 bp, Homo sapien
ttcctttctttaacgtaccaaaagt

SEQ ID NO: 115683 - DNA, 25 bp, Homo sapien
ttcctttgaaatacaagaagtttgt

SEQ ID NO: 115684 - DNA, 25 bp, Homo sapien
ttcctttgaaatataagaagtttgt

SEQ ID NO: 115685 - DNA, 25 bp, Homo sapien
ttcctttgcttggctacgtccatgt

SEQ ID NO: 115686 - DNA, 25 bp, Homo sapien
ttcctttgtttggctacgtccatgt

SEQ ID NO: 115687 - DNA, 25 bp, Homo sapien
ttccttttgagttcttggcattgat

SEQ ID NO: 115688 - DNA, 25 bp, Homo sapien
ttccttttgtgttcttggcattgat

SEQ ID NO: 115689 - DNA, 25 bp, Homo sapien
ttcctttttctcgtcacttgtagtt

SEQ ID NO: 115690 - DNA, 25 bp, Homo sapien
ttcctttttcttgtcacttgtagtt

SEQ ID NO: 115691 - DNA, 25 bp, Homo sapien
ttcgaaaagattaagtgcatgactc

SEQ ID NO: 115692 - DNA, 25 bp, Homo sapien
ttcgaaaatattaagtgcatgactc

SEQ ID NO: 115693 - DNA, 25 bp, Homo sapien
ttcgaaatgcaatacatttggaact

SEQ ID NO: 115694 - DNA, 25 bp, Homo sapien
ttcgaaatgcaatccatttggaact

SEQ ID NO: 115695 - DNA, 25 bp, Homo sapien
ttcgaaatgggtctttcgcgaagcc

SEQ ID NO: 115696 - DNA, 25 bp, Homo sapien
ttcgaaatgggtcttttgcgaagcc

SEQ ID NO: 115697 - DNA, 25 bp, Homo sapien
ttcgaacttacctcatatttgtgtt

SEQ ID NO: 115698 - DNA, 25 bp, Homo sapien
ttcgaacttacctcttatttgtgtt

SEQ ID NO: 115699 - DNA, 25 bp, Homo sapien
ttcgaagaagcacagatgtccagaa

SEQ ID NO: 115700 - DNA, 25 bp, Homo sapien
ttcgaagaagcgcagatgtccagaa

SEQ ID NO: 115701 - DNA, 25 bp, Homo sapien
ttcgaagtctgattatcctgagcag

SEQ ID NO: 115702 - DNA, 25 bp, Homo sapien
ttcgaagtctgattgtcctgagcag

SEQ ID NO: 115703 - DNA, 25 bp, Homo sapien
ttcgaagttgcatgtattgtgttaa

SEQ ID NO: 115704 - DNA, 25 bp, Homo sapien
ttcgaagttgcgtgtattgtgttaa

SEQ ID NO: 115705 - DNA, 25 bp, Homo sapien
ttcgaatgtttggcatggtgctagt

SEQ ID NO: 115706 - DNA, 25 bp, Homo sapien
ttcgaatgtttggcgtggtgctagt

SEQ ID NO: 115707 - DNA, 25 bp, Homo sapien
ttcgacctctacgtcagcagttcca

SEQ ID NO: 115708 - DNA, 25 bp, Homo sapien
ttcgacctctacgttagcagttcca

SEQ ID NO: 115709 - DNA, 25 bp, Homo sapien
ttcgatctggctgacttctcttcaa

SEQ ID NO: 115710 - DNA, 25 bp, Homo sapien
ttcgatctggctgccttctcttcaa

SEQ ID NO: 115711 - DNA, 25 bp, Homo sapien
ttcgatttgatcagactttgaatgt

SEQ ID NO: 115712 - DNA, 25 bp, Homo sapien
ttcgatttgatgagactttgaatgt

SEQ ID NO: 115713 - DNA, 25 bp, Homo sapien
ttcgcaatttgatcatgaaattttt

SEQ ID NO: 115714 - DNA, 25 bp, Homo sapien
ttcgcaatttggtcatgaaattttt

SEQ ID NO: 115715 - DNA, 25 bp, Homo sapien
ttcgcctggaattagcagagactta

SEQ ID NO: 115716 - DNA, 25 bp, Homo sapien
ttcgcctgggattagcagagactta

SEQ ID NO: 115717 - DNA, 25 bp, Homo sapien
ttcgctgaattattcttgtttgtca

SEQ ID NO: 115718 - DNA, 25 bp, Homo sapien
ttcgctgagttattcttgtttgtca

SEQ ID NO: 115719 - DNA, 25 bp, Homo sapien
ttcgctgttattaatgtactccgtg

SEQ ID NO: 115720 - DNA, 25 bp, Homo sapien
ttcgctgttattagtgtactccgtg

SEQ ID NO: 115721 - DNA, 25 bp, Homo sapien
ttcggagaaccaccaatgcacagga

SEQ ID NO: 115722 - DNA, 25 bp, Homo sapien
ttcggagaaccaccgatgcacagga

SEQ ID NO: 115723 - DNA, 25 bp, Homo sapien
ttcgggcattacacttattatccac

SEQ ID NO: 115724 - DNA, 25 bp, Homo sapien
ttcgggcattatacttattatccac

SEQ ID NO: 115725 - DNA, 25 bp, Homo sapien
ttcgggctaacaaattggttttcca

SEQ ID NO: 115726 - DNA, 25 bp, Homo sapien
ttcgggctgacaaattggttttcca

SEQ ID NO: 115727 - DNA, 25 bp, Homo sapien
ttcgggtaaatgattcttctctaaa

SEQ ID NO: 115728 - DNA, 25 bp, Homo sapien
ttcgggtaagtgattcttctctaaa

SEQ ID NO: 115729 - DNA, 25 bp, Homo sapien
ttcgtaatgacacaaagatgttatc

SEQ ID NO: 115730 - DNA, 25 bp, Homo sapien
ttcgtaatgacacaaatatgttatc

SEQ ID NO: 115731 - DNA, 25 bp, Homo sapien
ttcgtaatgctagacacatcgccat

SEQ ID NO: 115732 - DNA, 25 bp, Homo sapien
ttcgtaatgctggacacatcgccat

SEQ ID NO: 115733 - DNA, 25 bp, Homo sapien
ttcgtatgactttcggttctttttt

SEQ ID NO: 115734 - DNA, 25 bp, Homo sapien
ttcgtatgacttttggttctttttt

SEQ ID NO: 115735 - DNA, 25 bp, Homo sapien
ttcgtcattgtcctatgatgatact

SEQ ID NO: 115736 - DNA, 25 bp, Homo sapien
ttcgtcattgtcctgtgatgatact

SEQ ID NO: 115737 - DNA, 25 bp, Homo sapien
ttcgtcctacagtcccaaggaggaa

SEQ ID NO: 115738 - DNA, 25 bp, Homo sapien
ttcgtcctgcagtcccaaggaggaa

SEQ ID NO: 115739 - DNA, 25 bp, Homo sapien
ttcgtcgctgagtcacaggggcagg

SEQ ID NO: 115740 - DNA, 25 bp, Homo sapien
ttcgtcgctgagtcacgggggcagg

SEQ ID NO: 115741 - DNA, 25 bp, Homo sapien
ttcgtctggtagatgaatagaatgc

SEQ ID NO: 115742 - DNA, 25 bp, Homo sapien
ttcgtctggtaggtgaatagaatgc

SEQ ID NO: 115743 - DNA, 25 bp, Homo sapien
ttcgtgatccgcctgcctggactat

SEQ ID NO: 115744 - DNA, 25 bp, Homo sapien
ttcgtgatccgcgtgcctggactat

SEQ ID NO: 115745 - DNA, 25 bp, Homo sapien
ttcgtggccaaattagatcacatca

SEQ ID NO: 115746 - DNA, 25 bp, Homo sapien
ttcgtggcctaattagatcacatca

SEQ ID NO: 115747 - DNA, 25 bp, Homo sapien
ttcgtgtgatgttccaatgaaaaca

SEQ ID NO: 115748 - DNA, 25 bp, Homo sapien
ttcgtgtgatgttccagtgaaaaca

SEQ ID NO: 115749 - DNA, 25 bp, Homo sapien
ttcgttcacttgaacatcatagcag

SEQ ID NO: 115750 - DNA, 25 bp, Homo sapien
ttcgttcatttgaacatcatagcag

SEQ ID NO: 115751 - DNA, 25 bp, Homo sapien
ttcgttgaaacacaatagcattaca

SEQ ID NO: 115752 - DNA, 25 bp, Homo sapien
ttcgttgaaacacagtagcattaca

SEQ ID NO: 115753 - DNA, 25 bp, Homo sapien
ttcgtttggaattatcttctagtat

SEQ ID NO: 115754 - DNA, 25 bp, Homo sapien
ttcgtttggaattctcttctagtat

SEQ ID NO: 115755 - DNA, 25 bp, Homo sapien
ttctaaaactatgcaactcccatga

SEQ ID NO: 115756 - DNA, 25 bp, Homo sapien
ttctaaaagcactaatactgtaaaa

SEQ ID NO: 115757 - DNA, 25 bp, Homo sapien
ttctaaaagcactactactgtaaaa

SEQ ID NO: 115758 - DNA, 25 bp, Homo sapien
ttctaaaatataagagtgcagttgt

SEQ ID NO: 115759 - DNA, 25 bp, Homo sapien
ttctaaaatattagagtgcagttgt

SEQ ID NO: 115760 - DNA, 25 bp, Homo sapien
ttctaaaatccttgaaagatcccac

SEQ ID NO: 115761 - DNA, 25 bp, Homo sapien
ttctaaaatccttggaagatcccac

SEQ ID NO: 115762 - DNA, 25 bp, Homo sapien
ttctaaaatggattaccaggatgat

SEQ ID NO: 115763 - DNA, 25 bp, Homo sapien
ttctaaaattatgcaactcccatga

SEQ ID NO: 115764 - DNA, 25 bp, Homo sapien
ttctaaaattgattaccaggatgat

SEQ ID NO: 115765 - DNA, 25 bp, Homo sapien
ttctaaacaacccttccatgtccac

SEQ ID NO: 115766 - DNA, 25 bp, Homo sapien
ttctaaacaacctttccatgtccac

SEQ ID NO: 115767 - DNA, 25 bp, Homo sapien
ttctaaacatcataaggaaattaaa

SEQ ID NO: 115768 - DNA, 25 bp, Homo sapien
ttctaaacatcgtaaggaaattaaa

SEQ ID NO: 115769 - DNA, 25 bp, Homo sapien
ttctaaagaattaatgtacagagca

SEQ ID NO: 115770 - DNA, 25 bp, Homo sapien
ttctaaagagttaatgtacagagca

SEQ ID NO: 115771 - DNA, 25 bp, Homo sapien
ttctaaataatccacccaatgcccc

SEQ ID NO: 115772 - DNA, 25 bp, Homo sapien
ttctaaatactccacccaatgcccc

SEQ ID NO: 115773 - DNA, 25 bp, Homo sapien
ttctaaatacttgaagacctgttat

SEQ ID NO: 115774 - DNA, 25 bp, Homo sapien
ttctaaatacttgaggacctgttat

SEQ ID NO: 115775 - DNA, 25 bp, Homo sapien
ttctaaatatcacttttactgcatc

SEQ ID NO: 115776 - DNA, 25 bp, Homo sapien
ttctaaatatcgcttttactgcatc

SEQ ID NO: 115777 - DNA, 25 bp, Homo sapien
ttctaaatgacaggagcagcagcca

SEQ ID NO: 115778 - DNA, 25 bp, Homo sapien
ttctaaatgctgaatagctcccctt

SEQ ID NO: 115779 - DNA, 25 bp, Homo sapien
ttctaaatgctgcatagctcccctt

SEQ ID NO: 115780 - DNA, 25 bp, Homo sapien
ttctaaattacaggagcagcagcca

SEQ ID NO: 115781 - DNA, 25 bp, Homo sapien
ttctaaattcgtcgtgcgatgggga

SEQ ID NO: 115782 - DNA, 25 bp, Homo sapien
ttctaaatttgtcgtgcgatgggga

SEQ ID NO: 115783 - DNA, 25 bp, Homo sapien
ttctaacagcgaattttgagtgaaa

SEQ ID NO: 115784 - DNA, 25 bp, Homo sapien
ttctaacagtgaattttgagtgaaa

SEQ ID NO: 115785 - DNA, 25 bp, Homo sapien
ttctaaccacaagatttttttctgg

SEQ ID NO: 115786 - DNA, 25 bp, Homo sapien
ttctaaccacaaggtttttttctgg

SEQ ID NO: 115787 - DNA, 25 bp, Homo sapien
ttctaacctctggtacctcagaatg

SEQ ID NO: 115788 - DNA, 25 bp, Homo sapien
ttctaacctgtggtacctcagaatg

SEQ ID NO: 115789 - DNA, 25 bp, Homo sapien
ttctaactcactacaagtactacag

SEQ ID NO: 115790 - DNA, 25 bp, Homo sapien
ttctaactcactgcaagtactacag

SEQ ID NO: 115791 - DNA, 25 bp, Homo sapien
ttctaagagaaaaatgattgtgcta

SEQ ID NO: 115792 - DNA, 25 bp, Homo sapien
ttctaagagaaacatgattgtgcta

SEQ ID NO: 115793 - DNA, 25 bp, Homo sapien
ttctaagatagtaacttggtcagct

SEQ ID NO: 115794 - DNA, 25 bp, Homo sapien
ttctaagatagttacttggtcagct

SEQ ID NO: 115795 - DNA, 25 bp, Homo sapien
ttctaagatattcaactctcaacat

SEQ ID NO: 115796 - DNA, 25 bp, Homo sapien
ttctaagatattcagctctcaacat

SEQ ID NO: 115797 - DNA, 25 bp, Homo sapien
ttctaaggctcttgctggaaaccat

SEQ ID NO: 115798 - DNA, 25 bp, Homo sapien
ttctaaggctcttgttggaaaccat

SEQ ID NO: 115799 - DNA, 25 bp, Homo sapien
ttctaagggtatgcttaaattattg

SEQ ID NO: 115800 - DNA, 25 bp, Homo sapien
ttctaagggtatgcttcaattattg

SEQ ID NO: 115801 - DNA, 25 bp, Homo sapien
ttctaaggtacagtaacaacatgcc

SEQ ID NO: 115802 - DNA, 25 bp, Homo sapien
ttctaaggtacggtaacaacatgcc

SEQ ID NO: 115803 - DNA, 25 bp, Homo sapien
ttctaagtgctgcaaaaacactgga

SEQ ID NO: 115804 - DNA, 25 bp, Homo sapien
ttctaagtgctgcgaaaacactgga

SEQ ID NO: 115805 - DNA, 25 bp, Homo sapien
ttctaatagtactccatcatagagt

SEQ ID NO: 115806 - DNA, 25 bp, Homo sapien
ttctaatagtacttcatcatagagt

SEQ ID NO: 115807 - DNA, 25 bp, Homo sapien
ttctaatagtgaaaatatgacttga

SEQ ID NO: 115808 - DNA, 25 bp, Homo sapien
ttctaatagtggaaatatgacttga

SEQ ID NO: 115809 - DNA, 25 bp, Homo sapien
ttctaatatcagttataaggactag

SEQ ID NO: 115810 - DNA, 25 bp, Homo sapien
ttctaatatcagttttaaggactag

SEQ ID NO: 115811 - DNA, 25 bp, Homo sapien
ttctaatcctacatttattttgtta

SEQ ID NO: 115812 - DNA, 25 bp, Homo sapien
ttctaatcctacatttgttttgtta

SEQ ID NO: 115813 - DNA, 25 bp, Homo sapien
ttctaatcttggtattgttcatcaa

SEQ ID NO: 115814 - DNA, 25 bp, Homo sapien
ttctaatcttggtatttttcatcaa

SEQ ID NO: 115815 - DNA, 25 bp, Homo sapien
ttctaatgaatgtacgggttagcag

SEQ ID NO: 115816 - DNA, 25 bp, Homo sapien
ttctaatgaatgtatgggttagcag

SEQ ID NO: 115817 - DNA, 25 bp, Homo sapien
ttctaattttatccacatcattctc

SEQ ID NO: 115818 - DNA, 25 bp, Homo sapien
ttctaattttatccgcatcattctc

SEQ ID NO: 115819 - DNA, 25 bp, Homo sapien
ttctacaactagacctggttggatc

SEQ ID NO: 115820 - DNA, 25 bp, Homo sapien
ttctacaactagagctggttggatc

SEQ ID NO: 115821 - DNA, 25 bp, Homo sapien
ttctacaataatctgaactgtaagt

SEQ ID NO: 115822 - DNA, 25 bp, Homo sapien
ttctacaataatttgaactgtaagt

SEQ ID NO: 115823 - DNA, 25 bp, Homo sapien
ttctacaatattctatgtcatctag

SEQ ID NO: 115824 - DNA, 25 bp, Homo sapien
ttctacaatattttatgtcatctag

SEQ ID NO: 115825 - DNA, 25 bp, Homo sapien
ttctacaatgaaatatctatgcaaa

SEQ ID NO: 115826 - DNA, 25 bp, Homo sapien
ttctacaatgaaatgtctatgcaaa

SEQ ID NO: 115827 - DNA, 25 bp, Homo sapien
ttctacacagaggatcatgtcatct

SEQ ID NO: 115828 - DNA, 25 bp, Homo sapien
ttctacacagaggatcgtgtcatct

SEQ ID NO: 115829 - DNA, 25 bp, Homo sapien
ttctacaccaattcttccaaaaagt

SEQ ID NO: 115830 - DNA, 25 bp, Homo sapien
ttctacacctattcttccaaaaagt

SEQ ID NO: 115831 - DNA, 25 bp, Homo sapien
ttctacactcacttccagctctagg

SEQ ID NO: 115832 - DNA, 25 bp, Homo sapien
ttctacactcacttgcagctctagg

SEQ ID NO: 115833 - DNA, 25 bp, Homo sapien
ttctacagagtaacaaaacaaaaca

SEQ ID NO: 115834 - DNA, 25 bp, Homo sapien
ttctacagagtgacaaaacaaaaca

SEQ ID NO: 115835 - DNA, 25 bp, Homo sapien
ttctacaggcaacatgttacatata

SEQ ID NO: 115836 - DNA, 25 bp, Homo sapien
ttctacaggcaacgtgttacatata

SEQ ID NO: 115837 - DNA, 25 bp, Homo sapien
ttctacagtgaacattgatcacaag

SEQ ID NO: 115838 - DNA, 25 bp, Homo sapien
ttctacagtgaacgttgatcacaag

SEQ ID NO: 115839 - DNA, 25 bp, Homo sapien
ttctacatgtgcatgttggatgtgt

SEQ ID NO: 115840 - DNA, 25 bp, Homo sapien
ttctacatgtgtatgttggatgtgt

SEQ ID NO: 115841 - DNA, 25 bp, Homo sapien
ttctacattatcctccttagtgcag

SEQ ID NO: 115842 - DNA, 25 bp, Homo sapien
ttctacattgtcctccttagtgcag

SEQ ID NO: 115843 - DNA, 25 bp, Homo sapien
ttctaccaaggactcggtttccatt

SEQ ID NO: 115844 - DNA, 25 bp, Homo sapien
ttctaccacgctcccttacccacaa

SEQ ID NO: 115845 - DNA, 25 bp, Homo sapien
ttctaccagggactcggtttccatt

SEQ ID NO: 115846 - DNA, 25 bp, Homo sapien
ttctaccaggtcatataactcactg

SEQ ID NO: 115847 - DNA, 25 bp, Homo sapien
ttctaccaggtcatgtaactcactg

SEQ ID NO: 115848 - DNA, 25 bp, Homo sapien
ttctaccatacgtcacaaaccgctc

SEQ ID NO: 115849 - DNA, 25 bp, Homo sapien
ttctaccatgcgtcacaaaccgctc

SEQ ID NO: 115850 - DNA, 25 bp, Homo sapien
ttctaccatgctcccttacccacaa

SEQ ID NO: 115851 - DNA, 25 bp, Homo sapien
ttctacctaagggtaatcttctaca

SEQ ID NO: 115852 - DNA, 25 bp, Homo sapien
ttctacctaagtgtaatcttctaca

SEQ ID NO: 115853 - DNA, 25 bp, Homo sapien
ttctacctatcagattatcagtaaa

SEQ ID NO: 115854 - DNA, 25 bp, Homo sapien
ttctacctatcagattgtcagtaaa

SEQ ID NO: 115855 - DNA, 25 bp, Homo sapien
ttctactagttcatcttctataaga

SEQ ID NO: 115856 - DNA, 25 bp, Homo sapien
ttctactagttcgtcttctataaga

SEQ ID NO: 115857 - DNA, 25 bp, Homo sapien
ttctactcagaatcttaccctatta

SEQ ID NO: 115858 - DNA, 25 bp, Homo sapien
ttctactcagactcttaccctatta

SEQ ID NO: 115859 - DNA, 25 bp, Homo sapien
ttctactctgtctgcagatttaaat

SEQ ID NO: 115860 - DNA, 25 bp, Homo sapien
ttctactctgtcttcagatttaaat

SEQ ID NO: 115861 - DNA, 25 bp, Homo sapien
ttctactgaaagacactgaaataaa

SEQ ID NO: 115862 - DNA, 25 bp, Homo sapien
ttctactgaaaggcactgaaataaa

SEQ ID NO: 115863 - DNA, 25 bp, Homo sapien
ttctactttgagccatacagctgtg

SEQ ID NO: 115864 - DNA, 25 bp, Homo sapien
ttctactttgagtcatacagctgtg

SEQ ID NO: 115865 - DNA, 25 bp, Homo sapien
ttctagagaggcacttgcaggatct

SEQ ID NO: 115866 - DNA, 25 bp, Homo sapien
ttctagagaggcactttcaggatct

SEQ ID NO: 115867 - DNA, 25 bp, Homo sapien
ttctagagctcgtgccattcaacct

SEQ ID NO: 115868 - DNA, 25 bp, Homo sapien
ttctagagctcgtgccgttcaacct

SEQ ID NO: 115869 - DNA, 25 bp, Homo sapien
ttctagatcttgtactttaaactct

SEQ ID NO: 115870 - DNA, 25 bp, Homo sapien
ttctagatcttgtgctttaaactct

SEQ ID NO: 115871 - DNA, 25 bp, Homo sapien
ttctagcataactgacctttattgc

SEQ ID NO: 115872 - DNA, 25 bp, Homo sapien
ttctagcataactggcctttattgc

SEQ ID NO: 115873 - DNA, 25 bp, Homo sapien
ttctagcctctcgtctttcattaaa

SEQ ID NO: 115874 - DNA, 25 bp, Homo sapien
ttctagcctcttgtctttcattaaa

SEQ ID NO: 115875 - DNA, 25 bp, Homo sapien
ttctaggaaccaataatcagcacac

SEQ ID NO: 115876 - DNA, 25 bp, Homo sapien
ttctaggaaccagtaatcagcacac

SEQ ID NO: 115877 - DNA, 25 bp, Homo sapien
ttctaggagagtagggagaaaatct

SEQ ID NO: 115878 - DNA, 25 bp, Homo sapien
ttctaggagtgtagggagaaaatct

SEQ ID NO: 115879 - DNA, 25 bp, Homo sapien
ttctaggcagactcagaactacttt

SEQ ID NO: 115880 - DNA, 25 bp, Homo sapien
ttctaggcagagtcagaactacttt

SEQ ID NO: 115881 - DNA, 25 bp, Homo sapien
ttctaggcgcacttccttggactca

SEQ ID NO: 115882 - DNA, 25 bp, Homo sapien
ttctaggcgcatttccttggactca

SEQ ID NO: 115883 - DNA, 25 bp, Homo sapien
ttctaggctatcatgcagtgagggg

SEQ ID NO: 115884 - DNA, 25 bp, Homo sapien
ttctaggctatgatgcagtgagggg

SEQ ID NO: 115885 - DNA, 25 bp, Homo sapien
ttctaggtcaggtccaaacaatact

SEQ ID NO: 115886 - DNA, 25 bp, Homo sapien
ttctaggtcgggtccaaacaatact

SEQ ID NO: 115887 - DNA, 25 bp, Homo sapien
ttctaggttccacattcgtctccca

SEQ ID NO: 115888 - DNA, 25 bp, Homo sapien
ttctaggttgcacattcgtctccca

SEQ ID NO: 115889 - DNA, 25 bp, Homo sapien
ttctagtacagtagcaagcataaat

SEQ ID NO: 115890 - DNA, 25 bp, Homo sapien
ttctagtagactcgagctgctgtgg

SEQ ID NO: 115891 - DNA, 25 bp, Homo sapien
ttctagtagacttgagctgctgtgg

SEQ ID NO: 115892 - DNA, 25 bp, Homo sapien
ttctagtagcaaaaacagcagcagc

SEQ ID NO: 115893 - DNA, 25 bp, Homo sapien
ttctagtagcaataacagcagcagc

SEQ ID NO: 115894 - DNA, 25 bp, Homo sapien
ttctagtagtataaagttcccaggc

SEQ ID NO: 115895 - DNA, 25 bp, Homo sapien
ttctagtagtatgaagttcccaggc

SEQ ID NO: 115896 - DNA, 25 bp, Homo sapien
ttctagtatagtagcaagcataaat

SEQ ID NO: 115897 - DNA, 25 bp, Homo sapien
ttctagtcagaccgattatctgctc

SEQ ID NO: 115898 - DNA, 25 bp, Homo sapien
ttctagtcagactgattatctgctc

SEQ ID NO: 115899 - DNA, 25 bp, Homo sapien
ttctagtcatgattgcagctgatta

SEQ ID NO: 115900 - DNA, 25 bp, Homo sapien
ttctagtcattatccatcaagacac

SEQ ID NO: 115901 - DNA, 25 bp, Homo sapien
ttctagtcgtgattgcagctgatta

SEQ ID NO: 115902 - DNA, 25 bp, Homo sapien
ttctagtcgttatccatcaagacac

SEQ ID NO: 115903 - DNA, 25 bp, Homo sapien
ttctagtgtagaacctgtgaatatt

SEQ ID NO: 115904 - DNA, 25 bp, Homo sapien
ttctagtgtagatcctgtgaatatt

SEQ ID NO: 115905 - DNA, 25 bp, Homo sapien
ttctagtttatagaagaactttcca

SEQ ID NO: 115906 - DNA, 25 bp, Homo sapien
ttctagtttatagaaggactttcca

SEQ ID NO: 115907 - DNA, 25 bp, Homo sapien
ttctataaatcctagaaataaagga

SEQ ID NO: 115908 - DNA, 25 bp, Homo sapien
ttctataaatcctagatataaagga

SEQ ID NO: 115909 - DNA, 25 bp, Homo sapien
ttctataattcctctcatgccctgc

SEQ ID NO: 115910 - DNA, 25 bp, Homo sapien
ttctataattcctctcgtgccctgc

SEQ ID NO: 115911 - DNA, 25 bp, Homo sapien
ttctatacccacttctttacctcac

SEQ ID NO: 115912 - DNA, 25 bp, Homo sapien
ttctatacccagttctttacctcac

SEQ ID NO: 115913 - DNA, 25 bp, Homo sapien
ttctatacttgttccctggccagcc

SEQ ID NO: 115914 - DNA, 25 bp, Homo sapien
ttctatacttgtttcctggccagcc

SEQ ID NO: 115915 - DNA, 25 bp, Homo sapien
ttctatagccaagtagtaggaaaca

SEQ ID NO: 115916 - DNA, 25 bp, Homo sapien
ttctataggcaagtagtaggaaaca

SEQ ID NO: 115917 - DNA, 25 bp, Homo sapien
ttctatagtcaaagaaattaaagca

SEQ ID NO: 115918 - DNA, 25 bp, Homo sapien
ttctatagtcaaataaattaaagca

SEQ ID NO: 115919 - DNA, 25 bp, Homo sapien
ttctatatagaaaaagaagttggat

SEQ ID NO: 115920 - DNA, 25 bp, Homo sapien
ttctatatagagaaagaagttggat

SEQ ID NO: 115921 - DNA, 25 bp, Homo sapien
ttctatcaattgccaagtgcctatc

SEQ ID NO: 115922 - DNA, 25 bp, Homo sapien
ttctatcacccgtatctgctaagat

SEQ ID NO: 115923 - DNA, 25 bp, Homo sapien
ttctatcactgcttctggttgaatc

SEQ ID NO: 115924 - DNA, 25 bp, Homo sapien
ttctatcactgcttttggttgaatc

SEQ ID NO: 115925 - DNA, 25 bp, Homo sapien
ttctatcagacattcaaaagagaat

SEQ ID NO: 115926 - DNA, 25 bp, Homo sapien
ttctatcagacgttcaaaagagaat

SEQ ID NO: 115927 - DNA, 25 bp, Homo sapien
ttctatcagttgccaagtgcctatc

SEQ ID NO: 115928 - DNA, 25 bp, Homo sapien
ttctatcatattctgagtctcagtt

SEQ ID NO: 115929 - DNA, 25 bp, Homo sapien
ttctatcatccgtatctgctaagat

SEQ ID NO: 115930 - DNA, 25 bp, Homo sapien
ttctatcatgttctgagtctcagtt

SEQ ID NO: 115931 - DNA, 25 bp, Homo sapien
ttctatgaagtcagtcactttttcc

SEQ ID NO: 115932 - DNA, 25 bp, Homo sapien
ttctatgaggtcagtcactttttcc

SEQ ID NO: 115933 - DNA, 25 bp, Homo sapien
ttctatgaggttttcgatttacttt

SEQ ID NO: 115934 - DNA, 25 bp, Homo sapien
ttctatgaggtttttgatttacttt

SEQ ID NO: 115935 - DNA, 25 bp, Homo sapien
ttctatgatgaacaatgaagagaca

SEQ ID NO: 115936 - DNA, 25 bp, Homo sapien
ttctatgatgaccaatgaagagaca

SEQ ID NO: 115937 - DNA, 25 bp, Homo sapien
ttctatgattatgccaacattcact

SEQ ID NO: 115938 - DNA, 25 bp, Homo sapien
ttctatgattattccaacattcact

SEQ ID NO: 115939 - DNA, 25 bp, Homo sapien
ttctatgccatacttatcactgtgt

SEQ ID NO: 115940 - DNA, 25 bp, Homo sapien
ttctatgccgtacttatcactgtgt

SEQ ID NO: 115941 - DNA, 25 bp, Homo sapien
ttctatgcctgagattgagaaggga

SEQ ID NO: 115942 - DNA, 25 bp, Homo sapien
ttctatgcctgagtttgagaaggga

SEQ ID NO: 115943 - DNA, 25 bp, Homo sapien
ttctatggccggcatgactcagcaa

SEQ ID NO: 115944 - DNA, 25 bp, Homo sapien
ttctatggctggcatgactcagcaa

SEQ ID NO: 115945 - DNA, 25 bp, Homo sapien
ttctatgtgagggactaaaaaaacc

SEQ ID NO: 115946 - DNA, 25 bp, Homo sapien
ttctatgtgagggattaaaaaaacc

SEQ ID NO: 115947 - DNA, 25 bp, Homo sapien
ttctatgttgtctaagctaatcata

SEQ ID NO: 115948 - DNA, 25 bp, Homo sapien
ttctatgttgtctgagctaatcata

SEQ ID NO: 115949 - DNA, 25 bp, Homo sapien
ttctattacaacaatgtgtagctga

SEQ ID NO: 115950 - DNA, 25 bp, Homo sapien
ttctattataacaatgtgtagctga

SEQ ID NO: 115951 - DNA, 25 bp, Homo sapien
ttctattcacgcacttcaggaacag

SEQ ID NO: 115952 - DNA, 25 bp, Homo sapien
ttctattcatgcacttcaggaacag

SEQ ID NO: 115953 - DNA, 25 bp, Homo sapien
ttctattcttacgtggtagaacgct

SEQ ID NO: 115954 - DNA, 25 bp, Homo sapien
ttctattcttatgtggtagaacgct

SEQ ID NO: 115955 - DNA, 25 bp, Homo sapien
ttctattctttcacttaagagatct

SEQ ID NO: 115956 - DNA, 25 bp, Homo sapien
ttctattctttcccttaagagatct

SEQ ID NO: 115957 - DNA, 25 bp, Homo sapien
ttctattgtgtatgattttaactgt

SEQ ID NO: 115958 - DNA, 25 bp, Homo sapien
ttctattgtgtatgtttttaactgt

SEQ ID NO: 115959 - DNA, 25 bp, Homo sapien
ttctattgttcttggacgcataaac

SEQ ID NO: 115960 - DNA, 25 bp, Homo sapien
ttctattgttcttggaggcataaac

SEQ ID NO: 115961 - DNA, 25 bp, Homo sapien
ttctattttgagccttttttgactt

SEQ ID NO: 115962 - DNA, 25 bp, Homo sapien
ttctattttgagcgttttttgactt

SEQ ID NO: 115963 - DNA, 25 bp, Homo sapien
ttctcaaagtccataacatttatct

SEQ ID NO: 115964 - DNA, 25 bp, Homo sapien
ttctcaaagtccctaacatttatct

SEQ ID NO: 115965 - DNA, 25 bp, Homo sapien
ttctcaaccaacatcgaccctttga

SEQ ID NO: 115966 - DNA, 25 bp, Homo sapien
ttctcaaccaacattgaccctttga

SEQ ID NO: 115967 - DNA, 25 bp, Homo sapien
ttctcaactccataaaagtagtaaa

SEQ ID NO: 115968 - DNA, 25 bp, Homo sapien
ttctcaactccgtaaaagtagtaaa

SEQ ID NO: 115969 - DNA, 25 bp, Homo sapien
ttctcaacttttaactccacccttt

SEQ ID NO: 115970 - DNA, 25 bp, Homo sapien
ttctcaacttttcactccacccttt

SEQ ID NO: 115971 - DNA, 25 bp, Homo sapien
ttctcaagaacctgggtttctcctc

SEQ ID NO: 115972 - DNA, 25 bp, Homo sapien
ttctcaagaagattaaactgatcgg

SEQ ID NO: 115973 - DNA, 25 bp, Homo sapien
ttctcaagaagattaagctgatcgg

SEQ ID NO: 115974 - DNA, 25 bp, Homo sapien
ttctcaagatcctgggtttctcctc

SEQ ID NO: 115975 - DNA, 25 bp, Homo sapien
ttctcaagcctatatcccagagact

SEQ ID NO: 115976 - DNA, 25 bp, Homo sapien
ttctcaaggctatatcccagagact

SEQ ID NO: 115977 - DNA, 25 bp, Homo sapien
ttctcaataccttatctaaatgcca

SEQ ID NO: 115978 - DNA, 25 bp, Homo sapien
ttctcaataccttttctaaatgcca

SEQ ID NO: 115979 - DNA, 25 bp, Homo sapien
ttctcaatcttcaaatgagtctgat

SEQ ID NO: 115980 - DNA, 25 bp, Homo sapien
ttctcaatctttaaatgagtctgat

SEQ ID NO: 115981 - DNA, 25 bp, Homo sapien
ttctcaatgtctccatgtttctttt

SEQ ID NO: 115982 - DNA, 25 bp, Homo sapien
ttctcaatgtctccatttttctttt

SEQ ID NO: 115983 - DNA, 25 bp, Homo sapien
ttctcaatttcaagccacctgccaa

SEQ ID NO: 115984 - DNA, 25 bp, Homo sapien
ttctcaatttccagccacctgccaa

SEQ ID NO: 115985 - DNA, 25 bp, Homo sapien
ttctcacaggcatcacagataggaa

SEQ ID NO: 115986 - DNA, 25 bp, Homo sapien
ttctcacaggcatctcagataggaa

SEQ ID NO: 115987 - DNA, 25 bp, Homo sapien
ttctcacagtcggaaactctaagat

SEQ ID NO: 115988 - DNA, 25 bp, Homo sapien
ttctcacagtctgaaactctaagat

SEQ ID NO: 115989 - DNA, 25 bp, Homo sapien
ttctcacatggaaggagacttttct

SEQ ID NO: 115990 - DNA, 25 bp, Homo sapien
ttctcacattgaaggagacttttct

SEQ ID NO: 115991 - DNA, 25 bp, Homo sapien
ttctcactctattgcacggaatata

SEQ ID NO: 115992 - DNA, 25 bp, Homo sapien
ttctcactctattgcatggaatata

SEQ ID NO: 115993 - DNA, 25 bp, Homo sapien
ttctcactcttaatagaaactgctg

SEQ ID NO: 115994 - DNA, 25 bp, Homo sapien
ttctcactcttagtagaaactgctg

SEQ ID NO: 115995 - DNA, 25 bp, Homo sapien
ttctcactgtaaggatcttcattca

SEQ ID NO: 115996 - DNA, 25 bp, Homo sapien
ttctcactgtaaggttcttcattca

SEQ ID NO: 115997 - DNA, 25 bp, Homo sapien
ttctcactttgtcctcactcggtct

SEQ ID NO: 115998 - DNA, 25 bp, Homo sapien
ttctcactttgtgccactctgatgc

SEQ ID NO: 115999 - DNA, 25 bp, Homo sapien
ttctcactttgtgtcactctgatgc

SEQ ID NO: 116000 - DNA, 25 bp, Homo sapien
ttctcactttgttctcactcggtct

SEQ ID NO: 116001 - DNA, 25 bp, Homo sapien
ttctcagaaataatgttttccaata

SEQ ID NO: 116002 - DNA, 25 bp, Homo sapien
ttctcagaaatagtgttttccaata

SEQ ID NO: 116003 - DNA, 25 bp, Homo sapien
ttctcagaacgttaccacactttat

SEQ ID NO: 116004 - DNA, 25 bp, Homo sapien
ttctcagaatgttaccacactttat

SEQ ID NO: 116005 - DNA, 25 bp, Homo sapien
ttctcagagagtactcagatcagtt

SEQ ID NO: 116006 - DNA, 25 bp, Homo sapien
ttctcagaggttattaataccagct

SEQ ID NO: 116007 - DNA, 25 bp, Homo sapien
ttctcagaggttgttaataccagct

SEQ ID NO: 116008 - DNA, 25 bp, Homo sapien
ttctcagatagtactcagatcagtt

SEQ ID NO: 116009 - DNA, 25 bp, Homo sapien
ttctcagcaaaaagcagcaatattc

SEQ ID NO: 116010 - DNA, 25 bp, Homo sapien
ttctcagcacaaagcagcaatattc

SEQ ID NO: 116011 - DNA, 25 bp, Homo sapien
ttctcagccaggctacaacaaggag

SEQ ID NO: 116012 - DNA, 25 bp, Homo sapien
ttctcagccaggctgcaacaaggag

SEQ ID NO: 116013 - DNA, 25 bp, Homo sapien
ttctcagctagatttcaactagaga

SEQ ID NO: 116014 - DNA, 25 bp, Homo sapien
ttctcagctaggtttcaactagaga

SEQ ID NO: 116015 - DNA, 25 bp, Homo sapien
ttctcagggcctttcacattatttt

SEQ ID NO: 116016 - DNA, 25 bp, Homo sapien
ttctcagggcctttcatattatttt

SEQ ID NO: 116017 - DNA, 25 bp, Homo sapien
ttctcagtagtgtcaaagagtttgc

SEQ ID NO: 116018 - DNA, 25 bp, Homo sapien
ttctcagtagtgtcaaggagtttgc

SEQ ID NO: 116019 - DNA, 25 bp, Homo sapien
ttctcagtttttacgtcacttaaat

SEQ ID NO: 116020 - DNA, 25 bp, Homo sapien
ttctcagtttttatgtcacttaaat

SEQ ID NO: 116021 - DNA, 25 bp, Homo sapien
ttctcatcccaggaaataatcactg

SEQ ID NO: 116022 - DNA, 25 bp, Homo sapien
ttctcatctcaggaaataatcactg

SEQ ID NO: 116023 - DNA, 25 bp, Homo sapien
ttctcatctctactctctctcaaag

SEQ ID NO: 116024 - DNA, 25 bp, Homo sapien
ttctcatctctattctctctcaaag

SEQ ID NO: 116025 - DNA, 25 bp, Homo sapien
ttctcatctgtccaaattgtaatta

SEQ ID NO: 116026 - DNA, 25 bp, Homo sapien
ttctcatctgtccgaattgtaatta

SEQ ID NO: 116027 - DNA, 25 bp, Homo sapien
ttctcatgaaagactccaacaaggc

SEQ ID NO: 116028 - DNA, 25 bp, Homo sapien
ttctcatgaaagattccaacaaggc

SEQ ID NO: 116029 - DNA, 25 bp, Homo sapien
ttctcatgcctgccaacgcaacatc

SEQ ID NO: 116030 - DNA, 25 bp, Homo sapien
ttctcatgcctgccaatgcaacatc

SEQ ID NO: 116031 - DNA, 25 bp, Homo sapien
ttctcatggttacgtgaatatggac

SEQ ID NO: 116032 - DNA, 25 bp, Homo sapien
ttctcatggttatgtgaatatggac

SEQ ID NO: 116033 - DNA, 25 bp, Homo sapien
ttctcattaaagtcaagactaatga

SEQ ID NO: 116034 - DNA, 25 bp, Homo sapien
ttctcattacagggttagctaaaca

SEQ ID NO: 116035 - DNA, 25 bp, Homo sapien
ttctcattacagtcaagactaatga

SEQ ID NO: 116036 - DNA, 25 bp, Homo sapien
ttctcattagagggttagctaaaca

SEQ ID NO: 116037 - DNA, 25 bp, Homo sapien
ttctcattcctctggctctgtctcc

SEQ ID NO: 116038 - DNA, 25 bp, Homo sapien
ttctcattgcctattgtttctattt

SEQ ID NO: 116039 - DNA, 25 bp, Homo sapien
ttctcattgtccagaccttcatgtt

SEQ ID NO: 116040 - DNA, 25 bp, Homo sapien
ttctcattgtccaggccttcatgtt

SEQ ID NO: 116041 - DNA, 25 bp, Homo sapien
ttctcattgtctattgtttctattt

SEQ ID NO: 116042 - DNA, 25 bp, Homo sapien
ttctcatttacagtccttttgcatc

SEQ ID NO: 116043 - DNA, 25 bp, Homo sapien
ttctcatttacggtccttttgcatc

SEQ ID NO: 116044 - DNA, 25 bp, Homo sapien
ttctcatttctctggctctgtctcc

SEQ ID NO: 116045 - DNA, 25 bp, Homo sapien
ttctcatttgccttacgggtgtctg

SEQ ID NO: 116046 - DNA, 25 bp, Homo sapien
ttctcatttgctttacgggtgtctg

SEQ ID NO: 116047 - DNA, 25 bp, Homo sapien
ttctccaacaccgtgctctctagct

SEQ ID NO: 116048 - DNA, 25 bp, Homo sapien
ttctccaacactgtgctctctagct

SEQ ID NO: 116049 - DNA, 25 bp, Homo sapien
ttctccaatatgaaaggtgtgagcc

SEQ ID NO: 116050 - DNA, 25 bp, Homo sapien
ttctccaatctgaaaggtgtgagcc

SEQ ID NO: 116051 - DNA, 25 bp, Homo sapien
ttctccacaacatatccgctcctcc

SEQ ID NO: 116052 - DNA, 25 bp, Homo sapien
ttctccacaacatatctgctcctcc

SEQ ID NO: 116053 - DNA, 25 bp, Homo sapien
ttctccacagctgcctgcgaccttc

SEQ ID NO: 116054 - DNA, 25 bp, Homo sapien
ttctccacggctgcctgcgaccttc

SEQ ID NO: 116055 - DNA, 25 bp, Homo sapien
ttctccactctgaatacccagtgag

SEQ ID NO: 116056 - DNA, 25 bp, Homo sapien
ttctccactctgagtacccagtgag

SEQ ID NO: 116057 - DNA, 25 bp, Homo sapien
ttctccagattttcaacctgtgcag

SEQ ID NO: 116058 - DNA, 25 bp, Homo sapien
ttctccagattttcgacctgtgcag

SEQ ID NO: 116059 - DNA, 25 bp, Homo sapien
ttctccagcacctaaactggtatat

SEQ ID NO: 116060 - DNA, 25 bp, Homo sapien
ttctccagcacttaaactggtatat

SEQ ID NO: 116061 - DNA, 25 bp, Homo sapien
ttctccagccatacttgggtaacag

SEQ ID NO: 116062 - DNA, 25 bp, Homo sapien
ttctccagccatatttgggtaacag

SEQ ID NO: 116063 - DNA, 25 bp, Homo sapien
ttctccagcggcagaaatcttttag

SEQ ID NO: 116064 - DNA, 25 bp, Homo sapien
ttctccagtggcagaaatcttttag

SEQ ID NO: 116065 - DNA, 25 bp, Homo sapien
ttctccagtgtatgatatttagggt

SEQ ID NO: 116066 - DNA, 25 bp, Homo sapien
ttctccagtgtatgatttttagggt

SEQ ID NO: 116067 - DNA, 25 bp, Homo sapien
ttctccataacaataggctgtttta

SEQ ID NO: 116068 - DNA, 25 bp, Homo sapien
ttctccatacgtagcttcaagaaaa

SEQ ID NO: 116069 - DNA, 25 bp, Homo sapien
ttctccatatcaataggctgtttta

SEQ ID NO: 116070 - DNA, 25 bp, Homo sapien
ttctccatatgtagcttcaagaaaa

SEQ ID NO: 116071 - DNA, 25 bp, Homo sapien
ttctccatcaacactgctactgcac

SEQ ID NO: 116072 - DNA, 25 bp, Homo sapien
ttctccatcgacactgctactgcac

SEQ ID NO: 116073 - DNA, 25 bp, Homo sapien
ttctccatctcatcccttggtctta

SEQ ID NO: 116074 - DNA, 25 bp, Homo sapien
ttctccatctcgtcccttggtctta

SEQ ID NO: 116075 - DNA, 25 bp, Homo sapien
ttctccatgggcttacagtcgtgtg

SEQ ID NO: 116076 - DNA, 25 bp, Homo sapien
ttctccatgggcttccagtcgtgtg

SEQ ID NO: 116077 - DNA, 25 bp, Homo sapien
ttctccatggtctcaaggcctctat

SEQ ID NO: 116078 - DNA, 25 bp, Homo sapien
ttctccatggtctcgaggcctctat

SEQ ID NO: 116079 - DNA, 25 bp, Homo sapien
ttctccattctacgggacatcaagc

SEQ ID NO: 116080 - DNA, 25 bp, Homo sapien
ttctccattctatgggacatcaagc

SEQ ID NO: 116081 - DNA, 25 bp, Homo sapien
ttctcccaaatgaacagtgttcctc

SEQ ID NO: 116082 - DNA, 25 bp, Homo sapien
ttctcccaactgaacagtgttcctc

SEQ ID NO: 116083 - DNA, 25 bp, Homo sapien
ttctcccacaaatctgtctttagcg

SEQ ID NO: 116084 - DNA, 25 bp, Homo sapien
ttctcccacaagtctgtctttagcg

SEQ ID NO: 116085 - DNA, 25 bp, Homo sapien
ttctcccacatgattaagctgttgt

SEQ ID NO: 116086 - DNA, 25 bp, Homo sapien
ttctcccacgtgattaagctgttgt

SEQ ID NO: 116087 - DNA, 25 bp, Homo sapien
ttctcccaggccattctaacgtatg

SEQ ID NO: 116088 - DNA, 25 bp, Homo sapien
ttctcccaggcgattctaacgtatg

SEQ ID NO: 116089 - DNA, 25 bp, Homo sapien
ttctccccactgacatgtttcctca

SEQ ID NO: 116090 - DNA, 25 bp, Homo sapien
ttctccccactgacatttttcctca

SEQ ID NO: 116091 - DNA, 25 bp, Homo sapien
ttctcccgaatgatgggatctgtcc

SEQ ID NO: 116092 - DNA, 25 bp, Homo sapien
ttctcccgagtgatgggatctgtcc

SEQ ID NO: 116093 - DNA, 25 bp, Homo sapien
ttctccctatcagcagagtcattat

SEQ ID NO: 116094 - DNA, 25 bp, Homo sapien
ttctccctatcagcagtgtcattat

SEQ ID NO: 116095 - DNA, 25 bp, Homo sapien
ttctccgctatccaattcagcccct

SEQ ID NO: 116096 - DNA, 25 bp, Homo sapien
ttctccgctatccatttcagcccct

SEQ ID NO: 116097 - DNA, 25 bp, Homo sapien
ttctcctagacatcatggttacttt

SEQ ID NO: 116098 - DNA, 25 bp, Homo sapien
ttctcctaggcatcatggttacttt

SEQ ID NO: 116099 - DNA, 25 bp, Homo sapien
ttctcctcaaggagttcatggccaa

SEQ ID NO: 116100 - DNA, 25 bp, Homo sapien
ttctcctcatggagttcatggccaa

SEQ ID NO: 116101 - DNA, 25 bp, Homo sapien
ttctcctctgagaccccagggcatt

SEQ ID NO: 116102 - DNA, 25 bp, Homo sapien
ttctcctctgagtccccagggcatt

SEQ ID NO: 116103 - DNA, 25 bp, Homo sapien
ttctcctgctacatttcacttctta

SEQ ID NO: 116104 - DNA, 25 bp, Homo sapien
ttctcctgctacttttcacttctta

SEQ ID NO: 116105 - DNA, 25 bp, Homo sapien
ttctccttaagtacaattggatttt

SEQ ID NO: 116106 - DNA, 25 bp, Homo sapien
ttctccttaagttcaattggatttt

SEQ ID NO: 116107 - DNA, 25 bp, Homo sapien
ttctccttccatggttcttcactca

SEQ ID NO: 116108 - DNA, 25 bp, Homo sapien
ttctccttctatggttcttcactca

SEQ ID NO: 116109 - DNA, 25 bp, Homo sapien
ttctccttgtctcactgatcttaga

SEQ ID NO: 116110 - DNA, 25 bp, Homo sapien
ttctccttgtctcgctgatcttaga

SEQ ID NO: 116111 - DNA, 25 bp, Homo sapien
ttctcctttgtatcacagcatcata

SEQ ID NO: 116112 - DNA, 25 bp, Homo sapien
ttctcctttttatcacagcatcata

SEQ ID NO: 116113 - DNA, 25 bp, Homo sapien
ttctcgatgggacatatgaagacaa

SEQ ID NO: 116114 - DNA, 25 bp, Homo sapien
ttctcgatgggatatatgaagacaa

SEQ ID NO: 116115 - DNA, 25 bp, Homo sapien
ttctcgccacatcagtgtttttctt

SEQ ID NO: 116116 - DNA, 25 bp, Homo sapien
ttctcgccgcatcagtgtttttctt

SEQ ID NO: 116117 - DNA, 25 bp, Homo sapien
ttctcgcttttctcggacacaccac

SEQ ID NO: 116118 - DNA, 25 bp, Homo sapien
ttctcgcttttcttggacacaccac

SEQ ID NO: 116119 - DNA, 25 bp, Homo sapien
ttctcgtcaggccagtcacttccat

SEQ ID NO: 116120 - DNA, 25 bp, Homo sapien
ttctcgtcgggccagtcacttccat

SEQ ID NO: 116121 - DNA, 25 bp, Homo sapien
ttctcgtggaaacaagaaattcaac

SEQ ID NO: 116122 - DNA, 25 bp, Homo sapien
ttctcgtggaaataagaaattcaac

SEQ ID NO: 116123 - DNA, 25 bp, Homo sapien
ttctctaatcttcattgtgaaaacc

SEQ ID NO: 116124 - DNA, 25 bp, Homo sapien
ttctctaatcttcgttgtgaaaacc

SEQ ID NO: 116125 - DNA, 25 bp, Homo sapien
ttctctacttgctgcttcttcttaa

SEQ ID NO: 116126 - DNA, 25 bp, Homo sapien
ttctctacttgcttcttcttcttaa

SEQ ID NO: 116127 - DNA, 25 bp, Homo sapien
ttctctagcgctttatttgtgtgat

SEQ ID NO: 116128 - DNA, 25 bp, Homo sapien
ttctctagctctttatttgtgtgat

SEQ ID NO: 116129 - DNA, 25 bp, Homo sapien
ttctctatagcttaaaaaataatct

SEQ ID NO: 116130 - DNA, 25 bp, Homo sapien
ttctctatagcttacaaaataatct

SEQ ID NO: 116131 - DNA, 25 bp, Homo sapien
ttctctatcaccgtaggccctgata

SEQ ID NO: 116132 - DNA, 25 bp, Homo sapien
ttctctatcactgtaggccctgata

SEQ ID NO: 116133 - DNA, 25 bp, Homo sapien
ttctctcacatgcttttacagtctt

SEQ ID NO: 116134 - DNA, 25 bp, Homo sapien
ttctctcacatgtttttacagtctt

SEQ ID NO: 116135 - DNA, 25 bp, Homo sapien
ttctctcactgccactaatttagag

SEQ ID NO: 116136 - DNA, 25 bp, Homo sapien
ttctctcactgctactaatttagag

SEQ ID NO: 116137 - DNA, 25 bp, Homo sapien
ttctctcagttggacatgaatgttg

SEQ ID NO: 116138 - DNA, 25 bp, Homo sapien
ttctctcagttggatatgaatgttg

SEQ ID NO: 116139 - DNA, 25 bp, Homo sapien
ttctctccaacaactacctgctcta

SEQ ID NO: 116140 - DNA, 25 bp, Homo sapien
ttctctccaacaattacctgctcta

SEQ ID NO: 116141 - DNA, 25 bp, Homo sapien
ttctctccagaaaatgcggttttgt

SEQ ID NO: 116142 - DNA, 25 bp, Homo sapien
ttctctccagaaaatgtggttttgt

SEQ ID NO: 116143 - DNA, 25 bp, Homo sapien
ttctctccagcagaaatgatcatta

SEQ ID NO: 116144 - DNA, 25 bp, Homo sapien
ttctctccggcagaaatgatcatta

SEQ ID NO: 116145 - DNA, 25 bp, Homo sapien
ttctctctatatatatgcacatcta

SEQ ID NO: 116146 - DNA, 25 bp, Homo sapien
ttctctctcatgtatgaacaaatca

SEQ ID NO: 116147 - DNA, 25 bp, Homo sapien
ttctctctcatgtttgaacaaatca

SEQ ID NO: 116148 - DNA, 25 bp, Homo sapien
ttctctctcggcagatgtttacttt

SEQ ID NO: 116149 - DNA, 25 bp, Homo sapien
ttctctctcggcaggtgtttacttt

SEQ ID NO: 116150 - DNA, 25 bp, Homo sapien
ttctctctctatatatgcacatcta

SEQ ID NO: 116151 - DNA, 25 bp, Homo sapien
ttctctctctccaaatcggagtgtc

SEQ ID NO: 116152 - DNA, 25 bp, Homo sapien
ttctctctctccaaattggagtgtc

SEQ ID NO: 116153 - DNA, 25 bp, Homo sapien
ttctctctgacagtcccattgaaag

SEQ ID NO: 116154 - DNA, 25 bp, Homo sapien
ttctctctgatgtcaaagattttta

SEQ ID NO: 116155 - DNA, 25 bp, Homo sapien
ttctctctgcacatttcacttttta

SEQ ID NO: 116156 - DNA, 25 bp, Homo sapien
ttctctctgcacattttacttttta

SEQ ID NO: 116157 - DNA, 25 bp, Homo sapien
ttctctctgggaaggattgtggtat

SEQ ID NO: 116158 - DNA, 25 bp, Homo sapien
ttctctctgggtaggattgtggtat

SEQ ID NO: 116159 - DNA, 25 bp, Homo sapien
ttctctctggtgtcaaagattttta

SEQ ID NO: 116160 - DNA, 25 bp, Homo sapien
ttctctctgtgccaaaactttttgt

SEQ ID NO: 116161 - DNA, 25 bp, Homo sapien
ttctctctgtgccagaactttttgt

SEQ ID NO: 116162 - DNA, 25 bp, Homo sapien
ttctctctgtgtcctgaggaacctt

SEQ ID NO: 116163 - DNA, 25 bp, Homo sapien
ttctctctgtgtgctgaggaacctt

SEQ ID NO: 116164 - DNA, 25 bp, Homo sapien
ttctctcttacagtcccattgaaag

SEQ ID NO: 116165 - DNA, 25 bp, Homo sapien
ttctctctttggatatcaaggtctg

SEQ ID NO: 116166 - DNA, 25 bp, Homo sapien
ttctctctttgggtatcaaggtctg

SEQ ID NO: 116167 - DNA, 25 bp, Homo sapien
ttctctgaagtatgaatgtctagga

SEQ ID NO: 116168 - DNA, 25 bp, Homo sapien
ttctctgacaacaaggaaataaaac

SEQ ID NO: 116169 - DNA, 25 bp, Homo sapien
ttctctgactacaaggaaataaaac

SEQ ID NO: 116170 - DNA, 25 bp, Homo sapien
ttctctgactcaattatgtggaaag

SEQ ID NO: 116171 - DNA, 25 bp, Homo sapien
ttctctgactcgattatgtggaaag

SEQ ID NO: 116172 - DNA, 25 bp, Homo sapien
ttctctgaggtatgaatgtctagga

SEQ ID NO: 116173 - DNA, 25 bp, Homo sapien
ttctctgaggttcaatcatttgtca

SEQ ID NO: 116174 - DNA, 25 bp, Homo sapien
ttctctgaggttcagtcatttgtca

SEQ ID NO: 116175 - DNA, 25 bp, Homo sapien
ttctctgagtgttacctctctatta

SEQ ID NO: 116176 - DNA, 25 bp, Homo sapien
ttctctgagtgttatctctctatta

SEQ ID NO: 116177 - DNA, 25 bp, Homo sapien
ttctctgatagaatacatgttccat

SEQ ID NO: 116178 - DNA, 25 bp, Homo sapien
ttctctgatagactacatgttccat

SEQ ID NO: 116179 - DNA, 25 bp, Homo sapien
ttctctgatcctcttccttgtttcg

SEQ ID NO: 116180 - DNA, 25 bp, Homo sapien
ttctctgatccttttccttgtttcg

SEQ ID NO: 116181 - DNA, 25 bp, Homo sapien
ttctctgcaccatccagcgctgcga

SEQ ID NO: 116182 - DNA, 25 bp, Homo sapien
ttctctgcctatacatgggtccaga

SEQ ID NO: 116183 - DNA, 25 bp, Homo sapien
ttctctgcctatacctgggtccaga

SEQ ID NO: 116184 - DNA, 25 bp, Homo sapien
ttctctgcgccatccagcgctgcga

SEQ ID NO: 116185 - DNA, 25 bp, Homo sapien
ttctctggcaatgtgaatattcctc

SEQ ID NO: 116186 - DNA, 25 bp, Homo sapien
ttctctggctatgtgaatattcctc

SEQ ID NO: 116187 - DNA, 25 bp, Homo sapien
ttctctgggcgagactcatggattc

SEQ ID NO: 116188 - DNA, 25 bp, Homo sapien
ttctctgggcgagtctcatggattc

SEQ ID NO: 116189 - DNA, 25 bp, Homo sapien
ttctctgtaaagcagaactcacaat

SEQ ID NO: 116190 - DNA, 25 bp, Homo sapien
ttctctgtaaagtagaactcacaat

SEQ ID NO: 116191 - DNA, 25 bp, Homo sapien
ttctctgtggagatgatagcaattc

SEQ ID NO: 116192 - DNA, 25 bp, Homo sapien
ttctctgtggagattatagcaattc

SEQ ID NO: 116193 - DNA, 25 bp, Homo sapien
ttctctgttcacatctgctctctga

SEQ ID NO: 116194 - DNA, 25 bp, Homo sapien
ttctctgttcacatttgctctctga

SEQ ID NO: 116195 - DNA, 25 bp, Homo sapien
ttctctgttcagcatgaagtttttg

SEQ ID NO: 116196 - DNA, 25 bp, Homo sapien
ttctctgttcagcgtgaagtttttg

SEQ ID NO: 116197 - DNA, 25 bp, Homo sapien
ttctctgtttccatttttctttttt

SEQ ID NO: 116198 - DNA, 25 bp, Homo sapien
ttctctgtttccgtttttctttttt

SEQ ID NO: 116199 - DNA, 25 bp, Homo sapien
ttctcttagggagcacacttgcctt

SEQ ID NO: 116200 - DNA, 25 bp, Homo sapien
ttctcttatggagcacacttgcctt

SEQ ID NO: 116201 - DNA, 25 bp, Homo sapien
ttctcttctcatcccaggaaataat

SEQ ID NO: 116202 - DNA, 25 bp, Homo sapien
ttctcttctcatctcaggaaataat

SEQ ID NO: 116203 - DNA, 25 bp, Homo sapien
ttctcttcttgctattgtcagacaa

SEQ ID NO: 116204 - DNA, 25 bp, Homo sapien
ttctcttcttgctgttgtcagacaa

SEQ ID NO: 116205 - DNA, 25 bp, Homo sapien
ttctcttgcctttcggagagtttga

SEQ ID NO: 116206 - DNA, 25 bp, Homo sapien
ttctcttgcgtctgcagtcatgcat

SEQ ID NO: 116207 - DNA, 25 bp, Homo sapien
ttctcttggaacttgttcttattag

SEQ ID NO: 116208 - DNA, 25 bp, Homo sapien
ttctcttggaactttttcttattag

SEQ ID NO: 116209 - DNA, 25 bp, Homo sapien
ttctcttggatacagattgctaaga

SEQ ID NO: 116210 - DNA, 25 bp, Homo sapien
ttctcttggataccgattgctaaga

SEQ ID NO: 116211 - DNA, 25 bp, Homo sapien
ttctcttggtgcctctgtcacattg

SEQ ID NO: 116212 - DNA, 25 bp, Homo sapien
ttctcttggtgtctctgtcacattg

SEQ ID NO: 116213 - DNA, 25 bp, Homo sapien
ttctcttgtctttcggagagtttga

SEQ ID NO: 116214 - DNA, 25 bp, Homo sapien
ttctcttgtgtctgcagtcatgcat

SEQ ID NO: 116215 - DNA, 25 bp, Homo sapien
ttctcttgtgttcgccatctaccgc

SEQ ID NO: 116216 - DNA, 25 bp, Homo sapien
ttctcttgtgttcggcatctaccgc

SEQ ID NO: 116217 - DNA, 25 bp, Homo sapien
ttctctttatgaatagcagctgttt

SEQ ID NO: 116218 - DNA, 25 bp, Homo sapien
ttctctttatgagtagcagctgttt

SEQ ID NO: 116219 - DNA, 25 bp, Homo sapien
ttctctttggataacgacagtgact

SEQ ID NO: 116220 - DNA, 25 bp, Homo sapien
ttctctttggataatgacagtgact

SEQ ID NO: 116221 - DNA, 25 bp, Homo sapien
ttctctttgtttcctttttagacat

SEQ ID NO: 116222 - DNA, 25 bp, Homo sapien
ttctctttgtttcttttttagacat

SEQ ID NO: 116223 - DNA, 25 bp, Homo sapien
ttctcttttattaccagtgaatagt

SEQ ID NO: 116224 - DNA, 25 bp, Homo sapien
ttctcttttattatcagtgaatagt

SEQ ID NO: 116225 - DNA, 25 bp, Homo sapien
ttctgaaaaaccaactgtttgcttc

SEQ ID NO: 116226 - DNA, 25 bp, Homo sapien
ttctgaaaaaccaactttttgcttc

SEQ ID NO: 116227 - DNA, 25 bp, Homo sapien
ttctgaaaaagtcatccggtccttt

SEQ ID NO: 116228 - DNA, 25 bp, Homo sapien
ttctgaaaaagtcatcgggtccttt

SEQ ID NO: 116229 - DNA, 25 bp, Homo sapien
ttctgaaaaagtttgtgtagaatca

SEQ ID NO: 116230 - DNA, 25 bp, Homo sapien
ttctgaaaaggtttgtgtagaatca

SEQ ID NO: 116231 - DNA, 25 bp, Homo sapien
ttctgaaactactgtccttgttgtt

SEQ ID NO: 116232 - DNA, 25 bp, Homo sapien
ttctgaaactactgtcgttgttgtt

SEQ ID NO: 116233 - DNA, 25 bp, Homo sapien
ttctgaaatgcaaaactatggatta

SEQ ID NO: 116234 - DNA, 25 bp, Homo sapien
ttctgaaatgcaactttctggaaca

SEQ ID NO: 116235 - DNA, 25 bp, Homo sapien
ttctgaaatgcgaaactatggatta

SEQ ID NO: 116236 - DNA, 25 bp, Homo sapien
ttctgaaatgcgactttctggaaca

SEQ ID NO: 116237 - DNA, 25 bp, Homo sapien
ttctgaacagtaccatttagatgtt

SEQ ID NO: 116238 - DNA, 25 bp, Homo sapien
ttctgaaccgtaccatttagatgtt

SEQ ID NO: 116239 - DNA, 25 bp, Homo sapien
ttctgaacgtgtacaactgaaagca

SEQ ID NO: 116240 - DNA, 25 bp, Homo sapien
ttctgaacgtgtataactgaaagca

SEQ ID NO: 116241 - DNA, 25 bp, Homo sapien
ttctgaactcaaagatgacatctgg

SEQ ID NO: 116242 - DNA, 25 bp, Homo sapien
ttctgaactcagagatgacatctgg

SEQ ID NO: 116243 - DNA, 25 bp, Homo sapien
ttctgaagatgaatcctatgttttc

SEQ ID NO: 116244 - DNA, 25 bp, Homo sapien
ttctgaagatgactcctatgttttc

SEQ ID NO: 116245 - DNA, 25 bp, Homo sapien
ttctgaaggactatgaagcttggct

SEQ ID NO: 116246 - DNA, 25 bp, Homo sapien
ttctgaaggactgtgaagcttggct

SEQ ID NO: 116247 - DNA, 25 bp, Homo sapien
ttctgaagggtattctgctgttaag

SEQ ID NO: 116248 - DNA, 25 bp, Homo sapien
ttctgaaggttattctgctgttaag

SEQ ID NO: 116249 - DNA, 25 bp, Homo sapien
ttctgaatacgttcaatgcatggag

SEQ ID NO: 116250 - DNA, 25 bp, Homo sapien
ttctgaatatgttcaatgcatggag

SEQ ID NO: 116251 - DNA, 25 bp, Homo sapien
ttctgaatccataatggcatgagaa

SEQ ID NO: 116252 - DNA, 25 bp, Homo sapien
ttctgaatggactacataacttggg

SEQ ID NO: 116253 - DNA, 25 bp, Homo sapien
ttctgaatggactatataacttggg

SEQ ID NO: 116254 - DNA, 25 bp, Homo sapien
ttctgaattcaggattaaagtagaa

SEQ ID NO: 116255 - DNA, 25 bp, Homo sapien
ttctgaattcagggttaaagtagaa

SEQ ID NO: 116256 - DNA, 25 bp, Homo sapien
ttctgaattcataatggcatgagaa

SEQ ID NO: 116257 - DNA, 25 bp, Homo sapien
ttctgaatttttctactgtggaatt

SEQ ID NO: 116258 - DNA, 25 bp, Homo sapien
ttctgaatttttgtactgtggaatt

SEQ ID NO: 116259 - DNA, 25 bp, Homo sapien
ttctgacaatgcaagttcaaaaagg

SEQ ID NO: 116260 - DNA, 25 bp, Homo sapien
ttctgacagtgcaagttcaaaaagg

SEQ ID NO: 116261 - DNA, 25 bp, Homo sapien
ttctgaccactatctcttgccactt

SEQ ID NO: 116262 - DNA, 25 bp, Homo sapien
ttctgaccactatttcttgccactt

SEQ ID NO: 116263 - DNA, 25 bp, Homo sapien
ttctgaccttctaattcctttcttt

SEQ ID NO: 116264 - DNA, 25 bp, Homo sapien
ttctgaccttctcattcctttcttt

SEQ ID NO: 116265 - DNA, 25 bp, Homo sapien
ttctgactttccacccgtttttccc

SEQ ID NO: 116266 - DNA, 25 bp, Homo sapien
ttctgactttccacccttttttccc

SEQ ID NO: 116267 - DNA, 25 bp, Homo sapien
ttctgagaacaaacacaagtacaac

SEQ ID NO: 116268 - DNA, 25 bp, Homo sapien
ttctgagaacaaacaccagtacaac

SEQ ID NO: 116269 - DNA, 25 bp, Homo sapien
ttctgagaattagatagaccacctc

SEQ ID NO: 116270 - DNA, 25 bp, Homo sapien
ttctgagaattatatagaccacctc

SEQ ID NO: 116271 - DNA, 25 bp, Homo sapien
ttctgagactccgcataccagacgg

SEQ ID NO: 116272 - DNA, 25 bp, Homo sapien
ttctgagactccgtataccagacgg

SEQ ID NO: 116273 - DNA, 25 bp, Homo sapien
ttctgagagcaacttttgacagaag

SEQ ID NO: 116274 - DNA, 25 bp, Homo sapien
ttctgagagcagcttttgacagaag

SEQ ID NO: 116275 - DNA, 25 bp, Homo sapien
ttctgagcaacccaaagctggatgt

SEQ ID NO: 116276 - DNA, 25 bp, Homo sapien
ttctgagcaacccgaagctggatgt

SEQ ID NO: 116277 - DNA, 25 bp, Homo sapien
ttctgagcaggtatacaagaaacca

SEQ ID NO: 116278 - DNA, 25 bp, Homo sapien
ttctgagccataacatcctttctca

SEQ ID NO: 116279 - DNA, 25 bp, Homo sapien
ttctgagccataatatcctttctca

SEQ ID NO: 116280 - DNA, 25 bp, Homo sapien
ttctgagccatacgctttaacaggg

SEQ ID NO: 116281 - DNA, 25 bp, Homo sapien
ttctgagccatatgctttaacaggg

SEQ ID NO: 116282 - DNA, 25 bp, Homo sapien
ttctgagcctctatattttcatttc

SEQ ID NO: 116283 - DNA, 25 bp, Homo sapien
ttctgagcctctatgttttcatttc

SEQ ID NO: 116284 - DNA, 25 bp, Homo sapien
ttctgagcgggtatacaagaaacca

SEQ ID NO: 116285 - DNA, 25 bp, Homo sapien
ttctgagtggtgctaaaagaatcta

SEQ ID NO: 116286 - DNA, 25 bp, Homo sapien
ttctgagtggtgttaaaagaatcta

SEQ ID NO: 116287 - DNA, 25 bp, Homo sapien
ttctgagttgaaattcagttagatc

SEQ ID NO: 116288 - DNA, 25 bp, Homo sapien
ttctgagttgaatttcagttagatc

SEQ ID NO: 116289 - DNA, 25 bp, Homo sapien
ttctgagtttggtatgatcattagg

SEQ ID NO: 116290 - DNA, 25 bp, Homo sapien
ttctgagtttggtgtgatcattagg

SEQ ID NO: 116291 - DNA, 25 bp, Homo sapien
ttctgataaaacgaggagactgctg

SEQ ID NO: 116292 - DNA, 25 bp, Homo sapien
ttctgataaaaggaggagactgctg

SEQ ID NO: 116293 - DNA, 25 bp, Homo sapien
ttctgataacagtgataagaaaatt

SEQ ID NO: 116294 - DNA, 25 bp, Homo sapien
ttctgatagcagtgataagaaaatt

SEQ ID NO: 116295 - DNA, 25 bp, Homo sapien
ttctgatatagcataataccaagaa

SEQ ID NO: 116296 - DNA, 25 bp, Homo sapien
ttctgatatggcataataccaagaa

SEQ ID NO: 116297 - DNA, 25 bp, Homo sapien
ttctgatcaactaccacattcatgc

SEQ ID NO: 116298 - DNA, 25 bp, Homo sapien
ttctgatcaactacgacattcatgc

SEQ ID NO: 116299 - DNA, 25 bp, Homo sapien
ttctgatcacagtgatatatgagta

SEQ ID NO: 116300 - DNA, 25 bp, Homo sapien
ttctgatcacagtggtatatgagta

SEQ ID NO: 116301 - DNA, 25 bp, Homo sapien
ttctgatcttcaccctgaatgagta

SEQ ID NO: 116302 - DNA, 25 bp, Homo sapien
ttctgatcttctccctgaatgagta

SEQ ID NO: 116303 - DNA, 25 bp, Homo sapien
ttctgatgactctcataatggcatg

SEQ ID NO: 116304 - DNA, 25 bp, Homo sapien
ttctgatgaggacatcaagctgctt

SEQ ID NO: 116305 - DNA, 25 bp, Homo sapien
ttctgatgagggcatcaagctgctt

SEQ ID NO: 116306 - DNA, 25 bp, Homo sapien
ttctgatgatagaaagccatcacag

SEQ ID NO: 116307 - DNA, 25 bp, Homo sapien
ttctgatgatagaaggccatcacag

SEQ ID NO: 116308 - DNA, 25 bp, Homo sapien
ttctgatgctatactattgttttac

SEQ ID NO: 116309 - DNA, 25 bp, Homo sapien
ttctgatggctctcataatggcatg

SEQ ID NO: 116310 - DNA, 25 bp, Homo sapien
ttctgatggtatactattgttttac

SEQ ID NO: 116311 - DNA, 25 bp, Homo sapien
ttctgatgtcaaccaggagaatgag

SEQ ID NO: 116312 - DNA, 25 bp, Homo sapien
ttctgatgtcaacccggagaatgag

SEQ ID NO: 116313 - DNA, 25 bp, Homo sapien
ttctgattacattgtagagttttat

SEQ ID NO: 116314 - DNA, 25 bp, Homo sapien
ttctgattaggtgccttttcattca

SEQ ID NO: 116315 - DNA, 25 bp, Homo sapien
ttctgattaggtgtcttttcattca

SEQ ID NO: 116316 - DNA, 25 bp, Homo sapien
ttctgattatattgtagagttttat

SEQ ID NO: 116317 - DNA, 25 bp, Homo sapien
ttctgattgtgaattttgagacctg

SEQ ID NO: 116318 - DNA, 25 bp, Homo sapien
ttctgattgtgatttttgagacctg

SEQ ID NO: 116319 - DNA, 25 bp, Homo sapien
ttctgatttagttgcaagatgtaaa

SEQ ID NO: 116320 - DNA, 25 bp, Homo sapien
ttctgatttagtttcaagatgtaaa

SEQ ID NO: 116321 - DNA, 25 bp, Homo sapien
ttctgatttttacagtattgcaaac

SEQ ID NO: 116322 - DNA, 25 bp, Homo sapien
ttctgatttttacattattgcaaac

SEQ ID NO: 116323 - DNA, 25 bp, Homo sapien
ttctgcaaaaataacgtcaatgctt

SEQ ID NO: 116324 - DNA, 25 bp, Homo sapien
ttctgcaaaaataatgtcaatgctt

SEQ ID NO: 116325 - DNA, 25 bp, Homo sapien
ttctgcaaagccattaaaaatgagc

SEQ ID NO: 116326 - DNA, 25 bp, Homo sapien
ttctgcaatgccattaaaaatgagc

SEQ ID NO: 116327 - DNA, 25 bp, Homo sapien
ttctgcacatgtctgagttgtgcgt

SEQ ID NO: 116328 - DNA, 25 bp, Homo sapien
ttctgcacgtgtctgagttgtgcgt

SEQ ID NO: 116329 - DNA, 25 bp, Homo sapien
ttctgcagaaccgttttctccttga

SEQ ID NO: 116330 - DNA, 25 bp, Homo sapien
ttctgcagaactgttttctccttga

SEQ ID NO: 116331 - DNA, 25 bp, Homo sapien
ttctgcagcctaaatacttgaaagc

SEQ ID NO: 116332 - DNA, 25 bp, Homo sapien
ttctgcagcctagatacttgaaagc

SEQ ID NO: 116333 - DNA, 25 bp, Homo sapien
ttctgcagtttataagacacctagt

SEQ ID NO: 116334 - DNA, 25 bp, Homo sapien
ttctgcagtttataaggcacctagt

SEQ ID NO: 116335 - DNA, 25 bp, Homo sapien
ttctgcatagattcagatgattggt

SEQ ID NO: 116336 - DNA, 25 bp, Homo sapien
ttctgcatcagttgatctcttttca

SEQ ID NO: 116337 - DNA, 25 bp, Homo sapien
ttctgcatcagttgatttcttttca

SEQ ID NO: 116338 - DNA, 25 bp, Homo sapien
ttctgcatggattcagatgattggt

SEQ ID NO: 116339 - DNA, 25 bp, Homo sapien
ttctgcattcctcaacataggagtg

SEQ ID NO: 116340 - DNA, 25 bp, Homo sapien
ttctgcattgctcaacataggagtg

SEQ ID NO: 116341 - DNA, 25 bp, Homo sapien
ttctgccaaatcattagctctctct

SEQ ID NO: 116342 - DNA, 25 bp, Homo sapien
ttctgccaaatcgttagctctctct

SEQ ID NO: 116343 - DNA, 25 bp, Homo sapien
ttctgccactgataaaccctatggt

SEQ ID NO: 116344 - DNA, 25 bp, Homo sapien
ttctgccactgataaatcctatggt

SEQ ID NO: 116345 - DNA, 25 bp, Homo sapien
ttctgccactttctctcggtgctaa

SEQ ID NO: 116346 - DNA, 25 bp, Homo sapien
ttctgccactttctgtcggtgctaa

SEQ ID NO: 116347 - DNA, 25 bp, Homo sapien
ttctgccatatagccacctgtgttt

SEQ ID NO: 116348 - DNA, 25 bp, Homo sapien
ttctgccatatagtcacctgtgttt

SEQ ID NO: 116349 - DNA, 25 bp, Homo sapien
ttctgccgctattgctattcattct

SEQ ID NO: 116350 - DNA, 25 bp, Homo sapien
ttctgccgctattgctgttcattct

SEQ ID NO: 116351 - DNA, 25 bp, Homo sapien
ttctgccttaaccgaagagctcttt

SEQ ID NO: 116352 - DNA, 25 bp, Homo sapien
ttctgccttaatcgaagagctcttt

SEQ ID NO: 116353 - DNA, 25 bp, Homo sapien
ttctgccttcttcctttgttggcag

SEQ ID NO: 116354 - DNA, 25 bp, Homo sapien
ttctgccttcttcgtttgttggcag

SEQ ID NO: 116355 - DNA, 25 bp, Homo sapien
ttctgcggtaataacaagtctattc

SEQ ID NO: 116356 - DNA, 25 bp, Homo sapien
ttctgcggtaatagcaagtctattc

SEQ ID NO: 116357 - DNA, 25 bp, Homo sapien
ttctgctagaaagtcagcatcttac

SEQ ID NO: 116358 - DNA, 25 bp, Homo sapien
ttctgctagaaattcagcatcttac

SEQ ID NO: 116359 - DNA, 25 bp, Homo sapien
ttctgctaggtagtaatttctagca

SEQ ID NO: 116360 - DNA, 25 bp, Homo sapien
ttctgctaggtggtaatttctagca

SEQ ID NO: 116361 - DNA, 25 bp, Homo sapien
ttctgctatgtccactagaagaagt

SEQ ID NO: 116362 - DNA, 25 bp, Homo sapien
ttctgctatgtccactggaagaagt

SEQ ID NO: 116363 - DNA, 25 bp, Homo sapien
ttctgctccatgaaactcggaggaa

SEQ ID NO: 116364 - DNA, 25 bp, Homo sapien
ttctgctccatgaacctcggaggaa

SEQ ID NO: 116365 - DNA, 25 bp, Homo sapien
ttctgctcttaatttttacatatta

SEQ ID NO: 116366 - DNA, 25 bp, Homo sapien
ttctgctcttattttttacatatta

SEQ ID NO: 116367 - DNA, 25 bp, Homo sapien
ttctgctcttcatgcccataaggct

SEQ ID NO: 116368 - DNA, 25 bp, Homo sapien
ttctgctcttcatgcctataaggct

SEQ ID NO: 116369 - DNA, 25 bp, Homo sapien
ttctgctggtgattagagctcattc

SEQ ID NO: 116370 - DNA, 25 bp, Homo sapien
ttctgctggtggttagagctcattc

SEQ ID NO: 116371 - DNA, 25 bp, Homo sapien
ttctgcttaagaacattcctcttgg

SEQ ID NO: 116372 - DNA, 25 bp, Homo sapien
ttctgcttaagtacattcctcttgg

SEQ ID NO: 116373 - DNA, 25 bp, Homo sapien
ttctgcttatatcccaatggccaga

SEQ ID NO: 116374 - DNA, 25 bp, Homo sapien
ttctgcttatatcccattggccaga

SEQ ID NO: 116375 - DNA, 25 bp, Homo sapien
ttctgcttcaatgaaagtgagcgta

SEQ ID NO: 116376 - DNA, 25 bp, Homo sapien
ttctgcttccatgaaagtgagcgta

SEQ ID NO: 116377 - DNA, 25 bp, Homo sapien
ttctgctttcctcttgacctgcata

SEQ ID NO: 116378 - DNA, 25 bp, Homo sapien
ttctgcttttctcttgacctgcata

SEQ ID NO: 116379 - DNA, 25 bp, Homo sapien
ttctggaaaaacgtcaccctgccgc

SEQ ID NO: 116380 - DNA, 25 bp, Homo sapien
ttctggaaaaatgtcaccctgccgc

SEQ ID NO: 116381 - DNA, 25 bp, Homo sapien
ttctggaatacttatgcaggacatg

SEQ ID NO: 116382 - DNA, 25 bp, Homo sapien
ttctggaatacttgtgcaggacatg

SEQ ID NO: 116383 - DNA, 25 bp, Homo sapien
ttctggaggccttttctggaaacga

SEQ ID NO: 116384 - DNA, 25 bp, Homo sapien
ttctggaggtcttttctggaaacga

SEQ ID NO: 116385 - DNA, 25 bp, Homo sapien
ttctggagtacctgaatcatacaat

SEQ ID NO: 116386 - DNA, 25 bp, Homo sapien
ttctggagtacctgcatcatacaat

SEQ ID NO: 116387 - DNA, 25 bp, Homo sapien
ttctggatacttgcagccagctcta

SEQ ID NO: 116388 - DNA, 25 bp, Homo sapien
ttctggatactttcagccagctcta

SEQ ID NO: 116389 - DNA, 25 bp, Homo sapien
ttctggattatgttatcttctttta

SEQ ID NO: 116390 - DNA, 25 bp, Homo sapien
ttctggattatgttattttctttta

SEQ ID NO: 116391 - DNA, 25 bp, Homo sapien
ttctggatttttccataatcgccat

SEQ ID NO: 116392 - DNA, 25 bp, Homo sapien
ttctggattttttcataatcgccat

SEQ ID NO: 116393 - DNA, 25 bp, Homo sapien
ttctggcagctaagtacctattttt

SEQ ID NO: 116394 - DNA, 25 bp, Homo sapien
ttctggcagctaggtacctattttt

SEQ ID NO: 116395 - DNA, 25 bp, Homo sapien
ttctggcatctccaatagtaatcat

SEQ ID NO: 116396 - DNA, 25 bp, Homo sapien
ttctggcatctccagtagtaatcat

SEQ ID NO: 116397 - DNA, 25 bp, Homo sapien
ttctggccatgtgtctactgccata

SEQ ID NO: 116398 - DNA, 25 bp, Homo sapien
ttctggccgtgtgtctactgccata

SEQ ID NO: 116399 - DNA, 25 bp, Homo sapien
ttctggctcctaccagcctgctcag

SEQ ID NO: 116400 - DNA, 25 bp, Homo sapien
ttctggctcctactagcctgctcag

SEQ ID NO: 116401 - DNA, 25 bp, Homo sapien
ttctggctctgagaatatcttcatg

SEQ ID NO: 116402 - DNA, 25 bp, Homo sapien
ttctggctctgagattatcttcatg

SEQ ID NO: 116403 - DNA, 25 bp, Homo sapien
ttctgggaagctcgtcccattttag

SEQ ID NO: 116404 - DNA, 25 bp, Homo sapien
ttctgggaagcttgtcccattttag

SEQ ID NO: 116405 - DNA, 25 bp, Homo sapien
ttctgggattgtttattatagcagc

SEQ ID NO: 116406 - DNA, 25 bp, Homo sapien
ttctgggattgtttgttatagcagc

SEQ ID NO: 116407 - DNA, 25 bp, Homo sapien
ttctgggcactattatatacaatac

SEQ ID NO: 116408 - DNA, 25 bp, Homo sapien
ttctgggcgctattatatacaatac

SEQ ID NO: 116409 - DNA, 25 bp, Homo sapien
ttctgggctgattattctcaaagcc

SEQ ID NO: 116410 - DNA, 25 bp, Homo sapien
ttctgggctgattgttctcaaagcc

SEQ ID NO: 116411 - DNA, 25 bp, Homo sapien
ttctggggataatccagctaagcag

SEQ ID NO: 116412 - DNA, 25 bp, Homo sapien
ttctggggataattcagctaagcag

SEQ ID NO: 116413 - DNA, 25 bp, Homo sapien
ttctgggtatcatcaggtctctcct

SEQ ID NO: 116414 - DNA, 25 bp, Homo sapien
ttctgggtatcatcagttctctcct

SEQ ID NO: 116415 - DNA, 25 bp, Homo sapien
ttctgggttttctcgtccatttctt

SEQ ID NO: 116416 - DNA, 25 bp, Homo sapien
ttctgggttttcttgtccatttctt

SEQ ID NO: 116417 - DNA, 25 bp, Homo sapien
ttctggtaagattcagaaaaaaatg

SEQ ID NO: 116418 - DNA, 25 bp, Homo sapien
ttctggtaagattcaggaaaaaatg

SEQ ID NO: 116419 - DNA, 25 bp, Homo sapien
ttctggtacaagcctaattggaaaa

SEQ ID NO: 116420 - DNA, 25 bp, Homo sapien
ttctggtacaagtctaattggaaaa

SEQ ID NO: 116421 - DNA, 25 bp, Homo sapien
ttctggtccacgtagatttctatga

SEQ ID NO: 116422 - DNA, 25 bp, Homo sapien
ttctggtccacgtggatttctatga

SEQ ID NO: 116423 - DNA, 25 bp, Homo sapien
ttctggtgctaggcgagatcaatat

SEQ ID NO: 116424 - DNA, 25 bp, Homo sapien
ttctggtgctaggcgagatcaatta

SEQ ID NO: 116425 - DNA, 25 bp, Homo sapien
ttctggtgctaggtgagatcaatat

SEQ ID NO: 116426 - DNA, 25 bp, Homo sapien
ttctggtgctaggtgagatcaatta

SEQ ID NO: 116427 - DNA, 25 bp, Homo sapien
ttctggtgcttttctccgcaggcct

SEQ ID NO: 116428 - DNA, 25 bp, Homo sapien
ttctggtgcttttctctgcaggcct

SEQ ID NO: 116429 - DNA, 25 bp, Homo sapien
ttctggttgttctcaaatggaataa

SEQ ID NO: 116430 - DNA, 25 bp, Homo sapien
ttctggttgttctcgaatggaataa

SEQ ID NO: 116431 - DNA, 25 bp, Homo sapien
ttctgtaacaaattgccagaaactt

SEQ ID NO: 116432 - DNA, 25 bp, Homo sapien
ttctgtaaccaattgccagaaactt

SEQ ID NO: 116433 - DNA, 25 bp, Homo sapien
ttctgtacatcaggaagtataacaa

SEQ ID NO: 116434 - DNA, 25 bp, Homo sapien
ttctgtacatcatgaagtataacaa

SEQ ID NO: 116435 - DNA, 25 bp, Homo sapien
ttctgtacctgcacgtgactttgag

SEQ ID NO: 116436 - DNA, 25 bp, Homo sapien
ttctgtacctgcatgtgactttgag

SEQ ID NO: 116437 - DNA, 25 bp, Homo sapien
ttctgtagaaatatagtgtcagtat

SEQ ID NO: 116438 - DNA, 25 bp, Homo sapien
ttctgtagaagctgggctgatgcaa

SEQ ID NO: 116439 - DNA, 25 bp, Homo sapien
ttctgtagactctgcgtgtgtgtat

SEQ ID NO: 116440 - DNA, 25 bp, Homo sapien
ttctgtagactgtgcgtgtgtgtat

SEQ ID NO: 116441 - DNA, 25 bp, Homo sapien
ttctgtagcatgtatttacattgat

SEQ ID NO: 116442 - DNA, 25 bp, Homo sapien
ttctgtagcgtgtatttacattgat

SEQ ID NO: 116443 - DNA, 25 bp, Homo sapien
ttctgtaggaatatagtgtcagtat

SEQ ID NO: 116444 - DNA, 25 bp, Homo sapien
ttctgtaggagctgggctgatgcaa

SEQ ID NO: 116445 - DNA, 25 bp, Homo sapien
ttctgtaggttgcattcggttaatt

SEQ ID NO: 116446 - DNA, 25 bp, Homo sapien
ttctgtaggttgcatttggttaatt

SEQ ID NO: 116447 - DNA, 25 bp, Homo sapien
ttctgtatagtttcaattctcacat

SEQ ID NO: 116448 - DNA, 25 bp, Homo sapien
ttctgtatagtttctattctcacat

SEQ ID NO: 116449 - DNA, 25 bp, Homo sapien
ttctgtatctgaactaattggtgat

SEQ ID NO: 116450 - DNA, 25 bp, Homo sapien
ttctgtatctgaattaattggtgat

SEQ ID NO: 116451 - DNA, 25 bp, Homo sapien
ttctgtatgaaacgcccctgctctg

SEQ ID NO: 116452 - DNA, 25 bp, Homo sapien
ttctgtatgaaatgcccctgctctg

SEQ ID NO: 116453 - DNA, 25 bp, Homo sapien
ttctgtattaaaatcacaagaaaag

SEQ ID NO: 116454 - DNA, 25 bp, Homo sapien
ttctgtattaaagtcacaagaaaag

SEQ ID NO: 116455 - DNA, 25 bp, Homo sapien
ttctgtattcccttgcagatcctga

SEQ ID NO: 116456 - DNA, 25 bp, Homo sapien
ttctgtattcctttgcagatcctga

SEQ ID NO: 116457 - DNA, 25 bp, Homo sapien
ttctgtattttacacacatagcctg

SEQ ID NO: 116458 - DNA, 25 bp, Homo sapien
ttctgtattttacacatatagcctg

SEQ ID NO: 116459 - DNA, 25 bp, Homo sapien
ttctgtcaaaaccctaacttacggc

SEQ ID NO: 116460 - DNA, 25 bp, Homo sapien
ttctgtcaaaagcctaacttacggc

SEQ ID NO: 116461 - DNA, 25 bp, Homo sapien
ttctgtcaaagtaggatgagattta

SEQ ID NO: 116462 - DNA, 25 bp, Homo sapien
ttctgtcaaagtgggatgagattta

SEQ ID NO: 116463 - DNA, 25 bp, Homo sapien
ttctgtcataatttggaccttaagg

SEQ ID NO: 116464 - DNA, 25 bp, Homo sapien
ttctgtcatgatttggaccttaagg

SEQ ID NO: 116465 - DNA, 25 bp, Homo sapien
ttctgtcccatcccaaatcacacta

SEQ ID NO: 116466 - DNA, 25 bp, Homo sapien
ttctgtcccatttctacgggcagag

SEQ ID NO: 116467 - DNA, 25 bp, Homo sapien
ttctgtcccgtcccaaatcacacta

SEQ ID NO: 116468 - DNA, 25 bp, Homo sapien
ttctgtcccgtttctacgggcagag

SEQ ID NO: 116469 - DNA, 25 bp, Homo sapien
ttctgtctacgctcccatcttttgc

SEQ ID NO: 116470 - DNA, 25 bp, Homo sapien
ttctgtctatgctcccatcttttgc

SEQ ID NO: 116471 - DNA, 25 bp, Homo sapien
ttctgtctgtacaacccttttgaat

SEQ ID NO: 116472 - DNA, 25 bp, Homo sapien
ttctgtctgtataacccttttgaat

SEQ ID NO: 116473 - DNA, 25 bp, Homo sapien
ttctgtcttccaaatcttgagtgac

SEQ ID NO: 116474 - DNA, 25 bp, Homo sapien
ttctgtcttccacatcttgagtgac

SEQ ID NO: 116475 - DNA, 25 bp, Homo sapien
ttctgtcttcttaaaaaatccagca

SEQ ID NO: 116476 - DNA, 25 bp, Homo sapien
ttctgtcttcttgaaaaatccagca

SEQ ID NO: 116477 - DNA, 25 bp, Homo sapien
ttctgtcttggccccagattttgtt

SEQ ID NO: 116478 - DNA, 25 bp, Homo sapien
ttctgtcttggctccagattttgtt

SEQ ID NO: 116479 - DNA, 25 bp, Homo sapien
ttctgtgaccaacgctagacaaaca

SEQ ID NO: 116480 - DNA, 25 bp, Homo sapien
ttctgtgaccaacgctggacaaaca

SEQ ID NO: 116481 - DNA, 25 bp, Homo sapien
ttctgtgagtttccatttaatagtt

SEQ ID NO: 116482 - DNA, 25 bp, Homo sapien
ttctgtgagttttcatttaatagtt

SEQ ID NO: 116483 - DNA, 25 bp, Homo sapien
ttctgtgatctgcaaaatttcttaa

SEQ ID NO: 116484 - DNA, 25 bp, Homo sapien
ttctgtgatttgcaaaatttcttaa

SEQ ID NO: 116485 - DNA, 25 bp, Homo sapien
ttctgtgcttggtacatttcatttg

SEQ ID NO: 116486 - DNA, 25 bp, Homo sapien
ttctgtgcttggttcatttcatttg

SEQ ID NO: 116487 - DNA, 25 bp, Homo sapien
ttctgtggacagactcaagccagct

SEQ ID NO: 116488 - DNA, 25 bp, Homo sapien
ttctgtggacagattcaagccagct

SEQ ID NO: 116489 - DNA, 25 bp, Homo sapien
ttctgtgtacattttgagaaataaa

SEQ ID NO: 116490 - DNA, 25 bp, Homo sapien
ttctgtgtatattttgagaaataaa

SEQ ID NO: 116491 - DNA, 25 bp, Homo sapien
ttctgttcaggatttagctaactag

SEQ ID NO: 116492 - DNA, 25 bp, Homo sapien
ttctgttcgggatttagctaactag

SEQ ID NO: 116493 - DNA, 25 bp, Homo sapien
ttctgttctcatttgccttacgggt

SEQ ID NO: 116494 - DNA, 25 bp, Homo sapien
ttctgttctcatttgctttacgggt

SEQ ID NO: 116495 - DNA, 25 bp, Homo sapien
ttctgttcttcttgttcattcacat

SEQ ID NO: 116496 - DNA, 25 bp, Homo sapien
ttctgttcttcttgttgattcacat

SEQ ID NO: 116497 - DNA, 25 bp, Homo sapien
ttctgttgaataaaacaccaagtgg

SEQ ID NO: 116498 - DNA, 25 bp, Homo sapien
ttctgttgaataaaacgccaagtgg

SEQ ID NO: 116499 - DNA, 25 bp, Homo sapien
ttctgttgtacttacatggagtctt

SEQ ID NO: 116500 - DNA, 25 bp, Homo sapien
ttctgttgttcttacatggagtctt

SEQ ID NO: 116501 - DNA, 25 bp, Homo sapien
ttctgtttaaccatacctaaaaatg

SEQ ID NO: 116502 - DNA, 25 bp, Homo sapien
ttctgtttaaccgtacctaaaaatg

SEQ ID NO: 116503 - DNA, 25 bp, Homo sapien
ttctgtttaatgagagtgatgcagt

SEQ ID NO: 116504 - DNA, 25 bp, Homo sapien
ttctgtttaatgatagtgatgcagt

SEQ ID NO: 116505 - DNA, 25 bp, Homo sapien
ttctgtttatttaaggctgattgga

SEQ ID NO: 116506 - DNA, 25 bp, Homo sapien
ttctgtttcagaaagaataggttcc

SEQ ID NO: 116507 - DNA, 25 bp, Homo sapien
ttctgtttcagagagaataggttcc

SEQ ID NO: 116508 - DNA, 25 bp, Homo sapien
ttctgtttgtttaaggctgattgga

SEQ ID NO: 116509 - DNA, 25 bp, Homo sapien
ttctgttttaaccattgaccttcat

SEQ ID NO: 116510 - DNA, 25 bp, Homo sapien
ttctgttttaacgattgaccttcat

SEQ ID NO: 116511 - DNA, 25 bp, Homo sapien
ttctgttttcacgctcttatgtcct

SEQ ID NO: 116512 - DNA, 25 bp, Homo sapien
ttctgttttcatgctcttatgtcct

SEQ ID NO: 116513 - DNA, 25 bp, Homo sapien
ttctgttttcctccgtgttctctaa

SEQ ID NO: 116514 - DNA, 25 bp, Homo sapien
ttctgttttcctccttgttctctaa

SEQ ID NO: 116515 - DNA, 25 bp, Homo sapien
ttctgttttctgccagtgagtaaat

SEQ ID NO: 116516 - DNA, 25 bp, Homo sapien
ttctgttttctgctagtgagtaaat

SEQ ID NO: 116517 - DNA, 25 bp, Homo sapien
ttctgtttttccctctttatttgta

SEQ ID NO: 116518 - DNA, 25 bp, Homo sapien
ttctgtttttctctctttatttgta

SEQ ID NO: 116519 - DNA, 25 bp, Homo sapien
ttcttaaaatattactatgcaaagt

SEQ ID NO: 116520 - DNA, 25 bp, Homo sapien
ttcttaaaatgccaactgacttgtg

SEQ ID NO: 116521 - DNA, 25 bp, Homo sapien
ttcttaaaatgccagctgacttgtg

SEQ ID NO: 116522 - DNA, 25 bp, Homo sapien
ttcttaaaattttatggatacgaat

SEQ ID NO: 116523 - DNA, 25 bp, Homo sapien
ttcttaaaattttgtggatacgaat

SEQ ID NO: 116524 - DNA, 25 bp, Homo sapien
ttcttaaagtattactatgcaaagt

SEQ ID NO: 116525 - DNA, 25 bp, Homo sapien
ttcttaaatagaacaaacagggaca

SEQ ID NO: 116526 - DNA, 25 bp, Homo sapien
ttcttaaatagaacaagcagggaca

SEQ ID NO: 116527 - DNA, 25 bp, Homo sapien
ttcttaaataggtaggtattgaagt

SEQ ID NO: 116528 - DNA, 25 bp, Homo sapien
ttcttaaattggtaggtattgaagt

SEQ ID NO: 116529 - DNA, 25 bp, Homo sapien
ttcttaacactttcgtcactaagca

SEQ ID NO: 116530 - DNA, 25 bp, Homo sapien
ttcttaacacttttgtcactaagca

SEQ ID NO: 116531 - DNA, 25 bp, Homo sapien
ttcttaacagtgttttttgaatcac

SEQ ID NO: 116532 - DNA, 25 bp, Homo sapien
ttcttaaccgttctaatgcgctgac

SEQ ID NO: 116533 - DNA, 25 bp, Homo sapien
ttcttaacctttctaatgcgctgac

SEQ ID NO: 116534 - DNA, 25 bp, Homo sapien
ttcttaacggtgttttttgaatcac

SEQ ID NO: 116535 - DNA, 25 bp, Homo sapien
ttcttaaggtgaaagtgacttgact

SEQ ID NO: 116536 - DNA, 25 bp, Homo sapien
ttcttaaggtgaaattgacttgact

SEQ ID NO: 116537 - DNA, 25 bp, Homo sapien
ttcttaattctggaattatttttgc

SEQ ID NO: 116538 - DNA, 25 bp, Homo sapien
ttcttaattctggcattatttttgc

SEQ ID NO: 116539 - DNA, 25 bp, Homo sapien
ttcttaattgtccacttggagtgtt

SEQ ID NO: 116540 - DNA, 25 bp, Homo sapien
ttcttaattgtctacttggagtgtt

SEQ ID NO: 116541 - DNA, 25 bp, Homo sapien
ttcttacagagtacatgtgtctgtc

SEQ ID NO: 116542 - DNA, 25 bp, Homo sapien
ttcttacagcccgttttaagaactt

SEQ ID NO: 116543 - DNA, 25 bp, Homo sapien
ttcttacagcctgttttaagaactt

SEQ ID NO: 116544 - DNA, 25 bp, Homo sapien
ttcttacagcgatgttaccaagcac

SEQ ID NO: 116545 - DNA, 25 bp, Homo sapien
ttcttacagggtacatgtgtctgtc

SEQ ID NO: 116546 - DNA, 25 bp, Homo sapien
ttcttacagtgatgttaccaagcac

SEQ ID NO: 116547 - DNA, 25 bp, Homo sapien
ttcttaccaaactagagagagaagg

SEQ ID NO: 116548 - DNA, 25 bp, Homo sapien
ttcttaccaacagccctcagtgaac

SEQ ID NO: 116549 - DNA, 25 bp, Homo sapien
ttcttaccaacagctctcagtgaac

SEQ ID NO: 116550 - DNA, 25 bp, Homo sapien
ttcttaccacactagagagagaagg

SEQ ID NO: 116551 - DNA, 25 bp, Homo sapien
ttcttaccatacacgacagggttgt

SEQ ID NO: 116552 - DNA, 25 bp, Homo sapien
ttcttaccatcctatgtacagcttc

SEQ ID NO: 116553 - DNA, 25 bp, Homo sapien
ttcttaccgtacacgacagggttgt

SEQ ID NO: 116554 - DNA, 25 bp, Homo sapien
ttcttaccgtcctatgtacagcttc

SEQ ID NO: 116555 - DNA, 25 bp, Homo sapien
ttcttacgtagagattagtgctgat

SEQ ID NO: 116556 - DNA, 25 bp, Homo sapien
ttcttacgtagggattagtgctgat

SEQ ID NO: 116557 - DNA, 25 bp, Homo sapien
ttcttacgttaaacacctaatcttg

SEQ ID NO: 116558 - DNA, 25 bp, Homo sapien
ttcttacgttaatcacctaatcttg

SEQ ID NO: 116559 - DNA, 25 bp, Homo sapien
ttcttactcccttgacggtggctgt

SEQ ID NO: 116560 - DNA, 25 bp, Homo sapien
ttcttactctcttgacggtggctgt

SEQ ID NO: 116561 - DNA, 25 bp, Homo sapien
ttcttactgatcatttataaaaggt

SEQ ID NO: 116562 - DNA, 25 bp, Homo sapien
ttcttactgatcgtttataaaaggt

SEQ ID NO: 116563 - DNA, 25 bp, Homo sapien
ttcttactgggactgtgaaaaagaa

SEQ ID NO: 116564 - DNA, 25 bp, Homo sapien
ttcttactggggctgtgaaaaagaa

SEQ ID NO: 116565 - DNA, 25 bp, Homo sapien
ttcttacttcactgagttgatataa

SEQ ID NO: 116566 - DNA, 25 bp, Homo sapien
ttcttacttcattgagttgatataa

SEQ ID NO: 116567 - DNA, 25 bp, Homo sapien
ttcttactttgtcttagcccacagg

SEQ ID NO: 116568 - DNA, 25 bp, Homo sapien
ttcttactttgttttagcccacagg

SEQ ID NO: 116569 - DNA, 25 bp, Homo sapien
ttcttagaaaaggatttgtgatctg

SEQ ID NO: 116570 - DNA, 25 bp, Homo sapien
ttcttagaaaaggctttgtgatctg

SEQ ID NO: 116571 - DNA, 25 bp, Homo sapien
ttcttagacaaggtgtgaagaggcc

SEQ ID NO: 116572 - DNA, 25 bp, Homo sapien
ttcttagacaatgtgtgaagaggcc

SEQ ID NO: 116573 - DNA, 25 bp, Homo sapien
ttcttagagaggtaaacgattcttc

SEQ ID NO: 116574 - DNA, 25 bp, Homo sapien
ttcttagagaggtaaatgattcttc

SEQ ID NO: 116575 - DNA, 25 bp, Homo sapien
ttcttagatgtacttagggcatcct

SEQ ID NO: 116576 - DNA, 25 bp, Homo sapien
ttcttagatgtccttagggcatcct

SEQ ID NO: 116577 - DNA, 25 bp, Homo sapien
ttcttagctactaaaatctgtttct

SEQ ID NO: 116578 - DNA, 25 bp, Homo sapien
ttcttagctattaactctcaattac

SEQ ID NO: 116579 - DNA, 25 bp, Homo sapien
ttcttagctattaactttcaattac

SEQ ID NO: 116580 - DNA, 25 bp, Homo sapien
ttcttagctgctaaaatctgtttct

SEQ ID NO: 116581 - DNA, 25 bp, Homo sapien
ttcttaggtgttcaggcaaggttgg

SEQ ID NO: 116582 - DNA, 25 bp, Homo sapien
ttcttaggtgttgaggcaaggttgg

SEQ ID NO: 116583 - DNA, 25 bp, Homo sapien
ttcttagtatcgtaactgtttctgt

SEQ ID NO: 116584 - DNA, 25 bp, Homo sapien
ttcttagtgtcgtaactgtttctgt

SEQ ID NO: 116585 - DNA, 25 bp, Homo sapien
ttcttatcatttgtgcattcactga

SEQ ID NO: 116586 - DNA, 25 bp, Homo sapien
ttcttatcatttgtgcgttcactga

SEQ ID NO: 116587 - DNA, 25 bp, Homo sapien
ttcttatctgttcaatgtgactagt

SEQ ID NO: 116588 - DNA, 25 bp, Homo sapien
ttcttatctgtttaatgtgactagt

SEQ ID NO: 116589 - DNA, 25 bp, Homo sapien
ttcttatgacaatatatctgtgagg

SEQ ID NO: 116590 - DNA, 25 bp, Homo sapien
ttcttatgacaatgtatctgtgagg

SEQ ID NO: 116591 - DNA, 25 bp, Homo sapien
ttcttatttacaagcgattagtttg

SEQ ID NO: 116592 - DNA, 25 bp, Homo sapien
ttcttatttacaagtgattagtttg

SEQ ID NO: 116593 - DNA, 25 bp, Homo sapien
ttcttatttcagaaaggtgaagatg

SEQ ID NO: 116594 - DNA, 25 bp, Homo sapien
ttcttatttcagaaagttgaagatg

SEQ ID NO: 116595 - DNA, 25 bp, Homo sapien
ttcttatttgatccatgtgttactt

SEQ ID NO: 116596 - DNA, 25 bp, Homo sapien
ttcttatttgattcatgtgttactt

SEQ ID NO: 116597 - DNA, 25 bp, Homo sapien
ttcttcaaaacctatttcaaaacct

SEQ ID NO: 116598 - DNA, 25 bp, Homo sapien
ttcttcaaaacttatttcaaaacct

SEQ ID NO: 116599 - DNA, 25 bp, Homo sapien
ttcttcaaaccaatatcacaaatgg

SEQ ID NO: 116600 - DNA, 25 bp, Homo sapien
ttcttcaaaccagtatcacaaatgg

SEQ ID NO: 116601 - DNA, 25 bp, Homo sapien
ttcttcaaccttcgctttctggcct

SEQ ID NO: 116602 - DNA, 25 bp, Homo sapien
ttcttcaaccttggctttctggcct

SEQ ID NO: 116603 - DNA, 25 bp, Homo sapien
ttcttcaacgtcctactctgtaaga

SEQ ID NO: 116604 - DNA, 25 bp, Homo sapien
ttcttcaatataagttctcagcaca

SEQ ID NO: 116605 - DNA, 25 bp, Homo sapien
ttcttcaatgtaagttctcagcaca

SEQ ID NO: 116606 - DNA, 25 bp, Homo sapien
ttcttcaatgtcctactctgtaaga

SEQ ID NO: 116607 - DNA, 25 bp, Homo sapien
ttcttcacaactgttggaccgttac

SEQ ID NO: 116608 - DNA, 25 bp, Homo sapien
ttcttcacagctgttggaccgttac

SEQ ID NO: 116609 - DNA, 25 bp, Homo sapien
ttcttcaccagccagacatcgtcac

SEQ ID NO: 116610 - DNA, 25 bp, Homo sapien
ttcttcaccagctagacatcgtcac

SEQ ID NO: 116611 - DNA, 25 bp, Homo sapien
ttcttcaccatggggtaacatctag

SEQ ID NO: 116612 - DNA, 25 bp, Homo sapien
ttcttcactatggggtaacatctag

SEQ ID NO: 116613 - DNA, 25 bp, Homo sapien
ttcttcagatcctcctcactggctg

SEQ ID NO: 116614 - DNA, 25 bp, Homo sapien
ttcttcagatcctcttcactggctg

SEQ ID NO: 116615 - DNA, 25 bp, Homo sapien
ttcttcagcagccgcctctgctgat

SEQ ID NO: 116616 - DNA, 25 bp, Homo sapien
ttcttcagcagctgcctctgctgat

SEQ ID NO: 116617 - DNA, 25 bp, Homo sapien
ttcttcagcggcgttcagttctctc

SEQ ID NO: 116618 - DNA, 25 bp, Homo sapien
ttcttcagcggtgttcagttctctc

SEQ ID NO: 116619 - DNA, 25 bp, Homo sapien
ttcttcagtgatacaagaatcttag

SEQ ID NO: 116620 - DNA, 25 bp, Homo sapien
ttcttcagtgatacgagaatcttag

SEQ ID NO: 116621 - DNA, 25 bp, Homo sapien
ttcttcataaacctgacctggacgg

SEQ ID NO: 116622 - DNA, 25 bp, Homo sapien
ttcttcataaacgtgacctggacgg

SEQ ID NO: 116623 - DNA, 25 bp, Homo sapien
ttcttcataaagattgcataggact

SEQ ID NO: 116624 - DNA, 25 bp, Homo sapien
ttcttcatacgtaggcaaaaataac

SEQ ID NO: 116625 - DNA, 25 bp, Homo sapien
ttcttcatagagattgcataggact

SEQ ID NO: 116626 - DNA, 25 bp, Homo sapien
ttcttcatagcatggtaagaagaca

SEQ ID NO: 116627 - DNA, 25 bp, Homo sapien
ttcttcatatcatggtaagaagaca

SEQ ID NO: 116628 - DNA, 25 bp, Homo sapien
ttcttcatatgtaggcaaaaataac

SEQ ID NO: 116629 - DNA, 25 bp, Homo sapien
ttcttcatgcatatccacatcaggc

SEQ ID NO: 116630 - DNA, 25 bp, Homo sapien
ttcttcatgcatgtccacatcaggc

SEQ ID NO: 116631 - DNA, 25 bp, Homo sapien
ttcttcattttgtgagttttcttag

SEQ ID NO: 116632 - DNA, 25 bp, Homo sapien
ttcttcattttttgagttttcttag

SEQ ID NO: 116633 - DNA, 25 bp, Homo sapien
ttcttccaaatgcattagcctccta

SEQ ID NO: 116634 - DNA, 25 bp, Homo sapien
ttcttccaaatgcgttagcctccta

SEQ ID NO: 116635 - DNA, 25 bp, Homo sapien
ttcttccaagctatttgcaactgta

SEQ ID NO: 116636 - DNA, 25 bp, Homo sapien
ttcttccaagctctttgcaactgta

SEQ ID NO: 116637 - DNA, 25 bp, Homo sapien
ttcttcccagttaggagaactattt

SEQ ID NO: 116638 - DNA, 25 bp, Homo sapien
ttcttcccagttatgagaactattt

SEQ ID NO: 116639 - DNA, 25 bp, Homo sapien
ttcttcccctggtcccagaattaag

SEQ ID NO: 116640 - DNA, 25 bp, Homo sapien
ttcttcccctggtcccggaattaag

SEQ ID NO: 116641 - DNA, 25 bp, Homo sapien
ttcttcctcactatcttcacagaaa

SEQ ID NO: 116642 - DNA, 25 bp, Homo sapien
ttcttcctcatcaatgagcacacgt

SEQ ID NO: 116643 - DNA, 25 bp, Homo sapien
ttcttcctcatcagtgagcacacgt

SEQ ID NO: 116644 - DNA, 25 bp, Homo sapien
ttcttcctcgctatcttcacagaaa

SEQ ID NO: 116645 - DNA, 25 bp, Homo sapien
ttcttcctctagtgcgcagcacacc

SEQ ID NO: 116646 - DNA, 25 bp, Homo sapien
ttcttcctgccatctttttggaatt

SEQ ID NO: 116647 - DNA, 25 bp, Homo sapien
ttcttcctgccgtctttttggaatt

SEQ ID NO: 116648 - DNA, 25 bp, Homo sapien
ttcttcctgtagtgcgcagcacacc

SEQ ID NO: 116649 - DNA, 25 bp, Homo sapien
ttcttccttagaaaacaaaaccact

SEQ ID NO: 116650 - DNA, 25 bp, Homo sapien
ttcttccttggaaaacaaaaccact

SEQ ID NO: 116651 - DNA, 25 bp, Homo sapien
ttcttctatgaaatccataagcctc

SEQ ID NO: 116652 - DNA, 25 bp, Homo sapien
ttcttctatgaaatccgtaagcctc

SEQ ID NO: 116653 - DNA, 25 bp, Homo sapien
ttcttctatggccggcatgactcag

SEQ ID NO: 116654 - DNA, 25 bp, Homo sapien
ttcttctatggctggcatgactcag

SEQ ID NO: 116655 - DNA, 25 bp, Homo sapien
ttcttctcacatggaaggagacttt

SEQ ID NO: 116656 - DNA, 25 bp, Homo sapien
ttcttctcacattgaaggagacttt

SEQ ID NO: 116657 - DNA, 25 bp, Homo sapien
ttcttctcccgaatgcatttactgt

SEQ ID NO: 116658 - DNA, 25 bp, Homo sapien
ttcttctcctgaatgcatttactgt

SEQ ID NO: 116659 - DNA, 25 bp, Homo sapien
ttcttctctgtgattccaagtgttt

SEQ ID NO: 116660 - DNA, 25 bp, Homo sapien
ttcttctctgtggttccaagtgttt

SEQ ID NO: 116661 - DNA, 25 bp, Homo sapien
ttcttctgaagggtattctgctgtt

SEQ ID NO: 116662 - DNA, 25 bp, Homo sapien
ttcttctgaaggttattctgctgtt

SEQ ID NO: 116663 - DNA, 25 bp, Homo sapien
ttcttctgcagaaccgttttctcct

SEQ ID NO: 116664 - DNA, 25 bp, Homo sapien
ttcttctgcagaactgttttctcct

SEQ ID NO: 116665 - DNA, 25 bp, Homo sapien
ttcttctgctgaatcaattctattc

SEQ ID NO: 116666 - DNA, 25 bp, Homo sapien
ttcttctgctggatcaattctattc

SEQ ID NO: 116667 - DNA, 25 bp, Homo sapien
ttcttctggacactagattaattat

SEQ ID NO: 116668 - DNA, 25 bp, Homo sapien
ttcttctgggaaatgctaccctaaa

SEQ ID NO: 116669 - DNA, 25 bp, Homo sapien
ttcttctgggcactagattaattat

SEQ ID NO: 116670 - DNA, 25 bp, Homo sapien
ttcttctggtgctaggcgagatcaa

SEQ ID NO: 116671 - DNA, 25 bp, Homo sapien
ttcttctggtgctaggtgagatcaa

SEQ ID NO: 116672 - DNA, 25 bp, Homo sapien
ttcttctgtgaaatgctaccctaaa

SEQ ID NO: 116673 - DNA, 25 bp, Homo sapien
ttcttcttaccatcctatgtacagc

SEQ ID NO: 116674 - DNA, 25 bp, Homo sapien
ttcttcttaccgtcctatgtacagc

SEQ ID NO: 116675 - DNA, 25 bp, Homo sapien
ttcttcttacttcactgagttgata

SEQ ID NO: 116676 - DNA, 25 bp, Homo sapien
ttcttcttacttcattgagttgata

SEQ ID NO: 116677 - DNA, 25 bp, Homo sapien
ttcttcttcacttacccgcaagcac

SEQ ID NO: 116678 - DNA, 25 bp, Homo sapien
ttcttcttcacttgcccgcaagcac

SEQ ID NO: 116679 - DNA, 25 bp, Homo sapien
ttcttcttctacggttccactaatt

SEQ ID NO: 116680 - DNA, 25 bp, Homo sapien
ttcttcttctatggttccactaatt

SEQ ID NO: 116681 - DNA, 25 bp, Homo sapien
ttcttcttgttcattcacatattct

SEQ ID NO: 116682 - DNA, 25 bp, Homo sapien
ttcttcttgttgattcacatattct

SEQ ID NO: 116683 - DNA, 25 bp, Homo sapien
ttcttctttgttcctttctaccatt

SEQ ID NO: 116684 - DNA, 25 bp, Homo sapien
ttcttctttgttcttttctaccatt

SEQ ID NO: 116685 - DNA, 25 bp, Homo sapien
ttcttgaagtagccatactataccc

SEQ ID NO: 116686 - DNA, 25 bp, Homo sapien
ttcttgaagtagtcatactataccc

SEQ ID NO: 116687 - DNA, 25 bp, Homo sapien
ttcttgacacgcatgacgagtgagt

SEQ ID NO: 116688 - DNA, 25 bp, Homo sapien
ttcttgacacgcatgatgagtgagt

SEQ ID NO: 116689 - DNA, 25 bp, Homo sapien
ttcttgaccagatgcttcgtcaaga

SEQ ID NO: 116690 - DNA, 25 bp, Homo sapien
ttcttgaccagctgcttcgtcaaga

SEQ ID NO: 116691 - DNA, 25 bp, Homo sapien
ttcttgagccgagactttttgtttc

SEQ ID NO: 116692 - DNA, 25 bp, Homo sapien
ttcttgagctgagactttttgtttc

SEQ ID NO: 116693 - DNA, 25 bp, Homo sapien
ttcttgagtaatagtgacaagctaa

SEQ ID NO: 116694 - DNA, 25 bp, Homo sapien
ttcttgagtaatagtggcaagctaa

SEQ ID NO: 116695 - DNA, 25 bp, Homo sapien
ttcttgattcaactattctcctaaa

SEQ ID NO: 116696 - DNA, 25 bp, Homo sapien
ttcttgattcacctattctcctaaa

SEQ ID NO: 116697 - DNA, 25 bp, Homo sapien
ttcttgcaataactcttgatggaaa

SEQ ID NO: 116698 - DNA, 25 bp, Homo sapien
ttcttgcaataactgttgatggaaa

SEQ ID NO: 116699 - DNA, 25 bp, Homo sapien
ttcttgcaccaaagtttgattgatt

SEQ ID NO: 116700 - DNA, 25 bp, Homo sapien
ttcttgcaccaacgtttgattgatt

SEQ ID NO: 116701 - DNA, 25 bp, Homo sapien
ttcttgcaccatcaaggattttagg

SEQ ID NO: 116702 - DNA, 25 bp, Homo sapien
ttcttgcaccatcgaggattttagg

SEQ ID NO: 116703 - DNA, 25 bp, Homo sapien
ttcttgcagctgttcaggcagaaaa

SEQ ID NO: 116704 - DNA, 25 bp, Homo sapien
ttcttgcagttacttcctaacgcta

SEQ ID NO: 116705 - DNA, 25 bp, Homo sapien
ttcttgcagttatttcctaacgcta

SEQ ID NO: 116706 - DNA, 25 bp, Homo sapien
ttcttgcagttgttcaggcagaaaa

SEQ ID NO: 116707 - DNA, 25 bp, Homo sapien
ttcttgcatctgagctttaacgttg

SEQ ID NO: 116708 - DNA, 25 bp, Homo sapien
ttcttgcatgttatatggcttttgc

SEQ ID NO: 116709 - DNA, 25 bp, Homo sapien
ttcttgcatgttttatggcttttgc

SEQ ID NO: 116710 - DNA, 25 bp, Homo sapien
ttcttgcatttgagctttaacgttg

SEQ ID NO: 116711 - DNA, 25 bp, Homo sapien
ttcttgccttgagatatgaggctgt

SEQ ID NO: 116712 - DNA, 25 bp, Homo sapien
ttcttgccttgatatatgaggctgt

SEQ ID NO: 116713 - DNA, 25 bp, Homo sapien
ttcttggacgcataaacaaaaaata

SEQ ID NO: 116714 - DNA, 25 bp, Homo sapien
ttcttggagaaaacctgttaatatc

SEQ ID NO: 116715 - DNA, 25 bp, Homo sapien
ttcttggagaatcaattttagccta

SEQ ID NO: 116716 - DNA, 25 bp, Homo sapien
ttcttggagaattaattttagccta

SEQ ID NO: 116717 - DNA, 25 bp, Homo sapien
ttcttggaggcataaacaaaaaata

SEQ ID NO: 116718 - DNA, 25 bp, Homo sapien
ttcttggaggctgcatctgctcttc

SEQ ID NO: 116719 - DNA, 25 bp, Homo sapien
ttcttggaggctgtatctgctcttc

SEQ ID NO: 116720 - DNA, 25 bp, Homo sapien
ttcttggagtaaacctgttaatatc

SEQ ID NO: 116721 - DNA, 25 bp, Homo sapien
ttcttggatataacacatttgtaat

SEQ ID NO: 116722 - DNA, 25 bp, Homo sapien
ttcttggatataacgcatttgtaat

SEQ ID NO: 116723 - DNA, 25 bp, Homo sapien
ttcttggccttctgtgtgctgggtc

SEQ ID NO: 116724 - DNA, 25 bp, Homo sapien
ttcttggcgttctgtgtgctgggtc

SEQ ID NO: 116725 - DNA, 25 bp, Homo sapien
ttcttggtaatgaagaccactgcag

SEQ ID NO: 116726 - DNA, 25 bp, Homo sapien
ttcttggtaatgaggaccactgcag

SEQ ID NO: 116727 - DNA, 25 bp, Homo sapien
ttcttggtcagggttgttgtcttag

SEQ ID NO: 116728 - DNA, 25 bp, Homo sapien
ttcttggtccataagttttaactaa

SEQ ID NO: 116729 - DNA, 25 bp, Homo sapien
ttcttggtccatatgttttaactaa

SEQ ID NO: 116730 - DNA, 25 bp, Homo sapien
ttcttggtccgggttgttgtcttag

SEQ ID NO: 116731 - DNA, 25 bp, Homo sapien
ttcttggtgtcatctttctttacta

SEQ ID NO: 116732 - DNA, 25 bp, Homo sapien
ttcttggtgtcgtctttctttacta

SEQ ID NO: 116733 - DNA, 25 bp, Homo sapien
ttcttggtgttggtgctggtagcac

SEQ ID NO: 116734 - DNA, 25 bp, Homo sapien
ttcttggtgtttgtgctggtagcac

SEQ ID NO: 116735 - DNA, 25 bp, Homo sapien
ttcttgtacgaaccaaatgaagact

SEQ ID NO: 116736 - DNA, 25 bp, Homo sapien
ttcttgtacttttcttttggtggcc

SEQ ID NO: 116737 - DNA, 25 bp, Homo sapien
ttcttgtactttttttttggtggcc

SEQ ID NO: 116738 - DNA, 25 bp, Homo sapien
ttcttgtaggatcccgcaaagaaca

SEQ ID NO: 116739 - DNA, 25 bp, Homo sapien
ttcttgtaggatcctgcaaagaaca

SEQ ID NO: 116740 - DNA, 25 bp, Homo sapien
ttcttgtatgaaccaaatgaagact

SEQ ID NO: 116741 - DNA, 25 bp, Homo sapien
ttcttgtcctcatacacttttgaat

SEQ ID NO: 116742 - DNA, 25 bp, Homo sapien
ttcttgtcctcgtacacttttgaat

SEQ ID NO: 116743 - DNA, 25 bp, Homo sapien
ttcttgtcctgcgacagtgttcagg

SEQ ID NO: 116744 - DNA, 25 bp, Homo sapien
ttcttgtcctgtgacagtgttcagg

SEQ ID NO: 116745 - DNA, 25 bp, Homo sapien
ttcttgtgaaataagactgagcttt

SEQ ID NO: 116746 - DNA, 25 bp, Homo sapien
ttcttgtgaaataggactgagcttt

SEQ ID NO: 116747 - DNA, 25 bp, Homo sapien
ttcttgtgacacctaacttttcagc

SEQ ID NO: 116748 - DNA, 25 bp, Homo sapien
ttcttgtggcacctaacttttcagc

SEQ ID NO: 116749 - DNA, 25 bp, Homo sapien
ttcttgttagtgccatcccgtaagc

SEQ ID NO: 116750 - DNA, 25 bp, Homo sapien
ttcttgttagtgtcatcccgtaagc

SEQ ID NO: 116751 - DNA, 25 bp, Homo sapien
ttcttgttcattcacatattctgca

SEQ ID NO: 116752 - DNA, 25 bp, Homo sapien
ttcttgttgatgacagtctccaggc

SEQ ID NO: 116753 - DNA, 25 bp, Homo sapien
ttcttgttgatgacggtctccaggc

SEQ ID NO: 116754 - DNA, 25 bp, Homo sapien
ttcttgttgattcacatattctgca

SEQ ID NO: 116755 - DNA, 25 bp, Homo sapien
ttcttgttggctacaccctctggct

SEQ ID NO: 116756 - DNA, 25 bp, Homo sapien
ttcttgttggctccaccctctggct

SEQ ID NO: 116757 - DNA, 25 bp, Homo sapien
ttcttgtttgctaacaatgatgaaa

SEQ ID NO: 116758 - DNA, 25 bp, Homo sapien
ttcttgtttgctagcaatgatgaaa

SEQ ID NO: 116759 - DNA, 25 bp, Homo sapien
ttctttaaagcacattatcacagat

SEQ ID NO: 116760 - DNA, 25 bp, Homo sapien
ttctttaaagcacgttatcacagat

SEQ ID NO: 116761 - DNA, 25 bp, Homo sapien
ttctttaatcttatccatgaccttt

SEQ ID NO: 116762 - DNA, 25 bp, Homo sapien
ttctttaatcttatccgtgaccttt

SEQ ID NO: 116763 - DNA, 25 bp, Homo sapien
ttctttacagagcctcattatattg

SEQ ID NO: 116764 - DNA, 25 bp, Homo sapien
ttctttacagagtctcattatattg

SEQ ID NO: 116765 - DNA, 25 bp, Homo sapien
ttctttacatcaatgaagcagattt

SEQ ID NO: 116766 - DNA, 25 bp, Homo sapien
ttctttacatcgatgaagcagattt

SEQ ID NO: 116767 - DNA, 25 bp, Homo sapien
ttctttagctgataagttgattaaa

SEQ ID NO: 116768 - DNA, 25 bp, Homo sapien
ttctttagctggtaagttgattaaa

SEQ ID NO: 116769 - DNA, 25 bp, Homo sapien
ttctttaggtattacggtggaagaa

SEQ ID NO: 116770 - DNA, 25 bp, Homo sapien
ttctttaggtattatggtggaagaa

SEQ ID NO: 116771 - DNA, 25 bp, Homo sapien
ttctttagtacgctccctgtctcac

SEQ ID NO: 116772 - DNA, 25 bp, Homo sapien
ttctttagtacgttccctgtctcac

SEQ ID NO: 116773 - DNA, 25 bp, Homo sapien
ttctttatctggacgtagcaatgag

SEQ ID NO: 116774 - DNA, 25 bp, Homo sapien
ttctttatctggatgtagcaatgag

SEQ ID NO: 116775 - DNA, 25 bp, Homo sapien
ttctttattcactacaggttgttct

SEQ ID NO: 116776 - DNA, 25 bp, Homo sapien
ttctttattcactgcaggttgttct

SEQ ID NO: 116777 - DNA, 25 bp, Homo sapien
ttctttattgaaacggcaactcctc

SEQ ID NO: 116778 - DNA, 25 bp, Homo sapien
ttctttattgaaatggcaactcctc

SEQ ID NO: 116779 - DNA, 25 bp, Homo sapien
ttctttcaattctgtccaccttact

SEQ ID NO: 116780 - DNA, 25 bp, Homo sapien
ttctttcacaggtatgaaggttgac

SEQ ID NO: 116781 - DNA, 25 bp, Homo sapien
ttctttcacctgcatgtttacatat

SEQ ID NO: 116782 - DNA, 25 bp, Homo sapien
ttctttcacgggtatgaaggttgac

SEQ ID NO: 116783 - DNA, 25 bp, Homo sapien
ttctttcactgtgaaatttgatgat

SEQ ID NO: 116784 - DNA, 25 bp, Homo sapien
ttctttcactgtggaatttgatgat

SEQ ID NO: 116785 - DNA, 25 bp, Homo sapien
ttctttcagttctgtccaccttact

SEQ ID NO: 116786 - DNA, 25 bp, Homo sapien
ttctttcatctgcatgtttacatat

SEQ ID NO: 116787 - DNA, 25 bp, Homo sapien
ttctttccacaatgtttgtagtttt

SEQ ID NO: 116788 - DNA, 25 bp, Homo sapien
ttctttccatttttgtatatgcaat

SEQ ID NO: 116789 - DNA, 25 bp, Homo sapien
ttctttccctttttgtatatgcaat

SEQ ID NO: 116790 - DNA, 25 bp, Homo sapien
ttctttccgcaatgtttgtagtttt

SEQ ID NO: 116791 - DNA, 25 bp, Homo sapien
ttctttcctcaagggatcaaatcaa

SEQ ID NO: 116792 - DNA, 25 bp, Homo sapien
ttctttcctcaatggatcaaatcaa

SEQ ID NO: 116793 - DNA, 25 bp, Homo sapien
ttctttcctgacccaacggaatcta

SEQ ID NO: 116794 - DNA, 25 bp, Homo sapien
ttctttcctgacccaatggaatcta

SEQ ID NO: 116795 - DNA, 25 bp, Homo sapien
ttctttctaggtcaggtccaaacaa

SEQ ID NO: 116796 - DNA, 25 bp, Homo sapien
ttctttctaggtcgggtccaaacaa

SEQ ID NO: 116797 - DNA, 25 bp, Homo sapien
ttctttctcatcttagatgcttcct

SEQ ID NO: 116798 - DNA, 25 bp, Homo sapien
ttctttctcgtcttagatgcttcct

SEQ ID NO: 116799 - DNA, 25 bp, Homo sapien
ttctttctctattgtttggatattt

SEQ ID NO: 116800 - DNA, 25 bp, Homo sapien
ttctttctctgggctcaagaagttt

SEQ ID NO: 116801 - DNA, 25 bp, Homo sapien
ttctttctctgtgctcaagaagttt

SEQ ID NO: 116802 - DNA, 25 bp, Homo sapien
ttctttctgcgccatcctattgttt

SEQ ID NO: 116803 - DNA, 25 bp, Homo sapien
ttctttctgtgccatcctattgttt

SEQ ID NO: 116804 - DNA, 25 bp, Homo sapien
ttctttcttaaactacaaaagcaat

SEQ ID NO: 116805 - DNA, 25 bp, Homo sapien
ttctttcttgaactacaaaagcaat

SEQ ID NO: 116806 - DNA, 25 bp, Homo sapien
ttctttcttgcacccaagattttct

SEQ ID NO: 116807 - DNA, 25 bp, Homo sapien
ttctttcttgcatctgagctttaac

SEQ ID NO: 116808 - DNA, 25 bp, Homo sapien
ttctttcttgcatttgagctttaac

SEQ ID NO: 116809 - DNA, 25 bp, Homo sapien
ttctttctttattgtttggatattt

SEQ ID NO: 116810 - DNA, 25 bp, Homo sapien
ttctttctttcacccaagattttct

SEQ ID NO: 116811 - DNA, 25 bp, Homo sapien
ttctttctttcacctgcatgtttac

SEQ ID NO: 116812 - DNA, 25 bp, Homo sapien
ttctttctttcatctgcatgtttac

SEQ ID NO: 116813 - DNA, 25 bp, Homo sapien
ttctttgaatcattttattttgatt

SEQ ID NO: 116814 - DNA, 25 bp, Homo sapien
ttctttgactgcaaatcttgccatg

SEQ ID NO: 116815 - DNA, 25 bp, Homo sapien
ttctttgactgcgaatcttgccatg

SEQ ID NO: 116816 - DNA, 25 bp, Homo sapien
ttctttgagtggcataggaattatg

SEQ ID NO: 116817 - DNA, 25 bp, Homo sapien
ttctttgagtggcgtaggaattatg

SEQ ID NO: 116818 - DNA, 25 bp, Homo sapien
ttctttgattcattttattttgatt

SEQ ID NO: 116819 - DNA, 25 bp, Homo sapien
ttctttgatttaacagacaatgtat

SEQ ID NO: 116820 - DNA, 25 bp, Homo sapien
ttctttgatttgacagacaatgtat

SEQ ID NO: 116821 - DNA, 25 bp, Homo sapien
ttctttgcaaaaaaaccacaaagca

SEQ ID NO: 116822 - DNA, 25 bp, Homo sapien
ttctttgcaaaaaaactacaaagca

SEQ ID NO: 116823 - DNA, 25 bp, Homo sapien
ttctttgcccactgtcgatggccaa

SEQ ID NO: 116824 - DNA, 25 bp, Homo sapien
ttctttgcccactgtctatggccaa

SEQ ID NO: 116825 - DNA, 25 bp, Homo sapien
ttctttgctccacagctactaagca

SEQ ID NO: 116826 - DNA, 25 bp, Homo sapien
ttctttgctccatagctactaagca

SEQ ID NO: 116827 - DNA, 25 bp, Homo sapien
ttctttgcttccatccatcaaccca

SEQ ID NO: 116828 - DNA, 25 bp, Homo sapien
ttctttgcttccatccgtcaaccca

SEQ ID NO: 116829 - DNA, 25 bp, Homo sapien
ttctttggtattatcagagctttaa

SEQ ID NO: 116830 - DNA, 25 bp, Homo sapien
ttctttggtggtgtttctttgagac

SEQ ID NO: 116831 - DNA, 25 bp, Homo sapien
ttctttggtggtgtttttttgagac

SEQ ID NO: 116832 - DNA, 25 bp, Homo sapien
ttctttggtgttatcagagctttaa

SEQ ID NO: 116833 - DNA, 25 bp, Homo sapien
ttctttgtcacacgaagagagctgt

SEQ ID NO: 116834 - DNA, 25 bp, Homo sapien
ttctttgtcacatgaagagagctgt

SEQ ID NO: 116835 - DNA, 25 bp, Homo sapien
ttctttgtgtccatccacagatact

SEQ ID NO: 116836 - DNA, 25 bp, Homo sapien
ttctttgtgtctatccacagatact

SEQ ID NO: 116837 - DNA, 25 bp, Homo sapien
ttcttttaaaaaatgaagagtctgt

SEQ ID NO: 116838 - DNA, 25 bp, Homo sapien
ttcttttaaaaaatgacgagtctgt

SEQ ID NO: 116839 - DNA, 25 bp, Homo sapien
ttcttttacaccacttcttggattg

SEQ ID NO: 116840 - DNA, 25 bp, Homo sapien
ttcttttacaccatttcttggattg

SEQ ID NO: 116841 - DNA, 25 bp, Homo sapien
ttcttttacatgtcatcttagagga

SEQ ID NO: 116842 - DNA, 25 bp, Homo sapien
ttcttttacgtgtcatcttagagga

SEQ ID NO: 116843 - DNA, 25 bp, Homo sapien
ttcttttagcatatgtgaaaaacag

SEQ ID NO: 116844 - DNA, 25 bp, Homo sapien
ttcttttagcatgtgtgaaaaacag

SEQ ID NO: 116845 - DNA, 25 bp, Homo sapien
ttcttttatcttattgctccagcac

SEQ ID NO: 116846 - DNA, 25 bp, Homo sapien
ttcttttatcttattgttccagcac

SEQ ID NO: 116847 - DNA, 25 bp, Homo sapien
ttcttttcaactatgtgtttaaatc

SEQ ID NO: 116848 - DNA, 25 bp, Homo sapien
ttcttttcaactgtgtgtttaaatc

SEQ ID NO: 116849 - DNA, 25 bp, Homo sapien
ttcttttcacatagttaaccaatca

SEQ ID NO: 116850 - DNA, 25 bp, Homo sapien
ttcttttcacatggttaaccaatca

SEQ ID NO: 116851 - DNA, 25 bp, Homo sapien
ttcttttccaactgaattgtctttg

SEQ ID NO: 116852 - DNA, 25 bp, Homo sapien
ttcttttccattgaatccaggaata

SEQ ID NO: 116853 - DNA, 25 bp, Homo sapien
ttcttttccattgattccaggaata

SEQ ID NO: 116854 - DNA, 25 bp, Homo sapien
ttcttttccctgatgacatatgatg

SEQ ID NO: 116855 - DNA, 25 bp, Homo sapien
ttcttttccgactgaattgtctttg

SEQ ID NO: 116856 - DNA, 25 bp, Homo sapien
ttcttttccgtgatgacatatgatg

SEQ ID NO: 116857 - DNA, 25 bp, Homo sapien
ttcttttccttgagtaatgaatgca

SEQ ID NO: 116858 - DNA, 25 bp, Homo sapien
ttcttttccttgggtaatgaatgca

SEQ ID NO: 116859 - DNA, 25 bp, Homo sapien
ttcttttctacaacttacactacac

SEQ ID NO: 116860 - DNA, 25 bp, Homo sapien
ttcttttctacaccttacactacac

SEQ ID NO: 116861 - DNA, 25 bp, Homo sapien
ttcttttctcccgaatgatgggatc

SEQ ID NO: 116862 - DNA, 25 bp, Homo sapien
ttcttttctcccgagtgatgggatc

SEQ ID NO: 116863 - DNA, 25 bp, Homo sapien
ttcttttctctagtgtccttcttaa

SEQ ID NO: 116864 - DNA, 25 bp, Homo sapien
ttcttttctctagtgttcttcttaa

SEQ ID NO: 116865 - DNA, 25 bp, Homo sapien
ttcttttctctatcaccgtaggccc

SEQ ID NO: 116866 - DNA, 25 bp, Homo sapien
ttcttttctctatcactgtaggccc

SEQ ID NO: 116867 - DNA, 25 bp, Homo sapien
ttcttttgacagcttacagaagcca

SEQ ID NO: 116868 - DNA, 25 bp, Homo sapien
ttcttttgcaccttaaaatacttca

SEQ ID NO: 116869 - DNA, 25 bp, Homo sapien
ttcttttgccaacctgcatctttaa

SEQ ID NO: 116870 - DNA, 25 bp, Homo sapien
ttcttttgccagaacataccacaat

SEQ ID NO: 116871 - DNA, 25 bp, Homo sapien
ttcttttgccagagcataccacaat

SEQ ID NO: 116872 - DNA, 25 bp, Homo sapien
ttcttttgctccttaaaatacttca

SEQ ID NO: 116873 - DNA, 25 bp, Homo sapien
ttcttttgcttaatcaattctgctt

SEQ ID NO: 116874 - DNA, 25 bp, Homo sapien
ttcttttgcttaatcagttctgctt

SEQ ID NO: 116875 - DNA, 25 bp, Homo sapien
ttcttttgcttcgggcaatatccta

SEQ ID NO: 116876 - DNA, 25 bp, Homo sapien
ttcttttgctttgggcaatatccta

SEQ ID NO: 116877 - DNA, 25 bp, Homo sapien
ttcttttgtatcagcttcctccatt

SEQ ID NO: 116878 - DNA, 25 bp, Homo sapien
ttcttttgtatcagtttcctccatt

SEQ ID NO: 116879 - DNA, 25 bp, Homo sapien
ttcttttgtcaacctgcatctttaa

SEQ ID NO: 116880 - DNA, 25 bp, Homo sapien
ttcttttgtcagcttacagaagcca

SEQ ID NO: 116881 - DNA, 25 bp, Homo sapien
ttcttttgtgcacgaggcattttaa

SEQ ID NO: 116882 - DNA, 25 bp, Homo sapien
ttcttttgtgcatgaggcattttaa

SEQ ID NO: 116883 - DNA, 25 bp, Homo sapien
ttcttttgttcagacttgccttccc

SEQ ID NO: 116884 - DNA, 25 bp, Homo sapien
ttcttttgttcagatttgccttccc

SEQ ID NO: 116885 - DNA, 25 bp, Homo sapien
ttctttttacatacttggttgcttc

SEQ ID NO: 116886 - DNA, 25 bp, Homo sapien
ttctttttacatagttggttgcttc

SEQ ID NO: 116887 - DNA, 25 bp, Homo sapien
ttctttttagatcaggctggttagg

SEQ ID NO: 116888 - DNA, 25 bp, Homo sapien
ttctttttagatcaggttggttagg

SEQ ID NO: 116889 - DNA, 25 bp, Homo sapien
ttctttttcagcagtcattttcttc

SEQ ID NO: 116890 - DNA, 25 bp, Homo sapien
ttctttttcagcagtctttttcttc

SEQ ID NO: 116891 - DNA, 25 bp, Homo sapien
ttctttttctttcagatatcagctc

SEQ ID NO: 116892 - DNA, 25 bp, Homo sapien
ttctttttcttttagatatcagctc

SEQ ID NO: 116893 - DNA, 25 bp, Homo sapien
ttcttttttcctatagcaattatca

SEQ ID NO: 116894 - DNA, 25 bp, Homo sapien
ttcttttttcctgtagcaattatca

SEQ ID NO: 116895 - DNA, 25 bp, Homo sapien
ttctttttttcaaaattcagtaact

SEQ ID NO: 116896 - DNA, 25 bp, Homo sapien
ttctttttttcaaagttcagtaact

SEQ ID NO: 116897 - DNA, 25 bp, Homo sapien
ttgaaaaacacattaagagctccct

SEQ ID NO: 116898 - DNA, 25 bp, Homo sapien
ttgaaaaacccattaagagctccct

SEQ ID NO: 116899 - DNA, 25 bp, Homo sapien
ttgaaaaagatctgcaacgtctcaa

SEQ ID NO: 116900 - DNA, 25 bp, Homo sapien
ttgaaaaagatctgcagcgtctcaa

SEQ ID NO: 116901 - DNA, 25 bp, Homo sapien
ttgaaaaatgactcaacaatggcct

SEQ ID NO: 116902 - DNA, 25 bp, Homo sapien
ttgaaaaatgagtcaacaatggcct

SEQ ID NO: 116903 - DNA, 25 bp, Homo sapien
ttgaaaacgattgtcaaagaaagag

SEQ ID NO: 116904 - DNA, 25 bp, Homo sapien
ttgaaaacgattgttaaagaaagag

SEQ ID NO: 116905 - DNA, 25 bp, Homo sapien
ttgaaaagacggtccataacaaaaa

SEQ ID NO: 116906 - DNA, 25 bp, Homo sapien
ttgaaaagatggtccataacaaaaa

SEQ ID NO: 116907 - DNA, 25 bp, Homo sapien
ttgaaaagattttccgacatgataa

SEQ ID NO: 116908 - DNA, 25 bp, Homo sapien
ttgaaaagattttcggacatgataa

SEQ ID NO: 116909 - DNA, 25 bp, Homo sapien
ttgaaaagcagattccaaagttatc

SEQ ID NO: 116910 - DNA, 25 bp, Homo sapien
ttgaaaagcaggttccaaagttatc

SEQ ID NO: 116911 - DNA, 25 bp, Homo sapien
ttgaaaatatgatcaatccaagatg

SEQ ID NO: 116912 - DNA, 25 bp, Homo sapien
ttgaaaatatggtcaatccaagatg

SEQ ID NO: 116913 - DNA, 25 bp, Homo sapien
ttgaaaatgccctcagctgtgccaa

SEQ ID NO: 116914 - DNA, 25 bp, Homo sapien
ttgaaaatgtcctcagctgtgccaa

SEQ ID NO: 116915 - DNA, 25 bp, Homo sapien
ttgaaaattccctcaaacttggaaa

SEQ ID NO: 116916 - DNA, 25 bp, Homo sapien
ttgaaaattccctcgaacttggaaa

SEQ ID NO: 116917 - DNA, 25 bp, Homo sapien
ttgaaacatgaaagttgcctaaaaa

SEQ ID NO: 116918 - DNA, 25 bp, Homo sapien
ttgaaacatgaaagtttcctaaaaa

SEQ ID NO: 116919 - DNA, 25 bp, Homo sapien
ttgaaacatttcaggcaatctgaca

SEQ ID NO: 116920 - DNA, 25 bp, Homo sapien
ttgaaacatttcaggcgatctgaca

SEQ ID NO: 116921 - DNA, 25 bp, Homo sapien
ttgaaagaatgcttgtctccaattt

SEQ ID NO: 116922 - DNA, 25 bp, Homo sapien
ttgaaagacaaagtgctaccatttc

SEQ ID NO: 116923 - DNA, 25 bp, Homo sapien
ttgaaagacaacgtgctaccatttc

SEQ ID NO: 116924 - DNA, 25 bp, Homo sapien
ttgaaagacgctaagaagccacatg

SEQ ID NO: 116925 - DNA, 25 bp, Homo sapien
ttgaaagagtgcttgtctccaattt

SEQ ID NO: 116926 - DNA, 25 bp, Homo sapien
ttgaaagatgctaagaagccacatg

SEQ ID NO: 116927 - DNA, 25 bp, Homo sapien
ttgaaagcagtccttcctttctgag

SEQ ID NO: 116928 - DNA, 25 bp, Homo sapien
ttgaaagcagtctttcctttctgag

SEQ ID NO: 116929 - DNA, 25 bp, Homo sapien
ttgaaagccttaacaatagattaga

SEQ ID NO: 116930 - DNA, 25 bp, Homo sapien
ttgaaagccttaaccatagattaga

SEQ ID NO: 116931 - DNA, 25 bp, Homo sapien
ttgaaagctaccaccaaatcactca

SEQ ID NO: 116932 - DNA, 25 bp, Homo sapien
ttgaaagctactaccaaatcactca

SEQ ID NO: 116933 - DNA, 25 bp, Homo sapien
ttgaaagctgtagaaaagtttacat

SEQ ID NO: 116934 - DNA, 25 bp, Homo sapien
ttgaaagctgtataaaagtttacat

SEQ ID NO: 116935 - DNA, 25 bp, Homo sapien
ttgaaaggaagacgagacacataaa

SEQ ID NO: 116936 - DNA, 25 bp, Homo sapien
ttgaaaggaagatgagacacataaa

SEQ ID NO: 116937 - DNA, 25 bp, Homo sapien
ttgaaaggacagtcatttagataag

SEQ ID NO: 116938 - DNA, 25 bp, Homo sapien
ttgaaaggacagtcgtttagataag

SEQ ID NO: 116939 - DNA, 25 bp, Homo sapien
ttgaaagtaacaaacttgcttatga

SEQ ID NO: 116940 - DNA, 25 bp, Homo sapien
ttgaaagtagcaaacttgcttatga

SEQ ID NO: 116941 - DNA, 25 bp, Homo sapien
ttgaaagtgacggtagaaaaattat

SEQ ID NO: 116942 - DNA, 25 bp, Homo sapien
ttgaaagtgacggtaggaaaattat

SEQ ID NO: 116943 - DNA, 25 bp, Homo sapien
ttgaaagtggaaaaggataggctga

SEQ ID NO: 116944 - DNA, 25 bp, Homo sapien
ttgaaagtggaaccgttagtccatt

SEQ ID NO: 116945 - DNA, 25 bp, Homo sapien
ttgaaagtggaataggataggctga

SEQ ID NO: 116946 - DNA, 25 bp, Homo sapien
ttgaaagtggatccgttagtccatt

SEQ ID NO: 116947 - DNA, 25 bp, Homo sapien
ttgaaagtgttcgtgttttttctta

SEQ ID NO: 116948 - DNA, 25 bp, Homo sapien
ttgaaagtgtttgtgttttttctta

SEQ ID NO: 116949 - DNA, 25 bp, Homo sapien
ttgaaagttgtatacgttaatgatt

SEQ ID NO: 116950 - DNA, 25 bp, Homo sapien
ttgaaagttgtatatgttaatgatt

SEQ ID NO: 116951 - DNA, 25 bp, Homo sapien
ttgaaatacaagaagtttgtctaag

SEQ ID NO: 116952 - DNA, 25 bp, Homo sapien
ttgaaatacgaagacatggaaaacc

SEQ ID NO: 116953 - DNA, 25 bp, Homo sapien
ttgaaatataagaagtttgtctaag

SEQ ID NO: 116954 - DNA, 25 bp, Homo sapien
ttgaaatatgaagacatggaaaacc

SEQ ID NO: 116955 - DNA, 25 bp, Homo sapien
ttgaaatcagaaaaaaacagaagtt

SEQ ID NO: 116956 - DNA, 25 bp, Homo sapien
ttgaaatcagaagaaaacagaagtt

SEQ ID NO: 116957 - DNA, 25 bp, Homo sapien
ttgaaatcgggaatacaatgataag

SEQ ID NO: 116958 - DNA, 25 bp, Homo sapien
ttgaaatcggggatacaatgataag

SEQ ID NO: 116959 - DNA, 25 bp, Homo sapien
ttgaaatctataacccattttgagt

SEQ ID NO: 116960 - DNA, 25 bp, Homo sapien
ttgaaatctgtaacccattttgagt

SEQ ID NO: 116961 - DNA, 25 bp, Homo sapien
ttgaaatgatgctgacaagggccag

SEQ ID NO: 116962 - DNA, 25 bp, Homo sapien
ttgaaatgccagatatagcaaaaaa

SEQ ID NO: 116963 - DNA, 25 bp, Homo sapien
ttgaaatggtgctgacaagggccag

SEQ ID NO: 116964 - DNA, 25 bp, Homo sapien
ttgaaatgtcagatatagcaaaaaa

SEQ ID NO: 116965 - DNA, 25 bp, Homo sapien
ttgaaatgtggttgaccaacatcat

SEQ ID NO: 116966 - DNA, 25 bp, Homo sapien
ttgaaatgtggttgactaacatcat

SEQ ID NO: 116967 - DNA, 25 bp, Homo sapien
ttgaaatgtgtttaacttgaattgc

SEQ ID NO: 116968 - DNA, 25 bp, Homo sapien
ttgaaatgtgtttatcttgaattgc

SEQ ID NO: 116969 - DNA, 25 bp, Homo sapien
ttgaaattactccttactccatggg

SEQ ID NO: 116970 - DNA, 25 bp, Homo sapien
ttgaaattagtccttactccatggg

SEQ ID NO: 116971 - DNA, 25 bp, Homo sapien
ttgaaattcataacacacaaatgta

SEQ ID NO: 116972 - DNA, 25 bp, Homo sapien
ttgaaattcataacacgcaaatgta

SEQ ID NO: 116973 - DNA, 25 bp, Homo sapien
ttgaaatttggccttcaatattaga

SEQ ID NO: 116974 - DNA, 25 bp, Homo sapien
ttgaaatttggtcttcaatattaga

SEQ ID NO: 116975 - DNA, 25 bp, Homo sapien
ttgaacaaaactcttaaacagcctt

SEQ ID NO: 116976 - DNA, 25 bp, Homo sapien
ttgaacaaacctcttaaacagcctt

SEQ ID NO: 116977 - DNA, 25 bp, Homo sapien
ttgaacaaactctcttgattagctt

SEQ ID NO: 116978 - DNA, 25 bp, Homo sapien
ttgaacaaattctcttgattagctt

SEQ ID NO: 116979 - DNA, 25 bp, Homo sapien
ttgaacaacttcctccacagtaact

SEQ ID NO: 116980 - DNA, 25 bp, Homo sapien
ttgaacaacttcctccgcagtaact

SEQ ID NO: 116981 - DNA, 25 bp, Homo sapien
ttgaacacagactcagctcaacatg

SEQ ID NO: 116982 - DNA, 25 bp, Homo sapien
ttgaacacagattcagctcaacatg

SEQ ID NO: 116983 - DNA, 25 bp, Homo sapien
ttgaacacagtttgaacagttggtc

SEQ ID NO: 116984 - DNA, 25 bp, Homo sapien
ttgaacacagtttgaagagttggtc

SEQ ID NO: 116985 - DNA, 25 bp, Homo sapien
ttgaacatattcctcaacaacagca

SEQ ID NO: 116986 - DNA, 25 bp, Homo sapien
ttgaacatattcctcagcaacagca

SEQ ID NO: 116987 - DNA, 25 bp, Homo sapien
ttgaacatgcgcacagaaagggcct

SEQ ID NO: 116988 - DNA, 25 bp, Homo sapien
ttgaacatgtgcacagaaagggcct

SEQ ID NO: 116989 - DNA, 25 bp, Homo sapien
ttgaacatttattacacgtcacaaa

SEQ ID NO: 116990 - DNA, 25 bp, Homo sapien
ttgaacatttattacatgtcacaaa

SEQ ID NO: 116991 - DNA, 25 bp, Homo sapien
ttgaaccacttttgcatcactggga

SEQ ID NO: 116992 - DNA, 25 bp, Homo sapien
ttgaaccagtctccgggacatggaa

SEQ ID NO: 116993 - DNA, 25 bp, Homo sapien
ttgaaccagtcttcgggacatggaa

SEQ ID NO: 116994 - DNA, 25 bp, Homo sapien
ttgaaccatttttgcatcactggga

SEQ ID NO: 116995 - DNA, 25 bp, Homo sapien
ttgaaccttattaacttattttgca

SEQ ID NO: 116996 - DNA, 25 bp, Homo sapien
ttgaacctttttaacttattttgca

SEQ ID NO: 116997 - DNA, 25 bp, Homo sapien
ttgaactaggctctgaggagataat

SEQ ID NO: 116998 - DNA, 25 bp, Homo sapien
ttgaactaggctttgaggagataat

SEQ ID NO: 116999 - DNA, 25 bp, Homo sapien
ttgaactctgatacaggatatttta

SEQ ID NO: 117000 - DNA, 25 bp, Homo sapien
ttgaactctgatataggatatttta

SEQ ID NO: 117001 - DNA, 25 bp, Homo sapien
ttgaactctgtgtctgaaagtcaac

SEQ ID NO: 117002 - DNA, 25 bp, Homo sapien
ttgaactctttgtctgaaagtcaac

SEQ ID NO: 117003 - DNA, 25 bp, Homo sapien
ttgaactggacaacgctaaagaggt

SEQ ID NO: 117004 - DNA, 25 bp, Homo sapien
ttgaactggacatcgctaaagaggt

SEQ ID NO: 117005 - DNA, 25 bp, Homo sapien
ttgaactgttgaccacacattttca

SEQ ID NO: 117006 - DNA, 25 bp, Homo sapien
ttgaactgttgacctcacattttca

SEQ ID NO: 117007 - DNA, 25 bp, Homo sapien
ttgaacttacgcaaagcttcatctg

SEQ ID NO: 117008 - DNA, 25 bp, Homo sapien
ttgaacttatgcaaagcttcatctg

SEQ ID NO: 117009 - DNA, 25 bp, Homo sapien
ttgaacttttgcgttccttcttgga

SEQ ID NO: 117010 - DNA, 25 bp, Homo sapien
ttgaacttttgtgttccttcttgga

SEQ ID NO: 117011 - DNA, 25 bp, Homo sapien
ttgaagaaatgggcttaaatctgca

SEQ ID NO: 117012 - DNA, 25 bp, Homo sapien
ttgaagaaatgggtttaaatctgca

SEQ ID NO: 117013 - DNA, 25 bp, Homo sapien
ttgaagaccttgccatgttaagtga

SEQ ID NO: 117014 - DNA, 25 bp, Homo sapien
ttgaagaccttgccgtgttaagtga

SEQ ID NO: 117015 - DNA, 25 bp, Homo sapien
ttgaagagctaggcaaattatttca

SEQ ID NO: 117016 - DNA, 25 bp, Homo sapien
ttgaagaggatgggacttttcagtt

SEQ ID NO: 117017 - DNA, 25 bp, Homo sapien
ttgaagaggatgggccttttcagtt

SEQ ID NO: 117018 - DNA, 25 bp, Homo sapien
ttgaagagtaactgtgataggttcc

SEQ ID NO: 117019 - DNA, 25 bp, Homo sapien
ttgaagagtaactgtggtaggttcc

SEQ ID NO: 117020 - DNA, 25 bp, Homo sapien
ttgaagagttaggcaaattatttca

SEQ ID NO: 117021 - DNA, 25 bp, Homo sapien
ttgaagagtttaattttttcctgat

SEQ ID NO: 117022 - DNA, 25 bp, Homo sapien
ttgaagagttttattttttcctgat

SEQ ID NO: 117023 - DNA, 25 bp, Homo sapien
ttgaagataggataatggatgaata

SEQ ID NO: 117024 - DNA, 25 bp, Homo sapien
ttgaagataggctctttgaaaatat

SEQ ID NO: 117025 - DNA, 25 bp, Homo sapien
ttgaagataggctgtttgaaaatat

SEQ ID NO: 117026 - DNA, 25 bp, Homo sapien
ttgaagatcaaatagttgcaggtgt

SEQ ID NO: 117027 - DNA, 25 bp, Homo sapien
ttgaagatcaaatggttgcaggtgt

SEQ ID NO: 117028 - DNA, 25 bp, Homo sapien
ttgaagatgctgccctctttcttat

SEQ ID NO: 117029 - DNA, 25 bp, Homo sapien
ttgaagatgctgccttctttcttat

SEQ ID NO: 117030 - DNA, 25 bp, Homo sapien
ttgaagatgggataatggatgaata

SEQ ID NO: 117031 - DNA, 25 bp, Homo sapien
ttgaagcagaccataatatgatacc

SEQ ID NO: 117032 - DNA, 25 bp, Homo sapien
ttgaagcagaccatgatatgatacc

SEQ ID NO: 117033 - DNA, 25 bp, Homo sapien
ttgaagcatctgtgacatctgtgac

SEQ ID NO: 117034 - DNA, 25 bp, Homo sapien
ttgaagcatttgtgacatctgtgac

SEQ ID NO: 117035 - DNA, 25 bp, Homo sapien
ttgaagcttcttttgttcagagttt

SEQ ID NO: 117036 - DNA, 25 bp, Homo sapien
ttgaagcttgtaacagaaataggat

SEQ ID NO: 117037 - DNA, 25 bp, Homo sapien
ttgaagcttgtaccagaaataggat

SEQ ID NO: 117038 - DNA, 25 bp, Homo sapien
ttgaagcttgttttgttcagagttt

SEQ ID NO: 117039 - DNA, 25 bp, Homo sapien
ttgaaggaataactacttgttcatt

SEQ ID NO: 117040 - DNA, 25 bp, Homo sapien
ttgaaggaataattacttgttcatt

SEQ ID NO: 117041 - DNA, 25 bp, Homo sapien
ttgaaggacatcagtcaatctttaa

SEQ ID NO: 117042 - DNA, 25 bp, Homo sapien
ttgaaggacgtcagtcaatctttaa

SEQ ID NO: 117043 - DNA, 25 bp, Homo sapien
ttgaaggattccatgagaaaaaata

SEQ ID NO: 117044 - DNA, 25 bp, Homo sapien
ttgaaggattctatgagaaaaaata

SEQ ID NO: 117045 - DNA, 25 bp, Homo sapien
ttgaaggcaaggatgatgcctattt

SEQ ID NO: 117046 - DNA, 25 bp, Homo sapien
ttgaaggcactgaaaaaatatatat

SEQ ID NO: 117047 - DNA, 25 bp, Homo sapien
ttgaaggcactgagaaaatatatat

SEQ ID NO: 117048 - DNA, 25 bp, Homo sapien
ttgaaggcagggatgatgcctattt

SEQ ID NO: 117049 - DNA, 25 bp, Homo sapien
ttgaaggtgaacttggcatcagaaa

SEQ ID NO: 117050 - DNA, 25 bp, Homo sapien
ttgaaggtgaactttgcatcagaaa

SEQ ID NO: 117051 - DNA, 25 bp, Homo sapien
ttgaaggtgctgtcattgttgtaga

SEQ ID NO: 117052 - DNA, 25 bp, Homo sapien
ttgaaggttctgtcattgttgtaga

SEQ ID NO: 117053 - DNA, 25 bp, Homo sapien
ttgaagtagatgagcaaggtggatt

SEQ ID NO: 117054 - DNA, 25 bp, Homo sapien
ttgaagtagccatactataccctag

SEQ ID NO: 117055 - DNA, 25 bp, Homo sapien
ttgaagtaggtgagcaaggtggatt

SEQ ID NO: 117056 - DNA, 25 bp, Homo sapien
ttgaagtagtcatactataccctag

SEQ ID NO: 117057 - DNA, 25 bp, Homo sapien
ttgaagtgaagcgatactgaccata

SEQ ID NO: 117058 - DNA, 25 bp, Homo sapien
ttgaagtgaagctatactgaccata

SEQ ID NO: 117059 - DNA, 25 bp, Homo sapien
ttgaagtgagtttcagtgatatctt

SEQ ID NO: 117060 - DNA, 25 bp, Homo sapien
ttgaagtgattttcagtgatatctt

SEQ ID NO: 117061 - DNA, 25 bp, Homo sapien
ttgaagttacggctcttcttgcttc

SEQ ID NO: 117062 - DNA, 25 bp, Homo sapien
ttgaagttatggctcttcttgcttc

SEQ ID NO: 117063 - DNA, 25 bp, Homo sapien
ttgaataaacataagcagcagtcag

SEQ ID NO: 117064 - DNA, 25 bp, Homo sapien
ttgaataaacatcagcagcagtcag

SEQ ID NO: 117065 - DNA, 25 bp, Homo sapien
ttgaatagcaaagatgtgcgaacaa

SEQ ID NO: 117066 - DNA, 25 bp, Homo sapien
ttgaatagcaaaggtgtgcgaacaa

SEQ ID NO: 117067 - DNA, 25 bp, Homo sapien
ttgaatagtatcagacacttttaaa

SEQ ID NO: 117068 - DNA, 25 bp, Homo sapien
ttgaatagtattagacacttttaaa

SEQ ID NO: 117069 - DNA, 25 bp, Homo sapien
ttgaatatcgtgtactttatttctc

SEQ ID NO: 117070 - DNA, 25 bp, Homo sapien
ttgaatatggtcaattggcatcatg

SEQ ID NO: 117071 - DNA, 25 bp, Homo sapien
ttgaatatggtgtactttatttctc

SEQ ID NO: 117072 - DNA, 25 bp, Homo sapien
ttgaatatgttcaattggcatcatg

SEQ ID NO: 117073 - DNA, 25 bp, Homo sapien
ttgaatccctacatgataagaaact

SEQ ID NO: 117074 - DNA, 25 bp, Homo sapien
ttgaatccctacgtgataagaaact

SEQ ID NO: 117075 - DNA, 25 bp, Homo sapien
ttgaatccctggctccaattattcc

SEQ ID NO: 117076 - DNA, 25 bp, Homo sapien
ttgaatccctggctccgattattcc

SEQ ID NO: 117077 - DNA, 25 bp, Homo sapien
ttgaatctcagctctgccacatact

SEQ ID NO: 117078 - DNA, 25 bp, Homo sapien
ttgaatctcagctttgccacatact

SEQ ID NO: 117079 - DNA, 25 bp, Homo sapien
ttgaatctcatgtaggaagaaattc

SEQ ID NO: 117080 - DNA, 25 bp, Homo sapien
ttgaatctcgtgtaggaagaaattc

SEQ ID NO: 117081 - DNA, 25 bp, Homo sapien
ttgaatgaggagacgaacaaggcct

SEQ ID NO: 117082 - DNA, 25 bp, Homo sapien
ttgaatgaggagatgaacaaggcct

SEQ ID NO: 117083 - DNA, 25 bp, Homo sapien
ttgaatgcatttcggccatgaggtt

SEQ ID NO: 117084 - DNA, 25 bp, Homo sapien
ttgaatgcattttggccatgaggtt

SEQ ID NO: 117085 - DNA, 25 bp, Homo sapien
ttgaatgttcaatcactaacaaagg

SEQ ID NO: 117086 - DNA, 25 bp, Homo sapien
ttgaatgttcagtcactaacaaagg

SEQ ID NO: 117087 - DNA, 25 bp, Homo sapien
ttgaattaaggccgactctcatgat

SEQ ID NO: 117088 - DNA, 25 bp, Homo sapien
ttgaattaaggccgcctctcatgat

SEQ ID NO: 117089 - DNA, 25 bp, Homo sapien
ttgaattaatacgaaagaggcaaaa

SEQ ID NO: 117090 - DNA, 25 bp, Homo sapien
ttgaattaatatgaaagaggcaaaa

SEQ ID NO: 117091 - DNA, 25 bp, Homo sapien
ttgaattgtgcatcgtatggttggc

SEQ ID NO: 117092 - DNA, 25 bp, Homo sapien
ttgaattgtgcattgtatggttggc

SEQ ID NO: 117093 - DNA, 25 bp, Homo sapien
ttgaatttccaacatctcacttttt

SEQ ID NO: 117094 - DNA, 25 bp, Homo sapien
ttgaatttgcaacatctcacttttt

SEQ ID NO: 117095 - DNA, 25 bp, Homo sapien
ttgaattttcaaacattatcaaaat

SEQ ID NO: 117096 - DNA, 25 bp, Homo sapien
ttgaattttcaaactttatcaaaat

SEQ ID NO: 117097 - DNA, 25 bp, Homo sapien
ttgaattttctcctttgtttcagtg

SEQ ID NO: 117098 - DNA, 25 bp, Homo sapien
ttgaattttctcttttgtttcagtg

SEQ ID NO: 117099 - DNA, 25 bp, Homo sapien
ttgaatttttctcccgtaatgcata

SEQ ID NO: 117100 - DNA, 25 bp, Homo sapien
ttgaatttttctcctgtaatgcata

SEQ ID NO: 117101 - DNA, 25 bp, Homo sapien
ttgacaaaaagtaaagcaagtgtga

SEQ ID NO: 117102 - DNA, 25 bp, Homo sapien
ttgacaaaaagtaaggcaagtgtga

SEQ ID NO: 117103 - DNA, 25 bp, Homo sapien
ttgacaaacactcagaccagttcaa

SEQ ID NO: 117104 - DNA, 25 bp, Homo sapien
ttgacaaaggtagcggtcagctgtg

SEQ ID NO: 117105 - DNA, 25 bp, Homo sapien
ttgacaaaggtagtggtcagctgtg

SEQ ID NO: 117106 - DNA, 25 bp, Homo sapien
ttgacaaagtttccaaaaagtctcc

SEQ ID NO: 117107 - DNA, 25 bp, Homo sapien
ttgacaaagtttccgaaaagtctcc

SEQ ID NO: 117108 - DNA, 25 bp, Homo sapien
ttgacaaatactcagaccagttcaa

SEQ ID NO: 117109 - DNA, 25 bp, Homo sapien
ttgacaaatctggtgagttctcaag

SEQ ID NO: 117110 - DNA, 25 bp, Homo sapien
ttgacaaatctggttagttctcaag

SEQ ID NO: 117111 - DNA, 25 bp, Homo sapien
ttgacaagcagattttaaaatttat

SEQ ID NO: 117112 - DNA, 25 bp, Homo sapien
ttgacaagcagatttttaaatttat

SEQ ID NO: 117113 - DNA, 25 bp, Homo sapien
ttgacaaggataaacctatcatagg

SEQ ID NO: 117114 - DNA, 25 bp, Homo sapien
ttgacaaggctaaacctatcatagg

SEQ ID NO: 117115 - DNA, 25 bp, Homo sapien
ttgacacattaaatttcagtcttgg

SEQ ID NO: 117116 - DNA, 25 bp, Homo sapien
ttgacacattaaattttagtcttgg

SEQ ID NO: 117117 - DNA, 25 bp, Homo sapien
ttgacacattacctacattacttat

SEQ ID NO: 117118 - DNA, 25 bp, Homo sapien
ttgacacattacttacattacttat

SEQ ID NO: 117119 - DNA, 25 bp, Homo sapien
ttgacacctatatcatccagacaat

SEQ ID NO: 117120 - DNA, 25 bp, Homo sapien
ttgacacctatattatccagacaat

SEQ ID NO: 117121 - DNA, 25 bp, Homo sapien
ttgacacgcatgacgagtgagtgct

SEQ ID NO: 117122 - DNA, 25 bp, Homo sapien
ttgacacgcatgatgagtgagtgct

SEQ ID NO: 117123 - DNA, 25 bp, Homo sapien
ttgacactgaaatcatatcttgctc

SEQ ID NO: 117124 - DNA, 25 bp, Homo sapien
ttgacactgaaatgatatcttgctc

SEQ ID NO: 117125 - DNA, 25 bp, Homo sapien
ttgacagcaaaacctggcctttcct

SEQ ID NO: 117126 - DNA, 25 bp, Homo sapien
ttgacagcaaaatctggcctttcct

SEQ ID NO: 117127 - DNA, 25 bp, Homo sapien
ttgacagcagtgattgaaagctttg

SEQ ID NO: 117128 - DNA, 25 bp, Homo sapien
ttgacagccagtgcggtggatttca

SEQ ID NO: 117129 - DNA, 25 bp, Homo sapien
ttgacagccagtgtggtggatttca

SEQ ID NO: 117130 - DNA, 25 bp, Homo sapien
ttgacagccttaagcagcatagaga

SEQ ID NO: 117131 - DNA, 25 bp, Homo sapien
ttgacagccttatgcagcatagaga

SEQ ID NO: 117132 - DNA, 25 bp, Homo sapien
ttgacagcggtgattgaaagctttg

SEQ ID NO: 117133 - DNA, 25 bp, Homo sapien
ttgacagtccatatgtggtgaaaaa

SEQ ID NO: 117134 - DNA, 25 bp, Homo sapien
ttgacagttcatatgtggtgaaaaa

SEQ ID NO: 117135 - DNA, 25 bp, Homo sapien
ttgacagtttaacgtagccccagaa

SEQ ID NO: 117136 - DNA, 25 bp, Homo sapien
ttgacagtttaatgtagccccagaa

SEQ ID NO: 117137 - DNA, 25 bp, Homo sapien
ttgacataaaatggaacattacata

SEQ ID NO: 117138 - DNA, 25 bp, Homo sapien
ttgacataaaatggaatattacata

SEQ ID NO: 117139 - DNA, 25 bp, Homo sapien
ttgacatactggattggaattaaga

SEQ ID NO: 117140 - DNA, 25 bp, Homo sapien
ttgacatatgacggacataatgaaa

SEQ ID NO: 117141 - DNA, 25 bp, Homo sapien
ttgacatatgatggacataatgaaa

SEQ ID NO: 117142 - DNA, 25 bp, Homo sapien
ttgacatattggattggaattaaga

SEQ ID NO: 117143 - DNA, 25 bp, Homo sapien
ttgacatcagatactccgccttttg

SEQ ID NO: 117144 - DNA, 25 bp, Homo sapien
ttgacatcagatactctgccttttg

SEQ ID NO: 117145 - DNA, 25 bp, Homo sapien
ttgacatccacctgatcaccaccat

SEQ ID NO: 117146 - DNA, 25 bp, Homo sapien
ttgacatcctcctgatcaccaccat

SEQ ID NO: 117147 - DNA, 25 bp, Homo sapien
ttgacattacatatgcccagtagtg

SEQ ID NO: 117148 - DNA, 25 bp, Homo sapien
ttgacattctaactacaatttcaaa

SEQ ID NO: 117149 - DNA, 25 bp, Homo sapien
ttgacattctacctacaatttcaaa

SEQ ID NO: 117150 - DNA, 25 bp, Homo sapien
ttgacattgcatatgcccagtagtg

SEQ ID NO: 117151 - DNA, 25 bp, Homo sapien
ttgacattggttctcctgtgtgtgc

SEQ ID NO: 117152 - DNA, 25 bp, Homo sapien
ttgacattggttttcctgtgtgtgc

SEQ ID NO: 117153 - DNA, 25 bp, Homo sapien
ttgacatttgaagaaactaggctgg

SEQ ID NO: 117154 - DNA, 25 bp, Homo sapien
ttgacattttaagaaactaggctgg

SEQ ID NO: 117155 - DNA, 25 bp, Homo sapien
ttgaccaaacacggaaatagcaatg

SEQ ID NO: 117156 - DNA, 25 bp, Homo sapien
ttgaccaaacatggaaatagcaatg

SEQ ID NO: 117157 - DNA, 25 bp, Homo sapien
ttgaccacaggtaccaaaatgattc

SEQ ID NO: 117158 - DNA, 25 bp, Homo sapien
ttgaccacaggtaccagaatgattc

SEQ ID NO: 117159 - DNA, 25 bp, Homo sapien
ttgaccagataatttacgctaacaa

SEQ ID NO: 117160 - DNA, 25 bp, Homo sapien
ttgaccagataatttatgctaacaa

SEQ ID NO: 117161 - DNA, 25 bp, Homo sapien
ttgaccagatgcttcgtcaagaagg

SEQ ID NO: 117162 - DNA, 25 bp, Homo sapien
ttgaccagcatccagatcaagaaat

SEQ ID NO: 117163 - DNA, 25 bp, Homo sapien
ttgaccagctgcttcgtcaagaagg

SEQ ID NO: 117164 - DNA, 25 bp, Homo sapien
ttgaccagcttccagatcaagaaat

SEQ ID NO: 117165 - DNA, 25 bp, Homo sapien
ttgaccattaccattaccattaccc

SEQ ID NO: 117166 - DNA, 25 bp, Homo sapien
ttgaccattaccgttaccattaccc

SEQ ID NO: 117167 - DNA, 25 bp, Homo sapien
ttgacctagaaccaaagctaggctg

SEQ ID NO: 117168 - DNA, 25 bp, Homo sapien
ttgacctagaatcaaagctaggctg

SEQ ID NO: 117169 - DNA, 25 bp, Homo sapien
ttgacctatcaattgaggccatgag

SEQ ID NO: 117170 - DNA, 25 bp, Homo sapien
ttgacctatcagttgaggccatgag

SEQ ID NO: 117171 - DNA, 25 bp, Homo sapien
ttgaccttcagacttattttctcaa

SEQ ID NO: 117172 - DNA, 25 bp, Homo sapien
ttgaccttcagatttattttctcaa

SEQ ID NO: 117173 - DNA, 25 bp, Homo sapien
ttgaccttcatgagaagctattaca

SEQ ID NO: 117174 - DNA, 25 bp, Homo sapien
ttgaccttcatgataagctattaca

SEQ ID NO: 117175 - DNA, 25 bp, Homo sapien
ttgaccttgagaaaataaatcttca

SEQ ID NO: 117176 - DNA, 25 bp, Homo sapien
ttgaccttgagaaattaaatcttca

SEQ ID NO: 117177 - DNA, 25 bp, Homo sapien
ttgaccttggctatctctgtctact

SEQ ID NO: 117178 - DNA, 25 bp, Homo sapien
ttgaccttggctgtctctgtctact

SEQ ID NO: 117179 - DNA, 25 bp, Homo sapien
ttgaccttttggaacacaaacccat

SEQ ID NO: 117180 - DNA, 25 bp, Homo sapien
ttgaccttttggaatacaaacccat

SEQ ID NO: 117181 - DNA, 25 bp, Homo sapien
ttgactaaaatcaggtggtggaagt

SEQ ID NO: 117182 - DNA, 25 bp, Homo sapien
ttgactaaaatcagttggtggaagt

SEQ ID NO: 117183 - DNA, 25 bp, Homo sapien
ttgactaaatgacagaacataaatg

SEQ ID NO: 117184 - DNA, 25 bp, Homo sapien
ttgactaaatgagagaacataaatg

SEQ ID NO: 117185 - DNA, 25 bp, Homo sapien
ttgactaatagcacaaacatcaaat

SEQ ID NO: 117186 - DNA, 25 bp, Homo sapien
ttgactaatagcacgaacatcaaat

SEQ ID NO: 117187 - DNA, 25 bp, Homo sapien
ttgactactttgacgtttctcaaac

SEQ ID NO: 117188 - DNA, 25 bp, Homo sapien
ttgactactttgaggtttctcaaac

SEQ ID NO: 117189 - DNA, 25 bp, Homo sapien
ttgactaggtccgtgttaagtgtat

SEQ ID NO: 117190 - DNA, 25 bp, Homo sapien
ttgactaggtctgtgttaagtgtat

SEQ ID NO: 117191 - DNA, 25 bp, Homo sapien
ttgactctatatcgaatgcacagac

SEQ ID NO: 117192 - DNA, 25 bp, Homo sapien
ttgactctatattgaatgcacagac

SEQ ID NO: 117193 - DNA, 25 bp, Homo sapien
ttgactgaaatgaacctttctaaac

SEQ ID NO: 117194 - DNA, 25 bp, Homo sapien
ttgactgaaatgaatctttctaaac

SEQ ID NO: 117195 - DNA, 25 bp, Homo sapien
ttgactgaagagaatgttggaaaat

SEQ ID NO: 117196 - DNA, 25 bp, Homo sapien
ttgactgaagagattgttggaaaat

SEQ ID NO: 117197 - DNA, 25 bp, Homo sapien
ttgactgcaaactccaccactaact

SEQ ID NO: 117198 - DNA, 25 bp, Homo sapien
ttgactgcaaactctaccactaact

SEQ ID NO: 117199 - DNA, 25 bp, Homo sapien
ttgactgcacatcacaccagaagac

SEQ ID NO: 117200 - DNA, 25 bp, Homo sapien
ttgactgcacattacaccagaagac

SEQ ID NO: 117201 - DNA, 25 bp, Homo sapien
ttgactgcagtttacacttttctct

SEQ ID NO: 117202 - DNA, 25 bp, Homo sapien
ttgactgcagtttatacttttctct

SEQ ID NO: 117203 - DNA, 25 bp, Homo sapien
ttgactgcctaacttttcagggcac

SEQ ID NO: 117204 - DNA, 25 bp, Homo sapien
ttgactgcttaacttttcagggcac

SEQ ID NO: 117205 - DNA, 25 bp, Homo sapien
ttgactgcttagtatcgttgtctcc

SEQ ID NO: 117206 - DNA, 25 bp, Homo sapien
ttgactgcttagtatctttgtctcc

SEQ ID NO: 117207 - DNA, 25 bp, Homo sapien
ttgactgcttgcttcaactattaat

SEQ ID NO: 117208 - DNA, 25 bp, Homo sapien
ttgactgcttgctttaactattaat

SEQ ID NO: 117209 - DNA, 25 bp, Homo sapien
ttgactggaacgcttttggccgaca

SEQ ID NO: 117210 - DNA, 25 bp, Homo sapien
ttgactggaacgtttttggccgaca

SEQ ID NO: 117211 - DNA, 25 bp, Homo sapien
ttgactgtggtcagagcctgtgaca

SEQ ID NO: 117212 - DNA, 25 bp, Homo sapien
ttgactgtggtggataaactttttg

SEQ ID NO: 117213 - DNA, 25 bp, Homo sapien
ttgactgttgtcagagcctgtgaca

SEQ ID NO: 117214 - DNA, 25 bp, Homo sapien
ttgactgttgtggataaactttttg

SEQ ID NO: 117215 - DNA, 25 bp, Homo sapien
ttgacttaaaatataccattcatca

SEQ ID NO: 117216 - DNA, 25 bp, Homo sapien
ttgacttaaaatgtaccattcatca

SEQ ID NO: 117217 - DNA, 25 bp, Homo sapien
ttgacttcaggattcacagttcagc

SEQ ID NO: 117218 - DNA, 25 bp, Homo sapien
ttgacttcaggattcatagttcagc

SEQ ID NO: 117219 - DNA, 25 bp, Homo sapien
ttgacttgctgatgattccatagga

SEQ ID NO: 117220 - DNA, 25 bp, Homo sapien
ttgacttgttgatgattccatagga

SEQ ID NO: 117221 - DNA, 25 bp, Homo sapien
ttgacttgttggcatgttaatttct

SEQ ID NO: 117222 - DNA, 25 bp, Homo sapien
ttgacttgttggtatgttaatttct

SEQ ID NO: 117223 - DNA, 25 bp, Homo sapien
ttgactttcccattgcagtggctaa

SEQ ID NO: 117224 - DNA, 25 bp, Homo sapien
ttgactttcccgttgcagtggctaa

SEQ ID NO: 117225 - DNA, 25 bp, Homo sapien
ttgactttctagcagtagcatagta

SEQ ID NO: 117226 - DNA, 25 bp, Homo sapien
ttgactttctagtagtagcatagta

SEQ ID NO: 117227 - DNA, 25 bp, Homo sapien
ttgactttctccagcggcagaaatc

SEQ ID NO: 117228 - DNA, 25 bp, Homo sapien
ttgactttctccagtggcagaaatc

SEQ ID NO: 117229 - DNA, 25 bp, Homo sapien
ttgagaaaataaatcttcatgccat

SEQ ID NO: 117230 - DNA, 25 bp, Homo sapien
ttgagaaaatggcaataaaaagaag

SEQ ID NO: 117231 - DNA, 25 bp, Homo sapien
ttgagaaaatggcgataaaaagaag

SEQ ID NO: 117232 - DNA, 25 bp, Homo sapien
ttgagaaactgaaagggcatgagtc

SEQ ID NO: 117233 - DNA, 25 bp, Homo sapien
ttgagaaactggaagggcatgagtc

SEQ ID NO: 117234 - DNA, 25 bp, Homo sapien
ttgagaaattaaatcttcatgccat

SEQ ID NO: 117235 - DNA, 25 bp, Homo sapien
ttgagaacctctactctaggagaaa

SEQ ID NO: 117236 - DNA, 25 bp, Homo sapien
ttgagaacctctgctctaggagaaa

SEQ ID NO: 117237 - DNA, 25 bp, Homo sapien
ttgagaactgaacctgctcttgctg

SEQ ID NO: 117238 - DNA, 25 bp, Homo sapien
ttgagaactgaatctgctcttgctg

SEQ ID NO: 117239 - DNA, 25 bp, Homo sapien
ttgagaagaaatatgtcggcttaaa

SEQ ID NO: 117240 - DNA, 25 bp, Homo sapien
ttgagaagagacgcattggtaattg

SEQ ID NO: 117241 - DNA, 25 bp, Homo sapien
ttgagaagagacgcgttggtaattg

SEQ ID NO: 117242 - DNA, 25 bp, Homo sapien
ttgagaagagttaggaaataaagtt

SEQ ID NO: 117243 - DNA, 25 bp, Homo sapien
ttgagaagagtttggaaataaagtt

SEQ ID NO: 117244 - DNA, 25 bp, Homo sapien
ttgagaaggaatatgtcggcttaaa

SEQ ID NO: 117245 - DNA, 25 bp, Homo sapien
ttgagaatagttaaaaaattacaaa

SEQ ID NO: 117246 - DNA, 25 bp, Homo sapien
ttgagaatagtttaaaaattacaaa

SEQ ID NO: 117247 - DNA, 25 bp, Homo sapien
ttgagaatatgtgacggatcatctt

SEQ ID NO: 117248 - DNA, 25 bp, Homo sapien
ttgagaatatgtgatggatcatctt

SEQ ID NO: 117249 - DNA, 25 bp, Homo sapien
ttgagacactcgagattcggggatg

SEQ ID NO: 117250 - DNA, 25 bp, Homo sapien
ttgagacactcgggattcggggatg

SEQ ID NO: 117251 - DNA, 25 bp, Homo sapien
ttgagacagatgctttagtttggaa

SEQ ID NO: 117252 - DNA, 25 bp, Homo sapien
ttgagacagatgttttagtttggaa

SEQ ID NO: 117253 - DNA, 25 bp, Homo sapien
ttgagaccagattgagcaacatagt

SEQ ID NO: 117254 - DNA, 25 bp, Homo sapien
ttgagacctgattgagcaacatagt

SEQ ID NO: 117255 - DNA, 25 bp, Homo sapien
ttgagactccaagaactgtcatcta

SEQ ID NO: 117256 - DNA, 25 bp, Homo sapien
ttgagactccatgaactgtcatcta

SEQ ID NO: 117257 - DNA, 25 bp, Homo sapien
ttgagagaaggctggatacactgga

SEQ ID NO: 117258 - DNA, 25 bp, Homo sapien
ttgagagaagggaaccatcctgaat

SEQ ID NO: 117259 - DNA, 25 bp, Homo sapien
ttgagagaagggaaccgtcctgaat

SEQ ID NO: 117260 - DNA, 25 bp, Homo sapien
ttgagagaatgctggatacactgga

SEQ ID NO: 117261 - DNA, 25 bp, Homo sapien
ttgagagacaatcttggaaaacttg

SEQ ID NO: 117262 - DNA, 25 bp, Homo sapien
ttgagagagaatcttggaaaacttg

SEQ ID NO: 117263 - DNA, 25 bp, Homo sapien
ttgagagagagccagaaggctagca

SEQ ID NO: 117264 - DNA, 25 bp, Homo sapien
ttgagagagagccagagggctagca

SEQ ID NO: 117265 - DNA, 25 bp, Homo sapien
ttgagagctatatcttttcatagct

SEQ ID NO: 117266 - DNA, 25 bp, Homo sapien
ttgagagctgtatcttttcatagct

SEQ ID NO: 117267 - DNA, 25 bp, Homo sapien
ttgagaggacaataagtacaggcac

SEQ ID NO: 117268 - DNA, 25 bp, Homo sapien
ttgagaggacagtaagtacaggcac

SEQ ID NO: 117269 - DNA, 25 bp, Homo sapien
ttgagaggtttcactttgtccaaca

SEQ ID NO: 117270 - DNA, 25 bp, Homo sapien
ttgagaggtttgactttgtccaaca

SEQ ID NO: 117271 - DNA, 25 bp, Homo sapien
ttgagataatcagatggtttttgct

SEQ ID NO: 117272 - DNA, 25 bp, Homo sapien
ttgagataatcagatgttttttgct

SEQ ID NO: 117273 - DNA, 25 bp, Homo sapien
ttgagataggtcagaactagatgta

SEQ ID NO: 117274 - DNA, 25 bp, Homo sapien
ttgagataggtcagaagtagatgta

SEQ ID NO: 117275 - DNA, 25 bp, Homo sapien
ttgagatcagctcatggtgtaatat

SEQ ID NO: 117276 - DNA, 25 bp, Homo sapien
ttgagatcagctgatggtgtaatat

SEQ ID NO: 117277 - DNA, 25 bp, Homo sapien
ttgagatgatgtcactaggattctg

SEQ ID NO: 117278 - DNA, 25 bp, Homo sapien
ttgagatggtgtcactaggattctg

SEQ ID NO: 117279 - DNA, 25 bp, Homo sapien
ttgagattaatggaattgtctctct

SEQ ID NO: 117280 - DNA, 25 bp, Homo sapien
ttgagattaattgaattgtctctct

SEQ ID NO: 117281 - DNA, 25 bp, Homo sapien
ttgagattagaaaggtgagcaccaa

SEQ ID NO: 117282 - DNA, 25 bp, Homo sapien
ttgagattggaaaggtgagcaccaa

SEQ ID NO: 117283 - DNA, 25 bp, Homo sapien
ttgagcaaatcatcaaactccccaa

SEQ ID NO: 117284 - DNA, 25 bp, Homo sapien
ttgagcaagtaaataagtaaaggtc

SEQ ID NO: 117285 - DNA, 25 bp, Homo sapien
ttgagcaagtaagtaagtaaaggtc

SEQ ID NO: 117286 - DNA, 25 bp, Homo sapien
ttgagcaagtcatcaaactccccaa

SEQ ID NO: 117287 - DNA, 25 bp, Homo sapien
ttgagcaatccactcggtgtccatc

SEQ ID NO: 117288 - DNA, 25 bp, Homo sapien
ttgagcaatccactgggtgtccatc

SEQ ID NO: 117289 - DNA, 25 bp, Homo sapien
ttgagcacagtaaggagagtaagga

SEQ ID NO: 117290 - DNA, 25 bp, Homo sapien
ttgagcacggtaaggagagtaagga

SEQ ID NO: 117291 - DNA, 25 bp, Homo sapien
ttgagcagaattccggagttgaggg

SEQ ID NO: 117292 - DNA, 25 bp, Homo sapien
ttgagcagaattctggagttgaggg

SEQ ID NO: 117293 - DNA, 25 bp, Homo sapien
ttgagcagcactccgccagtgacct

SEQ ID NO: 117294 - DNA, 25 bp, Homo sapien
ttgagcagcactctgccagtgacct

SEQ ID NO: 117295 - DNA, 25 bp, Homo sapien
ttgagcagtcaagagaaaaaatgtt

SEQ ID NO: 117296 - DNA, 25 bp, Homo sapien
ttgagcagtcaagggaaaaaatgtt

SEQ ID NO: 117297 - DNA, 25 bp, Homo sapien
ttgagcatctttataacagtgtctt

SEQ ID NO: 117298 - DNA, 25 bp, Homo sapien
ttgagcatctttataatagtgtctt

SEQ ID NO: 117299 - DNA, 25 bp, Homo sapien
ttgagcattgagagctatatctttt

SEQ ID NO: 117300 - DNA, 25 bp, Homo sapien
ttgagcattgagagctgtatctttt

SEQ ID NO: 117301 - DNA, 25 bp, Homo sapien
ttgagcattttagaatttgggttta

SEQ ID NO: 117302 - DNA, 25 bp, Homo sapien
ttgagcattttagagtttgggttta

SEQ ID NO: 117303 - DNA, 25 bp, Homo sapien
ttgagccaaataaccctttgctgtg

SEQ ID NO: 117304 - DNA, 25 bp, Homo sapien
ttgagccaccatttaagaaatctgg

SEQ ID NO: 117305 - DNA, 25 bp, Homo sapien
ttgagccagataaccctttgctgtg

SEQ ID NO: 117306 - DNA, 25 bp, Homo sapien
ttgagccatcatttaagaaatctgg

SEQ ID NO: 117307 - DNA, 25 bp, Homo sapien
ttgagcccaggtagcttgggattgt

SEQ ID NO: 117308 - DNA, 25 bp, Homo sapien
ttgagcccgggtagcttgggattgt

SEQ ID NO: 117309 - DNA, 25 bp, Homo sapien
ttgagcgtattgccttatctgcatg

SEQ ID NO: 117310 - DNA, 25 bp, Homo sapien
ttgagcgtgttgccttatctgcatg

SEQ ID NO: 117311 - DNA, 25 bp, Homo sapien
ttgagctcagaccaataactattct

SEQ ID NO: 117312 - DNA, 25 bp, Homo sapien
ttgagctcagaccaatgactattct

SEQ ID NO: 117313 - DNA, 25 bp, Homo sapien
ttgagctccaaaaattctttctcct

SEQ ID NO: 117314 - DNA, 25 bp, Homo sapien
ttgagctccgaaaattctttctcct

SEQ ID NO: 117315 - DNA, 25 bp, Homo sapien
ttgagctctttcgcatttattttat

SEQ ID NO: 117316 - DNA, 25 bp, Homo sapien
ttgagctcttttgcatttattttat

SEQ ID NO: 117317 - DNA, 25 bp, Homo sapien
ttgagctgcggcatctgtgctaact

SEQ ID NO: 117318 - DNA, 25 bp, Homo sapien
ttgagctgtggcatctgtgctaact

SEQ ID NO: 117319 - DNA, 25 bp, Homo sapien
ttgagctgtgtttgtaagtttcatt

SEQ ID NO: 117320 - DNA, 25 bp, Homo sapien
ttgagctgtgtttttaagtttcatt

SEQ ID NO: 117321 - DNA, 25 bp, Homo sapien
ttgagcttcatgatctaatacaaat

SEQ ID NO: 117322 - DNA, 25 bp, Homo sapien
ttgagcttcatgatctcatacaaat

SEQ ID NO: 117323 - DNA, 25 bp, Homo sapien
ttgaggaaactcaaagaaatacaag

SEQ ID NO: 117324 - DNA, 25 bp, Homo sapien
ttgaggaaactcagagaaatacaag

SEQ ID NO: 117325 - DNA, 25 bp, Homo sapien
ttgaggaacggtgcactgtggccca

SEQ ID NO: 117326 - DNA, 25 bp, Homo sapien
ttgaggaatggtgcactgtggccca

SEQ ID NO: 117327 - DNA, 25 bp, Homo sapien
ttgaggactcacgtagtaaggtgtg

SEQ ID NO: 117328 - DNA, 25 bp, Homo sapien
ttgaggactcatgtagtaaggtgtg

SEQ ID NO: 117329 - DNA, 25 bp, Homo sapien
ttgaggagccttttcgcagagtctt

SEQ ID NO: 117330 - DNA, 25 bp, Homo sapien
ttgaggagcctttttgcagagtctt

SEQ ID NO: 117331 - DNA, 25 bp, Homo sapien
ttgaggagtttgcagtcaaaaagca

SEQ ID NO: 117332 - DNA, 25 bp, Homo sapien
ttgaggagtttgccgtcaaaaagca

SEQ ID NO: 117333 - DNA, 25 bp, Homo sapien
ttgaggatgcctaatgggtaacaaa

SEQ ID NO: 117334 - DNA, 25 bp, Homo sapien
ttgaggatggctaatgggtaacaaa

SEQ ID NO: 117335 - DNA, 25 bp, Homo sapien
ttgaggcaactcacctctgactcag

SEQ ID NO: 117336 - DNA, 25 bp, Homo sapien
ttgaggcaactcatctctgactcag

SEQ ID NO: 117337 - DNA, 25 bp, Homo sapien
ttgaggctgcaaacttctgcaatgt

SEQ ID NO: 117338 - DNA, 25 bp, Homo sapien
ttgaggctgcaaatttctgcaatgt

SEQ ID NO: 117339 - DNA, 25 bp, Homo sapien
ttgagggcacctgaatccacaagat

SEQ ID NO: 117340 - DNA, 25 bp, Homo sapien
ttgagggcacctgattccacaagat

SEQ ID NO: 117341 - DNA, 25 bp, Homo sapien
ttgagggtagcacacatccagaaac

SEQ ID NO: 117342 - DNA, 25 bp, Homo sapien
ttgagggtagcacatatccagaaac

SEQ ID NO: 117343 - DNA, 25 bp, Homo sapien
ttgagggtggaaagagagaaccctg

SEQ ID NO: 117344 - DNA, 25 bp, Homo sapien
ttgagggtggaaggagagaaccctg

SEQ ID NO: 117345 - DNA, 25 bp, Homo sapien
ttgaggtataagacaacagggcttg

SEQ ID NO: 117346 - DNA, 25 bp, Homo sapien
ttgaggtataaggcaacagggcttg

SEQ ID NO: 117347 - DNA, 25 bp, Homo sapien
ttgaggtccttaattcagagactcc

SEQ ID NO: 117348 - DNA, 25 bp, Homo sapien
ttgaggtccttagttcagagactcc

SEQ ID NO: 117349 - DNA, 25 bp, Homo sapien
ttgaggtgactgataaagtttgaat

SEQ ID NO: 117350 - DNA, 25 bp, Homo sapien
ttgaggtgattgataaagtttgaat

SEQ ID NO: 117351 - DNA, 25 bp, Homo sapien
ttgaggtgtccagccatcaaaaccc

SEQ ID NO: 117352 - DNA, 25 bp, Homo sapien
ttgaggtgttcagccatcaaaaccc

SEQ ID NO: 117353 - DNA, 25 bp, Homo sapien
ttgaggttactgcacttgcattttg

SEQ ID NO: 117354 - DNA, 25 bp, Homo sapien
ttgaggttattgcacttgcattttg

SEQ ID NO: 117355 - DNA, 25 bp, Homo sapien
ttgaggttgaaaatgcaattgacac

SEQ ID NO: 117356 - DNA, 25 bp, Homo sapien
ttgaggttgaaaatgcgattgacac

SEQ ID NO: 117357 - DNA, 25 bp, Homo sapien
ttgagtaaacatggcaaagaacagc

SEQ ID NO: 117358 - DNA, 25 bp, Homo sapien
ttgagtaaatatggcaaagaacagc

SEQ ID NO: 117359 - DNA, 25 bp, Homo sapien
ttgagtaattcttacgtggcagtca

SEQ ID NO: 117360 - DNA, 25 bp, Homo sapien
ttgagtaattcttatgtggcagtca

SEQ ID NO: 117361 - DNA, 25 bp, Homo sapien
ttgagtacaacagcaactaaaggga

SEQ ID NO: 117362 - DNA, 25 bp, Homo sapien
ttgagtacaccagcaactaaaggga

SEQ ID NO: 117363 - DNA, 25 bp, Homo sapien
ttgagtagtcactggtaaagaggac

SEQ ID NO: 117364 - DNA, 25 bp, Homo sapien
ttgagtagtgactggtaaagaggac

SEQ ID NO: 117365 - DNA, 25 bp, Homo sapien
ttgagtcaaataaccctgattctca

SEQ ID NO: 117366 - DNA, 25 bp, Homo sapien
ttgagtcaaatcaccctgattctca

SEQ ID NO: 117367 - DNA, 25 bp, Homo sapien
ttgagtctggttatctctatttaaa

SEQ ID NO: 117368 - DNA, 25 bp, Homo sapien
ttgagtctggttatttctatttaaa

SEQ ID NO: 117369 - DNA, 25 bp, Homo sapien
ttgagtgaaaccatgaataaaacaa

SEQ ID NO: 117370 - DNA, 25 bp, Homo sapien
ttgagtgaaactatgaataaaacaa

SEQ ID NO: 117371 - DNA, 25 bp, Homo sapien
ttgagtgaacgggtgaaaaacaaca

SEQ ID NO: 117372 - DNA, 25 bp, Homo sapien
ttgagtgaagacataagatctattc

SEQ ID NO: 117373 - DNA, 25 bp, Homo sapien
ttgagtgaagacgtaagatctattc

SEQ ID NO: 117374 - DNA, 25 bp, Homo sapien
ttgagtgaatgggtgaaaaacaaca

SEQ ID NO: 117375 - DNA, 25 bp, Homo sapien
ttgagtgactttcgttttcttcttt

SEQ ID NO: 117376 - DNA, 25 bp, Homo sapien
ttgagtgacttttgttttcttcttt

SEQ ID NO: 117377 - DNA, 25 bp, Homo sapien
ttgagtgcctttaaagatttccggc

SEQ ID NO: 117378 - DNA, 25 bp, Homo sapien
ttgagtgcctttgaagatttccggc

SEQ ID NO: 117379 - DNA, 25 bp, Homo sapien
ttgagtggcacatgacacagtgaga

SEQ ID NO: 117380 - DNA, 25 bp, Homo sapien
ttgagtggcacattacacagtgaga

SEQ ID NO: 117381 - DNA, 25 bp, Homo sapien
ttgagtggcataggaattatgatat

SEQ ID NO: 117382 - DNA, 25 bp, Homo sapien
ttgagtggcgtaggaattatgatat

SEQ ID NO: 117383 - DNA, 25 bp, Homo sapien
ttgagttcaaacaccaacaagaaaa

SEQ ID NO: 117384 - DNA, 25 bp, Homo sapien
ttgagttcaaacgccaacaagaaaa

SEQ ID NO: 117385 - DNA, 25 bp, Homo sapien
ttgagttccgtgtatgttgtcagat

SEQ ID NO: 117386 - DNA, 25 bp, Homo sapien
ttgagttccttgtatgttgtcagat

SEQ ID NO: 117387 - DNA, 25 bp, Homo sapien
ttgagttgctggaacataaatcatt

SEQ ID NO: 117388 - DNA, 25 bp, Homo sapien
ttgagttgttggaacataaatcatt

SEQ ID NO: 117389 - DNA, 25 bp, Homo sapien
ttgagttgtttccatattttagcta

SEQ ID NO: 117390 - DNA, 25 bp, Homo sapien
ttgagttgttttcatattttagcta

SEQ ID NO: 117391 - DNA, 25 bp, Homo sapien
ttgataaagtgtctatcaagtgcat

SEQ ID NO: 117392 - DNA, 25 bp, Homo sapien
ttgataaagtgtctctcaagtgcat

SEQ ID NO: 117393 - DNA, 25 bp, Homo sapien
ttgataagcatatcagacatagtgg

SEQ ID NO: 117394 - DNA, 25 bp, Homo sapien
ttgataagcgtatcagacatagtgg

SEQ ID NO: 117395 - DNA, 25 bp, Homo sapien
ttgataaggtcacccaaaaatgtcc

SEQ ID NO: 117396 - DNA, 25 bp, Homo sapien
ttgataaggtcatccaaaaatgtcc

SEQ ID NO: 117397 - DNA, 25 bp, Homo sapien
ttgataatcattgccaggatttgat

SEQ ID NO: 117398 - DNA, 25 bp, Homo sapien
ttgataatcattgtcaggatttgat

SEQ ID NO: 117399 - DNA, 25 bp, Homo sapien
ttgatactagcagtagaggattcag

SEQ ID NO: 117400 - DNA, 25 bp, Homo sapien
ttgatactagcggtagaggattcag

SEQ ID NO: 117401 - DNA, 25 bp, Homo sapien
ttgatacttgacttttatattcaat

SEQ ID NO: 117402 - DNA, 25 bp, Homo sapien
ttgatacttgatttttatattcaat

SEQ ID NO: 117403 - DNA, 25 bp, Homo sapien
ttgatacttttatgtaattctctgt

SEQ ID NO: 117404 - DNA, 25 bp, Homo sapien
ttgatacttttatttaattctctgt

SEQ ID NO: 117405 - DNA, 25 bp, Homo sapien
ttgatagatcgaagcctatagtgtc

SEQ ID NO: 117406 - DNA, 25 bp, Homo sapien
ttgatagattgaagcctatagtgtc

SEQ ID NO: 117407 - DNA, 25 bp, Homo sapien
ttgatagctatggtaaaataaggaa

SEQ ID NO: 117408 - DNA, 25 bp, Homo sapien
ttgatagctatgttaaaataaggaa

SEQ ID NO: 117409 - DNA, 25 bp, Homo sapien
ttgataggcaaataaataacttatg

SEQ ID NO: 117410 - DNA, 25 bp, Homo sapien
ttgataggtaaataaataacttatg

SEQ ID NO: 117411 - DNA, 25 bp, Homo sapien
ttgatagtaaaagactgaatgctgt

SEQ ID NO: 117412 - DNA, 25 bp, Homo sapien
ttgatagtaaaatactgaatgctgt

SEQ ID NO: 117413 - DNA, 25 bp, Homo sapien
ttgatatcatgctggcattaactag

SEQ ID NO: 117414 - DNA, 25 bp, Homo sapien
ttgatatcatgttggcattaactag

SEQ ID NO: 117415 - DNA, 25 bp, Homo sapien
ttgatatctatcaatggagaaggcg

SEQ ID NO: 117416 - DNA, 25 bp, Homo sapien
ttgatatctctcaatggagaaggcg

SEQ ID NO: 117417 - DNA, 25 bp, Homo sapien
ttgatatgcagatgaattatccaaa

SEQ ID NO: 117418 - DNA, 25 bp, Homo sapien
ttgatatgcggatgaattatccaaa

SEQ ID NO: 117419 - DNA, 25 bp, Homo sapien
ttgatatgtgtactcgtttcctgga

SEQ ID NO: 117420 - DNA, 25 bp, Homo sapien
ttgatatgtgtacttgtttcctgga

SEQ ID NO: 117421 - DNA, 25 bp, Homo sapien
ttgatattcatgaacatttcactct

SEQ ID NO: 117422 - DNA, 25 bp, Homo sapien
ttgatattcgtgaacatttcactct

SEQ ID NO: 117423 - DNA, 25 bp, Homo sapien
ttgatattgggtaagtttctgggca

SEQ ID NO: 117424 - DNA, 25 bp, Homo sapien
ttgatattgggtgagtttctgggca

SEQ ID NO: 117425 - DNA, 25 bp, Homo sapien
ttgatattttgagtcaaaaagtaac

SEQ ID NO: 117426 - DNA, 25 bp, Homo sapien
ttgatattttgagtgaaaaagtaac

SEQ ID NO: 117427 - DNA, 25 bp, Homo sapien
ttgatcaacgtaatagtaaaaattc

SEQ ID NO: 117428 - DNA, 25 bp, Homo sapien
ttgatcaacgtaatggtaaaaattc

SEQ ID NO: 117429 - DNA, 25 bp, Homo sapien
ttgatcaataggttaaatgtgatta

SEQ ID NO: 117430 - DNA, 25 bp, Homo sapien
ttgatcaataggttcaatgtgatta

SEQ ID NO: 117431 - DNA, 25 bp, Homo sapien
ttgatcacatgaaacactttattta

SEQ ID NO: 117432 - DNA, 25 bp, Homo sapien
ttgatcacatgaagcactttattta

SEQ ID NO: 117433 - DNA, 25 bp, Homo sapien
ttgatcacgtggtctgccagggctg

SEQ ID NO: 117434 - DNA, 25 bp, Homo sapien
ttgatcacgtggtttgccagggctg

SEQ ID NO: 117435 - DNA, 25 bp, Homo sapien
ttgatcatctgccaaaacatcctta

SEQ ID NO: 117436 - DNA, 25 bp, Homo sapien
ttgatcatctgccaaagcatcctta

SEQ ID NO: 117437 - DNA, 25 bp, Homo sapien
ttgatccagaagatttttctcatac

SEQ ID NO: 117438 - DNA, 25 bp, Homo sapien
ttgatccagcagatttttctcatac

SEQ ID NO: 117439 - DNA, 25 bp, Homo sapien
ttgatcgaggaatatgttattattc

SEQ ID NO: 117440 - DNA, 25 bp, Homo sapien
ttgatcgaggattatgttattattc

SEQ ID NO: 117441 - DNA, 25 bp, Homo sapien
ttgatctaccaacagggtgagatta

SEQ ID NO: 117442 - DNA, 25 bp, Homo sapien
ttgatctaccaatagggtgagatta

SEQ ID NO: 117443 - DNA, 25 bp, Homo sapien
ttgatctatgttttatcatttatca

SEQ ID NO: 117444 - DNA, 25 bp, Homo sapien
ttgatctatgttttatgatttatca

SEQ ID NO: 117445 - DNA, 25 bp, Homo sapien
ttgatctggttcagaacatcacaag

SEQ ID NO: 117446 - DNA, 25 bp, Homo sapien
ttgatctggttcagaatatcacaag

SEQ ID NO: 117447 - DNA, 25 bp, Homo sapien
ttgatgagaatacagagcaactgga

SEQ ID NO: 117448 - DNA, 25 bp, Homo sapien
ttgatgagaatacggagcaactgga

SEQ ID NO: 117449 - DNA, 25 bp, Homo sapien
ttgatgagactgatggcaaatgcac

SEQ ID NO: 117450 - DNA, 25 bp, Homo sapien
ttgatgagagccatattttaggaag

SEQ ID NO: 117451 - DNA, 25 bp, Homo sapien
ttgatgagagccttattttaggaag

SEQ ID NO: 117452 - DNA, 25 bp, Homo sapien
ttgatgagagtgatggcaaatgcac

SEQ ID NO: 117453 - DNA, 25 bp, Homo sapien
ttgatgaggcagaaagagctacagg

SEQ ID NO: 117454 - DNA, 25 bp, Homo sapien
ttgatgaggtagaaagagctacagg

SEQ ID NO: 117455 - DNA, 25 bp, Homo sapien
ttgatgatcaactgatttttgacaa

SEQ ID NO: 117456 - DNA, 25 bp, Homo sapien
ttgatgatcaattgatttttgacaa

SEQ ID NO: 117457 - DNA, 25 bp, Homo sapien
ttgatgcattttgtgtatgataaag

SEQ ID NO: 117458 - DNA, 25 bp, Homo sapien
ttgatgcattttttgtatgataaag

SEQ ID NO: 117459 - DNA, 25 bp, Homo sapien
ttgatgcctttccattgctttctcc

SEQ ID NO: 117460 - DNA, 25 bp, Homo sapien
ttgatgcctttctattgctttctcc

SEQ ID NO: 117461 - DNA, 25 bp, Homo sapien
ttgatgctcatgataatataaataa

SEQ ID NO: 117462 - DNA, 25 bp, Homo sapien
ttgatgctgatgataatataaataa

SEQ ID NO: 117463 - DNA, 25 bp, Homo sapien
ttgatggactgttagccgatttaac

SEQ ID NO: 117464 - DNA, 25 bp, Homo sapien
ttgatggactgttagctgatttaac

SEQ ID NO: 117465 - DNA, 25 bp, Homo sapien
ttgatggataaatttttctcagaag

SEQ ID NO: 117466 - DNA, 25 bp, Homo sapien
ttgatggataactttttctcagaag

SEQ ID NO: 117467 - DNA, 25 bp, Homo sapien
ttgatggatgaacagaaaatgtgat

SEQ ID NO: 117468 - DNA, 25 bp, Homo sapien
ttgatggatgaatagaaaatgtgat

SEQ ID NO: 117469 - DNA, 25 bp, Homo sapien
ttgatggccatgtccagtttgcctt

SEQ ID NO: 117470 - DNA, 25 bp, Homo sapien
ttgatggccatgtcgagtttgcctt

SEQ ID NO: 117471 - DNA, 25 bp, Homo sapien
ttgatggcttgaccgtggactttcc

SEQ ID NO: 117472 - DNA, 25 bp, Homo sapien
ttgatggcttgatcgtggactttcc

SEQ ID NO: 117473 - DNA, 25 bp, Homo sapien
ttgatggtttcgagttagagagaag

SEQ ID NO: 117474 - DNA, 25 bp, Homo sapien
ttgatggtttcgagttcgagagaag

SEQ ID NO: 117475 - DNA, 25 bp, Homo sapien
ttgatgtaatcatcagatccacttt

SEQ ID NO: 117476 - DNA, 25 bp, Homo sapien
ttgatgtaatcatctgatccacttt

SEQ ID NO: 117477 - DNA, 25 bp, Homo sapien
ttgatgtcacctaatgtaaaaaaaa

SEQ ID NO: 117478 - DNA, 25 bp, Homo sapien
ttgatgtcacctagtgtaaaaaaaa

SEQ ID NO: 117479 - DNA, 25 bp, Homo sapien
ttgatgtcatggaagtagagagtag

SEQ ID NO: 117480 - DNA, 25 bp, Homo sapien
ttgatgtcatggatgtagagagtag

SEQ ID NO: 117481 - DNA, 25 bp, Homo sapien
ttgatgtctgaatcgattggcagta

SEQ ID NO: 117482 - DNA, 25 bp, Homo sapien
ttgatgtctgaattgattggcagta

SEQ ID NO: 117483 - DNA, 25 bp, Homo sapien
ttgatgtgtctacctgcactcacta

SEQ ID NO: 117484 - DNA, 25 bp, Homo sapien
ttgatgtgtctatctgcactcacta

SEQ ID NO: 117485 - DNA, 25 bp, Homo sapien
ttgatgtgtctgaaggctgcacata

SEQ ID NO: 117486 - DNA, 25 bp, Homo sapien
ttgatgtgtctgagggctgcacata

SEQ ID NO: 117487 - DNA, 25 bp, Homo sapien
ttgatgtttaaagtaattgttgatg

SEQ ID NO: 117488 - DNA, 25 bp, Homo sapien
ttgatgtttaaagtgattgttgatg

SEQ ID NO: 117489 - DNA, 25 bp, Homo sapien
ttgatgtttcacaagactgctctta

SEQ ID NO: 117490 - DNA, 25 bp, Homo sapien
ttgatgtttcacacgactgctctta

SEQ ID NO: 117491 - DNA, 25 bp, Homo sapien
ttgattaaatgaccacatgaaaaat

SEQ ID NO: 117492 - DNA, 25 bp, Homo sapien
ttgattaaatggccacatgaaaaat

SEQ ID NO: 117493 - DNA, 25 bp, Homo sapien
ttgattacctgagttgcaaaaagaa

SEQ ID NO: 117494 - DNA, 25 bp, Homo sapien
ttgattacctgggttgcaaaaagaa

SEQ ID NO: 117495 - DNA, 25 bp, Homo sapien
ttgattcaacaatagctagaaagtg

SEQ ID NO: 117496 - DNA, 25 bp, Homo sapien
ttgattcaactattctcctaaactg

SEQ ID NO: 117497 - DNA, 25 bp, Homo sapien
ttgattcaagaatagctagaaagtg

SEQ ID NO: 117498 - DNA, 25 bp, Homo sapien
ttgattcacctattctcctaaactg

SEQ ID NO: 117499 - DNA, 25 bp, Homo sapien
ttgattccctgcaaaaccaaacttg

SEQ ID NO: 117500 - DNA, 25 bp, Homo sapien
ttgattccctgccaaaccaaacttg

SEQ ID NO: 117501 - DNA, 25 bp, Homo sapien
ttgattcctttcgcttcctcctttg

SEQ ID NO: 117502 - DNA, 25 bp, Homo sapien
ttgattcctttctcttcctcctttg

SEQ ID NO: 117503 - DNA, 25 bp, Homo sapien
ttgattctcctctgagaccccaggg

SEQ ID NO: 117504 - DNA, 25 bp, Homo sapien
ttgattctcctctgagtccccaggg

SEQ ID NO: 117505 - DNA, 25 bp, Homo sapien
ttgattgaaaggctattccattcat

SEQ ID NO: 117506 - DNA, 25 bp, Homo sapien
ttgattgaagggctattccattcat

SEQ ID NO: 117507 - DNA, 25 bp, Homo sapien
ttgattgacagaaataagagttaag

SEQ ID NO: 117508 - DNA, 25 bp, Homo sapien
ttgattgatagaaataagagttaag

SEQ ID NO: 117509 - DNA, 25 bp, Homo sapien
ttgattgatggctataatggcattt

SEQ ID NO: 117510 - DNA, 25 bp, Homo sapien
ttgattgatgggtataatggcattt

SEQ ID NO: 117511 - DNA, 25 bp, Homo sapien
ttgattgccagcaggtcagaaccct

SEQ ID NO: 117512 - DNA, 25 bp, Homo sapien
ttgattgccagcgggtcagaaccct

SEQ ID NO: 117513 - DNA, 25 bp, Homo sapien
ttgattggccacggtaaggttcagg

SEQ ID NO: 117514 - DNA, 25 bp, Homo sapien
ttgattggctacggtaaggttcagg

SEQ ID NO: 117515 - DNA, 25 bp, Homo sapien
ttgattgtattgtcttagatggcag

SEQ ID NO: 117516 - DNA, 25 bp, Homo sapien
ttgattgtattgttttgtctataac

SEQ ID NO: 117517 - DNA, 25 bp, Homo sapien
ttgattgtattgttttttctataac

SEQ ID NO: 117518 - DNA, 25 bp, Homo sapien
ttgattgtcacaacttaggagatgc

SEQ ID NO: 117519 - DNA, 25 bp, Homo sapien
ttgattgtcacagcttaggagatgc

SEQ ID NO: 117520 - DNA, 25 bp, Homo sapien
ttgattgtctgcctgctttttgttg

SEQ ID NO: 117521 - DNA, 25 bp, Homo sapien
ttgattgtctgcttgctttttgttg

SEQ ID NO: 117522 - DNA, 25 bp, Homo sapien
ttgattgtgttgtcttagatggcag

SEQ ID NO: 117523 - DNA, 25 bp, Homo sapien
ttgatttaccaggaaattacaggaa

SEQ ID NO: 117524 - DNA, 25 bp, Homo sapien
ttgatttactaggaaattacaggaa

SEQ ID NO: 117525 - DNA, 25 bp, Homo sapien
ttgatttcaatctccatacaaatga

SEQ ID NO: 117526 - DNA, 25 bp, Homo sapien
ttgatttcaatctctatacaaatga

SEQ ID NO: 117527 - DNA, 25 bp, Homo sapien
ttgatttcctctttaactcatcaga

SEQ ID NO: 117528 - DNA, 25 bp, Homo sapien
ttgatttctcgcactgagtctaaca

SEQ ID NO: 117529 - DNA, 25 bp, Homo sapien
ttgatttctggcactgagtctaaca

SEQ ID NO: 117530 - DNA, 25 bp, Homo sapien
ttgatttcttctttaactcatcaga

SEQ ID NO: 117531 - DNA, 25 bp, Homo sapien
ttgatttgaaggagtcagacaggcc

SEQ ID NO: 117532 - DNA, 25 bp, Homo sapien
ttgatttgaaggcgtcagacaggcc

SEQ ID NO: 117533 - DNA, 25 bp, Homo sapien
ttgatttgaaggtggtgctgagaag

SEQ ID NO: 117534 - DNA, 25 bp, Homo sapien
ttgatttgaaggtggttctgagaag

SEQ ID NO: 117535 - DNA, 25 bp, Homo sapien
ttgatttgatttgatttttagacgg

SEQ ID NO: 117536 - DNA, 25 bp, Homo sapien
ttgatttgattttatttttagacgg

SEQ ID NO: 117537 - DNA, 25 bp, Homo sapien
ttgatttggaaacactgatggccta

SEQ ID NO: 117538 - DNA, 25 bp, Homo sapien
ttgatttggaaatactgatggccta

SEQ ID NO: 117539 - DNA, 25 bp, Homo sapien
ttgattttattttaagctaacatac

SEQ ID NO: 117540 - DNA, 25 bp, Homo sapien
ttgattttattttaaggtaacatac

SEQ ID NO: 117541 - DNA, 25 bp, Homo sapien
ttgattttttgtaagactcatctca

SEQ ID NO: 117542 - DNA, 25 bp, Homo sapien
ttgattttttgtgagactcatctca

SEQ ID NO: 117543 - DNA, 25 bp, Homo sapien
ttgatttttttaacgtaagatttcg

SEQ ID NO: 117544 - DNA, 25 bp, Homo sapien
ttgatttttttaccgtaagatttcg

SEQ ID NO: 117545 - DNA, 25 bp, Homo sapien
ttgcaaaaaaaccacaaagcacctc

SEQ ID NO: 117546 - DNA, 25 bp, Homo sapien
ttgcaaaaaaactacaaagcacctc

SEQ ID NO: 117547 - DNA, 25 bp, Homo sapien
ttgcaaaacaccagtcacagccatg

SEQ ID NO: 117548 - DNA, 25 bp, Homo sapien
ttgcaaaacacctgtcacagccatg

SEQ ID NO: 117549 - DNA, 25 bp, Homo sapien
ttgcaaaacactcacaaataggttc

SEQ ID NO: 117550 - DNA, 25 bp, Homo sapien
ttgcaaaacacttacaaataggttc

SEQ ID NO: 117551 - DNA, 25 bp, Homo sapien
ttgcaaaaccttcaatcatctaact

SEQ ID NO: 117552 - DNA, 25 bp, Homo sapien
ttgcaaaagcttcaatcatctaact

SEQ ID NO: 117553 - DNA, 25 bp, Homo sapien
ttgcaaagtacccaattcactaccc

SEQ ID NO: 117554 - DNA, 25 bp, Homo sapien
ttgcaaagtacccagttcactaccc

SEQ ID NO: 117555 - DNA, 25 bp, Homo sapien
ttgcaaatccttggttcacaataag

SEQ ID NO: 117556 - DNA, 25 bp, Homo sapien
ttgcaaatcgttggttcacaataag

SEQ ID NO: 117557 - DNA, 25 bp, Homo sapien
ttgcaaatgtcttaccacttgttcg

SEQ ID NO: 117558 - DNA, 25 bp, Homo sapien
ttgcaaatgtcttcccacttgttcg

SEQ ID NO: 117559 - DNA, 25 bp, Homo sapien
ttgcaacatcacgacaaacactaca

SEQ ID NO: 117560 - DNA, 25 bp, Homo sapien
ttgcaacatcatgacaaacactaca

SEQ ID NO: 117561 - DNA, 25 bp, Homo sapien
ttgcaacatttcccttcgggttcca

SEQ ID NO: 117562 - DNA, 25 bp, Homo sapien
ttgcaacatttccctttgggttcca

SEQ ID NO: 117563 - DNA, 25 bp, Homo sapien
ttgcaacatttgaacaatgatgaag

SEQ ID NO: 117564 - DNA, 25 bp, Homo sapien
ttgcaacatttggacaatgatgaag

SEQ ID NO: 117565 - DNA, 25 bp, Homo sapien
ttgcaaccatttatctaataagagt

SEQ ID NO: 117566 - DNA, 25 bp, Homo sapien
ttgcaaccgtttatctaataagagt

SEQ ID NO: 117567 - DNA, 25 bp, Homo sapien
ttgcaacctccaaccgctggattca

SEQ ID NO: 117568 - DNA, 25 bp, Homo sapien
ttgcaacctccaactgctggattca

SEQ ID NO: 117569 - DNA, 25 bp, Homo sapien
ttgcaacctgacgcctctgctttcc

SEQ ID NO: 117570 - DNA, 25 bp, Homo sapien
ttgcaacctgacgcctgtgctttcc

SEQ ID NO: 117571 - DNA, 25 bp, Homo sapien
ttgcaagaaacattaacagaagttc

SEQ ID NO: 117572 - DNA, 25 bp, Homo sapien
ttgcaagaaacgttaacagaagttc

SEQ ID NO: 117573 - DNA, 25 bp, Homo sapien
ttgcaagagccatggaggactctgg

SEQ ID NO: 117574 - DNA, 25 bp, Homo sapien
ttgcaagagccgtggaggactctgg

SEQ ID NO: 117575 - DNA, 25 bp, Homo sapien
ttgcaataactcttgatggaaagaa

SEQ ID NO: 117576 - DNA, 25 bp, Homo sapien
ttgcaataactgttgatggaaagaa

SEQ ID NO: 117577 - DNA, 25 bp, Homo sapien
ttgcaatcaatcaccaagttctgct

SEQ ID NO: 117578 - DNA, 25 bp, Homo sapien
ttgcaatcagtcaccaagttctgct

SEQ ID NO: 117579 - DNA, 25 bp, Homo sapien
ttgcaatccacattaagataaggct

SEQ ID NO: 117580 - DNA, 25 bp, Homo sapien
ttgcaatccacattgagataaggct

SEQ ID NO: 117581 - DNA, 25 bp, Homo sapien
ttgcaatgattcaagagggagagga

SEQ ID NO: 117582 - DNA, 25 bp, Homo sapien
ttgcaatgattcaggagggagagga

SEQ ID NO: 117583 - DNA, 25 bp, Homo sapien
ttgcaattctttactctaatccatt

SEQ ID NO: 117584 - DNA, 25 bp, Homo sapien
ttgcaattctttgctctaatccatt

SEQ ID NO: 117585 - DNA, 25 bp, Homo sapien
ttgcacacaaaggcccaggaatcag

SEQ ID NO: 117586 - DNA, 25 bp, Homo sapien
ttgcacacaaagtcccaggaatcag

SEQ ID NO: 117587 - DNA, 25 bp, Homo sapien
ttgcacactagctacagcagagacc

SEQ ID NO: 117588 - DNA, 25 bp, Homo sapien
ttgcacactaggtacagcagagacc

SEQ ID NO: 117589 - DNA, 25 bp, Homo sapien
ttgcacactatattaccggaaagtg

SEQ ID NO: 117590 - DNA, 25 bp, Homo sapien
ttgcacactgtattaccggaaagtg

SEQ ID NO: 117591 - DNA, 25 bp, Homo sapien
ttgcacaggacaaactcaatcatgt

SEQ ID NO: 117592 - DNA, 25 bp, Homo sapien
ttgcacaggacaagctcaatcatgt

SEQ ID NO: 117593 - DNA, 25 bp, Homo sapien
ttgcaccaaagtttgattgatttga

SEQ ID NO: 117594 - DNA, 25 bp, Homo sapien
ttgcaccaacgtttgattgatttga

SEQ ID NO: 117595 - DNA, 25 bp, Homo sapien
ttgcaccagcgggcttcttagcctt

SEQ ID NO: 117596 - DNA, 25 bp, Homo sapien
ttgcaccatcgggcttcttagcctt

SEQ ID NO: 117597 - DNA, 25 bp, Homo sapien
ttgcacccaaaactccaaactgcat

SEQ ID NO: 117598 - DNA, 25 bp, Homo sapien
ttgcacccacaactccaaactgcat

SEQ ID NO: 117599 - DNA, 25 bp, Homo sapien
ttgcacctagaagaattagaaaaaa

SEQ ID NO: 117600 - DNA, 25 bp, Homo sapien
ttgcacctagaggaattagaaaaaa

SEQ ID NO: 117601 - DNA, 25 bp, Homo sapien
ttgcaccttgttctcacgtcttcta

SEQ ID NO: 117602 - DNA, 25 bp, Homo sapien
ttgcaccttgttctcatgtcttcta

SEQ ID NO: 117603 - DNA, 25 bp, Homo sapien
ttgcacgaacagcatggatttcccc

SEQ ID NO: 117604 - DNA, 25 bp, Homo sapien
ttgcacgaacaggatggatttcccc

SEQ ID NO: 117605 - DNA, 25 bp, Homo sapien
ttgcacgtccgtcttttttcttcct

SEQ ID NO: 117606 - DNA, 25 bp, Homo sapien
ttgcacgtctgtcttttttcttcct

SEQ ID NO: 117607 - DNA, 25 bp, Homo sapien
ttgcactcagggcaaacgtcaactc

SEQ ID NO: 117608 - DNA, 25 bp, Homo sapien
ttgcactcagggcaaatgtcaactc

SEQ ID NO: 117609 - DNA, 25 bp, Homo sapien
ttgcactccagtcagcatgacaaga

SEQ ID NO: 117610 - DNA, 25 bp, Homo sapien
ttgcactccagtcagcgtgacaaga

SEQ ID NO: 117611 - DNA, 25 bp, Homo sapien
ttgcactcggaccgcttcacaggtg

SEQ ID NO: 117612 - DNA, 25 bp, Homo sapien
ttgcactcggactgcttcacaggtg

SEQ ID NO: 117613 - DNA, 25 bp, Homo sapien
ttgcactctaatcatgagaataatt

SEQ ID NO: 117614 - DNA, 25 bp, Homo sapien
ttgcactctaatcatgggaataatt

SEQ ID NO: 117615 - DNA, 25 bp, Homo sapien
ttgcactgtgacattgagtaacaat

SEQ ID NO: 117616 - DNA, 25 bp, Homo sapien
ttgcactgtgatattgagtaacaat

SEQ ID NO: 117617 - DNA, 25 bp, Homo sapien
ttgcagaaaaagttctgaagtcttg

SEQ ID NO: 117618 - DNA, 25 bp, Homo sapien
ttgcagaaagagttctgaagtcttg

SEQ ID NO: 117619 - DNA, 25 bp, Homo sapien
ttgcagaagacaatggatatcggca

SEQ ID NO: 117620 - DNA, 25 bp, Homo sapien
ttgcagaaggcaatggatatcggca

SEQ ID NO: 117621 - DNA, 25 bp, Homo sapien
ttgcagactctaaagaggccaccca

SEQ ID NO: 117622 - DNA, 25 bp, Homo sapien
ttgcagactctgaagaggccaccca

SEQ ID NO: 117623 - DNA, 25 bp, Homo sapien
ttgcagagaagactgttcccttcat

SEQ ID NO: 117624 - DNA, 25 bp, Homo sapien
ttgcagagaagcctgttcccttcat

SEQ ID NO: 117625 - DNA, 25 bp, Homo sapien
ttgcagagaatatggaacaacttac

SEQ ID NO: 117626 - DNA, 25 bp, Homo sapien
ttgcagagaatatggagcaacttac

SEQ ID NO: 117627 - DNA, 25 bp, Homo sapien
ttgcagagacaaccaccaatagtga

SEQ ID NO: 117628 - DNA, 25 bp, Homo sapien
ttgcagagacaatcaccaatagtga

SEQ ID NO: 117629 - DNA, 25 bp, Homo sapien
ttgcagagactgcctttccatgtca

SEQ ID NO: 117630 - DNA, 25 bp, Homo sapien
ttgcagagcaccaacccagtcacgt

SEQ ID NO: 117631 - DNA, 25 bp, Homo sapien
ttgcagaggctgcctttccatgtca

SEQ ID NO: 117632 - DNA, 25 bp, Homo sapien
ttgcagagtaccaacccagtcacgt

SEQ ID NO: 117633 - DNA, 25 bp, Homo sapien
ttgcagatacaaagctggttttttt

SEQ ID NO: 117634 - DNA, 25 bp, Homo sapien
ttgcagatacaaggctggttttttt

SEQ ID NO: 117635 - DNA, 25 bp, Homo sapien
ttgcagatatgattatagagaaaag

SEQ ID NO: 117636 - DNA, 25 bp, Homo sapien
ttgcagatatggttatagagaaaag

SEQ ID NO: 117637 - DNA, 25 bp, Homo sapien
ttgcagatgtaaattacggacctcg

SEQ ID NO: 117638 - DNA, 25 bp, Homo sapien
ttgcagatgtaaattatggacctcg

SEQ ID NO: 117639 - DNA, 25 bp, Homo sapien
ttgcagcaaagcctttcccaccatt

SEQ ID NO: 117640 - DNA, 25 bp, Homo sapien
ttgcagcagagcctttcccaccatt

SEQ ID NO: 117641 - DNA, 25 bp, Homo sapien
ttgcagccaagacacccatgagagt

SEQ ID NO: 117642 - DNA, 25 bp, Homo sapien
ttgcagccaagacgcccatgagagt

SEQ ID NO: 117643 - DNA, 25 bp, Homo sapien
ttgcagccacattccaggaagtaga

SEQ ID NO: 117644 - DNA, 25 bp, Homo sapien
ttgcagccatattccaggaagtaga

SEQ ID NO: 117645 - DNA, 25 bp, Homo sapien
ttgcagctgaacttaaacccaatta

SEQ ID NO: 117646 - DNA, 25 bp, Homo sapien
ttgcagcttaacttaaacccaatta

SEQ ID NO: 117647 - DNA, 25 bp, Homo sapien
ttgcaggccttaagtatggcagaaa

SEQ ID NO: 117648 - DNA, 25 bp, Homo sapien
ttgcaggccttgagtatggcagaaa

SEQ ID NO: 117649 - DNA, 25 bp, Homo sapien
ttgcagggagttggtatgacactgt

SEQ ID NO: 117650 - DNA, 25 bp, Homo sapien
ttgcagggagtttgtatgacactgt

SEQ ID NO: 117651 - DNA, 25 bp, Homo sapien
ttgcagtaaccacgatggcagctgg

SEQ ID NO: 117652 - DNA, 25 bp, Homo sapien
ttgcagtaaccatgatggcagctgg

SEQ ID NO: 117653 - DNA, 25 bp, Homo sapien
ttgcagtattagaacacagacatcc

SEQ ID NO: 117654 - DNA, 25 bp, Homo sapien
ttgcagtattaggacacagacatcc

SEQ ID NO: 117655 - DNA, 25 bp, Homo sapien
ttgcagtcagttgttgcgataagat

SEQ ID NO: 117656 - DNA, 25 bp, Homo sapien
ttgcagtcagttgttgggataagat

SEQ ID NO: 117657 - DNA, 25 bp, Homo sapien
ttgcagtgattaaattgaagctcta

SEQ ID NO: 117658 - DNA, 25 bp, Homo sapien
ttgcagtgattgaattgaagctcta

SEQ ID NO: 117659 - DNA, 25 bp, Homo sapien
ttgcagtggatgagaaataaatgga

SEQ ID NO: 117660 - DNA, 25 bp, Homo sapien
ttgcagtgggtgagaaataaatgga

SEQ ID NO: 117661 - DNA, 25 bp, Homo sapien
ttgcagtgtgtacaaattgtgggaa

SEQ ID NO: 117662 - DNA, 25 bp, Homo sapien
ttgcagtgtgtacatattgtgggaa

SEQ ID NO: 117663 - DNA, 25 bp, Homo sapien
ttgcagttacttcctaacgctagat

SEQ ID NO: 117664 - DNA, 25 bp, Homo sapien
ttgcagttatttcctaacgctagat

SEQ ID NO: 117665 - DNA, 25 bp, Homo sapien
ttgcagttccccgtaaatagggtga

SEQ ID NO: 117666 - DNA, 25 bp, Homo sapien
ttgcagttccctgtaaatagggtga

SEQ ID NO: 117667 - DNA, 25 bp, Homo sapien
ttgcagtttaatcaaaaatttactt

SEQ ID NO: 117668 - DNA, 25 bp, Homo sapien
ttgcagtttaatcagaaatttactt

SEQ ID NO: 117669 - DNA, 25 bp, Homo sapien
ttgcataataacccacgaagacaaa

SEQ ID NO: 117670 - DNA, 25 bp, Homo sapien
ttgcataataagccacgaagacaaa

SEQ ID NO: 117671 - DNA, 25 bp, Homo sapien
ttgcataatttgataactaattcta

SEQ ID NO: 117672 - DNA, 25 bp, Homo sapien
ttgcataatttgctaactaattcta

SEQ ID NO: 117673 - DNA, 25 bp, Homo sapien
ttgcatacattctctctgtattgct

SEQ ID NO: 117674 - DNA, 25 bp, Homo sapien
ttgcataccaattacaactctgcct

SEQ ID NO: 117675 - DNA, 25 bp, Homo sapien
ttgcataccgattacaactctgcct

SEQ ID NO: 117676 - DNA, 25 bp, Homo sapien
ttgcatacctatagctctttctgtt

SEQ ID NO: 117677 - DNA, 25 bp, Homo sapien
ttgcatacgttctctctgtattgct

SEQ ID NO: 117678 - DNA, 25 bp, Homo sapien
ttgcatacttatagctctttctgtt

SEQ ID NO: 117679 - DNA, 25 bp, Homo sapien
ttgcatagagccacgtccagcatca

SEQ ID NO: 117680 - DNA, 25 bp, Homo sapien
ttgcatagagccatgtccagcatca

SEQ ID NO: 117681 - DNA, 25 bp, Homo sapien
ttgcatagtatactcatttgagcaa

SEQ ID NO: 117682 - DNA, 25 bp, Homo sapien
ttgcatagtgtactcatttgagcaa

SEQ ID NO: 117683 - DNA, 25 bp, Homo sapien
ttgcatcagaatctcacgtgggagg

SEQ ID NO: 117684 - DNA, 25 bp, Homo sapien
ttgcatcagaatctcaggtgggagg

SEQ ID NO: 117685 - DNA, 25 bp, Homo sapien
ttgcatcatgttatatactgatcac

SEQ ID NO: 117686 - DNA, 25 bp, Homo sapien
ttgcatcatgttatgtactgatcac

SEQ ID NO: 117687 - DNA, 25 bp, Homo sapien
ttgcatcatttcctttgtattatct

SEQ ID NO: 117688 - DNA, 25 bp, Homo sapien
ttgcatcatttcttttgtattatct

SEQ ID NO: 117689 - DNA, 25 bp, Homo sapien
ttgcatctcaattatccaggcatgg

SEQ ID NO: 117690 - DNA, 25 bp, Homo sapien
ttgcatctcaattttccaggcatgg

SEQ ID NO: 117691 - DNA, 25 bp, Homo sapien
ttgcatctgtgccggcagtttttgt

SEQ ID NO: 117692 - DNA, 25 bp, Homo sapien
ttgcatctgtgcctgcagtttttgt

SEQ ID NO: 117693 - DNA, 25 bp, Homo sapien
ttgcatgcctccgctgagctgtcaa

SEQ ID NO: 117694 - DNA, 25 bp, Homo sapien
ttgcatgcctctgctgagctgtcaa

SEQ ID NO: 117695 - DNA, 25 bp, Homo sapien
ttgcattaaaaactaaaaaacagat

SEQ ID NO: 117696 - DNA, 25 bp, Homo sapien
ttgcattaaaaagtaaaaaacagat

SEQ ID NO: 117697 - DNA, 25 bp, Homo sapien
ttgcattaaagttactggtgcttta

SEQ ID NO: 117698 - DNA, 25 bp, Homo sapien
ttgcattaaagttattggtgcttta

SEQ ID NO: 117699 - DNA, 25 bp, Homo sapien
ttgcattaagcattttataaagtaa

SEQ ID NO: 117700 - DNA, 25 bp, Homo sapien
ttgcattaagcgttttataaagtaa

SEQ ID NO: 117701 - DNA, 25 bp, Homo sapien
ttgcattatatgccaaatgaaagag

SEQ ID NO: 117702 - DNA, 25 bp, Homo sapien
ttgcattatttgccaaatgaaagag

SEQ ID NO: 117703 - DNA, 25 bp, Homo sapien
ttgcattcaatatagccatttatga

SEQ ID NO: 117704 - DNA, 25 bp, Homo sapien
ttgcattcaatatcgccatttatga

SEQ ID NO: 117705 - DNA, 25 bp, Homo sapien
ttgcattcatctaaacatttttaaa

SEQ ID NO: 117706 - DNA, 25 bp, Homo sapien
ttgcattcatctgaacatttttaaa

SEQ ID NO: 117707 - DNA, 25 bp, Homo sapien
ttgcattctgagagcaacttttgac

SEQ ID NO: 117708 - DNA, 25 bp, Homo sapien
ttgcattctgagagcagcttttgac

SEQ ID NO: 117709 - DNA, 25 bp, Homo sapien
ttgcattgctccatagctgttctca

SEQ ID NO: 117710 - DNA, 25 bp, Homo sapien
ttgcattgtagcagttttgcaagcc

SEQ ID NO: 117711 - DNA, 25 bp, Homo sapien
ttgcattgtaggatcagagtcccca

SEQ ID NO: 117712 - DNA, 25 bp, Homo sapien
ttgcattgtagtagttttgcaagcc

SEQ ID NO: 117713 - DNA, 25 bp, Homo sapien
ttgcattgtgggatcagagtcccca

SEQ ID NO: 117714 - DNA, 25 bp, Homo sapien
ttgcattgttccatagctgttctca

SEQ ID NO: 117715 - DNA, 25 bp, Homo sapien
ttgcatttatctatcaattattata

SEQ ID NO: 117716 - DNA, 25 bp, Homo sapien
ttgcatttatctgtcaattattata

SEQ ID NO: 117717 - DNA, 25 bp, Homo sapien
ttgcatttgaacgatatacttcaac

SEQ ID NO: 117718 - DNA, 25 bp, Homo sapien
ttgcatttgaactatatacttcaac

SEQ ID NO: 117719 - DNA, 25 bp, Homo sapien
ttgcattttcacgggtgtaggtttt

SEQ ID NO: 117720 - DNA, 25 bp, Homo sapien
ttgcattttcacgggtttaggtttt

SEQ ID NO: 117721 - DNA, 25 bp, Homo sapien
ttgcattttctccaatgaaaagcta

SEQ ID NO: 117722 - DNA, 25 bp, Homo sapien
ttgcattttcttcaatgaaaagcta

SEQ ID NO: 117723 - DNA, 25 bp, Homo sapien
ttgccaaaaacagactgagccccta

SEQ ID NO: 117724 - DNA, 25 bp, Homo sapien
ttgccaaaaacagattgagccccta

SEQ ID NO: 117725 - DNA, 25 bp, Homo sapien
ttgccaaatttgtctaatgggaatc

SEQ ID NO: 117726 - DNA, 25 bp, Homo sapien
ttgccaaatttgtttaatgggaatc

SEQ ID NO: 117727 - DNA, 25 bp, Homo sapien
ttgccaacatttaagggaggtagaa

SEQ ID NO: 117728 - DNA, 25 bp, Homo sapien
ttgccaacatttgtactcctctcta

SEQ ID NO: 117729 - DNA, 25 bp, Homo sapien
ttgccaacatttttactcctctcta

SEQ ID NO: 117730 - DNA, 25 bp, Homo sapien
ttgccaacgtttaagggaggtagaa

SEQ ID NO: 117731 - DNA, 25 bp, Homo sapien
ttgccaataggaaagtggaattcct

SEQ ID NO: 117732 - DNA, 25 bp, Homo sapien
ttgccaataggagagtggaattcct

SEQ ID NO: 117733 - DNA, 25 bp, Homo sapien
ttgccaattctcaagtatttcaaat

SEQ ID NO: 117734 - DNA, 25 bp, Homo sapien
ttgccaattctcaattatttcaaat

SEQ ID NO: 117735 - DNA, 25 bp, Homo sapien
ttgccacaatctacatgacagggat

SEQ ID NO: 117736 - DNA, 25 bp, Homo sapien
ttgccacaatctacgtgacagggat

SEQ ID NO: 117737 - DNA, 25 bp, Homo sapien
ttgccacatcctgaaccctggttag

SEQ ID NO: 117738 - DNA, 25 bp, Homo sapien
ttgccacatcctgaactctggttag

SEQ ID NO: 117739 - DNA, 25 bp, Homo sapien
ttgccacgttcagaaacggcagttg

SEQ ID NO: 117740 - DNA, 25 bp, Homo sapien
ttgccacgttcggaaacggcagttg

SEQ ID NO: 117741 - DNA, 25 bp, Homo sapien
ttgccactatttatttttctgatag

SEQ ID NO: 117742 - DNA, 25 bp, Homo sapien
ttgccactatttctttttctgatag

SEQ ID NO: 117743 - DNA, 25 bp, Homo sapien
ttgccagcaggtcagaaccctgtga

SEQ ID NO: 117744 - DNA, 25 bp, Homo sapien
ttgccagcgggtcagaaccctgtga

SEQ ID NO: 117745 - DNA, 25 bp, Homo sapien
ttgccaggtggactgacgctgattt

SEQ ID NO: 117746 - DNA, 25 bp, Homo sapien
ttgccaggtggactgatgctgattt

SEQ ID NO: 117747 - DNA, 25 bp, Homo sapien
ttgccatactggagcaagtagtgtt

SEQ ID NO: 117748 - DNA, 25 bp, Homo sapien
ttgccatagtggagcaagtagtgtt

SEQ ID NO: 117749 - DNA, 25 bp, Homo sapien
ttgccatctgaaaaactaaaacact

SEQ ID NO: 117750 - DNA, 25 bp, Homo sapien
ttgccatcttaaaaactaaaacact

SEQ ID NO: 117751 - DNA, 25 bp, Homo sapien
ttgccattaaaagtaccggcaaaaa

SEQ ID NO: 117752 - DNA, 25 bp, Homo sapien
ttgccattaaaagtactggcaaaaa

SEQ ID NO: 117753 - DNA, 25 bp, Homo sapien
ttgccattgcataataaggggtatc

SEQ ID NO: 117754 - DNA, 25 bp, Homo sapien
ttgccattgcatagtaaggggtatc

SEQ ID NO: 117755 - DNA, 25 bp, Homo sapien
ttgccatttgttgagcattggcaat

SEQ ID NO: 117756 - DNA, 25 bp, Homo sapien
ttgccatttgttgagcgttggcaat

SEQ ID NO: 117757 - DNA, 25 bp, Homo sapien
ttgcccaagatagtagacataaaac

SEQ ID NO: 117758 - DNA, 25 bp, Homo sapien
ttgcccaagatagtagtcataaaac

SEQ ID NO: 117759 - DNA, 25 bp, Homo sapien
ttgcccacaaatagtcacagcaact

SEQ ID NO: 117760 - DNA, 25 bp, Homo sapien
ttgcccaccaatagtcacagcaact

SEQ ID NO: 117761 - DNA, 25 bp, Homo sapien
ttgcccaccctcacttctgtggcta

SEQ ID NO: 117762 - DNA, 25 bp, Homo sapien
ttgcccaccctcacttgtgtggcta

SEQ ID NO: 117763 - DNA, 25 bp, Homo sapien
ttgcccactgtcgatggccaaaggc

SEQ ID NO: 117764 - DNA, 25 bp, Homo sapien
ttgcccactgtctatggccaaaggc

SEQ ID NO: 117765 - DNA, 25 bp, Homo sapien
ttgcccccaagctaacatgtcagcc

SEQ ID NO: 117766 - DNA, 25 bp, Homo sapien
ttgcccccaagctaacgtgtcagcc

SEQ ID NO: 117767 - DNA, 25 bp, Homo sapien
ttgcccctattcaaccttaagaagc

SEQ ID NO: 117768 - DNA, 25 bp, Homo sapien
ttgcccctattcagccttaagaagc

SEQ ID NO: 117769 - DNA, 25 bp, Homo sapien
ttgccctgaatgtatcagcacatct

SEQ ID NO: 117770 - DNA, 25 bp, Homo sapien
ttgccctgaatgtttcagcacatct

SEQ ID NO: 117771 - DNA, 25 bp, Homo sapien
ttgccctggagtcactggtgtaggg

SEQ ID NO: 117772 - DNA, 25 bp, Homo sapien
ttgccctggagtcattggtgtaggg

SEQ ID NO: 117773 - DNA, 25 bp, Homo sapien
ttgccgacagacaattttaaatagc

SEQ ID NO: 117774 - DNA, 25 bp, Homo sapien
ttgccgacagaccattttaaatagc

SEQ ID NO: 117775 - DNA, 25 bp, Homo sapien
ttgccgttatttacatttatgtctg

SEQ ID NO: 117776 - DNA, 25 bp, Homo sapien
ttgccgttgtttacatttatgtctg

SEQ ID NO: 117777 - DNA, 25 bp, Homo sapien
ttgcctaacgcaaggcaatccgctc

SEQ ID NO: 117778 - DNA, 25 bp, Homo sapien
ttgcctaatcgatcgaaagagggca

SEQ ID NO: 117779 - DNA, 25 bp, Homo sapien
ttgcctaatcgatggaaagagggca

SEQ ID NO: 117780 - DNA, 25 bp, Homo sapien
ttgcctaatgcaaggcaatccgctc

SEQ ID NO: 117781 - DNA, 25 bp, Homo sapien
ttgcctacttgacccacattttcat

SEQ ID NO: 117782 - DNA, 25 bp, Homo sapien
ttgcctacttgatccacattttcat

SEQ ID NO: 117783 - DNA, 25 bp, Homo sapien
ttgcctagagcccgatgctatccaa

SEQ ID NO: 117784 - DNA, 25 bp, Homo sapien
ttgcctagagctcgatgctatccaa

SEQ ID NO: 117785 - DNA, 25 bp, Homo sapien
ttgcctatctgtctaaaagcattag

SEQ ID NO: 117786 - DNA, 25 bp, Homo sapien
ttgcctatctgtctgaaagcattag

SEQ ID NO: 117787 - DNA, 25 bp, Homo sapien
ttgcctcaagcatgctgaacttgga

SEQ ID NO: 117788 - DNA, 25 bp, Homo sapien
ttgcctcaagcattctgaacttgga

SEQ ID NO: 117789 - DNA, 25 bp, Homo sapien
ttgcctcactcaacttatttgtacc

SEQ ID NO: 117790 - DNA, 25 bp, Homo sapien
ttgcctcactcatcttatttgtacc

SEQ ID NO: 117791 - DNA, 25 bp, Homo sapien
ttgcctccacggactatgaaggtga

SEQ ID NO: 117792 - DNA, 25 bp, Homo sapien
ttgcctccagggactatgaaggtga

SEQ ID NO: 117793 - DNA, 25 bp, Homo sapien
ttgcctccataagttaagattttaa

SEQ ID NO: 117794 - DNA, 25 bp, Homo sapien
ttgcctccctaaaattctcccaagt

SEQ ID NO: 117795 - DNA, 25 bp, Homo sapien
ttgcctccctaaaattttcccaagt

SEQ ID NO: 117796 - DNA, 25 bp, Homo sapien
ttgcctccgtaagttaagattttaa

SEQ ID NO: 117797 - DNA, 25 bp, Homo sapien
ttgcctctctctgactctccatcct

SEQ ID NO: 117798 - DNA, 25 bp, Homo sapien
ttgcctctgactgaacctgtgcata

SEQ ID NO: 117799 - DNA, 25 bp, Homo sapien
ttgcctctgactgcacctgtgcata

SEQ ID NO: 117800 - DNA, 25 bp, Homo sapien
ttgcctctgaggacatatgccaatg

SEQ ID NO: 117801 - DNA, 25 bp, Homo sapien
ttgcctctgaggacctatgccaatg

SEQ ID NO: 117802 - DNA, 25 bp, Homo sapien
ttgcctctgtctgactctccatcct

SEQ ID NO: 117803 - DNA, 25 bp, Homo sapien
ttgcctgactatagtaaccatttca

SEQ ID NO: 117804 - DNA, 25 bp, Homo sapien
ttgcctgactatattaaccatttca

SEQ ID NO: 117805 - DNA, 25 bp, Homo sapien
ttgcctgaggagacaaaaagaaagg

SEQ ID NO: 117806 - DNA, 25 bp, Homo sapien
ttgcctgaggagataaaaagaaagg

SEQ ID NO: 117807 - DNA, 25 bp, Homo sapien
ttgcctgagtaggagactggaagga

SEQ ID NO: 117808 - DNA, 25 bp, Homo sapien
ttgcctgagtaggagattggaagga

SEQ ID NO: 117809 - DNA, 25 bp, Homo sapien
ttgcctggaaatgtgacggtccggg

SEQ ID NO: 117810 - DNA, 25 bp, Homo sapien
ttgcctggaaatttgacggtccggg

SEQ ID NO: 117811 - DNA, 25 bp, Homo sapien
ttgcctggatttggccttatccaat

SEQ ID NO: 117812 - DNA, 25 bp, Homo sapien
ttgcctggcacaaaacagatctaga

SEQ ID NO: 117813 - DNA, 25 bp, Homo sapien
ttgcctggcacaaaactgatctaga

SEQ ID NO: 117814 - DNA, 25 bp, Homo sapien
ttgcctgggtttggccttatccaat

SEQ ID NO: 117815 - DNA, 25 bp, Homo sapien
ttgcctgtcgtgttcacctgtcccc

SEQ ID NO: 117816 - DNA, 25 bp, Homo sapien
ttgcctgtcttgttcacctgtcccc

SEQ ID NO: 117817 - DNA, 25 bp, Homo sapien
ttgcctgtgaggacaacaatttgtt

SEQ ID NO: 117818 - DNA, 25 bp, Homo sapien
ttgcctgtgaggacaataatttgtt

SEQ ID NO: 117819 - DNA, 25 bp, Homo sapien
ttgcctgtttagcccggaagttggt

SEQ ID NO: 117820 - DNA, 25 bp, Homo sapien
ttgcctgtttagcctggaagttggt

SEQ ID NO: 117821 - DNA, 25 bp, Homo sapien
ttgccttcatctttcattgtaacat

SEQ ID NO: 117822 - DNA, 25 bp, Homo sapien
ttgccttcattattcagtggtttgg

SEQ ID NO: 117823 - DNA, 25 bp, Homo sapien
ttgccttcattcttcagtggtttgg

SEQ ID NO: 117824 - DNA, 25 bp, Homo sapien
ttgccttccaccacacagtctgtag

SEQ ID NO: 117825 - DNA, 25 bp, Homo sapien
ttgccttccaccatacagtctgtag

SEQ ID NO: 117826 - DNA, 25 bp, Homo sapien
ttgccttcctctttcattgtaacat

SEQ ID NO: 117827 - DNA, 25 bp, Homo sapien
ttgccttgctttaagacagtcctct

SEQ ID NO: 117828 - DNA, 25 bp, Homo sapien
ttgccttgctttaagatagtcctct

SEQ ID NO: 117829 - DNA, 25 bp, Homo sapien
ttgcctttacacacactgatgcatt

SEQ ID NO: 117830 - DNA, 25 bp, Homo sapien
ttgcctttacatacactgatgcatt

SEQ ID NO: 117831 - DNA, 25 bp, Homo sapien
ttgccttttcagtttcataacagtg

SEQ ID NO: 117832 - DNA, 25 bp, Homo sapien
ttgccttttcattttcataacagtg

SEQ ID NO: 117833 - DNA, 25 bp, Homo sapien
ttgcgatgaggagatagggagagaa

SEQ ID NO: 117834 - DNA, 25 bp, Homo sapien
ttgcgatgaggagctagggagagaa

SEQ ID NO: 117835 - DNA, 25 bp, Homo sapien
ttgcgctacatagattgttgtttcg

SEQ ID NO: 117836 - DNA, 25 bp, Homo sapien
ttgcgctacatagatttttgtttcg

SEQ ID NO: 117837 - DNA, 25 bp, Homo sapien
ttgcggcgtatcggagacgagttta

SEQ ID NO: 117838 - DNA, 25 bp, Homo sapien
ttgcggcgtattggagacgagttta

SEQ ID NO: 117839 - DNA, 25 bp, Homo sapien
ttgcggcttcctccttcctgatgcc

SEQ ID NO: 117840 - DNA, 25 bp, Homo sapien
ttgcggcttgctccttcctgatgcc

SEQ ID NO: 117841 - DNA, 25 bp, Homo sapien
ttgcgtagtcaacactttagtaatg

SEQ ID NO: 117842 - DNA, 25 bp, Homo sapien
ttgcgtagtcaacattttagtaatg

SEQ ID NO: 117843 - DNA, 25 bp, Homo sapien
ttgctaaaagcccagacattttaat

SEQ ID NO: 117844 - DNA, 25 bp, Homo sapien
ttgctaaaagcccggacattttaat

SEQ ID NO: 117845 - DNA, 25 bp, Homo sapien
ttgctaaagaacattcttggcaaga

SEQ ID NO: 117846 - DNA, 25 bp, Homo sapien
ttgctaaagaacgttcttggcaaga

SEQ ID NO: 117847 - DNA, 25 bp, Homo sapien
ttgctaacagagaagtgtgaggaga

SEQ ID NO: 117848 - DNA, 25 bp, Homo sapien
ttgctaacagagaggtgtgaggaga

SEQ ID NO: 117849 - DNA, 25 bp, Homo sapien
ttgctaagcaaaaacaactgtccct

SEQ ID NO: 117850 - DNA, 25 bp, Homo sapien
ttgctaagcaaaagcaactgtccct

SEQ ID NO: 117851 - DNA, 25 bp, Homo sapien
ttgctaagcgtcaataaacagcatc

SEQ ID NO: 117852 - DNA, 25 bp, Homo sapien
ttgctaagcgtcagtaaacagcatc

SEQ ID NO: 117853 - DNA, 25 bp, Homo sapien
ttgctaaggaattaatgcaggcact

SEQ ID NO: 117854 - DNA, 25 bp, Homo sapien
ttgctaaggaattactgcaggcact

SEQ ID NO: 117855 - DNA, 25 bp, Homo sapien
ttgctaagtagtactccattttatg

SEQ ID NO: 117856 - DNA, 25 bp, Homo sapien
ttgctaagtagtattccattttatg

SEQ ID NO: 117857 - DNA, 25 bp, Homo sapien
ttgctaatagtagcggcctacaaat

SEQ ID NO: 117858 - DNA, 25 bp, Homo sapien
ttgctaatagtagtggcctacaaat

SEQ ID NO: 117859 - DNA, 25 bp, Homo sapien
ttgctaatctttttgatcctccaat

SEQ ID NO: 117860 - DNA, 25 bp, Homo sapien
ttgctaatcttttttatcctccaat

SEQ ID NO: 117861 - DNA, 25 bp, Homo sapien
ttgctacaaactaatgactaatgat

SEQ ID NO: 117862 - DNA, 25 bp, Homo sapien
ttgctacaaactgatgactaatgat

SEQ ID NO: 117863 - DNA, 25 bp, Homo sapien
ttgctagaagaattgtctttttttt

SEQ ID NO: 117864 - DNA, 25 bp, Homo sapien
ttgctagacgaattgtctttttttt

SEQ ID NO: 117865 - DNA, 25 bp, Homo sapien
ttgctagactcgctttgctaacatt

SEQ ID NO: 117866 - DNA, 25 bp, Homo sapien
ttgctagactcgttttgctaacatt

SEQ ID NO: 117867 - DNA, 25 bp, Homo sapien
ttgctagccctgccaactgaagaca

SEQ ID NO: 117868 - DNA, 25 bp, Homo sapien
ttgctagccctggcaactgaagaca

SEQ ID NO: 117869 - DNA, 25 bp, Homo sapien
ttgctagtctcaccctgggctcaac

SEQ ID NO: 117870 - DNA, 25 bp, Homo sapien
ttgctagtgtcaccctgggctcaac

SEQ ID NO: 117871 - DNA, 25 bp, Homo sapien
ttgctagtgtctgctaacaaaatgt

SEQ ID NO: 117872 - DNA, 25 bp, Homo sapien
ttgctagtgtctgctaccaaaatgt

SEQ ID NO: 117873 - DNA, 25 bp, Homo sapien
ttgctatatctctttcctcattgac

SEQ ID NO: 117874 - DNA, 25 bp, Homo sapien
ttgctatatgtctttcctcattgac

SEQ ID NO: 117875 - DNA, 25 bp, Homo sapien
ttgctatcaacaacgtattatgcca

SEQ ID NO: 117876 - DNA, 25 bp, Homo sapien
ttgctatcagcaacgtattatgcca

SEQ ID NO: 117877 - DNA, 25 bp, Homo sapien
ttgctatccatatgatcttgtaacc

SEQ ID NO: 117878 - DNA, 25 bp, Homo sapien
ttgctatccgtatgatcttgtaacc

SEQ ID NO: 117879 - DNA, 25 bp, Homo sapien
ttgctatgccattgtattcacttcc

SEQ ID NO: 117880 - DNA, 25 bp, Homo sapien
ttgctatgctattgtattcacttcc

SEQ ID NO: 117881 - DNA, 25 bp, Homo sapien
ttgctatggattactcttcatcaaa

SEQ ID NO: 117882 - DNA, 25 bp, Homo sapien
ttgctatggattattcttcatcaaa

SEQ ID NO: 117883 - DNA, 25 bp, Homo sapien
ttgctattacggtaatgctagcttc

SEQ ID NO: 117884 - DNA, 25 bp, Homo sapien
ttgctattagggtaatgctagcttc

SEQ ID NO: 117885 - DNA, 25 bp, Homo sapien
ttgctattattttacggtatctgca

SEQ ID NO: 117886 - DNA, 25 bp, Homo sapien
ttgctattattttatggtatctgca

SEQ ID NO: 117887 - DNA, 25 bp, Homo sapien
ttgctcaagaaaaatgaaattacat

SEQ ID NO: 117888 - DNA, 25 bp, Homo sapien
ttgctcaaggaaaatgaaattacat

SEQ ID NO: 117889 - DNA, 25 bp, Homo sapien
ttgctcactcaactgcctaaaaacg

SEQ ID NO: 117890 - DNA, 25 bp, Homo sapien
ttgctcactcaattgcctaaaaacg

SEQ ID NO: 117891 - DNA, 25 bp, Homo sapien
ttgctcacttatattataaactatt

SEQ ID NO: 117892 - DNA, 25 bp, Homo sapien
ttgctcacttatgttataaactatt

SEQ ID NO: 117893 - DNA, 25 bp, Homo sapien
ttgctcagaccagaaactctgaatt

SEQ ID NO: 117894 - DNA, 25 bp, Homo sapien
ttgctcagatcagaaactctgaatt

SEQ ID NO: 117895 - DNA, 25 bp, Homo sapien
ttgctcagatgtccccctggtagta

SEQ ID NO: 117896 - DNA, 25 bp, Homo sapien
ttgctcagatgttcccctggtagta

SEQ ID NO: 117897 - DNA, 25 bp, Homo sapien
ttgctcagctgtaaaaacaccttct

SEQ ID NO: 117898 - DNA, 25 bp, Homo sapien
ttgctcagctgtaaaagcaccttct

SEQ ID NO: 117899 - DNA, 25 bp, Homo sapien
ttgctcagcttctacgtaccacgct

SEQ ID NO: 117900 - DNA, 25 bp, Homo sapien
ttgctcagcttctatgtaccacgct

SEQ ID NO: 117901 - DNA, 25 bp, Homo sapien
ttgctcatagtactggaggcaagaa

SEQ ID NO: 117902 - DNA, 25 bp, Homo sapien
ttgctcatagtagtggaggcaagaa

SEQ ID NO: 117903 - DNA, 25 bp, Homo sapien
ttgctcatcttaaaatctggttgtt

SEQ ID NO: 117904 - DNA, 25 bp, Homo sapien
ttgctcatggttgtactggagagca

SEQ ID NO: 117905 - DNA, 25 bp, Homo sapien
ttgctcatggttgttctggagagca

SEQ ID NO: 117906 - DNA, 25 bp, Homo sapien
ttgctcattttaaaatctggttgtt

SEQ ID NO: 117907 - DNA, 25 bp, Homo sapien
ttgctcattttacatataaaggaaa

SEQ ID NO: 117908 - DNA, 25 bp, Homo sapien
ttgctcattttacgtataaaggaaa

SEQ ID NO: 117909 - DNA, 25 bp, Homo sapien
ttgctccctactgccttgtgctcca

SEQ ID NO: 117910 - DNA, 25 bp, Homo sapien
ttgctccctcctgccttgtgctcca

SEQ ID NO: 117911 - DNA, 25 bp, Homo sapien
ttgctcctaatttgagtggacaaag

SEQ ID NO: 117912 - DNA, 25 bp, Homo sapien
ttgctcctcaagtcggcattccttc

SEQ ID NO: 117913 - DNA, 25 bp, Homo sapien
ttgctcctcaagttggcattccttc

SEQ ID NO: 117914 - DNA, 25 bp, Homo sapien
ttgctcctgatttgagtggacaaag

SEQ ID NO: 117915 - DNA, 25 bp, Homo sapien
ttgctccttacatgtcagaagcacc

SEQ ID NO: 117916 - DNA, 25 bp, Homo sapien
ttgctccttacgtgtcagaagcacc

SEQ ID NO: 117917 - DNA, 25 bp, Homo sapien
ttgctccttataacaaaatgaccaa

SEQ ID NO: 117918 - DNA, 25 bp, Homo sapien
ttgctccttataataaaatgaccaa

SEQ ID NO: 117919 - DNA, 25 bp, Homo sapien
ttgctcgctcgctctctctcaaaca

SEQ ID NO: 117920 - DNA, 25 bp, Homo sapien
ttgctcgctggctctctctcaaaca

SEQ ID NO: 117921 - DNA, 25 bp, Homo sapien
ttgctcgtctctggttttgagtgtg

SEQ ID NO: 117922 - DNA, 25 bp, Homo sapien
ttgctcgtctctgtttttgagtgtg

SEQ ID NO: 117923 - DNA, 25 bp, Homo sapien
ttgctctacattcttttcaatccaa

SEQ ID NO: 117924 - DNA, 25 bp, Homo sapien
ttgctctacgttcttttcaatccaa

SEQ ID NO: 117925 - DNA, 25 bp, Homo sapien
ttgctctcacctgtggtcctagcta

SEQ ID NO: 117926 - DNA, 25 bp, Homo sapien
ttgctctcactttatggacttgccc

SEQ ID NO: 117927 - DNA, 25 bp, Homo sapien
ttgctctcagtttatggacttgccc

SEQ ID NO: 117928 - DNA, 25 bp, Homo sapien
ttgctctcatctgtggtcctagcta

SEQ ID NO: 117929 - DNA, 25 bp, Homo sapien
ttgctctccagcaccgactttctca

SEQ ID NO: 117930 - DNA, 25 bp, Homo sapien
ttgctctccagcactgactttctca

SEQ ID NO: 117931 - DNA, 25 bp, Homo sapien
ttgctctctatcaatacctggagaa

SEQ ID NO: 117932 - DNA, 25 bp, Homo sapien
ttgctctctgtcaatacctggagaa

SEQ ID NO: 117933 - DNA, 25 bp, Homo sapien
ttgctctgattgggaacgttgggta

SEQ ID NO: 117934 - DNA, 25 bp, Homo sapien
ttgctctgattgggaatgttgggta

SEQ ID NO: 117935 - DNA, 25 bp, Homo sapien
ttgctctgggaccaggagttgtgca

SEQ ID NO: 117936 - DNA, 25 bp, Homo sapien
ttgctctgggaccaggcgttgtgca

SEQ ID NO: 117937 - DNA, 25 bp, Homo sapien
ttgctctgtctatcggtctcacttc

SEQ ID NO: 117938 - DNA, 25 bp, Homo sapien
ttgctctgtctatgggtctcacttc

SEQ ID NO: 117939 - DNA, 25 bp, Homo sapien
ttgctctgtttctgaagaaaatgga

SEQ ID NO: 117940 - DNA, 25 bp, Homo sapien
ttgctctgtttctggagaaaatgga

SEQ ID NO: 117941 - DNA, 25 bp, Homo sapien
ttgctcttgcctcactcgacctcca

SEQ ID NO: 117942 - DNA, 25 bp, Homo sapien
ttgctcttgcctcattcgacctcca

SEQ ID NO: 117943 - DNA, 25 bp, Homo sapien
ttgctcttggattcaccaagcactc

SEQ ID NO: 117944 - DNA, 25 bp, Homo sapien
ttgctcttggattcgccaagcactc

SEQ ID NO: 117945 - DNA, 25 bp, Homo sapien
ttgctgaaaattgacacagaaaaat

SEQ ID NO: 117946 - DNA, 25 bp, Homo sapien
ttgctgaagattgacacagaaaaat

SEQ ID NO: 117947 - DNA, 25 bp, Homo sapien
ttgctgaaggctgcaatagctgtgt

SEQ ID NO: 117948 - DNA, 25 bp, Homo sapien
ttgctgaaggctggaatagctgtgt

SEQ ID NO: 117949 - DNA, 25 bp, Homo sapien
ttgctgaatactgttttttttgcgg

SEQ ID NO: 117950 - DNA, 25 bp, Homo sapien
ttgctgaatacttttttttttgcgg

SEQ ID NO: 117951 - DNA, 25 bp, Homo sapien
ttgctgacactgctgcccaccatgg

SEQ ID NO: 117952 - DNA, 25 bp, Homo sapien
ttgctgacataaaagctgcaggtat

SEQ ID NO: 117953 - DNA, 25 bp, Homo sapien
ttgctgacataagagctgcaggtat

SEQ ID NO: 117954 - DNA, 25 bp, Homo sapien
ttgctgacgctgctgcccaccatgg

SEQ ID NO: 117955 - DNA, 25 bp, Homo sapien
ttgctgagaaaacaagtaagttaca

SEQ ID NO: 117956 - DNA, 25 bp, Homo sapien
ttgctgagaaaataagtaagttaca

SEQ ID NO: 117957 - DNA, 25 bp, Homo sapien
ttgctgagaggtcatccttgtttct

SEQ ID NO: 117958 - DNA, 25 bp, Homo sapien
ttgctgagaggtcgtccttgtttct

SEQ ID NO: 117959 - DNA, 25 bp, Homo sapien
ttgctgagtaacacctgcattctct

SEQ ID NO: 117960 - DNA, 25 bp, Homo sapien
ttgctgagtaactcctgcattctct

SEQ ID NO: 117961 - DNA, 25 bp, Homo sapien
ttgctgatactttcttccgcctgct

SEQ ID NO: 117962 - DNA, 25 bp, Homo sapien
ttgctgatattttcttccgcctgct

SEQ ID NO: 117963 - DNA, 25 bp, Homo sapien
ttgctgatggccttgaagcagcctc

SEQ ID NO: 117964 - DNA, 25 bp, Homo sapien
ttgctgatggctttgaagcagcctc

SEQ ID NO: 117965 - DNA, 25 bp, Homo sapien
ttgctgcaactaattttttccagcc

SEQ ID NO: 117966 - DNA, 25 bp, Homo sapien
ttgctgcaattaattttttccagcc

SEQ ID NO: 117967 - DNA, 25 bp, Homo sapien
ttgctgcaggcatgaagagacaggt

SEQ ID NO: 117968 - DNA, 25 bp, Homo sapien
ttgctgcaggcgtgaagagacaggt

SEQ ID NO: 117969 - DNA, 25 bp, Homo sapien
ttgctgctcaatgacacctgcagac

SEQ ID NO: 117970 - DNA, 25 bp, Homo sapien
ttgctgctcaatgatacctgcagac

SEQ ID NO: 117971 - DNA, 25 bp, Homo sapien
ttgctggaagttttataagaaatca

SEQ ID NO: 117972 - DNA, 25 bp, Homo sapien
ttgctggaagttttgtaagaaatca

SEQ ID NO: 117973 - DNA, 25 bp, Homo sapien
ttgctggatatgaaattttgggtta

SEQ ID NO: 117974 - DNA, 25 bp, Homo sapien
ttgctggatatggaattttgggtta

SEQ ID NO: 117975 - DNA, 25 bp, Homo sapien
ttgctggcttttccatttgtcatcc

SEQ ID NO: 117976 - DNA, 25 bp, Homo sapien
ttgctggcttttccgtttgtcatcc

SEQ ID NO: 117977 - DNA, 25 bp, Homo sapien
ttgctgggacgcagtatgaccagga

SEQ ID NO: 117978 - DNA, 25 bp, Homo sapien
ttgctgggacgcggtatgaccagga

SEQ ID NO: 117979 - DNA, 25 bp, Homo sapien
ttgctggtaggcctataacaagatt

SEQ ID NO: 117980 - DNA, 25 bp, Homo sapien
ttgctggtaggcctgtaacaagatt

SEQ ID NO: 117981 - DNA, 25 bp, Homo sapien
ttgctgtaaattcctttcagggtca

SEQ ID NO: 117982 - DNA, 25 bp, Homo sapien
ttgctgtaaatttctttcagggtca

SEQ ID NO: 117983 - DNA, 25 bp, Homo sapien
ttgctgtaggtgcactgatacagaa

SEQ ID NO: 117984 - DNA, 25 bp, Homo sapien
ttgctgtaggtgcattgatacagaa

SEQ ID NO: 117985 - DNA, 25 bp, Homo sapien
ttgctgtcatagaacgcagctgaag

SEQ ID NO: 117986 - DNA, 25 bp, Homo sapien
ttgctgtcatagaatgcagctgaag

SEQ ID NO: 117987 - DNA, 25 bp, Homo sapien
ttgctgtcattgaaccgccagtgac

SEQ ID NO: 117988 - DNA, 25 bp, Homo sapien
ttgctgtcattggaccgccagtgac

SEQ ID NO: 117989 - DNA, 25 bp, Homo sapien
ttgctgtgaactgccatctcttctt

SEQ ID NO: 117990 - DNA, 25 bp, Homo sapien
ttgctgtgagctgccatctcttctt

SEQ ID NO: 117991 - DNA, 25 bp, Homo sapien
ttgctgtgggacaaatcacaagact

SEQ ID NO: 117992 - DNA, 25 bp, Homo sapien
ttgctgtgggacagatcacaagact

SEQ ID NO: 117993 - DNA, 25 bp, Homo sapien
ttgctgttggaccagcacagggctt

SEQ ID NO: 117994 - DNA, 25 bp, Homo sapien
ttgctgttggaccagcgcagggctt

SEQ ID NO: 117995 - DNA, 25 bp, Homo sapien
ttgctgtttctcaatgattctcaca

SEQ ID NO: 117996 - DNA, 25 bp, Homo sapien
ttgctgtttctcattgattctcaca

SEQ ID NO: 117997 - DNA, 25 bp, Homo sapien
ttgctgtttgggtggttcaaccaag

SEQ ID NO: 117998 - DNA, 25 bp, Homo sapien
ttgctgtttgggttgttcaaccaag

SEQ ID NO: 117999 - DNA, 25 bp, Homo sapien
ttgctgttttaacctactgaggtct

SEQ ID NO: 118000 - DNA, 25 bp, Homo sapien
ttgctgttttaagctactgaggtct

SEQ ID NO: 118001 - DNA, 25 bp, Homo sapien
ttgcttacctctcctttacatcatt

SEQ ID NO: 118002 - DNA, 25 bp, Homo sapien
ttgcttacctctgctttacatcatt

SEQ ID NO: 118003 - DNA, 25 bp, Homo sapien
ttgcttagaagcgtaaggtttatcc

SEQ ID NO: 118004 - DNA, 25 bp, Homo sapien
ttgcttagaagcttaaggtttatcc

SEQ ID NO: 118005 - DNA, 25 bp, Homo sapien
ttgcttagattgggtcgtgttttcc

SEQ ID NO: 118006 - DNA, 25 bp, Homo sapien
ttgcttagcccatgcacacagcatc

SEQ ID NO: 118007 - DNA, 25 bp, Homo sapien
ttgcttagcccgtgcacacagcatc

SEQ ID NO: 118008 - DNA, 25 bp, Homo sapien
ttgcttaggttgggtcgtgttttcc

SEQ ID NO: 118009 - DNA, 25 bp, Homo sapien
ttgcttcattgagcaggcacagggg

SEQ ID NO: 118010 - DNA, 25 bp, Homo sapien
ttgcttcattgatcaggcacagggg

SEQ ID NO: 118011 - DNA, 25 bp, Homo sapien
ttgcttcattttacttatgtaagga

SEQ ID NO: 118012 - DNA, 25 bp, Homo sapien
ttgcttcattttacttctgtaagga

SEQ ID NO: 118013 - DNA, 25 bp, Homo sapien
ttgcttccatccatcaacccatttg

SEQ ID NO: 118014 - DNA, 25 bp, Homo sapien
ttgcttccatccgtcaacccatttg

SEQ ID NO: 118015 - DNA, 25 bp, Homo sapien
ttgcttcctacaaggtctggtgact

SEQ ID NO: 118016 - DNA, 25 bp, Homo sapien
ttgcttcctacagggtctggtgact

SEQ ID NO: 118017 - DNA, 25 bp, Homo sapien
ttgcttcgagtttgactttgaaatg

SEQ ID NO: 118018 - DNA, 25 bp, Homo sapien
ttgcttcgagttttactttgaaatg

SEQ ID NO: 118019 - DNA, 25 bp, Homo sapien
ttgcttctacttgcggtcacttata

SEQ ID NO: 118020 - DNA, 25 bp, Homo sapien
ttgcttctacttgctgtcacttata

SEQ ID NO: 118021 - DNA, 25 bp, Homo sapien
ttgcttctccattctacgggacatc

SEQ ID NO: 118022 - DNA, 25 bp, Homo sapien
ttgcttctccattctatgggacatc

SEQ ID NO: 118023 - DNA, 25 bp, Homo sapien
ttgcttctccctgaaaaaaagcaag

SEQ ID NO: 118024 - DNA, 25 bp, Homo sapien
ttgcttctccctgcaaaaaagcaag

SEQ ID NO: 118025 - DNA, 25 bp, Homo sapien
ttgcttctgccttccacttcccagg

SEQ ID NO: 118026 - DNA, 25 bp, Homo sapien
ttgcttctgccttctacttcccagg

SEQ ID NO: 118027 - DNA, 25 bp, Homo sapien
ttgcttcttcctagccaatctcctg

SEQ ID NO: 118028 - DNA, 25 bp, Homo sapien
ttgcttcttcctagtcaatctcctg

SEQ ID NO: 118029 - DNA, 25 bp, Homo sapien
ttgcttgacaacatgctttcccagg

SEQ ID NO: 118030 - DNA, 25 bp, Homo sapien
ttgcttgacaacgtgctttcccagg

SEQ ID NO: 118031 - DNA, 25 bp, Homo sapien
ttgcttgacctatgttttttgcatt

SEQ ID NO: 118032 - DNA, 25 bp, Homo sapien
ttgcttgacttatgttttttgcatt

SEQ ID NO: 118033 - DNA, 25 bp, Homo sapien
ttgcttgcctcataagacttccaag

SEQ ID NO: 118034 - DNA, 25 bp, Homo sapien
ttgcttgcctcgtaagacttccaag

SEQ ID NO: 118035 - DNA, 25 bp, Homo sapien
ttgcttgcggaacgcgttataaatg

SEQ ID NO: 118036 - DNA, 25 bp, Homo sapien
ttgcttgcggaacgtgttataaatg

SEQ ID NO: 118037 - DNA, 25 bp, Homo sapien
ttgcttggcctcggaacccaaaggt

SEQ ID NO: 118038 - DNA, 25 bp, Homo sapien
ttgcttggccttggaacccaaaggt

SEQ ID NO: 118039 - DNA, 25 bp, Homo sapien
ttgcttgtaaatcgatcgctttctt

SEQ ID NO: 118040 - DNA, 25 bp, Homo sapien
ttgcttgtaaatcgattgctttctt

SEQ ID NO: 118041 - DNA, 25 bp, Homo sapien
ttgctttaagacagtcctctgatac

SEQ ID NO: 118042 - DNA, 25 bp, Homo sapien
ttgctttaagatagtcctctgatac

SEQ ID NO: 118043 - DNA, 25 bp, Homo sapien
ttgctttaatagtaaggtgaaagcc

SEQ ID NO: 118044 - DNA, 25 bp, Homo sapien
ttgctttagtagtaaggtgaaagcc

SEQ ID NO: 118045 - DNA, 25 bp, Homo sapien
ttgctttatctccaatgtcactttt

SEQ ID NO: 118046 - DNA, 25 bp, Homo sapien
ttgctttatctcccatgtcactttt

SEQ ID NO: 118047 - DNA, 25 bp, Homo sapien
ttgctttatggttaagcatgtggtc

SEQ ID NO: 118048 - DNA, 25 bp, Homo sapien
ttgctttatggttaagtatgtggtc

SEQ ID NO: 118049 - DNA, 25 bp, Homo sapien
ttgctttcaggctgctttgataatg

SEQ ID NO: 118050 - DNA, 25 bp, Homo sapien
ttgctttcctgaaatcaatcagaag

SEQ ID NO: 118051 - DNA, 25 bp, Homo sapien
ttgctttcctgaagtcaatcagaag

SEQ ID NO: 118052 - DNA, 25 bp, Homo sapien
ttgctttcgggctgctttgataatg

SEQ ID NO: 118053 - DNA, 25 bp, Homo sapien
ttgctttctttcctgtattgattat

SEQ ID NO: 118054 - DNA, 25 bp, Homo sapien
ttgctttcttttctgtattgattat

SEQ ID NO: 118055 - DNA, 25 bp, Homo sapien
ttgctttgaagtattcttttattgc

SEQ ID NO: 118056 - DNA, 25 bp, Homo sapien
ttgctttgactaacagaatatcata

SEQ ID NO: 118057 - DNA, 25 bp, Homo sapien
ttgctttgactaatagaatatcata

SEQ ID NO: 118058 - DNA, 25 bp, Homo sapien
ttgctttgcaacatcacgacaaaca

SEQ ID NO: 118059 - DNA, 25 bp, Homo sapien
ttgctttgcaacatcatgacaaaca

SEQ ID NO: 118060 - DNA, 25 bp, Homo sapien
ttgctttgcagcagtcttcataatg

SEQ ID NO: 118061 - DNA, 25 bp, Homo sapien
ttgctttgcagcggtcttcataatg

SEQ ID NO: 118062 - DNA, 25 bp, Homo sapien
ttgctttgcagtattcttttattgc

SEQ ID NO: 118063 - DNA, 25 bp, Homo sapien
ttgctttgcatgctgtgtacgctta

SEQ ID NO: 118064 - DNA, 25 bp, Homo sapien
ttgctttgcatgttgtgtacgctta

SEQ ID NO: 118065 - DNA, 25 bp, Homo sapien
ttgctttttctactagcatagagag

SEQ ID NO: 118066 - DNA, 25 bp, Homo sapien
ttgctttttgtactagcatagagag

SEQ ID NO: 118067 - DNA, 25 bp, Homo sapien
ttggaaaaacagaaattaaaactac

SEQ ID NO: 118068 - DNA, 25 bp, Homo sapien
ttggaaaaatagaaattaaaactac

SEQ ID NO: 118069 - DNA, 25 bp, Homo sapien
ttggaaaacggtaaatgtaatctat

SEQ ID NO: 118070 - DNA, 25 bp, Homo sapien
ttggaaaactcaaaacatccacggg

SEQ ID NO: 118071 - DNA, 25 bp, Homo sapien
ttggaaaactcaaagcatccacggg

SEQ ID NO: 118072 - DNA, 25 bp, Homo sapien
ttggaaaagcttcataatagtttct

SEQ ID NO: 118073 - DNA, 25 bp, Homo sapien
ttggaaaagcttcatagtagtttct

SEQ ID NO: 118074 - DNA, 25 bp, Homo sapien
ttggaaaaggcctgccagtagagca

SEQ ID NO: 118075 - DNA, 25 bp, Homo sapien
ttggaaaaggcctgtcagtagagca

SEQ ID NO: 118076 - DNA, 25 bp, Homo sapien
ttggaaaatctggataatctcccca

SEQ ID NO: 118077 - DNA, 25 bp, Homo sapien
ttggaaaatctggatagtctcccca

SEQ ID NO: 118078 - DNA, 25 bp, Homo sapien
ttggaaaatgataccctacatacaa

SEQ ID NO: 118079 - DNA, 25 bp, Homo sapien
ttggaaaatgatactctacatacaa

SEQ ID NO: 118080 - DNA, 25 bp, Homo sapien
ttggaaaatggtaaatgtaatctat

SEQ ID NO: 118081 - DNA, 25 bp, Homo sapien
ttggaaacactataggaacaggtcc

SEQ ID NO: 118082 - DNA, 25 bp, Homo sapien
ttggaaacagtataggaacaggtcc

SEQ ID NO: 118083 - DNA, 25 bp, Homo sapien
ttggaaactcttccctttggagcag

SEQ ID NO: 118084 - DNA, 25 bp, Homo sapien
ttggaaactcttcgctttggagcag

SEQ ID NO: 118085 - DNA, 25 bp, Homo sapien
ttggaaactttaattgatgtaatta

SEQ ID NO: 118086 - DNA, 25 bp, Homo sapien
ttggaaactttagttgatgtaatta

SEQ ID NO: 118087 - DNA, 25 bp, Homo sapien
ttggaaagacatcagaaataccaag

SEQ ID NO: 118088 - DNA, 25 bp, Homo sapien
ttggaaagacatcggaaataccaag

SEQ ID NO: 118089 - DNA, 25 bp, Homo sapien
ttggaaagacattccatgaacaagg

SEQ ID NO: 118090 - DNA, 25 bp, Homo sapien
ttggaaagacatttcatgaacaagg

SEQ ID NO: 118091 - DNA, 25 bp, Homo sapien
ttggaaagccagatgggagtgactg

SEQ ID NO: 118092 - DNA, 25 bp, Homo sapien
ttggaaagccaggtgggagtgactg

SEQ ID NO: 118093 - DNA, 25 bp, Homo sapien
ttggaaataaggtgtacactgttta

SEQ ID NO: 118094 - DNA, 25 bp, Homo sapien
ttggaaatagggtgtacactgttta

SEQ ID NO: 118095 - DNA, 25 bp, Homo sapien
ttggaaatctacatgccactgtcac

SEQ ID NO: 118096 - DNA, 25 bp, Homo sapien
ttggaaatctacctgccactgtcac

SEQ ID NO: 118097 - DNA, 25 bp, Homo sapien
ttggaaattaaatgtctgagaacac

SEQ ID NO: 118098 - DNA, 25 bp, Homo sapien
ttggaaattaagtgtctgagaacac

SEQ ID NO: 118099 - DNA, 25 bp, Homo sapien
ttggaaattgatggcctcaaaagat

SEQ ID NO: 118100 - DNA, 25 bp, Homo sapien
ttggaaattgatggtctcaaaagat

SEQ ID NO: 118101 - DNA, 25 bp, Homo sapien
ttggaacacaatctaactgttgctt

SEQ ID NO: 118102 - DNA, 25 bp, Homo sapien
ttggaacacgatctaactgttgctt

SEQ ID NO: 118103 - DNA, 25 bp, Homo sapien
ttggaaccagtctgaataggaggat

SEQ ID NO: 118104 - DNA, 25 bp, Homo sapien
ttggaaccagtctggataggaggat

SEQ ID NO: 118105 - DNA, 25 bp, Homo sapien
ttggaacccatgctgtggtatcaat

SEQ ID NO: 118106 - DNA, 25 bp, Homo sapien
ttggaacccgtgctgtggtatcaat

SEQ ID NO: 118107 - DNA, 25 bp, Homo sapien
ttggaacttgttcttattagactct

SEQ ID NO: 118108 - DNA, 25 bp, Homo sapien
ttggaactttttcttattagactct

SEQ ID NO: 118109 - DNA, 25 bp, Homo sapien
ttggaagacaatctgacactttctt

SEQ ID NO: 118110 - DNA, 25 bp, Homo sapien
ttggaagacaatttgacactttctt

SEQ ID NO: 118111 - DNA, 25 bp, Homo sapien
ttggaagcgacttcgaaattattat

SEQ ID NO: 118112 - DNA, 25 bp, Homo sapien
ttggaagcgactttgaaattattat

SEQ ID NO: 118113 - DNA, 25 bp, Homo sapien
ttggaaggaagccaatcacagggtc

SEQ ID NO: 118114 - DNA, 25 bp, Homo sapien
ttggaaggaagccgatcacagggtc

SEQ ID NO: 118115 - DNA, 25 bp, Homo sapien
ttggaagtaataacaaaccagaaac

SEQ ID NO: 118116 - DNA, 25 bp, Homo sapien
ttggaagtaataagaaaccagaaac

SEQ ID NO: 118117 - DNA, 25 bp, Homo sapien
ttggaagtactctgcatcttgaata

SEQ ID NO: 118118 - DNA, 25 bp, Homo sapien
ttggaagtcacagaatgtcatttct

SEQ ID NO: 118119 - DNA, 25 bp, Homo sapien
ttggaagtcacataatgtcatttct

SEQ ID NO: 118120 - DNA, 25 bp, Homo sapien
ttggaagtgctctgcatcttgaata

SEQ ID NO: 118121 - DNA, 25 bp, Homo sapien
ttggaatacaataaaatgcttgcac

SEQ ID NO: 118122 - DNA, 25 bp, Homo sapien
ttggaatacaatagaatgcttgcac

SEQ ID NO: 118123 - DNA, 25 bp, Homo sapien
ttggaatcaagatagtttgggattg

SEQ ID NO: 118124 - DNA, 25 bp, Homo sapien
ttggaatcagccttctctgccacga

SEQ ID NO: 118125 - DNA, 25 bp, Homo sapien
ttggaatcagccttttctgccacga

SEQ ID NO: 118126 - DNA, 25 bp, Homo sapien
ttggaatcgagatagtttgggattg

SEQ ID NO: 118127 - DNA, 25 bp, Homo sapien
ttggaatctgaacccaacaggatca

SEQ ID NO: 118128 - DNA, 25 bp, Homo sapien
ttggaatctgaactcaacaggatca

SEQ ID NO: 118129 - DNA, 25 bp, Homo sapien
ttggaatgaaaccatactctgtttg

SEQ ID NO: 118130 - DNA, 25 bp, Homo sapien
ttggaatgaaactatactctgtttg

SEQ ID NO: 118131 - DNA, 25 bp, Homo sapien
ttggaattcttgacctggttaaggg

SEQ ID NO: 118132 - DNA, 25 bp, Homo sapien
ttggaattcttgacttggttaaggg

SEQ ID NO: 118133 - DNA, 25 bp, Homo sapien
ttggacaaaagacgataatgtttat

SEQ ID NO: 118134 - DNA, 25 bp, Homo sapien
ttggacaaaagatgataatgtttat

SEQ ID NO: 118135 - DNA, 25 bp, Homo sapien
ttggacacactgatcaatcatgccc

SEQ ID NO: 118136 - DNA, 25 bp, Homo sapien
ttggacactaccaatttcatgtatt

SEQ ID NO: 118137 - DNA, 25 bp, Homo sapien
ttggacactactaatttcatgtatt

SEQ ID NO: 118138 - DNA, 25 bp, Homo sapien
ttggacactctgatcaatcatgccc

SEQ ID NO: 118139 - DNA, 25 bp, Homo sapien
ttggacagcagaacgttaatcgaca

SEQ ID NO: 118140 - DNA, 25 bp, Homo sapien
ttggacagcagaatgttaatcgaca

SEQ ID NO: 118141 - DNA, 25 bp, Homo sapien
ttggacagcatatctgattggctac

SEQ ID NO: 118142 - DNA, 25 bp, Homo sapien
ttggacagcatatctggttggctac

SEQ ID NO: 118143 - DNA, 25 bp, Homo sapien
ttggacatatccttactgttcataa

SEQ ID NO: 118144 - DNA, 25 bp, Homo sapien
ttggacatcatctacatctggattc

SEQ ID NO: 118145 - DNA, 25 bp, Homo sapien
ttggacatcatctgcatctggattc

SEQ ID NO: 118146 - DNA, 25 bp, Homo sapien
ttggacatgtccttactgttcataa

SEQ ID NO: 118147 - DNA, 25 bp, Homo sapien
ttggacatttcccgttaggaaccac

SEQ ID NO: 118148 - DNA, 25 bp, Homo sapien
ttggacatttccctttaggaaccac

SEQ ID NO: 118149 - DNA, 25 bp, Homo sapien
ttggaccaaacttcctccttcactt

SEQ ID NO: 118150 - DNA, 25 bp, Homo sapien
ttggaccaaccttcctccttcactt

SEQ ID NO: 118151 - DNA, 25 bp, Homo sapien
ttggaccatattcatcttcatcttt

SEQ ID NO: 118152 - DNA, 25 bp, Homo sapien
ttggaccatattcttcttcatcttt

SEQ ID NO: 118153 - DNA, 25 bp, Homo sapien
ttggaccatcaatgctttcctaatt

SEQ ID NO: 118154 - DNA, 25 bp, Homo sapien
ttggaccatcagtgctttcctaatt

SEQ ID NO: 118155 - DNA, 25 bp, Homo sapien
ttggactcagggtttatactagcgg

SEQ ID NO: 118156 - DNA, 25 bp, Homo sapien
ttggactcaggttttatactagcgg

SEQ ID NO: 118157 - DNA, 25 bp, Homo sapien
ttggacttgcacgagacctgtatcc

SEQ ID NO: 118158 - DNA, 25 bp, Homo sapien
ttggacttgcacgggacctgtatcc

SEQ ID NO: 118159 - DNA, 25 bp, Homo sapien
ttggactttatacaggaaataattc

SEQ ID NO: 118160 - DNA, 25 bp, Homo sapien
ttggactttatagaggaaataattc

SEQ ID NO: 118161 - DNA, 25 bp, Homo sapien
ttggagaaattacctaatcagcctg

SEQ ID NO: 118162 - DNA, 25 bp, Homo sapien
ttggagaaattacttaatcagcctg

SEQ ID NO: 118163 - DNA, 25 bp, Homo sapien
ttggagaaatttacttgccttaaat

SEQ ID NO: 118164 - DNA, 25 bp, Homo sapien
ttggagaataacgaaagagaagtaa

SEQ ID NO: 118165 - DNA, 25 bp, Homo sapien
ttggagaataatgaaagagaagtaa

SEQ ID NO: 118166 - DNA, 25 bp, Homo sapien
ttggagaatcaattttagcctaacc

SEQ ID NO: 118167 - DNA, 25 bp, Homo sapien
ttggagaatgcaaaaaaatcaaaat

SEQ ID NO: 118168 - DNA, 25 bp, Homo sapien
ttggagaatgcagaaaaatcaaaat

SEQ ID NO: 118169 - DNA, 25 bp, Homo sapien
ttggagaattaattttagcctaacc

SEQ ID NO: 118170 - DNA, 25 bp, Homo sapien
ttggagaattttacttgccttaaat

SEQ ID NO: 118171 - DNA, 25 bp, Homo sapien
ttggagacttagccataaattattt

SEQ ID NO: 118172 - DNA, 25 bp, Homo sapien
ttggagacttagccgtaaattattt

SEQ ID NO: 118173 - DNA, 25 bp, Homo sapien
ttggagagaagacagatctaattcc

SEQ ID NO: 118174 - DNA, 25 bp, Homo sapien
ttggagagaagacggatctaattcc

SEQ ID NO: 118175 - DNA, 25 bp, Homo sapien
ttggagagattcatctacaagtcaa

SEQ ID NO: 118176 - DNA, 25 bp, Homo sapien
ttggagagattgatctacaagtcaa

SEQ ID NO: 118177 - DNA, 25 bp, Homo sapien
ttggagaggtataaaatgaggtctg

SEQ ID NO: 118178 - DNA, 25 bp, Homo sapien
ttggagagttataaaatgaggtctg

SEQ ID NO: 118179 - DNA, 25 bp, Homo sapien
ttggagatagagcctttcaagaaat

SEQ ID NO: 118180 - DNA, 25 bp, Homo sapien
ttggagatagaggctttcaagaaat

SEQ ID NO: 118181 - DNA, 25 bp, Homo sapien
ttggagatgatgatgaccttgaggc

SEQ ID NO: 118182 - DNA, 25 bp, Homo sapien
ttggagatggtgatgaccttgaggc

SEQ ID NO: 118183 - DNA, 25 bp, Homo sapien
ttggagcaaatgagactcagattaa

SEQ ID NO: 118184 - DNA, 25 bp, Homo sapien
ttggagcaactgagactcagattaa

SEQ ID NO: 118185 - DNA, 25 bp, Homo sapien
ttggagcaattatacatagtactgc

SEQ ID NO: 118186 - DNA, 25 bp, Homo sapien
ttggagcaattatagatagtactgc

SEQ ID NO: 118187 - DNA, 25 bp, Homo sapien
ttggagccacaatagaactgcgtta

SEQ ID NO: 118188 - DNA, 25 bp, Homo sapien
ttggagcctcaatagaactgcgtta

SEQ ID NO: 118189 - DNA, 25 bp, Homo sapien
ttggagctcaaggataaagaggaga

SEQ ID NO: 118190 - DNA, 25 bp, Homo sapien
ttggagctcaaggatagagaggaga

SEQ ID NO: 118191 - DNA, 25 bp, Homo sapien
ttggagcttcctcatctcccatttc

SEQ ID NO: 118192 - DNA, 25 bp, Homo sapien
ttggagcttcctcgtctcccatttc

SEQ ID NO: 118193 - DNA, 25 bp, Homo sapien
ttggaggaatgtaagaagaatctgc

SEQ ID NO: 118194 - DNA, 25 bp, Homo sapien
ttggaggaatgtaagaggaatctgc

SEQ ID NO: 118195 - DNA, 25 bp, Homo sapien
ttggaggctattttaacagtccagg

SEQ ID NO: 118196 - DNA, 25 bp, Homo sapien
ttggaggctattttaatagtccagg

SEQ ID NO: 118197 - DNA, 25 bp, Homo sapien
ttggaggtatgtacacattttccca

SEQ ID NO: 118198 - DNA, 25 bp, Homo sapien
ttggaggtatgtactcattttccca

SEQ ID NO: 118199 - DNA, 25 bp, Homo sapien
ttggagtacagcagaaccacaaact

SEQ ID NO: 118200 - DNA, 25 bp, Homo sapien
ttggagtactgcagaaccacaaact

SEQ ID NO: 118201 - DNA, 25 bp, Homo sapien
ttggagtcatgcaaccaattcacta

SEQ ID NO: 118202 - DNA, 25 bp, Homo sapien
ttggagtcgtgcaaccaattcacta

SEQ ID NO: 118203 - DNA, 25 bp, Homo sapien
ttggagttatagcatgagaggaaat

SEQ ID NO: 118204 - DNA, 25 bp, Homo sapien
ttggagttctagcatgagaggaaat

SEQ ID NO: 118205 - DNA, 25 bp, Homo sapien
ttggagttcttgcatttaagcctgt

SEQ ID NO: 118206 - DNA, 25 bp, Homo sapien
ttggagttcttgcgtttaagcctgt

SEQ ID NO: 118207 - DNA, 25 bp, Homo sapien
ttggagttgcacatgctattcatta

SEQ ID NO: 118208 - DNA, 25 bp, Homo sapien
ttggagttgcacctgctattcatta

SEQ ID NO: 118209 - DNA, 25 bp, Homo sapien
ttggataacgacagtgactaatgct

SEQ ID NO: 118210 - DNA, 25 bp, Homo sapien
ttggataactaatacttgtacacac

SEQ ID NO: 118211 - DNA, 25 bp, Homo sapien
ttggataactaatatttgtacacac

SEQ ID NO: 118212 - DNA, 25 bp, Homo sapien
ttggataagtgaaaacaatgacttt

SEQ ID NO: 118213 - DNA, 25 bp, Homo sapien
ttggataatgacagtgactaatgct

SEQ ID NO: 118214 - DNA, 25 bp, Homo sapien
ttggataattgaaaacaatgacttt

SEQ ID NO: 118215 - DNA, 25 bp, Homo sapien
ttggatactctgtgggtggtttggc

SEQ ID NO: 118216 - DNA, 25 bp, Homo sapien
ttggatactttgtgggtggtttggc

SEQ ID NO: 118217 - DNA, 25 bp, Homo sapien
ttggatactttttccagttgattct

SEQ ID NO: 118218 - DNA, 25 bp, Homo sapien
ttggatacttttttcagttgattct

SEQ ID NO: 118219 - DNA, 25 bp, Homo sapien
ttggataggtaacccacagtcacac

SEQ ID NO: 118220 - DNA, 25 bp, Homo sapien
ttggataggtaccccacagtcacac

SEQ ID NO: 118221 - DNA, 25 bp, Homo sapien
ttggatatgcctcacagttgcattg

SEQ ID NO: 118222 - DNA, 25 bp, Homo sapien
ttggatatgcctcgcagttgcattg

SEQ ID NO: 118223 - DNA, 25 bp, Homo sapien
ttggatatttggattccagtccttt

SEQ ID NO: 118224 - DNA, 25 bp, Homo sapien
ttggatatttgggttccagtccttt

SEQ ID NO: 118225 - DNA, 25 bp, Homo sapien
ttggatcagcggccaagcagggtcc

SEQ ID NO: 118226 - DNA, 25 bp, Homo sapien
ttggatcagtggccaagcagggtcc

SEQ ID NO: 118227 - DNA, 25 bp, Homo sapien
ttggatcttgatttgtacaaactgc

SEQ ID NO: 118228 - DNA, 25 bp, Homo sapien
ttggatcttgatttgtgcaaactgc

SEQ ID NO: 118229 - DNA, 25 bp, Homo sapien
ttggatgaaaggccagagttggtcc

SEQ ID NO: 118230 - DNA, 25 bp, Homo sapien
ttggatgaaaggtcagagttggtcc

SEQ ID NO: 118231 - DNA, 25 bp, Homo sapien
ttggatgaagcccagcaaattccta

SEQ ID NO: 118232 - DNA, 25 bp, Homo sapien
ttggatgaagcgcagcaaattccta

SEQ ID NO: 118233 - DNA, 25 bp, Homo sapien
ttggatgacagcatactaagacatt

SEQ ID NO: 118234 - DNA, 25 bp, Homo sapien
ttggatgacagcgtactaagacatt

SEQ ID NO: 118235 - DNA, 25 bp, Homo sapien
ttggatgcagatgacagagtgtgtc

SEQ ID NO: 118236 - DNA, 25 bp, Homo sapien
ttggatgcagatgagagagtgtgtc

SEQ ID NO: 118237 - DNA, 25 bp, Homo sapien
ttggattaaagacaattcatgcctc

SEQ ID NO: 118238 - DNA, 25 bp, Homo sapien
ttggattaaaggcaattcatgcctc

SEQ ID NO: 118239 - DNA, 25 bp, Homo sapien
ttggattacatacttcgaagtgact

SEQ ID NO: 118240 - DNA, 25 bp, Homo sapien
ttggattacatatttcgaagtgact

SEQ ID NO: 118241 - DNA, 25 bp, Homo sapien
ttggattagacaaacatttcttaga

SEQ ID NO: 118242 - DNA, 25 bp, Homo sapien
ttggattatacaaacatttcttaga

SEQ ID NO: 118243 - DNA, 25 bp, Homo sapien
ttggattgactaagtgtttatgatc

SEQ ID NO: 118244 - DNA, 25 bp, Homo sapien
ttggattgactcaaactcttttaaa

SEQ ID NO: 118245 - DNA, 25 bp, Homo sapien
ttggattgactgagtgtttatgatc

SEQ ID NO: 118246 - DNA, 25 bp, Homo sapien
ttggattgacttaaactcttttaaa

SEQ ID NO: 118247 - DNA, 25 bp, Homo sapien
ttggattgtatcttagacattgtgg

SEQ ID NO: 118248 - DNA, 25 bp, Homo sapien
ttggattgtatgttagacattgtgg

SEQ ID NO: 118249 - DNA, 25 bp, Homo sapien
ttggatttatttcactgatgcttta

SEQ ID NO: 118250 - DNA, 25 bp, Homo sapien
ttggatttatttcattgatgcttta

SEQ ID NO: 118251 - DNA, 25 bp, Homo sapien
ttggatttctttctccatggttaat

SEQ ID NO: 118252 - DNA, 25 bp, Homo sapien
ttggatttctttttccatggttaat

SEQ ID NO: 118253 - DNA, 25 bp, Homo sapien
ttggatttgtgaaagatggctatag

SEQ ID NO: 118254 - DNA, 25 bp, Homo sapien
ttggatttgtgaacgatggctatag

SEQ ID NO: 118255 - DNA, 25 bp, Homo sapien
ttggcaaaactagtgatggaggcat

SEQ ID NO: 118256 - DNA, 25 bp, Homo sapien
ttggcaaaccatgtgttgttattat

SEQ ID NO: 118257 - DNA, 25 bp, Homo sapien
ttggcaaactatgtgttgttattat

SEQ ID NO: 118258 - DNA, 25 bp, Homo sapien
ttggcaaagatggatcggagagtca

SEQ ID NO: 118259 - DNA, 25 bp, Homo sapien
ttggcaaagatggatctgagagtca

SEQ ID NO: 118260 - DNA, 25 bp, Homo sapien
ttggcaaagctagtgatggaggcat

SEQ ID NO: 118261 - DNA, 25 bp, Homo sapien
ttggcaaatactgagggcagggcct

SEQ ID NO: 118262 - DNA, 25 bp, Homo sapien
ttggcaaatacttagggcagggcct

SEQ ID NO: 118263 - DNA, 25 bp, Homo sapien
ttggcaaatttgtagacgtgaactg

SEQ ID NO: 118264 - DNA, 25 bp, Homo sapien
ttggcaaatttgtagatgtgaactg

SEQ ID NO: 118265 - DNA, 25 bp, Homo sapien
ttggcaacattgatcaccagagtta

SEQ ID NO: 118266 - DNA, 25 bp, Homo sapien
ttggcaacattgatcatcagagtta

SEQ ID NO: 118267 - DNA, 25 bp, Homo sapien
ttggcaactaatatcaccatgagac

SEQ ID NO: 118268 - DNA, 25 bp, Homo sapien
ttggcaactaatgtcaccatgagac

SEQ ID NO: 118269 - DNA, 25 bp, Homo sapien
ttggcaagtcgatatagccctatct

SEQ ID NO: 118270 - DNA, 25 bp, Homo sapien
ttggcaagtggatatagccctatct

SEQ ID NO: 118271 - DNA, 25 bp, Homo sapien
ttggcaataaaggtactgagcataa

SEQ ID NO: 118272 - DNA, 25 bp, Homo sapien
ttggcaataaaggttctgagcataa

SEQ ID NO: 118273 - DNA, 25 bp, Homo sapien
ttggcaattcctaataaagcaacat

SEQ ID NO: 118274 - DNA, 25 bp, Homo sapien
ttggcaattcctattaaagcaacat

SEQ ID NO: 118275 - DNA, 25 bp, Homo sapien
ttggcacaattttgcagaggataga

SEQ ID NO: 118276 - DNA, 25 bp, Homo sapien
ttggcacagttttgcagaggataga

SEQ ID NO: 118277 - DNA, 25 bp, Homo sapien
ttggcacatggatgaaagattgcag

SEQ ID NO: 118278 - DNA, 25 bp, Homo sapien
ttggcacatggatgaatgattgcag

SEQ ID NO: 118279 - DNA, 25 bp, Homo sapien
ttggcacctccaacagttttgctcc

SEQ ID NO: 118280 - DNA, 25 bp, Homo sapien
ttggcacctccaatagttttgctcc

SEQ ID NO: 118281 - DNA, 25 bp, Homo sapien
ttggcacgttacattataaccactc

SEQ ID NO: 118282 - DNA, 25 bp, Homo sapien
ttggcacgttacgttataaccactc

SEQ ID NO: 118283 - DNA, 25 bp, Homo sapien
ttggcagacttcctgtcgatgggcc

SEQ ID NO: 118284 - DNA, 25 bp, Homo sapien
ttggcagacttcctgttgatgggcc

SEQ ID NO: 118285 - DNA, 25 bp, Homo sapien
ttggcagagataaacaattaaattc

SEQ ID NO: 118286 - DNA, 25 bp, Homo sapien
ttggcagagataagcaattaaattc

SEQ ID NO: 118287 - DNA, 25 bp, Homo sapien
ttggcagttaccctttgtcaagtta

SEQ ID NO: 118288 - DNA, 25 bp, Homo sapien
ttggcagttactctttgtcaagtta

SEQ ID NO: 118289 - DNA, 25 bp, Homo sapien
ttggcataagagtctcagtctggat

SEQ ID NO: 118290 - DNA, 25 bp, Homo sapien
ttggcataagagtttcagtctggat

SEQ ID NO: 118291 - DNA, 25 bp, Homo sapien
ttggcatacacatacgagttgaaag

SEQ ID NO: 118292 - DNA, 25 bp, Homo sapien
ttggcatacgcatacgagttgaaag

SEQ ID NO: 118293 - DNA, 25 bp, Homo sapien
ttggcatcatacaataagtgacaaa

SEQ ID NO: 118294 - DNA, 25 bp, Homo sapien
ttggcatcatataataagtgacaaa

SEQ ID NO: 118295 - DNA, 25 bp, Homo sapien
ttggcatgccttatggcaatgtaga

SEQ ID NO: 118296 - DNA, 25 bp, Homo sapien
ttggcatgccttattgcaatgtaga

SEQ ID NO: 118297 - DNA, 25 bp, Homo sapien
ttggcattactaacgtctcctttct

SEQ ID NO: 118298 - DNA, 25 bp, Homo sapien
ttggcattactaatgtctcctttct

SEQ ID NO: 118299 - DNA, 25 bp, Homo sapien
ttggcattgatcaaacactttacta

SEQ ID NO: 118300 - DNA, 25 bp, Homo sapien
ttggcattgttcaaacactttacta

SEQ ID NO: 118301 - DNA, 25 bp, Homo sapien
ttggcatttacctacttcaaaacat

SEQ ID NO: 118302 - DNA, 25 bp, Homo sapien
ttggcatttacctgcttcaaaacat

SEQ ID NO: 118303 - DNA, 25 bp, Homo sapien
ttggccaaggacgtcgtagttggag

SEQ ID NO: 118304 - DNA, 25 bp, Homo sapien
ttggccaaggacttcgtagttggag

SEQ ID NO: 118305 - DNA, 25 bp, Homo sapien
ttggccacaccactctcgtaaaagt

SEQ ID NO: 118306 - DNA, 25 bp, Homo sapien
ttggccacaccactcttgtaaaagt

SEQ ID NO: 118307 - DNA, 25 bp, Homo sapien
ttggccactctgtcatgcttgaaaa

SEQ ID NO: 118308 - DNA, 25 bp, Homo sapien
ttggccactctgtcattcttgaaaa

SEQ ID NO: 118309 - DNA, 25 bp, Homo sapien
ttggccattatggtattgtccagtt

SEQ ID NO: 118310 - DNA, 25 bp, Homo sapien
ttggccattatgttattgtccagtt

SEQ ID NO: 118311 - DNA, 25 bp, Homo sapien
ttggcccaacaaaggttcagaaatg

SEQ ID NO: 118312 - DNA, 25 bp, Homo sapien
ttggcccaacaaagtttcagaaatg

SEQ ID NO: 118313 - DNA, 25 bp, Homo sapien
ttggccgtagcgttaagtgtcagaa

SEQ ID NO: 118314 - DNA, 25 bp, Homo sapien
ttggccgtagctttaagtgtcagaa

SEQ ID NO: 118315 - DNA, 25 bp, Homo sapien
ttggcctgaaacatcgttcatggtg

SEQ ID NO: 118316 - DNA, 25 bp, Homo sapien
ttggcctgaaacatggttcatggtg

SEQ ID NO: 118317 - DNA, 25 bp, Homo sapien
ttggccttccaggtggagactaagt

SEQ ID NO: 118318 - DNA, 25 bp, Homo sapien
ttggccttctccgagccgcaccttc

SEQ ID NO: 118319 - DNA, 25 bp, Homo sapien
ttggccttctccgagctgcaccttc

SEQ ID NO: 118320 - DNA, 25 bp, Homo sapien
ttggccttgatatttttctgtctga

SEQ ID NO: 118321 - DNA, 25 bp, Homo sapien
ttggccttgctatttttctgtctga

SEQ ID NO: 118322 - DNA, 25 bp, Homo sapien
ttggcctttcaggtggagactaagt

SEQ ID NO: 118323 - DNA, 25 bp, Homo sapien
ttggcgtaacatacatactattgat

SEQ ID NO: 118324 - DNA, 25 bp, Homo sapien
ttggcgtaacatatatactattgat

SEQ ID NO: 118325 - DNA, 25 bp, Homo sapien
ttggctagcttcatggcatctggat

SEQ ID NO: 118326 - DNA, 25 bp, Homo sapien
ttggctagcttcatggtatctggat

SEQ ID NO: 118327 - DNA, 25 bp, Homo sapien
ttggctaggaaaatgaatatttact

SEQ ID NO: 118328 - DNA, 25 bp, Homo sapien
ttggctaggaaagtgaatatttact

SEQ ID NO: 118329 - DNA, 25 bp, Homo sapien
ttggctccctgctcatatttaagag

SEQ ID NO: 118330 - DNA, 25 bp, Homo sapien
ttggctccctgttcatatttaagag

SEQ ID NO: 118331 - DNA, 25 bp, Homo sapien
ttggctcttcttagatgagacccaa

SEQ ID NO: 118332 - DNA, 25 bp, Homo sapien
ttggctcttcttcgatgagacccaa

SEQ ID NO: 118333 - DNA, 25 bp, Homo sapien
ttggctcttggccgtagaagagcat

SEQ ID NO: 118334 - DNA, 25 bp, Homo sapien
ttggctcttggctgtagaagagcat

SEQ ID NO: 118335 - DNA, 25 bp, Homo sapien
ttggctcttttgtcagacagcatgt

SEQ ID NO: 118336 - DNA, 25 bp, Homo sapien
ttggctcttttgtcaggcagcatgt

SEQ ID NO: 118337 - DNA, 25 bp, Homo sapien
ttggctgaactcttagagaggcagg

SEQ ID NO: 118338 - DNA, 25 bp, Homo sapien
ttggctgaactcttggagaggcagg

SEQ ID NO: 118339 - DNA, 25 bp, Homo sapien
ttggctgaagcaatacaaaaaggat

SEQ ID NO: 118340 - DNA, 25 bp, Homo sapien
ttggctgaagcaatacgaaaaggat

SEQ ID NO: 118341 - DNA, 25 bp, Homo sapien
ttggctgatggcagaaaattttttt

SEQ ID NO: 118342 - DNA, 25 bp, Homo sapien
ttggctgatggcagaatattttttt

SEQ ID NO: 118343 - DNA, 25 bp, Homo sapien
ttggctgcactttgaaggtaggaaa

SEQ ID NO: 118344 - DNA, 25 bp, Homo sapien
ttggctgcgctttgaaggtaggaaa

SEQ ID NO: 118345 - DNA, 25 bp, Homo sapien
ttggctgggaccggtcatgtgtctg

SEQ ID NO: 118346 - DNA, 25 bp, Homo sapien
ttggctgggactggtcatgtgtctg

SEQ ID NO: 118347 - DNA, 25 bp, Homo sapien
ttggctgtcagtgaagcggaagcag

SEQ ID NO: 118348 - DNA, 25 bp, Homo sapien
ttggctgttagtgaagcggaagcag

SEQ ID NO: 118349 - DNA, 25 bp, Homo sapien
ttggctgttgttctccagaaccctc

SEQ ID NO: 118350 - DNA, 25 bp, Homo sapien
ttggctgtttttctccagaaccctc

SEQ ID NO: 118351 - DNA, 25 bp, Homo sapien
ttggcttaagcatatatatgactcc

SEQ ID NO: 118352 - DNA, 25 bp, Homo sapien
ttggcttaagcgtatatatgactcc

SEQ ID NO: 118353 - DNA, 25 bp, Homo sapien
ttggcttacatgattgtgaggtcta

SEQ ID NO: 118354 - DNA, 25 bp, Homo sapien
ttggcttacgtgattgtgaggtcta

SEQ ID NO: 118355 - DNA, 25 bp, Homo sapien
ttggcttactcaaagcagagagtgc

SEQ ID NO: 118356 - DNA, 25 bp, Homo sapien
ttggcttattcaaagcagagagtgc

SEQ ID NO: 118357 - DNA, 25 bp, Homo sapien
ttggcttcaagacacatttaagaga

SEQ ID NO: 118358 - DNA, 25 bp, Homo sapien
ttggcttcaagacagatttaagaga

SEQ ID NO: 118359 - DNA, 25 bp, Homo sapien
ttggctttcattacacagtagctct

SEQ ID NO: 118360 - DNA, 25 bp, Homo sapien
ttggctttcattgcacagtagctct

SEQ ID NO: 118361 - DNA, 25 bp, Homo sapien
ttggcttttaacaacatggtagaac

SEQ ID NO: 118362 - DNA, 25 bp, Homo sapien
ttggctttttaagtgatagcttgct

SEQ ID NO: 118363 - DNA, 25 bp, Homo sapien
ttggctttttacaacatggtagaac

SEQ ID NO: 118364 - DNA, 25 bp, Homo sapien
ttggctttttaggtgatagcttgct

SEQ ID NO: 118365 - DNA, 25 bp, Homo sapien
ttggctttttttggtccaactctag

SEQ ID NO: 118366 - DNA, 25 bp, Homo sapien
ttggcttttttttgtccaactctag

SEQ ID NO: 118367 - DNA, 25 bp, Homo sapien
ttgggaaaaagctgagggttaggag

SEQ ID NO: 118368 - DNA, 25 bp, Homo sapien
ttgggaaaaagctgagtgttaggag

SEQ ID NO: 118369 - DNA, 25 bp, Homo sapien
ttgggaaaccttccatcccttgctc

SEQ ID NO: 118370 - DNA, 25 bp, Homo sapien
ttgggaaacgttccatcccttgctc

SEQ ID NO: 118371 - DNA, 25 bp, Homo sapien
ttgggaaattaatactagtctaaat

SEQ ID NO: 118372 - DNA, 25 bp, Homo sapien
ttgggaaattaatacttgtctaaat

SEQ ID NO: 118373 - DNA, 25 bp, Homo sapien
ttgggaaattgtagcgccttctaaa

SEQ ID NO: 118374 - DNA, 25 bp, Homo sapien
ttgggaaattgtagtgccttctaaa

SEQ ID NO: 118375 - DNA, 25 bp, Homo sapien
ttgggaacaagctgactcttggtaa

SEQ ID NO: 118376 - DNA, 25 bp, Homo sapien
ttgggaacaagctggctcttggtaa

SEQ ID NO: 118377 - DNA, 25 bp, Homo sapien
ttgggaagaaaacgtctgtattgaa

SEQ ID NO: 118378 - DNA, 25 bp, Homo sapien
ttgggaagaaaatgtctgtattgaa

SEQ ID NO: 118379 - DNA, 25 bp, Homo sapien
ttgggaatctttccaacaaaaaggt

SEQ ID NO: 118380 - DNA, 25 bp, Homo sapien
ttgggaatctttctaacaaaaaggt

SEQ ID NO: 118381 - DNA, 25 bp, Homo sapien
ttgggaatgcagacaactagcatgc

SEQ ID NO: 118382 - DNA, 25 bp, Homo sapien
ttgggaatgtagacaactagcatgc

SEQ ID NO: 118383 - DNA, 25 bp, Homo sapien
ttgggacactgacagccagacttat

SEQ ID NO: 118384 - DNA, 25 bp, Homo sapien
ttgggacactgacggccagacttat

SEQ ID NO: 118385 - DNA, 25 bp, Homo sapien
ttgggacactgttctttccacctaa

SEQ ID NO: 118386 - DNA, 25 bp, Homo sapien
ttgggacattgttctttccacctaa

SEQ ID NO: 118387 - DNA, 25 bp, Homo sapien
ttgggagaatataaagccaatgtac

SEQ ID NO: 118388 - DNA, 25 bp, Homo sapien
ttgggagaatatgaagccaatgtac

SEQ ID NO: 118389 - DNA, 25 bp, Homo sapien
ttgggagacctaacaggttttgaaa

SEQ ID NO: 118390 - DNA, 25 bp, Homo sapien
ttgggagacctgacaggttttgaaa

SEQ ID NO: 118391 - DNA, 25 bp, Homo sapien
ttgggagactgcagttggaggatga

SEQ ID NO: 118392 - DNA, 25 bp, Homo sapien
ttgggagactgcggttggaggatga

SEQ ID NO: 118393 - DNA, 25 bp, Homo sapien
ttgggagaggtaaagtgatctctca

SEQ ID NO: 118394 - DNA, 25 bp, Homo sapien
ttgggagaggtgaagtgatctctca

SEQ ID NO: 118395 - DNA, 25 bp, Homo sapien
ttgggaggaaagagagtaatgacgg

SEQ ID NO: 118396 - DNA, 25 bp, Homo sapien
ttgggaggaaagatagtaatgacgg

SEQ ID NO: 118397 - DNA, 25 bp, Homo sapien
ttgggaggaggcttcttattcatgc

SEQ ID NO: 118398 - DNA, 25 bp, Homo sapien
ttgggaggagggttcttattcatgc

SEQ ID NO: 118399 - DNA, 25 bp, Homo sapien
ttgggagggagccaccagcagcatc

SEQ ID NO: 118400 - DNA, 25 bp, Homo sapien
ttgggagggagccgccagcagcatc

SEQ ID NO: 118401 - DNA, 25 bp, Homo sapien
ttgggagtttctactgctctgatag

SEQ ID NO: 118402 - DNA, 25 bp, Homo sapien
ttgggagtttctcctgctctgatag

SEQ ID NO: 118403 - DNA, 25 bp, Homo sapien
ttgggataaatgcacacatgtcaag

SEQ ID NO: 118404 - DNA, 25 bp, Homo sapien
ttgggataaatgcacagatgtcaag

SEQ ID NO: 118405 - DNA, 25 bp, Homo sapien
ttgggataggattgctaagcttgat

SEQ ID NO: 118406 - DNA, 25 bp, Homo sapien
ttgggataggattgctgagcttgat

SEQ ID NO: 118407 - DNA, 25 bp, Homo sapien
ttgggatcctggctcagttaatgag

SEQ ID NO: 118408 - DNA, 25 bp, Homo sapien
ttgggatcctggcttagttaatgag

SEQ ID NO: 118409 - DNA, 25 bp, Homo sapien
ttgggatgaccccttgaataagtct

SEQ ID NO: 118410 - DNA, 25 bp, Homo sapien
ttgggatgactaaaaagttttggaa

SEQ ID NO: 118411 - DNA, 25 bp, Homo sapien
ttgggatgattaaaaagttttggaa

SEQ ID NO: 118412 - DNA, 25 bp, Homo sapien
ttgggatgcccccttgaataagtct

SEQ ID NO: 118413 - DNA, 25 bp, Homo sapien
ttgggcaaatagcctaccctttctc

SEQ ID NO: 118414 - DNA, 25 bp, Homo sapien
ttgggcaaatagcttaccctttctc

SEQ ID NO: 118415 - DNA, 25 bp, Homo sapien
ttgggcacaaataccacatattaca

SEQ ID NO: 118416 - DNA, 25 bp, Homo sapien
ttgggcacaaatcccacatattaca

SEQ ID NO: 118417 - DNA, 25 bp, Homo sapien
ttgggcatccaccgggagcttttct

SEQ ID NO: 118418 - DNA, 25 bp, Homo sapien
ttgggcatccactgggagcttttct

SEQ ID NO: 118419 - DNA, 25 bp, Homo sapien
ttgggccagaagaaagttctagata

SEQ ID NO: 118420 - DNA, 25 bp, Homo sapien
ttgggccagaaggaagttctagata

SEQ ID NO: 118421 - DNA, 25 bp, Homo sapien
ttgggccagactcttcctatgtggg

SEQ ID NO: 118422 - DNA, 25 bp, Homo sapien
ttgggccagacttttcctatgtggg

SEQ ID NO: 118423 - DNA, 25 bp, Homo sapien
ttgggccagtttccgattccttttc

SEQ ID NO: 118424 - DNA, 25 bp, Homo sapien
ttgggccagtttctgattccttttc

SEQ ID NO: 118425 - DNA, 25 bp, Homo sapien
ttgggctcattgctcaacttctctg

SEQ ID NO: 118426 - DNA, 25 bp, Homo sapien
ttgggctcattgctcagcttctctg

SEQ ID NO: 118427 - DNA, 25 bp, Homo sapien
ttgggcttcgaacgtaactgacatc

SEQ ID NO: 118428 - DNA, 25 bp, Homo sapien
ttgggcttcgaatgtaactgacatc

SEQ ID NO: 118429 - DNA, 25 bp, Homo sapien
ttgggctttccaggtctgccttctt

SEQ ID NO: 118430 - DNA, 25 bp, Homo sapien
ttgggctttccatgtctgccttctt

SEQ ID NO: 118431 - DNA, 25 bp, Homo sapien
ttgggcttttacttattattacagc

SEQ ID NO: 118432 - DNA, 25 bp, Homo sapien
ttgggcttttactttttattacagc

SEQ ID NO: 118433 - DNA, 25 bp, Homo sapien
ttggggaaattagtttgattttcta

SEQ ID NO: 118434 - DNA, 25 bp, Homo sapien
ttggggaaattattttgattttcta

SEQ ID NO: 118435 - DNA, 25 bp, Homo sapien
ttggggactcaattaatggaacata

SEQ ID NO: 118436 - DNA, 25 bp, Homo sapien
ttggggactgaattaatggaacata

SEQ ID NO: 118437 - DNA, 25 bp, Homo sapien
ttggggagaagacgcaatagctctg

SEQ ID NO: 118438 - DNA, 25 bp, Homo sapien
ttggggagaagatgcaatagctctg

SEQ ID NO: 118439 - DNA, 25 bp, Homo sapien
ttggggcatcgtgaatctccctagt

SEQ ID NO: 118440 - DNA, 25 bp, Homo sapien
ttggggcatcgtgactctccctagt

SEQ ID NO: 118441 - DNA, 25 bp, Homo sapien
ttggggcattggaaagtaattaggt

SEQ ID NO: 118442 - DNA, 25 bp, Homo sapien
ttggggcattgggaagtaattaggt

SEQ ID NO: 118443 - DNA, 25 bp, Homo sapien
ttgggggccttctctgattctgctc

SEQ ID NO: 118444 - DNA, 25 bp, Homo sapien
ttgggggccttctctgtttctgctc

SEQ ID NO: 118445 - DNA, 25 bp, Homo sapien
ttgggggctttctttagaatgactg

SEQ ID NO: 118446 - DNA, 25 bp, Homo sapien
ttgggggctttgtttagaatgactg

SEQ ID NO: 118447 - DNA, 25 bp, Homo sapien
ttgggggttaaggcttcaacatatg

SEQ ID NO: 118448 - DNA, 25 bp, Homo sapien
ttgggggttaaggcttgaacatatg

SEQ ID NO: 118449 - DNA, 25 bp, Homo sapien
ttggggtggttgcccagctcattag

SEQ ID NO: 118450 - DNA, 25 bp, Homo sapien
ttggggtggttggccagctcattag

SEQ ID NO: 118451 - DNA, 25 bp, Homo sapien
ttgggtaaagaaactgccaagcctt

SEQ ID NO: 118452 - DNA, 25 bp, Homo sapien
ttgggtaaggaaactgccaagcctt

SEQ ID NO: 118453 - DNA, 25 bp, Homo sapien
ttgggtagtcaacgcactttgttaa

SEQ ID NO: 118454 - DNA, 25 bp, Homo sapien
ttgggtagtcaatgcactttgttaa

SEQ ID NO: 118455 - DNA, 25 bp, Homo sapien
ttgggtcatggtgttttagtctttg

SEQ ID NO: 118456 - DNA, 25 bp, Homo sapien
ttgggtcatggttttttagtctttg

SEQ ID NO: 118457 - DNA, 25 bp, Homo sapien
ttgggtcctctatagcacttactag

SEQ ID NO: 118458 - DNA, 25 bp, Homo sapien
ttgggtcctctgtagcacttactag

SEQ ID NO: 118459 - DNA, 25 bp, Homo sapien
ttgggtgcagagtagatatggtttc

SEQ ID NO: 118460 - DNA, 25 bp, Homo sapien
ttgggtgcggagtagatatggtttc

SEQ ID NO: 118461 - DNA, 25 bp, Homo sapien
ttgggtggtggcaacacagacttgt

SEQ ID NO: 118462 - DNA, 25 bp, Homo sapien
ttgggtggtggctacacagacttgt

SEQ ID NO: 118463 - DNA, 25 bp, Homo sapien
ttgggtgtagacagtaaatacacat

SEQ ID NO: 118464 - DNA, 25 bp, Homo sapien
ttgggtgtagatagtaaatacacat

SEQ ID NO: 118465 - DNA, 25 bp, Homo sapien
ttgggtgtcagccccacagaggaga

SEQ ID NO: 118466 - DNA, 25 bp, Homo sapien
ttgggtgtcagccctacagaggaga

SEQ ID NO: 118467 - DNA, 25 bp, Homo sapien
ttgggttaggagaacaggcaaaatc

SEQ ID NO: 118468 - DNA, 25 bp, Homo sapien
ttgggttaggagaccaggcaaaatc

SEQ ID NO: 118469 - DNA, 25 bp, Homo sapien
ttgggttatgaaaagacatcctaac

SEQ ID NO: 118470 - DNA, 25 bp, Homo sapien
ttgggttatgaaaatacatcctaac

SEQ ID NO: 118471 - DNA, 25 bp, Homo sapien
ttgggttcatgacagtggctagagg

SEQ ID NO: 118472 - DNA, 25 bp, Homo sapien
ttgggttcatgaccgtggctagagg

SEQ ID NO: 118473 - DNA, 25 bp, Homo sapien
ttgggttctgagacatactggtttc

SEQ ID NO: 118474 - DNA, 25 bp, Homo sapien
ttgggttctgagacgtactggtttc

SEQ ID NO: 118475 - DNA, 25 bp, Homo sapien
ttggtaaaaaaaaagaatgtctcat

SEQ ID NO: 118476 - DNA, 25 bp, Homo sapien
ttggtaaaaaaaatgaatgtctcat

SEQ ID NO: 118477 - DNA, 25 bp, Homo sapien
ttggtacatatttaacagaggagtt

SEQ ID NO: 118478 - DNA, 25 bp, Homo sapien
ttggtacatatttagcagaggagtt

SEQ ID NO: 118479 - DNA, 25 bp, Homo sapien
ttggtaccccagcgggttcaacagg

SEQ ID NO: 118480 - DNA, 25 bp, Homo sapien
ttggtaccccagtgggttcaacagg

SEQ ID NO: 118481 - DNA, 25 bp, Homo sapien
ttggtacctccactgaattaaagat

SEQ ID NO: 118482 - DNA, 25 bp, Homo sapien
ttggtacctccattgaattaaagat

SEQ ID NO: 118483 - DNA, 25 bp, Homo sapien
ttggtacctgccacctcggcatcca

SEQ ID NO: 118484 - DNA, 25 bp, Homo sapien
ttggtacctgcctcctcggcatcca

SEQ ID NO: 118485 - DNA, 25 bp, Homo sapien
ttggtactattaactgccaaccact

SEQ ID NO: 118486 - DNA, 25 bp, Homo sapien
ttggtactgttaactgccaaccact

SEQ ID NO: 118487 - DNA, 25 bp, Homo sapien
ttggtagacagataactcagctttc

SEQ ID NO: 118488 - DNA, 25 bp, Homo sapien
ttggtagatagataactcagctttc

SEQ ID NO: 118489 - DNA, 25 bp, Homo sapien
ttggtagcgaaatgctatgagcata

SEQ ID NO: 118490 - DNA, 25 bp, Homo sapien
ttggtagcgaaatgctgtgagcata

SEQ ID NO: 118491 - DNA, 25 bp, Homo sapien
ttggtagtttgtacacgtagctatt

SEQ ID NO: 118492 - DNA, 25 bp, Homo sapien
ttggtagtttgtacacttagctatt

SEQ ID NO: 118493 - DNA, 25 bp, Homo sapien
ttggtatatgtttgcaatgagcatg

SEQ ID NO: 118494 - DNA, 25 bp, Homo sapien
ttggtatatgtttggaatgagcatg

SEQ ID NO: 118495 - DNA, 25 bp, Homo sapien
ttggtatcattagtttctgtgatca

SEQ ID NO: 118496 - DNA, 25 bp, Homo sapien
ttggtatcattattttctgtgatca

SEQ ID NO: 118497 - DNA, 25 bp, Homo sapien
ttggtattcaccggtgtgaccctag

SEQ ID NO: 118498 - DNA, 25 bp, Homo sapien
ttggtattcactggtgtgaccctag

SEQ ID NO: 118499 - DNA, 25 bp, Homo sapien
ttggtattgttcatcaattttaatt

SEQ ID NO: 118500 - DNA, 25 bp, Homo sapien
ttggtatttttcatcaattttaatt

SEQ ID NO: 118501 - DNA, 25 bp, Homo sapien
ttggtcaacatgcagatgactagaa

SEQ ID NO: 118502 - DNA, 25 bp, Homo sapien
ttggtcaacgtgcagatgactagaa

SEQ ID NO: 118503 - DNA, 25 bp, Homo sapien
ttggtcacaccaagaacgaaaggga

SEQ ID NO: 118504 - DNA, 25 bp, Homo sapien
ttggtcacaccaagaatgaaaggga

SEQ ID NO: 118505 - DNA, 25 bp, Homo sapien
ttggtcacacgagttatagctattt

SEQ ID NO: 118506 - DNA, 25 bp, Homo sapien
ttggtcacatgagttatagctattt

SEQ ID NO: 118507 - DNA, 25 bp, Homo sapien
ttggtcaccgcacaggaacagggag

SEQ ID NO: 118508 - DNA, 25 bp, Homo sapien
ttggtcactgcacaggaacagggag

SEQ ID NO: 118509 - DNA, 25 bp, Homo sapien
ttggtcagttgttacatatttgtgt

SEQ ID NO: 118510 - DNA, 25 bp, Homo sapien
ttggtcagttgttatatatttgtgt

SEQ ID NO: 118511 - DNA, 25 bp, Homo sapien
ttggtcattttgggttcatttgttg

SEQ ID NO: 118512 - DNA, 25 bp, Homo sapien
ttggtcattttgtgttcatttgttg

SEQ ID NO: 118513 - DNA, 25 bp, Homo sapien
ttggtccacctcatatcagatgaac

SEQ ID NO: 118514 - DNA, 25 bp, Homo sapien
ttggtccacctcatgtcagatgaac

SEQ ID NO: 118515 - DNA, 25 bp, Homo sapien
ttggtccactgacttatcttggcac

SEQ ID NO: 118516 - DNA, 25 bp, Homo sapien
ttggtccattgacttatcttggcac

SEQ ID NO: 118517 - DNA, 25 bp, Homo sapien
ttggtccttgaaacatttatcttct

SEQ ID NO: 118518 - DNA, 25 bp, Homo sapien
ttggtccttgaaacctttatcttct

SEQ ID NO: 118519 - DNA, 25 bp, Homo sapien
ttggtctggataaggtaactgccat

SEQ ID NO: 118520 - DNA, 25 bp, Homo sapien
ttggtctggataaggtcactgccat

SEQ ID NO: 118521 - DNA, 25 bp, Homo sapien
ttggtcttagggaaataaatcattg

SEQ ID NO: 118522 - DNA, 25 bp, Homo sapien
ttggtcttaggtaaataaatcattg

SEQ ID NO: 118523 - DNA, 25 bp, Homo sapien
ttggtcttcaatttccatatgaaga

SEQ ID NO: 118524 - DNA, 25 bp, Homo sapien
ttggtcttcaatttccttatgaaga

SEQ ID NO: 118525 - DNA, 25 bp, Homo sapien
ttggtcttcggcctcctgcttccac

SEQ ID NO: 118526 - DNA, 25 bp, Homo sapien
ttggtcttgagagtacatggcattt

SEQ ID NO: 118527 - DNA, 25 bp, Homo sapien
ttggtcttgagagtacgtggcattt

SEQ ID NO: 118528 - DNA, 25 bp, Homo sapien
ttggtctttggcctcctgcttccac

SEQ ID NO: 118529 - DNA, 25 bp, Homo sapien
ttggtgaaatgttacaaaatataga

SEQ ID NO: 118530 - DNA, 25 bp, Homo sapien
ttggtgaaatgttagaaaatataga

SEQ ID NO: 118531 - DNA, 25 bp, Homo sapien
ttggtgacaacatcactatttatat

SEQ ID NO: 118532 - DNA, 25 bp, Homo sapien
ttggtgacagcatcactatttatat

SEQ ID NO: 118533 - DNA, 25 bp, Homo sapien
ttggtgaccttaagtgagttgctca

SEQ ID NO: 118534 - DNA, 25 bp, Homo sapien
ttggtgaccttaattgagttgctca

SEQ ID NO: 118535 - DNA, 25 bp, Homo sapien
ttggtgagcatcatcactaaggcca

SEQ ID NO: 118536 - DNA, 25 bp, Homo sapien
ttggtgagcgtcatcactaaggcca

SEQ ID NO: 118537 - DNA, 25 bp, Homo sapien
ttggtgagggatcgtacggtatgaa

SEQ ID NO: 118538 - DNA, 25 bp, Homo sapien
ttggtgagggatcgtatggtatgaa

SEQ ID NO: 118539 - DNA, 25 bp, Homo sapien
ttggtgaggtatgcgttaaggtctt

SEQ ID NO: 118540 - DNA, 25 bp, Homo sapien
ttggtgaggtatgtgttaaggtctt

SEQ ID NO: 118541 - DNA, 25 bp, Homo sapien
ttggtgatcatacaaagctggtata

SEQ ID NO: 118542 - DNA, 25 bp, Homo sapien
ttggtgattatacaaagctggtata

SEQ ID NO: 118543 - DNA, 25 bp, Homo sapien
ttggtgcaaatgcaggtattgtaac

SEQ ID NO: 118544 - DNA, 25 bp, Homo sapien
ttggtgcaaattattttattgtctc

SEQ ID NO: 118545 - DNA, 25 bp, Homo sapien
ttggtgcaagttattttattgtctc

SEQ ID NO: 118546 - DNA, 25 bp, Homo sapien
ttggtgcagatgcaggtattgtaac

SEQ ID NO: 118547 - DNA, 25 bp, Homo sapien
ttggtgccaggaaccaaaccaaggc

SEQ ID NO: 118548 - DNA, 25 bp, Homo sapien
ttggtgccaggatccaaaccaaggc

SEQ ID NO: 118549 - DNA, 25 bp, Homo sapien
ttggtgctctaagaaccaagaaaac

SEQ ID NO: 118550 - DNA, 25 bp, Homo sapien
ttggtgctgcatttgtctataaatt

SEQ ID NO: 118551 - DNA, 25 bp, Homo sapien
ttggtgctgcatttgtttataaatt

SEQ ID NO: 118552 - DNA, 25 bp, Homo sapien
ttggtgctgtaagaaccaagaaaac

SEQ ID NO: 118553 - DNA, 25 bp, Homo sapien
ttggtgcttatgcatggagagagat

SEQ ID NO: 118554 - DNA, 25 bp, Homo sapien
ttggtgcttatgcttggagagagat

SEQ ID NO: 118555 - DNA, 25 bp, Homo sapien
ttggtggaaacattgctaacactgc

SEQ ID NO: 118556 - DNA, 25 bp, Homo sapien
ttggtggaaacgttgctaacactgc

SEQ ID NO: 118557 - DNA, 25 bp, Homo sapien
ttggtggacattaacggaatcacac

SEQ ID NO: 118558 - DNA, 25 bp, Homo sapien
ttggtggacattaatggaatcacac

SEQ ID NO: 118559 - DNA, 25 bp, Homo sapien
ttggtgggacgaaagaagcttgtga

SEQ ID NO: 118560 - DNA, 25 bp, Homo sapien
ttggtgggacgaatgaagcttgtga

SEQ ID NO: 118561 - DNA, 25 bp, Homo sapien
ttggtgggatttaaatcaaaccagt

SEQ ID NO: 118562 - DNA, 25 bp, Homo sapien
ttggtgggattttaatcaaaccagt

SEQ ID NO: 118563 - DNA, 25 bp, Homo sapien
ttggtggtggaacccgttctcactc

SEQ ID NO: 118564 - DNA, 25 bp, Homo sapien
ttggtggtggaacctgttctcactc

SEQ ID NO: 118565 - DNA, 25 bp, Homo sapien
ttggtggtgtttctttgagacagag

SEQ ID NO: 118566 - DNA, 25 bp, Homo sapien
ttggtggtgtttttttgagacagag

SEQ ID NO: 118567 - DNA, 25 bp, Homo sapien
ttggtgtacagaatattttaccacc

SEQ ID NO: 118568 - DNA, 25 bp, Homo sapien
ttggtgtacagattattttaccacc

SEQ ID NO: 118569 - DNA, 25 bp, Homo sapien
ttggtgtatctctccgttgtgaagt

SEQ ID NO: 118570 - DNA, 25 bp, Homo sapien
ttggtgtatttctccgttgtgaagt

SEQ ID NO: 118571 - DNA, 25 bp, Homo sapien
ttggtgtcatctttctttactaaga

SEQ ID NO: 118572 - DNA, 25 bp, Homo sapien
ttggtgtcctccttccctgtcctgc

SEQ ID NO: 118573 - DNA, 25 bp, Homo sapien
ttggtgtcctctttccctgtcctgc

SEQ ID NO: 118574 - DNA, 25 bp, Homo sapien
ttggtgtcgtctttctttactaaga

SEQ ID NO: 118575 - DNA, 25 bp, Homo sapien
ttggtgtctaggttaaacaactcaa

SEQ ID NO: 118576 - DNA, 25 bp, Homo sapien
ttggtgtctaggttaagcaactcaa

SEQ ID NO: 118577 - DNA, 25 bp, Homo sapien
ttggtgttgataggcaaataaataa

SEQ ID NO: 118578 - DNA, 25 bp, Homo sapien
ttggtgttgataggtaaataaataa

SEQ ID NO: 118579 - DNA, 25 bp, Homo sapien
ttggtgttggtgctggtagcactgg

SEQ ID NO: 118580 - DNA, 25 bp, Homo sapien
ttggtgtttctactctttagcatac

SEQ ID NO: 118581 - DNA, 25 bp, Homo sapien
ttggtgtttctactttttagcatac

SEQ ID NO: 118582 - DNA, 25 bp, Homo sapien
ttggtgtttgtgctggtagcactgg

SEQ ID NO: 118583 - DNA, 25 bp, Homo sapien
ttggttaacgtactcttatattcta

SEQ ID NO: 118584 - DNA, 25 bp, Homo sapien
ttggttaagagaaaggtatctccag

SEQ ID NO: 118585 - DNA, 25 bp, Homo sapien
ttggttaagagacaggtatctccag

SEQ ID NO: 118586 - DNA, 25 bp, Homo sapien
ttggttaatgtactcttatattcta

SEQ ID NO: 118587 - DNA, 25 bp, Homo sapien
ttggttatgtcacagccagtgggtt

SEQ ID NO: 118588 - DNA, 25 bp, Homo sapien
ttggttatgtcatagccagtgggtt

SEQ ID NO: 118589 - DNA, 25 bp, Homo sapien
ttggttattttctcatggcatgaca

SEQ ID NO: 118590 - DNA, 25 bp, Homo sapien
ttggttattttttcatggcatgaca

SEQ ID NO: 118591 - DNA, 25 bp, Homo sapien
ttggttatttttttaaggcaagtat

SEQ ID NO: 118592 - DNA, 25 bp, Homo sapien
ttggttatttttttaatgcaagtat

SEQ ID NO: 118593 - DNA, 25 bp, Homo sapien
ttggttcaatcatccgtctactatt

SEQ ID NO: 118594 - DNA, 25 bp, Homo sapien
ttggttcaatcgtccgtctactatt

SEQ ID NO: 118595 - DNA, 25 bp, Homo sapien
ttggttcacccaaaattgaactgcc

SEQ ID NO: 118596 - DNA, 25 bp, Homo sapien
ttggttcacgcaaaattgaactgcc

SEQ ID NO: 118597 - DNA, 25 bp, Homo sapien
ttggttgaattggatcagactgtgg

SEQ ID NO: 118598 - DNA, 25 bp, Homo sapien
ttggttgacatccacctgatcacca

SEQ ID NO: 118599 - DNA, 25 bp, Homo sapien
ttggttgacatcctcctgatcacca

SEQ ID NO: 118600 - DNA, 25 bp, Homo sapien
ttggttgacttggatcagactgtgg

SEQ ID NO: 118601 - DNA, 25 bp, Homo sapien
ttggttgatgtgtctacctgcactc

SEQ ID NO: 118602 - DNA, 25 bp, Homo sapien
ttggttgatgtgtctatctgcactc

SEQ ID NO: 118603 - DNA, 25 bp, Homo sapien
ttggttgctcctaatttgagtggac

SEQ ID NO: 118604 - DNA, 25 bp, Homo sapien
ttggttgctcctgatttgagtggac

SEQ ID NO: 118605 - DNA, 25 bp, Homo sapien
ttggttggatttgacttcttcttat

SEQ ID NO: 118606 - DNA, 25 bp, Homo sapien
ttggttggatttgatttcttcttat

SEQ ID NO: 118607 - DNA, 25 bp, Homo sapien
ttggtttacatgcagatgttttcaa

SEQ ID NO: 118608 - DNA, 25 bp, Homo sapien
ttggtttacgtgcagatgttttcaa

SEQ ID NO: 118609 - DNA, 25 bp, Homo sapien
ttggtttatggagacctggctaagg

SEQ ID NO: 118610 - DNA, 25 bp, Homo sapien
ttggtttatggagccctggctaagg

SEQ ID NO: 118611 - DNA, 25 bp, Homo sapien
ttggtttcaagaacattgaatgctt

SEQ ID NO: 118612 - DNA, 25 bp, Homo sapien
ttggtttcaagaccattgaatgctt

SEQ ID NO: 118613 - DNA, 25 bp, Homo sapien
ttggtttcaatgtttgatttagaaa

SEQ ID NO: 118614 - DNA, 25 bp, Homo sapien
ttggtttcagtgtttgatttagaaa

SEQ ID NO: 118615 - DNA, 25 bp, Homo sapien
ttggttttcccatcagcagatgtga

SEQ ID NO: 118616 - DNA, 25 bp, Homo sapien
ttggttttctcatcagcagatgtga

SEQ ID NO: 118617 - DNA, 25 bp, Homo sapien
ttggttttgagatgaaatggttcca

SEQ ID NO: 118618 - DNA, 25 bp, Homo sapien
ttggttttgagatgaagtggttcca

SEQ ID NO: 118619 - DNA, 25 bp, Homo sapien
ttggtttttgacatctgaaaagccc

SEQ ID NO: 118620 - DNA, 25 bp, Homo sapien
ttggtttttgacgtctgaaaagccc

SEQ ID NO: 118621 - DNA, 25 bp, Homo sapien
ttggtttttttattgcccagaccat

SEQ ID NO: 118622 - DNA, 25 bp, Homo sapien
ttggtttttttgttgcccagaccat

SEQ ID NO: 118623 - DNA, 25 bp, Homo sapien
ttgtaaaaataggtcattcttaaat

SEQ ID NO: 118624 - DNA, 25 bp, Homo sapien
ttgtaaaagtaggtcattcttaaat

SEQ ID NO: 118625 - DNA, 25 bp, Homo sapien
ttgtaaacattaatgccatccacaa

SEQ ID NO: 118626 - DNA, 25 bp, Homo sapien
ttgtaaaccgtacgccttgaccagt

SEQ ID NO: 118627 - DNA, 25 bp, Homo sapien
ttgtaaaccgtgcgccttgaccagt

SEQ ID NO: 118628 - DNA, 25 bp, Homo sapien
ttgtaaacgttaatgccatccacaa

SEQ ID NO: 118629 - DNA, 25 bp, Homo sapien
ttgtaaagacgagtgatgttatcgt

SEQ ID NO: 118630 - DNA, 25 bp, Homo sapien
ttgtaaagatgagtgatgttatcgt

SEQ ID NO: 118631 - DNA, 25 bp, Homo sapien
ttgtaaatcgatcgctttctttctg

SEQ ID NO: 118632 - DNA, 25 bp, Homo sapien
ttgtaaatcgattgctttctttctg

SEQ ID NO: 118633 - DNA, 25 bp, Homo sapien
ttgtaaattggcagtgtgtatggca

SEQ ID NO: 118634 - DNA, 25 bp, Homo sapien
ttgtaaattggtagtgtgtatggca

SEQ ID NO: 118635 - DNA, 25 bp, Homo sapien
ttgtaacaaaactcatacaagctct

SEQ ID NO: 118636 - DNA, 25 bp, Homo sapien
ttgtaacaaaattcatacaagctct

SEQ ID NO: 118637 - DNA, 25 bp, Homo sapien
ttgtaacaaggatgatgtaattttg

SEQ ID NO: 118638 - DNA, 25 bp, Homo sapien
ttgtaacaaggattatgtaattttg

SEQ ID NO: 118639 - DNA, 25 bp, Homo sapien
ttgtaacctttctctcaggctgctc

SEQ ID NO: 118640 - DNA, 25 bp, Homo sapien
ttgtaacctttctctccggctgctc

SEQ ID NO: 118641 - DNA, 25 bp, Homo sapien
ttgtaagaatgtacgggcattgaag

SEQ ID NO: 118642 - DNA, 25 bp, Homo sapien
ttgtaagaatgtactggcattgaag

SEQ ID NO: 118643 - DNA, 25 bp, Homo sapien
ttgtaaggaatatacattggacttg

SEQ ID NO: 118644 - DNA, 25 bp, Homo sapien
ttgtaaggagtatacattggacttg

SEQ ID NO: 118645 - DNA, 25 bp, Homo sapien
ttgtaagtccacacgctcaggtttg

SEQ ID NO: 118646 - DNA, 25 bp, Homo sapien
ttgtaagtccacatgctcaggtttg

SEQ ID NO: 118647 - DNA, 25 bp, Homo sapien
ttgtaataaatgcggacagactagg

SEQ ID NO: 118648 - DNA, 25 bp, Homo sapien
ttgtaataaatgtggacagactagg

SEQ ID NO: 118649 - DNA, 25 bp, Homo sapien
ttgtaatagcttcaacataaaagtc

SEQ ID NO: 118650 - DNA, 25 bp, Homo sapien
ttgtaatagcttcaacgtaaaagtc

SEQ ID NO: 118651 - DNA, 25 bp, Homo sapien
ttgtaatattcaaatgcccaactgc

SEQ ID NO: 118652 - DNA, 25 bp, Homo sapien
ttgtaatattcaagtgcccaactgc

SEQ ID NO: 118653 - DNA, 25 bp, Homo sapien
ttgtaatgagcattatgaagtttaa

SEQ ID NO: 118654 - DNA, 25 bp, Homo sapien
ttgtaatgagcattgtgaagtttaa

SEQ ID NO: 118655 - DNA, 25 bp, Homo sapien
ttgtaatgcatgacccaaagtgttc

SEQ ID NO: 118656 - DNA, 25 bp, Homo sapien
ttgtaatgcatgacccaaagtgttt

SEQ ID NO: 118657 - DNA, 25 bp, Homo sapien
ttgtaatgcatgtcccaaagtgttc

SEQ ID NO: 118658 - DNA, 25 bp, Homo sapien
ttgtaatgcatgtcccaaagtgttt

SEQ ID NO: 118659 - DNA, 25 bp, Homo sapien
ttgtaatttcagcagaaaaatctaa

SEQ ID NO: 118660 - DNA, 25 bp, Homo sapien
ttgtaatttcagtagaaaaatctaa

SEQ ID NO: 118661 - DNA, 25 bp, Homo sapien
ttgtaatttgcacacgtggagggag

SEQ ID NO: 118662 - DNA, 25 bp, Homo sapien
ttgtaatttgcacatgtggagggag

SEQ ID NO: 118663 - DNA, 25 bp, Homo sapien
ttgtacaacaaattacagggtcata

SEQ ID NO: 118664 - DNA, 25 bp, Homo sapien
ttgtacaacagcaatgacccaaacc

SEQ ID NO: 118665 - DNA, 25 bp, Homo sapien
ttgtacaacagcactgacccaaacc

SEQ ID NO: 118666 - DNA, 25 bp, Homo sapien
ttgtacaataaattacagggtcata

SEQ ID NO: 118667 - DNA, 25 bp, Homo sapien
ttgtacacaggtactgaaacatcac

SEQ ID NO: 118668 - DNA, 25 bp, Homo sapien
ttgtacacaggtattgaaacatcac

SEQ ID NO: 118669 - DNA, 25 bp, Homo sapien
ttgtacagtgcaacagtttcatagc

SEQ ID NO: 118670 - DNA, 25 bp, Homo sapien
ttgtacagtgcagcagtttcatagc

SEQ ID NO: 118671 - DNA, 25 bp, Homo sapien
ttgtacatcacattgccagatgaca

SEQ ID NO: 118672 - DNA, 25 bp, Homo sapien
ttgtacatccaactcgttgttttcc

SEQ ID NO: 118673 - DNA, 25 bp, Homo sapien
ttgtacatccacctcgttgttttcc

SEQ ID NO: 118674 - DNA, 25 bp, Homo sapien
ttgtacatctcattgccagatgaca

SEQ ID NO: 118675 - DNA, 25 bp, Homo sapien
ttgtaccctcatacacagctactgg

SEQ ID NO: 118676 - DNA, 25 bp, Homo sapien
ttgtaccctcatacaccgctactgg

SEQ ID NO: 118677 - DNA, 25 bp, Homo sapien
ttgtacctagttctatggttacctt

SEQ ID NO: 118678 - DNA, 25 bp, Homo sapien
ttgtacctggttctatggttacctt

SEQ ID NO: 118679 - DNA, 25 bp, Homo sapien
ttgtacctttcaatttcaacaaata

SEQ ID NO: 118680 - DNA, 25 bp, Homo sapien
ttgtacctttcattttcaacaaata

SEQ ID NO: 118681 - DNA, 25 bp, Homo sapien
ttgtacgctaggaattttctcatgg

SEQ ID NO: 118682 - DNA, 25 bp, Homo sapien
ttgtacgctaggcattttctcatgg

SEQ ID NO: 118683 - DNA, 25 bp, Homo sapien
ttgtactacaacaagattccactcc

SEQ ID NO: 118684 - DNA, 25 bp, Homo sapien
ttgtactacgacaagattccactcc

SEQ ID NO: 118685 - DNA, 25 bp, Homo sapien
ttgtactcaattagacatttgtcag

SEQ ID NO: 118686 - DNA, 25 bp, Homo sapien
ttgtactcaattagacttttgtcag

SEQ ID NO: 118687 - DNA, 25 bp, Homo sapien
ttgtactccaacatgctctatagtg

SEQ ID NO: 118688 - DNA, 25 bp, Homo sapien
ttgtactccactgcattcccagtac

SEQ ID NO: 118689 - DNA, 25 bp, Homo sapien
ttgtactccacttcattcccagtac

SEQ ID NO: 118690 - DNA, 25 bp, Homo sapien
ttgtactcccacatgctctatagtg

SEQ ID NO: 118691 - DNA, 25 bp, Homo sapien
ttgtactttaagtttgattgaccag

SEQ ID NO: 118692 - DNA, 25 bp, Homo sapien
ttgtactttgagtttgattgaccag

SEQ ID NO: 118693 - DNA, 25 bp, Homo sapien
ttgtagaaacacctagatttgcagg

SEQ ID NO: 118694 - DNA, 25 bp, Homo sapien
ttgtagaaaccacagagtgacaggt

SEQ ID NO: 118695 - DNA, 25 bp, Homo sapien
ttgtagaaaccacggagtgacaggt

SEQ ID NO: 118696 - DNA, 25 bp, Homo sapien
ttgtagaaaggagtgatgtgatctg

SEQ ID NO: 118697 - DNA, 25 bp, Homo sapien
ttgtagaaaggtgtgatgtgatctg

SEQ ID NO: 118698 - DNA, 25 bp, Homo sapien
ttgtagaaatacctagatttgcagg

SEQ ID NO: 118699 - DNA, 25 bp, Homo sapien
ttgtagaacatgttgaagatttggt

SEQ ID NO: 118700 - DNA, 25 bp, Homo sapien
ttgtagaagtagcttccagctctaa

SEQ ID NO: 118701 - DNA, 25 bp, Homo sapien
ttgtagaatatgttgaagatttggt

SEQ ID NO: 118702 - DNA, 25 bp, Homo sapien
ttgtagaattagcttccagctctaa

SEQ ID NO: 118703 - DNA, 25 bp, Homo sapien
ttgtagacagtccagatcctgtgtt

SEQ ID NO: 118704 - DNA, 25 bp, Homo sapien
ttgtagacataacatgcttattttg

SEQ ID NO: 118705 - DNA, 25 bp, Homo sapien
ttgtagacataatatgcttattttg

SEQ ID NO: 118706 - DNA, 25 bp, Homo sapien
ttgtagaccagaagagcaaaccagc

SEQ ID NO: 118707 - DNA, 25 bp, Homo sapien
ttgtagaccagaagagtaaaccagc

SEQ ID NO: 118708 - DNA, 25 bp, Homo sapien
ttgtagactgtccagatcctgtgtt

SEQ ID NO: 118709 - DNA, 25 bp, Homo sapien
ttgtagagtagaatgtattttatgt

SEQ ID NO: 118710 - DNA, 25 bp, Homo sapien
ttgtagagtagaatgtgttttatgt

SEQ ID NO: 118711 - DNA, 25 bp, Homo sapien
ttgtagagtgaaaattgagcaaatc

SEQ ID NO: 118712 - DNA, 25 bp, Homo sapien
ttgtagagtgaaagttgagcaaatc

SEQ ID NO: 118713 - DNA, 25 bp, Homo sapien
ttgtagatgttcatcaggcattgaa

SEQ ID NO: 118714 - DNA, 25 bp, Homo sapien
ttgtagatgttcgtcaggcattgaa

SEQ ID NO: 118715 - DNA, 25 bp, Homo sapien
ttgtagccagtgttgcgtgtcttag

SEQ ID NO: 118716 - DNA, 25 bp, Homo sapien
ttgtagccagtgtttcgtgtcttag

SEQ ID NO: 118717 - DNA, 25 bp, Homo sapien
ttgtagctagggcactgaagatatt

SEQ ID NO: 118718 - DNA, 25 bp, Homo sapien
ttgtagctggggcactgaagatatt

SEQ ID NO: 118719 - DNA, 25 bp, Homo sapien
ttgtagcttgaaatctcttatgatg

SEQ ID NO: 118720 - DNA, 25 bp, Homo sapien
ttgtagctttaaatctcttatgatg

SEQ ID NO: 118721 - DNA, 25 bp, Homo sapien
ttgtaggaggaacgagctggaaata

SEQ ID NO: 118722 - DNA, 25 bp, Homo sapien
ttgtaggaggaatgagctggaaata

SEQ ID NO: 118723 - DNA, 25 bp, Homo sapien
ttgtaggatcccgcaaagaacaact

SEQ ID NO: 118724 - DNA, 25 bp, Homo sapien
ttgtaggatcctgcaaagaacaact

SEQ ID NO: 118725 - DNA, 25 bp, Homo sapien
ttgtaggctcatatgtaaaagttgg

SEQ ID NO: 118726 - DNA, 25 bp, Homo sapien
ttgtaggctcatgtgtaaaagttgg

SEQ ID NO: 118727 - DNA, 25 bp, Homo sapien
ttgtaggtataactactgctaaata

SEQ ID NO: 118728 - DNA, 25 bp, Homo sapien
ttgtaggtataattactgctaaata

SEQ ID NO: 118729 - DNA, 25 bp, Homo sapien
ttgtaggtcaccgggtgcagaacca

SEQ ID NO: 118730 - DNA, 25 bp, Homo sapien
ttgtaggtcactgggtgcagaacca

SEQ ID NO: 118731 - DNA, 25 bp, Homo sapien
ttgtagtacgatattcccaaatgta

SEQ ID NO: 118732 - DNA, 25 bp, Homo sapien
ttgtagtatgatattcccaaatgta

SEQ ID NO: 118733 - DNA, 25 bp, Homo sapien
ttgtagtgcccattggaggttggca

SEQ ID NO: 118734 - DNA, 25 bp, Homo sapien
ttgtagtgccctttggaggttggca

SEQ ID NO: 118735 - DNA, 25 bp, Homo sapien
ttgtagttagaggcatcccagaaaa

SEQ ID NO: 118736 - DNA, 25 bp, Homo sapien
ttgtagttataggcatcccagaaaa

SEQ ID NO: 118737 - DNA, 25 bp, Homo sapien
ttgtagttcttctgtagattgtctt

SEQ ID NO: 118738 - DNA, 25 bp, Homo sapien
ttgtagttttgactgaatttcttag

SEQ ID NO: 118739 - DNA, 25 bp, Homo sapien
ttgtagttttgattgaatttcttag

SEQ ID NO: 118740 - DNA, 25 bp, Homo sapien
ttgtagtttttctgtagattgtctt

SEQ ID NO: 118741 - DNA, 25 bp, Homo sapien
ttgtatacctatgcctatcatattt

SEQ ID NO: 118742 - DNA, 25 bp, Homo sapien
ttgtatacctatgcttatcatattt

SEQ ID NO: 118743 - DNA, 25 bp, Homo sapien
ttgtatagttttacctcttatattt

SEQ ID NO: 118744 - DNA, 25 bp, Homo sapien
ttgtatagttttacctgttatattt

SEQ ID NO: 118745 - DNA, 25 bp, Homo sapien
ttgtatatcagagcatcaagaacac

SEQ ID NO: 118746 - DNA, 25 bp, Homo sapien
ttgtatatcagagcgtcaagaacac

SEQ ID NO: 118747 - DNA, 25 bp, Homo sapien
ttgtatatctgttcatattctgtct

SEQ ID NO: 118748 - DNA, 25 bp, Homo sapien
ttgtatatctgttcgtattctgtct

SEQ ID NO: 118749 - DNA, 25 bp, Homo sapien
ttgtatatgccattttataaccttt

SEQ ID NO: 118750 - DNA, 25 bp, Homo sapien
ttgtatatgccgttttataaccttt

SEQ ID NO: 118751 - DNA, 25 bp, Homo sapien
ttgtatcacataagaaagcacccct

SEQ ID NO: 118752 - DNA, 25 bp, Homo sapien
ttgtatcacctctttacactccaac

SEQ ID NO: 118753 - DNA, 25 bp, Homo sapien
ttgtatcacgtaagaaagcacccct

SEQ ID NO: 118754 - DNA, 25 bp, Homo sapien
ttgtatcagaagcgttttgtgtaaa

SEQ ID NO: 118755 - DNA, 25 bp, Homo sapien
ttgtatcagaagtgttttgtgtaaa

SEQ ID NO: 118756 - DNA, 25 bp, Homo sapien
ttgtatcagcttcctccattatctc

SEQ ID NO: 118757 - DNA, 25 bp, Homo sapien
ttgtatcagtttcctccattatctc

SEQ ID NO: 118758 - DNA, 25 bp, Homo sapien
ttgtatcatctctttacactccaac

SEQ ID NO: 118759 - DNA, 25 bp, Homo sapien
ttgtatccagtctgataggtgtgaa

SEQ ID NO: 118760 - DNA, 25 bp, Homo sapien
ttgtatccattctgataggtgtgaa

SEQ ID NO: 118761 - DNA, 25 bp, Homo sapien
ttgtatcccttgctgtgttcctcac

SEQ ID NO: 118762 - DNA, 25 bp, Homo sapien
ttgtatcctttgctgtgttcctcac

SEQ ID NO: 118763 - DNA, 25 bp, Homo sapien
ttgtatctctgcttaaataaccaag

SEQ ID NO: 118764 - DNA, 25 bp, Homo sapien
ttgtatctctgcttaagtaaccaag

SEQ ID NO: 118765 - DNA, 25 bp, Homo sapien
ttgtatctgtggtttaagcttttca

SEQ ID NO: 118766 - DNA, 25 bp, Homo sapien
ttgtatctgtggtttacgcttttca

SEQ ID NO: 118767 - DNA, 25 bp, Homo sapien
ttgtatgaacgctattgtgcccttg

SEQ ID NO: 118768 - DNA, 25 bp, Homo sapien
ttgtatgaatgctattgtgcccttg

SEQ ID NO: 118769 - DNA, 25 bp, Homo sapien
ttgtatgacccttagagaaaggagc

SEQ ID NO: 118770 - DNA, 25 bp, Homo sapien
ttgtatgactaaagaagatgagtag

SEQ ID NO: 118771 - DNA, 25 bp, Homo sapien
ttgtatgactcttagagaaaggagc

SEQ ID NO: 118772 - DNA, 25 bp, Homo sapien
ttgtatgagtaaagaagatgagtag

SEQ ID NO: 118773 - DNA, 25 bp, Homo sapien
ttgtatggatttaatgtaagtcttg

SEQ ID NO: 118774 - DNA, 25 bp, Homo sapien
ttgtatggatttagtgtaagtcttg

SEQ ID NO: 118775 - DNA, 25 bp, Homo sapien
ttgtatgtgaaacttttgaaacagt

SEQ ID NO: 118776 - DNA, 25 bp, Homo sapien
ttgtatgtgaaatttttgaaacagt

SEQ ID NO: 118777 - DNA, 25 bp, Homo sapien
ttgtattagaaagtttcaataaatt

SEQ ID NO: 118778 - DNA, 25 bp, Homo sapien
ttgtattagaaagtttgaataaatt

SEQ ID NO: 118779 - DNA, 25 bp, Homo sapien
ttgtattcattgaatggctattact

SEQ ID NO: 118780 - DNA, 25 bp, Homo sapien
ttgtattcattgagtggctattact

SEQ ID NO: 118781 - DNA, 25 bp, Homo sapien
ttgtattgcaatttcctggctttag

SEQ ID NO: 118782 - DNA, 25 bp, Homo sapien
ttgtattgccatttcctggctttag

SEQ ID NO: 118783 - DNA, 25 bp, Homo sapien
ttgtattgcttcatccctgccccat

SEQ ID NO: 118784 - DNA, 25 bp, Homo sapien
ttgtattgcttcgtccctgccccat

SEQ ID NO: 118785 - DNA, 25 bp, Homo sapien
ttgtattgtgtcaggagcagctcta

SEQ ID NO: 118786 - DNA, 25 bp, Homo sapien
ttgtattgtgtcgggagcagctcta

SEQ ID NO: 118787 - DNA, 25 bp, Homo sapien
ttgtattgttttgtctataactttg

SEQ ID NO: 118788 - DNA, 25 bp, Homo sapien
ttgtattgttttttctataactttg

SEQ ID NO: 118789 - DNA, 25 bp, Homo sapien
ttgtatttcagttgcatcagttgta

SEQ ID NO: 118790 - DNA, 25 bp, Homo sapien
ttgtatttctgatgttttaaaatgt

SEQ ID NO: 118791 - DNA, 25 bp, Homo sapien
ttgtatttctgctgttttaaaatgt

SEQ ID NO: 118792 - DNA, 25 bp, Homo sapien
ttgtatttgcagtcttctgctttat

SEQ ID NO: 118793 - DNA, 25 bp, Homo sapien
ttgtatttggatgtctggatctcta

SEQ ID NO: 118794 - DNA, 25 bp, Homo sapien
ttgtatttggatttctggatctcta

SEQ ID NO: 118795 - DNA, 25 bp, Homo sapien
ttgtattttagaagccacaagttta

SEQ ID NO: 118796 - DNA, 25 bp, Homo sapien
ttgtattttagaagccgcaagttta

SEQ ID NO: 118797 - DNA, 25 bp, Homo sapien
ttgtattttagttgcatcagttgta

SEQ ID NO: 118798 - DNA, 25 bp, Homo sapien
ttgtattttcagtcttctgctttat

SEQ ID NO: 118799 - DNA, 25 bp, Homo sapien
ttgtattttctacctaattggcaca

SEQ ID NO: 118800 - DNA, 25 bp, Homo sapien
ttgtattttctccctaattggcaca

SEQ ID NO: 118801 - DNA, 25 bp, Homo sapien
ttgtatttttcactttagattcatt

SEQ ID NO: 118802 - DNA, 25 bp, Homo sapien
ttgtatttttcattttagattcatt

SEQ ID NO: 118803 - DNA, 25 bp, Homo sapien
ttgtcaaaacggccatactaccaag

SEQ ID NO: 118804 - DNA, 25 bp, Homo sapien
ttgtcaaaagggccatactaccaag

SEQ ID NO: 118805 - DNA, 25 bp, Homo sapien
ttgtcaaacttctgagctgagagag

SEQ ID NO: 118806 - DNA, 25 bp, Homo sapien
ttgtcaaacttttgagctgagagag

SEQ ID NO: 118807 - DNA, 25 bp, Homo sapien
ttgtcaaaggtaaaatattctgccc

SEQ ID NO: 118808 - DNA, 25 bp, Homo sapien
ttgtcaaaggtagtatgagctctgc

SEQ ID NO: 118809 - DNA, 25 bp, Homo sapien
ttgtcaaaggtgaaatattctgccc

SEQ ID NO: 118810 - DNA, 25 bp, Homo sapien
ttgtcaaaggtggtatgagctctgc

SEQ ID NO: 118811 - DNA, 25 bp, Homo sapien
ttgtcaaatccaattatctgcttac

SEQ ID NO: 118812 - DNA, 25 bp, Homo sapien
ttgtcaaatccagttatctgcttac

SEQ ID NO: 118813 - DNA, 25 bp, Homo sapien
ttgtcaagtaccttctcaataacac

SEQ ID NO: 118814 - DNA, 25 bp, Homo sapien
ttgtcaagtaccttgtcaataacac

SEQ ID NO: 118815 - DNA, 25 bp, Homo sapien
ttgtcaagtggtcataatactaagc

SEQ ID NO: 118816 - DNA, 25 bp, Homo sapien
ttgtcaagttgtcataatactaagc

SEQ ID NO: 118817 - DNA, 25 bp, Homo sapien
ttgtcaatagcaaatgtttcaattg

SEQ ID NO: 118818 - DNA, 25 bp, Homo sapien
ttgtcaatagcaagtgtttcaattg

SEQ ID NO: 118819 - DNA, 25 bp, Homo sapien
ttgtcacaaatcaattaaccattaa

SEQ ID NO: 118820 - DNA, 25 bp, Homo sapien
ttgtcacaaatcaatttaccattaa

SEQ ID NO: 118821 - DNA, 25 bp, Homo sapien
ttgtcacaacttaggagatgcctct

SEQ ID NO: 118822 - DNA, 25 bp, Homo sapien
ttgtcacagcttaggagatgcctct

SEQ ID NO: 118823 - DNA, 25 bp, Homo sapien
ttgtcaccaccatttcaagagggag

SEQ ID NO: 118824 - DNA, 25 bp, Homo sapien
ttgtcaccaccgtttcaagagggag

SEQ ID NO: 118825 - DNA, 25 bp, Homo sapien
ttgtcactatttgacctgtctggca

SEQ ID NO: 118826 - DNA, 25 bp, Homo sapien
ttgtcactcaagtaatgcctatccc

SEQ ID NO: 118827 - DNA, 25 bp, Homo sapien
ttgtcacttaagtaatgcctatccc

SEQ ID NO: 118828 - DNA, 25 bp, Homo sapien
ttgtcactttttgacctgtctggca

SEQ ID NO: 118829 - DNA, 25 bp, Homo sapien
ttgtcagaaaacgaagtcattactg

SEQ ID NO: 118830 - DNA, 25 bp, Homo sapien
ttgtcagaaaagtagctttagccat

SEQ ID NO: 118831 - DNA, 25 bp, Homo sapien
ttgtcagaaaatgaagtcattactg

SEQ ID NO: 118832 - DNA, 25 bp, Homo sapien
ttgtcagagaaccaccagctccaac

SEQ ID NO: 118833 - DNA, 25 bp, Homo sapien
ttgtcagagaagcaccagctccaac

SEQ ID NO: 118834 - DNA, 25 bp, Homo sapien
ttgtcagagccttatcccagctgga

SEQ ID NO: 118835 - DNA, 25 bp, Homo sapien
ttgtcagataagtagctttagccat

SEQ ID NO: 118836 - DNA, 25 bp, Homo sapien
ttgtcagatccttatcccagctgga

SEQ ID NO: 118837 - DNA, 25 bp, Homo sapien
ttgtcaggcatttcacagctttgtg

SEQ ID NO: 118838 - DNA, 25 bp, Homo sapien
ttgtcaggcatttcgcagctttgtg

SEQ ID NO: 118839 - DNA, 25 bp, Homo sapien
ttgtcagggctctgctgtaaatcct

SEQ ID NO: 118840 - DNA, 25 bp, Homo sapien
ttgtcagggctttgctgtaaatcct

SEQ ID NO: 118841 - DNA, 25 bp, Homo sapien
ttgtcagtcatcacctttgtcaact

SEQ ID NO: 118842 - DNA, 25 bp, Homo sapien
ttgtcagtcgtcacctttgtcaact

SEQ ID NO: 118843 - DNA, 25 bp, Homo sapien
ttgtcagtcttacgatttctatttt

SEQ ID NO: 118844 - DNA, 25 bp, Homo sapien
ttgtcagtcttatgatttctatttt

SEQ ID NO: 118845 - DNA, 25 bp, Homo sapien
ttgtcagtgaccatatgttgcctgt

SEQ ID NO: 118846 - DNA, 25 bp, Homo sapien
ttgtcagtgaccatattttgcctgt

SEQ ID NO: 118847 - DNA, 25 bp, Homo sapien
ttgtcagtggaacctttcacattct

SEQ ID NO: 118848 - DNA, 25 bp, Homo sapien
ttgtcagtggaagctttcacattct

SEQ ID NO: 118849 - DNA, 25 bp, Homo sapien
ttgtcagtttccttatcacccaccc

SEQ ID NO: 118850 - DNA, 25 bp, Homo sapien
ttgtcagtttctttatcacccaccc

SEQ ID NO: 118851 - DNA, 25 bp, Homo sapien
ttgtcatattatctctaggcagtaa

SEQ ID NO: 118852 - DNA, 25 bp, Homo sapien
ttgtcatattatttctaggcagtaa

SEQ ID NO: 118853 - DNA, 25 bp, Homo sapien
ttgtcatattccaactttgtgtttc

SEQ ID NO: 118854 - DNA, 25 bp, Homo sapien
ttgtcatattccaattttgtgtttc

SEQ ID NO: 118855 - DNA, 25 bp, Homo sapien
ttgtcatcctgggaatcaaaatcag

SEQ ID NO: 118856 - DNA, 25 bp, Homo sapien
ttgtcatcctgggagtcaaaatcag

SEQ ID NO: 118857 - DNA, 25 bp, Homo sapien
ttgtcatcttaccctggaagtctcc

SEQ ID NO: 118858 - DNA, 25 bp, Homo sapien
ttgtcatcttaccttggaagtctcc

SEQ ID NO: 118859 - DNA, 25 bp, Homo sapien
ttgtcatcttggaacacatgaacat

SEQ ID NO: 118860 - DNA, 25 bp, Homo sapien
ttgtcatcttgggacacatgaacat

SEQ ID NO: 118861 - DNA, 25 bp, Homo sapien
ttgtcattactttcaaccccatctg

SEQ ID NO: 118862 - DNA, 25 bp, Homo sapien
ttgtcattactttcgaccccatctg

SEQ ID NO: 118863 - DNA, 25 bp, Homo sapien
ttgtcattcaggttaaagagaaacc

SEQ ID NO: 118864 - DNA, 25 bp, Homo sapien
ttgtcattcagtttaaagagaaacc

SEQ ID NO: 118865 - DNA, 25 bp, Homo sapien
ttgtcatttccatgttttctattta

SEQ ID NO: 118866 - DNA, 25 bp, Homo sapien
ttgtcatttccattttttctattta

SEQ ID NO: 118867 - DNA, 25 bp, Homo sapien
ttgtcatttcgggatgagaagttgt

SEQ ID NO: 118868 - DNA, 25 bp, Homo sapien
ttgtcatttgatctttgtaaatatc

SEQ ID NO: 118869 - DNA, 25 bp, Homo sapien
ttgtcatttgatgtttgtaaatatc

SEQ ID NO: 118870 - DNA, 25 bp, Homo sapien
ttgtcattttgggatgagaagttgt

SEQ ID NO: 118871 - DNA, 25 bp, Homo sapien
ttgtcatttttcatgacgaactttg

SEQ ID NO: 118872 - DNA, 25 bp, Homo sapien
ttgtcatttttcatgatgaactttg

SEQ ID NO: 118873 - DNA, 25 bp, Homo sapien
ttgtccaaaacaaacaaatattgca

SEQ ID NO: 118874 - DNA, 25 bp, Homo sapien
ttgtccaaaacaaccaaatattgca

SEQ ID NO: 118875 - DNA, 25 bp, Homo sapien
ttgtccaatacggtatccaccagcc

SEQ ID NO: 118876 - DNA, 25 bp, Homo sapien
ttgtccaatacggtgtccaccagcc

SEQ ID NO: 118877 - DNA, 25 bp, Homo sapien
ttgtccaggcgaacttgtgggaact

SEQ ID NO: 118878 - DNA, 25 bp, Homo sapien
ttgtccaggtgaacttgtgggaact

SEQ ID NO: 118879 - DNA, 25 bp, Homo sapien
ttgtccatatttccatgtattatac

SEQ ID NO: 118880 - DNA, 25 bp, Homo sapien
ttgtccatattttcatgtattatac

SEQ ID NO: 118881 - DNA, 25 bp, Homo sapien
ttgtcctatacctgtgaagatgagc

SEQ ID NO: 118882 - DNA, 25 bp, Homo sapien
ttgtcctatacgtgtgaagatgagc

SEQ ID NO: 118883 - DNA, 25 bp, Homo sapien
ttgtcctcaagatttcaaaagctaa

SEQ ID NO: 118884 - DNA, 25 bp, Homo sapien
ttgtcctcaaggtttcaaaagctaa

SEQ ID NO: 118885 - DNA, 25 bp, Homo sapien
ttgtcctcatacacttttgaattac

SEQ ID NO: 118886 - DNA, 25 bp, Homo sapien
ttgtcctcgtacacttttgaattac

SEQ ID NO: 118887 - DNA, 25 bp, Homo sapien
ttgtcctgctataagaagatggaag

SEQ ID NO: 118888 - DNA, 25 bp, Homo sapien
ttgtcctgctataataagatggaag

SEQ ID NO: 118889 - DNA, 25 bp, Homo sapien
ttgtcctggaggcatccgaaatcgg

SEQ ID NO: 118890 - DNA, 25 bp, Homo sapien
ttgtcctggaggcatcggaaatcgg

SEQ ID NO: 118891 - DNA, 25 bp, Homo sapien
ttgtccttgaagacctcctggaatg

SEQ ID NO: 118892 - DNA, 25 bp, Homo sapien
ttgtccttgcagacctcctggaatg

SEQ ID NO: 118893 - DNA, 25 bp, Homo sapien
ttgtccttgcagagctcctggaatg

SEQ ID NO: 118894 - DNA, 25 bp, Homo sapien
ttgtcctttattccatattaaaaca

SEQ ID NO: 118895 - DNA, 25 bp, Homo sapien
ttgtcctttattccgtattaaaaca

SEQ ID NO: 118896 - DNA, 25 bp, Homo sapien
ttgtcctttatttcggcagatgtta

SEQ ID NO: 118897 - DNA, 25 bp, Homo sapien
ttgtcctttattttggcagatgtta

SEQ ID NO: 118898 - DNA, 25 bp, Homo sapien
ttgtctacactgacaatctgttgtt

SEQ ID NO: 118899 - DNA, 25 bp, Homo sapien
ttgtctacattgacaatctgttgtt

SEQ ID NO: 118900 - DNA, 25 bp, Homo sapien
ttgtctagattggaacccctgcaca

SEQ ID NO: 118901 - DNA, 25 bp, Homo sapien
ttgtctagattgggacccctgcaca

SEQ ID NO: 118902 - DNA, 25 bp, Homo sapien
ttgtctaggcacattgtcccattag

SEQ ID NO: 118903 - DNA, 25 bp, Homo sapien
ttgtctagtcacattgtcccattag

SEQ ID NO: 118904 - DNA, 25 bp, Homo sapien
ttgtctagtttatcacttggacaac

SEQ ID NO: 118905 - DNA, 25 bp, Homo sapien
ttgtctagtttctcacttggacaac

SEQ ID NO: 118906 - DNA, 25 bp, Homo sapien
ttgtctcaggccgcatataaaatac

SEQ ID NO: 118907 - DNA, 25 bp, Homo sapien
ttgtctcaggctgcatataaaatac

SEQ ID NO: 118908 - DNA, 25 bp, Homo sapien
ttgtctccctcaaagcaaggccatt

SEQ ID NO: 118909 - DNA, 25 bp, Homo sapien
ttgtctccctcagagcaaggccatt

SEQ ID NO: 118910 - DNA, 25 bp, Homo sapien
ttgtctctactgctcacacaaccgg

SEQ ID NO: 118911 - DNA, 25 bp, Homo sapien
ttgtctctagtgctcacacaaccgg

SEQ ID NO: 118912 - DNA, 25 bp, Homo sapien
ttgtctcttgcacccagttcacaca

SEQ ID NO: 118913 - DNA, 25 bp, Homo sapien
ttgtctcttgcactcagttcacaca

SEQ ID NO: 118914 - DNA, 25 bp, Homo sapien
ttgtctgaaaagaaactaagcacgt

SEQ ID NO: 118915 - DNA, 25 bp, Homo sapien
ttgtctgaaaagatactaagcacgt

SEQ ID NO: 118916 - DNA, 25 bp, Homo sapien
ttgtctgcaggattcagcaccaaga

SEQ ID NO: 118917 - DNA, 25 bp, Homo sapien
ttgtctgcaggattcatcaccaaga

SEQ ID NO: 118918 - DNA, 25 bp, Homo sapien
ttgtctgcattcgttaaaggaaaac

SEQ ID NO: 118919 - DNA, 25 bp, Homo sapien
ttgtctgcatttgttaaaggaaaac

SEQ ID NO: 118920 - DNA, 25 bp, Homo sapien
ttgtctgcctgctttttgttgttgc

SEQ ID NO: 118921 - DNA, 25 bp, Homo sapien
ttgtctgcttgctttttgttgttgc

SEQ ID NO: 118922 - DNA, 25 bp, Homo sapien
ttgtctggtaaatgctgaccatttg

SEQ ID NO: 118923 - DNA, 25 bp, Homo sapien
ttgtctggtaaatgttgaccatttg

SEQ ID NO: 118924 - DNA, 25 bp, Homo sapien
ttgtctggtgatcattatttgcctg

SEQ ID NO: 118925 - DNA, 25 bp, Homo sapien
ttgtctggtgatgattatttgcctg

SEQ ID NO: 118926 - DNA, 25 bp, Homo sapien
ttgtctggtggacccactgtaatca

SEQ ID NO: 118927 - DNA, 25 bp, Homo sapien
ttgtctggtggacccattgtaatca

SEQ ID NO: 118928 - DNA, 25 bp, Homo sapien
ttgtctgtaatgatttagttttaat

SEQ ID NO: 118929 - DNA, 25 bp, Homo sapien
ttgtctgtaattatttagttttaat

SEQ ID NO: 118930 - DNA, 25 bp, Homo sapien
ttgtctgtaccagaaaattcctcca

SEQ ID NO: 118931 - DNA, 25 bp, Homo sapien
ttgtctgtacctgaaaattcctcca

SEQ ID NO: 118932 - DNA, 25 bp, Homo sapien
ttgtcttagtgacgatttttcttgt

SEQ ID NO: 118933 - DNA, 25 bp, Homo sapien
ttgtcttagtgatgatttttcttgt

SEQ ID NO: 118934 - DNA, 25 bp, Homo sapien
ttgtcttcaaaacatctgcattaag

SEQ ID NO: 118935 - DNA, 25 bp, Homo sapien
ttgtcttcaaaacgtctgcattaag

SEQ ID NO: 118936 - DNA, 25 bp, Homo sapien
ttgtcttcaatttagaaagctctat

SEQ ID NO: 118937 - DNA, 25 bp, Homo sapien
ttgtcttcatcacctacagctccgt

SEQ ID NO: 118938 - DNA, 25 bp, Homo sapien
ttgtcttcatcacctatagctccgt

SEQ ID NO: 118939 - DNA, 25 bp, Homo sapien
ttgtcttccatttagaaagctctat

SEQ ID NO: 118940 - DNA, 25 bp, Homo sapien
ttgtcttctaccacctgtatcattt

SEQ ID NO: 118941 - DNA, 25 bp, Homo sapien
ttgtcttctaccgcctgtatcattt

SEQ ID NO: 118942 - DNA, 25 bp, Homo sapien
ttgtcttctagcacatggggcagtg

SEQ ID NO: 118943 - DNA, 25 bp, Homo sapien
ttgtcttctagcgcatggggcagtg

SEQ ID NO: 118944 - DNA, 25 bp, Homo sapien
ttgtctttaccttcatcctgcaatt

SEQ ID NO: 118945 - DNA, 25 bp, Homo sapien
ttgtctttacctttatcctgcaatt

SEQ ID NO: 118946 - DNA, 25 bp, Homo sapien
ttgtctttggacattttcaccttta

SEQ ID NO: 118947 - DNA, 25 bp, Homo sapien
ttgtctttggacgttttcaccttta

SEQ ID NO: 118948 - DNA, 25 bp, Homo sapien
ttgtcttttcactactacacagtgc

SEQ ID NO: 118949 - DNA, 25 bp, Homo sapien
ttgtcttttcactactccacagtgc

SEQ ID NO: 118950 - DNA, 25 bp, Homo sapien
ttgtgaaaaaacattaagttaccag

SEQ ID NO: 118951 - DNA, 25 bp, Homo sapien
ttgtgaaaaaatattaagttaccag

SEQ ID NO: 118952 - DNA, 25 bp, Homo sapien
ttgtgaaatttgaccactaatgcaa

SEQ ID NO: 118953 - DNA, 25 bp, Homo sapien
ttgtgaaatttgatcactaatgcaa

SEQ ID NO: 118954 - DNA, 25 bp, Homo sapien
ttgtgaatactacataagtgagtac

SEQ ID NO: 118955 - DNA, 25 bp, Homo sapien
ttgtgaatattacataagtgagtac

SEQ ID NO: 118956 - DNA, 25 bp, Homo sapien
ttgtgaatcttagtaaataaaggtc

SEQ ID NO: 118957 - DNA, 25 bp, Homo sapien
ttgtgaatcttagtaagtaaaggtc

SEQ ID NO: 118958 - DNA, 25 bp, Homo sapien
ttgtgaatgcctgttaacttaggtc

SEQ ID NO: 118959 - DNA, 25 bp, Homo sapien
ttgtgaatgtctgttaacttaggtc

SEQ ID NO: 118960 - DNA, 25 bp, Homo sapien
ttgtgaattccaacatgctcagagt

SEQ ID NO: 118961 - DNA, 25 bp, Homo sapien
ttgtgaattccagcatgctcagagt

SEQ ID NO: 118962 - DNA, 25 bp, Homo sapien
ttgtgacagcaagctctaatcacac

SEQ ID NO: 118963 - DNA, 25 bp, Homo sapien
ttgtgacagcaatctctaatcacac

SEQ ID NO: 118964 - DNA, 25 bp, Homo sapien
ttgtgaccatacatttaaaaacaaa

SEQ ID NO: 118965 - DNA, 25 bp, Homo sapien
ttgtgaccatacgtttaaaaacaaa

SEQ ID NO: 118966 - DNA, 25 bp, Homo sapien
ttgtgaccttgcctcgtcagtgttc

SEQ ID NO: 118967 - DNA, 25 bp, Homo sapien
ttgtgaccttgccttgtcagtgttc

SEQ ID NO: 118968 - DNA, 25 bp, Homo sapien
ttgtgactcaataacatgaacaaca

SEQ ID NO: 118969 - DNA, 25 bp, Homo sapien
ttgtgactcaatcacatgaacaaca

SEQ ID NO: 118970 - DNA, 25 bp, Homo sapien
ttgtgactgtccttcccgaaagcag

SEQ ID NO: 118971 - DNA, 25 bp, Homo sapien
ttgtgactgtccttcctgaaagcag

SEQ ID NO: 118972 - DNA, 25 bp, Homo sapien
ttgtgacttgttatttttctttttt

SEQ ID NO: 118973 - DNA, 25 bp, Homo sapien
ttgtgacttgttctttttctttttt

SEQ ID NO: 118974 - DNA, 25 bp, Homo sapien
ttgtgagaatcctcttttacattct

SEQ ID NO: 118975 - DNA, 25 bp, Homo sapien
ttgtgagaccagacaaagatttaga

SEQ ID NO: 118976 - DNA, 25 bp, Homo sapien
ttgtgagacgcacaattcacagagg

SEQ ID NO: 118977 - DNA, 25 bp, Homo sapien
ttgtgagagtcctcttttacattct

SEQ ID NO: 118978 - DNA, 25 bp, Homo sapien
ttgtgagataagtctgcaaactgaa

SEQ ID NO: 118979 - DNA, 25 bp, Homo sapien
ttgtgagatcagacaaagatttaga

SEQ ID NO: 118980 - DNA, 25 bp, Homo sapien
ttgtgagatcagtctgcaaactgaa

SEQ ID NO: 118981 - DNA, 25 bp, Homo sapien
ttgtgagatgcacaattcacagagg

SEQ ID NO: 118982 - DNA, 25 bp, Homo sapien
ttgtgagcagtaggtcttgaaagtg

SEQ ID NO: 118983 - DNA, 25 bp, Homo sapien
ttgtgagcggtaggtcttgaaagtg

SEQ ID NO: 118984 - DNA, 25 bp, Homo sapien
ttgtgaggattggaatagaatatgg

SEQ ID NO: 118985 - DNA, 25 bp, Homo sapien
ttgtgaggattggcatagaatatgg

SEQ ID NO: 118986 - DNA, 25 bp, Homo sapien
ttgtgagtaatcaaacagttgataa

SEQ ID NO: 118987 - DNA, 25 bp, Homo sapien
ttgtgagtaatcagacagttgataa

SEQ ID NO: 118988 - DNA, 25 bp, Homo sapien
ttgtgagtattccggagacatggcc

SEQ ID NO: 118989 - DNA, 25 bp, Homo sapien
ttgtgagtattctggagacatggcc

SEQ ID NO: 118990 - DNA, 25 bp, Homo sapien
ttgtgagttctgaattggaagagca

SEQ ID NO: 118991 - DNA, 25 bp, Homo sapien
ttgtgagttctgaatttgaagagca

SEQ ID NO: 118992 - DNA, 25 bp, Homo sapien
ttgtgatagctccttgattttcggg

SEQ ID NO: 118993 - DNA, 25 bp, Homo sapien
ttgtgatatctccttgattttcggg

SEQ ID NO: 118994 - DNA, 25 bp, Homo sapien
ttgtgatccaagctgtagtccacag

SEQ ID NO: 118995 - DNA, 25 bp, Homo sapien
ttgtgatccaagctgtcgtccacag

SEQ ID NO: 118996 - DNA, 25 bp, Homo sapien
ttgtgatccccatcctcgacctcac

SEQ ID NO: 118997 - DNA, 25 bp, Homo sapien
ttgtgatccccatccttgacctcac

SEQ ID NO: 118998 - DNA, 25 bp, Homo sapien
ttgtgatctctaccactattttgga

SEQ ID NO: 118999 - DNA, 25 bp, Homo sapien
ttgtgatctctactactattttgga

SEQ ID NO: 119000 - DNA, 25 bp, Homo sapien
ttgtgattcacagatttaatcccag

SEQ ID NO: 119001 - DNA, 25 bp, Homo sapien
ttgtgattcacatatttaatcccag

SEQ ID NO: 119002 - DNA, 25 bp, Homo sapien
ttgtgattctaaatgacaggagcag

SEQ ID NO: 119003 - DNA, 25 bp, Homo sapien
ttgtgattctaaattacaggagcag

SEQ ID NO: 119004 - DNA, 25 bp, Homo sapien
ttgtgattgtttttgaactgggtgg

SEQ ID NO: 119005 - DNA, 25 bp, Homo sapien
ttgtgattgtttttgacctgggtgg

SEQ ID NO: 119006 - DNA, 25 bp, Homo sapien
ttgtgcaaatcctaggtgctcaata

SEQ ID NO: 119007 - DNA, 25 bp, Homo sapien
ttgtgcaaatcttaggtgctcaata

SEQ ID NO: 119008 - DNA, 25 bp, Homo sapien
ttgtgcaactcagtactttaacaag

SEQ ID NO: 119009 - DNA, 25 bp, Homo sapien
ttgtgcaactcagtgctttaacaag

SEQ ID NO: 119010 - DNA, 25 bp, Homo sapien
ttgtgcaactcgtgacttcatcatg

SEQ ID NO: 119011 - DNA, 25 bp, Homo sapien
ttgtgcaactcttgacttcatcatg

SEQ ID NO: 119012 - DNA, 25 bp, Homo sapien
ttgtgcacatgcccatctgtggcat

SEQ ID NO: 119013 - DNA, 25 bp, Homo sapien
ttgtgcacatgctcatctgtggcat

SEQ ID NO: 119014 - DNA, 25 bp, Homo sapien
ttgtgcaccaaagtatcatcctagt

SEQ ID NO: 119015 - DNA, 25 bp, Homo sapien
ttgtgcaccaaagtgtcatcctagt

SEQ ID NO: 119016 - DNA, 25 bp, Homo sapien
ttgtgcagaaaatcgtaagtagctg

SEQ ID NO: 119017 - DNA, 25 bp, Homo sapien
ttgtgcagaaaattgtaagtagctg

SEQ ID NO: 119018 - DNA, 25 bp, Homo sapien
ttgtgcaggaggccagctgccagtg

SEQ ID NO: 119019 - DNA, 25 bp, Homo sapien
ttgtgcaggaggccggctgccagtg

SEQ ID NO: 119020 - DNA, 25 bp, Homo sapien
ttgtgcatcgtatggttggcacaat

SEQ ID NO: 119021 - DNA, 25 bp, Homo sapien
ttgtgcatcttattccatggacatc

SEQ ID NO: 119022 - DNA, 25 bp, Homo sapien
ttgtgcatcttattccgtggacatc

SEQ ID NO: 119023 - DNA, 25 bp, Homo sapien
ttgtgcatgtccatcctccatattt

SEQ ID NO: 119024 - DNA, 25 bp, Homo sapien
ttgtgcatgtccgtcctccatattt

SEQ ID NO: 119025 - DNA, 25 bp, Homo sapien
ttgtgcattgtatggttggcacaat

SEQ ID NO: 119026 - DNA, 25 bp, Homo sapien
ttgtgccaactccgcaagaattgaa

SEQ ID NO: 119027 - DNA, 25 bp, Homo sapien
ttgtgccaactcctcaagaattgaa

SEQ ID NO: 119028 - DNA, 25 bp, Homo sapien
ttgtgccacaagaatgttaagttcc

SEQ ID NO: 119029 - DNA, 25 bp, Homo sapien
ttgtgccacaagcatgttaagttcc

SEQ ID NO: 119030 - DNA, 25 bp, Homo sapien
ttgtgccattgactatgttggttaa

SEQ ID NO: 119031 - DNA, 25 bp, Homo sapien
ttgtgccattgtctatgttggttaa

SEQ ID NO: 119032 - DNA, 25 bp, Homo sapien
ttgtgcccaagtgctcactagtcca

SEQ ID NO: 119033 - DNA, 25 bp, Homo sapien
ttgtgcccaagtgctcgctagtcca

SEQ ID NO: 119034 - DNA, 25 bp, Homo sapien
ttgtgcccttctgcgttttgctttg

SEQ ID NO: 119035 - DNA, 25 bp, Homo sapien
ttgtgcccttctgtgttttgctttg

SEQ ID NO: 119036 - DNA, 25 bp, Homo sapien
ttgtgcctcgattccagaagtagag

SEQ ID NO: 119037 - DNA, 25 bp, Homo sapien
ttgtgccttgattccagaagtagag

SEQ ID NO: 119038 - DNA, 25 bp, Homo sapien
ttgtgccttgtcaacatattagtct

SEQ ID NO: 119039 - DNA, 25 bp, Homo sapien
ttgtgccttttcaacatattagtct

SEQ ID NO: 119040 - DNA, 25 bp, Homo sapien
ttgtgcggccaagatgaattttgag

SEQ ID NO: 119041 - DNA, 25 bp, Homo sapien
ttgtgcggccaagatgcattttgag

SEQ ID NO: 119042 - DNA, 25 bp, Homo sapien
ttgtgctaacgatctctgtctcctt

SEQ ID NO: 119043 - DNA, 25 bp, Homo sapien
ttgtgctaatgatctctgtctcctt

SEQ ID NO: 119044 - DNA, 25 bp, Homo sapien
ttgtgctaggtgccctggaggaata

SEQ ID NO: 119045 - DNA, 25 bp, Homo sapien
ttgtgctaggtgtcctggaggaata

SEQ ID NO: 119046 - DNA, 25 bp, Homo sapien
ttgtgcttatttgaatgttctctcc

SEQ ID NO: 119047 - DNA, 25 bp, Homo sapien
ttgtgcttatttgagtgttctctcc

SEQ ID NO: 119048 - DNA, 25 bp, Homo sapien
ttgtggaaacaaacagaatgcactc

SEQ ID NO: 119049 - DNA, 25 bp, Homo sapien
ttgtggaagcaaacagaatgcactc

SEQ ID NO: 119050 - DNA, 25 bp, Homo sapien
ttgtggaatgagaaaggacttgttt

SEQ ID NO: 119051 - DNA, 25 bp, Homo sapien
ttgtggaatgagagaggacttgttt

SEQ ID NO: 119052 - DNA, 25 bp, Homo sapien
ttgtggagaccattttaaccattga

SEQ ID NO: 119053 - DNA, 25 bp, Homo sapien
ttgtggagaggtgacgaggaatact

SEQ ID NO: 119054 - DNA, 25 bp, Homo sapien
ttgtggagaggtgatgaggaatact

SEQ ID NO: 119055 - DNA, 25 bp, Homo sapien
ttgtggagatcattttaaccattga

SEQ ID NO: 119056 - DNA, 25 bp, Homo sapien
ttgtggagctgagtaataccctcat

SEQ ID NO: 119057 - DNA, 25 bp, Homo sapien
ttgtggagctgggtaataccctcat

SEQ ID NO: 119058 - DNA, 25 bp, Homo sapien
ttgtggatcataggcccccagcaag

SEQ ID NO: 119059 - DNA, 25 bp, Homo sapien
ttgtggatcatgggcccccagcaag

SEQ ID NO: 119060 - DNA, 25 bp, Homo sapien
ttgtggatgaggaactagaagattg

SEQ ID NO: 119061 - DNA, 25 bp, Homo sapien
ttgtggatgaggaacttgaagattg

SEQ ID NO: 119062 - DNA, 25 bp, Homo sapien
ttgtggatgtagaacctgtggatgc

SEQ ID NO: 119063 - DNA, 25 bp, Homo sapien
ttgtggatgtagaagctgtggatgc

SEQ ID NO: 119064 - DNA, 25 bp, Homo sapien
ttgtggcaaagaagatcacaataat

SEQ ID NO: 119065 - DNA, 25 bp, Homo sapien
ttgtggcaaagaggatcacaataat

SEQ ID NO: 119066 - DNA, 25 bp, Homo sapien
ttgtggcataacttgcggtccagta

SEQ ID NO: 119067 - DNA, 25 bp, Homo sapien
ttgtggcataatttgcggtccagta

SEQ ID NO: 119068 - DNA, 25 bp, Homo sapien
ttgtggccaaccaaaatctccatat

SEQ ID NO: 119069 - DNA, 25 bp, Homo sapien
ttgtggccaaccgaaatctccatat

SEQ ID NO: 119070 - DNA, 25 bp, Homo sapien
ttgtggccaccatgagttatgagag

SEQ ID NO: 119071 - DNA, 25 bp, Homo sapien
ttgtggccatcatgagttatgagag

SEQ ID NO: 119072 - DNA, 25 bp, Homo sapien
ttgtggcctttacttatgcagtata

SEQ ID NO: 119073 - DNA, 25 bp, Homo sapien
ttgtggcctttagttatgcagtata

SEQ ID NO: 119074 - DNA, 25 bp, Homo sapien
ttgtggctacaaactgaagaacaac

SEQ ID NO: 119075 - DNA, 25 bp, Homo sapien
ttgtggctgcaaactgaagaacaac

SEQ ID NO: 119076 - DNA, 25 bp, Homo sapien
ttgtgggaattttaagcattttatc

SEQ ID NO: 119077 - DNA, 25 bp, Homo sapien
ttgtgggagaacagttactatgatg

SEQ ID NO: 119078 - DNA, 25 bp, Homo sapien
ttgtgggagaacggttactatgatg

SEQ ID NO: 119079 - DNA, 25 bp, Homo sapien
ttgtgggagttttaagcattttatc

SEQ ID NO: 119080 - DNA, 25 bp, Homo sapien
ttgtgggcatttgagttttcaatgc

SEQ ID NO: 119081 - DNA, 25 bp, Homo sapien
ttgtgggcatttgcgttttcaatgc

SEQ ID NO: 119082 - DNA, 25 bp, Homo sapien
ttgtggtaacaacaatagagacctt

SEQ ID NO: 119083 - DNA, 25 bp, Homo sapien
ttgtggtaacagcaatagagacctt

SEQ ID NO: 119084 - DNA, 25 bp, Homo sapien
ttgtggtcaaaaaccacgagctaca

SEQ ID NO: 119085 - DNA, 25 bp, Homo sapien
ttgtggtcagaaaccacgagctaca

SEQ ID NO: 119086 - DNA, 25 bp, Homo sapien
ttgtggtcattctcctcactcgaaa

SEQ ID NO: 119087 - DNA, 25 bp, Homo sapien
ttgtggtcattttcctcactcgaaa

SEQ ID NO: 119088 - DNA, 25 bp, Homo sapien
ttgtggttaaaggtgaagatgtggt

SEQ ID NO: 119089 - DNA, 25 bp, Homo sapien
ttgtggttaaatgtgaagatgtggt

SEQ ID NO: 119090 - DNA, 25 bp, Homo sapien
ttgtggttcttgaattgtctaaatt

SEQ ID NO: 119091 - DNA, 25 bp, Homo sapien
ttgtggttgtgaccatgcccgagac

SEQ ID NO: 119092 - DNA, 25 bp, Homo sapien
ttgtggttgtgtccatgcccgagac

SEQ ID NO: 119093 - DNA, 25 bp, Homo sapien
ttgtggttgttgaattgtctaaatt

SEQ ID NO: 119094 - DNA, 25 bp, Homo sapien
ttgtgtaagataaatttccatcttt

SEQ ID NO: 119095 - DNA, 25 bp, Homo sapien
ttgtgtaagttaaatttccatcttt

SEQ ID NO: 119096 - DNA, 25 bp, Homo sapien
ttgtgtatagccagcaggatgaatt

SEQ ID NO: 119097 - DNA, 25 bp, Homo sapien
ttgtgtatagccagtaggatgaatt

SEQ ID NO: 119098 - DNA, 25 bp, Homo sapien
ttgtgtatgattttaactgtgggct

SEQ ID NO: 119099 - DNA, 25 bp, Homo sapien
ttgtgtatgcaatcaaacaaccaga

SEQ ID NO: 119100 - DNA, 25 bp, Homo sapien
ttgtgtatgcaattaaacaaccaga

SEQ ID NO: 119101 - DNA, 25 bp, Homo sapien
ttgtgtatgtttttaactgtgggct

SEQ ID NO: 119102 - DNA, 25 bp, Homo sapien
ttgtgtcacctatcagcgggctatt

SEQ ID NO: 119103 - DNA, 25 bp, Homo sapien
ttgtgtcacgtaaagtgctattaat

SEQ ID NO: 119104 - DNA, 25 bp, Homo sapien
ttgtgtcaggaaaagcctatttatt

SEQ ID NO: 119105 - DNA, 25 bp, Homo sapien
ttgtgtcaggaaaggcctatttatt

SEQ ID NO: 119106 - DNA, 25 bp, Homo sapien
ttgtgtcatctatcagcgggctatt

SEQ ID NO: 119107 - DNA, 25 bp, Homo sapien
ttgtgtcatgtaaagtgctattaat

SEQ ID NO: 119108 - DNA, 25 bp, Homo sapien
ttgtgtccatttactatgttgttgg

SEQ ID NO: 119109 - DNA, 25 bp, Homo sapien
ttgtgtccatttagtatgttgttgg

SEQ ID NO: 119110 - DNA, 25 bp, Homo sapien
ttgtgtcgtctataatgtcttgcag

SEQ ID NO: 119111 - DNA, 25 bp, Homo sapien
ttgtgtcgtctataatttcttgcag

SEQ ID NO: 119112 - DNA, 25 bp, Homo sapien
ttgtgtctgagctatgagaaatccc

SEQ ID NO: 119113 - DNA, 25 bp, Homo sapien
ttgtgtctgagctgtgagaaatccc

SEQ ID NO: 119114 - DNA, 25 bp, Homo sapien
ttgtgtctggtccgctacagtgaga

SEQ ID NO: 119115 - DNA, 25 bp, Homo sapien
ttgtgtctggtcctctacagtgaga

SEQ ID NO: 119116 - DNA, 25 bp, Homo sapien
ttgtgtcttgctgccttcagtcttg

SEQ ID NO: 119117 - DNA, 25 bp, Homo sapien
ttgtgtcttgctggcttcagtcttg

SEQ ID NO: 119118 - DNA, 25 bp, Homo sapien
ttgtgtggagccgttttcctgtagc

SEQ ID NO: 119119 - DNA, 25 bp, Homo sapien
ttgtgtggagctgttttcctgtagc

SEQ ID NO: 119120 - DNA, 25 bp, Homo sapien
ttgtgtggataagttttcaatttgg

SEQ ID NO: 119121 - DNA, 25 bp, Homo sapien
ttgtgtggataatttttcaatttgg

SEQ ID NO: 119122 - DNA, 25 bp, Homo sapien
ttgtgtgggcactaatccctttaga

SEQ ID NO: 119123 - DNA, 25 bp, Homo sapien
ttgtgtgggcactactccctttaga

SEQ ID NO: 119124 - DNA, 25 bp, Homo sapien
ttgtgtggtttacattggtagctta

SEQ ID NO: 119125 - DNA, 25 bp, Homo sapien
ttgtgtggtttacatttgtagctta

SEQ ID NO: 119126 - DNA, 25 bp, Homo sapien
ttgtgttgaaatttggccttcaata

SEQ ID NO: 119127 - DNA, 25 bp, Homo sapien
ttgtgttgaaatttggtcttcaata

SEQ ID NO: 119128 - DNA, 25 bp, Homo sapien
ttgtgttggcaagtcgatatagccc

SEQ ID NO: 119129 - DNA, 25 bp, Homo sapien
ttgtgttggcaagtggatatagccc

SEQ ID NO: 119130 - DNA, 25 bp, Homo sapien
ttgtgttgttctggctgtcaataat

SEQ ID NO: 119131 - DNA, 25 bp, Homo sapien
ttgtgttgttcttgctgtcaataat

SEQ ID NO: 119132 - DNA, 25 bp, Homo sapien
ttgtgtttacgcatttaccttcagg

SEQ ID NO: 119133 - DNA, 25 bp, Homo sapien
ttgtgtttaggctgtagctggcccc

SEQ ID NO: 119134 - DNA, 25 bp, Homo sapien
ttgtgtttaggttgtagctggcccc

SEQ ID NO: 119135 - DNA, 25 bp, Homo sapien
ttgtgtttatgcatttaccttcagg

SEQ ID NO: 119136 - DNA, 25 bp, Homo sapien
ttgtgtttcatgaatcctctcttag

SEQ ID NO: 119137 - DNA, 25 bp, Homo sapien
ttgtgtttcctcggatacagaaata

SEQ ID NO: 119138 - DNA, 25 bp, Homo sapien
ttgtgtttccttggatacagaaata

SEQ ID NO: 119139 - DNA, 25 bp, Homo sapien
ttgtgtttcttataatgcaacaaaa

SEQ ID NO: 119140 - DNA, 25 bp, Homo sapien
ttgtgtttgcttttccttgtctgtg

SEQ ID NO: 119141 - DNA, 25 bp, Homo sapien
ttgtgtttgttataatgcaacaaaa

SEQ ID NO: 119142 - DNA, 25 bp, Homo sapien
ttgtgtttgtttttccttgtctgtg

SEQ ID NO: 119143 - DNA, 25 bp, Homo sapien
ttgtgttttatgaatcctctcttag

SEQ ID NO: 119144 - DNA, 25 bp, Homo sapien
ttgtgttttccgctaggttgctttg

SEQ ID NO: 119145 - DNA, 25 bp, Homo sapien
ttgtgttttcctctaggttgctttg

SEQ ID NO: 119146 - DNA, 25 bp, Homo sapien
ttgtgttttctcaacgattcaacct

SEQ ID NO: 119147 - DNA, 25 bp, Homo sapien
ttgtgttttctcaatgattcaacct

SEQ ID NO: 119148 - DNA, 25 bp, Homo sapien
ttgtgtttttttccctacagaatga

SEQ ID NO: 119149 - DNA, 25 bp, Homo sapien
ttgtgtttttttcccttcagaatga

SEQ ID NO: 119150 - DNA, 25 bp, Homo sapien
ttgtgtttttttctgcagtgattca

SEQ ID NO: 119151 - DNA, 25 bp, Homo sapien
ttgtgtttttttctgcggtgattca

SEQ ID NO: 119152 - DNA, 25 bp, Homo sapien
ttgttaaacgctaatctcccacaca

SEQ ID NO: 119153 - DNA, 25 bp, Homo sapien
ttgttaaacttacctgataggattc

SEQ ID NO: 119154 - DNA, 25 bp, Homo sapien
ttgttaaacttatctgataggattc

SEQ ID NO: 119155 - DNA, 25 bp, Homo sapien
ttgttaaagcacacattgctgggcc

SEQ ID NO: 119156 - DNA, 25 bp, Homo sapien
ttgttaaagcacagattgctgggcc

SEQ ID NO: 119157 - DNA, 25 bp, Homo sapien
ttgttaaataatttctgagcagtat

SEQ ID NO: 119158 - DNA, 25 bp, Homo sapien
ttgttaaatacctaagcatctcaaa

SEQ ID NO: 119159 - DNA, 25 bp, Homo sapien
ttgttaaatacctaggcatctcaaa

SEQ ID NO: 119160 - DNA, 25 bp, Homo sapien
ttgttaaatgatttctgagcagtat

SEQ ID NO: 119161 - DNA, 25 bp, Homo sapien
ttgttaaatgctaatctcccacaca

SEQ ID NO: 119162 - DNA, 25 bp, Homo sapien
ttgttaactctcctgtgttcatctg

SEQ ID NO: 119163 - DNA, 25 bp, Homo sapien
ttgttaactctcttgtgttcatctg

SEQ ID NO: 119164 - DNA, 25 bp, Homo sapien
ttgttacattttaagagtgacaagc

SEQ ID NO: 119165 - DNA, 25 bp, Homo sapien
ttgttacattttacgagtgacaagc

SEQ ID NO: 119166 - DNA, 25 bp, Homo sapien
ttgttaccaatctgatgaggaaagc

SEQ ID NO: 119167 - DNA, 25 bp, Homo sapien
ttgttaccaatcttatgaggaaagc

SEQ ID NO: 119168 - DNA, 25 bp, Homo sapien
ttgttaccccggaatatgctgtgtt

SEQ ID NO: 119169 - DNA, 25 bp, Homo sapien
ttgttaccccgggatatgctgtgtt

SEQ ID NO: 119170 - DNA, 25 bp, Homo sapien
ttgttactacattgagatacaccag

SEQ ID NO: 119171 - DNA, 25 bp, Homo sapien
ttgttactacattgcgatacaccag

SEQ ID NO: 119172 - DNA, 25 bp, Homo sapien
ttgttactattagaacaggcttaca

SEQ ID NO: 119173 - DNA, 25 bp, Homo sapien
ttgttactattagaaccggcttaca

SEQ ID NO: 119174 - DNA, 25 bp, Homo sapien
ttgttactgacatgatgccccttca

SEQ ID NO: 119175 - DNA, 25 bp, Homo sapien
ttgttactgacattatgccccttca

SEQ ID NO: 119176 - DNA, 25 bp, Homo sapien
ttgttacttgtatcacataagaaag

SEQ ID NO: 119177 - DNA, 25 bp, Homo sapien
ttgttacttgtatcacgtaagaaag

SEQ ID NO: 119178 - DNA, 25 bp, Homo sapien
ttgttagagcaataaacattcttca

SEQ ID NO: 119179 - DNA, 25 bp, Homo sapien
ttgttagagcaataaagattcttca

SEQ ID NO: 119180 - DNA, 25 bp, Homo sapien
ttgttaggttgcactgtcctccttg

SEQ ID NO: 119181 - DNA, 25 bp, Homo sapien
ttgttaggttgcagtgtcctccttg

SEQ ID NO: 119182 - DNA, 25 bp, Homo sapien
ttgttaggtttgctctattctttat

SEQ ID NO: 119183 - DNA, 25 bp, Homo sapien
ttgttaggtttgctttattctttat

SEQ ID NO: 119184 - DNA, 25 bp, Homo sapien
ttgttagtgccatcccgtaagctat

SEQ ID NO: 119185 - DNA, 25 bp, Homo sapien
ttgttagtgtcatcccgtaagctat

SEQ ID NO: 119186 - DNA, 25 bp, Homo sapien
ttgttatacgcacaattctatgaat

SEQ ID NO: 119187 - DNA, 25 bp, Homo sapien
ttgttatagaataataaacgaatac

SEQ ID NO: 119188 - DNA, 25 bp, Homo sapien
ttgttatataataataaacgaatac

SEQ ID NO: 119189 - DNA, 25 bp, Homo sapien
ttgttatatgcacaattctatgaat

SEQ ID NO: 119190 - DNA, 25 bp, Homo sapien
ttgttatctgaggatgaaaaaatga

SEQ ID NO: 119191 - DNA, 25 bp, Homo sapien
ttgttatctgaggttgaaaaaatga

SEQ ID NO: 119192 - DNA, 25 bp, Homo sapien
ttgttatgacaggacacaaaggagg

SEQ ID NO: 119193 - DNA, 25 bp, Homo sapien
ttgttatgacagggcacaaaggagg

SEQ ID NO: 119194 - DNA, 25 bp, Homo sapien
ttgttatgcccactcttctgcccag

SEQ ID NO: 119195 - DNA, 25 bp, Homo sapien
ttgttatgcccacttttctgcccag

SEQ ID NO: 119196 - DNA, 25 bp, Homo sapien
ttgttattatccttccaaaaataga

SEQ ID NO: 119197 - DNA, 25 bp, Homo sapien
ttgttattatcgttccaaaaataga

SEQ ID NO: 119198 - DNA, 25 bp, Homo sapien
ttgttattcatgcaattcctgacaa

SEQ ID NO: 119199 - DNA, 25 bp, Homo sapien
ttgttattcatgcagttcctgacaa

SEQ ID NO: 119200 - DNA, 25 bp, Homo sapien
ttgttattgaggcctgtataacatt

SEQ ID NO: 119201 - DNA, 25 bp, Homo sapien
ttgttattgaggtctgtataacatt

SEQ ID NO: 119202 - DNA, 25 bp, Homo sapien
ttgttattttcttccgacctcatat

SEQ ID NO: 119203 - DNA, 25 bp, Homo sapien
ttgttattttcttctgacctcatat

SEQ ID NO: 119204 - DNA, 25 bp, Homo sapien
ttgttcaaagatatacgcatgagat

SEQ ID NO: 119205 - DNA, 25 bp, Homo sapien
ttgttcaaagatgtacgcatgagat

SEQ ID NO: 119206 - DNA, 25 bp, Homo sapien
ttgttcacactccactgtatccctg

SEQ ID NO: 119207 - DNA, 25 bp, Homo sapien
ttgttcacacttcactgtatccctg

SEQ ID NO: 119208 - DNA, 25 bp, Homo sapien
ttgttcacatttttaacagaagcat

SEQ ID NO: 119209 - DNA, 25 bp, Homo sapien
ttgttcacgtttttaacagaagcat

SEQ ID NO: 119210 - DNA, 25 bp, Homo sapien
ttgttcaggcaaagaagaaggagtt

SEQ ID NO: 119211 - DNA, 25 bp, Homo sapien
ttgttcaggcaaggaagaaggagtt

SEQ ID NO: 119212 - DNA, 25 bp, Homo sapien
ttgttcagtgttttatccccagatc

SEQ ID NO: 119213 - DNA, 25 bp, Homo sapien
ttgttcagtgttttgtccccagatc

SEQ ID NO: 119214 - DNA, 25 bp, Homo sapien
ttgttcatcactcccgattgctctc

SEQ ID NO: 119215 - DNA, 25 bp, Homo sapien
ttgttcatcactcctgattgctctc

SEQ ID NO: 119216 - DNA, 25 bp, Homo sapien
ttgttcatcgcctatcaagcactac

SEQ ID NO: 119217 - DNA, 25 bp, Homo sapien
ttgttcatgttgcaatttgagcgga

SEQ ID NO: 119218 - DNA, 25 bp, Homo sapien
ttgttcattcaataatgcctgtttt

SEQ ID NO: 119219 - DNA, 25 bp, Homo sapien
ttgttcattcaatattgcctgtttt

SEQ ID NO: 119220 - DNA, 25 bp, Homo sapien
ttgttcattcacttgctcaacaact

SEQ ID NO: 119221 - DNA, 25 bp, Homo sapien
ttgttcattcagttgctcaacaact

SEQ ID NO: 119222 - DNA, 25 bp, Homo sapien
ttgttcattgcctatcaagcactac

SEQ ID NO: 119223 - DNA, 25 bp, Homo sapien
ttgttcattttgcaatttgagcgga

SEQ ID NO: 119224 - DNA, 25 bp, Homo sapien
ttgttccaataaaacgttactaaaa

SEQ ID NO: 119225 - DNA, 25 bp, Homo sapien
ttgttccaatagaacgttactaaaa

SEQ ID NO: 119226 - DNA, 25 bp, Homo sapien
ttgttccatttcccttctctacttt

SEQ ID NO: 119227 - DNA, 25 bp, Homo sapien
ttgttccatttcctttctctacttt

SEQ ID NO: 119228 - DNA, 25 bp, Homo sapien
ttgttccgcctctagcactcttttg

SEQ ID NO: 119229 - DNA, 25 bp, Homo sapien
ttgttccgcctctagcgctcttttg

SEQ ID NO: 119230 - DNA, 25 bp, Homo sapien
ttgttcctagaccactctgaccttg

SEQ ID NO: 119231 - DNA, 25 bp, Homo sapien
ttgttcctagaccactttgaccttg

SEQ ID NO: 119232 - DNA, 25 bp, Homo sapien
ttgttcctgtcatgaatggagtctt

SEQ ID NO: 119233 - DNA, 25 bp, Homo sapien
ttgttcctgtcgtgaatggagtctt

SEQ ID NO: 119234 - DNA, 25 bp, Homo sapien
ttgttctcagcaaaaagcagcaata

SEQ ID NO: 119235 - DNA, 25 bp, Homo sapien
ttgttctcagcacaaagcagcaata

SEQ ID NO: 119236 - DNA, 25 bp, Homo sapien
ttgttctcgccacatcagtgttttt

SEQ ID NO: 119237 - DNA, 25 bp, Homo sapien
ttgttctcgccgcatcagtgttttt

SEQ ID NO: 119238 - DNA, 25 bp, Homo sapien
ttgttctctggcaatgtgaatattc

SEQ ID NO: 119239 - DNA, 25 bp, Homo sapien
ttgttctctggctatgtgaatattc

SEQ ID NO: 119240 - DNA, 25 bp, Homo sapien
ttgttctcttggcaagttcatagtc

SEQ ID NO: 119241 - DNA, 25 bp, Homo sapien
ttgttctcttggccagttcatagtc

SEQ ID NO: 119242 - DNA, 25 bp, Homo sapien
ttgttctctttccatctgggtctag

SEQ ID NO: 119243 - DNA, 25 bp, Homo sapien
ttgttctctttccgtctgggtctag

SEQ ID NO: 119244 - DNA, 25 bp, Homo sapien
ttgttctgaggatagtggcctttgt

SEQ ID NO: 119245 - DNA, 25 bp, Homo sapien
ttgttctgagggtagtggcctttgt

SEQ ID NO: 119246 - DNA, 25 bp, Homo sapien
ttgttcttactcctagatatttgat

SEQ ID NO: 119247 - DNA, 25 bp, Homo sapien
ttgttcttactgctagatatttgat

SEQ ID NO: 119248 - DNA, 25 bp, Homo sapien
ttgttcttagaataaatgacaataa

SEQ ID NO: 119249 - DNA, 25 bp, Homo sapien
ttgttcttagacaaggtgtgaagag

SEQ ID NO: 119250 - DNA, 25 bp, Homo sapien
ttgttcttagacaatgtgtgaagag

SEQ ID NO: 119251 - DNA, 25 bp, Homo sapien
ttgttcttagagtaaatgacaataa

SEQ ID NO: 119252 - DNA, 25 bp, Homo sapien
ttgttcttatttcttgcttgtgttg

SEQ ID NO: 119253 - DNA, 25 bp, Homo sapien
ttgttcttatttgttgcttgtgttg

SEQ ID NO: 119254 - DNA, 25 bp, Homo sapien
ttgttcttcaacgtcctactctgta

SEQ ID NO: 119255 - DNA, 25 bp, Homo sapien
ttgttcttcaatgtcctactctgta

SEQ ID NO: 119256 - DNA, 25 bp, Homo sapien
ttgttcttggacgcataaacaaaaa

SEQ ID NO: 119257 - DNA, 25 bp, Homo sapien
ttgttcttggaggcataaacaaaaa

SEQ ID NO: 119258 - DNA, 25 bp, Homo sapien
ttgttctttctcccagtctgaggtg

SEQ ID NO: 119259 - DNA, 25 bp, Homo sapien
ttgttctttttcccagtctgaggtg

SEQ ID NO: 119260 - DNA, 25 bp, Homo sapien
ttgttgaaatgacaaccaaggcttt

SEQ ID NO: 119261 - DNA, 25 bp, Homo sapien
ttgttgaaatgacgaccaaggcttt

SEQ ID NO: 119262 - DNA, 25 bp, Homo sapien
ttgttgaagatcaaatagttgcagg

SEQ ID NO: 119263 - DNA, 25 bp, Homo sapien
ttgttgaagatcaaatggttgcagg

SEQ ID NO: 119264 - DNA, 25 bp, Homo sapien
ttgttgaatctatcagtagtccctt

SEQ ID NO: 119265 - DNA, 25 bp, Homo sapien
ttgttgaatctcttcagtagctcat

SEQ ID NO: 119266 - DNA, 25 bp, Homo sapien
ttgttgaatctcttcattagctcat

SEQ ID NO: 119267 - DNA, 25 bp, Homo sapien
ttgttgaatgtatcagtagtccctt

SEQ ID NO: 119268 - DNA, 25 bp, Homo sapien
ttgttgagtaaataagtatcttgtt

SEQ ID NO: 119269 - DNA, 25 bp, Homo sapien
ttgttgagtaaatatgtatcttgtt

SEQ ID NO: 119270 - DNA, 25 bp, Homo sapien
ttgttgatgacagtctccaggccca

SEQ ID NO: 119271 - DNA, 25 bp, Homo sapien
ttgttgatgacggtctccaggccca

SEQ ID NO: 119272 - DNA, 25 bp, Homo sapien
ttgttgatgctaagcttgcatgtaa

SEQ ID NO: 119273 - DNA, 25 bp, Homo sapien
ttgttgatgctatgcttgcatgtaa

SEQ ID NO: 119274 - DNA, 25 bp, Homo sapien
ttgttgcactccatcacattaaaat

SEQ ID NO: 119275 - DNA, 25 bp, Homo sapien
ttgttgcactctatcacattaaaat

SEQ ID NO: 119276 - DNA, 25 bp, Homo sapien
ttgttgcccctgactcagattatga

SEQ ID NO: 119277 - DNA, 25 bp, Homo sapien
ttgttgcctataactgtaagacata

SEQ ID NO: 119278 - DNA, 25 bp, Homo sapien
ttgttgcctccacggactatgaagg

SEQ ID NO: 119279 - DNA, 25 bp, Homo sapien
ttgttgcctccagggactatgaagg

SEQ ID NO: 119280 - DNA, 25 bp, Homo sapien
ttgttgcctctgactcagattatga

SEQ ID NO: 119281 - DNA, 25 bp, Homo sapien
ttgttgcctgtaactgtaagacata

SEQ ID NO: 119282 - DNA, 25 bp, Homo sapien
ttgttgctcttgatggttttaatgc

SEQ ID NO: 119283 - DNA, 25 bp, Homo sapien
ttgttgcttagacaatgcctagtcc

SEQ ID NO: 119284 - DNA, 25 bp, Homo sapien
ttgttgcttagaccatgcctagtcc

SEQ ID NO: 119285 - DNA, 25 bp, Homo sapien
ttgttgcttcgagtttgactttgaa

SEQ ID NO: 119286 - DNA, 25 bp, Homo sapien
ttgttgcttcgagttttactttgaa

SEQ ID NO: 119287 - DNA, 25 bp, Homo sapien
ttgttgcttttgatggttttaatgc

SEQ ID NO: 119288 - DNA, 25 bp, Homo sapien
ttgttggactgtacttcctcactcc

SEQ ID NO: 119289 - DNA, 25 bp, Homo sapien
ttgttggactgtatttcctcactcc

SEQ ID NO: 119290 - DNA, 25 bp, Homo sapien
ttgttggagagaaaggttacagaca

SEQ ID NO: 119291 - DNA, 25 bp, Homo sapien
ttgttggagcgaaaggttacagaca

SEQ ID NO: 119292 - DNA, 25 bp, Homo sapien
ttgttggatcagcggccaagcaggg

SEQ ID NO: 119293 - DNA, 25 bp, Homo sapien
ttgttggatcagtggccaagcaggg

SEQ ID NO: 119294 - DNA, 25 bp, Homo sapien
ttgttggattgactcaaactctttt

SEQ ID NO: 119295 - DNA, 25 bp, Homo sapien
ttgttggattgacttaaactctttt

SEQ ID NO: 119296 - DNA, 25 bp, Homo sapien
ttgttggcatttacctacttcaaaa

SEQ ID NO: 119297 - DNA, 25 bp, Homo sapien
ttgttggcatttacctgcttcaaaa

SEQ ID NO: 119298 - DNA, 25 bp, Homo sapien
ttgttggtccttccagatcttaaat

SEQ ID NO: 119299 - DNA, 25 bp, Homo sapien
ttgttggttcttccagatcttaaat

SEQ ID NO: 119300 - DNA, 25 bp, Homo sapien
ttgttggttggagtacagcagaacc

SEQ ID NO: 119301 - DNA, 25 bp, Homo sapien
ttgttggttggagtactgcagaacc

SEQ ID NO: 119302 - DNA, 25 bp, Homo sapien
ttgttgtagtacgatattcccaaat

SEQ ID NO: 119303 - DNA, 25 bp, Homo sapien
ttgttgtagtatgatattcccaaat

SEQ ID NO: 119304 - DNA, 25 bp, Homo sapien
ttgttgtcagtctcgtttggacatg

SEQ ID NO: 119305 - DNA, 25 bp, Homo sapien
ttgttgtcagtcttgtttggacatg

SEQ ID NO: 119306 - DNA, 25 bp, Homo sapien
ttgttgtcatagaggcaaatgagat

SEQ ID NO: 119307 - DNA, 25 bp, Homo sapien
ttgttgtcatagagtcaaatgagat

SEQ ID NO: 119308 - DNA, 25 bp, Homo sapien
ttgttgtcctccgattttatcatag

SEQ ID NO: 119309 - DNA, 25 bp, Homo sapien
ttgttgtcctctgattttatcatag

SEQ ID NO: 119310 - DNA, 25 bp, Homo sapien
ttgttgtgccaactccgcaagaatt

SEQ ID NO: 119311 - DNA, 25 bp, Homo sapien
ttgttgtgccaactcctcaagaatt

SEQ ID NO: 119312 - DNA, 25 bp, Homo sapien
ttgttgtgttagaaaggcatgtaaa

SEQ ID NO: 119313 - DNA, 25 bp, Homo sapien
ttgttgtgttataaaggcatgtaaa

SEQ ID NO: 119314 - DNA, 25 bp, Homo sapien
ttgttgttccaaagttacaattaaa

SEQ ID NO: 119315 - DNA, 25 bp, Homo sapien
ttgttgttcctgtcatgaatggagt

SEQ ID NO: 119316 - DNA, 25 bp, Homo sapien
ttgttgttcctgtcgtgaatggagt

SEQ ID NO: 119317 - DNA, 25 bp, Homo sapien
ttgttgttgtaaaggtgtgggcaat

SEQ ID NO: 119318 - DNA, 25 bp, Homo sapien
ttgttgttgtaaatgtgtgggcaat

SEQ ID NO: 119319 - DNA, 25 bp, Homo sapien
ttgttgttgttccaaagttacaatt

SEQ ID NO: 119320 - DNA, 25 bp, Homo sapien
ttgttgttgtttcaaagttacaatt

SEQ ID NO: 119321 - DNA, 25 bp, Homo sapien
ttgttgtttcaaagttacaattaaa

SEQ ID NO: 119322 - DNA, 25 bp, Homo sapien
ttgtttaagacatactagagctttg

SEQ ID NO: 119323 - DNA, 25 bp, Homo sapien
ttgtttaagacgtactagagctttg

SEQ ID NO: 119324 - DNA, 25 bp, Homo sapien
ttgtttaattcacagtcgaaatagg

SEQ ID NO: 119325 - DNA, 25 bp, Homo sapien
ttgtttaattcacagttgaaatagg

SEQ ID NO: 119326 - DNA, 25 bp, Homo sapien
ttgtttagtttgcaccattgttcct

SEQ ID NO: 119327 - DNA, 25 bp, Homo sapien
ttgtttagtttgcaccgttgttcct

SEQ ID NO: 119328 - DNA, 25 bp, Homo sapien
ttgtttatttgtaggcattattgta

SEQ ID NO: 119329 - DNA, 25 bp, Homo sapien
ttgtttatttgtgggcattattgta

SEQ ID NO: 119330 - DNA, 25 bp, Homo sapien
ttgtttcaaggttaataccctgata

SEQ ID NO: 119331 - DNA, 25 bp, Homo sapien
ttgtttcaaggttagtaccctgata

SEQ ID NO: 119332 - DNA, 25 bp, Homo sapien
ttgtttcaatccagcaatcccacta

SEQ ID NO: 119333 - DNA, 25 bp, Homo sapien
ttgtttcaatccggcaatcccacta

SEQ ID NO: 119334 - DNA, 25 bp, Homo sapien
ttgtttcagttagcattttcagctt

SEQ ID NO: 119335 - DNA, 25 bp, Homo sapien
ttgtttcagttagtattttcagctt

SEQ ID NO: 119336 - DNA, 25 bp, Homo sapien
ttgtttccaagccctttagatgaag

SEQ ID NO: 119337 - DNA, 25 bp, Homo sapien
ttgtttccaattctccagcataatc

SEQ ID NO: 119338 - DNA, 25 bp, Homo sapien
ttgtttccagttctccagcataatc

SEQ ID NO: 119339 - DNA, 25 bp, Homo sapien
ttgtttccatgccctttagatgaag

SEQ ID NO: 119340 - DNA, 25 bp, Homo sapien
ttgtttcctgactttgctcacagtg

SEQ ID NO: 119341 - DNA, 25 bp, Homo sapien
ttgtttcctgactttggtcacagtg

SEQ ID NO: 119342 - DNA, 25 bp, Homo sapien
ttgtttccttaagctcttaactact

SEQ ID NO: 119343 - DNA, 25 bp, Homo sapien
ttgtttccttaggctcttaactact

SEQ ID NO: 119344 - DNA, 25 bp, Homo sapien
ttgtttctacgagtagagctcagac

SEQ ID NO: 119345 - DNA, 25 bp, Homo sapien
ttgtttctatgagtagagctcagac

SEQ ID NO: 119346 - DNA, 25 bp, Homo sapien
ttgtttctcctttgtatcacagcat

SEQ ID NO: 119347 - DNA, 25 bp, Homo sapien
ttgtttctcctttttatcacagcat

SEQ ID NO: 119348 - DNA, 25 bp, Homo sapien
ttgtttctgagaccaggaaataact

SEQ ID NO: 119349 - DNA, 25 bp, Homo sapien
ttgtttctgatgactctcataatgg

SEQ ID NO: 119350 - DNA, 25 bp, Homo sapien
ttgtttctgatggctctcataatgg

SEQ ID NO: 119351 - DNA, 25 bp, Homo sapien
ttgtttcttaaatgggttgcttttt

SEQ ID NO: 119352 - DNA, 25 bp, Homo sapien
ttgtttcttaattgggttgcttttt

SEQ ID NO: 119353 - DNA, 25 bp, Homo sapien
ttgtttcttagaccaggaaataact

SEQ ID NO: 119354 - DNA, 25 bp, Homo sapien
ttgtttgaaatgccagatatagcaa

SEQ ID NO: 119355 - DNA, 25 bp, Homo sapien
ttgtttgaaatgtcagatatagcaa

SEQ ID NO: 119356 - DNA, 25 bp, Homo sapien
ttgtttgaatgtggatcaaaataag

SEQ ID NO: 119357 - DNA, 25 bp, Homo sapien
ttgtttgaatgtgggtcaaaataag

SEQ ID NO: 119358 - DNA, 25 bp, Homo sapien
ttgtttgccaagcgagacagattca

SEQ ID NO: 119359 - DNA, 25 bp, Homo sapien
ttgtttgccaagtgagacagattca

SEQ ID NO: 119360 - DNA, 25 bp, Homo sapien
ttgtttggagaaatttacttgcctt

SEQ ID NO: 119361 - DNA, 25 bp, Homo sapien
ttgtttggagaattttacttgcctt

SEQ ID NO: 119362 - DNA, 25 bp, Homo sapien
ttgtttggctcttcctcaacaatag

SEQ ID NO: 119363 - DNA, 25 bp, Homo sapien
ttgtttggtgcacccatatttgttc

SEQ ID NO: 119364 - DNA, 25 bp, Homo sapien
ttgtttggtgcactcatatttgttc

SEQ ID NO: 119365 - DNA, 25 bp, Homo sapien
ttgtttggttcttcctcaacaatag

SEQ ID NO: 119366 - DNA, 25 bp, Homo sapien
ttgtttgtcctctcagtacagaatg

SEQ ID NO: 119367 - DNA, 25 bp, Homo sapien
ttgtttgtcttctcagtacagaatg

SEQ ID NO: 119368 - DNA, 25 bp, Homo sapien
ttgtttgtggcctttacttatgcag

SEQ ID NO: 119369 - DNA, 25 bp, Homo sapien
ttgtttgtggcctttagttatgcag

SEQ ID NO: 119370 - DNA, 25 bp, Homo sapien
ttgtttgtttgaaatgccagatata

SEQ ID NO: 119371 - DNA, 25 bp, Homo sapien
ttgtttgtttgaaatgtcagatata

SEQ ID NO: 119372 - DNA, 25 bp, Homo sapien
ttgtttgtttgttccaatttcattt

SEQ ID NO: 119373 - DNA, 25 bp, Homo sapien
ttgtttgtttgttctaatttcattt

SEQ ID NO: 119374 - DNA, 25 bp, Homo sapien
ttgttttaaacccggtaagagagga

SEQ ID NO: 119375 - DNA, 25 bp, Homo sapien
ttgttttaaacctggtaagagagga

SEQ ID NO: 119376 - DNA, 25 bp, Homo sapien
ttgttttaaatatgttatgatgatg

SEQ ID NO: 119377 - DNA, 25 bp, Homo sapien
ttgttttaaatatgttgtgatgatg

SEQ ID NO: 119378 - DNA, 25 bp, Homo sapien
ttgttttaactacatgggattttgg

SEQ ID NO: 119379 - DNA, 25 bp, Homo sapien
ttgttttaactacgtgggattttgg

SEQ ID NO: 119380 - DNA, 25 bp, Homo sapien
ttgttttacaccactgagttccggg

SEQ ID NO: 119381 - DNA, 25 bp, Homo sapien
ttgttttactcctcgcttaacatct

SEQ ID NO: 119382 - DNA, 25 bp, Homo sapien
ttgttttactccttgcttaacatct

SEQ ID NO: 119383 - DNA, 25 bp, Homo sapien
ttgttttagcacctgatttagtcac

SEQ ID NO: 119384 - DNA, 25 bp, Homo sapien
ttgttttagtacctgatttagtcac

SEQ ID NO: 119385 - DNA, 25 bp, Homo sapien
ttgttttataccactgagttccggg

SEQ ID NO: 119386 - DNA, 25 bp, Homo sapien
ttgttttatcccaagccattgtgct

SEQ ID NO: 119387 - DNA, 25 bp, Homo sapien
ttgttttatcccaggccattgtgct

SEQ ID NO: 119388 - DNA, 25 bp, Homo sapien
ttgttttatgaatggaaactagtga

SEQ ID NO: 119389 - DNA, 25 bp, Homo sapien
ttgttttattaatggaaactagtga

SEQ ID NO: 119390 - DNA, 25 bp, Homo sapien
ttgttttccacaacggtatttggct

SEQ ID NO: 119391 - DNA, 25 bp, Homo sapien
ttgttttccacaatggtatttggct

SEQ ID NO: 119392 - DNA, 25 bp, Homo sapien
ttgttttccacagcggctatgctgt

SEQ ID NO: 119393 - DNA, 25 bp, Homo sapien
ttgttttccacagtggctatgctgt

SEQ ID NO: 119394 - DNA, 25 bp, Homo sapien
ttgttttctcacgactcattgttct

SEQ ID NO: 119395 - DNA, 25 bp, Homo sapien
ttgttttctcatgactcattgttct

SEQ ID NO: 119396 - DNA, 25 bp, Homo sapien
ttgttttcttaacatttgtgtattc

SEQ ID NO: 119397 - DNA, 25 bp, Homo sapien
ttgttttcttaatatttgtgtattc

SEQ ID NO: 119398 - DNA, 25 bp, Homo sapien
ttgttttgatacttaagtgtgataa

SEQ ID NO: 119399 - DNA, 25 bp, Homo sapien
ttgttttggtacttaagtgtgataa

SEQ ID NO: 119400 - DNA, 25 bp, Homo sapien
ttgttttgtctgcgaaaatctataa

SEQ ID NO: 119401 - DNA, 25 bp, Homo sapien
ttgttttgtctgtgaaaatctataa

SEQ ID NO: 119402 - DNA, 25 bp, Homo sapien
ttgtttttagtttctcaggctgtgc

SEQ ID NO: 119403 - DNA, 25 bp, Homo sapien
ttgtttttcacgtgccactgtttcc

SEQ ID NO: 119404 - DNA, 25 bp, Homo sapien
ttgtttttcacgtgtcactgtttcc

SEQ ID NO: 119405 - DNA, 25 bp, Homo sapien
ttgttttttcatgactgcgtactat

SEQ ID NO: 119406 - DNA, 25 bp, Homo sapien
ttgttttttgtttctcaggctgtgc

SEQ ID NO: 119407 - DNA, 25 bp, Homo sapien
ttgtttttttatgactgcgtactat

SEQ ID NO: 119408 - DNA, 25 bp, Homo sapien
tttaaaaaaagaaagacggcgattt

SEQ ID NO: 119409 - DNA, 25 bp, Homo sapien
tttaaaaaagagattgacagtctaa

SEQ ID NO: 119410 - DNA, 25 bp, Homo sapien
tttaaaaaagagattggcagtctaa

SEQ ID NO: 119411 - DNA, 25 bp, Homo sapien
tttaaaaaaggaaagacggcgattt

SEQ ID NO: 119412 - DNA, 25 bp, Homo sapien
tttaaaaaatgaagagtctgtcaaa

SEQ ID NO: 119413 - DNA, 25 bp, Homo sapien
tttaaaaaatgacgagtctgtcaaa

SEQ ID NO: 119414 - DNA, 25 bp, Homo sapien
tttaaaaacatagctcaagaactcc

SEQ ID NO: 119415 - DNA, 25 bp, Homo sapien
tttaaaaacatagctcgagaactcc

SEQ ID NO: 119416 - DNA, 25 bp, Homo sapien
tttaaaaagcaggtgccccttctgc

SEQ ID NO: 119417 - DNA, 25 bp, Homo sapien
tttaaaaataatgctacagatccct

SEQ ID NO: 119418 - DNA, 25 bp, Homo sapien
tttaaaaataatgctagagatccct

SEQ ID NO: 119419 - DNA, 25 bp, Homo sapien
tttaaaaatcaggtgccccttctgc

SEQ ID NO: 119420 - DNA, 25 bp, Homo sapien
tttaaaacaaaagtccagtcaagtc

SEQ ID NO: 119421 - DNA, 25 bp, Homo sapien
tttaaaacaaaagtccggtcaagtc

SEQ ID NO: 119422 - DNA, 25 bp, Homo sapien
tttaaaacagagaccttgtttatgt

SEQ ID NO: 119423 - DNA, 25 bp, Homo sapien
tttaaaacagaggccttgtttatgt

SEQ ID NO: 119424 - DNA, 25 bp, Homo sapien
tttaaaacatgcaactcaatgatat

SEQ ID NO: 119425 - DNA, 25 bp, Homo sapien
tttaaaacatgcaattcaatgatat

SEQ ID NO: 119426 - DNA, 25 bp, Homo sapien
tttaaaacctgatggacctttgtga

SEQ ID NO: 119427 - DNA, 25 bp, Homo sapien
tttaaaacgaggtaagagtttaagc

SEQ ID NO: 119428 - DNA, 25 bp, Homo sapien
tttaaaacgagttaagagtttaagc

SEQ ID NO: 119429 - DNA, 25 bp, Homo sapien
tttaaaacttgatggacctttgtga

SEQ ID NO: 119430 - DNA, 25 bp, Homo sapien
tttaaaactttcattaaacatggtg

SEQ ID NO: 119431 - DNA, 25 bp, Homo sapien
tttaaaactttcgttaaacatggtg

SEQ ID NO: 119432 - DNA, 25 bp, Homo sapien
tttaaaagatgtttcctgttgatag

SEQ ID NO: 119433 - DNA, 25 bp, Homo sapien
tttaaaagatgttttctgttgatag

SEQ ID NO: 119434 - DNA, 25 bp, Homo sapien
tttaaaagccaaatatccaggttcc

SEQ ID NO: 119435 - DNA, 25 bp, Homo sapien
tttaaaagccagatatccaggttcc

SEQ ID NO: 119436 - DNA, 25 bp, Homo sapien
tttaaaagtctgtatacgagtttaa

SEQ ID NO: 119437 - DNA, 25 bp, Homo sapien
tttaaaagtctgtatatgagtttaa

SEQ ID NO: 119438 - DNA, 25 bp, Homo sapien
tttaaaataacatcgcaggaaacta

SEQ ID NO: 119439 - DNA, 25 bp, Homo sapien
tttaaaataacatcgcgggaaacta

SEQ ID NO: 119440 - DNA, 25 bp, Homo sapien
tttaaaatactagtgctacaaagaa

SEQ ID NO: 119441 - DNA, 25 bp, Homo sapien
tttaaaattatgatttcggttagta

SEQ ID NO: 119442 - DNA, 25 bp, Homo sapien
tttaaaattatgattttggttagta

SEQ ID NO: 119443 - DNA, 25 bp, Homo sapien
tttaaaattctagtgctacaaagaa

SEQ ID NO: 119444 - DNA, 25 bp, Homo sapien
tttaaacaatcaatagaatatgatt

SEQ ID NO: 119445 - DNA, 25 bp, Homo sapien
tttaaacaatcagtagaatatgatt

SEQ ID NO: 119446 - DNA, 25 bp, Homo sapien
tttaaacacggcacttttggccacc

SEQ ID NO: 119447 - DNA, 25 bp, Homo sapien
tttaaacacggcgcttttggccacc

SEQ ID NO: 119448 - DNA, 25 bp, Homo sapien
tttaaacacgttatgtgtgctagca

SEQ ID NO: 119449 - DNA, 25 bp, Homo sapien
tttaaacatactacacattcaattc

SEQ ID NO: 119450 - DNA, 25 bp, Homo sapien
tttaaacatactgcacattcaattc

SEQ ID NO: 119451 - DNA, 25 bp, Homo sapien
tttaaacatgttatgtgtgctagca

SEQ ID NO: 119452 - DNA, 25 bp, Homo sapien
tttaaacattgtctctgctgggtgt

SEQ ID NO: 119453 - DNA, 25 bp, Homo sapien
tttaaacattgtctttgctgggtgt

SEQ ID NO: 119454 - DNA, 25 bp, Homo sapien
tttaaaccacagataaacttaccat

SEQ ID NO: 119455 - DNA, 25 bp, Homo sapien
tttaaaccacagataagcttaccat

SEQ ID NO: 119456 - DNA, 25 bp, Homo sapien
tttaaactacaccatgatgcttatt

SEQ ID NO: 119457 - DNA, 25 bp, Homo sapien
tttaaactataccatgatgcttatt

SEQ ID NO: 119458 - DNA, 25 bp, Homo sapien
tttaaactcaagacttcctcatagc

SEQ ID NO: 119459 - DNA, 25 bp, Homo sapien
tttaaactcaagtcttcctcatagc

SEQ ID NO: 119460 - DNA, 25 bp, Homo sapien
tttaaagaaattgaaaataaacact

SEQ ID NO: 119461 - DNA, 25 bp, Homo sapien
tttaaagaaattggaaataaacact

SEQ ID NO: 119462 - DNA, 25 bp, Homo sapien
tttaaagaatcagagttttttcaga

SEQ ID NO: 119463 - DNA, 25 bp, Homo sapien
tttaaagaatcggagttttttcaga

SEQ ID NO: 119464 - DNA, 25 bp, Homo sapien
tttaaagaatctgctgactgattca

SEQ ID NO: 119465 - DNA, 25 bp, Homo sapien
tttaaagaatctggtgactgattca

SEQ ID NO: 119466 - DNA, 25 bp, Homo sapien
tttaaagagccatgattattgtaaa

SEQ ID NO: 119467 - DNA, 25 bp, Homo sapien
tttaaagagccgtgattattgtaaa

SEQ ID NO: 119468 - DNA, 25 bp, Homo sapien
tttaaagatgaaagtgaattgagac

SEQ ID NO: 119469 - DNA, 25 bp, Homo sapien
tttaaagatgagagtgaattgagac

SEQ ID NO: 119470 - DNA, 25 bp, Homo sapien
tttaaagctcacgtctgtagaagcg

SEQ ID NO: 119471 - DNA, 25 bp, Homo sapien
tttaaagctcatgtctgtagaagcg

SEQ ID NO: 119472 - DNA, 25 bp, Homo sapien
tttaaagtaattgttgatgtagttg

SEQ ID NO: 119473 - DNA, 25 bp, Homo sapien
tttaaagtgattgttgatgtagttg

SEQ ID NO: 119474 - DNA, 25 bp, Homo sapien
tttaaagttggcgttgatggaactc

SEQ ID NO: 119475 - DNA, 25 bp, Homo sapien
tttaaagttggctttgatggaactc

SEQ ID NO: 119476 - DNA, 25 bp, Homo sapien
tttaaataaatatctgcaatcatat

SEQ ID NO: 119477 - DNA, 25 bp, Homo sapien
tttaaatacgagtctgtgaaattca

SEQ ID NO: 119478 - DNA, 25 bp, Homo sapien
tttaaatacgagtttgtgaaattca

SEQ ID NO: 119479 - DNA, 25 bp, Homo sapien
tttaaatagatatctgcaatcatat

SEQ ID NO: 119480 - DNA, 25 bp, Homo sapien
tttaaatatactacacctcagggac

SEQ ID NO: 119481 - DNA, 25 bp, Homo sapien
tttaaatatgctacacctcagggac

SEQ ID NO: 119482 - DNA, 25 bp, Homo sapien
tttaaatatgtgcaccttattgtat

SEQ ID NO: 119483 - DNA, 25 bp, Homo sapien
tttaaatatgtgcgccttattgtat

SEQ ID NO: 119484 - DNA, 25 bp, Homo sapien
tttaaatatgttatgatgatgtttg

SEQ ID NO: 119485 - DNA, 25 bp, Homo sapien
tttaaatatgttgtgatgatgtttg

SEQ ID NO: 119486 - DNA, 25 bp, Homo sapien
tttaaatcacataagctcctcctct

SEQ ID NO: 119487 - DNA, 25 bp, Homo sapien
tttaaatcacatatgctcctcctct

SEQ ID NO: 119488 - DNA, 25 bp, Homo sapien
tttaaatcacctctgaattacttgt

SEQ ID NO: 119489 - DNA, 25 bp, Homo sapien
tttaaatcacctctgagttacttgt

SEQ ID NO: 119490 - DNA, 25 bp, Homo sapien
tttaaatcacgaaaagcccacttgg

SEQ ID NO: 119491 - DNA, 25 bp, Homo sapien
tttaaatcatgaaaagcccacttgg

SEQ ID NO: 119492 - DNA, 25 bp, Homo sapien
tttaaatctgaattcctgcaaccct

SEQ ID NO: 119493 - DNA, 25 bp, Homo sapien
tttaaatcttaattcctgcaaccct

SEQ ID NO: 119494 - DNA, 25 bp, Homo sapien
tttaaatgctaaaatgatgtgtaaa

SEQ ID NO: 119495 - DNA, 25 bp, Homo sapien
tttaaatgctaaagtgatgtgtaaa

SEQ ID NO: 119496 - DNA, 25 bp, Homo sapien
tttaacaaacataattccctctcac

SEQ ID NO: 119497 - DNA, 25 bp, Homo sapien
tttaacaaacatcattccctctcac

SEQ ID NO: 119498 - DNA, 25 bp, Homo sapien
tttaacaaattccatgattgtcagt

SEQ ID NO: 119499 - DNA, 25 bp, Homo sapien
tttaacaaattccgtgattgtcagt

SEQ ID NO: 119500 - DNA, 25 bp, Homo sapien
tttaacaagtcaatttggtgatttt

SEQ ID NO: 119501 - DNA, 25 bp, Homo sapien
tttaacaagtcagtttggtgatttt

SEQ ID NO: 119502 - DNA, 25 bp, Homo sapien
tttaacaatacatacgaaatttttg

SEQ ID NO: 119503 - DNA, 25 bp, Homo sapien
tttaacaatacatatgaaatttttg

SEQ ID NO: 119504 - DNA, 25 bp, Homo sapien
tttaacaatttcaattatgcaagtg

SEQ ID NO: 119505 - DNA, 25 bp, Homo sapien
tttaacaatttcacttatgcaagtg

SEQ ID NO: 119506 - DNA, 25 bp, Homo sapien
tttaacagcaagaaattaacaaagg

SEQ ID NO: 119507 - DNA, 25 bp, Homo sapien
tttaacaggagcttcaggtttgttg

SEQ ID NO: 119508 - DNA, 25 bp, Homo sapien
tttaacaggcgcttcaggtttgttg

SEQ ID NO: 119509 - DNA, 25 bp, Homo sapien
tttaacagtaagaaattaacaaagg

SEQ ID NO: 119510 - DNA, 25 bp, Homo sapien
tttaacatgcacgtattttgctgca

SEQ ID NO: 119511 - DNA, 25 bp, Homo sapien
tttaacattcacgtattttgctgca

SEQ ID NO: 119512 - DNA, 25 bp, Homo sapien
tttaacattcagccagaaagatcat

SEQ ID NO: 119513 - DNA, 25 bp, Homo sapien
tttaacattcagccaggaagatcat

SEQ ID NO: 119514 - DNA, 25 bp, Homo sapien
tttaaccaatatttagaggggcctc

SEQ ID NO: 119515 - DNA, 25 bp, Homo sapien
tttaaccattatttagaggggcctc

SEQ ID NO: 119516 - DNA, 25 bp, Homo sapien
tttaacctatcaaaaaattgtgtct

SEQ ID NO: 119517 - DNA, 25 bp, Homo sapien
tttaacctatcaaagaattgtgtct

SEQ ID NO: 119518 - DNA, 25 bp, Homo sapien
tttaaccttactaagcctttttaac

SEQ ID NO: 119519 - DNA, 25 bp, Homo sapien
tttaaccttccatttctatgataag

SEQ ID NO: 119520 - DNA, 25 bp, Homo sapien
tttaaccttccgtttctatgataag

SEQ ID NO: 119521 - DNA, 25 bp, Homo sapien
tttaaccttcctaagcctttttaac

SEQ ID NO: 119522 - DNA, 25 bp, Homo sapien
tttaactacacctacaacttataga

SEQ ID NO: 119523 - DNA, 25 bp, Homo sapien
tttaactacacctacatcttataga

SEQ ID NO: 119524 - DNA, 25 bp, Homo sapien
tttaactatttctatttagccaacc

SEQ ID NO: 119525 - DNA, 25 bp, Homo sapien
tttaactatttctgtttagccaacc

SEQ ID NO: 119526 - DNA, 25 bp, Homo sapien
tttaactcaacttccttccctgcct

SEQ ID NO: 119527 - DNA, 25 bp, Homo sapien
tttaactcaagtatagtaatagatg

SEQ ID NO: 119528 - DNA, 25 bp, Homo sapien
tttaactcagcttccttccctgcct

SEQ ID NO: 119529 - DNA, 25 bp, Homo sapien
tttaactcaggtatagtaatagatg

SEQ ID NO: 119530 - DNA, 25 bp, Homo sapien
tttaactccaattactttatgggta

SEQ ID NO: 119531 - DNA, 25 bp, Homo sapien
tttaactccaattattttatgggta

SEQ ID NO: 119532 - DNA, 25 bp, Homo sapien
tttaactgattccttggctcaccat

SEQ ID NO: 119533 - DNA, 25 bp, Homo sapien
tttaactgattgcttggctcaccat

SEQ ID NO: 119534 - DNA, 25 bp, Homo sapien
tttaagaaaggaattcaagctgtac

SEQ ID NO: 119535 - DNA, 25 bp, Homo sapien
tttaagaaaggaattcgagctgtac

SEQ ID NO: 119536 - DNA, 25 bp, Homo sapien
tttaagacatactagagctttgtac

SEQ ID NO: 119537 - DNA, 25 bp, Homo sapien
tttaagacgtactagagctttgtac

SEQ ID NO: 119538 - DNA, 25 bp, Homo sapien
tttaagagaagtatgcaagaattca

SEQ ID NO: 119539 - DNA, 25 bp, Homo sapien
tttaagagaagtttgcaagaattca

SEQ ID NO: 119540 - DNA, 25 bp, Homo sapien
tttaagagcggtagtggcatgtccc

SEQ ID NO: 119541 - DNA, 25 bp, Homo sapien
tttaagagcggtcgtggcatgtccc

SEQ ID NO: 119542 - DNA, 25 bp, Homo sapien
tttaagatccagattttttctttat

SEQ ID NO: 119543 - DNA, 25 bp, Homo sapien
tttaagatccatattttttctttat

SEQ ID NO: 119544 - DNA, 25 bp, Homo sapien
tttaagatcgcataatgcatctgat

SEQ ID NO: 119545 - DNA, 25 bp, Homo sapien
tttaagattgcataatgcatctgat

SEQ ID NO: 119546 - DNA, 25 bp, Homo sapien
tttaagcaaagtatccagctaattt

SEQ ID NO: 119547 - DNA, 25 bp, Homo sapien
tttaagcaaagtattcagctaattt

SEQ ID NO: 119548 - DNA, 25 bp, Homo sapien
tttaagctaaaacatactaacacat

SEQ ID NO: 119549 - DNA, 25 bp, Homo sapien
tttaagctaaaacttactaacacat

SEQ ID NO: 119550 - DNA, 25 bp, Homo sapien
tttaagctagttctctccagtacag

SEQ ID NO: 119551 - DNA, 25 bp, Homo sapien
tttaagctagttctttccagtacag

SEQ ID NO: 119552 - DNA, 25 bp, Homo sapien
tttaagctcaccgttgagagaccta

SEQ ID NO: 119553 - DNA, 25 bp, Homo sapien
tttaagctcactgttgagagaccta

SEQ ID NO: 119554 - DNA, 25 bp, Homo sapien
tttaagctcattcaaactgttggct

SEQ ID NO: 119555 - DNA, 25 bp, Homo sapien
tttaagctcattcaaattgttggct

SEQ ID NO: 119556 - DNA, 25 bp, Homo sapien
tttaagctggccatgcatcaataac

SEQ ID NO: 119557 - DNA, 25 bp, Homo sapien
tttaagctggccatgcgtcaataac

SEQ ID NO: 119558 - DNA, 25 bp, Homo sapien
tttaaggaatggccgatgcccagtc

SEQ ID NO: 119559 - DNA, 25 bp, Homo sapien
tttaaggaatggctgatgcccagtc

SEQ ID NO: 119560 - DNA, 25 bp, Homo sapien
tttaaggacacatataggctgaaag

SEQ ID NO: 119561 - DNA, 25 bp, Homo sapien
tttaaggacacgtataggctgaaag

SEQ ID NO: 119562 - DNA, 25 bp, Homo sapien
tttaaggaccggcgttgctttctga

SEQ ID NO: 119563 - DNA, 25 bp, Homo sapien
tttaaggaccggtgttgctttctga

SEQ ID NO: 119564 - DNA, 25 bp, Homo sapien
tttaagtacaggcaactaaagaatg

SEQ ID NO: 119565 - DNA, 25 bp, Homo sapien
tttaagtacaggcagctaaagaatg

SEQ ID NO: 119566 - DNA, 25 bp, Homo sapien
tttaagtactgggatagactgataa

SEQ ID NO: 119567 - DNA, 25 bp, Homo sapien
tttaagtactggggtagactgataa

SEQ ID NO: 119568 - DNA, 25 bp, Homo sapien
tttaagtatgtgcagattcaagcaa

SEQ ID NO: 119569 - DNA, 25 bp, Homo sapien
tttaagtatgtgtagattcaagcaa

SEQ ID NO: 119570 - DNA, 25 bp, Homo sapien
tttaagtgaatgacgctaaagggta

SEQ ID NO: 119571 - DNA, 25 bp, Homo sapien
tttaagtgaatgatgctaaagggta

SEQ ID NO: 119572 - DNA, 25 bp, Homo sapien
tttaagtgcgataatttgtcagtgt

SEQ ID NO: 119573 - DNA, 25 bp, Homo sapien
tttaagtggtacatcagtgacctct

SEQ ID NO: 119574 - DNA, 25 bp, Homo sapien
tttaagtggtatatcagtgacctct

SEQ ID NO: 119575 - DNA, 25 bp, Homo sapien
tttaagtgtaagccaacgattttat

SEQ ID NO: 119576 - DNA, 25 bp, Homo sapien
tttaagtgtaagccaatgattttat

SEQ ID NO: 119577 - DNA, 25 bp, Homo sapien
tttaagtgtgataatttgtcagtgt

SEQ ID NO: 119578 - DNA, 25 bp, Homo sapien
tttaagttataatatccctaagctg

SEQ ID NO: 119579 - DNA, 25 bp, Homo sapien
tttaagttataatttccctaagctg

SEQ ID NO: 119580 - DNA, 25 bp, Homo sapien
tttaagttcaaggttaatttgatat

SEQ ID NO: 119581 - DNA, 25 bp, Homo sapien
tttaagttcaaggttattttgatat

SEQ ID NO: 119582 - DNA, 25 bp, Homo sapien
tttaagttcagctctcaaaatcatt

SEQ ID NO: 119583 - DNA, 25 bp, Homo sapien
tttaagttcggctctcaaaatcatt

SEQ ID NO: 119584 - DNA, 25 bp, Homo sapien
tttaagtttgccgtttaggctctag

SEQ ID NO: 119585 - DNA, 25 bp, Homo sapien
tttaagtttgctgtttaggctctag

SEQ ID NO: 119586 - DNA, 25 bp, Homo sapien
tttaataacttggcacctatttata

SEQ ID NO: 119587 - DNA, 25 bp, Homo sapien
tttaataacttggcacgtatttata

SEQ ID NO: 119588 - DNA, 25 bp, Homo sapien
tttaataatggctacttgatccaca

SEQ ID NO: 119589 - DNA, 25 bp, Homo sapien
tttaataattgctacttgatccaca

SEQ ID NO: 119590 - DNA, 25 bp, Homo sapien
tttaatagcaggttaagatgaaaca

SEQ ID NO: 119591 - DNA, 25 bp, Homo sapien
tttaatagcgggttaagatgaaaca

SEQ ID NO: 119592 - DNA, 25 bp, Homo sapien
tttaatatatgactgctgactttgc

SEQ ID NO: 119593 - DNA, 25 bp, Homo sapien
tttaatatatgagtgctgactttgc

SEQ ID NO: 119594 - DNA, 25 bp, Homo sapien
tttaatcaaaaatttacttaataga

SEQ ID NO: 119595 - DNA, 25 bp, Homo sapien
tttaatcaatcccagacgtttaacc

SEQ ID NO: 119596 - DNA, 25 bp, Homo sapien
tttaatcaatcccagatgtttaacc

SEQ ID NO: 119597 - DNA, 25 bp, Homo sapien
tttaatcagaaatttacttaataga

SEQ ID NO: 119598 - DNA, 25 bp, Homo sapien
tttaatcagttcctgaaaatttgtg

SEQ ID NO: 119599 - DNA, 25 bp, Homo sapien
tttaatcagtttctgaaaatttgtg

SEQ ID NO: 119600 - DNA, 25 bp, Homo sapien
tttaatccagccaatgtcatttccc

SEQ ID NO: 119601 - DNA, 25 bp, Homo sapien
tttaatccagcccatgtcatttccc

SEQ ID NO: 119602 - DNA, 25 bp, Homo sapien
tttaatcccgactctactcttttcc

SEQ ID NO: 119603 - DNA, 25 bp, Homo sapien
tttaatcccgactgtactcttttcc

SEQ ID NO: 119604 - DNA, 25 bp, Homo sapien
tttaatcctgggttagcaaaaatgg

SEQ ID NO: 119605 - DNA, 25 bp, Homo sapien
tttaatcctggtttagcaaaaatgg

SEQ ID NO: 119606 - DNA, 25 bp, Homo sapien
tttaatgaaaatcagtagaccatgt

SEQ ID NO: 119607 - DNA, 25 bp, Homo sapien
tttaatgaaaatcggtagaccatgt

SEQ ID NO: 119608 - DNA, 25 bp, Homo sapien
tttaatgaacaggtaaaaaaaaatg

SEQ ID NO: 119609 - DNA, 25 bp, Homo sapien
tttaatgaacaggttaaaaaaaatg

SEQ ID NO: 119610 - DNA, 25 bp, Homo sapien
tttaatgaagtatggttgcagaaaa

SEQ ID NO: 119611 - DNA, 25 bp, Homo sapien
tttaatgacgtatggttgcagaaaa

SEQ ID NO: 119612 - DNA, 25 bp, Homo sapien
tttaatggaaaactctttcagtttc

SEQ ID NO: 119613 - DNA, 25 bp, Homo sapien
tttaatggaaatctctttcagtttc

SEQ ID NO: 119614 - DNA, 25 bp, Homo sapien
tttaatggcttggatcttttgaata

SEQ ID NO: 119615 - DNA, 25 bp, Homo sapien
tttaatggcttggctcttttgaata

SEQ ID NO: 119616 - DNA, 25 bp, Homo sapien
tttaatgtaggcaatttgatgagtt

SEQ ID NO: 119617 - DNA, 25 bp, Homo sapien
tttaatgtatgcaatttgatgagtt

SEQ ID NO: 119618 - DNA, 25 bp, Homo sapien
tttaatgtctctctctgttccttct

SEQ ID NO: 119619 - DNA, 25 bp, Homo sapien
tttaatgtctctctgtgttccttct

SEQ ID NO: 119620 - DNA, 25 bp, Homo sapien
tttaatgttttgggataaatatggc

SEQ ID NO: 119621 - DNA, 25 bp, Homo sapien
tttaatgttttgtgataaatatggc

SEQ ID NO: 119622 - DNA, 25 bp, Homo sapien
tttaattagagcgaccaagaaagga

SEQ ID NO: 119623 - DNA, 25 bp, Homo sapien
tttaattagtgcgaccaagaaagga

SEQ ID NO: 119624 - DNA, 25 bp, Homo sapien
tttaattagttgaaactctcttgaa

SEQ ID NO: 119625 - DNA, 25 bp, Homo sapien
tttaattagttgaacctctcttgaa

SEQ ID NO: 119626 - DNA, 25 bp, Homo sapien
tttaattatcctcaacattactgcc

SEQ ID NO: 119627 - DNA, 25 bp, Homo sapien
tttaattatcctcaacgttactgcc

SEQ ID NO: 119628 - DNA, 25 bp, Homo sapien
tttaattcacagtcgaaataggatc

SEQ ID NO: 119629 - DNA, 25 bp, Homo sapien
tttaattcacagttgaaataggatc

SEQ ID NO: 119630 - DNA, 25 bp, Homo sapien
tttaattcccacatgaactctatgc

SEQ ID NO: 119631 - DNA, 25 bp, Homo sapien
tttaattcccacgtgaactctatgc

SEQ ID NO: 119632 - DNA, 25 bp, Homo sapien
tttaattgttcattcacttgctcaa

SEQ ID NO: 119633 - DNA, 25 bp, Homo sapien
tttaattgttcattcagttgctcaa

SEQ ID NO: 119634 - DNA, 25 bp, Homo sapien
tttaatttccagaatctctttgatc

SEQ ID NO: 119635 - DNA, 25 bp, Homo sapien
tttaatttccagagtctctttgatc

SEQ ID NO: 119636 - DNA, 25 bp, Homo sapien
tttaatttctacctactcctgttac

SEQ ID NO: 119637 - DNA, 25 bp, Homo sapien
tttaatttctacctcctcctgttac

SEQ ID NO: 119638 - DNA, 25 bp, Homo sapien
tttaattttcacatcacagtaataa

SEQ ID NO: 119639 - DNA, 25 bp, Homo sapien
tttaattttcacgtcacagtaataa

SEQ ID NO: 119640 - DNA, 25 bp, Homo sapien
tttacaaaaagaaaaaattagtatg

SEQ ID NO: 119641 - DNA, 25 bp, Homo sapien
tttacaaaaaggaaaaattagtatg

SEQ ID NO: 119642 - DNA, 25 bp, Homo sapien
tttacaaacattttctcacgatctg

SEQ ID NO: 119643 - DNA, 25 bp, Homo sapien
tttacaaacgttgttaactcatttc

SEQ ID NO: 119644 - DNA, 25 bp, Homo sapien
tttacaaacgttgttagctcatttc

SEQ ID NO: 119645 - DNA, 25 bp, Homo sapien
tttacaaacttacagaaactgaata

SEQ ID NO: 119646 - DNA, 25 bp, Homo sapien
tttacaaagatgcgtcttttcctgc

SEQ ID NO: 119647 - DNA, 25 bp, Homo sapien
tttacaaagatgtgtcttttcctgc

SEQ ID NO: 119648 - DNA, 25 bp, Homo sapien
tttacaaatattttctcacgatctg

SEQ ID NO: 119649 - DNA, 25 bp, Homo sapien
tttacaaatttacagaaactgaata

SEQ ID NO: 119650 - DNA, 25 bp, Homo sapien
tttacaagcgattagtttgctgtga

SEQ ID NO: 119651 - DNA, 25 bp, Homo sapien
tttacaagtgattagtttgctgtga

SEQ ID NO: 119652 - DNA, 25 bp, Homo sapien
tttacaatcgagaccactacagttc

SEQ ID NO: 119653 - DNA, 25 bp, Homo sapien
tttacaatgatggcagaattggtca

SEQ ID NO: 119654 - DNA, 25 bp, Homo sapien
tttacaatggtggcagaattggtca

SEQ ID NO: 119655 - DNA, 25 bp, Homo sapien
tttacaattgagaccactacagttc

SEQ ID NO: 119656 - DNA, 25 bp, Homo sapien
tttacacacatagcctgttacaaaa

SEQ ID NO: 119657 - DNA, 25 bp, Homo sapien
tttacacataactcatagggttttc

SEQ ID NO: 119658 - DNA, 25 bp, Homo sapien
tttacacataactcgtagggttttc

SEQ ID NO: 119659 - DNA, 25 bp, Homo sapien
tttacacatatagcctgttacaaaa

SEQ ID NO: 119660 - DNA, 25 bp, Homo sapien
tttacaccacttcttggattgcatg

SEQ ID NO: 119661 - DNA, 25 bp, Homo sapien
tttacaccatttcttggattgcatg

SEQ ID NO: 119662 - DNA, 25 bp, Homo sapien
tttacactcactgactgtgttgctt

SEQ ID NO: 119663 - DNA, 25 bp, Homo sapien
tttacacttactgactgtgttgctt

SEQ ID NO: 119664 - DNA, 25 bp, Homo sapien
tttacacttttttggttcaagttga

SEQ ID NO: 119665 - DNA, 25 bp, Homo sapien
tttacacttttttgtttcaagttga

SEQ ID NO: 119666 - DNA, 25 bp, Homo sapien
tttacagaacttcagtatttccaat

SEQ ID NO: 119667 - DNA, 25 bp, Homo sapien
tttacagacagcagaaactgtatct

SEQ ID NO: 119668 - DNA, 25 bp, Homo sapien
tttacagacagcggaaactgtatct

SEQ ID NO: 119669 - DNA, 25 bp, Homo sapien
tttacagagcttcagtatttccaat

SEQ ID NO: 119670 - DNA, 25 bp, Homo sapien
tttacagagtagccttgtgtttact

SEQ ID NO: 119671 - DNA, 25 bp, Homo sapien
tttacagagtaggcttgtgtttact

SEQ ID NO: 119672 - DNA, 25 bp, Homo sapien
tttacagcctgatatactgaatatt

SEQ ID NO: 119673 - DNA, 25 bp, Homo sapien
tttacagcctggtatactgaatatt

SEQ ID NO: 119674 - DNA, 25 bp, Homo sapien
tttacagtaaagagtgtccatcctc

SEQ ID NO: 119675 - DNA, 25 bp, Homo sapien
tttacagtagagagtgtccatcctc

SEQ ID NO: 119676 - DNA, 25 bp, Homo sapien
tttacagtttagtcagagtcaagag

SEQ ID NO: 119677 - DNA, 25 bp, Homo sapien
tttacagtttagttagagtcaagag

SEQ ID NO: 119678 - DNA, 25 bp, Homo sapien
tttacataacagtagtcataccctg

SEQ ID NO: 119679 - DNA, 25 bp, Homo sapien
tttacataatagtagtcataccctg

SEQ ID NO: 119680 - DNA, 25 bp, Homo sapien
tttacatacatctgaaaccttgaaa

SEQ ID NO: 119681 - DNA, 25 bp, Homo sapien
tttacatacatctgaacccttgaaa

SEQ ID NO: 119682 - DNA, 25 bp, Homo sapien
tttacatacttggttgcttcccttg

SEQ ID NO: 119683 - DNA, 25 bp, Homo sapien
tttacatagttggttgcttcccttg

SEQ ID NO: 119684 - DNA, 25 bp, Homo sapien
tttacatatatagcacacaatcatg

SEQ ID NO: 119685 - DNA, 25 bp, Homo sapien
tttacatatatatcacacaatcatg

SEQ ID NO: 119686 - DNA, 25 bp, Homo sapien
tttacatcaatgaagcagatttggt

SEQ ID NO: 119687 - DNA, 25 bp, Homo sapien
tttacatcgatgaagcagatttggt

SEQ ID NO: 119688 - DNA, 25 bp, Homo sapien
tttacatgtcgtctgggctgctttc

SEQ ID NO: 119689 - DNA, 25 bp, Homo sapien
tttacatgtctcaaataataccata

SEQ ID NO: 119690 - DNA, 25 bp, Homo sapien
tttacatgtctcagataataccata

SEQ ID NO: 119691 - DNA, 25 bp, Homo sapien
tttacatgttgtctgggctgctttc

SEQ ID NO: 119692 - DNA, 25 bp, Homo sapien
tttacattacacattgcggtgccat

SEQ ID NO: 119693 - DNA, 25 bp, Homo sapien
tttacattacacgttgcggtgccat

SEQ ID NO: 119694 - DNA, 25 bp, Homo sapien
tttaccaaataccacatatacataa

SEQ ID NO: 119695 - DNA, 25 bp, Homo sapien
tttaccaaatatcacatatacataa

SEQ ID NO: 119696 - DNA, 25 bp, Homo sapien
tttaccaaggaagactcagtgttgt

SEQ ID NO: 119697 - DNA, 25 bp, Homo sapien
tttaccaaggaagtctcagtgttgt

SEQ ID NO: 119698 - DNA, 25 bp, Homo sapien
tttaccaaggccgtgaaagtatgct

SEQ ID NO: 119699 - DNA, 25 bp, Homo sapien
tttaccaaggctgtgaaagtatgct

SEQ ID NO: 119700 - DNA, 25 bp, Homo sapien
tttaccaatcaacgtgtacacttaa

SEQ ID NO: 119701 - DNA, 25 bp, Homo sapien
tttaccaatcaatgtgtacacttaa

SEQ ID NO: 119702 - DNA, 25 bp, Homo sapien
tttaccacataggcatgactggcac

SEQ ID NO: 119703 - DNA, 25 bp, Homo sapien
tttaccacataggcgtgactggcac

SEQ ID NO: 119704 - DNA, 25 bp, Homo sapien
tttaccactttatcaccgctcctcc

SEQ ID NO: 119705 - DNA, 25 bp, Homo sapien
tttaccactttatcactgctcctcc

SEQ ID NO: 119706 - DNA, 25 bp, Homo sapien
tttaccagaaaaactgttgctatta

SEQ ID NO: 119707 - DNA, 25 bp, Homo sapien
tttaccagaaaacctgttgctatta

SEQ ID NO: 119708 - DNA, 25 bp, Homo sapien
tttaccagatttgtgactgtgaatt

SEQ ID NO: 119709 - DNA, 25 bp, Homo sapien
tttaccagatttgtgattgtgaatt

SEQ ID NO: 119710 - DNA, 25 bp, Homo sapien
tttaccagcattaccgagccactag

SEQ ID NO: 119711 - DNA, 25 bp, Homo sapien
tttaccagcattactgagccactag

SEQ ID NO: 119712 - DNA, 25 bp, Homo sapien
tttaccagtgaagtgggtgtaagag

SEQ ID NO: 119713 - DNA, 25 bp, Homo sapien
tttaccagtgaggtgggtgtaagag

SEQ ID NO: 119714 - DNA, 25 bp, Homo sapien
tttaccagttctattacaacaatgt

SEQ ID NO: 119715 - DNA, 25 bp, Homo sapien
tttaccagttctattataacaatgt

SEQ ID NO: 119716 - DNA, 25 bp, Homo sapien
tttacccaacatcacatagctaggg

SEQ ID NO: 119717 - DNA, 25 bp, Homo sapien
tttacccatcatcacatagctaggg

SEQ ID NO: 119718 - DNA, 25 bp, Homo sapien
tttaccccgtggcgtgctatgttgt

SEQ ID NO: 119719 - DNA, 25 bp, Homo sapien
tttaccccgtggtgtgctatgttgt

SEQ ID NO: 119720 - DNA, 25 bp, Homo sapien
tttaccctttcccattctactcaaa

SEQ ID NO: 119721 - DNA, 25 bp, Homo sapien
tttaccctttcccattttactcaaa

SEQ ID NO: 119722 - DNA, 25 bp, Homo sapien
tttaccgtggctttggtacatgctc

SEQ ID NO: 119723 - DNA, 25 bp, Homo sapien
tttaccgtggcttttgtacatgctc

SEQ ID NO: 119724 - DNA, 25 bp, Homo sapien
tttacctgagccaactccccagcct

SEQ ID NO: 119725 - DNA, 25 bp, Homo sapien
tttacctgagccatctccccagcct

SEQ ID NO: 119726 - DNA, 25 bp, Homo sapien
tttacctgattctcaaatgacagaa

SEQ ID NO: 119727 - DNA, 25 bp, Homo sapien
tttacctgcttctcaaatgacagaa

SEQ ID NO: 119728 - DNA, 25 bp, Homo sapien
tttacctggacaattcttccaatgc

SEQ ID NO: 119729 - DNA, 25 bp, Homo sapien
tttacctggacagttcttccaatgc

SEQ ID NO: 119730 - DNA, 25 bp, Homo sapien
tttacctgtctggcagcatatggtg

SEQ ID NO: 119731 - DNA, 25 bp, Homo sapien
tttacctgtctggcagtatatggtg

SEQ ID NO: 119732 - DNA, 25 bp, Homo sapien
tttaccttcatcctgcaattaaaaa

SEQ ID NO: 119733 - DNA, 25 bp, Homo sapien
tttaccttggaccctgacacagtag

SEQ ID NO: 119734 - DNA, 25 bp, Homo sapien
tttaccttggactctgacacagtag

SEQ ID NO: 119735 - DNA, 25 bp, Homo sapien
tttacctttaacgaaacagaaattt

SEQ ID NO: 119736 - DNA, 25 bp, Homo sapien
tttacctttaatgaaacagaaattt

SEQ ID NO: 119737 - DNA, 25 bp, Homo sapien
tttacctttatcctgcaattaaaaa

SEQ ID NO: 119738 - DNA, 25 bp, Homo sapien
tttacgaacgtccagacttctccat

SEQ ID NO: 119739 - DNA, 25 bp, Homo sapien
tttacgaatgtccagacttctccat

SEQ ID NO: 119740 - DNA, 25 bp, Homo sapien
tttacgccagtgttctaaagttttt

SEQ ID NO: 119741 - DNA, 25 bp, Homo sapien
tttacgccagtgttctgaagttttt

SEQ ID NO: 119742 - DNA, 25 bp, Homo sapien
tttacgctgacaaacccaatctaag

SEQ ID NO: 119743 - DNA, 25 bp, Homo sapien
tttacgctgaccaacccaatctaag

SEQ ID NO: 119744 - DNA, 25 bp, Homo sapien
tttacggtgctgccaaaaactatca

SEQ ID NO: 119745 - DNA, 25 bp, Homo sapien
tttacggtgctgtcaaaaactatca

SEQ ID NO: 119746 - DNA, 25 bp, Homo sapien
tttacgtagacgtttttgtgtgaac

SEQ ID NO: 119747 - DNA, 25 bp, Homo sapien
tttacgtagtcgtttttgtgtgaac

SEQ ID NO: 119748 - DNA, 25 bp, Homo sapien
tttactaaacagatcccgaataaag

SEQ ID NO: 119749 - DNA, 25 bp, Homo sapien
tttactaaacagatcctgaataaag

SEQ ID NO: 119750 - DNA, 25 bp, Homo sapien
tttactaaatcatcaagagtaaaat

SEQ ID NO: 119751 - DNA, 25 bp, Homo sapien
tttactaaatcatcgagagtaaaat

SEQ ID NO: 119752 - DNA, 25 bp, Homo sapien
tttactaaccattcaatccctttac

SEQ ID NO: 119753 - DNA, 25 bp, Homo sapien
tttactaactattcaatccctttac

SEQ ID NO: 119754 - DNA, 25 bp, Homo sapien
tttactaattttcacaatagtttgt

SEQ ID NO: 119755 - DNA, 25 bp, Homo sapien
tttactaatttttacaatagtttgt

SEQ ID NO: 119756 - DNA, 25 bp, Homo sapien
tttactatcgcatgatagagccaaa

SEQ ID NO: 119757 - DNA, 25 bp, Homo sapien
tttactatctgaatgtgtactacct

SEQ ID NO: 119758 - DNA, 25 bp, Homo sapien
tttactatgtgaatgtgtactacct

SEQ ID NO: 119759 - DNA, 25 bp, Homo sapien
tttactattgcatgatagagccaaa

SEQ ID NO: 119760 - DNA, 25 bp, Homo sapien
tttactattgctatatctctttcct

SEQ ID NO: 119761 - DNA, 25 bp, Homo sapien
tttactattgctatatgtctttcct

SEQ ID NO: 119762 - DNA, 25 bp, Homo sapien
tttactccagttcctccaaatgaaa

SEQ ID NO: 119763 - DNA, 25 bp, Homo sapien
tttactccggttcctccaaatgaaa

SEQ ID NO: 119764 - DNA, 25 bp, Homo sapien
tttactctaatacatagctgtaaca

SEQ ID NO: 119765 - DNA, 25 bp, Homo sapien
tttactctaatacgtagctgtaaca

SEQ ID NO: 119766 - DNA, 25 bp, Homo sapien
tttactctaggaaatcttatattca

SEQ ID NO: 119767 - DNA, 25 bp, Homo sapien
tttactcttggaaatcttatattca

SEQ ID NO: 119768 - DNA, 25 bp, Homo sapien
tttactgaaaacggaactgaaagtg

SEQ ID NO: 119769 - DNA, 25 bp, Homo sapien
tttactgaaaactgaactgaaagtg

SEQ ID NO: 119770 - DNA, 25 bp, Homo sapien
tttactgaatttttgtcaaatatag

SEQ ID NO: 119771 - DNA, 25 bp, Homo sapien
tttactgaatttttgttaaatatag

SEQ ID NO: 119772 - DNA, 25 bp, Homo sapien
tttactgcacttagctacacattaa

SEQ ID NO: 119773 - DNA, 25 bp, Homo sapien
tttactgcacttagttacacattaa

SEQ ID NO: 119774 - DNA, 25 bp, Homo sapien
tttactgcatcattaattttttcct

SEQ ID NO: 119775 - DNA, 25 bp, Homo sapien
tttactgcatcgttaattttttcct

SEQ ID NO: 119776 - DNA, 25 bp, Homo sapien
tttactgccccaacagaaagtatag

SEQ ID NO: 119777 - DNA, 25 bp, Homo sapien
tttactgccgcaacagaaagtatag

SEQ ID NO: 119778 - DNA, 25 bp, Homo sapien
tttactgcctcaaggaagatgtaag

SEQ ID NO: 119779 - DNA, 25 bp, Homo sapien
tttactgcctcaaggaggatgtaag

SEQ ID NO: 119780 - DNA, 25 bp, Homo sapien
tttactgcctctacgctctcttctt

SEQ ID NO: 119781 - DNA, 25 bp, Homo sapien
tttactgcctctatgctctcttctt

SEQ ID NO: 119782 - DNA, 25 bp, Homo sapien
tttactgtctaatgcccagaggtga

SEQ ID NO: 119783 - DNA, 25 bp, Homo sapien
tttactgtctactgcccagaggtga

SEQ ID NO: 119784 - DNA, 25 bp, Homo sapien
tttactgtgcttataacgattgcca

SEQ ID NO: 119785 - DNA, 25 bp, Homo sapien
tttactgtgcttataatgattgcca

SEQ ID NO: 119786 - DNA, 25 bp, Homo sapien
tttacttacttattgaactttgtag

SEQ ID NO: 119787 - DNA, 25 bp, Homo sapien
tttacttagttcttcgacgcagagc

SEQ ID NO: 119788 - DNA, 25 bp, Homo sapien
tttacttagttctttgacgcagagc

SEQ ID NO: 119789 - DNA, 25 bp, Homo sapien
tttacttatctgatctatacgtaac

SEQ ID NO: 119790 - DNA, 25 bp, Homo sapien
tttacttatctgatctgtacgtaac

SEQ ID NO: 119791 - DNA, 25 bp, Homo sapien
tttacttatttattgaactttgtag

SEQ ID NO: 119792 - DNA, 25 bp, Homo sapien
tttacttgggttccgctcagcaaca

SEQ ID NO: 119793 - DNA, 25 bp, Homo sapien
tttacttgggtttcgctcagcaaca

SEQ ID NO: 119794 - DNA, 25 bp, Homo sapien
tttacttgtagcacagacatgctcc

SEQ ID NO: 119795 - DNA, 25 bp, Homo sapien
tttacttgtggcacagacatgctcc

SEQ ID NO: 119796 - DNA, 25 bp, Homo sapien
tttacttgtggccgatgagttgtgc

SEQ ID NO: 119797 - DNA, 25 bp, Homo sapien
tttacttgtggtcgatgagttgtgc

SEQ ID NO: 119798 - DNA, 25 bp, Homo sapien
tttacttgtttggtctgcctgtaac

SEQ ID NO: 119799 - DNA, 25 bp, Homo sapien
tttacttgtttgttctgcctgtaac

SEQ ID NO: 119800 - DNA, 25 bp, Homo sapien
tttactttactcaccattgtataca

SEQ ID NO: 119801 - DNA, 25 bp, Homo sapien
tttactttagttcaccaaacctaga

SEQ ID NO: 119802 - DNA, 25 bp, Homo sapien
tttactttagttcatcaaacctaga

SEQ ID NO: 119803 - DNA, 25 bp, Homo sapien
tttactttattcaccattgtataca

SEQ ID NO: 119804 - DNA, 25 bp, Homo sapien
tttactttcactggacttattttgc

SEQ ID NO: 119805 - DNA, 25 bp, Homo sapien
tttactttcactgggcttattttgc

SEQ ID NO: 119806 - DNA, 25 bp, Homo sapien
tttactttcatctatgtcatggtca

SEQ ID NO: 119807 - DNA, 25 bp, Homo sapien
tttactttcatttatgtcatggtca

SEQ ID NO: 119808 - DNA, 25 bp, Homo sapien
tttacttttaaaatactagtgctac

SEQ ID NO: 119809 - DNA, 25 bp, Homo sapien
tttacttttaaaattctagtgctac

SEQ ID NO: 119810 - DNA, 25 bp, Homo sapien
tttacttttcaaaagcctacattat

SEQ ID NO: 119811 - DNA, 25 bp, Homo sapien
tttacttttcaaaagcttacattat

SEQ ID NO: 119812 - DNA, 25 bp, Homo sapien
tttacttttcctgaacaaacacctc

SEQ ID NO: 119813 - DNA, 25 bp, Homo sapien
tttacttttcctgagcaaacacctc

SEQ ID NO: 119814 - DNA, 25 bp, Homo sapien
tttacttttcgtcatgctggatttg

SEQ ID NO: 119815 - DNA, 25 bp, Homo sapien
tttacttttggtcatgctggatttg

SEQ ID NO: 119816 - DNA, 25 bp, Homo sapien
tttagaaaactcaactatcacccag

SEQ ID NO: 119817 - DNA, 25 bp, Homo sapien
tttagaaaattcaactatcacccag

SEQ ID NO: 119818 - DNA, 25 bp, Homo sapien
tttagaaagacagcatcactaaaag

SEQ ID NO: 119819 - DNA, 25 bp, Homo sapien
tttagaaagacaggatcactaaaag

SEQ ID NO: 119820 - DNA, 25 bp, Homo sapien
tttagaacccaaccatttctaccat

SEQ ID NO: 119821 - DNA, 25 bp, Homo sapien
tttagaacccagccatttctaccat

SEQ ID NO: 119822 - DNA, 25 bp, Homo sapien
tttagaacttttgcataaattcact

SEQ ID NO: 119823 - DNA, 25 bp, Homo sapien
tttagaacttttgtataaattcact

SEQ ID NO: 119824 - DNA, 25 bp, Homo sapien
tttagaagactgacattgcattacc

SEQ ID NO: 119825 - DNA, 25 bp, Homo sapien
tttagaagactgatattgcattacc

SEQ ID NO: 119826 - DNA, 25 bp, Homo sapien
tttagaagagatgtcacatgttgca

SEQ ID NO: 119827 - DNA, 25 bp, Homo sapien
tttagaagagatgttacatgttgca

SEQ ID NO: 119828 - DNA, 25 bp, Homo sapien
tttagaagcctcattggagatttct

SEQ ID NO: 119829 - DNA, 25 bp, Homo sapien
tttagaagccttattggagatttct

SEQ ID NO: 119830 - DNA, 25 bp, Homo sapien
tttagaagtggtccatgtataacaa

SEQ ID NO: 119831 - DNA, 25 bp, Homo sapien
tttagaagttgtccatgtataacaa

SEQ ID NO: 119832 - DNA, 25 bp, Homo sapien
tttagaatgacttcctcgaagccag

SEQ ID NO: 119833 - DNA, 25 bp, Homo sapien
tttagaatgacttccttgaagccag

SEQ ID NO: 119834 - DNA, 25 bp, Homo sapien
tttagaattatgatttgagcttttt

SEQ ID NO: 119835 - DNA, 25 bp, Homo sapien
tttagaattcaaaccattatctgcg

SEQ ID NO: 119836 - DNA, 25 bp, Homo sapien
tttagaattcagaccattatctgcg

SEQ ID NO: 119837 - DNA, 25 bp, Homo sapien
tttagaattgtgatttgagcttttt

SEQ ID NO: 119838 - DNA, 25 bp, Homo sapien
tttagacagtaacagaaagtataaa

SEQ ID NO: 119839 - DNA, 25 bp, Homo sapien
tttagacagtaatagaaagtataaa

SEQ ID NO: 119840 - DNA, 25 bp, Homo sapien
tttagacccaaaggccatagttata

SEQ ID NO: 119841 - DNA, 25 bp, Homo sapien
tttagacccaaaggccgtagttata

SEQ ID NO: 119842 - DNA, 25 bp, Homo sapien
tttagacgataaagtgctaggagac

SEQ ID NO: 119843 - DNA, 25 bp, Homo sapien
tttagacgcatcactcctatatctg

SEQ ID NO: 119844 - DNA, 25 bp, Homo sapien
tttagacgcatcactcgtatatctg

SEQ ID NO: 119845 - DNA, 25 bp, Homo sapien
tttagacggtaaagtgctaggagac

SEQ ID NO: 119846 - DNA, 25 bp, Homo sapien
tttagagaaaaagcgattggttagt

SEQ ID NO: 119847 - DNA, 25 bp, Homo sapien
tttagagaaaaggcgattggttagt

SEQ ID NO: 119848 - DNA, 25 bp, Homo sapien
tttagagacagctgattttcatatt

SEQ ID NO: 119849 - DNA, 25 bp, Homo sapien
tttagagaggaaaatacgtttggag

SEQ ID NO: 119850 - DNA, 25 bp, Homo sapien
tttagagaggaaaataggtttggag

SEQ ID NO: 119851 - DNA, 25 bp, Homo sapien
tttagagatagctgattttcatatt

SEQ ID NO: 119852 - DNA, 25 bp, Homo sapien
tttagagcacttctgcaacaaattc

SEQ ID NO: 119853 - DNA, 25 bp, Homo sapien
tttagagcccttctgcaacaaattc

SEQ ID NO: 119854 - DNA, 25 bp, Homo sapien
tttagagctttatcacttgatgagg

SEQ ID NO: 119855 - DNA, 25 bp, Homo sapien
tttagagctttatcgcttgatgagg

SEQ ID NO: 119856 - DNA, 25 bp, Homo sapien
tttagagtaaagcaggtaaacttcg

SEQ ID NO: 119857 - DNA, 25 bp, Homo sapien
tttagagtgaagcaggtaaacttcg

SEQ ID NO: 119858 - DNA, 25 bp, Homo sapien
tttagatatgttgagtctctgctgc

SEQ ID NO: 119859 - DNA, 25 bp, Homo sapien
tttagatatgttgagtttctgctgc

SEQ ID NO: 119860 - DNA, 25 bp, Homo sapien
tttagatcaggctggttaggcagat

SEQ ID NO: 119861 - DNA, 25 bp, Homo sapien
tttagatcaggttggttaggcagat

SEQ ID NO: 119862 - DNA, 25 bp, Homo sapien
tttagatgaaaaacctggcatgcac

SEQ ID NO: 119863 - DNA, 25 bp, Homo sapien
tttagatgaaaaatctggcatgcac

SEQ ID NO: 119864 - DNA, 25 bp, Homo sapien
tttagatgaaaagaatcactcctat

SEQ ID NO: 119865 - DNA, 25 bp, Homo sapien
tttagatgaaaggaatcactcctat

SEQ ID NO: 119866 - DNA, 25 bp, Homo sapien
tttagatgcaaatgacagcttgtta

SEQ ID NO: 119867 - DNA, 25 bp, Homo sapien
tttagatgcaaatggcagcttgtta

SEQ ID NO: 119868 - DNA, 25 bp, Homo sapien
tttagattggtgtaagcctttgact

SEQ ID NO: 119869 - DNA, 25 bp, Homo sapien
tttagattgttgtaagcctttgact

SEQ ID NO: 119870 - DNA, 25 bp, Homo sapien
tttagcaaacccaagtgatcattta

SEQ ID NO: 119871 - DNA, 25 bp, Homo sapien
tttagcaaacccacgtgatcattta

SEQ ID NO: 119872 - DNA, 25 bp, Homo sapien
tttagcagcattcctcacttctact

SEQ ID NO: 119873 - DNA, 25 bp, Homo sapien
tttagcagcattcctcgcttctact

SEQ ID NO: 119874 - DNA, 25 bp, Homo sapien
tttagcagccctattccagaaactt

SEQ ID NO: 119875 - DNA, 25 bp, Homo sapien
tttagcagctctattccagaaactt

SEQ ID NO: 119876 - DNA, 25 bp, Homo sapien
tttagcatagtgtagcattttaaga

SEQ ID NO: 119877 - DNA, 25 bp, Homo sapien
tttagcatagtgtagctttttaaga

SEQ ID NO: 119878 - DNA, 25 bp, Homo sapien
tttagcatatgtgaaaaacagaaac

SEQ ID NO: 119879 - DNA, 25 bp, Homo sapien
tttagcatgtgtgaaaaacagaaac

SEQ ID NO: 119880 - DNA, 25 bp, Homo sapien
tttagcattacccactagaccctta

SEQ ID NO: 119881 - DNA, 25 bp, Homo sapien
tttagcattccccactagaccctta

SEQ ID NO: 119882 - DNA, 25 bp, Homo sapien
tttagccactagcttcatgatcatt

SEQ ID NO: 119883 - DNA, 25 bp, Homo sapien
tttagccactagcttcgtgatcatt

SEQ ID NO: 119884 - DNA, 25 bp, Homo sapien
tttagcccagactattcatatacta

SEQ ID NO: 119885 - DNA, 25 bp, Homo sapien
tttagcccagattattcatatacta

SEQ ID NO: 119886 - DNA, 25 bp, Homo sapien
tttagccttacagaactcctatggg

SEQ ID NO: 119887 - DNA, 25 bp, Homo sapien
tttagccttacggaactcctatggg

SEQ ID NO: 119888 - DNA, 25 bp, Homo sapien
tttagccttcgctattgtttttaac

SEQ ID NO: 119889 - DNA, 25 bp, Homo sapien
tttagccttcgctattttttttaac

SEQ ID NO: 119890 - DNA, 25 bp, Homo sapien
tttagcgatcatgtataaaaacatt

SEQ ID NO: 119891 - DNA, 25 bp, Homo sapien
tttagcgatcatgtatgaaaacatt

SEQ ID NO: 119892 - DNA, 25 bp, Homo sapien
tttagctagagccaaacacaacaaa

SEQ ID NO: 119893 - DNA, 25 bp, Homo sapien
tttagctagaggcaaacacaacaaa

SEQ ID NO: 119894 - DNA, 25 bp, Homo sapien
tttagctagcagaggactcaatgat

SEQ ID NO: 119895 - DNA, 25 bp, Homo sapien
tttagctagcagaggattcaatgat

SEQ ID NO: 119896 - DNA, 25 bp, Homo sapien
tttagctattgcgaatatttctgca

SEQ ID NO: 119897 - DNA, 25 bp, Homo sapien
tttagctattgtgaatatttctgca

SEQ ID NO: 119898 - DNA, 25 bp, Homo sapien
tttagctcaacgtgggatgaatgcc

SEQ ID NO: 119899 - DNA, 25 bp, Homo sapien
tttagctcaacgttggatgaatgcc

SEQ ID NO: 119900 - DNA, 25 bp, Homo sapien
tttagctcagtgagtcccaggatgt

SEQ ID NO: 119901 - DNA, 25 bp, Homo sapien
tttagctcagtgcgtcccaggatgt

SEQ ID NO: 119902 - DNA, 25 bp, Homo sapien
tttagctgaggatcattctgcttta

SEQ ID NO: 119903 - DNA, 25 bp, Homo sapien
tttagctgaggctcattctgcttta

SEQ ID NO: 119904 - DNA, 25 bp, Homo sapien
tttagctgataagttgattaaagta

SEQ ID NO: 119905 - DNA, 25 bp, Homo sapien
tttagctgatttaaactcaatgtaa

SEQ ID NO: 119906 - DNA, 25 bp, Homo sapien
tttagctgatttagactcaatgtaa

SEQ ID NO: 119907 - DNA, 25 bp, Homo sapien
tttagctggtaagttgattaaagta

SEQ ID NO: 119908 - DNA, 25 bp, Homo sapien
tttagcttccacctttttttgaggt

SEQ ID NO: 119909 - DNA, 25 bp, Homo sapien
tttagcttccatctttttttgaggt

SEQ ID NO: 119910 - DNA, 25 bp, Homo sapien
tttaggaaaacatgatctgatccta

SEQ ID NO: 119911 - DNA, 25 bp, Homo sapien
tttaggaaaacatgatttgatccta

SEQ ID NO: 119912 - DNA, 25 bp, Homo sapien
tttaggaacttagactctagttagg

SEQ ID NO: 119913 - DNA, 25 bp, Homo sapien
tttaggaacttagagtctagttagg

SEQ ID NO: 119914 - DNA, 25 bp, Homo sapien
tttaggaagtagaaatgcttggaga

SEQ ID NO: 119915 - DNA, 25 bp, Homo sapien
tttaggaagtagaaattcttggaga

SEQ ID NO: 119916 - DNA, 25 bp, Homo sapien
tttaggagtggacttacagcgcaat

SEQ ID NO: 119917 - DNA, 25 bp, Homo sapien
tttaggagtggacttatagcgcaat

SEQ ID NO: 119918 - DNA, 25 bp, Homo sapien
tttaggatctctacagaaagtggtg

SEQ ID NO: 119919 - DNA, 25 bp, Homo sapien
tttaggatctctatagaaagtggtg

SEQ ID NO: 119920 - DNA, 25 bp, Homo sapien
tttaggctatttacataaaacttta

SEQ ID NO: 119921 - DNA, 25 bp, Homo sapien
tttaggctatttacgtaaaacttta

SEQ ID NO: 119922 - DNA, 25 bp, Homo sapien
tttagggacgctcagcaggccaggt

SEQ ID NO: 119923 - DNA, 25 bp, Homo sapien
tttagggatgctcagcaggccaggt

SEQ ID NO: 119924 - DNA, 25 bp, Homo sapien
tttagggtgtaattgtcacatcact

SEQ ID NO: 119925 - DNA, 25 bp, Homo sapien
tttagggtgtacttgtcacatcact

SEQ ID NO: 119926 - DNA, 25 bp, Homo sapien
tttaggtcatatttatttcaaagca

SEQ ID NO: 119927 - DNA, 25 bp, Homo sapien
tttaggtcgtatttatttcaaagca

SEQ ID NO: 119928 - DNA, 25 bp, Homo sapien
tttaggtctacaaacactgaatgag

SEQ ID NO: 119929 - DNA, 25 bp, Homo sapien
tttaggtctacaagcactgaatgag

SEQ ID NO: 119930 - DNA, 25 bp, Homo sapien
tttaggtgaatagggacactctcca

SEQ ID NO: 119931 - DNA, 25 bp, Homo sapien
tttaggtgaatagggatactctcca

SEQ ID NO: 119932 - DNA, 25 bp, Homo sapien
tttaggtgttgaataaatgagtcaa

SEQ ID NO: 119933 - DNA, 25 bp, Homo sapien
tttaggtgttggataaatgagtcaa

SEQ ID NO: 119934 - DNA, 25 bp, Homo sapien
tttaggttacctaacaacataccat

SEQ ID NO: 119935 - DNA, 25 bp, Homo sapien
tttaggttacctaacatcataccat

SEQ ID NO: 119936 - DNA, 25 bp, Homo sapien
tttaggttgcgctaaaatttacatt

SEQ ID NO: 119937 - DNA, 25 bp, Homo sapien
tttaggttgtgctaaaatttacatt

SEQ ID NO: 119938 - DNA, 25 bp, Homo sapien
tttagtaaatatcactggttctccc

SEQ ID NO: 119939 - DNA, 25 bp, Homo sapien
tttagtaaatatcattggttctccc

SEQ ID NO: 119940 - DNA, 25 bp, Homo sapien
tttagtacgctccctgtctcactgg

SEQ ID NO: 119941 - DNA, 25 bp, Homo sapien
tttagtacgttccctgtctcactgg

SEQ ID NO: 119942 - DNA, 25 bp, Homo sapien
tttagtagcaagaaggttactggtg

SEQ ID NO: 119943 - DNA, 25 bp, Homo sapien
tttagtagcaaggaggttactggtg

SEQ ID NO: 119944 - DNA, 25 bp, Homo sapien
tttagtagtggctgagccttggtaa

SEQ ID NO: 119945 - DNA, 25 bp, Homo sapien
tttagtagtggctgagtcttggtaa

SEQ ID NO: 119946 - DNA, 25 bp, Homo sapien
tttagtatgccttcaaattttttct

SEQ ID NO: 119947 - DNA, 25 bp, Homo sapien
tttagtatgccttctaattttttct

SEQ ID NO: 119948 - DNA, 25 bp, Homo sapien
tttagtcaaatgtatcaaactccct

SEQ ID NO: 119949 - DNA, 25 bp, Homo sapien
tttagtcaagtgtatcaaactccct

SEQ ID NO: 119950 - DNA, 25 bp, Homo sapien
tttagtcagcaagagaacacatata

SEQ ID NO: 119951 - DNA, 25 bp, Homo sapien
tttagtcagcaagagaccacatata

SEQ ID NO: 119952 - DNA, 25 bp, Homo sapien
tttagtctcatcacaaattctgttt

SEQ ID NO: 119953 - DNA, 25 bp, Homo sapien
tttagtctcatcacaatttctgttt

SEQ ID NO: 119954 - DNA, 25 bp, Homo sapien
tttagtgcactggttccctgactag

SEQ ID NO: 119955 - DNA, 25 bp, Homo sapien
tttagtgcgctggttccctgactag

SEQ ID NO: 119956 - DNA, 25 bp, Homo sapien
tttagtgttctttactgttgatttt

SEQ ID NO: 119957 - DNA, 25 bp, Homo sapien
tttagtgttctttgctgttgatttt

SEQ ID NO: 119958 - DNA, 25 bp, Homo sapien
tttagttagggacgaattcagatta

SEQ ID NO: 119959 - DNA, 25 bp, Homo sapien
tttagttagggatgaattcagatta

SEQ ID NO: 119960 - DNA, 25 bp, Homo sapien
tttagttgcgttgaactcaaaatct

SEQ ID NO: 119961 - DNA, 25 bp, Homo sapien
tttagttgggttgaactcaaaatct
